United States Patent 11,640,849 (METHODS FOR HISTOLOGICAL DIAGNOSIS AND TREATMENT OF DISEASES) - sequence listing, part 34

SEQ ID NO: 1326370 - protein, 27 aa, Mycobacterium
RTYRGTKEFIFLGLLSLPHNEDGLESF

SEQ ID NO: 1326371 - protein, 25 aa, Mycobacterium
RVAALFNQLVMLPADHPGLAAACSR

SEQ ID NO: 1326372 - protein, 23 aa, Mycobacterium
RVACLIVEPILSDGGLVVPPDGF

SEQ ID NO: 1326373 - protein, 19 aa, Mycobacterium
RVADGIRMLVVPGSMRVRA

SEQ ID NO: 1326374 - protein, 44 aa, Mycobacterium
RVADKLLIIDLPRPPAPLHVLRLAAMLPWAPLVPFLHDGVISSL

SEQ ID NO: 1326375 - protein, 19 aa, Mycobacterium
RVADPPEWFGVIKPSRLMA

SEQ ID NO: 1326376 - protein, 31 aa, Mycobacterium
RVAELRSLLRFLFVRGLTPRLLTTAVPPVAG

SEQ ID NO: 1326377 - protein, 28 aa, Mycobacterium
RVAGRTWRVPVTAFWQAHRDAPALYSAL

SEQ ID NO: 1326378 - protein, 22 aa, Mycobacterium
RVAGVHFLMKKNKITEVHGYAK

SEQ ID NO: 1326379 - protein, 20 aa, Mycobacterium
RVAKVICSFPRQADSYVFDA

SEQ ID NO: 1326380 - protein, 21 aa, Mycobacterium
RVALWNIVATVDAFLSSGFTP

SEQ ID NO: 1326381 - protein, 18 aa, Mycobacterium
RVAMMTREYPPEVYGGAG

SEQ ID NO: 1326382 - protein, 17 aa, Mycobacterium
RVAPVLYDFINNEALPG

SEQ ID NO: 1326383 - protein, 24 aa, Mycobacterium
RVARLFPEMSLTAALARWAEDVLA

SEQ ID NO: 1326384 - protein, 23 aa, Mycobacterium
RVASAVTIWTAGFGVPDLAVRSG

SEQ ID NO: 1326385 - protein, 25 aa, Mycobacterium
RVASRAQQMLWLNRLRVNRTTTGNT

SEQ ID NO: 1326386 - protein, 17 aa, Mycobacterium
RVAVQRLADREEADRLT

SEQ ID NO: 1326387 - protein, 17 aa, Mycobacterium
RVAVRHLIGRIAALLAV

SEQ ID NO: 1326388 - protein, 20 aa, Mycobacterium
RVDAARVAVQRLADREEADR

SEQ ID NO: 1326389 - protein, 17 aa, Mycobacterium
RVDAATALALFCGSADS

SEQ ID NO: 1326390 - protein, 25 aa, Mycobacterium
RVDAPLFGLGLPRTGSTALSFLLAQ

SEQ ID NO: 1326391 - protein, 23 aa, Mycobacterium
RVDDAPWTPPPRTSPARVTVALA

SEQ ID NO: 1326392 - protein, 25 aa, Mycobacterium
RVDKQANLHFVIGKASFDESKLAEN

SEQ ID NO: 1326393 - protein, 25 aa, Mycobacterium
RVDNALALMWGAEDLFAVLGGTANR

SEQ ID NO: 1326394 - protein, 19 aa, Mycobacterium
RVDPQGRRPLWTYAHVPAG

SEQ ID NO: 1326395 - protein, 23 aa, Mycobacterium
RVDPQLSMLIPVEDYPLIDGQGR

SEQ ID NO: 1326396 - protein, 28 aa, Mycobacterium
RVDQIESELLWLDALRRDSDVTVPTVLP

SEQ ID NO: 1326397 - protein, 25 aa, Mycobacterium
RVDSPEPMLWGGELILRDGAVAGQA

SEQ ID NO: 1326398 - protein, 18 aa, Mycobacterium
RVDVQIGVQLLHRDLQPP

SEQ ID NO: 1326399 - protein, 29 aa, Mycobacterium
RVDWAATPLGPPSRWPQSLLTAASILLSS

SEQ ID NO: 1326400 - protein, 18 aa, Mycobacterium
RVDWIRDGVINALSYPRA

SEQ ID NO: 1326401 - protein, 18 aa, Mycobacterium
RVEAPAVCYLDEAIALES

SEQ ID NO: 1326402 - protein, 20 aa, Mycobacterium
RVEAPAVCYLDEAIALESLR

SEQ ID NO: 1326403 - protein, 17 aa, Mycobacterium
RVEIQSFDWRTLPLVRH

SEQ ID NO: 1326404 - protein, 23 aa, Mycobacterium
RVELLPVPGLPEFRPGDNLSAAI

SEQ ID NO: 1326405 - protein, 18 aa, Mycobacterium
RVELRLLGPEYKSPRLIK

SEQ ID NO: 1326406 - protein, 33 aa, Mycobacterium
RVEVPPGWRVDVTEMPFLLPPGEYLESTVEVVI

SEQ ID NO: 1326407 - protein, 17 aa, Mycobacterium
RVFADVASLEHAWRALD

SEQ ID NO: 1326408 - protein, 17 aa, Mycobacterium
RVFVTIGIRNARSIRDV

SEQ ID NO: 1326409 - protein, 17 aa, Mycobacterium
RVGFSALRDALPTRHGV

SEQ ID NO: 1326410 - protein, 29 aa, Mycobacterium
RVGIDLSLPWRNFTGFKSYWLQNDGYGSY

SEQ ID NO: 1326411 - protein, 23 aa, Mycobacterium
RVGISQMHVSRLLAKSLARLRDQ

SEQ ID NO: 1326412 - protein, 25 aa, Mycobacterium
RVGKSRLIFWMVREAADGRRDEETV

SEQ ID NO: 1326413 - protein, 19 aa, Mycobacterium
RVGLRPDVRRVPMFGLGCV

SEQ ID NO: 1326414 - protein, 18 aa, Mycobacterium
RVGMPVTAVFRPVDDADP

SEQ ID NO: 1326415 - protein, 29 aa, Mycobacterium
RVGNVMAAVRLPRGLWREAHRQNLALWVC

SEQ ID NO: 1326416 - protein, 18 aa, Mycobacterium
RVGPRGGPLYVLQSDFEK

SEQ ID NO: 1326417 - protein, 20 aa, Mycobacterium
RVGVDTWVLGRPGALNVDGA

SEQ ID NO: 1326418 - protein, 21 aa, Mycobacterium
RVGWRISIPATLSYWSELTRA

SEQ ID NO: 1326419 - protein, 22 aa, Mycobacterium
RVHGLRLPRHVHRIGVLEIDHG

SEQ ID NO: 1326420 - protein, 27 aa, Mycobacterium
RVHKMLAGLFGLCERHRHLFQAMLEVR

SEQ ID NO: 1326421 - protein, 17 aa, Mycobacterium
RVHMASLGLPLLGDPLY

SEQ ID NO: 1326422 - protein, 26 aa, Mycobacterium
RVHNLGKPPRMLVLLHLDGASDRPST

SEQ ID NO: 1326423 - protein, 31 aa, Mycobacterium
RVHRVPSMMFPKITSLPLGVPRPRMVGVLRG

SEQ ID NO: 1326424 - protein, 18 aa, Mycobacterium
RVIEAALPGLHDWVDEQL

SEQ ID NO: 1326425 - protein, 19 aa, Mycobacterium
RVIEIGTLISGPFAGRLLG

SEQ ID NO: 1326426 - protein, 18 aa, Mycobacterium
RVIGRLTDLGWGARLRTL

SEQ ID NO: 1326427 - protein, 18 aa, Mycobacterium
RVILIEHLGPRAIVTIDA

SEQ ID NO: 1326428 - protein, 25 aa, Mycobacterium
RVKDVFFYEPIILPEKASREVQLTL

SEQ ID NO: 1326429 - protein, 25 aa, Mycobacterium
RVKDVFFYEPIILPEKSSREVQLTL

SEQ ID NO: 1326430 - protein, 25 aa, Mycobacterium
RVKRPQMGIAAWIIPSIVAFGTDEQ

SEQ ID NO: 1326431 - protein, 33 aa, Mycobacterium
RVKVGADVLPWWPVRGVYLLLERGASTSTDLLG

SEQ ID NO: 1326432 - protein, 19 aa, Mycobacterium
RVLADHVIWLAGKQGAASG

SEQ ID NO: 1326433 - protein, 17 aa, Mycobacterium
RVLAEHFGVPRSLVELT

SEQ ID NO: 1326434 - protein, 19 aa, Mycobacterium
RVLARCSYLCDGVAVRDTT

SEQ ID NO: 1326435 - protein, 17 aa, Mycobacterium
RVLARQPVDLDRPHPFT

SEQ ID NO: 1326436 - protein, 20 aa, Mycobacterium
RVLARVAGGWELTDLGREAL

SEQ ID NO: 1326437 - protein, 17 aa, Mycobacterium
RVLATKRTPWPAAPGRI

SEQ ID NO: 1326438 - protein, 31 aa, Mycobacterium
RVLCEEFPWLKSRLPSLWTNSYFVATVGGAP

SEQ ID NO: 1326439 - protein, 27 aa, Mycobacterium
RVLDPTRPFFAFLTDLLDVWVAYFAEH

SEQ ID NO: 1326440 - protein, 21 aa, Mycobacterium
RVLEAWPRHDLGYAITDLIAR

SEQ ID NO: 1326441 - protein, 25 aa, Mycobacterium
RVLEVAMYGFVPSAGAVLAEWGADV

SEQ ID NO: 1326442 - protein, 22 aa, Mycobacterium
RVLEVAQFTFVPSAGAVLADWG

SEQ ID NO: 1326443 - protein, 24 aa, Mycobacterium
RVLEVAQFTFVPSAGAVLSDWGAE

SEQ ID NO: 1326444 - protein, 28 aa, Mycobacterium
RVLGVEPSCPLLLVVRTSFADNGVAVEF

SEQ ID NO: 1326445 - protein, 17 aa, Mycobacterium
RVLHLSDLHMRPSQRRK

SEQ ID NO: 1326446 - protein, 18 aa, Mycobacterium
RVLHLSDLHMRPSQRRKQ

SEQ ID NO: 1326447 - protein, 32 aa, Mycobacterium
RVLHTRALVRAPIWVYRAGLGFVFGSRLLMLE

SEQ ID NO: 1326448 - protein, 27 aa, Mycobacterium
RVLLPESPEPFCLFLDELPASSPDVQK

SEQ ID NO: 1326449 - protein, 33 aa, Mycobacterium
RVLLQLPNSCQFAIALFGLLRAAAVPVMCLPGH

SEQ ID NO: 1326450 - protein, 33 aa, Mycobacterium
RVLLQLPNSVRFAVAFFGLLRAGAVPVMCLPGH

SEQ ID NO: 1326451 - protein, 17 aa, Mycobacterium
RVLQFKPGLLLNRDLCE

SEQ ID NO: 1326452 - protein, 18 aa, Mycobacterium
RVLQPVRHRLGAAALSFK

SEQ ID NO: 1326453 - protein, 17 aa, Mycobacterium
RVLREFNPQLRLIGVDT

SEQ ID NO: 1326454 - protein, 23 aa, Mycobacterium
RVLRPGGVLLMSTPNRITFSPGR

SEQ ID NO: 1326455 - protein, 23 aa, Mycobacterium
RVLRQRLGIHPVFKTVDTCAAEF

SEQ ID NO: 1326456 - protein, 18 aa, Mycobacterium
RVLRVFERHDIPLTVFAV

SEQ ID NO: 1326457 - protein, 17 aa, Mycobacterium
RVLVAVPRTEESRFRAM

SEQ ID NO: 1326458 - protein, 17 aa, Mycobacterium
RVLVLGGGESRDLHLSN

SEQ ID NO: 1326459 - protein, 21 aa, Mycobacterium
RVLVLLGRIHAYEGHDLRHVV

SEQ ID NO: 1326460 - protein, 25 aa, Mycobacterium
RVMKKAVAYLLPFIEAEKAENGTSD

SEQ ID NO: 1326461 - protein, 17 aa, Mycobacterium
RVMPGNCFAPFHFNDEH

SEQ ID NO: 1326462 - protein, 25 aa, Mycobacterium
RVMQLNYYAPLRLIRGLAPGMIERG

SEQ ID NO: 1326463 - protein, 26 aa, Mycobacterium
RVMRNPATLPFVENWNLLVSQSRGEF

SEQ ID NO: 1326464 - protein, 18 aa, Mycobacterium
RVNALAPDLTMTEGLQKL

SEQ ID NO: 1326465 - protein, 17 aa, Mycobacterium
RVNFRHPAWARSTFTHL

SEQ ID NO: 1326466 - protein, 21 aa, Mycobacterium
RVNMGPIVNAPLRTVGAKSGK

SEQ ID NO: 1326467 - protein, 19 aa, Mycobacterium
RVNTLMPGPFLTDISDAWT

SEQ ID NO: 1326468 - protein, 18 aa, Mycobacterium
RVPALLKATARYCAPPPP

SEQ ID NO: 1326469 - protein, 38 aa, Mycobacterium
RVPGRLVHFVMTVWQKLHFRFGLPKPLLEPLSVERIYL

SEQ ID NO: 1326470 - protein, 38 aa, Mycobacterium
RVPGRLVHFVMTVWQQLHFRFGLPKPLLEPLGVERIYL

SEQ ID NO: 1326471 - protein, 21 aa, Mycobacterium
RVPLWVEETLRFDTSSQILAR

SEQ ID NO: 1326472 - protein, 20 aa, Mycobacterium
RVPQHRVRLQPTAHDGLLLA

SEQ ID NO: 1326473 - protein, 18 aa, Mycobacterium
RVPQLIPVYSHHYLPAGR

SEQ ID NO: 1326474 - protein, 18 aa, Mycobacterium
RVPRPAPRPAYSALSGAG

SEQ ID NO: 1326475 - protein, 19 aa, Mycobacterium
RVQILWALVSREMSVNDLA

SEQ ID NO: 1326476 - protein, 21 aa, Mycobacterium
RVQIPTTPWHHTHHWIHTSSA

SEQ ID NO: 1326477 - protein, 19 aa, Mycobacterium
RVQLAAQRYHLTASSALSD

SEQ ID NO: 1326478 - protein, 19 aa, Mycobacterium
RVQLLRDLGSAASPFNAFL

SEQ ID NO: 1326479 - protein, 25 aa, Mycobacterium
RVQRALYDAGWMRYGWPESAGGLGG

SEQ ID NO: 1326480 - protein, 24 aa, Mycobacterium
RVQRRTVPLPLSQKIFDSRWVESA

SEQ ID NO: 1326481 - protein, 30 aa, Mycobacterium
RVRAAAARRGRTLRFGLRLHTVARPTEEQA

SEQ ID NO: 1326482 - protein, 17 aa, Mycobacterium
RVRDVRRIGSCALDLCM

SEQ ID NO: 1326483 - protein, 26 aa, Mycobacterium
RVRFPDLDENLISDLILGCVSPVGDQ

SEQ ID NO: 1326484 - protein, 19 aa, Mycobacterium
RVRGALMGGYFAGLVDRRI

SEQ ID NO: 1326485 - protein, 17 aa, Mycobacterium
RVRGRGVPKRSGGHGDL

SEQ ID NO: 1326486 - protein, 17 aa, Mycobacterium
RVRLLEVETPTPSPFAA

SEQ ID NO: 1326487 - protein, 30 aa, Mycobacterium
RVRLSLDEFVTQLATLWLITGNGAAQIARA

SEQ ID NO: 1326488 - protein, 19 aa, Mycobacterium
RVRLTEVPSLDLYREPDPF

SEQ ID NO: 1326489 - protein, 18 aa, Mycobacterium
RVRQQVIQLLSGYQGKET

SEQ ID NO: 1326490 - protein, 29 aa, Mycobacterium
RVRTGRVDLYWRAILFRIDDKSSGTTYIY

SEQ ID NO: 1326491 - protein, 28 aa, Mycobacterium
RVSDGSLLFLMHLISKMQPVKGGEGGSR

SEQ ID NO: 1326492 - protein, 25 aa, Mycobacterium
RVSDLIGMVRPRIVDIPLGAHFHNT

SEQ ID NO: 1326493 - protein, 28 aa, Mycobacterium
RVSDRRVLKLLRLWLQAGVMVDGVVSRT

SEQ ID NO: 1326494 - protein, 21 aa, Mycobacterium
RVSLVLKADIRPGYTGQLTAK

SEQ ID NO: 1326495 - protein, 22 aa, Mycobacterium
RVSQPPKLFLLTRNAQPVSEGD

SEQ ID NO: 1326496 - protein, 18 aa, Mycobacterium
RVSRHACELFWEKGVAAT

SEQ ID NO: 1326497 - protein, 33 aa, Mycobacterium; identical to SEQ ID NO: 1279683

SEQ ID NO: 1326498 - protein, 19 aa, Mycobacterium
RVTFGDVWGLLVDGRFGRG

SEQ ID NO: 1326499 - protein, 18 aa, Mycobacterium
RVTFNEQIFGPLDGTPMP

SEQ ID NO: 1326500 - protein, 19 aa, Mycobacterium
RVTNPSPYMYLLNVPDETG

SEQ ID NO: 1326501 - protein, 21 aa, Mycobacterium
RVTPFAYMEPVKIAGSTVGLA

SEQ ID NO: 1326502 - protein, 26 aa, Mycobacterium
RVTRPGGLAVLSYTVWLGPFGGHEMG

SEQ ID NO: 1326503 - protein, 23 aa, Mycobacterium
RVTSYVPGYRLKQRVQFETFTAT

SEQ ID NO: 1326504 - protein, 21 aa, Mycobacterium
RVTTRRVLLATGMEYCPPELP

SEQ ID NO: 1326505 - protein, 24 aa, Mycobacterium
RVTVTAGVPTIWMGAAPLLADYDL

SEQ ID NO: 1326506 - protein, 19 aa, Mycobacterium
RVVAPHRLTDPKAGPLIAV

SEQ ID NO: 1326507 - protein, 23 aa, Mycobacterium
RVVDKLLHAPTVRVKQLAGAPGG

SEQ ID NO: 1326508 - protein, 25 aa, Mycobacterium
RVVELAAWTFVPAAGAVLADWGADV

SEQ ID NO: 1326509 - protein, 17 aa, Mycobacterium
RVVELAGIGPGPHAAMI

SEQ ID NO: 1326510 - protein, 18 aa, Mycobacterium
RVVRLIDARVVRIGAVVR

SEQ ID NO: 1326511 - protein, 17 aa, Mycobacterium
RVVTPFRLRLTASEEPT

SEQ ID NO: 1326512 - protein, 17 aa, Mycobacterium
RVVVPRDAVAGIPADYA

SEQ ID NO: 1326513 - protein, 20 aa, Mycobacterium
RVWDPVVALLADRFRIVAYD

SEQ ID NO: 1326514 - protein, 22 aa, Mycobacterium
RVWHAALRRRRPDRPFTVVIDE

SEQ ID NO: 1326515 - protein, 21 aa, Mycobacterium
RVWVGHYFDYMDHHGAFVLAS

SEQ ID NO: 1326516 - protein, 19 aa, Mycobacterium
RVYGQQASELVIRRAMSQL

SEQ ID NO: 1326517 - protein, 19 aa, Mycobacterium
RVYQINYLRCIGCGLCIEA

SEQ ID NO: 1326518 - protein, 23 aa, Mycobacterium
RVYRDRGLLHPPLRVGRIALFND

SEQ ID NO: 1326519 - protein, 17 aa, Mycobacterium
RWAARAYADYDQAAVSA

SEQ ID NO: 1326520 - protein, 20 aa, Mycobacterium
RWADQFATSLRRLEFLPNSP

SEQ ID NO: 1326521 - protein, 23 aa, Mycobacterium
RWAKTWEFQALLKARPAAGDMEL

SEQ ID NO: 1326522 - protein, 21 aa, Mycobacterium
RWASSISGYWRRGRTEETFRQ

SEQ ID NO: 1326523 - protein, 19 aa, Mycobacterium
RWCAEQQGLKAFRGQCLVH

SEQ ID NO: 1326524 - protein, 18 aa, Mycobacterium
RWCKPTMDAIRPGTLYRT

SEQ ID NO: 1326525 - protein, 25 aa, Mycobacterium
RWDADGWVGYYYYSFSQAIGGGTSE

SEQ ID NO: 1326526 - protein, 18 aa, Mycobacterium
RWDELIATPLPDDPQLYC

SEQ ID NO: 1326527 - protein, 17 aa, Mycobacterium
RWDHVVVLPNTDLPDDF

SEQ ID NO: 1326528 - protein, 21 aa, Mycobacterium
RWEAFTDWPDPWVMIGAIALA

SEQ ID NO: 1326529 - protein, 21 aa, Mycobacterium
RWEVRWSATGLHPRLGENQTF

SEQ ID NO: 1326530 - protein, 24 aa, Mycobacterium
RWFEVEPCYVFHPMNAFDDGDTVV

SEQ ID NO: 1326531 - protein, 27 aa, Mycobacterium
RWGDRERPLWIKPENLQPIGAFKVRGA

SEQ ID NO: 1326532 - protein, 18 aa, Mycobacterium
RWGPLSQDRLRCAIDALI

SEQ ID NO: 1326533 - protein, 19 aa, Mycobacterium
RWIGFLERIKRRDLPGLEV

SEQ ID NO: 1326534 - protein, 19 aa, Mycobacterium
RWINGLWAGERIAADLVSP

SEQ ID NO: 1326535 - protein, 17 aa, Mycobacterium
RWLTDPSSRDFDLSDLV

SEQ ID NO: 1326536 - protein, 20 aa, Mycobacterium
RWLTQPGVRIVRADAGYCSP

SEQ ID NO: 1326537 - protein, 22 aa, Mycobacterium
RWQHLPVPFEVYADGIDLVIFE

SEQ ID NO: 1326538 - protein, 17 aa, Mycobacterium
RWQIRGRGVFVHCEEGV

SEQ ID NO: 1326539 - protein, 18 aa, Mycobacterium
RWQRDPWLTTAMTRAFAV

SEQ ID NO: 1326540 - protein, 20 aa, Mycobacterium
RWQTAVAALTPIQGATGPSD

SEQ ID NO: 1326541 - protein, 17 aa, Mycobacterium
RWRRTSGIHKVRDPRAL

SEQ ID NO: 1326542 - protein, 18 aa, Mycobacterium
RWSAYFPPAPAEAMFRWL

SEQ ID NO: 1326543 - protein, 33 aa, Mycobacterium
RWSLPKYEIVFKFVMGFPVWLTAKALGPRAARL

SEQ ID NO: 1326544 - protein, 17 aa, Mycobacterium
RWSMADAFLHPVTHRPN

SEQ ID NO: 1326545 - protein, 27 aa, Mycobacterium
RWSTPVRMPPVPPLPDPPPKRAVLMVW

SEQ ID NO: 1326546 - protein, 17 aa, Mycobacterium
RWTFLILDGAAFMMQAM

SEQ ID NO: 1326547 - protein, 17 aa, Mycobacterium
RWTVRLAETGWGETTLV

SEQ ID NO: 1326548 - protein, 18 aa, Mycobacterium
RWVAVHELDDLPWVPADR

SEQ ID NO: 1326549 - protein, 26 aa, Mycobacterium
RWVEPVLRGQVMWCQLFSEPGAGSDA

SEQ ID NO: 1326550 - protein, 19 aa, Mycobacterium
RWVMRSACADFAGWRARGI

SEQ ID NO: 1326551 - protein, 25 aa, Mycobacterium
RWVTRWPVVPDARRGPLGFVHQETS

SEQ ID NO: 1326552 - protein, 18 aa, Mycobacterium
RWVVPGNRIANTMKLAII

SEQ ID NO: 1326553 - protein, 17 aa, Mycobacterium
RWWDGQRWTDQVSSRGQ

SEQ ID NO: 1326554 - protein, 21 aa, Mycobacterium
RWYTPLYRGVFVRKGVEVTLR

SEQ ID NO: 1326555 - protein, 24 aa, Mycobacterium
RYAGRFTVLHWLESIQGLPSHAQL

SEQ ID NO: 1326556 - protein, 24 aa, Mycobacterium
RYCRELVSPFWELHPELVAGKMEL

SEQ ID NO: 1326557 - protein, 21 aa, Mycobacterium
RYDNWKIVFLEQRAAGTLQVW

SEQ ID NO: 1326558 - protein, 17 aa, Mycobacterium
RYDRPPPSLADYDDLLT

SEQ ID NO: 1326559 - protein, 18 aa, Mycobacterium
RYDTYFFVGALPQGQRAD

SEQ ID NO: 1326560 - protein, 25 aa, Mycobacterium
RYDYPAAENLLLRDVLPLIEHAGVD

SEQ ID NO: 1326561 - protein, 17 aa, Mycobacterium
RYENLARRFLTLYPLDA

SEQ ID NO: 1326562 - protein, 26 aa, Mycobacterium
RYGAHLRVNVLPIYGGASYVPQLSGL

SEQ ID NO: 1326563 - protein, 17 aa, Mycobacterium
RYGGTFIADALPAPRTG

SEQ ID NO: 1326564 - protein, 20 aa, Mycobacterium
RYGLGERPVVVCVSRLVPRK

SEQ ID NO: 1326565 - protein, 20 aa, Mycobacterium
RYGRLQLVKHPAHGLTLVSF

SEQ ID NO: 1326566 - protein, 17 aa, Mycobacterium
RYHAILGASRHCIAVHP

SEQ ID NO: 1326567 - protein, 19 aa, Mycobacterium
RYIHELLVERLHVVEVLVG

SEQ ID NO: 1326568 - protein, 19 aa, Mycobacterium
RYISGAPQLWVVGTRPFGP

SEQ ID NO: 1326569 - protein, 17 aa, Mycobacterium
RYITNPPGNPVRVHQHL

SEQ ID NO: 1326570 - protein, 26 aa, Mycobacterium
RYKDQGRPFLAFVYGIAAHKIADAHR

SEQ ID NO: 1326571 - protein, 27 aa, Mycobacterium
RYLALEWLERMALVGGKLICLVRAKDD

SEQ ID NO: 1326572 - protein, 18 aa, Mycobacterium
RYLEGHGFTNYIASGGGR

SEQ ID NO: 1326573 - protein, 18 aa, Mycobacterium
RYLLDREIDLQLAQLQWA

SEQ ID NO: 1326574 - protein, 17 aa, Mycobacterium
RYLQVARALRKEIVDGI

SEQ ID NO: 1326575 - protein, 28 aa, Mycobacterium
RYLTNVKVPLQPGVPWVFQTTLDDPTQW

SEQ ID NO: 1326576 - protein, 23 aa, Mycobacterium
RYPADYLVKLSTLSTSAAAAIGT

SEQ ID NO: 1326577 - protein, 25 aa, Mycobacterium
RYQQQTIRMFGLPESGLADTLRDAE

SEQ ID NO: 1326578 - protein, 34 aa, Mycobacterium
RYQTGWKRSLTAMRSQRYFRLLDALEELIATEPV

SEQ ID NO: 1326579 - protein, 19 aa, Mycobacterium
RYREWLSIHRVWRSKLPDV

SEQ ID NO: 1326580 - protein, 19 aa, Mycobacterium
RYRVDAVQAFELLRKLSQD

SEQ ID NO: 1326581 - protein, 17 aa, Mycobacterium
RYRVPPMPFSLSPAQLA

SEQ ID NO: 1326582 - protein, 29 aa, Mycobacterium
RYSRFLDTKDWDSWRSLFADDFHSDTAGA

SEQ ID NO: 1326583 - protein, 21 aa, Mycobacterium
RYSRHLIIPDVGLDGQKRLKN

SEQ ID NO: 1326584 - protein, 17 aa, Mycobacterium
RYSWDRIAADTLRIYER

SEQ ID NO: 1326585 - protein, 24 aa, Mycobacterium
RYTITDLAAPALPLVFLGAPVKNP

SEQ ID NO: 1326586 - protein, 25 aa, Mycobacterium
RYVDPFRGEVERLGRIVFGDSFEVD

SEQ ID NO: 1326587 - protein, 28 aa, Mycobacterium
RYVMDQRKLRRLAALGWIVVRVIAEDDE

SEQ ID NO: 1326588 - protein, 18 aa, Mycobacterium
RYWNIDPGDTFLVPSPIA

SEQ ID NO: 1326589 - protein, 23 aa, Mycobacterium
SAAANMRMYLLLRQRAAAFRADP

SEQ ID NO: 1326590 - protein, 21 aa, Mycobacterium
SAAARAFKAAALAAACGAATE

SEQ ID NO: 1326591 - protein, 24 aa, Mycobacterium
SAADQHVHRLLSQALFHADHIEAG

SEQ ID NO: 1326592 - protein, 24 aa, Mycobacterium
SAADRWRVAPGPIAARHWAVEPDL

SEQ ID NO: 1326593 - protein, 34 aa, Mycobacterium
SAAETLGWMQHRVLAAARRLFQLAATAGARAPIW

SEQ ID NO: 1326594 - protein, 18 aa, Mycobacterium
SAAGPTPGLSPTAPVGAA

SEQ ID NO: 1326595 - protein, 28 aa, Mycobacterium
SAAGVLELAWTTGLVKWEDDPQPGWYDT

SEQ ID NO: 1326596 - protein, 34 aa, Mycobacterium
SAAKTTAPKLPRMAVRPIRIVGDPVLHTATEPVP

SEQ ID NO: 1326597 - protein, 18 aa, Mycobacterium
SAALLAGMYAASNGAAAT

SEQ ID NO: 1326598 - protein, 17 aa, Mycobacterium
SAALTLAIHHPEQFRYA

SEQ ID NO: 1326599 - protein, 25 aa, Mycobacterium
SAANWLAMPAQRYMHDFGLTREHLG

SEQ ID NO: 1326600 - protein, 24 aa, Mycobacterium
SAAPGVLYVLTPTNCPPLQVLPKE

SEQ ID NO: 1326601 - protein, 24 aa, Mycobacterium
SAARRAELVSAIDGELVALYERQR

SEQ ID NO: 1326602 - protein, 17 aa, Mycobacterium
SAAVAYLVSDAARYVTG

SEQ ID NO: 1326603 - protein, 31 aa, Mycobacterium
SAAVGRFVIGGWAEVLLLAGRRDGAHRVVVD

SEQ ID NO: 1326604 - protein, 20 aa, Mycobacterium
SAAVLFCDLVGVLKQHGRTV

SEQ ID NO: 1326605 - protein, 26 aa, Mycobacterium
SACNPYLTFAVLLAAGLRGIEKNYVL

SEQ ID NO: 1326606 - protein, 20 aa, Mycobacterium
SACRALLFDNPSPAAALAGM

SEQ ID NO: 1326607 - protein, 19 aa, Mycobacterium
SACRILTSGTIRIGDAVTI

SEQ ID NO: 1326608 - protein, 20 aa, Mycobacterium
SADALTFVARRLLADPIAMV

SEQ ID NO: 1326609 - protein, 17 aa, Mycobacterium
SADDLLVLLAVGRTGRY

SEQ ID NO: 1326610 - protein, 25 aa, Mycobacterium
SADGKQWLSLWPATTDAVREDLHGL

SEQ ID NO: 1326611 - protein, 21 aa, Mycobacterium
SADNQFDFWFSPSAHGCQRRT

SEQ ID NO: 1326612 - protein, 24 aa, Mycobacterium
SADPFGDVFLVVDGWPAFTAEFPD

SEQ ID NO: 1326613 - protein, 24 aa, Mycobacterium
SADRGLINMPMFHVGALAIVGGLH

SEQ ID NO: 1326614 - protein, 18 aa, Mycobacterium
SADWLHRLRIVGIDLRDP

SEQ ID NO: 1326615 - protein, 28 aa, Mycobacterium
SADWSGLFNSFFWIDRKAGIGAVIATQL

SEQ ID NO: 1326616 - protein, 24 aa, Mycobacterium
SAEDRKVLWLSPTEARSTPAHDAE

SEQ ID NO: 1326617 - protein, 26 aa, Mycobacterium
SAEFARLENEKLWPKVWQVACRVEEV

SEQ ID NO: 1326618 - protein, 24 aa, Mycobacterium
SAELLPLDLAVRDWARRDGEVAAR

SEQ ID NO: 1326619 - protein, 31 aa, Mycobacterium
SAEMSDGTLRFLLWAAALLSPQPPSLMVLNE

SEQ ID NO: 1326620 - protein, 22 aa, Mycobacterium
SAEPAIPTPPFAMPHPKSEAAA

SEQ ID NO: 1326621 - protein, 22 aa, Mycobacterium
SAEQLAMKAAGWVFADHRRLEA

SEQ ID NO: 1326622 - protein, 29 aa, Mycobacterium
SAESLGGGWFWPAAAAHPSLPRGAMMQVA

SEQ ID NO: 1326623 - protein, 19 aa, Mycobacterium
SAFAPLVRRGFRASLRYRV

SEQ ID NO: 1326624 - protein, 17 aa, Mycobacterium
SAFFADNPFRFNDDIIV

SEQ ID NO: 1326625 - protein, 22 aa, Mycobacterium
SAFYAALEFWSAMHGFVLLEMT

SEQ ID NO: 1326626 - protein, 19 aa, Mycobacterium
SAGEFLALGHLPGIDIVID

SEQ ID NO: 1326627 - protein, 26 aa, Mycobacterium
SAGEPLPVMFFIHGGGYILGSSATPL

SEQ ID NO: 1326628 - protein, 17 aa, Mycobacterium
SAGLELPRKVFAHGWLL

SEQ ID NO: 1326629 - protein, 23 aa, Mycobacterium
SAGLVLIGFEFTSEAGLASFETH

SEQ ID NO: 1326630 - protein, 20 aa, Mycobacterium
SAGRLLLDGPVLTGSAVVGI

SEQ ID NO: 1326631 - protein, 25 aa, Mycobacterium
SAGYWGSLLPAVWSFMLALRSRGLG

SEQ ID NO: 1326632 - protein, 23 aa, Mycobacterium
SAHAAILPLHYLTRAGVPPSDLQ

SEQ ID NO: 1326633 - protein, 31 aa, Mycobacterium
SAHFVWPRETLRLGEKYPLKAGLVTSLGFGH

SEQ ID NO: 1326634 - protein, 24 aa, Mycobacterium
SAHHTHLYPGPDGQAATLCLSQRA

SEQ ID NO: 1326635 - protein, 21 aa, Mycobacterium
SAHIHLALVALVRGDLRGAER

SEQ ID NO: 1326636 - protein, 24 aa, Mycobacterium
SAHTDAQLGILLEKARQIAAEDQG

SEQ ID NO: 1326637 - protein, 23 aa, Mycobacterium
SAICGALDVPLSRVLSEAGDEMA

SEQ ID NO: 1326638 - protein, 22 aa, Mycobacterium
SAIHLSIFGMQPVVKHGSDELK

SEQ ID NO: 1326639 - protein, 25 aa, Mycobacterium
SAKDYRAWFATLPTEFADAVVEHWG

SEQ ID NO: 1326640 - protein, 17 aa, Mycobacterium
SAKLELLAAIAATGVRE

SEQ ID NO: 1326641 - protein, 23 aa, Mycobacterium
SAKPAYSIVLPPPNVTGSLHMGH

SEQ ID NO: 1326642 - protein, 23 aa, Mycobacterium
SAKRFIALANRWPAELSLADHMA

SEQ ID NO: 1326643 - protein, 28 aa, Mycobacterium
SALAEGITWQWESFPEYLDAIEKRSLAI

SEQ ID NO: 1326644 - protein, 20 aa, Mycobacterium
SALAFDLRTTPLRDVNAALH

SEQ ID NO: 1326645 - protein, 26 aa, Mycobacterium
SALDLFRTRRIASPAQRIMLIARDGG

SEQ ID NO: 1326646 - protein, 25 aa, Mycobacterium
SALDPHLWNWIAVSGLFVVLNSFTP

SEQ ID NO: 1326647 - protein, 19 aa, Mycobacterium
SALFLRDALDKLGVQAQFV

SEQ ID NO: 1326648 - protein, 24 aa, Mycobacterium
SALLKGMTAHYLIKSTYPVQQGDV

SEQ ID NO: 1326649 - protein, 23 aa, Mycobacterium
SALPAAMGAFPPGGGLGGGSPLD

SEQ ID NO: 1326650 - protein, 28 aa, Mycobacterium
SALPEWPQMLLRALMFRLAVHALHPRST

SEQ ID NO: 1326651 - protein, 18 aa, Mycobacterium
SALRHWAHAAVADLISHT

SEQ ID NO: 1326652 - protein, 25 aa, Mycobacterium
SALTYANLTRWLRGAERMHDAAMAK

SEQ ID NO: 1326653 - protein, 18 aa, Mycobacterium
SALVDFGLPGLAVDESLG

SEQ ID NO: 1326654 - protein, 23 aa, Mycobacterium
SALVSFEVFVRPALRAAMGLPHT

SEQ ID NO: 1326655 - protein, 20 aa, Mycobacterium
SALWEASLFEEHGFGDIKIS

SEQ ID NO: 1326656 - protein, 17 aa, Mycobacterium
SAMALRMRTICDRIAEF

SEQ ID NO: 1326657 - protein, 25 aa, Mycobacterium
SAMPWSDFAAIVYGLVMEGRETESG

SEQ ID NO: 1326658 - protein, 23 aa, Mycobacterium
SANAYLGGWGIAAALRGGADVVI

SEQ ID NO: 1326659 - protein, 19 aa, Mycobacterium
SAPDWHRKEWEPFWAAAEE

SEQ ID NO: 1326660 - protein, 17 aa, Mycobacterium
SAPDYRHVVATKDFHID

SEQ ID NO: 1326661 - protein, 20 aa, Mycobacterium
SAPLDLDLLGSAVARIRDAG

SEQ ID NO: 1326662 - protein, 24 aa, Mycobacterium
SAPLHRLVGAMLAAGAPDAVHTLR

SEQ ID NO: 1326663 - protein, 20 aa, Mycobacterium
SAPLLGIAYGYCGSPDQWWQ

SEQ ID NO: 1326664 - protein, 38 aa, Mycobacterium
SAPPKPIEIIGNLLPPAVKWKAFFARQAKNPKYLRHGD

SEQ ID NO: 1326665 - protein, 19 aa, Mycobacterium
SAPQMWRWAASRSVDHRTA

SEQ ID NO: 1326666 - protein, 19 aa, Mycobacterium
SAPTLLVRGLLSDVVSQAT

SEQ ID NO: 1326667 - protein, 26 aa, Mycobacterium
SAPTSPPVPLGPPTTPAPPAPPHLRR

SEQ ID NO: 1326668 - protein, 18 aa, Mycobacterium
SAPTYRYEFGWRSTGVGG

SEQ ID NO: 1326669 - protein, 27 aa, Mycobacterium
SAPVNAGPLPPLPAPGTVPSGGSAMPG

SEQ ID NO: 1326670 - protein, 20 aa, Mycobacterium
SAQHRVEWFWVKGHSGIADN

SEQ ID NO: 1326671 - protein, 22 aa, Mycobacterium
SAQLLDRIPWPRNSAYVVAAPL

SEQ ID NO: 1326672 - protein, 23 aa, Mycobacterium
SAQRLFHRAIAQSPALPLVADRE

SEQ ID NO: 1326673 - protein, 18 aa, Mycobacterium
SAQRWFRESLARAAKFPD

SEQ ID NO: 1326674 - protein, 27 aa, Mycobacterium
SARAEPFPVFTFFRDYNRYLSRGASSW

SEQ ID NO: 1326675 - protein, 17 aa, Mycobacterium
SARALGCTIKLLAICER

SEQ ID NO: 1326676 - protein, 23 aa, Mycobacterium
SARESMLFLDYDGTLSPIVSDPA

SEQ ID NO: 1326677 - protein, 25 aa, Mycobacterium
SARFSAKIVALNLLGALSVSTHANA

SEQ ID NO: 1326678 - protein, 21 aa, Mycobacterium
SARFTFGLHLLVDGIAVHSRA

SEQ ID NO: 1326679 - protein, 28 aa, Mycobacterium
SARGADPVFMLTGPIPATQYALDRAGLT

SEQ ID NO: 1326680 - protein, 22 aa, Mycobacterium
SARGMLFYRLLQQSVNTDPHPL

SEQ ID NO: 1326681 - protein, 23 aa, Mycobacterium
SARHVVFEVVTSRGMYLGRSDSV

SEQ ID NO: 1326682 - protein, 21 aa, Mycobacterium
SARLPMLTIMEMLGVPGADQP

SEQ ID NO: 1326683 - protein, 24 aa, Mycobacterium
SARNIVHYWGIRQTDLRDLQRRLA

SEQ ID NO: 1326684 - protein, 18 aa, Mycobacterium
SARNLKYMRAFAAAWPDP

SEQ ID NO: 1326685 - protein, 22 aa, Mycobacterium
SARPYLLAVVVPTEAALAGADA

SEQ ID NO: 1326686 - protein, 25 aa, Mycobacterium
SARQFRHELSMPLILLGGITTRDTM

SEQ ID NO: 1326687 - protein, 19 aa, Mycobacterium
SARQRAEQFTWPRSAAGML

SEQ ID NO: 1326688 - protein, 19 aa, Mycobacterium
SARRLWDLSAELTGCAWQE

SEQ ID NO: 1326689 - protein, 17 aa, Mycobacterium
SARRRRTFERFGIERFV

SEQ ID NO: 1326690 - protein, 17 aa, Mycobacterium
SARTPHFINENLVFVVT

SEQ ID NO: 1326691 - protein, 22 aa, Mycobacterium
SARYNACTALRKGLLVGLGTTG

SEQ ID NO: 1326692 - protein, 30 aa, Mycobacterium
SASCCWRWIAPWSRCSRRRGVSTCRWPRSR

SEQ ID NO: 1326693 - protein, 17 aa, Mycobacterium
SASECWDLLAGAPLGRL

SEQ ID NO: 1326694 - protein, 24 aa, Mycobacterium
SASFWGSLLPAAWSFMLALRSRGL

SEQ ID NO: 1326695 - protein, 22 aa, Mycobacterium
SASLSRLLPMLQSMGVVVLEER

SEQ ID NO: 1326696 - protein, 20 aa, Mycobacterium
SASQFIPDVRRYGATYANYV

SEQ ID NO: 1326697 - protein, 26 aa, Mycobacterium
SASRTRLIRLFPTVFKGTHVNLDEVR

SEQ ID NO: 1326698 - protein, 26 aa, Mycobacterium
SASTSAMADLLPPSAPVTSAAASTCP

SEQ ID NO: 1326699 - protein, 29 aa, Mycobacterium
SASWYVPGIPYDKPTLMRHIRELELHSVS

SEQ ID NO: 1326700 - protein, 27 aa, Mycobacterium
SASYHLPRLIGIAKTKQLMLTNRTLSA

SEQ ID NO: 1326701 - protein, 17 aa, Mycobacterium
SASYLRLAQKMLTGRSA

SEQ ID NO: 1326702 - protein, 29 aa, Mycobacterium
SATAGTLTVFHPQSFRAFASPLSSGVFVD

SEQ ID NO: 1326703 - protein, 23 aa, Mycobacterium
SATFRDLLTEWKAVGRAAKDVDD

SEQ ID NO: 1326704 - protein, 18 aa, Mycobacterium
SATFRYPGPLAISVAQVD

SEQ ID NO: 1326705 - protein, 28 aa, Mycobacterium
SATGTMTHAWLITGPPGSGRSIAALCFA

SEQ ID NO: 1326706 - protein, 24 aa, Mycobacterium
SATHRFLAEMPGYRGWQWAVVVAA

SEQ ID NO: 1326707 - protein, 26 aa, Mycobacterium
SATKDAIYLFNMPLGQRLAKVAFDRT

SEQ ID NO: 1326708 - protein, 18 aa, Mycobacterium
SATSARVSCRWCASRCLP

SEQ ID NO: 1326709 - protein, 25 aa, Mycobacterium
SATVDWLTTVLAEDALGGPAALRRT

SEQ ID NO: 1326710 - protein, 24 aa, Mycobacterium
SATYSYWFEPNPNWSRLYAPGTEL

SEQ ID NO: 1326711 - protein, 27 aa, Mycobacterium
SAVCDLEPYWEALRKVYAPFDVAAAGP

SEQ ID NO: 1326712 - protein, 19 aa, Mycobacterium
SAVCLLGNYYTMHFALQRR

SEQ ID NO: 1326713 - protein, 26 aa, Mycobacterium
SAVFLQHPWKVLPDELIAPIEDAAKA

SEQ ID NO: 1326714 - protein, 19 aa, Mycobacterium
SAVNSVQWMGPDAERFKAD

SEQ ID NO: 1326715 - protein, 17 aa, Mycobacterium
SAVPYLESVVLAAGAIA

SEQ ID NO: 1326716 - protein, 25 aa, Mycobacterium
SAVQLLTQSLPWNNALAKTPSAPKD

SEQ ID NO: 1326717 - protein, 33 aa, Mycobacterium
SAVRSGWPVAMLVGRFLPRHWVLIVNASDDEMH

SEQ ID NO: 1326718 - protein, 24 aa, Mycobacterium
SAVVVFDHAFHGRSLLTMTMTAKN

SEQ ID NO: 1326719 - protein, 19 aa, Mycobacterium
SAYFETFPGVWRHGDWITI

SEQ ID NO: 1326720 - protein, 17 aa, Mycobacterium
SAYGESPYTYLMTRRIE

SEQ ID NO: 1326721 - protein, 25 aa, Mycobacterium
SAYIASWHAAPLLTAQQRGLVVFTS

SEQ ID NO: 1326722 - protein, 26 aa, Mycobacterium
SAYRGGLVPGFPNMFISSAPNYSPGH

SEQ ID NO: 1326723 - protein, 24 aa, Mycobacterium
SCEVSALPTRHLARSRGHLRPCGV

SEQ ID NO: 1326724 - protein, 25 aa, Mycobacterium
SCHRWKAPLNPRPNGPSGHARITMA

SEQ ID NO: 1326725 - protein, 17 aa, Mycobacterium
SCPGPEAALALVGAARR

SEQ ID NO: 1326726 - protein, 18 aa, Mycobacterium
SCRFRGRPADFVADVALS

SEQ ID NO: 1326727 - protein, 19 aa, Mycobacterium
SCRQIKLTWPVLDNDELNK

SEQ ID NO: 1326728 - protein, 23 aa, Mycobacterium
SCSLSTLALLAKGFDVPVTSLFR

SEQ ID NO: 1326729 - protein, 23 aa, Mycobacterium
SCYEAIALLIALASRAGSLAIDA

SEQ ID NO: 1326730 - protein, 27 aa, Mycobacterium
SCYVHPEIEFFLLKPGPDDGTQPIPAD

SEQ ID NO: 1326731 - protein, 40 aa, Mycobacterium
SDADLIAAGAYLWLRAWPAPGGDLWAVPTGWRVGDHAPTT

SEQ ID NO: 1326732 - protein, 24 aa, Mycobacterium
SDAVAPLITRFFQMESRPPAAVKG

SEQ ID NO: 1326733 - protein, 22 aa, Mycobacterium
SDAVYYPLYTKCAELELPLCIN

SEQ ID NO: 1326734 - protein, 25 aa, Mycobacterium
SDDAESYLITPYVDVLASLAESATP

SEQ ID NO: 1326735 - protein, 21 aa, Mycobacterium
SDDCIYADMPLGPALAARGPE

SEQ ID NO: 1326736 - protein, 18 aa, Mycobacterium
SDDFAEYWNEICSLPIAL

SEQ ID NO: 1326737 - protein, 24 aa, Mycobacterium
SDDNALQLLGWTEATATPQVEVAL

SEQ ID NO: 1326738 - protein, 29 aa, Mycobacterium
SDDPFSAGLLQTLLVTVPRAVAAALGAED

SEQ ID NO: 1326739 - protein, 26 aa, Mycobacterium
SDDWDTQMLFFLQRGYRVIAHDRRGH

SEQ ID NO: 1326740 - protein, 23 aa, Mycobacterium
SDELFAGFALWAESNGTPLYPAQ

SEQ ID NO: 1326741 - protein, 24 aa, Mycobacterium
SDEQYTYWRIALPHAEAAVFDAAL

SEQ ID NO: 1326742 - protein, 22 aa, Mycobacterium
SDERYWSARLGQFAGGTAAVES

SEQ ID NO: 1326743 - protein, 26 aa, Mycobacterium
SDESLDLRWWPIDELPRDCDFGLTQL

SEQ ID NO: 1326744 - protein, 24 aa, Mycobacterium
SDFPKNGWVVQALQAAWSAIATTA

SEQ ID NO: 1326745 - protein, 22 aa, Mycobacterium
SDFRRWLPLDMYRPLRSTMVTL

SEQ ID NO: 1326746 - protein, 18 aa, Mycobacterium
SDGFRVPGLPMPSLPVVG

SEQ ID NO: 1326747 - protein, 22 aa, Mycobacterium
SDGFRVPGLPMPSLPVVGGDAA

SEQ ID NO: 1326748 - protein, 24 aa, Mycobacterium
SDGKRFMFDYIPEVFKGQYAESEE

SEQ ID NO: 1326749 - protein, 24 aa, Mycobacterium
SDGLAATLRLAPTPPWHTTRWQVT

SEQ ID NO: 1326750 - protein, 25 aa, Mycobacterium
SDGRAILAAQILGADFAYLGTRFIA

SEQ ID NO: 1326751 - protein, 19 aa, Mycobacterium
SDGRLVRSATWIVEGDLST

SEQ ID NO: 1326752 - protein, 17 aa, Mycobacterium
SDGTPWRPLVHAQDIAV

SEQ ID NO: 1326753 - protein, 24 aa, Mycobacterium
SDGVLCVPALAGLAAPWWDSAATA

SEQ ID NO: 1326754 - protein, 24 aa, Mycobacterium
SDGWRFRHELLREVAAELAPESVR

SEQ ID NO: 1326755 - protein, 25 aa, Mycobacterium
SDHATYLAECLLLGSGVPTTDRHEV

SEQ ID NO: 1326756 - protein, 17 aa, Mycobacterium
SDHLSPRLNVRPSIAAT

SEQ ID NO: 1326757 - protein, 29 aa, Mycobacterium
SDHSRRLWTVLIFMLWHAIFVEGSVTPRI

SEQ ID NO: 1326758 - protein, 24 aa, Mycobacterium
SDHYEGFWALVDYASVFEAARDDA

SEQ ID NO: 1326759 - protein, 28 aa, Mycobacterium
SDIDDLARYPLVYFIDSMLQVDDLDSAT

SEQ ID NO: 1326760 - protein, 23 aa, Mycobacterium
SDIKAFINFAPDALARPVPAEPV

SEQ ID NO: 1326761 - protein, 17 aa, Mycobacterium
SDKHPMWYLNLRANPTV

SEQ ID NO: 1326762 - protein, 20 aa, Mycobacterium
SDKKRLQRLATEQRRLASLR

SEQ ID NO: 1326763 - protein, 18 aa, Mycobacterium
SDLAFLQDLYRRVNQDGH

SEQ ID NO: 1326764 - protein, 20 aa, Mycobacterium
SDLALFDKKLDELHLRGQWQ

SEQ ID NO: 1326765 - protein, 23 aa, Mycobacterium
SDLARARLRREDARRRLADAEQA

SEQ ID NO: 1326766 - protein, 25 aa, Mycobacterium
SDLCYGYNAFWRRNLECLDLPATDL

SEQ ID NO: 1326767 - protein, 23 aa, Mycobacterium
SDLGEWPGPEWVTPIRARFRGVD

SEQ ID NO: 1326768 - protein, 28 aa, Mycobacterium
SDLKTDIAAWFSGLPIVSDVLPEMLTTL

SEQ ID NO: 1326769 - protein, 21 aa, Mycobacterium
SDLLAVVARINRLANQRVRMP

SEQ ID NO: 1326770 - protein, 23 aa, Mycobacterium
SDLPQLAKFFYRQSVEERNHAMM

SEQ ID NO: 1326771 - protein, 29 aa, Mycobacterium
SDLPTRHPYGLALWQKHIERILAEWVDEL

SEQ ID NO: 1326772 - protein, 24 aa, Mycobacterium
SDLTAIHLVTLLEALPIQETLEAI

SEQ ID NO: 1326773 - protein, 19 aa, Mycobacterium
SDLTLAATALGLASCPLTE

SEQ ID NO: 1326774 - protein, 29 aa, Mycobacterium
SDLVDRPFGIGLISWAVAEQPRLLEAALA

SEQ ID NO: 1326775 - protein, 25 aa, Mycobacterium
SDLVNVRYLSGFTGSNAALLILAED

SEQ ID NO: 1326776 - protein, 27 aa, Mycobacterium
SDMTRTFVLAPIADWQRDIYDLVATAQ

SEQ ID NO: 1326777 - protein, 17 aa, Mycobacterium
SDPALAKGSYYLPTIFD

SEQ ID NO: 1326778 - protein, 22 aa, Mycobacterium
SDPEWLVWTHGCPGGESVEAVN

SEQ ID NO: 1326779 - protein, 18 aa, Mycobacterium
SDPRLRFLRCDLADRTSI

SEQ ID NO: 1326780 - protein, 20 aa, Mycobacterium
SDPSISILASTQPGPRPGGK

SEQ ID NO: 1326781 - protein, 24 aa, Mycobacterium
SDPTGTLYGIGIRALLVGTSYLDS

SEQ ID NO: 1326782 - protein, 24 aa, Mycobacterium
SDPTRAEILLILREGRGYPSELAD

SEQ ID NO: 1326783 - protein, 33 aa, Mycobacterium
SDPVLAEWFLRRFSLLDSLYMVPSPRLVGRTIG

SEQ ID NO: 1326784 - protein, 21 aa, Mycobacterium
SDQGRFPGVAAVALVADINGN

SEQ ID NO: 1326785 - protein, 34 aa, Mycobacterium
SDQPWRRRYLLQPLQNLFLALTFEWGIALHGVNL

SEQ ID NO: 1326786 - protein, 21 aa, Mycobacterium
SDQVYLDLLTGWRDAWDIGTT

SEQ ID NO: 1326787 - protein, 24 aa, Mycobacterium
SDQVYLDLLTGWRDAWQLGSATRD

SEQ ID NO: 1326788 - protein, 24 aa, Mycobacterium
SDQWMARFVLGFGSAVRVLEPVDL

SEQ ID NO: 1326789 - protein, 19 aa, Mycobacterium
SDQWRTWPGYSPAERIAAE

SEQ ID NO: 1326790 - protein, 18 aa, Mycobacterium
SDRFRALANQLSRAWSLC

SEQ ID NO: 1326791 - protein, 17 aa, Mycobacterium
SDRLVDTLVAWGGPRHV

SEQ ID NO: 1326792 - protein, 18 aa, Mycobacterium
SDRPDWPAAPLFGQCCAA

SEQ ID NO: 1326793 - protein, 20 aa, Mycobacterium
SDRWTHFFAEQPELQAYFQE

SEQ ID NO: 1326794 - protein, 24 aa, Mycobacterium
SDSARYVLVYGHRRRAAALEAGRD

SEQ ID NO: 1326795 - protein, 25 aa, Mycobacterium
SDSLPEPTFVPVLGRIAAGGPILAE

SEQ ID NO: 1326796 - protein, 27 aa, Mycobacterium
SDTDTDPVLAWLYVLDAWEGGIPSARY

SEQ ID NO: 1326797 - protein, 26 aa, Mycobacterium
SDTPGIRRLIADLQGWLTGITGYDEI

SEQ ID NO: 1326798 - protein, 24 aa, Mycobacterium
SDTVLVFMHPIGGGAYLPMINALA

SEQ ID NO: 1326799 - protein, 26 aa, Mycobacterium
SDVDLTLFQGDLRFLIGPNGAGKTTV

SEQ ID NO: 1326800 - protein, 31 aa, Mycobacterium
SDVDVLEPSEWFPLQLALKVHQSRAGMPTGE

SEQ ID NO: 1326801 - protein, 19 aa, Mycobacterium
SDVELAQGFLLTEGIISSR

SEQ ID NO: 1326802 - protein, 18 aa, Mycobacterium
SDVKYKGALQGDPDSRKP

SEQ ID NO: 1326803 - protein, 22 aa, Mycobacterium
SDVLALKIADFGNPSLLASACV

SEQ ID NO: 1326804 - protein, 23 aa, Mycobacterium
SDVLAVWREILGERAWTVSGEEA

SEQ ID NO: 1326805 - protein, 28 aa, Mycobacterium
SDVMTDGLKFHWYLPTHGDTATIADNRG

SEQ ID NO: 1326806 - protein, 24 aa, Mycobacterium
SDVPGIPVPVFLGGAKVLAQYGFG

SEQ ID NO: 1326807 - protein, 23 aa, Mycobacterium
SDVVLLSLEIPIDTAVTAARIGR

SEQ ID NO: 1326808 - protein, 35 aa, Mycobacterium
SDVYFSSAPIYHAAPLRWCGMVHALGGTVVLAKRF

SEQ ID NO: 1326809 - protein, 21 aa, Mycobacterium
SDYVWRTWYPRTRPATITLDP

SEQ ID NO: 1326810 - protein, 23 aa, Mycobacterium
SEAAGFRQLRRWARGFYPDAEPA

SEQ ID NO: 1326811 - protein, 17 aa, Mycobacterium
SEAHHVPRFSRLGPRRR

SEQ ID NO: 1326812 - protein, 25 aa, Mycobacterium
SEALRGFPPVPSRWIDPASVPGWLV

SEQ ID NO: 1326813 - protein, 23 aa, Mycobacterium
SEDIRWALVPSKAVDRLLRICDP

SEQ ID NO: 1326814 - protein, 22 aa, Mycobacterium
SEDPHPVWSLAPESLIVAPAAG

SEQ ID NO: 1326815 - protein, 24 aa, Mycobacterium
SEELIGQFGIGFYASFMVADRVEL

SEQ ID NO: 1326816 - protein, 20 aa, Mycobacterium
SEELLAEPLLDVFVDSRLSV

SEQ ID NO: 1326817 - protein, 19 aa, Mycobacterium
SEERRLAYVGITRARQRLY

SEQ ID NO: 1326818 - protein, 18 aa, Mycobacterium
SEFGGIDYLVNNAAIFGG

SEQ ID NO: 1326819 - protein, 23 aa, Mycobacterium
SEFINDDLLRWCQKRRITFTRSR

SEQ ID NO: 1326820 - protein, 17 aa, Mycobacterium
SEFTLGPAYEGPPGWVH

SEQ ID NO: 1326821 - protein, 18 aa, Mycobacterium
SEGCGILVLKRLGDAVRD

SEQ ID NO: 1326822 - protein, 23 aa, Mycobacterium
SEGFATRPFLAPAPLAPTGRGTA

SEQ ID NO: 1326823 - protein, 23 aa, Mycobacterium
SEGLDRIFIDAGAEWRQAGCSMC

SEQ ID NO: 1326824 - protein, 27 aa, Mycobacterium
SEGSGFIPPGVFLPSSARLVFSDPGLD

SEQ ID NO: 1326825 - protein, 21 aa, Mycobacterium
SEHTRYRLGLPHAGRWREVLN

SEQ ID NO: 1326826 - protein, 24 aa, Mycobacterium
SEHVLDRYILAKLAVLRDDLTASL

SEQ ID NO: 1326827 - protein, 24 aa, Mycobacterium
SEICQYLFQHGWLYSPTDKGYDQE

SEQ ID NO: 1326828 - protein, 25 aa, Mycobacterium
SEIELPFATIPLRDEWRGVVEDGKL

SEQ ID NO: 1326829 - protein, 37 aa, Mycobacterium
SEKAARFIRTCDCFNIPIVLLVDVPGFLPGTDQEYNG

SEQ ID NO: 1326830 - protein, 28 aa, Mycobacterium
SEKAGICLPTTYHLLRTLVHEGYLQRDD

SEQ ID NO: 1326831 - protein, 22 aa, Mycobacterium
SEKLMLRADLLRPWANWVTPKE

SEQ ID NO: 1326832 - protein, 19 aa, Mycobacterium
SEKVAIDAAQVWLGVVEDQ

SEQ ID NO: 1326833 - protein, 32 aa, Mycobacterium
SELGFEYVDLFLIHWPLPTLYDGDFVSTWQTL

SEQ ID NO: 1326834 - protein, 22 aa, Mycobacterium
SELLRLLHRADAAVLPSHYEPF

SEQ ID NO: 1326835 - protein, 30 aa, Mycobacterium
SELPACPKHWTLLISLKRLAEVQTGLTLGK

SEQ ID NO: 1326836 - protein, 24 aa, Mycobacterium
SELPDRACWALQHLLTRRYISAES

SEQ ID NO: 1326837 - protein, 32 aa, Mycobacterium
SELRELNLLTAKPFLYVFNADEAVLTDTERVA

SEQ ID NO: 1326838 - protein, 21 aa, Mycobacterium
SELSLFEWADAIVAPLGMVLT

SEQ ID NO: 1326839 - protein, 24 aa, Mycobacterium
SELVFHAILGDRPDLAPFAGTDRR

SEQ ID NO: 1326840 - protein, 26 aa, Mycobacterium
SELYQNLLGFKLSDIIDFGPGASATF

SEQ ID NO: 1326841 - protein, 26 aa, Mycobacterium
SENAALVVDALKLALARFATAIDDLP

SEQ ID NO: 1326842 - protein, 25 aa, Mycobacterium
SEPPSVATLTLRREWARKAVVAGVT

SEQ ID NO: 1326843 - protein, 24 aa, Mycobacterium
SEPRFDPKVWARLGSELGVLGMSV

SEQ ID NO: 1326844 - protein, 24 aa, Mycobacterium
SEPRHAWFPIDRSMVLYYCSLVED

SEQ ID NO: 1326845 - protein, 22 aa, Mycobacterium
SEPTVVRVLGAIEIPVVAQALA

SEQ ID NO: 1326846 - protein, 25 aa, Mycobacterium
SEQAALFLDVPLSSLSQIVLHLGNG

SEQ ID NO: 1326847 - protein, 18 aa, Mycobacterium
SEQGRWWGLVTYPIRHGS

SEQ ID NO: 1326848 - protein, 22 aa, Mycobacterium
SERDLLDVYRRALAASGGPELD

SEQ ID NO: 1326849 - protein, 21 aa, Mycobacterium
SERQLIIDALLSYSDTIISVP

SEQ ID NO: 1326850 - protein, 17 aa, Mycobacterium
SERQNLGVLALARNASA

SEQ ID NO: 1326851 - protein, 29 aa, Mycobacterium
SERTPLTAELLLRGWQDSGAPEVLALAQG

SEQ ID NO: 1326852 - protein, 28 aa, Mycobacterium
SESPGTKLMVLPPLMHGAAQWAVFTAMN

SEQ ID NO: 1326853 - protein, 22 aa, Mycobacterium
SESVRHDLWWDYRSCMKDDQQT

SEQ ID NO: 1326854 - protein, 27 aa, Mycobacterium
SESYHRIEKAFPGRFLLGIGVGHPEHT

SEQ ID NO: 1326855 - protein, 19 aa, Mycobacterium
SETAVYNVLPQWAKLATKP

SEQ ID NO: 1326856 - protein, 17 aa, Mycobacterium
SETIDWARTLAVLGVDE

SEQ ID NO: 1326857 - protein, 17 aa, Mycobacterium
SETPLIKAARAAGAQVI

SEQ ID NO: 1326858 - protein, 25 aa, Mycobacterium
SETQWDWLDLPNPPASWGWGTMAHL

SEQ ID NO: 1326859 - protein, 26 aa, Mycobacterium
SEVAEMLRRPAPWRGAMEIDRLNVAI

SEQ ID NO: 1326860 - protein, 27 aa, Mycobacterium
SEVAPAVIIHLAAIIPPAIYKNRALAR

SEQ ID NO: 1326861 - protein, 29 aa, Mycobacterium
SEVGLLHLQATLYSLWHGKTTAVIEESQV

SEQ ID NO: 1326862 - protein, 22 aa, Mycobacterium
SEVLLIEPFYDSYSPVIAMAGC

SEQ ID NO: 1326863 - protein, 28 aa, Mycobacterium
SEVRNFLVANALYWLQEYHIDGLRVDAV

SEQ ID NO: 1326864 - protein, 19 aa, Mycobacterium
SEVSITRRMFRDGAGEYEI

SEQ ID NO: 1326865 - protein, 23 aa, Mycobacterium
SEWNGQSVFALNAAISALRSGAD

SEQ ID NO: 1326866 - protein, 17 aa, Mycobacterium
SEYKPRWGTSLATGWAS

SEQ ID NO: 1326867 - protein, 23 aa, Mycobacterium
SEYVRFFEDFGIEDVPLVGGKNA

SEQ ID NO: 1326868 - protein, 17 aa, Mycobacterium
SFAARAYRLLPEKPAYT

SEQ ID NO: 1326869 - protein, 18 aa, Mycobacterium
SFAAVDFFEARGLPFLVA

SEQ ID NO: 1326870 - protein, 25 aa, Mycobacterium
SFAEFGGWLMPVSYAGTVAEHTATR

SEQ ID NO: 1326871 - protein, 19 aa, Mycobacterium
SFAFLGDYGGTGYAAGKGA

SEQ ID NO: 1326872 - protein, 21 aa, Mycobacterium
SFALRMLVTLIYAHERKMGIT

SEQ ID NO: 1326873 - protein, 28 aa, Mycobacterium
SFATYFNAFPASYWRRWSTLTSVVLRVE

SEQ ID NO: 1326874 - protein, 19 aa, Mycobacterium
SFCYEAQRQVPAILDLLAT

SEQ ID NO: 1326875 - protein, 23 aa, Mycobacterium
SFELTQKAVMAGIPVLAAVSAPS

SEQ ID NO: 1326876 - protein, 18 aa, Mycobacterium
SFEMLRYVGDRFLLLPMP

SEQ ID NO: 1326877 - protein, 25 aa, Mycobacterium
SFEPGEDWFWNFDTGAYYDGPELAA

SEQ ID NO: 1326878 - protein, 21 aa, Mycobacterium
SFEWPRLEGAFNWATDWFDVI

SEQ ID NO: 1326879 - protein, 19 aa, Mycobacterium
SFFTELLPRLKSVELAGRP

SEQ ID NO: 1326880 - protein, 27 aa, Mycobacterium
SFGDRFGIIAAQWTYATLLLQAGSPRR

SEQ ID NO: 1326881 - protein, 17 aa, Mycobacterium
SFGILRDPNPHVGFGGT

SEQ ID NO: 1326882 - protein, 25 aa, Mycobacterium
SFGTYFLCVDPRPLGFTDSAAFCAE

SEQ ID NO: 1326883 - protein, 28 aa, Mycobacterium
SFHVCVVYPWVRFLDRDPATPLRVLQSC

SEQ ID NO: 1326884 - protein, 20 aa, Mycobacterium
SFIGKIFSPPEFKLIPLDES

SEQ ID NO: 1326885 - protein, 19 aa, Mycobacterium
SFLDAIGVDRVLRLADSTL

SEQ ID NO: 1326886 - protein, 20 aa, Mycobacterium
SFLERRPAVFPPLDDHPADH

SEQ ID NO: 1326887 - protein, 25 aa, Mycobacterium
SFLLDHALVDIGVGVRWLREVQGVE

SEQ ID NO: 1326888 - protein, 17 aa, Mycobacterium
SFLPALPNFTLTSQSFE

SEQ ID NO: 1326889 - protein, 19 aa, Mycobacterium
SFLQLLAAVVDTWRTRRAD

SEQ ID NO: 1326890 - protein, 25 aa, Mycobacterium
SFNAAFAPFNLPRTAFKPSYGLAEA

SEQ ID NO: 1326891 - protein, 23 aa, Mycobacterium
SFNGWFRSWIPVTLQSDRSGLIM

SEQ ID NO: 1326892 - protein, 18 aa, Mycobacterium
SFNLFAHKTILENVTLAP

SEQ ID NO: 1326893 - protein, 21 aa, Mycobacterium
SFQPEWWQRAAELGWASLLVP

SEQ ID NO: 1326894 - protein, 29 aa, Mycobacterium
SFRLPDVGVINALRWRPHPWGDDLRETAV

SEQ ID NO: 1326895 - protein, 19 aa, Mycobacterium
SFRMMEGFGVHTFRLTGPD

SEQ ID NO: 1326896 - protein, 29 aa, Mycobacterium
SFSAAAVWRIRRAAPLLPTVLLGETSRYL

SEQ ID NO: 1326897 - protein, 34 aa, Mycobacterium
SFSTTDVDFYKWTQWIFLQIYNAWFDTAQNKARP

SEQ ID NO: 1326898 - protein, 19 aa, Mycobacterium
SFTMVGDLAQRRSPAGAAS

SEQ ID NO: 1326899 - protein, 21 aa, Mycobacterium
SFTPKFFGHTGLRPAPADPTG

SEQ ID NO: 1326900 - protein, 18 aa, Mycobacterium
SFTPVLIPTSRGILATCT

SEQ ID NO: 1326901 - protein, 22 aa, Mycobacterium
SFTWLDDRVVEWTPAQPLPAHT

SEQ ID NO: 1326902 - protein, 21 aa, Mycobacterium
SFVFNLVQYLGQLGVDAQVWR

SEQ ID NO: 1326903 - protein, 31 aa, Mycobacterium
SFVNPHDIVLFPAWARRNPLPASPLDPPPVP

SEQ ID NO: 1326904 - protein, 26 aa, Mycobacterium
SFVNQLQMALFAWIKRNPAGERPLGG

SEQ ID NO: 1326905 - protein, 32 aa, Mycobacterium
SFVPITDQHLDVPLYWQCWKLDSDTVRQVTAA

SEQ ID NO: 1326906 - protein, 18 aa, Mycobacterium
SFVRRPAGPPVDKLTARL

SEQ ID NO: 1326907 - protein, 17 aa, Mycobacterium
SFWAARRARNEAEATRS

SEQ ID NO: 1326908 - protein, 18 aa, Mycobacterium
SFWRDLVSFTWNIKTLEG

SEQ ID NO: 1326909 - protein, 17 aa, Mycobacterium
SFYDWYADLPVASPQVF

SEQ ID NO: 1326910 - protein, 23 aa, Mycobacterium
SFYVRTPSGFDIEYGWDAVTVDE

SEQ ID NO: 1326911 - protein, 22 aa, Mycobacterium
SFYVRTPSGFDLEYGWDAVTVD

SEQ ID NO: 1326912 - protein, 28 aa, Mycobacterium
SGAAIKTLWLPGPDPEPHYRPSAKLAAF

SEQ ID NO: 1326913 - protein, 29 aa, Mycobacterium
SGAASSAYSPLWAEWLDGATTLVDTLEEL

SEQ ID NO: 1326914 - protein, 25 aa, Mycobacterium
SGAGILNFVFGEVWLRPGLGMRERR

SEQ ID NO: 1326915 - protein, 17 aa, Mycobacterium
SGAGRILTLACARLRLG

SEQ ID NO: 1326916 - protein, 34 aa, Mycobacterium
SGAHKPTPTITARLNFQLAFGARVGQRLAEAREE

SEQ ID NO: 1326917 - protein, 25 aa, Mycobacterium
SGAKTWISNARRSGLIALLCKTDPE

SEQ ID NO: 1326918 - protein, 17 aa, Mycobacterium
SGALLLLASGAGSFITG

SEQ ID NO: 1326919 - protein, 25 aa, Mycobacterium
SGALVALPVLRAAVATLASMATFEE

SEQ ID NO: 1326920 - protein, 24 aa, Mycobacterium
SGAPDSLLPRPDSLAELLPDSLPR

SEQ ID NO: 1326921 - protein, 17 aa, Mycobacterium
SGAPKIVDACTLPLTGQ

SEQ ID NO: 1326922 - protein, 27 aa, Mycobacterium
SGAPPAPPVPLGPPTSPAPPGPVPPTG

SEQ ID NO: 1326923 - protein, 21 aa, Mycobacterium
SGARLLAVAVPPTVPHEFPVT

SEQ ID NO: 1326924 - protein, 26 aa, Mycobacterium
SGATALLYHAAFAPRLAEVLADLPNL

SEQ ID NO: 1326925 - protein, 25 aa, Mycobacterium
SGATTPPFWMVYDDRAGDIPPVSAT

SEQ ID NO: 1326926 - protein, 23 aa, Mycobacterium
SGCRFRTRCWKATDVCATTTPSA

SEQ ID NO: 1326927 - protein, 33 aa, Mycobacterium
SGDAILAKAIVMRAWLAGWNPVVDQYAVNHPTV

SEQ ID NO: 1326928 - protein, 28 aa, Mycobacterium
SGDDALNLPWLAMGAVGFISVWGHLAAS

SEQ ID NO: 1326929 - protein, 24 aa, Mycobacterium
SGDDTGVAWYWPPSEAEVADEDEA

SEQ ID NO: 1326930 - protein, 18 aa, Mycobacterium
SGDEMARMFAHCPEVVTA

SEQ ID NO: 1326931 - protein, 24 aa, Mycobacterium
SGDGAGILIQLPVDLLRAVTDFAL

SEQ ID NO: 1326932 - protein, 30 aa, Mycobacterium
SGDLTLAQLSILLTLFDQGPMRMTELAAHE

SEQ ID NO: 1326933 - protein, 20 aa, Mycobacterium
SGDMLRRSGPRKDGVPLWWK

SEQ ID NO: 1326934 - protein, 39 aa, Mycobacterium
SGDNPHILTLSPPVRLEARWLKPTAYMMAKFGMTLCALG

SEQ ID NO: 1326935 - protein, 19 aa, Mycobacterium
SGDPVLWFHGTPGGRRQFP

SEQ ID NO: 1326936 - protein, 31 aa, Mycobacterium
SGDPWEDFLARPADYFALLAELGFITEDDEK

SEQ ID NO: 1326937 - protein, 24 aa, Mycobacterium
SGDRAYVAHAFPFPNREGEPRAIV

SEQ ID NO: 1326938 - protein, 25 aa, Mycobacterium
SGDRQYRHRWWVGGHWRQQACGPNH

SEQ ID NO: 1326939 - protein, 23 aa, Mycobacterium
SGDVLRSLWLPAHALRSPTAFRK

SEQ ID NO: 1326940 - protein, 25 aa, Mycobacterium
SGEAAKWLYALTARLPMGQADRYSV

SEQ ID NO: 1326941 - protein, 25 aa, Mycobacterium
SGEDHAWSYVFLASHRSRGLTGETI

SEQ ID NO: 1326942 - protein, 26 aa, Mycobacterium
SGEDHAWSYVFLASHRSRGLTGETIH

SEQ ID NO: 1326943 - protein, 26 aa, Mycobacterium
SGEEFDLSNLFLLASTAALFSPALKD

SEQ ID NO: 1326944 - protein, 24 aa, Mycobacterium
SGELTFLDVTRQVPLRIRLERFAP

SEQ ID NO: 1326945 - protein, 27 aa, Mycobacterium
SGEMEPYPIIRKLFATFGIADMARESL

SEQ ID NO: 1326946 - protein, 33 aa, Mycobacterium
SGEPTWIQLYLQGHLGWPAGVSYRVVALTPPEA

SEQ ID NO: 1326947 - protein, 28 aa, Mycobacterium
SGEPWQAVAPLRYFNDRAGSIYAGSNEI

SEQ ID NO: 1326948 - protein, 48 aa, Mycobacterium
SGEQRLSGFLLWQSAYSEMWFTEAYWPEFRRVDFLRALRDYSARHRRY

SEQ ID NO: 1326949 - protein, 25 aa, Mycobacterium
SGFENIIIRGLFLGQTRKQMMSKVD

SEQ ID NO: 1326950 - protein, 34 aa, Mycobacterium
SGFERFPAWMWRNTVVRDFVDWLHARNSRCRADG

SEQ ID NO: 1326951 - protein, 18 aa, Mycobacterium
SGFIAVTVIVRRGTGKPA

SEQ ID NO: 1326952 - protein, 27 aa, Mycobacterium
SGFLNLSEGWWPFLVGLAMGDAGGYKS

SEQ ID NO: 1326953 - protein, 24 aa, Mycobacterium
SGFLNLSEGWWPFLVGLSMGDAGG

SEQ ID NO: 1326954 - protein, 29 aa, Mycobacterium
SGFRGAKNVLLVFFPLAFTGICQRELDEI

SEQ ID NO: 1326955 - protein, 20 aa, Mycobacterium
SGFRPLMSVLLDTLDELAGA

SEQ ID NO: 1326956 - protein, 25 aa, Mycobacterium
SGGCDLIPYLPFSTAAGVSLLTDRL

SEQ ID NO: 1326957 - protein, 19 aa, Mycobacterium
SGGGFPEFPLPLGNPAEST

SEQ ID NO: 1326958 - protein, 21 aa, Mycobacterium
SGGIYAPMLHPWSPSTQGTGS

SEQ ID NO: 1326959 - protein, 28 aa, Mycobacterium
SGGQKQCVAIARAVFFGARVLILDEPTA

SEQ ID NO: 1326960 - protein, 29 aa, Mycobacterium
SGGQQRRLQLLLILLSQPNVLILDEPTND

SEQ ID NO: 1326961 - protein, 31 aa, Mycobacterium; identical to SEQ ID NO: 860783

SEQ ID NO: 1326962 - protein, 28 aa, Mycobacterium
SGGWSVGAVALVAGWVARNSPAGATVAA

SEQ ID NO: 1326963 - protein, 25 aa, Mycobacterium
SGHDALRRRHLVPEPPYGQGEIAAR

SEQ ID NO: 1326964 - protein, 25 aa, Mycobacterium
SGHDHAWSYVFLASHRSRGLTGETI

SEQ ID NO: 1326965 - protein, 26 aa, Mycobacterium
SGHDHAWSYVFLASHRSRGLTGETIH

SEQ ID NO: 1326966 - protein, 25 aa, Mycobacterium
SGHRVPWSSLRLRTARLCRPGIAPC

SEQ ID NO: 1326967 - protein, 21 aa, Mycobacterium
SGHVPPPQPPPTTPPQQQPPT

SEQ ID NO: 1326968 - protein, 24 aa, Mycobacterium
SGIAKTTIYRRHSDRRDMLAVALS

SEQ ID NO: 1326969 - protein, 27 aa, Mycobacterium
SGIDANLVAYWAILATRVEAPGLAELG

SEQ ID NO: 1326970 - protein, 26 aa, Mycobacterium
SGIEWELYYEPTAPMWELLPMKVRDN

SEQ ID NO: 1326971 - protein, 22 aa, Mycobacterium
SGIGAALCRALVAAGAEVLCTD

SEQ ID NO: 1326972 - protein, 28 aa, Mycobacterium
SGIHVYLKRATLNRALFGSPAAQRKRLS

SEQ ID NO: 1326973 - protein, 23 aa, Mycobacterium
SGISWELYYEPTAPIWEMLPMKV

SEQ ID NO: 1326974 - protein, 23 aa, Mycobacterium
SGITPIMSLIRTALATSARSIRL

SEQ ID NO: 1326975 - protein, 24 aa, Mycobacterium
SGKSTLLSLLAGVLRPATGRVDVD

SEQ ID NO: 1326976 - protein, 17 aa, Mycobacterium
SGKTTTTYLVEAGLRAA

SEQ ID NO: 1326977 - protein, 24 aa, Mycobacterium
SGLDARAYRLPWPSGSVVYEIDQP

SEQ ID NO: 1326978 - protein, 27 aa, Mycobacterium
SGLGMIVAFEEMFWGDAGIALAILGTG

SEQ ID NO: 1326979 - protein, 26 aa, Mycobacterium
SGLHNRILALGYRIAPRPVLAMVSEQ

SEQ ID NO: 1326980 - protein, 25 aa, Mycobacterium
SGLIEPAHPLAFQRTLHDAVAQVVG

SEQ ID NO: 1326981 - protein, 17 aa, Mycobacterium
SGLIERFGSGKGCDICK

SEQ ID NO: 1326982 - protein, 18 aa, Mycobacterium
SGLLMVAPYIARMTPQLL

SEQ ID NO: 1326983 - protein, 19 aa, Mycobacterium
SGLMGILASNGAFGPRFMP

SEQ ID NO: 1326984 - protein, 19 aa, Mycobacterium
SGLMLSGALFRDGLTIVHT

SEQ ID NO: 1326985 - protein, 29 aa, Mycobacterium
SGLNRAILGKGWHQFALALASAARYTGTA

SEQ ID NO: 1326986 - protein, 28 aa, Mycobacterium
SGLNRAILGKGWHQFALALSSAARYTGT

SEQ ID NO: 1326987 - protein, 25 aa, Mycobacterium
SGLPAGTFSLLFGSGPGLGIALVTD

SEQ ID NO: 1326988 - protein, 21 aa, Mycobacterium
SGLRDHWLLRSCEPEEVAAGV

SEQ ID NO: 1326989 - protein, 24 aa, Mycobacterium
SGLRDWMREFFDDKYVDGWDFVTI

SEQ ID NO: 1326990 - protein, 24 aa, Mycobacterium
SGLTRFAFAGVGVLLPRWSGDQYN

SEQ ID NO: 1326991 - protein, 21 aa, Mycobacterium
SGLVGFFAYDLVRRLERLPEL

SEQ ID NO: 1326992 - protein, 17 aa, Mycobacterium
SGLYHEPRLFSCGARLP

SEQ ID NO: 1326993 - protein, 22 aa, Mycobacterium
SGMAVVELLRRGITARDILTKE

SEQ ID NO: 1326994 - protein, 25 aa, Mycobacterium
SGMVWVNNWHVIHPAYPFGGYKESG

SEQ ID NO: 1326995 - protein, 23 aa, Mycobacterium
SGNPFLIAIDHHRVWYRYHHLFG

SEQ ID NO: 1326996 - protein, 24 aa, Mycobacterium
SGNPFVMYPSYREIAALPLAERVA

SEQ ID NO: 1326997 - protein, 20 aa, Mycobacterium
SGNPYLAFAAMLMAGIDGIK

SEQ ID NO: 1326998 - protein, 27 aa, Mycobacterium
SGPADAASNWYSEFARLAPLMEKDVHY

SEQ ID NO: 1326999 - protein, 23 aa, Mycobacterium
SGPAQLLYLGRLEYEKGVHDLIA

SEQ ID NO: 1327000 - protein, 21 aa, Mycobacterium
SGPDWYPAFLTAVADRIEIGR

SEQ ID NO: 1327001 - protein, 29 aa, Mycobacterium
SGPGDVPLLDTYLAVANYLLIPTRDDQAS

SEQ ID NO: 1327002 - protein, 21 aa, Mycobacterium
SGPLSAKLLRNGTLKTYAGFP

SEQ ID NO: 1327003 - protein, 23 aa, Mycobacterium
SGPMPKWYAPVGSLFDQFLGAAE

SEQ ID NO: 1327004 - protein, 25 aa, Mycobacterium
SGPMVRYPIPPMIHGATQSATWMAL

SEQ ID NO: 1327005 - protein, 21 aa, Mycobacterium
SGQATLYHLGLSGIPVVNVNN

SEQ ID NO: 1327006 - protein, 24 aa, Mycobacterium
SGQDLLLVTVLKGAVMFVTDLARA

SEQ ID NO: 1327007 - protein, 31 aa, Mycobacterium
SGQGVMFDRLPPLFLEMALSFLAMDPPRHDK

SEQ ID NO: 1327008 - protein, 32 aa, Mycobacterium
SGQKLYLATVIDLYSRRLLGAAMGLHPDADLA

SEQ ID NO: 1327009 - protein, 23 aa, Mycobacterium
SGQSCILPSRILLPRSRYDEGIE

SEQ ID NO: 1327010 - protein, 29 aa, Mycobacterium
SGQVGLLRYPLQLIAPLARVFVARQGAYR

SEQ ID NO: 1327011 - protein, 22 aa, Mycobacterium
SGRAIVVFQPHLYSRTVTFASE

SEQ ID NO: 1327012 - protein, 17 aa, Mycobacterium
SGRIAYTLGLAGPAITV

SEQ ID NO: 1327013 - protein, 33 aa, Mycobacterium
SGRIRTAASWLGTALALKPLLRLDVDGRLVLDQ

SEQ ID NO: 1327014 - protein, 20 aa, Mycobacterium
SGRLAAIRQAARRVTSTKRG

SEQ ID NO: 1327015 - protein, 23 aa, Mycobacterium
SGRLRRRLVLPAVLPPLRTNDPV

SEQ ID NO: 1327016 - protein, 27 aa, Mycobacterium
SGRPLAMPRLDMVTGLYFLTTEIEGDT

SEQ ID NO: 1327017 - protein, 28 aa, Mycobacterium
SGRPVTLINVVTPIAISWPTIMLQEQIS

SEQ ID NO: 1327018 - protein, 29 aa, Mycobacterium
SGRPVTLINVVTPIAISWPTIMLQEQISA

SEQ ID NO: 1327019 - protein, 17 aa, Mycobacterium
SGRPYFVHTGEPDYMVE

SEQ ID NO: 1327020 - protein, 33 aa, Mycobacterium
SGRPYRYTYAATGKPGWFLFDGLVRHDLHTGTE

SEQ ID NO: 1327021 - protein, 23 aa, Mycobacterium
SGRQIPVQLSIQERLRHIHVLGR

SEQ ID NO: 1327022 - protein, 29 aa, Mycobacterium
SGRRGLARWIFGNSAERLLPRLPCSVLAV

SEQ ID NO: 1327023 - protein, 34 aa, Mycobacterium
SGRYRLKCVIGERIRVLEWLPDDPYPRAVVELWP

SEQ ID NO: 1327024 - protein, 24 aa, Mycobacterium
SGSKGLHLYVPLDEPISSRGASVL

SEQ ID NO: 1327025 - protein, 24 aa, Mycobacterium
SGSKGLHLYVPLQEPISSQGASVL

SEQ ID NO: 1327026 - protein, 24 aa, Mycobacterium
SGSQLAHYFADKQTLLRALIERQM

SEQ ID NO: 1327027 - protein, 35 aa, Mycobacterium
SGSRGFHIYARIHRRWPFKLVRLAAETVAREVERR

SEQ ID NO: 1327028 - protein, 21 aa, Mycobacterium
SGSRIPFQDWWTNPVVTDADG

SEQ ID NO: 1327029 - protein, 18 aa, Mycobacterium
SGSRMRPDVVIKFMDRFG

SEQ ID NO: 1327030 - protein, 22 aa, Mycobacterium
SGSSQFVSGLLLSGAAFTEGLT

SEQ ID NO: 1327031 - protein, 24 aa, Mycobacterium
SGSVAQRLWAKPAITVIGIDTTPI

SEQ ID NO: 1327032 - protein, 24 aa, Mycobacterium
SGSVILLVVPMFHANAWGTPYTAA

SEQ ID NO: 1327033 - protein, 26 aa, Mycobacterium
SGTATLRYSGIFAFGTYSVTYKNYSD

SEQ ID NO: 1327034 - protein, 24 aa, Mycobacterium
SGTAWQIFPNFQIGQGLTSALCYS

SEQ ID NO: 1327035 - protein, 19 aa, Mycobacterium
SGTDLFVDIWARYIGSLTR

SEQ ID NO: 1327036 - protein, 17 aa, Mycobacterium
SGTLFRLEEDESWFTGI

SEQ ID NO: 1327037 - protein, 17 aa, Mycobacterium
SGTLKQGISSEDAKKIT

SEQ ID NO: 1327038 - protein, 23 aa, Mycobacterium
SGTRLYPITLGISKQLVPVYDKP

SEQ ID NO: 1327039 - protein, 23 aa, Mycobacterium
SGTRPLHEWLDALRTGIDQLTSV

SEQ ID NO: 1327040 - protein, 25 aa, Mycobacterium
SGVAFDVLRRWLTAKGFDVAFIRNV

SEQ ID NO: 1327041 - protein, 18 aa, Mycobacterium
SGVEQLIFAPRGPLAAPP

SEQ ID NO: 1327042 - protein, 22 aa, Mycobacterium
SGVHFAFVSNASPWTYANARPV

SEQ ID NO: 1327043 - protein, 18 aa, Mycobacterium
SGVPDYGYAFWPGRTVEG

SEQ ID NO: 1327044 - protein, 25 aa, Mycobacterium
SGVPKTLIQHLIRWVISSDQFDKAV

SEQ ID NO: 1327045 - protein, 25 aa, Mycobacterium
SGVRWTLLAGTHVRRLLRICDPVRE

SEQ ID NO: 1327046 - protein, 17 aa, Mycobacterium
SGWRLTGQKVWTSAAHK

SEQ ID NO: 1327047 - protein, 22 aa, Mycobacterium
SGYGLATAHRFLDEGWNVVATM

SEQ ID NO: 1327048 - protein, 26 aa, Mycobacterium
SGYGLPMALTLFRRQLDVWTPGEHNG

SEQ ID NO: 1327049 - protein, 22 aa, Mycobacterium
SGYKISVPHAVRISPDGIYLHE

SEQ ID NO: 1327050 - protein, 18 aa, Mycobacterium
SGYLQPHWPKPYGRGADS

SEQ ID NO: 1327051 - protein, 34 aa, Mycobacterium
SGYRRFTAYDCARLRFILTAQRDQYLPLKVIKAQ

SEQ ID NO: 1327052 - protein, 24 aa, Mycobacterium
SHAPGQLDFLGYGAQRALDAGVPA

SEQ ID NO: 1327053 - protein, 25 aa, Mycobacterium
SHASDIPFYGISRLLRRGMGIDAVD

SEQ ID NO: 1327054 - protein, 26 aa, Mycobacterium
SHDHLWRARVLPGERSYPVAHRVRGV

SEQ ID NO: 1327055 - protein, 19 aa, Mycobacterium
SHDTMEVWSWFLVEKDADE

SEQ ID NO: 1327056 - protein, 18 aa, Mycobacterium
SHDTPKTAWLFTGQGSQY

SEQ ID NO: 1327057 - protein, 24 aa, Mycobacterium
SHEASMFAWTKPPMLPTTKASIDG

SEQ ID NO: 1327058 - protein, 20 aa, Mycobacterium
SHEGVDWLLAQSELPDMVFE

SEQ ID NO: 1327059 - protein, 25 aa, Mycobacterium
SHERLDRLVGQILPVPIARAVADVA

SEQ ID NO: 1327060 - protein, 19 aa, Mycobacterium
SHLAADNTSLFLKDESFRE

SEQ ID NO: 1327061 - protein, 26 aa, Mycobacterium
SHLDSPYPFVLVTPQTDVDRTLLDYA

SEQ ID NO: 1327062 - protein, 18 aa, Mycobacterium
SHLLIDGARRVSAPTLLV

SEQ ID NO: 1327063 - protein, 20 aa, Mycobacterium
SHLLVWTTTPWTLPSNQAVA

SEQ ID NO: 1327064 - protein, 21 aa, Mycobacterium
SHLNWYLGGRSASLSRLLPML

SEQ ID NO: 1327065 - protein, 25 aa, Mycobacterium
SHLSLLRRLMMDDNWYRGELIFVFD

SEQ ID NO: 1327066 - protein, 30 aa, Mycobacterium; identical to SEQ ID NO: 861235

SEQ ID NO: 1327067 - protein, 25 aa, Mycobacterium
SHPDEVLWGWLPNAQTRPALSVASG

SEQ ID NO: 1327068 - protein, 21 aa, Mycobacterium
SHPIRLFIGSGMPAGLWKRVV

SEQ ID NO: 1327069 - protein, 21 aa, Mycobacterium
SHQVGGLLDLPHGVINGVLLP

SEQ ID NO: 1327070 - protein, 17 aa, Mycobacterium
SHRCGALILLGPTGDQS

SEQ ID NO: 1327071 - protein, 22 aa, Mycobacterium
SHRLRCRHRNRAPRQSRAPNSV

SEQ ID NO: 1327072 - protein, 18 aa, Mycobacterium
SHRNILNNGFFVTEQIRL

SEQ ID NO: 1327073 - protein, 23 aa, Mycobacterium
SHRPRALTLLGDYLDELDAVPED

SEQ ID NO: 1327074 - protein, 24 aa, Mycobacterium
SHRSRLWDRIAQWVPTVVPVGETV

SEQ ID NO: 1327075 - protein, 17 aa, Mycobacterium
SHSWCWNLDGSLNEVID

SEQ ID NO: 1327076 - protein, 23 aa, Mycobacterium
SHVEVALKHPIKLIANALGSPPK

SEQ ID NO: 1327077 - protein, 19 aa, Mycobacterium
SHVFFDWFDAVGVEDLPAV

SEQ ID NO: 1327078 - protein, 27 aa, Mycobacterium
SHVRRHSLWWPVDVPAADLAAALVPLH

SEQ ID NO: 1327079 - protein, 19 aa, Mycobacterium
SHWFDEQPAYRAPLPGDRD

SEQ ID NO: 1327080 - protein, 17 aa, Mycobacterium
SIAARWGFPHLPSFEEL

SEQ ID NO: 1327081 - protein, 24 aa, Mycobacterium
SIADTFLMFGARIMDTGATMIDFV

SEQ ID NO: 1327082 - protein, 23 aa, Mycobacterium
SIALDMLLDFMPRYGVEWDGCRR

SEQ ID NO: 1327083 - protein, 24 aa, Mycobacterium
SIALYRAFRRRAAVAGLDVIMVEH

SEQ ID NO: 1327084 - protein, 18 aa, Mycobacterium
SIDVVAPGDIIAVDRGSG

SEQ ID NO: 1327085 - protein, 21 aa, Mycobacterium
SIDYDYLIYAVGSTGAAPTVP

SEQ ID NO: 1327086 - protein, 21 aa, Mycobacterium
SIEAVAALRDSGIDARLVVVG

SEQ ID NO: 1327087 - protein, 18 aa, Mycobacterium
SIEEAAEFFAPISSIHRY

SEQ ID NO: 1327088 - protein, 26 aa, Mycobacterium
SIENGSYFVYRLIKRLKKSANNAPYH

SEQ ID NO: 1327089 - protein, 18 aa, Mycobacterium
SIEVFKKSGLGALPVPKA

SEQ ID NO: 1327090 - protein, 18 aa, Mycobacterium
SIFGVAPVRPGWQRWLYQ

SEQ ID NO: 1327091 - protein, 18 aa, Mycobacterium
SIFVRPLPHQFSALQELL

SEQ ID NO: 1327092 - protein, 26 aa, Mycobacterium
SIGRAYYGFSTLLCTPSSLAQPVGLA

SEQ ID NO: 1327093 - protein, 23 aa, Mycobacterium
SIGRSWWLRHVVVSAAHWQRFSK

SEQ ID NO: 1327094 - protein, 29 aa, Mycobacterium
SIGVRSVSYLPLTYDHRLIDGADAGRFVT

SEQ ID NO: 1327095 - protein, 17 aa, Mycobacterium
SIKHQLPSVIFSLEMSK

SEQ ID NO: 1327096 - protein, 26 aa, Mycobacterium
SILALLSHLRDEFGLSIILITHEMEV

SEQ ID NO: 1327097 - protein, 19 aa, Mycobacterium
SILDRTPWRAEEVTVIVAP

SEQ ID NO: 1327098 - protein, 33 aa, Mycobacterium
SILGLLRPRLNPLDWMNGAWRATLAAAGAAEHA

SEQ ID NO: 1327099 - protein, 17 aa, Mycobacterium
SILLTRFLEGSWQYRRL

SEQ ID NO: 1327100 - protein, 25 aa, Mycobacterium
SILNDPYPTYRLLRDVAPVYRAEES

SEQ ID NO: 1327101 - protein, 17 aa, Mycobacterium
SILQRNGATRVSVLARK

SEQ ID NO: 1327102 - protein, 21 aa, Mycobacterium
SINLPYITVDADKNPLFLDEQ

SEQ ID NO: 1327103 - protein, 24 aa, Mycobacterium
SIQDSYNLAWKIAAVLRGQADPAL

SEQ ID NO: 1327104 - protein, 23 aa, Mycobacterium
SIQQVTVLAAKPFGAHDPRELAK

SEQ ID NO: 1327105 - protein, 29 aa, Mycobacterium
SIRDVLRSPAIFEWFDISGADDIPPIFGG

SEQ ID NO: 1327106 - protein, 20 aa, Mycobacterium
SIREAAKFWVGLRAAKRAGK

SEQ ID NO: 1327107 - protein, 20 aa, Mycobacterium
SIREFGLMQPIVVRATPGGE

SEQ ID NO: 1327108 - protein, 27 aa, Mycobacterium
SIRIPKPWFVLMPTPMWDQMFRPMVGA

SEQ ID NO: 1327109 - protein, 17 aa, Mycobacterium
SITRELARLGVLGDRLT

SEQ ID NO: 1327110 - protein, 28 aa, Mycobacterium
SIVFDTFPPRYVATAKRLIWASINKPTP

SEQ ID NO: 1327111 - protein, 30 aa, Mycobacterium
SIWEKWIELTPRYFAFWNKWDPGAISSQHG

SEQ ID NO: 1327112 - protein, 21 aa, Mycobacterium
SIYAFECPLLLGTQAVLMQRW

SEQ ID NO: 1327113 - protein, 19 aa, Mycobacterium
SIYTLVPRIAPGKAMIVIP

SEQ ID NO: 1327114 - protein, 29 aa, Mycobacterium
SKAADRPWRMWLPGHPEVSAYRRSPRAPI

SEQ ID NO: 1327115 - protein, 18 aa, Mycobacterium
SKAALDHLMMVAADELGP

SEQ ID NO: 1327116 - protein, 21 aa, Mycobacterium
SKDLVAKRLFIAPSTVRTHLQ

SEQ ID NO: 1327117 - protein, 24 aa, Mycobacterium
SKFENPWLFDVGRHPNPHVGFGGG

SEQ ID NO: 1327118 - protein, 25 aa, Mycobacterium
SKGNEYFLRHLLGADSNLQATPTEE

SEQ ID NO: 1327119 - protein, 24 aa, Mycobacterium
SKICWRTRLVVDSQVWALLDGELA

SEQ ID NO: 1327120 - protein, 25 aa, Mycobacterium
SKKAYDLLIQCEAGLLATTGTADTP

SEQ ID NO: 1327121 - protein, 20 aa, Mycobacterium
SKLLAAGQPFRHPDLRGALA

SEQ ID NO: 1327122 - protein, 24 aa, Mycobacterium
SKMVRYHLLLPDTATRRDLQDAKT

SEQ ID NO: 1327123 - protein, 29 aa, Mycobacterium
SKREIPHYYLANEILLDASSQWLAERNAQ

SEQ ID NO: 1327124 - protein, 19 aa, Mycobacterium
SKRWRGSQPTLWRAFAPGG

SEQ ID NO: 1327125 - protein, 18 aa, Mycobacterium
SKSAVLVALFDRVIDELL

SEQ ID NO: 1327126 - protein, 29 aa, Mycobacterium
SKSLAPALRLGWMALPDALVEPVLAAAGG

SEQ ID NO: 1327127 - protein, 23 aa, Mycobacterium
SKVLALLHRYGIASPASADLSRA

SEQ ID NO: 1327128 - protein, 18 aa, Mycobacterium
SKVLLLTATPYNLAFQDV

SEQ ID NO: 1327129 - protein, 24 aa, Mycobacterium
SKVQPILRTPAIQLALAEYVTRLN

SEQ ID NO: 1327130 - protein, 18 aa, Mycobacterium
SLADELMRRFNGATLETL

SEQ ID NO: 1327131 - protein, 20 aa, Mycobacterium
SLAEIPHPALPKGSSIYGGT

SEQ ID NO: 1327132 - protein, 18 aa, Mycobacterium
SLAGLFHRGAGLQLLVRE

SEQ ID NO: 1327133 - protein, 18 aa, Mycobacterium
SLAKAVLPIMNPGGGIVG

SEQ ID NO: 1327134 - protein, 21 aa, Mycobacterium
SLAPVRAIAAAVWASGIARRP

SEQ ID NO: 1327135 - protein, 20 aa, Mycobacterium
SLARRDLLVRQKSERYGRVV

SEQ ID NO: 1327136 - protein, 18 aa, Mycobacterium
SLATGWASIHGFPVGILA

SEQ ID NO: 1327137 - protein, 20 aa, Mycobacterium
SLAWPLFDALVDQSPFRTVN

SEQ ID NO: 1327138 - protein, 26 aa, Mycobacterium
SLCHGLLQGWPLEKTLRYANAAGAIV

SEQ ID NO: 1327139 - protein, 19 aa, Mycobacterium
SLDAGIWPWELDPEDSTGG

SEQ ID NO: 1327140 - protein, 21 aa, Mycobacterium
SLDALEIEALTWQNPATLAAM

SEQ ID NO: 1327141 - protein, 27 aa, Mycobacterium
SLDCLNRYPEFLPHRLRSLIAGRLGAD

SEQ ID NO: 1327142 - protein, 30 aa, Mycobacterium
SLDRNTFRWWLTVATLRWGVICRHQAERHL

SEQ ID NO: 1327143 - protein, 17 aa, Mycobacterium
SLDRSLAVARRLRAGFI

SEQ ID NO: 1327144 - protein, 25 aa, Mycobacterium
SLDRTSFVPGVLLAVRKVSERPGLS

SEQ ID NO: 1327145 - protein, 26 aa, Mycobacterium
SLDVRAFKLWAGLSGLVPRIAVVKGR

SEQ ID NO: 1327146 - protein, 24 aa, Mycobacterium
SLEAAELLSRTLLWQGRPAAAEAI

SEQ ID NO: 1327147 - protein, 31 aa, Mycobacterium
SLEGLAYRLARLFWWEILQINPDQKDLAISA

SEQ ID NO: 1327148 - protein, 19 aa, Mycobacterium
SLEGWYAHIPGIKVVAPAT

SEQ ID NO: 1327149 - protein, 24 aa, Mycobacterium
SLEIPCELALLAIGFEGVEHMALL

SEQ ID NO: 1327150 - protein, 19 aa, Mycobacterium
SLELVWWAGQLPESTARKV

SEQ ID NO: 1327151 - protein, 25 aa, Mycobacterium
SLEPFLAAGALLYQGPWVAERLVEF

SEQ ID NO: 1327152 - protein, 26 aa, Mycobacterium
SLEPFLAAGTLLYQGPWVAERLVEFG

SEQ ID NO: 1327153 - protein, 19 aa, Mycobacterium
SLEPRWFGWVDNMHDWCIS

SEQ ID NO: 1327154 - protein, 27 aa, Mycobacterium
SLERDRRYLAVPVFPSRHFRLSCIFVG

SEQ ID NO: 1327155 - protein, 24 aa, Mycobacterium
SLERNVLLTVLSRLGAGSRVVLTH

SEQ ID NO: 1327156 - protein, 25 aa, Mycobacterium
SLESNYLGWSRAMAPTIMGAPEQPE

SEQ ID NO: 1327157 - protein, 27 aa, Mycobacterium
SLGEVEFAFFVILLAVAGNETTRNAMT

SEQ ID NO: 1327158 - protein, 25 aa, Mycobacterium
SLGEVFTEWQVSLSADNIGALRAVD

SEQ ID NO: 1327159 - protein, 20 aa, Mycobacterium
SLGGWIAAWTALEHPDRVDR

SEQ ID NO: 1327160 - protein, 17 aa, Mycobacterium
SLGIARSDGLRLLYPGH

SEQ ID NO: 1327161 - protein, 26 aa, Mycobacterium
SLGLVQLTRKKLGTGLIEAFSTTCSH

SEQ ID NO: 1327162 - protein, 17 aa, Mycobacterium
SLGPPLGDQRLDLCDLY

SEQ ID NO: 1327163 - protein, 22 aa, Mycobacterium
SLGRFWAEEGPLSYLGLAVAGF

SEQ ID NO: 1327164 - protein, 21 aa, Mycobacterium
SLHCGLAQLWPRLNEDLDARA

SEQ ID NO: 1327165 - protein, 20 aa, Mycobacterium
SLIAPRLWVGAAVDGVDDRI

SEQ ID NO: 1327166 - protein, 17 aa, Mycobacterium
SLIMAGAFGSWRHDLSL

SEQ ID NO: 1327167 - protein, 20 aa, Mycobacterium
SLISLRQTLVLLPEAGTVIT

SEQ ID NO: 1327168 - protein, 18 aa, Mycobacterium
SLKDRIYAAWLWSRRRAV

SEQ ID NO: 1327169 - protein, 30 aa, Mycobacterium; identical to SEQ ID NO: 861771

SEQ ID NO: 1327170 - protein, 23 aa, Mycobacterium
SLLADDFYQVWWSDSQFADSRDA

SEQ ID NO: 1327171 - protein, 20 aa, Mycobacterium
SLLAGFAARLGLLLGRTDDA

SEQ ID NO: 1327172 - protein, 26 aa, Mycobacterium
SLLAYLFEVDYLDHFVFVLTEGPDGP

SEQ ID NO: 1327173 - protein, 17 aa, Mycobacterium
SLLGARRWVRMPGVHFG

SEQ ID NO: 1327174 - protein, 22 aa, Mycobacterium
SLLGFGSGMLLGRLVDHAFGRK

SEQ ID NO: 1327175 - protein, 21 aa, Mycobacterium
SLLGSALYRFPVSYETLEETG

SEQ ID NO: 1327176 - protein, 17 aa, Mycobacterium
SLLHLQPSNYHADITQP

SEQ ID NO: 1327177 - protein, 24 aa, Mycobacterium
SLMDTVGVLPYAAIGAVHADPVDP

SEQ ID NO: 1327178 - protein, 19 aa, Mycobacterium
SLMVKAGVQWGLFGGAIEN

SEQ ID NO: 1327179 - protein, 26 aa, Mycobacterium
SLPGEPPFVRGPYPTMYVNQPWTIRQ

SEQ ID NO: 1327180 - protein, 27 aa, Mycobacterium
SLPGGPTFATYWLFGDDTALRDAFAAH

SEQ ID NO: 1327181 - protein, 19 aa, Mycobacterium
SLPHAVLMMIPEAWENNTT

SEQ ID NO: 1327182 - protein, 23 aa, Mycobacterium
SLPLFMGELLTLYRAGGDVTALP

SEQ ID NO: 1327183 - protein, 18 aa, Mycobacterium
SLPPGRLGWRKAQEIASR

SEQ ID NO: 1327184 - protein, 22 aa, Mycobacterium
SLPPPVSPTMGPGGGMMPMGGM

SEQ ID NO: 1327185 - protein, 17 aa, Mycobacterium
SLPSPLTRGAVHRVTSV

SEQ ID NO: 1327186 - protein, 34 aa, Mycobacterium
SLPVATLLIERSAAWMFDYYPLRVLREFDDGSCE

SEQ ID NO: 1327187 - protein, 30 aa, Mycobacterium
SLQHEMLPRHLHFKTPSPHIPWDRLAVRVV

SEQ ID NO: 1327188 - protein, 24 aa, Mycobacterium
SLRAGLFERPLIAGHGVWLTEADI

SEQ ID NO: 1327189 - protein, 27 aa, Mycobacterium
SLRFAQDMYALIPLILMERKPVELADG

SEQ ID NO: 1327190 - protein, 25 aa, Mycobacterium
SLRQEGMLALARLQRKMRLVESPYR

SEQ ID NO: 1327191 - protein, 20 aa, Mycobacterium
SLRQKNPAVTARRRLRMICH

SEQ ID NO: 1327192 - protein, 20 aa, Mycobacterium
SLRRALSRVLGPRYVERARE

SEQ ID NO: 1327193 - protein, 17 aa, Mycobacterium
SLRSLAPGGRLLVIGFT

SEQ ID NO: 1327194 - protein, 21 aa, Mycobacterium
SLRTFYRHFASKHDLLFADYD

SEQ ID NO: 1327195 - protein, 21 aa, Mycobacterium
SLRVDRDRLLIRCRGPRERGL

SEQ ID NO: 1327196 - protein, 20 aa, Mycobacterium
SLSDYPLARGLIDRHFTAGI

SEQ ID NO: 1327197 - protein, 24 aa, Mycobacterium
SLSGLPLQPVSLADSALVLIDCQN

SEQ ID NO: 1327198 - protein, 24 aa, Mycobacterium
SLSIALQLMLYPDTPVDIICAAFP

SEQ ID NO: 1327199 - protein, 18 aa, Mycobacterium
SLSLGARQRVAIAGALLG

SEQ ID NO: 1327200 - protein, 28 aa, Mycobacterium
SLSPTEFTLLRYFIINAGTVLSKPKILD

SEQ ID NO: 1327201 - protein, 29 aa, Mycobacterium
SLSPTEFTLLRYFIINAGTVLSKPKILDH

SEQ ID NO: 1327202 - protein, 31 aa, Mycobacterium; identical to SEQ ID NO: 786011

SEQ ID NO: 1327203 - protein, 21 aa, Mycobacterium
SLTERHVVFYDLPVTFDSRQA

SEQ ID NO: 1327204 - protein, 19 aa, Mycobacterium
SLTFDLTGPLARRLHVAVD

SEQ ID NO: 1327205 - protein, 21 aa, Mycobacterium
SLTFDLTGPLARRLHVAVDGR

SEQ ID NO: 1327206 - protein, 18 aa, Mycobacterium
SLTGNPGFRRAGLDPITA

SEQ ID NO: 1327207 - protein, 25 aa, Mycobacterium
SLTKIANDIRWMGSGPLTGLGELQL

SEQ ID NO: 1327208 - protein, 20 aa, Mycobacterium
SLTLLGALAAWTDRVRLVTT

SEQ ID NO: 1327209 - protein, 18 aa, Mycobacterium
SLTMDLVLNLLGGDGAMG

SEQ ID NO: 1327210 - protein, 23 aa, Mycobacterium
SLTPADLKLWTLLSTGMETVDIA

SEQ ID NO: 1327211 - protein, 23 aa, Mycobacterium
SLTPQLMLRPPTWVADTVAELEA

SEQ ID NO: 1327212 - protein, 27 aa, Mycobacterium
SLTPQQRAWLKLVKPLVITEGFALLSV

SEQ ID NO: 1327213 - protein, 34 aa, Mycobacterium
SLTTLAPHLVKPLPFLFPLTNRGWERPYIAAGIF

SEQ ID NO: 1327214 - protein, 26 aa, Mycobacterium
SLVASPDGKWLYAVRNRRVDTTGGLY

SEQ ID NO: 1327215 - protein, 21 aa, Mycobacterium
SLVEIPIQWALDDWEQYCFLP

SEQ ID NO: 1327216 - protein, 18 aa, Mycobacterium
SLVLDVPRHCSGRFRYQA

SEQ ID NO: 1327217 - protein, 23 aa, Mycobacterium
SLVPMLAMRLTHFENLIDISRVD

SEQ ID NO: 1327218 - protein, 20 aa, Mycobacterium
SMADAFLHPVTHRPNLTVYA

SEQ ID NO: 1327219 - protein, 31 aa, Mycobacterium
SMAFAARELAPAMAWPVVAGAYIALAQRLVA

SEQ ID NO: 1327220 - protein, 27 aa, Mycobacterium
SMAKEWFPHDYVPWSRGRDFAFLGGED

SEQ ID NO: 1327221 - protein, 28 aa, Mycobacterium
SMAPENISPLVVWLGSVESRDVTGRVFE

SEQ ID NO: 1327222 - protein, 17 aa, Mycobacterium
SMASLLLAVLRGMEALR

SEQ ID NO: 1327223 - protein, 27 aa, Mycobacterium
SMATWFTEVFARLPHVLFDIRIEDQDH

SEQ ID NO: 1327224 - protein, 22 aa, Mycobacterium
SMEALGLVLIDESFRVLRDLLR

SEQ ID NO: 1327225 - protein, 27 aa, Mycobacterium
SMEFAARYYHRFGLAAPALNSIGESCY

SEQ ID NO: 1327226 - protein, 26 aa, Mycobacterium
SMEILDDVILGLRKMHQPVIAAVNGA

SEQ ID NO: 1327227 - protein, 17 aa, Mycobacterium
SMESLYEYGSRAGLWRV

SEQ ID NO: 1327228 - protein, 25 aa, Mycobacterium
SMEVLDDVILALRKLHQPVIAAVNG

SEQ ID NO: 1327229 - protein, 19 aa, Mycobacterium
SMFAWGRPPMLPTTPAGVD

SEQ ID NO: 1327230 - protein, 22 aa, Mycobacterium
SMGNYIFTTKVLIDAIRADAED

SEQ ID NO: 1327231 - protein, 18 aa, Mycobacterium
SMIMPIIRDDEIIAWVAA

SEQ ID NO: 1327232 - protein, 19 aa, Mycobacterium
SMITDGLAMRHGKDLTWSQ

SEQ ID NO: 1327233 - protein, 24 aa, Mycobacterium
SMLNLAMIAVLNRPQELATHIRGA

SEQ ID NO: 1327234 - protein, 18 aa, Mycobacterium
SMPICIWHMTQLAGHSAR

SEQ ID NO: 1327235 - protein, 17 aa, Mycobacterium
SMPVQIAFHDGSPLYLE

SEQ ID NO: 1327236 - protein, 25 aa, Mycobacterium
SMQDRTRMLTPLLPALLAAATAHKD

SEQ ID NO: 1327237 - protein, 17 aa, Mycobacterium
SMQMTTTLALRLARRRT

SEQ ID NO: 1327238 - protein, 28 aa, Mycobacterium
SMQRKRFGRIIFIGSVSGMWGIGNQANY

SEQ ID NO: 1327239 - protein, 28 aa, Mycobacterium
SMRIPKPWFVMMPTPLWDQIFKPMVGAQ

SEQ ID NO: 1327240 - protein, 21 aa, Mycobacterium
SMRPDDLAAQMVRAALDKVPS

SEQ ID NO: 1327241 - protein, 25 aa, Mycobacterium
SMSKSFWGGLRIGWIRAERSTLATV

SEQ ID NO: 1327242 - protein, 19 aa, Mycobacterium
SMSMEMLRLVEAFGYGWSD

SEQ ID NO: 1327243 - protein, 21 aa, Mycobacterium
SMSSRYNLIGRPAVVAVRDGR

SEQ ID NO: 1327244 - protein, 17 aa, Mycobacterium
SMTGRRFVFGPEPDNGS

SEQ ID NO: 1327245 - protein, 23 aa, Mycobacterium
SMVSLTMMARLLEAVRPDTRLLF

SEQ ID NO: 1327246 - protein, 25 aa, Mycobacterium
SNALDADLYLRIAPELFLKRCVVGG

SEQ ID NO: 1327247 - protein, 32 aa, Mycobacterium
SNCDKITPGMLMAALRLNIPTVFVSGGPMEGG

SEQ ID NO: 1327248 - protein, 17 aa, Mycobacterium
SNDFFVNLLDMGTEWKP

SEQ ID NO: 1327249 - protein, 21 aa, Mycobacterium
SNDLLIFMLAGHDTTATALTH

SEQ ID NO: 1327250 - protein, 25 aa, Mycobacterium
SNDRAVRRFALRKVLRNLDLAAELG

SEQ ID NO: 1327251 - protein, 23 aa, Mycobacterium
SNDTWMVLSALERTLLNAPGVPP

SEQ ID NO: 1327252 - protein, 27 aa, Mycobacterium
SNENEPWTYPFDPPAPPDSAPGGGRWE

SEQ ID NO: 1327253 - protein, 18 aa, Mycobacterium
SNFALVVHLGMSGQMLLG

SEQ ID NO: 1327254 - protein, 26 aa, Mycobacterium
SNFASPFSPQTSWAPTFAPETDTDLL

SEQ ID NO: 1327255 - protein, 23 aa, Mycobacterium
SNGAIYHAFGSRGGLLGQVWLRA

SEQ ID NO: 1327256 - protein, 26 aa, Mycobacterium
SNGELVFDAPWQGRLFGLVVHLCQAG

SEQ ID NO: 1327257 - protein, 36 aa, Mycobacterium
SNHALDILLGDWTGARTLACLPGEFGPNLAIMARHG

SEQ ID NO: 1327258 - protein, 26 aa, Mycobacterium
SNHKTMGIPILYPWANRLSSNGYGVD

SEQ ID NO: 1327259 - protein, 22 aa, Mycobacterium
SNIADRIPLPGRRMRPRPTSRP

SEQ ID NO: 1327260 - protein, 23 aa, Mycobacterium
SNKGKDLIWAPGAFRFVMMVLRH

SEQ ID NO: 1327261 - protein, 25 aa, Mycobacterium
SNLAGLSFPFLREKVHGRSNPRIVA

SEQ ID NO: 1327262 - protein, 25 aa, Mycobacterium
SNLIGMGVIPLQFPKGESAASLKLD

SEQ ID NO: 1327263 - protein, 23 aa, Mycobacterium
SNLKALCRKHHLLKTFWGWRDAQ

SEQ ID NO: 1327264 - protein, 24 aa, Mycobacterium
SNLKLGSGIAPWRKLRDAGVNLGL

SEQ ID NO: 1327265 - protein, 25 aa, Mycobacterium
SNLPDWLLDSLCYALLVNYANVDRA

SEQ ID NO: 1327266 - protein, 33 aa, Mycobacterium; identical to SEQ ID NO: 862182

SEQ ID NO: 1327267 - protein, 18 aa, Mycobacterium
SNPYTFRKVFRGMAIARE

SEQ ID NO: 1327268 - protein, 30 aa, Mycobacterium
SNQSVRWLTRWPVVPEIRHGSLGFAAREAA

SEQ ID NO: 1327269 - protein, 22 aa, Mycobacterium
SNRYTGILLGREARHLAAGAQA

SEQ ID NO: 1327270 - protein, 27 aa, Mycobacterium
SNTKSFRFSFLVAYAGRIGERLTATNS

SEQ ID NO: 1327271 - protein, 18 aa, Mycobacterium
SNVHQLFWRCWTRRRPPA

SEQ ID NO: 1327272 - protein, 26 aa, Mycobacterium
SNVIGLSLPLVHRLVRRTGLSISDLW

SEQ ID NO: 1327273 - protein, 19 aa, Mycobacterium
SNYWGYNTIGFLAPDPKYS

SEQ ID NO: 1327274 - protein, 29 aa, Mycobacterium
SPAFVDAALPRVLTYAPAKVFLPWAAFSE

SEQ ID NO: 1327275 - protein, 25 aa, Mycobacterium
SPAGLRLPLHSISWQPPRPTFDADP

SEQ ID NO: 1327276 - protein, 24 aa, Mycobacterium
SPALLARFLHEKRGFFLLVGGDYS

SEQ ID NO: 1327277 - protein, 26 aa, Mycobacterium
SPAQATLAALIKKLGLPIQAATGIQL

SEQ ID NO: 1327278 - protein, 26 aa, Mycobacterium
SPARRRVLDPAIYREAASRLDRYFSI

SEQ ID NO: 1327279 - protein, 31 aa, Mycobacterium
SPARTAFDLGRRRGLTLAVIRMDALMRTTGA

SEQ ID NO: 1327280 - protein, 21 aa, Mycobacterium
SPAVMAAGYLRMYEECVTRGR

SEQ ID NO: 1327281 - protein, 25 aa, Mycobacterium
SPDDRWLALYRRDVPVDVLTAVVDG

SEQ ID NO: 1327282 - protein, 33 aa, Mycobacterium
SPDGRLIGPLNGYLYNPVIGQALFEVGNAFASS

SEQ ID NO: 1327283 - protein, 31 aa, Mycobacterium
SPDGRTCLLTPPPWYPILRGTTQQALFELAR

SEQ ID NO: 1327284 - protein, 27 aa, Mycobacterium
SPDGRYAYLVMTPLPGWEGNHYLGIFD

SEQ ID NO: 1327285 - protein, 20 aa, Mycobacterium
SPDTLARWVTRVNFSLMSEP

SEQ ID NO: 1327286 - protein, 29 aa, Mycobacterium
SPDVLAPLRLHYLRWVLFDVGSGLHFQYQ

SEQ ID NO: 1327287 - protein, 22 aa, Mycobacterium
SPDVVLLDLKLSAGSEFEGLTL

SEQ ID NO: 1327288 - protein, 17 aa, Mycobacterium
SPEAIYKSLVRRTERLE

SEQ ID NO: 1327289 - protein, 29 aa, Mycobacterium
SPEGGWIRTWLDTVLDLPWNVTTEDSTDL

SEQ ID NO: 1327290 - protein, 28 aa, Mycobacterium
SPEHAALFELPRLAPVYPTAAGLVAAVA

SEQ ID NO: 1327291 - protein, 23 aa, Mycobacterium
SPELVWVWDQLMIAFEHGLGWFT

SEQ ID NO: 1327292 - protein, 21 aa, Mycobacterium
SPEPVLLMLAAVKCGAISGML

SEQ ID NO: 1327293 - protein, 35 aa, Mycobacterium
SPEWYRTPNYRRRLVRWPRQVLAEFGLYLPDDIEV

SEQ ID NO: 1327294 - protein, 17 aa, Mycobacterium
SPFVTWGTNPGQGVPLS

SEQ ID NO: 1327295 - protein, 25 aa, Mycobacterium
SPGADVLFAFTGTAANIIALASAVR

SEQ ID NO: 1327296 - protein, 24 aa, Mycobacterium
SPGEATLLVLRGKVQIGTATDSVD

SEQ ID NO: 1327297 - protein, 24 aa, Mycobacterium
SPGGRFITGFPPFPGARSIRSLRK

SEQ ID NO: 1327298 - protein, 26 aa, Mycobacterium
SPGLTTIWARIFAATPQPPNAASTTW

SEQ ID NO: 1327299 - protein, 22 aa, Mycobacterium
SPGQLLERLGFSSAQLSTPVKD

SEQ ID NO: 1327300 - protein, 25 aa, Mycobacterium
SPGTLYPTLHRLEADGLLTSRQRVV

SEQ ID NO: 1327301 - protein, 18 aa, Mycobacterium
SPGWVTALDLPLIPGLGT

SEQ ID NO: 1327302 - protein, 19 aa, Mycobacterium
SPHRPVFVMSVAEGRPFPV

SEQ ID NO: 1327303 - protein, 25 aa, Mycobacterium
SPHSGSWLPLVAVFGYHPAPGSDAD

SEQ ID NO: 1327304 - protein, 23 aa, Mycobacterium
SPINPLVGLYPTADDRYISFVMM

SEQ ID NO: 1327305 - protein, 23 aa, Mycobacterium
SPIVLSRFGIKIVGRSRRLTLNY

SEQ ID NO: 1327306 - protein, 26 aa, Mycobacterium
SPKEHFDFFPLTIDVEERMYAAGRIP

SEQ ID NO: 1327307 - protein, 31 aa, Mycobacterium
SPKEMWDAFYDEYLAPITPLERIRQKVDASE

SEQ ID NO: 1327308 - protein, 26 aa, Mycobacterium
SPKLIGAWLTELDLLKELANPKWQGF

SEQ ID NO: 1327309 - protein, 22 aa, Mycobacterium
SPKQLQVVLFDELEMPKTKRTK

SEQ ID NO: 1327310 - protein, 18 aa, Mycobacterium
SPKRLPDSLLHYMRTRGK

SEQ ID NO: 1327311 - protein, 21 aa, Mycobacterium
SPLFHNTGLPEDRLRALLTDA

SEQ ID NO: 1327312 - protein, 27 aa, Mycobacterium
SPLGLSIRRWCAPLLGLPPRADGEVYW

SEQ ID NO: 1327313 - protein, 25 aa, Mycobacterium
SPLIREMMIYALRWHIERGPGAGDD

SEQ ID NO: 1327314 - protein, 26 aa, Mycobacterium
SPLIREMMIYALRWPIDRRAGAVHDE

SEQ ID NO: 1327315 - protein, 20 aa, Mycobacterium
SPLSCAIGLTVLDVLRAEDL

SEQ ID NO: 1327316 - protein, 34 aa, Mycobacterium
SPLTVRSYAFDLLRWFRFLHDRLISWERAERVDV

SEQ ID NO: 1327317 - protein, 20 aa, Mycobacterium
SPLVRIVRALAAVGDVVVAA

SEQ ID NO: 1327318 - protein, 29 aa, Mycobacterium
SPLWGRQWPRSRPVWLRPGRLRQYWRQWT

SEQ ID NO: 1327319 - protein, 19 aa, Mycobacterium
SPPRIAVWLATTKPVELDG

SEQ ID NO: 1327320 - protein, 25 aa, Mycobacterium
SPPSVWFHELLRPDGQPYRDSEVRT

SEQ ID NO: 1327321 - protein, 26 aa, Mycobacterium
SPQETRLRLLIIRSGLPRPVTQIPVH

SEQ ID NO: 1327322 - protein, 25 aa, Mycobacterium
SPQETWLRLFLIEEEFPRPSTQIPV

SEQ ID NO: 1327323 - protein, 26 aa, Mycobacterium
SPQHAKIWYQVVLAFLAHHVLGQDSE

SEQ ID NO: 1327324 - protein, 24 aa, Mycobacterium
SPQVIVDLRLLGGALVREPQHRSA

SEQ ID NO: 1327325 - protein, 17 aa, Mycobacterium
SPRCRWSGPTPRCGPPV

SEQ ID NO: 1327326 - protein, 17 aa, Mycobacterium
SPRLRLVGVAGYEAALS

SEQ ID NO: 1327327 - protein, 17 aa, Mycobacterium
SPRPWIDDLRNGAGVKF

SEQ ID NO: 1327328 - protein, 26 aa, Mycobacterium
SPRQSRLRLWLLDCGFPRPQTQIPVL

SEQ ID NO: 1327329 - protein, 21 aa, Mycobacterium
SPRVEGLWAGIYVPEAGRGRT

SEQ ID NO: 1327330 - protein, 25 aa, Mycobacterium
SPSLVHAIIPVERLSIEVPDQGLVN

SEQ ID NO: 1327331 - protein, 25 aa, Mycobacterium
SPSQLTGYRLLAESTLAYVDGDRFV

SEQ ID NO: 1327332 - protein, 25 aa, Mycobacterium
SPTETEVWRWYLIDKNAPDDVRDWL

SEQ ID NO: 1327333 - protein, 27 aa, Mycobacterium
SPTFKATYTGLLKLFLDQFGQGELGQI

SEQ ID NO: 1327334 - protein, 28 aa, Mycobacterium
SPTSAKWHLLVSSWLELPGRPSLVGSRG

SEQ ID NO: 1327335 - protein, 26 aa, Mycobacterium
SPTSVALARRLLGRSWGHPTPRSAAE

SEQ ID NO: 1327336 - protein, 27 aa, Mycobacterium
SPVGLARFCTLRSWLSQWSFDDAHGDA

SEQ ID NO: 1327337 - protein, 26 aa, Mycobacterium
SPVKSVSALWAIAPLPVSEQIEAAHD

SEQ ID NO: 1327338 - protein, 19 aa, Mycobacterium
SPVLNYPLRQYMFCAPDEG

SEQ ID NO: 1327339 - protein, 24 aa, Mycobacterium
SPVQIRALLERDLPVYIISIGRTF

SEQ ID NO: 1327340 - protein, 21 aa, Mycobacterium
SPVRAKLPAACKAPRLIPNAA

SEQ ID NO: 1327341 - protein, 19 aa, Mycobacterium
SPVRSAWLDIPSLVEAAKQ

SEQ ID NO: 1327342 - protein, 17 aa, Mycobacterium
SPWLTRHPEMPEWHLHL

SEQ ID NO: 1327343 - protein, 21 aa, Mycobacterium
SPYTYLMTRRIERAMALLRRG

SEQ ID NO: 1327344 - protein, 24 aa, Mycobacterium
SQAAALFVAPASQVARLAAALQEK

SEQ ID NO: 1327345 - protein, 22 aa, Mycobacterium
SQAGFTLWDSGISGHDALRRRH

SEQ ID NO: 1327346 - protein, 21 aa, Mycobacterium
SQAIRVLMGCPFLNGLRARGA

SEQ ID NO: 1327347 - protein, 24 aa, Mycobacterium
SQGFVPHCFAAVKKWPIAPYVVNN

SEQ ID NO: 1327348 - protein, 25 aa, Mycobacterium
SQGVPTVWMMLFSYLDEHPEIDAHE

SEQ ID NO: 1327349 - protein, 19 aa, Mycobacterium
SQIDLFRGWMRCHEQTLRR

SEQ ID NO: 1327350 - protein, 24 aa, Mycobacterium
SQKATLLPRMLRADDIWCQGMSEP

SEQ ID NO: 1327351 - protein, 19 aa, Mycobacterium
SQKLLAELVPIIYKGLKST

SEQ ID NO: 1327352 - protein, 17 aa, Mycobacterium
SQLGFRVVPSDANFILF

SEQ ID NO: 1327353 - protein, 18 aa, Mycobacterium
SQLIVYNHMWSDGAEWQC

SEQ ID NO: 1327354 - protein, 25 aa, Mycobacterium
SQLPGFAWLAGLVTNSPAVGSLATL

SEQ ID NO: 1327355 - protein, 25 aa, Mycobacterium
SQLPKVFFVNWFRRGDDGRFLWPGF

SEQ ID NO: 1327356 - protein, 26 aa, Mycobacterium
SQLRQRSWWTGPDVVLLVDDWHMITA

SEQ ID NO: 1327357 - protein, 17 aa, Mycobacterium
SQLVRRLGPFTYGSSWL

SEQ ID NO: 1327358 - protein, 25 aa, Mycobacterium
SQMDIAPLYGDCAFLPDWPGVPVGN

SEQ ID NO: 1327359 - protein, 26 aa, Mycobacterium
SQMRSLPEYYFYYAGLADKLQGEVVP

SEQ ID NO: 1327360 - protein, 35 aa, Mycobacterium
SQPLVTGPLLRYLAGCVLAAFPNTAAAPPRVQDSS

SEQ ID NO: 1327361 - protein, 28 aa, Mycobacterium
SQQWLNLRYVTRLLVRLGATEDAAALHC

SEQ ID NO: 1327362 - protein, 27 aa, Mycobacterium
SQRWPDGTPLLFPRPTKNLNGQLPLAI

SEQ ID NO: 1327363 - protein, 24 aa, Mycobacterium
SQTYPLFQHPGTEFIYMLEGVMDY

SEQ ID NO: 1327364 - protein, 20 aa, Mycobacterium
SQVFLTLFGLPMADRDRLVH

SEQ ID NO: 1327365 - protein, 21 aa, Mycobacterium
SQVHRFLKMLGGYTYSRHSYS

SEQ ID NO: 1327366 - protein, 20 aa, Mycobacterium
SQVRILRAFGVRDVLLANEV

SEQ ID NO: 1327367 - protein, 29 aa, Mycobacterium
SRAAEVRLPLTWITLLHGRIGASLAATTG

SEQ ID NO: 1327368 - protein, 21 aa, Mycobacterium
SRAAMITAVLEKRAKLPVGMN

SEQ ID NO: 1327369 - protein, 22 aa, Mycobacterium
SRADSWFRRATASPRWYDRDGG

SEQ ID NO: 1327370 - protein, 17 aa, Mycobacterium
SRAFRRTFGVPPSRAAD

SEQ ID NO: 1327371 - protein, 24 aa, Mycobacterium
SRAMALMLEDWLPAFEGAPSTAAT

SEQ ID NO: 1327372 - protein, 33 aa, Mycobacterium
SRAPGPLRIAMSTKFPFTVFRAGLHPEIRTALQ

SEQ ID NO: 1327373 - protein, 31 aa, Mycobacterium
SRAQEIYDDLAPLLRFIVAGGLPTTVKAGLE

SEQ ID NO: 1327374 - protein, 24 aa, Mycobacterium
SRASELLGFQVPPAIRQVATAIEN

SEQ ID NO: 1327375 - protein, 21 aa, Mycobacterium
SRATHIVVWATLDKSLGRAAI

SEQ ID NO: 1327376 - protein, 35 aa, Mycobacterium
SRAVQRRFWSGGRGVILLVLIRKRLGKGDGFGLAM

SEQ ID NO: 1327377 - protein, 18 aa, Mycobacterium
SRCFPKGLAAFIDLRDQT

SEQ ID NO: 1327378 - protein, 28 aa, Mycobacterium
SRCGNEPMILLIGSLELIWSAHESSVWS

SEQ ID NO: 1327379 - protein, 29 aa, Mycobacterium
SRDALDRALIDLATYFRDALLVSSGATDV

SEQ ID NO: 1327380 - protein, 21 aa, Mycobacterium
SRDLRYSLLDDIPVATLVSGH

SEQ ID NO: 1327381 - protein, 18 aa, Mycobacterium
SRDLSSLELVWWAGQLPE

SEQ ID NO: 1327382 - protein, 26 aa, Mycobacterium
SRDSVAQALRLVAALNADVKGAAADA

SEQ ID NO: 1327383 - protein, 23 aa, Mycobacterium
SRDTDLMISALQGLGVVVEAPDT

SEQ ID NO: 1327384 - protein, 19 aa, Mycobacterium
SREQFGRPLAKFQAVQHLI

SEQ ID NO: 1327385 - protein, 30 aa, Mycobacterium
SRERSSAPLLLWIHGGPLASWNAWHWRWNP

SEQ ID NO: 1327386 - protein, 17 aa, Mycobacterium
SRFAPPSPKGCVFEYVY

SEQ ID NO: 1327387 - protein, 30 aa, Mycobacterium
SRFGVQPRRGWPALNLFYNTAFDAQHQLVS

SEQ ID NO: 1327388 - protein, 17 aa, Mycobacterium
SRGGASKGRSWAVLGEM

SEQ ID NO: 1327389 - protein, 21 aa, Mycobacterium
SRGIHIFVPIDDSAPVDDVAA

SEQ ID NO: 1327390 - protein, 34 aa, Mycobacterium
SRGWEPEPLRWLGVRGLYLAYRLADRHEARGRAT

SEQ ID NO: 1327391 - protein, 18 aa, Mycobacterium
SRGYRAMSGIPRLQFAHV

SEQ ID NO: 1327392 - protein, 25 aa, Mycobacterium
SRIHFETHFAPLLHLTGELQGVAVD

SEQ ID NO: 1327393 - protein, 26 aa, Mycobacterium
SRIHFETHFAPLLHLTGELQGVAVDL

SEQ ID NO: 1327394 - protein, 27 aa, Mycobacterium
SRIHFETHFVPLLHLTGELQGVAVDLI

SEQ ID NO: 1327395 - protein, 23 aa, Mycobacterium
SRIHLRGLNIRWADGARRSLGDG

SEQ ID NO: 1327396 - protein, 20 aa, Mycobacterium
SRILEEVWGFDFPTSGNALE

SEQ ID NO: 1327397 - protein, 17 aa, Mycobacterium
SRILGMGDVLTLIEQAE

SEQ ID NO: 1327398 - protein, 29 aa, Mycobacterium
SRIVAFVGRIQPLKAPDVLLRAAALLPDV

SEQ ID NO: 1327399 - protein, 19 aa, Mycobacterium
SRLAALAQAWRDPAAWQGM

SEQ ID NO: 1327400 - protein, 26 aa, Mycobacterium
SRLAAPLLPLITEVIWRGVTGERSVH

SEQ ID NO: 1327401 - protein, 21 aa, Mycobacterium
SRLAELLVAAGLPIPEVSASA

SEQ ID NO: 1327402 - protein, 24 aa, Mycobacterium
SRLAPAPMLVAPNEHWVFADHAKN

SEQ ID NO: 1327403 - protein, 18 aa, Mycobacterium
SRLFYRAFPYNEAALLLT

SEQ ID NO: 1327404 - protein, 26 aa, Mycobacterium
SRLHWRSKEYFAPGTTVRVDARFYGV

SEQ ID NO: 1327405 - protein, 25 aa, Mycobacterium
SRLIGPIRRVVYDPSSWKSAPSRVI

SEQ ID NO: 1327406 - protein, 18 aa, Mycobacterium
SRLLGLPEEDLPWFRKRA

SEQ ID NO: 1327407 - protein, 21 aa, Mycobacterium
SRLMHDYTIPLRPSGPRPTEP

SEQ ID NO: 1327408 - protein, 23 aa, Mycobacterium
SRNDPVLMAMRRLAEPYAQARDD

SEQ ID NO: 1327409 - protein, 20 aa, Mycobacterium
SRPAALPFLSIKKITVHYRP

SEQ ID NO: 1327410 - protein, 25 aa, Mycobacterium
SRPDAPWGLFPAQGDDRWVAITVRD

SEQ ID NO: 1327411 - protein, 17 aa, Mycobacterium
SRPPIPRPLQAEGGVPD

SEQ ID NO: 1327412 - protein, 31 aa, Mycobacterium
SRPSPLSLDDVVKFLLPPAAAKKPGKAATSA

SEQ ID NO: 1327413 - protein, 21 aa, Mycobacterium
SRPTRPHPLFAAFVGASLDYK

SEQ ID NO: 1327414 - protein, 18 aa, Mycobacterium
SRPTYRLLFDHPTDDRFT

SEQ ID NO: 1327415 - protein, 23 aa, Mycobacterium
SRPVALVPLARRDVPECLAEELR

SEQ ID NO: 1327416 - protein, 18 aa, Mycobacterium
SRQRRTLGLPPATTRPVA

SEQ ID NO: 1327417 - protein, 28 aa, Mycobacterium
SRRAEDLFAGWWQLIAALGAVPRTLVWD

SEQ ID NO: 1327418 - protein, 29 aa, Mycobacterium
SRRAEDLFAGWWQLIAALGAVPRTLVWDG

SEQ ID NO: 1327419 - protein, 22 aa, Mycobacterium
SRRAKRLIVFDVDSTLIQGEVI

SEQ ID NO: 1327420 - protein, 22 aa, Mycobacterium
SRRDEWLHRLFGRVVNLTFKML

SEQ ID NO: 1327421 - protein, 17 aa, Mycobacterium
SRRIPVLVLAGQVTLDR

SEQ ID NO: 1327422 - protein, 17 aa, Mycobacterium
SRRLARLTRRPGLEFGP

SEQ ID NO: 1327423 - protein, 17 aa, Mycobacterium
SRRLRRALEHRDRTCVV

SEQ ID NO: 1327424 - protein, 22 aa, Mycobacterium
SRRLVISMICTVGNYEYGFFWY

SEQ ID NO: 1327425 - protein, 25 aa, Mycobacterium
SRRNDVMLLDFDDLLLHTAAAIEND

SEQ ID NO: 1327426 - protein, 21 aa, Mycobacterium
SRRPQRRLCPQPRSGDALSQA

SEQ ID NO: 1327427 - protein, 29 aa, Mycobacterium
SRRREDYVGPWLPEPLLTEADPSADVVLA

SEQ ID NO: 1327428 - protein, 25 aa, Mycobacterium
SRRRFDPRSYLPPLDDLLEVLRDRH

SEQ ID NO: 1327429 - protein, 18 aa, Mycobacterium
SRRVVDLEAIPLAELGRP

SEQ ID NO: 1327430 - protein, 24 aa, Mycobacterium
SRRVVPIDGWLADDLRAYLADDHP

SEQ ID NO: 1327431 - protein, 24 aa, Mycobacterium
SRRYVGLPDWPGLLRHFADYTSHP

SEQ ID NO: 1327432 - protein, 25 aa, Mycobacterium
SRSFFPPMAGLWSDNRTLTDGVFGF

SEQ ID NO: 1327433 - protein, 24 aa, Mycobacterium
SRSGGRIVLVALAATAAKAVAGAT

SEQ ID NO: 1327434 - protein, 23 aa, Mycobacterium
SRSLAQWLRRWDIRGGSASPEAV

SEQ ID NO: 1327435 - protein, 24 aa, Mycobacterium
SRSTLYRRFPTRDALITELGRQTF

SEQ ID NO: 1327436 - protein, 19 aa, Mycobacterium
SRSWLKLGAGLHLFDPTDA

SEQ ID NO: 1327437 - protein, 18 aa, Mycobacterium
SRTFAALCDIFDCTPNDL

SEQ ID NO: 1327438 - protein, 21 aa, Mycobacterium
SRTHPNLVRKLFSLEVPEIAD

SEQ ID NO: 1327439 - protein, 28 aa, Mycobacterium
SRTRDAFEFALLQGALRRQIPVLGICRG

SEQ ID NO: 1327440 - protein, 18 aa, Mycobacterium
SRTSRPVALVPLARRDVP

SEQ ID NO: 1327441 - protein, 25 aa, Mycobacterium
SRTVPLDWLTSIQSAPGLSGAAVSV

SEQ ID NO: 1327442 - protein, 35 aa, Mycobacterium
SRVAVLLPAHWQTAAVLFGIWWIGAEAVLSGDADI

SEQ ID NO: 1327443 - protein, 25 aa, Mycobacterium
SRVGFWRVHRLLTERGLVATASACA

SEQ ID NO: 1327444 - protein, 18 aa, Mycobacterium
SRVLLRDSILDGMREMLL

SEQ ID NO: 1327445 - protein, 21 aa, Mycobacterium
SRYFNRLPRKLVDRVLPAPGT

SEQ ID NO: 1327446 - protein, 23 aa, Mycobacterium
SRYWYHAELIDTARLTRLATRIT

SEQ ID NO: 1327447 - protein, 22 aa, Mycobacterium
SSAAFQAAHARFVEASAKINAL

SEQ ID NO: 1327448 - protein, 26 aa, Mycobacterium
SSAAGIVALPWHAAYSASKYGLRGLS

SEQ ID NO: 1327449 - protein, 19 aa, Mycobacterium
SSAARHLAARWAAKEAVIK

SEQ ID NO: 1327450 - protein, 24 aa, Mycobacterium
SSADALRWGLINQVAPDGAVVEAA

SEQ ID NO: 1327451 - protein, 21 aa, Mycobacterium
SSADALRWGLINQVVPDGTVV

SEQ ID NO: 1327452 - protein, 28 aa, Mycobacterium
SSAFGPTGPWAKRLGYGPLVRAAVGFTD

SEQ ID NO: 1327453 - protein, 23 aa, Mycobacterium
SSAGLPDFPLLDGDLHYADYAIW

SEQ ID NO: 1327454 - protein, 19 aa, Mycobacterium
SSAVYRYVSSRDDLLTLLL

SEQ ID NO: 1327455 - protein, 24 aa, Mycobacterium
SSCETRLLIIDDLHFLRGRRERMT

SEQ ID NO: 1327456 - protein, 24 aa, Mycobacterium
SSDAAIILLRRLYARELAAIEAGH

SEQ ID NO: 1327457 - protein, 18 aa, Mycobacterium
SSDCVAAVFGGWTSSSRK

SEQ ID NO: 1327458 - protein, 25 aa, Mycobacterium
SSDGVLCVPALAGLAAPWWDSGATA

SEQ ID NO: 1327459 - protein, 23 aa, Mycobacterium
SSDPHFPMIVPFTTVAAEPIRAR

SEQ ID NO: 1327460 - protein, 25 aa, Mycobacterium
SSDTWRAVLPQLAKRYRVIAPDLLG

SEQ ID NO: 1327461 - protein, 29 aa, Mycobacterium
SSEPPPPPLPAKPFPKACPAPGVMQGCLE

SEQ ID NO: 1327462 - protein, 22 aa, Mycobacterium
SSFAVPTRWLIRTEPLPTLAGE

SEQ ID NO: 1327463 - protein, 23 aa, Mycobacterium
SSFGINLPPMPTGMLNGTPSAPT

SEQ ID NO: 1327464 - protein, 25 aa, Mycobacterium
SSFPDDRGWSLRALFDGSRRDGFKR

SEQ ID NO: 1327465 - protein, 25 aa, Mycobacterium
SSGAVVLGPWLPFTDDIDLASARAS

SEQ ID NO: 1327466 - protein, 19 aa, Mycobacterium
SSGFDWLAAGFVRSGSSGS

SEQ ID NO: 1327467 - protein, 21 aa, Mycobacterium
SSGFTYWPEGPLKAPKRVQPP

SEQ ID NO: 1327468 - protein, 22 aa, Mycobacterium
SSGGFVNYPAPPVPPTPPNSAG

SEQ ID NO: 1327469 - protein, 29 aa, Mycobacterium
SSGMDQVLFVPLRFGIGFGLPTPQSVPAV

SEQ ID NO: 1327470 - protein, 26 aa, Mycobacterium
SSGTPVLVDFWATWCGPCKMVAPVLE

SEQ ID NO: 1327471 - protein, 21 aa, Mycobacterium
SSGTWDLITALIRPVVRDEDG

SEQ ID NO: 1327472 - protein, 19 aa, Mycobacterium
SSHTYSWLNAADELFWVKY

SEQ ID NO: 1327473 - protein, 17 aa, Mycobacterium
SSIPNIVFGWDIEDTLM

SEQ ID NO: 1327474 - protein, 27 aa, Mycobacterium
SSKNHLIAEIYLSLITKVDYFTDVNDS

SEQ ID NO: 1327475 - protein, 19 aa, Mycobacterium
SSLAYTVTGPPAKGLVSID

SEQ ID NO: 1327476 - protein, 18 aa, Mycobacterium
SSLDFLAPGAGAAANLGI

SEQ ID NO: 1327477 - protein, 18 aa, Mycobacterium
SSLFSPFPPVRGAAGLLR

SEQ ID NO: 1327478 - protein, 18 aa, Mycobacterium
SSLGGHAFWNEADPQRKA

SEQ ID NO: 1327479 - protein, 24 aa, Mycobacterium
SSLLKGMTAHYLIKSTYPVQQGDT

SEQ ID NO: 1327480 - protein, 25 aa, Mycobacterium
SSLPDAPVLPINYTNTAGMTAELAS

SEQ ID NO: 1327481 - protein, 29 aa, Mycobacterium
SSLRLQSGLWMWVGSYFAGLISAAPAGTM

SEQ ID NO: 1327482 - protein, 18 aa, Mycobacterium
SSNLMFMNGWLDAVGTFN

SEQ ID NO: 1327483 - protein, 26 aa, Mycobacterium
SSNPRLDIPRMLELYGSGRLMLDELI

SEQ ID NO: 1327484 - protein, 24 aa, Mycobacterium
SSNTHRWFGAYGPSKAALDHLMMV

SEQ ID NO: 1327485 - protein, 23 aa, Mycobacterium
SSPALWAVAAWVRRQATQAIDGF

SEQ ID NO: 1327486 - protein, 34 aa, Mycobacterium
SSPAQALFPSIREIYCLMVLLVCERGFNLSVMDN

SEQ ID NO: 1327487 - protein, 27 aa, Mycobacterium
SSPDPLLVVFLLFDVMRDALRERVVNS

SEQ ID NO: 1327488 - protein, 21 aa, Mycobacterium
SSPERIAWLEKVLDAGYAVPT

SEQ ID NO: 1327489 - protein, 30 aa, Mycobacterium
SSPLVAHLRFGLRLIYGRLADEFTALGFGV

SEQ ID NO: 1327490 - protein, 24 aa, Mycobacterium
SSPQAILRSLTRRRDRLRAQADQA

SEQ ID NO: 1327491 - protein, 32 aa, Mycobacterium
SSPRLYGGTYNLFHYTLPKLGIEVSFVENPDD

SEQ ID NO: 1327492 - protein, 18 aa, Mycobacterium
SSPYNGGALLGDRIRMAA

SEQ ID NO: 1327493 - protein, 19 aa, Mycobacterium
SSQFVSGLMLSGALFRDGL

SEQ ID NO: 1327494 - protein, 23 aa, Mycobacterium
SSQLTRKIRLKVPLVSSAMDTVT

SEQ ID NO: 1327495 - protein, 19 aa, Mycobacterium
SSRAVLAFAARRLKGAVGV

SEQ ID NO: 1327496 - protein, 25 aa, Mycobacterium
SSRAWLALLSVLYREVSRPESIVQH

SEQ ID NO: 1327497 - protein, 17 aa, Mycobacterium
SSREPYRRLVNQGYIQA

SEQ ID NO: 1327498 - protein, 24 aa, Mycobacterium
SSREYPWYGSFMIETLPELTAQDA

SEQ ID NO: 1327499 - protein, 33 aa, Mycobacterium
SSRKAMLPVFESANSLLYYPVQYEGLESSKNIF

SEQ ID NO: 1327500 - protein, 25 aa, Mycobacterium
SSRPPRLVRLSHKGAVRTRTRGART

SEQ ID NO: 1327501 - protein, 25 aa, Mycobacterium
SSSAHLSWRRPIASLNYLLTSHVWR

SEQ ID NO: 1327502 - protein, 23 aa, Mycobacterium
SSSQLRSWFGYRIEGRSPVNNIP

SEQ ID NO: 1327503 - protein, 20 aa, Mycobacterium
SSSWPLIREIGAVCVNVLAA

SEQ ID NO: 1327504 - protein, 22 aa, Mycobacterium
SSTPTFWSGWPSNPGTLGTIYR

SEQ ID NO: 1327505 - protein, 20 aa, Mycobacterium
SSVTEVVVWEADWLCTDYAA

SEQ ID NO: 1327506 - protein, 18 aa, Mycobacterium
SSVTLACARLGWPVQDTE

SEQ ID NO: 1327507 - protein, 22 aa, Mycobacterium
SSVYRPMYLFRGDVPVREFTKV

SEQ ID NO: 1327508 - protein, 21 aa, Mycobacterium
SSWAAPWTLDANTDALAALLD

SEQ ID NO: 1327509 - protein, 19 aa, Mycobacterium
SSWEKALSLPSVRGLIVGR

SEQ ID NO: 1327510 - protein, 22 aa, Mycobacterium
SSWLTGQILRINGDKLTRINGF

SEQ ID NO: 1327511 - protein, 18 aa, Mycobacterium
SSWSPLMHTLVKSAAKDI

SEQ ID NO: 1327512 - protein, 28 aa, Mycobacterium
SSYLLPQLIGRQNAAWLLLSSEWVDAAE

SEQ ID NO: 1327513 - protein, 20 aa, Mycobacterium
SSYQREYGLYPDGICGPETL

SEQ ID NO: 1327514 - protein, 20 aa, Mycobacterium
STACRLILNDAKSARVEHRR

SEQ ID NO: 1327515 - protein, 23 aa, Mycobacterium
STAGTVELLKWAKSQGISITAEV

SEQ ID NO: 1327516 - protein, 26 aa, Mycobacterium
STAHRLLAMLSYRGLIRQDPKTKAYR

SEQ ID NO: 1327517 - protein, 24 aa, Mycobacterium
STAIPVVPRRPGGLVLLTSGTTGI

SEQ ID NO: 1327518 - protein, 30 aa, Mycobacterium
STALEAMRAIPVPVYLLPGNHDPLDASSVY

SEQ ID NO: 1327519 - protein, 25 aa, Mycobacterium
STALYLAAQAIRGGLADCTLALGFE

SEQ ID NO: 1327520 - protein, 31 aa, Mycobacterium
STAMSHLLREFGLLEPLRARLAEGMPAYGSC

SEQ ID NO: 1327521 - protein, 24 aa, Mycobacterium
STDGMLLLLNCEPATALADPSCDA

SEQ ID NO: 1327522 - protein, 20 aa, Mycobacterium
STDIPSLTVSLRGLADCVVE

SEQ ID NO: 1327523 - protein, 26 aa, Mycobacterium
STDPRSRVPALPRLEPGVALPCCRQT

SEQ ID NO: 1327524 - protein, 24 aa, Mycobacterium
STEFDVERYFRDAPLMIVGEGTNE

SEQ ID NO: 1327525 - protein, 17 aa, Mycobacterium
STELLTIRVGGNEAAFL

SEQ ID NO: 1327526 - protein, 28 aa, Mycobacterium
STEPAHTLALRDLGLEPLVELGMRLGEG

SEQ ID NO: 1327527 - protein, 23 aa, Mycobacterium
STEPGPIHRLRPTYPCCVKPVNS

SEQ ID NO: 1327528 - protein, 24 aa, Mycobacterium
STEVAWFTEFCGDAHHVLIGDGVG

SEQ ID NO: 1327529 - protein, 20 aa, Mycobacterium
STEWELAISAAHRALATELV

SEQ ID NO: 1327530 - protein, 24 aa, Mycobacterium
STEYDVERYFRDAPLMIVGEGTNE

SEQ ID NO: 1327531 - protein, 18 aa, Mycobacterium
STFCAPPTVWRMLIQSDL

SEQ ID NO: 1327532 - protein, 29 aa, Mycobacterium
STFGARWAGFARASLFPALARALDDGGAD

SEQ ID NO: 1327533 - protein, 23 aa, Mycobacterium
STFGKIDVLFNIAGVFPAGDGDV

SEQ ID NO: 1327534 - protein, 25 aa, Mycobacterium
STGLFGQFLAYLRTGDLPGTARIGA

SEQ ID NO: 1327535 - protein, 22 aa, Mycobacterium
STGLLWDAALKRIRARRSRPEP

SEQ ID NO: 1327536 - protein, 23 aa, Mycobacterium
STGQATWDTALLLFLERSGYPEE

SEQ ID NO: 1327537 - protein, 22 aa, Mycobacterium
STGTNIWGAFGLLAEMAAQGCS

SEQ ID NO: 1327538 - protein, 19 aa, Mycobacterium
STHEFLGMLIAHTGYEDVD

SEQ ID NO: 1327539 - protein, 20 aa, Mycobacterium
STILADLRKLEALAARAMRH

SEQ ID NO: 1327540 - protein, 17 aa, Mycobacterium
STILGDALFRTGTERFA

SEQ ID NO: 1327541 - protein, 24 aa, Mycobacterium
STKGPLSLITLRQADHDAVVAALT

SEQ ID NO: 1327542 - protein, 19 aa, Mycobacterium
STKKLFKALTRRGPHRVLR

SEQ ID NO: 1327543 - protein, 20 aa, Mycobacterium
STLERILEDLAVELAATVAI

SEQ ID NO: 1327544 - protein, 27 aa, Mycobacterium
STLHLGTFVLNAGFYRPALLARDAAAL

SEQ ID NO: 1327545 - protein, 20 aa, Mycobacterium
STLLGLLTGRIAPHSGRVTR

SEQ ID NO: 1327546 - protein, 30 aa, Mycobacterium
STLRLIPNIVVLPYRNPFVVAKAGATLDLI

SEQ ID NO: 1327547 - protein, 17 aa, Mycobacterium
STLYLPVQVEGANFFAG

SEQ ID NO: 1327548 - protein, 18 aa, Mycobacterium
STMPMMPGMDDMPGHGGM

SEQ ID NO: 1327549 - protein, 18 aa, Mycobacterium
STMVRAGVIAPMRPDKYL

SEQ ID NO: 1327550 - protein, 35 aa, Mycobacterium; identical to SEQ ID NO: 863486

SEQ ID NO: 1327551 - protein, 26 aa, Mycobacterium
STNAVLHLLAIAWEANVKLTLEDFTR

SEQ ID NO: 1327552 - protein, 23 aa, Mycobacterium
STNNGLIEIVPLGVSKATGIEEL

SEQ ID NO: 1327553 - protein, 41 aa, Mycobacterium
STNPYPAVSAPLLPPGPLGPPPSVPAAIPPAAGAVPLIGGA

SEQ ID NO: 1327554 - protein, 22 aa, Mycobacterium
STPRMWHLLAECADAPSLDAVT

SEQ ID NO: 1327555 - protein, 25 aa, Mycobacterium
STPRPEYRFPGLNPGDRWCVTAANW

SEQ ID NO: 1327556 - protein, 20 aa, Mycobacterium
STRAPLLAEERRLLIAAFGR

SEQ ID NO: 1327557 - protein, 25 aa, Mycobacterium
STRDAQLDWPLTESLRYPAALVDDF

SEQ ID NO: 1327558 - protein, 19 aa, Mycobacterium
STREALRRAALASFAARGF

SEQ ID NO: 1327559 - protein, 21 aa, Mycobacterium
STRFLDAISAPPITIGSLYAD

SEQ ID NO: 1327560 - protein, 23 aa, Mycobacterium
STRLVPVARPGRLPYDHADIIVR

SEQ ID NO: 1327561 - protein, 24 aa, Mycobacterium
STRSSAWIVPKYIAGRPGDTFWRT

SEQ ID NO: 1327562 - protein, 18 aa, Mycobacterium
STSGLIMLPDSQSALVAE

SEQ ID NO: 1327563 - protein, 25 aa, Mycobacterium
STSGQRALYELGMTGIPIANVNNNC

SEQ ID NO: 1327564 - protein, 26 aa, Mycobacterium
STSLKEKFLELLPNRIITDSIGSSET

SEQ ID NO: 1327565 - protein, 23 aa, Mycobacterium
STTDWAKRPIPDDLRRALTGPQQ

SEQ ID NO: 1327566 - protein, 24 aa, Mycobacterium
STTVGALVGAYRLAGKRVAVLAVD

SEQ ID NO: 1327567 - protein, 25 aa, Mycobacterium
STTYLATLNWYLDTLGMIVSDFLYF

SEQ ID NO: 1327568 - protein, 26 aa, Mycobacterium
STTYSYWFEPNPYWSRLYAPGSELKT

SEQ ID NO: 1327569 - protein, 23 aa, Mycobacterium
STVAAVFARIRLNIWHVVAASDD

SEQ ID NO: 1327570 - protein, 26 aa, Mycobacterium
STVAQDYLKVIWTAQEWSREKVSTKL

SEQ ID NO: 1327571 - protein, 17 aa, Mycobacterium
STVFGTRFPGPLGLAAG

SEQ ID NO: 1327572 - protein, 28 aa, Mycobacterium
STVKDLLPLLEKVIQAGKPLLIIAEDVE

SEQ ID NO: 1327573 - protein, 26 aa, Mycobacterium
STVRRLEVVALTPARLLLVVITDTGR

SEQ ID NO: 1327574 - protein, 17 aa, Mycobacterium
STYARFLDITDDDFRHT

SEQ ID NO: 1327575 - protein, 19 aa, Mycobacterium
SVAATAAPAGYALGGGDPI

SEQ ID NO: 1327576 - protein, 26 aa, Mycobacterium
SVAATMLFVFFQRTAWYLVKHDPGVD

SEQ ID NO: 1327577 - protein, 30 aa, Mycobacterium
SVACFLRAHPSYWHRLPAHVVWADLDWVAR

SEQ ID NO: 1327578 - protein, 29 aa, Mycobacterium
SVAEADALWPMLVLRTAVLIVSGAQQSVL

SEQ ID NO: 1327579 - protein, 26 aa, Mycobacterium
SVAGDFTLPAIPGPTLFVSGGSGITP

SEQ ID NO: 1327580 - protein, 18 aa, Mycobacterium
SVAGLIGLGAPIAGSVGY

SEQ ID NO: 1327581 - protein, 23 aa, Mycobacterium
SVALPLRLGGWVIDTPGIRSFGL

SEQ ID NO: 1327582 - protein, 17 aa, Mycobacterium
SVALSLLDEHLSHCVRD

SEQ ID NO: 1327583 - protein, 18 aa, Mycobacterium
SVALTRNVLLPVGTDYTP

SEQ ID NO: 1327584 - protein, 21 aa, Mycobacterium
SVARRKVEAALAGDVHTRELS

SEQ ID NO: 1327585 - protein, 25 aa, Mycobacterium
SVARYIPRQVITPVTLPVVRMVTRL

SEQ ID NO: 1327586 - protein, 21 aa, Mycobacterium
SVATLAFPRYGVSVPADLAAE

SEQ ID NO: 1327587 - protein, 27 aa, Mycobacterium
SVDATANSLLPQWRGQAGEAAQAALVR

SEQ ID NO: 1327588 - protein, 17 aa, Mycobacterium
SVDAVQAFALLRKLSQD

SEQ ID NO: 1327589 - protein, 25 aa, Mycobacterium
SVDGRPRGHLRKFGLSRVRVRELAH

SEQ ID NO: 1327590 - protein, 26 aa, Mycobacterium
SVDICPWALREGLILRKLDSEADGSA

SEQ ID NO: 1327591 - protein, 19 aa, Mycobacterium
SVDMSPNGQWLAVGSSRTL

SEQ ID NO: 1327592 - protein, 23 aa, Mycobacterium
SVDPFHDFWLPDYCPRCNPAGHH

SEQ ID NO: 1327593 - protein, 26 aa, Mycobacterium
SVDRGQPFLALVDYAHKPGALRAVLQ

SEQ ID NO: 1327594 - protein, 23 aa, Mycobacterium
SVDTFAGFIFLNPDPDAAPLREY

SEQ ID NO: 1327595 - protein, 27 aa, Mycobacterium
SVESAVGWIPFLLESLDFHYKKYEPWL

SEQ ID NO: 1327596 - protein, 24 aa, Mycobacterium
SVGAAVVKLRLAIDGLVDLARRVS

SEQ ID NO: 1327597 - protein, 18 aa, Mycobacterium
SVGALELRLQYGVGRPER

SEQ ID NO: 1327598 - protein, 21 aa, Mycobacterium
SVGCNNTCTFCIVPALRGREV

SEQ ID NO: 1327599 - protein, 20 aa, Mycobacterium
SVGCNNTCTFCIVPSLRGKE

SEQ ID NO: 1327600 - protein, 24 aa, Mycobacterium
SVGSALSWLLTLAHRRAVDRVRSE

SEQ ID NO: 1327601 - protein, 30 aa, Mycobacterium
SVHIKDALTPTLLFPFAAPRVGGDLSDAGS

SEQ ID NO: 1327602 - protein, 19 aa, Mycobacterium
SVHLLTKAWAAEYGPSGVR

SEQ ID NO: 1327603 - protein, 25 aa, Mycobacterium
SVHRKALLPHLAVKRIRAFEPFIDD

SEQ ID NO: 1327604 - protein, 17 aa, Mycobacterium
SVKLVNNTVFAAQIGLL

SEQ ID NO: 1327605 - protein, 25 aa, Mycobacterium
SVLEAIAFGFRHHVDVFAEIGIPLR

SEQ ID NO: 1327606 - protein, 17 aa, Mycobacterium
SVLFGFYEHACAADLGP

SEQ ID NO: 1327607 - protein, 19 aa, Mycobacterium
SVLGSLRSLLRPGGVLAVH

SEQ ID NO: 1327608 - protein, 27 aa, Mycobacterium
SVLIEYTLRMQLSDVYFIVIESPFNVD

SEQ ID NO: 1327609 - protein, 20 aa, Mycobacterium
SVLIKTHCSLISAGTERQMV

SEQ ID NO: 1327610 - protein, 23 aa, Mycobacterium
SVLKLVTYTTPPPAPAAPGGGRA

SEQ ID NO: 1327611 - protein, 22 aa, Mycobacterium
SVLRALALNRFAKSPMLVGGQM

SEQ ID NO: 1327612 - protein, 23 aa, Mycobacterium
SVLRVGVADFRRALERVMPNPND

SEQ ID NO: 1327613 - protein, 33 aa, Mycobacterium
SVLSRALAFLEEYQHRLPFDRLAAARYSLDDIN

SEQ ID NO: 1327614 - protein, 23 aa, Mycobacterium
SVLTSQVLPVWLLSRDPDAEVIV

SEQ ID NO: 1327615 - protein, 17 aa, Mycobacterium
SVLVTLPELTAVSLRTA

SEQ ID NO: 1327616 - protein, 21 aa, Mycobacterium
SVLVTLPELTAVTLRTAQSEP

SEQ ID NO: 1327617 - protein, 19 aa, Mycobacterium
SVMGRHRDAMRQRYVDPFR

SEQ ID NO: 1327618 - protein, 18 aa, Mycobacterium
SVMLGYWNDPDKTAQAID

SEQ ID NO: 1327619 - protein, 29 aa, Mycobacterium
SVNRYRLAGWLGTLPLPAGKKNPPPTGYT

SEQ ID NO: 1327620 - protein, 25 aa, Mycobacterium
SVPARTLMLPLSTNARAKMSLLRHG

SEQ ID NO: 1327621 - protein, 26 aa, Mycobacterium
SVPGFPNFFTVFGPYGYVGSSYFALI

SEQ ID NO: 1327622 - protein, 21 aa, Mycobacterium
SVPPSLIRRAAAYFERALVTR

SEQ ID NO: 1327623 - protein, 18 aa, Mycobacterium
SVPRNRGAFAELLRACGR

SEQ ID NO: 1327624 - protein, 25 aa, Mycobacterium
SVPSDQFLLYAFDGPVADLDRALRV

SEQ ID NO: 1327625 - protein, 45 aa, Mycobacterium
SVPSGLLERGLLLRIRFELDHHINLRPARLYPGVQSPLAGNPEID

SEQ ID NO: 1327626 - protein, 18 aa, Mycobacterium
SVQDTEIISLVWHEPHTA

SEQ ID NO: 1327627 - protein, 24 aa, Mycobacterium
SVQGSLAMFAIHRWGSEEQRTRWL

SEQ ID NO: 1327628 - protein, 36 aa, Mycobacterium
SVQSKVLDLLARLQRDLGLTYLFIGHDLAVIQRMSH

SEQ ID NO: 1327629 - protein, 17 aa, Mycobacterium
SVRAELTHIPGVREVDV

SEQ ID NO: 1327630 - protein, 18 aa, Mycobacterium
SVRDLTVCILDRPRHQQL

SEQ ID NO: 1327631 - protein, 20 aa, Mycobacterium
SVREVTGVPILFASAGEKLE

SEQ ID NO: 1327632 - protein, 19 aa, Mycobacterium
SVRGNWPLVPTMDVVVPHT

SEQ ID NO: 1327633 - protein, 23 aa, Mycobacterium
SVRHRAEVAIACDSLGLAEQMLA

SEQ ID NO: 1327634 - protein, 18 aa, Mycobacterium
SVRLAFIAALQHLPPRQR

SEQ ID NO: 1327635 - protein, 21 aa, Mycobacterium
SVRLMRDLWLGDRVDFEGEYY

SEQ ID NO: 1327636 - protein, 24 aa, Mycobacterium
SVSDAIALIHKRAHGAAVVLFENR

SEQ ID NO: 1327637 - protein, 18 aa, Mycobacterium
SVSLQLLGGRVRGVTQAA

SEQ ID NO: 1327638 - protein, 18 aa, Mycobacterium
SVSRLWRRDIKTGDLSPG

SEQ ID NO: 1327639 - protein, 22 aa, Mycobacterium
SVSSYSALFPPPDGIISADSPT

SEQ ID NO: 1327640 - protein, 19 aa, Mycobacterium
SVSVCELSGLWLTTALAMS

SEQ ID NO: 1327641 - protein, 23 aa, Mycobacterium
SVSVPELLAVRPAPGVWHLVSTV

SEQ ID NO: 1327642 - protein, 26 aa, Mycobacterium
SVTRANFYYYFRDKAELFIELGTQTY

SEQ ID NO: 1327643 - protein, 30 aa, Mycobacterium
SVTVQRWRHIWLHEGFACYAEWLWSEHCGE

SEQ ID NO: 1327644 - protein, 22 aa, Mycobacterium
SVVAALRAVRAAAPGLPCEVEV

SEQ ID NO: 1327645 - protein, 31 aa, Mycobacterium
SVVEAHRERHGFPHWVIWDEAHLLGRQREER

SEQ ID NO: 1327646 - protein, 17 aa, Mycobacterium
SVVPQLVPPAIPGVGEP

SEQ ID NO: 1327647 - protein, 25 aa, Mycobacterium
SVVPTLKRYILEMRFKPMPRYQQGA

SEQ ID NO: 1327648 - protein, 35 aa, Mycobacterium
SVVRLAVASWLDRVPPVAWWCRRDLSGGQIVEQAV

SEQ ID NO: 1327649 - protein, 20 aa, Mycobacterium
SVVRRQISFGYTEEDLRILL

SEQ ID NO: 1327650 - protein, 26 aa, Mycobacterium
SVWESAYAAVYLLADESRFMTGQQIR

SEQ ID NO: 1327651 - protein, 19 aa, Mycobacterium
SVYMMADCFDLTLDEVKFS

SEQ ID NO: 1327652 - protein, 23 aa, Mycobacterium
SVYTDEIFGPVLSVLRVESYDQA

SEQ ID NO: 1327653 - protein, 20 aa, Mycobacterium
SWETYLVTAAWDSGKKSAAY

SEQ ID NO: 1327654 - protein, 27 aa, Mycobacterium
SWIAAGPPPIYFGFGSMPLHNPTDTVR

SEQ ID NO: 1327655 - protein, 17 aa, Mycobacterium
SWKKVLTTSLRVSGAEA

SEQ ID NO: 1327656 - protein, 18 aa, Mycobacterium
SWMFVGWCRLREGIRGFH

SEQ ID NO: 1327657 - protein, 25 aa, Mycobacterium
SWSGGWRFRHELLREVAAELAPPSV

SEQ ID NO: 1327658 - protein, 22 aa, Mycobacterium
SWTRSSTLAFASLSSNLDSTRE

SEQ ID NO: 1327659 - protein, 21 aa, Mycobacterium
SWVLLELPGGWGPSAFLQSPA

SEQ ID NO: 1327660 - protein, 18 aa, Mycobacterium
SWVPAVTWSLGHDIYKRY

SEQ ID NO: 1327661 - protein, 24 aa, Mycobacterium
SYAEGLRALYLYTATFQDTAVAKA

SEQ ID NO: 1327662 - protein, 34 aa, Mycobacterium
SYAGTLARWSTNRRFLLNLPMFGREQFHPDVDKL

SEQ ID NO: 1327663 - protein, 18 aa, Mycobacterium
SYALYPHMTVRQNIGFPL

SEQ ID NO: 1327664 - protein, 26 aa, Mycobacterium
SYAQPALFAIEMGLARLWQARGIEPD

SEQ ID NO: 1327665 - protein, 26 aa, Mycobacterium
SYATMAQWCFLLARTSRVGEGATQKK

SEQ ID NO: 1327666 - protein, 20 aa, Mycobacterium
SYDETLPPRATFDHLLLTAH

SEQ ID NO: 1327667 - protein, 25 aa, Mycobacterium
SYDLSSLRYIMWCATPVTKSVADDV

SEQ ID NO: 1327668 - protein, 18 aa, Mycobacterium
SYDYPPGYKYIDGAPDGW

SEQ ID NO: 1327669 - protein, 26 aa, Mycobacterium
SYEIYRLDAVPGTEKLPYSLKVLAEN

SEQ ID NO: 1327670 - protein, 17 aa, Mycobacterium
SYFEVNVLAAARLIRHY

SEQ ID NO: 1327671 - protein, 27 aa, Mycobacterium
SYLDSDPYLPLITPFLEDLRAEQDETF

SEQ ID NO: 1327672 - protein, 18 aa, Mycobacterium
SYLSALGVDLRRVLHGEQ

SEQ ID NO: 1327673 - protein, 20 aa, Mycobacterium
SYNRPKLPGIPGIKDFAGHV

SEQ ID NO: 1327674 - protein, 18 aa, Mycobacterium
SYQLLIEDADLISTKRRV

SEQ ID NO: 1327675 - protein, 25 aa, Mycobacterium
SYQRGAPVEFPLDGVVPGFQKAIAG

SEQ ID NO: 1327676 - protein, 27 aa, Mycobacterium
SYREEALPKIQLWPLGADGSYGRAEDI

SEQ ID NO: 1327677 - protein, 21 aa, Mycobacterium
SYSRFIVAPDVWPVTREQSEG

SEQ ID NO: 1327678 - protein, 18 aa, Mycobacterium
SYVFDALYRAGKVDLEVV

SEQ ID NO: 1327679 - protein, 18 aa, Mycobacterium
SYVGIAGRLGFKGPPTLS

SEQ ID NO: 1327680 - protein, 20 aa, Mycobacterium
SYVPMDGFHLSNAQLDRLGR

SEQ ID NO: 1327681 - protein, 27 aa, Mycobacterium
TAAAFTALPFDHLFFTGSPAVGVHVQR

SEQ ID NO: 1327682 - protein, 30 aa, Mycobacterium
TAAALTESILPLLTADLPAAARLSAHHDTR

SEQ ID NO: 1327683 - protein, 25 aa, Mycobacterium
TAAAYVLNRWLSSGGVLAAKIPATP

SEQ ID NO: 1327684 - protein, 24 aa, Mycobacterium
TAADLGVPLYLHPSFPPPQVAEIY

SEQ ID NO: 1327685 - protein, 18 aa, Mycobacterium
TAAELTDRRLPGMDPGAL

SEQ ID NO: 1327686 - protein, 22 aa, Mycobacterium
TAAFYNFAPERVAKALPAAWDV

SEQ ID NO: 1327687 - protein, 26 aa, Mycobacterium
TAAGPHPFPLMVRDFQRIIGLEARAQ

SEQ ID NO: 1327688 - protein, 19 aa, Mycobacterium
TAAKALLGNDFRLTARRGE

SEQ ID NO: 1327689 - protein, 37 aa, Mycobacterium
TAALPTSEPFDFMADFALPFPIAVASAWLGLSEDTAG

SEQ ID NO: 1327690 - protein, 31 aa, Mycobacterium
TAANIIALASAVRPWHEIFCSDVAHVLVDEA

SEQ ID NO: 1327691 - protein, 23 aa, Mycobacterium
TAANPLKAPPFTFPAHLHQLVNG

SEQ ID NO: 1327692 - protein, 24 aa, Mycobacterium
TAANRLLGAISWLAAQKPGIYDGL

SEQ ID NO: 1327693 - protein, 25 aa, Mycobacterium
TAAPNFAYALFAKRLRRQAKPGEFD

SEQ ID NO: 1327694 - protein, 23 aa, Mycobacterium
TAAPNFAYEWTAARGVPADGSGI

SEQ ID NO: 1327695 - protein, 25 aa, Mycobacterium
TAAPNFAYNLLARRLRRQADPGEFD

SEQ ID NO: 1327696 - protein, 17 aa, Mycobacterium
TAAQWSALKAAWDGCAY

SEQ ID NO: 1327697 - protein, 26 aa, Mycobacterium
TAARTRPIRIAPRKALALRALDVVAP

SEQ ID NO: 1327698 - protein, 28 aa, Mycobacterium
TAARWAERLGLPLRTASLGGGPDPVRVF

SEQ ID NO: 1327699 - protein, 17 aa, Mycobacterium
TAAVRELGLEPGSVAVA

SEQ ID NO: 1327700 - protein, 21 aa, Mycobacterium
TAAVTALVPAGADEVSAMAAA

SEQ ID NO: 1327701 - protein, 19 aa, Mycobacterium
TACLIGERWTVGDSGLVLE

SEQ ID NO: 1327702 - protein, 17 aa, Mycobacterium
TADEIILNCLDLGAITY

SEQ ID NO: 1327703 - protein, 22 aa, Mycobacterium
TADGALPLLAPMSEVAGRLSAQ

SEQ ID NO: 1327704 - protein, 32 aa, Mycobacterium
TADGYLALFITHDGFWRLFASEAGLEGYPTMA

SEQ ID NO: 1327705 - protein, 17 aa, Mycobacterium
TADLWLEHGPVMRMAVD

SEQ ID NO: 1327706 - protein, 18 aa, Mycobacterium
TADMPLVIALTDKKARVV

SEQ ID NO: 1327707 - protein, 27 aa, Mycobacterium
TADRQIGLLLPCNVAVRADTSAGGDAV

SEQ ID NO: 1327708 - protein, 17 aa, Mycobacterium
TADTMRRYLEFAVDNCE

SEQ ID NO: 1327709 - protein, 23 aa, Mycobacterium
TADWLDLFRELEIPAAPLNTPDA

SEQ ID NO: 1327710 - protein, 27 aa, Mycobacterium
TAEDAWDLWLYWLTPSDLLDAARELIA

SEQ ID NO: 1327711 - protein, 28 aa, Mycobacterium
TAEDGAGWLTFWRSLTARGLSGVRLVTS

SEQ ID NO: 1327712 - protein, 17 aa, Mycobacterium
TAEPFTAAGLTYDVYRK

SEQ ID NO: 1327713 - protein, 36 aa, Mycobacterium
TAEPLLSGFLPMQSQYAQLLFLTTPLNELTPQHIDG

SEQ ID NO: 1327714 - protein, 20 aa, Mycobacterium
TAFELVVVNLYPFTQTVNSG

SEQ ID NO: 1327715 - protein, 29 aa, Mycobacterium
TAFGVSVATPFLLTGLIAPAMVQRGDGAI

SEQ ID NO: 1327716 - protein, 17 aa, Mycobacterium
TAFNAVIWMPPDGDRAG

SEQ ID NO: 1327717 - protein, 27 aa, Mycobacterium
TAFQNAWVNPIIWNAFLGWTGVDQYDE

SEQ ID NO: 1327718 - protein, 25 aa, Mycobacterium
TAGAELGRLGWWDGPRPHCAHEASA

SEQ ID NO: 1327719 - protein, 20 aa, Mycobacterium
TAGALNLFALKPNAFDADAE

SEQ ID NO: 1327720 - protein, 24 aa, Mycobacterium
TAGARAPIWLITAGAQRITGDETV

SEQ ID NO: 1327721 - protein, 18 aa, Mycobacterium
TAGDLRRQMGMSGAAITY

SEQ ID NO: 1327722 - protein, 29 aa, Mycobacterium
TAGEALLLGPILNIGLPIFTSGALEIPGK

SEQ ID NO: 1327723 - protein, 27 aa, Mycobacterium
TAGIVHFFGPFLYRSQFHAGTEAEESE

SEQ ID NO: 1327724 - protein, 23 aa, Mycobacterium
TAGLKIVPTMGVYAATKNAVRTM

SEQ ID NO: 1327725 - protein, 26 aa, Mycobacterium
TAGPQLVVPILNARFALNAANARWGS

SEQ ID NO: 1327726 - protein, 33 aa, Mycobacterium
TAGPVDLRHLSQWWYWTPGASWRHPIGPGSSIV

SEQ ID NO: 1327727 - protein, 22 aa, Mycobacterium
TAGRRQPPFVTLGPGDDAAVVL

SEQ ID NO: 1327728 - protein, 21 aa, Mycobacterium
TAGRYLLYLDFKVQDTVHTAS

SEQ ID NO: 1327729 - protein, 27 aa, Mycobacterium
TAGTFGNVMRFLPPLSISDELLTEAFD

SEQ ID NO: 1327730 - protein, 29 aa, Mycobacterium
TAGTRLANPPLLVPVLRAGLGMVDQAHAL

SEQ ID NO: 1327731 - protein, 23 aa, Mycobacterium
TAGVSGMLPMFLTGGKTVIPPSG

SEQ ID NO: 1327732 - protein, 27 aa, Mycobacterium
TAHGPTRVSALLRQARPVLLDLGAPDA

SEQ ID NO: 1327733 - protein, 20 aa, Mycobacterium
TAHHILIDGWSLPLFMGELL

SEQ ID NO: 1327734 - protein, 20 aa, Mycobacterium
TAHHWLVIGSADLAAPLTGA

SEQ ID NO: 1327735 - protein, 34 aa, Mycobacterium
TAHKFGGPIGVGALLLRRETACVPLLHGGGQERD

SEQ ID NO: 1327736 - protein, 17 aa, Mycobacterium
TAHPRPVSTPHPPIWVG

SEQ ID NO: 1327737 - protein, 25 aa, Mycobacterium
TAHRLRGFPNAPMRATPLWAQPEPL

SEQ ID NO: 1327738 - protein, 31 aa, Mycobacterium
TAHVRIIQDFVKKLPVWVSWDRREGYERDLV

SEQ ID NO: 1327739 - protein, 25 aa, Mycobacterium
TAIALEHLLDFMPRFEVDFSGLQRV

SEQ ID NO: 1327740 - protein, 25 aa, Mycobacterium
TAIDGWHWLIEWTTTSFYIKSMNPA

SEQ ID NO: 1327741 - protein, 22 aa, Mycobacterium
TAIRGFDPTHRLFRGRHTTSYT

SEQ ID NO: 1327742 - protein, 17 aa, Mycobacterium
TAISRTMHIHPTVSELI

SEQ ID NO: 1327743 - protein, 24 aa, Mycobacterium
TAITRLHFIRAGQAAGLTLDDIAS

SEQ ID NO: 1327744 - protein, 25 aa, Mycobacterium
TAIVEFPPAGTLTGIAKRELRGVPT

SEQ ID NO: 1327745 - protein, 17 aa, Mycobacterium
TAIVKGLRTGTDFEYEL

SEQ ID NO: 1327746 - protein, 20 aa, Mycobacterium
TAIVVERALMRLPLEQRAAV

SEQ ID NO: 1327747 - protein, 23 aa, Mycobacterium
TAKARLKLLADLEPLRIGDDVRD

SEQ ID NO: 1327748 - protein, 25 aa, Mycobacterium
TAKNMIQAFFLDLQAINGGASRPDG

SEQ ID NO: 1327749 - protein, 25 aa, Mycobacterium
TAKNPRLWRRLLQCSSATGADGVVV

SEQ ID NO: 1327750 - protein, 23 aa, Mycobacterium
TAKPVIPVFVNSVATPLGPMRRV

SEQ ID NO: 1327751 - protein, 24 aa, Mycobacterium
TAKQQPLGILPQPKELPRGCIAAG

SEQ ID NO: 1327752 - protein, 30 aa, Mycobacterium
TAKSDLVGAYLLIWTTTPWTLPSNQAVAVN

SEQ ID NO: 1327753 - protein, 20 aa, Mycobacterium
TAKVWGLYMAASRVGFEQNS

SEQ ID NO: 1327754 - protein, 25 aa, Mycobacterium
TALADAMPWNQLPGPVRRLAHALPL

SEQ ID NO: 1327755 - protein, 19 aa, Mycobacterium
TALADVWLVAQIEELSGIA

SEQ ID NO: 1327756 - protein, 20 aa, Mycobacterium
TALARLGMFAPALSHLERPE

SEQ ID NO: 1327757 - protein, 22 aa, Mycobacterium
TALDFIGPYESLRWLPDVEVRF

SEQ ID NO: 1327758 - protein, 23 aa, Mycobacterium
TALGEGFFINQKITWQVGDEDVA

SEQ ID NO: 1327759 - protein, 25 aa, Mycobacterium
TALIAGLLRSLLDRGITPHTEARAV

SEQ ID NO: 1327760 - protein, 28 aa, Mycobacterium
TALLCPFDPLIFFRPRVERLFGGFHYRI

SEQ ID NO: 1327761 - protein, 18 aa, Mycobacterium
TALLMRALRIGLEKDDAD

SEQ ID NO: 1327762 - protein, 20 aa, Mycobacterium
TALLVNSADYPLLSAKASVG

SEQ ID NO: 1327763 - protein, 17 aa, Mycobacterium
TALPLRRAVIMLMCGKA

SEQ ID NO: 1327764 - protein, 29 aa, Mycobacterium
TALQANMKVGLHLANGWLAPLTSSAEEPA

SEQ ID NO: 1327765 - protein, 17 aa, Mycobacterium
TALQDEIGFTRVLYDDH

SEQ ID NO: 1327766 - protein, 20 aa, Mycobacterium
TALQTLEWARMALASCHLTA

SEQ ID NO: 1327767 - protein, 19 aa, Mycobacterium
TALSRYLAGPVVPTVLGQD

SEQ ID NO: 1327768 - protein, 21 aa, Mycobacterium
TALVPTLINIENFPDIAASAD

SEQ ID NO: 1327769 - protein, 17 aa, Mycobacterium
TALWNVLCNQVGVAAIA

SEQ ID NO: 1327770 - protein, 21 aa, Mycobacterium
TAMTHFLLPGEWRIQGHVAYV

SEQ ID NO: 1327771 - protein, 19 aa, Mycobacterium
TANGYSRILLGVDIHDITA

SEQ ID NO: 1327772 - protein, 34 aa, Mycobacterium
TANHPLLCLVDVGGVPTLLWKLIAEIRPSDRVVL

SEQ ID NO: 1327773 - protein, 30 aa, Mycobacterium
TANPLVLRLGTDLLRFRGVVTAAEQVAKVE

SEQ ID NO: 1327774 - protein, 20 aa, Mycobacterium
TAPALIVWGSRDTAIPLPIG

SEQ ID NO: 1327775 - protein, 22 aa, Mycobacterium
TAPAMFPKLTEEAFRLTFDVHV

SEQ ID NO: 1327776 - protein, 23 aa, Mycobacterium
TAPAVVVGLVTLGARFVTVAARH

SEQ ID NO: 1327777 - protein, 18 aa, Mycobacterium
TAPDLLRFFSAMADGGAP

SEQ ID NO: 1327778 - protein, 21 aa, Mycobacterium
TAPEMTALIGGLRTLNANHGG

SEQ ID NO: 1327779 - protein, 17 aa, Mycobacterium
TAPITVLRLRPVEVISA

SEQ ID NO: 1327780 - protein, 18 aa, Mycobacterium
TAPLLANRRRAGQGLPLE

SEQ ID NO: 1327781 - protein, 18 aa, Mycobacterium
TAPLLLVHGLNDTNVPPG

SEQ ID NO: 1327782 - protein, 19 aa, Mycobacterium
TAPPLPGPPVYARSIIEGG

SEQ ID NO: 1327783 - protein, 20 aa, Mycobacterium
TAPQPTSYAEWIRPADLVPH

SEQ ID NO: 1327784 - protein, 24 aa, Mycobacterium
TAPRLLLEVVCARLLLPSASDTEA

SEQ ID NO: 1327785 - protein, 23 aa, Mycobacterium
TAPRYRMTALPTTPPKPGVTRVP

SEQ ID NO: 1327786 - protein, 20 aa, Mycobacterium
TAPTLPAIHRYTGVLYDALD

SEQ ID NO: 1327787 - protein, 25 aa, Mycobacterium
TAQHNWALLHALPEFVTTGIPVLVG

SEQ ID NO: 1327788 - protein, 24 aa, Mycobacterium
TAQHRLARRKSLSLKQLCEYPVIS

SEQ ID NO: 1327789 - protein, 23 aa, Mycobacterium
TAQPAVAPPPPAPAAPLAPGLAP

SEQ ID NO: 1327790 - protein, 21 aa, Mycobacterium
TAQPSVLWRPVPDAFVLDAMG

SEQ ID NO: 1327791 - protein, 37 aa, Mycobacterium
TAQQAWFLAEYLNAGMYPWKLAITSPYLDPGEREGFN

SEQ ID NO: 1327792 - protein, 23 aa, Mycobacterium
TAQRILAHFGLDGHFEVIAGAGA

SEQ ID NO: 1327793 - protein, 24 aa, Mycobacterium
TAQTPLDAQYWRRHSRQPVQFAES

SEQ ID NO: 1327794 - protein, 19 aa, Mycobacterium
TARAGKLGVPCRWPEDAVT

SEQ ID NO: 1327795 - protein, 17 aa, Mycobacterium
TARATARRWLTAVGADE

SEQ ID NO: 1327796 - protein, 24 aa, Mycobacterium
TARATLFPLTWNEPGGTAVIESLA

SEQ ID NO: 1327797 - protein, 25 aa, Mycobacterium
TARAVWLRETLLLPTVGEPVADVWV

SEQ ID NO: 1327798 - protein, 23 aa, Mycobacterium
TARGMLFYRLLQQSVNTDPHPLS

SEQ ID NO: 1327799 - protein, 23 aa, Mycobacterium
TARHDVMWAMIADMPAVEAGRGG

SEQ ID NO: 1327800 - protein, 29 aa, Mycobacterium
TARHLQIPSDRWVFPYAGADSHDTYAIAE

SEQ ID NO: 1327801 - protein, 23 aa, Mycobacterium
TARISALMELLGSPQLGYPSIHI

SEQ ID NO: 1327802 - protein, 23 aa, Mycobacterium
TARKIVEIPRPAGVVLALTPTTN

SEQ ID NO: 1327803 - protein, 24 aa, Mycobacterium
TARMLVAVGDLYRLRLREVGDSAY

SEQ ID NO: 1327804 - protein, 21 aa, Mycobacterium
TARPYRRRAVTGRPSRRPMSQ

SEQ ID NO: 1327805 - protein, 28 aa, Mycobacterium
TARQLKIPSERWIFPYAGTDSHDTYAIG

SEQ ID NO: 1327806 - protein, 23 aa, Mycobacterium
TARRDQVLIDWITAAAARARRVV

SEQ ID NO: 1327807 - protein, 19 aa, Mycobacterium
TARRWLTAVGADELADRRP

SEQ ID NO: 1327808 - protein, 23 aa, Mycobacterium
TARSLPPAIRLDGPEIARVQQIV

SEQ ID NO: 1327809 - protein, 25 aa, Mycobacterium
TASHYVDRFILTEKPFVLDLSGVDS

SEQ ID NO: 1327810 - protein, 29 aa, Mycobacterium
TASQVREEFGHWLDAHFALDPVRSSDLIL

SEQ ID NO: 1327811 - protein, 25 aa, Mycobacterium
TASTKLDNWWEYLRGIESTYPLSYG

SEQ ID NO: 1327812 - protein, 18 aa, Mycobacterium
TATAAALSHRVWLRPFRN

SEQ ID NO: 1327813 - protein, 21 aa, Mycobacterium
TATAPIPPAYSPTSPVRSLRR

SEQ ID NO: 1327814 - protein, 20 aa, Mycobacterium
TATAPRVGVFRPITRSGPAR

SEQ ID NO: 1327815 - protein, 19 aa, Mycobacterium
TATARRVPALLKATARYCA

SEQ ID NO: 1327816 - protein, 19 aa, Mycobacterium
TATAVPWAAYAGRVVAIWS

SEQ ID NO: 1327817 - protein, 39 aa, Mycobacterium
TATFGAPLAPGLTLVPDALVGLCWPAVFSAIGSALTEDG

SEQ ID NO: 1327818 - protein, 24 aa, Mycobacterium
TATHHFRILREAGVTERLVIDGLI

SEQ ID NO: 1327819 - protein, 26 aa, Mycobacterium
TATLQSPLPELTWIYDVDVERAVATF

SEQ ID NO: 1327820 - protein, 21 aa, Mycobacterium
TATLRMLLAAIQTEEVSGKEA

SEQ ID NO: 1327821 - protein, 22 aa, Mycobacterium
TATPWQWVGQELPQFSSAPADH

SEQ ID NO: 1327822 - protein, 23 aa, Mycobacterium
TATVRAMFYNPMQLPGMAEQSAC

SEQ ID NO: 1327823 - protein, 28 aa, Mycobacterium
TATVRSFYITVPTTLTAWPDKPSGSLPG

SEQ ID NO: 1327824 - protein, 19 aa, Mycobacterium
TATWRNFFLGGATELRVGN

SEQ ID NO: 1327825 - protein, 24 aa, Mycobacterium
TAVATFYSMYRREPTGEYLVGVCT

SEQ ID NO: 1327826 - protein, 20 aa, Mycobacterium
TAVDLARRYPLNTAVAAIDA

SEQ ID NO: 1327827 - protein, 25 aa, Mycobacterium
TAVERARPVLAAYGDPILRVGELGA

SEQ ID NO: 1327828 - protein, 25 aa, Mycobacterium
TAVFDWVMVSRVAGSTWRPVVRYEM

SEQ ID NO: 1327829 - protein, 17 aa, Mycobacterium
TAVGLPEADRRLDSYPH

SEQ ID NO: 1327830 - protein, 17 aa, Mycobacterium
TAVGMALAFKKQGSDRV

SEQ ID NO: 1327831 - protein, 20 aa, Mycobacterium
TAVLIETLVALGAEVRWASC

SEQ ID NO: 1327832 - protein, 20 aa, Mycobacterium
TAVLRYVMKVPPLATIPTED

SEQ ID NO: 1327833 - protein, 27 aa, Mycobacterium
TAVNDKIFFQIYWLGSRDDILARMERA

SEQ ID NO: 1327834 - protein, 18 aa, Mycobacterium
TAVPPSWRPDIKQPADLV

SEQ ID NO: 1327835 - protein, 22 aa, Mycobacterium
TAVRMLRLLATAEAVGGLAACT

SEQ ID NO: 1327836 - protein, 20 aa, Mycobacterium
TAVSILDRLLHHATVVITNG

SEQ ID NO: 1327837 - protein, 19 aa, Mycobacterium
TAVTPIYGPALDGTLAGNE

SEQ ID NO: 1327838 - protein, 22 aa, Mycobacterium
TAWATQLRMVQSQILAKIAAAV

SEQ ID NO: 1327839 - protein, 17 aa, Mycobacterium
TAWMPQVPNDFDCLTMV

SEQ ID NO: 1327840 - protein, 20 aa, Mycobacterium
TAWQHSPYWMVDRSAGQGFS

SEQ ID NO: 1327841 - protein, 19 aa, Mycobacterium
TAYHALRSTARLSAGDELV

SEQ ID NO: 1327842 - protein, 17 aa, Mycobacterium
TCAGAPIKDPRTGHVIG

SEQ ID NO: 1327843 - protein, 22 aa, Mycobacterium
TCHGRVRRLQELGVIRGFYADI

SEQ ID NO: 1327844 - protein, 18 aa, Mycobacterium
TCLLVGAQWFLDNGGRDY

SEQ ID NO: 1327845 - protein, 26 aa, Mycobacterium
TCMSSSLPTLFRRAADYQRQITLTAS

SEQ ID NO: 1327846 - protein, 26 aa, Mycobacterium
TCMSSSLPTLFRRAADYQRQITLTPS

SEQ ID NO: 1327847 - protein, 17 aa, Mycobacterium
TCNLHGWQWNLENGRCL

SEQ ID NO: 1327848 - protein, 17 aa, Mycobacterium
TCNLHGWQWNLTNGRCL

SEQ ID NO: 1327849 - protein, 18 aa, Mycobacterium
TCSTLHLHAWPAATELDL

SEQ ID NO: 1327850 - protein, 22 aa, Mycobacterium
TCVAVLLRLPPKVYGDGRSTVR

SEQ ID NO: 1327851 - protein, 18 aa, Mycobacterium
TCVRILRNQASLLPGLNS

SEQ ID NO: 1327852 - protein, 20 aa, Mycobacterium
TCWHDYRLGVLQAPLITVLG

SEQ ID NO: 1327853 - protein, 24 aa, Mycobacterium
TDAKGNVIAWLYNQRRFEVPSDQI

SEQ ID NO: 1327854 - protein, 17 aa, Mycobacterium
TDALRAELAPRGIHVAA

SEQ ID NO: 1327855 - protein, 25 aa, Mycobacterium
TDARGAFFEWFTDAGFTAITGHRLD

SEQ ID NO: 1327856 - protein, 22 aa, Mycobacterium
TDAVLHLAMHEGRLRHATVRQI

SEQ ID NO: 1327857 - protein, 24 aa, Mycobacterium
TDAYARRILGWRVASTMATTMVLD

SEQ ID NO: 1327858 - protein, 20 aa, Mycobacterium
TDCFFVWDDIYVDAKALTTH

SEQ ID NO: 1327859 - protein, 23 aa, Mycobacterium
TDCPRLPVRFAWVSAELAMFRGE

SEQ ID NO: 1327860 - protein, 24 aa, Mycobacterium
TDDAVWEMPPFDGWYQGPANIVTL

SEQ ID NO: 1327861 - protein, 24 aa, Mycobacterium
TDDEFGFFMVLLAVAGNETTRNSI

SEQ ID NO: 1327862 - protein, 23 aa, Mycobacterium
TDDLLVCIPLPGRNRYRMSMLVP

SEQ ID NO: 1327863 - protein, 25 aa, Mycobacterium
TDDVVAFLKDQHKLIKDMFDDVIHA

SEQ ID NO: 1327864 - protein, 17 aa, Mycobacterium
TDDWPKPVPARRLVSYL

SEQ ID NO: 1327865 - protein, 20 aa, Mycobacterium
TDELLRLYTPTLGLARTVSR

SEQ ID NO: 1327866 - protein, 24 aa, Mycobacterium
TDEMLAWQTERFLELADGAAPAAT

SEQ ID NO: 1327867 - protein, 22 aa, Mycobacterium
TDERMVVRLLAFGLRAHRLSDV

SEQ ID NO: 1327868 - protein, 18 aa, Mycobacterium
TDERRPWLVWVHGAGQGQ

SEQ ID NO: 1327869 - protein, 19 aa, Mycobacterium
TDFHALAARAILAGDALAS

SEQ ID NO: 1327870 - protein, 21 aa, Mycobacterium
TDFRSWARVELELEPGRTVFV

SEQ ID NO: 1327871 - protein, 26 aa, Mycobacterium
TDGAHIVMIGILPTLMPEHLSGHWMS

SEQ ID NO: 1327872 - protein, 24 aa, Mycobacterium
TDGELFVCTTLRLVDDEPWSVTMT

SEQ ID NO: 1327873 - protein, 20 aa, Mycobacterium
TDGITYLLIPMNSPGITVRP

SEQ ID NO: 1327874 - protein, 19 aa, Mycobacterium
TDGLDFLRLAVLDALLVLH

SEQ ID NO: 1327875 - protein, 27 aa, Mycobacterium
TDGLRITKSVLFAGLAEAKQSGDHQAV

SEQ ID NO: 1327876 - protein, 24 aa, Mycobacterium
TDGWSFRVLLGDLGRTYQALERGA

SEQ ID NO: 1327877 - protein, 31 aa, Mycobacterium
TDHAPLPLREPVRSLVWIGGRVQAVPSADVS

SEQ ID NO: 1327878 - protein, 25 aa, Mycobacterium
TDHARHFLFSILRVFGPSTSSSEVD

SEQ ID NO: 1327879 - protein, 17 aa, Mycobacterium
TDHLMRFPGKFSEQLLA

SEQ ID NO: 1327880 - protein, 26 aa, Mycobacterium
TDHPIHRYFLAAKQTEFAVGGATGQL

SEQ ID NO: 1327881 - protein, 24 aa, Mycobacterium
TDHRPEILLSFGFVPKVENRVGLI

SEQ ID NO: 1327882 - protein, 29 aa, Mycobacterium
TDHSLLLASSLHPLWRARGRLQEGQAWFD

SEQ ID NO: 1327883 - protein, 22 aa, Mycobacterium
TDIVLGGNVDYLLDRRLRQRGL

SEQ ID NO: 1327884 - protein, 24 aa, Mycobacterium
TDKPLKYPHMFAAAGLIIVNKTDL

SEQ ID NO: 1327885 - protein, 17 aa, Mycobacterium
TDLALVTDGLRAEREQG

SEQ ID NO: 1327886 - protein, 28 aa, Mycobacterium
TDLGKPLYTVRGWVPWTGPTSVLALDGA

SEQ ID NO: 1327887 - protein, 17 aa, Mycobacterium
TDLGWGARLRKVLDEPD

SEQ ID NO: 1327888 - protein, 17 aa, Mycobacterium
TDLHILKGDVPEVQPGR

SEQ ID NO: 1327889 - protein, 35 aa, Mycobacterium
TDLLVEAVAYLIERLPDEPLLGLLLETDRMRVMSR

SEQ ID NO: 1327890 - protein, 19 aa, Mycobacterium
TDLRRGGRPLALVDKHSTG

SEQ ID NO: 1327891 - protein, 26 aa, Mycobacterium
TDLTPPALMKAILKAPADLLWNGGIG

SEQ ID NO: 1327892 - protein, 26 aa, Mycobacterium
TDLVPRRPEAYPLLERTLRTGQPHRV

SEQ ID NO: 1327893 - protein, 25 aa, Mycobacterium
TDMDVRALLAHLIGVLARVAALGNG

SEQ ID NO: 1327894 - protein, 23 aa, Mycobacterium
TDMFAPGTGFLYSHAGRTAVVER

SEQ ID NO: 1327895 - protein, 24 aa, Mycobacterium
TDNARFFFGDLAVASLDALVNPNV

SEQ ID NO: 1327896 - protein, 29 aa, Mycobacterium
TDNEIVLVDFWASWCGPCRAFAPTFAASS

SEQ ID NO: 1327897 - protein, 22 aa, Mycobacterium
TDNGTYIIGDRYSHLIMDSSTY

SEQ ID NO: 1327898 - protein, 24 aa, Mycobacterium
TDPARTFELLPQDDQVFGFTADEP

SEQ ID NO: 1327899 - protein, 19 aa, Mycobacterium
TDPTRRFHTLWSGDRSEVE

SEQ ID NO: 1327900 - protein, 24 aa, Mycobacterium
TDQAPGFDWPGWLAGLGGTAEQAA

SEQ ID NO: 1327901 - protein, 22 aa, Mycobacterium
TDQIIPAVYLKRVTRTGFEDGL

SEQ ID NO: 1327902 - protein, 21 aa, Mycobacterium
TDRFRLAVRELTWSTGAAGVE

SEQ ID NO: 1327903 - protein, 24 aa, Mycobacterium
TDRFVRDFFGPATATEWAKGINPA

SEQ ID NO: 1327904 - protein, 25 aa, Mycobacterium
TDRGWRLCRDLLAAGAPPRSTGPAK

SEQ ID NO: 1327905 - protein, 17 aa, Mycobacterium
TDRLPLRAPERWQEFEP

SEQ ID NO: 1327906 - protein, 25 aa, Mycobacterium
TDRLPQVAALFTAGLITDLLVRAIV

SEQ ID NO: 1327907 - protein, 17 aa, Mycobacterium
TDRPVWVRGVGLGMDRV

SEQ ID NO: 1327908 - protein, 25 aa, Mycobacterium
TDRQWRGIGMIPRSGWTLSPRYAEF

SEQ ID NO: 1327909 - protein, 22 aa, Mycobacterium
TDSAVRRYVTDAGPLLGQLHKL

SEQ ID NO: 1327910 - protein, 26 aa, Mycobacterium
TDSDLLTSILTYHVVPGQAAPDQVAG

SEQ ID NO: 1327911 - protein, 17 aa, Mycobacterium
TDSFVVKPMVFPGGSIG

SEQ ID NO: 1327912 - protein, 25 aa, Mycobacterium
TDSLDIYLKLLFQGDQLPGYGWVFP

SEQ ID NO: 1327913 - protein, 26 aa, Mycobacterium
TDSLFRRDDWPRPVPARRIIGYVQRF

SEQ ID NO: 1327914 - protein, 23 aa, Mycobacterium
TDSVGLIAWKYRHELRRSSAAQP

SEQ ID NO: 1327915 - protein, 19 aa, Mycobacterium
TDTAVWSALVDFGLPGLAV

SEQ ID NO: 1327916 - protein, 25 aa, Mycobacterium
TDTGAMLRILFSRLGQPHIGSPQAF

SEQ ID NO: 1327917 - protein, 22 aa, Mycobacterium
TDTPVYPTHGFGSFCSATPASG

SEQ ID NO: 1327918 - protein, 26 aa, Mycobacterium
TDVEYLGSQPWPFPRSLMVGFHAIGD

SEQ ID NO: 1327919 - protein, 26 aa, Mycobacterium
TDVGIGIIRTMLRHAPKGEKSTPSNG

SEQ ID NO: 1327920 - protein, 18 aa, Mycobacterium
TDWHWYTTVVDINCREII

SEQ ID NO: 1327921 - protein, 20 aa, Mycobacterium
TDYDTADRLYFEPLTFEDVL

SEQ ID NO: 1327922 - protein, 23 aa, Mycobacterium
TDYPFAIAERPAGAALLGAGLPE

SEQ ID NO: 1327923 - protein, 18 aa, Mycobacterium
TEAGGRFGFVSAAPANDP

SEQ ID NO: 1327924 - protein, 23 aa, Mycobacterium
TEALINDGRLRKLTFTGSTGVGK

SEQ ID NO: 1327925 - protein, 24 aa, Mycobacterium
TEANIVNFRRQLGRLGLGHDSRRS

SEQ ID NO: 1327926 - protein, 25 aa, Mycobacterium
TEAQKQEWLPLLASGKALGAFGLTE

SEQ ID NO: 1327927 - protein, 17 aa, Mycobacterium
TEATHHVLWNMSDRGIP

SEQ ID NO: 1327928 - protein, 26 aa, Mycobacterium
TEAVDPLLPEVAWSWLVDALNQRAEH

SEQ ID NO: 1327929 - protein, 24 aa, Mycobacterium
TEAYRLLMEVLGTAATLRPNSPGA

SEQ ID NO: 1327930 - protein, 19 aa, Mycobacterium
TECPVLAAAVRRARPGTGS

SEQ ID NO: 1327931 - protein, 17 aa, Mycobacterium
TEDAEFGGYLFPVGTFV

SEQ ID NO: 1327932 - protein, 21 aa, Mycobacterium
TEDFRSSWLCRYLEDAHNAGE

SEQ ID NO: 1327933 - protein, 19 aa, Mycobacterium
TEDMPFNWIDKGGAYIRSR

SEQ ID NO: 1327934 - protein, 25 aa, Mycobacterium
TEEETYFFRLSAYADRLLALYADHP

SEQ ID NO: 1327935 - protein, 22 aa, Mycobacterium
TEEMPIKVPWSLPSARPCLAGS

SEQ ID NO: 1327936 - protein, 24 aa, Mycobacterium
TEEQKRHFLPRILSAEDRWCQGFS

SEQ ID NO: 1327937 - protein, 26 aa, Mycobacterium
TEEQRKQWLEPLLAGEIRSAFAMTEP

SEQ ID NO: 1327938 - protein, 24 aa, Mycobacterium
TEERRQFDWIVDLLTKLGREEDAY

SEQ ID NO: 1327939 - protein, 17 aa, Mycobacterium
TEFELLRLLMRNQRKAL

SEQ ID NO: 1327940 - protein, 20 aa, Mycobacterium
TEFFALLKDWTNRYRHSSVV

SEQ ID NO: 1327941 - protein, 18 aa, Mycobacterium
TEFLAFNSAIFSEQVWLI

SEQ ID NO: 1327942 - protein, 23 aa, Mycobacterium
TEFNDIVAVLALYRPGPMGMNAH

SEQ ID NO: 1327943 - protein, 19 aa, Mycobacterium
TEFPYVFCDATFCKARIGA

SEQ ID NO: 1327944 - protein, 23 aa, Mycobacterium
TEGDAYHHVLMRILVAARANGIA

SEQ ID NO: 1327945 - protein, 31 aa, Mycobacterium
TEGISPDLPVKPPIPLTRPPGDEVPSPDTEE

SEQ ID NO: 1327946 - protein, 37 aa, Mycobacterium
TEGNITYVFVPTRNLPLLTPLRLIGLGWLADELNEPL

SEQ ID NO: 1327947 - protein, 28 aa, Mycobacterium
TEGRSGVPFILAGWSLGGVLAYACAIGL

SEQ ID NO: 1327948 - protein, 25 aa, Mycobacterium
TEHGGHTLTWIAHDVPSVGWRSYRM

SEQ ID NO: 1327949 - protein, 22 aa, Mycobacterium
TEIPPWVKMTATAIARWTRRLG

SEQ ID NO: 1327950 - protein, 21 aa, Mycobacterium
TEIRSTIFNLQKPAEAHGAFA

SEQ ID NO: 1327951 - protein, 20 aa, Mycobacterium
TEIVLMELGLDWDRIEALKD

SEQ ID NO: 1327952 - protein, 35 aa, Mycobacterium
TEKGLAFFPVLVCALAWAQRWLPSPEGPAVLLTHT

SEQ ID NO: 1327953 - protein, 22 aa, Mycobacterium
TELEFMVFDDTFRDAWKADYRG

SEQ ID NO: 1327954 - protein, 21 aa, Mycobacterium
TELHRRLLRSGLPFGTCLQAV

SEQ ID NO: 1327955 - protein, 59 aa, Mycobacterium
TELKPAFEWLQQIPVLGRFVVTPIVHLIHAIPFVSEILHPLIGFPIDHDAPPGTPRART

SEQ ID NO: 1327956 - protein, 22 aa, Mycobacterium
TELLQIQRRLGITSVYVTHDQE

SEQ ID NO: 1327957 - protein, 17 aa, Mycobacterium
TELLVEVAGADALPFGS

SEQ ID NO: 1327958 - protein, 17 aa, Mycobacterium
TELPALYELGVGSMEKL

SEQ ID NO: 1327959 - protein, 17 aa, Mycobacterium
TELPPPDDAWAWAHAQV

SEQ ID NO: 1327960 - protein, 24 aa, Mycobacterium
TELQTSFMLSPWAARTPIDVEVPF

SEQ ID NO: 1327961 - protein, 27 aa, Mycobacterium
TELTRNLWPVARRPVELVWGLVSQTPE

SEQ ID NO: 1327962 - protein, 33 aa, Mycobacterium
TEMEHHANLIPWQELARRTGATLRWFGLTDDGE

SEQ ID NO: 1327963 - protein, 19 aa, Mycobacterium
TEMHDCRPGFLLPGFIDTH

SEQ ID NO: 1327964 - protein, 23 aa, Mycobacterium
TENAYFAESFVKRGLVVDGGGCY

SEQ ID NO: 1327965 - protein, 26 aa, Mycobacterium
TENHRFLMTRIFPRQAEITTATELYL

SEQ ID NO: 1327966 - protein, 23 aa, Mycobacterium
TENLIGLFVNALPIRIRLDGDPD

SEQ ID NO: 1327967 - protein, 25 aa, Mycobacterium
TENLSARCLLSLAISYIAVATDAAD

SEQ ID NO: 1327968 - protein, 17 aa, Mycobacterium
TENRYAPPPPYPSPDPF

SEQ ID NO: 1327969 - protein, 24 aa, Mycobacterium
TEPARTWYLAMKPIAEDFGPVAMP

SEQ ID NO: 1327970 - protein, 17 aa, Mycobacterium
TEPELWAEYVRGAQLSY

SEQ ID NO: 1327971 - protein, 23 aa, Mycobacterium
TEPKARALRPYAEKLITHAKKGT

SEQ ID NO: 1327972 - protein, 19 aa, Mycobacterium
TEPTHLLGAPQLTLTYSGT

SEQ ID NO: 1327973 - protein, 17 aa, Mycobacterium
TEPVDWDSFLRVNLYGV

SEQ ID NO: 1327974 - protein, 24 aa, Mycobacterium
TEQELRWMFLACVAAAHVWDLDRL

SEQ ID NO: 1327975 - protein, 24 aa, Mycobacterium
TEQKQAWLPAMLSGQTIGAYSLSE

SEQ ID NO: 1327976 - protein, 22 aa, Mycobacterium
TERAVLLVLMAESRPVPNPELA

SEQ ID NO: 1327977 - protein, 18 aa, Mycobacterium
TERGMAYTRIGYARPIDS

SEQ ID NO: 1327978 - protein, 18 aa, Mycobacterium
TERLMGLIRPVVKGWHRA

SEQ ID NO: 1327979 - protein, 24 aa, Mycobacterium
TERLRSVGFPFPGARVRILGDDGR

SEQ ID NO: 1327980 - protein, 22 aa, Mycobacterium
TERRRARRINDAKFPRLKRLAE

SEQ ID NO: 1327981 - protein, 21 aa, Mycobacterium
TERTFFRHFPTKEAVLFQDYE

SEQ ID NO: 1327982 - protein, 19 aa, Mycobacterium
TERWLLADLHLDWDLDRGG

SEQ ID NO: 1327983 - protein, 20 aa, Mycobacterium
TERWVPLERVGLYVPGGNAV

SEQ ID NO: 1327984 - protein, 25 aa, Mycobacterium
TERYNPVYDYTYRRAPQTPYDTVEV

SEQ ID NO: 1327985 - protein, 33 aa, Mycobacterium
TESDAARVLAARNLLPVPWVEPVDVANAVCFLA

SEQ ID NO: 1327986 - protein, 17 aa, Mycobacterium
TESKDLVAKRLFIAPST

SEQ ID NO: 1327987 - protein, 20 aa, Mycobacterium
TESPAVGPLAILVDAAGGIV

SEQ ID NO: 1327988 - protein, 24 aa, Mycobacterium
TESRLHTVIALLRQIVQGTETEPE

SEQ ID NO: 1327989 - protein, 23 aa, Mycobacterium
TESSWLRHLVMQGARERYGPPER

SEQ ID NO: 1327990 - protein, 29 aa, Mycobacterium
TESTFLGGWLGPFLWLRERMPGINRQVYR

SEQ ID NO: 1327991 - protein, 25 aa, Mycobacterium
TETAQGVFYVLTVSVTNIGDEARSY

SEQ ID NO: 1327992 - protein, 18 aa, Mycobacterium
TETEKLYLAGFFAGIEEG

SEQ ID NO: 1327993 - protein, 24 aa, Mycobacterium
TETPHEMPYGIDSGFRDPSGNSVR

SEQ ID NO: 1327994 - protein, 18 aa, Mycobacterium
TETRFYRELSPELTTGVP

SEQ ID NO: 1327995 - protein, 19 aa, Mycobacterium
TETRGVYRPSWTIADVAEN

SEQ ID NO: 1327996 - protein, 25 aa, Mycobacterium
TETVGGVLRLGYLGTLGVGPGFAIG

SEQ ID NO: 1327997 - protein, 27 aa, Mycobacterium
TETYLHKRAADLPPAVGVLVEYTGGDT

SEQ ID NO: 1327998 - protein, 20 aa, Mycobacterium
TEVAIFADPQQLVRGILVNG

SEQ ID NO: 1327999 - protein, 30 aa, Mycobacterium
TEVAPSAIIHLAAVIPPPIYRNPKVARKVN

SEQ ID NO: 1328000 - protein, 18 aa, Mycobacterium
TEVAWVPVKDLPSRLAYA

SEQ ID NO: 1328001 - protein, 28 aa, Mycobacterium
TEVSRDPFLPLLLAADRSTSLQLGTGVA

SEQ ID NO: 1328002 - protein, 31 aa, Mycobacterium
TEWATGQLATRAAFIVCSHIQVVYGGVNLTT

SEQ ID NO: 1328003 - protein, 29 aa, Mycobacterium
TEYEQDSLIAWTILGRLRPQIGHVYGYRL

SEQ ID NO: 1328004 - protein, 18 aa, Mycobacterium
TEYLGVSRATLYRYLDDA

SEQ ID NO: 1328005 - protein, 18 aa, Mycobacterium
TEYVIRRAMSQMGVPYSW

SEQ ID NO: 1328006 - protein, 18 aa, Mycobacterium
TFALFTREPRRGSSPATR

SEQ ID NO: 1328007 - protein, 20 aa, Mycobacterium
TFARYRRSLTAVAVVGVVPG

SEQ ID NO: 1328008 - protein, 17 aa, Mycobacterium
TFATFVRLGNPVARMVW

SEQ ID NO: 1328009 - protein, 24 aa, Mycobacterium
TFATGYQKFLLWGVDPPTQHRIRR

SEQ ID NO: 1328010 - protein, 27 aa, Mycobacterium
TFATTELFLERLGLSSLADLPDIAPLL

SEQ ID NO: 1328011 - protein, 18 aa, Mycobacterium
TFCRICEPLCGMIATVED

SEQ ID NO: 1328012 - protein, 33 aa, Mycobacterium
TFDEHLHPARPRSLRFRPRVRAPFTRRSLARDG

SEQ ID NO: 1328013 - protein, 31 aa, Mycobacterium
TFDGEWTEPTWLPARWPVLLCNGAVGIAEGW

SEQ ID NO: 1328014 - protein, 27 aa, Mycobacterium
TFDIHLGGPALFGPIGMVVAGALRGDI

SEQ ID NO: 1328015 - protein, 18 aa, Mycobacterium
TFDRPVLVVWAREDRMMP

SEQ ID NO: 1328016 - protein, 20 aa, Mycobacterium
TFEFDPSRFVFANKTMVGVS

SEQ ID NO: 1328017 - protein, 18 aa, Mycobacterium
TFEMCRQRLMDASLDADF

SEQ ID NO: 1328018 - protein, 17 aa, Mycobacterium
TFERFGIERFVRLTAAP

SEQ ID NO: 1328019 - protein, 17 aa, Mycobacterium
TFEVFARRLPDGRRYGV

SEQ ID NO: 1328020 - protein, 28 aa, Mycobacterium
TFFGEVVPGPFKWLDLHFGRSPRERSLQ

SEQ ID NO: 1328021 - protein, 25 aa, Mycobacterium
TFGPMTEVWYRLGKTYRGKAQNLTQ

SEQ ID NO: 1328022 - protein, 19 aa, Mycobacterium
TFGRIGVKVWIYKGDIVGG

SEQ ID NO: 1328023 - protein, 17 aa, Mycobacterium
TFHDLGEMLSDPRYRDW

SEQ ID NO: 1328024 - protein, 19 aa, Mycobacterium
TFISNGLLSKLVLTAVKTD

SEQ ID NO: 1328025 - protein, 27 aa, Mycobacterium
TFKTALWELIWTGWVTGDTFAPVRAIL

SEQ ID NO: 1328026 - protein, 17 aa, Mycobacterium
TFLILDGAAFMMQAMHP

SEQ ID NO: 1328027 - protein, 22 aa, Mycobacterium
TFMSIFAVMIQNHFFQHVDVGL

SEQ ID NO: 1328028 - protein, 27 aa, Mycobacterium
TFNAGEKVVLWYPAANRDPAVFDNPET

SEQ ID NO: 1328029 - protein, 28 aa, Mycobacterium
TFNHGKWLPYYADLIERSAPFPPPPPGF

SEQ ID NO: 1328030 - protein, 24 aa, Mycobacterium
TFQAAFPLKGKPPNVYGFALSKAR

SEQ ID NO: 1328031 - protein, 19 aa, Mycobacterium
TFQARLLARAPRPAQATLA

SEQ ID NO: 1328032 - protein, 20 aa, Mycobacterium
TFRARAVILAMGAAARHLGV

SEQ ID NO: 1328033 - protein, 18 aa, Mycobacterium
TFRRLNGSIYAGLPALVV

SEQ ID NO: 1328034 - protein, 25 aa, Mycobacterium
TFSDTERWWLDRMVSVIASSAGIRV

SEQ ID NO: 1328035 - protein, 26 aa, Mycobacterium
TFSDTERWWLDRMVSVIASSAGIRVE

SEQ ID NO: 1328036 - protein, 19 aa, Mycobacterium
TFSMVRLTELPAGMPVAVV

SEQ ID NO: 1328037 - protein, 25 aa, Mycobacterium
TFSRGTAYALTWALAHQARVRSLSI

SEQ ID NO: 1328038 - protein, 23 aa, Mycobacterium
TFTAAGLPGAYFRVIEPGTVGAG

SEQ ID NO: 1328039 - protein, 25 aa, Mycobacterium
TFTEAALRALQAHGLIPSTAPDAAG

SEQ ID NO: 1328040 - protein, 24 aa, Mycobacterium
TFTICSFWLVSALVEIGEIHRARH

SEQ ID NO: 1328041 - protein, 17 aa, Mycobacterium
TFTIEPMINLGGLDYEI

SEQ ID NO: 1328042 - protein, 17 aa, Mycobacterium
TFTLTGAALDVNFAHED

SEQ ID NO: 1328043 - protein, 17 aa, Mycobacterium
TFTTHPHPTHLGQEFIF

SEQ ID NO: 1328044 - protein, 18 aa, Mycobacterium
TFVARRLLADPIAMVIST

SEQ ID NO: 1328045 - protein, 18 aa, Mycobacterium
TFVDSLGGLWAQGKLADK

SEQ ID NO: 1328046 - protein, 19 aa, Mycobacterium
TFVRLGNPVARMVWAKVLP

SEQ ID NO: 1328047 - protein, 24 aa, Mycobacterium
TFVYKGMLTTPQLKAFYLDLQDER

SEQ ID NO: 1328048 - protein, 21 aa, Mycobacterium
TFYEWVLGPSMTYTCACYPHP

SEQ ID NO: 1328049 - protein, 32 aa, Mycobacterium
TGADELAEPALPGRWPFVRGGDALRDVKSGWK

SEQ ID NO: 1328050 - protein, 30 aa, Mycobacterium
TGADGTYCFWAITPTPYPIPHDGPVGEMLE

SEQ ID NO: 1328051 - protein, 30 aa, Mycobacterium
TGAHLPFEGLRVLDLTTFWAGPSCTHILAL

SEQ ID NO: 1328052 - protein, 18 aa, Mycobacterium
TGAKRWVGAWRRTQRRGS

SEQ ID NO: 1328053 - protein, 17 aa, Mycobacterium
TGALLELNRLFMAWVET

SEQ ID NO: 1328054 - protein, 21 aa, Mycobacterium
TGALRVLELHPLMNPAAYVSV

SEQ ID NO: 1328055 - protein, 18 aa, Mycobacterium
TGALTYYGLTPRDSRSAS

SEQ ID NO: 1328056 - protein, 17 aa, Mycobacterium
TGARLIRRMQPSGSVAR

SEQ ID NO: 1328057 - protein, 19 aa, Mycobacterium
TGARSIPALVAWKLGLSSK

SEQ ID NO: 1328058 - protein, 22 aa, Mycobacterium
TGATRPWQFGDTEPWNVTRTVT

SEQ ID NO: 1328059 - protein, 26 aa, Mycobacterium
TGAVILDHWGIIKADIGIRDGRIVAI

SEQ ID NO: 1328060 - protein, 26 aa, Mycobacterium
TGAWIRLHRRFDIDAMLRHIESDRIT

SEQ ID NO: 1328061 - protein, 28 aa, Mycobacterium
TGDELRATLLQLLGSPALCSRAFITEQY

SEQ ID NO: 1328062 - protein, 22 aa, Mycobacterium
TGDGHALALRAGSGLINMEFIQ

SEQ ID NO: 1328063 - protein, 23 aa, Mycobacterium
TGDGLGIVFRKGLPLEDMEFHQF

SEQ ID NO: 1328064 - protein, 23 aa, Mycobacterium
TGDRFASIRDPFGVRWTVMTRVE

SEQ ID NO: 1328065 - protein, 18 aa, Mycobacterium
TGDRFRFPYAIDLDGDCV

SEQ ID NO: 1328066 - protein, 24 aa, Mycobacterium
TGDVTLPAALPRALHPLARATARR

SEQ ID NO: 1328067 - protein, 23 aa, Mycobacterium
TGDYLAELTMLILGRDRMKNPDR

SEQ ID NO: 1328068 - protein, 26 aa, Mycobacterium
TGEAQLDLVLAILRARQLFGGEQTVP

SEQ ID NO: 1328069 - protein, 17 aa, Mycobacterium
TGEAYEPFFRDSWQHVR

SEQ ID NO: 1328070 - protein, 27 aa, Mycobacterium
TGEFDVFDYFYFGLGDLVDAGALTDLT

SEQ ID NO: 1328071 - protein, 27 aa, Mycobacterium
TGENHAYRMWLPPLADPTPVNELIARD

SEQ ID NO: 1328072 - protein, 33 aa, Mycobacterium
TGEPIWSDWYAGRPLLVTANDYGLRLYNGDTGV

SEQ ID NO: 1328073 - protein, 26 aa, Mycobacterium
TGEQRVFFGWAQVWRTKSREAEAIRR

SEQ ID NO: 1328074 - protein, 20 aa, Mycobacterium
TGFKWLSRADDDLPGKTMVY

SEQ ID NO: 1328075 - protein, 28 aa, Mycobacterium
TGGAGGVGGKGIQGGQGLQGGQGGDGGT

SEQ ID NO: 1328076 - protein, 27 aa, Mycobacterium
TGGFRGDMLAVLRAWAALFTGDSAALM

SEQ ID NO: 1328077 - protein, 22 aa, Mycobacterium
TGGIEVLFFPQTYSMFGAEIAD

SEQ ID NO: 1328078 - protein, 22 aa, Mycobacterium
TGGLEIALYCDILIASEQARFA

SEQ ID NO: 1328079 - protein, 24 aa, Mycobacterium
TGGLEMALGCDFLIASHRAVFADT

SEQ ID NO: 1328080 - protein, 28 aa, Mycobacterium
TGGMGAYTPLPWLPADVTRRIVDEIVKP

SEQ ID NO: 1328081 - protein, 23 aa, Mycobacterium
TGGPLREWLHKQRTGMPHVTWKF

SEQ ID NO: 1328082 - protein, 24 aa, Mycobacterium
TGGRYSVQSYLEHQGRKLLARFDA

SEQ ID NO: 1328083 - protein, 20 aa, Mycobacterium
TGGSGGVPPPIGVPAGTPGT

SEQ ID NO: 1328084 - protein, 23 aa, Mycobacterium
TGGTVVPLPLPPPDGYAAGADGN

SEQ ID NO: 1328085 - protein, 25 aa, Mycobacterium
TGHAEYAFRHPLIRTVAYESQLRSD

SEQ ID NO: 1328086 - protein, 38 aa, Mycobacterium
TGHASFWDSMRFLTDTPTYFLLAPRSGGPVRTVETDAF

SEQ ID NO: 1328087 - protein, 27 aa, Mycobacterium
TGHASWRSVLWARWPSAGPPPHFDSAD

SEQ ID NO: 1328088 - protein, 24 aa, Mycobacterium
TGHGKRWETLFTRHLPDVTALAPD

SEQ ID NO: 1328089 - protein, 27 aa, Mycobacterium
TGHPQVDAFLWVKRPGESDGSCGGGAP

SEQ ID NO: 1328090 - protein, 25 aa, Mycobacterium
TGIDLPGVLSVQVIPGASAAATAAA

SEQ ID NO: 1328091 - protein, 20 aa, Mycobacterium
TGIDLVRAQLLVAAGHPIPS

SEQ ID NO: 1328092 - protein, 26 aa, Mycobacterium
TGIDPYFDDLFLMSAQKRLLSVERVV

SEQ ID NO: 1328093 - protein, 20 aa, Mycobacterium
TGIDPYFDDLFLMSAQKRLM

SEQ ID NO: 1328094 - protein, 22 aa, Mycobacterium
TGIDPYFDDLFLMSAQNRLMSV

SEQ ID NO: 1328095 - protein, 20 aa, Mycobacterium
TGIRLRLFHGRGGTVGRGGG

SEQ ID NO: 1328096 - protein, 22 aa, Mycobacterium
TGIWSGLFLTRLGGHHQYSSGS

SEQ ID NO: 1328097 - protein, 25 aa, Mycobacterium
TGKSTIAAALALALAAGGRKVLLVE

SEQ ID NO: 1328098 - protein, 17 aa, Mycobacterium
TGKTAAFAIPILSKIDT

SEQ ID NO: 1328099 - protein, 23 aa, Mycobacterium
TGLALTGLDLRPATSLRHCLDLL

SEQ ID NO: 1328100 - protein, 21 aa, Mycobacterium
TGLANLRRALDAPSALRDYGM

SEQ ID NO: 1328101 - protein, 21 aa, Mycobacterium
TGLEPIEFWESFRVGHRGYAH

SEQ ID NO: 1328102 - protein, 22 aa, Mycobacterium
TGLESTLRFLLSGKSAYVDGQV

SEQ ID NO: 1328103 - protein, 18 aa, Mycobacterium
TGLFHLRVVQLSGNATLS

SEQ ID NO: 1328104 - protein, 27 aa, Mycobacterium
TGLGWQPEIWRAFAEELGILGAALPEE

SEQ ID NO: 1328105 - protein, 20 aa, Mycobacterium
TGLITVKDFVKTEQFPLATK

SEQ ID NO: 1328106 - protein, 28 aa, Mycobacterium
TGLLADGPVVLFFYPAAMTPGCTKEACH

SEQ ID NO: 1328107 - protein, 27 aa, Mycobacterium
TGLLKPSRLHILPTRDFHDQALEPVTL

SEQ ID NO: 1328108 - protein, 19 aa, Mycobacterium
TGLPAAELVTPLLAGTTLE

SEQ ID NO: 1328109 - protein, 18 aa, Mycobacterium
TGLPLELLVELQAKAREL

SEQ ID NO: 1328110 - protein, 20 aa, Mycobacterium
TGLPRHFVDALDAIDGQTHG

SEQ ID NO: 1328111 - protein, 25 aa, Mycobacterium
TGLVAFSLHYPWSHRLTVHSLDGTT

SEQ ID NO: 1328112 - protein, 34 aa, Mycobacterium
TGMAGHDVLLAPTLLTPPPPYALLDQPRGTTRAF

SEQ ID NO: 1328113 - protein, 23 aa, Mycobacterium
TGMGGIEELAFAYDHLREHHLEL

SEQ ID NO: 1328114 - protein, 25 aa, Mycobacterium
TGMGKTFAFGVPLLHRITTDTERPL

SEQ ID NO: 1328115 - protein, 20 aa, Mycobacterium
TGMPYGPKVFARYDDFSFNQ

SEQ ID NO: 1328116 - protein, 24 aa, Mycobacterium
TGNGLPFKIRDIPVAPDITGLLCS

SEQ ID NO: 1328117 - protein, 31 aa, Mycobacterium
TGNPIVLVDFWASWCGPCRAFAPVFERSSQT

SEQ ID NO: 1328118 - protein, 24 aa, Mycobacterium
TGNPPWVMAPMIATAEEAKSFADR

SEQ ID NO: 1328119 - protein, 17 aa, Mycobacterium
TGPLLSSALRHAVTLVV

SEQ ID NO: 1328120 - protein, 30 aa, Mycobacterium
TGPTAARLFYAYAETLLALGREAEALQWFL

SEQ ID NO: 1328121 - protein, 18 aa, Mycobacterium
TGPTQKFMAIWRASKPVI

SEQ ID NO: 1328122 - protein, 23 aa, Mycobacterium
TGQDYTWFVLNSRIIAKEFGLSG

SEQ ID NO: 1328123 - protein, 17 aa, Mycobacterium
TGQIADALMRRLDPRGV

SEQ ID NO: 1328124 - protein, 20 aa, Mycobacterium
TGQKVWTSLAHLCEWGLATV

SEQ ID NO: 1328125 - protein, 17 aa, Mycobacterium
TGQLPAGAAWAVDLVDP

SEQ ID NO: 1328126 - protein, 17 aa, Mycobacterium
TGQRYRWVSELDGSAMD

SEQ ID NO: 1328127 - protein, 27 aa, Mycobacterium
TGQSLVLAFVASFRPALQGTPAPPTVS

SEQ ID NO: 1328128 - protein, 19 aa, Mycobacterium
TGQVMTLLFTNGADINHDI

SEQ ID NO: 1328129 - protein, 17 aa, Mycobacterium
TGQVWPGDLLSFGGRVT

SEQ ID NO: 1328130 - protein, 17 aa, Mycobacterium
TGRALTPAVVWQDRRAE

SEQ ID NO: 1328131 - protein, 32 aa, Mycobacterium
TGRELLDLHYAPPFPYFMDSPNAFRVLPGEFV

SEQ ID NO: 1328132 - protein, 30 aa, Mycobacterium; identical to SEQ ID NO: 866213

SEQ ID NO: 1328133 - protein, 25 aa, Mycobacterium
TGRHADILVLLSRHPEGLSADHLAV

SEQ ID NO: 1328134 - protein, 18 aa, Mycobacterium
TGRILTWGNVAIGMRNAV

SEQ ID NO: 1328135 - protein, 20 aa, Mycobacterium
TGRLRHFRSAALPYAAMVHD

SEQ ID NO: 1328136 - protein, 17 aa, Mycobacterium
TGRLWERFSRELSRYGL

SEQ ID NO: 1328137 - protein, 17 aa, Mycobacterium
TGRPRLDPWRSRLAADP

SEQ ID NO: 1328138 - protein, 19 aa, Mycobacterium
TGRPVPVSAATLIAVLDAL

SEQ ID NO: 1328139 - protein, 24 aa, Mycobacterium
TGRRGKYLWLTLDGGDEPLARRAE

SEQ ID NO: 1328140 - protein, 23 aa, Mycobacterium
TGRTALPGFGRHLQLARPGGPVL

SEQ ID NO: 1328141 - protein, 27 aa, Mycobacterium
TGRYLGCVHLQRLLREPPAGLVSGIVD

SEQ ID NO: 1328142 - protein, 24 aa, Mycobacterium
TGSAGDMYLLHPFTVHAADEHRGR

SEQ ID NO: 1328143 - protein, 18 aa, Mycobacterium
TGSARFRNLIKAEDYDTA

SEQ ID NO: 1328144 - protein, 25 aa, Mycobacterium
TGSFRWASARAHRLAARLLEIGVDN

SEQ ID NO: 1328145 - protein, 19 aa, Mycobacterium
TGSFYHYFANWSAYTRELV

SEQ ID NO: 1328146 - protein, 27 aa, Mycobacterium
TGSGKTLAAFLWAIDGLAREPAAQRGT

SEQ ID NO: 1328147 - protein, 24 aa, Mycobacterium
TGSGPITAIPKALELAGRKLEDVA

SEQ ID NO: 1328148 - protein, 26 aa, Mycobacterium
TGSMFFTPIMDFLNNPPPLPNSASDT

SEQ ID NO: 1328149 - protein, 26 aa, Mycobacterium
TGSRVPMCFGFHPYLQLPGIPRAQWT

SEQ ID NO: 1328150 - protein, 25 aa, Mycobacterium
TGSSTYWYARHLRLPPGVPAHLSGY

SEQ ID NO: 1328151 - protein, 27 aa, Mycobacterium
TGSVTYRYTWHLPKNRTWTYDGQLNLV

SEQ ID NO: 1328152 - protein, 21 aa, Mycobacterium
TGTACNGGRGGLLWGNGGDGA

SEQ ID NO: 1328153 - protein, 23 aa, Mycobacterium
TGTAVLGMFAGLEVGVWEMTEGV

SEQ ID NO: 1328154 - protein, 18 aa, Mycobacterium
TGTPLPPLWESTAAAQAQ

SEQ ID NO: 1328155 - protein, 21 aa, Mycobacterium
TGTTILFDLLAQDPALRPPLT

SEQ ID NO: 1328156 - protein, 23 aa, Mycobacterium
TGTYAVNMYAFDPCAPFGGFKNS

SEQ ID NO: 1328157 - protein, 25 aa, Mycobacterium
TGVDDAMALVYLFGSPDADLVGIAS

SEQ ID NO: 1328158 - protein, 19 aa, Mycobacterium
TGVDIRRFAPFNGNNRWLH

SEQ ID NO: 1328159 - protein, 24 aa, Mycobacterium
TGVDPGFVTDLLPLALASTCQSVS

SEQ ID NO: 1328160 - protein, 25 aa, Mycobacterium
TGVGLAIVAQQRGYKCIFVCPDKVS

SEQ ID NO: 1328161 - protein, 25 aa, Mycobacterium
TGVGLALVAQQRGYKCIFVCPDKVS

SEQ ID NO: 1328162 - protein, 17 aa, Mycobacterium
TGVPGVVLPPDAASTPL

SEQ ID NO: 1328163 - protein, 37 aa, Mycobacterium
TGVRALSDQPLDWSFKGIPARWWGRTPAQIVAQRPEL

SEQ ID NO: 1328164 - protein, 28 aa, Mycobacterium
TGVSDEEFVRFQKAWFAELHSAGYAVPH

SEQ ID NO: 1328165 - protein, 25 aa, Mycobacterium
TGVVRYTIMMLRRKLGDPPVVETEP

SEQ ID NO: 1328166 - protein, 25 aa, Mycobacterium
TGWTRYSLLETLRAYGRNLLRENAI

SEQ ID NO: 1328167 - protein, 24 aa, Mycobacterium
TGYAYSLLSPPITAIYQLTDILNV

SEQ ID NO: 1328168 - protein, 21 aa, Mycobacterium
TGYLDWLPAALAATHRKRRMR

SEQ ID NO: 1328169 - protein, 21 aa, Mycobacterium
TGYRGDMAFSALIVGGGSSEY

SEQ ID NO: 1328170 - protein, 18 aa, Mycobacterium
TGYRHHWGGPYPVLSDRR

SEQ ID NO: 1328171 - protein, 17 aa, Mycobacterium
THAIVLPHVLAFNVSNA

SEQ ID NO: 1328172 - protein, 28 aa, Mycobacterium
THARVGLMPTWGLSVRLPQKVGVGMARR

SEQ ID NO: 1328173 - protein, 32 aa, Mycobacterium
THFAGVLTVVLKLFNTVRPDRAYFGEKDFQQL

SEQ ID NO: 1328174 - protein, 18 aa, Mycobacterium
THGAGAFAVFRPVRNPKP

SEQ ID NO: 1328175 - protein, 35 aa, Mycobacterium
THGVHANPFTLFPRIIVSMAWLPGPRAQRQLRDAL

SEQ ID NO: 1328176 - protein, 36 aa, Mycobacterium
THGVHANPFTLFPRIIVSMAWLPGPRAQRQLRDALI

SEQ ID NO: 1328177 - protein, 20 aa, Mycobacterium
THHFKVLREAGVTERLVIDG

SEQ ID NO: 1328178 - protein, 21 aa, Mycobacterium
THHGIVAYLNDPARKGKVGFE

SEQ ID NO: 1328179 - protein, 23 aa, Mycobacterium
THHRSAITGKFVKGSTAARHPNT

SEQ ID NO: 1328180 - protein, 32 aa, Mycobacterium
THITGSLKHRLARSLFLYALCNGWIGEDTTVI

SEQ ID NO: 1328181 - protein, 18 aa, Mycobacterium
THKLPFGGVGPSGMGAYH

SEQ ID NO: 1328182 - protein, 31 aa, Mycobacterium; identical to SEQ ID NO: 866460

SEQ ID NO: 1328183 - protein, 21 aa, Mycobacterium
THLRPLLFTIAYEILGSATES

SEQ ID NO: 1328184 - protein, 17 aa, Mycobacterium
THLWERLSIDFDDFTDE

SEQ ID NO: 1328185 - protein, 24 aa, Mycobacterium
THMATLLRGWSDDVVLLTGGPAEL

SEQ ID NO: 1328186 - protein, 19 aa, Mycobacterium
THPAVVRAAILVALDAPAR

SEQ ID NO: 1328187 - protein, 20 aa, Mycobacterium
THPAVVRAAILVALDAPARS

SEQ ID NO: 1328188 - protein, 26 aa, Mycobacterium
THPDGTSAFALWFTGGIFVDDHGRRF

SEQ ID NO: 1328189 - protein, 21 aa, Mycobacterium
THPLRSDIPIMLGAEGPKNVA

SEQ ID NO: 1328190 - protein, 24 aa, Mycobacterium
THPQYLVMLSLWDQQKRSSGRPSP

SEQ ID NO: 1328191 - protein, 25 aa, Mycobacterium
THRELIMLQDRLLKDPPRPLGEQFR

SEQ ID NO: 1328192 - protein, 25 aa, Mycobacterium
THTVDWHLRKVFVKLGITSRRQLRS

SEQ ID NO: 1328193 - protein, 30 aa, Mycobacterium
THVRIIQEFVKKLPAWVSWERRDHYERDLV

SEQ ID NO: 1328194 - protein, 19 aa, Mycobacterium
THVVALCGEVFPVTRSAKP

SEQ ID NO: 1328195 - protein, 25 aa, Mycobacterium
THYLRVYLAQLRRKLEDDPSHPVHL

SEQ ID NO: 1328196 - protein, 29 aa, Mycobacterium
TIAMPSTPANYFHLLRRHGLDGIHRPLIV

SEQ ID NO: 1328197 - protein, 22 aa, Mycobacterium
TIATPYLIQPLSHGADIVVHSA

SEQ ID NO: 1328198 - protein, 22 aa, Mycobacterium
TIAVEPFRKWWQPGPGEGCIGF

SEQ ID NO: 1328199 - protein, 22 aa, Mycobacterium
TIDAIFLDINMPGLSGIELAGV

SEQ ID NO: 1328200 - protein, 22 aa, Mycobacterium
TIDALSPFLRNASPAAVVNITS

SEQ ID NO: 1328201 - protein, 22 aa, Mycobacterium
TIDAVFLDINMPGLSGIELAGV

SEQ ID NO: 1328202 - protein, 19 aa, Mycobacterium
TIDQAFLWAREFHVSTGDG

SEQ ID NO: 1328203 - protein, 18 aa, Mycobacterium
TIDRVGLLARLTAVFERD

SEQ ID NO: 1328204 - protein, 26 aa, Mycobacterium
TIDVAYRYFATAKRKFIIADTPGHIQ

SEQ ID NO: 1328205 - protein, 34 aa, Mycobacterium
TIEAIAAGNLKGIRKWVWERLAGTLFAQKATDAL

SEQ ID NO: 1328206 - protein, 17 aa, Mycobacterium
TIEFLRDVGKYFSVNVM

SEQ ID NO: 1328207 - protein, 28 aa, Mycobacterium
TIEMERIFGRAWVFLGHESELAKSGDFV

SEQ ID NO: 1328208 - protein, 24 aa, Mycobacterium
TIGAPRWDTAIIGLDWETSVLDER

SEQ ID NO: 1328209 - protein, 26 aa, Mycobacterium
TIGDRTYLLEYPISGDFALIAADTAD

SEQ ID NO: 1328210 - protein, 23 aa, Mycobacterium
TIGELKLSLFDDIFNTPAGQEFG

SEQ ID NO: 1328211 - protein, 26 aa, Mycobacterium
TIGGDHTIALPLLRAAHATHGPVALV

SEQ ID NO: 1328212 - protein, 28 aa, Mycobacterium
TIGGGAYPRPGLFGKFFDSRARPLVEVV

SEQ ID NO: 1328213 - protein, 22 aa, Mycobacterium
TIGRRLAKTLQLPLLDTDVAIE

SEQ ID NO: 1328214 - protein, 25 aa, Mycobacterium
TIGSLAPKMPWPWGAVDFACRALRP

SEQ ID NO: 1328215 - protein, 27 aa, Mycobacterium
TIHEHKVNLLFFTGDAMARPLLDALLA

SEQ ID NO: 1328216 - protein, 19 aa, Mycobacterium
TIHKLALPDRLLTATSDDA

SEQ ID NO: 1328217 - protein, 26 aa, Mycobacterium
TIIDGYLHEIMFHALAQLSSNLRDFG

SEQ ID NO: 1328218 - protein, 17 aa, Mycobacterium
TIIEYYLGEKPLLANVD

SEQ ID NO: 1328219 - protein, 23 aa, Mycobacterium
TILEIVDDIFLPLATHFGTNITR

SEQ ID NO: 1328220 - protein, 25 aa, Mycobacterium
TILPQVWAMRYTLERVIRGQDTIAV

SEQ ID NO: 1328221 - protein, 18 aa, Mycobacterium
TILRPHTGGEKRVSASGD

SEQ ID NO: 1328222 - protein, 18 aa, Mycobacterium
TILRTHTGGEKRVSASGG

SEQ ID NO: 1328223 - protein, 35 aa, Mycobacterium
TIMAGLFIKEALARGWIRRCLIVVPGSLVEQWQNE

SEQ ID NO: 1328224 - protein, 26 aa, Mycobacterium
TIMETPPSPFTLIPGVGESGSAAATA

SEQ ID NO: 1328225 - protein, 20 aa, Mycobacterium
TIPAGRKVLLLYGSANRDER

SEQ ID NO: 1328226 - protein, 26 aa, Mycobacterium
TIPAHKPVFLMKAAANRDPRAFDNAE

SEQ ID NO: 1328227 - protein, 27 aa, Mycobacterium
TIPGAVHIPLAQLRARLAHLPSDRPIV

SEQ ID NO: 1328228 - protein, 19 aa, Mycobacterium
TIPGSLEQVIWQNPNTGGK

SEQ ID NO: 1328229 - protein, 17 aa, Mycobacterium
TIPLPGPGPGQTAYVFT

SEQ ID NO: 1328230 - protein, 21 aa, Mycobacterium
TIRERFGGRLRFFVSAAAPLN

SEQ ID NO: 1328231 - protein, 18 aa, Mycobacterium
TIREVLELRLQLPTPEKA

SEQ ID NO: 1328232 - protein, 18 aa, Mycobacterium
TIRPAPDTMAYVTALLPV

SEQ ID NO: 1328233 - protein, 32 aa, Mycobacterium
TIRTNPIVLVDFWASWCGPCRSFAPVFDRSSQ

SEQ ID NO: 1328234 - protein, 19 aa, Mycobacterium
TIRWMLDEPRRPFSWCQGA

SEQ ID NO: 1328235 - protein, 21 aa, Mycobacterium
TIRYLMFSVFAVTPGALDTAD

SEQ ID NO: 1328236 - protein, 36 aa, Mycobacterium
TISTYHAFAGNLLREFGLLLPVEPDTRLLGETELWQ

SEQ ID NO: 1328237 - protein, 26 aa, Mycobacterium
TITEVYDYLRLLYARAGMPHCPVCGE

SEQ ID NO: 1328238 - protein, 17 aa, Mycobacterium
TITSAITSPMTVSTARP

SEQ ID NO: 1328239 - protein, 20 aa, Mycobacterium
TIVATLAALPGYRRDHLRDD

SEQ ID NO: 1328240 - protein, 18 aa, Mycobacterium
TIVVLGRPITAEAFGVVA

SEQ ID NO: 1328241 - protein, 24 aa, Mycobacterium
TIYPDLPVVDNVRYFAALSGTDRQ

SEQ ID NO: 1328242 - protein, 29 aa, Mycobacterium
TKADSLVIGGGMCFTFLAAQGLSVGSSLL

SEQ ID NO: 1328243 - protein, 23 aa, Mycobacterium
TKAKELGLTPLARIVSTGVSGLS

SEQ ID NO: 1328244 - protein, 32 aa, Mycobacterium
TKDDVFSEEFLLTRPLLTAIRRTEPTVLLIDE

SEQ ID NO: 1328245 - protein, 24 aa, Mycobacterium
TKEELFLAVMERQLQRFLDGFTDI

SEQ ID NO: 1328246 - protein, 24 aa, Mycobacterium
TKGHPKKMWRPKVPISIAVGKPIE

SEQ ID NO: 1328247 - protein, 23 aa, Mycobacterium
TKGKLFEYYLAVADRMVALLRDR

SEQ ID NO: 1328248 - protein, 24 aa, Mycobacterium
TKGSLYYHFRAREDLLRALVGPLI

SEQ ID NO: 1328249 - protein, 22 aa, Mycobacterium
TKIERRGWHALLTLALNGDVDL

SEQ ID NO: 1328250 - protein, 24 aa, Mycobacterium
TKKLPSWKVVVPPGQAVAGYYYQA

SEQ ID NO: 1328251 - protein, 25 aa, Mycobacterium
TKLAPKQLIVDELLYRELQDRYGEY

SEQ ID NO: 1328252 - protein, 25 aa, Mycobacterium
TKLDIRKWTFLNTDLAVHIHRVPGG

SEQ ID NO: 1328253 - protein, 29 aa, Mycobacterium
TKLGHYTHFGNLLDLLGAAIPLGATADGR

SEQ ID NO: 1328254 - protein, 22 aa, Mycobacterium
TKLLETYAVPPLLHNQALAIGV

SEQ ID NO: 1328255 - protein, 20 aa, Mycobacterium
TKLMNAVTQHAIRLSKGLIN

SEQ ID NO: 1328256 - protein, 18 aa, Mycobacterium
TKMEIFGVGYRVVAKGSN

SEQ ID NO: 1328257 - protein, 20 aa, Mycobacterium
TKPLHEWLEALRTGIDQLTA

SEQ ID NO: 1328258 - protein, 20 aa, Mycobacterium
TKPLWEMWVIEGCAKADTLA

SEQ ID NO: 1328259 - protein, 35 aa, Mycobacterium; identical to SEQ ID NO: 866833

SEQ ID NO: 1328260 - protein, 25 aa, Mycobacterium
TKQMISVVLFRDGAPMRHFPIAAKG

SEQ ID NO: 1328261 - protein, 20 aa, Mycobacterium
TKRFAPFVPLLASKLGNNTG

SEQ ID NO: 1328262 - protein, 23 aa, Mycobacterium
TKTPLEYLYDVFATYVEERRAEP

SEQ ID NO: 1328263 - protein, 17 aa, Mycobacterium
TKVICSFPRQADSYVFD

SEQ ID NO: 1328264 - protein, 18 aa, Mycobacterium
TKVICSFPRQADSYVFDA

SEQ ID NO: 1328265 - protein, 21 aa, Mycobacterium
TLADAICEVLPSAKLSDILIG

SEQ ID NO: 1328266 - protein, 25 aa, Mycobacterium
TLADHAAEWRGLFDAGLVASVLTVQ

SEQ ID NO: 1328267 - protein, 17 aa, Mycobacterium
TLADLAFAWRTCRAVKS

SEQ ID NO: 1328268 - protein, 17 aa, Mycobacterium
TLADLLPTGYEVGAING

SEQ ID NO: 1328269 - protein, 20 aa, Mycobacterium
TLADQVLTLLQLRSRTRQTA

SEQ ID NO: 1328270 - protein, 19 aa, Mycobacterium
TLADSQVFYAIPYAAAPEG

SEQ ID NO: 1328271 - protein, 24 aa, Mycobacterium
TLAGIDSVLLPIAKRRDIWAQIES

SEQ ID NO: 1328272 - protein, 19 aa, Mycobacterium
TLAGLFDPMLAVATSDVRP

SEQ ID NO: 1328273 - protein, 34 aa, Mycobacterium
TLAGPNQLRAFLWWLLRLRPDLEIYLLKSNLGLI

SEQ ID NO: 1328274 - protein, 17 aa, Mycobacterium
TLAGTLAPTGALPGGER

SEQ ID NO: 1328275 - protein, 22 aa, Mycobacterium
TLALLTDLLERFDVPVLAAGGI

SEQ ID NO: 1328276 - protein, 18 aa, Mycobacterium
TLALPRYRLADYDNPRAP

SEQ ID NO: 1328277 - protein, 18 aa, Mycobacterium
TLAMDIGCVFSIDTDSHA

SEQ ID NO: 1328278 - protein, 31 aa, Mycobacterium
TLAPTGYSWGPLAWMLLAQALGRLDQTVDAG

SEQ ID NO: 1328279 - protein, 27 aa, Mycobacterium
TLAQATIPSFLRYGTYPQIVVVREQSG

SEQ ID NO: 1328280 - protein, 32 aa, Mycobacterium
TLARHPDLTARFLPFSTYLTEQSTLPARLREL

SEQ ID NO: 1328281 - protein, 28 aa, Mycobacterium
TLATITLQNYFRLYDRLAGMTGTARSEA

SEQ ID NO: 1328282 - protein, 23 aa, Mycobacterium
TLAVDDPVLYYQCPVDYTAQCGF

SEQ ID NO: 1328283 - protein, 26 aa, Mycobacterium
TLAVIHALNQWMLEHWGFDYQGRVFS

SEQ ID NO: 1328284 - protein, 19 aa, Mycobacterium
TLAVRAFAQMFPSRRLGGG

SEQ ID NO: 1328285 - protein, 19 aa, Mycobacterium
TLCRSRHSANRHGRSTSAG

SEQ ID NO: 1328286 - protein, 17 aa, Mycobacterium
TLDAIPELIKPAAVEVF

SEQ ID NO: 1328287 - protein, 18 aa, Mycobacterium
TLDALTLTALQAAIAAAV

SEQ ID NO: 1328288 - protein, 21 aa, Mycobacterium
TLDCRWWRRDLGGKMVRFVVC

SEQ ID NO: 1328289 - protein, 30 aa, Mycobacterium
TLDDINEYLFQFALSTAWMNGIPGGRAAKL

SEQ ID NO: 1328290 - protein, 36 aa, Mycobacterium
TLDEVFAMLVGLGDPVLWAVPLHWAGVHAGILANSP

SEQ ID NO: 1328291 - protein, 18 aa, Mycobacterium
TLDRVSGGRLTLGVGVGS

SEQ ID NO: 1328292 - protein, 29 aa, Mycobacterium
TLDSFVEIGLGYLSLDRPAGTLSGGEAQR

SEQ ID NO: 1328293 - protein, 27 aa, Mycobacterium
TLDWDDELLGFFDIPRQMLPEIRPSSS

SEQ ID NO: 1328294 - protein, 38 aa, Mycobacterium
TLDYLTPMSQIVRPTFVPAYVVFPTFQAKKGSLNQAWV

SEQ ID NO: 1328295 - protein, 24 aa, Mycobacterium
TLEAKRFPHIIFRSDRIAKTDDGY

SEQ ID NO: 1328296 - protein, 30 aa, Mycobacterium
TLEELKSLGLRTFLLPLNPGKDDDGNIYDY

SEQ ID NO: 1328297 - protein, 22 aa, Mycobacterium
TLETLLTRLNLPDDVPIEAKMV

SEQ ID NO: 1328298 - protein, 22 aa, Mycobacterium
TLFKTIIGLVRPDTGRVLINGG

SEQ ID NO: 1328299 - protein, 22 aa, Mycobacterium
TLGALGGPFDRGQRLGDSGMRG

SEQ ID NO: 1328300 - protein, 25 aa, Mycobacterium
TLGEAGLLSLPYPEEWGGGGQPYEV

SEQ ID NO: 1328301 - protein, 22 aa, Mycobacterium
TLGFVARRLLAEPVVMVFAVRD

SEQ ID NO: 1328302 - protein, 18 aa, Mycobacterium
TLGILGYGRIGRAVARRA

SEQ ID NO: 1328303 - protein, 20 aa, Mycobacterium
TLHALAWMIPGEVALFGLDE

SEQ ID NO: 1328304 - protein, 25 aa, Mycobacterium
TLHLEDIWIRNLTITTGLVDTYSTP

SEQ ID NO: 1328305 - protein, 20 aa, Mycobacterium
TLHRHFAGRVALMTALEELA

SEQ ID NO: 1328306 - protein, 17 aa, Mycobacterium
TLHSVKVIPGRGAWLEF

SEQ ID NO: 1328307 - protein, 20 aa, Mycobacterium
TLIMDLARFSQNPRVHLFFG

SEQ ID NO: 1328308 - protein, 24 aa, Mycobacterium
TLIYAVAPTVVSWPMAPLQDTVVE

SEQ ID NO: 1328309 - protein, 26 aa, Mycobacterium
TLKHNPILRMMLGHLLKPGRLREILA

SEQ ID NO: 1328310 - protein, 20 aa, Mycobacterium
TLLAERPFIVLDGPDEYAPL

SEQ ID NO: 1328311 - protein, 18 aa, Mycobacterium
TLLALARFGGQPAVVLGQ

SEQ ID NO: 1328312 - protein, 21 aa, Mycobacterium
TLLNVLVSPPIWYADAPNTVT

SEQ ID NO: 1328313 - protein, 24 aa, Mycobacterium
TLNARANLKWTPQPAMPGQLRAVT

SEQ ID NO: 1328314 - protein, 33 aa, Mycobacterium
TLNARELDWMLHWRKMFDGLQTVGAIPMAIECG

SEQ ID NO: 1328315 - protein, 18 aa, Mycobacterium
TLNFLPMSHVMGRGLLCG

SEQ ID NO: 1328316 - protein, 22 aa, Mycobacterium
TLNGGEFTVFAPTDDAFAKIDP

SEQ ID NO: 1328317 - protein, 20 aa, Mycobacterium
TLPDFPQLWADMLAGQTDLQ

SEQ ID NO: 1328318 - protein, 17 aa, Mycobacterium
TLPELTAVSLRTAQTEP

SEQ ID NO: 1328319 - protein, 17 aa, Mycobacterium
TLPHPYAHARAFVLVPW

SEQ ID NO: 1328320 - protein, 17 aa, Mycobacterium
TLPTLRTLAYGGSKVPL

SEQ ID NO: 1328321 - protein, 20 aa, Mycobacterium
TLPVLLRPDGAVQIGWDPRR

SEQ ID NO: 1328322 - protein, 21 aa, Mycobacterium
TLQAPPKIGIPGRDPDWREAD

SEQ ID NO: 1328323 - protein, 18 aa, Mycobacterium
TLQDALLTTLRKALVEQW

SEQ ID NO: 1328324 - protein, 35 aa, Mycobacterium
TLQFDPVIIKFLASHQPFQAFIARLYAVLVGDAGR

SEQ ID NO: 1328325 - protein, 35 aa, Mycobacterium
TLQFNRIPQPWLREPAKRWIRLRLSRGLGLEAGGG

SEQ ID NO: 1328326 - protein, 17 aa, Mycobacterium
TLQIYLRYESAIAELLG

SEQ ID NO: 1328327 - protein, 17 aa, Mycobacterium
TLRANLELWKDHLGSDT

SEQ ID NO: 1328328 - protein, 18 aa, Mycobacterium
TLREAVDICTDWLHRHGF

SEQ ID NO: 1328329 - protein, 22 aa, Mycobacterium
TLREHIAFPPFPVDHLHNSLAN

SEQ ID NO: 1328330 - protein, 25 aa, Mycobacterium
TLRGMPFVVRLTGCPLVRGLEVDTT

SEQ ID NO: 1328331 - protein, 25 aa, Mycobacterium
TLRPGTAHRIMTGAPLPAGATAVIP

SEQ ID NO: 1328332 - protein, 17 aa, Mycobacterium
TLRRALLVMHSPTDNTV

SEQ ID NO: 1328333 - protein, 21 aa, Mycobacterium
TLRRCDALLLTLRTDRDWIAD

SEQ ID NO: 1328334 - protein, 26 aa, Mycobacterium
TLRRMALFGLTKWRVARRDRGPVRAG

SEQ ID NO: 1328335 - protein, 24 aa, Mycobacterium
TLRRRLDREFGWQATVPRPNQQFS

SEQ ID NO: 1328336 - protein, 27 aa, Mycobacterium
TLRRYKPGEPPLPGALLIAGEGRVVEP

SEQ ID NO: 1328337 - protein, 17 aa, Mycobacterium
TLRYYERAGLIESVERS

SEQ ID NO: 1328338 - protein, 25 aa, Mycobacterium
TLSAWDLKPRRWTSGHLQLMEDFVA

SEQ ID NO: 1328339 - protein, 28 aa, Mycobacterium
TLSENGWKTFFRGLANDGVQGPSVANYL

SEQ ID NO: 1328340 - protein, 18 aa, Mycobacterium
TLSLGMSQRLGIAAALLG

SEQ ID NO: 1328341 - protein, 31 aa, Mycobacterium
TLSSRAPLLAEEWRLLIAAMGRARSRLLVTA

SEQ ID NO: 1328342 - protein, 22 aa, Mycobacterium
TLSTWPQLVGDVLVGAAAVAEA

SEQ ID NO: 1328343 - protein, 22 aa, Mycobacterium
TLSVFEPILRPMHEKIVGRIAV

SEQ ID NO: 1328344 - protein, 18 aa, Mycobacterium
TLSVLRRGFKDLNAQFQM

SEQ ID NO: 1328345 - protein, 25 aa, Mycobacterium
TLSVPLLAAFATVLQRYSGQHDLVI

SEQ ID NO: 1328346 - protein, 28 aa, Mycobacterium
TLSWVDANVWRRIVPKGWFYNVMVTGVK

SEQ ID NO: 1328347 - protein, 18 aa, Mycobacterium
TLTFCEPIGHRPGDGDAL

SEQ ID NO: 1328348 - protein, 19 aa, Mycobacterium
TLTFCEPIGHRPGDGDALE

SEQ ID NO: 1328349 - protein, 18 aa, Mycobacterium
TLTKGDVYTLWAPRWRAD

SEQ ID NO: 1328350 - protein, 21 aa, Mycobacterium
TLTPELIAIRYAAAGKHLTRR

SEQ ID NO: 1328351 - protein, 18 aa, Mycobacterium
TLTPLLHSPLGIAALRNI

SEQ ID NO: 1328352 - protein, 30 aa, Mycobacterium
TLTPPVLRRNILENPAWYTAYTPYQPEISQ

SEQ ID NO: 1328353 - protein, 17 aa, Mycobacterium
TLTRDLAPRYRVRPGLT

SEQ ID NO: 1328354 - protein, 19 aa, Mycobacterium
TLTVEYLRPVPLHQTHRIT

SEQ ID NO: 1328355 - protein, 21 aa, Mycobacterium
TLTYTLRMAAVGRPLQHHLSA

SEQ ID NO: 1328356 - protein, 17 aa, Mycobacterium
TLVALGAEVRWASCNIF

SEQ ID NO: 1328357 - protein, 18 aa, Mycobacterium
TLVHLLTVANGGARPRLT

SEQ ID NO: 1328358 - protein, 18 aa, Mycobacterium
TLVLLESMKMEIPVLAEV

SEQ ID NO: 1328359 - protein, 23 aa, Mycobacterium
TLVRHHLLLPHTATRRDLQDPAT

SEQ ID NO: 1328360 - protein, 27 aa, Mycobacterium
TLVSLLLMILPHLALAPYVRGLDPILG

SEQ ID NO: 1328361 - protein, 24 aa, Mycobacterium
TLVTSFYDWSGIHQQWREAGIFPV

SEQ ID NO: 1328362 - protein, 23 aa, Mycobacterium
TLWASWVIAGPKHRVFFGGDTGY

SEQ ID NO: 1328363 - protein, 25 aa, Mycobacterium
TLWGRNIGQFQLIQLKLARIEVARM

SEQ ID NO: 1328364 - protein, 17 aa, Mycobacterium
TLWKLMDVKERTGIELT

SEQ ID NO: 1328365 - protein, 18 aa, Mycobacterium
TLWPQREALKSALQYPAL

SEQ ID NO: 1328366 - protein, 24 aa, Mycobacterium
TLYRRYPNREALITELGRQTFDFA

SEQ ID NO: 1328367 - protein, 17 aa, Mycobacterium
TLYWAINGPADILDSVP

SEQ ID NO: 1328368 - protein, 25 aa, Mycobacterium
TMEEFQAMQSAWWKIAIDTAGYGRA

SEQ ID NO: 1328369 - protein, 25 aa, Mycobacterium
TMEEFQAMQSAWWKMAIDTAGYGRA

SEQ ID NO: 1328370 - protein, 26 aa, Mycobacterium
TMEETALWLELTYDGTTPVVLTGAQR

SEQ ID NO: 1328371 - protein, 20 aa, Mycobacterium
TMGCLYPGRIFLGVGTGEAL

SEQ ID NO: 1328372 - protein, 18 aa, Mycobacterium
TMKRNLMELGGKSAYLLL

SEQ ID NO: 1328373 - protein, 18 aa, Mycobacterium
TMLATLYAKALDADAPRS

SEQ ID NO: 1328374 - protein, 20 aa, Mycobacterium
TMLTGLRHGVTLGGPIAIEI

SEQ ID NO: 1328375 - protein, 18 aa, Mycobacterium
TMMVLFNIDDYTAWRLLE

SEQ ID NO: 1328376 - protein, 20 aa, Mycobacterium
TMNHLAFHVPAEKFDEYRQR

SEQ ID NO: 1328377 - protein, 19 aa, Mycobacterium
TMNHRLLARLQAESTPQQL

SEQ ID NO: 1328378 - protein, 22 aa, Mycobacterium
TMPAGLARWAAAQLAPAVVPWP

SEQ ID NO: 1328379 - protein, 17 aa, Mycobacterium
TMPISLRASSDAPGGNR

SEQ ID NO: 1328380 - protein, 24 aa, Mycobacterium
TMRRTFRRNLGISPSTYRSRFRTT

SEQ ID NO: 1328381 - protein, 26 aa, Mycobacterium
TMRTPRQDVLPPSDRLRVIALDVTRP

SEQ ID NO: 1328382 - protein, 24 aa, Mycobacterium
TMTLNYYGPLRLIRGLAPGMLERG

SEQ ID NO: 1328383 - protein, 25 aa, Mycobacterium
TMTSVVINPFFQWGSDRPPRTPYHE

SEQ ID NO: 1328384 - protein, 20 aa, Mycobacterium
TMVDQMVAQWPLLQSPDCGQ

SEQ ID NO: 1328385 - protein, 20 aa, Mycobacterium
TMWDAGVLLASRRSWWRIAA

SEQ ID NO: 1328386 - protein, 17 aa, Mycobacterium
TMYSYYRDELGLPEMGL

SEQ ID NO: 1328387 - protein, 25 aa, Mycobacterium
TMYTTTWCGYCTRLKMALKSEGIRW

SEQ ID NO: 1328388 - protein, 32 aa, Mycobacterium
TNAARYVWEVPYYPQYYIPLRDVRPGLLRDDG

SEQ ID NO: 1328389 - protein, 17 aa, Mycobacterium
TNAICNLHLATGAICRP

SEQ ID NO: 1328390 - protein, 27 aa, Mycobacterium
TNAMPAPYQAMILLASWCALRFGELTE

SEQ ID NO: 1328391 - protein, 33 aa, Mycobacterium
TNARAKMSLLRHGFVKIFCRPATGVVIGGVVVA

SEQ ID NO: 1328392 - protein, 27 aa, Mycobacterium
TNATMPYVLKIADKGWRDACRADAALA

SEQ ID NO: 1328393 - protein, 25 aa, Mycobacterium
TNATMPYVLKLADKGWRGACQADPA

SEQ ID NO: 1328394 - protein, 27 aa, Mycobacterium
TNAVYGFTAMLINLLRDEQPTHIAAAF

SEQ ID NO: 1328395 - protein, 25 aa, Mycobacterium
TNCPDILDVPLMAEVLRGLGATVEL

SEQ ID NO: 1328396 - protein, 28 aa, Mycobacterium
TNDPLMQARLFSYLDTQLTRLGGPNFTQ

SEQ ID NO: 1328397 - protein, 24 aa, Mycobacterium
TNELLKLIPTFRQHEERLLICATN

SEQ ID NO: 1328398 - protein, 25 aa, Mycobacterium
TNEPIAVIGLGLRLPGGADLDSNIE

SEQ ID NO: 1328399 - protein, 19 aa, Mycobacterium
TNFVVGDLVVVALPGVVLP

SEQ ID NO: 1328400 - protein, 27 aa, Mycobacterium
TNGDQFLVLRPLLVDYVMSMPRGAQVV

SEQ ID NO: 1328401 - protein, 28 aa, Mycobacterium
TNHLGHFELTRLLFPALVAADGARVVNL

SEQ ID NO: 1328402 - protein, 23 aa, Mycobacterium
TNHSVWFHRQVRFDDWVLYSTTS

SEQ ID NO: 1328403 - protein, 23 aa, Mycobacterium
TNIDLFEQNLWKSYIKTHEALYE

SEQ ID NO: 1328404 - protein, 18 aa, Mycobacterium
TNIPFLQAVIDDPDFRAG

SEQ ID NO: 1328405 - protein, 26 aa, Mycobacterium
TNKLFATVYKEYLMRALPAMASAVSS

SEQ ID NO: 1328406 - protein, 18 aa, Mycobacterium
TNLFLDMVRRRGRIRMEA

SEQ ID NO: 1328407 - protein, 18 aa, Mycobacterium
TNLGKAKAQPLWRVLVAL

SEQ ID NO: 1328408 - protein, 21 aa, Mycobacterium
TNLHHALALATRHLRRHPNAQ

SEQ ID NO: 1328409 - protein, 22 aa, Mycobacterium
TNMLFTMRAAWAEADSCDAGDD

SEQ ID NO: 1328410 - protein, 27 aa, Mycobacterium
TNNKLNVRFFGPPSARPPGNYWIVDLD

SEQ ID NO: 1328411 - protein, 30 aa, Mycobacterium
TNPDAGGATYWWFPPGTTPNAGGRKAWNSH

SEQ ID NO: 1328412 - protein, 20 aa, Mycobacterium
TNQKWLRRDFGDKLPSDVFR

SEQ ID NO: 1328413 - protein, 24 aa, Mycobacterium
TNRCPALPRQWTPHWLRHTHATAL

SEQ ID NO: 1328414 - protein, 26 aa, Mycobacterium
TNREFDLLLFFLTHPDTVFTREDLLK

SEQ ID NO: 1328415 - protein, 20 aa, Mycobacterium
TNSTGWWHTARPLPVGSFTD

SEQ ID NO: 1328416 - protein, 17 aa, Mycobacterium
TNTVLGHYTHFGNLLDL

SEQ ID NO: 1328417 - protein, 25 aa, Mycobacterium
TNVFNIPANLFIALANTPYNFFTAL

SEQ ID NO: 1328418 - protein, 21 aa, Mycobacterium
TNVGGTYFLTAAVVPAMLLRG

SEQ ID NO: 1328419 - protein, 20 aa, Mycobacterium
TNVLVFRSLNGRSGRRFGRE

SEQ ID NO: 1328420 - protein, 24 aa, Mycobacterium
TNWGQPPGWQPARGPLPPAGAPPQ

SEQ ID NO: 1328421 - protein, 23 aa, Mycobacterium
TNWGQPPGWQPARGPLPPAGTPP

SEQ ID NO: 1328422 - protein, 17 aa, Mycobacterium
TNWSRRYKANLEKLASG

SEQ ID NO: 1328423 - protein, 23 aa, Mycobacterium
TNYTRLIPYFATSVAVRRTSDGV

SEQ ID NO: 1328424 - protein, 24 aa, Mycobacterium
TPADAADALALAICHCWRAPMIAR

SEQ ID NO: 1328425 - protein, 29 aa, Mycobacterium
TPADAADALALAICHCWRAPMLGRMAAAE

SEQ ID NO: 1328426 - protein, 25 aa, Mycobacterium
TPAGEQAFLKFLRSQVAAIGEVLQS

SEQ ID NO: 1328427 - protein, 24 aa, Mycobacterium
TPAGRMMIGVLGSLAEYERELIKE

SEQ ID NO: 1328428 - protein, 28 aa, Mycobacterium
TPAIATLILLAEQIDWLLGNGGLDWATK

SEQ ID NO: 1328429 - protein, 18 aa, Mycobacterium
TPAIRWIVVKDAAISPVG

SEQ ID NO: 1328430 - protein, 23 aa, Mycobacterium
TPAKWARIWAERHPEAPLQLRTL

SEQ ID NO: 1328431 - protein, 17 aa, Mycobacterium
TPALLAERDFLYDSSLM

SEQ ID NO: 1328432 - protein, 17 aa, Mycobacterium
TPALPRLDSYRGHPDGG

SEQ ID NO: 1328433 - protein, 22 aa, Mycobacterium
TPALVLCHISHVYPTGASLYFT

SEQ ID NO: 1328434 - protein, 24 aa, Mycobacterium
TPAQSLWRQRIFFEAQADLGGPAR

SEQ ID NO: 1328435 - protein, 26 aa, Mycobacterium
TPATTFDVFISTWKAGLEASGFRAGC

SEQ ID NO: 1328436 - protein, 17 aa, Mycobacterium
TPAVPPWVQGALRADAA

SEQ ID NO: 1328437 - protein, 19 aa, Mycobacterium
TPAWIRACGDLRQALEQVQ

SEQ ID NO: 1328438 - protein, 20 aa, Mycobacterium
TPAYLGFNLFGHAIARALIT

SEQ ID NO: 1328439 - protein, 30 aa, Mycobacterium
TPCQTFVTWLGIPGWIKTFTAAGLPGAYFR

SEQ ID NO: 1328440 - protein, 25 aa, Mycobacterium
TPDELVLRRLLPMADEGLRRWEVAT

SEQ ID NO: 1328441 - protein, 26 aa, Mycobacterium
TPDGLAAWLVLSSEALHAGAREALSI

SEQ ID NO: 1328442 - protein, 23 aa, Mycobacterium
TPDHKNLWLIAREPRIDPAIEAA

SEQ ID NO: 1328443 - protein, 23 aa, Mycobacterium
TPDHLRIVTLPWARDLANAIERL

SEQ ID NO: 1328444 - protein, 24 aa, Mycobacterium
TPDHLRIVTLPWSRDLAAAIERLG

SEQ ID NO: 1328445 - protein, 26 aa, Mycobacterium
TPDILSPLCWSLWGNGVELASRAGLY

SEQ ID NO: 1328446 - protein, 23 aa, Mycobacterium
TPDKKTWWRNFTGDGGPITLMNF

SEQ ID NO: 1328447 - protein, 22 aa, Mycobacterium
TPDLDRIAALAAPPDRRQWWIA

SEQ ID NO: 1328448 - protein, 29 aa, Mycobacterium
TPDMTLEMPLIDFFSRGGSLKSSWYGDCL

SEQ ID NO: 1328449 - protein, 25 aa, Mycobacterium
TPDRLRSGWLNGIKHWQVDYTGPSG

SEQ ID NO: 1328450 - protein, 20 aa, Mycobacterium
TPDRRAIITEALRKIDDLTA

SEQ ID NO: 1328451 - protein, 18 aa, Mycobacterium
TPEARAHWDLIAAKYAAP

SEQ ID NO: 1328452 - protein, 24 aa, Mycobacterium
TPEARAHWDLIAAKYAAPGTNRPH

SEQ ID NO: 1328453 - protein, 25 aa, Mycobacterium
TPEAWAVWEVLFAKYAAPGMCNPDD

SEQ ID NO: 1328454 - protein, 31 aa, Mycobacterium
TPEGGLIKAAWIDTWRLPAAPPGTVKIVVGV

SEQ ID NO: 1328455 - protein, 23 aa, Mycobacterium
TPEGLELLMKLLETADVFVTNLL

SEQ ID NO: 1328456 - protein, 24 aa, Mycobacterium
TPEIKSYLTDWAAAADRLAMSQLD

SEQ ID NO: 1328457 - protein, 25 aa, Mycobacterium
TPEPGERFSLLPLSARTPSALVRIA

SEQ ID NO: 1328458 - protein, 24 aa, Mycobacterium
TPEYKQVALFSATMPPAIKKITAK

SEQ ID NO: 1328459 - protein, 17 aa, Mycobacterium
TPFAIAAAVERLTGSLP

SEQ ID NO: 1328460 - protein, 23 aa, Mycobacterium
TPFEDGGWIWFDITTDAKSTLHH

SEQ ID NO: 1328461 - protein, 25 aa, Mycobacterium
TPFGGVQIVLVGDLYQLPPVVREDE

SEQ ID NO: 1328462 - protein, 25 aa, Mycobacterium
TPGAAPVGITWGGDAVWFVEIATGR

SEQ ID NO: 1328463 - protein, 27 aa, Mycobacterium
TPGDLPLVLALFYLVVDRRTTPLLLDQ

SEQ ID NO: 1328464 - protein, 25 aa, Mycobacterium
TPGLAGLVLGEFRRIERDSPAGPTL

SEQ ID NO: 1328465 - protein, 19 aa, Mycobacterium
TPGLLMAMGPGFCSELVLL

SEQ ID NO: 1328466 - protein, 23 aa, Mycobacterium
TPGMLAEWLELPGAAQRIQAWSE

SEQ ID NO: 1328467 - protein, 21 aa, Mycobacterium
TPGWVLPRLDLPMPAAVQALF

SEQ ID NO: 1328468 - protein, 19 aa, Mycobacterium
TPGYDLRYLVGSRAQTFER

SEQ ID NO: 1328469 - protein, 24 aa, Mycobacterium
TPHGPVRFPGVPTWFSRTPGKVRG

SEQ ID NO: 1328470 - protein, 26 aa, Mycobacterium
TPHRTYGRFSPWGRLAAYRRQYDDVI

SEQ ID NO: 1328471 - protein, 24 aa, Mycobacterium
TPHSVHTYFLRPGDSRLTVTFEVV

SEQ ID NO: 1328472 - protein, 26 aa, Mycobacterium
TPHVLACIYSVFTEGYWSTAGPSAIR

SEQ ID NO: 1328473 - protein, 29 aa, Mycobacterium
TPIHPQTMAGLLVWALRFVADFSDDILAA

SEQ ID NO: 1328474 - protein, 22 aa, Mycobacterium
TPKAVVRLLRRLGCHVEFPAAQ

SEQ ID NO: 1328475 - protein, 21 aa, Mycobacterium
TPKKMIRAALRGALSDRARND

SEQ ID NO: 1328476 - protein, 22 aa, Mycobacterium
TPKQIARAWLQLGPSIVAVTEG

SEQ ID NO: 1328477 - protein, 25 aa, Mycobacterium
TPKSSWPWVRTLLHSVFDQPDAESV

SEQ ID NO: 1328478 - protein, 31 aa, Mycobacterium
TPLEQLLVDKAYFLDLTAPEMTALIGGLRTL

SEQ ID NO: 1328479 - protein, 20 aa, Mycobacterium
TPLGPMRRVRALGAAVGTHL

SEQ ID NO: 1328480 - protein, 24 aa, Mycobacterium
TPLKRWQLCLDVNTTGVFLVTKAV

SEQ ID NO: 1328481 - protein, 19 aa, Mycobacterium
TPLLTYLPHARDAGLHVIV

SEQ ID NO: 1328482 - protein, 21 aa, Mycobacterium
TPLNPLDIAAGGTGGWWGTSN

SEQ ID NO: 1328483 - protein, 27 aa, Mycobacterium
TPLRTGSLRVNFLRRLVAGGECRYSAT

SEQ ID NO: 1328484 - protein, 23 aa, Mycobacterium
TPLTVTAPVPYAPTGGLRNPFPP

SEQ ID NO: 1328485 - protein, 19 aa, Mycobacterium
TPMLAILKSALVEGSGKVV

SEQ ID NO: 1328486 - protein, 17 aa, Mycobacterium
TPMLRLLRLGAAHATEL

SEQ ID NO: 1328487 - protein, 20 aa, Mycobacterium
TPMPAYRFPGLVPGDRWCVT

SEQ ID NO: 1328488 - protein, 34 aa, Mycobacterium
TPMQRFAALLDRYLGFLALDPTTARLFLVEVNAA

SEQ ID NO: 1328489 - protein, 25 aa, Mycobacterium
TPMVNIKLADLLRDAIRYGEREEVR

SEQ ID NO: 1328490 - protein, 22 aa, Mycobacterium
TPNGWDPFGPDMSGYRVQKVMV

SEQ ID NO: 1328491 - protein, 20 aa, Mycobacterium
TPPGLPVELPGHGPRFVALT

SEQ ID NO: 1328492 - protein, 20 aa, Mycobacterium
TPPVWTGSPSPTAGPDEQGS

SEQ ID NO: 1328493 - protein, 28 aa, Mycobacterium
TPRDGGVFDQLPFALAPGPPIRTTALRE

SEQ ID NO: 1328494 - protein, 24 aa, Mycobacterium
TPREVTALVLLTDLAALASADVAA

SEQ ID NO: 1328495 - protein, 19 aa, Mycobacterium
TPRPRVPATPPPVPGRPKA

SEQ ID NO: 1328496 - protein, 26 aa, Mycobacterium
TPRRGELLPYIPEPWRSKYFLTRKVG

SEQ ID NO: 1328497 - protein, 24 aa, Mycobacterium
TPSEVRAPIIAWIGIQIDSMHEVN

SEQ ID NO: 1328498 - protein, 23 aa, Mycobacterium
TPSGRGFWAKLEGFNPGGMKDRP

SEQ ID NO: 1328499 - protein, 25 aa, Mycobacterium
TPSHTGWLFPGRLPGTHLSTENIRT

SEQ ID NO: 1328500 - protein, 19 aa, Mycobacterium
TPSIFTEFLDSGRPGFHQL

SEQ ID NO: 1328501 - protein, 28 aa, Mycobacterium
TPSLLHRELSGRWALLAPPDAPAGCADV

SEQ ID NO: 1328502 - protein, 21 aa, Mycobacterium
TPSLYSLYDPRSAPPEWVQRL

SEQ ID NO: 1328503 - protein, 17 aa, Mycobacterium
TPSSPRGLDGPAGPPNP

SEQ ID NO: 1328504 - protein, 29 aa, Mycobacterium
TPSTPTDAYWLLRYAIASRDPVIFLEPKR

SEQ ID NO: 1328505 - protein, 17 aa, Mycobacterium
TPTARRVVAGALVVLAG

SEQ ID NO: 1328506 - protein, 22 aa, Mycobacterium
TPTDIGLALITPLVGQEFLDRY

SEQ ID NO: 1328507 - protein, 25 aa, Mycobacterium
TPTEGLVDLIRPVLRDYLTSRGHEA

SEQ ID NO: 1328508 - protein, 29 aa, Mycobacterium
TPTFTGRSWPLADVRLLAPILASKVVCIG

SEQ ID NO: 1328509 - protein, 19 aa, Mycobacterium
TPTHLPRLVTLLDALDNVA

SEQ ID NO: 1328510 - protein, 28 aa, Mycobacterium
TPTKWDNSFLEILYGNEWELFKSPAGAN

SEQ ID NO: 1328511 - protein, 24 aa, Mycobacterium
TPTLKFVMIQLAEPAKTASLTFVG

SEQ ID NO: 1328512 - protein, 24 aa, Mycobacterium
TPVADRYLLLSFGDSPRALDTVRQ

SEQ ID NO: 1328513 - protein, 17 aa, Mycobacterium
TPVITVRPGAVEAAPAA

SEQ ID NO: 1328514 - protein, 27 aa, Mycobacterium
TPVLLDAIYDPWPTPLAAAVQAAGGQV

SEQ ID NO: 1328515 - protein, 25 aa, Mycobacterium
TPVMDTVGVLPYAAIGAVHADPVDP

SEQ ID NO: 1328516 - protein, 25 aa, Mycobacterium
TPVRTLPGFGHLAWHLVDPGTGAQL

SEQ ID NO: 1328517 - protein, 19 aa, Mycobacterium
TPVVFAGTTYTLPMGSYLA

SEQ ID NO: 1328518 - protein, 19 aa, Mycobacterium
TPWRVSIISFPSREATTPL

SEQ ID NO: 1328519 - protein, 23 aa, Mycobacterium
TPYALRSRFRAVHPDVYVPTHAE

SEQ ID NO: 1328520 - protein, 22 aa, Mycobacterium
TQAALPFIPIDGTGRIVNVTSA

SEQ ID NO: 1328521 - protein, 29 aa, Mycobacterium
TQAANLKCLCRLHHLLKTFGGWKDQQLPD

SEQ ID NO: 1328522 - protein, 24 aa, Mycobacterium
TQAVLMQRWDPDAAVALMLRHRCT

SEQ ID NO: 1328523 - protein, 26 aa, Mycobacterium
TQDYYRDFYRAAGKDGLLTLDRHLES

SEQ ID NO: 1328524 - protein, 33 aa, Mycobacterium
TQEHDLSLLLLRVQALRPAWGDPTWHRRRVLEA

SEQ ID NO: 1328525 - protein, 27 aa, Mycobacterium
TQESTLGLIFHWADQQGLALLDLKDLR

SEQ ID NO: 1328526 - protein, 25 aa, Mycobacterium
TQFAAPVWMPRARRTPIRDVQEAVE

SEQ ID NO: 1328527 - protein, 17 aa, Mycobacterium
TQFLVRQARLAGVAAPD

SEQ ID NO: 1328528 - protein, 30 aa, Mycobacterium
TQFYTMLGTRGIWHKGWFASAVHAASPSGW

SEQ ID NO: 1328529 - protein, 26 aa, Mycobacterium
TQGVRPRVWFGERWITSIFDLFEENV

SEQ ID NO: 1328530 - protein, 18 aa, Mycobacterium
TQHNSYFAARPWTARQTC

SEQ ID NO: 1328531 - protein, 21 aa, Mycobacterium
TQHTFLWQHTAAVVPGFTAGT

SEQ ID NO: 1328532 - protein, 21 aa, Mycobacterium
TQKFMAIWRASKPVIAQVHGW

SEQ ID NO: 1328533 - protein, 17 aa, Mycobacterium
TQLNFEIVPGLPGTSAV

SEQ ID NO: 1328534 - protein, 26 aa, Mycobacterium
TQLNFVHFIVFACACQRLRRCVAERV

SEQ ID NO: 1328535 - protein, 29 aa, Mycobacterium
TQNDFVLLPDLTADLALTPAAVAALCDRR

SEQ ID NO: 1328536 - protein, 21 aa, Mycobacterium
TQNSRWFLLSKYDGVTVTTAD

SEQ ID NO: 1328537 - protein, 19 aa, Mycobacterium
TQPLVVAATLLAYEELTKR

SEQ ID NO: 1328538 - protein, 25 aa, Mycobacterium
TQQARPLLRRFPVLVPTGVGFMKNA

SEQ ID NO: 1328539 - protein, 22 aa, Mycobacterium
TQQPRRGFVVLPITRRDIADVA

SEQ ID NO: 1328540 - protein, 21 aa, Mycobacterium
TQQTYLLAFGRVKDDLRRSQT

SEQ ID NO: 1328541 - protein, 24 aa, Mycobacterium
TQQTYLLAFGRVKDDLRRSQTERA

SEQ ID NO: 1328542 - protein, 22 aa, Mycobacterium
TQRPIPPLTTALSTREYEVGGT

SEQ ID NO: 1328543 - protein, 20 aa, Mycobacterium
TQRQSVILPAYTAAKAMVTS

SEQ ID NO: 1328544 - protein, 34 aa, Mycobacterium
TQRVKANLFYRGLTFYRYPVIGDSLFTRTEVVGL

SEQ ID NO: 1328545 - protein, 22 aa, Mycobacterium
TQSATWMALFSGQTTVLTPEFD

SEQ ID NO: 1328546 - protein, 22 aa, Mycobacterium
TQVEPVVPRPLIREVTERIDYK

SEQ ID NO: 1328547 - protein, 18 aa, Mycobacterium
TQVPLAVARAFADALAAY

SEQ ID NO: 1328548 - protein, 19 aa, Mycobacterium
TQWAQAWEVQALLRAHRVA

SEQ ID NO: 1328549 - protein, 23 aa, Mycobacterium
TRAAQAPGAPLSRRLYVARRSAE

SEQ ID NO: 1328550 - protein, 26 aa, Mycobacterium
TRAAQAPGAPLSRRLYVARRSAELTV

SEQ ID NO: 1328551 - protein, 22 aa, Mycobacterium
TRAARRGRFLRRGALESGLDHV

SEQ ID NO: 1328552 - protein, 23 aa, Mycobacterium
TRADITALALPVLIGEPDDLAAL

SEQ ID NO: 1328553 - protein, 18 aa, Mycobacterium
TRAEWYLRQMLGAANFKA

SEQ ID NO: 1328554 - protein, 20 aa, Mycobacterium
TRAFRSWSRQFYPEPSLAEV

SEQ ID NO: 1328555 - protein, 25 aa, Mycobacterium
TRAGVGILILTHYVPTLQPGQEEDW

SEQ ID NO: 1328556 - protein, 21 aa, Mycobacterium
TRAKGAWLWSGRDAVAAGLSA

SEQ ID NO: 1328557 - protein, 32 aa, Mycobacterium
TRDAKWKPFNLGNVLYNAILAIGFEWGVGLQH

SEQ ID NO: 1328558 - protein, 37 aa, Mycobacterium
TRDDGWVLLQVAGPPMFKRWCRLVGRPELFDDPRFAN

SEQ ID NO: 1328559 - protein, 26 aa, Mycobacterium
TRDELGYPWLWSRATNQLMFIYAKTV

SEQ ID NO: 1328560 - protein, 40 aa, Mycobacterium
TRDEPWQPVHLLQPLRNMLLAVIFEWGIALHGIHSERDRL

SEQ ID NO: 1328561 - protein, 27 aa, Mycobacterium
TRDGEGWYWLGRLDGPYFYDADGEVVD

SEQ ID NO: 1328562 - protein, 28 aa, Mycobacterium
TRDGEPLFMAGLWSTWRPKGADKDVKPL

SEQ ID NO: 1328563 - protein, 24 aa, Mycobacterium
TRDKRLRRLPNPTLVLWGRDDKVN

SEQ ID NO: 1328564 - protein, 38 aa, Mycobacterium
TRDRVLEVAAAKWWRKPLVRRWYGFAEMQKQVARQIPE

SEQ ID NO: 1328565 - protein, 25 aa, Mycobacterium
TREEGVACYRLFIAGLLDITDNVDK

SEQ ID NO: 1328566 - protein, 21 aa, Mycobacterium
TREGRWTLLDYVDIVVHIQHQ

SEQ ID NO: 1328567 - protein, 18 aa, Mycobacterium
TREHAQVPRLIAAGADMG

SEQ ID NO: 1328568 - protein, 18 aa, Mycobacterium
TREIILIHHTDCGMLTFT

SEQ ID NO: 1328569 - protein, 24 aa, Mycobacterium
TRFARGWHCLGLADAFRDGRPHGV

SEQ ID NO: 1328570 - protein, 23 aa, Mycobacterium
TRFARGWHCLGLTSDLGDGQPHA

SEQ ID NO: 1328571 - protein, 31 aa, Mycobacterium
TRFHNHLYEVLGLDFIYKAFTTTDIVAAIGG

SEQ ID NO: 1328572 - protein, 21 aa, Mycobacterium
TRFLARIVAWIAAGYPEGIPG

SEQ ID NO: 1328573 - protein, 19 aa, Mycobacterium
TRFRIGKRVYLMVDDDATR

SEQ ID NO: 1328574 - protein, 20 aa, Mycobacterium
TRGDLNIAAGWMNRARRLLD

SEQ ID NO: 1328575 - protein, 19 aa, Mycobacterium
TRGEWYLRQILGAANFRAG

SEQ ID NO: 1328576 - protein, 23 aa, Mycobacterium
TRGHAWALALSADGNVWGATVNK

SEQ ID NO: 1328577 - protein, 33 aa, Mycobacterium
TRGHLGGLAAAVPAAIRLLSALGYDLVILETVG

SEQ ID NO: 1328578 - protein, 17 aa, Mycobacterium
TRGIIVADTKFEFGVDA

SEQ ID NO: 1328579 - protein, 31 aa, Mycobacterium
TRGINDRCRRLRPYAELLVDGFGIPEQLRYA

SEQ ID NO: 1328580 - protein, 18 aa, Mycobacterium
TRGWGVFAHGFTLGKDSP

SEQ ID NO: 1328581 - protein, 19 aa, Mycobacterium
TRGYSVMLGYWRDEEKTAQ

SEQ ID NO: 1328582 - protein, 20 aa, Mycobacterium
TRHARAYVLDAWLRPLPDGV

SEQ ID NO: 1328583 - protein, 24 aa, Mycobacterium
TRHPRACWGALRSTILGDALFRTG

SEQ ID NO: 1328584 - protein, 19 aa, Mycobacterium
TRHSGPVTGIQYAGSVLLA

SEQ ID NO: 1328585 - protein, 19 aa, Mycobacterium
TRIGYPLRTLLTDSDVLAA

SEQ ID NO: 1328586 - protein, 27 aa, Mycobacterium
TRIVVLGDAWGLLKFLDEGAFVLDERA

SEQ ID NO: 1328587 - protein, 18 aa, Mycobacterium
TRKALADQGFGVLTEIDM

SEQ ID NO: 1328588 - protein, 34 aa, Mycobacterium
TRKIKFVGPVKVAMANMAVLGAGLRLLGQVDGLV

SEQ ID NO: 1328589 - protein, 23 aa, Mycobacterium
TRKSFVEALKGKAKEVAGAITGN

SEQ ID NO: 1328590 - protein, 20 aa, Mycobacterium
TRLGVPFTPRRLADGIIRVC

SEQ ID NO: 1328591 - protein, 18 aa, Mycobacterium
TRLIGRALSPLTLTVDPA

SEQ ID NO: 1328592 - protein, 22 aa, Mycobacterium
TRLLQWVPVFESDVFDRLPGVY

SEQ ID NO: 1328593 - protein, 29 aa, Mycobacterium
TRLPVAEAIGFMLEILPALGHLHSIGLVY

SEQ ID NO: 1328594 - protein, 27 aa, Mycobacterium
TRLVDGHWAPTFPNATYLIPRADFDYW

SEQ ID NO: 1328595 - protein, 28 aa, Mycobacterium
TRLVDGHWAPTFPNATYLIPRADFDYWN

SEQ ID NO: 1328596 - protein, 22 aa, Mycobacterium
TRMDKPLQRYWRDVHVGQAHAI

SEQ ID NO: 1328597 - protein, 19 aa, Mycobacterium
TRMLILAGGLVAEGLHLLD

SEQ ID NO: 1328598 - protein, 27 aa, Mycobacterium
TRMMDRYIRHVLVERDGTLVGIVSARD

SEQ ID NO: 1328599 - protein, 30 aa, Mycobacterium
TRMNDQCEVEWIPPPRLDTGQARLNHYHRP

SEQ ID NO: 1328600 - protein, 22 aa, Mycobacterium
TRMNDRCEVEWIPPPALDTGQA

SEQ ID NO: 1328601 - protein, 24 aa, Mycobacterium
TRMYRFDHFGWSLRMLGLGATHGS

SEQ ID NO: 1328602 - protein, 28 aa, Mycobacterium
TRNAPHLVHAMPQLVPLLPEMNAASRAL

SEQ ID NO: 1328603 - protein, 28 aa, Mycobacterium
TRNEDIMDLWKCLLPHDQWLVVGRRSAM

SEQ ID NO: 1328604 - protein, 19 aa, Mycobacterium
TRPAINHYFSSKRVLWAEV

SEQ ID NO: 1328605 - protein, 25 aa, Mycobacterium
TRPDWQLICRIAAELGFGADFAYTD

SEQ ID NO: 1328606 - protein, 23 aa, Mycobacterium
TRPELLDLLASAETLLAATGNAV

SEQ ID NO: 1328607 - protein, 18 aa, Mycobacterium
TRPLSATKRWRLVEVLEK

SEQ ID NO: 1328608 - protein, 19 aa, Mycobacterium
TRPLVDVLSARGQRYRIFG

SEQ ID NO: 1328609 - protein, 17 aa, Mycobacterium
TRQWMHRDHILQAYYHA

SEQ ID NO: 1328610 - protein, 19 aa, Mycobacterium
TRRAIVERLVRRPATVKAL

SEQ ID NO: 1328611 - protein, 35 aa, Mycobacterium
TRRARETVWLTPEPRYSWGLGSCELPAYAEFCDRV

SEQ ID NO: 1328612 - protein, 20 aa, Mycobacterium
TRRGDWWYYGRSFEGKQYGV

SEQ ID NO: 1328613 - protein, 18 aa, Mycobacterium
TRRGEVLTDLRLLGPRIA

SEQ ID NO: 1328614 - protein, 19 aa, Mycobacterium
TRRGWLRCRLLEPSPGQDT

SEQ ID NO: 1328615 - protein, 25 aa, Mycobacterium
TRRIGRWRTAYLVLSGRPIDAGTAL

SEQ ID NO: 1328616 - protein, 24 aa, Mycobacterium
TRRIGRWRTGYLVLSGRTIDPSTA

SEQ ID NO: 1328617 - protein, 31 aa, Mycobacterium
TRRLTRFFDSYDLLLTPSLATPPPAIGEFDL

SEQ ID NO: 1328618 - protein, 24 aa, Mycobacterium
TRRPRLVAAPLDGPAPLSSSQLRS

SEQ ID NO: 1328619 - protein, 26 aa, Mycobacterium
TRSGIRILRIGMPYPLDPQVVSRLAD

SEQ ID NO: 1328620 - protein, 23 aa, Mycobacterium
TRSHVFLVVHRLDNLRRSGRIRT

SEQ ID NO: 1328621 - protein, 24 aa, Mycobacterium
TRSLNLFTTIPFVKDNLTKWWRGD

SEQ ID NO: 1328622 - protein, 26 aa, Mycobacterium
TRSNARMGWLLSQNVLRKARAGEAAS

SEQ ID NO: 1328623 - protein, 30 aa, Mycobacterium
TRSRTLFARGFFLTQHDIDWFRARYLGGAQ

SEQ ID NO: 1328624 - protein, 27 aa, Mycobacterium
TRSVGPLLGQFFTALRDKRIVGVRGSD

SEQ ID NO: 1328625 - protein, 18 aa, Mycobacterium
TRTAVMMGVYYTEYQNSS

SEQ ID NO: 1328626 - protein, 19 aa, Mycobacterium
TRTFPLRSSFAPTYNMTIN

SEQ ID NO: 1328627 - protein, 32 aa, Mycobacterium
TRTVEPWGVVTDRGRWYLVGHDRDRDAVRTFR

SEQ ID NO: 1328628 - protein, 32 aa, Mycobacterium
TRTVEPWGVVTHRGRWYLVGHDRDRDAPRTFR

SEQ ID NO: 1328629 - protein, 28 aa, Mycobacterium
TRVGDGLLSLPWDGLSLSRGDAAVPTRM

SEQ ID NO: 1328630 - protein, 20 aa, Mycobacterium
TRVKARVPVALAAGLRDFAT

SEQ ID NO: 1328631 - protein, 17 aa, Mycobacterium
TRVPGPHFDPALVGTVG

SEQ ID NO: 1328632 - protein, 17 aa, Mycobacterium
TRWEPLSDDKLTAALDA

SEQ ID NO: 1328633 - protein, 24 aa, Mycobacterium
TRYEAWSFPDFATGADALRAVAQT

SEQ ID NO: 1328634 - protein, 20 aa, Mycobacterium
TRYEWVLADFSVLCAGAATT

SEQ ID NO: 1328635 - protein, 26 aa, Mycobacterium
TRYLNGAQLMGIFPVSALAASIGLNV

SEQ ID NO: 1328636 - protein, 25 aa, Mycobacterium
TRYRRILHPFFSPQALGVLLPSLQA

SEQ ID NO: 1328637 - protein, 21 aa, Mycobacterium
TSAAPLYFPAAYVDGHRLIDG

SEQ ID NO: 1328638 - protein, 25 aa, Mycobacterium
TSAGAYEFDLFYLTSQPPSMEAFNA

SEQ ID NO: 1328639 - protein, 17 aa, Mycobacterium
TSALVTHRYPLDEFERA

SEQ ID NO: 1328640 - protein, 17 aa, Mycobacterium
TSALWPTLTEPLRTRSE

SEQ ID NO: 1328641 - protein, 23 aa, Mycobacterium
TSAPRILVNPTGKFVLGGPMGDA

SEQ ID NO: 1328642 - protein, 24 aa, Mycobacterium
TSAQWLRHLYEKWSATLDFEVPSF

SEQ ID NO: 1328643 - protein, 47 aa, Mycobacterium
TSARSKLPGLPPLRLNLPTPEQFIASIPAPVVTCLCGVINTVTNFFD

SEQ ID NO: 1328644 - protein, 48 aa, Mycobacterium
TSARTKLTGLPPLRLNLPTPEEFIASIPAPVVTCLCGVINTVTKFFDN

SEQ ID NO: 1328645 - protein, 23 aa, Mycobacterium
TSATFGVLQREIQLAPGALGFRY

SEQ ID NO: 1328646 - protein, 23 aa, Mycobacterium
TSDAAVLPVRSLVLICGGGEIQR

SEQ ID NO: 1328647 - protein, 19 aa, Mycobacterium
TSDGFHMVAPDPNGKRAGY

SEQ ID NO: 1328648 - protein, 24 aa, Mycobacterium
TSEEGFDFLLSKGKVLMPKLFDEE

SEQ ID NO: 1328649 - protein, 24 aa, Mycobacterium
TSEELPRQLLARLHAIFPETAQAN

SEQ ID NO: 1328650 - protein, 23 aa, Mycobacterium
TSEIALAIAERYLRNARARIVLA

SEQ ID NO: 1328651 - protein, 28 aa, Mycobacterium
TSEVIARLPFVPSILEWLHAGRTSVVMD

SEQ ID NO: 1328652 - protein, 29 aa, Mycobacterium
TSFIPGLEDRTFPYLFSPAANEAVEQSDL

SEQ ID NO: 1328653 - protein, 19 aa, Mycobacterium
TSFPSLWSVIDEATARIIC

SEQ ID NO: 1328654 - protein, 20 aa, Mycobacterium
TSFRRIGNLGLNWLVNCLFG

SEQ ID NO: 1328655 - protein, 30 aa, Mycobacterium
TSFSMVMENRWLPMKRTALALNHLVSTRFR

SEQ ID NO: 1328656 - protein, 18 aa, Mycobacterium
TSHWAALPVLKTFGVQPV

SEQ ID NO: 1328657 - protein, 23 aa, Mycobacterium
TSIKEVLANHLRISRKAAGDRLT

SEQ ID NO: 1328658 - protein, 23 aa, Mycobacterium
TSIKEVLANHLRISRKAAGEQLT

SEQ ID NO: 1328659 - protein, 37 aa, Mycobacterium
TSISDLRAIPWVLAWSQSRVMLPGWYGTGTAFEEYVG

SEQ ID NO: 1328660 - protein, 24 aa, Mycobacterium
TSKPDLLQLITTDSAPIINHCSSR

SEQ ID NO: 1328661 - protein, 22 aa, Mycobacterium
TSLKVQGPKWAALVARSATAEG

SEQ ID NO: 1328662 - protein, 27 aa, Mycobacterium
TSLLGFGSGMLLGRLVDHAFGRKLTRQ

SEQ ID NO: 1328663 - protein, 24 aa, Mycobacterium
TSLQDEIGFTRVLYDDHIGKVSLI

SEQ ID NO: 1328664 - protein, 17 aa, Mycobacterium
TSLQNWVRPHLEELLGD

SEQ ID NO: 1328665 - protein, 26 aa, Mycobacterium
TSLRAFYQHFATKDELLLALVERVMV

SEQ ID NO: 1328666 - protein, 24 aa, Mycobacterium
TSLTDLIYAHHPRFLGVRRAYESR

SEQ ID NO: 1328667 - protein, 17 aa, Mycobacterium
TSMGAAAWAAGAAGLAA

SEQ ID NO: 1328668 - protein, 24 aa, Mycobacterium
TSMRGMLQAVFGRGPRGGAVNARA

SEQ ID NO: 1328669 - protein, 24 aa, Mycobacterium
TSMVSLTLMARLLEAVRPDSRLLL

SEQ ID NO: 1328670 - protein, 18 aa, Mycobacterium
TSNPWTLRKILRANQIAL

SEQ ID NO: 1328671 - protein, 20 aa, Mycobacterium
TSNPWTLRKILRANQIALQN

SEQ ID NO: 1328672 - protein, 27 aa, Mycobacterium
TSNVDRVYPFQVLLQAPDSGLAVASKA

SEQ ID NO: 1328673 - protein, 20 aa, Mycobacterium
TSPLLRQRAVAELPQIDKVR

SEQ ID NO: 1328674 - protein, 37 aa, Mycobacterium
TSQDWWPADYGSYAGLFIRMSWHAAGTYRIFDGRGGA

SEQ ID NO: 1328675 - protein, 20 aa, Mycobacterium
TSRAPRWAVAYKYPPEEAQT

SEQ ID NO: 1328676 - protein, 17 aa, Mycobacterium
TSRGKMLLGRRRHRRRP

SEQ ID NO: 1328677 - protein, 27 aa, Mycobacterium
TSRIRVMTYILVSGYRSPYLTAKAAAS

SEQ ID NO: 1328678 - protein, 27 aa, Mycobacterium
TSRKPALHVLLWERALDPEKGRWALPG

SEQ ID NO: 1328679 - protein, 20 aa, Mycobacterium
TSRMLIHRSLYDQAVTDITA

SEQ ID NO: 1328680 - protein, 23 aa, Mycobacterium
TSRPFRMMRLDEVIDLYPTLADA

SEQ ID NO: 1328681 - protein, 22 aa, Mycobacterium
TSRRWDPNIQSVRAVAAPGGNK

SEQ ID NO: 1328682 - protein, 18 aa, Mycobacterium
TSRYFYQHFSGRDALLRA

SEQ ID NO: 1328683 - protein, 24 aa, Mycobacterium
TSSDIQLYHLGLGAGMDPMDRAEL

SEQ ID NO: 1328684 - protein, 19 aa, Mycobacterium
TSSDPAAALAFLRRLHDET

SEQ ID NO: 1328685 - protein, 21 aa, Mycobacterium
TSSFSFLNFYSYGAITVEGMS

SEQ ID NO: 1328686 - protein, 38 aa, Mycobacterium
TSSPAPAPVPIPPNSVPAPPPPPPMPGFENVAADGDIL

SEQ ID NO: 1328687 - protein, 26 aa, Mycobacterium
TSSYGRGFLAPRDSLRQRCLTHELQI

SEQ ID NO: 1328688 - protein, 25 aa, Mycobacterium
TSTFSNGFVRRLALLMPNTLYFNSG

SEQ ID NO: 1328689 - protein, 22 aa, Mycobacterium
TSTRVSALPRRCGPRRRRHREP

SEQ ID NO: 1328690 - protein, 17 aa, Mycobacterium
TSVAWRLRGATSYCIDG

SEQ ID NO: 1328691 - protein, 17 aa, Mycobacterium
TSVIRYHFGSRDGLIRA

SEQ ID NO: 1328692 - protein, 20 aa, Mycobacterium
TTAAALWDFEDDRPFAWVRI

SEQ ID NO: 1328693 - protein, 26 aa, Mycobacterium
TTAALIPSYSPWLNPQVSPSTRFVSW

SEQ ID NO: 1328694 - protein, 22 aa, Mycobacterium
TTAAWLWSHRQGVVSGLAASAM

SEQ ID NO: 1328695 - protein, 25 aa, Mycobacterium
TTACRYDFLIPNRGVGVLLPDGAQA

SEQ ID NO: 1328696 - protein, 24 aa, Mycobacterium
TTADPRTVAWLRAHHVAAFDGPLA

SEQ ID NO: 1328697 - protein, 27 aa, Mycobacterium
TTADRVITLRYLLSMIAAERGMIATFM

SEQ ID NO: 1328698 - protein, 23 aa, Mycobacterium
TTAGLRWPDLALRAGRVGYPALR

SEQ ID NO: 1328699 - protein, 18 aa, Mycobacterium
TTAHRWFEEFEGAGLDGV

SEQ ID NO: 1328700 - protein, 23 aa, Mycobacterium
TTAMPMLLLNRRSVDVDGVPIEV

SEQ ID NO: 1328701 - protein, 24 aa, Mycobacterium
TTASSAEWPTGVPAICFACGYPTM

SEQ ID NO: 1328702 - protein, 31 aa, Mycobacterium
TTDARPDQMLPFLRGWGDALWDTGIDFGTLG

SEQ ID NO: 1328703 - protein, 24 aa, Mycobacterium
TTDGHWADYGYLLARTDPDAPKHK

SEQ ID NO: 1328704 - protein, 24 aa, Mycobacterium
TTDQEVRWCPGCGDYVILNTIRNF

SEQ ID NO: 1328705 - protein, 17 aa, Mycobacterium
TTELRRQLKPLGRQAEM

SEQ ID NO: 1328706 - protein, 27 aa, Mycobacterium
TTEWAASRWGTAYFLPALFADRVTHLG

SEQ ID NO: 1328707 - protein, 20 aa, Mycobacterium
TTFETLRWLTDNVAVPQLGC

SEQ ID NO: 1328708 - protein, 39 aa, Mycobacterium
TTFLDTFAFARRAAGLPACAINWGLWKSLADAQTGFERQ

SEQ ID NO: 1328709 - protein, 23 aa, Mycobacterium
TTGGLPPQARRLLDLPWSEHQER

SEQ ID NO: 1328710 - protein, 22 aa, Mycobacterium
TTGLTPFDVQLQGALRMLAGDV

SEQ ID NO: 1328711 - protein, 20 aa, Mycobacterium
TTGRLFVAGLTGGVVQIIDV

SEQ ID NO: 1328712 - protein, 24 aa, Mycobacterium
TTGSFYHYFPNWPAYSQELVGHWY

SEQ ID NO: 1328713 - protein, 21 aa, Mycobacterium
TTGVFLVTKAVIPHVRARGGG

SEQ ID NO: 1328714 - protein, 23 aa, Mycobacterium
TTGVLRLYQFEAAGELPFPAINV

SEQ ID NO: 1328715 - protein, 25 aa, Mycobacterium
TTHGRRIWLALRRTPKVNSLVNRWL

SEQ ID NO: 1328716 - protein, 31 aa, Mycobacterium
TTIGDPLTDIGWLELLWMQPVGITSHPGALG

SEQ ID NO: 1328717 - protein, 24 aa, Mycobacterium
TTIVSRVWLALRAAGAPVQPPNLN

SEQ ID NO: 1328718 - protein, 25 aa, Mycobacterium
TTKQALTEAVLWPLQHPETFQRLGV

SEQ ID NO: 1328719 - protein, 19 aa, Mycobacterium
TTLAWIRDRIDPSGSLLPI

SEQ ID NO: 1328720 - protein, 30 aa, Mycobacterium
TTLDYPRGNLAFRWFLADQVPARPEVMLVD

SEQ ID NO: 1328721 - protein, 26 aa, Mycobacterium
TTLHYDKLILATGSRSFFPPMAGLWS

SEQ ID NO: 1328722 - protein, 20 aa, Mycobacterium
TTLLERTIRELGAHRPIAVI

SEQ ID NO: 1328723 - protein, 21 aa, Mycobacterium
TTLRRLIVHRSVADDLVERIV

SEQ ID NO: 1328724 - protein, 23 aa, Mycobacterium
TTLWPDFTFRFRNQTRRFDLDAY

SEQ ID NO: 1328725 - protein, 27 aa, Mycobacterium
TTMADRADWMFALVRTGPAGRSTDGIT

SEQ ID NO: 1328726 - protein, 20 aa, Mycobacterium
TTMRIILGLDHPTSGTATID

SEQ ID NO: 1328727 - protein, 29 aa, Mycobacterium
TTNPPTEGSWAWLPDESAGSRLHWRSKEY

SEQ ID NO: 1328728 - protein, 28 aa, Mycobacterium
TTNTQLLWYRADLIPQPPTTWDGMVAEA

SEQ ID NO: 1328729 - protein, 25 aa, Mycobacterium
TTPAPPAPPHLRRSRYRQRVRNVRP

SEQ ID NO: 1328730 - protein, 35 aa, Mycobacterium
TTPHDLAVMLRAALKYPLIAQIMRSPTAPFPGKTL

SEQ ID NO: 1328731 - protein, 17 aa, Mycobacterium
TTPLMRLQDPELTKVIV

SEQ ID NO: 1328732 - protein, 26 aa, Mycobacterium
TTPLPARLILRLLNFDESRAMDWVHW

SEQ ID NO: 1328733 - protein, 29 aa, Mycobacterium
TTPPADNSLMLWFETMKPLMSTSAERGAA

SEQ ID NO: 1328734 - protein, 32 aa, Mycobacterium
TTPQKAAELGLRPLVRLVSWGVAGVAPNVMGI

SEQ ID NO: 1328735 - protein, 18 aa, Mycobacterium
TTQFFGMKANRYLHEHGI

SEQ ID NO: 1328736 - protein, 22 aa, Mycobacterium
TTQMNERCEVEWTPPPPLDTGQ

SEQ ID NO: 1328737 - protein, 26 aa, Mycobacterium
TTRARVPLPLNIIGMNNIAPAIIQYG

SEQ ID NO: 1328738 - protein, 19 aa, Mycobacterium
TTRFEDFWRRVGVTKAAAA

SEQ ID NO: 1328739 - protein, 25 aa, Mycobacterium
TTRHADVILPPPPPSRSPHFDFALN

SEQ ID NO: 1328740 - protein, 18 aa, Mycobacterium
TTRQLLSALLMVSGNDAA

SEQ ID NO: 1328741 - protein, 17 aa, Mycobacterium
TTSEWLDRLAPKATAVV

SEQ ID NO: 1328742 - protein, 23 aa, Mycobacterium
TTSMLIVALQHSGFDPSFAVGGD

SEQ ID NO: 1328743 - protein, 24 aa, Mycobacterium
TTTAAIYRRWSGKVHLVHEAVLSD

SEQ ID NO: 1328744 - protein, 22 aa, Mycobacterium
TTTERILFYTGISYKIGEVHDG

SEQ ID NO: 1328745 - protein, 25 aa, Mycobacterium
TTTGDLLRNVNLLPVPPALADVRVR

SEQ ID NO: 1328746 - protein, 25 aa, Mycobacterium
TTTGRWTLGPELYLLGTGAAHRYDI

SEQ ID NO: 1328747 - protein, 24 aa, Mycobacterium
TTTGVLRLYQFAAAGELAFPAINV

SEQ ID NO: 1328748 - protein, 29 aa, Mycobacterium
TTTRLLAPLRAVLKDRVTLAPAPPPTLDL

SEQ ID NO: 1328749 - protein, 23 aa, Mycobacterium
TTTTSMLYAILRAADRRVMLCGN

SEQ ID NO: 1328750 - protein, 23 aa, Mycobacterium
TTTTVRVAVRYFAAARAAAGTES

SEQ ID NO: 1328751 - protein, 30 aa, Mycobacterium
TTTVDRIKLFDGLFAYLVQIAPTAGHFPTG

SEQ ID NO: 1328752 - protein, 18 aa, Mycobacterium
TTTYLVEAGLRAAGRVAG

SEQ ID NO: 1328753 - protein, 23 aa, Mycobacterium
TTVATGLMGALRLAGHRVAPFKV

SEQ ID NO: 1328754 - protein, 22 aa, Mycobacterium
TTVHPSLWRQSTLAAKQGLYRV

SEQ ID NO: 1328755 - protein, 17 aa, Mycobacterium
TTVLLMPSWSIVDSRFW

SEQ ID NO: 1328756 - protein, 21 aa, Mycobacterium
TTYPGLFTFSENPGEGGLIQA

SEQ ID NO: 1328757 - protein, 23 aa, Mycobacterium
TTYPPITPLRPPQGAPNVLIVLL

SEQ ID NO: 1328758 - protein, 27 aa, Mycobacterium
TTYSSLMPLRYEGGVWWVRAHLTTKLD

SEQ ID NO: 1328759 - protein, 29 aa, Mycobacterium
TVAADRGAALRWFGLDGVEHPAASAPADL

SEQ ID NO: 1328760 - protein, 24 aa, Mycobacterium
TVADAPPWIGALDVIVVAGDDPAD

SEQ ID NO: 1328761 - protein, 24 aa, Mycobacterium
TVADARAAIRWYIDVFDAELVGDP

SEQ ID NO: 1328762 - protein, 23 aa, Mycobacterium
TVAIRDRFWALMDEPGPLIEAIQ

SEQ ID NO: 1328763 - protein, 25 aa, Mycobacterium
TVALGPQRLLPLWRQHRRNNTGPVE

SEQ ID NO: 1328764 - protein, 17 aa, Mycobacterium
TVALTRNVLLPVGTDYT

SEQ ID NO: 1328765 - protein, 17 aa, Mycobacterium
TVAMIYSFQSPDAIARD

SEQ ID NO: 1328766 - protein, 23 aa, Mycobacterium
TVANRSWYRAFNAYKMAVICLIG

SEQ ID NO: 1328767 - protein, 19 aa, Mycobacterium
TVAQRRLPLLVASGADVHV

SEQ ID NO: 1328768 - protein, 20 aa, Mycobacterium
TVAQSRLLQRLDPGGMRLTD

SEQ ID NO: 1328769 - protein, 18 aa, Mycobacterium
TVARAFLQQALGVEIVSH

SEQ ID NO: 1328770 - protein, 25 aa, Mycobacterium
TVARRGGIVVLPQDLPVSAVKQTVD

SEQ ID NO: 1328771 - protein, 17 aa, Mycobacterium
TVARRHAMLREAIQIIR

SEQ ID NO: 1328772 - protein, 20 aa, Mycobacterium
TVAVMELLHELSAEHQVILF

SEQ ID NO: 1328773 - protein, 20 aa, Mycobacterium
TVAYLYDYANFAHPFREGNG

SEQ ID NO: 1328774 - protein, 19 aa, Mycobacterium
TVDANLKLGLPADARDYGT

SEQ ID NO: 1328775 - protein, 24 aa, Mycobacterium
TVDGYLQLILADIGALATAVVESA

SEQ ID NO: 1328776 - protein, 24 aa, Mycobacterium
TVDVALLRLPADTSALAVIPLYEE

SEQ ID NO: 1328777 - protein, 23 aa, Mycobacterium
TVDVALLRLPADTSGLAVIPLYE

SEQ ID NO: 1328778 - protein, 19 aa, Mycobacterium
TVDWYSVDLPAVIALREAL

SEQ ID NO: 1328779 - protein, 25 aa, Mycobacterium
TVDYPPVNAIPSRGWFELADTITAA

SEQ ID NO: 1328780 - protein, 19 aa, Mycobacterium
TVELARRIVLATGMQYRLQ

SEQ ID NO: 1328781 - protein, 23 aa, Mycobacterium
TVELNGSFYRWPSDAQFQRWRDQ

SEQ ID NO: 1328782 - protein, 19 aa, Mycobacterium
TVERLTFDPAAFGFARAHV

SEQ ID NO: 1328783 - protein, 25 aa, Mycobacterium
TVETNLTRVYRKLGIRSRAQLGTQL

SEQ ID NO: 1328784 - protein, 20 aa, Mycobacterium
TVEVRYRFGRATVSVRIGDW

SEQ ID NO: 1328785 - protein, 35 aa, Mycobacterium
TVEVTLNGHQWLKDVYIQDGLLRLGAEEVEQRVNE

SEQ ID NO: 1328786 - protein, 27 aa, Mycobacterium
TVEYLVDAVFNYPTFSEAYKVAALDVM

SEQ ID NO: 1328787 - protein, 21 aa, Mycobacterium
TVFEELFWGDAGIALSILATG

SEQ ID NO: 1328788 - protein, 26 aa, Mycobacterium
TVFEHLGRLLIVDCGVLFPTHDEPGV

SEQ ID NO: 1328789 - protein, 17 aa, Mycobacterium
TVFLLCAPSVDPEDIAI

SEQ ID NO: 1328790 - protein, 28 aa, Mycobacterium
TVFTREDLLKQVWLWDFGDLSTVTVHVK

SEQ ID NO: 1328791 - protein, 18 aa, Mycobacterium
TVGALKRHKDKPVLFLGD

SEQ ID NO: 1328792 - protein, 23 aa, Mycobacterium
TVGAWLWSKRRAVITGKAAAALH

SEQ ID NO: 1328793 - protein, 28 aa, Mycobacterium
TVGCRLPALSYRLLARLQAETTPPQMGA

SEQ ID NO: 1328794 - protein, 26 aa, Mycobacterium
TVGGDYPRDWPRPQHGWTLTIEGDPS

SEQ ID NO: 1328795 - protein, 21 aa, Mycobacterium
TVGKPRRLVVAAAGIGKAWGQ

SEQ ID NO: 1328796 - protein, 26 aa, Mycobacterium
TVGLDGWYLMFQAPGGLNASMRPSLD

SEQ ID NO: 1328797 - protein, 25 aa, Mycobacterium
TVGPFLNRRAMIAEAGDALAVFGVS

SEQ ID NO: 1328798 - protein, 18 aa, Mycobacterium
TVGRTVDWRFAATVGAKL

SEQ ID NO: 1328799 - protein, 23 aa, Mycobacterium
TVGRTVDWRFAATVGAKLVRPGP

SEQ ID NO: 1328800 - protein, 19 aa, Mycobacterium
TVHHRIHRPLSALRPELTA

SEQ ID NO: 1328801 - protein, 20 aa, Mycobacterium
TVHIWGCGGLGSWIAEFIAR

SEQ ID NO: 1328802 - protein, 29 aa, Mycobacterium
TVHNPTVLGAEQPLPVLVAALGPVMLQIA

SEQ ID NO: 1328803 - protein, 29 aa, Mycobacterium
TVHPGVYVRSFYFLDPDGITLEFACWTKQ

SEQ ID NO: 1328804 - protein, 20 aa, Mycobacterium
TVHRRFQQPLRMLRPELDSR

SEQ ID NO: 1328805 - protein, 28 aa, Mycobacterium
TVIEDLKAWLTTVVSRLALDRLRSAAHR

SEQ ID NO: 1328806 - protein, 29 aa, Mycobacterium
TVIGLPPTVTVFGTPIFKLGGAPVKVVSS

SEQ ID NO: 1328807 - protein, 18 aa, Mycobacterium
TVIGQPRAIEHQRLGGLD

SEQ ID NO: 1328808 - protein, 17 aa, Mycobacterium
TVILPAAIRYQTELAQN

SEQ ID NO: 1328809 - protein, 28 aa, Mycobacterium
TVIMGRLTWESLPAKFRPLPGRRNVVVT

SEQ ID NO: 1328810 - protein, 24 aa, Mycobacterium
TVKKVKFPSDRGLLGLLPVQNREA

SEQ ID NO: 1328811 - protein, 29 aa, Mycobacterium
TVKRFRRTLAWFIYRKPGGRVALGVQYGH

SEQ ID NO: 1328812 - protein, 23 aa, Mycobacterium
TVKSHGWGVPGLSWMPGEDPDPF

SEQ ID NO: 1328813 - protein, 26 aa, Mycobacterium
TVKSHIGRIFLKLRLRDRAAAIVYAY

SEQ ID NO: 1328814 - protein, 25 aa, Mycobacterium
TVKVNRLLLRNVSVVGVGWGEFVNR

SEQ ID NO: 1328815 - protein, 25 aa, Mycobacterium
TVLAARGWALRPLSVSATAEQLGVA

SEQ ID NO: 1328816 - protein, 21 aa, Mycobacterium
TVLAQAIIKGGLRNVAAGANP

SEQ ID NO: 1328817 - protein, 23 aa, Mycobacterium
TVLDMMANAAFYYGMLRALSEED

SEQ ID NO: 1328818 - protein, 27 aa, Mycobacterium
TVLDSSRFRYLIAQQADLAVGNVHGLI

SEQ ID NO: 1328819 - protein, 26 aa, Mycobacterium
TVLGHYTHFGNLLDLLAVAVPVGSTA

SEQ ID NO: 1328820 - protein, 31 aa, Mycobacterium
TVLPNGRPHLVAMWYAVLDGEIWFETKAKSQ

SEQ ID NO: 1328821 - protein, 26 aa, Mycobacterium
TVLQQWPTFFDNAAGPLTGLPFDKDV

SEQ ID NO: 1328822 - protein, 21 aa, Mycobacterium
TVLRHSRIDWRARGRWVTGAE

SEQ ID NO: 1328823 - protein, 19 aa, Mycobacterium
TVLTLAPAFNELKSNWLRG

SEQ ID NO: 1328824 - protein, 18 aa, Mycobacterium
TVLTPRREQLTGDEAHER

SEQ ID NO: 1328825 - protein, 17 aa, Mycobacterium
TVLVLHESATRPLADAA

SEQ ID NO: 1328826 - protein, 29 aa, Mycobacterium
TVLVTGYDILFFWVARMMMFGTFVGDDPA

SEQ ID NO: 1328827 - protein, 17 aa, Mycobacterium
TVLYPRKGVSELTRFTP

SEQ ID NO: 1328828 - protein, 24 aa, Mycobacterium
TVMDVRFLPNPHWVDRLRPNTGQH

SEQ ID NO: 1328829 - protein, 19 aa, Mycobacterium
TVMLAELAAKYLPAGVLNV

SEQ ID NO: 1328830 - protein, 18 aa, Mycobacterium
TVMLRLDREVPGEVLAAI

SEQ ID NO: 1328831 - protein, 52 aa, Mycobacterium
TVNFEQLMRSFFAEKPLPPDATLVSWLPFYHDMGLVLGVCAPILCGRRAELM

SEQ ID NO: 1328832 - protein, 24 aa, Mycobacterium
TVNKIVEIPRPAGVVLALTPTTNP

SEQ ID NO: 1328833 - protein, 19 aa, Mycobacterium
TVNMQVGFLPPQDMIENAK

SEQ ID NO: 1328834 - protein, 35 aa, Mycobacterium
TVPAIRDWYARRGLTPWLAVPDRLVRLPLRDVHLE

SEQ ID NO: 1328835 - protein, 26 aa, Mycobacterium
TVPETPFDGLTALAAYVCGAPMALLS

SEQ ID NO: 1328836 - protein, 17 aa, Mycobacterium
TVPFIARYRKEATGSLD

SEQ ID NO: 1328837 - protein, 17 aa, Mycobacterium
TVPIVAAVGRVGAVSYA

SEQ ID NO: 1328838 - protein, 27 aa, Mycobacterium
TVPMPLPTLFSRWYGPIAPVKAVRDQT

SEQ ID NO: 1328839 - protein, 20 aa, Mycobacterium
TVQAQILRLLADLNRERELA

SEQ ID NO: 1328840 - protein, 23 aa, Mycobacterium
TVQFPVNPFLGIMGVARATEDPV

SEQ ID NO: 1328841 - protein, 24 aa, Mycobacterium
TVQNGAVKLPGGLWIVTERAVATE

SEQ ID NO: 1328842 - protein, 25 aa, Mycobacterium
TVRDPNKVIWLSQTTLSVDETMETV

SEQ ID NO: 1328843 - protein, 22 aa, Mycobacterium
TVRGAQFLEPLFEFPGACAGCG

SEQ ID NO: 1328844 - protein, 19 aa, Mycobacterium
TVRGGAFVRLSFAGPASDL

SEQ ID NO: 1328845 - protein, 17 aa, Mycobacterium
TVRIGYQSPNARLAATV

SEQ ID NO: 1328846 - protein, 20 aa, Mycobacterium
TVRIPVPDLPSPYSLAVVQL

SEQ ID NO: 1328847 - protein, 17 aa, Mycobacterium
TVRLLGRDPWRDAVDLH

SEQ ID NO: 1328848 - protein, 23 aa, Mycobacterium
TVRMIEAYHRLSKLNEYSAVDFT

SEQ ID NO: 1328849 - protein, 21 aa, Mycobacterium
TVRNLLGAPLTLRGPVTRADG

SEQ ID NO: 1328850 - protein, 31 aa, Mycobacterium
TVRQRVRWLALHGFVRGMSRLGMRRGDPQAR

SEQ ID NO: 1328851 - protein, 25 aa, Mycobacterium
TVRRSAPFATLPRSAFEATLDLLSG

SEQ ID NO: 1328852 - protein, 24 aa, Mycobacterium
TVRVDARFYGVKFGEDAYGAADSS

SEQ ID NO: 1328853 - protein, 25 aa, Mycobacterium
TVRVTRPSRFFVLDATAFAEFMQKE

SEQ ID NO: 1328854 - protein, 17 aa, Mycobacterium
TVRWHIPTRPVTARVAR

SEQ ID NO: 1328855 - protein, 34 aa, Mycobacterium
TVSGPLLPVSPPPPAAPWLPQAPVSTSSQIFAGP

SEQ ID NO: 1328856 - protein, 24 aa, Mycobacterium
TVSQPRPHILYLAALEEPGGSAAE

SEQ ID NO: 1328857 - protein, 26 aa, Mycobacterium
TVSVSFHEPVRWDGWLLYSHESTQVG

SEQ ID NO: 1328858 - protein, 27 aa, Mycobacterium
TVTLEDALRLLSLPRVVGVDPASGEEI

SEQ ID NO: 1328859 - protein, 30 aa, Mycobacterium
TVTNRARLNWWESRALYGWTVLVPRTKDQA

SEQ ID NO: 1328860 - protein, 23 aa, Mycobacterium
TVTPWGTFTYRPSKAARHAAAAT

SEQ ID NO: 1328861 - protein, 47 aa, Mycobacterium
TVTRLGAALWEAFNPFVPGSFLWKGYPYTLVTDLIKPFVSILCPECD

SEQ ID NO: 1328862 - protein, 29 aa, Mycobacterium
TVTSGYLRRPPLLVRALTTVPIACAHARD

SEQ ID NO: 1328863 - protein, 34 aa, Mycobacterium
TVTTRVFDIALGYPWPPTIPERVLRNAFTDSWHG

SEQ ID NO: 1328864 - protein, 18 aa, Mycobacterium
TVTVLLLGGRMRGRTLAT

SEQ ID NO: 1328865 - protein, 24 aa, Mycobacterium
TVTVPELLAVRPAPGVWHLVSTVT

SEQ ID NO: 1328866 - protein, 24 aa, Mycobacterium
TVTVPVSFHELALGATLSVPTLEG

SEQ ID NO: 1328867 - protein, 22 aa, Mycobacterium
TVTYGPIWDWQRSHVFEYLAGR

SEQ ID NO: 1328868 - protein, 17 aa, Mycobacterium
TVVAKLLTLFGTEEQKR

SEQ ID NO: 1328869 - protein, 25 aa, Mycobacterium
TVVALHRVAYLLYTQRKRMESHGVL

SEQ ID NO: 1328870 - protein, 18 aa, Mycobacterium
TVVDGRPLAIWTPSGEAA

SEQ ID NO: 1328871 - protein, 24 aa, Mycobacterium
TVVLKPAPDAPLGFGVLMEAIEEA

SEQ ID NO: 1328872 - protein, 29 aa, Mycobacterium
TVVLQVLHLLGTIPRIDALLPLPGSRNQL

SEQ ID NO: 1328873 - protein, 18 aa, Mycobacterium
TVVRRWLTLTGVHNYEPR

SEQ ID NO: 1328874 - protein, 28 aa, Mycobacterium
TVVWKPASTVPLLALRFAEALTDAGLPP

SEQ ID NO: 1328875 - protein, 21 aa, Mycobacterium
TVWSPLEYLGHLRESMAFHRW

SEQ ID NO: 1328876 - protein, 17 aa, Mycobacterium
TVYNLVGGMKAWREAGR

SEQ ID NO: 1328877 - protein, 26 aa, Mycobacterium
TVYQRTPIWVMPKFDLSFGPRTQRIF

SEQ ID NO: 1328878 - protein, 19 aa, Mycobacterium
TVYRHWPDRAALVADALAG

SEQ ID NO: 1328879 - protein, 18 aa, Mycobacterium
TVYYPLVSTPMIAPTQAY

SEQ ID NO: 1328880 - protein, 28 aa, Mycobacterium
TWAIARIGVEWWPELSLIDRSRHRGDVT

SEQ ID NO: 1328881 - protein, 17 aa, Mycobacterium
TWALLGRQDLRAAEDAL

SEQ ID NO: 1328882 - protein, 18 aa, Mycobacterium
TWAVLDWNENAIALYDAV

SEQ ID NO: 1328883 - protein, 23 aa, Mycobacterium
TWDTVVVGLGLPALAVDLPGHGR

SEQ ID NO: 1328884 - protein, 27 aa, Mycobacterium
TWEDVAWLREQWGGPFLLKGTVRVDDA

SEQ ID NO: 1328885 - protein, 27 aa, Mycobacterium
TWEHDLHLFLRRVALYRAMFGSPEDHH

SEQ ID NO: 1328886 - protein, 18 aa, Mycobacterium
TWESGIHVYLKRATLNRA

SEQ ID NO: 1328887 - protein, 19 aa, Mycobacterium
TWGGVYVHSAPWSVGSQGY

SEQ ID NO: 1328888 - protein, 24 aa, Mycobacterium
TWHIARPLPERAVIAKAAEVIRSA

SEQ ID NO: 1328889 - protein, 22 aa, Mycobacterium
TWHTMQEIWERGFKAVMADAVA

SEQ ID NO: 1328890 - protein, 17 aa, Mycobacterium
TWKPPATVPALHRGRGI

SEQ ID NO: 1328891 - protein, 17 aa, Mycobacterium
TWLPDLALRSLGGAVVW

SEQ ID NO: 1328892 - protein, 18 aa, Mycobacterium
TWLQRLDGQLSPSALWKL

SEQ ID NO: 1328893 - protein, 19 aa, Mycobacterium
TWRRNWPAPMPVPVDTHSP

SEQ ID NO: 1328894 - protein, 32 aa, Mycobacterium
TWSAREQRWFERLFLFVAFVNRFLPPFVRQGG

SEQ ID NO: 1328895 - protein, 23 aa, Mycobacterium
TWTAPELSIRFLQRISGPTELVM

SEQ ID NO: 1328896 - protein, 18 aa, Mycobacterium
TWTVRRFDPPSALEISGE

SEQ ID NO: 1328897 - protein, 19 aa, Mycobacterium
TWVEMRLGLQRPDTGLTFV

SEQ ID NO: 1328898 - protein, 17 aa, Mycobacterium
TWVIGGERIYTLALGRA

SEQ ID NO: 1328899 - protein, 21 aa, Mycobacterium
TYAALEGLLRDRHAREIFSTD

SEQ ID NO: 1328900 - protein, 18 aa, Mycobacterium
TYAAPLFVTAEFINNNTG

SEQ ID NO: 1328901 - protein, 17 aa, Mycobacterium
TYAKPRELRRLKSLLRR

SEQ ID NO: 1328902 - protein, 22 aa, Mycobacterium
TYANYVGKPLSYILATPPRPDD

SEQ ID NO: 1328903 - protein, 21 aa, Mycobacterium
TYDFFGLIFDGHPALTRIEMP

SEQ ID NO: 1328904 - protein, 18 aa, Mycobacterium
TYEQGALLVCPMCGHEWS

SEQ ID NO: 1328905 - protein, 24 aa, Mycobacterium
TYGAEFFRWFAEEAVRIEGRYTPA

SEQ ID NO: 1328906 - protein, 18 aa, Mycobacterium
TYGRLDILIHNAGNVRRA

SEQ ID NO: 1328907 - protein, 34 aa, Mycobacterium
TYHAFAGMLLRDHGLLLPIEPETRLLGETELWQL

SEQ ID NO: 1328908 - protein, 18 aa, Mycobacterium
TYIIGDRYSHLVMDSSTY

SEQ ID NO: 1328909 - protein, 19 aa, Mycobacterium
TYLLPELIGRQNAAWILMS

SEQ ID NO: 1328910 - protein, 18 aa, Mycobacterium
TYLRYELVEQGRVAVITL

SEQ ID NO: 1328911 - protein, 18 aa, Mycobacterium
TYLSCDGVWYTVATGTVR

SEQ ID NO: 1328912 - protein, 19 aa, Mycobacterium
TYRAARLIRALVCAGQRVG

SEQ ID NO: 1328913 - protein, 20 aa, Mycobacterium
TYRIPLVPNARRFEAGHRVR

SEQ ID NO: 1328914 - protein, 23 aa, Mycobacterium
TYSARYDWPVRTGIIIGRLDADG

SEQ ID NO: 1328915 - protein, 27 aa, Mycobacterium
TYTSSQGLLLMIPNMYKIAGELTSAVI

SEQ ID NO: 1328916 - protein, 25 aa, Mycobacterium
TYTTQEFPPPLPYKGNRSPDVFKPY

SEQ ID NO: 1328917 - protein, 25 aa, Mycobacterium
TYVKLVTGVFVYVAFVIDAYAGSIV

SEQ ID NO: 1328918 - protein, 21 aa, Mycobacterium
TYYVFGVTDWGRLVFCGSPRR

SEQ ID NO: 1328919 - protein, 18 aa, Mycobacterium
VAAAGFLLVDPMDRLRLL

SEQ ID NO: 1328920 - protein, 29 aa, Mycobacterium
VAAEGIEPFGFYYEKFALAAPAAETSAAA

SEQ ID NO: 1328921 - protein, 18 aa, Mycobacterium
VAAEPGRRFAWEVNHGWA

SEQ ID NO: 1328922 - protein, 23 aa, Mycobacterium
VAAGAGLIDLMLAAGGELVTVLT

SEQ ID NO: 1328923 - protein, 33 aa, Mycobacterium
VAAGIPWDVPALTINKMCLSGIDAIALADQLIR

SEQ ID NO: 1328924 - protein, 24 aa, Mycobacterium
VAAGPTLSFGWTKRALAAAALDRL

SEQ ID NO: 1328925 - protein, 32 aa, Mycobacterium; identical to SEQ ID NO: 869789

SEQ ID NO: 1328926 - protein, 18 aa, Mycobacterium
VAAIFPDGPQRYFDTIYN

SEQ ID NO: 1328927 - protein, 18 aa, Mycobacterium
VAAIFPDGPQRYFDTVYN

SEQ ID NO: 1328928 - protein, 19 aa, Mycobacterium
VAALADWLRDPDAPAPARA

SEQ ID NO: 1328929 - protein, 23 aa, Mycobacterium
VAALARLDLGSVLIPMPEAGQVQ

SEQ ID NO: 1328930 - protein, 29 aa, Mycobacterium
VAALERLETLLALIEGWVQTVVTAALGDR

SEQ ID NO: 1328931 - protein, 25 aa, Mycobacterium
VAALIYFRDKVLMTHRWQSSGGASL

SEQ ID NO: 1328932 - protein, 25 aa, Mycobacterium
VAALPAARWTLPTPAPGWTIAHQIG

SEQ ID NO: 1328933 - protein, 24 aa, Mycobacterium
VAALRSIGITPDALILRCDRDVPE

SEQ ID NO: 1328934 - protein, 24 aa, Mycobacterium
VAANLMIQGWKRDPSIVDTLAAAG

SEQ ID NO: 1328935 - protein, 19 aa, Mycobacterium
VAANTYPIAALAGSRNPDA

SEQ ID NO: 1328936 - protein, 21 aa, Mycobacterium
VAANWWPQLGVAGIGLWAENV

SEQ ID NO: 1328937 - protein, 19 aa, Mycobacterium
VAAPPLPPAPGGAGAVPAG

SEQ ID NO: 1328938 - protein, 26 aa, Mycobacterium
VAAPSAFFQLAFSKVGLMPDGGASAL

SEQ ID NO: 1328939 - protein, 19 aa, Mycobacterium
VAARHGLRISFSPVPFEGA

SEQ ID NO: 1328940 - protein, 32 aa, Mycobacterium
VAARVGRPPVIRRAILTLFADRAPEVGVPGEW

SEQ ID NO: 1328941 - protein, 20 aa, Mycobacterium
VAARWGLWDQPAVLVAQTYL

SEQ ID NO: 1328942 - protein, 29 aa, Mycobacterium
VAASTWQVPKLYWTVTSSSALAAALASMG

SEQ ID NO: 1328943 - protein, 22 aa, Mycobacterium
VAASWFTGTPPPVDALIIGSID

SEQ ID NO: 1328944 - protein, 24 aa, Mycobacterium
VAATGVIWLQHGFLGNKASLSKLA

SEQ ID NO: 1328945 - protein, 20 aa, Mycobacterium
VAAVLRGFSFAWKICPDDPP

SEQ ID NO: 1328946 - protein, 18 aa, Mycobacterium
VAAVRFLIEGLVDGAPAI

SEQ ID NO: 1328947 - protein, 19 aa, Mycobacterium
VAAVRYPWGEIVTGRRHRN

SEQ ID NO: 1328948 - protein, 18 aa, Mycobacterium
VAAWTELVSGRDAPPAAD

SEQ ID NO: 1328949 - protein, 24 aa, Mycobacterium
VAAYRARKAGERPTWAPLPVQYTD

SEQ ID NO: 1328950 - protein, 23 aa, Mycobacterium
VACRPWLLAELDAVRPEVVVLLG

SEQ ID NO: 1328951 - protein, 29 aa, Mycobacterium
VACTRVDYGLCPFAGWPVAIPDGAEPNTG

SEQ ID NO: 1328952 - protein, 20 aa, Mycobacterium
VACYALPAARRALDLTKAYA

SEQ ID NO: 1328953 - protein, 23 aa, Mycobacterium
VADAWHHRLLIWNQVPESDDVAP

SEQ ID NO: 1328954 - protein, 29 aa, Mycobacterium
VADFPADPFNLLAMLNIGAGILSSVHLDY

SEQ ID NO: 1328955 - protein, 30 aa, Mycobacterium
VADFTYVKLVTGVFVYVAFVIDAYAGSIVG

SEQ ID NO: 1328956 - protein, 24 aa, Mycobacterium
VADGGLPWRYHPDGSVALASPPKE

SEQ ID NO: 1328957 - protein, 20 aa, Mycobacterium
VADHLPGLSAMLRISRDVGA

SEQ ID NO: 1328958 - protein, 27 aa, Mycobacterium
VADIARPYPIPIICALLGAPREDWRLF

SEQ ID NO: 1328959 - protein, 17 aa, Mycobacterium
VADLIAEYGPDVPLPPS

SEQ ID NO: 1328960 - protein, 18 aa, Mycobacterium
VADLLTFQARLLARAPRP

SEQ ID NO: 1328961 - protein, 22 aa, Mycobacterium
VADLTGLPVRLGGDGLCMALGE

SEQ ID NO: 1328962 - protein, 25 aa, Mycobacterium
VADNLPPELIAQMVDLGLAAGSRIT

SEQ ID NO: 1328963 - protein, 23 aa, Mycobacterium
VADPPLHPMPFHANFDAPIYDEV

SEQ ID NO: 1328964 - protein, 20 aa, Mycobacterium
VADQPVPYGWLPARARTVFG

SEQ ID NO: 1328965 - protein, 22 aa, Mycobacterium
VADRLFPTLRERGLIGTDKSGT

SEQ ID NO: 1328966 - protein, 17 aa, Mycobacterium
VADTDAALEILRAELRP

SEQ ID NO: 1328967 - protein, 19 aa, Mycobacterium
VADVAIIWARSKEGVLGFA

SEQ ID NO: 1328968 - protein, 30 aa, Mycobacterium
VAEALRALHRRCADVRYLGSWPTGDVVGAA

SEQ ID NO: 1328969 - protein, 25 aa, Mycobacterium
VAEAVEFLLSPRASFITAQTLLVDG

SEQ ID NO: 1328970 - protein, 19 aa, Mycobacterium
VAEENYWFRRHEVVYRRLV

SEQ ID NO: 1328971 - protein, 20 aa, Mycobacterium
VAEFAKILARLIPAGATVAT

SEQ ID NO: 1328972 - protein, 25 aa, Mycobacterium
VAEFGRLDFVLANAGILPAAGPQGL

SEQ ID NO: 1328973 - protein, 19 aa, Mycobacterium
VAEGIVYRVPGRGTYARET

SEQ ID NO: 1328974 - protein, 30 aa, Mycobacterium
VAEGRAYRALADPIALSAALQLGHDRLLDV

SEQ ID NO: 1328975 - protein, 27 aa, Mycobacterium
VAEHSRRFILHRVREAFARRGWIPPSS

SEQ ID NO: 1328976 - protein, 19 aa, Mycobacterium
VAEIARLLKPAGRLAFSAW

SEQ ID NO: 1328977 - protein, 18 aa, Mycobacterium
VAEILFGLGKIQRPEVME

SEQ ID NO: 1328978 - protein, 30 aa, Mycobacterium
VAEIYDAFTYMLLLTLEDLGFCPKGEGGGF

SEQ ID NO: 1328979 - protein, 27 aa, Mycobacterium
VAELDRGTWTPAPVFGMIAQRGRIERA

SEQ ID NO: 1328980 - protein, 22 aa, Mycobacterium
VAELGRLDIILANAGIGNGGQT

SEQ ID NO: 1328981 - protein, 19 aa, Mycobacterium
VAELLDLVGLPTDFASRYP

SEQ ID NO: 1328982 - protein, 23 aa, Mycobacterium
VAELRTRLRTILGRELGMPDNAV

SEQ ID NO: 1328983 - protein, 21 aa, Mycobacterium
VAELSHWAALHYPGAVQTHYW

SEQ ID NO: 1328984 - protein, 22 aa, Mycobacterium
VAELYRARRMPYTAGLLGSVPR

SEQ ID NO: 1328985 - protein, 23 aa, Mycobacterium
VAEMMWRIMKFKPAERAKGAQVP

SEQ ID NO: 1328986 - protein, 17 aa, Mycobacterium
VAEPLVDAFAAALGRLG

SEQ ID NO: 1328987 - protein, 18 aa, Mycobacterium
VAERLLARNGWRSTSLAQ

SEQ ID NO: 1328988 - protein, 28 aa, Mycobacterium
VAESKALVRLYLALVALLRGDMERAEDE

SEQ ID NO: 1328989 - protein, 17 aa, Mycobacterium
VAETAAVTVCYMGVNGR

SEQ ID NO: 1328990 - protein, 20 aa, Mycobacterium
VAETIDWGRTLLALGMDTVD

SEQ ID NO: 1328991 - protein, 23 aa, Mycobacterium
VAETRRVLALQPGPTVLAGHSWS

SEQ ID NO: 1328992 - protein, 25 aa, Mycobacterium
VAEVQTYVPGYRLLNEPQFDEPSVV

SEQ ID NO: 1328993 - protein, 18 aa, Mycobacterium
VAFALKRRAITNTVILES

SEQ ID NO: 1328994 - protein, 20 aa, Mycobacterium
VAFIQYQYGIYGGAAGEHVL

SEQ ID NO: 1328995 - protein, 17 aa, Mycobacterium
VAFVERMAALVAPVFGT

SEQ ID NO: 1328996 - protein, 27 aa, Mycobacterium
VAGAAHFLEHLLFKATPTRTAVQIAQA

SEQ ID NO: 1328997 - protein, 26 aa, Mycobacterium
VAGEADYIWRTWHPRTRPDGIADDAT

SEQ ID NO: 1328998 - protein, 25 aa, Mycobacterium
VAGERFDLIVSNPPFVVGTGSLDYI

SEQ ID NO: 1328999 - protein, 29 aa, Mycobacterium
VAGFSHFTLLLVHALRQQFSRVRVFAFID

SEQ ID NO: 1329000 - protein, 24 aa, Mycobacterium
VAGIISDIWLANLVAFSGHRATAA

SEQ ID NO: 1329001 - protein, 19 aa, Mycobacterium
VAGLAAALAAHRRGRRVVL

SEQ ID NO: 1329002 - protein, 28 aa, Mycobacterium
VAGLIQRRPPVRLPIAATLGLTLAEDIV

SEQ ID NO: 1329003 - protein, 24 aa, Mycobacterium
VAGLSQYHFARLFKKRFGAPPHAY

SEQ ID NO: 1329004 - protein, 25 aa, Mycobacterium
VAGMADMGLFGLPFPEEYGGMGGDY

SEQ ID NO: 1329005 - protein, 17 aa, Mycobacterium
VAGPNWMLIGDAAACVN

SEQ ID NO: 1329006 - protein, 26 aa, Mycobacterium
VAGRAKMVLVGDPYQLAPVKARGGMF

SEQ ID NO: 1329007 - protein, 29 aa, Mycobacterium
VAGRIRSAGAIFVGPWSPVSLGDYCAGSN

SEQ ID NO: 1329008 - protein, 26 aa, Mycobacterium
VAGSLRDGLRRNDVAIRWGGEEFLVF

SEQ ID NO: 1329009 - protein, 17 aa, Mycobacterium
VAGTPVLVCRLDETLYA

SEQ ID NO: 1329010 - protein, 23 aa, Mycobacterium
VAGVVRRLGHVPLAIAMAASYFR

SEQ ID NO: 1329011 - protein, 24 aa, Mycobacterium
VAGYVRKGSLWPATFGLACCAIEM

SEQ ID NO: 1329012 - protein, 22 aa, Mycobacterium
VAHHNILFGGAWEQTFRDIIDE

SEQ ID NO: 1329013 - protein, 21 aa, Mycobacterium
VAHPGVPRFDCWRGMAIPGHA

SEQ ID NO: 1329014 - protein, 24 aa, Mycobacterium
VAHPRALLAAFRGYAKIVGRHDDP

SEQ ID NO: 1329015 - protein, 24 aa, Mycobacterium
VAHRARWLVRVMTSLMLFPGHDET

SEQ ID NO: 1329016 - protein, 25 aa, Mycobacterium
VAHRPSVLYWVIQPGANVGGIGAGL

SEQ ID NO: 1329017 - protein, 24 aa, Mycobacterium
VAIARAFVNRPLVLLADEPTGNLD

SEQ ID NO: 1329018 - protein, 23 aa, Mycobacterium
VAIKMLPAVLGPDAPVQAVVAGA

SEQ ID NO: 1329019 - protein, 21 aa, Mycobacterium
VAILEPKLRAFARAALDAIDP

SEQ ID NO: 1329020 - protein, 28 aa, Mycobacterium
VAISSNFFYTVTLPVTLWFMDKAKAGTQ

SEQ ID NO: 1329021 - protein, 29 aa, Mycobacterium
VAISSNFFYTVTLPVTLWFMDKAKAGTQR

SEQ ID NO: 1329022 - protein, 23 aa, Mycobacterium
VAKGEFFTVRLRVTNIGDDARSF

SEQ ID NO: 1329023 - protein, 22 aa, Mycobacterium
VAKGYPDFPIVLEAVRECLQDV

SEQ ID NO: 1329024 - protein, 17 aa, Mycobacterium
VAKLVKRTLDGWLRELT

SEQ ID NO: 1329025 - protein, 23 aa, Mycobacterium
VAKTLTLWAGLIGAISLEVFGQY

SEQ ID NO: 1329026 - protein, 23 aa, Mycobacterium
VAKWMRRTTLLRPARLAGLRAEV

SEQ ID NO: 1329027 - protein, 18 aa, Mycobacterium
VAKYLLEFERGGGASAPA

SEQ ID NO: 1329028 - protein, 28 aa, Mycobacterium
VALADRLPHVAALFTAGLITDLLVRAIV

SEQ ID NO: 1329029 - protein, 30 aa, Mycobacterium
VALALVLPCWTLLGILDRAVALTVAHVSLR

SEQ ID NO: 1329030 - protein, 27 aa, Mycobacterium
VALGELLAERAVLPQGTLYASTPHQTV

SEQ ID NO: 1329031 - protein, 22 aa, Mycobacterium
VALGFGFRCGFLGLLHMEITRE

SEQ ID NO: 1329032 - protein, 24 aa, Mycobacterium
VALGHYPPWIGQCPAGTWSTALLP

SEQ ID NO: 1329033 - protein, 25 aa, Mycobacterium
VALKPDACCYNPLWPSVDELVRLLE

SEQ ID NO: 1329034 - protein, 27 aa, Mycobacterium
VALLPGVKVLPLVALAEAIRAGAAIKI

SEQ ID NO: 1329035 - protein, 17 aa, Mycobacterium
VALNVLGALGLITLGRA

SEQ ID NO: 1329036 - protein, 23 aa, Mycobacterium
VALPEGCFPAFVAAGADGAVWAT

SEQ ID NO: 1329037 - protein, 24 aa, Mycobacterium
VALPGGGFIRRLPADGLELDLLVP

SEQ ID NO: 1329038 - protein, 24 aa, Mycobacterium
VALQRALSTGYFRPYTNADVIGAE

SEQ ID NO: 1329039 - protein, 25 aa, Mycobacterium
VALQRVRELIDRYPLRGIKGPMGTA

SEQ ID NO: 1329040 - protein, 19 aa, Mycobacterium
VALRGPVTGLLLAAVRRKT

SEQ ID NO: 1329041 - protein, 17 aa, Mycobacterium
VALRRALIDLGLGLWLT

SEQ ID NO: 1329042 - protein, 17 aa, Mycobacterium
VALVLAGESFHAAAQRS

SEQ ID NO: 1329043 - protein, 20 aa, Mycobacterium
VAMAINYGYNKVRFITPVRV

SEQ ID NO: 1329044 - protein, 34 aa, Mycobacterium
VAMESRSWLFPKGLATFIGLRDQSCRTPYCDAPI

SEQ ID NO: 1329045 - protein, 20 aa, Mycobacterium
VAMFRSKMDAAALLHQLSAG

SEQ ID NO: 1329046 - protein, 18 aa, Mycobacterium
VAMGARYLDTGAMYRIVT

SEQ ID NO: 1329047 - protein, 20 aa, Mycobacterium
VAMNVMLRRTFKATLELTAP

SEQ ID NO: 1329048 - protein, 23 aa, Mycobacterium
VAMPSSLLGLLSQIPNHTPVEAP

SEQ ID NO: 1329049 - protein, 18 aa, Mycobacterium
VAMYFHDSYLARIRAMSV

SEQ ID NO: 1329050 - protein, 18 aa, Mycobacterium
VANGFWRQPTLQTAAQIG

SEQ ID NO: 1329051 - protein, 24 aa, Mycobacterium
VANHSWVLYGLRSGLPRLAEALAP

SEQ ID NO: 1329052 - protein, 31 aa, Mycobacterium
VANRAVLGVYRPLLDPLGLTHPQYLVMLVLW

SEQ ID NO: 1329053 - protein, 20 aa, Mycobacterium
VANYLLIPTRDDQASLGGVE

SEQ ID NO: 1329054 - protein, 19 aa, Mycobacterium
VAPAGRWIIDPDGAVVRSG

SEQ ID NO: 1329055 - protein, 17 aa, Mycobacterium
VAPEFTLALIRDTFPNL

SEQ ID NO: 1329056 - protein, 24 aa, Mycobacterium
VAPGLTIPGKLDKLGYKGIDTTEL

SEQ ID NO: 1329057 - protein, 22 aa, Mycobacterium
VAPGPVWTPLIPATMDAEKTAS

SEQ ID NO: 1329058 - protein, 17 aa, Mycobacterium
VAPIRVETPLRWVAPQL

SEQ ID NO: 1329059 - protein, 18 aa, Mycobacterium
VAPMPGGWPVELGQILRY

SEQ ID NO: 1329060 - protein, 24 aa, Mycobacterium
VAPRFIDTLTPFRPDRRWGGDNTD

SEQ ID NO: 1329061 - protein, 26 aa, Mycobacterium
VAPSIISLTLLPKMAPRAAGRYFVTG

SEQ ID NO: 1329062 - protein, 26 aa, Mycobacterium
VAPSIISLTLLPKMTARAAGRYFVTG

SEQ ID NO: 1329063 - protein, 23 aa, Mycobacterium
VAQAIGSALFEEILIGPDGAVMT

SEQ ID NO: 1329064 - protein, 20 aa, Mycobacterium
VAQALGCRYSIGLYSSSGAT

SEQ ID NO: 1329065 - protein, 26 aa, Mycobacterium
VAQILKFMPNFMFNPAPYPEIGTRDD

SEQ ID NO: 1329066 - protein, 29 aa, Mycobacterium
VAQIYDCYTFTALLTLEDYGFVPKGEGGP

SEQ ID NO: 1329067 - protein, 26 aa, Mycobacterium
VAQMTRPVRWDLCTASMKDLGVTAIV

SEQ ID NO: 1329068 - protein, 29 aa, Mycobacterium
VAQTMPNWHYLHIHNDVLPALRARGVTDE

SEQ ID NO: 1329069 - protein, 25 aa, Mycobacterium
VAQVTLQNYFRMYEKLAGMTGTAET

SEQ ID NO: 1329070 - protein, 20 aa, Mycobacterium
VAQWVGLQEGNDAYFCVVDL

SEQ ID NO: 1329071 - protein, 21 aa, Mycobacterium
VARAFEFGALATSALLVGAAQ

SEQ ID NO: 1329072 - protein, 25 aa, Mycobacterium
VARALTLARLDAVALLPAADGDPMV

SEQ ID NO: 1329073 - protein, 20 aa, Mycobacterium
VARDLARLMTPFAERYGVID

SEQ ID NO: 1329074 - protein, 21 aa, Mycobacterium
VARFYRGRDCMTWLADMGLYD

SEQ ID NO: 1329075 - protein, 30 aa, Mycobacterium; identical to SEQ ID NO: 870426

SEQ ID NO: 1329076 - protein, 28 aa, Mycobacterium
VARIAVPVQLFLYGYNRGYLEFVLENPP

SEQ ID NO: 1329077 - protein, 28 aa, Mycobacterium
VARIDWATFLPVYQLQRRRAFLSQLERE

SEQ ID NO: 1329078 - protein, 26 aa, Mycobacterium
VARIDWERFLPLYQQAGRRAFLAELE

SEQ ID NO: 1329079 - protein, 17 aa, Mycobacterium
VARLADLLLRSGIDDDR

SEQ ID NO: 1329080 - protein, 19 aa, Mycobacterium
VARLKALLPYIDGGAESPR

SEQ ID NO: 1329081 - protein, 18 aa, Mycobacterium
VARLKPGIILCREKGDAT

SEQ ID NO: 1329082 - protein, 17 aa, Mycobacterium
VARMRTPVVGAINGATF

SEQ ID NO: 1329083 - protein, 17 aa, Mycobacterium
VARPLLASLRPELMCLY

SEQ ID NO: 1329084 - protein, 22 aa, Mycobacterium
VARRGLPLITDSFQYPIEGFTD

SEQ ID NO: 1329085 - protein, 24 aa, Mycobacterium
VARRIPMFEFAIRSLIPAGDVLDN

SEQ ID NO: 1329086 - protein, 19 aa, Mycobacterium
VARRIPMFEFAVRSLIPSG

SEQ ID NO: 1329087 - protein, 17 aa, Mycobacterium
VARSALWLGSDESSFVT

SEQ ID NO: 1329088 - protein, 20 aa, Mycobacterium
VARSYPLIPGIDVAGTVTSS

SEQ ID NO: 1329089 - protein, 25 aa, Mycobacterium
VARTGRLDLIFNNAGIVWGGDTELL

SEQ ID NO: 1329090 - protein, 17 aa, Mycobacterium
VARVLREFNPQLRLIGV

SEQ ID NO: 1329091 - protein, 25 aa, Mycobacterium
VASATPLPVIGVPVPLARLDGLDSL

SEQ ID NO: 1329092 - protein, 17 aa, Mycobacterium
VASIYRTRDNRFISFVL

SEQ ID NO: 1329093 - protein, 24 aa, Mycobacterium
VASKAHARVLFRAGLLTEEQRDGL

SEQ ID NO: 1329094 - protein, 17 aa, Mycobacterium
VASLFGGLVRSLAAHLD

SEQ ID NO: 1329095 - protein, 19 aa, Mycobacterium
VASLFSRRGYNIQSLAVGA

SEQ ID NO: 1329096 - protein, 17 aa, Mycobacterium
VASLLADAGLNPKVLPG

SEQ ID NO: 1329097 - protein, 28 aa, Mycobacterium
VASLMRVSKMTVYRLVHNGELPAVRVGR

SEQ ID NO: 1329098 - protein, 19 aa, Mycobacterium
VASRKPPLFGINPDARVTA

SEQ ID NO: 1329099 - protein, 22 aa, Mycobacterium
VASTFVDYLLPTATEVPPIEFG

SEQ ID NO: 1329100 - protein, 18 aa, Mycobacterium
VASVELLLATDWTARVRA

SEQ ID NO: 1329101 - protein, 26 aa, Mycobacterium
VASVLLSGAVFYRILMTAEAPDPGDI

SEQ ID NO: 1329102 - protein, 30 aa, Mycobacterium
VASVPDRALLLVHHPLLLRGVDSVAADTAK

SEQ ID NO: 1329103 - protein, 19 aa, Mycobacterium
VATAMIPFLEHDDANRALM

SEQ ID NO: 1329104 - protein, 17 aa, Mycobacterium
VATILGRQAPDRLRALF

SEQ ID NO: 1329105 - protein, 19 aa, Mycobacterium
VATIQLPVVCTVRGWAVGL

SEQ ID NO: 1329106 - protein, 18 aa, Mycobacterium
VATLIDIAAGRLAERHVG

SEQ ID NO: 1329107 - protein, 23 aa, Mycobacterium
VATSGQLLRFYSRSRLDIEIRDG

SEQ ID NO: 1329108 - protein, 24 aa, Mycobacterium
VATVRAHAHRFYPFADAEALVGDF

SEQ ID NO: 1329109 - protein, 17 aa, Mycobacterium
VATWKNPSATTLSSSPA

SEQ ID NO: 1329110 - protein, 18 aa, Mycobacterium
VAVARTLIGYFGGPAAPG

SEQ ID NO: 1329111 - protein, 31 aa, Mycobacterium
VAVEHGVWLRPFRNLVYVMPPYICTAAEVDQ

SEQ ID NO: 1329112 - protein, 18 aa, Mycobacterium
VAVFLDLELTVPGGAVLP

SEQ ID NO: 1329113 - protein, 18 aa, Mycobacterium
VAVLARLKRDLGVTVLVV

SEQ ID NO: 1329114 - protein, 17 aa, Mycobacterium
VAVLRAMRALNIVGADV

SEQ ID NO: 1329115 - protein, 18 aa, Mycobacterium
VAVLYYRAQHLAGNTGYV

SEQ ID NO: 1329116 - protein, 19 aa, Mycobacterium
VAVMGDLSRRRWWPLAEIV

SEQ ID NO: 1329117 - protein, 18 aa, Mycobacterium
VAVPFTNLIDYRFEIRYS

SEQ ID NO: 1329118 - protein, 18 aa, Mycobacterium
VAVPGRHLLTRDHRIVLS

SEQ ID NO: 1329119 - protein, 19 aa, Mycobacterium
VAVPMIILNTIMADSFDYM

SEQ ID NO: 1329120 - protein, 20 aa, Mycobacterium
VAVPYLERMDLAYAAADLAV

SEQ ID NO: 1329121 - protein, 19 aa, Mycobacterium
VAVRHWRAALGLTSADRMQ

SEQ ID NO: 1329122 - protein, 18 aa, Mycobacterium
VAVRQYLEPIAELCARCH

SEQ ID NO: 1329123 - protein, 25 aa, Mycobacterium
VAVTREVLGAGIPLFGICFGNQILG

SEQ ID NO: 1329124 - protein, 30 aa, Mycobacterium
VCAAPRIESVLPAFLEFARGSVLVAHNAGF

SEQ ID NO: 1329125 - protein, 29 aa, Mycobacterium
VCAEYRGQWLICRALEVVLGWIADDNCGA

SEQ ID NO: 1329126 - protein, 20 aa, Mycobacterium
VCALLSDWLPATTGTVIFAD

SEQ ID NO: 1329127 - protein, 17 aa, Mycobacterium
VCAPLSALPIVMVPDRR

SEQ ID NO: 1329128 - protein, 20 aa, Mycobacterium
VCATFQYLFDKNATGIVGPR

SEQ ID NO: 1329129 - protein, 25 aa, Mycobacterium
VCEEALGGVLFIDEAYRLVPETEGH

SEQ ID NO: 1329130 - protein, 29 aa, Mycobacterium
VCIGLSPAWGRSVWLTLCGLTIGEVLRQI

SEQ ID NO: 1329131 - protein, 21 aa, Mycobacterium
VCIGSRPAQGPPIGCIAKVLA

SEQ ID NO: 1329132 - protein, 25 aa, Mycobacterium
VCKQLTLVWVAVLQAALDAVIRANS

SEQ ID NO: 1329133 - protein, 22 aa, Mycobacterium
VCLGQHVMPFPAGTIGMHAGPF

SEQ ID NO: 1329134 - protein, 24 aa, Mycobacterium
VCLQMHLLVLSYNLAVRARANGDA

SEQ ID NO: 1329135 - protein, 18 aa, Mycobacterium
VCMGPWPALSLRDACQRG

SEQ ID NO: 1329136 - protein, 24 aa, Mycobacterium
VCNPTTDIPLPWVRNEVTVLNLTG

SEQ ID NO: 1329137 - protein, 17 aa, Mycobacterium
VCPAPLRDAPNIVMGHG

SEQ ID NO: 1329138 - protein, 17 aa, Mycobacterium
VCPDYVLVPEYLVDEFS

SEQ ID NO: 1329139 - protein, 18 aa, Mycobacterium
VCPGAILTPMIEPLYLEN

SEQ ID NO: 1329140 - protein, 18 aa, Mycobacterium
VCPLPVEVSAVPGALKIL

SEQ ID NO: 1329141 - protein, 25 aa, Mycobacterium
VCQDWGGLIGLRLVGEHPDRFARVV

SEQ ID NO: 1329142 - protein, 26 aa, Mycobacterium
VCSAQAQLIARWMLVGFVHGVMNTDN

SEQ ID NO: 1329143 - protein, 30 aa, Mycobacterium
VCSTAMTPWIWPTMHLNPPNWIEPITVACE

SEQ ID NO: 1329144 - protein, 18 aa, Mycobacterium
VCVGIAPDLFDLDDDDYA

SEQ ID NO: 1329145 - protein, 17 aa, Mycobacterium
VCYQDVPAPLLPSAIAE

SEQ ID NO: 1329146 - protein, 24 aa, Mycobacterium
VDAAAPGARLAWRDDARWAPHGGE

SEQ ID NO: 1329147 - protein, 22 aa, Mycobacterium
VDAADIHALGGWWAEVLGYAQE

SEQ ID NO: 1329148 - protein, 29 aa, Mycobacterium
VDAADWAEMLMRMYIRWAEQHKYPVEVFD

SEQ ID NO: 1329149 - protein, 17 aa, Mycobacterium
VDAAGPGWWLPSLLVRR

SEQ ID NO: 1329150 - protein, 18 aa, Mycobacterium
VDAALPYLLEADSGSIVT

SEQ ID NO: 1329151 - protein, 23 aa, Mycobacterium
VDADLLFTQTYVDQVRLAETIRA

SEQ ID NO: 1329152 - protein, 24 aa, Mycobacterium
VDADVIWAIPQLHSLVVVREDVET

SEQ ID NO: 1329153 - protein, 22 aa, Mycobacterium
VDAFLDLVLEHGKGLRWRTTIS

SEQ ID NO: 1329154 - protein, 21 aa, Mycobacterium
VDAGRWLLIATSTDAQPEAAR

SEQ ID NO: 1329155 - protein, 23 aa, Mycobacterium
VDAGSALMIMTLGAGNGAEVTVS

SEQ ID NO: 1329156 - protein, 29 aa, Mycobacterium
VDALGALVFWRLIALGKPVSARHLDRVAA

SEQ ID NO: 1329157 - protein, 31 aa, Mycobacterium
VDALIKVVTYKFAAAWPGWTPQRLKAHAQSR

SEQ ID NO: 1329158 - protein, 17 aa, Mycobacterium
VDALIWAAGPASGLGVD

SEQ ID NO: 1329159 - protein, 26 aa, Mycobacterium
VDALLPVPAEPVATLILTELRSAVAT

SEQ ID NO: 1329160 - protein, 27 aa, Mycobacterium
VDAMPLHNRILLPERLGPGRVRLATLG

SEQ ID NO: 1329161 - protein, 27 aa, Mycobacterium
VDAPEPPLRVFFGELPLELARADYESR

SEQ ID NO: 1329162 - protein, 21 aa, Mycobacterium
VDAQFEYYFSEPFPIIGATLE

SEQ ID NO: 1329163 - protein, 26 aa, Mycobacterium
VDATANSLLPQWRGQAGEAAQAALLR

SEQ ID NO: 1329164 - protein, 30 aa, Mycobacterium
VDATGVPAERWGWLPLLTGLAVAHVVREDY

SEQ ID NO: 1329165 - protein, 27 aa, Mycobacterium
VDAVLCAYVGLYWYHRPEDVTIYGDAA

SEQ ID NO: 1329166 - protein, 29 aa, Mycobacterium
VDAVRVVNLLSWRYRDPGLLLAQRIRADK

SEQ ID NO: 1329167 - protein, 25 aa, Mycobacterium
VDCLGTWLTAVLDRNNLWDKGSREV

SEQ ID NO: 1329168 - protein, 25 aa, Mycobacterium
VDDEGYLYLADRKAFMIISGGVNIY

SEQ ID NO: 1329169 - protein, 24 aa, Mycobacterium
VDDMFRSLQALAALPGDPTVFPGH

SEQ ID NO: 1329170 - protein, 28 aa, Mycobacterium
VDDQELVRSGLRRILRRKDGIAVVGECA

SEQ ID NO: 1329171 - protein, 25 aa, Mycobacterium
VDDQRRWRAELGRYVLAVGGIEPRK

SEQ ID NO: 1329172 - protein, 25 aa, Mycobacterium
VDDRITLLDLVAPAGLRPGVEVGQS

SEQ ID NO: 1329173 - protein, 28 aa, Mycobacterium
VDEAAELMINLFWLGLKGAPSAADVDAT

SEQ ID NO: 1329174 - protein, 31 aa, Mycobacterium
VDEEIARVVPFIEWLRATFPDRVISVDTWRA

SEQ ID NO: 1329175 - protein, 34 aa, Mycobacterium
VDELLTGRENIRMIGGLYGIRRKDLDRLGDQLLH

SEQ ID NO: 1329176 - protein, 19 aa, Mycobacterium
VDEPIDIMPGTRLASILGA

SEQ ID NO: 1329177 - protein, 20 aa, Mycobacterium
VDEPIILRVASDVTDELHVH

SEQ ID NO: 1329178 - protein, 25 aa, Mycobacterium
VDERVLPRAIIYDAALTLSLPVDMS

SEQ ID NO: 1329179 - protein, 34 aa, Mycobacterium
VDESRLTFLAVRRWYGWSAGRIINIDIGGGSLEL

SEQ ID NO: 1329180 - protein, 28 aa, Mycobacterium
VDESRRWSHLCDRLWLIAAIEHYTAVMG

SEQ ID NO: 1329181 - protein, 22 aa, Mycobacterium
VDETHGFRFFDNRDLLGFVDGT

SEQ ID NO: 1329182 - protein, 24 aa, Mycobacterium
VDEVVLALHRYLGRTPSRLLALSL

SEQ ID NO: 1329183 - protein, 21 aa, Mycobacterium
VDEYVSVCNKIFGALGRKFSG

SEQ ID NO: 1329184 - protein, 36 aa, Mycobacterium
VDFAAARGWWVLRWAGLDDVRILDGGWPAWARAGHP

SEQ ID NO: 1329185 - protein, 37 aa, Mycobacterium
VDFAAARGWWVLRWAGLDDVRILDGGWPAWARAGHPG

SEQ ID NO: 1329186 - protein, 21 aa, Mycobacterium
VDFAPFLEISPDRWQRLIEVN

SEQ ID NO: 1329187 - protein, 23 aa, Mycobacterium
VDFGCVRILPEHIRRGWIAMGRA

SEQ ID NO: 1329188 - protein, 22 aa, Mycobacterium
VDFVGWYNAHPHFEQMGPDLST

SEQ ID NO: 1329189 - protein, 23 aa, Mycobacterium
VDFYTNVLGMPLVKSLDLPGGMG

SEQ ID NO: 1329190 - protein, 22 aa, Mycobacterium
VDGETVVPLLPAQDFKRVGDGD

SEQ ID NO: 1329191 - protein, 24 aa, Mycobacterium
VDGGPDALLFPAAHGRHLAPATLY

SEQ ID NO: 1329192 - protein, 24 aa, Mycobacterium
VDGGRWTFGYLMSRATTIGAGTAE

SEQ ID NO: 1329193 - protein, 17 aa, Mycobacterium
VDGHWEPTFPNATYLIP

SEQ ID NO: 1329194 - protein, 19 aa, Mycobacterium
VDGLLPELPLAHPAPRVVV

SEQ ID NO: 1329195 - protein, 23 aa, Mycobacterium
VDGPTLLTPALTSSAPTPGRPRL

SEQ ID NO: 1329196 - protein, 51 aa, Mycobacterium
VDGQHISTLLLTLLFRFMKPLVENGHIFLAQPPLYKLKWQRSDPEFAYSDR

SEQ ID NO: 1329197 - protein, 21 aa, Mycobacterium
VDGRFPALPLTLGEAISAFRA

SEQ ID NO: 1329198 - protein, 28 aa, Mycobacterium
VDGTTYGVPFYNYALGYIYNKPDLQAAN

SEQ ID NO: 1329199 - protein, 17 aa, Mycobacterium
VDGTWRDAGHRQRAHAV

SEQ ID NO: 1329200 - protein, 27 aa, Mycobacterium
VDGVPVARIIRPLWPVKPTDVVAIGDF

SEQ ID NO: 1329201 - protein, 25 aa, Mycobacterium
VDHERVLSCLTLAVSIDGAAVGTVE

SEQ ID NO: 1329202 - protein, 21 aa, Mycobacterium
VDHGLAAPGWPRSVGGLELSL

SEQ ID NO: 1329203 - protein, 18 aa, Mycobacterium
VDILIHNAGIVRRAPLAE

SEQ ID NO: 1329204 - protein, 38 aa, Mycobacterium
VDKAGYDVLFFADVFGLRAPWNGNWRKAVEGGIQVPVN

SEQ ID NO: 1329205 - protein, 18 aa, Mycobacterium
VDKFPRMVDYVLPSGVRI

SEQ ID NO: 1329206 - protein, 24 aa, Mycobacterium
VDKPKLVFVFDEAHLLFADASKAF

SEQ ID NO: 1329207 - protein, 18 aa, Mycobacterium
VDKRRALLVLNTVANYCI

SEQ ID NO: 1329208 - protein, 24 aa, Mycobacterium
VDKTRLYSPLEAAKLAKETSSKKQ

SEQ ID NO: 1329209 - protein, 22 aa, Mycobacterium
VDLAQLLWSFAPARRGRPAGLS

SEQ ID NO: 1329210 - protein, 22 aa, Mycobacterium
VDLDLWQAQRVLQSAPTSAADL

SEQ ID NO: 1329211 - protein, 17 aa, Mycobacterium
VDLDPMPGVGWRQILDV

SEQ ID NO: 1329212 - protein, 25 aa, Mycobacterium
VDLGEGRWFNLRMSNTEPLLRLNVE

SEQ ID NO: 1329213 - protein, 22 aa, Mycobacterium
VDLRSLGFLAVDGIAALHASTR

SEQ ID NO: 1329214 - protein, 23 aa, Mycobacterium
VDLRSLGFLAVDGIAALHASTRS

SEQ ID NO: 1329215 - protein, 27 aa, Mycobacterium
VDLTTLPALRRYLESLPDPERRTATAQ

SEQ ID NO: 1329216 - protein, 26 aa, Mycobacterium
VDMAHFFYIHHAYPTYFKNVIEGHTA

SEQ ID NO: 1329217 - protein, 20 aa, Mycobacterium
VDMEPFFDAFRAIKPYLITS

SEQ ID NO: 1329218 - protein, 23 aa, Mycobacterium
VDNNLPAMPPGRREAELLITGDD

SEQ ID NO: 1329219 - protein, 23 aa, Mycobacterium
VDNSMRPLRDTLSQLRLRELLNE

SEQ ID NO: 1329220 - protein, 25 aa, Mycobacterium
VDPALVHHYFGTKTQLFAAAIEIPI

SEQ ID NO: 1329221 - protein, 21 aa, Mycobacterium
VDPDALLEWLPPRGMRGEFER

SEQ ID NO: 1329222 - protein, 24 aa, Mycobacterium
VDPGHLWWIRCQLREELIEDVRAR

SEQ ID NO: 1329223 - protein, 24 aa, Mycobacterium
VDPGHTEVLPLYARLPTAEQQKVF

SEQ ID NO: 1329224 - protein, 20 aa, Mycobacterium
VDPHVPVVFFDSGLQFPETI

SEQ ID NO: 1329225 - protein, 30 aa, Mycobacterium
VDPMALSLNEFPFPPLPAVRTALAASLDCL

SEQ ID NO: 1329226 - protein, 23 aa, Mycobacterium
VDPTRLAFCTILYGLSVVDEVSD

SEQ ID NO: 1329227 - protein, 22 aa, Mycobacterium
VDQGLSLTLFFKDTATTREVNK

SEQ ID NO: 1329228 - protein, 24 aa, Mycobacterium
VDQRFLFHRPIKDGDRLRGALTIL

SEQ ID NO: 1329229 - protein, 24 aa, Mycobacterium
VDQRPELLLRSRSHAPTPAPADGA

SEQ ID NO: 1329230 - protein, 23 aa, Mycobacterium
VDQRVREILATKKLLFESFARES

SEQ ID NO: 1329231 - protein, 28 aa, Mycobacterium
VDQTGLPFSRIRILLRLSRGSMTVKEVA

SEQ ID NO: 1329232 - protein, 22 aa, Mycobacterium
VDRALVVLEILAKAGQAGVTEI

SEQ ID NO: 1329233 - protein, 19 aa, Mycobacterium
VDREGTLIRWIQTKKATVV

SEQ ID NO: 1329234 - protein, 29 aa, Mycobacterium
VDRGPLEGQWYLHLFAPGQPDLNWENDEV

SEQ ID NO: 1329235 - protein, 20 aa, Mycobacterium
VDRLYGLAGRFWSTAAELTD

SEQ ID NO: 1329236 - protein, 22 aa, Mycobacterium
VDRRARWGDHVSDGFARISLGI

SEQ ID NO: 1329237 - protein, 25 aa, Mycobacterium
VDRSARAWLFTVARNMIIDERRSAR

SEQ ID NO: 1329238 - protein, 22 aa, Mycobacterium
VDSGPTMLLPHSQRFTGGYVAF

SEQ ID NO: 1329239 - protein, 30 aa, Mycobacterium; identical to SEQ ID NO: 871146

SEQ ID NO: 1329240 - protein, 23 aa, Mycobacterium
VDSLKKAMAAFGPVFVQLYGQGE

SEQ ID NO: 1329241 - protein, 32 aa, Mycobacterium
VDSPCGCTHFVALPRFPDPAAALAHGSLLAPM

SEQ ID NO: 1329242 - protein, 37 aa, Mycobacterium
VDSPELPPLWEVFGARLRTDGRWALPELSVDVASPDA

SEQ ID NO: 1329243 - protein, 30 aa, Mycobacterium
VDSPHYVYKLEWLAALRDTASSWLESNPSA

SEQ ID NO: 1329244 - protein, 18 aa, Mycobacterium
VDSWRRVVIKATELGIPI

SEQ ID NO: 1329245 - protein, 28 aa, Mycobacterium
VDTANYRSIWMFLKDLEFRQGFVDITVN

SEQ ID NO: 1329246 - protein, 27 aa, Mycobacterium
VDTDPRVEGSWYWLDDHTAHWRPRQYH

SEQ ID NO: 1329247 - protein, 25 aa, Mycobacterium
VDTHSTPTLIRLVANHQLDTAAMIT

SEQ ID NO: 1329248 - protein, 20 aa, Mycobacterium
VDTLLLARWVAAVCQGIAIQ

SEQ ID NO: 1329249 - protein, 24 aa, Mycobacterium
VDTPRHWVGHLNVLRGIQDRTGGF

SEQ ID NO: 1329250 - protein, 31 aa, Mycobacterium
VDTRWDPEELLILLFGLGLAWAHWPDPRSVT

SEQ ID NO: 1329251 - protein, 25 aa, Mycobacterium
VDTVGARMMLLRRLTHPDDARLGPP

SEQ ID NO: 1329252 - protein, 25 aa, Mycobacterium
VDVAFNWDHFFPLYGDPDGAHFECW

SEQ ID NO: 1329253 - protein, 18 aa, Mycobacterium
VDVDPWSGGLDLLLGVET

SEQ ID NO: 1329254 - protein, 18 aa, Mycobacterium
VDVLFLDTGYHFVETIGT

SEQ ID NO: 1329255 - protein, 17 aa, Mycobacterium
VDVLTVDLALPGSAAEL

SEQ ID NO: 1329256 - protein, 23 aa, Mycobacterium
VDVSLLNAAIWQLGPDIVGAGVT

SEQ ID NO: 1329257 - protein, 28 aa, Mycobacterium
VDVWTDELFGPVLAIRRATDAEEAFALA

SEQ ID NO: 1329258 - protein, 24 aa, Mycobacterium
VDWFAANFGVLPWSMHYITNIEAD

SEQ ID NO: 1329259 - protein, 19 aa, Mycobacterium
VDWKLAATLGGKLARPEPP

SEQ ID NO: 1329260 - protein, 20 aa, Mycobacterium
VDWVEPAGGPALGLHGSDWT

SEQ ID NO: 1329261 - protein, 22 aa, Mycobacterium
VDYAQRRRLKIFGHARIVTAEQ

SEQ ID NO: 1329262 - protein, 18 aa, Mycobacterium
VDYDVPVGVILFGDIRVD

SEQ ID NO: 1329263 - protein, 19 aa, Mycobacterium
VDYLGDMAWYLDLITQKSK

SEQ ID NO: 1329264 - protein, 18 aa, Mycobacterium
VDYLQGLGLRVLARNWRC

SEQ ID NO: 1329265 - protein, 31 aa, Mycobacterium
VEAAIRIGLALNCDIAPWGRFARKNYFYPDQ

SEQ ID NO: 1329266 - protein, 23 aa, Mycobacterium
VEADLFTFGKVMSGGLPAAAFGG

SEQ ID NO: 1329267 - protein, 19 aa, Mycobacterium
VEAGRALVLAFNKWDLVDE

SEQ ID NO: 1329268 - protein, 21 aa, Mycobacterium
VEALESLGVLRRVVGGAIAVQ

SEQ ID NO: 1329269 - protein, 17 aa, Mycobacterium
VEALSALTYANLTRWLR

SEQ ID NO: 1329270 - protein, 18 aa, Mycobacterium
VEAMGLLRGGDSWMFVGW

SEQ ID NO: 1329271 - protein, 24 aa, Mycobacterium
VEAMGLLRGGDSWMFVGWCRLREG

SEQ ID NO: 1329272 - protein, 28 aa, Mycobacterium
VEAPLAVTPWRSVLLFDLDEGVADVALR

SEQ ID NO: 1329273 - protein, 24 aa, Mycobacterium
VEARAMLAFSLVIGNHLIAAEHPG

SEQ ID NO: 1329274 - protein, 23 aa, Mycobacterium
VEARLPVLSTYLGHRDPRWTYWY

SEQ ID NO: 1329275 - protein, 30 aa, Mycobacterium
VEARRRGIPVLLRPAVLARLMAGHTTLMVT

SEQ ID NO: 1329276 - protein, 18 aa, Mycobacterium
VEAVGLPHFIRVARGEID

SEQ ID NO: 1329277 - protein, 27 aa, Mycobacterium
VEAVVDWLQRFIDELLVCLHGCGAANL

SEQ ID NO: 1329278 - protein, 21 aa, Mycobacterium
VEAYLTLLDALAGRGETAAAV

SEQ ID NO: 1329279 - protein, 58 aa, Mycobacterium
VEDFKPPLEWLQHIPVLGRFVVTPLVHLAHALPFVGEFLHPLIGWPVDHDAAPGDPKP

SEQ ID NO: 1329280 - protein, 26 aa, Mycobacterium
VEDIANLAVFLLSDAASFITGQVINV

SEQ ID NO: 1329281 - protein, 23 aa, Mycobacterium
VEDVWAPLRRTTQARIGLGRAGN

SEQ ID NO: 1329282 - protein, 19 aa, Mycobacterium
VEEALLRGAALRVVATWPS

SEQ ID NO: 1329283 - protein, 25 aa, Mycobacterium
VEEARALAALLTKHADKLESSDRDK

SEQ ID NO: 1329284 - protein, 23 aa, Mycobacterium
VEEAVFRLFAELAGKTGTDAHVA

SEQ ID NO: 1329285 - protein, 17 aa, Mycobacterium
VEELFANVYRQPLRPEA

SEQ ID NO: 1329286 - protein, 29 aa, Mycobacterium
VEELKKLAKARGLWNLFLPSESGLSNLEY

SEQ ID NO: 1329287 - protein, 33 aa, Mycobacterium
VEELWEFTVGDKLWAPTFVRDFPVETTPLTRPH

SEQ ID NO: 1329288 - protein, 25 aa, Mycobacterium
VEEPPPSTVFLLCAPSVDPEDIAIT

SEQ ID NO: 1329289 - protein, 30 aa, Mycobacterium
VEEQMAVLTDFFNYFGALTASRRANPTDDL

SEQ ID NO: 1329290 - protein, 18 aa, Mycobacterium
VEFALTHPALVDLLVTEV

SEQ ID NO: 1329291 - protein, 24 aa, Mycobacterium
VEFDPLCDPLPPDAAALVLPGGFP

SEQ ID NO: 1329292 - protein, 25 aa, Mycobacterium
VEFDRTQWRALRMSTPLKLTEDELV

SEQ ID NO: 1329293 - protein, 27 aa, Mycobacterium
VEFDTSWLDPFTEFRFPRIGTAVLGGV

SEQ ID NO: 1329294 - protein, 19 aa, Mycobacterium
VEFTLRTMLSFFVAPNVRP

SEQ ID NO: 1329295 - protein, 35 aa, Mycobacterium
VEGAALSGHRWLLSPAALGSFLAALPAPMQLGAVE

SEQ ID NO: 1329296 - protein, 28 aa, Mycobacterium
VEGKEFPRATYWRFIPDTTGTGDPHAEG

SEQ ID NO: 1329297 - protein, 21 aa, Mycobacterium
VEGMLPRMRRGGSVVAVASIA

SEQ ID NO: 1329298 - protein, 20 aa, Mycobacterium
VEGMPAMMSGMMDGGMMGPG

SEQ ID NO: 1329299 - protein, 24 aa, Mycobacterium
VEGMPAMMSGMMDGGMMGPGMGHG

SEQ ID NO: 1329300 - protein, 24 aa, Mycobacterium
VEGVHLRFGFVARGGLRWSDRRED

SEQ ID NO: 1329301 - protein, 17 aa, Mycobacterium
VEHLFGSIWTRPGLSMR

SEQ ID NO: 1329302 - protein, 19 aa, Mycobacterium
VEHMPLLDGLGLSLNNRGA

SEQ ID NO: 1329303 - protein, 27 aa, Mycobacterium
VEHVLATQTLPLRPFKTMAVNVDGQLP

SEQ ID NO: 1329304 - protein, 28 aa, Mycobacterium
VEHYDRHLTLDGLRLVFERNRDSQRGKL

SEQ ID NO: 1329305 - protein, 24 aa, Mycobacterium
VEICLACHFILPDDWRNGHAVCIA

SEQ ID NO: 1329306 - protein, 20 aa, Mycobacterium
VEIEPFLTAATLLHDGALVS

SEQ ID NO: 1329307 - protein, 19 aa, Mycobacterium
VEIGDLHWFHVYSAVVWCC

SEQ ID NO: 1329308 - protein, 24 aa, Mycobacterium
VEIIPDVLRHRLVLTYDALADEIS

SEQ ID NO: 1329309 - protein, 26 aa, Mycobacterium
VEIKRRMIDWWGPIIDEYYASSEAVG

SEQ ID NO: 1329310 - protein, 18 aa, Mycobacterium
VEIQTPYRKVGAGPLDTA

SEQ ID NO: 1329311 - protein, 23 aa, Mycobacterium
VEIRYYSIIYQAIDEIESALKGM

SEQ ID NO: 1329312 - protein, 22 aa, Mycobacterium
VEKSLYSLLDPGVDPGPTHVHG

SEQ ID NO: 1329313 - protein, 17 aa, Mycobacterium
VELAERGAEIITAHASW

SEQ ID NO: 1329314 - protein, 17 aa, Mycobacterium
VELAKRIEAGLFATQKL

SEQ ID NO: 1329315 - protein, 25 aa, Mycobacterium
VELDVSLLSTAWWAAGASVTQGMET

SEQ ID NO: 1329316 - protein, 20 aa, Mycobacterium
VELERLVLNLPAGRYQRDRG

SEQ ID NO: 1329317 - protein, 17 aa, Mycobacterium
VELGLDWDRIIELKTAG

SEQ ID NO: 1329318 - protein, 18 aa, Mycobacterium
VELGTLRENLDSAASRLA

SEQ ID NO: 1329319 - protein, 29 aa, Mycobacterium
VELLDAVWRMRGYGDFWSYCLVAEGAVDI

SEQ ID NO: 1329320 - protein, 19 aa, Mycobacterium
VELLGRTDLLPDTRHRFLV

SEQ ID NO: 1329321 - protein, 21 aa, Mycobacterium
VELLRRDGFAALTVRRVAAEA

SEQ ID NO: 1329322 - protein, 38 aa, Mycobacterium; identical to SEQ ID NO: 223938

SEQ ID NO: 1329323 - protein, 21 aa, Mycobacterium
VELPLMFEPYDRKSLRKRATE

SEQ ID NO: 1329324 - protein, 19 aa, Mycobacterium
VELVKNNFGLVRYGDPTAA

SEQ ID NO: 1329325 - protein, 26 aa, Mycobacterium
VEMENGYLLLMRVGDGSNLATLATRG

SEQ ID NO: 1329326 - protein, 18 aa, Mycobacterium
VEMTWNALGVRMRAIGAH

SEQ ID NO: 1329327 - protein, 17 aa, Mycobacterium
VENALLALCGEPPWPPS

SEQ ID NO: 1329328 - protein, 28 aa, Mycobacterium
VENLAASFYDWYTDTMQFLAGPARAPFG

SEQ ID NO: 1329329 - protein, 33 aa, Mycobacterium
VEPAATVLTLTPLWPVWPLEYALQGSLCESGGC

SEQ ID NO: 1329330 - protein, 28 aa, Mycobacterium
VEPEPVPPPLPPPPPVRPPAAPVVEAPA

SEQ ID NO: 1329331 - protein, 17 aa, Mycobacterium
VEPIAVSGSFLWAPDPG

SEQ ID NO: 1329332 - protein, 27 aa, Mycobacterium
VEQKPYTRRPYAPFMTSTLQQEAGRKL

SEQ ID NO: 1329333 - protein, 28 aa, Mycobacterium
VEQLRTTIPELPWLARKRIQQDWGISDE

SEQ ID NO: 1329334 - protein, 25 aa, Mycobacterium
VERAHRLLVLLGGRVAHPALRAIVT

SEQ ID NO: 1329335 - protein, 27 aa, Mycobacterium
VERAQWQVPKFYWTVMSRSGMGDAFAV

SEQ ID NO: 1329336 - protein, 20 aa, Mycobacterium
VERFLGDLATQNRWEFAPPA

SEQ ID NO: 1329337 - protein, 21 aa, Mycobacterium
VERGYLRIPVALQALGGGDPS

SEQ ID NO: 1329338 - protein, 17 aa, Mycobacterium
VERIYLDNHFSIAKAER

SEQ ID NO: 1329339 - protein, 22 aa, Mycobacterium
VERLAALKLIDGRDVWAAGAKL

SEQ ID NO: 1329340 - protein, 31 aa, Mycobacterium
VERLTVFQRTPIWCFPKFDVPLSKTAQTMMR

SEQ ID NO: 1329341 - protein, 18 aa, Mycobacterium
VERRLARGQILYDAPELV

SEQ ID NO: 1329342 - protein, 24 aa, Mycobacterium
VERRWVYLHYFKDGQPSINWLDPS

SEQ ID NO: 1329343 - protein, 22 aa, Mycobacterium
VERSNRLAAYLHAQGLGCHTER

SEQ ID NO: 1329344 - protein, 18 aa, Mycobacterium
VERVAARVFPHMRQIVES

SEQ ID NO: 1329345 - protein, 18 aa, Mycobacterium
VERWFTAPYRAAHPRVRA

SEQ ID NO: 1329346 - protein, 36 aa, Mycobacterium
VESAEPLHWLPAEDEWIWARATVLAAAYLTGLAAAA

SEQ ID NO: 1329347 - protein, 21 aa, Mycobacterium
VESALARYPGPLLAQSVSPAI

SEQ ID NO: 1329348 - protein, 24 aa, Mycobacterium
VESGPESLLFPAARGGHMNDRVFS

SEQ ID NO: 1329349 - protein, 22 aa, Mycobacterium
VESLREFLLGRGVAKFKVPEQV

SEQ ID NO: 1329350 - protein, 17 aa, Mycobacterium
VESQMAPMFPLVVIVHA

SEQ ID NO: 1329351 - protein, 36 aa, Mycobacterium
VESRAQMATLPRLKPRMFYDLVVEVALIRPGPIQGG

SEQ ID NO: 1329352 - protein, 25 aa, Mycobacterium
VESTWQALLEGRSGIRRLEDSFIEE

SEQ ID NO: 1329353 - protein, 25 aa, Mycobacterium
VETAEKAMLWMRLTARGRAGHGSMV

SEQ ID NO: 1329354 - protein, 18 aa, Mycobacterium
VETASFYHFFHTTPSGRH

SEQ ID NO: 1329355 - protein, 18 aa, Mycobacterium
VETFGKFLGGSAANVAVA

SEQ ID NO: 1329356 - protein, 21 aa, Mycobacterium
VETLIRLRPTFGAVNLEDISA

SEQ ID NO: 1329357 - protein, 25 aa, Mycobacterium
VETPHHLYMVRFTSTDLWGDEAPEA

SEQ ID NO: 1329358 - protein, 19 aa, Mycobacterium
VETSFLAKAFSVLTTPRTP

SEQ ID NO: 1329359 - protein, 22 aa, Mycobacterium
VETVLCLGAIHTPKVLMHSGIG

SEQ ID NO: 1329360 - protein, 17 aa, Mycobacterium
VEVAGADALPFGSHGIA

SEQ ID NO: 1329361 - protein, 18 aa, Mycobacterium
VEVAYWRDYWDMRDFLDL

SEQ ID NO: 1329362 - protein, 30 aa, Mycobacterium
VEVFTAALSSPLYWIATNAGLDGAVVVNKV

SEQ ID NO: 1329363 - protein, 33 aa, Mycobacterium; identical to SEQ ID NO: 871660

SEQ ID NO: 1329364 - protein, 19 aa, Mycobacterium
VEVGLKHPIKLIANALGSP

SEQ ID NO: 1329365 - protein, 25 aa, Mycobacterium
VEVLHTWLPPRLAPAGMTTFDISEF

SEQ ID NO: 1329366 - protein, 23 aa, Mycobacterium
VEVNLFERLPTPFGLIRAGVAPD

SEQ ID NO: 1329367 - protein, 17 aa, Mycobacterium
VEVPATELPPPDDAWAW

SEQ ID NO: 1329368 - protein, 26 aa, Mycobacterium
VEVPGYNPFWAITKHADIMAVERDNL

SEQ ID NO: 1329369 - protein, 19 aa, Mycobacterium
VEVPPPPPLLPLTTPSDPE

SEQ ID NO: 1329370 - protein, 25 aa, Mycobacterium
VEVSPHPLLGYAIKDTLAGTHHHSI

SEQ ID NO: 1329371 - protein, 17 aa, Mycobacterium
VEWIPPPALDTGQARVN

SEQ ID NO: 1329372 - protein, 20 aa, Mycobacterium
VEWVWYVETLRETPGFGAQV

SEQ ID NO: 1329373 - protein, 30 aa, Mycobacterium
VEYAQQRAEWGWRLVAAASTLPTPALRDAG

SEQ ID NO: 1329374 - protein, 17 aa, Mycobacterium
VEYLAETVLAMCHLPAV

SEQ ID NO: 1329375 - protein, 24 aa, Mycobacterium
VEYRNLALPLERYPRLSGFTEANA

SEQ ID NO: 1329376 - protein, 19 aa, Mycobacterium
VFAAIGHQPPPRLWDRLRG

SEQ ID NO: 1329377 - protein, 17 aa, Mycobacterium
VFAHGFTLGKDSPAASR

SEQ ID NO: 1329378 - protein, 37 aa, Mycobacterium
VFAPNGRAFRFPVWAFDRVLMPGIVRWGIYRGVRQDV

SEQ ID NO: 1329379 - protein, 17 aa, Mycobacterium
VFAVTDRQWRGIGMIPR

SEQ ID NO: 1329380 - protein, 18 aa, Mycobacterium
VFCPPRVLLPESPEPFCL

SEQ ID NO: 1329381 - protein, 29 aa, Mycobacterium
VFDDIDYRFRPYDPWTAYGQSKTADILLA

SEQ ID NO: 1329382 - protein, 26 aa, Mycobacterium
VFDEADPLRLLIYTSGSTGAPKGAMY

SEQ ID NO: 1329383 - protein, 29 aa, Mycobacterium
VFDGYFVPEDGFVSVWRAGAFGVLEWASL

SEQ ID NO: 1329384 - protein, 18 aa, Mycobacterium
VFDGYRPWAGEIRARHTG

SEQ ID NO: 1329385 - protein, 17 aa, Mycobacterium
VFDLPVEAVFSRKPFPP

SEQ ID NO: 1329386 - protein, 21 aa, Mycobacterium
VFDPFSEEFYRDPQGCYPRLR

SEQ ID NO: 1329387 - protein, 19 aa, Mycobacterium
VFDRFGADLPALEGVYLAS

SEQ ID NO: 1329388 - protein, 21 aa, Mycobacterium
VFDRLPGVYRLLGAVMNRIPA

SEQ ID NO: 1329389 - protein, 18 aa, Mycobacterium
VFDRPLAGYQLTQAKIAD

SEQ ID NO: 1329390 - protein, 24 aa, Mycobacterium
VFDVSPFNLFPKVFDMLVHGQTPR

SEQ ID NO: 1329391 - protein, 32 aa, Mycobacterium
VFEIPGLPPIMLPWPPPPPPPAPPPPPPPPPA

SEQ ID NO: 1329392 - protein, 24 aa, Mycobacterium
VFGAGPIGCMHIRIARGVHNCGPV

SEQ ID NO: 1329393 - protein, 28 aa, Mycobacterium
VFGAGPIGIGLWFALRGKGLDDVFVVEP

SEQ ID NO: 1329394 - protein, 17 aa, Mycobacterium
VFGARSAMPMLQAKRLV

SEQ ID NO: 1329395 - protein, 23 aa, Mycobacterium
VFGHSHIPWDTTAKTGLRLLNPG

SEQ ID NO: 1329396 - protein, 23 aa, Mycobacterium
VFGNGMLLSKHIRLLAAFDHRHI

SEQ ID NO: 1329397 - protein, 20 aa, Mycobacterium
VFGTRFPGPLGLAAGFDKDG

SEQ ID NO: 1329398 - protein, 21 aa, Mycobacterium
VFHIHLHVLPRRSGDKLSFAK

SEQ ID NO: 1329399 - protein, 22 aa, Mycobacterium
VFIHSMRAAAIAKLGFDYQTVA

SEQ ID NO: 1329400 - protein, 19 aa, Mycobacterium
VFKEKLVRRDISMKAFDAG

SEQ ID NO: 1329401 - protein, 38 aa, Mycobacterium
VFLDFEGHPFWRADTGLFFLFGLIEQSEDRWRYRSWWA

SEQ ID NO: 1329402 - protein, 21 aa, Mycobacterium
VFLIQQGLPAWDRTLAHELGH

SEQ ID NO: 1329403 - protein, 18 aa, Mycobacterium
VFLRRCVSLARTALDGGD

SEQ ID NO: 1329404 - protein, 20 aa, Mycobacterium
VFLTSFLPGHRQKFGIDVDD

SEQ ID NO: 1329405 - protein, 24 aa, Mycobacterium
VFNDWHYRYLLQELLETGTGDPLR

SEQ ID NO: 1329406 - protein, 22 aa, Mycobacterium
VFNGHYLTWFDEACTGLLESLG

SEQ ID NO: 1329407 - protein, 18 aa, Mycobacterium
VFNHYFPGLTADLLAKGS

SEQ ID NO: 1329408 - protein, 29 aa, Mycobacterium
VFNRPVIAMYRLAPPVYDVLMGVFLRTFG

SEQ ID NO: 1329409 - protein, 26 aa, Mycobacterium
VFPTQVFLTLFGLPLEMRDQFIEWKN

SEQ ID NO: 1329410 - protein, 17 aa, Mycobacterium
VFQNALLLRTAQTLLVD

SEQ ID NO: 1329411 - protein, 28 aa, Mycobacterium
VFQQADDVWLPLFRPVAGDLGELPADEI

SEQ ID NO: 1329412 - protein, 23 aa, Mycobacterium
VFQSLGLVRNPLKTSLLSAADVK

SEQ ID NO: 1329413 - protein, 18 aa, Mycobacterium
VFRETVGWVLTERAVSRI

SEQ ID NO: 1329414 - protein, 22 aa, Mycobacterium
VFRGVQKWRIKSNWKFVSENFL

SEQ ID NO: 1329415 - protein, 21 aa, Mycobacterium
VFRRVHPPRAVLVDLIALFPR

SEQ ID NO: 1329416 - protein, 17 aa, Mycobacterium
VFSGRQWVIDPIDGTKN

SEQ ID NO: 1329417 - protein, 22 aa, Mycobacterium
VFSQLEFGGSRTEWRRSQGIAD

SEQ ID NO: 1329418 - protein, 25 aa, Mycobacterium
VFSRAFRRMYGLPPSQASDVHFRLP

SEQ ID NO: 1329419 - protein, 21 aa, Mycobacterium
VFSRAKVAVFLDGCFWHGCPD

SEQ ID NO: 1329420 - protein, 25 aa, Mycobacterium
VFSSDFFAGWGKFAATRTPTIAAVA

SEQ ID NO: 1329421 - protein, 19 aa, Mycobacterium
VFSWLADPASLTAAPLVLR

SEQ ID NO: 1329422 - protein, 17 aa, Mycobacterium
VFTRFVFGFGLDDRDMQ

SEQ ID NO: 1329423 - protein, 30 aa, Mycobacterium
VFTTHPGSRLLFPALCRPTAPVVVSSADLA

SEQ ID NO: 1329424 - protein, 19 aa, Mycobacterium
VFVDVITWALTERAIAKIG

SEQ ID NO: 1329425 - protein, 18 aa, Mycobacterium
VFVHGEVISSRRGELSVL

SEQ ID NO: 1329426 - protein, 17 aa, Mycobacterium
VFVKLGITSRRQLRSAS

SEQ ID NO: 1329427 - protein, 17 aa, Mycobacterium
VFVLAATSNPEGASVQC

SEQ ID NO: 1329428 - protein, 42 aa, Mycobacterium
VFVPRSVRVLATDPLVKDSFRKLWFGWSDPARVLVEYAQQRA

SEQ ID NO: 1329429 - protein, 33 aa, Mycobacterium
VFVVARRLRRLPWLLRLVAWLPQPDPHRPPADR

SEQ ID NO: 1329430 - protein, 19 aa, Mycobacterium
VFVVPPGARWKFLAENAKG

SEQ ID NO: 1329431 - protein, 24 aa, Mycobacterium
VGAAFAALQVLIDEPWRAQRVLDH

SEQ ID NO: 1329432 - protein, 28 aa, Mycobacterium
VGAAIAPVAPLIFLAQPIQAALTQTLAN

SEQ ID NO: 1329433 - protein, 25 aa, Mycobacterium
VGAAPTLFSPGYYHDLTVPVGVIDP

SEQ ID NO: 1329434 - protein, 37 aa, Mycobacterium
VGADARVWTFIGPRPAGWWIRRRVHETAVHRADAALA

SEQ ID NO: 1329435 - protein, 17 aa, Mycobacterium
VGADLPLRLSFGGEIDG

SEQ ID NO: 1329436 - protein, 23 aa, Mycobacterium
VGAGLNLALAADVRIAGPAALFD

SEQ ID NO: 1329437 - protein, 24 aa, Mycobacterium
VGAGMAPWPGLVGRVRDAGVRAVV

SEQ ID NO: 1329438 - protein, 28 aa, Mycobacterium
VGAGYTGLWTAYYLKRADPSLRIAILEA

SEQ ID NO: 1329439 - protein, 30 aa, Mycobacterium
VGAHVGHTVGKYAESLLTLGWAEEFASVPI

SEQ ID NO: 1329440 - protein, 18 aa, Mycobacterium
VGAIPTAVPASPFITAEF

SEQ ID NO: 1329441 - protein, 27 aa, Mycobacterium
VGAITPWNFPHQINLAKIGPALAAGNT

SEQ ID NO: 1329442 - protein, 28 aa, Mycobacterium
VGAITPWNVPFYLNIAETVPALMAGNTV

SEQ ID NO: 1329443 - protein, 17 aa, Mycobacterium
VGALHIPMGDVPSRLAE

SEQ ID NO: 1329444 - protein, 23 aa, Mycobacterium
VGARKFATLVKRAKPGLLMLSVC

SEQ ID NO: 1329445 - protein, 26 aa, Mycobacterium
VGASDAFFPFPDGLETLIRAGVKAVV

SEQ ID NO: 1329446 - protein, 23 aa, Mycobacterium
VGATPYAVLLAVFGVLIHRYSHV

SEQ ID NO: 1329447 - protein, 30 aa, Mycobacterium; identical to SEQ ID NO: 871947

SEQ ID NO: 1329448 - protein, 31 aa, Mycobacterium; identical to SEQ ID NO: 871954

SEQ ID NO: 1329449 - protein, 26 aa, Mycobacterium
VGDATLGERLILSSGFIAVTVIVRRG

SEQ ID NO: 1329450 - protein, 26 aa, Mycobacterium
VGDAYAAPLIAELRRRPYDLSSLFAI

SEQ ID NO: 1329451 - protein, 31 aa, Mycobacterium
VGDDQFRGKPLLLNIFPSIDTPVCAASVRRF

SEQ ID NO: 1329452 - protein, 18 aa, Mycobacterium
VGDFVRSGKPVAAICHGP

SEQ ID NO: 1329453 - protein, 25 aa, Mycobacterium
VGDGRWWRRWAARHAPTHPPTVLRA

SEQ ID NO: 1329454 - protein, 18 aa, Mycobacterium
VGDLPEVISTYPAALIAE

SEQ ID NO: 1329455 - protein, 18 aa, Mycobacterium
VGDLVRLMEFRKGQANLV

SEQ ID NO: 1329456 - protein, 25 aa, Mycobacterium
VGDMTYLQWLQRYIELAIGDGDSTA

SEQ ID NO: 1329457 - protein, 28 aa, Mycobacterium
VGDPLLDLGWMLICWPDGPNPIDVGSEL

SEQ ID NO: 1329458 - protein, 25 aa, Mycobacterium
VGDPVLFKPSELTPLMGQRLVEALL

SEQ ID NO: 1329459 - protein, 24 aa, Mycobacterium
VGDRFLLLPMPEWSANPIDPIAIS

SEQ ID NO: 1329460 - protein, 24 aa, Mycobacterium
VGDVPDMSALLLGGELVLTTGTAL

SEQ ID NO: 1329461 - protein, 24 aa, Mycobacterium
VGDVRLITLFATRVWRSDRADADP

SEQ ID NO: 1329462 - protein, 32 aa, Mycobacterium
VGEEWLYQSWSASYLPLTRVLRRLAGEGRDHL

SEQ ID NO: 1329463 - protein, 22 aa, Mycobacterium
VGEHRVCTVFDLMLAQYGVARP

SEQ ID NO: 1329464 - protein, 38 aa, Mycobacterium
VGEIQYALSFDWFPIPLPPLPPFPPLPIFDAADSAPTE

SEQ ID NO: 1329465 - protein, 23 aa, Mycobacterium
VGEQIAGLLPPIMELCRRSARLA

SEQ ID NO: 1329466 - protein, 17 aa, Mycobacterium
VGETGWPYVQFRGGPRG

SEQ ID NO: 1329467 - protein, 23 aa, Mycobacterium
VGEYLGLRPRWIDSTAVGGASWE

SEQ ID NO: 1329468 - protein, 22 aa, Mycobacterium
VGFALVVLQRRLASSPQAILRS

SEQ ID NO: 1329469 - protein, 25 aa, Mycobacterium
VGFATSALFLRDALDKAGIQAQFTA

SEQ ID NO: 1329470 - protein, 17 aa, Mycobacterium
VGFLFNVQVERAPSAPT

SEQ ID NO: 1329471 - protein, 18 aa, Mycobacterium
VGFRPFVYTRATALGLSG

SEQ ID NO: 1329472 - protein, 24 aa, Mycobacterium
VGFTALNFLYHLMNMIAEGVFERM

SEQ ID NO: 1329473 - protein, 17 aa, Mycobacterium
VGFVFQQFNLVGRLSCL

SEQ ID NO: 1329474 - protein, 18 aa, Mycobacterium
VGFVLGPPVLRERLGRDP

SEQ ID NO: 1329475 - protein, 27 aa, Mycobacterium
VGGAEALAWLTLRHGLGRAALQLGVLE

SEQ ID NO: 1329476 - protein, 23 aa, Mycobacterium
VGGDLFALYWESGGTEPVGLTAA

SEQ ID NO: 1329477 - protein, 25 aa, Mycobacterium
VGGKSFVFFRTPRPDALDPDTGERY

SEQ ID NO: 1329478 - protein, 24 aa, Mycobacterium
VGGRRLEVSLPGDLALGGGGAPAH

SEQ ID NO: 1329479 - protein, 23 aa, Mycobacterium
VGGSRLLPGVPLDRILAFGAEDD

SEQ ID NO: 1329480 - protein, 18 aa, Mycobacterium
VGGTCVAVLLRLPPKVYG

SEQ ID NO: 1329481 - protein, 37 aa, Mycobacterium
VGGVFRVLLCVAEARPFVLLPKFELKQWADAVREHRP

SEQ ID NO: 1329482 - protein, 21 aa, Mycobacterium
VGHLTARLTTLGPAATLARGY

SEQ ID NO: 1329483 - protein, 23 aa, Mycobacterium
VGHQDMRWITLGPVGRPDTNIVL

SEQ ID NO: 1329484 - protein, 24 aa, Mycobacterium
VGIASVLPVLRWSGPDEDAREAAV

SEQ ID NO: 1329485 - protein, 26 aa, Mycobacterium
VGIERATKILGLLTATDKSYAATIRL

SEQ ID NO: 1329486 - protein, 24 aa, Mycobacterium
VGIGMVRTILRHAPKVEKSTPSNG

SEQ ID NO: 1329487 - protein, 31 aa, Mycobacterium
VGINVPIPVPMAYFSFGGWKASLFGDSHAHG

SEQ ID NO: 1329488 - protein, 19 aa, Mycobacterium
VGIWYVDEFVRTAQGWRMS

SEQ ID NO: 1329489 - protein, 32 aa, Mycobacterium
VGKGTLFRRFGSRAGLMIVLLDEDEKALQQAF

SEQ ID NO: 1329490 - protein, 17 aa, Mycobacterium
VGKPDRPLTVTGGLTFA

SEQ ID NO: 1329491 - protein, 22 aa, Mycobacterium
VGKPHDTLPVLLGIDGSPASEN

SEQ ID NO: 1329492 - protein, 23 aa, Mycobacterium
VGKRLLDLFDYRASGPAGRNLLV

SEQ ID NO: 1329493 - protein, 25 aa, Mycobacterium
VGKSTLLLEVAHRWASTGRRALYLS

SEQ ID NO: 1329494 - protein, 17 aa, Mycobacterium
VGLAFFFRNSALGRVVA

SEQ ID NO: 1329495 - protein, 22 aa, Mycobacterium
VGLAVAELLAALGAGVVVNGRD

SEQ ID NO: 1329496 - protein, 17 aa, Mycobacterium
VGLEPVRRWSDRPVAVV

SEQ ID NO: 1329497 - protein, 19 aa, Mycobacterium
VGLGRRQVLSLWGRNDTAQ

SEQ ID NO: 1329498 - protein, 21 aa, Mycobacterium
VGLHPFGRFEGKTAMHMGVDA

SEQ ID NO: 1329499 - protein, 18 aa, Mycobacterium
VGLIITTDWSFSSGRDWG

SEQ ID NO: 1329500 - protein, 19 aa, Mycobacterium
VGLLNVQYALKDDVLYVLE

SEQ ID NO: 1329501 - protein, 27 aa, Mycobacterium
VGMDLILCTLPTSAARHRFFEALPLRR

SEQ ID NO: 1329502 - protein, 17 aa, Mycobacterium
VGMLHQLRRAAPEIDFR

SEQ ID NO: 1329503 - protein, 25 aa, Mycobacterium
VGMSQPWDFILVRSPQTLTTFRDHV

SEQ ID NO: 1329504 - protein, 18 aa, Mycobacterium
VGMVGLSGIPFTNVFNAC

SEQ ID NO: 1329505 - protein, 30 aa, Mycobacterium
VGNMLFAVTRAWLYAPYLPEAERLVRPPWE

SEQ ID NO: 1329506 - protein, 29 aa, Mycobacterium
VGPEALKMGFKRVLLMSSGLRGTDIVHNM

SEQ ID NO: 1329507 - protein, 27 aa, Mycobacterium
VGPFSRRRIIMLLGGLRELTASTVEEG

SEQ ID NO: 1329508 - protein, 18 aa, Mycobacterium
VGPLAILVDAAGGIVNHY

SEQ ID NO: 1329509 - protein, 22 aa, Mycobacterium
VGPSLHRLMRGADGRVIVACFA

SEQ ID NO: 1329510 - protein, 19 aa, Mycobacterium
VGQFRSALPLLPLPRVPVR

SEQ ID NO: 1329511 - protein, 23 aa, Mycobacterium
VGQLLLSHFVVAQAISGLGHTQP

SEQ ID NO: 1329512 - protein, 25 aa, Mycobacterium
VGQSYPFAPPVGLMFVLWDDEAVRD

SEQ ID NO: 1329513 - protein, 26 aa, Mycobacterium
VGRATDPMLYIRAIVRIVASTRHNVD

SEQ ID NO: 1329514 - protein, 20 aa, Mycobacterium
VGRAWPVGEKGPTAMALCEF

SEQ ID NO: 1329515 - protein, 24 aa, Mycobacterium
VGRCEFLSAYAKPFSLLVIADMLG

SEQ ID NO: 1329516 - protein, 25 aa, Mycobacterium
VGRFRLRCLMGERIRVRQWLDDAPY

SEQ ID NO: 1329517 - protein, 37 aa, Mycobacterium
VGRGSPWAAPLPLMIPRRVVMELVLTGAPMSARRAHE

SEQ ID NO: 1329518 - protein, 17 aa, Mycobacterium
VGRKLHPLGRRIQPGVG

SEQ ID NO: 1329519 - protein, 23 aa, Mycobacterium
VGRLALAALLGNPAYELTAVGVS

SEQ ID NO: 1329520 - protein, 20 aa, Mycobacterium
VGRLGMLIDYDKTFPESARA

SEQ ID NO: 1329521 - protein, 18 aa, Mycobacterium
VGRVRPGSDSLLRMRLDL

SEQ ID NO: 1329522 - protein, 23 aa, Mycobacterium
VGSALSAFLSTGGHRVIRLVRGP

SEQ ID NO: 1329523 - protein, 25 aa, Mycobacterium
VGSEALIMWCHCKVHVVPLQDLVQH

SEQ ID NO: 1329524 - protein, 18 aa, Mycobacterium
VGSEEPFWKQTFGEFSTL

SEQ ID NO: 1329525 - protein, 37 aa, Mycobacterium
VGSGTKVWTFLGPRPAGWWIRRRVHEVAVHRADAALA

SEQ ID NO: 1329526 - protein, 21 aa, Mycobacterium
VGSKGWYVAPTVLAGVAPQAD

SEQ ID NO: 1329527 - protein, 20 aa, Mycobacterium
VGSLWDVVRDRRLTHRPQVR

SEQ ID NO: 1329528 - protein, 24 aa, Mycobacterium
VGSSRFAAPRRIFLGSTAARILAG

SEQ ID NO: 1329529 - protein, 26 aa, Mycobacterium
VGSTDLPALFAIPVAGPEAPLGAYTA

SEQ ID NO: 1329530 - protein, 23 aa, Mycobacterium
VGTDLMMKILRSDGPLTVGALVG

SEQ ID NO: 1329531 - protein, 25 aa, Mycobacterium
VGTGGAMLPLLIFASARANVPFTPL

SEQ ID NO: 1329532 - protein, 26 aa, Mycobacterium
VGTGPKNMFPIFTVEGGLTCSIVTFS

SEQ ID NO: 1329533 - protein, 17 aa, Mycobacterium
VGTLACSAKWRGVLAPE

SEQ ID NO: 1329534 - protein, 22 aa, Mycobacterium
VGTLPLLVEVLDRVAVPVLAAG

SEQ ID NO: 1329535 - protein, 22 aa, Mycobacterium
VGTPDPGAFWRVASEHGVKALF

SEQ ID NO: 1329536 - protein, 27 aa, Mycobacterium
VGTRLGMCGVEFFGHPWEFGPRKAKEL

SEQ ID NO: 1329537 - protein, 24 aa, Mycobacterium
VGTVFAPRKERMSARRFWVRYAAE

SEQ ID NO: 1329538 - protein, 22 aa, Mycobacterium
VGTVFRALMGERALLPTLAAAD

SEQ ID NO: 1329539 - protein, 26 aa, Mycobacterium
VGVGDPAWDLARPAGFWAAGLIPDVD

SEQ ID NO: 1329540 - protein, 26 aa, Mycobacterium
VGVIVPRVDAWFYSTILAGIADEFDT

SEQ ID NO: 1329541 - protein, 17 aa, Mycobacterium
VGVLVFSQWVETRYATE

SEQ ID NO: 1329542 - protein, 30 aa, Mycobacterium
VGVPAPPSPLTPLAATGLSNLVSPPSLTIP

SEQ ID NO: 1329543 - protein, 19 aa, Mycobacterium
VGVRIWIHPSHRKQGYGTA

SEQ ID NO: 1329544 - protein, 23 aa, Mycobacterium
VGVRLDALLSRLIALLGGEPPEL

SEQ ID NO: 1329545 - protein, 34 aa, Mycobacterium
VGVVAAITPWNSPLLLLTWKLAAGLAAGCTFVVK

SEQ ID NO: 1329546 - protein, 30 aa, Mycobacterium
VGVVQVRLYRPFPTAAFLESLPATVRAVGV

SEQ ID NO: 1329547 - protein, 19 aa, Mycobacterium
VGWTLLGYPIDDPQMVELL

SEQ ID NO: 1329548 - protein, 20 aa, Mycobacterium
VGWVLTERAVSRIGRGWLSR

SEQ ID NO: 1329549 - protein, 34 aa, Mycobacterium
VGYGFCAPALGRTLWTMQLPFGTSLAALVAVAAS

SEQ ID NO: 1329550 - protein, 17 aa, Mycobacterium
VGYGLLRVTRDAKWKPF

SEQ ID NO: 1329551 - protein, 17 aa, Mycobacterium
VGYLVKRVQQSLRRRCD

SEQ ID NO: 1329552 - protein, 20 aa, Mycobacterium
VGYPSIFDPAMRSLITLGRS

SEQ ID NO: 1329553 - protein, 23 aa, Mycobacterium
VGYQLDRVFAPRLGVGRSNGCSY

SEQ ID NO: 1329554 - protein, 25 aa, Mycobacterium
VGYRAPMWDLSWRTPALLAERDFLY

SEQ ID NO: 1329555 - protein, 23 aa, Mycobacterium
VGYRAPMWDLSWRTPALLAERGF

SEQ ID NO: 1329556 - protein, 20 aa, Mycobacterium
VGYRLLTKFGTKGSINLVKA

SEQ ID NO: 1329557 - protein, 18 aa, Mycobacterium
VHAALRQVLGPNAVQAGS

SEQ ID NO: 1329558 - protein, 28 aa, Mycobacterium
VHAARKALAPLFGLEPDQMRVIAPHVGG

SEQ ID NO: 1329559 - protein, 23 aa, Mycobacterium
VHAGMDLYKWAVKLGPLIESGLV

SEQ ID NO: 1329560 - protein, 17 aa, Mycobacterium
VHALTDDNWMLTMGDRP

SEQ ID NO: 1329561 - protein, 25 aa, Mycobacterium
VHARPLLHEAMWAVAPPDAGLRTDE

SEQ ID NO: 1329562 - protein, 33 aa, Mycobacterium
VHAVEWEAVLTPRARLLLPGDQQFKFTAALARR

SEQ ID NO: 1329563 - protein, 17 aa, Mycobacterium
VHDAAERLALVLAGHGL

SEQ ID NO: 1329564 - protein, 33 aa, Mycobacterium
VHDGSALQFPPPNKYVAPIAFNVVPLAGSLVDD

SEQ ID NO: 1329565 - protein, 25 aa, Mycobacterium
VHDHVTSVFRHPDLAAALAATELTE

SEQ ID NO: 1329566 - protein, 17 aa, Mycobacterium
VHDVIIIGSGPAGYTAA

SEQ ID NO: 1329567 - protein, 26 aa, Mycobacterium
VHELDDLPWVPADRAWLGALGHALRN

SEQ ID NO: 1329568 - protein, 24 aa, Mycobacterium
VHEYRTWDWRELTFRAVAERAGVG

SEQ ID NO: 1329569 - protein, 25 aa, Mycobacterium
VHGAAYMAFWGPDDVFRRANLEPSV

SEQ ID NO: 1329570 - protein, 24 aa, Mycobacterium
VHGESSYFVWLNRGKESVEIDIKD

SEQ ID NO: 1329571 - protein, 17 aa, Mycobacterium
VHGGIAFTWEHDMHLYF

SEQ ID NO: 1329572 - protein, 25 aa, Mycobacterium
VHGGVLPLLFDSMFGMVIHATGRPI

SEQ ID NO: 1329573 - protein, 25 aa, Mycobacterium
VHGPPIAFFGHSMGGLLAFEVARRF

SEQ ID NO: 1329574 - protein, 27 aa, Mycobacterium
VHGRVQGVGFRWWTRSRALELGLTGYA

SEQ ID NO: 1329575 - protein, 18 aa, Mycobacterium
VHLALPVIRAFTHFALLA

SEQ ID NO: 1329576 - protein, 24 aa, Mycobacterium
VHLKGHFAMLHHAAAYWKEQSKAG

SEQ ID NO: 1329577 - protein, 28 aa, Mycobacterium
VHLKSVVYELLWFLRGESNVRWLQEHGV

SEQ ID NO: 1329578 - protein, 29 aa, Mycobacterium
VHNRYVRYPVLLGPVPYPRPVVGPVQLAI

SEQ ID NO: 1329579 - protein, 21 aa, Mycobacterium
VHPAGLPFIGASLALAAAGRR

SEQ ID NO: 1329580 - protein, 22 aa, Mycobacterium
VHPDFWHEDEFGYRSIYVAYTA

SEQ ID NO: 1329581 - protein, 23 aa, Mycobacterium
VHPDFWHEDEFGYRSIYVAYTAG

SEQ ID NO: 1329582 - protein, 18 aa, Mycobacterium
VHPDVPPIVFHRSTFRRL

SEQ ID NO: 1329583 - protein, 19 aa, Mycobacterium
VHPGLWQPAVLAKLGATAD

SEQ ID NO: 1329584 - protein, 18 aa, Mycobacterium
VHPGVDLATFTPGDRLAA

SEQ ID NO: 1329585 - protein, 17 aa, Mycobacterium
VHQIPQPIAWPGSSDRN

SEQ ID NO: 1329586 - protein, 28 aa, Mycobacterium
VHQRRLLPLIARSYALQFAQNELVAKCH

SEQ ID NO: 1329587 - protein, 27 aa, Mycobacterium
VHRHLLRYMNWIPAEFVDALAPTTGFA

SEQ ID NO: 1329588 - protein, 19 aa, Mycobacterium
VHRRRVGLMPQEGALFPHL

SEQ ID NO: 1329589 - protein, 18 aa, Mycobacterium
VHSALSLPLIVDDQVIGA

SEQ ID NO: 1329590 - protein, 26 aa, Mycobacterium
VHSTTLYYPLVKTPMIAPTRAYDGLP

SEQ ID NO: 1329591 - protein, 17 aa, Mycobacterium
VHTAIVMPPGGSPAKWI

SEQ ID NO: 1329592 - protein, 24 aa, Mycobacterium
VHTIARVGPLSGDPYRLAGELGMP

SEQ ID NO: 1329593 - protein, 23 aa, Mycobacterium
VHTYKHVIVIDGVARICCFIGIC

SEQ ID NO: 1329594 - protein, 27 aa, Mycobacterium
VHVGCERFFLPTYAAQIVDNWIPALEG

SEQ ID NO: 1329595 - protein, 19 aa, Mycobacterium
VHVWGDVGGLPLQGDEWRG

SEQ ID NO: 1329596 - protein, 17 aa, Mycobacterium
VHWRQWTPAALAEAAER

SEQ ID NO: 1329597 - protein, 18 aa, Mycobacterium
VHYAGTVAGLAGLISDIA

SEQ ID NO: 1329598 - protein, 23 aa, Mycobacterium
VHYGPVLALDRATLSLQAGRVCG

SEQ ID NO: 1329599 - protein, 31 aa, Mycobacterium
VHYRPRPVVGIIAPWNYPVANALMDAVGALA

SEQ ID NO: 1329600 - protein, 25 aa, Mycobacterium
VIAANTPRWFVGSRLPAMPAVGSTA

SEQ ID NO: 1329601 - protein, 25 aa, Mycobacterium
VIAELASMMPMRVIGMLLGIPESEQ

SEQ ID NO: 1329602 - protein, 17 aa, Mycobacterium
VIALAYADGVLFVAENP

SEQ ID NO: 1329603 - protein, 17 aa, Mycobacterium
VIAPDKPWFSYVCPGAG

SEQ ID NO: 1329604 - protein, 28 aa, Mycobacterium
VIASEKAFFMLAFTKIGLMPDGGASALI

SEQ ID NO: 1329605 - protein, 27 aa, Mycobacterium
VIAVHLRGHFLLTRNAATYWRSKAKQG

SEQ ID NO: 1329606 - protein, 22 aa, Mycobacterium
VIAYARRFLDGAVPLASGSWSD

SEQ ID NO: 1329607 - protein, 17 aa, Mycobacterium
VIAYERTLFEPEHDMFR

SEQ ID NO: 1329608 - protein, 17 aa, Mycobacterium
VIAYRQPVTRARVSAVR

SEQ ID NO: 1329609 - protein, 17 aa, Mycobacterium
VIDAQYWRRHARQPVQF

SEQ ID NO: 1329610 - protein, 32 aa, Mycobacterium
VIDDAWQLARRFGELVRLLPAASAIAERVWLT

SEQ ID NO: 1329611 - protein, 17 aa, Mycobacterium
VIDPACWTPYPDTATVL

SEQ ID NO: 1329612 - protein, 23 aa, Mycobacterium
VIDRLLPAYLATYRGPHGGAPGA

SEQ ID NO: 1329613 - protein, 25 aa, Mycobacterium
VIDRRQDYFLWDMSGRRLIDMHLNG

SEQ ID NO: 1329614 - protein, 22 aa, Mycobacterium
VIEGMMALTGYYAWHRICVDRG

SEQ ID NO: 1329615 - protein, 25 aa, Mycobacterium
VIENGALLLHYLPEVDMRTGEILAC

SEQ ID NO: 1329616 - protein, 26 aa, Mycobacterium
VIEPTPDWPLIVNLPATVEMATPNVY

SEQ ID NO: 1329617 - protein, 25 aa, Mycobacterium
VIEQLNFPGYFLVVHDITRFCRDNN

SEQ ID NO: 1329618 - protein, 24 aa, Mycobacterium
VIGAFPMARRRALFAELQPLVTTF

SEQ ID NO: 1329619 - protein, 24 aa, Mycobacterium
VIGCDSMLFLDGTLRGKPGSAEAA

SEQ ID NO: 1329620 - protein, 19 aa, Mycobacterium
VIGCEHLLLGILRGGDEVA

SEQ ID NO: 1329621 - protein, 26 aa, Mycobacterium
VIGGLGIRLSSYLPTRTFELAVHGLD

SEQ ID NO: 1329622 - protein, 18 aa, Mycobacterium
VIGLMRTFAVELGQHSIR

SEQ ID NO: 1329623 - protein, 20 aa, Mycobacterium
VIGLPEVTLGLLPGGGGVAR

SEQ ID NO: 1329624 - protein, 26 aa, Mycobacterium
VIGPDRRYVMAISSLDPDDDASARET

SEQ ID NO: 1329625 - protein, 27 aa, Mycobacterium
VIGSKELIAWLPTLLGAGSDDLVVVPE

SEQ ID NO: 1329626 - protein, 21 aa, Mycobacterium
VIHPAYPFGGYKESGLGREGG

SEQ ID NO: 1329627 - protein, 23 aa, Mycobacterium
VIHSRLYKLDPFRYELVDIPFKF

SEQ ID NO: 1329628 - protein, 23 aa, Mycobacterium
VIKVILSLEHRTLPKHLNFENPS

SEQ ID NO: 1329629 - protein, 17 aa, Mycobacterium
VILAVRNLELGAQRAAE

SEQ ID NO: 1329630 - protein, 17 aa, Mycobacterium
VIMARMPGFGLDGPWRD

SEQ ID NO: 1329631 - protein, 19 aa, Mycobacterium
VIPDLITWWCERDGVRPDK

SEQ ID NO: 1329632 - protein, 18 aa, Mycobacterium
VIPSDLDGDSVGRLAYLL

SEQ ID NO: 1329633 - protein, 21 aa, Mycobacterium
VIQELLLRHRARTVIIVCPAG

SEQ ID NO: 1329634 - protein, 27 aa, Mycobacterium
VIQRELDRYLPFLATTRILIAAVRAGV

SEQ ID NO: 1329635 - protein, 26 aa, Mycobacterium
VIRARTSLLATIVRPGLLTDDEPTGR

SEQ ID NO: 1329636 - protein, 27 aa, Mycobacterium
VIRLRTFVRVPYRARIPMTRAALMHRD

SEQ ID NO: 1329637 - protein, 34 aa, Mycobacterium
VIRQKAGLPPATYFSGGKLQWLLENVDGLRADAE

SEQ ID NO: 1329638 - protein, 26 aa, Mycobacterium
VISDDLVSPKPFWEKPRALADVLDVG

SEQ ID NO: 1329639 - protein, 17 aa, Mycobacterium
VISVLGDRFVVSETFSV

SEQ ID NO: 1329640 - protein, 20 aa, Mycobacterium
VITEPLNYSFSDPAALDFVA

SEQ ID NO: 1329641 - protein, 28 aa, Mycobacterium
VITGAVILDYWGIIKADIGIRDGRITAI

SEQ ID NO: 1329642 - protein, 32 aa, Mycobacterium
VITIVLQLLHLLGRIPKIQPVLPLPGEHRQAP

SEQ ID NO: 1329643 - protein, 26 aa, Mycobacterium
VITTVGPYLRYGLPLVAACAAAGTDY

SEQ ID NO: 1329644 - protein, 23 aa, Mycobacterium
VITTVGPYTKYGLPLVAACAAAG

SEQ ID NO: 1329645 - protein, 17 aa, Mycobacterium
VIVDGTWRDAGHRQRAH

SEQ ID NO: 1329646 - protein, 20 aa, Mycobacterium
VIVEVRLSLPPVIALRDTDG

SEQ ID NO: 1329647 - protein, 24 aa, Mycobacterium
VIVLDFNTERLALAKSLGAEATIQ

SEQ ID NO: 1329648 - protein, 17 aa, Mycobacterium
VIVVMPSPKNSATLHSK

SEQ ID NO: 1329649 - protein, 21 aa, Mycobacterium
VIWGHGWDETRWPERRAPSTA

SEQ ID NO: 1329650 - protein, 23 aa, Mycobacterium
VKAMYPLGPIFHGSGLNMTVMSL

SEQ ID NO: 1329651 - protein, 18 aa, Mycobacterium
VKASLPRLGELAIGGTAV

SEQ ID NO: 1329652 - protein, 21 aa, Mycobacterium
VKATLRRLYRHPSSGQLVAME

SEQ ID NO: 1329653 - protein, 21 aa, Mycobacterium
VKATLRRLYRHPTSGQLVAME

SEQ ID NO: 1329654 - protein, 24 aa, Mycobacterium
VKDVFVPRHRFLSYKAMNDGTAGG

SEQ ID NO: 1329655 - protein, 21 aa, Mycobacterium
VKEAPWLPGQVQVFIHGEAQA

SEQ ID NO: 1329656 - protein, 27 aa, Mycobacterium
VKHLAGAFFTKWLYFASATTSADDANA

SEQ ID NO: 1329657 - protein, 26 aa, Mycobacterium
VKNNLQTVAALLRLQARRTNNPEGRE

SEQ ID NO: 1329658 - protein, 34 aa, Mycobacterium
VKNRYLVFTSHDIRALYLFKRTAWVPYSVTMKQV

SEQ ID NO: 1329659 - protein, 22 aa, Mycobacterium
VKNYVSRLLAKLGMERRTQAAV

SEQ ID NO: 1329660 - protein, 27 aa, Mycobacterium
VKPERRRRRPVWRRAPLSLTASPSTEA

SEQ ID NO: 1329661 - protein, 25 aa, Mycobacterium
VKQKLIQLGFAVQTLPNGKLVINVE

SEQ ID NO: 1329662 - protein, 30 aa, Mycobacterium
VKRLLGQIKAIWRVNELLNWQVAASGETIA

SEQ ID NO: 1329663 - protein, 22 aa, Mycobacterium
VKRRDRALLSKDATIREIHHRV

SEQ ID NO: 1329664 - protein, 26 aa, Mycobacterium
VKSAEAGLTPLRPWRDALAEALATVA

SEQ ID NO: 1329665 - protein, 22 aa, Mycobacterium
VKSFARLSLERFKRGASTRLRI

SEQ ID NO: 1329666 - protein, 18 aa, Mycobacterium
VKSGLFIPRDVVFNVPRD

SEQ ID NO: 1329667 - protein, 26 aa, Mycobacterium
VKTPRPRKSRPAVPAWEDVLLGVRSS

SEQ ID NO: 1329668 - protein, 24 aa, Mycobacterium
VKVIDFGRFAWRPAVTDFCRLAAQ

SEQ ID NO: 1329669 - protein, 29 aa, Mycobacterium
VKVKPTSVPAFRPGAQFKAVVSGAQKLPA

SEQ ID NO: 1329670 - protein, 20 aa, Mycobacterium
VKVLAAWDWQVRPTAVMALD

SEQ ID NO: 1329671 - protein, 18 aa, Mycobacterium
VKVLGTAASAPGSSFAPI

SEQ ID NO: 1329672 - protein, 17 aa, Mycobacterium
VKVNLMLTRLPRLRDES

SEQ ID NO: 1329673 - protein, 19 aa, Mycobacterium
VKVPVRWWHGDADSIISLA

SEQ ID NO: 1329674 - protein, 28 aa, Mycobacterium
VLAAFGDRDYWLARLAAYGGDSMSLDSL

SEQ ID NO: 1329675 - protein, 23 aa, Mycobacterium
VLAALNHIAAAMPFPILGVDSDN

SEQ ID NO: 1329676 - protein, 26 aa, Mycobacterium
VLAALPDAYVVRTAWIYEGGAGTDFA

SEQ ID NO: 1329677 - protein, 28 aa, Mycobacterium
VLAAQGFEVLLLLAAVPTPVVAFTVRHM

SEQ ID NO: 1329678 - protein, 20 aa, Mycobacterium
VLAATGLLDAPGARVSGSST

SEQ ID NO: 1329679 - protein, 17 aa, Mycobacterium
VLADIEALPAWSSVYRK

SEQ ID NO: 1329680 - protein, 18 aa, Mycobacterium
VLADILPTSYEVGVLAGA

SEQ ID NO: 1329681 - protein, 17 aa, Mycobacterium
VLAGGWVLRALQGTPAS

SEQ ID NO: 1329682 - protein, 25 aa, Mycobacterium
VLAHGWGAAGVWQYLKRADAPERVA

SEQ ID NO: 1329683 - protein, 23 aa, Mycobacterium
VLAHPRIRTGWPGAGALTVRSRR

SEQ ID NO: 1329684 - protein, 25 aa, Mycobacterium
VLAKRQPLLIVSSDLRRALDTAVAL

SEQ ID NO: 1329685 - protein, 18 aa, Mycobacterium
VLALHRLPGARLTGVDIS

SEQ ID NO: 1329686 - protein, 17 aa, Mycobacterium
VLALLEGAAVLAESDPA

SEQ ID NO: 1329687 - protein, 17 aa, Mycobacterium
VLALLGVRPIWDDASRR

SEQ ID NO: 1329688 - protein, 17 aa, Mycobacterium
VLAPGSVLTKRPPRWIV

SEQ ID NO: 1329689 - protein, 19 aa, Mycobacterium
VLAPLTPAAIFLVATIDEG

SEQ ID NO: 1329690 - protein, 26 aa, Mycobacterium
VLARGMLEVLPLTHIRGRSLHDSFVI

SEQ ID NO: 1329691 - protein, 27 aa, Mycobacterium
VLARRYELLDRRLADAGFDWYEVSNWS

SEQ ID NO: 1329692 - protein, 17 aa, Mycobacterium
VLASAELFATFVDPPLS

SEQ ID NO: 1329693 - protein, 31 aa, Mycobacterium
VLATDPLVDDSFRQRWFGWGDPARVLVEYAQ

SEQ ID NO: 1329694 - protein, 25 aa, Mycobacterium
VLAVKACFAAFRTGKLDHHGQFYNL

SEQ ID NO: 1329695 - protein, 31 aa, Mycobacterium
VLAVRADPGRFAKLVLLTPSPCYVDDGDYRG

SEQ ID NO: 1329696 - protein, 18 aa, Mycobacterium
VLAVRPELVLTPREAFFA

SEQ ID NO: 1329697 - protein, 17 aa, Mycobacterium
VLAWHDALNAADLDTLL

SEQ ID NO: 1329698 - protein, 21 aa, Mycobacterium
VLCALPARYLTPTSDKKPAPL

SEQ ID NO: 1329699 - protein, 17 aa, Mycobacterium
VLCPFTHAGLRTLVDRR

SEQ ID NO: 1329700 - protein, 17 aa, Mycobacterium
VLCRARAHRFSRGYFDH

SEQ ID NO: 1329701 - protein, 17 aa, Mycobacterium
VLCTGFDIWEANIPAIE

SEQ ID NO: 1329702 - protein, 20 aa, Mycobacterium
VLDALAPLLPPSRSNPRDAG

SEQ ID NO: 1329703 - protein, 26 aa, Mycobacterium
VLDALPHGYVVRTAWVYEGADGTDFV

SEQ ID NO: 1329704 - protein, 19 aa, Mycobacterium
VLDDADFNAALPLAAMMAC

SEQ ID NO: 1329705 - protein, 22 aa, Mycobacterium
VLDDIPVVLIAGDRFTRPEPVN

SEQ ID NO: 1329706 - protein, 21 aa, Mycobacterium
VLDGFKSVLDTGIDFSKTVNS

SEQ ID NO: 1329707 - protein, 18 aa, Mycobacterium
VLDGKLHKHWGFGGGPHR

SEQ ID NO: 1329708 - protein, 19 aa, Mycobacterium
VLDLALRARVHALHTRLAE

SEQ ID NO: 1329709 - protein, 22 aa, Mycobacterium
VLDMLAPWDVLGAVGKALVPGG

SEQ ID NO: 1329710 - protein, 24 aa, Mycobacterium
VLDNVFATPILQQGFPLGVDVVVY

SEQ ID NO: 1329711 - protein, 25 aa, Mycobacterium
VLDNVFATPLLQQGLPLGVDVVVYS

SEQ ID NO: 1329712 - protein, 22 aa, Mycobacterium
VLDQLMYPAMMFGAAGAWSIDV

SEQ ID NO: 1329713 - protein, 17 aa, Mycobacterium
VLDSLRLGRPVEFGEAP

SEQ ID NO: 1329714 - protein, 25 aa, Mycobacterium
VLDSPDFLRLGLMLALERRPVEPKA

SEQ ID NO: 1329715 - protein, 39 aa, Mycobacterium; identical to SEQ ID NO: 1142722

SEQ ID NO: 1329716 - protein, 22 aa, Mycobacterium
VLDVLWSLPSYERLADAWELSA

SEQ ID NO: 1329717 - protein, 18 aa, Mycobacterium
VLDVRPVVTLKQVPEPPD

SEQ ID NO: 1329718 - protein, 18 aa, Mycobacterium
VLDWPLNVVVVRSGDRTI

SEQ ID NO: 1329719 - protein, 18 aa, Mycobacterium
VLDWPLNVVVVRTGGQTI

SEQ ID NO: 1329720 - protein, 24 aa, Mycobacterium
VLDYRPDLGVLLLSYIDGKTLENS

SEQ ID NO: 1329721 - protein, 25 aa, Mycobacterium
VLEDALVLLHREKISSLPDLLPLLE

SEQ ID NO: 1329722 - protein, 17 aa, Mycobacterium
VLEGRLEQLRTFEREYR

SEQ ID NO: 1329723 - protein, 24 aa, Mycobacterium
VLELSVLLPQWRAQIAGDLTRRGL

SEQ ID NO: 1329724 - protein, 27 aa, Mycobacterium
VLENPELLATFLPAFRNDYRALQAYHR

SEQ ID NO: 1329725 - protein, 26 aa, Mycobacterium
VLESPGLLRFLPQLAETLLGETPLLA

SEQ ID NO: 1329726 - protein, 17 aa, Mycobacterium
VLETSHPPTYYLPRSCF

SEQ ID NO: 1329727 - protein, 20 aa, Mycobacterium
VLEVALRLPELDYIGVMGSR

SEQ ID NO: 1329728 - protein, 18 aa, Mycobacterium
VLFELSYPDEKIAREALT

SEQ ID NO: 1329729 - protein, 23 aa, Mycobacterium
VLFHARAKLRRKGCDLLVVNAVG

SEQ ID NO: 1329730 - protein, 18 aa, Mycobacterium
VLFPNYFMTVRAGECHVI

SEQ ID NO: 1329731 - protein, 17 aa, Mycobacterium
VLGAIVWTKQVWLATIA

SEQ ID NO: 1329732 - protein, 19 aa, Mycobacterium
VLGAPLALAYAMRCTACWW

SEQ ID NO: 1329733 - protein, 25 aa, Mycobacterium
VLGDPDLLHLFFVDGGALAVENALK

SEQ ID NO: 1329734 - protein, 20 aa, Mycobacterium
VLGETRMWAAFLRFEPDLLD

SEQ ID NO: 1329735 - protein, 18 aa, Mycobacterium
VLGFIKFGDREWTAEELN

SEQ ID NO: 1329736 - protein, 17 aa, Mycobacterium
VLGFSTQAFYKWRKAPL

SEQ ID NO: 1329737 - protein, 27 aa, Mycobacterium
VLGGDDPYLRPLQLIVGRACELTGAEQ

SEQ ID NO: 1329738 - protein, 19 aa, Mycobacterium
VLGNAIVPALAARALGKHG

SEQ ID NO: 1329739 - protein, 18 aa, Mycobacterium
VLGPRAVLTPLAREKARA

SEQ ID NO: 1329740 - protein, 19 aa, Mycobacterium
VLGPRAVLTPLARERARAL

SEQ ID NO: 1329741 - protein, 18 aa, Mycobacterium
VLGRPGGPAFRPSEVARL

SEQ ID NO: 1329742 - protein, 29 aa, Mycobacterium
VLGSETEPGLRWPDLSLAGGRVGFSALRD

SEQ ID NO: 1329743 - protein, 17 aa, Mycobacterium
VLHRTLRSELLGKPVRL

SEQ ID NO: 1329744 - protein, 18 aa, Mycobacterium
VLHVPLIVVLGHDSCGAV

SEQ ID NO: 1329745 - protein, 17 aa, Mycobacterium
VLIDENFPESLQLGARA

SEQ ID NO: 1329746 - protein, 21 aa, Mycobacterium
VLIPAPDYPLWTACTSLAGGT

SEQ ID NO: 1329747 - protein, 24 aa, Mycobacterium
VLKDSMVLAYRWPADRNSVTWSLV

SEQ ID NO: 1329748 - protein, 18 aa, Mycobacterium
VLKFVRPIKAGDTLYCDV

SEQ ID NO: 1329749 - protein, 17 aa, Mycobacterium
VLKLLQWGQPTRPWRLK

SEQ ID NO: 1329750 - protein, 26 aa, Mycobacterium
VLKPDEHAPLLPLELAREFDAAGLPP

SEQ ID NO: 1329751 - protein, 28 aa, Mycobacterium
VLKPDPHTPWNATRLGRLIAEHTDIPAG

SEQ ID NO: 1329752 - protein, 19 aa, Mycobacterium
VLLAPTLREAWAVIAPMLA

SEQ ID NO: 1329753 - protein, 17 aa, Mycobacterium
VLLCLAGGTYDKQYWHL

SEQ ID NO: 1329754 - protein, 24 aa, Mycobacterium
VLLDLVRELAPTVTLILTSHQHFD

SEQ ID NO: 1329755 - protein, 21 aa, Mycobacterium
VLLDRCVELLAPALTRTSTDG

SEQ ID NO: 1329756 - protein, 19 aa, Mycobacterium
VLLGASAGLEPRRARARTA

SEQ ID NO: 1329757 - protein, 18 aa, Mycobacterium
VLLITDIDALLPATPEPV

SEQ ID NO: 1329758 - protein, 19 aa, Mycobacterium
VLLLYYSYTGQSKKVLDAA

SEQ ID NO: 1329759 - protein, 30 aa, Mycobacterium
VLLMAVERIELFVKILLRGGRPADTPVLVV

SEQ ID NO: 1329760 - protein, 18 aa, Mycobacterium
VLLMRSWSRFVAACRRRY

SEQ ID NO: 1329761 - protein, 17 aa, Mycobacterium
VLLQVLFHARIAEEAPH

SEQ ID NO: 1329762 - protein, 18 aa, Mycobacterium
VLLSCGAVLHHCAVALGA

SEQ ID NO: 1329763 - protein, 17 aa, Mycobacterium
VLLSPAWKQAEVGHALS

SEQ ID NO: 1329764 - protein, 19 aa, Mycobacterium
VLLTHRNARTTLLGRMLIV

SEQ ID NO: 1329765 - protein, 24 aa, Mycobacterium
VLMEIGPQPFLIAAALRVWPESAA

SEQ ID NO: 1329766 - protein, 19 aa, Mycobacterium
VLMNNAGVMFTPFGRTVDG

SEQ ID NO: 1329767 - protein, 20 aa, Mycobacterium
VLMPLDHVVAWAEAPGTLVD

SEQ ID NO: 1329768 - protein, 18 aa, Mycobacterium
VLMYIAHREVESRVMAAL

SEQ ID NO: 1329769 - protein, 17 aa, Mycobacterium
VLNRLRRAQGQLAGVIS

SEQ ID NO: 1329770 - protein, 18 aa, Mycobacterium
VLNRLRRAQGQLAGVITM

SEQ ID NO: 1329771 - protein, 33 aa, Mycobacterium
VLNSRSAPLARTWPLLIRGLVALRRTGDDGGVI

SEQ ID NO: 1329772 - protein, 18 aa, Mycobacterium
VLPAADVKIFLTASAEER

SEQ ID NO: 1329773 - protein, 25 aa, Mycobacterium
VLPGQSLLVYEMTPALFAAVAANEA

SEQ ID NO: 1329774 - protein, 17 aa, Mycobacterium
VLPIMNPGGGIVGMDFD

SEQ ID NO: 1329775 - protein, 21 aa, Mycobacterium
VLPLYARLPTAEQQKVFAPHT

SEQ ID NO: 1329776 - protein, 25 aa, Mycobacterium
VLPQGEVDDLLRAIYRLRALGDEFS

SEQ ID NO: 1329777 - protein, 17 aa, Mycobacterium
VLPRRPTFALLKGRGNY

SEQ ID NO: 1329778 - protein, 19 aa, Mycobacterium
VLPYASEIFGVYQPLIGWS

SEQ ID NO: 1329779 - protein, 26 aa, Mycobacterium
VLQAFPQIAQYYRRRFRHILVDEYQD

SEQ ID NO: 1329780 - protein, 25 aa, Mycobacterium
VLQIRYIDDLPTLKRILRPADESPA

SEQ ID NO: 1329781 - protein, 18 aa, Mycobacterium
VLQPLRSIVLSTGGLLGA

SEQ ID NO: 1329782 - protein, 18 aa, Mycobacterium
VLQRFRAARIDAVDLDPA

SEQ ID NO: 1329783 - protein, 25 aa, Mycobacterium
VLQRSWVHVLPSRKEGWGLAVTEAG

SEQ ID NO: 1329784 - protein, 19 aa, Mycobacterium
VLQWGVIVEKPKGLDDGTT

SEQ ID NO: 1329785 - protein, 19 aa, Mycobacterium
VLRADLWDRFDRLARDGTT

SEQ ID NO: 1329786 - protein, 22 aa, Mycobacterium
VLRDPFGHLWSMGQPVREVSPE

SEQ ID NO: 1329787 - protein, 22 aa, Mycobacterium
VLRDPRFVIPPGIHLSAHGITS

SEQ ID NO: 1329788 - protein, 27 aa, Mycobacterium
VLRDRLLVDLIHEAFRRLFERHGQHDP

SEQ ID NO: 1329789 - protein, 26 aa, Mycobacterium
VLRDRLPKIGALFLQGLLSELLVRAI

SEQ ID NO: 1329790 - protein, 25 aa, Mycobacterium
VLRDRLTRLWLRAEAQRLTSERSRA

SEQ ID NO: 1329791 - protein, 18 aa, Mycobacterium
VLREMYAPLLAAGVPFLI

SEQ ID NO: 1329792 - protein, 24 aa, Mycobacterium
VLRQFVGYIVEKRFNLSWAIEGTR

SEQ ID NO: 1329793 - protein, 30 aa, Mycobacterium
VLRQRHDGRWIWRWDPAFIHSNFDFLRDES

SEQ ID NO: 1329794 - protein, 22 aa, Mycobacterium
VLRTFLLERGELPESSLVAMVP

SEQ ID NO: 1329795 - protein, 22 aa, Mycobacterium
VLRTTRFESLRWCTGRRSPAQL

SEQ ID NO: 1329796 - protein, 26 aa, Mycobacterium
VLSEELIENLFLPAFGSQPGPSRDSA

SEQ ID NO: 1329797 - protein, 26 aa, Mycobacterium
VLSGSHIPLCLDTGHLLIGGTDPLAL

SEQ ID NO: 1329798 - protein, 19 aa, Mycobacterium
VLSLAIPPEGPMITAVRAG

SEQ ID NO: 1329799 - protein, 27 aa, Mycobacterium
VLSQRSKLLYDYFVELFAQVTNPPLDA

SEQ ID NO: 1329800 - protein, 25 aa, Mycobacterium
VLSRAQLLELVWGYDFAADTNVVDV

SEQ ID NO: 1329801 - protein, 17 aa, Mycobacterium
VLSRAVLWHCEDRVIRH

SEQ ID NO: 1329802 - protein, 26 aa, Mycobacterium
VLSRGMLEVLPLTHIRGRSLHDSFVI

SEQ ID NO: 1329803 - protein, 27 aa, Mycobacterium
VLSRYVDAIVWRTFAQERLTAMASGST

SEQ ID NO: 1329804 - protein, 17 aa, Mycobacterium
VLTDRKFGDWAHTVMPA

SEQ ID NO: 1329805 - protein, 17 aa, Mycobacterium
VLTGIDDARARCVAIAL

SEQ ID NO: 1329806 - protein, 17 aa, Mycobacterium
VLTGPQWRPRPADLLIA

SEQ ID NO: 1329807 - protein, 19 aa, Mycobacterium
VLTMTYLDGMDWAAAQQAD

SEQ ID NO: 1329808 - protein, 26 aa, Mycobacterium
VLTPLPAAVRRRVIRGWLLGGGANGL

SEQ ID NO: 1329809 - protein, 37 aa, Mycobacterium
VLTTELPTTYRLLGRTPRRLLPLRPAPSAVVAHVGCA

SEQ ID NO: 1329810 - protein, 23 aa, Mycobacterium
VLTTRIYCRPSCPVRPPYARNMR

SEQ ID NO: 1329811 - protein, 17 aa, Mycobacterium
VLVCPYHHRLHHRGVIT

SEQ ID NO: 1329812 - protein, 22 aa, Mycobacterium
VLVDLIELHLQAKQAHWNVVGT

SEQ ID NO: 1329813 - protein, 25 aa, Mycobacterium
VLVDTARLWLSLGHHDRYGRWRIDG

SEQ ID NO: 1329814 - protein, 34 aa, Mycobacterium
VLVFGHGLLMDGRQWRRVIPLLPGYRCITPTLPM

SEQ ID NO: 1329815 - protein, 33 aa, Mycobacterium
VLVGQPTLRHRLRLGVLAALDQRIAVRYTLPGM

SEQ ID NO: 1329816 - protein, 19 aa, Mycobacterium
VLVISGKDKGAKGKVLVAY

SEQ ID NO: 1329817 - protein, 18 aa, Mycobacterium
VLVKQWLGPHGLEMEITE

SEQ ID NO: 1329818 - protein, 26 aa, Mycobacterium
VLVSFAGTVRRPLGLRKVATEDLDGF

SEQ ID NO: 1329819 - protein, 19 aa, Mycobacterium
VLVVCPAAVETPILDKGAV

SEQ ID NO: 1329820 - protein, 17 aa, Mycobacterium
VLVVGRDRNILFGLMLS

SEQ ID NO: 1329821 - protein, 28 aa, Mycobacterium
VLVVQRMLASRFVPRALLGTDRRLTELG

SEQ ID NO: 1329822 - protein, 18 aa, Mycobacterium
VLVVWAREDRMMPPAHAD

SEQ ID NO: 1329823 - protein, 17 aa, Mycobacterium
VLWGIQAAAAKFKELGN

SEQ ID NO: 1329824 - protein, 26 aa, Mycobacterium
VLYDEHAAALWRYALRLTGDRARAED

SEQ ID NO: 1329825 - protein, 22 aa, Mycobacterium
VLYEGYLLYPYRATSGKNQSRW

SEQ ID NO: 1329826 - protein, 20 aa, Mycobacterium
VLYTVGRKALGYFSFRQREV

SEQ ID NO: 1329827 - protein, 20 aa, Mycobacterium
VMDAEPLNYLIFTYNRLSCC

SEQ ID NO: 1329828 - protein, 29 aa, Mycobacterium
VMDRPFVAHFPFLADALDPAERRALDALT

SEQ ID NO: 1329829 - protein, 32 aa, Mycobacterium
VMEDAWWGPTVPLVDAPWFALSERNSPGSIIV

SEQ ID NO: 1329830 - protein, 19 aa, Mycobacterium
VMGLPFTSGHYLAYRDFPA

SEQ ID NO: 1329831 - protein, 21 aa, Mycobacterium
VMGRLTWESLPPKVRPLPGRK

SEQ ID NO: 1329832 - protein, 22 aa, Mycobacterium
VMHTHRGLLYQAADTNLVTEAN

SEQ ID NO: 1329833 - protein, 19 aa, Mycobacterium
VMIGRAYLWGLAAGGQAGV

SEQ ID NO: 1329834 - protein, 26 aa, Mycobacterium
VMKPGPGFAMLRRGGLRLLLNVPEGG

SEQ ID NO: 1329835 - protein, 23 aa, Mycobacterium
VMKRRRGFLPGDTKADNARAKRY

SEQ ID NO: 1329836 - protein, 21 aa, Mycobacterium
VMLFETGLPTRYYIDRTDIAF

SEQ ID NO: 1329837 - protein, 19 aa, Mycobacterium
VMLGYWRDEEKTAQAVDAD

SEQ ID NO: 1329838 - protein, 19 aa, Mycobacterium
VMLHLAIKAFAPARLPFPV

SEQ ID NO: 1329839 - protein, 27 aa, Mycobacterium
VMLKAKFKLPFYNTSRWTFAALVGDPE

SEQ ID NO: 1329840 - protein, 26 aa, Mycobacterium
VMLNGVYFTIEAALPALLRNPDGGAI

SEQ ID NO: 1329841 - protein, 19 aa, Mycobacterium
VMNFGLAVTALRGEGVDAH

SEQ ID NO: 1329842 - protein, 20 aa, Mycobacterium
VMNWVKLHPTNISQKVQIIV

SEQ ID NO: 1329843 - protein, 25 aa, Mycobacterium
VMPAPIMSWMYECGNYRRFTQNVLV

SEQ ID NO: 1329844 - protein, 28 aa, Mycobacterium
VMPPWNRKLAYPRLQFSPLHTWVTDTEF

SEQ ID NO: 1329845 - protein, 20 aa, Mycobacterium
VMPRFEPHEFLRLVTEHRVT

SEQ ID NO: 1329846 - protein, 21 aa, Mycobacterium
VMPVLKKWRIFEREDFNGESA

SEQ ID NO: 1329847 - protein, 26 aa, Mycobacterium
VMRLRDLLKFEFYFADSAGYRDHVAA

SEQ ID NO: 1329848 - protein, 20 aa, Mycobacterium
VMRTLLAERDFPATGVRFFA

SEQ ID NO: 1329849 - protein, 20 aa, Mycobacterium
VMRVDDLVGAIWLPADGKAN

SEQ ID NO: 1329850 - protein, 24 aa, Mycobacterium
VMSQPSLPLPLTPKQRRDPGLSEA

SEQ ID NO: 1329851 - protein, 17 aa, Mycobacterium
VMTLLAQLSRHSGTHFG

SEQ ID NO: 1329852 - protein, 31 aa, Mycobacterium
VMTLQPYLGAYGHLVALREGDLAYLHVHPEG

SEQ ID NO: 1329853 - protein, 33 aa, Mycobacterium
VMTPPSHILGLLNIVMALDTGAWIRLHRRFDID

SEQ ID NO: 1329854 - protein, 24 aa, Mycobacterium
VMTQELLEFPGGVLGVALNLDEHS

SEQ ID NO: 1329855 - protein, 17 aa, Mycobacterium
VMTYFFTDPGGMEPFLA

SEQ ID NO: 1329856 - protein, 18 aa, Mycobacterium
VMVHPYVASKWAVRGLTK

SEQ ID NO: 1329857 - protein, 18 aa, Mycobacterium
VMVYLDARFPLHGMPDDA

SEQ ID NO: 1329858 - protein, 20 aa, Mycobacterium
VMWAATLAGIAFGNAGVHIP

SEQ ID NO: 1329859 - protein, 29 aa, Mycobacterium
VMWNFSTGNPLFLRHLVEGALADGALTEV

SEQ ID NO: 1329860 - protein, 27 aa, Mycobacterium
VNAIAPIARTRLTLATPGMGALMAEPD

SEQ ID NO: 1329861 - protein, 30 aa, Mycobacterium
VNARELIAELDWIFATRPLAEWAEIFAAEP

SEQ ID NO: 1329862 - protein, 23 aa, Mycobacterium
VNASWSRVRWWVPDLERSGIGML

SEQ ID NO: 1329863 - protein, 18 aa, Mycobacterium
VNDGWRLARTTLANERVA

SEQ ID NO: 1329864 - protein, 24 aa, Mycobacterium
VNEAGLAANLLWLAESQYPADDAG

SEQ ID NO: 1329865 - protein, 26 aa, Mycobacterium
VNEIRINWVWNPPWGPDKITDDGREQ

SEQ ID NO: 1329866 - protein, 24 aa, Mycobacterium
VNEWDPEPLARLRSYPLLAGIRGS

SEQ ID NO: 1329867 - protein, 18 aa, Mycobacterium
VNFGAFVDLGGVDGLVHV

SEQ ID NO: 1329868 - protein, 29 aa, Mycobacterium
VNGALARYASLPTKALFRIPDEISLAEAA

SEQ ID NO: 1329869 - protein, 33 aa, Mycobacterium
VNGDVHRRLATRAMPLMPTGARIVFVTSHQAHF

SEQ ID NO: 1329870 - protein, 24 aa, Mycobacterium
VNGEPWPFAPRVILKSLIERCSDA

SEQ ID NO: 1329871 - protein, 41 aa, Mycobacterium
VNGGYFCRGLPADFDGWRVPGWTWRDVLPHFRAIETDLDFT

SEQ ID NO: 1329872 - protein, 25 aa, Mycobacterium
VNGNPAVVILWDWTGEGLTTFRGVP

SEQ ID NO: 1329873 - protein, 24 aa, Mycobacterium
VNGRTYGFLVDRATQVWWPSDDLQ

SEQ ID NO: 1329874 - protein, 28 aa, Mycobacterium
VNHHDGVVAFLRRARRALPGDPDFGDPL

SEQ ID NO: 1329875 - protein, 25 aa, Mycobacterium
VNHLVEMLVAVVWGMGFYAGFVGDR

SEQ ID NO: 1329876 - protein, 17 aa, Mycobacterium
VNKGWLVARATLGNERI

SEQ ID NO: 1329877 - protein, 27 aa, Mycobacterium
VNKLVAMSATFRRDGWYPVVGEAIGGL

SEQ ID NO: 1329878 - protein, 29 aa, Mycobacterium
VNLAASSRPLYPWPLALARDTEPRRTTAA

SEQ ID NO: 1329879 - protein, 18 aa, Mycobacterium
VNLDITWLRDESLEDADN

SEQ ID NO: 1329880 - protein, 24 aa, Mycobacterium
VNLGGVWKTVKAGVPHILAGGRGG

SEQ ID NO: 1329881 - protein, 17 aa, Mycobacterium
VNLSAPAVKRRVDRMLD

SEQ ID NO: 1329882 - protein, 21 aa, Mycobacterium
VNLSGVWKTVKAGVPHILAGG

SEQ ID NO: 1329883 - protein, 21 aa, Mycobacterium
VNLTGVWHTVKASVPHLGAAG

SEQ ID NO: 1329884 - protein, 20 aa, Mycobacterium
VNLTGVWKTVKAGIPHMIAG

SEQ ID NO: 1329885 - protein, 18 aa, Mycobacterium
VNLYGVLHCTRAVLPTMI

SEQ ID NO: 1329886 - protein, 27 aa, Mycobacterium
VNPIAGVIGIFIGNGDEPGENGGLLFG

SEQ ID NO: 1329887 - protein, 23 aa, Mycobacterium
VNQYLAVSALIAGGLYGIDNELE

SEQ ID NO: 1329888 - protein, 26 aa, Mycobacterium
VNRFALAVHTLLKPIGKLLTELGGLI

SEQ ID NO: 1329889 - protein, 18 aa, Mycobacterium
VNRVWFLDAVRGEADVYN

SEQ ID NO: 1329890 - protein, 18 aa, Mycobacterium
VNRWLINGAVYTMKTRPG

SEQ ID NO: 1329891 - protein, 19 aa, Mycobacterium
VNTFGPIMHQFKSAVSDLM

SEQ ID NO: 1329892 - protein, 23 aa, Mycobacterium
VNTSSFAFLGDYGGTGYPAGKGA

SEQ ID NO: 1329893 - protein, 31 aa, Mycobacterium
VNVASMAAYLLPAELIPTSAFPLALQDTEAF

SEQ ID NO: 1329894 - protein, 24 aa, Mycobacterium
VNVDAVIRTLLARGLITEAGTDSD

SEQ ID NO: 1329895 - protein, 29 aa, Mycobacterium
VNVVGAVALTLELLPALRSAGGHVVFINS

SEQ ID NO: 1329896 - protein, 18 aa, Mycobacterium
VPAERVRGALMGGYFAGL

SEQ ID NO: 1329897 - protein, 20 aa, Mycobacterium
VPAICFACGYPTMHPGLCAY

SEQ ID NO: 1329898 - protein, 28 aa, Mycobacterium
VPAIIAEYLGLPQLTHVRKLSVENGKVT

SEQ ID NO: 1329899 - protein, 19 aa, Mycobacterium
VPALPQLRTLTTWLESRRA

SEQ ID NO: 1329900 - protein, 24 aa, Mycobacterium
VPALREELVTALIRSLPKDLRRNF

SEQ ID NO: 1329901 - protein, 18 aa, Mycobacterium
VPAMFVRMLKLPEAVRKS

SEQ ID NO: 1329902 - protein, 17 aa, Mycobacterium
VPANRFAIVGYAARFPG

SEQ ID NO: 1329903 - protein, 26 aa, Mycobacterium
VPASAIGRIFSPPEFRLIPIDESTWP

SEQ ID NO: 1329904 - protein, 17 aa, Mycobacterium
VPASIADLTVALPAGVL

SEQ ID NO: 1329905 - protein, 23 aa, Mycobacterium
VPASLLSCWLDAQSTPGADGAGS

SEQ ID NO: 1329906 - protein, 27 aa, Mycobacterium
VPASVDSFVWLALYLAQRPPIEPGGPV

SEQ ID NO: 1329907 - protein, 24 aa, Mycobacterium
VPASVVIRGDLAYIANFGGNSLSV

SEQ ID NO: 1329908 - protein, 23 aa, Mycobacterium
VPDATWPAVVYTLATLLDDPAAA

SEQ ID NO: 1329909 - protein, 18 aa, Mycobacterium
VPDAVGADRLLVLVDGAV

SEQ ID NO: 1329910 - protein, 17 aa, Mycobacterium
VPDENAALMKKLRGGIG

SEQ ID NO: 1329911 - protein, 19 aa, Mycobacterium
VPDPLPCEIYCHTLADPTI

SEQ ID NO: 1329912 - protein, 18 aa, Mycobacterium
VPDPPGPHLLVLARGPEG

SEQ ID NO: 1329913 - protein, 27 aa, Mycobacterium
VPDRHYVKFLELLGLELRPPGAAQGEV

SEQ ID NO: 1329914 - protein, 17 aa, Mycobacterium
VPDRWMYRTLTVNYRTP

SEQ ID NO: 1329915 - protein, 24 aa, Mycobacterium
VPDSFWAGVLPRVRERHPQAWFVG

SEQ ID NO: 1329916 - protein, 33 aa, Mycobacterium
VPDSRGRVRWLYKQFPGEDWAGWHVLVLVSTAT

SEQ ID NO: 1329917 - protein, 25 aa, Mycobacterium
VPEDGFVSFFGPWQNWKDRKPAEID

SEQ ID NO: 1329918 - protein, 18 aa, Mycobacterium
VPEEKWVYLHGHSDLVEQ

SEQ ID NO: 1329919 - protein, 22 aa, Mycobacterium
VPEIPVATRLAGLEPLNITDDS

SEQ ID NO: 1329920 - protein, 17 aa, Mycobacterium
VPELFRGIADTYYSQVL

SEQ ID NO: 1329921 - protein, 20 aa, Mycobacterium
VPELLRVLDFTPTPDLVLRP

SEQ ID NO: 1329922 - protein, 27 aa, Mycobacterium
VPEMNLGQLALLLRGKYLIDVQSVTKV

SEQ ID NO: 1329923 - protein, 17 aa, Mycobacterium
VPEPFAVYAHHPGLMLT

SEQ ID NO: 1329924 - protein, 18 aa, Mycobacterium
VPERLVIVDALPRTSLGK

SEQ ID NO: 1329925 - protein, 32 aa, Mycobacterium
VPESLRDIVLAIVRDRPLAPVARISTLRNVDV

SEQ ID NO: 1329926 - protein, 23 aa, Mycobacterium
VPETLPEWFVREHNLMSEDEALR

SEQ ID NO: 1329927 - protein, 23 aa, Mycobacterium
VPETLYEPLFARLRASANAIPVL

SEQ ID NO: 1329928 - protein, 25 aa, Mycobacterium
VPEVIAAALQRTADLWLEHGPVMRM

SEQ ID NO: 1329929 - protein, 19 aa, Mycobacterium
VPFAEQVPLAPLTTLRVGP

SEQ ID NO: 1329930 - protein, 19 aa, Mycobacterium
VPFLSDYVASKFGVVGLTQ

SEQ ID NO: 1329931 - protein, 19 aa, Mycobacterium
VPFVDPLTTILDPSLPLTV

SEQ ID NO: 1329932 - protein, 18 aa, Mycobacterium
VPGAPATYAIWEADEFEV

SEQ ID NO: 1329933 - protein, 24 aa, Mycobacterium
VPGDVRGLPPGTQFGRDAIAAGEA

SEQ ID NO: 1329934 - protein, 22 aa, Mycobacterium
VPGEQRSFRLPNGSIQQVTVLA

SEQ ID NO: 1329935 - protein, 26 aa, Mycobacterium
VPGGRDEIWRFTPLKRLRGLHDGSAP

SEQ ID NO: 1329936 - protein, 17 aa, Mycobacterium
VPGISRPGLTDQDLIAG

SEQ ID NO: 1329937 - protein, 18 aa, Mycobacterium
VPGLPEFRPGDDLAAALA

SEQ ID NO: 1329938 - protein, 24 aa, Mycobacterium
VPGNARYFVVPVTNLWTVTGNYWD

SEQ ID NO: 1329939 - protein, 19 aa, Mycobacterium
VPGQGIVKSGLFIPRDVVF

SEQ ID NO: 1329940 - protein, 37 aa, Mycobacterium
VPGRLVHFVMTVWQKLHFRFGLPKPLLEPLSVERIYL

SEQ ID NO: 1329941 - protein, 18 aa, Mycobacterium
VPGTGWPEPGGLLPREAL

SEQ ID NO: 1329942 - protein, 18 aa, Mycobacterium
VPGVWPPVTIGGRRFMDG

SEQ ID NO: 1329943 - protein, 18 aa, Mycobacterium
VPGVWPPVTIGPRRFMDG

SEQ ID NO: 1329944 - protein, 18 aa, Mycobacterium
VPHDRTFALFTREPRRGS

SEQ ID NO: 1329945 - protein, 24 aa, Mycobacterium
VPHLHVHVFPARNLSDFGFANVDR

SEQ ID NO: 1329946 - protein, 17 aa, Mycobacterium
VPIQTRHPMILAQQGLT

SEQ ID NO: 1329947 - protein, 20 aa, Mycobacterium
VPISAILFGGRRKTTVPLIT

SEQ ID NO: 1329948 - protein, 21 aa, Mycobacterium
VPKQRLHLERFTVAAAPDTVT

SEQ ID NO: 1329949 - protein, 25 aa, Mycobacterium
VPLAPLTTLRVGPVARRLITCVATE

SEQ ID NO: 1329950 - protein, 19 aa, Mycobacterium
VPLGAFHRTLSIEDPHEPA

SEQ ID NO: 1329951 - protein, 20 aa, Mycobacterium
VPLIEEWFEFVGEKLPTGIK

SEQ ID NO: 1329952 - protein, 18 aa, Mycobacterium
VPLKDLALQAIAYGNVYV

SEQ ID NO: 1329953 - protein, 31 aa, Mycobacterium
VPLSHAQEQLWFLNQLLPSSSAYNVAIRVDI

SEQ ID NO: 1329954 - protein, 20 aa, Mycobacterium
VPLYYQLAQAIEAAIRGGEL

SEQ ID NO: 1329955 - protein, 25 aa, Mycobacterium
VPMREDMCILLAARKMPTATSNAQS

SEQ ID NO: 1329956 - protein, 17 aa, Mycobacterium
VPPACTTGFLPAQQRRP

SEQ ID NO: 1329957 - protein, 17 aa, Mycobacterium
VPPEFGPVRVRFLGVNQ

SEQ ID NO: 1329958 - protein, 21 aa, Mycobacterium
VPPLAKLQRELLASAIRLTRP

SEQ ID NO: 1329959 - protein, 24 aa, Mycobacterium
VPPQRLQMAVAYGSAAAALPGTTL

SEQ ID NO: 1329960 - protein, 18 aa, Mycobacterium
VPPVPSYPQYQPSTGVAP

SEQ ID NO: 1329961 - protein, 17 aa, Mycobacterium
VPQPLPCEIYCHSLNDP

SEQ ID NO: 1329962 - protein, 27 aa, Mycobacterium
VPRGGVYLLPFPMCHIAGYNMLVQHAV

SEQ ID NO: 1329963 - protein, 27 aa, Mycobacterium
VPRVNPFRWMEFYAFGAHFPDLPDEDK

SEQ ID NO: 1329964 - protein, 18 aa, Mycobacterium
VPSALYSLSYKPNPRWSR

SEQ ID NO: 1329965 - protein, 26 aa, Mycobacterium
VPSDMKGLWGFVPACSTPDAADVNAV

SEQ ID NO: 1329966 - protein, 41 aa, Mycobacterium
VPSHKLLIRAGYVRPVGPGLYSWLPLGLKVLRKIENIVRNE

SEQ ID NO: 1329967 - protein, 25 aa, Mycobacterium
VPSLDLYREPDPFRIPRPSEIKTSI

SEQ ID NO: 1329968 - protein, 18 aa, Mycobacterium
VPSWIRRTGSAPTAAFTI

SEQ ID NO: 1329969 - protein, 23 aa, Mycobacterium
VPSYVKPVFKLGWSRRLAPLMRR

SEQ ID NO: 1329970 - protein, 18 aa, Mycobacterium
VPTAALLTLAEALNADHF

SEQ ID NO: 1329971 - protein, 30 aa, Mycobacterium
VPTEGEMPAWAPALAGSFWAARRARNEAEA

SEQ ID NO: 1329972 - protein, 31 aa, Mycobacterium
VPTEGEMPAWAPALAGSFWAARRARNEAEAT

SEQ ID NO: 1329973 - protein, 34 aa, Mycobacterium
VPTEPEPPYKWIPIMIDPPDHAKWRQVLAEYFSP

SEQ ID NO: 1329974 - protein, 25 aa, Mycobacterium
VPTPAGWRMLSGDETGWLLGDYILS

SEQ ID NO: 1329975 - protein, 17 aa, Mycobacterium
VPTPRDLSLLLSSSVQR

SEQ ID NO: 1329976 - protein, 24 aa, Mycobacterium
VPTVEVSFLHLLFTIQTCGVTSEL

SEQ ID NO: 1329977 - protein, 20 aa, Mycobacterium
VPVAHRLLEFLNAATIPEAP

SEQ ID NO: 1329978 - protein, 32 aa, Mycobacterium
VPVALTHSIWLDTILDSVLYWADLATSYPYEV

SEQ ID NO: 1329979 - protein, 26 aa, Mycobacterium
VPVAPPFIRADLAPGWLAQVRDPRPL

SEQ ID NO: 1329980 - protein, 20 aa, Mycobacterium
VPVIAIAPPGSAPAPGRIVD

SEQ ID NO: 1329981 - protein, 21 aa, Mycobacterium
VPVITWEPWLWRTDVTVAGAE

SEQ ID NO: 1329982 - protein, 25 aa, Mycobacterium
VPVKMGAFMCKYRREFALVESRYGC

SEQ ID NO: 1329983 - protein, 21 aa, Mycobacterium
VPVLIEERVAMRRELAALVAR

SEQ ID NO: 1329984 - protein, 24 aa, Mycobacterium
VPVLSLGRYAGPRRKAIVALKEHG

SEQ ID NO: 1329985 - protein, 17 aa, Mycobacterium
VPVNFRLAAGEIGYVLS

SEQ ID NO: 1329986 - protein, 19 aa, Mycobacterium
VPVNFRMTPPEIAFLVSDC

SEQ ID NO: 1329987 - protein, 24 aa, Mycobacterium
VPVQVGYQRRFDAAFAAVKHAVDD

SEQ ID NO: 1329988 - protein, 23 aa, Mycobacterium
VPVRDALIRLPACPLPEDLDAGQ

SEQ ID NO: 1329989 - protein, 20 aa, Mycobacterium
VPVRFPVSPPAEDRGWHIDL

SEQ ID NO: 1329990 - protein, 27 aa, Mycobacterium
VPVTLDELIPLVRGVVRGAPHALVVAD

SEQ ID NO: 1329991 - protein, 18 aa, Mycobacterium
VPVVLMTFDPHPMEVVFP

SEQ ID NO: 1329992 - protein, 31 aa, Mycobacterium
VQAEAFDWPVSLFAERTWHIARPLPERAVIA

SEQ ID NO: 1329993 - protein, 21 aa, Mycobacterium
VQAFELLRKLSQDSNVPLIKI

SEQ ID NO: 1329994 - protein, 17 aa, Mycobacterium
VQAGLVMLAYAAASPNA

SEQ ID NO: 1329995 - protein, 24 aa, Mycobacterium
VQAMGFLQRVPFPGAPRDVPIIET

SEQ ID NO: 1329996 - protein, 25 aa, Mycobacterium
VQATDMSRWRQFAFGVLGFAEGSGP

SEQ ID NO: 1329997 - protein, 17 aa, Mycobacterium
VQDFSGPFPVEVITRMA

SEQ ID NO: 1329998 - protein, 23 aa, Mycobacterium
VQDFSGPFPVEVITRMAGVPEEF

SEQ ID NO: 1329999 - protein, 23 aa, Mycobacterium
VQEPTVLPSRFPNLLANGSGGIA

SEQ ID NO: 1330000 - protein, 25 aa, Mycobacterium
VQEQRAWHRPLPEPGMRSEYTPDRV

SEQ ID NO: 1330001 - protein, 18 aa, Mycobacterium
VQGLRRRPRPQDGFDVVA

SEQ ID NO: 1330002 - protein, 24 aa, Mycobacterium
VQGLVPDLAAFWSRYLLAARERGE

SEQ ID NO: 1330003 - protein, 18 aa, Mycobacterium
VQGPQIFGSGLLGGAQAD

SEQ ID NO: 1330004 - protein, 18 aa, Mycobacterium
VQGWAVGLGCNLALAADF

SEQ ID NO: 1330005 - protein, 19 aa, Mycobacterium
VQIGRRLARLARTHQVIVV

SEQ ID NO: 1330006 - protein, 35 aa, Mycobacterium
VQIPTRPVAAPPPRRSGRRAIPVLAGALVAAAGVG

SEQ ID NO: 1330007 - protein, 26 aa, Mycobacterium
VQKARAAWLWSGRRGTLVGLSAAAVL

SEQ ID NO: 1330008 - protein, 24 aa, Mycobacterium
VQLALTKLWQSYGVNPDAVIGHSM

SEQ ID NO: 1330009 - protein, 17 aa, Mycobacterium
VQLARARALLLGRDYVI

SEQ ID NO: 1330010 - protein, 29 aa, Mycobacterium
VQLCNQTAPFILVSRLRPAMAAAPARRTY

SEQ ID NO: 1330011 - protein, 18 aa, Mycobacterium
VQLLSFASDEPPTIIVIG

SEQ ID NO: 1330012 - protein, 23 aa, Mycobacterium
VQMSPVAFMQKPARWMQQLGSHP

SEQ ID NO: 1330013 - protein, 17 aa, Mycobacterium
VQMWVVPDESGIAPGYQ

SEQ ID NO: 1330014 - protein, 20 aa, Mycobacterium
VQNRCFLYHLIGGGTGDWDV

SEQ ID NO: 1330015 - protein, 27 aa, Mycobacterium
VQPWDRDQIHRLFDDLEFRVLRDRLFE

SEQ ID NO: 1330016 - protein, 20 aa, Mycobacterium
VQQAVWAAGAVLVQMPTRAA

SEQ ID NO: 1330017 - protein, 28 aa, Mycobacterium
VQQDDLAERLLALGRRTAQRMTSATKNL

SEQ ID NO: 1330018 - protein, 27 aa, Mycobacterium
VQREAAWLIKSLYLGPLVPRSVLELLR

SEQ ID NO: 1330019 - protein, 37 aa, Mycobacterium
VQRGQGKWYPGEPLPRWQIGLYWRTDGAPLWTDASLL

SEQ ID NO: 1330020 - protein, 19 aa, Mycobacterium
VQRRWRAFSRTGTPGDAWA

SEQ ID NO: 1330021 - protein, 37 aa, Mycobacterium
VQRSQGKWYPGEPLPRWQIGLFWRTDGEPLWADESLL

SEQ ID NO: 1330022 - protein, 17 aa, Mycobacterium
VQTAWLRVAATPGPRDI

SEQ ID NO: 1330023 - protein, 22 aa, Mycobacterium
VQTLAFVARRLLAEPIAMVFAA

SEQ ID NO: 1330024 - protein, 21 aa, Mycobacterium
VQTWRLHVFPAVEGLPEAGAG

SEQ ID NO: 1330025 - protein, 28 aa, Mycobacterium
VQVGLRGYWPPQDTFEWMLEQGMTWHTM

SEQ ID NO: 1330026 - protein, 30 aa, Mycobacterium
VQVGLRGYWPPQDTFEWMLEQKMTWHTMQE

SEQ ID NO: 1330027 - protein, 19 aa, Mycobacterium
VQVPRRGYVPALACARCRS

SEQ ID NO: 1330028 - protein, 30 aa, Mycobacterium
VRAALAEYAGLSFLRGLRVLPAELGGEAGL

SEQ ID NO: 1330029 - protein, 19 aa, Mycobacterium
VRACMLTFLSDFGPVPVAR

SEQ ID NO: 1330030 - protein, 25 aa, Mycobacterium
VRADLEDLVRIQSVWADPARRAEVH

SEQ ID NO: 1330031 - protein, 34 aa, Mycobacterium
VRADSLKWHPNGLALDVMIPNWNTPQGKALGDEV

SEQ ID NO: 1330032 - protein, 24 aa, Mycobacterium
VRAEVVLLKTLALQFIMSDHRHLQ

SEQ ID NO: 1330033 - protein, 17 aa, Mycobacterium
VRAIRRSSELEGASSTA

SEQ ID NO: 1330034 - protein, 21 aa, Mycobacterium
VRAKYGWTDVSRFAALGIPAV

SEQ ID NO: 1330035 - protein, 19 aa, Mycobacterium
VRALRVSPQQLRDVAEREG

SEQ ID NO: 1330036 - protein, 20 aa, Mycobacterium
VRARFELFTKPSLAGRRVGA

SEQ ID NO: 1330037 - protein, 26 aa, Mycobacterium
VRARGRGLDVLFANAGLAVLGPLAQA

SEQ ID NO: 1330038 - protein, 25 aa, Mycobacterium
VRARQRLAIGSALFGLLRADDPVPA

SEQ ID NO: 1330039 - protein, 22 aa, Mycobacterium
VRARRFYEQGLGWVPKAAPEGV

SEQ ID NO: 1330040 - protein, 21 aa, Mycobacterium
VRASMSIPFLFRPSTLKDAAG

SEQ ID NO: 1330041 - protein, 18 aa, Mycobacterium
VRASRRLARLTRRPGLEF

SEQ ID NO: 1330042 - protein, 24 aa, Mycobacterium
VRASSLEWVVLRLGGVLSTDPNAI

SEQ ID NO: 1330043 - protein, 17 aa, Mycobacterium
VRCRATVGEVGNAEQAN

SEQ ID NO: 1330044 - protein, 27 aa, Mycobacterium
VRDAVPFSAYLFYKWAGHPNAEPDRFG

SEQ ID NO: 1330045 - protein, 17 aa, Mycobacterium
VRDDEILRPLYPEDDLD

SEQ ID NO: 1330046 - protein, 17 aa, Mycobacterium
VRDEHYLYRANVLGTQA

SEQ ID NO: 1330047 - protein, 31 aa, Mycobacterium
VRDFRRTAGLDLLPRLLMRGGELDLTVVRSI

SEQ ID NO: 1330048 - protein, 26 aa, Mycobacterium
VRDGRARLILRRETFDDLLSLEVSEV

SEQ ID NO: 1330049 - protein, 26 aa, Mycobacterium
VRDLAELLERLVGAAVAYLPNPRAEA

SEQ ID NO: 1330050 - protein, 23 aa, Mycobacterium
VRDLDQVIDLNLVASPTALRQLI

SEQ ID NO: 1330051 - protein, 17 aa, Mycobacterium
VRDRLIPPTLRGETAWC

SEQ ID NO: 1330052 - protein, 18 aa, Mycobacterium
VRDYPIVPGIDLTGEVVA

SEQ ID NO: 1330053 - protein, 26 aa, Mycobacterium
VREFTKVMPPLLRPGVRILGKGVMGS

SEQ ID NO: 1330054 - protein, 24 aa, Mycobacterium
VREGAMYFVALAKDLLGVYRAKGY

SEQ ID NO: 1330055 - protein, 25 aa, Mycobacterium
VREGAMYFVALAKDLLGVYRAKGYE

SEQ ID NO: 1330056 - protein, 22 aa, Mycobacterium
VRELAVFWTARTVGCSWCVDFG

SEQ ID NO: 1330057 - protein, 18 aa, Mycobacterium
VREMLPTPKIREILSAAT

SEQ ID NO: 1330058 - protein, 37 aa, Mycobacterium
VREPIGVVAAIVPWNIPLLTTVWKIGPALAAGNSVVL

SEQ ID NO: 1330059 - protein, 26 aa, Mycobacterium
VREPKELVICDLGMPRDVDPAVAGLP

SEQ ID NO: 1330060 - protein, 37 aa, Mycobacterium
VREPYGVVAAITPWNYPLYQVVAKVLPAIAAGCTVVL

SEQ ID NO: 1330061 - protein, 27 aa, Mycobacterium
VRFEVTVDPIMPLPGFLSRRAAKGVID

SEQ ID NO: 1330062 - protein, 36 aa, Mycobacterium; identical to SEQ ID NO: 874777

SEQ ID NO: 1330063 - protein, 21 aa, Mycobacterium
VRFGKPARQLLAQAERAQLVV

SEQ ID NO: 1330064 - protein, 21 aa, Mycobacterium
VRFRHPLIRSTAYRSVALSDR

SEQ ID NO: 1330065 - protein, 23 aa, Mycobacterium
VRGDRPFELISLAVDPAATPVLS

SEQ ID NO: 1330066 - protein, 22 aa, Mycobacterium
VRGDWFCRLEIKDPVKMIGVVC

SEQ ID NO: 1330067 - protein, 18 aa, Mycobacterium
VRGFSSLMRCDKPTVVKI

SEQ ID NO: 1330068 - protein, 25 aa, Mycobacterium
VRGGKQPRILFATQATARPPTFVLF

SEQ ID NO: 1330069 - protein, 18 aa, Mycobacterium
VRGLNFLVTGFASADEGL

SEQ ID NO: 1330070 - protein, 17 aa, Mycobacterium
VRGPASRIHLRGLNIRW

SEQ ID NO: 1330071 - protein, 20 aa, Mycobacterium
VRGPEPVRVYYRGLPRHAPC

SEQ ID NO: 1330072 - protein, 18 aa, Mycobacterium
VRGPLRRVLENRGIDSPF

SEQ ID NO: 1330073 - protein, 24 aa, Mycobacterium
VRGRPHPDLVLTALMRAGVDDVRS

SEQ ID NO: 1330074 - protein, 20 aa, Mycobacterium
VRGSYVAGWIKRGPTGFIGT

SEQ ID NO: 1330075 - protein, 20 aa, Mycobacterium
VRGTGKGLRSARRLGRRRHT

SEQ ID NO: 1330076 - protein, 17 aa, Mycobacterium
VRHQFGRPIGSFQAVAH

SEQ ID NO: 1330077 - protein, 18 aa, Mycobacterium
VRHQFGRPIGSFQAVKHA

SEQ ID NO: 1330078 - protein, 18 aa, Mycobacterium
VRHQLASVLAMRELNRLN

SEQ ID NO: 1330079 - protein, 18 aa, Mycobacterium
VRIRPLNITGRRFVFGAR

SEQ ID NO: 1330080 - protein, 18 aa, Mycobacterium
VRKIWVYRAFDDGQEVLI

SEQ ID NO: 1330081 - protein, 18 aa, Mycobacterium
VRKLWGIGPVAEDRLHRL

SEQ ID NO: 1330082 - protein, 17 aa, Mycobacterium
VRKVFRRSVARPVHYVP

SEQ ID NO: 1330083 - protein, 19 aa, Mycobacterium
VRLADPPPVTGAVGLGLVA

SEQ ID NO: 1330084 - protein, 17 aa, Mycobacterium
VRLAGLVAHQEVLFGTM

SEQ ID NO: 1330085 - protein, 19 aa, Mycobacterium
VRLARAIGVIYLPATERQS

SEQ ID NO: 1330086 - protein, 22 aa, Mycobacterium
VRLLNMVPYFQANPRITYAEAA

SEQ ID NO: 1330087 - protein, 22 aa, Mycobacterium
VRLLRLGGVRVSIPEALDAMRC

SEQ ID NO: 1330088 - protein, 19 aa, Mycobacterium
VRLNRLRRWHTDGLLFIGD

SEQ ID NO: 1330089 - protein, 25 aa, Mycobacterium
VRMMDPQHRLLLETAWRAVEHSGTA

SEQ ID NO: 1330090 - protein, 22 aa, Mycobacterium
VRMPHHRVVLRQQIFGYTYEEL

SEQ ID NO: 1330091 - protein, 18 aa, Mycobacterium
VRNIRRKAMEELTRIKKD

SEQ ID NO: 1330092 - protein, 32 aa, Mycobacterium
VRNKRLYDALDQWAFCTLTRSPGARAYYDQHR

SEQ ID NO: 1330093 - protein, 17 aa, Mycobacterium
VRNLWAYVVIFCGHFPD

SEQ ID NO: 1330094 - protein, 18 aa, Mycobacterium
VRPDLVAGLVLLDPAVAL

SEQ ID NO: 1330095 - protein, 21 aa, Mycobacterium
VRPEPFGALLYHFGTRKLSFL

SEQ ID NO: 1330096 - protein, 24 aa, Mycobacterium
VRPGLAALLHYAREGDIVVVTAID

SEQ ID NO: 1330097 - protein, 25 aa, Mycobacterium
VRPHVFRFPLPPTAGEIRTALAAIA

SEQ ID NO: 1330098 - protein, 24 aa, Mycobacterium
VRPKKPLLAPPKQPPGREPLRRWR

SEQ ID NO: 1330099 - protein, 19 aa, Mycobacterium
VRPQPLDLRYVDPPARLAL

SEQ ID NO: 1330100 - protein, 27 aa, Mycobacterium
VRPSLGISEWILPTLISSAPEHIQQRF

SEQ ID NO: 1330101 - protein, 29 aa, Mycobacterium
VRPTVYQAQLLPTSTLLLGGRGVGLAAVP

SEQ ID NO: 1330102 - protein, 32 aa, Mycobacterium; identical to SEQ ID NO: 874945

SEQ ID NO: 1330103 - protein, 21 aa, Mycobacterium
VRQFRASVCVLGPLVGRCKKA

SEQ ID NO: 1330104 - protein, 22 aa, Mycobacterium
VRQNIGFPLTLAKLSRQEIAEK

SEQ ID NO: 1330105 - protein, 19 aa, Mycobacterium
VRRDAVEAAWLPALTAELD

SEQ ID NO: 1330106 - protein, 27 aa, Mycobacterium
VRRGRPPDPLLVLGPERMPGARLWMYT

SEQ ID NO: 1330107 - protein, 25 aa, Mycobacterium
VRRLAELPLAFQPGTGWLYDTPVKV

SEQ ID NO: 1330108 - protein, 20 aa, Mycobacterium
VRRLGNGKADYRWAKSQATQ

SEQ ID NO: 1330109 - protein, 17 aa, Mycobacterium
VRRLLAELFEFDEVNRY

SEQ ID NO: 1330110 - protein, 17 aa, Mycobacterium
VRRMLGQRVPYPERVDI

SEQ ID NO: 1330111 - protein, 18 aa, Mycobacterium
VRRPACWPAAARSGRGSP

SEQ ID NO: 1330112 - protein, 22 aa, Mycobacterium
VRRPDGFQLPHPPRDAREFHTH

SEQ ID NO: 1330113 - protein, 27 aa, Mycobacterium
VRRQRSWFRRDHRITWLDGAAGGSAAL

SEQ ID NO: 1330114 - protein, 35 aa, Mycobacterium
VRRRGAHLYNFWRDATNPKGLWRRTTLESYLTEKP

SEQ ID NO: 1330115 - protein, 23 aa, Mycobacterium
VRRRIYTGKPARLLKSRWTDAWD

SEQ ID NO: 1330116 - protein, 24 aa, Mycobacterium
VRRSELLVLLGLSGSGKSTLLRCL

SEQ ID NO: 1330117 - protein, 24 aa, Mycobacterium
VRRYFRDHGWSLKVPRRLKELNVR

SEQ ID NO: 1330118 - protein, 18 aa, Mycobacterium
VRSAREILGVLRAVLFAP

SEQ ID NO: 1330119 - protein, 25 aa, Mycobacterium
VRSEGCGILLLKRLSDAVRDGDRVC

SEQ ID NO: 1330120 - protein, 23 aa, Mycobacterium
VRSPRLRDLRTVLAAAGLAVRED

SEQ ID NO: 1330121 - protein, 26 aa, Mycobacterium
VRSTVYRYYPSRDDLLLGLVLRRVDR

SEQ ID NO: 1330122 - protein, 18 aa, Mycobacterium
VRSWTTRAPAGDVTIPFL

SEQ ID NO: 1330123 - protein, 33 aa, Mycobacterium
VRSYGITAEAFPFDHLPPLLTDADIVVTCTGAV

SEQ ID NO: 1330124 - protein, 22 aa, Mycobacterium
VRTAAPLLFASGEFLGADKAAS

SEQ ID NO: 1330125 - protein, 24 aa, Mycobacterium
VRTDAEWRFVGVPDLSPLSRDAVF

SEQ ID NO: 1330126 - protein, 17 aa, Mycobacterium
VRTKDLMFTGRTLTAEE

SEQ ID NO: 1330127 - protein, 23 aa, Mycobacterium
VRTLLRIDRTLGWQPGSAAVVLL

SEQ ID NO: 1330128 - protein, 20 aa, Mycobacterium
VRTLRRYHEGGLLEPAWVDG

SEQ ID NO: 1330129 - protein, 17 aa, Mycobacterium
VRTPAGWRIARRRFTTV

SEQ ID NO: 1330130 - protein, 17 aa, Mycobacterium
VRTPAIRWIVVKDAAIS

SEQ ID NO: 1330131 - protein, 26 aa, Mycobacterium
VRTVHSYAFAVLRLAAQRNGSPPPRL

SEQ ID NO: 1330132 - protein, 20 aa, Mycobacterium
VRTWHLTRYAGIADEITAIT

SEQ ID NO: 1330133 - protein, 28 aa, Mycobacterium
VRVADEIDFWLWLDAGFEDRAIEAWILE

SEQ ID NO: 1330134 - protein, 19 aa, Mycobacterium
VRVLLGQVMAVSALPAHYV

SEQ ID NO: 1330135 - protein, 30 aa, Mycobacterium
VRVPLAEHDLLACWLLEAAGLPVDDAVRTV

SEQ ID NO: 1330136 - protein, 27 aa, Mycobacterium
VRVSDKIDFWLWLDAGFEDQAIEAWVI

SEQ ID NO: 1330137 - protein, 28 aa, Mycobacterium
VRVSMGHALLVPFAKAANWPGDLELLRD

SEQ ID NO: 1330138 - protein, 20 aa, Mycobacterium
VRVTMFERLPTPYGLVRAGV

SEQ ID NO: 1330139 - protein, 19 aa, Mycobacterium
VRWACPPGGRFPFATAAAG

SEQ ID NO: 1330140 - protein, 17 aa, Mycobacterium
VRWADAMELLLTGKPMT

SEQ ID NO: 1330141 - protein, 18 aa, Mycobacterium
VRWGLWRSDSGEGIVGAA

SEQ ID NO: 1330142 - protein, 18 aa, Mycobacterium
VRWIERVIELLPTISEGS

SEQ ID NO: 1330143 - protein, 22 aa, Mycobacterium
VRWQPPPVDDLPPLPSPPVTVV

SEQ ID NO: 1330144 - protein, 26 aa, Mycobacterium
VRWRHPTRGLLLPESFIGVAESINLA

SEQ ID NO: 1330145 - protein, 24 aa, Mycobacterium
VRYRPNIVIDTPAGCPPFIENDWV

SEQ ID NO: 1330146 - protein, 23 aa, Mycobacterium
VSADLTWRGLYPAALERPHEMLT

SEQ ID NO: 1330147 - protein, 27 aa, Mycobacterium
VSADWYFPPGNTPPKGLIYLQHGMLAS

SEQ ID NO: 1330148 - protein, 26 aa, Mycobacterium
VSAEAALGLLRRNKIEKLPIVDGHGK

SEQ ID NO: 1330149 - protein, 17 aa, Mycobacterium
VSAIFTKLDLAPSQAHH

SEQ ID NO: 1330150 - protein, 18 aa, Mycobacterium
VSALLRYGTTDRVLLSGT

SEQ ID NO: 1330151 - protein, 31 aa, Mycobacterium
VSALNRLHFTLGLPTLLIWGDQDRLIPPAHG

SEQ ID NO: 1330152 - protein, 43 aa, Mycobacterium
VSALVVFEVMVRPLIRLSLGKRAPMRRIVEARALSPITSVAGR

SEQ ID NO: 1330153 - protein, 40 aa, Mycobacterium
VSAQARVLDLLSRLQRELGLTYLLIGHDLAVIRQVSHEIL

SEQ ID NO: 1330154 - protein, 26 aa, Mycobacterium
VSAREAPYPYFPYRRQEGFALLDPPV

SEQ ID NO: 1330155 - protein, 23 aa, Mycobacterium
VSARELLPERALLGDATAGAALE

SEQ ID NO: 1330156 - protein, 27 aa, Mycobacterium
VSAVSIWMGILLTDKLRSAFDGSPEAL

SEQ ID NO: 1330157 - protein, 21 aa, Mycobacterium
VSCDRTTIRYFRRRCYHEGIS

SEQ ID NO: 1330158 - protein, 28 aa, Mycobacterium
VSCTATTLKPLFLAAAHWKRTGRFPGVD

SEQ ID NO: 1330159 - protein, 22 aa, Mycobacterium
VSDFQPYWRRLQGQLAAALAGG

SEQ ID NO: 1330160 - protein, 17 aa, Mycobacterium
VSDHLVYSIARPAAVLT

SEQ ID NO: 1330161 - protein, 27 aa, Mycobacterium
VSDHRPHLLSFLFSPDRGSPTARIAVN

SEQ ID NO: 1330162 - protein, 22 aa, Mycobacterium
VSDLTFQGPVVRLSLAAPDDST

SEQ ID NO: 1330163 - protein, 17 aa, Mycobacterium
VSDRYWRRYFDNFAEVM

SEQ ID NO: 1330164 - protein, 27 aa, Mycobacterium
VSEAYFAAMLGLPFIAVMPASTSSSKV

SEQ ID NO: 1330165 - protein, 29 aa, Mycobacterium
VSEKSTLLFPLFAQWFVDGFLRTDPTNPL

SEQ ID NO: 1330166 - protein, 37 aa, Mycobacterium; identical to SEQ ID NO: 786395

SEQ ID NO: 1330167 - protein, 30 aa, Mycobacterium
VSELPLALSCLITPLLFTGRFGEAARAIDE

SEQ ID NO: 1330168 - protein, 27 aa, Mycobacterium
VSEVEYRQLRLERVVLVGVWTEGSAAD

SEQ ID NO: 1330169 - protein, 28 aa, Mycobacterium
VSEYPYVLPLLDLTTSNPAYVFAAVDHL

SEQ ID NO: 1330170 - protein, 32 aa, Mycobacterium
VSFATYFNAFPASYWRRWSILEAVVLRVELTG

SEQ ID NO: 1330171 - protein, 21 aa, Mycobacterium
VSGALRIVQWCRDNPVEAQVM

SEQ ID NO: 1330172 - protein, 25 aa, Mycobacterium
VSGEPAVAIFRPAAVAVYRQRPHGS

SEQ ID NO: 1330173 - protein, 25 aa, Mycobacterium
VSGLLLGRPTVLYPVGAFDPNELLD

SEQ ID NO: 1330174 - protein, 33 aa, Mycobacterium
VSGPLLPVSPPPPTAPWLPQAPVSTSSQIFAGP

SEQ ID NO: 1330175 - protein, 17 aa, Mycobacterium
VSGPLLSGGYWNLPEAT

SEQ ID NO: 1330176 - protein, 19 aa, Mycobacterium
VSGRRPTPGTVAYGAAKAG

SEQ ID NO: 1330177 - protein, 27 aa, Mycobacterium
VSGSGPAYFFLMVEALVDAAVDAGLAR

SEQ ID NO: 1330178 - protein, 23 aa, Mycobacterium
VSGVSPVVLGLRAARLLLAAAHT

SEQ ID NO: 1330179 - protein, 23 aa, Mycobacterium
VSHLLDLRGPSVALDAACAASLV

SEQ ID NO: 1330180 - protein, 22 aa, Mycobacterium
VSHNDWFVTLLAAAGDPDIAER

SEQ ID NO: 1330181 - protein, 37 aa, Mycobacterium
VSHPELMATYWRRYILPRRRLAAALLERARELGTVAA

SEQ ID NO: 1330182 - protein, 20 aa, Mycobacterium
VSHYPPLYDLRPTGLPRNVM

SEQ ID NO: 1330183 - protein, 26 aa, Mycobacterium
VSIDTEHLPSYWFVGAFFTDEEHHEG

SEQ ID NO: 1330184 - protein, 19 aa, Mycobacterium
VSIMMHQAMFMAAAVDKAA

SEQ ID NO: 1330185 - protein, 36 aa, Mycobacterium
VSIQAGIINLLLDLQDRFGLAYLFVSHDLSVVRHLA

SEQ ID NO: 1330186 - protein, 28 aa, Mycobacterium
VSITHNTIFPNFSWLGAHSTMRVWHPRG

SEQ ID NO: 1330187 - protein, 25 aa, Mycobacterium
VSLDSPPFYDPWFAKARTSGSIEAR

SEQ ID NO: 1330188 - protein, 27 aa, Mycobacterium
VSLEPFLAAGALLYQGPWVAERLVEFG

SEQ ID NO: 1330189 - protein, 26 aa, Mycobacterium
VSLEPSELRWETFDPRFDLAKTPNEV

SEQ ID NO: 1330190 - protein, 17 aa, Mycobacterium
VSLLGAAIVRLNEAYWS

SEQ ID NO: 1330191 - protein, 18 aa, Mycobacterium
VSLLGAAIVRLNEAYWSE

SEQ ID NO: 1330192 - protein, 19 aa, Mycobacterium
VSLRPRRLRVILGSRRTPD

SEQ ID NO: 1330193 - protein, 19 aa, Mycobacterium
VSLVHLRLTIRDGQAQPTL

SEQ ID NO: 1330194 - protein, 25 aa, Mycobacterium
VSLVLDVPRHCSGRFRYQAGQFLTL

SEQ ID NO: 1330195 - protein, 24 aa, Mycobacterium
VSLVLDVPRHCSGRFRYQVGQFLT

SEQ ID NO: 1330196 - protein, 31 aa, Mycobacterium
VSMLPARYLNRLSDLLFILSRVANPDGDVLW

SEQ ID NO: 1330197 - protein, 24 aa, Mycobacterium
VSMQTPPGWHPYQNSNLAPGTRVI

SEQ ID NO: 1330198 - protein, 27 aa, Mycobacterium
VSNTELMRHLHLPSVFNPLVGVLTQSP

SEQ ID NO: 1330199 - protein, 28 aa, Mycobacterium
VSPKFVRQFPFNVLLKDLDWRVRTGRPL

SEQ ID NO: 1330200 - protein, 22 aa, Mycobacterium
VSPPTVLRFAHSLGFEGFADLQ

SEQ ID NO: 1330201 - protein, 22 aa, Mycobacterium
VSPPTVLRFAQSLGYDGFTDLQ

SEQ ID NO: 1330202 - protein, 18 aa, Mycobacterium
VSPQLYIALGISGAIQHR

SEQ ID NO: 1330203 - protein, 24 aa, Mycobacterium
VSQRFPQIIRKFSASGLMALPGEA

SEQ ID NO: 1330204 - protein, 26 aa, Mycobacterium
VSQSHPVPLLFVHGAWHAAWCWDEHF

SEQ ID NO: 1330205 - protein, 25 aa, Mycobacterium
VSRALMYHYFPDKRAFFAAVVRAET

SEQ ID NO: 1330206 - protein, 19 aa, Mycobacterium
VSRDVLLTDVFTAFSQRMA

SEQ ID NO: 1330207 - protein, 18 aa, Mycobacterium
VSRGFTPRHLARLNARTA

SEQ ID NO: 1330208 - protein, 33 aa, Mycobacterium
VSRGGGRYSVYPWALLVMALARVGLGPLRGVRP

SEQ ID NO: 1330209 - protein, 31 aa, Mycobacterium
VSRIQWRFERLCKQIPLAAPWTAAAAHRLDD

SEQ ID NO: 1330210 - protein, 19 aa, Mycobacterium
VSRPKLVQPLSLRSYTEGA

SEQ ID NO: 1330211 - protein, 24 aa, Mycobacterium
VSRPTLYRYFADKRELLDVFVVWE

SEQ ID NO: 1330212 - protein, 23 aa, Mycobacterium
VSRYLGPWVAEPQLWQDPVPAVD

SEQ ID NO: 1330213 - protein, 24 aa, Mycobacterium
VSSARAFLHPVAHRPNLTIATDTT

SEQ ID NO: 1330214 - protein, 17 aa, Mycobacterium
VSTAGTRRWLLAPEYMY

SEQ ID NO: 1330215 - protein, 24 aa, Mycobacterium
VSTAYYENKLPAGAPVIRAMPNAP

SEQ ID NO: 1330216 - protein, 25 aa, Mycobacterium
VSTCATCDGFFFRDQDIAVVGGGDS

SEQ ID NO: 1330217 - protein, 25 aa, Mycobacterium
VSTSLAVLRLDRELPMPARAHDGDA

SEQ ID NO: 1330218 - protein, 20 aa, Mycobacterium
VSVDLLSALGYHVVASTGKP

SEQ ID NO: 1330219 - protein, 18 aa, Mycobacterium
VSVHAFNQWLDEDWGFDR

SEQ ID NO: 1330220 - protein, 24 aa, Mycobacterium
VSVHPVFNLYNKRWPIRGGAENLA

SEQ ID NO: 1330221 - protein, 20 aa, Mycobacterium
VSVVLTYLSGLVFAFANGST

SEQ ID NO: 1330222 - protein, 30 aa, Mycobacterium
VTAALGVLATPPPFAPMAPNPAAALAALGN

SEQ ID NO: 1330223 - protein, 17 aa, Mycobacterium
VTAARRAFATWSQTTRE

SEQ ID NO: 1330224 - protein, 25 aa, Mycobacterium
VTADPAPYLDLSTVALLGNASRGPS

SEQ ID NO: 1330225 - protein, 25 aa, Mycobacterium
VTADPRRIVVLSGDQLDALCALGLQ

SEQ ID NO: 1330226 - protein, 26 aa, Mycobacterium
VTADQIPPGYIPPAGITGPMAPEIAD

SEQ ID NO: 1330227 - protein, 25 aa, Mycobacterium
VTAEHPLPVILLNSTVITQGANWSV

SEQ ID NO: 1330228 - protein, 23 aa, Mycobacterium
VTAGAARWLVLSGPAGIGKTRLA

SEQ ID NO: 1330229 - protein, 26 aa, Mycobacterium
VTAGLLTPVIPLAHLAYRGLSAAMPE

SEQ ID NO: 1330230 - protein, 27 aa, Mycobacterium
VTAGSDLDWWVGFSSIVSLLGSPGQAA

SEQ ID NO: 1330231 - protein, 24 aa, Mycobacterium
VTAIDHVVMLSPDLSRTVDALAVV

SEQ ID NO: 1330232 - protein, 18 aa, Mycobacterium
VTALGLIAAGIEAILHAR

SEQ ID NO: 1330233 - protein, 21 aa, Mycobacterium
VTALPPGCPFAPRCPLAIDEC

SEQ ID NO: 1330234 - protein, 25 aa, Mycobacterium
VTALRIAPRTMLVSTELFVGADPDN

SEQ ID NO: 1330235 - protein, 23 aa, Mycobacterium
VTAPAGFRATGIAAGIKASGKLD

SEQ ID NO: 1330236 - protein, 18 aa, Mycobacterium
VTAPAWVGPVLAARSLTT

SEQ ID NO: 1330237 - protein, 22 aa, Mycobacterium
VTAPELVRRLVLVDVTPSAPER

SEQ ID NO: 1330238 - protein, 24 aa, Mycobacterium
VTAPRLAVLSALEQAPHSTADDVA

SEQ ID NO: 1330239 - protein, 24 aa, Mycobacterium
VTARAALGPVLLPGVTLFVFRHEG

SEQ ID NO: 1330240 - protein, 22 aa, Mycobacterium
VTARRPLRMVCHGIGYTEGFSP

SEQ ID NO: 1330241 - protein, 22 aa, Mycobacterium
VTASPYLGFGSLQPLLDTAAAH

SEQ ID NO: 1330242 - protein, 24 aa, Mycobacterium
VTASPYLGFGSLQPLLDTAREHDR

SEQ ID NO: 1330243 - protein, 22 aa, Mycobacterium
VTATPPSWRPDLRQPADLVEEV

SEQ ID NO: 1330244 - protein, 18 aa, Mycobacterium
VTCDDLVLAWASQSGRFP

SEQ ID NO: 1330245 - protein, 26 aa, Mycobacterium
VTCGLGRGWGLPKSVRLGIAAGAAML

SEQ ID NO: 1330246 - protein, 27 aa, Mycobacterium
VTCMSSSLPTLFRRAADYQRQITLTAS

SEQ ID NO: 1330247 - protein, 26 aa, Mycobacterium
VTCMSSSLPTLFRRAAHYQRQITLTA

SEQ ID NO: 1330248 - protein, 18 aa, Mycobacterium
VTCYLDRTPPAPKTTEIP

SEQ ID NO: 1330249 - protein, 23 aa, Mycobacterium
VTDADLLLGYLDPDNYANGYIKL

SEQ ID NO: 1330250 - protein, 27 aa, Mycobacterium
VTDADVVLGIIDPTYFLGGSMGLDKEG

SEQ ID NO: 1330251 - protein, 24 aa, Mycobacterium
VTDFSLAMIDPWPAGYYGAQDHYD

SEQ ID NO: 1330252 - protein, 19 aa, Mycobacterium
VTDIFAARRVGALARRLVD

SEQ ID NO: 1330253 - protein, 20 aa, Mycobacterium
VTDLARGPALKVIPLAPPTP

SEQ ID NO: 1330254 - protein, 19 aa, Mycobacterium
VTDLTFVPTWVGVAYVCFI

SEQ ID NO: 1330255 - protein, 25 aa, Mycobacterium
VTDPGRFDVIVTDNLFGDIITDLAA

SEQ ID NO: 1330256 - protein, 26 aa, Mycobacterium
VTDRTKLIWIETPTNPLLSIADIAAI

SEQ ID NO: 1330257 - protein, 28 aa, Mycobacterium
VTDSMPALHLLPLAEVLGAVPVLATDVL

SEQ ID NO: 1330258 - protein, 24 aa, Mycobacterium
VTDVGWTPYFTVIAALITDIGSSV

SEQ ID NO: 1330259 - protein, 39 aa, Mycobacterium
VTDYYEKAGLWPYLEKLGFFLVGYGCTTCIGNSGPLPEE

SEQ ID NO: 1330260 - protein, 33 aa, Mycobacterium; identical to SEQ ID NO: 786411

SEQ ID NO: 1330261 - protein, 21 aa, Mycobacterium
VTEAIDLLPRLSPVPGDQEGS

SEQ ID NO: 1330262 - protein, 24 aa, Mycobacterium
VTECTWWVYRDPADVPDHVYERVG

SEQ ID NO: 1330263 - protein, 20 aa, Mycobacterium
VTEDLITYHRLPAAGGVGMT

SEQ ID NO: 1330264 - protein, 22 aa, Mycobacterium
VTEFCAKWTTPDPQELATYFTE

SEQ ID NO: 1330265 - protein, 29 aa, Mycobacterium
VTEGRWSCVQWGKLTPPFGPEAPVVTSPE

SEQ ID NO: 1330266 - protein, 26 aa, Mycobacterium
VTEKRMFGGLAFLLDGNMAVAASGHG

SEQ ID NO: 1330267 - protein, 23 aa, Mycobacterium
VTEKWDLYIRNFELATGYSELVD

SEQ ID NO: 1330268 - protein, 18 aa, Mycobacterium
VTEQIRLGPGDRLCIPVP

SEQ ID NO: 1330269 - protein, 18 aa, Mycobacterium
VTERIVVQRFADVRFRMQ

SEQ ID NO: 1330270 - protein, 33 aa, Mycobacterium
VTERPLVILLHGFASFWWSWRHQLRGLSGARVV

SEQ ID NO: 1330271 - protein, 28 aa, Mycobacterium
VTFAQPYPAWREMFNDILPAHIVKDVPG

SEQ ID NO: 1330272 - protein, 24 aa, Mycobacterium
VTFARFPDQWQKLLDDRSKIPAAV

SEQ ID NO: 1330273 - protein, 25 aa, Mycobacterium
VTGDPHVRFYAGVPIVTGDGHALGA

SEQ ID NO: 1330274 - protein, 20 aa, Mycobacterium
VTGIDLLVPDVTRPEYVFIE

SEQ ID NO: 1330275 - protein, 31 aa, Mycobacterium
VTGPLAVGAVPLFVIGGSLLGGWKGADLGEA

SEQ ID NO: 1330276 - protein, 21 aa, Mycobacterium
VTGPLDNRWAHYLHSRSSEMA

SEQ ID NO: 1330277 - protein, 21 aa, Mycobacterium
VTGTWRTVRAVLPAMIERRRG

SEQ ID NO: 1330278 - protein, 23 aa, Mycobacterium
VTGWDAMIDVNLRGVLHGIAAAM

SEQ ID NO: 1330279 - protein, 18 aa, Mycobacterium
VTGWEDGMFPHMRALGDP

SEQ ID NO: 1330280 - protein, 18 aa, Mycobacterium
VTGWPAVSTQPAAAIMAI

SEQ ID NO: 1330281 - protein, 23 aa, Mycobacterium
VTGYWTMFKQNIGIMIAVAQLAA

SEQ ID NO: 1330282 - protein, 18 aa, Mycobacterium
VTHCAAYYQLLVKALLLP

SEQ ID NO: 1330283 - protein, 19 aa, Mycobacterium
VTHDRWFLDEVATTTWEVH

SEQ ID NO: 1330284 - protein, 21 aa, Mycobacterium
VTHPAVVRAAILVALDAPARS

SEQ ID NO: 1330285 - protein, 26 aa, Mycobacterium
VTHVGFRWGFLVGDTVICNGVTDVGS

SEQ ID NO: 1330286 - protein, 25 aa, Mycobacterium
VTIANRRLIRYLAERPDYTRTFENI

SEQ ID NO: 1330287 - protein, 18 aa, Mycobacterium
VTINDMVLAISTGALRTL

SEQ ID NO: 1330288 - protein, 22 aa, Mycobacterium
VTIPVAVKLSPYFSATADMARR

SEQ ID NO: 1330289 - protein, 21 aa, Mycobacterium
VTIPYGAVLPTGPRAKRGSRP

SEQ ID NO: 1330290 - protein, 28 aa, Mycobacterium
VTIYYTAPTLVRTFMKWGRQLPAEHDLS

SEQ ID NO: 1330291 - protein, 25 aa, Mycobacterium
VTKAAIEPVWYLPGVARRFGCSETD

SEQ ID NO: 1330292 - protein, 17 aa, Mycobacterium
VTKLYKQPLPGVEPYGG

SEQ ID NO: 1330293 - protein, 20 aa, Mycobacterium
VTKRALVLAGGGIAGIAWET

SEQ ID NO: 1330294 - protein, 24 aa, Mycobacterium
VTKSQLAGWRRAPVVLAPEHGTRP

SEQ ID NO: 1330295 - protein, 18 aa, Mycobacterium
VTLADRLGRKRLSEPWQQ

SEQ ID NO: 1330296 - protein, 27 aa, Mycobacterium
VTLANSIRPWAPPPPPPPPAPGDPNVP

SEQ ID NO: 1330297 - protein, 27 aa, Mycobacterium
VTLGLALARLGMFAPAMSYLAEPAGPI

SEQ ID NO: 1330298 - protein, 17 aa, Mycobacterium
VTLLWDVLAAKGFEKNT

SEQ ID NO: 1330299 - protein, 18 aa, Mycobacterium
VTLPFDVRRYLPDGWDTL

SEQ ID NO: 1330300 - protein, 23 aa, Mycobacterium
VTLPGAAIWHMAWSDKDDAIDWQ

SEQ ID NO: 1330301 - protein, 38 aa, Mycobacterium
VTLSFDVRPPRWLPPGRWWALIRVAAAGRLVYSPAVEV

SEQ ID NO: 1330302 - protein, 30 aa, Mycobacterium; identical to SEQ ID NO: 875778

SEQ ID NO: 1330303 - protein, 26 aa, Mycobacterium
VTLVELTGYFLPAMIAAKRGVVLNVG

SEQ ID NO: 1330304 - protein, 22 aa, Mycobacterium
VTMDELPLLRLAEARDVVVITS

SEQ ID NO: 1330305 - protein, 18 aa, Mycobacterium
VTMICAPGVPMLVIVDDE

SEQ ID NO: 1330306 - protein, 26 aa, Mycobacterium
VTMRRVELTPAFRTTLALAVGQHAAD

SEQ ID NO: 1330307 - protein, 25 aa, Mycobacterium
VTNRPQTVLVLTLLSEVTLADAPTR

SEQ ID NO: 1330308 - protein, 23 aa, Mycobacterium
VTPEQWLVGQFLDSLADKFTGFL

SEQ ID NO: 1330309 - protein, 20 aa, Mycobacterium
VTPERLIAQLIPPPTFADVS

SEQ ID NO: 1330310 - protein, 38 aa, Mycobacterium
VTPGAWHLARMLEALDTWPLNIALLGKGNTVSAEAMWE

SEQ ID NO: 1330311 - protein, 25 aa, Mycobacterium
VTPIVNLARWGGLTAGLTTATTPAR

SEQ ID NO: 1330312 - protein, 26 aa, Mycobacterium
VTPRALQYMFRKYLDMTPMEYLRRVR

SEQ ID NO: 1330313 - protein, 17 aa, Mycobacterium
VTPRKGLQHLRLGVAGG

SEQ ID NO: 1330314 - protein, 26 aa, Mycobacterium
VTPSNFPIEVILNKLGPALAAGNTVV

SEQ ID NO: 1330315 - protein, 17 aa, Mycobacterium
VTPTWTLGEARARVVAV

SEQ ID NO: 1330316 - protein, 27 aa, Mycobacterium
VTQAVSVVGLVAIPWAQGDRSGVAFRA

SEQ ID NO: 1330317 - protein, 28 aa, Mycobacterium
VTQLMLGPFMNTVPLRIDLPEGGGLAAM

SEQ ID NO: 1330318 - protein, 17 aa, Mycobacterium
VTQLRTAIRLEPRPAPE

SEQ ID NO: 1330319 - protein, 17 aa, Mycobacterium
VTQPLVVAATLLAHEEA

SEQ ID NO: 1330320 - protein, 20 aa, Mycobacterium
VTQRYLTGPAGWNEFQAGVL

SEQ ID NO: 1330321 - protein, 29 aa, Mycobacterium
VTRAMNWRLFPAVGQSFFSTGYRALLTFE

SEQ ID NO: 1330322 - protein, 28 aa, Mycobacterium
VTRARVHLTLSWALARKPGGRQGRRPSR

SEQ ID NO: 1330323 - protein, 22 aa, Mycobacterium
VTRCATPLKWVRLDSAPFTDRL

SEQ ID NO: 1330324 - protein, 23 aa, Mycobacterium
VTRQTVYRYFPGPEAIVVACAMR

SEQ ID NO: 1330325 - protein, 25 aa, Mycobacterium
VTRQTVYRYFPSTEALLVAAAVHAV

SEQ ID NO: 1330326 - protein, 18 aa, Mycobacterium
VTSFRDVLAPAWQQATGG

SEQ ID NO: 1330327 - protein, 26 aa, Mycobacterium
VTSMSLVTPWLLAVPDRFSLMHGDYR

SEQ ID NO: 1330328 - protein, 21 aa, Mycobacterium
VTTAFFMVDDLYKSSFCDLRW

SEQ ID NO: 1330329 - protein, 18 aa, Mycobacterium
VTTKFFGMKANHYIHKHN

SEQ ID NO: 1330330 - protein, 31 aa, Mycobacterium
VTTKLHFNHFVLKLPIRPPALVAKQAGSLAA

SEQ ID NO: 1330331 - protein, 36 aa, Mycobacterium
VTTNPPVEGAFYWLNSREVRWRPAEYWKPGTKVEVA

SEQ ID NO: 1330332 - protein, 18 aa, Mycobacterium
VTTVLYPGLPSHPNHDVA

SEQ ID NO: 1330333 - protein, 18 aa, Mycobacterium
VTVGWIHAIRRAQSRLHR

SEQ ID NO: 1330334 - protein, 32 aa, Mycobacterium
VTVIGLPPTVTVFGLPIFKLGGSPVKVVSSVT

SEQ ID NO: 1330335 - protein, 29 aa, Mycobacterium
VTVIVAPMFHAWGFGQLVFAAMMACTIVT

SEQ ID NO: 1330336 - protein, 18 aa, Mycobacterium
VTVLFDDYGYRTLAMAAV

SEQ ID NO: 1330337 - protein, 18 aa, Mycobacterium
VTVLGLGPIGDMAARIAQ

SEQ ID NO: 1330338 - protein, 20 aa, Mycobacterium
VTVLHFMPGWLEMLAEVDGD

SEQ ID NO: 1330339 - protein, 19 aa, Mycobacterium
VTVNFRFAPDRSVEQAYAH

SEQ ID NO: 1330340 - protein, 19 aa, Mycobacterium
VTVRIYRGGPPGSGVVLYC

SEQ ID NO: 1330341 - protein, 20 aa, Mycobacterium
VTVSELRLDKEGRSASRVIA

SEQ ID NO: 1330342 - protein, 35 aa, Mycobacterium
VTVTVPVFVDPVIQLPPLITPIAGPGYTLGGDPVK

SEQ ID NO: 1330343 - protein, 25 aa, Mycobacterium
VTVVDPRWVLPVPEEIATLATRHKL

SEQ ID NO: 1330344 - protein, 27 aa, Mycobacterium
VTVVEMFARLQRGLLSDLRLGLMHGRL

SEQ ID NO: 1330345 - protein, 17 aa, Mycobacterium
VTWGPAFSDVAYFLGCA

SEQ ID NO: 1330346 - protein, 17 aa, Mycobacterium
VVAAFDTELFGHWWYEG

SEQ ID NO: 1330347 - protein, 32 aa, Mycobacterium
VVAAITPWNYPLPLNIFKVAAALAAGCTVVLK

SEQ ID NO: 1330348 - protein, 18 aa, Mycobacterium
VVADWHQPPRARKPQRHL

SEQ ID NO: 1330349 - protein, 22 aa, Mycobacterium
VVAEHSVALLTLLKAMVDDVET

SEQ ID NO: 1330350 - protein, 17 aa, Mycobacterium
VVAGTSLNFSLGPLAFQ

SEQ ID NO: 1330351 - protein, 27 aa, Mycobacterium
VVAHDLNPLLPILTGAIYLLDGHPHYD

SEQ ID NO: 1330352 - protein, 20 aa, Mycobacterium
VVALDPFLRSVIETGYDRPV

SEQ ID NO: 1330353 - protein, 18 aa, Mycobacterium
VVAMLRLAADPTAGAAAV

SEQ ID NO: 1330354 - protein, 21 aa, Mycobacterium
VVARCLVLWAALVGAISLEVF

SEQ ID NO: 1330355 - protein, 29 aa, Mycobacterium
VVARHVKRTLDAWLRELTATISAAQADGD

SEQ ID NO: 1330356 - protein, 22 aa, Mycobacterium
VVARPAGLLLALSGTSLTDVMT

SEQ ID NO: 1330357 - protein, 18 aa, Mycobacterium
VVATALAPIFAAGGDIAL

SEQ ID NO: 1330358 - protein, 32 aa, Mycobacterium
VVATITPWNYPLQMAVWKVLPALAAGCSVVIK

SEQ ID NO: 1330359 - protein, 18 aa, Mycobacterium
VVAVLAALPAWTGAPDAA

SEQ ID NO: 1330360 - protein, 24 aa, Mycobacterium
VVAVSDWMRAVPEQIRPWVPGTYI

SEQ ID NO: 1330361 - protein, 25 aa, Mycobacterium
VVAVSDWMRAVPEQIRPWVPGTYIT

SEQ ID NO: 1330362 - protein, 17 aa, Mycobacterium
VVCDRVMPGNCFAPFHF

SEQ ID NO: 1330363 - protein, 30 aa, Mycobacterium
VVCRDDDWRPQWRVDLIPSYKAHRVAVPAE

SEQ ID NO: 1330364 - protein, 37 aa, Mycobacterium
VVCTLCSCYPWTLLGIPPAWFKYPQYRARVVKEPRSV

SEQ ID NO: 1330365 - protein, 20 aa, Mycobacterium
VVDAFYHQLCPDCAALNRAK

SEQ ID NO: 1330366 - protein, 17 aa, Mycobacterium
VVDAVIPPGILRATLDR

SEQ ID NO: 1330367 - protein, 24 aa, Mycobacterium
VVDDSGLTALLPGAATALVKNPDR

SEQ ID NO: 1330368 - protein, 26 aa, Mycobacterium
VVDGDPLAFKITTPLDLVLAEAILAG

SEQ ID NO: 1330369 - protein, 18 aa, Mycobacterium
VVDLPEALEPLVEYFRSI

SEQ ID NO: 1330370 - protein, 20 aa, Mycobacterium
VVDMEPFFDAYRAVKPYLMT

SEQ ID NO: 1330371 - protein, 23 aa, Mycobacterium
VVDPLGELLSRYARTRGPFTTAE

SEQ ID NO: 1330372 - protein, 28 aa, Mycobacterium
VVDPSNNVEFFFLRPKDIAIYVGSGELD

SEQ ID NO: 1330373 - protein, 18 aa, Mycobacterium
VVDQLLALYAVGASLVLV

SEQ ID NO: 1330374 - protein, 24 aa, Mycobacterium
VVDRQWLRGLARGFARAPRVTCVA

SEQ ID NO: 1330375 - protein, 18 aa, Mycobacterium
VVDRSGLAAADFDDLVLA

SEQ ID NO: 1330376 - protein, 28 aa, Mycobacterium
VVDRYNLPVLAPPIPRTVRFAEATASGC

SEQ ID NO: 1330377 - protein, 20 aa, Mycobacterium
VVDTAWFKGNYPPTVSIDAI

SEQ ID NO: 1330378 - protein, 26 aa, Mycobacterium
VVDVFIGYLRRKLEANGAPRLLHTVR

SEQ ID NO: 1330379 - protein, 26 aa, Mycobacterium
VVEGMPAMMSGMMGGGMMGPGMGHGM

SEQ ID NO: 1330380 - protein, 21 aa, Mycobacterium
VVEGMPAMMSGMMGGGMMGPP

SEQ ID NO: 1330381 - protein, 17 aa, Mycobacterium
VVELACTRCAAIAIRRR

SEQ ID NO: 1330382 - protein, 21 aa, Mycobacterium
VVEQVFRTTISERGWVVGARF

SEQ ID NO: 1330383 - protein, 18 aa, Mycobacterium
VVERIMMLTTGWLNERAH

SEQ ID NO: 1330384 - protein, 19 aa, Mycobacterium
VVERWFTAPYRAAHPRVRA

SEQ ID NO: 1330385 - protein, 20 aa, Mycobacterium
VVEVALIRPGPIQGGSVHPY

SEQ ID NO: 1330386 - protein, 26 aa, Mycobacterium
VVEWFAANFGVIPWSMHYITNIEVTD

SEQ ID NO: 1330387 - protein, 23 aa, Mycobacterium
VVEWTPAQPLPAHTAIGVSVGAF

SEQ ID NO: 1330388 - protein, 17 aa, Mycobacterium
VVFEPNDDALWAKLRRT

SEQ ID NO: 1330389 - protein, 17 aa, Mycobacterium
VVFGVPMPQVPAPDLAG

SEQ ID NO: 1330390 - protein, 37 aa, Mycobacterium
VVGAVVPWNMPQFLIVTKLIPALLAGCTVVVKPAPES

SEQ ID NO: 1330391 - protein, 21 aa, Mycobacterium
VVGHCYPSMEAPAIGRVIALD

SEQ ID NO: 1330392 - protein, 24 aa, Mycobacterium
VVGHPFIDIWEAVKPARIGVKSWP

SEQ ID NO: 1330393 - protein, 19 aa, Mycobacterium
VVGHPYIDIWEAVKPARLD

SEQ ID NO: 1330394 - protein, 30 aa, Mycobacterium
VVGIEKVLPSWRDLEVLLQVLPRSSTGERE

SEQ ID NO: 1330395 - protein, 28 aa, Mycobacterium
VVGKDAFRAWRLLVTRYGAPAPGPAPAH

SEQ ID NO: 1330396 - protein, 20 aa, Mycobacterium
VVGPGSWTPLIDTDTHHGIV

SEQ ID NO: 1330397 - protein, 18 aa, Mycobacterium
VVGPNAAFLRHIGRVLPS

SEQ ID NO: 1330398 - protein, 25 aa, Mycobacterium
VVGQGHLLKPNSPLRRLIEGSGAAS

SEQ ID NO: 1330399 - protein, 21 aa, Mycobacterium
VVGRDRNILFGLMLSSRDHHG

SEQ ID NO: 1330400 - protein, 19 aa, Mycobacterium
VVGSDLPFTITGRAAPPFP

SEQ ID NO: 1330401 - protein, 21 aa, Mycobacterium
VVGSPTWPAWTPAALANRWPG

SEQ ID NO: 1330402 - protein, 28 aa, Mycobacterium
VVGSSPGFLAYPWGVIPDRAIERVESAA

SEQ ID NO: 1330403 - protein, 18 aa, Mycobacterium
VVGTLLFGGMWNAPIPDL

SEQ ID NO: 1330404 - protein, 28 aa, Mycobacterium
VVHAETFAPILYVLTYDDDLGEAISLNN

SEQ ID NO: 1330405 - protein, 23 aa, Mycobacterium
VVHAHDWLVAHPAITLAEFFDVP

SEQ ID NO: 1330406 - protein, 18 aa, Mycobacterium
VVHDPYWTPMAKHADIVV

SEQ ID NO: 1330407 - protein, 25 aa, Mycobacterium
VVHKETFAPILYVMTYETLDEAIAL

SEQ ID NO: 1330408 - protein, 17 aa, Mycobacterium
VVHLLRASMRYASYTDR

SEQ ID NO: 1330409 - protein, 18 aa, Mycobacterium
VVHPVRTACAAGVHTVVL

SEQ ID NO: 1330410 - protein, 17 aa, Mycobacterium
VVHSCQLLDPGLDVRRI

SEQ ID NO: 1330411 - protein, 19 aa, Mycobacterium
VVHTRRGHLPDPAASVLLG

SEQ ID NO: 1330412 - protein, 25 aa, Mycobacterium
VVHVTMHHALLGRDAVLRHAAVTLG

SEQ ID NO: 1330413 - protein, 19 aa, Mycobacterium
VVIDWCYTFYNHQRRHSAA

SEQ ID NO: 1330414 - protein, 18 aa, Mycobacterium
VVIEVRIARVLGSSSLLD

SEQ ID NO: 1330415 - protein, 28 aa, Mycobacterium
VVITGRHGGWLPGDWPAKVLDLQPLTDE

SEQ ID NO: 1330416 - protein, 17 aa, Mycobacterium
VVITPDGVFHPIRDYTV

SEQ ID NO: 1330417 - protein, 17 aa, Mycobacterium
VVIVFGGDHRRAFRHVV

SEQ ID NO: 1330418 - protein, 18 aa, Mycobacterium
VVIYMPMIPEAVIAMLAC

SEQ ID NO: 1330419 - protein, 43 aa, Mycobacterium; identical to SEQ ID NO: 876257

SEQ ID NO: 1330420 - protein, 30 aa, Mycobacterium
VVKETLRLHPPLIILMRVAQGEFEVAGFPI

SEQ ID NO: 1330421 - protein, 34 aa, Mycobacterium
VVKSLRAGLAKRQWFRPAVDMLVGLLACLRGEFE

SEQ ID NO: 1330422 - protein, 30 aa, Mycobacterium
VVLADALLEPLRFPPAYRAAVLDPQATGEA

SEQ ID NO: 1330423 - protein, 19 aa, Mycobacterium
VVLALCAGALRGFLADRDE

SEQ ID NO: 1330424 - protein, 25 aa, Mycobacterium
VVLCAIPARYLTPTSPKKPKPLVDA

SEQ ID NO: 1330425 - protein, 20 aa, Mycobacterium
VVLCQLWGPMTDLPPAIPRF

SEQ ID NO: 1330426 - protein, 17 aa, Mycobacterium
VVLEELLARKPTEDSVR

SEQ ID NO: 1330427 - protein, 19 aa, Mycobacterium
VVLFGKPSTRFLDAISAPP

SEQ ID NO: 1330428 - protein, 30 aa, Mycobacterium
VVLIHWDDFFRPLDKPLRSLPFAVDDLDVS

SEQ ID NO: 1330429 - protein, 25 aa, Mycobacterium
VVLIPEMPGLHPGVLALGNHLVDNG

SEQ ID NO: 1330430 - protein, 18 aa, Mycobacterium
VVLLDALCATLTGHAPRR

SEQ ID NO: 1330431 - protein, 18 aa, Mycobacterium
VVLNWRAVCGQCRACKRG

SEQ ID NO: 1330432 - protein, 19 aa, Mycobacterium
VVLPILHLNGYKIANPTLL

SEQ ID NO: 1330433 - protein, 17 aa, Mycobacterium
VVLSRPWGVALDGLLAS

SEQ ID NO: 1330434 - protein, 25 aa, Mycobacterium
VVLSRQRLLELVWGYDFDVDTNVAD

SEQ ID NO: 1330435 - protein, 22 aa, Mycobacterium
VVLVAPPTLLPVGVRQWPVTVS

SEQ ID NO: 1330436 - protein, 19 aa, Mycobacterium
VVMALCAGALRGFLNKRAE

SEQ ID NO: 1330437 - protein, 29 aa, Mycobacterium
VVMVDGLPWHWETFPEFLDALDAGARDID

SEQ ID NO: 1330438 - protein, 17 aa, Mycobacterium
VVNGTKAFLPHLIASGD

SEQ ID NO: 1330439 - protein, 20 aa, Mycobacterium
VVNKFRGDPALLAPGLRDLE

SEQ ID NO: 1330440 - protein, 23 aa, Mycobacterium
VVNLNLKGPFRLSVLVGDRMVAD

SEQ ID NO: 1330441 - protein, 24 aa, Mycobacterium
VVNRYLKVVFLPNFNVKNAHLVYP

SEQ ID NO: 1330442 - protein, 31 aa, Mycobacterium; identical to SEQ ID NO: 876370

SEQ ID NO: 1330443 - protein, 19 aa, Mycobacterium
VVNSHYTWSYYAISAGLEI

SEQ ID NO: 1330444 - protein, 30 aa, Mycobacterium
VVNTVLPPFQLPWYVPCFKYLREMGALDDD

SEQ ID NO: 1330445 - protein, 29 aa, Mycobacterium
VVPEGLNAEYLFRLALPTGIYGGTLDVFR

SEQ ID NO: 1330446 - protein, 27 aa, Mycobacterium
VVPGGPWFQWHFDRWTPPPGATEIART

SEQ ID NO: 1330447 - protein, 27 aa, Mycobacterium
VVPIVPAAVIFDLPVGGWKCRPDADFG

SEQ ID NO: 1330448 - protein, 19 aa, Mycobacterium
VVPPIPRKDSLPLEGLRVV

SEQ ID NO: 1330449 - protein, 17 aa, Mycobacterium
VVPRLELAALKESALPE

SEQ ID NO: 1330450 - protein, 44 aa, Mycobacterium
VVPRRGTLALAFDVAPPVWAEPGRWWALVRVACAGELVYSPAVP

SEQ ID NO: 1330451 - protein, 26 aa, Mycobacterium
VVPVFGRVRLPIRWLADMAAMSTDPR

SEQ ID NO: 1330452 - protein, 17 aa, Mycobacterium
VVPYLTVADARAAIRWY

SEQ ID NO: 1330453 - protein, 24 aa, Mycobacterium
VVQETWIALLKGIDRFEGRSSLRT

SEQ ID NO: 1330454 - protein, 17 aa, Mycobacterium
VVQPRATIFERAVSAGV

SEQ ID NO: 1330455 - protein, 44 aa, Mycobacterium
VVQRRPVGVLLGVMPWNFPVYQVARFAAPNLVLGNTILLKHAES

SEQ ID NO: 1330456 - protein, 29 aa, Mycobacterium
VVQTLLLTSHLLFVGFSLTDKNFLAMAEA

SEQ ID NO: 1330457 - protein, 25 aa, Mycobacterium
VVRDDHGFILAGPDLRDVSGWTLDR

SEQ ID NO: 1330458 - protein, 28 aa, Mycobacterium
VVRDGALWLIPLRGPRSGGLLLKQRTPA

SEQ ID NO: 1330459 - protein, 32 aa, Mycobacterium
VVRRGDTPLPVRTPLPVQLPEPMAAQLAAAQQ

SEQ ID NO: 1330460 - protein, 27 aa, Mycobacterium
VVRRRGNVTLARFVPHSLVLDRAVCVV

SEQ ID NO: 1330461 - protein, 23 aa, Mycobacterium
VVRRSNALLGYAYGRRFEYAEQM

SEQ ID NO: 1330462 - protein, 28 aa, Mycobacterium
VVRWANRVAPRLARQWLLPVCAETWDGY

SEQ ID NO: 1330463 - protein, 27 aa, Mycobacterium
VVSAPALHRRWWAADGLGAFVTVSGES

SEQ ID NO: 1330464 - protein, 19 aa, Mycobacterium
VVSDRIAAWGLADEPELKQ

SEQ ID NO: 1330465 - protein, 18 aa, Mycobacterium
VVSGRWPDSTKEWAQLLM

SEQ ID NO: 1330466 - protein, 18 aa, Mycobacterium
VVSLAWLANTLGQQNDCL

SEQ ID NO: 1330467 - protein, 17 aa, Mycobacterium
VVSLHRLLNPEPADLEV

SEQ ID NO: 1330468 - protein, 19 aa, Mycobacterium
VVSTLLLQIDRLPSHVVAV

SEQ ID NO: 1330469 - protein, 19 aa, Mycobacterium
VVTGGMGGLGLFLAEKMAA

SEQ ID NO: 1330470 - protein, 24 aa, Mycobacterium
VVTGSIGFLEIWDAQAWQDYQELH

SEQ ID NO: 1330471 - protein, 19 aa, Mycobacterium
VVTHDRWFLDEVCTVTWEV

SEQ ID NO: 1330472 - protein, 24 aa, Mycobacterium
VVTLEPCNHFGRTPPCVDALLDAG

SEQ ID NO: 1330473 - protein, 38 aa, Mycobacterium
VVTLGRTVAHRAKLNWWESRALYGWTVLVPRTKDQAGE

SEQ ID NO: 1330474 - protein, 18 aa, Mycobacterium
VVTLPQLLDFVRPRHRMV

SEQ ID NO: 1330475 - protein, 24 aa, Mycobacterium
VVTTTDTWLVHRLCGAFVTDASTA

SEQ ID NO: 1330476 - protein, 23 aa, Mycobacterium
VVTTTDTWLVHRLCGAFVTDTST

SEQ ID NO: 1330477 - protein, 17 aa, Mycobacterium
VVVAGKMRFGSLTARHP

SEQ ID NO: 1330478 - protein, 17 aa, Mycobacterium
VVVAPYEGPLRDATAGR

SEQ ID NO: 1330479 - protein, 18 aa, Mycobacterium
VVVAWPTAQIAVMGASGA

SEQ ID NO: 1330480 - protein, 19 aa, Mycobacterium
VVVDPKFAWGQPVIERNKV

SEQ ID NO: 1330481 - protein, 25 aa, Mycobacterium
VVVIGRGVTVGRPLGLLLTRRSENA

SEQ ID NO: 1330482 - protein, 17 aa, Mycobacterium
VVVPPRMAAYSQASADV

SEQ ID NO: 1330483 - protein, 17 aa, Mycobacterium
VVVSWLSGELTQRQIGV

SEQ ID NO: 1330484 - protein, 18 aa, Mycobacterium
VVVVPLRSERQNLGVLAL

SEQ ID NO: 1330485 - protein, 22 aa, Mycobacterium
VVVVSIFVNPLQFAANEDLGAY

SEQ ID NO: 1330486 - protein, 18 aa, Mycobacterium
VVWYGDTVVRLDPFALGA

SEQ ID NO: 1330487 - protein, 23 aa, Mycobacterium
VVYEPLMKRLPADTPVYGIERVE

SEQ ID NO: 1330488 - protein, 19 aa, Mycobacterium
VVYLCAPGSSWLTGEVLDI

SEQ ID NO: 1330489 - protein, 19 aa, Mycobacterium
VVYPHHGAALIEAIETRTI

SEQ ID NO: 1330490 - protein, 20 aa, Mycobacterium
VWAKVLPTHLAIVRSLVEEA

SEQ ID NO: 1330491 - protein, 21 aa, Mycobacterium
VWALHDALPDHLRVAVLLGAF

SEQ ID NO: 1330492 - protein, 17 aa, Mycobacterium
VWDELAGAGIRSLAGHR

SEQ ID NO: 1330493 - protein, 29 aa, Mycobacterium
VWDRAWAEFVPFLAFPVEIRKIIYTTNAI

SEQ ID NO: 1330494 - protein, 23 aa, Mycobacterium
VWDRRIERLLAFGRGQHFCLGVH

SEQ ID NO: 1330495 - protein, 18 aa, Mycobacterium
VWEAGQAYGLAPLGLEAL

SEQ ID NO: 1330496 - protein, 29 aa, Mycobacterium
VWGEVIFPSLGMWASTFRTPELLKACMRA

SEQ ID NO: 1330497 - protein, 17 aa, Mycobacterium
VWGPAYAKETHYLRVYL

SEQ ID NO: 1330498 - protein, 20 aa, Mycobacterium
VWGRRLVEQALWMVDVHRTL

SEQ ID NO: 1330499 - protein, 33 aa, Mycobacterium
VWIGPPNLEPPERPLPGPLKWDLTTGIATATTQ

SEQ ID NO: 1330500 - protein, 19 aa, Mycobacterium
VWKTVKAGIPHMIAGGRGG

SEQ ID NO: 1330501 - protein, 22 aa, Mycobacterium
VWLAKRGLSVWACDASSVAIAQ

SEQ ID NO: 1330502 - protein, 20 aa, Mycobacterium
VWLDIPRPQFPTPSGPPVTC

SEQ ID NO: 1330503 - protein, 19 aa, Mycobacterium
VWNTFGRHWDDLRPDHYAA

SEQ ID NO: 1330504 - protein, 17 aa, Mycobacterium
VWQCASLLLSYPDHSRF

SEQ ID NO: 1330505 - protein, 24 aa, Mycobacterium
VWRELIRLHYPGTGWLRLTRDTID

SEQ ID NO: 1330506 - protein, 19 aa, Mycobacterium
VWTDGPLTRAVKAGAICYL

SEQ ID NO: 1330507 - protein, 33 aa, Mycobacterium
VWTRPFLARYGIDVPIRVIREQIVLIDPGVEVG

SEQ ID NO: 1330508 - protein, 18 aa, Mycobacterium
VWVSAWTSPGGAVPRPPD

SEQ ID NO: 1330509 - protein, 18 aa, Mycobacterium
VWWHESLSGAALPGWVTE

SEQ ID NO: 1330510 - protein, 21 aa, Mycobacterium
VYAASTYFLSTLIPARFDPAD

SEQ ID NO: 1330511 - protein, 18 aa, Mycobacterium
VYAPLRTLIYEDPAGRTR

SEQ ID NO: 1330512 - protein, 18 aa, Mycobacterium
VYARALADRAFMDGHVGI

SEQ ID NO: 1330513 - protein, 30 aa, Mycobacterium
VYARTAHWIGSYDWVLSALGAPIHVEQNWA

SEQ ID NO: 1330514 - protein, 26 aa, Mycobacterium
VYARVNPFGFIETPYRKVTDGVVTDQ

SEQ ID NO: 1330515 - protein, 18 aa, Mycobacterium
VYLDEGFTPRLIAERIAE

SEQ ID NO: 1330516 - protein, 22 aa, Mycobacterium
VYLELMIRQHRFTISVARDELQ

SEQ ID NO: 1330517 - protein, 17 aa, Mycobacterium
VYLKFGEPIPVTSLLGF

SEQ ID NO: 1330518 - protein, 24 aa, Mycobacterium
VYLSPAPLYHTAPSFWSMVVQSMG

SEQ ID NO: 1330519 - protein, 18 aa, Mycobacterium
VYLSRLGELGIPTDLLPL

SEQ ID NO: 1330520 - protein, 23 aa, Mycobacterium
VYNRAYDVLAANPLAQALFGDFG

SEQ ID NO: 1330521 - protein, 18 aa, Mycobacterium
VYQMRRWYQQFYVDVADV

SEQ ID NO: 1330522 - protein, 20 aa, Mycobacterium
VYRAWELGAVVYYVGGNVLE

SEQ ID NO: 1330523 - protein, 17 aa, Mycobacterium
VYRDETAPLLDYYSADL

SEQ ID NO: 1330524 - protein, 22 aa, Mycobacterium
VYRGAEYSVDFVPKVRVEVVVD

SEQ ID NO: 1330525 - protein, 18 aa, Mycobacterium
VYRRFPTKDALFEAIFRD

SEQ ID NO: 1330526 - protein, 17 aa, Mycobacterium
VYRYDYAPRPLHWSGMG

SEQ ID NO: 1330527 - protein, 18 aa, Mycobacterium
VYSIARPAAVLTPEHYYR

SEQ ID NO: 1330528 - protein, 19 aa, Mycobacterium
VYTPPWIWHRHYADDGRDV

SEQ ID NO: 1330529 - protein, 19 aa, Mycobacterium
VYVRATRVPSLPDGVPLPV

SEQ ID NO: 1330530 - protein, 26 aa, Mycobacterium
WAAAQLAPAVVPWPKVLRAAVRRAVE

SEQ ID NO: 1330531 - protein, 18 aa, Mycobacterium
WAAPLLQPDRFSSVAGLS

SEQ ID NO: 1330532 - protein, 18 aa, Mycobacterium
WAAYAGRVVAIWSDGDSH

SEQ ID NO: 1330533 - protein, 18 aa, Mycobacterium
WADHLAFLADIRESIHLR

SEQ ID NO: 1330534 - protein, 26 aa, Mycobacterium
WAEGRRYLGLDILARCRLTTITNDNP

SEQ ID NO: 1330535 - protein, 21 aa, Mycobacterium
WAESRRYLGLDVLSKSRAVND

SEQ ID NO: 1330536 - protein, 18 aa, Mycobacterium
WAFAEGFGYAYERTVLLE

SEQ ID NO: 1330537 - protein, 21 aa, Mycobacterium
WAHATFVEQIYYFADTFVKRL

SEQ ID NO: 1330538 - protein, 18 aa, Mycobacterium
WAISPWAAEQVPLLDAAG

SEQ ID NO: 1330539 - protein, 17 aa, Mycobacterium
WALLGSEERMTAATALR

SEQ ID NO: 1330540 - protein, 18 aa, Mycobacterium
WALPGTFLHEGETLAMAV

SEQ ID NO: 1330541 - protein, 18 aa, Mycobacterium
WAMFDTVRFDLNLVVAGD

SEQ ID NO: 1330542 - protein, 17 aa, Mycobacterium
WANLRPVLGGHPIKVEE

SEQ ID NO: 1330543 - protein, 19 aa, Mycobacterium
WANYGTIIDTFSKKYGIKV

SEQ ID NO: 1330544 - protein, 17 aa, Mycobacterium
WAPAHGDPLLEPLRAKF

SEQ ID NO: 1330545 - protein, 18 aa, Mycobacterium
WAQEIAGFAPLALQHAKR

SEQ ID NO: 1330546 - protein, 27 aa, Mycobacterium
WAQRVSLAHALIGWTRGTGLMGHNDVI

SEQ ID NO: 1330547 - protein, 20 aa, Mycobacterium
WARAIAADIARRNAGRDPVK

SEQ ID NO: 1330548 - protein, 27 aa, Mycobacterium
WARENIPVLGAKRFFFAEKTGPQGDFT

SEQ ID NO: 1330549 - protein, 18 aa, Mycobacterium
WARGCRDALYSELGFGRS

SEQ ID NO: 1330550 - protein, 17 aa, Mycobacterium
WARLAEAGVPVIFHLSD

SEQ ID NO: 1330551 - protein, 18 aa, Mycobacterium
WASLMFASIYLGMQQRIL

SEQ ID NO: 1330552 - protein, 29 aa, Mycobacterium
WASLPEWPQMLLRALMFRLAVHALHPRST

SEQ ID NO: 1330553 - protein, 20 aa, Mycobacterium
WASQGWLHRIVDPRSDQNVC

SEQ ID NO: 1330554 - protein, 26 aa, Mycobacterium
WATLNHADAVVRILPSADPEVIDIPT

SEQ ID NO: 1330555 - protein, 18 aa, Mycobacterium
WAVAYKYPPEEAQTKLLD

SEQ ID NO: 1330556 - protein, 19 aa, Mycobacterium
WAVGLGCNLALAADFTVAG

SEQ ID NO: 1330557 - protein, 27 aa, Mycobacterium
WAVHHPARWALLYGSPVPGYHAPREQT

SEQ ID NO: 1330558 - protein, 18 aa, Mycobacterium
WAVSLDDGGLEFVDDGDL

SEQ ID NO: 1330559 - protein, 24 aa, Mycobacterium
WAVYEPARPFAPLLAATKATRTDG

SEQ ID NO: 1330560 - protein, 17 aa, Mycobacterium
WCAEQQGLKAFRGQCLV

SEQ ID NO: 1330561 - protein, 21 aa, Mycobacterium
WCAGRFWWDGARPVDAEVTPL

SEQ ID NO: 1330562 - protein, 17 aa, Mycobacterium
WCQLFSEPGAGSDAAAV

SEQ ID NO: 1330563 - protein, 20 aa, Mycobacterium
WDAPLFDETYAFGGLPTGRG

SEQ ID NO: 1330564 - protein, 26 aa, Mycobacterium
WDARTWLGRPGLVDGAPADLVCYDED

SEQ ID NO: 1330565 - protein, 27 aa, Mycobacterium
WDARTWLGRPGLVDGAPADLVCYDQDP

SEQ ID NO: 1330566 - protein, 20 aa, Mycobacterium
WDELKAMWRADARGLDLDRD

SEQ ID NO: 1330567 - protein, 21 aa, Mycobacterium
WDEQFGDRHISLTALICGADP

SEQ ID NO: 1330568 - protein, 21 aa, Mycobacterium
WDEYSRWHLGLTDGAVDGTKA

SEQ ID NO: 1330569 - protein, 18 aa, Mycobacterium
WDGTMRLVAYIQADLDST

SEQ ID NO: 1330570 - protein, 31 aa, Mycobacterium
WDLETLRAALSTLYPVVWQPDPRPHMRGLTR

SEQ ID NO: 1330571 - protein, 18 aa, Mycobacterium
WDLRCGSLFEPVAGERFD

SEQ ID NO: 1330572 - protein, 19 aa, Mycobacterium
WDMFETIRFDLNLVVAGDD

SEQ ID NO: 1330573 - protein, 32 aa, Mycobacterium
WDPHQNMGVIYWIYPNLILANSPIGVEIIDIL

SEQ ID NO: 1330574 - protein, 26 aa, Mycobacterium
WDRGADPRLRGFARKLCRHAAGVMLQ

SEQ ID NO: 1330575 - protein, 18 aa, Mycobacterium
WDRLLQACRPGAPVSSLL

SEQ ID NO: 1330576 - protein, 18 aa, Mycobacterium
WDTGLLEHNIHFPRFHRD

SEQ ID NO: 1330577 - protein, 17 aa, Mycobacterium
WDVGTRDNAITLERFDD

SEQ ID NO: 1330578 - protein, 18 aa, Mycobacterium
WDVGTRDNAITLERFDDG

SEQ ID NO: 1330579 - protein, 18 aa, Mycobacterium
WDVHEYDLARMYNFQCWI

SEQ ID NO: 1330580 - protein, 17 aa, Mycobacterium
WDVPEVPVPIAAAVSGD

SEQ ID NO: 1330581 - protein, 28 aa, Mycobacterium
WDVPKHKGLSLFIMPMNQAGIEVRPLVQ

SEQ ID NO: 1330582 - protein, 27 aa, Mycobacterium
WDVRASFLPAIYFEGVGMAGGIAVLLP

SEQ ID NO: 1330583 - protein, 22 aa, Mycobacterium
WEADWLCTDYAAAGLVLCDSLA

SEQ ID NO: 1330584 - protein, 18 aa, Mycobacterium
WEALSARDWTALKTFLSA

SEQ ID NO: 1330585 - protein, 18 aa, Mycobacterium
WEEIEDTLLIADLGPVVT

SEQ ID NO: 1330586 - protein, 17 aa, Mycobacterium
WEELPFDAQWYSDNERV

SEQ ID NO: 1330587 - protein, 25 aa, Mycobacterium
WEFQTPTIPVLYFLDTRTNRGYKDD

SEQ ID NO: 1330588 - protein, 17 aa, Mycobacterium
WEFYAQRRAFREELHPH

SEQ ID NO: 1330589 - protein, 19 aa, Mycobacterium
WEGPLGVTYPGVVADGIVC

SEQ ID NO: 1330590 - protein, 23 aa, Mycobacterium
WEHDAHLYIRRATVLQAFAGDQD

SEQ ID NO: 1330591 - protein, 21 aa, Mycobacterium
WEKLAQIALAAAWSVTALGAI

SEQ ID NO: 1330592 - protein, 24 aa, Mycobacterium
WEKMPEQFLAALDARFGIASPRDH

SEQ ID NO: 1330593 - protein, 20 aa, Mycobacterium
WELGVPRRDLHALAAQLGSD

SEQ ID NO: 1330594 - protein, 18 aa, Mycobacterium
WENGARIPGIDALERLAA

SEQ ID NO: 1330595 - protein, 23 aa, Mycobacterium
WENSCRFFSWDPFKLTPKEQATA

SEQ ID NO: 1330596 - protein, 29 aa, Mycobacterium
WEPENQLLGALLWMPYTRARTFCDLIPDT

SEQ ID NO: 1330597 - protein, 31 aa, Mycobacterium
WEQDPDVLDTWFSSALWPFSTMGWPDHTAEL

SEQ ID NO: 1330598 - protein, 18 aa, Mycobacterium
WERPAAFSRFAWDWENSL

SEQ ID NO: 1330599 - protein, 18 aa, Mycobacterium
WERPYVAAGIFLYDQLGG

SEQ ID NO: 1330600 - protein, 31 aa, Mycobacterium
WERVIDIFNDRFFVPFRLAATNRDRVVLGQE

SEQ ID NO: 1330601 - protein, 21 aa, Mycobacterium
WESDIQLYFKRAHGSAQLFGP

SEQ ID NO: 1330602 - protein, 17 aa, Mycobacterium
WETSKAFYDKVLGVLGY

SEQ ID NO: 1330603 - protein, 20 aa, Mycobacterium
WETVQARIKWLMADKTKDYD

SEQ ID NO: 1330604 - protein, 39 aa, Mycobacterium
WEVDYFLHENPELKRFSFAWLTDFVGWLPMPDGGPREAA

SEQ ID NO: 1330605 - protein, 25 aa, Mycobacterium
WEWDSAAPAGVLWAAGMHASRIDGS

SEQ ID NO: 1330606 - protein, 18 aa, Mycobacterium
WFDAIGIIVLEGYGLTET

SEQ ID NO: 1330607 - protein, 19 aa, Mycobacterium
WFGYLSYPDGGADGLGPRI

SEQ ID NO: 1330608 - protein, 17 aa, Mycobacterium
WFIKVTQFRDRMVELNQ

SEQ ID NO: 1330609 - protein, 20 aa, Mycobacterium
WFRESLARAAKFPDLSVSVC

SEQ ID NO: 1330610 - protein, 19 aa, Mycobacterium
WFTGTFATMGLSYLGFTQW

SEQ ID NO: 1330611 - protein, 26 aa, Mycobacterium
WFTVHDRWLDQPPATLTPGARLTAKI

SEQ ID NO: 1330612 - protein, 17 aa, Mycobacterium
WFVDGFLRTDPTNPLKN

SEQ ID NO: 1330613 - protein, 21 aa, Mycobacterium
WGELFNIPLTAHFLGGAAIGD

SEQ ID NO: 1330614 - protein, 22 aa, Mycobacterium
WGERQKRILAWLQVLDAGDDLD

SEQ ID NO: 1330615 - protein, 22 aa, Mycobacterium
WGGKLMWNQTPLLLDRAKDLPD

SEQ ID NO: 1330616 - protein, 23 aa, Mycobacterium
WGGPGFFGPLQKPLPMSLTAHPT

SEQ ID NO: 1330617 - protein, 21 aa, Mycobacterium
WGGPPIGALVFRDPAVIDAFG

SEQ ID NO: 1330618 - protein, 23 aa, Mycobacterium
WGGQLVYPLPTLHSADLHATQPS

SEQ ID NO: 1330619 - protein, 24 aa, Mycobacterium
WGHPVQPGLALLRLAQGRVDDALA

SEQ ID NO: 1330620 - protein, 26 aa, Mycobacterium
WGKSAVYFISAKLLRAAGHGPTVIVS

SEQ ID NO: 1330621 - protein, 17 aa, Mycobacterium
WGLAQKTAMTYPDAVRR

SEQ ID NO: 1330622 - protein, 39 aa, Mycobacterium
WGLDSFQLFPNFVMLFWGQGWYLTYHYWPTSHNTHLFEG

SEQ ID NO: 1330623 - protein, 39 aa, Mycobacterium
WGLDSFQLFPNFVVLFWGQGWYLTYHYWPTSHNTHIFEG

SEQ ID NO: 1330624 - protein, 19 aa, Mycobacterium
WGLQEHRDRFVSPTGARFV

SEQ ID NO: 1330625 - protein, 25 aa, Mycobacterium
WGLRALDRGWLHRGIRYRGRGGRAF

SEQ ID NO: 1330626 - protein, 18 aa, Mycobacterium
WGNLIPEVKWVEEKQGEY

SEQ ID NO: 1330627 - protein, 21 aa, Mycobacterium
WGNQMRSYVLHPYQMVKDLRT

SEQ ID NO: 1330628 - protein, 28 aa, Mycobacterium
WGPNAIHQLIAPNAWRLPFEREWREKAP

SEQ ID NO: 1330629 - protein, 36 aa, Mycobacterium
WGQDSFEFFPNFTLLLWAPGWYLTYNYWPTAVDKHI

SEQ ID NO: 1330630 - protein, 17 aa, Mycobacterium
WGRIDFLVNNAGIGSPK

SEQ ID NO: 1330631 - protein, 21 aa, Mycobacterium
WGRRRLAYEIAKHAEGIYAVI

SEQ ID NO: 1330632 - protein, 17 aa, Mycobacterium
WGRTLLALGMDTVDDEV

SEQ ID NO: 1330633 - protein, 21 aa, Mycobacterium
WGSMAHLFVGTLACSAKWRGV

SEQ ID NO: 1330634 - protein, 24 aa, Mycobacterium
WGSTGPFRDYKGWEALVMAKTGVM

SEQ ID NO: 1330635 - protein, 23 aa, Mycobacterium
WGTHSLAPLSFRGAAYSGVFTLM

SEQ ID NO: 1330636 - protein, 24 aa, Mycobacterium
WGTLLPTVLALTLAREHPRIFPVA

SEQ ID NO: 1330637 - protein, 20 aa, Mycobacterium
WGYPKVMADFTIRNGRHFGF

SEQ ID NO: 1330638 - protein, 29 aa, Mycobacterium
WHAATTLTKLPWLDGWRRPQAELDESSRA

SEQ ID NO: 1330639 - protein, 30 aa, Mycobacterium; identical to SEQ ID NO: 1285107

SEQ ID NO: 1330640 - protein, 20 aa, Mycobacterium
WHALPARLLAEVLRLRGWHV

SEQ ID NO: 1330641 - protein, 28 aa, Mycobacterium
WHARLGTAAVCWRLRRRHGLQVHDIAPM

SEQ ID NO: 1330642 - protein, 17 aa, Mycobacterium
WHFAKLTATGRSLPYVS

SEQ ID NO: 1330643 - protein, 23 aa, Mycobacterium
WHLRKVFVKLGITSRRQLRSISW

SEQ ID NO: 1330644 - protein, 19 aa, Mycobacterium
WHPFEEVWARLSSERQTAL

SEQ ID NO: 1330645 - protein, 17 aa, Mycobacterium
WHPRAHASARWADGGGD

SEQ ID NO: 1330646 - protein, 18 aa, Mycobacterium
WHQPPRARKPQRHLRLFG

SEQ ID NO: 1330647 - protein, 18 aa, Mycobacterium
WHTDVRGGLLFVWHDHEG

SEQ ID NO: 1330648 - protein, 18 aa, Mycobacterium
WHTVKASVPHLGAAGGSI

SEQ ID NO: 1330649 - protein, 33 aa, Mycobacterium; identical to SEQ ID NO: 786460

SEQ ID NO: 1330650 - protein, 33 aa, Mycobacterium
WHVEEWCGAYPARFIPMTLPVIWDPVACAAEIR

SEQ ID NO: 1330651 - protein, 18 aa, Mycobacterium
WHVGADRLDLFAVPRLHL

SEQ ID NO: 1330652 - protein, 17 aa, Mycobacterium
WHWTRQLRPRLDGLTDD

SEQ ID NO: 1330653 - protein, 28 aa, Mycobacterium
WIAGVLNMMPRWYIGSMLRNIDFLCSDV

SEQ ID NO: 1330654 - protein, 17 aa, Mycobacterium
WIAHTLHALAWMIPGEV

SEQ ID NO: 1330655 - protein, 20 aa, Mycobacterium
WIDLPAVVLESLEGIRRAGA

SEQ ID NO: 1330656 - protein, 21 aa, Mycobacterium
WIDPQQRLVLETAWEGLERAG

SEQ ID NO: 1330657 - protein, 17 aa, Mycobacterium
WIGFLERIKRRDLPGLD

SEQ ID NO: 1330658 - protein, 20 aa, Mycobacterium
WIGPPNLEPPERPLPGPLKW

SEQ ID NO: 1330659 - protein, 17 aa, Mycobacterium
WIHPGGLLGAMPMPDSS

SEQ ID NO: 1330660 - protein, 17 aa, Mycobacterium
WILATASFGPPLDPGQL

SEQ ID NO: 1330661 - protein, 18 aa, Mycobacterium
WIQQFYAALGPKGRAGFV

SEQ ID NO: 1330662 - protein, 17 aa, Mycobacterium
WIRDGVINALSYPRAAA

SEQ ID NO: 1330663 - protein, 18 aa, Mycobacterium
WIRDRTVLFDGERPHGIV

SEQ ID NO: 1330664 - protein, 19 aa, Mycobacterium
WIRLVALTAHHPGTDWTAV

SEQ ID NO: 1330665 - protein, 21 aa, Mycobacterium
WIRTEEIETLPWVPADRAWLP

SEQ ID NO: 1330666 - protein, 29 aa, Mycobacterium
WITHGGIADFYSLFARTGEGSGGISCFLV

SEQ ID NO: 1330667 - protein, 17 aa, Mycobacterium
WIVMHRGSLSIACNLGA

SEQ ID NO: 1330668 - protein, 26 aa, Mycobacterium
WIVRDMLGLPYEKPAAYTRDYLEVLN

SEQ ID NO: 1330669 - protein, 20 aa, Mycobacterium
WKAETSWAQRVSLAHALIGW

SEQ ID NO: 1330670 - protein, 18 aa, Mycobacterium
WKCRPDADFGYRAAAAAG

SEQ ID NO: 1330671 - protein, 17 aa, Mycobacterium
WKPTQQPNLWFHGGNLH

SEQ ID NO: 1330672 - protein, 23 aa, Mycobacterium
WKRDFNALVYVLSGRGAVGPVAH

SEQ ID NO: 1330673 - protein, 19 aa, Mycobacterium
WKTINDYVTAVAPELLPRM

SEQ ID NO: 1330674 - protein, 18 aa, Mycobacterium
WKTVKAGVPHILAGGNGG

SEQ ID NO: 1330675 - protein, 19 aa, Mycobacterium
WKVEIGTNLWVLPRGIRRA

SEQ ID NO: 1330676 - protein, 28 aa, Mycobacterium
WKVVDTNLGGTFFLVQAVLPHMRAAGAG

SEQ ID NO: 1330677 - protein, 17 aa, Mycobacterium
WKYVGWLMGVDEDWLCD

SEQ ID NO: 1330678 - protein, 18 aa, Mycobacterium
WLAAHRLGAIAVPVNFRL

SEQ ID NO: 1330679 - protein, 17 aa, Mycobacterium
WLALCAAILRRAPKLEG

SEQ ID NO: 1330680 - protein, 18 aa, Mycobacterium
WLAQVRDPRPLLGLAPLE

SEQ ID NO: 1330681 - protein, 30 aa, Mycobacterium
WLDPEMTSPYAWYQYFINTADADVLPYLRW

SEQ ID NO: 1330682 - protein, 26 aa, Mycobacterium
WLEKMFDGVVLHYFLHAEPSGAAARD

SEQ ID NO: 1330683 - protein, 18 aa, Mycobacterium
WLGDPVSVASLILEPPSG

SEQ ID NO: 1330684 - protein, 19 aa, Mycobacterium
WLGTPYLTFKREGAFAICT

SEQ ID NO: 1330685 - protein, 20 aa, Mycobacterium
WLHNVPALMRGRDRCTLLMH

SEQ ID NO: 1330686 - protein, 19 aa, Mycobacterium
WLIRPTVVTDLPATARLCR

SEQ ID NO: 1330687 - protein, 18 aa, Mycobacterium
WLKDLRKNGPHPKNLVAA

SEQ ID NO: 1330688 - protein, 27 aa, Mycobacterium
WLKVTNGIPWRRPIASLNYLLSSHVWR

SEQ ID NO: 1330689 - protein, 18 aa, Mycobacterium
WLNAADELFWVKYHIKTD

SEQ ID NO: 1330690 - protein, 17 aa, Mycobacterium
WLPREKYIGLIMVPGRS

SEQ ID NO: 1330691 - protein, 18 aa, Mycobacterium
WLRAHKPLDFIPGLMHGD

SEQ ID NO: 1330692 - protein, 20 aa, Mycobacterium
WLSQWPALPEAMDAAAGYVA

SEQ ID NO: 1330693 - protein, 21 aa, Mycobacterium
WLTAQFMIDTRTIAGVALGPS

SEQ ID NO: 1330694 - protein, 18 aa, Mycobacterium
WLTRHPEMPEWHLHLASI

SEQ ID NO: 1330695 - protein, 21 aa, Mycobacterium
WLTSRGWWTDVVEARHLPGLS

SEQ ID NO: 1330696 - protein, 18 aa, Mycobacterium
WLTTITLADRRAPGPFTA

SEQ ID NO: 1330697 - protein, 20 aa, Mycobacterium
WLTYSLLEPFDWAGVEVTGV

SEQ ID NO: 1330698 - protein, 22 aa, Mycobacterium
WLVVDLSGLTFFSTAGFSALHT

SEQ ID NO: 1330699 - protein, 19 aa, Mycobacterium
WLWAVRLTKTRPDAAAACR

SEQ ID NO: 1330700 - protein, 19 aa, Mycobacterium
WLWAVRLTKTRPDAASACR

SEQ ID NO: 1330701 - protein, 17 aa, Mycobacterium
WLYTEYIVRQRSCADLA

SEQ ID NO: 1330702 - protein, 21 aa, Mycobacterium
WMFSRAVCLKAPYFRTIHPAI

SEQ ID NO: 1330703 - protein, 17 aa, Mycobacterium
WMGSAFLTAAEYDLGHR

SEQ ID NO: 1330704 - protein, 17 aa, Mycobacterium
WMHWQLLKPAESRQRRT

SEQ ID NO: 1330705 - protein, 17 aa, Mycobacterium
WMPQVPNDFDCLTMVAL

SEQ ID NO: 1330706 - protein, 18 aa, Mycobacterium
WMQPTRHALGALLLEQGR

SEQ ID NO: 1330707 - protein, 17 aa, Mycobacterium
WMSRGGASKGRSWAVLG

SEQ ID NO: 1330708 - protein, 18 aa, Mycobacterium
WMYRTLTVNYRTPAEIMA

SEQ ID NO: 1330709 - protein, 20 aa, Mycobacterium
WNEITPCNLSLDRLAKAVKE

SEQ ID NO: 1330710 - protein, 17 aa, Mycobacterium
WNELIDAIDPRLRSDAY

SEQ ID NO: 1330711 - protein, 23 aa, Mycobacterium
WNIDEWCGTYPGRMIPQALPPIW

SEQ ID NO: 1330712 - protein, 24 aa, Mycobacterium
WNLARFAETLLPLFDDDIDRAITL

SEQ ID NO: 1330713 - protein, 22 aa, Mycobacterium
WNRMGAALRRNDAELLGISVRT

SEQ ID NO: 1330714 - protein, 27 aa, Mycobacterium
WPDISDLFAGLPAWANLRPVLGGHPIK

SEQ ID NO: 1330715 - protein, 17 aa, Mycobacterium
WPDLFIAGGGISRKADK

SEQ ID NO: 1330716 - protein, 21 aa, Mycobacterium
WPERAFLAELAAKHNYYVAAR

SEQ ID NO: 1330717 - protein, 19 aa, Mycobacterium
WPERGPLLGVDLEGSLYTS

SEQ ID NO: 1330718 - protein, 34 aa, Mycobacterium
WPEVADFFAGFPSWANLRPMFGGHLIKVEDDIKD

SEQ ID NO: 1330719 - protein, 21 aa, Mycobacterium
WPGAYGTWWQADPSADVILIY

SEQ ID NO: 1330720 - protein, 37 aa, Mycobacterium
WPGAYGTWWQADPTNDLILIYLIQNLPDFGADAAAAV

SEQ ID NO: 1330721 - protein, 26 aa, Mycobacterium
WPGTEHQWLDGWLLRHGQGVTRRANS

SEQ ID NO: 1330722 - protein, 19 aa, Mycobacterium
WPGTLIVVSHDRYLLERIT

SEQ ID NO: 1330723 - protein, 17 aa, Mycobacterium
WPLYATVMGDGPALIML

SEQ ID NO: 1330724 - protein, 39 aa, Mycobacterium
WPNVAALCMPFQFPDGTPSAFLSWRVWVPRGPEHFELFH

SEQ ID NO: 1330725 - protein, 17 aa, Mycobacterium
WPPVPPPTTIRGTFHNG

SEQ ID NO: 1330726 - protein, 20 aa, Mycobacterium
WPQHHWVYRSLLADPPTSAG

SEQ ID NO: 1330727 - protein, 17 aa, Mycobacterium
WPQVTIIWEIDAFADYA

SEQ ID NO: 1330728 - protein, 53 aa, Mycobacterium
WPTFRVSGRLVWFAMTIWQFLHFRFGLPKPLLEPLAVERLYLDNYFSIAKAER

SEQ ID NO: 1330729 - protein, 25 aa, Mycobacterium
WPTGARPHWMPAEFDWVVGCSYTGQ

SEQ ID NO: 1330730 - protein, 25 aa, Mycobacterium
WPTLDQDGMLFVWNDPEKKAPPAEV

SEQ ID NO: 1330731 - protein, 19 aa, Mycobacterium
WPTTEVNGQLLVWHDPERS

SEQ ID NO: 1330732 - protein, 30 aa, Mycobacterium
WPVMPVDIVSFWLKPFGFFDRNPALDVVGT

SEQ ID NO: 1330733 - protein, 22 aa, Mycobacterium
WQADWAIEIDRGRLALDGSLVD

SEQ ID NO: 1330734 - protein, 19 aa, Mycobacterium
WQASYLHNGAVYKALATFP

SEQ ID NO: 1330735 - protein, 25 aa, Mycobacterium
WQETRIPLLEQLLDTRRPKDIRRGA

SEQ ID NO: 1330736 - protein, 19 aa, Mycobacterium
WQFVNFEGEWFCTLTPAYF

SEQ ID NO: 1330737 - protein, 25 aa, Mycobacterium
WQNWEEMFSIARFIGVSRPGYELDG

SEQ ID NO: 1330738 - protein, 18 aa, Mycobacterium
WQPQHRLNATPQALLAAG

SEQ ID NO: 1330739 - protein, 25 aa, Mycobacterium
WQRRRALVGSRIRALRLERGLSQES

SEQ ID NO: 1330740 - protein, 18 aa, Mycobacterium
WQTAVVYQVYIRSFADGN

SEQ ID NO: 1330741 - protein, 17 aa, Mycobacterium
WQTQIAVQRRDSRSPAT

SEQ ID NO: 1330742 - protein, 24 aa, Mycobacterium
WQVPALREELLTALIKSLPKDLRR

SEQ ID NO: 1330743 - protein, 18 aa, Mycobacterium
WQVRRPGPMATKPLVRAT

SEQ ID NO: 1330744 - protein, 27 aa, Mycobacterium
WQWHARPGAMRRLVPPWQPMSVVSEAE

SEQ ID NO: 1330745 - protein, 18 aa, Mycobacterium
WRAAFDHEDICVAIIKHA

SEQ ID NO: 1330746 - protein, 17 aa, Mycobacterium
WRAFSRTGTPGDAWAPY

SEQ ID NO: 1330747 - protein, 18 aa, Mycobacterium
WREISTGLFGQFLAYLRT

SEQ ID NO: 1330748 - protein, 19 aa, Mycobacterium
WRFVHAERARLADDLAGLP

SEQ ID NO: 1330749 - protein, 18 aa, Mycobacterium
WRFVVTAHHILIDGWSLP

SEQ ID NO: 1330750 - protein, 19 aa, Mycobacterium
WRGDPPRADWAQPPVSMPV

SEQ ID NO: 1330751 - protein, 22 aa, Mycobacterium
WRGPIQQRFLRSRANTIEGGTS

SEQ ID NO: 1330752 - protein, 17 aa, Mycobacterium
WRGRRAAHKVSEAVAAA

SEQ ID NO: 1330753 - protein, 30 aa, Mycobacterium
WRHDLSLRHAEILCALAFSPQGRSAPQLAE

SEQ ID NO: 1330754 - protein, 17 aa, Mycobacterium
WRHLDTFARRYPSTRVE

SEQ ID NO: 1330755 - protein, 17 aa, Mycobacterium
WRICSQQGLWSVFGKKR

SEQ ID NO: 1330756 - protein, 19 aa, Mycobacterium
WRIDQPAASLWYHPHPHGA

SEQ ID NO: 1330757 - protein, 41 aa, Mycobacterium
WRKQTWIGRFVSTYGWRAYALPLLVALTAVVIFQTITGTSA

SEQ ID NO: 1330758 - protein, 17 aa, Mycobacterium
WRLARPDDWARHNWIPF

SEQ ID NO: 1330759 - protein, 17 aa, Mycobacterium
WRPAFTPADPERFTAML

SEQ ID NO: 1330760 - protein, 19 aa, Mycobacterium
WRPAHIHFSFFGTEFTQRM

SEQ ID NO: 1330761 - protein, 17 aa, Mycobacterium
WRPDIVHAHDWLVATPA

SEQ ID NO: 1330762 - protein, 18 aa, Mycobacterium
WRPTWRIDQPAASLWYHP

SEQ ID NO: 1330763 - protein, 19 aa, Mycobacterium
WRRAVVEETGLPFSRVRVL

SEQ ID NO: 1330764 - protein, 17 aa, Mycobacterium
WRRDLIAEGVTILQAAL

SEQ ID NO: 1330765 - protein, 18 aa, Mycobacterium
WRRLGHDASLAHGPFPVA

SEQ ID NO: 1330766 - protein, 17 aa, Mycobacterium
WRRTFAVNIDSFFHVTK

SEQ ID NO: 1330767 - protein, 21 aa, Mycobacterium
WRVDVLHDDTCPWFSAYEARH

SEQ ID NO: 1330768 - protein, 20 aa, Mycobacterium
WRWTVYPRSAAAGLVMPAFA

SEQ ID NO: 1330769 - protein, 19 aa, Mycobacterium
WRWVSEGAVVSLFLDDARA

SEQ ID NO: 1330770 - protein, 28 aa, Mycobacterium
WSDISDLFAGLPAWANLRPVLGGHPIKV

SEQ ID NO: 1330771 - protein, 30 aa, Mycobacterium
WSDISDLFAGLPAWANLRPVLGGHPIKVEE

SEQ ID NO: 1330772 - protein, 17 aa, Mycobacterium
WSDLLALVGIKSGSYGP

SEQ ID NO: 1330773 - protein, 18 aa, Mycobacterium
WSNGQIYPGAVLYQRIID

SEQ ID NO: 1330774 - protein, 17 aa, Mycobacterium
WSPDAMVWPLLDVIDGC

SEQ ID NO: 1330775 - protein, 25 aa, Mycobacterium
WSPEAKIVAERRLWLAVLKAQAELG

SEQ ID NO: 1330776 - protein, 24 aa, Mycobacterium
WSPKRLPDSLLHFMRTRGKNKVIF

SEQ ID NO: 1330777 - protein, 19 aa, Mycobacterium
WSRFSVDLIPAMGRAIFSR

SEQ ID NO: 1330778 - protein, 18 aa, Mycobacterium
WSRGFQATVLYLNERRFA

SEQ ID NO: 1330779 - protein, 17 aa, Mycobacterium
WSRVLRDGLRELPDLRA

SEQ ID NO: 1330780 - protein, 21 aa, Mycobacterium
WSSAPNFAFDLAARKTTDADL

SEQ ID NO: 1330781 - protein, 19 aa, Mycobacterium
WSTALLPRIAPTARDGDTP

SEQ ID NO: 1330782 - protein, 29 aa, Mycobacterium
WSVEDLAGFWGALWEYFDLGTAPAEVLAD

SEQ ID NO: 1330783 - protein, 17 aa, Mycobacterium
WSWEYRARPTWEAAFDA

SEQ ID NO: 1330784 - protein, 17 aa, Mycobacterium
WTATLIEGVENGRAALM

SEQ ID NO: 1330785 - protein, 23 aa, Mycobacterium
WTDDGYLMVTGRAKDIIIRNGEN

SEQ ID NO: 1330786 - protein, 18 aa, Mycobacterium
WTDIVSRVFGRIDPLASG

SEQ ID NO: 1330787 - protein, 18 aa, Mycobacterium
WTDSHLHRFSLGGGAFDR

SEQ ID NO: 1330788 - protein, 18 aa, Mycobacterium
WTEAAMFRGFEIILQGKD

SEQ ID NO: 1330789 - protein, 17 aa, Mycobacterium
WTLAVDPTATLPGVGAA

SEQ ID NO: 1330790 - protein, 17 aa, Mycobacterium
WTLVRHPVKSREFPAKA

SEQ ID NO: 1330791 - protein, 20 aa, Mycobacterium
WTNATAPAWARPLITVNPVL

SEQ ID NO: 1330792 - protein, 19 aa, Mycobacterium
WTQPVLWAADLTGDGPCGE

SEQ ID NO: 1330793 - protein, 17 aa, Mycobacterium
WTSFAQYSHRCILLTRT

SEQ ID NO: 1330794 - protein, 18 aa, Mycobacterium
WTSLAHLCEWGLATVRTD

SEQ ID NO: 1330795 - protein, 18 aa, Mycobacterium
WTTPFNRDGIPEKAFLAV

SEQ ID NO: 1330796 - protein, 19 aa, Mycobacterium
WVAHVPMDGFHLADDQLRR

SEQ ID NO: 1330797 - protein, 22 aa, Mycobacterium
WVAMASEYRALAGLPGVEEARI

SEQ ID NO: 1330798 - protein, 30 aa, Mycobacterium
WVDAGFAWDYYDMNAIPWSQLRVLAPTSVS

SEQ ID NO: 1330799 - protein, 35 aa, Mycobacterium
WVDNMHDWCISRQLWWGHRIPIWHGPNGETVCVGP

SEQ ID NO: 1330800 - protein, 25 aa, Mycobacterium
WVDSLRAALPERAAILAGISSTATV

SEQ ID NO: 1330801 - protein, 20 aa, Mycobacterium
WVDVVFGTHNIGSLPALLDR

SEQ ID NO: 1330802 - protein, 17 aa, Mycobacterium
WVEADGVRPARKIAAIG

SEQ ID NO: 1330803 - protein, 17 aa, Mycobacterium
WVFLGHESELAKSGDFV

SEQ ID NO: 1330804 - protein, 19 aa, Mycobacterium
WVGLGAEFGAALRDWSRQV

SEQ ID NO: 1330805 - protein, 31 aa, Mycobacterium
WVHGRVQGVGFRWWTRSRALELGLTGFAANK

SEQ ID NO: 1330806 - protein, 17 aa, Mycobacterium
WVLASDLKRFDEWLTIF

SEQ ID NO: 1330807 - protein, 27 aa, Mycobacterium
WVNVGMGALLRRIYRRRRSRIGGFRAV

SEQ ID NO: 1330808 - protein, 21 aa, Mycobacterium
WVPQVWRDMDTTLAAAPLGHP

SEQ ID NO: 1330809 - protein, 27 aa, Mycobacterium
WVRDSTFALWGLYTLGLDREDDDFFAF

SEQ ID NO: 1330810 - protein, 22 aa, Mycobacterium
WVRKNVLPKLPSPASPLWRSRR

SEQ ID NO: 1330811 - protein, 26 aa, Mycobacterium
WVRTDDQWTWLVHTLTVEKVRELLPE

SEQ ID NO: 1330812 - protein, 23 aa, Mycobacterium
WVRTDSFVDPFPLYNADGTRNLR

SEQ ID NO: 1330813 - protein, 23 aa, Mycobacterium
WVTGMSYGVIAPLLHGVTSIVDE

SEQ ID NO: 1330814 - protein, 17 aa, Mycobacterium
WVTLLRSAGAHDTYLRT

SEQ ID NO: 1330815 - protein, 25 aa, Mycobacterium
WVVEARPDLLERALCARPALLSVSF

SEQ ID NO: 1330816 - protein, 17 aa, Mycobacterium
WVVPGADHYVQCDAPGQ

SEQ ID NO: 1330817 - protein, 25 aa, Mycobacterium
WVVTPDGRFTIAAYAAPKSAGLWRE

SEQ ID NO: 1330818 - protein, 19 aa, Mycobacterium
WWCRTLVLAAERTARREGI

SEQ ID NO: 1330819 - protein, 19 aa, Mycobacterium
WWFDDTHIHGPDGLTLPMT

SEQ ID NO: 1330820 - protein, 19 aa, Mycobacterium
WWGHAVVPSWYTEASLVLD

SEQ ID NO: 1330821 - protein, 18 aa, Mycobacterium
WWLGAEQDSPRRLPSEKF

SEQ ID NO: 1330822 - protein, 17 aa, Mycobacterium
WWQQQVVAGLKRVGAEP

SEQ ID NO: 1330823 - protein, 18 aa, Mycobacterium
WWVRAHLTTKLDGPGLSL

SEQ ID NO: 1330824 - protein, 17 aa, Mycobacterium
WYAAVGTLPARSGAASA

SEQ ID NO: 1330825 - protein, 17 aa, Mycobacterium
WYCSGLVRQFNIGAVVI

SEQ ID NO: 1330826 - protein, 17 aa, Mycobacterium
WYELWNDQDKQGWLRHW

SEQ ID NO: 1330827 - protein, 19 aa, Mycobacterium
WYRAMLWDRYHQVPDHVPA

SEQ ID NO: 1330828 - protein, 19 aa, Mycobacterium
WYRILQSQQVTVWYTAPTA

SEQ ID NO: 1330829 - protein, 18 aa, Mycobacterium
WYWSGDLGYLDGAGFLYF

SEQ ID NO: 1330830 - protein, 27 aa, Mycobacterium
YAADTRWLTDDFIPTVARRGTAIIEAR

SEQ ID NO: 1330831 - protein, 24 aa, Mycobacterium
YAAELSALGLPKRALVSSSAANVD

SEQ ID NO: 1330832 - protein, 21 aa, Mycobacterium
YAAFDEVHWVAPAEAVWACRT

SEQ ID NO: 1330833 - protein, 17 aa, Mycobacterium
YAAFNTAYAAWFPDRLP

SEQ ID NO: 1330834 - protein, 19 aa, Mycobacterium
YAAGLAVGFWDGADDLRRN

SEQ ID NO: 1330835 - protein, 29 aa, Mycobacterium
YAAGLPTAAILLGLLRDGEPVAGLTWLPF

SEQ ID NO: 1330836 - protein, 23 aa, Mycobacterium
YAAKTLDLCIPEDPVCSPTGRDN

SEQ ID NO: 1330837 - protein, 17 aa, Mycobacterium
YAALGMQTEVYPKAIKL

SEQ ID NO: 1330838 - protein, 24 aa, Mycobacterium
YAASLSGFLNLSEGWWPMLVGISM

SEQ ID NO: 1330839 - protein, 27 aa, Mycobacterium
YAATGFTPLYPSWPLAPEAFEEAPSYT

SEQ ID NO: 1330840 - protein, 21 aa, Mycobacterium
YADDLPYWVRVHDTEHLVVPY

SEQ ID NO: 1330841 - protein, 24 aa, Mycobacterium
YADGRLRFMVGPSAPQRCSPELMV

SEQ ID NO: 1330842 - protein, 36 aa, Mycobacterium
YADHLIEIPAVSTLFQPLLSTIPMQLFSAGVAQARG

SEQ ID NO: 1330843 - protein, 21 aa, Mycobacterium
YADLLQAGRFTDDLISAGCEC

SEQ ID NO: 1330844 - protein, 19 aa, Mycobacterium
YADQPYWGRPAPGFGSPRP

SEQ ID NO: 1330845 - protein, 20 aa, Mycobacterium
YADSIEWMSRNLARRGSIIL

SEQ ID NO: 1330846 - protein, 32 aa, Mycobacterium
YAEELRRRWGGLLSYRYIGRLYASMDPRAVDD

SEQ ID NO: 1330847 - protein, 29 aa, Mycobacterium
YAEELRRRWGGLLSYRYIGRSYAQMDLGP

SEQ ID NO: 1330848 - protein, 25 aa, Mycobacterium
YAGAVVHQTPLPTPGWMVLQQAALC

SEQ ID NO: 1330849 - protein, 27 aa, Mycobacterium
YAGDQPWESIYGLPLRLASDARRFDVS

SEQ ID NO: 1330850 - protein, 26 aa, Mycobacterium
YAGLTVTLWIHLTSIHILLADEVIKT

SEQ ID NO: 1330851 - protein, 32 aa, Mycobacterium
YAGMAGHLAALLYGVPHVLTAHSLEPMRPWKA

SEQ ID NO: 1330852 - protein, 21 aa, Mycobacterium
YAGVLLTGLSDWLARKNFHAL

SEQ ID NO: 1330853 - protein, 25 aa, Mycobacterium
YAISKSFVRWYSSSQAERFNGRGLR

SEQ ID NO: 1330854 - protein, 27 aa, Mycobacterium
YAKGFKFSTYATWWIRQAITRGMADQS

SEQ ID NO: 1330855 - protein, 20 aa, Mycobacterium
YALANDERFGIWGGLSERER

SEQ ID NO: 1330856 - protein, 20 aa, Mycobacterium
YALAPRRRFPAAPQQIYDIV

SEQ ID NO: 1330857 - protein, 17 aa, Mycobacterium
YALEALLARGTALIDEA

SEQ ID NO: 1330858 - protein, 19 aa, Mycobacterium
YALRAIIQLDTDAGLVGLG

SEQ ID NO: 1330859 - protein, 17 aa, Mycobacterium
YALWPHMDVSKNVAFGL

SEQ ID NO: 1330860 - protein, 29 aa, Mycobacterium
YANFAVAEPPLKLVLLQNPGKGGTINHLG

SEQ ID NO: 1330861 - protein, 24 aa, Mycobacterium
YAPDIQLFLSFLSVQGIDWRTATF

SEQ ID NO: 1330862 - protein, 17 aa, Mycobacterium
YAPIPVVEVILPAVRRA

SEQ ID NO: 1330863 - protein, 22 aa, Mycobacterium
YAPMAELLRYLEGHGFTNYIAS

SEQ ID NO: 1330864 - protein, 25 aa, Mycobacterium
YAPQLDVPVFLAFGAALDVSPNPHA

SEQ ID NO: 1330865 - protein, 19 aa, Mycobacterium
YAPYGIRVNALAPGPVDTD

SEQ ID NO: 1330866 - protein, 17 aa, Mycobacterium
YAQSARQLGPLATFLVV

SEQ ID NO: 1330867 - protein, 28 aa, Mycobacterium
YAQSAVKPWLVTVAKLLGRIAPGAPVEQ

SEQ ID NO: 1330868 - protein, 28 aa, Mycobacterium
YAQWPIDRRLDAFLLHRGHRRLHDDGSA

SEQ ID NO: 1330869 - protein, 27 aa, Mycobacterium
YARFGWAAARFDDLLNLAPARLTGVLA

SEQ ID NO: 1330870 - protein, 21 aa, Mycobacterium
YARFLDITDDDFRHTFDWCVT

SEQ ID NO: 1330871 - protein, 18 aa, Mycobacterium
YARIIADEAMRRGIWVEV

SEQ ID NO: 1330872 - protein, 20 aa, Mycobacterium
YARPGLRETGFWRFVSDPGD

SEQ ID NO: 1330873 - protein, 23 aa, Mycobacterium
YARPLEMAVLPTPERIRAAIIEM

SEQ ID NO: 1330874 - protein, 20 aa, Mycobacterium
YARRREVLLPALKAAGYTVD

SEQ ID NO: 1330875 - protein, 19 aa, Mycobacterium
YARTFLRQLEECLGLAKDR

SEQ ID NO: 1330876 - protein, 21 aa, Mycobacterium
YASHPADFLEYVNAPVGAGAA

SEQ ID NO: 1330877 - protein, 21 aa, Mycobacterium
YASMKAALHRFTQGVAAELLD

SEQ ID NO: 1330878 - protein, 24 aa, Mycobacterium
YASPAVLLTMGTWFSDKYAEGTVG

SEQ ID NO: 1330879 - protein, 28 aa, Mycobacterium
YATESCRTFALWAVGLMYSAAGDRHVVA

SEQ ID NO: 1330880 - protein, 31 aa, Mycobacterium; identical to SEQ ID NO: 118618

SEQ ID NO: 1330881 - protein, 23 aa, Mycobacterium
YATRRPIAPLTDRIPDLTVAEGF

SEQ ID NO: 1330882 - protein, 27 aa, Mycobacterium
YAVAGGLELALWCDLRIVEQDAVMGVF

SEQ ID NO: 1330883 - protein, 18 aa, Mycobacterium
YAVAPLAALATVMPMMPA

SEQ ID NO: 1330884 - protein, 26 aa, Mycobacterium
YAVDEARALALWDLSERLCTRSSPSL

SEQ ID NO: 1330885 - protein, 17 aa, Mycobacterium
YAVLQRAQRVAVDMVRP

SEQ ID NO: 1330886 - protein, 21 aa, Mycobacterium
YAVRRLFALTDQLGAAATLGD

SEQ ID NO: 1330887 - protein, 18 aa, Mycobacterium
YAWLRAFDAESVPVDSWR

SEQ ID NO: 1330888 - protein, 29 aa, Mycobacterium
YCCMPLFHGNAIMALWAPALANGATVCLT

SEQ ID NO: 1330889 - protein, 17 aa, Mycobacterium
YCDCAVLRDSPLEPGIL

SEQ ID NO: 1330890 - protein, 20 aa, Mycobacterium
YCHCMFTALDTLPAQRYTPW

SEQ ID NO: 1330891 - protein, 25 aa, Mycobacterium
YCLQGMQHWLANWQLRAVEAATMRT

SEQ ID NO: 1330892 - protein, 18 aa, Mycobacterium
YCQRYRPAARRPQPVDTG

SEQ ID NO: 1330893 - protein, 20 aa, Mycobacterium
YCVVDARAWLRDPAPLFRTN

SEQ ID NO: 1330894 - protein, 24 aa, Mycobacterium
YDAGLAWVHFPEGLGGLGVSRGLQ

SEQ ID NO: 1330895 - protein, 18 aa, Mycobacterium
YDARQRAAAERLAQIRES

SEQ ID NO: 1330896 - protein, 25 aa, Mycobacterium
YDDEQYLFQALRVGASGYLLKSISS

SEQ ID NO: 1330897 - protein, 20 aa, Mycobacterium
YDEALWKMLCEQVGAAALVV

SEQ ID NO: 1330898 - protein, 26 aa, Mycobacterium
YDELRLDFHMSYDAAPLGRICLCRVH

SEQ ID NO: 1330899 - protein, 25 aa, Mycobacterium
YDGALLLVTHDRRMLQNVRLDRSWR

SEQ ID NO: 1330900 - protein, 23 aa, Mycobacterium
YDGDRLLAILHRGDEEGSVVLTG

SEQ ID NO: 1330901 - protein, 19 aa, Mycobacterium
YDGRTWYRTGDLVRYRPGG

SEQ ID NO: 1330902 - protein, 27 aa, Mycobacterium
YDIKKWINWAIRFFYSSPAYSQIYSEL

SEQ ID NO: 1330903 - protein, 25 aa, Mycobacterium
YDKISQLKPVFRPNGTITAGNACPL

SEQ ID NO: 1330904 - protein, 23 aa, Mycobacterium
YDLARMYNFQCWIYGADPAGNAF

SEQ ID NO: 1330905 - protein, 21 aa, Mycobacterium
YDMTAFWCRAGTAATITPPGT

SEQ ID NO: 1330906 - protein, 17 aa, Mycobacterium
YDNFGSGDPVVVKNSIG

SEQ ID NO: 1330907 - protein, 19 aa, Mycobacterium
YDNPWLYDNYDPHPPIPEA

SEQ ID NO: 1330908 - protein, 26 aa, Mycobacterium
YDPDIAVRLIVWFPDDEHAVIALFAG

SEQ ID NO: 1330909 - protein, 20 aa, Mycobacterium
YDPIWPRHGIRILPGPSSLW

SEQ ID NO: 1330910 - protein, 20 aa, Mycobacterium
YDQRRAVSWPAQARPYTGAA

SEQ ID NO: 1330911 - protein, 27 aa, Mycobacterium
YDRDSAVMYLIYPYDTPGRMDVTNDPN

SEQ ID NO: 1330912 - protein, 18 aa, Mycobacterium
YDRPVEWWHGYLRAQLAG

SEQ ID NO: 1330913 - protein, 17 aa, Mycobacterium
YDRRLVDAARARKLPVV

SEQ ID NO: 1330914 - protein, 17 aa, Mycobacterium
YDRTAITRLHFIRAGQA

SEQ ID NO: 1330915 - protein, 21 aa, Mycobacterium
YDRVKPVFKQWASMVVRAGEP

SEQ ID NO: 1330916 - protein, 29 aa, Mycobacterium
YDSTLDVPIIFRAPFVHALVMSWTGRLEQ

SEQ ID NO: 1330917 - protein, 28 aa, Mycobacterium
YDTGLYLRFRATTRDDFALAYAVRLCDT

SEQ ID NO: 1330918 - protein, 30 aa, Mycobacterium; identical to SEQ ID NO: 878393

SEQ ID NO: 1330919 - protein, 18 aa, Mycobacterium
YDVLMGVFLRTFGFTSES

SEQ ID NO: 1330920 - protein, 19 aa, Mycobacterium
YDVVLLDRYVASNAAYSAA

SEQ ID NO: 1330921 - protein, 17 aa, Mycobacterium
YDYANFAHPFREGNGRS

SEQ ID NO: 1330922 - protein, 36 aa, Mycobacterium
YEALTPQQRDVLAAAPPPPPVPAAAPVPPPPGQDPA

SEQ ID NO: 1330923 - protein, 36 aa, Mycobacterium
YEALTPRQREALAALPPAPAVPAPAAAPPANDPGVL

SEQ ID NO: 1330924 - protein, 18 aa, Mycobacterium
YEDGAWISLVSPVADLPL

SEQ ID NO: 1330925 - protein, 26 aa, Mycobacterium
YEDPDAEVPLPFRARAIAGLIDSWTG

SEQ ID NO: 1330926 - protein, 23 aa, Mycobacterium
YEDRFGYVYLVCASGRSADELLD

SEQ ID NO: 1330927 - protein, 31 aa, Mycobacterium; identical to SEQ ID NO: 878425

SEQ ID NO: 1330928 - protein, 33 aa, Mycobacterium
YEDRSFTFALKTPPAAKLLLKAAGVPKGSGEPH

SEQ ID NO: 1330929 - protein, 18 aa, Mycobacterium
YEFLRIDRRDWLTHMGYT

SEQ ID NO: 1330930 - protein, 21 aa, Mycobacterium
YEGLMVWFNTLLESAGGQVLS

SEQ ID NO: 1330931 - protein, 28 aa, Mycobacterium
YEHFPPSNFAPIVRLCRSRLVGAALMRL

SEQ ID NO: 1330932 - protein, 17 aa, Mycobacterium
YELSVDLIIPMIGLLKR

SEQ ID NO: 1330933 - protein, 25 aa, Mycobacterium
YEMPPPGQGLAVLQALRLYQRFAPD

SEQ ID NO: 1330934 - protein, 20 aa, Mycobacterium
YEPFFRDSWQHVRAGARADQ

SEQ ID NO: 1330935 - protein, 18 aa, Mycobacterium
YEPVGVVGAITPWNVPFY

SEQ ID NO: 1330936 - protein, 28 aa, Mycobacterium
YEQIIARLIEWVAFTPLQNATGEPAISL

SEQ ID NO: 1330937 - protein, 18 aa, Mycobacterium
YEQVMLLRAAVGMAAPQA

SEQ ID NO: 1330938 - protein, 23 aa, Mycobacterium
YESPEVLAWRDRTLPCRKWFDDH

SEQ ID NO: 1330939 - protein, 18 aa, Mycobacterium
YESTWQWSRGFQATVLYL

SEQ ID NO: 1330940 - protein, 26 aa, Mycobacterium
YETAGITDFIVLVGYKGYMIKEYFMN

SEQ ID NO: 1330941 - protein, 17 aa, Mycobacterium
YETAWTDGMRAKLGVPG

SEQ ID NO: 1330942 - protein, 19 aa, Mycobacterium
YEVARMLTDPAFLASVRAQ

SEQ ID NO: 1330943 - protein, 29 aa, Mycobacterium
YEVNEAFAPVPLAWLADTGADAAKLNPLG

SEQ ID NO: 1330944 - protein, 22 aa, Mycobacterium
YEVPARVLVVDALPRGAALKVD

SEQ ID NO: 1330945 - protein, 23 aa, Mycobacterium
YEVVDLLTLLVDKSLLIAENTAG

SEQ ID NO: 1330946 - protein, 18 aa, Mycobacterium
YEWALAVASAPDLIRGYE

SEQ ID NO: 1330947 - protein, 18 aa, Mycobacterium
YFALTEAVSVLQYAVQEQ

SEQ ID NO: 1330948 - protein, 17 aa, Mycobacterium
YFDDLFLMSAQKRLMSV

SEQ ID NO: 1330949 - protein, 22 aa, Mycobacterium
YFDQRVSWAGSLRPRLFSMAEP

SEQ ID NO: 1330950 - protein, 23 aa, Mycobacterium
YFGPSFMINWLHNKYGDFKAESI

SEQ ID NO: 1330951 - protein, 24 aa, Mycobacterium
YFHRQVYANYWYEDLQPWHVAAIG

SEQ ID NO: 1330952 - protein, 19 aa, Mycobacterium
YFIHLRSDGAHRLQADALE

SEQ ID NO: 1330953 - protein, 17 aa, Mycobacterium
YFKRLTALQFEFGSTDH

SEQ ID NO: 1330954 - protein, 17 aa, Mycobacterium
YFPKLGKDGTKGKLFEY

SEQ ID NO: 1330955 - protein, 17 aa, Mycobacterium
YFPRFRALCMAENATHN

SEQ ID NO: 1330956 - protein, 24 aa, Mycobacterium
YFVGGYADYFVLPAGAVVYTVPDA

SEQ ID NO: 1330957 - protein, 17 aa, Mycobacterium
YFVHTGEPDYMVEFTIA

SEQ ID NO: 1330958 - protein, 20 aa, Mycobacterium
YFYGPGAINCLATRGFPTTG

SEQ ID NO: 1330959 - protein, 32 aa, Mycobacterium
YGARNAALVDPFGHRWMLTGPVTGAAVPIQHG

SEQ ID NO: 1330960 - protein, 29 aa, Mycobacterium
YGASAVPLEWRTLLHGWPGVRARELVKLS

SEQ ID NO: 1330961 - protein, 26 aa, Mycobacterium
YGATKAALLALTKYTATQYGRERVRC

SEQ ID NO: 1330962 - protein, 27 aa, Mycobacterium
YGATVAHGFLTLSLIPALSKDNYRVED

SEQ ID NO: 1330963 - protein, 24 aa, Mycobacterium
YGAVEVWPMVHWNAPDRPTTGNDW

SEQ ID NO: 1330964 - protein, 18 aa, Mycobacterium
YGDFGFIEMFEHGYRVLM

SEQ ID NO: 1330965 - protein, 24 aa, Mycobacterium
YGDLLRTYARVAGVWRAPVAVYGV

SEQ ID NO: 1330966 - protein, 33 aa, Mycobacterium
YGDPDRGWAWQVPLLELPDAQFLLMSATLGDVT

SEQ ID NO: 1330967 - protein, 24 aa, Mycobacterium
YGDPRLLHERGLIASLAAAWLDTP

SEQ ID NO: 1330968 - protein, 25 aa, Mycobacterium
YGEEQFMAWRRSYDTPPPPIEAGSE

SEQ ID NO: 1330969 - protein, 25 aa, Mycobacterium
YGETKLIGEWLLRDAGRASGLRHTS

SEQ ID NO: 1330970 - protein, 22 aa, Mycobacterium
YGGTPRPIRSLWGEVGFEELTD

SEQ ID NO: 1330971 - protein, 31 aa, Mycobacterium
YGGVKAFGRIFAEGLWLELRDHDVHVLELVL

SEQ ID NO: 1330972 - protein, 17 aa, Mycobacterium
YGGVLGYLDFAGNADFA

SEQ ID NO: 1330973 - protein, 18 aa, Mycobacterium
YGGVLGYLDFAGNADFAI

SEQ ID NO: 1330974 - protein, 30 aa, Mycobacterium; identical to SEQ ID NO: 878642

SEQ ID NO: 1330975 - protein, 24 aa, Mycobacterium
YGHNNPILKQPLLDYLSSDMIVHS

SEQ ID NO: 1330976 - protein, 29 aa, Mycobacterium
YGIRGMHLAYDLLGPWSALVLVDAVPDRG

SEQ ID NO: 1330977 - protein, 19 aa, Mycobacterium
YGKDFEHWSIHRKPPAFAD

SEQ ID NO: 1330978 - protein, 24 aa, Mycobacterium
YGKSWRTIAKLSLPDRFLTDTADD

SEQ ID NO: 1330979 - protein, 20 aa, Mycobacterium
YGLATAQRFHREGWNVVATM

SEQ ID NO: 1330980 - protein, 23 aa, Mycobacterium
YGLIVYQEQIMFIAQKVASYSMG

SEQ ID NO: 1330981 - protein, 21 aa, Mycobacterium
YGLIVYQEQIMFIAQKVASYT

SEQ ID NO: 1330982 - protein, 17 aa, Mycobacterium
YGLLDNARRSRLGLGVG

SEQ ID NO: 1330983 - protein, 33 aa, Mycobacterium
YGLLRPMVGEPLPGAPLALITPAGAEGGGGLGV

SEQ ID NO: 1330984 - protein, 22 aa, Mycobacterium
YGLVTQEVTRYLRACLGGAGVV

SEQ ID NO: 1330985 - protein, 20 aa, Mycobacterium
YGMICDASFPTYMLTHWVRD

SEQ ID NO: 1330986 - protein, 29 aa, Mycobacterium
YGPAMLDMRIRGVFAMPVLIAGEYVGALD

SEQ ID NO: 1330987 - protein, 17 aa, Mycobacterium
YGPLTELPFSHEIGEGT

SEQ ID NO: 1330988 - protein, 23 aa, Mycobacterium
YGQRLAAFVVLRDGASATPEDLK

SEQ ID NO: 1330989 - protein, 19 aa, Mycobacterium
YGRIWATWPTNGESARPLM

SEQ ID NO: 1330990 - protein, 28 aa, Mycobacterium
YGSASILPITWAYIRMMGAQGLRSASLV

SEQ ID NO: 1330991 - protein, 18 aa, Mycobacterium
YGSLYPALRRMQADGLIV

SEQ ID NO: 1330992 - protein, 18 aa, Mycobacterium
YGTFKLARQIAPSADLLV

SEQ ID NO: 1330993 - protein, 17 aa, Mycobacterium
YGVFVVPPGARWKFLAE

SEQ ID NO: 1330994 - protein, 23 aa, Mycobacterium
YGVPTMFIAMLGHPDFPGTDLSS

SEQ ID NO: 1330995 - protein, 20 aa, Mycobacterium
YGYLNDDVTRRRASIGLSLE

SEQ ID NO: 1330996 - protein, 20 aa, Mycobacterium
YHAIKRSLPLLTPGATAVAI

SEQ ID NO: 1330997 - protein, 19 aa, Mycobacterium
YHALWQWSVDDVEAFWGAL

SEQ ID NO: 1330998 - protein, 25 aa, Mycobacterium
YHDDVALLLYRQPAPLDLEFAADVA

SEQ ID NO: 1330999 - protein, 19 aa, Mycobacterium
YHDPDLPPSHHYLAAYRWL

SEQ ID NO: 1331000 - protein, 18 aa, Mycobacterium
YHFLAGRGADGELPPNDW

SEQ ID NO: 1331001 - protein, 17 aa, Mycobacterium
YHLYLQPGADVVDEAGG

SEQ ID NO: 1331002 - protein, 19 aa, Mycobacterium
YHMGLQFDLAKDGELYMIS

SEQ ID NO: 1331003 - protein, 21 aa, Mycobacterium
YHQLMTVAVGHGLHAAPWADD

SEQ ID NO: 1331004 - protein, 17 aa, Mycobacterium
YHRDGLAARLPRMLGTQ

SEQ ID NO: 1331005 - protein, 23 aa, Mycobacterium
YHSAELVHRLDCAQLPAGLLDGL

SEQ ID NO: 1331006 - protein, 20 aa, Mycobacterium
YHTFGGWKRSGFGDLNQHGP

SEQ ID NO: 1331007 - protein, 17 aa, Mycobacterium
YHTIIPAMLGGPDGFRG

SEQ ID NO: 1331008 - protein, 28 aa, Mycobacterium
YIDYSDFTVWVLRVRRVRWVGGYGRMDS

SEQ ID NO: 1331009 - protein, 29 aa, Mycobacterium
YIDYSDFTVWVLRVRRVRWVGGYGRMDSC

SEQ ID NO: 1331010 - protein, 24 aa, Mycobacterium
YIECAQACGLTLLGGPPTVRTALD

SEQ ID NO: 1331011 - protein, 19 aa, Mycobacterium
YIELFYGRPLNQSSWELVT

SEQ ID NO: 1331012 - protein, 29 aa, Mycobacterium
YIGQTRGWFYTLHILATALFDRPAFRTCV

SEQ ID NO: 1331013 - protein, 17 aa, Mycobacterium
YIHGGLPTGFKNVFEGH

SEQ ID NO: 1331014 - protein, 20 aa, Mycobacterium
YIHRLRKYVGAYLATLGSVD

SEQ ID NO: 1331015 - protein, 20 aa, Mycobacterium
YIKEDVAIRKLLATGLERAG

SEQ ID NO: 1331016 - protein, 26 aa, Mycobacterium
YINHITPIKFPLFVEPGLGAQERWFR

SEQ ID NO: 1331017 - protein, 19 aa, Mycobacterium
YIPKHLNFTQLTPHAGPGA

SEQ ID NO: 1331018 - protein, 22 aa, Mycobacterium
YIQSLDWRWLNDILHSAQAECW

SEQ ID NO: 1331019 - protein, 21 aa, Mycobacterium
YIQVLQLLWDSWEDDARVADA

SEQ ID NO: 1331020 - protein, 17 aa, Mycobacterium
YIRRTIAFQRALDVGAR

SEQ ID NO: 1331021 - protein, 17 aa, Mycobacterium
YISGAPQLWVVGTRPFG

SEQ ID NO: 1331022 - protein, 31 aa, Mycobacterium
YITGQTLLVDGGLNLKWSHLAADNTSLFLKD

SEQ ID NO: 1331023 - protein, 27 aa, Mycobacterium
YITTPGSALLFPGLCAPTTPAAAAPTT

SEQ ID NO: 1331024 - protein, 19 aa, Mycobacterium
YIVIFGADHVYRMDPEQMV

SEQ ID NO: 1331025 - protein, 25 aa, Mycobacterium
YKDLQYWTDLAKLLERGRFDGLFIA

SEQ ID NO: 1331026 - protein, 25 aa, Mycobacterium
YKDQGRPFLAFVYGIAAHKVADAHR

SEQ ID NO: 1331027 - protein, 17 aa, Mycobacterium
YKGFQRLARLRYVPLAG

SEQ ID NO: 1331028 - protein, 17 aa, Mycobacterium
YKGYWLPNSFDNHGPHQ

SEQ ID NO: 1331029 - protein, 20 aa, Mycobacterium
YKHGFGPFAPEVYRAPMAYP

SEQ ID NO: 1331030 - protein, 18 aa, Mycobacterium
YKLFKRYASHEGGIADTA

SEQ ID NO: 1331031 - protein, 17 aa, Mycobacterium
YKRLLRVVTWSPDAGHL

SEQ ID NO: 1331032 - protein, 21 aa, Mycobacterium
YKRLTLMLRDPDRLARLLLDE

SEQ ID NO: 1331033 - protein, 24 aa, Mycobacterium
YLAAKLMTIFVEHPVVFLGYSMTD

SEQ ID NO: 1331034 - protein, 17 aa, Mycobacterium
YLALLYTQSQEIDMDAT

SEQ ID NO: 1331035 - protein, 17 aa, Mycobacterium
YLALRQFPATTFAPAYV

SEQ ID NO: 1331036 - protein, 24 aa, Mycobacterium
YLAMIASALGIDLTAAAPATRWLA

SEQ ID NO: 1331037 - protein, 21 aa, Mycobacterium
YLAPRGLMHQWGKPKPTKLKA

SEQ ID NO: 1331038 - protein, 18 aa, Mycobacterium
YLAVFDDHTEEILYLGRA

SEQ ID NO: 1331039 - protein, 33 aa, Mycobacterium
YLDHDWLEELGEQLPVYRPPLDMARLFGEPAIG

SEQ ID NO: 1331040 - protein, 21 aa, Mycobacterium
YLDVVRGLILKNGWAVQYVES

SEQ ID NO: 1331041 - protein, 23 aa, Mycobacterium
YLEQVQWFRQVDDDSSFSLNLDT

SEQ ID NO: 1331042 - protein, 26 aa, Mycobacterium
YLFAHEKIDFLWVTGGPKIVALANAA

SEQ ID NO: 1331043 - protein, 17 aa, Mycobacterium
YLFLGLKNQYRGQRPRP

SEQ ID NO: 1331044 - protein, 17 aa, Mycobacterium
YLGADGVDKLIVLLRGL

SEQ ID NO: 1331045 - protein, 25 aa, Mycobacterium
YLGDVRALFDFLAERRPGTGLRGLT

SEQ ID NO: 1331046 - protein, 27 aa, Mycobacterium
YLGITVPMFPNLFLLYGPNTNVGSGSI

SEQ ID NO: 1331047 - protein, 24 aa, Mycobacterium
YLGKQLYIGFNFGESLVASLVFNG

SEQ ID NO: 1331048 - protein, 19 aa, Mycobacterium
YLHNGAVYKALATFPTKSS

SEQ ID NO: 1331049 - protein, 19 aa, Mycobacterium
YLIDQPLMRNVLADLAVEA

SEQ ID NO: 1331050 - protein, 20 aa, Mycobacterium
YLKGLAQQPAPPLAPMFTVP

SEQ ID NO: 1331051 - protein, 23 aa, Mycobacterium
YLKVRDRRRYAFALVSVAAVLRF

SEQ ID NO: 1331052 - protein, 31 aa, Mycobacterium
YLPARWRAPIEPESTWWTWRGRRVHIARAVR

SEQ ID NO: 1331053 - protein, 17 aa, Mycobacterium
YLPLANLTAFQVALLDE

SEQ ID NO: 1331054 - protein, 18 aa, Mycobacterium
YLPVLAIALRRIEAMAAV

SEQ ID NO: 1331055 - protein, 19 aa, Mycobacterium
YLQETMTFLCYTAEASVAL

SEQ ID NO: 1331056 - protein, 22 aa, Mycobacterium
YLQLTPHRDFIPFFNHPRADDT

SEQ ID NO: 1331057 - protein, 19 aa, Mycobacterium
YLQVWRNAAGYDPSVGSAL

SEQ ID NO: 1331058 - protein, 17 aa, Mycobacterium
YLRSLSKEQLDDIALYL

SEQ ID NO: 1331059 - protein, 25 aa, Mycobacterium
YLSDADVALLLRRLEHVPIATVVRL

SEQ ID NO: 1331060 - protein, 17 aa, Mycobacterium
YLSRWHRRRALWVGVAA

SEQ ID NO: 1331061 - protein, 18 aa, Mycobacterium
YLSRWHRRRALWVGVAAG

SEQ ID NO: 1331062 - protein, 18 aa, Mycobacterium
YLTEAMAIDRIAPELRKK

SEQ ID NO: 1331063 - protein, 24 aa, Mycobacterium
YLTFDLVHRLWRDSGHDVHYVQNI

SEQ ID NO: 1331064 - protein, 22 aa, Mycobacterium
YLTPQALIDLVASRSYCITSPE

SEQ ID NO: 1331065 - protein, 26 aa, Mycobacterium
YLVDGKPVILTPPKKAVPAAPTRTAS

SEQ ID NO: 1331066 - protein, 19 aa, Mycobacterium
YLVEQFLTQFYGDQAELGG

SEQ ID NO: 1331067 - protein, 20 aa, Mycobacterium
YLVRGRPDLARRGRGTPAIF

SEQ ID NO: 1331068 - protein, 19 aa, Mycobacterium
YMGYLVPLFEHDARSALPV

SEQ ID NO: 1331069 - protein, 21 aa, Mycobacterium
YMKLLAPKWQMMSDPQLTGYF

SEQ ID NO: 1331070 - protein, 30 aa, Mycobacterium
YMLLHSVACTGLMTWYPALEAVRQFGRVVV

SEQ ID NO: 1331071 - protein, 21 aa, Mycobacterium
YMRLKALLDGGELGQPLVMHC

SEQ ID NO: 1331072 - protein, 20 aa, Mycobacterium
YMRTLDPWVSLGTAAAVTSR

SEQ ID NO: 1331073 - protein, 17 aa, Mycobacterium
YMSTDLPGLQPFMPPYV

SEQ ID NO: 1331074 - protein, 20 aa, Mycobacterium
YNEAMVAQYAPRIAGRPAAS

SEQ ID NO: 1331075 - protein, 19 aa, Mycobacterium
YNEDGVWKSKVEGSGRAAH

SEQ ID NO: 1331076 - protein, 21 aa, Mycobacterium
YNGFFYKVMPPFCVGTSAQGV

SEQ ID NO: 1331077 - protein, 29 aa, Mycobacterium
YNHYPIGWAMAFNTPYKLFKRYASHEGGI

SEQ ID NO: 1331078 - protein, 17 aa, Mycobacterium
YNLQWKPVGGFPVTVGW

SEQ ID NO: 1331079 - protein, 31 aa, Mycobacterium
YNPVRLLRSLRAFRHNPLFSPAAIARFRSYT

SEQ ID NO: 1331080 - protein, 19 aa, Mycobacterium
YNRPKLPGIPGIKDFTGHV

SEQ ID NO: 1331081 - protein, 27 aa, Mycobacterium
YNRSPIELLALWRQTVAAGPLPITLQD

SEQ ID NO: 1331082 - protein, 24 aa, Mycobacterium
YNTRLEAHLISRLGVRFAEQSRGR

SEQ ID NO: 1331083 - protein, 23 aa, Mycobacterium
YNYRLELVPDYHPEPDPALAGVT

SEQ ID NO: 1331084 - protein, 22 aa, Mycobacterium
YPAVQYIPLRDVNDSALVCSDT

SEQ ID NO: 1331085 - protein, 23 aa, Mycobacterium
YPCDHFDVWPGHDWFDKTVSDQV

SEQ ID NO: 1331086 - protein, 25 aa, Mycobacterium
YPDEPEPFRLVPPADQWESDAASVA

SEQ ID NO: 1331087 - protein, 27 aa, Mycobacterium
YPDPRYRTKMMWWDRSTFIRHAEPAQV

SEQ ID NO: 1331088 - protein, 23 aa, Mycobacterium
YPDSLDTMGWRVGASGFQLILSP

SEQ ID NO: 1331089 - protein, 17 aa, Mycobacterium
YPDYFAVDREKIREFAR

SEQ ID NO: 1331090 - protein, 25 aa, Mycobacterium
YPEAWIEKMKQIGIFGLAIPESEGG

SEQ ID NO: 1331091 - protein, 19 aa, Mycobacterium
YPERLRGTTLSRLDATTVD

SEQ ID NO: 1331092 - protein, 20 aa, Mycobacterium
YPESVLARELEMCYAAIALV

SEQ ID NO: 1331093 - protein, 18 aa, Mycobacterium
YPFVLPPSVLEKMRFIHT

SEQ ID NO: 1331094 - protein, 18 aa, Mycobacterium
YPGDAGVLCSMLLNRLSL

SEQ ID NO: 1331095 - protein, 26 aa, Mycobacterium
YPGGVWYVDLAPITDPALVAITVARA

SEQ ID NO: 1331096 - protein, 18 aa, Mycobacterium
YPHVRWRTEAVGAVWDED

SEQ ID NO: 1331097 - protein, 22 aa, Mycobacterium
YPKRDGKLPPTSKLAPVLEAPE

SEQ ID NO: 1331098 - protein, 26 aa, Mycobacterium
YPLDRGAAGIALLASMPPRPGERDLV

SEQ ID NO: 1331099 - protein, 17 aa, Mycobacterium
YPLGGIPVEYHGAEIPP

SEQ ID NO: 1331100 - protein, 35 aa, Mycobacterium
YPLKEIRHWLQVFAQRFYSFSQFKRSALPNGPKVS

SEQ ID NO: 1331101 - protein, 21 aa, Mycobacterium
YPQLNPRYLFLGLKNQYRGQR

SEQ ID NO: 1331102 - protein, 20 aa, Mycobacterium
YPRLKVYRGPRRKGVRYFGP

SEQ ID NO: 1331103 - protein, 18 aa, Mycobacterium
YPRMTAPLLVINGDSDTL

SEQ ID NO: 1331104 - protein, 17 aa, Mycobacterium
YPSIEVFKKSGLGALPV

SEQ ID NO: 1331105 - protein, 20 aa, Mycobacterium
YPSQVFLTLFGLPLQDRERL

SEQ ID NO: 1331106 - protein, 18 aa, Mycobacterium
YPSVTSLFAFGGRCGLIC

SEQ ID NO: 1331107 - protein, 17 aa, Mycobacterium
YPVRALLECRCGIVRET

SEQ ID NO: 1331108 - protein, 19 aa, Mycobacterium
YPWPDHLPERVLTDGAGRA

SEQ ID NO: 1331109 - protein, 24 aa, Mycobacterium
YPWPRQEGRRKFGFYGDDMAAAQW

SEQ ID NO: 1331110 - protein, 29 aa, Mycobacterium
YQAETQMNLLFEPIPPMTPIVIPGVGEST

SEQ ID NO: 1331111 - protein, 19 aa, Mycobacterium
YQAGDPIYVVGFSQGANAA

SEQ ID NO: 1331112 - protein, 28 aa, Mycobacterium
YQDDVALLLYRHPAPLQLNFPADANHLA

SEQ ID NO: 1331113 - protein, 20 aa, Mycobacterium
YQDLARVPLWVEETLRFDTS

SEQ ID NO: 1331114 - protein, 17 aa, Mycobacterium
YQISPGTLYPTLHRLEA

SEQ ID NO: 1331115 - protein, 18 aa, Mycobacterium
YQLPILTALKENPRSRAL

SEQ ID NO: 1331116 - protein, 18 aa, Mycobacterium
YQLSFHEGSRYPLDRGAA

SEQ ID NO: 1331117 - protein, 17 aa, Mycobacterium
YQRFAPDSDHHLVESIK

SEQ ID NO: 1331118 - protein, 28 aa, Mycobacterium
YQRGTVIALTRLEFAILAALSESPGEPL

SEQ ID NO: 1331119 - protein, 45 aa, Mycobacterium
YQRTPIHVVPKFDFPIPVLLRRLFARVPLLQRAFRFTTDANLEVM

SEQ ID NO: 1331120 - protein, 22 aa, Mycobacterium
YQSPNPHIPFEKLRLKVVAEHT

SEQ ID NO: 1331121 - protein, 25 aa, Mycobacterium
YQTASLRVNFLRPFHGGGEGHYRAT

SEQ ID NO: 1331122 - protein, 22 aa, Mycobacterium
YQTHYDCVLAKLLTAAGRRDEA

SEQ ID NO: 1331123 - protein, 26 aa, Mycobacterium
YQYDGGFAEFMIVPRQVLKVDGLNRI

SEQ ID NO: 1331124 - protein, 22 aa, Mycobacterium
YRAERYLGIIDRVRAAIPHAAI

SEQ ID NO: 1331125 - protein, 27 aa, Mycobacterium
YRAGPGLDLLAFSVLRRLDVGDRARPV

SEQ ID NO: 1331126 - protein, 22 aa, Mycobacterium
YRAHADPVLVKQWLGPHGLEME

SEQ ID NO: 1331127 - protein, 18 aa, Mycobacterium
YRAHVRPWIYTWGARPDE

SEQ ID NO: 1331128 - protein, 18 aa, Mycobacterium
YRALAGLTIRGVDPRYLV

SEQ ID NO: 1331129 - protein, 25 aa, Mycobacterium
YRAVRLTHVLGDFDQILIGARLADG

SEQ ID NO: 1331130 - protein, 24 aa, Mycobacterium
YRDAGVLHVDWWFDGDRFDHATVQ

SEQ ID NO: 1331131 - protein, 21 aa, Mycobacterium
YRDIDVLLVDDIQFIEGKDGI

SEQ ID NO: 1331132 - protein, 19 aa, Mycobacterium
YRDPLLNDEVFTDDGWFRT

SEQ ID NO: 1331133 - protein, 19 aa, Mycobacterium
YRDWWTAHPEATLADVCFT

SEQ ID NO: 1331134 - protein, 22 aa, Mycobacterium
YRETGKFVLFEAPAIVLATGGI

SEQ ID NO: 1331135 - protein, 19 aa, Mycobacterium
YRFRARPFDLVSSPSVCEH

SEQ ID NO: 1331136 - protein, 18 aa, Mycobacterium
YRGAERRVPRLEPRPLPA

SEQ ID NO: 1331137 - protein, 28 aa, Mycobacterium
YRGCMRGRTLWVVPFCMGPLDADDPKLG

SEQ ID NO: 1331138 - protein, 34 aa, Mycobacterium; identical to SEQ ID NO: 224665

SEQ ID NO: 1331139 - protein, 19 aa, Mycobacterium
YRHVVATKDFHIDPGPHFS

SEQ ID NO: 1331140 - protein, 17 aa, Mycobacterium
YRIRGAVDLAALRGALD

SEQ ID NO: 1331141 - protein, 18 aa, Mycobacterium
YRKDGLSYVVQWNISPVR

SEQ ID NO: 1331142 - protein, 17 aa, Mycobacterium
YRLKTRFELVHRNVYAL

SEQ ID NO: 1331143 - protein, 18 aa, Mycobacterium
YRLPAGVMVIPGLVAVHA

SEQ ID NO: 1331144 - protein, 20 aa, Mycobacterium
YRMLPRATFCQPQVASFGLT

SEQ ID NO: 1331145 - protein, 18 aa, Mycobacterium
YRMRVAPSVFAHVWAALK

SEQ ID NO: 1331146 - protein, 21 aa, Mycobacterium
YRNDILRLEYIHSVGWVVVRV

SEQ ID NO: 1331147 - protein, 22 aa, Mycobacterium
YRNGVPFRRVNLTTGEHLDLYD

SEQ ID NO: 1331148 - protein, 26 aa, Mycobacterium
YRPNPGLARDLAFIGFSTISGELVAR

SEQ ID NO: 1331149 - protein, 20 aa, Mycobacterium
YRPQPVDLWFLETGGKRRTA

SEQ ID NO: 1331150 - protein, 21 aa, Mycobacterium
YRQCATVTSALWPTLTEPLRT

SEQ ID NO: 1331151 - protein, 18 aa, Mycobacterium
YRRDLPPETLAWLYESMV

SEQ ID NO: 1331152 - protein, 26 aa, Mycobacterium
YRRLAAHFFITFPQLDDVRFTHRWAG

SEQ ID NO: 1331153 - protein, 26 aa, Mycobacterium
YRRLAAHFFLTFPQLHDVRFDYRWAG

SEQ ID NO: 1331154 - protein, 17 aa, Mycobacterium
YRRLVNQGYIQAFAYTD

SEQ ID NO: 1331155 - protein, 19 aa, Mycobacterium
YRRPRKRWVLKGFHGFRLT

SEQ ID NO: 1331156 - protein, 24 aa, Mycobacterium
YRSNLRHVLLCTQRVARRLVEVGQ

SEQ ID NO: 1331157 - protein, 21 aa, Mycobacterium
YRSQVDLAQKHRIAAAATGLL

SEQ ID NO: 1331158 - protein, 20 aa, Mycobacterium
YRTPLLVFKTHDGYAILVGY

SEQ ID NO: 1331159 - protein, 19 aa, Mycobacterium
YRVLAPDMLGFGDSAKVVD

SEQ ID NO: 1331160 - protein, 17 aa, Mycobacterium
YRVLMAIELLRVVASGL

SEQ ID NO: 1331161 - protein, 19 aa, Mycobacterium
YRVQLPPPQYPTDPVCGIR

SEQ ID NO: 1331162 - protein, 17 aa, Mycobacterium
YSAALQRIHSRLIGLVE

SEQ ID NO: 1331163 - protein, 26 aa, Mycobacterium
YSAVLRSAALRVTRPRMAVLHAVGRH

SEQ ID NO: 1331164 - protein, 25 aa, Mycobacterium
YSEAIALSRLGWAALAVGTSHAVLD

SEQ ID NO: 1331165 - protein, 21 aa, Mycobacterium
YSEELFGPVAVVYRVRDEEEA

SEQ ID NO: 1331166 - protein, 25 aa, Mycobacterium
YSETAILAYAAKFASGFYGPFREAV

SEQ ID NO: 1331167 - protein, 21 aa, Mycobacterium
YSHIAWLRTIKEKISYKGMRD

SEQ ID NO: 1331168 - protein, 28 aa, Mycobacterium
YSKEYEIERLMRDAPFLLIGEGTSEIQK

SEQ ID NO: 1331169 - protein, 28 aa, Mycobacterium
YSKLDGRHLLASWIQLAALSAQMPGTDW

SEQ ID NO: 1331170 - protein, 27 aa, Mycobacterium
YSKLDGRHLLASWIRLVALTAHHPGTD

SEQ ID NO: 1331171 - protein, 24 aa, Mycobacterium
YSLRGHKWFTSAPMCDIFLVLAQA

SEQ ID NO: 1331172 - protein, 17 aa, Mycobacterium
YSLSYKPNPRWSRRYAE

SEQ ID NO: 1331173 - protein, 23 aa, Mycobacterium
YSNRAYLVQIRRAGAGSVLIDPV

SEQ ID NO: 1331174 - protein, 20 aa, Mycobacterium
YSPGFYAFDELIAEWRARGA

SEQ ID NO: 1331175 - protein, 19 aa, Mycobacterium
YSPLRHWNAGPGSRVAVIG

SEQ ID NO: 1331176 - protein, 24 aa, Mycobacterium
YSQAGLFPIAYTKGTDFRRAKRLP

SEQ ID NO: 1331177 - protein, 30 aa, Mycobacterium
YSQSKLANLLFTYELQRRLAPRGKTIAVAA

SEQ ID NO: 1331178 - protein, 25 aa, Mycobacterium
YSRAAFRMLQHTGSPLRLRSLTTIG

SEQ ID NO: 1331179 - protein, 24 aa, Mycobacterium
YSRHFDFDVLMKPGPGFALVARDN

SEQ ID NO: 1331180 - protein, 18 aa, Mycobacterium
YSRILLGVDIHDITAGYR

SEQ ID NO: 1331181 - protein, 23 aa, Mycobacterium
YSRLSWAVLDWNVNAIALYDSVG

SEQ ID NO: 1331182 - protein, 18 aa, Mycobacterium
YSSGEALLLLARTGLELG

SEQ ID NO: 1331183 - protein, 24 aa, Mycobacterium
YSSGEALLLLARTGLELGVPDRVT

SEQ ID NO: 1331184 - protein, 20 aa, Mycobacterium
YSTVPVLVVPNPLLTEEYAA

SEQ ID NO: 1331185 - protein, 18 aa, Mycobacterium
YSWFVDLDALPRLPRWLR

SEQ ID NO: 1331186 - protein, 20 aa, Mycobacterium
YTAPTAIRLLIKAGPELAAR

SEQ ID NO: 1331187 - protein, 24 aa, Mycobacterium
YTAPTAIRLLIKAGPELAARFEFP

SEQ ID NO: 1331188 - protein, 28 aa, Mycobacterium
YTDSLAPPVSTWWPWRGRTVHVARAAVP

SEQ ID NO: 1331189 - protein, 21 aa, Mycobacterium
YTDVDGIFTADPRIVPNARRL

SEQ ID NO: 1331190 - protein, 23 aa, Mycobacterium
YTELAVEILGLEALSPAGPGNGE

SEQ ID NO: 1331191 - protein, 17 aa, Mycobacterium
YTEPILHRRRREFKAAS

SEQ ID NO: 1331192 - protein, 19 aa, Mycobacterium
YTETEIVRWLFTPDASLTI

SEQ ID NO: 1331193 - protein, 18 aa, Mycobacterium
YTIGTAPVKLIASASIAD

SEQ ID NO: 1331194 - protein, 18 aa, Mycobacterium
YTMRLLLSEIGGLVASSA

SEQ ID NO: 1331195 - protein, 20 aa, Mycobacterium
YTNAWKVMIAIPGIAAMLQQ

SEQ ID NO: 1331196 - protein, 21 aa, Mycobacterium
YTPQEISARVLMKLKRDAESY

SEQ ID NO: 1331197 - protein, 35 aa, Mycobacterium
YTRARTFCDLIPDTAIWRPMNRWVYEIIRRVTDAR

SEQ ID NO: 1331198 - protein, 32 aa, Mycobacterium
YTRELARVLHRPALLPVPALGPRILLGEQGAR

SEQ ID NO: 1331199 - protein, 21 aa, Mycobacterium
YTRGAVPFYKTYPGMYVPNAL

SEQ ID NO: 1331200 - protein, 17 aa, Mycobacterium
YTSLISAKTFWGNAGAT

SEQ ID NO: 1331201 - protein, 18 aa, Mycobacterium
YTSLISAKTFWGNAGATV

SEQ ID NO: 1331202 - protein, 28 aa, Mycobacterium
YTTRPGSALLFPTLCTPTADVPIQPTKD

SEQ ID NO: 1331203 - protein, 21 aa, Mycobacterium
YTVREPVGIVGAITPWNFPLN

SEQ ID NO: 1331204 - protein, 27 aa, Mycobacterium
YTWEHDLHLYWRRATSLAASIGPAGRY

SEQ ID NO: 1331205 - protein, 17 aa, Mycobacterium
YTWSYYAISAGLEIGDI

SEQ ID NO: 1331206 - protein, 27 aa, Mycobacterium
YTYNDVPFFFHFTGPGTALGGPEVMVD

SEQ ID NO: 1331207 - protein, 29 aa, Mycobacterium
YVAFHRPGFLDYFASHHVQLPLRKGDAVF

SEQ ID NO: 1331208 - protein, 20 aa, Mycobacterium
YVASKWAVRGLTKSAALELG

SEQ ID NO: 1331209 - protein, 17 aa, Mycobacterium
YVDAGHPRWVAADVMAG

SEQ ID NO: 1331210 - protein, 32 aa, Mycobacterium
YVDGIQRIPRALARLEVPLIAAVNGPAIGAGC

SEQ ID NO: 1331211 - protein, 18 aa, Mycobacterium
YVDPLTDAGIIVEFTDRA

SEQ ID NO: 1331212 - protein, 30 aa, Mycobacterium
YVDSKLAEFEDFLNGTLRSVGRGRHQLRTA

SEQ ID NO: 1331213 - protein, 20 aa, Mycobacterium
YVFVNLWGGSVGTPLRYWNV

SEQ ID NO: 1331214 - protein, 18 aa, Mycobacterium
YVFVNLWGRPHGHPWTYA

SEQ ID NO: 1331215 - protein, 28 aa, Mycobacterium
YVGAGGAMLPLLLFASARAAVPVTPLNY

SEQ ID NO: 1331216 - protein, 18 aa, Mycobacterium
YVGTELEFMVFDDTFRDA

SEQ ID NO: 1331217 - protein, 17 aa, Mycobacterium
YVKPYQALVDYLDKLDA

SEQ ID NO: 1331218 - protein, 31 aa, Mycobacterium
YVLDRLMRPVPPGVGGALFIAGPALAREYVG

SEQ ID NO: 1331219 - protein, 20 aa, Mycobacterium
YVLEEAIIADFALVHARLGD

SEQ ID NO: 1331220 - protein, 18 aa, Mycobacterium
YVLGFVMSVARIAIDTNA

SEQ ID NO: 1331221 - protein, 25 aa, Mycobacterium
YVLHDLFAVPFDRVADILGVTPAGA

SEQ ID NO: 1331222 - protein, 22 aa, Mycobacterium
YVLNIPDAIPLDKAAPLLCAGI

SEQ ID NO: 1331223 - protein, 21 aa, Mycobacterium
YVMLLVAHHIAWDDASWEVFF

SEQ ID NO: 1331224 - protein, 22 aa, Mycobacterium
YVNDLAPFKERLPYVAAIVELD

SEQ ID NO: 1331225 - protein, 17 aa, Mycobacterium
YVNHPRLGWSDAPVGTV

SEQ ID NO: 1331226 - protein, 18 aa, Mycobacterium
YVQKMATVLGRRVWENAG

SEQ ID NO: 1331227 - protein, 19 aa, Mycobacterium
YVRQYTDLPFLVKLEDRDG

SEQ ID NO: 1331228 - protein, 18 aa, Mycobacterium
YVSRLNFEPSLGNAIRAI

SEQ ID NO: 1331229 - protein, 26 aa, Mycobacterium
YVSTWSGFAYVAFVTDAYARRILGWR

SEQ ID NO: 1331230 - protein, 17 aa, Mycobacterium
YVTARLLDDPHLWVRTL

SEQ ID NO: 1331231 - protein, 18 aa, Mycobacterium
YVTAVAPELLPRMTQYEP

SEQ ID NO: 1331232 - protein, 21 aa, Mycobacterium
YVTRDEIWLGCEGCPFNLGGC

SEQ ID NO: 1331233 - protein, 19 aa, Mycobacterium
YVYPIELAEQIYPWARSIS

SEQ ID NO: 1331234 - protein, 17 aa, Mycobacterium
YVYQTHYDCVLAKLLTA

SEQ ID NO: 1331235 - protein, 22 aa, Mycobacterium
YWARQGEWHQALYSAGFFGTSW

SEQ ID NO: 1331236 - protein, 17 aa, Mycobacterium
YWARYRDGLRVDGPAVN

SEQ ID NO: 1331237 - protein, 17 aa, Mycobacterium
YWLAQIYERLETGAGTE

SEQ ID NO: 1331238 - protein, 21 aa, Mycobacterium
YWNKHNPVLDFLKNKNFQTFF

SEQ ID NO: 1331239 - protein, 22 aa, Mycobacterium
YWRLQGPNLWPAQPPGFRAAFE

SEQ ID NO: 1331240 - protein, 20 aa, Mycobacterium
YWSKRPRGSQLGAWASQQSR

SEQ ID NO: 1331241 - protein, 18 aa, Mycobacterium
YWTGRPLESLLLDAAHRR

SEQ ID NO: 1331242 - protein, 17 aa, Mycobacterium
YWVIDARTHRPVGNRMR

SEQ ID NO: 1331243 - protein, 19 aa, Mycobacterium
YYCFGTAAGPHPFPMMVRD

SEQ ID NO: 1331244 - protein, 25 aa, Mycobacterium
YYCVVDTRGWLRDPAPLFRTNVEGT

SEQ ID NO: 1331245 - protein, 18 aa, Mycobacterium
YYENKLPAGSPVVRVMPN

SEQ ID NO: 1331246 - protein, 18 aa, Mycobacterium
YYFNDHGAQIDRFTNSLI

SEQ ID NO: 1331247 - protein, 21 aa, Mycobacterium
YYHRIDYVLEAVERGPVGLIH

SEQ ID NO: 1331248 - protein, 27 aa, Mycobacterium
YYQLLDSTRGRPFGLWLHGNEGTEGAE

SEQ ID NO: 1331249 - protein, 29 aa, Mycobacterium
YYRYDTAPELLLLNEIWKLQSMLTNYFHP

SEQ ID NO: 1331250 - protein, 18 aa, Mycobacterium
YYVNVAAAMLPHIAGRAV

SEQ ID NO: 1331251 - protein, 19 aa, Mycobacterium
YYVQYAHARLSALARNAAE

SEQ ID NO: 1331252 - protein, 23 aa, Mycobacterium
SQDRGWVILLARYQRPKAIRQSG

SEQ ID NO: 1331253 - protein, 19 aa, Mycobacterium
AAIKPLWLPGPDPEPHYRP

SEQ ID NO: 1331254 - protein, 19 aa, Mycobacterium
KSRSVMLVHLPRLEGWGLA

SEQ ID NO: 1331255 - protein, 18 aa, Mycobacterium
PTVTVFGVPIFKLGGAPV

SEQ ID NO: 1331256 - protein, 17 aa, Mycobacterium
THPGCTVPFYWTEAHHT

SEQ ID NO: 1331257 - protein, 21 aa, Mycobacterium
YTFMDLWFYHCNPRHHSIALT

SEQ ID NO: 1331258 - protein, 17 aa, Mycobacterium
ADNDEWLKWLLVRRGSG

SEQ ID NO: 1331259 - protein, 27 aa, Mycobacterium
AITPWNFPVVLAFMKLAPALVAGNTVV

SEQ ID NO: 1331260 - protein, 17 aa, Mycobacterium
CTVPFYWTEAHHTHDYS

SEQ ID NO: 1331261 - protein, 23 aa, Mycobacterium
QVVPGLHRYLMPVNWKLLAENFG

SEQ ID NO: 1331262 - protein, 24 aa, Mycobacterium
SGPRKDGVPLWWKSAARNKSSVAV

SEQ ID NO: 1331263 - protein, 18 aa, Mycobacterium
VIPLLRQGGGGSIVNVAS

SEQ ID NO: 1331264 - protein, 24 aa, Mycobacterium
PPTVTVFGIPIFKLGGAPVKVVSS

SEQ ID NO: 1331265 - protein, 24 aa, Mycobacterium
AKAQPLWRVLVALSIRHVGPTAAR

SEQ ID NO: 1331266 - protein, 24 aa, Mycobacterium
AKRITAILPFYPYARQDKKHRGRE

SEQ ID NO: 1331267 - protein, 21 aa, Mycobacterium
ALFFGHGLNIHFGLIKPPANV

SEQ ID NO: 1331268 - protein, 19 aa, Mycobacterium
AMWALSIPVPFTKPVGAGA

SEQ ID NO: 1331269 - protein, 18 aa, Mycobacterium
APLLYPHMWSWDAAFVAI

SEQ ID NO: 1331270 - protein, 24 aa, Mycobacterium
ASILPSFPALLKKQLKGAPMPAPR

SEQ ID NO: 1331271 - protein, 17 aa, Mycobacterium
AVRLNAALLPALYARGK

SEQ ID NO: 1331272 - protein, 21 aa, Mycobacterium
AWNVPFFLAANKLGPALLAGC

SEQ ID NO: 1331273 - protein, 26 aa, Mycobacterium
AWRLPMGFTAWPPWRPGVLFTGDSLG

SEQ ID NO: 1331274 - protein, 17 aa, Mycobacterium
AYLLAARDVGVGQVLAI

SEQ ID NO: 1331275 - protein, 23 aa, Mycobacterium
DFTNIYFYTVLYHALRASNRIAI

SEQ ID NO: 1331276 - protein, 17 aa, Mycobacterium
DTPILVPPQAAMLGTGA

SEQ ID NO: 1331277 - protein, 18 aa, Mycobacterium
DVLLFIDNIFRFTQAGSE

SEQ ID NO: 1331278 - protein, 17 aa, Mycobacterium
DVTIVEFLPRALPNEDA

SEQ ID NO: 1331279 - protein, 19 aa, Mycobacterium
EALARVFDYTLAIGKTPIV

SEQ ID NO: 1331280 - protein, 17 aa, Mycobacterium
EEFLRFFTPAPGDGRTF

SEQ ID NO: 1331281 - protein, 24 aa, Mycobacterium
EGPLPQTRFVLRKALAAHLPVILV

SEQ ID NO: 1331282 - protein, 23 aa, Mycobacterium
EHAVLHLLYSRFWHKVLYDLGHV

SEQ ID NO: 1331283 - protein, 27 aa, Mycobacterium
ELAAPVTHIWYFKGVPSRLGYLLDLAP

SEQ ID NO: 1331284 - protein, 24 aa, Mycobacterium
ELCRRWYPRIYFGQPEKGLAHRAL

SEQ ID NO: 1331285 - protein, 17 aa, Mycobacterium
ELLSPKWQKMWKPVVCA

SEQ ID NO: 1331286 - protein, 23 aa, Mycobacterium
EPEDLPWEVPLIELGLDSLMAVR

SEQ ID NO: 1331287 - protein, 25 aa, Mycobacterium
EYASRGTWIWPPEPSLRLIADTIEF

SEQ ID NO: 1331288 - protein, 18 aa, Mycobacterium
FARGLLNRLFTRAYIPGK

SEQ ID NO: 1331289 - protein, 17 aa, Mycobacterium
FHDMGMVGFLTIPMYFG

SEQ ID NO: 1331290 - protein, 17 aa, Mycobacterium
FPGVFRGALDAGARRIT

SEQ ID NO: 1331291 - protein, 25 aa, Mycobacterium
FVPAFSGLFAPYWRSDARGAIVGLS

SEQ ID NO: 1331292 - protein, 18 aa, Mycobacterium
FYSGFYLPMYWSSRAKLT

SEQ ID NO: 1331293 - protein, 24 aa, Mycobacterium
GGQEILFPALLPRAPYETTNRWTE

SEQ ID NO: 1331294 - protein, 28 aa, Mycobacterium
GQVAPWNYPMMMAIWKICPAIAAGNTVV

SEQ ID NO: 1331295 - protein, 27 aa, Mycobacterium
GRAYSPRFLWMWPNARISVMGGEQAAS

SEQ ID NO: 1331296 - protein, 18 aa, Mycobacterium
GVGFRWWTRSRALELGLT

SEQ ID NO: 1331297 - protein, 19 aa, Mycobacterium
GYTLGNSLRRTLLSSIPGA

SEQ ID NO: 1331298 - protein, 19 aa, Mycobacterium
HFTPYTLIQLEELGFCGKG

SEQ ID NO: 1331299 - protein, 22 aa, Mycobacterium
HGALAYLLKPFTFAAFRDRLER

SEQ ID NO: 1331300 - protein, 24 aa, Mycobacterium
HHSRRGLLLLVGRRRRLLKYVAQV

SEQ ID NO: 1331301 - protein, 17 aa, Mycobacterium
HLLLAMFNALQPGVFAL

SEQ ID NO: 1331302 - protein, 17 aa, Mycobacterium
HVAALFTAGLITDLLVR

SEQ ID NO: 1331303 - protein, 24 aa, Mycobacterium
IAEEYYISFLLDRANRTYLAMCSV

SEQ ID NO: 1331304 - protein, 26 aa, Mycobacterium
IASEKAFFMLAFTKIGLMPDGGASAL

SEQ ID NO: 1331305 - protein, 19 aa, Mycobacterium
IHMRLPKLKGFRNRFRTEY

SEQ ID NO: 1331306 - protein, 17 aa, Mycobacterium
ILRDYLTDLFPILELGT

SEQ ID NO: 1331307 - protein, 21 aa, Mycobacterium
INNVLAFPGVFRGALDAGARR

SEQ ID NO: 1331308 - protein, 26 aa, Mycobacterium
ITPFNFPAMIPLWKAGPALACGNAFI

SEQ ID NO: 1331309 - protein, 24 aa, Mycobacterium
KAVAAFRLALPRTMLRFAGGREIT

SEQ ID NO: 1331310 - protein, 17 aa, Mycobacterium
KVKHRVFHYPGGLVDFV

SEQ ID NO: 1331311 - protein, 18 aa, Mycobacterium
LADLSFADYLMWVRRDDG

SEQ ID NO: 1331312 - protein, 26 aa, Mycobacterium
LCRKIVIELLAWQFASPVRWIETQDL

SEQ ID NO: 1331313 - protein, 25 aa, Mycobacterium
LEEYLGEGLLWYLDNFLLDCDPNGL

SEQ ID NO: 1331314 - protein, 25 aa, Mycobacterium
LLADGPVVLFFYPAAMTPGCTKEAC

SEQ ID NO: 1331315 - protein, 21 aa, Mycobacterium
LPTPAVAYLTSAYDADFGVMI

SEQ ID NO: 1331316 - protein, 18 aa, Mycobacterium
LRNRALLELLYSTGARIS

SEQ ID NO: 1331317 - protein, 18 aa, Mycobacterium
MGIDRLLMALTGLSIRET

SEQ ID NO: 1331318 - protein, 19 aa, Mycobacterium
MKLDFLITVDWDYYKKFMS

SEQ ID NO: 1331319 - protein, 26 aa, Mycobacterium
NLPITLWPGMKIGQLCLLRLTSPAEH

SEQ ID NO: 1331320 - protein, 20 aa, Mycobacterium
NTFPSWPLAHPFRFVAHNGE

SEQ ID NO: 1331321 - protein, 18 aa, Mycobacterium
PEMGLVGRQLWEQSGLSP

SEQ ID NO: 1331322 - protein, 24 aa, Mycobacterium
PTEFTLLRYFIINAGTVLSKPKIL

SEQ ID NO: 1331323 - protein, 23 aa, Mycobacterium
PTKVAMLGLTFDDVLLLPAASDV

SEQ ID NO: 1331324 - protein, 23 aa, Mycobacterium
PTLGMMMFTLFQKRLLGSLYGEA

SEQ ID NO: 1331325 - protein, 19 aa, Mycobacterium
PVIDKDVRRWWRSDSLWQA

SEQ ID NO: 1331326 - protein, 27 aa, Mycobacterium
PVLTTAAIGMFFPGPYRVPKASFNYKT

SEQ ID NO: 1331327 - protein, 20 aa, Mycobacterium
PVRFFNPLSMRFAKKATRED

SEQ ID NO: 1331328 - protein, 25 aa, Mycobacterium
PVVARGWRTPLRLLFIDGGHTEEAA

SEQ ID NO: 1331329 - protein, 19 aa, Mycobacterium
QAVAPLRYFNDRAGSIYAG

SEQ ID NO: 1331330 - protein, 24 aa, Mycobacterium
QEDFIGIHFFSPVDKMPLVEIIKG

SEQ ID NO: 1331331 - protein, 26 aa, Mycobacterium
QESFKRHVGLPPLTYLREVRLIRAHA

SEQ ID NO: 1331332 - protein, 17 aa, Mycobacterium
QLELGGKAPFVVFDDAD

SEQ ID NO: 1331333 - protein, 19 aa, Mycobacterium
QMLLKIGWPAEDLAGYVDG

SEQ ID NO: 1331334 - protein, 23 aa, Mycobacterium
RAGKLPVTLFTAGGIATPADAAM

SEQ ID NO: 1331335 - protein, 23 aa, Mycobacterium
RARRCGWFDAVIARYATRVNGIT

SEQ ID NO: 1331336 - protein, 21 aa, Mycobacterium
RGFYHLMTNLPSERLSIAISA

SEQ ID NO: 1331337 - protein, 21 aa, Mycobacterium
RLTLPAKFRDALAGGLMVTKS

SEQ ID NO: 1331338 - protein, 27 aa, Mycobacterium
RPVITNMIRLLRLPIAVQRRVAAGVLS

SEQ ID NO: 1331339 - protein, 25 aa, Mycobacterium
RTEKSVLFVIPWGTHWIIGTTDTDW

SEQ ID NO: 1331340 - protein, 20 aa, Mycobacterium
RVLAALHGWLAPLPPEGASA

SEQ ID NO: 1331341 - protein, 24 aa, Mycobacterium
SDRQRHRLALWSRRLLGEAITQAQ

SEQ ID NO: 1331342 - protein, 20 aa, Mycobacterium
SPIVGIWHSGGARLAEGVKA

SEQ ID NO: 1331343 - protein, 23 aa, Mycobacterium
SSLISMFLDFYRPLVEAGMVYVT

SEQ ID NO: 1331344 - protein, 21 aa, Mycobacterium
STPLFFAQAIGRFVRSRRPGE

SEQ ID NO: 1331345 - protein, 20 aa, Mycobacterium
TGRGPTPFRWSLTAGPAEPA

SEQ ID NO: 1331346 - protein, 23 aa, Mycobacterium
TITPWNYPLQMAVWKVLPALAAG

SEQ ID NO: 1331347 - protein, 21 aa, Mycobacterium
TLLESFLFYSGFYLPMYWSSR

SEQ ID NO: 1331348 - protein, 24 aa, Mycobacterium
TNLKAWLYRILTNTYINSYRKKQR

SEQ ID NO: 1331349 - protein, 21 aa, Mycobacterium
TRMFTVLFALGRLPGWIAHWR

SEQ ID NO: 1331350 - protein, 26 aa, Mycobacterium
VDDPLAMYLFDLCTLPLNLAGHCGMS

SEQ ID NO: 1331351 - protein, 22 aa, Mycobacterium
VKDLHLPWQWGARWFLEQLVDG

SEQ ID NO: 1331352 - protein, 25 aa, Mycobacterium
WKDGEALFLRCNIWREAAENVAESL

SEQ ID NO: 1331353 - protein, 17 aa, Mycobacterium
WKYLMALFSSKVDEYAD

SEQ ID NO: 1331354 - protein, 22 aa, Mycobacterium
YAQLLQFRLMVLYTAWEIDKYN

SEQ ID NO: 1331355 - protein, 18 aa, Mycobacterium
YNYPNQLALAKLAPALAA

SEQ ID NO: 1331356 - protein, 17 aa, Mycobacterium
AADLARMYIRYAERHGW

SEQ ID NO: 1331357 - protein, 23 aa, Mycobacterium
AADWAEMLMRMYIRWAEQHDYPV

SEQ ID NO: 1331358 - protein, 18 aa, Mycobacterium
AAELEKFQWFVRAHLENA

SEQ ID NO: 1331359 - protein, 21 aa, Mycobacterium
AAFVDFLFPMQPGLPQAWTPE

SEQ ID NO: 1331360 - protein, 19 aa, Mycobacterium
AAIRRRVIRSWLLAGGARG

SEQ ID NO: 1331361 - protein, 24 aa, Mycobacterium
AAKRTSDLIPLCHQLALTGVDVDF

SEQ ID NO: 1331362 - protein, 17 aa, Mycobacterium
AALAPFLRGLVSTDKPQ

SEQ ID NO: 1331363 - protein, 26 aa, Mycobacterium
AANPGTKLLILPPLMHGAAQWAVMTA

SEQ ID NO: 1331364 - protein, 24 aa, Mycobacterium
AANPKLFFQIYWLGGREAILERAQ

SEQ ID NO: 1331365 - protein, 21 aa, Mycobacterium
AAPIERILLRLPAINRVAVYP

SEQ ID NO: 1331366 - protein, 23 aa, Mycobacterium
AAQGFEVLLLLAAVPTPVVAFTV

SEQ ID NO: 1331367 - protein, 20 aa, Mycobacterium
AAQRTWFRLSALAERVNATV

SEQ ID NO: 1331368 - protein, 24 aa, Mycobacterium
AARLRDLLKFDFYFADSAAFREHV

SEQ ID NO: 1331369 - protein, 25 aa, Mycobacterium
AAVGPDYPIIFRFSQWKGLDYTASI

SEQ ID NO: 1331370 - protein, 25 aa, Mycobacterium
AAWFYDPPWTLPFRRRNEIAVAVRQ

SEQ ID NO: 1331371 - protein, 25 aa, Mycobacterium
AAWSLVHGFIMLWLNDLIATEGDPL

SEQ ID NO: 1331372 - protein, 18 aa, Mycobacterium
ADALLLRVDRRNQVLIAG

SEQ ID NO: 1331373 - protein, 26 aa, Mycobacterium
ADEPIRWAYFPWRRTVVSVLGPRAHS

SEQ ID NO: 1331374 - protein, 23 aa, Mycobacterium
ADHTWLSTVPLLLDAAYGLPDLP

SEQ ID NO: 1331375 - protein, 24 aa, Mycobacterium
ADLLPALRALVRHRLEVAHPGYDQ

SEQ ID NO: 1331376 - protein, 21 aa, Mycobacterium
ADMTWLLSRWTCVFGTPACQG

SEQ ID NO: 1331377 - protein, 26 aa, Mycobacterium
ADSGYASWRRMLWARWPSAGPPPHFD

SEQ ID NO: 1331378 - protein, 24 aa, Mycobacterium
AELQIVFHTLLRRIPTMRLGIPFD

SEQ ID NO: 1331379 - protein, 25 aa, Mycobacterium
AESAGLPLFRYLGGPNAHILPVPMM

SEQ ID NO: 1331380 - protein, 19 aa, Mycobacterium
AFDLVHRLWLDAGHRVHYV

SEQ ID NO: 1331381 - protein, 20 aa, Mycobacterium
AFLRFNVHLLFRSTLPARLR

SEQ ID NO: 1331382 - protein, 21 aa, Mycobacterium
AGDGFARFWLHNGWVTMGGEK

SEQ ID NO: 1331383 - protein, 23 aa, Mycobacterium
AGGTLRLFRPLFGAGLGGRLGTG

SEQ ID NO: 1331384 - protein, 19 aa, Mycobacterium
AGHLTLVPALRDALAAVGR

SEQ ID NO: 1331385 - protein, 18 aa, Mycobacterium
AGKLAKWLRGQGHTPLLV

SEQ ID NO: 1331386 - protein, 24 aa, Mycobacterium
AGLDTRAFRLPWPDGMTVFEIDQP

SEQ ID NO: 1331387 - protein, 27 aa, Mycobacterium
AGPVRILCAMPFFWIGGLLAATGALHE

SEQ ID NO: 1331388 - protein, 21 aa, Mycobacterium
AGVMAQLLPILDDLDRARSHG

SEQ ID NO: 1331389 - protein, 24 aa, Mycobacterium
AGVYAFDITALRSALRRLRSDNAQ

SEQ ID NO: 1331390 - protein, 24 aa, Mycobacterium
AGYDLLFFADVFGLRAPWNGNWRK

SEQ ID NO: 1331391 - protein, 21 aa, Mycobacterium
AHLGPYCWPAAIKMIESGILP

SEQ ID NO: 1331392 - protein, 21 aa, Mycobacterium
AIAVPAHWGPGTVGALRGALR

SEQ ID NO: 1331393 - protein, 25 aa, Mycobacterium
AIDGRGMFLCCKFAIEAMLPTGGGA

SEQ ID NO: 1331394 - protein, 20 aa, Mycobacterium
AIHFQEWWVRYRAKVPTHSF

SEQ ID NO: 1331395 - protein, 17 aa, Mycobacterium
AIRRLLDRISLGGAWDM

SEQ ID NO: 1331396 - protein, 18 aa, Mycobacterium
AITELLIEALKRLNMSWP

SEQ ID NO: 1331397 - protein, 22 aa, Mycobacterium
AKNMFALGLLSWMYGRELHQSE

SEQ ID NO: 1331398 - protein, 19 aa, Mycobacterium
ALDILRWAPQQASEPVAKV

SEQ ID NO: 1331399 - protein, 17 aa, Mycobacterium
ALHLLDLGYFRAGGDQY

SEQ ID NO: 1331400 - protein, 17 aa, Mycobacterium
ALLYRLSGDRNPLHSDP

SEQ ID NO: 1331401 - protein, 17 aa, Mycobacterium
ALPLLRSLHREHGPIAV

SEQ ID NO: 1331402 - protein, 17 aa, Mycobacterium
ALQLLISSLPKFLNLEK

SEQ ID NO: 1331403 - protein, 19 aa, Mycobacterium
ALRLWYELLTRSRLPAADD

SEQ ID NO: 1331404 - protein, 19 aa, Mycobacterium
ALVLLERFPVPVLAIAEDG

SEQ ID NO: 1331405 - protein, 18 aa, Mycobacterium
AMTGWRLGWLLVPQELRR

SEQ ID NO: 1331406 - protein, 25 aa, Mycobacterium
ANPKNPRPVMLWGYQPLADNGQGRA

SEQ ID NO: 1331407 - protein, 31 aa, Mycobacterium
APGHPLMFMVQAWNWIFPLGENPDYEPAAST

SEQ ID NO: 1331408 - protein, 25 aa, Mycobacterium
APHLVKPLPFLFPLTNRWWERPYVA

SEQ ID NO: 1331409 - protein, 26 aa, Mycobacterium
APKRLGSFMDSRLWRMLLAPGRGIGK

SEQ ID NO: 1331410 - protein, 20 aa, Mycobacterium
APLAVPIWYGYQPGGEVLLW

SEQ ID NO: 1331411 - protein, 21 aa, Mycobacterium
APMFHAWGFSQLLFAGLLACT

SEQ ID NO: 1331412 - protein, 18 aa, Mycobacterium
APSYVFFAAGRMSSYYSG

SEQ ID NO: 1331413 - protein, 17 aa, Mycobacterium
APTLLTPPPPYALLDQP

SEQ ID NO: 1331414 - protein, 23 aa, Mycobacterium
APVYLYRFDFATPMLRLLRLGAA

SEQ ID NO: 1331415 - protein, 21 aa, Mycobacterium
AQGRWGALPPSYRSTSRDDGI

SEQ ID NO: 1331416 - protein, 18 aa, Mycobacterium
AQIGLLREAVRLGGALGV

SEQ ID NO: 1331417 - protein, 22 aa, Mycobacterium
AQVLAAALPWLKQLHGKIVVVK

SEQ ID NO: 1331418 - protein, 20 aa, Mycobacterium
AQWRWLAHTLTVDLLRELLP

SEQ ID NO: 1331419 - protein, 18 aa, Mycobacterium
ARDLAFIAFSTLGGELVA

SEQ ID NO: 1331420 - protein, 18 aa, Mycobacterium
ARDYILELLLAHSTAGLT

SEQ ID NO: 1331421 - protein, 19 aa, Mycobacterium
ARQLYYGCDVWLNNPLRPL

SEQ ID NO: 1331422 - protein, 17 aa, Mycobacterium
ARQPYYRWRANPITNAE

SEQ ID NO: 1331423 - protein, 21 aa, Mycobacterium
ARSGFYFYFDSKYAVLAVIVA

SEQ ID NO: 1331424 - protein, 22 aa, Mycobacterium
ASCRYMKMITPAALLRCLTYGT

SEQ ID NO: 1331425 - protein, 17 aa, Mycobacterium
ASGKLPRLASAALAFSV

SEQ ID NO: 1331426 - protein, 25 aa, Mycobacterium
ASGRIKLAWFLLHVARYLPPLLYAT

SEQ ID NO: 1331427 - protein, 21 aa, Mycobacterium
ASHQALCYFGYLAGYRLVHDA

SEQ ID NO: 1331428 - protein, 23 aa, Mycobacterium
ASWESLPAILFQSGFRQLLSPEL

SEQ ID NO: 1331429 - protein, 26 aa, Mycobacterium
ATERGLLLTTLWYIREVDPTVLLLTG

SEQ ID NO: 1331430 - protein, 26 aa, Mycobacterium
ATIIDPFGHRWMLSGPVPLAGALIQH

SEQ ID NO: 1331431 - protein, 27 aa, Mycobacterium
ATKGLIYYHFRSKFDIFLAVYQDGMRR

SEQ ID NO: 1331432 - protein, 23 aa, Mycobacterium
ATRMLVWRAGWMHRNNKAFTSAE

SEQ ID NO: 1331433 - protein, 17 aa, Mycobacterium
ATRPRIRLAYRLTPRRV

SEQ ID NO: 1331434 - protein, 23 aa, Mycobacterium
ATTLCDVFLMLQRLRMTHQVEQL

SEQ ID NO: 1331435 - protein, 17 aa, Mycobacterium
AVDPLLPEVAWSWLVEA

SEQ ID NO: 1331436 - protein, 24 aa, Mycobacterium
AVHYPWLPVRRLLLDRYPSIERIA

SEQ ID NO: 1331437 - protein, 21 aa, Mycobacterium
AVKALWDTILPFAGYAFNKSH

SEQ ID NO: 1331438 - protein, 17 aa, Mycobacterium
AVLLPDVYYRRGEWEPF

SEQ ID NO: 1331439 - protein, 19 aa, Mycobacterium
AVLRFQYQIARIPLQVIED

SEQ ID NO: 1331440 - protein, 21 aa, Mycobacterium
AVRLVRQIPYTIACDLLLTGR

SEQ ID NO: 1331441 - protein, 23 aa, Mycobacterium
AVTGIDLPAWMFRLARGESDVLA

SEQ ID NO: 1331442 - protein, 23 aa, Mycobacterium
AVWNAVCWAIIIPAGRLRTGDAS

SEQ ID NO: 1331443 - protein, 26 aa, Mycobacterium
AYAKKFRFPTFLGAFKYYTSYTLKTF

SEQ ID NO: 1331444 - protein, 17 aa, Mycobacterium
AYFQFPVAKYGIALDNW

SEQ ID NO: 1331445 - protein, 19 aa, Mycobacterium
AYRGPWQYETLAREIMFDI

SEQ ID NO: 1331446 - protein, 30 aa, Mycobacterium
CAGIIPWNFPLLLAVWKLGPALAAGNTVVL

SEQ ID NO: 1331447 - protein, 27 aa, Mycobacterium
CASSAWTIGFYILHNWMLALFGEQAQA

SEQ ID NO: 1331448 - protein, 18 aa, Mycobacterium
CGRALRLLPLPVEVDLFD

SEQ ID NO: 1331449 - protein, 23 aa, Mycobacterium
CGRHPFIDLPYRPGHEAVGVVDA

SEQ ID NO: 1331450 - protein, 20 aa, Mycobacterium
CGYRRFFSITSLAGLRQEDP

SEQ ID NO: 1331451 - protein, 18 aa, Mycobacterium
CRSAGYWALPYPVAERLA

SEQ ID NO: 1331452 - protein, 29 aa, Mycobacterium
CSPPPYLPPVFTGLARAWTAVIRKLLAQY

SEQ ID NO: 1331453 - protein, 24 aa, Mycobacterium
CWALWPVLVSIWHWERTWVPGHTS

SEQ ID NO: 1331454 - protein, 20 aa, Mycobacterium
DAARPFIFDTGLAPAAVGAA

SEQ ID NO: 1331455 - protein, 28 aa, Mycobacterium
DAEPLFNLFQAMPIPYIEPEDMANLGVF

SEQ ID NO: 1331456 - protein, 23 aa, Mycobacterium
DAQTPTLLFPFAAPRVAGDMSEV

SEQ ID NO: 1331457 - protein, 17 aa, Mycobacterium
DAQYWRRHSRQPVQFAE

SEQ ID NO: 1331458 - protein, 23 aa, Mycobacterium
DARARLEVHLGWEPGTIAAVRAG

SEQ ID NO: 1331459 - protein, 17 aa, Mycobacterium
DARGFLLGAAVALRLGT

SEQ ID NO: 1331460 - protein, 22 aa, Mycobacterium
DATLLQWIAFEEEYFRAGAPGR

SEQ ID NO: 1331461 - protein, 18 aa, Mycobacterium
DATVCWFADAPLRAGDRL

SEQ ID NO: 1331462 - protein, 21 aa, Mycobacterium
DAWAFTWVVDWPLFEMAEDAT

SEQ ID NO: 1331463 - protein, 17 aa, Mycobacterium
DCFSANELLLYEALGLC

SEQ ID NO: 1331464 - protein, 18 aa, Mycobacterium
DCTLPPPMRLLLDGRMPG

SEQ ID NO: 1331465 - protein, 26 aa, Mycobacterium
DDPGQLLRWLVPAFPILQEAAAHELW

SEQ ID NO: 1331466 - protein, 26 aa, Mycobacterium
DDTRTPWPMWPLVLRTRLSPAHAEGG

SEQ ID NO: 1331467 - protein, 20 aa, Mycobacterium
DDVLLFKYIIKNTAWQEGKT

SEQ ID NO: 1331468 - protein, 18 aa, Mycobacterium
DECRVFLSMLGIGPSKLE

SEQ ID NO: 1331469 - protein, 17 aa, Mycobacterium
DELRWWTEPSRPYRGVP

SEQ ID NO: 1331470 - protein, 24 aa, Mycobacterium
DEPKGWLITTAWRRFLDLSRSDTA

SEQ ID NO: 1331471 - protein, 23 aa, Mycobacterium
DERAKWATFPMLALHGWAQHHDV

SEQ ID NO: 1331472 - protein, 24 aa, Mycobacterium
DESLDLRWWPLDALPPDTDFGLAQ

SEQ ID NO: 1331473 - protein, 26 aa, Mycobacterium
DESLDYFLNLMLRAPFRLSRDVIPHM

SEQ ID NO: 1331474 - protein, 21 aa, Mycobacterium
DEVRILRLHLLHLLQTVSPNS

SEQ ID NO: 1331475 - protein, 18 aa, Mycobacterium
DFDHPLWVLYSSGTTGLP

SEQ ID NO: 1331476 - protein, 24 aa, Mycobacterium
DGASMWFRSYFALPSSITAPDGRP

SEQ ID NO: 1331477 - protein, 17 aa, Mycobacterium
DGDAWLLLSMLQVIFAE

SEQ ID NO: 1331478 - protein, 23 aa, Mycobacterium
DGLRAFLSRFLLPAILAGDHARP

SEQ ID NO: 1331479 - protein, 17 aa, Mycobacterium
DGLRLITWRGASRAEQG

SEQ ID NO: 1331480 - protein, 17 aa, Mycobacterium
DGRTWYRTGDLVRYLPD

SEQ ID NO: 1331481 - protein, 24 aa, Mycobacterium
DGSDAMRWFLMASPILRGGNLIVT

SEQ ID NO: 1331482 - protein, 19 aa, Mycobacterium
DHFIPWLYLAGLASTAADS

SEQ ID NO: 1331483 - protein, 17 aa, Mycobacterium
DIDRPWHKLPKRQRNWI

SEQ ID NO: 1331484 - protein, 25 aa, Mycobacterium
DIEHWRWMWESNVLGTLLVTRALLP

SEQ ID NO: 1331485 - protein, 24 aa, Mycobacterium
DIIDVHLTAPFRILRAAQPVISGL

SEQ ID NO: 1331486 - protein, 19 aa, Mycobacterium
DIKINWVWNPPWGPDKITE

SEQ ID NO: 1331487 - protein, 17 aa, Mycobacterium
DKPTILFLGRHVGYPVA

SEQ ID NO: 1331488 - protein, 17 aa, Mycobacterium
DLATGLMPLRWGTGYML

SEQ ID NO: 1331489 - protein, 20 aa, Mycobacterium
DLAWSRITYWRALLTSAVDQ

SEQ ID NO: 1331490 - protein, 24 aa, Mycobacterium
DLDRGFVLPWRKDIALFLSDLYVG

SEQ ID NO: 1331491 - protein, 17 aa, Mycobacterium
DLGWMLICWPHDPNPID

SEQ ID NO: 1331492 - protein, 22 aa, Mycobacterium
DLHLYLRRATLYRSLYGTPEDH

SEQ ID NO: 1331493 - protein, 17 aa, Mycobacterium
DLKFKLVEPLRLLFKDE

SEQ ID NO: 1331494 - protein, 17 aa, Mycobacterium
DLLPLLEKVAEAGKPLL

SEQ ID NO: 1331495 - protein, 18 aa, Mycobacterium
DLTIGFFLHIPFPPVELF

SEQ ID NO: 1331496 - protein, 17 aa, Mycobacterium
DLYLRIAPELFLKRALV

SEQ ID NO: 1331497 - protein, 19 aa, Mycobacterium
DMCRAFLPVLLARPEANLT

SEQ ID NO: 1331498 - protein, 19 aa, Mycobacterium
DMKLPIALALGWPDRIPGA

SEQ ID NO: 1331499 - protein, 28 aa, Mycobacterium
DNATLAHLLKFDSILGRLPYEVSLEGDD

SEQ ID NO: 1331500 - protein, 19 aa, Mycobacterium
DNEAKWFWFEGNFGAYEEN

SEQ ID NO: 1331501 - protein, 23 aa, Mycobacterium
DNMALLVGDLLWSAAHDTFDDAV

SEQ ID NO: 1331502 - protein, 22 aa, Mycobacterium
DPDILLLGFSLPGAPPKPAERL

SEQ ID NO: 1331503 - protein, 24 aa, Mycobacterium
DPGHLWWIRSQLRRALVDDVRARL

SEQ ID NO: 1331504 - protein, 20 aa, Mycobacterium
DPGPLRRLIATLPALEVPRP

SEQ ID NO: 1331505 - protein, 23 aa, Mycobacterium
DPGRFAKLVLLTPSPCYVDDGDY

SEQ ID NO: 1331506 - protein, 20 aa, Mycobacterium
DPPTRLLKLALDIGCVFSID

SEQ ID NO: 1331507 - protein, 17 aa, Mycobacterium
DPQHRLLLETAWRAVEH

SEQ ID NO: 1331508 - protein, 23 aa, Mycobacterium
DPRLKRPIPFLPGTIGLITGRAS

SEQ ID NO: 1331509 - protein, 24 aa, Mycobacterium
DQVATLFRAWLRDAIRRVADGVLG

SEQ ID NO: 1331510 - protein, 17 aa, Mycobacterium
DRFLRSRRPWIWGPRML

SEQ ID NO: 1331511 - protein, 23 aa, Mycobacterium
DRGLFGTSILWFEQDRDGQDATG

SEQ ID NO: 1331512 - protein, 32 aa, Mycobacterium
DRGLHVLVFGPLRALRLTTALRRAAGTTERTG

SEQ ID NO: 1331513 - protein, 20 aa, Mycobacterium
DRGLLRLLPGARALLERIKE

SEQ ID NO: 1331514 - protein, 23 aa, Mycobacterium
DRGVSWLPFFHDMGLITIMISPM

SEQ ID NO: 1331515 - protein, 17 aa, Mycobacterium
DRHLTLDGLRLVFERNR

SEQ ID NO: 1331516 - protein, 24 aa, Mycobacterium
DRIDPVLLDLLRLGTYQLLRTRVE

SEQ ID NO: 1331517 - protein, 28 aa, Mycobacterium
DRILAVLPFFHIYGMTVLLNAALHARAA

SEQ ID NO: 1331518 - protein, 19 aa, Mycobacterium
DRIRRAHLLLAMFNALQPG

SEQ ID NO: 1331519 - protein, 18 aa, Mycobacterium
DRIVAYVAPILLGGPVTA

SEQ ID NO: 1331520 - protein, 31 aa, Mycobacterium
DSFEFFPNFTLLLWVPGWYLTYNYWPTGVDT

SEQ ID NO: 1331521 - protein, 22 aa, Mycobacterium
DSGLTLSWLLRNLATRQPRSLR

SEQ ID NO: 1331522 - protein, 21 aa, Mycobacterium
DSIGWLRTFLQNHSGGLVVIS

SEQ ID NO: 1331523 - protein, 18 aa, Mycobacterium
DSMPALHLLPLAGVLGEV

SEQ ID NO: 1331524 - protein, 23 aa, Mycobacterium
DSNLFLRDLVMALRWVRDNIAVF

SEQ ID NO: 1331525 - protein, 19 aa, Mycobacterium
DSPPYRPFWAITKHADIMA

SEQ ID NO: 1331526 - protein, 24 aa, Mycobacterium
DTARLLHHVAWQPVAWPDADLPAE

SEQ ID NO: 1331527 - protein, 21 aa, Mycobacterium
DTELFGHWWYEGPEWLARVLR

SEQ ID NO: 1331528 - protein, 22 aa, Mycobacterium
DTHPFAWLPMLSRVLASARLLP

SEQ ID NO: 1331529 - protein, 19 aa, Mycobacterium
DTNIEFLRFLLTDPDVAAG

SEQ ID NO: 1331530 - protein, 23 aa, Mycobacterium
DVAAARWWRKPLVRRWYGFAEMQ

SEQ ID NO: 1331531 - protein, 27 aa, Mycobacterium
DVAEIYVPFSWFEPMWLENLGFAAEGE

SEQ ID NO: 1331532 - protein, 23 aa, Mycobacterium
DVAGPYSWWSWRGRAFDNDAGWR

SEQ ID NO: 1331533 - protein, 21 aa, Mycobacterium
DVALGQHVFPIPAGIIGTHSG

SEQ ID NO: 1331534 - protein, 17 aa, Mycobacterium
DVAYRYFATAKRKFIIA

SEQ ID NO: 1331535 - protein, 25 aa, Mycobacterium
DVDFYTWTQWIFLQIYNAWFDRDAN

SEQ ID NO: 1331536 - protein, 17 aa, Mycobacterium
DVDLYLRIAPELFLKRA

SEQ ID NO: 1331537 - protein, 23 aa, Mycobacterium
DVEFAFFVILLAVAGNETTRNAM

SEQ ID NO: 1331538 - protein, 23 aa, Mycobacterium
DVEQTFLRRLLTGELRQGALIGV

SEQ ID NO: 1331539 - protein, 26 aa, Mycobacterium
DVFQRTPIWCFPKFDVPLPRALRGAM

SEQ ID NO: 1331540 - protein, 27 aa, Mycobacterium
DVFSEEFLLSRPLLTAIRRTDPTVLLV

SEQ ID NO: 1331541 - protein, 25 aa, Mycobacterium
DVKLNLFLFTMLQKTLKGNIFGGGS

SEQ ID NO: 1331542 - protein, 18 aa, Mycobacterium
DVLLIAGRYQVSVPTPFV

SEQ ID NO: 1331543 - protein, 19 aa, Mycobacterium
DVLLPFLVTRQLICGAGKV

SEQ ID NO: 1331544 - protein, 19 aa, Mycobacterium
DWQRLLFDNGWLLPAQPPE

SEQ ID NO: 1331545 - protein, 21 aa, Mycobacterium
EAALFRWMKSPLMPITPQAIS

SEQ ID NO: 1331546 - protein, 23 aa, Mycobacterium
EALALLRLPLVLPTLQVAGRLAG

SEQ ID NO: 1331547 - protein, 17 aa, Mycobacterium
EAMARAWGLADTKWHGL

SEQ ID NO: 1331548 - protein, 17 aa, Mycobacterium
EAMLLVRLPYHLSSLTQ

SEQ ID NO: 1331549 - protein, 18 aa, Mycobacterium
EAVAGVVVLLRRAGRPAF

SEQ ID NO: 1331550 - protein, 21 aa, Mycobacterium
EDPDVLFLAEAFTRPARLYGL

SEQ ID NO: 1331551 - protein, 20 aa, Mycobacterium
EDSWLRHLVMLGARNRYGPP

SEQ ID NO: 1331552 - protein, 22 aa, Mycobacterium
EDVARLLVFLYLGVRQASDLDD

SEQ ID NO: 1331553 - protein, 24 aa, Mycobacterium
EGGWPGFFAVLRLYLRDFAGQPAA

SEQ ID NO: 1331554 - protein, 17 aa, Mycobacterium
EGLLYERRLFHSTFATE

SEQ ID NO: 1331555 - protein, 23 aa, Mycobacterium
EGRGFFYILDGLNPERMLIAAEA

SEQ ID NO: 1331556 - protein, 17 aa, Mycobacterium
EGWMPFGRVFETLTWGR

SEQ ID NO: 1331557 - protein, 20 aa, Mycobacterium
EIYTMWRPSPLIRARRFEKA

SEQ ID NO: 1331558 - protein, 17 aa, Mycobacterium
ELDGLRLITWRGASRAE

SEQ ID NO: 1331559 - protein, 21 aa, Mycobacterium
ELIDFWRFNVAFARGILTQQP

SEQ ID NO: 1331560 - protein, 18 aa, Mycobacterium
ELLFLYNGVKPRNVMPVH

SEQ ID NO: 1331561 - protein, 26 aa, Mycobacterium
ELRRRWGGLLSYRYIGRLYASMDPRA

SEQ ID NO: 1331562 - protein, 24 aa, Mycobacterium
ELSDGTLRFLLWTAALLSPEPPSL

SEQ ID NO: 1331563 - protein, 26 aa, Mycobacterium
ELVVVRPIGFEPLRWVRALAAEEPVP

SEQ ID NO: 1331564 - protein, 18 aa, Mycobacterium
EMGLLKYLIGQLLLSEAD

SEQ ID NO: 1331565 - protein, 18 aa, Mycobacterium
ENGYLLLMRVGDGSNLAT

SEQ ID NO: 1331566 - protein, 17 aa, Mycobacterium
ENLFFKEKRYDLARVGR

SEQ ID NO: 1331567 - protein, 23 aa, Mycobacterium
ENPIPNPPPFWRAAAEQGLQGVH

SEQ ID NO: 1331568 - protein, 19 aa, Mycobacterium
EPAFFGVRPHAVIKGGMIA

SEQ ID NO: 1331569 - protein, 17 aa, Mycobacterium
EPSPYLPTSRRFVNPLY

SEQ ID NO: 1331570 - protein, 28 aa, Mycobacterium
EPSWSFLYRKMIPILAGAGFRVVCPDLV

SEQ ID NO: 1331571 - protein, 17 aa, Mycobacterium
EPVSRFLVGGLLEVLRS

SEQ ID NO: 1331572 - protein, 21 aa, Mycobacterium
EPYRREVERLGRLVFGDSFEV

SEQ ID NO: 1331573 - protein, 22 aa, Mycobacterium
EQRKQWLDPLLNGEIRSAFAMT

SEQ ID NO: 1331574 - protein, 18 aa, Mycobacterium
ERDDLPIMFAACSPTLFV

SEQ ID NO: 1331575 - protein, 22 aa, Mycobacterium
ERFTLLRPLLFTIAYEILGSAT

SEQ ID NO: 1331576 - protein, 26 aa, Mycobacterium
ERGPAIRFLLIELPGPAWRLVIVAHH

SEQ ID NO: 1331577 - protein, 19 aa, Mycobacterium
ERRAFLTDVSLIGGLIIAA

SEQ ID NO: 1331578 - protein, 22 aa, Mycobacterium
ESTLGLIFHWADQKGLPLLDLK

SEQ ID NO: 1331579 - protein, 24 aa, Mycobacterium
ETLFDALLPRYVSTRIFAAMLEAA

SEQ ID NO: 1331580 - protein, 22 aa, Mycobacterium
ETLSFFPLWSYATPPAIELAER

SEQ ID NO: 1331581 - protein, 25 aa, Mycobacterium
ETQMNLLFEPIPPMTPIVIPGVGES

SEQ ID NO: 1331582 - protein, 17 aa, Mycobacterium
ETYLDIHRIIAAASLTG

SEQ ID NO: 1331583 - protein, 25 aa, Mycobacterium
EVGKLADLVLWEPAFFGVRPHAVIK

SEQ ID NO: 1331584 - protein, 24 aa, Mycobacterium
EVIGTFTQLPFKLAWAITIHKSQG

SEQ ID NO: 1331585 - protein, 18 aa, Mycobacterium
EVLPLLYLHGLSTSDFGP

SEQ ID NO: 1331586 - protein, 25 aa, Mycobacterium
EVMPEDLIKFGLIPEFIGRLPVVAS

SEQ ID NO: 1331587 - protein, 17 aa, Mycobacterium
EWGATSAAFRDLLAEWK

SEQ ID NO: 1331588 - protein, 17 aa, Mycobacterium
EWGMPPAAVLRAATVVA

SEQ ID NO: 1331589 - protein, 17 aa, Mycobacterium
EWIVGHPATVRSALILA

SEQ ID NO: 1331590 - protein, 22 aa, Mycobacterium
EYDHLTLSWVYDWMARGVPVVA

SEQ ID NO: 1331591 - protein, 22 aa, Mycobacterium
EYGISWILPRLVGFGAAMDLLL

SEQ ID NO: 1331592 - protein, 17 aa, Mycobacterium
EYSVDLFALLPLGELWV

SEQ ID NO: 1331593 - protein, 19 aa, Mycobacterium
FANRDLLPGALASLADPHV

SEQ ID NO: 1331594 - protein, 18 aa, Mycobacterium
FARAYLATGLLALGKTRL

SEQ ID NO: 1331595 - protein, 22 aa, Mycobacterium
FEHLGRLLIIDCGVLFPGHDEP

SEQ ID NO: 1331596 - protein, 25 aa, Mycobacterium
FEPLLLDWRAPLSRAFYVATAAHPE

SEQ ID NO: 1331597 - protein, 17 aa, Mycobacterium
FFALLRDWTARHRHSTA

SEQ ID NO: 1331598 - protein, 17 aa, Mycobacterium
FGDRRKAFLDDLAVVTG

SEQ ID NO: 1331599 - protein, 27 aa, Mycobacterium
FGDRVVWVPWRRPGFQLGLDIAEIKRA

SEQ ID NO: 1331600 - protein, 23 aa, Mycobacterium
FGELTARLYALEALLAAGTARID

SEQ ID NO: 1331601 - protein, 24 aa, Mycobacterium
FHIYARIEPRWPFKFVRLAAQTIA

SEQ ID NO: 1331602 - protein, 18 aa, Mycobacterium
FHPSVYLGIIKFLGFEQI

SEQ ID NO: 1331603 - protein, 18 aa, Mycobacterium
FIFINLDPEPRWSLREFL

SEQ ID NO: 1331604 - protein, 17 aa, Mycobacterium
FIRQFPFNVLLKDLDRR

SEQ ID NO: 1331605 - protein, 18 aa, Mycobacterium
FLAWHAWRDADSGNWPTG

SEQ ID NO: 1331606 - protein, 26 aa, Mycobacterium
FLRSRRPWIWGPRMLTGLDVSAGATL

SEQ ID NO: 1331607 - protein, 17 aa, Mycobacterium
FMRPFRADEWLLYDQSS

SEQ ID NO: 1331608 - protein, 17 aa, Mycobacterium
FNIPIVMLVDVPGFLPG

SEQ ID NO: 1331609 - protein, 18 aa, Mycobacterium
FNVLRLSAERIAKTEPIN

SEQ ID NO: 1331610 - protein, 19 aa, Mycobacterium
FPASLTDVGVRLPFGEVTL

SEQ ID NO: 1331611 - protein, 20 aa, Mycobacterium
FPELNGLFHLALRGAARNAV

SEQ ID NO: 1331612 - protein, 19 aa, Mycobacterium
FPEPVLMWWNFVGRSHEEI

SEQ ID NO: 1331613 - protein, 26 aa, Mycobacterium
FPNGVDWIVWWLAVSRIGALAVPLST

SEQ ID NO: 1331614 - protein, 18 aa, Mycobacterium
FPTLYYLTHPVLTAAASR

SEQ ID NO: 1331615 - protein, 23 aa, Mycobacterium
FPYPVTVGYMYILKLHHLVDDKI

SEQ ID NO: 1331616 - protein, 19 aa, Mycobacterium
FQASPFRWLNWLSDSRATI

SEQ ID NO: 1331617 - protein, 20 aa, Mycobacterium
FQQFNLFPHRSVLDNVTLAP

SEQ ID NO: 1331618 - protein, 17 aa, Mycobacterium
FRFIAEDIRRYLAEMGF

SEQ ID NO: 1331619 - protein, 26 aa, Mycobacterium
FRGAKNVLLVFFPLAFTGICQGELDE

SEQ ID NO: 1331620 - protein, 17 aa, Mycobacterium
FRQLLAGRDFAVGDMIA

SEQ ID NO: 1331621 - protein, 20 aa, Mycobacterium
FSALFPIEIISRMIGVPAED

SEQ ID NO: 1331622 - protein, 18 aa, Mycobacterium
FSALGAGLTLPWLAGLDR

SEQ ID NO: 1331623 - protein, 17 aa, Mycobacterium
FTMLGTLIRGRVTVGGS

SEQ ID NO: 1331624 - protein, 17 aa, Mycobacterium
FVKWYSSAQAERFNARG

SEQ ID NO: 1331625 - protein, 17 aa, Mycobacterium
FVPILRVTAIEPSAVTL

SEQ ID NO: 1331626 - protein, 19 aa, Mycobacterium
FVSRQWFRRGWQVEREVLL

SEQ ID NO: 1331627 - protein, 25 aa, Mycobacterium
FWFDPLCPWCWITSRWILEVEKVRD

SEQ ID NO: 1331628 - protein, 17 aa, Mycobacterium
FWGGLRIGWIRADPSTL

SEQ ID NO: 1331629 - protein, 17 aa, Mycobacterium
FYGPQFALTFPVLTHYG

SEQ ID NO: 1331630 - protein, 18 aa, Mycobacterium
FYLAMYWAQELAGQTEDK

SEQ ID NO: 1331631 - protein, 22 aa, Mycobacterium
GAAHFLEHLLFKSTPTRTAVDI

SEQ ID NO: 1331632 - protein, 24 aa, Mycobacterium
GAATPLFRLHLDPDILLLGFSLPG

SEQ ID NO: 1331633 - protein, 19 aa, Mycobacterium
GALMVIYRISADQAFRVLQ

SEQ ID NO: 1331634 - protein, 17 aa, Mycobacterium
GAYGTWWQADPTNDLIL

SEQ ID NO: 1331635 - protein, 25 aa, Mycobacterium
GCSWLPLYHDMGLSFLLTGALAGVE

SEQ ID NO: 1331636 - protein, 24 aa, Mycobacterium
GDARSELWFFYHLGRILREKLAGS

SEQ ID NO: 1331637 - protein, 24 aa, Mycobacterium
GDAYHHIFMRILIAARTHGIHAID

SEQ ID NO: 1331638 - protein, 22 aa, Mycobacterium
GDFLFAALHRAGLANQSLCVDA

SEQ ID NO: 1331639 - protein, 24 aa, Mycobacterium
GDLRGRFRWWGLYTQRKPGFDGTW

SEQ ID NO: 1331640 - protein, 17 aa, Mycobacterium
GDRLPAWAPGAHVAVTL

SEQ ID NO: 1331641 - protein, 25 aa, Mycobacterium
GDSKMGLFPFRRNLAFYAVDLALLT

SEQ ID NO: 1331642 - protein, 25 aa, Mycobacterium
GEEVAPWLDLVRKLGLLAGTLATEP

SEQ ID NO: 1331643 - protein, 20 aa, Mycobacterium
GELDWMVLFSSCGYLAGFPG

SEQ ID NO: 1331644 - protein, 18 aa, Mycobacterium
GEPPLPGALLIAGEGRVV

SEQ ID NO: 1331645 - protein, 17 aa, Mycobacterium
GERIVYIRTLVTGKSSS

SEQ ID NO: 1331646 - protein, 21 aa, Mycobacterium
GFALPIPSLVICELLGVPYAD

SEQ ID NO: 1331647 - protein, 17 aa, Mycobacterium
GFGTATLLRHHFRRIIG

SEQ ID NO: 1331648 - protein, 35 aa, Mycobacterium
GFLLWQSAYSEMWFTEAYWPAFRRVDFLRALRDYT

SEQ ID NO: 1331649 - protein, 18 aa, Mycobacterium
GFVFQHYAAFKHLSVREN

SEQ ID NO: 1331650 - protein, 19 aa, Mycobacterium
GFVPFIIPINDRTLEDTRA

SEQ ID NO: 1331651 - protein, 26 aa, Mycobacterium
GGDATRLLYTLGWHEVPLPAVDPAAP

SEQ ID NO: 1331652 - protein, 18 aa, Mycobacterium
GGLGLLTPPPWYPILRGT

SEQ ID NO: 1331653 - protein, 18 aa, Mycobacterium
GGLVVLPQDLPISAVQQT

SEQ ID NO: 1331654 - protein, 26 aa, Mycobacterium
GGNNNWFAAYAYWYFKLYGHENVKLL

SEQ ID NO: 1331655 - protein, 17 aa, Mycobacterium
GGPFYRYLFTNPAVYRR

SEQ ID NO: 1331656 - protein, 18 aa, Mycobacterium
GGPSILCQVLLYPGLDRD

SEQ ID NO: 1331657 - protein, 24 aa, Mycobacterium
GGQKPWLPHFYLGHGIGTSAAEMP

SEQ ID NO: 1331658 - protein, 24 aa, Mycobacterium
GGTDNWFWIKVPVGYLYTIANPRT

SEQ ID NO: 1331659 - protein, 25 aa, Mycobacterium
GGTRFRPHFFPFTEPSAEVDVWFPG

SEQ ID NO: 1331660 - protein, 24 aa, Mycobacterium
GGTYNLFHYTLPKLGIDVSFVENP

SEQ ID NO: 1331661 - protein, 22 aa, Mycobacterium
GHDLDMRTLFPRRSRGLAGALD

SEQ ID NO: 1331662 - protein, 19 aa, Mycobacterium
GHDVLLAPTLLTPPPPYAL

SEQ ID NO: 1331663 - protein, 19 aa, Mycobacterium
GIFVQRIVALTPIQALRKD

SEQ ID NO: 1331664 - protein, 18 aa, Mycobacterium
GIGAAWFEREHRGLGVPY

SEQ ID NO: 1331665 - protein, 18 aa, Mycobacterium
GIQFLPFNTVYQLAVERA

SEQ ID NO: 1331666 - protein, 19 aa, Mycobacterium
GIRFYAGYPLYGPGGHPVG

SEQ ID NO: 1331667 - protein, 22 aa, Mycobacterium
GKHLWMIYLMRVVDARVVLDKP

SEQ ID NO: 1331668 - protein, 18 aa, Mycobacterium
GLAFRKRTPVRVDRLTLG

SEQ ID NO: 1331669 - protein, 23 aa, Mycobacterium
GLELARRLAREWLNYEFDPASKS

SEQ ID NO: 1331670 - protein, 21 aa, Mycobacterium
GLEYVLAFLGAMQAGLVAVPL

SEQ ID NO: 1331671 - protein, 17 aa, Mycobacterium
GLFALRGGYREPVLASS

SEQ ID NO: 1331672 - protein, 18 aa, Mycobacterium
GLFDNDGFRRAWLADAAA

SEQ ID NO: 1331673 - protein, 18 aa, Mycobacterium
GLFVWRRYHPSPAPDRGV

SEQ ID NO: 1331674 - protein, 24 aa, Mycobacterium
GLKGLFEFFTPLLRNVTPNARLVV

SEQ ID NO: 1331675 - protein, 17 aa, Mycobacterium
GLPWMAEYRREFGLVDP

SEQ ID NO: 1331676 - protein, 22 aa, Mycobacterium
GLSCFFLPRILPDGTRNRMLLQ

SEQ ID NO: 1331677 - protein, 17 aa, Mycobacterium
GLVLSYLTGRKLTLDEV

SEQ ID NO: 1331678 - protein, 23 aa, Mycobacterium
GMGAYAPLPWLPADITTSIVDDI

SEQ ID NO: 1331679 - protein, 23 aa, Mycobacterium
GMGRALIAPLRIALREAGVPVLL

SEQ ID NO: 1331680 - protein, 24 aa, Mycobacterium
GMLTTVQLPLYFSDLRDARCTSAI

SEQ ID NO: 1331681 - protein, 23 aa, Mycobacterium
GNAGIFDYFAPLVGFDGADLSSA

SEQ ID NO: 1331682 - protein, 19 aa, Mycobacterium
GNVLRFLPPLAISDELLDE

SEQ ID NO: 1331683 - protein, 21 aa, Mycobacterium
GNYICVYPFVRSLEWYLLPDD

SEQ ID NO: 1331684 - protein, 23 aa, Mycobacterium
GPAVDGGWWLLGVRTAAMADCLR

SEQ ID NO: 1331685 - protein, 19 aa, Mycobacterium
GPTTGLWILLLAKGGGDDT

SEQ ID NO: 1331686 - protein, 23 aa, Mycobacterium
GQFAFDEFLEIKAALGYAPEAAA

SEQ ID NO: 1331687 - protein, 31 aa, Mycobacterium
GQHISTLLLTLLFRFMKPLIENGHVFLAQPP

SEQ ID NO: 1331688 - protein, 18 aa, Mycobacterium
GRAWLGIGAAWFEREHRG

SEQ ID NO: 1331689 - protein, 21 aa, Mycobacterium
GRGKYRLGFAIARLARASSGH

SEQ ID NO: 1331690 - protein, 19 aa, Mycobacterium
GRGYWFAPTVLTPQRTDRT

SEQ ID NO: 1331691 - protein, 18 aa, Mycobacterium
GRIARILGPRGLMPNPKT

SEQ ID NO: 1331692 - protein, 25 aa, Mycobacterium
GRKRTHWIWFIFPQLRGLGRSPTAQ

SEQ ID NO: 1331693 - protein, 20 aa, Mycobacterium
GRVLPMCPIALQIEADVAGL

SEQ ID NO: 1331694 - protein, 25 aa, Mycobacterium
GSFVSYFGWLYEWGAPVTLIGESQD

SEQ ID NO: 1331695 - protein, 24 aa, Mycobacterium
GSGEGFVRRLWWRVTVDLPDDALL

SEQ ID NO: 1331696 - protein, 20 aa, Mycobacterium
GSQQIRLFAPLKPAGRLSVV

SEQ ID NO: 1331697 - protein, 25 aa, Mycobacterium
GTEQLSHTFALIDLLPWGRQEEWQD

SEQ ID NO: 1331698 - protein, 24 aa, Mycobacterium
GTGTWMLSVDRTGQVRWFGLDGVE

SEQ ID NO: 1331699 - protein, 25 aa, Mycobacterium
GTHDAPVYRLPWQPVFALNFSAVNL

SEQ ID NO: 1331700 - protein, 18 aa, Mycobacterium
GTLLDRHRPLWEAHLVEG

SEQ ID NO: 1331701 - protein, 17 aa, Mycobacterium
GVFALSGWDLCGMLTLP

SEQ ID NO: 1331702 - protein, 19 aa, Mycobacterium
GVLLLFSALELLHACALVH

SEQ ID NO: 1331703 - protein, 23 aa, Mycobacterium
GVLLPIHWGTFRLAPHPWAEPVQ

SEQ ID NO: 1331704 - protein, 20 aa, Mycobacterium
GVLVLWIELLEQRPFTPEDR

SEQ ID NO: 1331705 - protein, 24 aa, Mycobacterium
GWEPEPLRWLGVRGLYLAYRLADR

SEQ ID NO: 1331706 - protein, 17 aa, Mycobacterium
GWFMAWLARAHPELVGE

SEQ ID NO: 1331707 - protein, 23 aa, Mycobacterium
GWHPKGEELLWRPDLQQLKRSQS

SEQ ID NO: 1331708 - protein, 18 aa, Mycobacterium
GWIRLFVSTPSPASLRLI

SEQ ID NO: 1331709 - protein, 17 aa, Mycobacterium
GWVRMDFIVPSRGLIGF

SEQ ID NO: 1331710 - protein, 19 aa, Mycobacterium
GYCFQIDLTWRTINNGFVV

SEQ ID NO: 1331711 - protein, 21 aa, Mycobacterium
GYSWGPLAWMLLAQALGERGA

SEQ ID NO: 1331712 - protein, 20 aa, Mycobacterium
HAPFRIGYIERDAWLRCMHT

SEQ ID NO: 1331713 - protein, 22 aa, Mycobacterium
HAWSCFFAPWIAEATIFVYNYR

SEQ ID NO: 1331714 - protein, 27 aa, Mycobacterium
HDPVWYDHLPYLPFPQNWPVFAPKDKI

SEQ ID NO: 1331715 - protein, 26 aa, Mycobacterium
HEDDLQLLWLPLAHAFGKVLISAQLA

SEQ ID NO: 1331716 - protein, 24 aa, Mycobacterium
HEVGWSMLPVARTALRRIGDDTDV

SEQ ID NO: 1331717 - protein, 24 aa, Mycobacterium
HFAGVLTVVCKLLHIVRPDRAFFG

SEQ ID NO: 1331718 - protein, 17 aa, Mycobacterium
HFRRIIGVTPTDYRRRF

SEQ ID NO: 1331719 - protein, 22 aa, Mycobacterium
HGGLPHPTILAAAALLGVDEVW

SEQ ID NO: 1331720 - protein, 18 aa, Mycobacterium
HGIQLWVNLPRKDKFATP

SEQ ID NO: 1331721 - protein, 19 aa, Mycobacterium
HHCAWPLHRRFGITATARA

SEQ ID NO: 1331722 - protein, 19 aa, Mycobacterium
HIDKWKFTVPFVCGATNLG

SEQ ID NO: 1331723 - protein, 20 aa, Mycobacterium
HIGAVPFLLKLRPDIPVVGS

SEQ ID NO: 1331724 - protein, 17 aa, Mycobacterium
HKDLYREYSLRPPKGVL

SEQ ID NO: 1331725 - protein, 24 aa, Mycobacterium
HKRQYGYYVWPFLLDGRLVGRVDL

SEQ ID NO: 1331726 - protein, 24 aa, Mycobacterium
HKVSERLPLPAPLRRIHDPSINIS

SEQ ID NO: 1331727 - protein, 23 aa, Mycobacterium
HLDPTMFAAFMPGALELTVEEGI

SEQ ID NO: 1331728 - protein, 18 aa, Mycobacterium
HLHVHVFPAYNLTDFGFA

SEQ ID NO: 1331729 - protein, 30 aa, Mycobacterium; identical to SEQ ID NO: 227588

SEQ ID NO: 1331730 - protein, 22 aa, Mycobacterium
HNRILALGYRIAPRPVLAMVSE

SEQ ID NO: 1331731 - protein, 21 aa, Mycobacterium
HPDTLWRFEYSPESYTGTELE

SEQ ID NO: 1331732 - protein, 24 aa, Mycobacterium
HPHQAGWWMHFFLADGGAVLVGSG

SEQ ID NO: 1331733 - protein, 18 aa, Mycobacterium
HRALFANRDLLPGALASL

SEQ ID NO: 1331734 - protein, 22 aa, Mycobacterium
HRDFAVRLVTFAAIALAAGQPY

SEQ ID NO: 1331735 - protein, 18 aa, Mycobacterium
HRPVAEYFVWFKADYQVD

SEQ ID NO: 1331736 - protein, 18 aa, Mycobacterium
HSDLAPPVFYLTAAPDLS

SEQ ID NO: 1331737 - protein, 30 aa, Mycobacterium
HTAPFEAGSPWLLRFFDRISWYPVSAEELL

SEQ ID NO: 1331738 - protein, 20 aa, Mycobacterium
HTGTLWRVGFGGFAPGFAYL

SEQ ID NO: 1331739 - protein, 25 aa, Mycobacterium
HVSLWGLLIPIRRAFRQYVNLRPIR

SEQ ID NO: 1331740 - protein, 25 aa, Mycobacterium
HWDTTLMRRIGLRPSLFRELVEPGS

SEQ ID NO: 1331741 - protein, 17 aa, Mycobacterium
HWFYVYSAVIWACVFMR

SEQ ID NO: 1331742 - protein, 17 aa, Mycobacterium
HYALFPHMSVWDNVAYG

SEQ ID NO: 1331743 - protein, 23 aa, Mycobacterium
IAAYPRVVWIAGGLLKGVSVDAL

SEQ ID NO: 1331744 - protein, 22 aa, Mycobacterium
IDALWPMVVLRTAVLIVSGAQQ

SEQ ID NO: 1331745 - protein, 18 aa, Mycobacterium
IDDEFFVIVRPAPSGTRL

SEQ ID NO: 1331746 - protein, 26 aa, Mycobacterium
IDHIIGLFRLWWIPRGAAPTEGTYVR

SEQ ID NO: 1331747 - protein, 18 aa, Mycobacterium
IEFPARIGVWWASETWSI

SEQ ID NO: 1331748 - protein, 18 aa, Mycobacterium
IFVTYRHRLLLGWTHMQD

SEQ ID NO: 1331749 - protein, 17 aa, Mycobacterium
IGDEKFFALLRDWTARH

SEQ ID NO: 1331750 - protein, 17 aa, Mycobacterium
IGPYYLRLSFTAGGMLA

SEQ ID NO: 1331751 - protein, 17 aa, Mycobacterium
IGWTCRDVWWAATQDPR

SEQ ID NO: 1331752 - protein, 18 aa, Mycobacterium
IHSHALHIYLLHAPDFLG

SEQ ID NO: 1331753 - protein, 17 aa, Mycobacterium
IHSVFLFHAIKAGLDMG

SEQ ID NO: 1331754 - protein, 23 aa, Mycobacterium
IINALPLFFQKSVLWIAALVGEE

SEQ ID NO: 1331755 - protein, 17 aa, Mycobacterium
ILCECNCGIVVEVEGRS

SEQ ID NO: 1331756 - protein, 20 aa, Mycobacterium
ILGLGMPFFAQSMYMIADGL

SEQ ID NO: 1331757 - protein, 17 aa, Mycobacterium
ILKALWALIGHDLPTPL

SEQ ID NO: 1331758 - protein, 18 aa, Mycobacterium
ILMHWRSVAAERPHQVPV

SEQ ID NO: 1331759 - protein, 21 aa, Mycobacterium
ILPITWMYIRMMGAPGLRAAS

SEQ ID NO: 1331760 - protein, 17 aa, Mycobacterium
ILQGQCRFSWPPQIDLP

SEQ ID NO: 1331761 - protein, 19 aa, Mycobacterium
ILVLGRLRIAIPADFAPII

SEQ ID NO: 1331762 - protein, 21 aa, Mycobacterium
IPAWLIFDQQYRDRYIFAGLQ

SEQ ID NO: 1331763 - protein, 20 aa, Mycobacterium
IPFAIPYTKPLKFASGEVTD

SEQ ID NO: 1331764 - protein, 17 aa, Mycobacterium
IPIVMLVDVPGFLPGTE

SEQ ID NO: 1331765 - protein, 24 aa, Mycobacterium
IQFNSLFLDPYLWKLQLGGKRLVQ

SEQ ID NO: 1331766 - protein, 18 aa, Mycobacterium
IREMMIYALRWPIDRRAG

SEQ ID NO: 1331767 - protein, 25 aa, Mycobacterium
IRHLSAPLYYQFLTTTTPLSTRDAD

SEQ ID NO: 1331768 - protein, 26 aa, Mycobacterium
IRQNVGLVPGLLRWDRKRIASRVDEL

SEQ ID NO: 1331769 - protein, 17 aa, Mycobacterium
IRRTLTVARLLAPIAVP

SEQ ID NO: 1331770 - protein, 19 aa, Mycobacterium
ISPVDYMLYTPLLPDVAGG

SEQ ID NO: 1331771 - protein, 17 aa, Mycobacterium
ISYSPRPPAAGASDIAL

SEQ ID NO: 1331772 - protein, 17 aa, Mycobacterium
ITAWNVPFFLAANKLGP

SEQ ID NO: 1331773 - protein, 17 aa, Mycobacterium
IVLWSWALKQPNDGRPA

SEQ ID NO: 1331774 - protein, 21 aa, Mycobacterium
IVRDLDLLRPIYAPTAAYGHF

SEQ ID NO: 1331775 - protein, 18 aa, Mycobacterium
IWAFKQLWDKGLAYQGVR

SEQ ID NO: 1331776 - protein, 22 aa, Mycobacterium
IYEDLAWFCIRAWRFGASERLG

SEQ ID NO: 1331777 - protein, 21 aa, Mycobacterium
KAGFDLPMLRAVRGAVTVPVI

SEQ ID NO: 1331778 - protein, 24 aa, Mycobacterium
KAGPDALVVVLLPDGGRGYLSKIF

SEQ ID NO: 1331779 - protein, 26 aa, Mycobacterium
KDGYGRNYLLPRGLAIVASRGAQRQA

SEQ ID NO: 1331780 - protein, 20 aa, Mycobacterium
KDLLPLLEKVIQSGKPLLII

SEQ ID NO: 1331781 - protein, 23 aa, Mycobacterium
KEWHQYWIDTRLQWYVDLGIDRD

SEQ ID NO: 1331782 - protein, 17 aa, Mycobacterium
KFQFITLAGFHALNYSM

SEQ ID NO: 1331783 - protein, 25 aa, Mycobacterium
KGETLEEYWWAAEQMLTWPGEPANM

SEQ ID NO: 1331784 - protein, 22 aa, Mycobacterium
KHGIVGLMRTLANALAPHSIRV

SEQ ID NO: 1331785 - protein, 21 aa, Mycobacterium
KHIAWYLHGFPAGSDLRRALA

SEQ ID NO: 1331786 - protein, 17 aa, Mycobacterium
KHRVFHYPGGLVDFVKH

SEQ ID NO: 1331787 - protein, 20 aa, Mycobacterium
KLLIVDLPRPPAPLHVVRLL

SEQ ID NO: 1331788 - protein, 21 aa, Mycobacterium
KLTVYLVDWTPEKMPAFADGL

SEQ ID NO: 1331789 - protein, 20 aa, Mycobacterium
KNPRLWRRLLQCSSATGADG

SEQ ID NO: 1331790 - protein, 23 aa, Mycobacterium
KNQARWQFGVLGPPGAAAAGIGE

SEQ ID NO: 1331791 - protein, 26 aa, Mycobacterium
KPHRGYWYLKKYGLPFMYWNLMLKGL

SEQ ID NO: 1331792 - protein, 17 aa, Mycobacterium
KPRLLATFPFPHVLTMS

SEQ ID NO: 1331793 - protein, 25 aa, Mycobacterium
KQFRTWHYWWQAHLLDCLVDAQLRE

SEQ ID NO: 1331794 - protein, 20 aa, Mycobacterium
KQWFSVHRTIFRLAFPGGKP

SEQ ID NO: 1331795 - protein, 22 aa, Mycobacterium
KRHEILQLSLLKPKIAILDETD

SEQ ID NO: 1331796 - protein, 25 aa, Mycobacterium
KRSLIAMRSQRYFRLLDALDGLVAA

SEQ ID NO: 1331797 - protein, 25 aa, Mycobacterium
KRVRLMLEMHLLAPLHLSQLAIPAM

SEQ ID NO: 1331798 - protein, 24 aa, Mycobacterium
KTFGDHFFYILYFQEPGVADADLG

SEQ ID NO: 1331799 - protein, 20 aa, Mycobacterium
KVVPLYFLADAGVIGLLTGR

SEQ ID NO: 1331800 - protein, 17 aa, Mycobacterium
LAAHFFLTFPQLHDVRF

SEQ ID NO: 1331801 - protein, 23 aa, Mycobacterium
LAELQRLWLIEAVKYDVLPIDDR

SEQ ID NO: 1331802 - protein, 23 aa, Mycobacterium
LAGIPWFLIEALLDQGADDLTIV

SEQ ID NO: 1331803 - protein, 17 aa, Mycobacterium
LAHRFADKPTILFLGRH

SEQ ID NO: 1331804 - protein, 19 aa, Mycobacterium
LALDSLGLTPILDLGMRLG

SEQ ID NO: 1331805 - protein, 19 aa, Mycobacterium
LALPLALYRAVTAFGRVAV

SEQ ID NO: 1331806 - protein, 18 aa, Mycobacterium
LALVSFGLLLVLTGDRSG

SEQ ID NO: 1331807 - protein, 22 aa, Mycobacterium
LAPALRLGWMALPDALVEPVLA

SEQ ID NO: 1331808 - protein, 23 aa, Mycobacterium
LARPSWMPVGPGTYGRFLAIRVF

SEQ ID NO: 1331809 - protein, 24 aa, Mycobacterium
LATQRTRLPLPWAQARLLSTIEDQ

SEQ ID NO: 1331810 - protein, 23 aa, Mycobacterium
LCDKRVIPLLFLQNIAGFMVGRD

SEQ ID NO: 1331811 - protein, 24 aa, Mycobacterium
LCPFDPLIFFRPRVERLFGFHYRI

SEQ ID NO: 1331812 - protein, 20 aa, Mycobacterium
LCYAGPFFRYERPQAGRYRQ

SEQ ID NO: 1331813 - protein, 18 aa, Mycobacterium
LDAFTHWRRAQGLPASAI

SEQ ID NO: 1331814 - protein, 23 aa, Mycobacterium
LDGSKVPLLLIPGAFMATDSMQA

SEQ ID NO: 1331815 - protein, 20 aa, Mycobacterium
LDHAMWFMRPFRADEWLLYD

SEQ ID NO: 1331816 - protein, 19 aa, Mycobacterium
LDNWWSYLREVQSTYPLSY

SEQ ID NO: 1331817 - protein, 24 aa, Mycobacterium
LDRSAFRWWLTVATLRWGVICRFQ

SEQ ID NO: 1331818 - protein, 17 aa, Mycobacterium
LDSPPFYDPWFSKARTS

SEQ ID NO: 1331819 - protein, 23 aa, Mycobacterium
LDTPLFPVIGHPGASLGAAVIAA

SEQ ID NO: 1331820 - protein, 18 aa, Mycobacterium
LEAPLKQIAFNGGLEPGV

SEQ ID NO: 1331821 - protein, 18 aa, Mycobacterium
LEARPQTIFLYHNFIRHW

SEQ ID NO: 1331822 - protein, 26 aa, Mycobacterium
LEDWKHWVRWRLIHARAFLLTDELVA

SEQ ID NO: 1331823 - protein, 22 aa, Mycobacterium
LEFDLLMLVAPVLRKLALNDAK

SEQ ID NO: 1331824 - protein, 23 aa, Mycobacterium
LEGRRLRFTLSGPPTLVLRALSS

SEQ ID NO: 1331825 - protein, 23 aa, Mycobacterium
LEGSWQYRRLFRRLPPEEPKHRA

SEQ ID NO: 1331826 - protein, 24 aa, Mycobacterium
LELRRHILTLWQTALIRLSRLKIQ

SEQ ID NO: 1331827 - protein, 19 aa, Mycobacterium
LEYTLRWRNTPKPSIAAVQ

SEQ ID NO: 1331828 - protein, 20 aa, Mycobacterium
LFAAFIGAALDYKAAERLPV

SEQ ID NO: 1331829 - protein, 17 aa, Mycobacterium
LFIVGRIKDLLIIRGRN

SEQ ID NO: 1331830 - protein, 18 aa, Mycobacterium
LFRRTEVPPILLTSARTA

SEQ ID NO: 1331831 - protein, 17 aa, Mycobacterium
LGGFAGLFALRGGYREP

SEQ ID NO: 1331832 - protein, 18 aa, Mycobacterium
LGLLGFDVGLPRLPQIPP

SEQ ID NO: 1331833 - protein, 18 aa, Mycobacterium
LGMPPWRVQKAQKQARRW

SEQ ID NO: 1331834 - protein, 23 aa, Mycobacterium
LGPTLIASWLNYLPPRLVPPVFR

SEQ ID NO: 1331835 - protein, 17 aa, Mycobacterium
LGRKYPWALGRPASEVW

SEQ ID NO: 1331836 - protein, 19 aa, Mycobacterium
LGTFPYRDLYMLDAARQFV

SEQ ID NO: 1331837 - protein, 24 aa, Mycobacterium
LGVLLAYSPLHTLLFGLPGDEPGP

SEQ ID NO: 1331838 - protein, 23 aa, Mycobacterium
LGVTCLWLMPFYPTARKDDGYDI

SEQ ID NO: 1331839 - protein, 24 aa, Mycobacterium
LGVYGRIMHILATDLLYLPEEEQS

SEQ ID NO: 1331840 - protein, 23 aa, Mycobacterium
LHEAKLAMHDLAGRGWKLAGVTS

SEQ ID NO: 1331841 - protein, 19 aa, Mycobacterium
LHINFLAAVRLNAALLPAL

SEQ ID NO: 1331842 - protein, 18 aa, Mycobacterium
LHQGLGLQVPPYDYAHPD

SEQ ID NO: 1331843 - protein, 26 aa, Mycobacterium
LHRTDPLLLLPLLRAMTPVPVLLLHC

SEQ ID NO: 1331844 - protein, 26 aa, Mycobacterium
LHSCAVGLPWKLLLRSRLQAVAVDAV

SEQ ID NO: 1331845 - protein, 22 aa, Mycobacterium
LIDRPMEFLGNLVLLIVGGNDT

SEQ ID NO: 1331846 - protein, 17 aa, Mycobacterium
LIQHLIRWVILSKQFDD

SEQ ID NO: 1331847 - protein, 18 aa, Mycobacterium
LIRAFWPGALSLVVRQAP

SEQ ID NO: 1331848 - protein, 25 aa, Mycobacterium
LIRGEWRPLYLFADRPQPLIDLEVG

SEQ ID NO: 1331849 - protein, 19 aa, Mycobacterium
LITIILMRCGLRITDALRL

SEQ ID NO: 1331850 - protein, 18 aa, Mycobacterium
LIVIPNDRLLQMGDAAVS

SEQ ID NO: 1331851 - protein, 19 aa, Mycobacterium
LIVRGFFGEIISKIAVPAV

SEQ ID NO: 1331852 - protein, 18 aa, Mycobacterium
LLALIFEWGIALHGLHSS

SEQ ID NO: 1331853 - protein, 30 aa, Mycobacterium
LLDPDPMFVPKLLGPLLLTPGVHLVKGFYR

SEQ ID NO: 1331854 - protein, 19 aa, Mycobacterium
LLHPMSAPMTLRWLRDRFA

SEQ ID NO: 1331855 - protein, 17 aa, Mycobacterium
LLKPPFPDPGTPLQLVH

SEQ ID NO: 1331856 - protein, 19 aa, Mycobacterium
LLNYLRRMVFWADVTIEPA

SEQ ID NO: 1331857 - protein, 20 aa, Mycobacterium
LLPIPPIALQLRTGIAILSY

SEQ ID NO: 1331858 - protein, 24 aa, Mycobacterium
LLSSRFPMWMAWGPELTFFCNAAY

SEQ ID NO: 1331859 - protein, 19 aa, Mycobacterium
LLVPLVRFLPPDDPRVRAT

SEQ ID NO: 1331860 - protein, 19 aa, Mycobacterium
LLYVADFITQRLWAEPLLA

SEQ ID NO: 1331861 - protein, 19 aa, Mycobacterium
LMINLFWRGLKGTPSDAAG

SEQ ID NO: 1331862 - protein, 18 aa, Mycobacterium
LMPLRWGTGYMLGSKRFG

SEQ ID NO: 1331863 - protein, 17 aa, Mycobacterium
LMTLMVEAPFLLIRAAL

SEQ ID NO: 1331864 - protein, 21 aa, Mycobacterium
LNLALLWASAFPYGPTFADRI

SEQ ID NO: 1331865 - protein, 18 aa, Mycobacterium
LNQWLMEQLIMIDALKRG

SEQ ID NO: 1331866 - protein, 29 aa, Mycobacterium
LPAFIEPRWLRFLPVLPLDRGLVVPIIHA

SEQ ID NO: 1331867 - protein, 18 aa, Mycobacterium
LPAGSRLLLLWGAANRDP

SEQ ID NO: 1331868 - protein, 24 aa, Mycobacterium
LPILPQQALLYRLCGDRNPLHSDP

SEQ ID NO: 1331869 - protein, 18 aa, Mycobacterium
LPNVHWLYEYGHPRRLAQ

SEQ ID NO: 1331870 - protein, 22 aa, Mycobacterium
LPPPPPIDPFAPPPPPPAPFDA

SEQ ID NO: 1331871 - protein, 18 aa, Mycobacterium
LPVPPTPYLDLSTVALLG

SEQ ID NO: 1331872 - protein, 26 aa, Mycobacterium
LPVYDKPLIYYPLSTLIMAGIRDIQV

SEQ ID NO: 1331873 - protein, 18 aa, Mycobacterium
LQLFGAMGFTWENDLQFA

SEQ ID NO: 1331874 - protein, 24 aa, Mycobacterium
LQSALPLQILARTSALLLGRDVDK

SEQ ID NO: 1331875 - protein, 17 aa, Mycobacterium
LRADPVPIVSFTFGLPA

SEQ ID NO: 1331876 - protein, 19 aa, Mycobacterium
LREQIPGLPLLLLTAKDSV

SEQ ID NO: 1331877 - protein, 17 aa, Mycobacterium
LRIVKYLAYGWSSLRSR

SEQ ID NO: 1331878 - protein, 19 aa, Mycobacterium
LRLPMITRSLLAYRYRRLP

SEQ ID NO: 1331879 - protein, 20 aa, Mycobacterium
LRLPVLRAQLRWMEAVLAVW

SEQ ID NO: 1331880 - protein, 24 aa, Mycobacterium
LRNKIPLVMLLEGAGFRPSGEHYG

SEQ ID NO: 1331881 - protein, 19 aa, Mycobacterium
LRPRFAYWAWRVGAPADAA

SEQ ID NO: 1331882 - protein, 22 aa, Mycobacterium
LRSAALAAWLFGRPAPVDAVTV

SEQ ID NO: 1331883 - protein, 20 aa, Mycobacterium
LRSAQRLPWHPGRCAEVLIG

SEQ ID NO: 1331884 - protein, 18 aa, Mycobacterium
LRVFFGEVPLGIAKADYE

SEQ ID NO: 1331885 - protein, 19 aa, Mycobacterium
LSAFSVLLDMLVRPPLKTA

SEQ ID NO: 1331886 - protein, 24 aa, Mycobacterium
LSEKGWRTFFRGLANDGVQGPSVA

SEQ ID NO: 1331887 - protein, 22 aa, Mycobacterium
LSLAHLRRALPEAVFVSARTGQ

SEQ ID NO: 1331888 - protein, 20 aa, Mycobacterium
LSRIIPLMRARLEKLLSGPN

SEQ ID NO: 1331889 - protein, 24 aa, Mycobacterium
LTAALRLIYPRETLWRPPVLTMSA

SEQ ID NO: 1331890 - protein, 27 aa, Mycobacterium
LTDEAIYSFLRLLLPAGLETTYRSSGN

SEQ ID NO: 1331891 - protein, 20 aa, Mycobacterium
LTGPIPLKLLTKPPARLCNE

SEQ ID NO: 1331892 - protein, 20 aa, Mycobacterium
LTKPRWLWDFGKTFSPPDLR

SEQ ID NO: 1331893 - protein, 18 aa, Mycobacterium
LTLSLLPHFSHQLYTVGN

SEQ ID NO: 1331894 - protein, 24 aa, Mycobacterium
LTPDKPFFMYFAPGATHAPHHVPR

SEQ ID NO: 1331895 - protein, 25 aa, Mycobacterium
LVDLDNWKLLKWLDPPAPFYDWRAN

SEQ ID NO: 1331896 - protein, 24 aa, Mycobacterium
LVETGMAPFFPLVVVVWADEETRV

SEQ ID NO: 1331897 - protein, 17 aa, Mycobacterium
LVGTFNVLRLSAERIAK

SEQ ID NO: 1331898 - protein, 23 aa, Mycobacterium
LVIPPAWKKVWICPYPNGHIQAV

SEQ ID NO: 1331899 - protein, 19 aa, Mycobacterium
LVLKPWTMPEPLLPIAVQP

SEQ ID NO: 1331900 - protein, 21 aa, Mycobacterium
LVPDPYPYFDYLRAKCPVQRA

SEQ ID NO: 1331901 - protein, 17 aa, Mycobacterium
LVQPLRLHYAKTLDIWA

SEQ ID NO: 1331902 - protein, 20 aa, Mycobacterium
LVRGPYGRGWPFSLLFAVVY

SEQ ID NO: 1331903 - protein, 20 aa, Mycobacterium
LVTLVEWGMPPAAVLRAATV

SEQ ID NO: 1331904 - protein, 19 aa, Mycobacterium
LYCVVLHRFLRWRQPGYDP

SEQ ID NO: 1331905 - protein, 20 aa, Mycobacterium
LYDAPELVIPFLVPDGAHDY

SEQ ID NO: 1331906 - protein, 25 aa, Mycobacterium
LYKMPWSTMFPLGISSATIGICEGA

SEQ ID NO: 1331907 - protein, 18 aa, Mycobacterium
LYNFWRDAANPRGLWRRT

SEQ ID NO: 1331908 - protein, 17 aa, Mycobacterium
LYTLWAPRWRDAGDEWE

SEQ ID NO: 1331909 - protein, 21 aa, Mycobacterium
MAALANFFRIKPAYFTDDEYY

SEQ ID NO: 1331910 - protein, 29 aa, Mycobacterium
MAGGPAMPPPPMPLGPPPTPSPAAPVVPT

SEQ ID NO: 1331911 - protein, 19 aa, Mycobacterium
MAHFFYIHFGLPTYFKNVF

SEQ ID NO: 1331912 - protein, 17 aa, Mycobacterium
MALSLRLAAYELLRTDG

SEQ ID NO: 1331913 - protein, 18 aa, Mycobacterium
MEAAYVSVYLWKNTVEKA

SEQ ID NO: 1331914 - protein, 17 aa, Mycobacterium
MFQAILPLRGKIINVEK

SEQ ID NO: 1331915 - protein, 17 aa, Mycobacterium
MGFPFHARRRFTGVQLE

SEQ ID NO: 1331916 - protein, 17 aa, Mycobacterium
MGPGIRRLLRLSAPSPV

SEQ ID NO: 1331917 - protein, 17 aa, Mycobacterium
MHHYNFPPYSTGETGRV

SEQ ID NO: 1331918 - protein, 20 aa, Mycobacterium
MLDIARWRRRRRDELAALGD

SEQ ID NO: 1331919 - protein, 18 aa, Mycobacterium
MLDRLFPRSIFYSLRLAE

SEQ ID NO: 1331920 - protein, 20 aa, Mycobacterium
MLPLRNLYRDRLLVLAALDV

SEQ ID NO: 1331921 - protein, 26 aa, Mycobacterium
MLRSWYIFYFQLPWLPDRSASWVVPW

SEQ ID NO: 1331922 - protein, 17 aa, Mycobacterium
MLTLPGTLALYLERAWP

SEQ ID NO: 1331923 - protein, 22 aa, Mycobacterium
MPDVLHWFGIRKIHRLVSMSNM

SEQ ID NO: 1331924 - protein, 23 aa, Mycobacterium
MRIAFPALLRRFPTLTLAEPFED

SEQ ID NO: 1331925 - protein, 18 aa, Mycobacterium
MSATFRRDGWYPVVGEAI

SEQ ID NO: 1331926 - protein, 23 aa, Mycobacterium
MSRLFDYLLMSLRSLPLVMVIGQ

SEQ ID NO: 1331927 - protein, 23 aa, Mycobacterium
MTDLRFMRFIAKEIFPGGSVPCD

SEQ ID NO: 1331928 - protein, 23 aa, Mycobacterium
MVAPQLMTLLFDLTIEATEEAIV

SEQ ID NO: 1331929 - protein, 25 aa, Mycobacterium
MVEAPFLLIRAALPYMYAQKFGRVI

SEQ ID NO: 1331930 - protein, 18 aa, Mycobacterium
MVRFIGVDGYRWMIRCVV

SEQ ID NO: 1331931 - protein, 25 aa, Mycobacterium
MVTKRYWWHAWWWVPHAIIRGGVDK

SEQ ID NO: 1331932 - protein, 21 aa, Mycobacterium
NAPALLGLIGLWYSNFFGAQS

SEQ ID NO: 1331933 - protein, 22 aa, Mycobacterium
NAPAPLLLWIHGGPLASWNAWH

SEQ ID NO: 1331934 - protein, 19 aa, Mycobacterium
NAQNGAFNLGFGDITLGDK

SEQ ID NO: 1331935 - protein, 22 aa, Mycobacterium
NCEIVPWCRFARKNYFYPDQPK

SEQ ID NO: 1331936 - protein, 22 aa, Mycobacterium
NDVPFFFHFTGPGTALGGPEVM

SEQ ID NO: 1331937 - protein, 19 aa, Mycobacterium
NELLLYEALGLCGEGEAPK

SEQ ID NO: 1331938 - protein, 17 aa, Mycobacterium
NFLLGPILTELPPQVLL

SEQ ID NO: 1331939 - protein, 17 aa, Mycobacterium
NLPLLPPTDARAYCRTV

SEQ ID NO: 1331940 - protein, 19 aa, Mycobacterium
NPIVELAHRFADKPTILFL

SEQ ID NO: 1331941 - protein, 17 aa, Mycobacterium
NPVLLKPGSDRTSQLVV

SEQ ID NO: 1331942 - protein, 21 aa, Mycobacterium
NRAWRLYRRLGFSDVIRGYHF

SEQ ID NO: 1331943 - protein, 19 aa, Mycobacterium
NRPGYLRFDFNWQGALTDD

SEQ ID NO: 1331944 - protein, 21 aa, Mycobacterium
NRYGIRVIAMWPLYVQTAMTD

SEQ ID NO: 1331945 - protein, 17 aa, Mycobacterium
NTALWPITWAPLFDRVM

SEQ ID NO: 1331946 - protein, 27 aa, Mycobacterium
NVLGQHRLLFLAFLPYSGVLLGRLGKL

SEQ ID NO: 1331947 - protein, 20 aa, Mycobacterium
NVVVPGWIATAAQLPSEVVA

SEQ ID NO: 1331948 - protein, 26 aa, Mycobacterium
PAAVSPWWMQRRLLLSGIRAISPAVD

SEQ ID NO: 1331949 - protein, 20 aa, Mycobacterium
PAISLPLHWTADGLPLGVQF

SEQ ID NO: 1331950 - protein, 20 aa, Mycobacterium
PALHLLPLAGVLGEVPVLAT

SEQ ID NO: 1331951 - protein, 23 aa, Mycobacterium
PDAPPRLFLSRYARATAPGGGPS

SEQ ID NO: 1331952 - protein, 20 aa, Mycobacterium
PDFLLTIGLLPLQTAYALNT

SEQ ID NO: 1331953 - protein, 19 aa, Mycobacterium
PDGTPFPTLYYLTHPVLTA

SEQ ID NO: 1331954 - protein, 24 aa, Mycobacterium
PDPSPRIRLWWRPAEPMPDDPILN

SEQ ID NO: 1331955 - protein, 24 aa, Mycobacterium
PEDLVGMCLFLLSDQAKWITGQIF

SEQ ID NO: 1331956 - protein, 22 aa, Mycobacterium
PENVSPLVVWLGSTESRDITGQ

SEQ ID NO: 1331957 - protein, 23 aa, Mycobacterium
PEPHPLLPATPWHHAHHWIKVDP

SEQ ID NO: 1331958 - protein, 18 aa, Mycobacterium
PEQGAWLQPFRPLSALLT

SEQ ID NO: 1331959 - protein, 23 aa, Mycobacterium
PERERMVLLLRFFENLTQTQIAE

SEQ ID NO: 1331960 - protein, 26 aa, Mycobacterium
PEYRTMPMVWYIPPLSPIVDAVARDG

SEQ ID NO: 1331961 - protein, 17 aa, Mycobacterium
PFDYWRLHLKTMKGQWA

SEQ ID NO: 1331962 - protein, 17 aa, Mycobacterium
PFYDPWFSKARTSGSIE

SEQ ID NO: 1331963 - protein, 23 aa, Mycobacterium
PGAWLAYGQWLRTPVHGIHWAGT

SEQ ID NO: 1331964 - protein, 18 aa, Mycobacterium
PGENIPAWLIFDQQYRDR

SEQ ID NO: 1331965 - protein, 23 aa, Mycobacterium
PGHPSYFLKPPTSLALSGRPVER

SEQ ID NO: 1331966 - protein, 17 aa, Mycobacterium
PGQWYLHLFDPEQPDLN

SEQ ID NO: 1331967 - protein, 19 aa, Mycobacterium
PGRGLVLRPGLTLALEPWF

SEQ ID NO: 1331968 - protein, 18 aa, Mycobacterium
PGRLSGKFWKLLGAATEK

SEQ ID NO: 1331969 - protein, 18 aa, Mycobacterium
PGRMWWSVPPGKQTFHTW

SEQ ID NO: 1331970 - protein, 18 aa, Mycobacterium
PIIDAVGLALPFVPLCTP

SEQ ID NO: 1331971 - protein, 25 aa, Mycobacterium
PILSGARRWCPMRRWIDIGAFDDGA

SEQ ID NO: 1331972 - protein, 18 aa, Mycobacterium
PIQPKPIQRPHPPIWFGA

SEQ ID NO: 1331973 - protein, 18 aa, Mycobacterium
PIRDLIRMAAHSRHYLAV

SEQ ID NO: 1331974 - protein, 20 aa, Mycobacterium
PIVFLRLRKAVRKQGLQVLS

SEQ ID NO: 1331975 - protein, 19 aa, Mycobacterium
PIYHAAPLRWCSMVHALGG

SEQ ID NO: 1331976 - protein, 24 aa, Mycobacterium
PKASVMTHYRWLRALAGFGGLGVR

SEQ ID NO: 1331977 - protein, 24 aa, Mycobacterium
PKETWLRLLLIRHDFPRPRTQIPV

SEQ ID NO: 1331978 - protein, 19 aa, Mycobacterium
PLDRRLLLAVLADLPAGSG

SEQ ID NO: 1331979 - protein, 20 aa, Mycobacterium
PLIDAIPLWRRPQDGAVITG

SEQ ID NO: 1331980 - protein, 25 aa, Mycobacterium
PLLATYGFLPIIRTFAGAAGINVET

SEQ ID NO: 1331981 - protein, 21 aa, Mycobacterium
PLLDMRRFHLLLAGASWVAEY

SEQ ID NO: 1331982 - protein, 19 aa, Mycobacterium
PLPFVHQSSPLYLSGGARP

SEQ ID NO: 1331983 - protein, 17 aa, Mycobacterium
PLRWSSRHLLQFLTVGF

SEQ ID NO: 1331984 - protein, 19 aa, Mycobacterium
PLTLPGYGSPARLLHFVAG

SEQ ID NO: 1331985 - protein, 17 aa, Mycobacterium
PLTMLYLAKLMAEAGLP

SEQ ID NO: 1331986 - protein, 17 aa, Mycobacterium
PLTPRLLVRRLESMIVE

SEQ ID NO: 1331987 - protein, 21 aa, Mycobacterium
PLVAPVWFIVEGNQLVFNTDR

SEQ ID NO: 1331988 - protein, 23 aa, Mycobacterium
PMDRFHRRLLWPIRAAGGEVIGF

SEQ ID NO: 1331989 - protein, 19 aa, Mycobacterium
PMLALHGWAQHHDVPLRAV

SEQ ID NO: 1331990 - protein, 19 aa, Mycobacterium
PPALKPFAAVPPLISDIDL

SEQ ID NO: 1331991 - protein, 21 aa, Mycobacterium
PPDIELIGMLNLLIGGGFDTT

SEQ ID NO: 1331992 - protein, 25 aa, Mycobacterium
PPGMTFVSWLPFYHDMGLIKGVCAP

SEQ ID NO: 1331993 - protein, 17 aa, Mycobacterium
PPKLAIPMRVIASVVAI

SEQ ID NO: 1331994 - protein, 23 aa, Mycobacterium
PPTVTVFGIPIFKLGGAPVNVVS

SEQ ID NO: 1331995 - protein, 23 aa, Mycobacterium
PPVTPFVLTLRLLTLALRHQPAL

SEQ ID NO: 1331996 - protein, 18 aa, Mycobacterium
PREPFFNDPQWKHITDWN

SEQ ID NO: 1331997 - protein, 21 aa, Mycobacterium
PRFRPVPPPTPPPPPPAHTGI

SEQ ID NO: 1331998 - protein, 18 aa, Mycobacterium
PRHVLFVDALPLTTNGKI

SEQ ID NO: 1331999 - protein, 23 aa, Mycobacterium
PRQNRWWWDLLTHGRDSAYADYF

SEQ ID NO: 1332000 - protein, 18 aa, Mycobacterium
PRWVAPVVDGLGLAPMAV

SEQ ID NO: 1332001 - protein, 52 aa, Mycobacterium
PSDRPTPNPIARFFKFLSDLFWRVVHFFEDLVSRFVDVLFGGGPVGRDGWWE

SEQ ID NO: 1332002 - protein, 22 aa, Mycobacterium
PSGRPHLVAMWYAVLDGEIWFE

SEQ ID NO: 1332003 - protein, 23 aa, Mycobacterium
PSHGWRKWLYLATFKLVNIGESP

SEQ ID NO: 1332004 - protein, 23 aa, Mycobacterium
PSHHYLAAYRWIDSGYPTGFGAH

SEQ ID NO: 1332005 - protein, 18 aa, Mycobacterium
PSLLRSLLSEHLDPGYAA

SEQ ID NO: 1332006 - protein, 26 aa, Mycobacterium
PSSTTTFVSWLPFYHDMGLVLGICVP

SEQ ID NO: 1332007 - protein, 19 aa, Mycobacterium
PSVRFNPVLLKPGSDRTSQ

SEQ ID NO: 1332008 - protein, 17 aa, Mycobacterium
PSYLPVPLARRGRRFPT

SEQ ID NO: 1332009 - protein, 22 aa, Mycobacterium
PTDTRAYFRGECLRRFGADIAA

SEQ ID NO: 1332010 - protein, 24 aa, Mycobacterium
PTPLLWQRYLAIIFDGLRPEGAHP

SEQ ID NO: 1332011 - protein, 18 aa, Mycobacterium
PTPQPVLPRPMFGAAPAA

SEQ ID NO: 1332012 - protein, 20 aa, Mycobacterium
PVFLQYPWQVLPEELIAPIE

SEQ ID NO: 1332013 - protein, 20 aa, Mycobacterium
PVGFKWFVDGLIGGTIGFGG

SEQ ID NO: 1332014 - protein, 26 aa, Mycobacterium
PVGVCGLITPWNWPINQIACKVFPAL

SEQ ID NO: 1332015 - protein, 19 aa, Mycobacterium
PVMRRLPFQTLLETTGRKS

SEQ ID NO: 1332016 - protein, 21 aa, Mycobacterium
PVPLWQHVLVGKRLFDLFDYR

SEQ ID NO: 1332017 - protein, 23 aa, Mycobacterium
PWNTPFMLESWKLAPALASGCTV

SEQ ID NO: 1332018 - protein, 19 aa, Mycobacterium
PWWEWAATYERAFSAAYDA

SEQ ID NO: 1332019 - protein, 19 aa, Mycobacterium
PWWLKPLNKVVIASTKLGL

SEQ ID NO: 1332020 - protein, 18 aa, Mycobacterium
PYPPARLEKLWLPGVDRL

SEQ ID NO: 1332021 - protein, 25 aa, Mycobacterium
QAEAGEWHWPVPHLVITRGARGASY

SEQ ID NO: 1332022 - protein, 17 aa, Mycobacterium
QAFFLDLQLTVPGGAVL

SEQ ID NO: 1332023 - protein, 23 aa, Mycobacterium
QAIGYMLEILPALGYLHSLGLTY

SEQ ID NO: 1332024 - protein, 18 aa, Mycobacterium
QALLYCVVLHRFLRWRQP

SEQ ID NO: 1332025 - protein, 21 aa, Mycobacterium
QAQLVGWLEGLFHGIQTALFA

SEQ ID NO: 1332026 - protein, 22 aa, Mycobacterium
QDRGWVILLARYQRPKAIRQSG

SEQ ID NO: 1332027 - protein, 18 aa, Mycobacterium
QFVPFFLGQRTPPYQRAT

SEQ ID NO: 1332028 - protein, 23 aa, Mycobacterium
QGTLQIWFEPFTPLRAPKLFNLR

SEQ ID NO: 1332029 - protein, 18 aa, Mycobacterium
QHRLLLETAWRAVEHSGT

SEQ ID NO: 1332030 - protein, 24 aa, Mycobacterium
QISKPMLYLYYGSKEDLFGACLDR

SEQ ID NO: 1332031 - protein, 20 aa, Mycobacterium
QLDWVFETFPRLAERRSQVG

SEQ ID NO: 1332032 - protein, 17 aa, Mycobacterium
QLLFAHPGYLRAARGIE

SEQ ID NO: 1332033 - protein, 21 aa, Mycobacterium
QLRYFWPRVVGDTSWQLLDSK

SEQ ID NO: 1332034 - protein, 19 aa, Mycobacterium
QLVGFFINILVLRNDLRGN

SEQ ID NO: 1332035 - protein, 21 aa, Mycobacterium
QNPRLLPWRRALANVTFALAD

SEQ ID NO: 1332036 - protein, 20 aa, Mycobacterium
QPILAILAADLIYLPEKAQE

SEQ ID NO: 1332037 - protein, 20 aa, Mycobacterium
QPRLFPWRTVGGNVDLALKY

SEQ ID NO: 1332038 - protein, 18 aa, Mycobacterium
QPTACILCECNCGIVVEV

SEQ ID NO: 1332039 - protein, 23 aa, Mycobacterium
QPTVQFAFLQLFIHAVVAGILEN

SEQ ID NO: 1332040 - protein, 17 aa, Mycobacterium
QPVGPCYAITPWNFPLA

SEQ ID NO: 1332041 - protein, 21 aa, Mycobacterium
QPWEPRYLLQPLRNIALAIGF

SEQ ID NO: 1332042 - protein, 17 aa, Mycobacterium
QRDLPWRRPGVTPWQIL

SEQ ID NO: 1332043 - protein, 25 aa, Mycobacterium
QRGWRHVLYLLTRINLGLSPDEMYE

SEQ ID NO: 1332044 - protein, 20 aa, Mycobacterium
QRNRFLLVTNFEYVDPVFMF

SEQ ID NO: 1332045 - protein, 20 aa, Mycobacterium
QRYMGWFDGNPGRLWAHPPE

SEQ ID NO: 1332046 - protein, 22 aa, Mycobacterium
QTPASILYLMSLIADLLPAGVV

SEQ ID NO: 1332047 - protein, 21 aa, Mycobacterium
QTWFDRGLIWAYAFNHEEAIR

SEQ ID NO: 1332048 - protein, 25 aa, Mycobacterium
QVLLPLWNAYTFLALYAPKKGTWRT

SEQ ID NO: 1332049 - protein, 21 aa, Mycobacterium
QVPLIAVVLRRGYGLGAQAMT

SEQ ID NO: 1332050 - protein, 21 aa, Mycobacterium
QVRGYTLRLPLDVLVVASANP

SEQ ID NO: 1332051 - protein, 18 aa, Mycobacterium
QWLDLRFVSGRGALLRGV

SEQ ID NO: 1332052 - protein, 20 aa, Mycobacterium
RAALEILALGRWPFDRITRE

SEQ ID NO: 1332053 - protein, 23 aa, Mycobacterium
RAFTARLLGIPAQKVRVIMRDTG

SEQ ID NO: 1332054 - protein, 17 aa, Mycobacterium
RAFYLDLQDERLTSALG

SEQ ID NO: 1332055 - protein, 20 aa, Mycobacterium
RAIPIVLRPVVLAKLMAGHT

SEQ ID NO: 1332056 - protein, 23 aa, Mycobacterium
RALRFWEVMYPSPPPGLAGPDDT

SEQ ID NO: 1332057 - protein, 22 aa, Mycobacterium
RARQMLRFLSSPLWRAYTSTYV

SEQ ID NO: 1332058 - protein, 21 aa, Mycobacterium
RARVLFVDYLTLLPPPGEPVA

SEQ ID NO: 1332059 - protein, 19 aa, Mycobacterium
RARYLLLRLLERSGEQRVA

SEQ ID NO: 1332060 - protein, 29 aa, Mycobacterium
RASETWRFPPFFHALLDAGVYPPPSAFEA

SEQ ID NO: 1332061 - protein, 23 aa, Mycobacterium
RATPPWWPMRQLVRALGADPDDV

SEQ ID NO: 1332062 - protein, 17 aa, Mycobacterium
RAVWRINELLNWQVAAA

SEQ ID NO: 1332063 - protein, 21 aa, Mycobacterium
RAYRALADPIALSAALQLGHD

SEQ ID NO: 1332064 - protein, 22 aa, Mycobacterium
RDMVLFIGHPIRWADWGNLEHS

SEQ ID NO: 1332065 - protein, 19 aa, Mycobacterium
RDYLTDLFPILELGTSAKM

SEQ ID NO: 1332066 - protein, 24 aa, Mycobacterium
REGLRPFIFALWDMVRTYREAQPP

SEQ ID NO: 1332067 - protein, 19 aa, Mycobacterium
RETLWRPPVLTMSALHGDG

SEQ ID NO: 1332068 - protein, 25 aa, Mycobacterium
REVQDTWTWLRPYFDERATATAARL

SEQ ID NO: 1332069 - protein, 23 aa, Mycobacterium
RFHTVYWPAFLMSAGLELPRKVF

SEQ ID NO: 1332070 - protein, 17 aa, Mycobacterium
RFLVLPHPAVRDMLAGK

SEQ ID NO: 1332071 - protein, 23 aa, Mycobacterium
RGALLQLGLMQLAVRLATDNGFT

SEQ ID NO: 1332072 - protein, 19 aa, Mycobacterium
RGFQRFPAWMWRNVVVRDF

SEQ ID NO: 1332073 - protein, 20 aa, Mycobacterium
RGGAYFFLPGLRGLRYLATL

SEQ ID NO: 1332074 - protein, 28 aa, Mycobacterium
RGGPPIAFQLLWYPVTMWDMSLPSVTEN

SEQ ID NO: 1332075 - protein, 17 aa, Mycobacterium
RGRRWLNKKLGLDNVFL

SEQ ID NO: 1332076 - protein, 24 aa, Mycobacterium
RGSPWAAPLSWLVPPRVAMQILLT

SEQ ID NO: 1332077 - protein, 17 aa, Mycobacterium
RGSQFYLAMYWAQELAG

SEQ ID NO: 1332078 - protein, 21 aa, Mycobacterium
RGYVLRRLLRRVIRSAKLLGI

SEQ ID NO: 1332079 - protein, 18 aa, Mycobacterium
RHLLFTRTPTDLVRPEWL

SEQ ID NO: 1332080 - protein, 17 aa, Mycobacterium
RHLVMLGARNRYGPPER

SEQ ID NO: 1332081 - protein, 24 aa, Mycobacterium
RIDPRTRWLLRELVYALLVKKDHA

SEQ ID NO: 1332082 - protein, 18 aa, Mycobacterium
RIDWARFLPLYQQAGRRA

SEQ ID NO: 1332083 - protein, 19 aa, Mycobacterium
RIEDKFPSRFLLGIGIGHP

SEQ ID NO: 1332084 - protein, 23 aa, Mycobacterium
RINGFGTPWWADDLAALAGTSVG

SEQ ID NO: 1332085 - protein, 17 aa, Mycobacterium
RITLTLPAVQRSREVWL

SEQ ID NO: 1332086 - protein, 24 aa, Mycobacterium
RIYCPGWVGLIRWAKPILTTRIGQ

SEQ ID NO: 1332087 - protein, 28 aa, Mycobacterium
RKKRLMTLVHLWLVHRFKADAVYYVTPT

SEQ ID NO: 1332088 - protein, 23 aa, Mycobacterium
RKVVRMFPIPPIALGLRTGIAIV

SEQ ID NO: 1332089 - protein, 17 aa, Mycobacterium
RKYPWALGRPASEVWAE

SEQ ID NO: 1332090 - protein, 22 aa, Mycobacterium
RLADAWVWDMYRPARFVKQVRV

SEQ ID NO: 1332091 - protein, 19 aa, Mycobacterium
RLEMPLVDFFSRGGSLKSS

SEQ ID NO: 1332092 - protein, 18 aa, Mycobacterium
RLFSRFLPLLPMSEPMIE

SEQ ID NO: 1332093 - protein, 26 aa, Mycobacterium
RLGIRCFGFIPLRLPPELDFAALFHG

SEQ ID NO: 1332094 - protein, 17 aa, Mycobacterium
RLLATHNLGLYATLMER

SEQ ID NO: 1332095 - protein, 20 aa, Mycobacterium
RLLNLLHYVKWYLDGTLTFR

SEQ ID NO: 1332096 - protein, 21 aa, Mycobacterium
RLPDGALMRRAALGLATAIAR

SEQ ID NO: 1332097 - protein, 24 aa, Mycobacterium
RLRPAFAYWGWRAVADRPADSGVL

SEQ ID NO: 1332098 - protein, 20 aa, Mycobacterium
RLSPLLRAPALTAPLLLVHG

SEQ ID NO: 1332099 - protein, 22 aa, Mycobacterium
RLTFLAVRRWYGWSAGRIINID

SEQ ID NO: 1332100 - protein, 18 aa, Mycobacterium
RMFPKVTSLPLGVPRPRM

SEQ ID NO: 1332101 - protein, 21 aa, Mycobacterium
RMLLVHFLRDELRLTGTHWGC

SEQ ID NO: 1332102 - protein, 17 aa, Mycobacterium
RMYRPFPVEALAAALPE

SEQ ID NO: 1332103 - protein, 18 aa, Mycobacterium
RNFYALDRLWRDCPTVPV

SEQ ID NO: 1332104 - protein, 21 aa, Mycobacterium
RNRTALLDVPRLGPKAFEQCA

SEQ ID NO: 1332105 - protein, 25 aa, Mycobacterium
RPDGPGWWWQTWHLYPGGPRVPGGT

SEQ ID NO: 1332106 - protein, 17 aa, Mycobacterium
RPDLVIGWWAAPTILEH

SEQ ID NO: 1332107 - protein, 21 aa, Mycobacterium
RPFFPFLVDLLDAWVAYFAEH

SEQ ID NO: 1332108 - protein, 23 aa, Mycobacterium
RPNGNLLLALRFPTTAAGEPILV

SEQ ID NO: 1332109 - protein, 21 aa, Mycobacterium
RPQTIFLYHNFIRHWRHPLRD

SEQ ID NO: 1332110 - protein, 24 aa, Mycobacterium
RPRAVWLPHYPYPLARFLPGNRRT

SEQ ID NO: 1332111 - protein, 25 aa, Mycobacterium
RPVLFSTFLMWVLADLFTTLPEVGD

SEQ ID NO: 1332112 - protein, 21 aa, Mycobacterium
RPVMGRLFQRFLHNLRRYTDQ

SEQ ID NO: 1332113 - protein, 22 aa, Mycobacterium
RQALYEYFFFGDPVRMAGALVN

SEQ ID NO: 1332114 - protein, 20 aa, Mycobacterium
RQMRPLYVMPTKGVWTSGFG

SEQ ID NO: 1332115 - protein, 19 aa, Mycobacterium
RQTLWPERLFSILAGFVEA

SEQ ID NO: 1332116 - protein, 23 aa, Mycobacterium
RRARWLVRVLTSLLLFPGGDEGE

SEQ ID NO: 1332117 - protein, 18 aa, Mycobacterium
RRELLAEMPPFLTGGSMI

SEQ ID NO: 1332118 - protein, 17 aa, Mycobacterium
RRLLSDLQFPVLSDLGL

SEQ ID NO: 1332119 - protein, 20 aa, Mycobacterium
RRLRLPSPIRDLALGRDGLA

SEQ ID NO: 1332120 - protein, 18 aa, Mycobacterium
RRLWAMGFPFHARRRFTG

SEQ ID NO: 1332121 - protein, 24 aa, Mycobacterium
RRTGLIWLRWFLPEATPARPQCRV

SEQ ID NO: 1332122 - protein, 25 aa, Mycobacterium
RRVGLLLQDPLLFPHLQVAANVAFG

SEQ ID NO: 1332123 - protein, 18 aa, Mycobacterium
RRVPGWIHLYRAAEALGA

SEQ ID NO: 1332124 - protein, 20 aa, Mycobacterium
RSAWTLLRRRHGVSPAIEEA

SEQ ID NO: 1332125 - protein, 20 aa, Mycobacterium
RSDIAVELLLRALDYLRGRL

SEQ ID NO: 1332126 - protein, 17 aa, Mycobacterium
RSGFGTATLLRHHFRRI

SEQ ID NO: 1332127 - protein, 27 aa, Mycobacterium
RSGVMRMTWWPLGVLVFLEVSLGNYSQ

SEQ ID NO: 1332128 - protein, 24 aa, Mycobacterium
RSGVPFILAGWSLGGVLAYACAIG

SEQ ID NO: 1332129 - protein, 23 aa, Mycobacterium
RSNRLILSPYWPESLGVLAVPIH

SEQ ID NO: 1332130 - protein, 22 aa, Mycobacterium
RTDPPPWRLVYGGRDRAAMAFL

SEQ ID NO: 1332131 - protein, 24 aa, Mycobacterium
RTHPVWDFLFTYYSLRPRHLRCWH

SEQ ID NO: 1332132 - protein, 17 aa, Mycobacterium
RTPHIPIPYVYNVNLRA

SEQ ID NO: 1332133 - protein, 21 aa, Mycobacterium
RTQLEVILPYFLHYANDEQRK

SEQ ID NO: 1332134 - protein, 24 aa, Mycobacterium
RTRQYSLLPLLHNYQRPAHPINGA

SEQ ID NO: 1332135 - protein, 17 aa, Mycobacterium
RVAIWSPNTWHWVVAAL

SEQ ID NO: 1332136 - protein, 20 aa, Mycobacterium
RVEELIARYPLRGIKGPMGT

SEQ ID NO: 1332137 - protein, 25 aa, Mycobacterium
RVEYKLRDWLFARQRYWGEPFPIVY

SEQ ID NO: 1332138 - protein, 18 aa, Mycobacterium
RVFHYPGGLVDFVKHINR

SEQ ID NO: 1332139 - protein, 21 aa, Mycobacterium
RVFRRYVGVPVKWVLCRYRLQ

SEQ ID NO: 1332140 - protein, 20 aa, Mycobacterium
RVLGLHFFNPVPVLPLVELV

SEQ ID NO: 1332141 - protein, 18 aa, Mycobacterium
RVPVFLLPANPVSALVVF

SEQ ID NO: 1332142 - protein, 20 aa, Mycobacterium
RVPVWFMRQAGRSLPEYRAL

SEQ ID NO: 1332143 - protein, 17 aa, Mycobacterium
RVVPFIEWLRGTFPDVV

SEQ ID NO: 1332144 - protein, 34 aa, Mycobacterium
RWALRHLPFYGRWYRFLLFWPGCDKGLAAARVDP

SEQ ID NO: 1332145 - protein, 19 aa, Mycobacterium
RWRVKHPDLIPLYQRAREL

SEQ ID NO: 1332146 - protein, 20 aa, Mycobacterium
RYMKYLTGCQYYFIDESIDV

SEQ ID NO: 1332147 - protein, 19 aa, Mycobacterium
RYRLIDIPFRFHHPMWLEN

SEQ ID NO: 1332148 - protein, 21 aa, Mycobacterium
RYTWPRFVCGLPREFFAAVRA

SEQ ID NO: 1332149 - protein, 25 aa, Mycobacterium
SAIVGHDRLLLALLLCAVRPEIGGV

SEQ ID NO: 1332150 - protein, 21 aa, Mycobacterium
SALSAPLYWIATNAGLDGSVV

SEQ ID NO: 1332151 - protein, 23 aa, Mycobacterium
SARIALWALGWLARVQFLTGDWD

SEQ ID NO: 1332152 - protein, 17 aa, Mycobacterium
SARSLGCTIKLLAICER

SEQ ID NO: 1332153 - protein, 18 aa, Mycobacterium
SATLLYQLGLTGTASLVV

SEQ ID NO: 1332154 - protein, 19 aa, Mycobacterium
SATYSLLPALVRALREALP

SEQ ID NO: 1332155 - protein, 23 aa, Mycobacterium
SDFLGPIDWMRPLRAIAGRHEVL

SEQ ID NO: 1332156 - protein, 17 aa, Mycobacterium
SDRSVLFPVWDMPLTST

SEQ ID NO: 1332157 - protein, 17 aa, Mycobacterium
SEHMLLHPMSAPMTLRW

SEQ ID NO: 1332158 - protein, 21 aa, Mycobacterium
SEVRALVRWLLPQSTTVVVSG

SEQ ID NO: 1332159 - protein, 19 aa, Mycobacterium
SFHVFVVYPWARFLDRDPT

SEQ ID NO: 1332160 - protein, 17 aa, Mycobacterium
SFLTPPEKIAERLEFIK

SEQ ID NO: 1332161 - protein, 26 aa, Mycobacterium
SFQLFPNFVVLFWGQGWYLTYHYWPT

SEQ ID NO: 1332162 - protein, 24 aa, Mycobacterium
SGKTMGIPLLYPWANRLSSSKYAI

SEQ ID NO: 1332163 - protein, 28 aa, Mycobacterium
SGQQDWHRWLWEAWTIDGLAGGRWALAV

SEQ ID NO: 1332164 - protein, 19 aa, Mycobacterium
SGVLPPQLLFAHPGYLRAA

SEQ ID NO: 1332165 - protein, 19 aa, Mycobacterium
SGVLWGALLSALGTRLGDT

SEQ ID NO: 1332166 - protein, 22 aa, Mycobacterium
SGYRLFSGIRRLTSVLAAMAAP

SEQ ID NO: 1332167 - protein, 24 aa, Mycobacterium
SIGVRSICYLPLTYDHRLIDGADA

SEQ ID NO: 1332168 - protein, 17 aa, Mycobacterium
SIPTMILFKDGEPVKRI

SEQ ID NO: 1332169 - protein, 23 aa, Mycobacterium
SKGLQYPVVYLPFAFNRNIQTRD

SEQ ID NO: 1332170 - protein, 24 aa, Mycobacterium
SLADPLAFLLRKEGFETTVVADGP

SEQ ID NO: 1332171 - protein, 20 aa, Mycobacterium
SLEVYPGLWAGPSLLRDGAG

SEQ ID NO: 1332172 - protein, 24 aa, Mycobacterium
SLLVRALVAWFWDEPLRAPLIRHG

SEQ ID NO: 1332173 - protein, 25 aa, Mycobacterium
SLQTVGMLFTPGYPGFLRGLTPVGG

SEQ ID NO: 1332174 - protein, 25 aa, Mycobacterium
SLSHPYLDTVLFILGVTRGEIEAAD

SEQ ID NO: 1332175 - protein, 20 aa, Mycobacterium
SLTLYIQLYLGGFGLELEDI

SEQ ID NO: 1332176 - protein, 20 aa, Mycobacterium
SLTQILAWDLPLDAKLRTAV

SEQ ID NO: 1332177 - protein, 24 aa, Mycobacterium
SLVERLIPDFLWISTEYTAKLSLD

SEQ ID NO: 1332178 - protein, 27 aa, Mycobacterium
SPFNFPAMVPMWFFPVAIATGNTVVLK

SEQ ID NO: 1332179 - protein, 22 aa, Mycobacterium
SPLAKLLDWLAHTYNVLILVSA

SEQ ID NO: 1332180 - protein, 24 aa, Mycobacterium
SPMIGHYISFMTPAAFVRRPGRWI

SEQ ID NO: 1332181 - protein, 21 aa, Mycobacterium
SPMPLPLLRQALKAWPDTDFI

SEQ ID NO: 1332182 - protein, 23 aa, Mycobacterium
SPPVRWPCFYGIDFATPAELIAN

SEQ ID NO: 1332183 - protein, 19 aa, Mycobacterium
SQAPWPVRAGLSATPLLVV

SEQ ID NO: 1332184 - protein, 20 aa, Mycobacterium
SQFAPGLPQWNLRGSFTTGP

SEQ ID NO: 1332185 - protein, 20 aa, Mycobacterium
SRERGYAYFLYPPEQPLTET

SEQ ID NO: 1332186 - protein, 25 aa, Mycobacterium
SSVLAQMMWAFRAMGMWSDERGVNM

SEQ ID NO: 1332187 - protein, 21 aa, Mycobacterium
STFAYLGWLAGAAPDDAALRA

SEQ ID NO: 1332188 - protein, 25 aa, Mycobacterium
STGALIAAFPRYHPRWAWWTNAVPG

SEQ ID NO: 1332189 - protein, 20 aa, Mycobacterium
STLLGLLAGVLRPAGGVVAT

SEQ ID NO: 1332190 - protein, 21 aa, Mycobacterium
SVPMYRLRRYFPPDVRPGAKP

SEQ ID NO: 1332191 - protein, 17 aa, Mycobacterium
SWFKLHHPAAFCAALLR

SEQ ID NO: 1332192 - protein, 19 aa, Mycobacterium
SWMEIEAFRLLTLQTAWKI

SEQ ID NO: 1332193 - protein, 24 aa, Mycobacterium
SWNAWHWRWNPWLMVAQGYAVLLP

SEQ ID NO: 1332194 - protein, 20 aa, Mycobacterium
TAFLELCPFAAWGSKFPVGG

SEQ ID NO: 1332195 - protein, 18 aa, Mycobacterium
TAFPKQIWRQIWSNNPLS

SEQ ID NO: 1332196 - protein, 18 aa, Mycobacterium
TAYRLLPERISYTPLAYH

SEQ ID NO: 1332197 - protein, 23 aa, Mycobacterium
TCSSCFLVFHRSRLARDSNGTMI

SEQ ID NO: 1332198 - protein, 17 aa, Mycobacterium
TDVSLIGGLIIAAVDTE

SEQ ID NO: 1332199 - protein, 20 aa, Mycobacterium
TEVRMWLDVPPTDEFWRTVE

SEQ ID NO: 1332200 - protein, 17 aa, Mycobacterium
TEVWRWYLIDKNAPDDV

SEQ ID NO: 1332201 - protein, 20 aa, Mycobacterium
TFEWAFRWLAAHRPPPSPHR

SEQ ID NO: 1332202 - protein, 19 aa, Mycobacterium
TFPSWPLAHPFRRVAHNGE

SEQ ID NO: 1332203 - protein, 17 aa, Mycobacterium
TFVLFTSGFLEAGYRRF

SEQ ID NO: 1332204 - protein, 24 aa, Mycobacterium
TGALLYIPLLTRMLMNLNAMGLSE

SEQ ID NO: 1332205 - protein, 22 aa, Mycobacterium
TGCSWLPLYHDMGLAFLLTNAL

SEQ ID NO: 1332206 - protein, 17 aa, Mycobacterium
TGIDPAAVSPWWMQRRL

SEQ ID NO: 1332207 - protein, 21 aa, Mycobacterium
TGLRTPIWLITRGAQRVTATD

SEQ ID NO: 1332208 - protein, 23 aa, Mycobacterium
TGSGKTLAAFLWAIDRLASSEPR

SEQ ID NO: 1332209 - protein, 20 aa, Mycobacterium
TGSLRVNFLRRLVAGGECRY

SEQ ID NO: 1332210 - protein, 24 aa, Mycobacterium
TGYNITFPFFDPALISAPDNQIRL

SEQ ID NO: 1332211 - protein, 26 aa, Mycobacterium
THEHDLSLWLLRVQALRSAWGSPTWH

SEQ ID NO: 1332212 - protein, 25 aa, Mycobacterium
THNEPMIPIYIFYSMFGFQRTGDSF

SEQ ID NO: 1332213 - protein, 17 aa, Mycobacterium
THPGCTVPFYWAEAHHT

SEQ ID NO: 1332214 - protein, 23 aa, Mycobacterium
TIHDYLWRWDTDWFWCSRAFGAQ

SEQ ID NO: 1332215 - protein, 23 aa, Mycobacterium
TKGERMLVFLPLAHVLARAITIA

SEQ ID NO: 1332216 - protein, 22 aa, Mycobacterium
TKGSFYWHFSDIQAYRAALVEA

SEQ ID NO: 1332217 - protein, 19 aa, Mycobacterium
TLDQPLDWFCSFSSAAAMV

SEQ ID NO: 1332218 - protein, 18 aa, Mycobacterium
TLENGLLTGIRKLARPKL

SEQ ID NO: 1332219 - protein, 23 aa, Mycobacterium
TLGRVMFNELLPISYPFINEQMH

SEQ ID NO: 1332220 - protein, 19 aa, Mycobacterium
TLHALLMLWTDRLDEAADQ

SEQ ID NO: 1332221 - protein, 17 aa, Mycobacterium
TLSPWRLVDYWTWTRRP

SEQ ID NO: 1332222 - protein, 26 aa, Mycobacterium
TPDFDTLRLLPWLPGTALVMADLSWT

SEQ ID NO: 1332223 - protein, 27 aa, Mycobacterium
TPGFEVPYYWWTFNMPTDHGEVVLTDV

SEQ ID NO: 1332224 - protein, 20 aa, Mycobacterium
TPLLLLPIRIETRLTPGRTQ

SEQ ID NO: 1332225 - protein, 19 aa, Mycobacterium
TPPFRRMAKPVLAAINGIC

SEQ ID NO: 1332226 - protein, 23 aa, Mycobacterium
TPRLTGTITMRYLRTTRLGRLHA

SEQ ID NO: 1332227 - protein, 18 aa, Mycobacterium
TPWNYPLYQVVAKVVPAI

SEQ ID NO: 1332228 - protein, 28 aa, Mycobacterium
TPYARMWGAYLTGMWLYRLSLAKVKWHS

SEQ ID NO: 1332229 - protein, 24 aa, Mycobacterium
TRAGMGLQYLLLRSGPMTMPPSTL

SEQ ID NO: 1332230 - protein, 23 aa, Mycobacterium
TRARPLLAPLARNTLLTPAESRK

SEQ ID NO: 1332231 - protein, 17 aa, Mycobacterium
TRGWFMAWLARAHPELV

SEQ ID NO: 1332232 - protein, 24 aa, Mycobacterium
TRRPALAFGPQWLNRILVATSRKV

SEQ ID NO: 1332233 - protein, 24 aa, Mycobacterium
TRVGWRWRLVWFRAVAELLSADYE

SEQ ID NO: 1332234 - protein, 22 aa, Mycobacterium
TSIPALIGLCLFGDGAAAVVAT

SEQ ID NO: 1332235 - protein, 26 aa, Mycobacterium
TSPDIRALYLFKRTMWWPYSVAMRQV

SEQ ID NO: 1332236 - protein, 21 aa, Mycobacterium
TVARWLVMYLRRPGGQTQFAA

SEQ ID NO: 1332237 - protein, 23 aa, Mycobacterium
TVCSYLNKLLWILTGNFAKRGAQ

SEQ ID NO: 1332238 - protein, 18 aa, Mycobacterium
TVLNRFLLQAAIGYPLTV

SEQ ID NO: 1332239 - protein, 22 aa, Mycobacterium
TVVRSWLQQLLAKALREDPGLA

SEQ ID NO: 1332240 - protein, 19 aa, Mycobacterium
TWRFIRTAYRLLPERISYT

SEQ ID NO: 1332241 - protein, 18 aa, Mycobacterium
TYRWPMVPALALLAAMPA

SEQ ID NO: 1332242 - protein, 25 aa, Mycobacterium
VAAHDLALTEWRLLTAAALVGLVEE

SEQ ID NO: 1332243 - protein, 18 aa, Mycobacterium
VACTPWYEPFGIVPLEAM

SEQ ID NO: 1332244 - protein, 24 aa, Mycobacterium
VAGEHGFRFFPAYYLHIWDLFQRI

SEQ ID NO: 1332245 - protein, 21 aa, Mycobacterium
VAHFDWLVECGVPFKAEFFGE

SEQ ID NO: 1332246 - protein, 19 aa, Mycobacterium
VAPNLFPLIVRRQLELTLA

SEQ ID NO: 1332247 - protein, 19 aa, Mycobacterium
VAQLWTPPFASEPLRRRLR

SEQ ID NO: 1332248 - protein, 24 aa, Mycobacterium
VARDMPLRRFVFTSSYVTVGRRRG

SEQ ID NO: 1332249 - protein, 31 aa, Mycobacterium
VCVLIAPWNYPLLQMSWKVAPALAAGCTMVM

SEQ ID NO: 1332250 - protein, 23 aa, Mycobacterium
VDALHPGWRYPDPLAPVAAAERA

SEQ ID NO: 1332251 - protein, 22 aa, Mycobacterium
VDDILWQVPYLPIDPKDVGRTY

SEQ ID NO: 1332252 - protein, 17 aa, Mycobacterium
VDFWASWCGPCRAFAPT

SEQ ID NO: 1332253 - protein, 19 aa, Mycobacterium
VEILPTPFLPAGVFDVWGL

SEQ ID NO: 1332254 - protein, 17 aa, Mycobacterium
VELLLVIGRLIAGALHQ

SEQ ID NO: 1332255 - protein, 23 aa, Mycobacterium
VEPKPLRGMPPFSGPQGPFAGIA

SEQ ID NO: 1332256 - protein, 19 aa, Mycobacterium
VFIGYLRRKLEAGGAPRLL

SEQ ID NO: 1332257 - protein, 23 aa, Mycobacterium
VGADVLPWWPVRGVYLLLERGAS

SEQ ID NO: 1332258 - protein, 18 aa, Mycobacterium
VGHFTWDLKRFAASVALM

SEQ ID NO: 1332259 - protein, 21 aa, Mycobacterium
VGHSYIVYAPLLLGATTVLYE

SEQ ID NO: 1332260 - protein, 19 aa, Mycobacterium
VGLDLFWRNIRTHSLHDPV

SEQ ID NO: 1332261 - protein, 22 aa, Mycobacterium
VGLFGPPLKFDVSLPLSQIGAF

SEQ ID NO: 1332262 - protein, 19 aa, Mycobacterium
VGLLLGRPTVLYPLGAFDP

SEQ ID NO: 1332263 - protein, 22 aa, Mycobacterium
VGPGLYTWLPLGLRVFRKIEQI

SEQ ID NO: 1332264 - protein, 28 aa, Mycobacterium
VGQIIPWNFPILMATWKLAPALAAGNAV

SEQ ID NO: 1332265 - protein, 23 aa, Mycobacterium
VGQLLLAHFVLNAAIGGLGDTEP

SEQ ID NO: 1332266 - protein, 21 aa, Mycobacterium
VGRPPVIRRAILTLFADRAPE

SEQ ID NO: 1332267 - protein, 17 aa, Mycobacterium
VHRLWLDAGHRVHYVQN

SEQ ID NO: 1332268 - protein, 19 aa, Mycobacterium
VHSRTPLLLLPIRIETRLT

SEQ ID NO: 1332269 - protein, 24 aa, Mycobacterium
VHVYLKRAALNRSLFGSPAAHRRQ

SEQ ID NO: 1332270 - protein, 28 aa, Mycobacterium
VIGGYAERMLLSAPLLLPVPNGLDPRHA

SEQ ID NO: 1332271 - protein, 17 aa, Mycobacterium
VISDFLGPIDWMRPLRA

SEQ ID NO: 1332272 - protein, 23 aa, Mycobacterium
VITPWNFPMTIAAWGFAPALAAG

SEQ ID NO: 1332273 - protein, 17 aa, Mycobacterium
VIVLPWDKHIAAGTEIQ

SEQ ID NO: 1332274 - protein, 27 aa, Mycobacterium
VKPTSVPAFRPGAQFKAIVSGAQKLAS

SEQ ID NO: 1332275 - protein, 18 aa, Mycobacterium
VLAALSLLLRRERTGLGG

SEQ ID NO: 1332276 - protein, 25 aa, Mycobacterium
VLAEWFLRRFSLLDSLYMVPSPRLV

SEQ ID NO: 1332277 - protein, 17 aa, Mycobacterium
VLAWLYVVDAWEGGLPS

SEQ ID NO: 1332278 - protein, 19 aa, Mycobacterium
VLGFSLLGLLPDNATVSGT

SEQ ID NO: 1332279 - protein, 18 aa, Mycobacterium
VLLESFLDGPEVSLFCVV

SEQ ID NO: 1332280 - protein, 18 aa, Mycobacterium
VLLQLRWLALEGRPDRVD

SEQ ID NO: 1332281 - protein, 19 aa, Mycobacterium
VLNNWIRQGVVRRGLVVSG

SEQ ID NO: 1332282 - protein, 17 aa, Mycobacterium
VLPFLLPDTPVVAWWPG

SEQ ID NO: 1332283 - protein, 25 aa, Mycobacterium
VLSQRPRMLFDYFQQLFAQVTNPPL

SEQ ID NO: 1332284 - protein, 21 aa, Mycobacterium
VLTFAGALWWRTVQEVGAEYP

SEQ ID NO: 1332285 - protein, 18 aa, Mycobacterium
VMAALREPGIGVIAEVKR

SEQ ID NO: 1332286 - protein, 17 aa, Mycobacterium
VNLTYLPFIARAVIDAL

SEQ ID NO: 1332287 - protein, 17 aa, Mycobacterium
VPFIEWLRGTFPDVVIS

SEQ ID NO: 1332288 - protein, 20 aa, Mycobacterium
VPLRVHVLVRFGRWDDLIAE

SEQ ID NO: 1332289 - protein, 19 aa, Mycobacterium
VPMFLLYDYSFLPPGTASK

SEQ ID NO: 1332290 - protein, 29 aa, Mycobacterium
VPPHGWINLHFSLLPAWRGAAPVQAAIAA

SEQ ID NO: 1332291 - protein, 23 aa, Mycobacterium
VPPKDYFPLLALLKRSLTEEEVV

SEQ ID NO: 1332292 - protein, 17 aa, Mycobacterium
VPPMAPLAPLLPAAADI

SEQ ID NO: 1332293 - protein, 17 aa, Mycobacterium
VQRPDLVIGWWAAPTIL

SEQ ID NO: 1332294 - protein, 23 aa, Mycobacterium
VQRVFFGWAQVWRTKYRSAEAIR

SEQ ID NO: 1332295 - protein, 24 aa, Mycobacterium
VQRVKTWLQFPQWFYNDSPPNTMV

SEQ ID NO: 1332296 - protein, 21 aa, Mycobacterium
VQWQLVRRLVTIVEFSFAARC

SEQ ID NO: 1332297 - protein, 22 aa, Mycobacterium
VRAPILLYRCGLGFMLGDRFLM

SEQ ID NO: 1332298 - protein, 23 aa, Mycobacterium
VRDPYLYRRFFPTVEYRPVLPGP

SEQ ID NO: 1332299 - protein, 21 aa, Mycobacterium
VRDWWAMDWVWNALHLDDGTH

SEQ ID NO: 1332300 - protein, 17 aa, Mycobacterium
VRIIRMFVEFWDRTRLA

SEQ ID NO: 1332301 - protein, 18 aa, Mycobacterium
VRIRLLRELAATGESLVA

SEQ ID NO: 1332302 - protein, 19 aa, Mycobacterium
VRPRHKMVLITHRADGSLQ

SEQ ID NO: 1332303 - protein, 23 aa, Mycobacterium
VRTRFFDDFFLSSGLPQAVILAS

SEQ ID NO: 1332304 - protein, 18 aa, Mycobacterium
VRYFVKRYTLKRSALAFG

SEQ ID NO: 1332305 - protein, 18 aa, Mycobacterium
VSLAYLTDVFFARSVVSI

SEQ ID NO: 1332306 - protein, 23 aa, Mycobacterium
VSMPYFPNYLSLASPYAFLGLNF

SEQ ID NO: 1332307 - protein, 26 aa, Mycobacterium
VSPPTKWHLIVPFLNVLPGGMFAGAA

SEQ ID NO: 1332308 - protein, 24 aa, Mycobacterium
VSRPTLYRWFPSKQDLLSAFVVWE

SEQ ID NO: 1332309 - protein, 17 aa, Mycobacterium
VTGNYRAWRHFIAMRAS

SEQ ID NO: 1332310 - protein, 18 aa, Mycobacterium
VTLNLAMLTLLQKNLQGT

SEQ ID NO: 1332311 - protein, 21 aa, Mycobacterium
VTLPGMLHLAILRSPYAHARI

SEQ ID NO: 1332312 - protein, 17 aa, Mycobacterium
VTLRLPLTRGVGIYAAC

SEQ ID NO: 1332313 - protein, 20 aa, Mycobacterium
VTPMDFLRDTLLWAKLIDKY

SEQ ID NO: 1332314 - protein, 18 aa, Mycobacterium
VTSIYWYFRKKDDLLNAM

SEQ ID NO: 1332315 - protein, 25 aa, Mycobacterium
VTVPQWRVLVLIYTRGPMNLASVAA

SEQ ID NO: 1332316 - protein, 20 aa, Mycobacterium
VVARLPFVPSLLEWLHAGRT

SEQ ID NO: 1332317 - protein, 22 aa, Mycobacterium
VVDTILDKGLVLDAYVRVSVVG

SEQ ID NO: 1332318 - protein, 27 aa, Mycobacterium
VVFEKRPLFLKLLLMLVLERGDGDPGV

SEQ ID NO: 1332319 - protein, 22 aa, Mycobacterium
VVFEVMVRPLIRLSLGKRAPMR

SEQ ID NO: 1332320 - protein, 20 aa, Mycobacterium
VVPFLHPDLVWDFRLPRVVS

SEQ ID NO: 1332321 - protein, 26 aa, Mycobacterium
VVPWNMPQFLIVTKLIPALLAGCTVV

SEQ ID NO: 1332322 - protein, 17 aa, Mycobacterium
VVRRLRLPSPIRDLALG

SEQ ID NO: 1332323 - protein, 19 aa, Mycobacterium
VVSLLPPWAIRMGARAYRK

SEQ ID NO: 1332324 - protein, 18 aa, Mycobacterium
VVVLLRRAGRPAFTAEQL

SEQ ID NO: 1332325 - protein, 23 aa, Mycobacterium
VVYEPLMKRLPPDTPIYGIERVE

SEQ ID NO: 1332326 - protein, 18 aa, Mycobacterium
VWLAGPKARYITGTALPV

SEQ ID NO: 1332327 - protein, 17 aa, Mycobacterium
VWRWYLIDKNAPDDVRD

SEQ ID NO: 1332328 - protein, 17 aa, Mycobacterium
VYQWLTVLQEYLVLSLV

SEQ ID NO: 1332329 - protein, 21 aa, Mycobacterium
WAAYALWVFTLFGHPDVRLLD

SEQ ID NO: 1332330 - protein, 19 aa, Mycobacterium
WAGVPFYLRTGKRLGRRVT

SEQ ID NO: 1332331 - protein, 21 aa, Mycobacterium
WCISRQLWWGHRIPIWHGPNG

SEQ ID NO: 1332332 - protein, 21 aa, Mycobacterium
WDDLPWLRSLTKLPVILKGIC

SEQ ID NO: 1332333 - protein, 23 aa, Mycobacterium
WDLEQLWTALKQLYPVGIDYHDL

SEQ ID NO: 1332334 - protein, 18 aa, Mycobacterium
WDWVIDRIYLVLYGSAIA

SEQ ID NO: 1332335 - protein, 21 aa, Mycobacterium
WEFLDRLVAIALPRIRDFRGL

SEQ ID NO: 1332336 - protein, 19 aa, Mycobacterium
WFERLFLFVAFVNRFLPPF

SEQ ID NO: 1332337 - protein, 22 aa, Mycobacterium
WGDTHYYLIPAERLPLLMPFEQ

SEQ ID NO: 1332338 - protein, 21 aa, Mycobacterium
WGPTVPLVGAPWFALSERNSP

SEQ ID NO: 1332339 - protein, 18 aa, Mycobacterium
WGVYLPRWETLNAARNWY

SEQ ID NO: 1332340 - protein, 17 aa, Mycobacterium
WLDDPTRFFAPPPPLTD

SEQ ID NO: 1332341 - protein, 17 aa, Mycobacterium
WLDVPPTDEFWRTVEHQ

SEQ ID NO: 1332342 - protein, 18 aa, Mycobacterium
WLRPFRNLVYVMPPYICT

SEQ ID NO: 1332343 - protein, 28 aa, Mycobacterium
WLSDAELYLFFYLLFSAGAETTRNSIAG

SEQ ID NO: 1332344 - protein, 19 aa, Mycobacterium
WMLDIRLRALRTFDKKPMP

SEQ ID NO: 1332345 - protein, 18 aa, Mycobacterium
WMPGWLEMLLEVGGALPS

SEQ ID NO: 1332346 - protein, 17 aa, Mycobacterium
WQAWHRSGLQRRWLAAS

SEQ ID NO: 1332347 - protein, 17 aa, Mycobacterium
WQRLLFDNGWLLPGHPP

SEQ ID NO: 1332348 - protein, 22 aa, Mycobacterium
WRLDRAGWFGPPRRWLVVTGTN

SEQ ID NO: 1332349 - protein, 18 aa, Mycobacterium
WRPWRAYATQHLWTALDH

SEQ ID NO: 1332350 - protein, 17 aa, Mycobacterium
WRRLLQCSSATGADGVV

SEQ ID NO: 1332351 - protein, 18 aa, Mycobacterium
WSPNTWHWVVAALATTYA

SEQ ID NO: 1332352 - protein, 21 aa, Mycobacterium
WVDANVWRRIVPKGWFYNVMV

SEQ ID NO: 1332353 - protein, 24 aa, Mycobacterium
YAEIGLLGFALITDALGGVDVCLK

SEQ ID NO: 1332354 - protein, 22 aa, Mycobacterium
YAGLFIRMSWHAAGTYRIFDGR

SEQ ID NO: 1332355 - protein, 18 aa, Mycobacterium
YALAHDERFGIWGGLSER

SEQ ID NO: 1332356 - protein, 18 aa, Mycobacterium
YAYFLYPPEQPLTETAYD

SEQ ID NO: 1332357 - protein, 19 aa, Mycobacterium
YAYKLEWLAALRKTAHGWL

SEQ ID NO: 1332358 - protein, 25 aa, Mycobacterium
YDAYLRLHLLSHRLIQPRGANLDGV

SEQ ID NO: 1332359 - protein, 20 aa, Mycobacterium
YDAYLWLRRKGYEPDQIVLA

SEQ ID NO: 1332360 - protein, 23 aa, Mycobacterium
YDDEFFVVLPRDHRFAAAVEVPF

SEQ ID NO: 1332361 - protein, 17 aa, Mycobacterium
YDFVFAEVWQRPVLSRR

SEQ ID NO: 1332362 - protein, 17 aa, Mycobacterium
YDRLLYVADFITQRLWA

SEQ ID NO: 1332363 - protein, 24 aa, Mycobacterium
YEEERPTIVMPGTGGTVAGTAVND

SEQ ID NO: 1332364 - protein, 19 aa, Mycobacterium
YETPYFFSARKFERAHFPT

SEQ ID NO: 1332365 - protein, 21 aa, Mycobacterium
YEWPIIDFAILAVGALTVPIY

SEQ ID NO: 1332366 - protein, 19 aa, Mycobacterium
YEYGFFWYFYNDASMEVEV

SEQ ID NO: 1332367 - protein, 25 aa, Mycobacterium
YFEDPAYVPLLLRAYDLWDRLATDS

SEQ ID NO: 1332368 - protein, 18 aa, Mycobacterium
YFLPLDKAGIDPFVTAYP

SEQ ID NO: 1332369 - protein, 18 aa, Mycobacterium
YGASPMPLPLLRQALKAW

SEQ ID NO: 1332370 - protein, 18 aa, Mycobacterium
YGCDVWLNNPLRPLEACG

SEQ ID NO: 1332371 - protein, 20 aa, Mycobacterium
YGDKSNWWAAYALWVFTLFG

SEQ ID NO: 1332372 - protein, 20 aa, Mycobacterium
YGDMGLALPILAPGGVAAAL

SEQ ID NO: 1332373 - protein, 19 aa, Mycobacterium
YGWGPRMWTWIQMMGLRAF

SEQ ID NO: 1332374 - protein, 23 aa, Mycobacterium
YIHRLRKYIGAYLALLGSTDVIV

SEQ ID NO: 1332375 - protein, 23 aa, Mycobacterium
YKGRKVIVYFYPAASTPGCTKQA

SEQ ID NO: 1332376 - protein, 22 aa, Mycobacterium
YKKLLLAMLQRREAWQIIDFVN

SEQ ID NO: 1332377 - protein, 21 aa, Mycobacterium
YLADEVLMDPALAWLAERNAA

SEQ ID NO: 1332378 - protein, 18 aa, Mycobacterium
YLELPVTVELLVASTEPG

SEQ ID NO: 1332379 - protein, 26 aa, Mycobacterium
YLFNGQFLSLPWFYRSGYDVLLYTLP

SEQ ID NO: 1332380 - protein, 20 aa, Mycobacterium
YLGLPYYGRWLLAVARVLVE

SEQ ID NO: 1332381 - protein, 18 aa, Mycobacterium
YLPDLLMCRTEVVDVLLA

SEQ ID NO: 1332382 - protein, 18 aa, Mycobacterium
YLQTFRTIHRYALPNRFT

SEQ ID NO: 1332383 - protein, 18 aa, Mycobacterium
YMLYTPLLPDVAGGLVDA

SEQ ID NO: 1332384 - protein, 21 aa, Mycobacterium
YMYTTIFDAIIGRLLIAAGEP

SEQ ID NO: 1332385 - protein, 29 aa, Mycobacterium
YNRRSKFPQRWWWVVLTDEPFPRFSVVRA

SEQ ID NO: 1332386 - protein, 30 aa, Mycobacterium
YRGHIFWDELFIFPVLNLRLPMITRSLLAY

SEQ ID NO: 1332387 - protein, 25 aa, Mycobacterium
YRHPTRLHWYVPNSIRWLDRLKAVS

SEQ ID NO: 1332388 - protein, 18 aa, Mycobacterium
YRRLIIAGDWWDTVDEIA

SEQ ID NO: 1332389 - protein, 24 aa, Mycobacterium
YVHPEIEFFLLKPGPNDGTPPVPA

SEQ ID NO: 1332390 - protein, 17 aa, Mycobacterium
YVMAISSLDPDDDASAR

SEQ ID NO: 1332391 - protein, 29 aa, Mycobacterium
YYEKAGLWPYLEKLGFFLVGYGCTTCIGN

SEQ ID NO: 1332392 - protein, 27 aa, Mycobacterium
AAASWRPFQLAFILLQIPSLTDPAHPF

SEQ ID NO: 1332393 - protein, 24 aa, Mycobacterium
AAHHRLFSHVPWLSSQLLSAVEAF

SEQ ID NO: 1332394 - protein, 23 aa, Mycobacterium
AAHPADLWRAAADLGWHGLAVAE

SEQ ID NO: 1332395 - protein, 20 aa, Mycobacterium
AAIAAIMPPGSDIPSVKVSE

SEQ ID NO: 1332396 - protein, 22 aa, Mycobacterium
AALVFWRLIALGKPVSARHLDR

SEQ ID NO: 1332397 - protein, 18 aa, Mycobacterium
AALVLVFVASFRAPLQGT

SEQ ID NO: 1332398 - protein, 25 aa, Mycobacterium
AAQAFDLFRWLGPSPDALLSAAGTV

SEQ ID NO: 1332399 - protein, 23 aa, Mycobacterium
ADKFVPEWIWQSPAAVKRVFLQA

SEQ ID NO: 1332400 - protein, 19 aa, Mycobacterium
ADMLLLIVAALEQPVLESL

SEQ ID NO: 1332401 - protein, 17 aa, Mycobacterium
ADPVFMLTGPIPATRYA

SEQ ID NO: 1332402 - protein, 23 aa, Mycobacterium
AEEAAFVLLALQAPVAGDLRAVV

SEQ ID NO: 1332403 - protein, 25 aa, Mycobacterium
AEEIAWWVWWCWDQQLRKIEPSLLA

SEQ ID NO: 1332404 - protein, 21 aa, Mycobacterium
AEESLALLRLLLRGDPIDLGG

SEQ ID NO: 1332405 - protein, 25 aa, Mycobacterium
AERYGLDMWLRVGATWLSAVDALAA

SEQ ID NO: 1332406 - protein, 26 aa, Mycobacterium
AESKALVRLYLALVALLRGDFDRAED

SEQ ID NO: 1332407 - protein, 17 aa, Mycobacterium
AFDPVFRPMLDGLRDEL

SEQ ID NO: 1332408 - protein, 18 aa, Mycobacterium
AFHADWFLRRILAAEERI

SEQ ID NO: 1332409 - protein, 22 aa, Mycobacterium
AGKTWAIMTLLFHLVDIGGQFL

SEQ ID NO: 1332410 - protein, 21 aa, Mycobacterium
AGLDLLILRIAALFHENLLVL

SEQ ID NO: 1332411 - protein, 19 aa, Mycobacterium
AGNTLILKPAPDTPWCAAA

SEQ ID NO: 1332412 - protein, 22 aa, Mycobacterium
AGPVRLRYPVYVDLLPPCNDAC

SEQ ID NO: 1332413 - protein, 31 aa, Mycobacterium
AGRAVVLAPRLWVPDDFGLSRYLAAGLAVLQ

SEQ ID NO: 1332414 - protein, 25 aa, Mycobacterium
AGVAFPDALLTRGLYQYKPDLPFTP

SEQ ID NO: 1332415 - protein, 18 aa, Mycobacterium
AHGWRRWVYRLSFGRINP

SEQ ID NO: 1332416 - protein, 24 aa, Mycobacterium
AHGWTAENLRWLLARIGPVGIVAF

SEQ ID NO: 1332417 - protein, 19 aa, Mycobacterium
AHPQMLLRIGWLPRDAVAL

SEQ ID NO: 1332418 - protein, 28 aa, Mycobacterium
AHRLAALDVPVPFWFRAPGECPGAYAAE

SEQ ID NO: 1332419 - protein, 19 aa, Mycobacterium
AICRRAGVTVRYFYECFTD

SEQ ID NO: 1332420 - protein, 21 aa, Mycobacterium
AIRVLMGCPFLNGLQARRLER

SEQ ID NO: 1332421 - protein, 20 aa, Mycobacterium
AKMSLLRHGFVKIFCRPATG

SEQ ID NO: 1332422 - protein, 25 aa, Mycobacterium
ALAPLRLHYLRWQLFDVGSGLHFQY

SEQ ID NO: 1332423 - protein, 23 aa, Mycobacterium
ALDRALIDLATYFRDALLVSSGA

SEQ ID NO: 1332424 - protein, 20 aa, Mycobacterium
ALHVLLWQRALDPERGRWSL

SEQ ID NO: 1332425 - protein, 20 aa, Mycobacterium
ALLETAPLPGLPPLSSGLVG

SEQ ID NO: 1332426 - protein, 17 aa, Mycobacterium
ALNLPWLAMGAVGFISV

SEQ ID NO: 1332427 - protein, 21 aa, Mycobacterium
AMIAGRMRIPWVPVDNARIAR

SEQ ID NO: 1332428 - protein, 20 aa, Mycobacterium
AMRDGRFLVLPHPAVRDMLA

SEQ ID NO: 1332429 - protein, 25 aa, Mycobacterium
ANPEKVWAWYLWRHYMMDAVQPNNG

SEQ ID NO: 1332430 - protein, 19 aa, Mycobacterium
APATPWLATTVRLAWRVKL

SEQ ID NO: 1332431 - protein, 29 aa, Mycobacterium
APRTPVLRKLLWLLPDRFAPQLKPEVWAV

SEQ ID NO: 1332432 - protein, 23 aa, Mycobacterium
APSIISLTLLPKMTPRAAGRYFV

SEQ ID NO: 1332433 - protein, 19 aa, Mycobacterium
AQPWSLRYPLVDGQGNFGS

SEQ ID NO: 1332434 - protein, 21 aa, Mycobacterium
AQRLALFAREKWTRILIPWRH

SEQ ID NO: 1332435 - protein, 25 aa, Mycobacterium
ARFRDALFPVWRYHPFFTNTDLPTA

SEQ ID NO: 1332436 - protein, 26 aa, Mycobacterium
ARLGGPGRWLLALPAHHIAGLQVLVR

SEQ ID NO: 1332437 - protein, 18 aa, Mycobacterium
ARLLPWNFKAILARCARV

SEQ ID NO: 1332438 - protein, 26 aa, Mycobacterium
ARMEFVISEYIRFHPLALLHPEKVDD

SEQ ID NO: 1332439 - protein, 19 aa, Mycobacterium
ARRLLWPIKQKYGNKISWA

SEQ ID NO: 1332440 - protein, 18 aa, Mycobacterium
ARVWALNPLTIPVTAHQL

SEQ ID NO: 1332441 - protein, 30 aa, Mycobacterium
ASGPYFKVMLVNLAPYWILQPYVDAAFKKR

SEQ ID NO: 1332442 - protein, 37 aa, Mycobacterium; identical to SEQ ID NO: 1251071

SEQ ID NO: 1332443 - protein, 19 aa, Mycobacterium
ASYLPLMRVLRRLAGEGRD

SEQ ID NO: 1332444 - protein, 18 aa, Mycobacterium
ASYQRKLRYLAYKAKTIV

SEQ ID NO: 1332445 - protein, 17 aa, Mycobacterium
ATAPLPVFLQRSPHFRP

SEQ ID NO: 1332446 - protein, 19 aa, Mycobacterium
ATGRPPRWVAPVVDGLGLA

SEQ ID NO: 1332447 - protein, 17 aa, Mycobacterium
ATIVPMFLLYDYSFLPP

SEQ ID NO: 1332448 - protein, 22 aa, Mycobacterium
ATMPYVLKLADKGWRAACQADP

SEQ ID NO: 1332449 - protein, 25 aa, Mycobacterium
ATRGSRFYPLLYLLTRVDGARDFGS

SEQ ID NO: 1332450 - protein, 23 aa, Mycobacterium
AVAMLVAIFRARPSPFYVMDEVE

SEQ ID NO: 1332451 - protein, 25 aa, Mycobacterium
AVARPEVWIFLRPFADALTDAEAVD

SEQ ID NO: 1332452 - protein, 19 aa, Mycobacterium
AVLPPWLQPGDYAPAFGAK

SEQ ID NO: 1332453 - protein, 25 aa, Mycobacterium
AVNGQLFIVYGPKVTLVAAPVAEAH

SEQ ID NO: 1332454 - protein, 17 aa, Mycobacterium
AVSLIWERGGTVSAWLA

SEQ ID NO: 1332455 - protein, 19 aa, Mycobacterium
CDQNLWRLVTARLAPEFRV

SEQ ID NO: 1332456 - protein, 23 aa, Mycobacterium
CMSSSLPTLFRRAADYQRQITLT

SEQ ID NO: 1332457 - protein, 17 aa, Mycobacterium
CRAEQWLDLRFVSGRGA

SEQ ID NO: 1332458 - protein, 17 aa, Mycobacterium
DAKVLWQLKRALPGPFT

SEQ ID NO: 1332459 - protein, 24 aa, Mycobacterium
DALDRALIDLATYFRDALLVSSGA

SEQ ID NO: 1332460 - protein, 24 aa, Mycobacterium
DASDLFYVWIKRALAGSWPEIGFT

SEQ ID NO: 1332461 - protein, 24 aa, Mycobacterium
DAYHDFLFAVPWADGVAVPVNTRW

SEQ ID NO: 1332462 - protein, 23 aa, Mycobacterium
DDRLWDILGAISADHRPAWTSTL

SEQ ID NO: 1332463 - protein, 24 aa, Mycobacterium
DEEIYSFLRLLLPAGVETTYRSLG

SEQ ID NO: 1332464 - protein, 17 aa, Mycobacterium
DEFGFFVILLAVAGNET

SEQ ID NO: 1332465 - protein, 19 aa, Mycobacterium
DELRRAIPADLLARRRFDA

SEQ ID NO: 1332466 - protein, 18 aa, Mycobacterium
DELWPVLTPQTLLADLYE

SEQ ID NO: 1332467 - protein, 17 aa, Mycobacterium
DERLTPVLIPLGDGLLA

SEQ ID NO: 1332468 - protein, 19 aa, Mycobacterium
DFLRRPLLGFLSMAAGPTP

SEQ ID NO: 1332469 - protein, 17 aa, Mycobacterium
DFNFLWPTARIAVIGAE

SEQ ID NO: 1332470 - protein, 20 aa, Mycobacterium
DFNFMLIGAAFYRDRYRRTP

SEQ ID NO: 1332471 - protein, 18 aa, Mycobacterium
DFVKKLPAWVSWDRREDY

SEQ ID NO: 1332472 - protein, 18 aa, Mycobacterium
DGADIRVLPPLDPPPPGV

SEQ ID NO: 1332473 - protein, 23 aa, Mycobacterium
DGAGWLTFWRSLTARGLSGVKLV

SEQ ID NO: 1332474 - protein, 21 aa, Mycobacterium
DGFMIFPPRVPYGIGAFVDLV

SEQ ID NO: 1332475 - protein, 29 aa, Mycobacterium
DGPAVNLYERFLWRLFSKDYSLFERYQPF

SEQ ID NO: 1332476 - protein, 18 aa, Mycobacterium
DILFFWVARMMMFGTFVA

SEQ ID NO: 1332477 - protein, 22 aa, Mycobacterium
DIRFVRLWFTDVLGYLKSVAIA

SEQ ID NO: 1332478 - protein, 20 aa, Mycobacterium
DIRVLPPLDPPPPGVYAAFR

SEQ ID NO: 1332479 - protein, 17 aa, Mycobacterium
DKARRLLWPIKQKYGNK

SEQ ID NO: 1332480 - protein, 23 aa, Mycobacterium
DKVAKWWIPERWSFVSDIPRTSV

SEQ ID NO: 1332481 - protein, 19 aa, Mycobacterium
DLAEAALALRAGALWVAAN

SEQ ID NO: 1332482 - protein, 23 aa, Mycobacterium
DLALLTDPWQPAVLALVAMTVRA

SEQ ID NO: 1332483 - protein, 19 aa, Mycobacterium
DLDYYLVLAKWKLAIVLEQ

SEQ ID NO: 1332484 - protein, 18 aa, Mycobacterium
DLFRSPAAAASFVVDPDG

SEQ ID NO: 1332485 - protein, 17 aa, Mycobacterium
DLLAAPDQFDWLATRLE

SEQ ID NO: 1332486 - protein, 17 aa, Mycobacterium
DLLFWVDEYRRLPKLRA

SEQ ID NO: 1332487 - protein, 21 aa, Mycobacterium
DMALLDLFWTSVSGVLHAVNV

SEQ ID NO: 1332488 - protein, 18 aa, Mycobacterium
DMLLLIVAALEQPVLESL

SEQ ID NO: 1332489 - protein, 20 aa, Mycobacterium
DNWRWAGVPIYLRTGKKMAE

SEQ ID NO: 1332490 - protein, 24 aa, Mycobacterium
DPANNVEFFFLRPKDIAIYVGSGQ

SEQ ID NO: 1332491 - protein, 23 aa, Mycobacterium
DPCQLCRWWWRQGRTWPKAHPFQ

SEQ ID NO: 1332492 - protein, 18 aa, Mycobacterium
DPDLWWPDKRPYAPGSVL

SEQ ID NO: 1332493 - protein, 17 aa, Mycobacterium
DPRMMVAVLLYGYTVGV

SEQ ID NO: 1332494 - protein, 24 aa, Mycobacterium
DPTNDLILIYLIQNLPNFGADAAA

SEQ ID NO: 1332495 - protein, 20 aa, Mycobacterium
DQLHRLFDDLEFRVLRDRLF

SEQ ID NO: 1332496 - protein, 19 aa, Mycobacterium
DRSASWMFDYYPLRVVREL

SEQ ID NO: 1332497 - protein, 27 aa, Mycobacterium
DSEPGRPLWPMIILRTPKGWTGPREVD

SEQ ID NO: 1332498 - protein, 17 aa, Mycobacterium
DSRAYRLPWPAGTVVFE

SEQ ID NO: 1332499 - protein, 26 aa, Mycobacterium
DSVLLPIGPRRELWARLGGALKPPHL

SEQ ID NO: 1332500 - protein, 32 aa, Mycobacterium
DTAYYLIPTYPLPLLMPLTWIPVIGPIAVDML

SEQ ID NO: 1332501 - protein, 18 aa, Mycobacterium
DVDVVLSPFFNTLPIRRA

SEQ ID NO: 1332502 - protein, 24 aa, Mycobacterium
DVERLHLVLVYRSVGLPLEEIRTL

SEQ ID NO: 1332503 - protein, 24 aa, Mycobacterium
DVNVKGVFLLTRALVPLLEAAATE

SEQ ID NO: 1332504 - protein, 17 aa, Mycobacterium
DWPRIDAPFIRPGADMA

SEQ ID NO: 1332505 - protein, 17 aa, Mycobacterium
DWQLICRIAAELGFGAD

SEQ ID NO: 1332506 - protein, 18 aa, Mycobacterium
EALRLVLERGWTAQRAAE

SEQ ID NO: 1332507 - protein, 25 aa, Mycobacterium
EARLRRLPVLLLGRQPRHGNGGDEL

SEQ ID NO: 1332508 - protein, 17 aa, Mycobacterium
ECSRPFPLIGRLNLRQP

SEQ ID NO: 1332509 - protein, 23 aa, Mycobacterium
EDFIGIHFFSPVDKMPLVEIIKG

SEQ ID NO: 1332510 - protein, 18 aa, Mycobacterium
EDQALLYRLSGDRNPLHS

SEQ ID NO: 1332511 - protein, 17 aa, Mycobacterium
EEFVRFQKAWFAELHSA

SEQ ID NO: 1332512 - protein, 17 aa, Mycobacterium
EELLRRGAWARCVQTIG

SEQ ID NO: 1332513 - protein, 17 aa, Mycobacterium
EENYWFRRHEVVYARLA

SEQ ID NO: 1332514 - protein, 25 aa, Mycobacterium
EGIEPFGFYYEKFALAAPAAATSAA

SEQ ID NO: 1332515 - protein, 30 aa, Mycobacterium
EGIPAIMQAFLQPILFPSLALLMPVQGIIT

SEQ ID NO: 1332516 - protein, 22 aa, Mycobacterium
EGLTMFLMPLDAPGITMRRIKQ

SEQ ID NO: 1332517 - protein, 19 aa, Mycobacterium
EGRFYLPGGRRLGYAEFGD

SEQ ID NO: 1332518 - protein, 22 aa, Mycobacterium
EHVQFRLLPIGDPFRFLVNLAK

SEQ ID NO: 1332519 - protein, 18 aa, Mycobacterium
EIAATRRHWAKQAAAPAS

SEQ ID NO: 1332520 - protein, 18 aa, Mycobacterium
EKSNLPAMLPLPHPQMRP

SEQ ID NO: 1332521 - protein, 29 aa, Mycobacterium
ELGFDYVDLFLIHWPLPTLYDGDFVSTWQ

SEQ ID NO: 1332522 - protein, 17 aa, Mycobacterium
ELIKRTQWWGRQMLIWG

SEQ ID NO: 1332523 - protein, 17 aa, Mycobacterium
EPPPDIELIGMLNLLIG

SEQ ID NO: 1332524 - protein, 24 aa, Mycobacterium
EQEYELIVYWWPTPDKASVAGAIL

SEQ ID NO: 1332525 - protein, 23 aa, Mycobacterium
EQVEIPLRRYVLWTRLRIAITRV

SEQ ID NO: 1332526 - protein, 22 aa, Mycobacterium
ERAAALWPDRLAVTALPGGTNL

SEQ ID NO: 1332527 - protein, 25 aa, Mycobacterium
ERAWEQFIPFLAFPPELRRVIYTTN

SEQ ID NO: 1332528 - protein, 23 aa, Mycobacterium
ERGRLWSALWLRPAHGPGVLVVT

SEQ ID NO: 1332529 - protein, 21 aa, Mycobacterium
ETWTNPWPMYAALRDHDPVHH

SEQ ID NO: 1332530 - protein, 24 aa, Mycobacterium
EVDNPMFGVIYRSPLRHLALIGTE

SEQ ID NO: 1332531 - protein, 22 aa, Mycobacterium
EVIAWQWIPFGPVLNARAEWLE

SEQ ID NO: 1332532 - protein, 18 aa, Mycobacterium
EVPLGTLIDLLAAFHDVD

SEQ ID NO: 1332533 - protein, 18 aa, Mycobacterium
EVSTPWYRALIGTEPVLD

SEQ ID NO: 1332534 - protein, 21 aa, Mycobacterium
EWIELAFFALLLRGCREAARG

SEQ ID NO: 1332535 - protein, 19 aa, Mycobacterium
EWYRCDTCRLLTAFSIRDV

SEQ ID NO: 1332536 - protein, 18 aa, Mycobacterium
EYFLWLRARTDRGLRGDD

SEQ ID NO: 1332537 - protein, 18 aa, Mycobacterium
FAALLGLPFIAVMTSSTS

SEQ ID NO: 1332538 - protein, 17 aa, Mycobacterium
FALLPLGELWVAAARLR

SEQ ID NO: 1332539 - protein, 18 aa, Mycobacterium
FALLPLNPFVPKRAVKRA

SEQ ID NO: 1332540 - protein, 20 aa, Mycobacterium
FAVPTFEQFWRDGSLRLPTE

SEQ ID NO: 1332541 - protein, 17 aa, Mycobacterium
FDILRLDGRWLLKAKYR

SEQ ID NO: 1332542 - protein, 17 aa, Mycobacterium
FDLLDKFSLARFPRIEE

SEQ ID NO: 1332543 - protein, 20 aa, Mycobacterium
FDLYSCFPFPVFAVCDEFGL

SEQ ID NO: 1332544 - protein, 21 aa, Mycobacterium
FDPDRFLSRRPTPFEYAPFGG

SEQ ID NO: 1332545 - protein, 26 aa, Mycobacterium
FEHLPQLLLTAMRWPRVGVMIARGDL

SEQ ID NO: 1332546 - protein, 18 aa, Mycobacterium
FHQLAWWVDDYDAALRSA

SEQ ID NO: 1332547 - protein, 17 aa, Mycobacterium
FIFLLWQRRRTTLRTRI

SEQ ID NO: 1332548 - protein, 17 aa, Mycobacterium
FIHHNLVLRRGPVAAVA

SEQ ID NO: 1332549 - protein, 17 aa, Mycobacterium
FLPLVRRLGRFLPADVR

SEQ ID NO: 1332550 - protein, 19 aa, Mycobacterium
FLPTRLTVDLFKAARGVPT

SEQ ID NO: 1332551 - protein, 17 aa, Mycobacterium
FLRREFDALWSAIRFDE

SEQ ID NO: 1332552 - protein, 22 aa, Mycobacterium
FLRRKLHLRPIFMKSYSQLTQL

SEQ ID NO: 1332553 - protein, 18 aa, Mycobacterium
FLVHRIWLDRPVAPDRPA

SEQ ID NO: 1332554 - protein, 17 aa, Mycobacterium
FPTMFRKALRKMAERRL

SEQ ID NO: 1332555 - protein, 21 aa, Mycobacterium
FRIQLAWMRQSPPGTPNPGWL

SEQ ID NO: 1332556 - protein, 25 aa, Mycobacterium
FRRTAGLDLLPRLLIRGGELDLTVV

SEQ ID NO: 1332557 - protein, 19 aa, Mycobacterium
FSMPWSHPVGRMREFVAAL

SEQ ID NO: 1332558 - protein, 17 aa, Mycobacterium
FVPFFPLGSAFTADNPI

SEQ ID NO: 1332559 - protein, 18 aa, Mycobacterium
FVRFVLRRSTFPYSNTVG

SEQ ID NO: 1332560 - protein, 22 aa, Mycobacterium
GADDTFFWFTSPSWMMWNFQVA

SEQ ID NO: 1332561 - protein, 20 aa, Mycobacterium
GAMGFKFQFITLAGFHALNY

SEQ ID NO: 1332562 - protein, 23 aa, Mycobacterium
GDASLAPILLRRVNKRPIPATSA

SEQ ID NO: 1332563 - protein, 17 aa, Mycobacterium
GDRYAFAELFVRHQRQL

SEQ ID NO: 1332564 - protein, 24 aa, Mycobacterium
GEGPRWFEGLLWFSDMFGEAVHTV

SEQ ID NO: 1332565 - protein, 23 aa, Mycobacterium
GELTWPPGWSRWPSRRYGDTRLD

SEQ ID NO: 1332566 - protein, 19 aa, Mycobacterium
GFLTPRDSLRQRCLTHELL

SEQ ID NO: 1332567 - protein, 19 aa, Mycobacterium
GFWGALWEYFDLGTAPAEV

SEQ ID NO: 1332568 - protein, 22 aa, Mycobacterium
GGGALPFGIFAGGLLTGPELIN

SEQ ID NO: 1332569 - protein, 18 aa, Mycobacterium
GGTPFFPTLPSWISLRLL

SEQ ID NO: 1332570 - protein, 20 aa, Mycobacterium
GGTRVLLQWTGVAARPAPSH

SEQ ID NO: 1332571 - protein, 20 aa, Mycobacterium
GGTSLMDILGQLLGAGGSGM

SEQ ID NO: 1332572 - protein, 23 aa, Mycobacterium
GHVVIAWMWLEQFLAAEGRTGDF

SEQ ID NO: 1332573 - protein, 20 aa, Mycobacterium
GKPRVFMLFIGGFGVYLDIC

SEQ ID NO: 1332574 - protein, 24 aa, Mycobacterium
GKSLSMLWFTQKVLRHVRGKWTFV

SEQ ID NO: 1332575 - protein, 18 aa, Mycobacterium
GLILTQWATSLTAKVITT

SEQ ID NO: 1332576 - protein, 20 aa, Mycobacterium
GLLRLPPAYIKAVGGPGELA

SEQ ID NO: 1332577 - protein, 18 aa, Mycobacterium
GLPMALTLFRRDLDVWAP

SEQ ID NO: 1332578 - protein, 20 aa, Mycobacterium
GLPPDFLMRALHDCLAAWQA

SEQ ID NO: 1332579 - protein, 18 aa, Mycobacterium
GMLPLPLLEVLFAADRET

SEQ ID NO: 1332580 - protein, 19 aa, Mycobacterium
GPWNFPVNLVVLPAAAAFA

SEQ ID NO: 1332581 - protein, 22 aa, Mycobacterium
GQSSLYYWFRSKDAILRGIMNQ

SEQ ID NO: 1332582 - protein, 17 aa, Mycobacterium
GRLGWWDGPRPHCAHEA

SEQ ID NO: 1332583 - protein, 20 aa, Mycobacterium
GSDRRYVMAISSLDPDDDAS

SEQ ID NO: 1332584 - protein, 18 aa, Mycobacterium
GSLIRWFQTLIGGVDLLQ

SEQ ID NO: 1332585 - protein, 19 aa, Mycobacterium
GSLWLYDHLYGPGAPDYPS

SEQ ID NO: 1332586 - protein, 24 aa, Mycobacterium
GTGGVLLPLLLFASARAAIPFTPL

SEQ ID NO: 1332587 - protein, 17 aa, Mycobacterium
GTRYLPPFPYFTDKPEA

SEQ ID NO: 1332588 - protein, 22 aa, Mycobacterium
GTYGRFLAIRVFDFWVHERDIT

SEQ ID NO: 1332589 - protein, 27 aa, Mycobacterium
GVDYLDLYLIHWPVPEKNLFVDTFKAF

SEQ ID NO: 1332590 - protein, 19 aa, Mycobacterium
GVELVVVRAWWSPGAFELP

SEQ ID NO: 1332591 - protein, 18 aa, Mycobacterium
GVPFLWRWHDVYAKLLKS

SEQ ID NO: 1332592 - protein, 26 aa, Mycobacterium
GVSKALFYFYFPRKEDVLFEVGVMST

SEQ ID NO: 1332593 - protein, 20 aa, Mycobacterium
GVTVEHPLWLSTMRARSCVD

SEQ ID NO: 1332594 - protein, 17 aa, Mycobacterium
GVYRPLLEPLGLTHPQY

SEQ ID NO: 1332595 - protein, 18 aa, Mycobacterium
GWRISIPAMMSYWSELAR

SEQ ID NO: 1332596 - protein, 28 aa, Mycobacterium
GYGEEPGPLPWYKRPPVLFGAAAAAALA

SEQ ID NO: 1332597 - protein, 19 aa, Mycobacterium
GYRGFWMGYFAARSAPLGR

SEQ ID NO: 1332598 - protein, 17 aa, Mycobacterium
GYTRYWIAEHHNMPAVA

SEQ ID NO: 1332599 - protein, 17 aa, Mycobacterium
HALGPIHLIQRVLPDMR

SEQ ID NO: 1332600 - protein, 18 aa, Mycobacterium
HAMLRILFSRLGEPHIGS

SEQ ID NO: 1332601 - protein, 19 aa, Mycobacterium
HDHSWFILTQRIIEKEFAL

SEQ ID NO: 1332602 - protein, 17 aa, Mycobacterium
HFRPPRDGVTPMIMVGP

SEQ ID NO: 1332603 - protein, 17 aa, Mycobacterium
HGFILAGPDLRDVSGWM

SEQ ID NO: 1332604 - protein, 17 aa, Mycobacterium
HGIAFVPFFPLGSAFTA

SEQ ID NO: 1332605 - protein, 21 aa, Mycobacterium
HLAYDLLEPWELLVLVDALPD

SEQ ID NO: 1332606 - protein, 24 aa, Mycobacterium
HQKAGLRLIVIDYLQLMTSGKKVE

SEQ ID NO: 1332607 - protein, 22 aa, Mycobacterium
HRGKEWLFRHLLHLVDPAIYPD

SEQ ID NO: 1332608 - protein, 18 aa, Mycobacterium
HSHFVFLEALRLQGTADQ

SEQ ID NO: 1332609 - protein, 23 aa, Mycobacterium
HTPVWVLLAKLVAGGLLGAIFQG

SEQ ID NO: 1332610 - protein, 23 aa, Mycobacterium
HVDPSMVLYLFGSKLDLFRESLR

SEQ ID NO: 1332611 - protein, 19 aa, Mycobacterium
HVLFAWHLPELWRRFTITM

SEQ ID NO: 1332612 - protein, 19 aa, Mycobacterium
HYFDHPLLVEMFAESISVA

SEQ ID NO: 1332613 - protein, 17 aa, Mycobacterium
IAAFLSIHNMCAWMVDT

SEQ ID NO: 1332614 - protein, 17 aa, Mycobacterium
IALLSRFPAETWQVVRL

SEQ ID NO: 1332615 - protein, 19 aa, Mycobacterium
IDELLRLFTLWQQDPSVSF

SEQ ID NO: 1332616 - protein, 17 aa, Mycobacterium
IDGLPRIALLDGLPFSN

SEQ ID NO: 1332617 - protein, 18 aa, Mycobacterium
IENGSYFVYRLIKRLKKS

SEQ ID NO: 1332618 - protein, 19 aa, Mycobacterium
IENGSYFVYRLIKRLKKSA

SEQ ID NO: 1332619 - protein, 17 aa, Mycobacterium
IGALLLWRAGLADSIRT

SEQ ID NO: 1332620 - protein, 18 aa, Mycobacterium
IGLFTLLAARHAGARVVV

SEQ ID NO: 1332621 - protein, 19 aa, Mycobacterium
IHILRQRPEWRRQLLDDIA

SEQ ID NO: 1332622 - protein, 17 aa, Mycobacterium
IHRLFDDLEFRVLRDRL

SEQ ID NO: 1332623 - protein, 21 aa, Mycobacterium
ILRRFDIIVLPLVNPDGRWVS

SEQ ID NO: 1332624 - protein, 21 aa, Mycobacterium
ILTAMSVFFFDLIDAPNHLAG

SEQ ID NO: 1332625 - protein, 25 aa, Mycobacterium
IQDAGRWRVPLLLAIRPEVGVDDVR

SEQ ID NO: 1332626 - protein, 17 aa, Mycobacterium
IRLAYRLTPRRVTGATR

SEQ ID NO: 1332627 - protein, 18 aa, Mycobacterium
IRYLPYWESLEPVPAPGE

SEQ ID NO: 1332628 - protein, 26 aa, Mycobacterium
IRYVDRFLMFYIRTADRLQRTAPWVE

SEQ ID NO: 1332629 - protein, 18 aa, Mycobacterium
ISIPFFLNPALDALIPIL

SEQ ID NO: 1332630 - protein, 18 aa, Mycobacterium
IVGLQLALTKLWRSYGVT

SEQ ID NO: 1332631 - protein, 20 aa, Mycobacterium
IVLQGLHRLWPPVIDLVRHL

SEQ ID NO: 1332632 - protein, 20 aa, Mycobacterium
KAQIYAWRKGIKTLYYIRLR

SEQ ID NO: 1332633 - protein, 24 aa, Mycobacterium
KARQLWFDRILPLAENIRAGEVVR

SEQ ID NO: 1332634 - protein, 18 aa, Mycobacterium
KAVRAVRLFGPVGSALIY

SEQ ID NO: 1332635 - protein, 23 aa, Mycobacterium
KETLRLHPPLIILMRVAQGEFEV

SEQ ID NO: 1332636 - protein, 17 aa, Mycobacterium
KGTVYLYWPTKEDLLIG

SEQ ID NO: 1332637 - protein, 23 aa, Mycobacterium
KHSAIAALPWFWSDQYDLKLQIA

SEQ ID NO: 1332638 - protein, 19 aa, Mycobacterium
KLARQPYYRWRAHPVTDAE

SEQ ID NO: 1332639 - protein, 25 aa, Mycobacterium
KMLYDNALLLRAYAHWARRTGDPLA

SEQ ID NO: 1332640 - protein, 18 aa, Mycobacterium
KMSLLRHGFVKIFCRPAT

SEQ ID NO: 1332641 - protein, 24 aa, Mycobacterium
KPNELLAPLPLTPLTPRLLVRRLE

SEQ ID NO: 1332642 - protein, 20 aa, Mycobacterium
KPWPYAPRIILRSLIQQAAD

SEQ ID NO: 1332643 - protein, 23 aa, Mycobacterium
KQDFGQWMFYGLGQALVGAAITV

SEQ ID NO: 1332644 - protein, 18 aa, Mycobacterium
KVSLLRRANPDRPHACLL

SEQ ID NO: 1332645 - protein, 24 aa, Mycobacterium
LADAWEPIFFYPEKLQDVWGEALA

SEQ ID NO: 1332646 - protein, 18 aa, Mycobacterium
LAGWVSAVVFFRSSRWHD

SEQ ID NO: 1332647 - protein, 19 aa, Mycobacterium
LAILLAAVPITFWDPVRLA

SEQ ID NO: 1332648 - protein, 18 aa, Mycobacterium
LALHGFVRGMSRLGMRRG

SEQ ID NO: 1332649 - protein, 17 aa, Mycobacterium
LARSTFHWVLAFAYKGL

SEQ ID NO: 1332650 - protein, 24 aa, Mycobacterium
LASWYMYFFQLPYVPELLLTRRRG

SEQ ID NO: 1332651 - protein, 17 aa, Mycobacterium
LCLPYFLGEKSPLHDPD

SEQ ID NO: 1332652 - protein, 23 aa, Mycobacterium
LDGRHLLASWIQLAALTAQLPGT

SEQ ID NO: 1332653 - protein, 18 aa, Mycobacterium
LDLAVTWPHSLPGVGAAV

SEQ ID NO: 1332654 - protein, 20 aa, Mycobacterium
LDPRRRAIVGMIFFDCLTQR

SEQ ID NO: 1332655 - protein, 17 aa, Mycobacterium
LDTWPLNVVLLGKGNTV

SEQ ID NO: 1332656 - protein, 18 aa, Mycobacterium
LDVLLQWFLADVRPKFPN

SEQ ID NO: 1332657 - protein, 24 aa, Mycobacterium
LEEYLGEGLLWYLDNFLLDCDPNG

SEQ ID NO: 1332658 - protein, 23 aa, Mycobacterium
LEFEALVALLRFPARFFTTAPVS

SEQ ID NO: 1332659 - protein, 19 aa, Mycobacterium
LELAFDYRVLWAEPLPGKV

SEQ ID NO: 1332660 - protein, 18 aa, Mycobacterium
LFGMLMTWDIPPWLDARG

SEQ ID NO: 1332661 - protein, 17 aa, Mycobacterium
LGWQVLRFTWLDLTEYP

SEQ ID NO: 1332662 - protein, 17 aa, Mycobacterium
LHCLPPRDWTEPGFMGL

SEQ ID NO: 1332663 - protein, 22 aa, Mycobacterium
LHHRRRIRPAAGRFNRILAAEE

SEQ ID NO: 1332664 - protein, 18 aa, Mycobacterium
LHLYVPLKEPISSQGASV

SEQ ID NO: 1332665 - protein, 29 aa, Mycobacterium
LIAAGAYLWLRAWPVPGGDLWAVPTGWRV

SEQ ID NO: 1332666 - protein, 17 aa, Mycobacterium
LIAPGQRVLFWVSAHPL

SEQ ID NO: 1332667 - protein, 27 aa, Mycobacterium
LIRYIDRFLMFYIRTADRLQRTAPWVE

SEQ ID NO: 1332668 - protein, 18 aa, Mycobacterium
LLIGQLIDRSGMAWCISN

SEQ ID NO: 1332669 - protein, 21 aa, Mycobacterium
LLLNGAPPVLPPFLPPELAPL

SEQ ID NO: 1332670 - protein, 19 aa, Mycobacterium
LLPVPWVDPVDVANAVVFL

SEQ ID NO: 1332671 - protein, 20 aa, Mycobacterium
LLVIGLRHRSPVGKLLLGSV

SEQ ID NO: 1332672 - protein, 19 aa, Mycobacterium
LMPVKLKWGISLGALIMHL

SEQ ID NO: 1332673 - protein, 25 aa, Mycobacterium
LNLKSPFWLVQALLPALRSAGTADD

SEQ ID NO: 1332674 - protein, 18 aa, Mycobacterium
LNVQSWLPTGAVPLDFDP

SEQ ID NO: 1332675 - protein, 24 aa, Mycobacterium
LPDEMPAAALWWRITETLAPTAAV

SEQ ID NO: 1332676 - protein, 17 aa, Mycobacterium
LPGLIKLALERGLAAEL

SEQ ID NO: 1332677 - protein, 17 aa, Mycobacterium
LPHDWLTWRLSGSDDIG

SEQ ID NO: 1332678 - protein, 24 aa, Mycobacterium
LQDLYRRWPFFRTVLSNMAQVLAK

SEQ ID NO: 1332679 - protein, 19 aa, Mycobacterium
LRAGFFRGDLPRPVQVVPA

SEQ ID NO: 1332680 - protein, 19 aa, Mycobacterium
LRGRLVLAWRASGPVSPAA

SEQ ID NO: 1332681 - protein, 24 aa, Mycobacterium
LRHLNQWWYWTPGASWRHPIGPGS

SEQ ID NO: 1332682 - protein, 17 aa, Mycobacterium
LRLDPWTTPIPGAYLCS

SEQ ID NO: 1332683 - protein, 18 aa, Mycobacterium
LRLVFVCAMWMTGFDAPS

SEQ ID NO: 1332684 - protein, 21 aa, Mycobacterium
LRRFIDLYEALPGRYRRVESF

SEQ ID NO: 1332685 - protein, 22 aa, Mycobacterium
LRTTLFFENFANAFPPVRGDDG

SEQ ID NO: 1332686 - protein, 17 aa, Mycobacterium
LSAFSVAGWLRAKARTT

SEQ ID NO: 1332687 - protein, 30 aa, Mycobacterium
LSFDVRPPRWLPPGRWWALIRVAAAGRLVY

SEQ ID NO: 1332688 - protein, 22 aa, Mycobacterium
LSKAYWDFWRQFLDRIAAEHPT

SEQ ID NO: 1332689 - protein, 25 aa, Mycobacterium
LSNPTLLCYYLFFPAHEESVGAGAC

SEQ ID NO: 1332690 - protein, 20 aa, Mycobacterium
LSPMELPDSALLRLKRMYPG

SEQ ID NO: 1332691 - protein, 17 aa, Mycobacterium
LTPPPWYPILRGTTQQA

SEQ ID NO: 1332692 - protein, 23 aa, Mycobacterium
LTRNLWPVARRPVELVWGLVAQT

SEQ ID NO: 1332693 - protein, 17 aa, Mycobacterium
LVALWDDTTWVPGSPWL

SEQ ID NO: 1332694 - protein, 26 aa, Mycobacterium
LVDDHFRQLWFGWGDPARVLIEYAQL

SEQ ID NO: 1332695 - protein, 20 aa, Mycobacterium
LVDFWAPWCGPCRAFAPVFE

SEQ ID NO: 1332696 - protein, 22 aa, Mycobacterium
LVILLHGFASFWWSWRHQLRGL

SEQ ID NO: 1332697 - protein, 21 aa, Mycobacterium
MAALWRLPVLFCCENNLYAMG

SEQ ID NO: 1332698 - protein, 17 aa, Mycobacterium
MDRYPLVSALSRPLIVK

SEQ ID NO: 1332699 - protein, 24 aa, Mycobacterium
MHEHRLAVLWPDVYPRLLRVMTAD

SEQ ID NO: 1332700 - protein, 17 aa, Mycobacterium
MLTAYYRARSSPSGQTL

SEQ ID NO: 1332701 - protein, 18 aa, Mycobacterium
MPFILRGAALLGIDSVLL

SEQ ID NO: 1332702 - protein, 24 aa, Mycobacterium
MQDYLDAPPISTPFRLFDCSLETD

SEQ ID NO: 1332703 - protein, 17 aa, Mycobacterium
MRTIGVPVYLLPGNHDP

SEQ ID NO: 1332704 - protein, 22 aa, Mycobacterium
MVHRARDMLWLNRSRWNRTTTG

SEQ ID NO: 1332705 - protein, 19 aa, Mycobacterium
MVHVWPLFSSILPEGVDAA

SEQ ID NO: 1332706 - protein, 23 aa, Mycobacterium
MWVNARYQFLVLYTVGDDALANA

SEQ ID NO: 1332707 - protein, 17 aa, Mycobacterium
MYRNKCWLPYPGDDVLL

SEQ ID NO: 1332708 - protein, 25 aa, Mycobacterium
NAGGPDLLVWVAPPPAAPAGSGAGA

SEQ ID NO: 1332709 - protein, 18 aa, Mycobacterium
NARRRWLMQHVRAGVVQT

SEQ ID NO: 1332710 - protein, 21 aa, Mycobacterium
NFFYTVTLPVTLWFMDKAKAG

SEQ ID NO: 1332711 - protein, 18 aa, Mycobacterium
NIEFLWFEDLGDGRSRLR

SEQ ID NO: 1332712 - protein, 17 aa, Mycobacterium
NLFDLLDKFSLARFPRI

SEQ ID NO: 1332713 - protein, 31 aa, Mycobacterium
NPIPGHFMDDFLLYWAFLSFALVRGGRRTFG

SEQ ID NO: 1332714 - protein, 17 aa, Mycobacterium
NPIVLVDFWAPWCGPCR

SEQ ID NO: 1332715 - protein, 21 aa, Mycobacterium
NQPWESIYGLPLRLASDARRF

SEQ ID NO: 1332716 - protein, 28 aa, Mycobacterium
NRAYTPWYLVRYWRLLKFKLTNPHVITR

SEQ ID NO: 1332717 - protein, 19 aa, Mycobacterium
NRMISWPYPKLMNSNNMVD

SEQ ID NO: 1332718 - protein, 18 aa, Mycobacterium
NRWFLNGADFIALRKLKE

SEQ ID NO: 1332719 - protein, 18 aa, Mycobacterium
NSFFFAAPLEWQERLWPT

SEQ ID NO: 1332720 - protein, 18 aa, Mycobacterium
NSTRARIVLFRKPIERRA

SEQ ID NO: 1332721 - protein, 17 aa, Mycobacterium
NTPFFSRVLVAAALAGL

SEQ ID NO: 1332722 - protein, 17 aa, Mycobacterium
NTVFAAQIGLLREAVRL

SEQ ID NO: 1332723 - protein, 19 aa, Mycobacterium
NVLSVLSWFHPPTSGAYSA

SEQ ID NO: 1332724 - protein, 25 aa, Mycobacterium
PADNSLMLWFEVMKPLMSTSAERGA

SEQ ID NO: 1332725 - protein, 27 aa, Mycobacterium
PADPPFEGMWWLYVPMAFDDFAIVLII

SEQ ID NO: 1332726 - protein, 25 aa, Mycobacterium
PAILEAWTWPQHGRVLLGWYERFRD

SEQ ID NO: 1332727 - protein, 20 aa, Mycobacterium
PALLDRLYYLDTEPAVRRAR

SEQ ID NO: 1332728 - protein, 19 aa, Mycobacterium
PARPRPMVLRWPAVRRTAR

SEQ ID NO: 1332729 - protein, 21 aa, Mycobacterium
PASLRLIALLDPPVEHLRLTP

SEQ ID NO: 1332730 - protein, 24 aa, Mycobacterium
PDRELAFLHPLPVRRLWGVGEKTA

SEQ ID NO: 1332731 - protein, 22 aa, Mycobacterium
PDRPAFFFAIDGHSLWANSTAL

SEQ ID NO: 1332732 - protein, 18 aa, Mycobacterium
PDRPAVLVPAFLSRGYHV

SEQ ID NO: 1332733 - protein, 22 aa, Mycobacterium
PDTPIPFGVWQRVSVAVRNRPD

SEQ ID NO: 1332734 - protein, 17 aa, Mycobacterium
PEAMRRLPVTPYGFRLR

SEQ ID NO: 1332735 - protein, 20 aa, Mycobacterium
PELLDDVHLLRFPPGAHVHV

SEQ ID NO: 1332736 - protein, 17 aa, Mycobacterium
PEPLPPGPTRRAPLGLV

SEQ ID NO: 1332737 - protein, 18 aa, Mycobacterium
PFGWLRGFPFLAVQVVWA

SEQ ID NO: 1332738 - protein, 17 aa, Mycobacterium
PFKWWRGLQARKVLDNY

SEQ ID NO: 1332739 - protein, 17 aa, Mycobacterium
PGFIETPLFDAVVGMPG

SEQ ID NO: 1332740 - protein, 21 aa, Mycobacterium
PGFPNLFFLYGPNTNPPGGSW

SEQ ID NO: 1332741 - protein, 17 aa, Mycobacterium
PGMLTAYYRARSSPSGQ

SEQ ID NO: 1332742 - protein, 22 aa, Mycobacterium
PGYEWPGHKPGQYVRLGLVIDG

SEQ ID NO: 1332743 - protein, 19 aa, Mycobacterium
PIASLLRDRFLTLLATGGG

SEQ ID NO: 1332744 - protein, 18 aa, Mycobacterium
PIEPDPYLKSYPWAAGLS

SEQ ID NO: 1332745 - protein, 24 aa, Mycobacterium
PKETWLRLLIVRAGFPRPETQLPV

SEQ ID NO: 1332746 - protein, 19 aa, Mycobacterium
PKWFTPLHQAAWHGAPLSV

SEQ ID NO: 1332747 - protein, 18 aa, Mycobacterium
PLHVVRLLAMLPLAPLVP

SEQ ID NO: 1332748 - protein, 25 aa, Mycobacterium
PLPRDVRMRLLRTLGLRGVEHSVRA

SEQ ID NO: 1332749 - protein, 17 aa, Mycobacterium
PQLRAFYLDLQDERLTS

SEQ ID NO: 1332750 - protein, 17 aa, Mycobacterium
PRRAAWAAALYLPKNYG

SEQ ID NO: 1332751 - protein, 18 aa, Mycobacterium
PRWQIGLYWRADGAPLWT

SEQ ID NO: 1332752 - protein, 19 aa, Mycobacterium
PSVPPIEFPATVPAVPGGQ

SEQ ID NO: 1332753 - protein, 22 aa, Mycobacterium
PTPPVAAPPPRRSGRRAIPVLA

SEQ ID NO: 1332754 - protein, 17 aa, Mycobacterium
PVARYWPEFGRAGKEDI

SEQ ID NO: 1332755 - protein, 17 aa, Mycobacterium
PVSPPPPAAPWLPQAPV

SEQ ID NO: 1332756 - protein, 19 aa, Mycobacterium
PWDRDQLHRLFDDLEFRVL

SEQ ID NO: 1332757 - protein, 19 aa, Mycobacterium
PWRTEALVLLAFSAYARGD

SEQ ID NO: 1332758 - protein, 25 aa, Mycobacterium
PYAHLRGFVLMPWLAAEPEATLTVA

SEQ ID NO: 1332759 - protein, 20 aa, Mycobacterium
PYPAWRELFNNILPAHIVKD

SEQ ID NO: 1332760 - protein, 19 aa, Mycobacterium
QAIPYAWLPGRARTFYGTD

SEQ ID NO: 1332761 - protein, 20 aa, Mycobacterium
QALALPLPSLVICELLGIPY

SEQ ID NO: 1332762 - protein, 17 aa, Mycobacterium
QANVWMFSPNRLLAHAK

SEQ ID NO: 1332763 - protein, 17 aa, Mycobacterium
QARARPIAPLLAGLQAL

SEQ ID NO: 1332764 - protein, 22 aa, Mycobacterium
QAVVLFPYREKAAAFYEASVHQ

SEQ ID NO: 1332765 - protein, 17 aa, Mycobacterium
QCRFSWPPQIDLPGYKP

SEQ ID NO: 1332766 - protein, 17 aa, Mycobacterium
QFAKFPLWKDLDESWKQ

SEQ ID NO: 1332767 - protein, 18 aa, Mycobacterium
QFWPLWEAAADAGLPVAV

SEQ ID NO: 1332768 - protein, 23 aa, Mycobacterium
QGRALLPSLLRYQTPMWPERALT

SEQ ID NO: 1332769 - protein, 17 aa, Mycobacterium
QHRLLLETAWRAVEHSG

SEQ ID NO: 1332770 - protein, 19 aa, Mycobacterium
QHSWVHVLPSRKEGWGLAV

SEQ ID NO: 1332771 - protein, 21 aa, Mycobacterium
QLALTKLWRSYGVTPDAVIGH

SEQ ID NO: 1332772 - protein, 25 aa, Mycobacterium
QLDEVFRPLYWWAQDLRAGGDVLQC

SEQ ID NO: 1332773 - protein, 17 aa, Mycobacterium
QLFILVFAKGAFPPDLE

SEQ ID NO: 1332774 - protein, 22 aa, Mycobacterium
QLRDLMDLHFFGPAALVRAALP

SEQ ID NO: 1332775 - protein, 26 aa, Mycobacterium
QPTQVRITFWFDAKYPVPADAKAVIL

SEQ ID NO: 1332776 - protein, 24 aa, Mycobacterium
QQADDVWLPLFRPVAGDPGELPAD

SEQ ID NO: 1332777 - protein, 23 aa, Mycobacterium
QQAFLFGPPPLGPGAPPLERLLA

SEQ ID NO: 1332778 - protein, 23 aa, Mycobacterium
QRAEVERLAALKLIDGRDVWAAG

SEQ ID NO: 1332779 - protein, 19 aa, Mycobacterium
QRFALLFPAWLAAHPEVRD

SEQ ID NO: 1332780 - protein, 23 aa, Mycobacterium
QRTDLRLIVVDYLQLMTSGKRVE

SEQ ID NO: 1332781 - protein, 22 aa, Mycobacterium
QSAVKPWLVTVAKLLGRIAPGV

SEQ ID NO: 1332782 - protein, 17 aa, Mycobacterium
QSRPRTRWRWRAIVTDL

SEQ ID NO: 1332783 - protein, 17 aa, Mycobacterium
QSWSASYLPLMRVLRRL

SEQ ID NO: 1332784 - protein, 24 aa, Mycobacterium
QTSPACERLLWLPDLVAAAYRRTI

SEQ ID NO: 1332785 - protein, 19 aa, Mycobacterium
QVHHIFPKALLRKHGLDRN

SEQ ID NO: 1332786 - protein, 17 aa, Mycobacterium
QVPAILDLLATGAINLG

SEQ ID NO: 1332787 - protein, 18 aa, Mycobacterium
QWWGRQMLIWGVHVHVGI

SEQ ID NO: 1332788 - protein, 22 aa, Mycobacterium
RADRPIQWWRSDGWLCPYGPLA

SEQ ID NO: 1332789 - protein, 20 aa, Mycobacterium
RARIVLFRKPIERRAKDSDE

SEQ ID NO: 1332790 - protein, 20 aa, Mycobacterium
RARPIAPLLAGLQALGVRID

SEQ ID NO: 1332791 - protein, 24 aa, Mycobacterium
RAVVMTYWNPVLRWGIDAFARDLA

SEQ ID NO: 1332792 - protein, 17 aa, Mycobacterium
RAYRLPWPAGTVVFEID

SEQ ID NO: 1332793 - protein, 17 aa, Mycobacterium
RAYRMWLPPLTDPTPVD

SEQ ID NO: 1332794 - protein, 23 aa, Mycobacterium
RCVRAALPLLRSASWARIVNFSA

SEQ ID NO: 1332795 - protein, 26 aa, Mycobacterium
RDAARFLLLTPPLPLPARAPYGVLAA

SEQ ID NO: 1332796 - protein, 26 aa, Mycobacterium
RDGRRRISIYWTWSYPWEAQRNPAEV

SEQ ID NO: 1332797 - protein, 23 aa, Mycobacterium
RDIRFVRLWFTDVLGYLKSVAIA

SEQ ID NO: 1332798 - protein, 21 aa, Mycobacterium
RDLYFTLSRWSDYSTLLMHTS

SEQ ID NO: 1332799 - protein, 22 aa, Mycobacterium
REHALLLALRRDPEVEALAVAP

SEQ ID NO: 1332800 - protein, 17 aa, Mycobacterium
RFFMVPGGHIHRSTACH

SEQ ID NO: 1332801 - protein, 21 aa, Mycobacterium
RFPELSTWRCNLRELREWPPE

SEQ ID NO: 1332802 - protein, 18 aa, Mycobacterium
RFPKFDWPRIDAPFIRPG

SEQ ID NO: 1332803 - protein, 20 aa, Mycobacterium
RGAVFAFFREVKPKYVILAA

SEQ ID NO: 1332804 - protein, 19 aa, Mycobacterium
RGRGLLIGIALRAAAAKPA

SEQ ID NO: 1332805 - protein, 22 aa, Mycobacterium
RGSYLQMHFALDAAPTFAAPYE

SEQ ID NO: 1332806 - protein, 18 aa, Mycobacterium
RGVFDFFFIGDRLVGLPS

SEQ ID NO: 1332807 - protein, 20 aa, Mycobacterium
RGVGRLLWLKAFDRVSVRST

SEQ ID NO: 1332808 - protein, 20 aa, Mycobacterium
RGVPYRKFIRRYPALTLLVL

SEQ ID NO: 1332809 - protein, 20 aa, Mycobacterium
RHALLMAAVLMRHPLRRIAE

SEQ ID NO: 1332810 - protein, 21 aa, Mycobacterium
RHPLGRRLWELPAGLLDMGGE

SEQ ID NO: 1332811 - protein, 18 aa, Mycobacterium
RHWLQVFAQRFYSFSQFK

SEQ ID NO: 1332812 - protein, 17 aa, Mycobacterium
RIFVPILRVTAIEPSAV

SEQ ID NO: 1332813 - protein, 18 aa, Mycobacterium
RIQPRDCEFLGISPDQVE

SEQ ID NO: 1332814 - protein, 17 aa, Mycobacterium
RIVFVEHAFSWILPLMW

SEQ ID NO: 1332815 - protein, 19 aa, Mycobacterium
RKLFGKVGVVFKGSGFYRT

SEQ ID NO: 1332816 - protein, 18 aa, Mycobacterium
RLALLLLAPEVRAAVDGG

SEQ ID NO: 1332817 - protein, 23 aa, Mycobacterium
RLESLYTLSPPPTAPAGLVTARR

SEQ ID NO: 1332818 - protein, 17 aa, Mycobacterium
RLGLHRLPITEFPRLRE

SEQ ID NO: 1332819 - protein, 17 aa, Mycobacterium
RLIELFELFDPADPEVI

SEQ ID NO: 1332820 - protein, 17 aa, Mycobacterium
RLLIIRSGLPRPVTQIP

SEQ ID NO: 1332821 - protein, 20 aa, Mycobacterium
RLLTMLRPELADWTALVLPD

SEQ ID NO: 1332822 - protein, 17 aa, Mycobacterium
RMMDPQHRLFLQTAWHA

SEQ ID NO: 1332823 - protein, 24 aa, Mycobacterium
RPDAWGWLPLLTGVAVRDAVAEVS

SEQ ID NO: 1332824 - protein, 21 aa, Mycobacterium
RPDLVPLFLNALPVVMADAVD

SEQ ID NO: 1332825 - protein, 24 aa, Mycobacterium
RPLLLMLSHPFYWQHFGRLTDVVR

SEQ ID NO: 1332826 - protein, 18 aa, Mycobacterium
RPVVGIIAPWNYPVANAL

SEQ ID NO: 1332827 - protein, 18 aa, Mycobacterium
RQRPGLLVDWLAGNPADL

SEQ ID NO: 1332828 - protein, 21 aa, Mycobacterium
RRERMFPSWVPLPVSELAVGR

SEQ ID NO: 1332829 - protein, 19 aa, Mycobacterium
RRLEQIEALRLVLERGWTA

SEQ ID NO: 1332830 - protein, 22 aa, Mycobacterium
RRLPVTPYGFRLRPVADIVAAL

SEQ ID NO: 1332831 - protein, 20 aa, Mycobacterium
RRLQFLRMLLDEPNVLLLDE

SEQ ID NO: 1332832 - protein, 18 aa, Mycobacterium
RRPGWPQARWLRVAIHHR

SEQ ID NO: 1332833 - protein, 19 aa, Mycobacterium
RRRLDLAVSLLAAPPVLFL

SEQ ID NO: 1332834 - protein, 17 aa, Mycobacterium
RRRVALCKLLLSKPDLL

SEQ ID NO: 1332835 - protein, 24 aa, Mycobacterium
RRTGWSWWRHARGMKLRKGGDGLG

SEQ ID NO: 1332836 - protein, 18 aa, Mycobacterium
RRYILDCALRWMRDFHAD

SEQ ID NO: 1332837 - protein, 20 aa, Mycobacterium
RSFRRYRWVLPMARLIGNAA

SEQ ID NO: 1332838 - protein, 19 aa, Mycobacterium
RSRTHHYPFRLLAPKTMRT

SEQ ID NO: 1332839 - protein, 20 aa, Mycobacterium
RSTFHWVLAFAYKGLSTPKV

SEQ ID NO: 1332840 - protein, 22 aa, Mycobacterium
RTLPMRVLVLGGGDIRDLHVPD

SEQ ID NO: 1332841 - protein, 22 aa, Mycobacterium
RTPTLFIVGGPPLRESATNPLQ

SEQ ID NO: 1332842 - protein, 19 aa, Mycobacterium
RTRLIRLFPTVFKGTHVNL

SEQ ID NO: 1332843 - protein, 19 aa, Mycobacterium
RVALCKLLLSKPDLLLLDE

SEQ ID NO: 1332844 - protein, 24 aa, Mycobacterium
RVKCALLGWMAFKDAVAQASHDSE

SEQ ID NO: 1332845 - protein, 17 aa, Mycobacterium
RVVKFVRFVLRRSTFPY

SEQ ID NO: 1332846 - protein, 17 aa, Mycobacterium
RWPGLIEAYRDRLPVGD

SEQ ID NO: 1332847 - protein, 25 aa, Mycobacterium
RYLDTGAMYRIVTLAVLRAGIDPSD

SEQ ID NO: 1332848 - protein, 24 aa, Mycobacterium
RYSVYPWALLVMALARIGLGPLRG

SEQ ID NO: 1332849 - protein, 17 aa, Mycobacterium
SALVVFEVMVRPLIRLS

SEQ ID NO: 1332850 - protein, 18 aa, Mycobacterium
SALVVFEVMVRPLIRLSL

SEQ ID NO: 1332851 - protein, 19 aa, Mycobacterium
SAMYVMFAGFFHGAAMVAT

SEQ ID NO: 1332852 - protein, 23 aa, Mycobacterium
SDPRIVRVWWRLTPREQEILRVK

SEQ ID NO: 1332853 - protein, 23 aa, Mycobacterium
SFASLVFYSSWFKLHHPAAFCAA

SEQ ID NO: 1332854 - protein, 26 aa, Mycobacterium
SFDARTRFALWWVRLYGRGVQAKSEL

SEQ ID NO: 1332855 - protein, 21 aa, Mycobacterium
SFDWRTLPLVRQQAPSVPLVA

SEQ ID NO: 1332856 - protein, 21 aa, Mycobacterium
SGALAFKLLYRCRALLQTGEV

SEQ ID NO: 1332857 - protein, 18 aa, Mycobacterium
SKGRDLYFTLSRWSDYST

SEQ ID NO: 1332858 - protein, 20 aa, Mycobacterium
SLALPLALYRAVTAFGRVAV

SEQ ID NO: 1332859 - protein, 25 aa, Mycobacterium
SLEENFGIFLWLRSLDSPPEKKYAL

SEQ ID NO: 1332860 - protein, 20 aa, Mycobacterium
SLEIHPIRRNIQHADLLVVR

SEQ ID NO: 1332861 - protein, 25 aa, Mycobacterium
SLVKFHWKPRLGVHSLVWEEAQIAA

SEQ ID NO: 1332862 - protein, 21 aa, Mycobacterium
SNRLRPWLPVLLALTANSAIY

SEQ ID NO: 1332863 - protein, 30 aa, Mycobacterium
SPADYIYAYGFRNPFRLTFTPDGKLLVADV

SEQ ID NO: 1332864 - protein, 25 aa, Mycobacterium
SPEWIVALFALLLQGAVPVLGNRWW

SEQ ID NO: 1332865 - protein, 24 aa, Mycobacterium
SPRETWLRLLAIRNGFPPPTTQIP

SEQ ID NO: 1332866 - protein, 24 aa, Mycobacterium
SPRETWLRLLLIDAGFPRPTTQIP

SEQ ID NO: 1332867 - protein, 21 aa, Mycobacterium
SQLLYWTQVLMIARGLSPDDV

SEQ ID NO: 1332868 - protein, 25 aa, Mycobacterium
SRDKFPRAVLPRTFDFGFATGLMVK

SEQ ID NO: 1332869 - protein, 23 aa, Mycobacterium
SRGWLYRHFPDKVSLLGAAIVRL

SEQ ID NO: 1332870 - protein, 22 aa, Mycobacterium
SRRLWTVLIFMLWHAIFVEGSV

SEQ ID NO: 1332871 - protein, 19 aa, Mycobacterium
STFRYVMTLTLHAGIPVHC

SEQ ID NO: 1332872 - protein, 17 aa, Mycobacterium
STRARIVLFRKPIERRA

SEQ ID NO: 1332873 - protein, 24 aa, Mycobacterium
SVVAPLLSRSLILQLQPLAPDSIT

SEQ ID NO: 1332874 - protein, 23 aa, Mycobacterium
SWLLPRLVGLARTKRMLLLGEKV

SEQ ID NO: 1332875 - protein, 22 aa, Mycobacterium
TAALPVMVWIPGGAFVYGAGQL

SEQ ID NO: 1332876 - protein, 18 aa, Mycobacterium
TAHGYILGIRQPVTDRLL

SEQ ID NO: 1332877 - protein, 18 aa, Mycobacterium
TALPFDHLFFTGSPAVGV

SEQ ID NO: 1332878 - protein, 24 aa, Mycobacterium
TAVAMLVAIFRARPSPFYVMDEVE

SEQ ID NO: 1332879 - protein, 23 aa, Mycobacterium
TEGEMPAWAPALAGSFWAARRAR

SEQ ID NO: 1332880 - protein, 26 aa, Mycobacterium
TEYRAQWLICRALEVVLGWIADGNSG

SEQ ID NO: 1332881 - protein, 24 aa, Mycobacterium
TGEAWVWSPAFLRLLQRVRITMSD

SEQ ID NO: 1332882 - protein, 19 aa, Mycobacterium
TGRSWPLADVRLLAPILAS

SEQ ID NO: 1332883 - protein, 18 aa, Mycobacterium
TGTLMLPLGVRRLSAHAS

SEQ ID NO: 1332884 - protein, 19 aa, Mycobacterium
TGVRLWPAQPLTLVAPWDG

SEQ ID NO: 1332885 - protein, 17 aa, Mycobacterium
THDIFFATTLLTLMEET

SEQ ID NO: 1332886 - protein, 17 aa, Mycobacterium
THGLLGAEKRRELRAIR

SEQ ID NO: 1332887 - protein, 22 aa, Mycobacterium
TKLVFYPFLPWPWPRVVGAHFV

SEQ ID NO: 1332888 - protein, 27 aa, Mycobacterium
TKPHRAYWYLKKYGLPFMYWNLMLKGL

SEQ ID NO: 1332889 - protein, 22 aa, Mycobacterium
TKRLFARVPLLQRTVRLITDTI

SEQ ID NO: 1332890 - protein, 21 aa, Mycobacterium
TLARILPTPWRTEALVLLAFS

SEQ ID NO: 1332891 - protein, 17 aa, Mycobacterium
TMKRLFLELGGKSATIV

SEQ ID NO: 1332892 - protein, 20 aa, Mycobacterium
TMLDALWPFVEELERRVSDG

SEQ ID NO: 1332893 - protein, 22 aa, Mycobacterium
TNVFGALWITQAALPYLREQRG

SEQ ID NO: 1332894 - protein, 20 aa, Mycobacterium
TPAQVLLRWSIQLGNVVIAR

SEQ ID NO: 1332895 - protein, 20 aa, Mycobacterium
TPLFQRFGTDLPPLGGIYLA

SEQ ID NO: 1332896 - protein, 23 aa, Mycobacterium
TPPALIKAILKAPVDLLWNGGIG

SEQ ID NO: 1332897 - protein, 20 aa, Mycobacterium
TQLRWRPIDFWPANTTVNID

SEQ ID NO: 1332898 - protein, 22 aa, Mycobacterium
TSPHNLFPLVFDMLYRGDTPRI

SEQ ID NO: 1332899 - protein, 17 aa, Mycobacterium
TSWLFGHRLREAGLLGS

SEQ ID NO: 1332900 - protein, 20 aa, Mycobacterium
TTGLFLERLGLSSLADLPDI

SEQ ID NO: 1332901 - protein, 25 aa, Mycobacterium
TTTLRFNFFVLKLPIRPPALVAKQA

SEQ ID NO: 1332902 - protein, 19 aa, Mycobacterium
TVATTRLVLGPKVRIQAPP

SEQ ID NO: 1332903 - protein, 24 aa, Mycobacterium
TVDGLLVRLLRYLPGGTLIDADHL

SEQ ID NO: 1332904 - protein, 18 aa, Mycobacterium
TVYLYWPTKEDLLIGLIG

SEQ ID NO: 1332905 - protein, 17 aa, Mycobacterium
TWLELYPATRSQVHRLA

SEQ ID NO: 1332906 - protein, 17 aa, Mycobacterium
VADLHYRFTLDGSRISR

SEQ ID NO: 1332907 - protein, 18 aa, Mycobacterium
VAETWRRLRPAPLVVDPV

SEQ ID NO: 1332908 - protein, 24 aa, Mycobacterium
VDDLARYPLVYFIDSMLQVDDLDS

SEQ ID NO: 1332909 - protein, 19 aa, Mycobacterium
VDGWPNQRFALLFPAWLAA

SEQ ID NO: 1332910 - protein, 19 aa, Mycobacterium
VDQKFLFHRPIVAGDSLTG

SEQ ID NO: 1332911 - protein, 18 aa, Mycobacterium
VEFDLLPIPEFYGGTVYF

SEQ ID NO: 1332912 - protein, 19 aa, Mycobacterium
VEGAFYWLSNREVRWRPAE

SEQ ID NO: 1332913 - protein, 19 aa, Mycobacterium
VEHAFSWILPLMWRMDALY

SEQ ID NO: 1332914 - protein, 22 aa, Mycobacterium
VELLTRRRIFVPILRVTAIEPS

SEQ ID NO: 1332915 - protein, 18 aa, Mycobacterium
VEPRMLLVHFLRDELRLT

SEQ ID NO: 1332916 - protein, 17 aa, Mycobacterium
VFATPLLQQGFPLGVDV

SEQ ID NO: 1332917 - protein, 24 aa, Mycobacterium
VFTSDFFALWGKFAATRTPTIAAV

SEQ ID NO: 1332918 - protein, 23 aa, Mycobacterium
VGFCMGGGMVWRLLAAGEPRLAA

SEQ ID NO: 1332919 - protein, 23 aa, Mycobacterium
VGHAAWFLHVQGVLVPAAGGIGL

SEQ ID NO: 1332920 - protein, 23 aa, Mycobacterium
VGLMQPWRFIRITDPALRRDIHA

SEQ ID NO: 1332921 - protein, 17 aa, Mycobacterium
VGLPRWLRHFNNRWTLR

SEQ ID NO: 1332922 - protein, 25 aa, Mycobacterium
VHLDVPLYWQCWKLDSPLVARLTGA

SEQ ID NO: 1332923 - protein, 17 aa, Mycobacterium
VHVLPSRKEGWGLAVTE

SEQ ID NO: 1332924 - protein, 17 aa, Mycobacterium
VIGWWAAPTILEHGSPE

SEQ ID NO: 1332925 - protein, 22 aa, Mycobacterium
VLEHCIWYFLRPGGAPVVVVAD

SEQ ID NO: 1332926 - protein, 19 aa, Mycobacterium
VLYTSLLRRAITTANIALD

SEQ ID NO: 1332927 - protein, 28 aa, Mycobacterium
VPHHGIGYGLLRFLYGPTARTLSPVPPP

SEQ ID NO: 1332928 - protein, 19 aa, Mycobacterium
VPQLWRDMDTTLAAAPLGD

SEQ ID NO: 1332929 - protein, 17 aa, Mycobacterium
VQDTADPDLWWPDKRPY

SEQ ID NO: 1332930 - protein, 21 aa, Mycobacterium
VRLPRIPVPFPMYLPGPNRVQ

SEQ ID NO: 1332931 - protein, 22 aa, Mycobacterium
VSARVYPALVPLDHPLASVNGA

SEQ ID NO: 1332932 - protein, 24 aa, Mycobacterium
VSQVAELLWYPLWDANIRLDHSVR

SEQ ID NO: 1332933 - protein, 21 aa, Mycobacterium
VTKLFAAGLLPASYALQRLGY

SEQ ID NO: 1332934 - protein, 20 aa, Mycobacterium
VVLSPFFNTLPIRRAGLHEH

SEQ ID NO: 1332935 - protein, 20 aa, Mycobacterium
VVRPFLKYQIITVAAPETAA

SEQ ID NO: 1332936 - protein, 20 aa, Mycobacterium
VVYELLWFLRGESNVRWLQE

SEQ ID NO: 1332937 - protein, 24 aa, Mycobacterium
VWPVMTWLFAWCFARRGWAERARV

SEQ ID NO: 1332938 - protein, 17 aa, Mycobacterium
VYAAWFTVLGHGPVMGT

SEQ ID NO: 1332939 - protein, 23 aa, Mycobacterium
WAFRNVPGFLRLARAGIYTSREV

SEQ ID NO: 1332940 - protein, 17 aa, Mycobacterium
WDRRPGWFRKPAGWATG

SEQ ID NO: 1332941 - protein, 18 aa, Mycobacterium
WFILTQRIIEKEFALSGS

SEQ ID NO: 1332942 - protein, 25 aa, Mycobacterium
WFTSPSWMMWNFQVAGLLVGATIVC

SEQ ID NO: 1332943 - protein, 18 aa, Mycobacterium
WLARLWKEAGLPDGVFNV

SEQ ID NO: 1332944 - protein, 17 aa, Mycobacterium
WMFDYYPLRVVRELPDG

SEQ ID NO: 1332945 - protein, 20 aa, Mycobacterium
WNMWTVLPILQDTTIVAAGP

SEQ ID NO: 1332946 - protein, 22 aa, Mycobacterium
WRKAGFRFSLDWLLRNATAVAT

SEQ ID NO: 1332947 - protein, 17 aa, Mycobacterium
YFVYRLIKRLKKSANAA

SEQ ID NO: 1332948 - protein, 26 aa, Mycobacterium
YGFISKRVFGQMFPNLWEWAEEWTER

SEQ ID NO: 1332949 - protein, 18 aa, Mycobacterium
YGFRLRPVADIVAALERA

SEQ ID NO: 1332950 - protein, 17 aa, Mycobacterium
YHPLLVRALLAHASSWG

SEQ ID NO: 1332951 - protein, 20 aa, Mycobacterium
YKRPSRVVFVPAIPRLPSGK

SEQ ID NO: 1332952 - protein, 20 aa, Mycobacterium
YLFRRHLGVGPLDHLRRIRL

SEQ ID NO: 1332953 - protein, 18 aa, Mycobacterium
YMDRYPLVSALSRPLIVK

SEQ ID NO: 1332954 - protein, 22 aa, Mycobacterium
YNDLRVIDNVRYFAALYGTGGQ

SEQ ID NO: 1332955 - protein, 17 aa, Mycobacterium
YPRSPYAAAKLYSYWIT

SEQ ID NO: 1332956 - protein, 19 aa, Mycobacterium
YQMARIFPTMFRKALRKMA

SEQ ID NO: 1332957 - protein, 17 aa, Mycobacterium
YRMWLPPLTDPTPVDEL

SEQ ID NO: 1332958 - protein, 19 aa, Mycobacterium
YWLSNREVRWRPAEYWKPG

SEQ ID NO: 1332959 - protein, 27 aa, Mycobacterium
AAAARPMNLLAIPWIDPVDVANASLFL

SEQ ID NO: 1332960 - protein, 18 aa, Mycobacterium
AAADARLILLDPGTRRGP

SEQ ID NO: 1332961 - protein, 22 aa, Mycobacterium
AAAFVDFLFPGQPGLPQAWTPD

SEQ ID NO: 1332962 - protein, 36 aa, Mycobacterium
AADDAGRYLLIEEGPILPPDLLVGRKGLDPETVATI

SEQ ID NO: 1332963 - protein, 24 aa, Mycobacterium
AADWAEMLMRMYIRWAEQHKYPVE

SEQ ID NO: 1332964 - protein, 22 aa, Mycobacterium
AAELGLRPLVRLVSWGVAGVAP

SEQ ID NO: 1332965 - protein, 25 aa, Mycobacterium
AAGPPLLRKLVWRLPSRVQPKPEAV

SEQ ID NO: 1332966 - protein, 25 aa, Mycobacterium
AAGRDFFLPAYDLLVRLLGTYPLYD

SEQ ID NO: 1332967 - protein, 25 aa, Mycobacterium
AAHHRLFSHVPWLPGQLLNAVEAFA

SEQ ID NO: 1332968 - protein, 23 aa, Mycobacterium
AAHRKLLVPYLAAKRVRALETFA

SEQ ID NO: 1332969 - protein, 22 aa, Mycobacterium
AAIAPWNFPLMLETWKVAPALA

SEQ ID NO: 1332970 - protein, 22 aa, Mycobacterium
AAILLYIFFTRGEGANVVLFAV

SEQ ID NO: 1332971 - protein, 22 aa, Mycobacterium
AAIRIGLALNCDIAPWGRFARK

SEQ ID NO: 1332972 - protein, 29 aa, Mycobacterium
AAITPWNSPLLLLTWKLAAGLAAGCTFVV

SEQ ID NO: 1332973 - protein, 17 aa, Mycobacterium
AALLALWPALAEGLVEP

SEQ ID NO: 1332974 - protein, 17 aa, Mycobacterium
AALLDRYLGFLALDPTT

SEQ ID NO: 1332975 - protein, 20 aa, Mycobacterium
AALQGFVALPLLAGYDLDDP

SEQ ID NO: 1332976 - protein, 27 aa, Mycobacterium
AALSGHRWLLSPAALGSFLAALPAPMQ

SEQ ID NO: 1332977 - protein, 24 aa, Mycobacterium
AALSSPLYWIATNAGLDGAVVVNK

SEQ ID NO: 1332978 - protein, 17 aa, Mycobacterium
AALTWLTLPGQCGIGGD

SEQ ID NO: 1332979 - protein, 17 aa, Mycobacterium
AANFGVIPWSMHYITNI

SEQ ID NO: 1332980 - protein, 24 aa, Mycobacterium
AAPSAFFQLAFSKVGLMPDGGASA

SEQ ID NO: 1332981 - protein, 27 aa, Mycobacterium
AAQWIVRVVLALLFWPVEDPAAEREML

SEQ ID NO: 1332982 - protein, 17 aa, Mycobacterium
AAQWRARALSRFAGTGW

SEQ ID NO: 1332983 - protein, 22 aa, Mycobacterium
AASLPVMVWIPGGAFVYGAGQF

SEQ ID NO: 1332984 - protein, 25 aa, Mycobacterium
AASRLPFFTAWLRDHRWLPDARYRA

SEQ ID NO: 1332985 - protein, 19 aa, Mycobacterium
AAVWRIRRAAPLLPTVLLG

SEQ ID NO: 1332986 - protein, 17 aa, Mycobacterium
AAWDLLNLLTCAPGAIG

SEQ ID NO: 1332987 - protein, 22 aa, Mycobacterium
AAWLRTMFAILPLAVGVKNADV

SEQ ID NO: 1332988 - protein, 25 aa, Mycobacterium
ACPVTWPWNLLGWPSINVPAGFTSD

SEQ ID NO: 1332989 - protein, 24 aa, Mycobacterium
ADDRYVVLPFWLVCDVSASMGPHI

SEQ ID NO: 1332990 - protein, 31 aa, Mycobacterium
ADDTFFWFTSPSWMMWNFQVAGLLVGATIVC

SEQ ID NO: 1332991 - protein, 23 aa, Mycobacterium
ADEIDFWLWLDAGFEDRAIEAWI

SEQ ID NO: 1332992 - protein, 18 aa, Mycobacterium
ADILLISTPVWLGHPSSV

SEQ ID NO: 1332993 - protein, 23 aa, Mycobacterium
ADKLLIIDLPRPPAPLHVLRLAA

SEQ ID NO: 1332994 - protein, 19 aa, Mycobacterium
ADKMRAGLLALLSYARSGD

SEQ ID NO: 1332995 - protein, 24 aa, Mycobacterium
ADKVAKWWIPERWSFVSDIPRTSV

SEQ ID NO: 1332996 - protein, 24 aa, Mycobacterium
ADLALLTDPWQPAVLALVAMTVRA

SEQ ID NO: 1332997 - protein, 31 aa, Mycobacterium
ADLIAAGAYLWLRAWPAPGGDLWAVPTGWRV

SEQ ID NO: 1332998 - protein, 21 aa, Mycobacterium
ADMTWLLSRWTCVFGTPACKG

SEQ ID NO: 1332999 - protein, 23 aa, Mycobacterium
ADPDQFWLAIEALRLRHAAVLNP

SEQ ID NO: 1333000 - protein, 19 aa, Mycobacterium
ADPVFMLTGPIPATQYALD

SEQ ID NO: 1333001 - protein, 23 aa, Mycobacterium
ADQVGLPDLPWPDPEAWLTAVRA

SEQ ID NO: 1333002 - protein, 18 aa, Mycobacterium
ADRRALFFMGRLSVEGDW

SEQ ID NO: 1333003 - protein, 26 aa, Mycobacterium
AEADALWPMLVLRTAVLIVSGAQQSV

SEQ ID NO: 1333004 - protein, 25 aa, Mycobacterium
AEAFRAEWLLAFLAADLRGGIPEGL

SEQ ID NO: 1333005 - protein, 22 aa, Mycobacterium
AEDLFAGWWQLIAALGAVPRTL

SEQ ID NO: 1333006 - protein, 23 aa, Mycobacterium
AEDLVALAVLRLGAPVRYEFSRT

SEQ ID NO: 1333007 - protein, 23 aa, Mycobacterium
AEFKAMFQMKFYAVALLRSRGVL

SEQ ID NO: 1333008 - protein, 17 aa, Mycobacterium
AEGVACYKLFISGLLDI

SEQ ID NO: 1333009 - protein, 24 aa, Mycobacterium
AELQIVFHTLLRRIPTMKPAIPLE

SEQ ID NO: 1333010 - protein, 25 aa, Mycobacterium
AELRSLLRFLFVRGLTPRLLTTAVP

SEQ ID NO: 1333011 - protein, 23 aa, Mycobacterium
AEQLAFFPLWSYATPTAIELADR

SEQ ID NO: 1333012 - protein, 25 aa, Mycobacterium
AERYGLDMWLRVGATWLSAVAALAA

SEQ ID NO: 1333013 - protein, 26 aa, Mycobacterium
AESKALVRLYLALVALLRGDMERAED

SEQ ID NO: 1333014 - protein, 25 aa, Mycobacterium
AEYRGQWLICRALEVVLGWIADDNC

SEQ ID NO: 1333015 - protein, 23 aa, Mycobacterium
AFALDVLLKLLHPVMPFVTEVLW

SEQ ID NO: 1333016 - protein, 18 aa, Mycobacterium
AFAPPYLIAGQALAVDAE

SEQ ID NO: 1333017 - protein, 18 aa, Mycobacterium
AFAPVPLAWLADTGADAA

SEQ ID NO: 1333018 - protein, 19 aa, Mycobacterium
AFDILRLDGRWLLKAKYRD

SEQ ID NO: 1333019 - protein, 18 aa, Mycobacterium
AFFFAIDGHSLWANSTAL

SEQ ID NO: 1333020 - protein, 19 aa, Mycobacterium
AFNFPVAVWSWNTAVALVC

SEQ ID NO: 1333021 - protein, 19 aa, Mycobacterium
AFPRTQWIRWRKPVIGAPT

SEQ ID NO: 1333022 - protein, 22 aa, Mycobacterium
AFRNVQGFLRLARAGIYTSREV

SEQ ID NO: 1333023 - protein, 19 aa, Mycobacterium
AFSRGLWWSALRATDRADA

SEQ ID NO: 1333024 - protein, 22 aa, Mycobacterium
AFVIPVPHRFLPMMPPAAVQFA

SEQ ID NO: 1333025 - protein, 23 aa, Mycobacterium
AFVIPVPHRFLPMMPPAAVQFAG

SEQ ID NO: 1333026 - protein, 17 aa, Mycobacterium
AFWRSRPVNWVWDRLPM

SEQ ID NO: 1333027 - protein, 19 aa, Mycobacterium
AFYDEYLAPITPLERIRQK

SEQ ID NO: 1333028 - protein, 22 aa, Mycobacterium
AGALYPPLIIRGLGTRQVYSAS

SEQ ID NO: 1333029 - protein, 17 aa, Mycobacterium
AGDGFARFWLHNGWVTM

SEQ ID NO: 1333030 - protein, 22 aa, Mycobacterium
AGDGGWWVLGVRDAGFAECLRN

SEQ ID NO: 1333031 - protein, 23 aa, Mycobacterium
AGDILWAVFSPYTPFLNSPGMPP

SEQ ID NO: 1333032 - protein, 23 aa, Mycobacterium
AGDIPWAVFSPYTPFLNSPGMPP

SEQ ID NO: 1333033 - protein, 17 aa, Mycobacterium
AGELEKFQWFVRAHLEN

SEQ ID NO: 1333034 - protein, 20 aa, Mycobacterium
AGFWGALWEYFDLGTAPAEV

SEQ ID NO: 1333035 - protein, 23 aa, Mycobacterium
AGGLPIRRYAFPNLKALNFVIVG

SEQ ID NO: 1333036 - protein, 24 aa, Mycobacterium
AGKSTLLRLLLGRLLPDEGRASMG

SEQ ID NO: 1333037 - protein, 21 aa, Mycobacterium
AGLDLLILRVAALFHENLLVL

SEQ ID NO: 1333038 - protein, 21 aa, Mycobacterium
AGLPFLLRPALAAAGDGVASM

SEQ ID NO: 1333039 - protein, 17 aa, Mycobacterium
AGLRWIGPPVAAVAAMG

SEQ ID NO: 1333040 - protein, 17 aa, Mycobacterium
AGNTLILKPAPDTPWCA

SEQ ID NO: 1333041 - protein, 29 aa, Mycobacterium
AGPNQLRAFLWWLLRLRPDLEIYLLKSNL

SEQ ID NO: 1333042 - protein, 25 aa, Mycobacterium
AGTFYWPFGFAILGDRFWVADTGNR

SEQ ID NO: 1333043 - protein, 24 aa, Mycobacterium
AGVAFPDALLTRGLYQYKPDLPFT

SEQ ID NO: 1333044 - protein, 22 aa, Mycobacterium
AGWRKWLYWGSGRLIDVGESPK

SEQ ID NO: 1333045 - protein, 19 aa, Mycobacterium
AGWVRMDFIVPSRGLIGFR

SEQ ID NO: 1333046 - protein, 26 aa, Mycobacterium
AGYMFKLWDQLVWGVTLVIPPTPWSA

SEQ ID NO: 1333047 - protein, 24 aa, Mycobacterium
AHAFDLFRWLGPSPDALLSAAGTV

SEQ ID NO: 1333048 - protein, 18 aa, Mycobacterium
AHALPLLKPPFPDPGTPV

SEQ ID NO: 1333049 - protein, 20 aa, Mycobacterium
AHAMLRILFSRLGEPHIGSP

SEQ ID NO: 1333050 - protein, 23 aa, Mycobacterium
AHGLLTLSLLPYFTHQLYTVDNV

SEQ ID NO: 1333051 - protein, 22 aa, Mycobacterium
AHGPTRVSALLRQARPVLLDLG

SEQ ID NO: 1333052 - protein, 25 aa, Mycobacterium
AHLRRRVMVVLPFLTPTIASLWVGL

SEQ ID NO: 1333053 - protein, 22 aa, Mycobacterium
AHPDRVWAWYLWRHHMMSAVAP

SEQ ID NO: 1333054 - protein, 18 aa, Mycobacterium
AHPQMLLRIGWLPRDAVA

SEQ ID NO: 1333055 - protein, 20 aa, Mycobacterium
AHRERHGFPHWVIWDEAHLL

SEQ ID NO: 1333056 - protein, 24 aa, Mycobacterium
AICKGTLWGLRRGARKPGSAIWFK

SEQ ID NO: 1333057 - protein, 17 aa, Mycobacterium
AICRRAGVTVRYFYECF

SEQ ID NO: 1333058 - protein, 19 aa, Mycobacterium
AIHAVFLFHAIKAGLDMGI

SEQ ID NO: 1333059 - protein, 20 aa, Mycobacterium
AIIHLAAVIPPPIYRNPKVA

SEQ ID NO: 1333060 - protein, 18 aa, Mycobacterium
AIKTLWLPGPDPEPHYRP

SEQ ID NO: 1333061 - protein, 25 aa, Mycobacterium
AIVPWNIPLLTTVWKIGPALAAGNS

SEQ ID NO: 1333062 - protein, 22 aa, Mycobacterium
AIVRDLDLLRPIYAPTAAYGHF

SEQ ID NO: 1333063 - protein, 19 aa, Mycobacterium
AIYRWTWQAPTATAFVGVP

SEQ ID NO: 1333064 - protein, 20 aa, Mycobacterium
AKALGPRRGLTGTPLPPLWE

SEQ ID NO: 1333065 - protein, 22 aa, Mycobacterium
AKEWFPHDYVPWSRGRDFAFLG

SEQ ID NO: 1333066 - protein, 28 aa, Mycobacterium
AKLTDPRWRLLFPLLMETGLRLNDALHL

SEQ ID NO: 1333067 - protein, 23 aa, Mycobacterium
AKNMFALGLLSWMYGRELEHSES

SEQ ID NO: 1333068 - protein, 23 aa, Mycobacterium
ALAAPHRFRRLALLIPPVAWESG

SEQ ID NO: 1333069 - protein, 21 aa, Mycobacterium
ALAAYWIFQAWGNDPKVSARE

SEQ ID NO: 1333070 - protein, 23 aa, Mycobacterium
ALAIRPRVLLLDEPLSALDAKVR

SEQ ID NO: 1333071 - protein, 20 aa, Mycobacterium
ALALLRWRPLTRSDQAVREV

SEQ ID NO: 1333072 - protein, 18 aa, Mycobacterium
ALAWLFFNMAVSTTLRYI

SEQ ID NO: 1333073 - protein, 17 aa, Mycobacterium
ALCKLLLSKPDLLLLDE

SEQ ID NO: 1333074 - protein, 29 aa, Mycobacterium
ALDFDYVDLFLIHWPLPTLYDGDFVSTWK

SEQ ID NO: 1333075 - protein, 18 aa, Mycobacterium
ALDLRPTAQLPPKNLRRL

SEQ ID NO: 1333076 - protein, 17 aa, Mycobacterium
ALDPLLRAIIETGYDRP

SEQ ID NO: 1333077 - protein, 17 aa, Mycobacterium
ALDTRAWRLPWLNDTVI

SEQ ID NO: 1333078 - protein, 20 aa, Mycobacterium
ALGPVRTFFGGTALIPGDPT

SEQ ID NO: 1333079 - protein, 24 aa, Mycobacterium
ALGRTLWTMQLPFGTSLAALVAVA

SEQ ID NO: 1333080 - protein, 19 aa, Mycobacterium
ALIAPLRIGLREAGVPVRL

SEQ ID NO: 1333081 - protein, 17 aa, Mycobacterium
ALLKIVHGLGLPLGTAV

SEQ ID NO: 1333082 - protein, 19 aa, Mycobacterium
ALLLHYLPEVDMRTGEILA

SEQ ID NO: 1333083 - protein, 20 aa, Mycobacterium
ALLPSLLRYQTPMWPERALT

SEQ ID NO: 1333084 - protein, 19 aa, Mycobacterium
ALMRRAAFGLATAIARELG

SEQ ID NO: 1333085 - protein, 25 aa, Mycobacterium
ALMVPTLRPAQARVLLMAALAADVP

SEQ ID NO: 1333086 - protein, 22 aa, Mycobacterium
ALNRLHFTLGLPTLLIWGDQDR

SEQ ID NO: 1333087 - protein, 17 aa, Mycobacterium
ALPIPSLVICELLGVPY

SEQ ID NO: 1333088 - protein, 21 aa, Mycobacterium
ALPWYLAMACFKLAVVIEGTW

SEQ ID NO: 1333089 - protein, 17 aa, Mycobacterium
ALQERLIRQSPVPYTIV

SEQ ID NO: 1333090 - protein, 22 aa, Mycobacterium
ALRDRVPLVMLLEGAGFRPSGE

SEQ ID NO: 1333091 - protein, 18 aa, Mycobacterium
ALRPVRAPRWLLTPARQR

SEQ ID NO: 1333092 - protein, 25 aa, Mycobacterium
ALRQGRLLVPRLLPWSRSGQLAIPR

SEQ ID NO: 1333093 - protein, 17 aa, Mycobacterium
ALRRSVKFPAFLDGIEA

SEQ ID NO: 1333094 - protein, 18 aa, Mycobacterium
ALSGLRRLLFVNGHMGNT

SEQ ID NO: 1333095 - protein, 23 aa, Mycobacterium
ALTGPALRWNPWSTPIPKAYLCS

SEQ ID NO: 1333096 - protein, 23 aa, Mycobacterium
AMAWSLLGWVRRNFFNQAPVVDY

SEQ ID NO: 1333097 - protein, 23 aa, Mycobacterium
AMRAIPVPVYLLPGNHDPLDASS

SEQ ID NO: 1333098 - protein, 24 aa, Mycobacterium
AMRCTACWWLGRPGWRRDFDRAVE

SEQ ID NO: 1333099 - protein, 20 aa, Mycobacterium
AMTPAMYFGIRYAISRVNAD

SEQ ID NO: 1333100 - protein, 18 aa, Mycobacterium
ANAELLATFLRFLAASTS

SEQ ID NO: 1333101 - protein, 17 aa, Mycobacterium
ANAFVMSFLGAVSSLNG

SEQ ID NO: 1333102 - protein, 22 aa, Mycobacterium
ANELLLYEALGLCGPGEAPALI

SEQ ID NO: 1333103 - protein, 18 aa, Mycobacterium
ANLDKARRLLWPIKQKYG

SEQ ID NO: 1333104 - protein, 25 aa, Mycobacterium
ANLDKARRLLWPIKQKYGNKISWAD

SEQ ID NO: 1333105 - protein, 19 aa, Mycobacterium
ANRGLLPPSFALVGFARRD

SEQ ID NO: 1333106 - protein, 22 aa, Mycobacterium
ANYRAHWLVARAAEHIGGWANR

SEQ ID NO: 1333107 - protein, 25 aa, Mycobacterium
APADPDAVFLPYPNPFRPGPDGVEA

SEQ ID NO: 1333108 - protein, 20 aa, Mycobacterium
APALVFVSWPDSGPLIGADA

SEQ ID NO: 1333109 - protein, 20 aa, Mycobacterium
APATPWLATTVRLAWRVKLM

SEQ ID NO: 1333110 - protein, 24 aa, Mycobacterium
APEPPLRVFFGELPLELARADYES

SEQ ID NO: 1333111 - protein, 26 aa, Mycobacterium
APGFSVPYYWWTFNMPTDHGEVVLEN

SEQ ID NO: 1333112 - protein, 18 aa, Mycobacterium
APGSGLFALLLPASHRSP

SEQ ID NO: 1333113 - protein, 24 aa, Mycobacterium
APHLVKPLPFLFPLTNRGWERPYI

SEQ ID NO: 1333114 - protein, 26 aa, Mycobacterium
APKRLGSFMDSRLWRMLLAPGRGIGR

SEQ ID NO: 1333115 - protein, 23 aa, Mycobacterium
APLYLTLPVWSRATLALAYASAL

SEQ ID NO: 1333116 - protein, 21 aa, Mycobacterium
APNQELLWAWVQTEMLRLHVR

SEQ ID NO: 1333117 - protein, 27 aa, Mycobacterium
APRAPVLRKLLWLLPDRFAPQLTPEVW

SEQ ID NO: 1333118 - protein, 18 aa, Mycobacterium
APSYVFFAASRMSSYYSG

SEQ ID NO: 1333119 - protein, 26 aa, Mycobacterium
APTLPQWLRRRLALLLDLCYGAGARP

SEQ ID NO: 1333120 - protein, 17 aa, Mycobacterium
APVAWTFAWLHPQRCRG

SEQ ID NO: 1333121 - protein, 21 aa, Mycobacterium
AQAQWWFARLAPGLMNRMAMR

SEQ ID NO: 1333122 - protein, 18 aa, Mycobacterium
AQLDWPLAESLRYPAGLI

SEQ ID NO: 1333123 - protein, 24 aa, Mycobacterium
AQLFARIWIAQVGRIPLLLLDSDI

SEQ ID NO: 1333124 - protein, 18 aa, Mycobacterium
AQLSILLTLFDQGPMRMT

SEQ ID NO: 1333125 - protein, 19 aa, Mycobacterium
AQLVGWLEGLFHGIQTALF

SEQ ID NO: 1333126 - protein, 18 aa, Mycobacterium
AQPWSLRYPLVDGQGNFG

SEQ ID NO: 1333127 - protein, 20 aa, Mycobacterium
AQPWSLRYPLVDGQGNFGSP

SEQ ID NO: 1333128 - protein, 19 aa, Mycobacterium
AQQALQAFRKFGFQLVIVA

SEQ ID NO: 1333129 - protein, 17 aa, Mycobacterium
ARALSRFAGTGWVEGVA

SEQ ID NO: 1333130 - protein, 21 aa, Mycobacterium
ARAMLYGAYRSGAPFGGRVTE

SEQ ID NO: 1333131 - protein, 17 aa, Mycobacterium
ARCLLSLAISYIAVATD

SEQ ID NO: 1333132 - protein, 22 aa, Mycobacterium
ARDLKFYAFYGEVLFVLEVRRQ

SEQ ID NO: 1333133 - protein, 23 aa, Mycobacterium
AREHALLLALRRDPEVEALAVAP

SEQ ID NO: 1333134 - protein, 19 aa, Mycobacterium
ARFCTQFIKLGLGGCDIGV

SEQ ID NO: 1333135 - protein, 19 aa, Mycobacterium
ARFLRQWMTWLAEKDIHEF

SEQ ID NO: 1333136 - protein, 18 aa, Mycobacterium
ARGWIRRCLIVVPGSLVE

SEQ ID NO: 1333137 - protein, 18 aa, Mycobacterium
ARILPNPWRTEALVLLAF

SEQ ID NO: 1333138 - protein, 19 aa, Mycobacterium
ARIYVVDLTPERLGEAFPA

SEQ ID NO: 1333139 - protein, 18 aa, Mycobacterium
ARLDLASVFLYAGSILPG

SEQ ID NO: 1333140 - protein, 26 aa, Mycobacterium
ARLGGPGRWLLALPAYHVAGFQVLVR

SEQ ID NO: 1333141 - protein, 17 aa, Mycobacterium
ARLNFQLAFGARVGQRL

SEQ ID NO: 1333142 - protein, 21 aa, Mycobacterium
ARLQRPLYVMPTRGILTSGYG

SEQ ID NO: 1333143 - protein, 24 aa, Mycobacterium
ARLRRLPVLLLGRQPRHGDGGDEL

SEQ ID NO: 1333144 - protein, 25 aa, Mycobacterium
ARMEFVISEYIRFHPLALLHPEKVD

SEQ ID NO: 1333145 - protein, 17 aa, Mycobacterium
ARQRGCTLLVTGGDWQG

SEQ ID NO: 1333146 - protein, 19 aa, Mycobacterium
ARRGGQWLDWFDAEGIAGV

SEQ ID NO: 1333147 - protein, 17 aa, Mycobacterium
ARRLGVPEAKWVYLRGH

SEQ ID NO: 1333148 - protein, 22 aa, Mycobacterium
ARRRIYWLSLPLDYGLAGRTPS

SEQ ID NO: 1333149 - protein, 25 aa, Mycobacterium
ARYTWPRFVCALPCEFFAAVRAELD

SEQ ID NO: 1333150 - protein, 23 aa, Mycobacterium
ASAVPLEWRTLLHGWPGVRAREL

SEQ ID NO: 1333151 - protein, 18 aa, Mycobacterium
ASCRFMKMITPAAMLRCL

SEQ ID NO: 1333152 - protein, 22 aa, Mycobacterium
ASDAFFPFPDGLETLIRAGVKA

SEQ ID NO: 1333153 - protein, 22 aa, Mycobacterium
ASFWDSMRFLTDTPTYFLLAPR

SEQ ID NO: 1333154 - protein, 17 aa, Mycobacterium
ASFYRWPRGATFEGWRQ

SEQ ID NO: 1333155 - protein, 17 aa, Mycobacterium
ASHQPFQAFIARLYAVL

SEQ ID NO: 1333156 - protein, 17 aa, Mycobacterium
ASPQPLWALWRFSNQPE

SEQ ID NO: 1333157 - protein, 21 aa, Mycobacterium
ASRLVAEWPVRPGVPDPDPLA

SEQ ID NO: 1333158 - protein, 18 aa, Mycobacterium
ASSPGFLGWLDPSAVGAP

SEQ ID NO: 1333159 - protein, 23 aa, Mycobacterium
ASTWADPWPMYRALRDHDPVHHV

SEQ ID NO: 1333160 - protein, 23 aa, Mycobacterium
ATGFTPLYPSWPLAPEAFEEAPS

SEQ ID NO: 1333161 - protein, 18 aa, Mycobacterium
ATIPSFLRYGTYPQIVVV

SEQ ID NO: 1333162 - protein, 21 aa, Mycobacterium
ATMPYVLKLADKGWRGACQAD

SEQ ID NO: 1333163 - protein, 22 aa, Mycobacterium
ATNYLGHFALTVGLYPALEAAC

SEQ ID NO: 1333164 - protein, 21 aa, Mycobacterium
ATTFDVFISTWKAGLEASGFR

SEQ ID NO: 1333165 - protein, 19 aa, Mycobacterium
ATWDRLWPELGRQVRDGDA

SEQ ID NO: 1333166 - protein, 18 aa, Mycobacterium
AVAFLLSDDARFITGEAL

SEQ ID NO: 1333167 - protein, 24 aa, Mycobacterium
AVAGWPDALLLRVDRRNQVLISGG

SEQ ID NO: 1333168 - protein, 19 aa, Mycobacterium
AVASGHWPLLRFDPVMRAA

SEQ ID NO: 1333169 - protein, 17 aa, Mycobacterium
AVDAWWEEGRRLVHYPP

SEQ ID NO: 1333170 - protein, 22 aa, Mycobacterium
AVEDLVYLLRDSGIHVDVDLES

SEQ ID NO: 1333171 - protein, 19 aa, Mycobacterium
AVGLAVWRLGAGRSAPGEQ

SEQ ID NO: 1333172 - protein, 23 aa, Mycobacterium
AVGVRPWLTPPGRAALLLGDRAT

SEQ ID NO: 1333173 - protein, 26 aa, Mycobacterium
AVGVWPAIKLPPLVTPLPGLGYTIGD

SEQ ID NO: 1333174 - protein, 17 aa, Mycobacterium
AVKRYKITAAWPKSLEI

SEQ ID NO: 1333175 - protein, 20 aa, Mycobacterium
AVLRFQYRLARTPLQLIERR

SEQ ID NO: 1333176 - protein, 17 aa, Mycobacterium
AVLWHTTFPLPAPSAWP

SEQ ID NO: 1333177 - protein, 18 aa, Mycobacterium
AVLWHTTFPLPAPSAWPA

SEQ ID NO: 1333178 - protein, 28 aa, Mycobacterium
AVMATMPMVMWLRMLSLQAQKRAAQASA

SEQ ID NO: 1333179 - protein, 24 aa, Mycobacterium
AVNDKIFFQIYWLGSRDDILARME

SEQ ID NO: 1333180 - protein, 28 aa, Mycobacterium
AVPHYGIGYGLLRYLYAPTARVLGASRP

SEQ ID NO: 1333181 - protein, 17 aa, Mycobacterium
AVSRDGIMPRLRAASAR

SEQ ID NO: 1333182 - protein, 18 aa, Mycobacterium
AVSWLYGTAPRGLAGPLP

SEQ ID NO: 1333183 - protein, 23 aa, Mycobacterium
AVTKLFAAGLLPASYALQRLGYS

SEQ ID NO: 1333184 - protein, 19 aa, Mycobacterium
AWAFLPERPVDARAVLLCL

SEQ ID NO: 1333185 - protein, 18 aa, Mycobacterium
AWDYYDMNAIPWSQLRVL

SEQ ID NO: 1333186 - protein, 20 aa, Mycobacterium
AWFYDPPWTLPFRRRNEVAV

SEQ ID NO: 1333187 - protein, 17 aa, Mycobacterium
AWLLLSMLQVIFAEGLE

SEQ ID NO: 1333188 - protein, 18 aa, Mycobacterium
AWTFAWLHPQRCAGVAGI

SEQ ID NO: 1333189 - protein, 26 aa, Mycobacterium
AYDAYLRLHLLSHRLVAPHGLNADGL

SEQ ID NO: 1333190 - protein, 20 aa, Mycobacterium
AYFAAMLGLPFIAVMPASTS

SEQ ID NO: 1333191 - protein, 17 aa, Mycobacterium
AYFFLPGLTALRYLTTL

SEQ ID NO: 1333192 - protein, 29 aa, Mycobacterium
AYKCRVRTPWWRVPYLRPADLFLTYMNAD

SEQ ID NO: 1333193 - protein, 17 aa, Mycobacterium
AYLLIWTTTPWTLPSNQ

SEQ ID NO: 1333194 - protein, 17 aa, Mycobacterium
AYRALQAWGLPVSPHTA

SEQ ID NO: 1333195 - protein, 23 aa, Mycobacterium
AYYQLLVKALLLPGLMELADTRI

SEQ ID NO: 1333196 - protein, 30 aa, Mycobacterium
CAGMIPWNFPLLLAVWKLGPALAAGNTVVL

SEQ ID NO: 1333197 - protein, 19 aa, Mycobacterium
CDHWGVVPDIYLLGKALGG

SEQ ID NO: 1333198 - protein, 18 aa, Mycobacterium
CEEAPFYTLGPLATDIAP

SEQ ID NO: 1333199 - protein, 17 aa, Mycobacterium
CEKLGIDSLWLYDHLYG

SEQ ID NO: 1333200 - protein, 18 aa, Mycobacterium
CFLIRTYMLPFADLAAFE

SEQ ID NO: 1333201 - protein, 23 aa, Mycobacterium
CFNIPIVLLVDVPGFLPGTDQEY

SEQ ID NO: 1333202 - protein, 20 aa, Mycobacterium
CGFGWYFYDFGTAVSFFEDH

SEQ ID NO: 1333203 - protein, 23 aa, Mycobacterium
CGNEPMILLIGSLELIWSAHESS

SEQ ID NO: 1333204 - protein, 17 aa, Mycobacterium
CGNGFIYDPYRWCKPTM

SEQ ID NO: 1333205 - protein, 19 aa, Mycobacterium
CGYRRFFSITSLAGLRQED

SEQ ID NO: 1333206 - protein, 17 aa, Mycobacterium
CIFLNRPGWPKGIGCAL

SEQ ID NO: 1333207 - protein, 20 aa, Mycobacterium
CISRQLWWGHRIPIWHGPNG

SEQ ID NO: 1333208 - protein, 18 aa, Mycobacterium
CLPHDWLTWRLSGSDDIG

SEQ ID NO: 1333209 - protein, 23 aa, Mycobacterium
CMSSSLPTLFRRAAHYQRQITLT

SEQ ID NO: 1333210 - protein, 17 aa, Mycobacterium
CNPYLTFAVLLAAGLRG

SEQ ID NO: 1333211 - protein, 20 aa, Mycobacterium
CPFDPLIFFRPRVERLFGGF

SEQ ID NO: 1333212 - protein, 17 aa, Mycobacterium
CQDFAHLTLMLLRGMGI

SEQ ID NO: 1333213 - protein, 17 aa, Mycobacterium
CRRAGVTVRYFYECFTD

SEQ ID NO: 1333214 - protein, 24 aa, Mycobacterium
CRSAGYWALPYPLAERLAKPADLD

SEQ ID NO: 1333215 - protein, 18 aa, Mycobacterium
CTVPFYWTEAHHTHDYSR

SEQ ID NO: 1333216 - protein, 18 aa, Mycobacterium
CVGGFVPVVLYKDDHDPA

SEQ ID NO: 1333217 - protein, 27 aa, Mycobacterium
DAAFGGMWWLYLPLAFDDYQLFLILQE

SEQ ID NO: 1333218 - protein, 18 aa, Mycobacterium
DAAVALMLRHRCTHMAGA

SEQ ID NO: 1333219 - protein, 23 aa, Mycobacterium
DADVLPYLRWFTFLSADELVELE

SEQ ID NO: 1333220 - protein, 20 aa, Mycobacterium
DAFAYARRALGLPATVLDWG

SEQ ID NO: 1333221 - protein, 23 aa, Mycobacterium
DAFTYMLLLTLEDLGFCPKGEGG

SEQ ID NO: 1333222 - protein, 19 aa, Mycobacterium
DAFVVPRLRPPQARVLLMA

SEQ ID NO: 1333223 - protein, 24 aa, Mycobacterium
DAGDILWAVFSPYTPFLNSPGMPP

SEQ ID NO: 1333224 - protein, 25 aa, Mycobacterium
DAGGATYWWFPPGTTPNAGGRKAWN

SEQ ID NO: 1333225 - protein, 26 aa, Mycobacterium
DAGIPLRFQLLWYPSTTFDTSLPSFV

SEQ ID NO: 1333226 - protein, 25 aa, Mycobacterium
DALAPLRLHYLRWQLFDVGSGLHFQ

SEQ ID NO: 1333227 - protein, 18 aa, Mycobacterium
DALNLPWLAMGAVGFISV

SEQ ID NO: 1333228 - protein, 20 aa, Mycobacterium
DALNLPWLAMGAVGFISVWG

SEQ ID NO: 1333229 - protein, 27 aa, Mycobacterium
DAPAQVPWFDALLAWVRRQITHTFFNK

SEQ ID NO: 1333230 - protein, 20 aa, Mycobacterium
DAPILLVRLITDTPDRVDLS

SEQ ID NO: 1333231 - protein, 20 aa, Mycobacterium
DARLILLDPGTRRGPSSSAV

SEQ ID NO: 1333232 - protein, 24 aa, Mycobacterium
DARPDQMLPFLRGWGDALWDTGID

SEQ ID NO: 1333233 - protein, 23 aa, Mycobacterium
DASRPVFGFAPYPGVQPGDPARV

SEQ ID NO: 1333234 - protein, 25 aa, Mycobacterium
DATGVPAERWGWLPLLTGLAVAHVV

SEQ ID NO: 1333235 - protein, 17 aa, Mycobacterium
DATLGERLILSSGFIAV

SEQ ID NO: 1333236 - protein, 23 aa, Mycobacterium
DAVPFSAYLFYKWAGHPNAEPDR

SEQ ID NO: 1333237 - protein, 21 aa, Mycobacterium
DDALWAKLRRTISAFLVNEWR

SEQ ID NO: 1333238 - protein, 17 aa, Mycobacterium
DDEFFVIVRPAPSGTRL

SEQ ID NO: 1333239 - protein, 28 aa, Mycobacterium
DDELIAAAAYRWLRSWPVAPSSPWEVPS

SEQ ID NO: 1333240 - protein, 23 aa, Mycobacterium
DDINEYLFQFALSTAWMNGIPGG

SEQ ID NO: 1333241 - protein, 24 aa, Mycobacterium
DDLDYYLVLAKWKLAIVLEQGFQR

SEQ ID NO: 1333242 - protein, 22 aa, Mycobacterium
DDLNFLWLPLAHAFGKVMLALP

SEQ ID NO: 1333243 - protein, 19 aa, Mycobacterium
DDLVTPFLGLYRDNNLRAD

SEQ ID NO: 1333244 - protein, 20 aa, Mycobacterium
DDVLLFKYIIKNTAWQNGKT

SEQ ID NO: 1333245 - protein, 25 aa, Mycobacterium
DEAAELMINLFWLGLKGAPSAADVD

SEQ ID NO: 1333246 - protein, 26 aa, Mycobacterium
DEAPLLATYAFLPVVRTFASAAGIDV

SEQ ID NO: 1333247 - protein, 23 aa, Mycobacterium
DEEAIGLCFLFILAGLDTVMDSL

SEQ ID NO: 1333248 - protein, 23 aa, Mycobacterium
DEEIYSFLRLLLPAGVETTYRSL

SEQ ID NO: 1333249 - protein, 18 aa, Mycobacterium
DEFGFFVILLAVAGNETT

SEQ ID NO: 1333250 - protein, 22 aa, Mycobacterium
DEHIERLAALGPIPLVLISHRH

SEQ ID NO: 1333251 - protein, 23 aa, Mycobacterium
DEIALLMPGVWIERPRLSDGELV

SEQ ID NO: 1333252 - protein, 24 aa, Mycobacterium
DELIAGLLERRPQWLEARWVRAVL

SEQ ID NO: 1333253 - protein, 24 aa, Mycobacterium
DELRATLLQLLGSPALCSRAFITE

SEQ ID NO: 1333254 - protein, 17 aa, Mycobacterium
DEPEFLPLVRRLGRFLP

SEQ ID NO: 1333255 - protein, 23 aa, Mycobacterium
DERFRARVLPRVPVRRWGAAEDV

SEQ ID NO: 1333256 - protein, 18 aa, Mycobacterium
DEVTLMALNYLRPWPTPP

SEQ ID NO: 1333257 - protein, 19 aa, Mycobacterium
DFDFMLIGAAFYRDRYRRT

SEQ ID NO: 1333258 - protein, 25 aa, Mycobacterium
DFEGHPFWRADTGLFFLFGLIEQSE

SEQ ID NO: 1333259 - protein, 18 aa, Mycobacterium
DFLALPRHALADAALTAA

SEQ ID NO: 1333260 - protein, 21 aa, Mycobacterium
DFMADFALPFPIAVASAWLGL

SEQ ID NO: 1333261 - protein, 24 aa, Mycobacterium
DGADIRVLPPLDPPPPGAYAAFRN

SEQ ID NO: 1333262 - protein, 23 aa, Mycobacterium
DGAGWLTFWRSLTARGLSGVRLV

SEQ ID NO: 1333263 - protein, 17 aa, Mycobacterium
DGDALTRWNAFTATPAV

SEQ ID NO: 1333264 - protein, 23 aa, Mycobacterium
DGEGWYWLGRLDGPYFYDADGEV

SEQ ID NO: 1333265 - protein, 18 aa, Mycobacterium
DGFARFWLHNGWVTMGGE

SEQ ID NO: 1333266 - protein, 20 aa, Mycobacterium
DGFMIFPPRVPYGIGAFVDL

SEQ ID NO: 1333267 - protein, 19 aa, Mycobacterium
DGIMPRLRAASARAGAACA

SEQ ID NO: 1333268 - protein, 25 aa, Mycobacterium
DGKLNLLHFLRPDFGIPRVTIGLDV

SEQ ID NO: 1333269 - protein, 20 aa, Mycobacterium
DGLLSLPWDGLSLSRGDAAV

SEQ ID NO: 1333270 - protein, 19 aa, Mycobacterium
DGMLPLPLLEVLFAADRET

SEQ ID NO: 1333271 - protein, 21 aa, Mycobacterium
DGRHLLASWIQLAALSAQMPG

SEQ ID NO: 1333272 - protein, 22 aa, Mycobacterium
DGRTCLLTPPPWYPILRGTTQQ

SEQ ID NO: 1333273 - protein, 17 aa, Mycobacterium
DGRVVFVRYALPGETVR

SEQ ID NO: 1333274 - protein, 23 aa, Mycobacterium
DGRYAYLVMTPLPGWEGNHYLGI

SEQ ID NO: 1333275 - protein, 23 aa, Mycobacterium
DGSDAMRWFLMASPILRGGNLIV

SEQ ID NO: 1333276 - protein, 18 aa, Mycobacterium
DGTPFPTLFYLTHPALTA

SEQ ID NO: 1333277 - protein, 20 aa, Mycobacterium
DHFTFARYLAAGLAVLQAVA

SEQ ID NO: 1333278 - protein, 22 aa, Mycobacterium
DHPEWVIPVRWTPTHDLPPLEA

SEQ ID NO: 1333279 - protein, 19 aa, Mycobacterium
DHPPYRPFWAITKHADIMA

SEQ ID NO: 1333280 - protein, 19 aa, Mycobacterium
DHRVARWMVPAFPIMQETA

SEQ ID NO: 1333281 - protein, 17 aa, Mycobacterium
DIAAWFSGLPIVSDVLP

SEQ ID NO: 1333282 - protein, 22 aa, Mycobacterium
DIANLAVFLLSDAASFITGQVI

SEQ ID NO: 1333283 - protein, 24 aa, Mycobacterium
DIFNDRFFVPFRLAATNRDRVVLG

SEQ ID NO: 1333284 - protein, 17 aa, Mycobacterium
DILFFWVARMMMFGTFV

SEQ ID NO: 1333285 - protein, 23 aa, Mycobacterium
DILSPLCWSLWGNGVELASRAGL

SEQ ID NO: 1333286 - protein, 20 aa, Mycobacterium
DIMDGLSPVFIFYQNHRDKA

SEQ ID NO: 1333287 - protein, 17 aa, Mycobacterium
DIQVRGYTLRLPLDVLV

SEQ ID NO: 1333288 - protein, 20 aa, Mycobacterium
DIWDWAVPWEEWKSMSALSD

SEQ ID NO: 1333289 - protein, 19 aa, Mycobacterium
DIYRFLPGLGVILGARVLG

SEQ ID NO: 1333290 - protein, 24 aa, Mycobacterium
DKIDPVLLDLLRLGSYQLLRTRVD

SEQ ID NO: 1333291 - protein, 17 aa, Mycobacterium
DKRSLVFPVKRLADLGF

SEQ ID NO: 1333292 - protein, 19 aa, Mycobacterium
DKTMLDALLPFVEELERRV

SEQ ID NO: 1333293 - protein, 20 aa, Mycobacterium
DLAEAALALRAGALWVAANV

SEQ ID NO: 1333294 - protein, 20 aa, Mycobacterium
DLAERLLALGRRTAQRMTSA

SEQ ID NO: 1333295 - protein, 22 aa, Mycobacterium
DLDAYLLADKLFHQTLLEASGN

SEQ ID NO: 1333296 - protein, 18 aa, Mycobacterium
DLDRPVRLLGVRLELVMP

SEQ ID NO: 1333297 - protein, 18 aa, Mycobacterium
DLDWFAFLVRLRQTGMPI

SEQ ID NO: 1333298 - protein, 19 aa, Mycobacterium
DLDYYLVLARWKLAIVLEQ

SEQ ID NO: 1333299 - protein, 19 aa, Mycobacterium
DLEKLWEGLRQLYPVGIDH

SEQ ID NO: 1333300 - protein, 22 aa, Mycobacterium
DLELLNCLLLLFMAGLDTVSNQ

SEQ ID NO: 1333301 - protein, 17 aa, Mycobacterium
DLFRSPASAASFVVDPD

SEQ ID NO: 1333302 - protein, 17 aa, Mycobacterium
DLGFRMPSLWFADGHRA

SEQ ID NO: 1333303 - protein, 18 aa, Mycobacterium
DLGWYRLPKGSLGGNYIK

SEQ ID NO: 1333304 - protein, 20 aa, Mycobacterium
DLHLWLPHPSDKLWTSLRGV

SEQ ID NO: 1333305 - protein, 26 aa, Mycobacterium
DLIDDRFWLHLGMGWQFFAPDDYIRR

SEQ ID NO: 1333306 - protein, 18 aa, Mycobacterium
DLLAAPDQFDWLATRLEI

SEQ ID NO: 1333307 - protein, 17 aa, Mycobacterium
DLLLQLIFAHRLDVTEV

SEQ ID NO: 1333308 - protein, 18 aa, Mycobacterium
DLLLTLEQRLLLTQKYPG

SEQ ID NO: 1333309 - protein, 18 aa, Mycobacterium
DLLRYWLDEWRAYIAPKK

SEQ ID NO: 1333310 - protein, 24 aa, Mycobacterium
DLNWKSRPYLAWPAYGQSKLANLL

SEQ ID NO: 1333311 - protein, 21 aa, Mycobacterium
DLRKVTGFGRLLLFGGTRDKA

SEQ ID NO: 1333312 - protein, 19 aa, Mycobacterium
DLTIGFFLHIPFPPVELFM

SEQ ID NO: 1333313 - protein, 17 aa, Mycobacterium
DLWKCLLPHDQWLVVGR

SEQ ID NO: 1333314 - protein, 21 aa, Mycobacterium
DLYRNPLFPVRRTGSVLYIVG

SEQ ID NO: 1333315 - protein, 18 aa, Mycobacterium
DMLLGKQGIDPRVLDLAK

SEQ ID NO: 1333316 - protein, 20 aa, Mycobacterium
DMVTSLRWTLTGVRSRFAVR

SEQ ID NO: 1333317 - protein, 28 aa, Mycobacterium
DNATLAHLLKFDSILGRLPYDVSLEGED

SEQ ID NO: 1333318 - protein, 22 aa, Mycobacterium
DNLFLRDLVMALRWVRDNVAAF

SEQ ID NO: 1333319 - protein, 24 aa, Mycobacterium
DNPALLCYYLFFPAHEESVGDGAC

SEQ ID NO: 1333320 - protein, 23 aa, Mycobacterium
DPANNVEFFFLRPKDIAIYVGSG

SEQ ID NO: 1333321 - protein, 21 aa, Mycobacterium
DPDLLRTVLMLLRTAALAAST

SEQ ID NO: 1333322 - protein, 17 aa, Mycobacterium
DPDWFVIRKSAVNVFRA

SEQ ID NO: 1333323 - protein, 19 aa, Mycobacterium
DPDWLRWNYATVVWGIATA

SEQ ID NO: 1333324 - protein, 26 aa, Mycobacterium
DPEQLMRWLFDNALTRVTRQAAALGV

SEQ ID NO: 1333325 - protein, 18 aa, Mycobacterium
DPGFEFMVLPWPDYYGSA

SEQ ID NO: 1333326 - protein, 29 aa, Mycobacterium
DPHQNMGVIYWIYPNLILANSPIGVEIID

SEQ ID NO: 1333327 - protein, 24 aa, Mycobacterium
DPRLKRPIPFLPGTIGLITGRASA

SEQ ID NO: 1333328 - protein, 19 aa, Mycobacterium
DPRRRAIVGMIFFDCLTQR

SEQ ID NO: 1333329 - protein, 24 aa, Mycobacterium
DPTNDLILIYLIQNLPDFGADAAA

SEQ ID NO: 1333330 - protein, 22 aa, Mycobacterium
DPVDLVAFLSLRFAPPTLTNTE

SEQ ID NO: 1333331 - protein, 25 aa, Mycobacterium
DPVWYDHLPYLPFPQNWPVFAPKDK

SEQ ID NO: 1333332 - protein, 21 aa, Mycobacterium
DPWASFVTYGLLDGAPVLCVS

SEQ ID NO: 1333333 - protein, 21 aa, Mycobacterium
DQPWESIYGLPLRLASDARRF

SEQ ID NO: 1333334 - protein, 25 aa, Mycobacterium
DQVATLFRLWLRDAIRRVADGVLEV

SEQ ID NO: 1333335 - protein, 23 aa, Mycobacterium
DRALLLVHHPLLLRGVDSVAADT

SEQ ID NO: 1333336 - protein, 18 aa, Mycobacterium
DRGQPFLALVDYAHKPGA

SEQ ID NO: 1333337 - protein, 24 aa, Mycobacterium
DRRVLKLLRLWLQAGVMVDGVVSR

SEQ ID NO: 1333338 - protein, 23 aa, Mycobacterium
DRSASWMFDYYPLRVVRELADGA

SEQ ID NO: 1333339 - protein, 17 aa, Mycobacterium
DRVPPVAWWCRRDLSGG

SEQ ID NO: 1333340 - protein, 19 aa, Mycobacterium
DRYLGFLALDPTTARLFLV

SEQ ID NO: 1333341 - protein, 28 aa, Mycobacterium
DSFEFFPNFTLLLWAPGWYLTYNYWPTA

SEQ ID NO: 1333342 - protein, 18 aa, Mycobacterium
DSGMLWITTLGREGEFWD

SEQ ID NO: 1333343 - protein, 21 aa, Mycobacterium
DSIGWLRTFLQNHTGGLVVIS

SEQ ID NO: 1333344 - protein, 24 aa, Mycobacterium
DSLAPPVSTWWPWRGRTVHVARAA

SEQ ID NO: 1333345 - protein, 25 aa, Mycobacterium
DSLRRLALGHWMRRWWPASVRDGIP

SEQ ID NO: 1333346 - protein, 20 aa, Mycobacterium
DSRAYRLPWPAGTVVFEIDQ

SEQ ID NO: 1333347 - protein, 23 aa, Mycobacterium
DSTYYLIPAPITPVLVPLTWVPI

SEQ ID NO: 1333348 - protein, 25 aa, Mycobacterium
DTATVLHKLSLRTPVRRFVLFSSIT

SEQ ID NO: 1333349 - protein, 33 aa, Mycobacterium
DTAYYLIPTYPLPLLMPLTWIPVIGPIAVDMLD

SEQ ID NO: 1333350 - protein, 19 aa, Mycobacterium
DTDPVLAWLYVLDAWEGGI

SEQ ID NO: 1333351 - protein, 21 aa, Mycobacterium
DTHPFAWLPMLSRVLGSARLD

SEQ ID NO: 1333352 - protein, 17 aa, Mycobacterium
DTLYLYFLCAHPSLTPS

SEQ ID NO: 1333353 - protein, 20 aa, Mycobacterium
DTRAYFRGECLRRFGADIAA

SEQ ID NO: 1333354 - protein, 24 aa, Mycobacterium
DTSPHNLFPLVFDMLYRGDTPRIN

SEQ ID NO: 1333355 - protein, 18 aa, Mycobacterium
DTVREFLYPIAATRLRGL

SEQ ID NO: 1333356 - protein, 20 aa, Mycobacterium
DTVWLAHRYGPQARQIVAAV

SEQ ID NO: 1333357 - protein, 18 aa, Mycobacterium
DTYRFYFCSTACLRQFAD

SEQ ID NO: 1333358 - protein, 24 aa, Mycobacterium
DVACALDWLLYDWLMAHRDGPDSA

SEQ ID NO: 1333359 - protein, 22 aa, Mycobacterium
DVAEILCLPYFLGEKSPLHDPD

SEQ ID NO: 1333360 - protein, 24 aa, Mycobacterium
DVAGPYAWWSWRGKAFDNDAGWRI

SEQ ID NO: 1333361 - protein, 22 aa, Mycobacterium
DVALLLYRHPAPLQLNFPADAN

SEQ ID NO: 1333362 - protein, 25 aa, Mycobacterium
DVDVIFSPFFNALPIRRTGVYKDGG

SEQ ID NO: 1333363 - protein, 24 aa, Mycobacterium
DVDVVLSPFFNTLPIRRAGLHEHS

SEQ ID NO: 1333364 - protein, 24 aa, Mycobacterium
DVERLHLVLVFRSVGLPLEEIRTL

SEQ ID NO: 1333365 - protein, 23 aa, Mycobacterium
DVGRLLKVVPPLASLIAAARAAG

SEQ ID NO: 1333366 - protein, 18 aa, Mycobacterium
DVIPLRYFGVELVAFRDL

SEQ ID NO: 1333367 - protein, 25 aa, Mycobacterium
DVLEPSEWFPLQLALKVHQSRAGMP

SEQ ID NO: 1333368 - protein, 21 aa, Mycobacterium
DVPGHWLLARLGKRVLRPGGL

SEQ ID NO: 1333369 - protein, 19 aa, Mycobacterium
DVRALLAHLIGVLARVAAL

SEQ ID NO: 1333370 - protein, 24 aa, Mycobacterium
DVSRSWLYFGLISISVGALDDADE

SEQ ID NO: 1333371 - protein, 19 aa, Mycobacterium
DVWAPLRRTTQARIGLGRA

SEQ ID NO: 1333372 - protein, 24 aa, Mycobacterium
DWGRAFAWMGMPDEYFASSGNAPI

SEQ ID NO: 1333373 - protein, 19 aa, Mycobacterium
DYFKFRYYEKWLGGITQFF

SEQ ID NO: 1333374 - protein, 20 aa, Mycobacterium
EAALGLLRRNKIEKLPIVDG

SEQ ID NO: 1333375 - protein, 26 aa, Mycobacterium
EADGIAFIPWFPLAAGPLAAADGPLH

SEQ ID NO: 1333376 - protein, 23 aa, Mycobacterium
EAGRPCWLLCLLFDDADGCAGHS

SEQ ID NO: 1333377 - protein, 22 aa, Mycobacterium
EAGWALYLPHLQPLIVNLVRDA

SEQ ID NO: 1333378 - protein, 22 aa, Mycobacterium
EAKEPWFLDAYRRAWEWADTTG

SEQ ID NO: 1333379 - protein, 25 aa, Mycobacterium
EALDTWPLNIALLGKGNTVSAEAMW

SEQ ID NO: 1333380 - protein, 24 aa, Mycobacterium
EALETWPLRIFGDALPRHLELIYE

SEQ ID NO: 1333381 - protein, 17 aa, Mycobacterium
EALRELVTLIDRGRLTV

SEQ ID NO: 1333382 - protein, 23 aa, Mycobacterium
EANMYSTFYDAVLGRLLIAVDQS

SEQ ID NO: 1333383 - protein, 17 aa, Mycobacterium
EAPPDIELIGMLNLLIG

SEQ ID NO: 1333384 - protein, 25 aa, Mycobacterium
EARWDSVLAVNLLAPLRLAEGLVAS

SEQ ID NO: 1333385 - protein, 26 aa, Mycobacterium
EAVARPEVWIFLRPFADALTDAEAVD

SEQ ID NO: 1333386 - protein, 17 aa, Mycobacterium
ECALRWMRDFHADGLRL

SEQ ID NO: 1333387 - protein, 21 aa, Mycobacterium
EDFLARPADYFALLAELGFIT

SEQ ID NO: 1333388 - protein, 24 aa, Mycobacterium
EDLVGMLLFLLSDQAKWITGQIFN

SEQ ID NO: 1333389 - protein, 17 aa, Mycobacterium
EDQALLYRLSGDRNPLH

SEQ ID NO: 1333390 - protein, 17 aa, Mycobacterium
EDVARFVRRRIFEGTYP

SEQ ID NO: 1333391 - protein, 23 aa, Mycobacterium
EDYQDPWFPFSHPPTEDAPALDM

SEQ ID NO: 1333392 - protein, 19 aa, Mycobacterium
EEILWLCEAAHLPVIWATQ

SEQ ID NO: 1333393 - protein, 23 aa, Mycobacterium
EESPILYLRLRKAVRRHGLQVLS

SEQ ID NO: 1333394 - protein, 18 aa, Mycobacterium
EFDADFFGFTPYAARMLD

SEQ ID NO: 1333395 - protein, 23 aa, Mycobacterium
EFDRLATLLRFPAAFFTTAPVSR

SEQ ID NO: 1333396 - protein, 20 aa, Mycobacterium
EFFLSATPPRQAWELGYQDL

SEQ ID NO: 1333397 - protein, 17 aa, Mycobacterium
EFGAYWYANLRNTIRFD

SEQ ID NO: 1333398 - protein, 19 aa, Mycobacterium
EFIHHNLVLRRGPVAAVAA

SEQ ID NO: 1333399 - protein, 17 aa, Mycobacterium
EFLAFFVAAIKAAVPGF

SEQ ID NO: 1333400 - protein, 21 aa, Mycobacterium
EFLQWFLDTVPIEPIWLCPLR

SEQ ID NO: 1333401 - protein, 20 aa, Mycobacterium
EFLRRDFGFVYQVRPKFLDR

SEQ ID NO: 1333402 - protein, 18 aa, Mycobacterium
EFMVLPWPDYYGSAPGAR

SEQ ID NO: 1333403 - protein, 23 aa, Mycobacterium
EFNLLYRWHSLIPTKVRVGGQRR

SEQ ID NO: 1333404 - protein, 18 aa, Mycobacterium
EFPWRREVGNARAGRLVA

SEQ ID NO: 1333405 - protein, 22 aa, Mycobacterium
EFRIQLAWMRQSPPGTPNPGWL

SEQ ID NO: 1333406 - protein, 17 aa, Mycobacterium
EFWREFLASLKARGLSG

SEQ ID NO: 1333407 - protein, 24 aa, Mycobacterium
EGIEPFGFYYEKFALAAPAAETSA

SEQ ID NO: 1333408 - protein, 21 aa, Mycobacterium
EGKPLLGLTWLPFMGQRYTSM

SEQ ID NO: 1333409 - protein, 17 aa, Mycobacterium
EGLMSFRWFLADELPEH

SEQ ID NO: 1333410 - protein, 25 aa, Mycobacterium
EGLNAEYLFRLALPTGIYGGTLDVF

SEQ ID NO: 1333411 - protein, 22 aa, Mycobacterium
EGLTMFLVPLDAPGITMRRIKQ

SEQ ID NO: 1333412 - protein, 23 aa, Mycobacterium
EGPDALVVVLLPDGGRGYLSKIF

SEQ ID NO: 1333413 - protein, 17 aa, Mycobacterium
EGVPALLDRLYYLDTEP

SEQ ID NO: 1333414 - protein, 18 aa, Mycobacterium
EGVPALLDRLYYLDTEPA

SEQ ID NO: 1333415 - protein, 24 aa, Mycobacterium
EHDLSLLLLRVQALRPAWGDPTWH

SEQ ID NO: 1333416 - protein, 29 aa, Mycobacterium
EHLPYYARWYRFLLMWPGADKGLDAARVD

SEQ ID NO: 1333417 - protein, 17 aa, Mycobacterium
EILQLGLLKPKIAILDE

SEQ ID NO: 1333418 - protein, 26 aa, Mycobacterium
EIQGNGPYILAGWSLGGALAYACAVG

SEQ ID NO: 1333419 - protein, 21 aa, Mycobacterium
EIRINWVWNPPWGPDKITDDG

SEQ ID NO: 1333420 - protein, 24 aa, Mycobacterium
EISEVLFPPAPWMFGAAGREHMKE

SEQ ID NO: 1333421 - protein, 25 aa, Mycobacterium
EIYEDLAWFCIRAWRFGAPETLGAG

SEQ ID NO: 1333422 - protein, 19 aa, Mycobacterium
EKIDPYLRPLYDALHDMMD

SEQ ID NO: 1333423 - protein, 25 aa, Mycobacterium
EKPNELLAPLPLTPLTPRLLVRRLE

SEQ ID NO: 1333424 - protein, 23 aa, Mycobacterium
EKSWLLRLFEVPLGAQAPANFLR

SEQ ID NO: 1333425 - protein, 22 aa, Mycobacterium
ELADWKWVLDINLWGPIHGCHV

SEQ ID NO: 1333426 - protein, 18 aa, Mycobacterium
ELAGIPLLDLLDTDLRAA

SEQ ID NO: 1333427 - protein, 17 aa, Mycobacterium
ELEFFLSATPPRQAWEL

SEQ ID NO: 1333428 - protein, 18 aa, Mycobacterium
ELGDFFFTILRSGVTPEV

SEQ ID NO: 1333429 - protein, 22 aa, Mycobacterium
ELGLVPLHWALASLLADIGSAA

SEQ ID NO: 1333430 - protein, 19 aa, Mycobacterium
ELGMPPWRVQKAQKQARRW

SEQ ID NO: 1333431 - protein, 23 aa, Mycobacterium
ELGRLCCWILLDAAAPVSLTLAC

SEQ ID NO: 1333432 - protein, 18 aa, Mycobacterium
ELIKRTQWWGRQMLIWGV

SEQ ID NO: 1333433 - protein, 24 aa, Mycobacterium
ELKRFSFAWLTDFVGWLPMPDGGP

SEQ ID NO: 1333434 - protein, 18 aa, Mycobacterium
ELLFLYNGVRPRNVMPVH

SEQ ID NO: 1333435 - protein, 20 aa, Mycobacterium
ELLRLWADYLDMPPLRVDPA

SEQ ID NO: 1333436 - protein, 22 aa, Mycobacterium
ELNVAFRMLYARYPDITAAGEP

SEQ ID NO: 1333437 - protein, 23 aa, Mycobacterium
ELPAAALWWRISGALSPTATLAT

SEQ ID NO: 1333438 - protein, 19 aa, Mycobacterium
ELRFGSFAELLLNKGLAHE

SEQ ID NO: 1333439 - protein, 23 aa, Mycobacterium
ELRRHILTLWQTALIRLSRLKIQ

SEQ ID NO: 1333440 - protein, 25 aa, Mycobacterium
ELRRRWGGLLSYRYIGRSYAQMDLG

SEQ ID NO: 1333441 - protein, 24 aa, Mycobacterium
EMNAPWNGLLLYSNHKFFSDENVV

SEQ ID NO: 1333442 - protein, 23 aa, Mycobacterium
EMRHWWQVPLLGHHVLIAGATGA

SEQ ID NO: 1333443 - protein, 25 aa, Mycobacterium
EMSDGTLRFLLWAAALLSPQPPSLM

SEQ ID NO: 1333444 - protein, 22 aa, Mycobacterium
ENHMMFFLFIAAHLPPDVGARL

SEQ ID NO: 1333445 - protein, 18 aa, Mycobacterium
ENISPLVVWLGSVESRDV

SEQ ID NO: 1333446 - protein, 20 aa, Mycobacterium
ENLPAGHWPPTGWYAEWVSG

SEQ ID NO: 1333447 - protein, 22 aa, Mycobacterium
ENVLRAFTFPLEKVRVLIVGQD

SEQ ID NO: 1333448 - protein, 24 aa, Mycobacterium
EPAGVMRWPFKLLAPVVKSGFGRM

SEQ ID NO: 1333449 - protein, 22 aa, Mycobacterium
EPARTWFTAMTPIATAFGDVTL

SEQ ID NO: 1333450 - protein, 24 aa, Mycobacterium
EPEPVPPPLPPPPPVRPPAAPVVE

SEQ ID NO: 1333451 - protein, 22 aa, Mycobacterium
EPFKGLPHPTILAAAALLGVDE

SEQ ID NO: 1333452 - protein, 19 aa, Mycobacterium
EPLLLDWRAPAARAFYVAT

SEQ ID NO: 1333453 - protein, 17 aa, Mycobacterium
EPRMLLVHFLRDELRLT

SEQ ID NO: 1333454 - protein, 31 aa, Mycobacterium
EQDALERMALLGLPFLFFIDAAQGRASLLYR

SEQ ID NO: 1333455 - protein, 17 aa, Mycobacterium
EQRAWHRPLPEPGMRSE

SEQ ID NO: 1333456 - protein, 23 aa, Mycobacterium
EQRKQWLEPLLAGEIRSAFAMTE

SEQ ID NO: 1333457 - protein, 26 aa, Mycobacterium
EQSLVERLIPDFLWIDTEYTAKVSLD

SEQ ID NO: 1333458 - protein, 24 aa, Mycobacterium
EQTTADWLALFDKLGIPASPLRTT

SEQ ID NO: 1333459 - protein, 26 aa, Mycobacterium
EQVGIPLRRYVLWLRLRLAIICAHAG

SEQ ID NO: 1333460 - protein, 17 aa, Mycobacterium
ERAVLPQGTLYASTPHQ

SEQ ID NO: 1333461 - protein, 21 aa, Mycobacterium
ERFAVWLIFELLAVTLVDAKP

SEQ ID NO: 1333462 - protein, 17 aa, Mycobacterium
ERFGMQDAIWRGVYYTP

SEQ ID NO: 1333463 - protein, 18 aa, Mycobacterium
ERFLLLWAEGSMTIAMPS

SEQ ID NO: 1333464 - protein, 22 aa, Mycobacterium
ERGRLWSALWLRPAHGPGVLVV

SEQ ID NO: 1333465 - protein, 20 aa, Mycobacterium
ERLDWVLETFPRLAERRNQV

SEQ ID NO: 1333466 - protein, 17 aa, Mycobacterium
ERNIAFVPFFPLGSGFV

SEQ ID NO: 1333467 - protein, 20 aa, Mycobacterium
ERRPGWPQARWLRVAIHHRT

SEQ ID NO: 1333468 - protein, 17 aa, Mycobacterium
ERSAAWMFDYYPLRVLR

SEQ ID NO: 1333469 - protein, 23 aa, Mycobacterium
ERSSAPLLLWIHGGPLASWNAWH

SEQ ID NO: 1333470 - protein, 24 aa, Mycobacterium
ERVGWRWRLVWFRAVSELLTADYD

SEQ ID NO: 1333471 - protein, 19 aa, Mycobacterium
ERYRRWLAVLRGDARFVIG

SEQ ID NO: 1333472 - protein, 30 aa, Mycobacterium
ESARPMTLRFLDAPPRFLFFTGKGGVGKTS

SEQ ID NO: 1333473 - protein, 28 aa, Mycobacterium
ESDELLKFSLLPWPDYFGKAPKARADGM

SEQ ID NO: 1333474 - protein, 22 aa, Mycobacterium
ESFRLLFDIHVMGAFNVTQAAL

SEQ ID NO: 1333475 - protein, 22 aa, Mycobacterium
ESGHWWIEYVAATLRLGDPYHL

SEQ ID NO: 1333476 - protein, 19 aa, Mycobacterium
ESLDLRWWPIDELPRDCDF

SEQ ID NO: 1333477 - protein, 24 aa, Mycobacterium
ESLQNFPFLIARLDQFSRSSELTA

SEQ ID NO: 1333478 - protein, 22 aa, Mycobacterium
ESRLRLLLVDTWLDPVRTQIKV

SEQ ID NO: 1333479 - protein, 23 aa, Mycobacterium
ESRSPWPTWPIVLRTRLSPAHAE

SEQ ID NO: 1333480 - protein, 22 aa, Mycobacterium
ESWSMALALRLAAYELLRVEGS

SEQ ID NO: 1333481 - protein, 17 aa, Mycobacterium
ETAFQFAWLLDAAKAGH

SEQ ID NO: 1333482 - protein, 21 aa, Mycobacterium
ETEPGLRWPDLSLAGGRVGFS

SEQ ID NO: 1333483 - protein, 18 aa, Mycobacterium
ETITRWRPYLTGERNSYA

SEQ ID NO: 1333484 - protein, 24 aa, Mycobacterium
ETLFDALLPRYVATRVYAALLEAA

SEQ ID NO: 1333485 - protein, 21 aa, Mycobacterium
ETLLPWLKFRGHGLGMFIMEM

SEQ ID NO: 1333486 - protein, 26 aa, Mycobacterium
ETSLPWQLPGRLLLARAYAALGRTDE

SEQ ID NO: 1333487 - protein, 28 aa, Mycobacterium
ETSLVHRVLPIGAPIRDIAYAGGAVYVL

SEQ ID NO: 1333488 - protein, 24 aa, Mycobacterium
EVAAAKWWRKPLVRRWYGFAEMQK

SEQ ID NO: 1333489 - protein, 25 aa, Mycobacterium
EVDNPMFGVIYRSPLRHLALIGTEQ

SEQ ID NO: 1333490 - protein, 22 aa, Mycobacterium
EVEFAFFVILLAVAGNETTRNA

SEQ ID NO: 1333491 - protein, 25 aa, Mycobacterium
EVGKLADLVLWEPAFFGVRPHAVVK

SEQ ID NO: 1333492 - protein, 23 aa, Mycobacterium
EVIARLPFVPSILEWLHAGRTSV

SEQ ID NO: 1333493 - protein, 23 aa, Mycobacterium
EVIAWQWIPFGPVLNARADWLEE

SEQ ID NO: 1333494 - protein, 25 aa, Mycobacterium
EVITKPRWFFSFAKHLRPPDLRVPN

SEQ ID NO: 1333495 - protein, 22 aa, Mycobacterium
EVLLFIELGKRLAPGPFLACTL

SEQ ID NO: 1333496 - protein, 18 aa, Mycobacterium
EVLWLCEAAHLPVIWATQ

SEQ ID NO: 1333497 - protein, 24 aa, Mycobacterium
EVMPEDLIKFGLIPEFIGRLPVVA

SEQ ID NO: 1333498 - protein, 20 aa, Mycobacterium
EVRLPLTWITLLHGRIGASL

SEQ ID NO: 1333499 - protein, 17 aa, Mycobacterium
EVVALTPARLLLVVITD

SEQ ID NO: 1333500 - protein, 17 aa, Mycobacterium
EVWAWTYVPKDAPPKVK

SEQ ID NO: 1333501 - protein, 28 aa, Mycobacterium
EWAIDGTGKLWWLQARPITTLPGDLNEM

SEQ ID NO: 1333502 - protein, 18 aa, Mycobacterium
EWFAANFGVIPWSMHYIT

SEQ ID NO: 1333503 - protein, 19 aa, Mycobacterium
EWIVAVFALLLQGAVPVLG

SEQ ID NO: 1333504 - protein, 20 aa, Mycobacterium
EWLIDTYVRPTLHGELIGSL

SEQ ID NO: 1333505 - protein, 22 aa, Mycobacterium
EYAQLRAQWGWKLVAAATTAGV

SEQ ID NO: 1333506 - protein, 17 aa, Mycobacterium
EYVIGFLGAIQAGFIAV

SEQ ID NO: 1333507 - protein, 19 aa, Mycobacterium
FAADLARMYIRYAERHGWT

SEQ ID NO: 1333508 - protein, 23 aa, Mycobacterium
FADNDLAWGPAWCSSLRSLWVGT

SEQ ID NO: 1333509 - protein, 18 aa, Mycobacterium
FALTMLPGGRRAASVTGS

SEQ ID NO: 1333510 - protein, 17 aa, Mycobacterium
FAPPYLIAGQALAVDAE

SEQ ID NO: 1333511 - protein, 20 aa, Mycobacterium
FARYPFLVKGYIGPKALLAN

SEQ ID NO: 1333512 - protein, 19 aa, Mycobacterium
FATYLREFPMAFRFAVLNV

SEQ ID NO: 1333513 - protein, 22 aa, Mycobacterium
FAVPTFEQFWRDGSLRLPTERG

SEQ ID NO: 1333514 - protein, 18 aa, Mycobacterium
FDCSGLVMWAFQQEGISL

SEQ ID NO: 1333515 - protein, 19 aa, Mycobacterium
FDCSGLVMWSFQQAGISLP

SEQ ID NO: 1333516 - protein, 17 aa, Mycobacterium
FDDLHLWYFGDAPQRPQ

SEQ ID NO: 1333517 - protein, 18 aa, Mycobacterium
FDGVLLHPFLTPAAVGRS

SEQ ID NO: 1333518 - protein, 18 aa, Mycobacterium
FDLLLQLIFAHRLDVTEV

SEQ ID NO: 1333519 - protein, 17 aa, Mycobacterium
FDRAFKELAKQVRLPGF

SEQ ID NO: 1333520 - protein, 22 aa, Mycobacterium
FDWPVSLFAERTWHIARPLPER

SEQ ID NO: 1333521 - protein, 18 aa, Mycobacterium
FEFALLQGALRRQIPVLG

SEQ ID NO: 1333522 - protein, 24 aa, Mycobacterium
FGHVVIAWMWLEQFLAAEGRTGDF

SEQ ID NO: 1333523 - protein, 22 aa, Mycobacterium
FGIQRFFGGLLYWEVWSKLGGP

SEQ ID NO: 1333524 - protein, 22 aa, Mycobacterium
FGKVMLALPLLVGFPTAIDGRV

SEQ ID NO: 1333525 - protein, 18 aa, Mycobacterium
FGMTLPSPLFMAPIGVIG

SEQ ID NO: 1333526 - protein, 22 aa, Mycobacterium
FGPTTGLWILLLAKGGGDTKVS

SEQ ID NO: 1333527 - protein, 17 aa, Mycobacterium
FGRIFAEGLWLELRDHD

SEQ ID NO: 1333528 - protein, 17 aa, Mycobacterium
FGSYRRQLSLGDGVDTA

SEQ ID NO: 1333529 - protein, 25 aa, Mycobacterium
FHGVKAFLPRMIAAGAPAWVWNLSS

SEQ ID NO: 1333530 - protein, 18 aa, Mycobacterium
FHTVYWPAFLMSAGIELP

SEQ ID NO: 1333531 - protein, 18 aa, Mycobacterium
FHYLFHPVTQRALSLAGD

SEQ ID NO: 1333532 - protein, 18 aa, Mycobacterium
FIRTCDCFNIPIVLLVDV

SEQ ID NO: 1333533 - protein, 19 aa, Mycobacterium
FLEYLDMFYNLGLAGRAMR

SEQ ID NO: 1333534 - protein, 19 aa, Mycobacterium
FLFGPPPLGPGAPPLERLL

SEQ ID NO: 1333535 - protein, 17 aa, Mycobacterium
FLGMPFWLGRGFGLNLS

SEQ ID NO: 1333536 - protein, 18 aa, Mycobacterium
FLGWLDPSAVGAPAPTPA

SEQ ID NO: 1333537 - protein, 17 aa, Mycobacterium
FLPKIAAGDLHFSIGYS

SEQ ID NO: 1333538 - protein, 17 aa, Mycobacterium
FLRALPADGWLRVMCTA

SEQ ID NO: 1333539 - protein, 26 aa, Mycobacterium
FLSDIHLWVRLLGCGDFYGIPATHAS

SEQ ID NO: 1333540 - protein, 17 aa, Mycobacterium
FLYPIAATRLRGLALPG

SEQ ID NO: 1333541 - protein, 18 aa, Mycobacterium
FMKMITPAAMLRCLIEGA

SEQ ID NO: 1333542 - protein, 23 aa, Mycobacterium
FMVRNTYIYPPKPSMRIISDIFG

SEQ ID NO: 1333543 - protein, 18 aa, Mycobacterium
FNDAWMSSYGFLRSRLDG

SEQ ID NO: 1333544 - protein, 17 aa, Mycobacterium
FNFPVAVWSWNTAVALV

SEQ ID NO: 1333545 - protein, 21 aa, Mycobacterium
FNGILARYLALVATALPGGSP

SEQ ID NO: 1333546 - protein, 17 aa, Mycobacterium
FPALCRPTAPVVVSSAD

SEQ ID NO: 1333547 - protein, 17 aa, Mycobacterium
FPGHWYSADPSAPLSDV

SEQ ID NO: 1333548 - protein, 18 aa, Mycobacterium
FPGLSWPITLGHEIAGTV

SEQ ID NO: 1333549 - protein, 19 aa, Mycobacterium
FPGLSWPITLGHEIAGTVA

SEQ ID NO: 1333550 - protein, 19 aa, Mycobacterium
FPPDDFPLYFYRKPSAPDL

SEQ ID NO: 1333551 - protein, 22 aa, Mycobacterium
FPPRIPLPYDVAGACVLLIDGL

SEQ ID NO: 1333552 - protein, 18 aa, Mycobacterium
FPSWPLAHPFRRVAHNGE

SEQ ID NO: 1333553 - protein, 21 aa, Mycobacterium
FPYPVTVGYMYILKLHHLVDD

SEQ ID NO: 1333554 - protein, 20 aa, Mycobacterium
FQHFNLFPHMTVIENITLAP

SEQ ID NO: 1333555 - protein, 21 aa, Mycobacterium
FQHFQLFPHRTVLDNVTLAPR

SEQ ID NO: 1333556 - protein, 19 aa, Mycobacterium
FQWPRITGTFNWATDWFDA

SEQ ID NO: 1333557 - protein, 21 aa, Mycobacterium
FRFPTFVGAFKYYTSYTLKTF

SEQ ID NO: 1333558 - protein, 25 aa, Mycobacterium
FRGAKNVLLVFFPLAFTGICQRELD

SEQ ID NO: 1333559 - protein, 17 aa, Mycobacterium
FRHNPLFSPAAIARFRS

SEQ ID NO: 1333560 - protein, 19 aa, Mycobacterium
FRRIFADRFFYILYFQDRG

SEQ ID NO: 1333561 - protein, 24 aa, Mycobacterium
FRRTLAWFIYRKPGGRVALGVQYG

SEQ ID NO: 1333562 - protein, 18 aa, Mycobacterium
FSAILPVLAHDIPWNSGV

SEQ ID NO: 1333563 - protein, 17 aa, Mycobacterium
FSFGLWTVGWPGVDPFG

SEQ ID NO: 1333564 - protein, 29 aa, Mycobacterium
FSGFTGDLFAVLFLLAGRRTAGLAAALTE

SEQ ID NO: 1333565 - protein, 19 aa, Mycobacterium
FSIIRMFLELPYKQALLDA

SEQ ID NO: 1333566 - protein, 17 aa, Mycobacterium
FSKYAKALGFYCDCAVL

SEQ ID NO: 1333567 - protein, 22 aa, Mycobacterium
FSKYAKALGFYCDCAVLRDSPL

SEQ ID NO: 1333568 - protein, 17 aa, Mycobacterium
FSLWLLRVSRVRWVGGY

SEQ ID NO: 1333569 - protein, 18 aa, Mycobacterium
FSMPWSHPVGRMREFVAA

SEQ ID NO: 1333570 - protein, 20 aa, Mycobacterium
FTALPFDHLFFTGSPAVGVH

SEQ ID NO: 1333571 - protein, 18 aa, Mycobacterium
FTGWHRLEYLLFSQNTTE

SEQ ID NO: 1333572 - protein, 17 aa, Mycobacterium
FTLRCYLDDQPIFLGRN

SEQ ID NO: 1333573 - protein, 19 aa, Mycobacterium
FVGEFLHPLIGWPVDHDAA

SEQ ID NO: 1333574 - protein, 18 aa, Mycobacterium
FVLLPDLTADLALTPAAV

SEQ ID NO: 1333575 - protein, 21 aa, Mycobacterium
FVPLRVHVLVRFGRWDELIAT

SEQ ID NO: 1333576 - protein, 28 aa, Mycobacterium
FVSTYGWRAYALPLLVALTAVVIFQTIT

SEQ ID NO: 1333577 - protein, 19 aa, Mycobacterium
FVVELLDAASFWESVRSGM

SEQ ID NO: 1333578 - protein, 18 aa, Mycobacterium
FVVTPLVHLAHALPFVGE

SEQ ID NO: 1333579 - protein, 17 aa, Mycobacterium
FVYALDWPGESPLRPSY

SEQ ID NO: 1333580 - protein, 17 aa, Mycobacterium
FWEPLARWQPPLLVVRS

SEQ ID NO: 1333581 - protein, 24 aa, Mycobacterium
FWFDPLCPWAWITSRWVLEVEKVR

SEQ ID NO: 1333582 - protein, 18 aa, Mycobacterium
FWLWLDAGFEDRAIEAWI

SEQ ID NO: 1333583 - protein, 25 aa, Mycobacterium
FYKWTQWIFLQIYNAWFDTAQNKAR

SEQ ID NO: 1333584 - protein, 22 aa, Mycobacterium
FYRGLTFYRYPVIGDSLFTRTE

SEQ ID NO: 1333585 - protein, 23 aa, Mycobacterium
GAAHFLEHLLFKATPTRTAVQIA

SEQ ID NO: 1333586 - protein, 22 aa, Mycobacterium
GAAIKILWLPGPDPEPHYRPSA

SEQ ID NO: 1333587 - protein, 17 aa, Mycobacterium
GACIFLNRPGWPKGIGC

SEQ ID NO: 1333588 - protein, 23 aa, Mycobacterium
GADRPIQWWRSDGWLCPYGPLAV

SEQ ID NO: 1333589 - protein, 19 aa, Mycobacterium
GAFLGLWQPTGHRGYGIVG

SEQ ID NO: 1333590 - protein, 24 aa, Mycobacterium
GAGGAMLPLLLFASARAAVPVTPL

SEQ ID NO: 1333591 - protein, 18 aa, Mycobacterium
GAGKSTLLMLIAGLLRPD

SEQ ID NO: 1333592 - protein, 18 aa, Mycobacterium
GAGVVNPLRWRPHPWGED

SEQ ID NO: 1333593 - protein, 17 aa, Mycobacterium
GAGYFVLVFAKGAFPAE

SEQ ID NO: 1333594 - protein, 25 aa, Mycobacterium
GAKRTHWIWFVFPQLRGLGHSATAY

SEQ ID NO: 1333595 - protein, 24 aa, Mycobacterium
GALLAAFPRYHPRWAWGLTKVPGL

SEQ ID NO: 1333596 - protein, 22 aa, Mycobacterium
GALVFWRLIALGKPVSARHLDR

SEQ ID NO: 1333597 - protein, 20 aa, Mycobacterium
GALWLIPLRGPRSGGLLLKQ

SEQ ID NO: 1333598 - protein, 18 aa, Mycobacterium
GAMGFKFQFITLAGFHAL

SEQ ID NO: 1333599 - protein, 22 aa, Mycobacterium
GAMGFKFQFITLAGFHALNYSM

SEQ ID NO: 1333600 - protein, 18 aa, Mycobacterium
GARKPGSAIWFKGGPRPG

SEQ ID NO: 1333601 - protein, 20 aa, Mycobacterium
GARRLVIVPWFLAHGRITDR

SEQ ID NO: 1333602 - protein, 25 aa, Mycobacterium
GASAVPWHWRLTLKGWPGLNTRGLV

SEQ ID NO: 1333603 - protein, 24 aa, Mycobacterium
GASPMPLPLLRQALQAWPNTDFMQ

SEQ ID NO: 1333604 - protein, 20 aa, Mycobacterium
GAVPLFVIGGSLLGGWKGAD

SEQ ID NO: 1333605 - protein, 21 aa, Mycobacterium
GAYICVYPFVRSLEWYLLPDE

SEQ ID NO: 1333606 - protein, 21 aa, Mycobacterium
GAYTQLPFKLAWAITIHKSQG

SEQ ID NO: 1333607 - protein, 26 aa, Mycobacterium
GDADFYTDLLFYHLRLRCFVVIELKI

SEQ ID NO: 1333608 - protein, 26 aa, Mycobacterium
GDAPQPPFLWALLSFARRELDNLFAA

SEQ ID NO: 1333609 - protein, 24 aa, Mycobacterium
GDATRLLYTLGWHEVPAPASGDAA

SEQ ID NO: 1333610 - protein, 18 aa, Mycobacterium
GDGRWWRRWAARHAPTHP

SEQ ID NO: 1333611 - protein, 19 aa, Mycobacterium
GDKSNWWAAYALWVFTLFG

SEQ ID NO: 1333612 - protein, 22 aa, Mycobacterium
GDLPLVLALFYLVVDRRTTPLL

SEQ ID NO: 1333613 - protein, 24 aa, Mycobacterium
GDLRGRFRWWGLYTQRKPGYDGTW

SEQ ID NO: 1333614 - protein, 23 aa, Mycobacterium
GDPKLTWHFPVRPIGPSQIVEQW

SEQ ID NO: 1333615 - protein, 29 aa, Mycobacterium
GDRGVSWLPFFHDMGLITVLLPTVIGHYV

SEQ ID NO: 1333616 - protein, 18 aa, Mycobacterium
GDRHRDALPHAPRLTVIG

SEQ ID NO: 1333617 - protein, 23 aa, Mycobacterium
GDRTYLLEYPISGDFALIAADTA

SEQ ID NO: 1333618 - protein, 18 aa, Mycobacterium
GDRYAFAELFVRHQRQLE

SEQ ID NO: 1333619 - protein, 19 aa, Mycobacterium
GDVPLLDTYLAVANYLLIP

SEQ ID NO: 1333620 - protein, 22 aa, Mycobacterium
GDYMNQFIVFDFTISRLKSGIF

SEQ ID NO: 1333621 - protein, 25 aa, Mycobacterium
GEAKLETICRLIMLYHLDRAWADHL

SEQ ID NO: 1333622 - protein, 25 aa, Mycobacterium
GEEVAPWLDLVRKLGLLVGVLSSEP

SEQ ID NO: 1333623 - protein, 23 aa, Mycobacterium
GEKPWLPHFYLGHGIGTSAAEMP

SEQ ID NO: 1333624 - protein, 22 aa, Mycobacterium
GELPLWWDQFVANGFHAVHLPE

SEQ ID NO: 1333625 - protein, 25 aa, Mycobacterium
GEPLFMAGLWTTWRPRDAPKEAPPL

SEQ ID NO: 1333626 - protein, 21 aa, Mycobacterium
GEPLLSFLRKMVFWADVVVEP

SEQ ID NO: 1333627 - protein, 17 aa, Mycobacterium
GEPLPVMFFIHGGGYIL

SEQ ID NO: 1333628 - protein, 23 aa, Mycobacterium
GERFTVLRPLLFTIAYEILGSAT

SEQ ID NO: 1333629 - protein, 17 aa, Mycobacterium
GERLFEIYAPGRALPAA

SEQ ID NO: 1333630 - protein, 23 aa, Mycobacterium
GETLEEYWWAAEQMLTWEGKPAN

SEQ ID NO: 1333631 - protein, 19 aa, Mycobacterium
GEVPLGTLIDLLAAFHDVD

SEQ ID NO: 1333632 - protein, 21 aa, Mycobacterium
GEWLKRFFVIDEVRFSDVVLA

SEQ ID NO: 1333633 - protein, 18 aa, Mycobacterium
GFDAPPLHTLYLDRPLKG

SEQ ID NO: 1333634 - protein, 17 aa, Mycobacterium
GFDIWRQRAAFLEAAVG

SEQ ID NO: 1333635 - protein, 17 aa, Mycobacterium
GFDLMFAAPKSVSLLRS

SEQ ID NO: 1333636 - protein, 19 aa, Mycobacterium
GFFLTQHDIDWFRARYLGG

SEQ ID NO: 1333637 - protein, 25 aa, Mycobacterium
GFGAPAHRVWLPPLSRAPALDAVLS

SEQ ID NO: 1333638 - protein, 19 aa, Mycobacterium
GFHQLAWWVDDYDAALRSA

SEQ ID NO: 1333639 - protein, 17 aa, Mycobacterium
GFKFQFITLAGFHALNY

SEQ ID NO: 1333640 - protein, 31 aa, Mycobacterium; identical to SEQ ID NO: 883566

SEQ ID NO: 1333641 - protein, 17 aa, Mycobacterium
GFRRLIDNLIDFPKPLV

SEQ ID NO: 1333642 - protein, 18 aa, Mycobacterium
GFVSRICGWLLGIAHHFQ

SEQ ID NO: 1333643 - protein, 19 aa, Mycobacterium
GGAWQSFWAAGSYIGGTCT

SEQ ID NO: 1333644 - protein, 24 aa, Mycobacterium
GGDGGLGGLGGFGGVGGTGGQGGQ

SEQ ID NO: 1333645 - protein, 17 aa, Mycobacterium
GGDMIAALFSAIETNPT

SEQ ID NO: 1333646 - protein, 19 aa, Mycobacterium
GGFLSSLKVRACKFPDGGT

SEQ ID NO: 1333647 - protein, 25 aa, Mycobacterium
GGGPDPVRVFWPLMSAQLWDTNGAW

SEQ ID NO: 1333648 - protein, 24 aa, Mycobacterium
GGKDDWFWIKVPVGYLYTIANPRT

SEQ ID NO: 1333649 - protein, 27 aa, Mycobacterium
GGNGGNGGRGSLFGRGGNAGNGGNGGT

SEQ ID NO: 1333650 - protein, 26 aa, Mycobacterium
GGNNNWFAAYAYWYFKLYGHQDVKLL

SEQ ID NO: 1333651 - protein, 20 aa, Mycobacterium
GGPWFQWHFDRWTPPPGATE

SEQ ID NO: 1333652 - protein, 22 aa, Mycobacterium
GGRDEIWRFTPLKRLRGLHDGS

SEQ ID NO: 1333653 - protein, 29 aa, Mycobacterium
GGTGQGVTGFLALPHRYNISGDGGDGGNG

SEQ ID NO: 1333654 - protein, 24 aa, Mycobacterium
GGTYNLFHYTLPKLGIEVSFVENP

SEQ ID NO: 1333655 - protein, 17 aa, Mycobacterium
GGWFWPAAAAHPSLPRG

SEQ ID NO: 1333656 - protein, 22 aa, Mycobacterium
GHDLDMRTLFPLPADRPVDPAT

SEQ ID NO: 1333657 - protein, 29 aa, Mycobacterium
GHGEEPGPLPWYKRPPVLFGAAAAAALAA

SEQ ID NO: 1333658 - protein, 20 aa, Mycobacterium
GHVLFAWHLPELWRRFTITM

SEQ ID NO: 1333659 - protein, 20 aa, Mycobacterium
GHYDGLLAWLRGLVRTGYVA

SEQ ID NO: 1333660 - protein, 18 aa, Mycobacterium
GHYYFYRLIGPSATYLEG

SEQ ID NO: 1333661 - protein, 24 aa, Mycobacterium
GIADNLVRFLGALALAGPVAKLQQ

SEQ ID NO: 1333662 - protein, 18 aa, Mycobacterium
GIPAMKWTTQLTYAADGL

SEQ ID NO: 1333663 - protein, 25 aa, Mycobacterium
GKHSAIAALPWFWSDQYDLKLQIAG

SEQ ID NO: 1333664 - protein, 21 aa, Mycobacterium
GKPLLLNIFPSIDTPVCAASV

SEQ ID NO: 1333665 - protein, 23 aa, Mycobacterium
GKPVMGWLFQRFLHNLRRYTDER

SEQ ID NO: 1333666 - protein, 24 aa, Mycobacterium
GKQDFGQWMFFGLGQALVGAAITV

SEQ ID NO: 1333667 - protein, 19 aa, Mycobacterium
GKVRVIIPARWNFLNVVRP

SEQ ID NO: 1333668 - protein, 25 aa, Mycobacterium
GKYYSGVKWTWYRPIYAGRPVLVEN

SEQ ID NO: 1333669 - protein, 18 aa, Mycobacterium
GLAAAWWHGLTRFAPEQV

SEQ ID NO: 1333670 - protein, 22 aa, Mycobacterium
GLAAWLVLSSEALHAGAREALS

SEQ ID NO: 1333671 - protein, 25 aa, Mycobacterium
GLASWYMYFFQLPYVPELLLTRRRG

SEQ ID NO: 1333672 - protein, 20 aa, Mycobacterium
GLDLLPRLLIRDGDLDLAVV

SEQ ID NO: 1333673 - protein, 22 aa, Mycobacterium
GLDSRAFRLPWPAGTTVFEIDQ

SEQ ID NO: 1333674 - protein, 24 aa, Mycobacterium
GLDVPGIVWLRELLRRLAADGRTL

SEQ ID NO: 1333675 - protein, 19 aa, Mycobacterium
GLEYILAFLGSMQAGLVAV

SEQ ID NO: 1333676 - protein, 17 aa, Mycobacterium
GLFTLLAARHAGARVVV

SEQ ID NO: 1333677 - protein, 18 aa, Mycobacterium
GLGLPFFAQSMYMIADGL

SEQ ID NO: 1333678 - protein, 17 aa, Mycobacterium
GLHVLVFGPFRALRLAT

SEQ ID NO: 1333679 - protein, 25 aa, Mycobacterium
GLIGRLLVPPVVPAGPPTPTPLALA

SEQ ID NO: 1333680 - protein, 25 aa, Mycobacterium
GLIKAAWIDTWRLPAAPPGTVKIVV

SEQ ID NO: 1333681 - protein, 19 aa, Mycobacterium
GLIYLQHGMLASASFYSAT

SEQ ID NO: 1333682 - protein, 18 aa, Mycobacterium
GLLDFELKRLGFVTAMPL

SEQ ID NO: 1333683 - protein, 22 aa, Mycobacterium
GLPPLRLNLPTPEEFIASIPAP

SEQ ID NO: 1333684 - protein, 21 aa, Mycobacterium
GLSCFFLPRILPDGSRNRMFL

SEQ ID NO: 1333685 - protein, 20 aa, Mycobacterium
GLWHVIPLRFDDQALVQCLA

SEQ ID NO: 1333686 - protein, 19 aa, Mycobacterium
GMCGVEFFGHPWEFGPRKA

SEQ ID NO: 1333687 - protein, 23 aa, Mycobacterium
GMGAYTPLPWLPADVTRRIVDEI

SEQ ID NO: 1333688 - protein, 18 aa, Mycobacterium
GMGRALIAPLRIGLREAG

SEQ ID NO: 1333689 - protein, 19 aa, Mycobacterium
GMLFSPGYPGFLRGVTAVG

SEQ ID NO: 1333690 - protein, 30 aa, Mycobacterium
GMTETLYLMPWSTMFPLGISSATIGIAEGA

SEQ ID NO: 1333691 - protein, 19 aa, Mycobacterium
GMTWLPLYHDMGLTFLLTG

SEQ ID NO: 1333692 - protein, 18 aa, Mycobacterium
GMYRNKCWLPYPGDDVLL

SEQ ID NO: 1333693 - protein, 22 aa, Mycobacterium
GNAGIFDYFAPLVGFDGADLSS

SEQ ID NO: 1333694 - protein, 23 aa, Mycobacterium
GNVPILVQVLLRLSFALNSIGDL

SEQ ID NO: 1333695 - protein, 23 aa, Mycobacterium
GPAGPLPSFIPGGAAGGPLGTGF

SEQ ID NO: 1333696 - protein, 23 aa, Mycobacterium
GPALRLMNFNYLPLPFNAYLGPA

SEQ ID NO: 1333697 - protein, 20 aa, Mycobacterium
GPDRRYVMAISSLDPDDDAS

SEQ ID NO: 1333698 - protein, 24 aa, Mycobacterium
GPERILSTGPLLFAAIRALGAGPA

SEQ ID NO: 1333699 - protein, 20 aa, Mycobacterium
GPERRMLFLVSATDAYPERL

SEQ ID NO: 1333700 - protein, 18 aa, Mycobacterium
GPLATMGLFPPGSTFKIV

SEQ ID NO: 1333701 - protein, 25 aa, Mycobacterium
GPMDRFHRRLLWPIRTSAGEVIGFG

SEQ ID NO: 1333702 - protein, 18 aa, Mycobacterium
GPRRAAWAAALYLPKNYG

SEQ ID NO: 1333703 - protein, 18 aa, Mycobacterium
GPSKPLMPSTWGAAPTTA

SEQ ID NO: 1333704 - protein, 20 aa, Mycobacterium
GPWNFPVNLVVLPAAAAFAA

SEQ ID NO: 1333705 - protein, 23 aa, Mycobacterium
GQAGVAGKGGLFGGSGSAGTAGV

SEQ ID NO: 1333706 - protein, 20 aa, Mycobacterium
GQDMGLIPRARILATAVSGS

SEQ ID NO: 1333707 - protein, 28 aa, Mycobacterium
GQHISTLLLTLLFRFMKPLVENGHIFLA

SEQ ID NO: 1333708 - protein, 28 aa, Mycobacterium
GQIIPWNFPILMAVWKLAPALAAGNAIV

SEQ ID NO: 1333709 - protein, 21 aa, Mycobacterium
GQPMWSQWYPGRPLLVTANDY

SEQ ID NO: 1333710 - protein, 26 aa, Mycobacterium
GQQRRLQLLLILLSQPNVLILDEPTN

SEQ ID NO: 1333711 - protein, 25 aa, Mycobacterium
GQRGAWLLRPFHESLLWYDARKESA

SEQ ID NO: 1333712 - protein, 21 aa, Mycobacterium
GQSSLYYWFRSKDAILRGIMN

SEQ ID NO: 1333713 - protein, 17 aa, Mycobacterium
GQYVVGRLIWNAGLLAP

SEQ ID NO: 1333714 - protein, 22 aa, Mycobacterium
GRAYYGFSTLLCTPSSLAQPVG

SEQ ID NO: 1333715 - protein, 18 aa, Mycobacterium
GRDYVLEYPIFGDVALIG

SEQ ID NO: 1333716 - protein, 18 aa, Mycobacterium
GRIPKIQPVLPLPGEHRQ

SEQ ID NO: 1333717 - protein, 25 aa, Mycobacterium
GRLAYLLGEVGGNIPIVALFVRNGS

SEQ ID NO: 1333718 - protein, 18 aa, Mycobacterium
GRLLIVDCGVLFPTHDEP

SEQ ID NO: 1333719 - protein, 20 aa, Mycobacterium
GRPHTLLLLTLLSDVGPDDA

SEQ ID NO: 1333720 - protein, 17 aa, Mycobacterium
GRSWPLADVRLLAPILA

SEQ ID NO: 1333721 - protein, 25 aa, Mycobacterium
GRTRFRPHFFPFTEPSAEVDIWFPN

SEQ ID NO: 1333722 - protein, 23 aa, Mycobacterium
GRVDLYWRAILFRIDDKSSGTTY

SEQ ID NO: 1333723 - protein, 17 aa, Mycobacterium
GRWWALIRVAAAGRLVY

SEQ ID NO: 1333724 - protein, 18 aa, Mycobacterium
GSDLYWNLSLWSDYNVML

SEQ ID NO: 1333725 - protein, 26 aa, Mycobacterium
GSEALALLRLPLVLPALQVLGRVSGT

SEQ ID NO: 1333726 - protein, 24 aa, Mycobacterium
GSFVSYFGWLYEWGAPVTLIGESP

SEQ ID NO: 1333727 - protein, 23 aa, Mycobacterium
GSGFIPPGVFLPSSARLVFSDPG

SEQ ID NO: 1333728 - protein, 23 aa, Mycobacterium
GSTRGWFMDWLARTYPDLVGEYR

SEQ ID NO: 1333729 - protein, 20 aa, Mycobacterium
GTFLLFDHDWAPPAAKLRSY

SEQ ID NO: 1333730 - protein, 23 aa, Mycobacterium
GTLATWLVFVLNTALGSLDRLGG

SEQ ID NO: 1333731 - protein, 17 aa, Mycobacterium
GTPFFPTLPSWISLRLL

SEQ ID NO: 1333732 - protein, 22 aa, Mycobacterium
GTPMPRALFWAIQEHILGANPA

SEQ ID NO: 1333733 - protein, 19 aa, Mycobacterium
GTRVLLQWTGVAARPAPSH

SEQ ID NO: 1333734 - protein, 18 aa, Mycobacterium
GTRYLPPFPYFTDKPEAQ

SEQ ID NO: 1333735 - protein, 26 aa, Mycobacterium
GVDYLDLYLIHWPVPEKNLFVDTFRA

SEQ ID NO: 1333736 - protein, 24 aa, Mycobacterium
GVELTWPPGWSRWPSRRYGDTRLD

SEQ ID NO: 1333737 - protein, 25 aa, Mycobacterium
GVEPKPLKGMPPFSGPQGPFAGVTS

SEQ ID NO: 1333738 - protein, 18 aa, Mycobacterium
GVFLLTRALVPLLEAAAT

SEQ ID NO: 1333739 - protein, 24 aa, Mycobacterium
GVGAKSLFLLLFTSGTTGTSKAVR

SEQ ID NO: 1333740 - protein, 29 aa, Mycobacterium
GVHANPFTLFPRIIVSMAWLPGPRAQRQL

SEQ ID NO: 1333741 - protein, 30 aa, Mycobacterium
GVHANPFTLFPRIIVSMAWLPGPRAQRQLR

SEQ ID NO: 1333742 - protein, 20 aa, Mycobacterium
GVIFYLWRTAGMSVEDIEAM

SEQ ID NO: 1333743 - protein, 17 aa, Mycobacterium
GVLGKVRFLYFSPREYL

SEQ ID NO: 1333744 - protein, 22 aa, Mycobacterium
GVMPWNFPVYQVARFAAPNLVL

SEQ ID NO: 1333745 - protein, 19 aa, Mycobacterium
GVMSWWSIQPHGGVYGGRT

SEQ ID NO: 1333746 - protein, 25 aa, Mycobacterium
GVNGQLFIVYGPKVTLVAAPVAEAH

SEQ ID NO: 1333747 - protein, 23 aa, Mycobacterium
GVNLTYLPFIARAVIDALKIHPN

SEQ ID NO: 1333748 - protein, 26 aa, Mycobacterium
GVSKALFYFYFPRKEDVLFEVGVLST

SEQ ID NO: 1333749 - protein, 25 aa, Mycobacterium
GVSKALFYFYFPRKEDVLFEVGVMS

SEQ ID NO: 1333750 - protein, 17 aa, Mycobacterium
GVTLAQLRRALPGAVFV

SEQ ID NO: 1333751 - protein, 21 aa, Mycobacterium
GVVRPDLVIGWWAVPTILEHG

SEQ ID NO: 1333752 - protein, 19 aa, Mycobacterium
GWRISIPAMMSYWSELARP

SEQ ID NO: 1333753 - protein, 20 aa, Mycobacterium
GYRGFWMGYFAARSAPLGRV

SEQ ID NO: 1333754 - protein, 24 aa, Mycobacterium
GYSWGPLAWMLLAQALGRLDQTVD

SEQ ID NO: 1333755 - protein, 23 aa, Mycobacterium
GYVLRRLLRRIIRAAKLLGVDDP

SEQ ID NO: 1333756 - protein, 18 aa, Mycobacterium
HAFFRQYYNLRALLRRSD

SEQ ID NO: 1333757 - protein, 20 aa, Mycobacterium
HAPFRIGYLERDAWLRCMHT

SEQ ID NO: 1333758 - protein, 21 aa, Mycobacterium
HAQRDLPWRRPGVSAWQILVS

SEQ ID NO: 1333759 - protein, 22 aa, Mycobacterium
HATGKWLRQLPITLEALLGPRD

SEQ ID NO: 1333760 - protein, 22 aa, Mycobacterium
HATYLAECLLLGSGVPTTDRHE

SEQ ID NO: 1333761 - protein, 25 aa, Mycobacterium
HCLDMPGLFVWRRYHPTPAPERGVV

SEQ ID NO: 1333762 - protein, 17 aa, Mycobacterium
HDHAWSYVFLASHRSRG

SEQ ID NO: 1333763 - protein, 21 aa, Mycobacterium
HDLHLFLRRVALYRAMFGSPE

SEQ ID NO: 1333764 - protein, 17 aa, Mycobacterium
HDLTWPLIADATLDAVL

SEQ ID NO: 1333765 - protein, 23 aa, Mycobacterium
HEGLTMFLVPLNAPGITMRRIKE

SEQ ID NO: 1333766 - protein, 25 aa, Mycobacterium
HERSLNIDFLLGYLRELLPRRPDLK

SEQ ID NO: 1333767 - protein, 26 aa, Mycobacterium
HERSLNIDFLLGYLRQLLPRRPDLKV

SEQ ID NO: 1333768 - protein, 26 aa, Mycobacterium
HESLNMAVLWRLPVLFCCENNLYAMG

SEQ ID NO: 1333769 - protein, 18 aa, Mycobacterium
HFALAPRGVLFLGHAEML

SEQ ID NO: 1333770 - protein, 19 aa, Mycobacterium
HFVALPRFPDPAAALAHGS

SEQ ID NO: 1333771 - protein, 18 aa, Mycobacterium
HGFILAGPDLRDVSGWML

SEQ ID NO: 1333772 - protein, 17 aa, Mycobacterium
HGFILAGPDLRDVSGWT

SEQ ID NO: 1333773 - protein, 17 aa, Mycobacterium
HGKAPRLWLVTQGGLVV

SEQ ID NO: 1333774 - protein, 19 aa, Mycobacterium
HGLGHRRVLPGHGPELDDV

SEQ ID NO: 1333775 - protein, 22 aa, Mycobacterium
HGLNLMRRLGLPVPPAFCLTTD

SEQ ID NO: 1333776 - protein, 17 aa, Mycobacterium
HGLPFPGVLPGFGHVGL

SEQ ID NO: 1333777 - protein, 17 aa, Mycobacterium
HGPRFAVARGLIAMYAA

SEQ ID NO: 1333778 - protein, 23 aa, Mycobacterium
HGVWLRPFRNLVYVMPPYICTAA

SEQ ID NO: 1333779 - protein, 18 aa, Mycobacterium
HGWIHNELRRRCGGPPVA

SEQ ID NO: 1333780 - protein, 19 aa, Mycobacterium
HIDKWRFTVPFVCGATNLG

SEQ ID NO: 1333781 - protein, 17 aa, Mycobacterium
HIDYWWSAALASMRARP

SEQ ID NO: 1333782 - protein, 24 aa, Mycobacterium
HIYARIHRRWPFKLVRLAAETVAR

SEQ ID NO: 1333783 - protein, 21 aa, Mycobacterium
HKSLTMFLVPLDSPGVEIQGI

SEQ ID NO: 1333784 - protein, 19 aa, Mycobacterium
HLASKHRFVAAQFAGLFEG

SEQ ID NO: 1333785 - protein, 22 aa, Mycobacterium
HLAYDLLEPWDLLVLVDALPDR

SEQ ID NO: 1333786 - protein, 23 aa, Mycobacterium
HLELITLVPLPRKLSADLFRLPM

SEQ ID NO: 1333787 - protein, 20 aa, Mycobacterium
HLTSDLPLLVIWGDEDRIIP

SEQ ID NO: 1333788 - protein, 18 aa, Mycobacterium
HLTTLFPPVRPRGFLEVR

SEQ ID NO: 1333789 - protein, 18 aa, Mycobacterium
HLYNFWRDATNPKGLWRR

SEQ ID NO: 1333790 - protein, 30 aa, Mycobacterium; identical to SEQ ID NO: 884403

SEQ ID NO: 1333791 - protein, 19 aa, Mycobacterium
HPALKIGWFEGGIAWVPTA

SEQ ID NO: 1333792 - protein, 25 aa, Mycobacterium
HPDDPRGWLITTAWRRFVDLVRADA

SEQ ID NO: 1333793 - protein, 20 aa, Mycobacterium
HPEWVIPVRWTPTHDLPPLE

SEQ ID NO: 1333794 - protein, 17 aa, Mycobacterium
HPLIGWPVDHDAAPGDP

SEQ ID NO: 1333795 - protein, 27 aa, Mycobacterium
HPRGMRAVAWSWLSLGPVGGAGSLLGA

SEQ ID NO: 1333796 - protein, 17 aa, Mycobacterium
HPRLMPDFWEFPTVSMG

SEQ ID NO: 1333797 - protein, 17 aa, Mycobacterium
HPRWAWWTNAVPGLREF

SEQ ID NO: 1333798 - protein, 17 aa, Mycobacterium
HPTSTAIFIYFLGPDNL

SEQ ID NO: 1333799 - protein, 26 aa, Mycobacterium
HPYAHLRAFVLMPWLAAEPEATLTVA

SEQ ID NO: 1333800 - protein, 27 aa, Mycobacterium
HQLASLDVPVPFWFRAPGECPGTYAAE

SEQ ID NO: 1333801 - protein, 23 aa, Mycobacterium
HQLHGLPLPTRRLLALAAAEPAG

SEQ ID NO: 1333802 - protein, 21 aa, Mycobacterium
HQSLTMFLVPLGSAGIEIQGI

SEQ ID NO: 1333803 - protein, 23 aa, Mycobacterium
HRGCWLRVVLRFLPPGGAEPDSL

SEQ ID NO: 1333804 - protein, 25 aa, Mycobacterium
HRLAVLWPEVYPRLLRIMDADPLCQ

SEQ ID NO: 1333805 - protein, 21 aa, Mycobacterium
HSHYWLSGQVGWLAADRWAVP

SEQ ID NO: 1333806 - protein, 20 aa, Mycobacterium
HTLWQAWHRSGLQKRWLAAS

SEQ ID NO: 1333807 - protein, 18 aa, Mycobacterium
HTVGKYAESLLTLGWAEE

SEQ ID NO: 1333808 - protein, 24 aa, Mycobacterium
HVDPSMVLYLFGSKLDLFRESLRL

SEQ ID NO: 1333809 - protein, 23 aa, Mycobacterium
HVHAHYATYPALAAWVCRRLAGI

SEQ ID NO: 1333810 - protein, 21 aa, Mycobacterium
HVIWWQIYPLGFVGAFPADPP

SEQ ID NO: 1333811 - protein, 19 aa, Mycobacterium
HVNPRHRVDLPLTAREVVL

SEQ ID NO: 1333812 - protein, 18 aa, Mycobacterium
HVPWFPKDVPAWSVRWVF

SEQ ID NO: 1333813 - protein, 20 aa, Mycobacterium
HVTTLAWLSLGPTGSNAQAE

SEQ ID NO: 1333814 - protein, 19 aa, Mycobacterium
HVTTLAWLSLGPTGSNNEA

SEQ ID NO: 1333815 - protein, 17 aa, Mycobacterium
HVVTLVRFLASPASEGV

SEQ ID NO: 1333816 - protein, 21 aa, Mycobacterium
HVVWWQVYPLGFVGAYPADPP

SEQ ID NO: 1333817 - protein, 17 aa, Mycobacterium
HWFLPTYGDSRLIVGGG

SEQ ID NO: 1333818 - protein, 18 aa, Mycobacterium
HWLGIRKIHRFVSMSNMK

SEQ ID NO: 1333819 - protein, 22 aa, Mycobacterium
HWQTAAVLFGIWWIGAEAVLSG

SEQ ID NO: 1333820 - protein, 20 aa, Mycobacterium
HYFDHPLLVEMFAESIGVAA

SEQ ID NO: 1333821 - protein, 17 aa, Mycobacterium
HYTRRWLQKMTAIELDK

SEQ ID NO: 1333822 - protein, 23 aa, Mycobacterium
IAARAHALGLRKVPRYLPMVVRV

SEQ ID NO: 1333823 - protein, 18 aa, Mycobacterium
IAAYAGGLVPILCLTKTD

SEQ ID NO: 1333824 - protein, 17 aa, Mycobacterium
IAEGLLIYLPPDAQDRL

SEQ ID NO: 1333825 - protein, 17 aa, Mycobacterium
IAELAAMMPMRVIGMLL

SEQ ID NO: 1333826 - protein, 21 aa, Mycobacterium
IAFSAILHHPIRYIMKYWKDE

SEQ ID NO: 1333827 - protein, 18 aa, Mycobacterium
IALALLKRGLPADTALTT

SEQ ID NO: 1333828 - protein, 18 aa, Mycobacterium
IALGYPWPPTIPERVLRN

SEQ ID NO: 1333829 - protein, 18 aa, Mycobacterium
IALLSRFPAETWQVVRLP

SEQ ID NO: 1333830 - protein, 23 aa, Mycobacterium
IALPRVWAFNMPVAYKRFADIAQ

SEQ ID NO: 1333831 - protein, 19 aa, Mycobacterium
IAPPPPPPPPGAPPGLPPP

SEQ ID NO: 1333832 - protein, 17 aa, Mycobacterium
IAPWSRCSRRRGVSTCR

SEQ ID NO: 1333833 - protein, 18 aa, Mycobacterium
IARTRLTLATPGMGALMA

SEQ ID NO: 1333834 - protein, 19 aa, Mycobacterium
ICLPTTYHLLRTLVHEGYL

SEQ ID NO: 1333835 - protein, 23 aa, Mycobacterium
IDDLARYPLVYFIDSMLQVDDLD

SEQ ID NO: 1333836 - protein, 19 aa, Mycobacterium
IDLLKGVLMPAIMSAVKPP

SEQ ID NO: 1333837 - protein, 21 aa, Mycobacterium
IDNWRWAGVPIYLRTGKKMAE

SEQ ID NO: 1333838 - protein, 22 aa, Mycobacterium
IDPRTRWLLRELVYALLVKKDH

SEQ ID NO: 1333839 - protein, 18 aa, Mycobacterium
IDSLWLYDHLYGPGMPDY

SEQ ID NO: 1333840 - protein, 17 aa, Mycobacterium
IDTPLIFLQNTTGFMVG

SEQ ID NO: 1333841 - protein, 18 aa, Mycobacterium
IDTPLIFLQNTTGFMVGA

SEQ ID NO: 1333842 - protein, 17 aa, Mycobacterium
IEFLWFEDLGDGRSRLR

SEQ ID NO: 1333843 - protein, 18 aa, Mycobacterium
IEKAFPGRFLLGIGVGHP

SEQ ID NO: 1333844 - protein, 20 aa, Mycobacterium
IELDGLRLITWRGAARADQG

SEQ ID NO: 1333845 - protein, 22 aa, Mycobacterium
IEVTPVRVLWWPGGNLDHRPQL

SEQ ID NO: 1333846 - protein, 18 aa, Mycobacterium
IFDIDKMLYFVSPEWWRP

SEQ ID NO: 1333847 - protein, 17 aa, Mycobacterium
IFLQNVTGFMVGAEYEQ

SEQ ID NO: 1333848 - protein, 18 aa, Mycobacterium
IFPTMFRKALRKMAERRL

SEQ ID NO: 1333849 - protein, 23 aa, Mycobacterium
IFPTQYRLPDYYRWLLYDADHGP

SEQ ID NO: 1333850 - protein, 19 aa, Mycobacterium
IFTWHLAIAMRPKLWMFNS

SEQ ID NO: 1333851 - protein, 21 aa, Mycobacterium
IGDLPFLYQPGMLSAAWGVGV

SEQ ID NO: 1333852 - protein, 23 aa, Mycobacterium
IGFVFQRFHLIPRLTVVHNVVHG

SEQ ID NO: 1333853 - protein, 19 aa, Mycobacterium
IGKFRLVFLTGPKGADGGA

SEQ ID NO: 1333854 - protein, 17 aa, Mycobacterium
IGRLRRPLLTPAADDRD

SEQ ID NO: 1333855 - protein, 20 aa, Mycobacterium
IGSLWLYDHLYGPGAPDYPS

SEQ ID NO: 1333856 - protein, 21 aa, Mycobacterium
IGVTVEHPLWLSTMRARSWVD

SEQ ID NO: 1333857 - protein, 25 aa, Mycobacterium
IGWDTPIVSKLPWFALSDPAVTQMV

SEQ ID NO: 1333858 - protein, 19 aa, Mycobacterium
IHILRQRPEWRRQLLADIV

SEQ ID NO: 1333859 - protein, 18 aa, Mycobacterium
IHVYLKRATLNRALFGSP

SEQ ID NO: 1333860 - protein, 20 aa, Mycobacterium
IIARLIEWVAFTPLQNATGE

SEQ ID NO: 1333861 - protein, 26 aa, Mycobacterium
IIFVERSLLSVLWPLADQLPEVRYFV

SEQ ID NO: 1333862 - protein, 18 aa, Mycobacterium
IIGAWNFPFALTLGPAVG

SEQ ID NO: 1333863 - protein, 25 aa, Mycobacterium
IISDFLGPINWMRPLRAIAGRHEVL

SEQ ID NO: 1333864 - protein, 25 aa, Mycobacterium
IKDALTPTLLFPFAAPRVGGDLSDA

SEQ ID NO: 1333865 - protein, 17 aa, Mycobacterium
ILDYWGIIKADIGIRDG

SEQ ID NO: 1333866 - protein, 17 aa, Mycobacterium
ILGYWLASQAPPAMRLC

SEQ ID NO: 1333867 - protein, 25 aa, Mycobacterium
ILIYHGWYLLYRYWPTSHSTHKFEA

SEQ ID NO: 1333868 - protein, 22 aa, Mycobacterium
ILKAIWALIGYDLPLPLPRISH

SEQ ID NO: 1333869 - protein, 20 aa, Mycobacterium
ILKFMPNFMFNPAPYPEIGT

SEQ ID NO: 1333870 - protein, 17 aa, Mycobacterium
ILWADMPTLPLYRQQRT

SEQ ID NO: 1333871 - protein, 17 aa, Mycobacterium
IMDLWKCLLPHDQWLVV

SEQ ID NO: 1333872 - protein, 24 aa, Mycobacterium
INCPGWVGVLRWLKSLLSTPIGEQ

SEQ ID NO: 1333873 - protein, 18 aa, Mycobacterium
IPLDDALRPKWLFGATVH

SEQ ID NO: 1333874 - protein, 18 aa, Mycobacterium
IPPGYIPPAGITGPMAPE

SEQ ID NO: 1333875 - protein, 19 aa, Mycobacterium
IPPKLAIPMRVIASIVAIS

SEQ ID NO: 1333876 - protein, 18 aa, Mycobacterium
IPVPMAYFSFGGWKASLF

SEQ ID NO: 1333877 - protein, 18 aa, Mycobacterium
IQAWTGEWWHYDPTNDAD

SEQ ID NO: 1333878 - protein, 19 aa, Mycobacterium
IQFHPTMLYAGHGGGRRPL

SEQ ID NO: 1333879 - protein, 18 aa, Mycobacterium
IRERGIDTVWFGAAAPLA

SEQ ID NO: 1333880 - protein, 19 aa, Mycobacterium
IRHWLQVFAQRFYSFSQFK

SEQ ID NO: 1333881 - protein, 20 aa, Mycobacterium
IRSRTHHYPFRLLAPKTMRT

SEQ ID NO: 1333882 - protein, 21 aa, Mycobacterium
IRSRTHHYPFRLLAPKTMRTL

SEQ ID NO: 1333883 - protein, 17 aa, Mycobacterium
IRWLALHGVIRGLSKVA

SEQ ID NO: 1333884 - protein, 23 aa, Mycobacterium
ISQLLYWTQVLMIARGLSPDDVY

SEQ ID NO: 1333885 - protein, 22 aa, Mycobacterium
ISRPTFYFYFASKDAVLLTLLE

SEQ ID NO: 1333886 - protein, 22 aa, Mycobacterium
ITDQHLDVPLYWQCWKLDSDTV

SEQ ID NO: 1333887 - protein, 17 aa, Mycobacterium
ITELLIETLKRLNMSWP

SEQ ID NO: 1333888 - protein, 17 aa, Mycobacterium
ITLYVTLMHFGGIIVPP

SEQ ID NO: 1333889 - protein, 19 aa, Mycobacterium
ITPWNYPLYQVVAKVLPAI

SEQ ID NO: 1333890 - protein, 23 aa, Mycobacterium
ITRTLLRDLLPPQLHRLDGIELA

SEQ ID NO: 1333891 - protein, 21 aa, Mycobacterium
ITVTGVFRYTDTWPAAIHLVN

SEQ ID NO: 1333892 - protein, 17 aa, Mycobacterium
IVFDFTISRLKSGIFLG

SEQ ID NO: 1333893 - protein, 18 aa, Mycobacterium
IVGLMRALANALAPHNIR

SEQ ID NO: 1333894 - protein, 19 aa, Mycobacterium
IVPAAVIFDLPVGGWKCRP

SEQ ID NO: 1333895 - protein, 20 aa, Mycobacterium
IVVLSLWEPGADKPVLVGLR

SEQ ID NO: 1333896 - protein, 19 aa, Mycobacterium
IVVNYDLPWAIIRLIQRAG

SEQ ID NO: 1333897 - protein, 17 aa, Mycobacterium
IWLITRGAQRVTATDTV

SEQ ID NO: 1333898 - protein, 18 aa, Mycobacterium
IWVFKQLWDKGLAYEGNR

SEQ ID NO: 1333899 - protein, 17 aa, Mycobacterium
IYLPFKPKRRTKAQIAR

SEQ ID NO: 1333900 - protein, 28 aa, Mycobacterium
KAAGLQYYRPWILLLTDGKPNLDGFDEA

SEQ ID NO: 1333901 - protein, 17 aa, Mycobacterium
KAFDMVFAEALWAELHD

SEQ ID NO: 1333902 - protein, 19 aa, Mycobacterium
KAQIYAWRKGIKTLYYIRL

SEQ ID NO: 1333903 - protein, 21 aa, Mycobacterium
KARQLWFDRILPLAENIRTGE

SEQ ID NO: 1333904 - protein, 17 aa, Mycobacterium
KATLYYYFAGKEDILAF

SEQ ID NO: 1333905 - protein, 26 aa, Mycobacterium
KAVSPWWIQRRLLLSGIRAISPAVDV

SEQ ID NO: 1333906 - protein, 25 aa, Mycobacterium
KCLCRFHHLLKTFWLGATGWHDRQH

SEQ ID NO: 1333907 - protein, 27 aa, Mycobacterium
KDGYGRNYLLPRGLAIVATRGAQRQAD

SEQ ID NO: 1333908 - protein, 23 aa, Mycobacterium
KDLLPLLEKVIQAGKPLLIIAED

SEQ ID NO: 1333909 - protein, 21 aa, Mycobacterium
KEIRHWLQVFAQRFYSFSQFK

SEQ ID NO: 1333910 - protein, 21 aa, Mycobacterium
KELIRAFWPGALSLVVRQAPS

SEQ ID NO: 1333911 - protein, 28 aa, Mycobacterium
KEPIGVCGLITPWNWPINQIACKVFPAL

SEQ ID NO: 1333912 - protein, 19 aa, Mycobacterium
KETLRLHPPLIILMRVAQG

SEQ ID NO: 1333913 - protein, 26 aa, Mycobacterium
KFDFPIPVLLRRLFARVPLLQRAFRF

SEQ ID NO: 1333914 - protein, 17 aa, Mycobacterium
KFLVAFRPGVLSPTLAA

SEQ ID NO: 1333915 - protein, 21 aa, Mycobacterium
KFVRQFPFNVLLKDLDWRVRT

SEQ ID NO: 1333916 - protein, 17 aa, Mycobacterium
KGPIPLTLLSAPPKKFC

SEQ ID NO: 1333917 - protein, 17 aa, Mycobacterium
KGRKVIVYFYPAASTPG

SEQ ID NO: 1333918 - protein, 20 aa, Mycobacterium
KGTVYLYWPTKEDLLIGLIG

SEQ ID NO: 1333919 - protein, 17 aa, Mycobacterium
KGTWNGLRAAAAVMREQ

SEQ ID NO: 1333920 - protein, 22 aa, Mycobacterium
KGYFQWSAMSWFALADAGFAPE

SEQ ID NO: 1333921 - protein, 17 aa, Mycobacterium
KGYPYTLVTDLIKPFVS

SEQ ID NO: 1333922 - protein, 23 aa, Mycobacterium
KHAWSCFFAPWLAEATIFVYNYG

SEQ ID NO: 1333923 - protein, 19 aa, Mycobacterium
KHKVVIIPGLQYKALTTGG

SEQ ID NO: 1333924 - protein, 17 aa, Mycobacterium
KHWTLLISLKRLAEVQT

SEQ ID NO: 1333925 - protein, 23 aa, Mycobacterium
KLDEEFIWYGRIPRAKLAGYVAD

SEQ ID NO: 1333926 - protein, 22 aa, Mycobacterium
KLFATVYKEYLMRALPAMASAV

SEQ ID NO: 1333927 - protein, 19 aa, Mycobacterium
KLMVLPPLMHGAAQWAVFT

SEQ ID NO: 1333928 - protein, 27 aa, Mycobacterium
KLPGLPPLRLNLPTPEQFIASIPAPVV

SEQ ID NO: 1333929 - protein, 20 aa, Mycobacterium
KLPPHLEWVAPFGALSAANW

SEQ ID NO: 1333930 - protein, 17 aa, Mycobacterium
KLRFLSWGAAPASDTLL

SEQ ID NO: 1333931 - protein, 21 aa, Mycobacterium
KLRQYFDHPLLIEMFADAIRD

SEQ ID NO: 1333932 - protein, 20 aa, Mycobacterium
KLTRPMVPLIVLAVPSSRGK

SEQ ID NO: 1333933 - protein, 25 aa, Mycobacterium
KMLYDNALLLRAYAHWARRTGAPLA

SEQ ID NO: 1333934 - protein, 23 aa, Mycobacterium
KPMPPLVVFKWGNVTSFPAFVTQ

SEQ ID NO: 1333935 - protein, 22 aa, Mycobacterium
KQTLRSLPWPAGAWSGARDAPV

SEQ ID NO: 1333936 - protein, 18 aa, Mycobacterium
KRHEILQLGLLKPKIAIL

SEQ ID NO: 1333937 - protein, 21 aa, Mycobacterium
KRLFARVPLLQRTVRLITDTI

SEQ ID NO: 1333938 - protein, 27 aa, Mycobacterium
KRLMDLIHLWLIHRFKAEIVYYVTPTE

SEQ ID NO: 1333939 - protein, 20 aa, Mycobacterium
KRMEIALTYIYGIGRTRSQE

SEQ ID NO: 1333940 - protein, 18 aa, Mycobacterium
KRQWFRPAVDMLVGLLAC

SEQ ID NO: 1333941 - protein, 19 aa, Mycobacterium
KRRFGYYVWPFLLDGDLVG

SEQ ID NO: 1333942 - protein, 24 aa, Mycobacterium
KRTSDLVPLCHPLAITGVDIDFTI

SEQ ID NO: 1333943 - protein, 20 aa, Mycobacterium
KRYKITAAWPKSLEISSLKA

SEQ ID NO: 1333944 - protein, 19 aa, Mycobacterium
KSDLVGAYLLIWTTTPWTL

SEQ ID NO: 1333945 - protein, 19 aa, Mycobacterium
KSLTMFLVPLDSPGVEIQP

SEQ ID NO: 1333946 - protein, 27 aa, Mycobacterium
KSMMMQAILAFWWPDLPRCTAAMSCID

SEQ ID NO: 1333947 - protein, 20 aa, Mycobacterium
KSTLLMLIAGLLRPDVGRIE

SEQ ID NO: 1333948 - protein, 20 aa, Mycobacterium
KTFDFLLSNPPFRKMSVCCG

SEQ ID NO: 1333949 - protein, 20 aa, Mycobacterium
KTLGPRRGLTGTPLPPLWES

SEQ ID NO: 1333950 - protein, 20 aa, Mycobacterium
KTWPVRLMKFVLSVGWLATA

SEQ ID NO: 1333951 - protein, 22 aa, Mycobacterium
KVRTRLIELFDLFDPADPEVVA

SEQ ID NO: 1333952 - protein, 19 aa, Mycobacterium
KWDNSFLEILYGNEWELFK

SEQ ID NO: 1333953 - protein, 19 aa, Mycobacterium
KWLPYYADLIERSAPFPPP

SEQ ID NO: 1333954 - protein, 17 aa, Mycobacterium
KWRISLGALILHLRESK

SEQ ID NO: 1333955 - protein, 19 aa, Mycobacterium
KYAALYWPWVSTGNGYLPP

SEQ ID NO: 1333956 - protein, 20 aa, Mycobacterium
KYAKALGFYCDCAVLRDSPL

SEQ ID NO: 1333957 - protein, 24 aa, Mycobacterium
KYCYNFFGIEYYFVTAELPLPGGQ

SEQ ID NO: 1333958 - protein, 24 aa, Mycobacterium
KYYIDYRDFTVWVLRVRRVRWVGG

SEQ ID NO: 1333959 - protein, 18 aa, Mycobacterium
LAAAAFLGSALRGIGRHL

SEQ ID NO: 1333960 - protein, 20 aa, Mycobacterium
LAALQRLWLIEAVKYNVVPL

SEQ ID NO: 1333961 - protein, 19 aa, Mycobacterium
LAAQIIWTLNRAGINGPYV

SEQ ID NO: 1333962 - protein, 21 aa, Mycobacterium
LADALPWLTALNDKIVVVKYG

SEQ ID NO: 1333963 - protein, 24 aa, Mycobacterium
LADFPDRWWNLTAVANALAGAAVR

SEQ ID NO: 1333964 - protein, 26 aa, Mycobacterium
LADRYPRWWQAPLRWAFRGALGARAS

SEQ ID NO: 1333965 - protein, 19 aa, Mycobacterium
LADYLFPAAKILDPFGLEN

SEQ ID NO: 1333966 - protein, 23 aa, Mycobacterium
LAEESLALLRLLLRGDPIDLGGR

SEQ ID NO: 1333967 - protein, 24 aa, Mycobacterium
LAEHDLLACWLLEAAGLPVDDAVR

SEQ ID NO: 1333968 - protein, 24 aa, Mycobacterium
LAGAIRLIYPRETLWRPPVLTMSA

SEQ ID NO: 1333969 - protein, 17 aa, Mycobacterium
LAIIYLPSPYDTAVLEP

SEQ ID NO: 1333970 - protein, 18 aa, Mycobacterium
LALALQLLDRGYFRAGGE

SEQ ID NO: 1333971 - protein, 17 aa, Mycobacterium
LALLLRGKYLIDVQSVT

SEQ ID NO: 1333972 - protein, 19 aa, Mycobacterium
LALSCLITPLLFTGRFGEA

SEQ ID NO: 1333973 - protein, 17 aa, Mycobacterium
LAMLAPIWGYPPILDIE

SEQ ID NO: 1333974 - protein, 19 aa, Mycobacterium
LAPLTFISVFGYQAQYAMF

SEQ ID NO: 1333975 - protein, 20 aa, Mycobacterium
LAPTHTLFLAGRPSPRLDAV

SEQ ID NO: 1333976 - protein, 19 aa, Mycobacterium
LAREFLLTWFVYTAWELAD

SEQ ID NO: 1333977 - protein, 22 aa, Mycobacterium
LARLLGLPYFPVTPLFPLAGPL

SEQ ID NO: 1333978 - protein, 25 aa, Mycobacterium
LARLNAIYLLWRLKESPHWPAIRDA

SEQ ID NO: 1333979 - protein, 17 aa, Mycobacterium
LARRREFGIGYWTVFDE

SEQ ID NO: 1333980 - protein, 22 aa, Mycobacterium
LARSTFHWVLAFAYKGLSTPKV

SEQ ID NO: 1333981 - protein, 17 aa, Mycobacterium
LAWFYRIVDVPSTGPSL

SEQ ID NO: 1333982 - protein, 17 aa, Mycobacterium
LCCAGCVPKFDADPAKY

SEQ ID NO: 1333983 - protein, 18 aa, Mycobacterium
LCRWWWRQGRVWPKAHPF

SEQ ID NO: 1333984 - protein, 27 aa, Mycobacterium
LCSCYPWTLLGIPPAWFKYPQYRARVV

SEQ ID NO: 1333985 - protein, 23 aa, Mycobacterium
LDAKVLWQLKRALPGPFTRTLGL

SEQ ID NO: 1333986 - protein, 22 aa, Mycobacterium
LDARAYRLSWPQDMVLFEIDQP

SEQ ID NO: 1333987 - protein, 19 aa, Mycobacterium
LDELWPVLTPQTLLADLYE

SEQ ID NO: 1333988 - protein, 21 aa, Mycobacterium
LDFLRRPLLGFLSMAAGPTPP

SEQ ID NO: 1333989 - protein, 20 aa, Mycobacterium
LDGLVAWRTAAGLPALAVNW

SEQ ID NO: 1333990 - protein, 20 aa, Mycobacterium
LDHAMWFMRAFRADEWLLYD

SEQ ID NO: 1333991 - protein, 27 aa, Mycobacterium
LDHWDFYMALAYFKLAIIGAGIAYRAR

SEQ ID NO: 1333992 - protein, 18 aa, Mycobacterium
LDIAQWRRRRRDELAALG

SEQ ID NO: 1333993 - protein, 19 aa, Mycobacterium
LDILLGDWTGARTLACLPG

SEQ ID NO: 1333994 - protein, 18 aa, Mycobacterium
LDKDFHARWFGWVNPAQT

SEQ ID NO: 1333995 - protein, 18 aa, Mycobacterium
LDLFRSPASAASFVMDPD

SEQ ID NO: 1333996 - protein, 17 aa, Mycobacterium
LDLLSRLQRELGLTYLL

SEQ ID NO: 1333997 - protein, 18 aa, Mycobacterium
LDNLPAFAALRPFFETRT

SEQ ID NO: 1333998 - protein, 28 aa, Mycobacterium
LDNLPLEHWMLLSYPVLGLAPLSPDLIR

SEQ ID NO: 1333999 - protein, 23 aa, Mycobacterium
LDPDPMFVPKLLGPLLTAEDVHL

SEQ ID NO: 1334000 - protein, 17 aa, Mycobacterium
LDRAIFDALRRIPRGAG

SEQ ID NO: 1334001 - protein, 24 aa, Mycobacterium
LDRFLDIMLRAPFRLARDVIVHMQ

SEQ ID NO: 1334002 - protein, 24 aa, Mycobacterium
LDRNTFRWWLTVATLRWGVICRHQ

SEQ ID NO: 1334003 - protein, 17 aa, Mycobacterium
LDRPFAWALIKLDGADT

SEQ ID NO: 1334004 - protein, 24 aa, Mycobacterium
LDSDPYLPLITPFLEDLRAEQDET

SEQ ID NO: 1334005 - protein, 19 aa, Mycobacterium
LDWYVAMACFKLAIVIEGT

SEQ ID NO: 1334006 - protein, 17 aa, Mycobacterium
LEAHGWDLGFWTVLDEG

SEQ ID NO: 1334007 - protein, 26 aa, Mycobacterium
LEDWKNWLRWRVIHARAFLLTDELIA

SEQ ID NO: 1334008 - protein, 22 aa, Mycobacterium
LEFDLLMLVAPILRKLAEANPA

SEQ ID NO: 1334009 - protein, 18 aa, Mycobacterium
LEGQWYLHLFAPGQPDLN

SEQ ID NO: 1334010 - protein, 18 aa, Mycobacterium
LEHGLRDIGRWRIPVILG

SEQ ID NO: 1334011 - protein, 17 aa, Mycobacterium
LEILYGNEWELFKSPAG

SEQ ID NO: 1334012 - protein, 18 aa, Mycobacterium
LEQLRMRYLEDGSWHGDI

SEQ ID NO: 1334013 - protein, 17 aa, Mycobacterium
LERSTLIELLRLFAPLP

SEQ ID NO: 1334014 - protein, 18 aa, Mycobacterium
LERSTLIELLRLFAPLPT

SEQ ID NO: 1334015 - protein, 19 aa, Mycobacterium
LESFLRTAWPLVLARMPDA

SEQ ID NO: 1334016 - protein, 23 aa, Mycobacterium
LESLRLWREGFLDGLPPEVVTAR

SEQ ID NO: 1334017 - protein, 18 aa, Mycobacterium
LETAPLPGLPPLSSGLVG

SEQ ID NO: 1334018 - protein, 21 aa, Mycobacterium
LETFAVLPWDTSFARVFCRLY

SEQ ID NO: 1334019 - protein, 17 aa, Mycobacterium
LEVQLDQCWDLLRQRRA

SEQ ID NO: 1334020 - protein, 19 aa, Mycobacterium
LEVSTPWYRALIGTEPVLD

SEQ ID NO: 1334021 - protein, 18 aa, Mycobacterium
LEYIIAFYGAMTAGFIAV

SEQ ID NO: 1334022 - protein, 19 aa, Mycobacterium
LEYTLRWRNVPKPSIAAVQ

SEQ ID NO: 1334023 - protein, 17 aa, Mycobacterium
LFARFRRAVTDTGLYKD

SEQ ID NO: 1334024 - protein, 17 aa, Mycobacterium
LFFMGRLSVEGDWALAM

SEQ ID NO: 1334025 - protein, 30 aa, Mycobacterium; identical to SEQ ID NO: 135986

SEQ ID NO: 1334026 - protein, 19 aa, Mycobacterium
LFGMLMTWDIPPWLDARGC

SEQ ID NO: 1334027 - protein, 18 aa, Mycobacterium
LFLGTLPLLLGDPAKRPP

SEQ ID NO: 1334028 - protein, 18 aa, Mycobacterium
LFNSQPWRWVSEGAVVSL

SEQ ID NO: 1334029 - protein, 18 aa, Mycobacterium
LFTALDWLSERLSRQRFL

SEQ ID NO: 1334030 - protein, 21 aa, Mycobacterium
LGDAWVWDMYRPARFVKQVRV

SEQ ID NO: 1334031 - protein, 21 aa, Mycobacterium
LGELLAERAVLPQGTLYASTP

SEQ ID NO: 1334032 - protein, 28 aa, Mycobacterium
LGFEYVDLFLIHWPLPTLYDGDFVSTWQ

SEQ ID NO: 1334033 - protein, 20 aa, Mycobacterium
LGHFALTARLLPLLTAGAAR

SEQ ID NO: 1334034 - protein, 24 aa, Mycobacterium
LGLGVGPYRHLMAELFAPMSKVAA

SEQ ID NO: 1334035 - protein, 19 aa, Mycobacterium
LGLTIWPTGFHPAAWRVPG

SEQ ID NO: 1334036 - protein, 20 aa, Mycobacterium
LGLVPLHWALASLLADIGSA

SEQ ID NO: 1334037 - protein, 20 aa, Mycobacterium
LGLVPLRWALASLLADIGSA

SEQ ID NO: 1334038 - protein, 18 aa, Mycobacterium
LGPFMNTVPLRIDLPEGG

SEQ ID NO: 1334039 - protein, 19 aa, Mycobacterium
LGRKYPWALGRPASEVWAE

SEQ ID NO: 1334040 - protein, 17 aa, Mycobacterium
LGRPVRRVPLSPKVLLA

SEQ ID NO: 1334041 - protein, 21 aa, Mycobacterium
LGRVLFNELLPRGYPFVNKQM

SEQ ID NO: 1334042 - protein, 22 aa, Mycobacterium
LGSCFGFFPLRLARYGIDVLAT

SEQ ID NO: 1334043 - protein, 18 aa, Mycobacterium
LGTTGFPYTNVVVDNAIT

SEQ ID NO: 1334044 - protein, 20 aa, Mycobacterium
LGYSRWLSAILLPSRRAEDL

SEQ ID NO: 1334045 - protein, 19 aa, Mycobacterium
LHAVIVAPLYLTLPVWSRA

SEQ ID NO: 1334046 - protein, 17 aa, Mycobacterium
LHLLGRIPKIQPVLPLP

SEQ ID NO: 1334047 - protein, 18 aa, Mycobacterium
LHLQATLYSLWHGKTTAV

SEQ ID NO: 1334048 - protein, 17 aa, Mycobacterium
LHPLIGFPIDHDAPPGT

SEQ ID NO: 1334049 - protein, 18 aa, Mycobacterium
LHPMSAPMTLRWLRDRFA

SEQ ID NO: 1334050 - protein, 17 aa, Mycobacterium
LHPPLIILMRVAQDEFE

SEQ ID NO: 1334051 - protein, 26 aa, Mycobacterium
LHRSDPLLLLPLLRTMPPVPVLLLHC

SEQ ID NO: 1334052 - protein, 17 aa, Mycobacterium
LHVNRWFYDCPPAFHRK

SEQ ID NO: 1334053 - protein, 17 aa, Mycobacterium
LHVVRLLAMLPLAPLVP

SEQ ID NO: 1334054 - protein, 17 aa, Mycobacterium
LICVPPYHIAGVSAALS

SEQ ID NO: 1334055 - protein, 17 aa, Mycobacterium
LIDFWRFDEFRDSRLWD

SEQ ID NO: 1334056 - protein, 18 aa, Mycobacterium
LIDGLEKLAWLIRSENRK

SEQ ID NO: 1334057 - protein, 17 aa, Mycobacterium
LIELLRLFAPLPTQLEG

SEQ ID NO: 1334058 - protein, 18 aa, Mycobacterium
LIELLRLFAPLPTQLEGD

SEQ ID NO: 1334059 - protein, 17 aa, Mycobacterium
LIERMQLPTVFFAEGGG

SEQ ID NO: 1334060 - protein, 21 aa, Mycobacterium
LIFHRPILAGDKLWFDSYLDS

SEQ ID NO: 1334061 - protein, 18 aa, Mycobacterium
LIGEWLLRDIGVATGLRH

SEQ ID NO: 1334062 - protein, 17 aa, Mycobacterium
LIMLYHLDRAWADHLAF

SEQ ID NO: 1334063 - protein, 18 aa, Mycobacterium
LIPTFPFPNETIENWQRG

SEQ ID NO: 1334064 - protein, 17 aa, Mycobacterium
LITIGNRKIWFFTPAPL

SEQ ID NO: 1334065 - protein, 19 aa, Mycobacterium
LIVIPNDRLLQMGDAAVSL

SEQ ID NO: 1334066 - protein, 18 aa, Mycobacterium
LKFTLVEPLRLLFKDEVR

SEQ ID NO: 1334067 - protein, 21 aa, Mycobacterium
LKHRLARSLFLYALCNGWIGE

SEQ ID NO: 1334068 - protein, 19 aa, Mycobacterium
LKRATLNRALFGSPAAQRK

SEQ ID NO: 1334069 - protein, 20 aa, Mycobacterium
LLAPLRAVLKDRVTLAPAPP

SEQ ID NO: 1334070 - protein, 18 aa, Mycobacterium
LLAPLRLAEGLVASGLIG

SEQ ID NO: 1334071 - protein, 29 aa, Mycobacterium
LLDLPTYPFQHRAYWFPQGQARTAPTDPV

SEQ ID NO: 1334072 - protein, 18 aa, Mycobacterium
LLDMKRFHLLLAGASWVA

SEQ ID NO: 1334073 - protein, 17 aa, Mycobacterium
LLERFELQRWADAVRRH

SEQ ID NO: 1334074 - protein, 20 aa, Mycobacterium
LLESKWLRPTPYMMAKFGMT

SEQ ID NO: 1334075 - protein, 19 aa, Mycobacterium
LLETAPLPGLPPLSSGLVG

SEQ ID NO: 1334076 - protein, 18 aa, Mycobacterium
LLGLPYFPVTPLFPVAGP

SEQ ID NO: 1334077 - protein, 19 aa, Mycobacterium
LLGLPYFPVTPLFPVAGPL

SEQ ID NO: 1334078 - protein, 18 aa, Mycobacterium
LLIGQLIDRSGMAWCISK

SEQ ID NO: 1334079 - protein, 18 aa, Mycobacterium
LLITHYTRILRYIQPQFV

SEQ ID NO: 1334080 - protein, 17 aa, Mycobacterium
LLKPPFPDPGTPVQLVH

SEQ ID NO: 1334081 - protein, 20 aa, Mycobacterium
LLLQEWLRFGWYFLISRRDP

SEQ ID NO: 1334082 - protein, 22 aa, Mycobacterium
LLMETVLPWFNLGNAAVSLGLA

SEQ ID NO: 1334083 - protein, 20 aa, Mycobacterium
LLMLAALRRLPVLDRATREG

SEQ ID NO: 1334084 - protein, 24 aa, Mycobacterium
LLNYRSLLHRWPLTQPRLLSDMPV

SEQ ID NO: 1334085 - protein, 17 aa, Mycobacterium
LLPQWRGQAGEAAQAAL

SEQ ID NO: 1334086 - protein, 19 aa, Mycobacterium
LLRSCGRPYPWVQIRIVDE

SEQ ID NO: 1334087 - protein, 18 aa, Mycobacterium
LLSRSLILQLQPLTPEDV

SEQ ID NO: 1334088 - protein, 25 aa, Mycobacterium
LLTALGDPLLWSVPLHWAGVHAGIL

SEQ ID NO: 1334089 - protein, 18 aa, Mycobacterium
LLTKLRALSLKDLYPRMT

SEQ ID NO: 1334090 - protein, 19 aa, Mycobacterium
LLTMLRPELADWTALVLPD

SEQ ID NO: 1334091 - protein, 18 aa, Mycobacterium
LLVQDLQMRPGSSSGWHT

SEQ ID NO: 1334092 - protein, 20 aa, Mycobacterium
LLWPIKRKYGNKISWADLIA

SEQ ID NO: 1334093 - protein, 17 aa, Mycobacterium
LMFDSMFGMVIHATGRP

SEQ ID NO: 1334094 - protein, 19 aa, Mycobacterium
LMHVLGTSAYVPELLMRAP

SEQ ID NO: 1334095 - protein, 17 aa, Mycobacterium
LMKAILKAPADLLWNGG

SEQ ID NO: 1334096 - protein, 18 aa, Mycobacterium
LMRRSGVIFLRRKLDDPL

SEQ ID NO: 1334097 - protein, 17 aa, Mycobacterium
LMSFRWFLADELPEHPA

SEQ ID NO: 1334098 - protein, 20 aa, Mycobacterium
LNAGMYPWKLAITSPYLDPG

SEQ ID NO: 1334099 - protein, 17 aa, Mycobacterium
LNGHLLYWLPDGEYETA

SEQ ID NO: 1334100 - protein, 26 aa, Mycobacterium
LNGHQWLKDVYIQDGLLRLGAEEVEQ

SEQ ID NO: 1334101 - protein, 26 aa, Mycobacterium
LNLKSPFWLVQALLPALRSAGTADDP

SEQ ID NO: 1334102 - protein, 17 aa, Mycobacterium
LNNLLFTANLGSALSTL

SEQ ID NO: 1334103 - protein, 17 aa, Mycobacterium
LNRSLLPAFDRQYRQVM

SEQ ID NO: 1334104 - protein, 19 aa, Mycobacterium
LNTWLMEQLIMIDALKRGS

SEQ ID NO: 1334105 - protein, 19 aa, Mycobacterium
LNWDSLPLRLFAGGNAKFW

SEQ ID NO: 1334106 - protein, 17 aa, Mycobacterium
LPAIYFEGVGMAGGIAV

SEQ ID NO: 1334107 - protein, 17 aa, Mycobacterium
LPAKPFPKACPAPGVMQ

SEQ ID NO: 1334108 - protein, 17 aa, Mycobacterium
LPALAVNWGQWADVGLA

SEQ ID NO: 1334109 - protein, 17 aa, Mycobacterium
LPEVAWSWLVDALNQRA

SEQ ID NO: 1334110 - protein, 20 aa, Mycobacterium
LPGYWQCTFALGPDPDGEGE

SEQ ID NO: 1334111 - protein, 17 aa, Mycobacterium
LPMALTLFRRDLDVWAP

SEQ ID NO: 1334112 - protein, 19 aa, Mycobacterium
LPPDFLMRALHDCLAAWQA

SEQ ID NO: 1334113 - protein, 19 aa, Mycobacterium
LPPFKWWRGLQARKVLDNY

SEQ ID NO: 1334114 - protein, 17 aa, Mycobacterium
LPPFQLPWYVPCFKYLR

SEQ ID NO: 1334115 - protein, 22 aa, Mycobacterium
LPPGWLRLLTDERLRPAVTSMH

SEQ ID NO: 1334116 - protein, 21 aa, Mycobacterium
LPQTILMYPMTIASQLAQLVM

SEQ ID NO: 1334117 - protein, 17 aa, Mycobacterium
LPTRLTVDLFKAARGVP

SEQ ID NO: 1334118 - protein, 17 aa, Mycobacterium
LPTYPYTQEFIDRGIRG

SEQ ID NO: 1334119 - protein, 19 aa, Mycobacterium
LPVLGLAGSVFFTAATELG

SEQ ID NO: 1334120 - protein, 17 aa, Mycobacterium
LQAAGKYPPPPGASDIL

SEQ ID NO: 1334121 - protein, 21 aa, Mycobacterium
LQLGWRLFGPFLRAATGLDDP

SEQ ID NO: 1334122 - protein, 18 aa, Mycobacterium
LQLLLYPVTHYDAETRSR

SEQ ID NO: 1334123 - protein, 19 aa, Mycobacterium
LQMRPGSSSGWHTHPGPEH

SEQ ID NO: 1334124 - protein, 22 aa, Mycobacterium
LQQWPTFFDNAAGPLTGLPFDK

SEQ ID NO: 1334125 - protein, 23 aa, Mycobacterium
LQRGWVHVLPSRKEGWGLSVVEA

SEQ ID NO: 1334126 - protein, 21 aa, Mycobacterium
LRAIPWVLAWSQSRVMLPGWY

SEQ ID NO: 1334127 - protein, 18 aa, Mycobacterium
LRDALLDLYDFWLTTKAS

SEQ ID NO: 1334128 - protein, 17 aa, Mycobacterium
LRDGIIPPTLNLKNLDP

SEQ ID NO: 1334129 - protein, 23 aa, Mycobacterium
LRDRTIAAWLWSGRGAVVAGAAA

SEQ ID NO: 1334130 - protein, 19 aa, Mycobacterium
LREGLRFWLRSALTYDLLT

SEQ ID NO: 1334131 - protein, 23 aa, Mycobacterium
LRERHPAWRLLRAGNAALVLSFL

SEQ ID NO: 1334132 - protein, 21 aa, Mycobacterium
LRHLNLWWTWTPGASWRHPVG

SEQ ID NO: 1334133 - protein, 24 aa, Mycobacterium
LRHLSQWWYWTPGASWRHPIGPGS

SEQ ID NO: 1334134 - protein, 28 aa, Mycobacterium
LRIAADGLWRFVTLPWQLTRVIPETTAV

SEQ ID NO: 1334135 - protein, 18 aa, Mycobacterium
LRIVFVEHAFSWILPLMW

SEQ ID NO: 1334136 - protein, 19 aa, Mycobacterium
LRIVFVEHAFTWILPLMWR

SEQ ID NO: 1334137 - protein, 25 aa, Mycobacterium
LRKGERLLVFLPLAHVLARALSMTA

SEQ ID NO: 1334138 - protein, 19 aa, Mycobacterium
LRLGLDIMLIGVWNAFQVA

SEQ ID NO: 1334139 - protein, 18 aa, Mycobacterium
LRLLIIRSGLPRPVTQIP

SEQ ID NO: 1334140 - protein, 17 aa, Mycobacterium
LRLTLTQAAWRLSEDLP

SEQ ID NO: 1334141 - protein, 17 aa, Mycobacterium
LRLWADYLDMPPLRVDP

SEQ ID NO: 1334142 - protein, 32 aa, Mycobacterium
LRNEAIIVVPRWWKALWYLERLSPALSMRTAA

SEQ ID NO: 1334143 - protein, 17 aa, Mycobacterium
LRPTSRVSLLSPTGAFL

SEQ ID NO: 1334144 - protein, 17 aa, Mycobacterium
LRPVARTGPPPLSYAQE

SEQ ID NO: 1334145 - protein, 17 aa, Mycobacterium
LRQSLPELPWLRRNRIQ

SEQ ID NO: 1334146 - protein, 18 aa, Mycobacterium
LRRNVKLCAVPWLHRLGL

SEQ ID NO: 1334147 - protein, 19 aa, Mycobacterium
LRRPDLLVSLLTYWQRHPS

SEQ ID NO: 1334148 - protein, 24 aa, Mycobacterium
LRTDWSYRFQNYPAGSLLAADYEE

SEQ ID NO: 1334149 - protein, 19 aa, Mycobacterium
LRTPVRRFVLFSSITGLLG

SEQ ID NO: 1334150 - protein, 23 aa, Mycobacterium
LRVNFLRPFFAGRESRYVGTALR

SEQ ID NO: 1334151 - protein, 21 aa, Mycobacterium
LRVPVWMMRQAGRSLPEYRAL

SEQ ID NO: 1334152 - protein, 19 aa, Mycobacterium
LRWERFITAVRLLSERLGV

SEQ ID NO: 1334153 - protein, 18 aa, Mycobacterium
LRYFVKRYTLKRGALAFG

SEQ ID NO: 1334154 - protein, 20 aa, Mycobacterium
LSAMYVMFAGFFHGAAMVAT

SEQ ID NO: 1334155 - protein, 23 aa, Mycobacterium
LSARPRMLFDYFQQLFAQVTNPP

SEQ ID NO: 1334156 - protein, 18 aa, Mycobacterium
LSDQPLDWSFKGIPARWW

SEQ ID NO: 1334157 - protein, 28 aa, Mycobacterium
LSFASLVFYSSWFKLHHPAAFCAALLRA

SEQ ID NO: 1334158 - protein, 28 aa, Mycobacterium
LSFDVRPPRWLPPGRWWALIRVAAAGRL

SEQ ID NO: 1334159 - protein, 17 aa, Mycobacterium
LSFPFLREKIHGRSNPR

SEQ ID NO: 1334160 - protein, 17 aa, Mycobacterium
LSFPFLREKVHGRSNPR

SEQ ID NO: 1334161 - protein, 18 aa, Mycobacterium
LSKIFNDAWMSSYGFLRS

SEQ ID NO: 1334162 - protein, 31 aa, Mycobacterium
LSKLTHQVYIYAIPYLWAFPPAEQIFGTTAV

SEQ ID NO: 1334163 - protein, 28 aa, Mycobacterium
LSLGTTEQIYLLLRVTLSQVLSGGTETA

SEQ ID NO: 1334164 - protein, 21 aa, Mycobacterium
LSLLSTLPWPKENIDKIVRGD

SEQ ID NO: 1334165 - protein, 23 aa, Mycobacterium
LSSRFPMWMAWGPELTFFCNDAY

SEQ ID NO: 1334166 - protein, 20 aa, Mycobacterium
LSVFLQLALFPDTPPSVLTS

SEQ ID NO: 1334167 - protein, 24 aa, Mycobacterium
LSVHHGFIPKQLYFKKLTPQACEG

SEQ ID NO: 1334168 - protein, 18 aa, Mycobacterium
LSWYLAMACFKLAVVIEG

SEQ ID NO: 1334169 - protein, 19 aa, Mycobacterium
LSWYLAMACFKLAVVIEGT

SEQ ID NO: 1334170 - protein, 17 aa, Mycobacterium
LTALWRSYGVEPDAVIG

SEQ ID NO: 1334171 - protein, 26 aa, Mycobacterium
LTDEAIFSFLRLLLPAGLETTFRSSG

SEQ ID NO: 1334172 - protein, 20 aa, Mycobacterium
LTDIGWLELLWMQPVGITSH

SEQ ID NO: 1334173 - protein, 23 aa, Mycobacterium
LTDWRQWWEWVPGADWRHPSGPG

SEQ ID NO: 1334174 - protein, 21 aa, Mycobacterium
LTDYHRWFLTSGIGPAIEQAR

SEQ ID NO: 1334175 - protein, 20 aa, Mycobacterium
LTEGLLYERRLFHSAFATDD

SEQ ID NO: 1334176 - protein, 18 aa, Mycobacterium
LTFAVLLAAGLRGIEKNY

SEQ ID NO: 1334177 - protein, 18 aa, Mycobacterium
LTHSIWLDTILDSVLYWA

SEQ ID NO: 1334178 - protein, 17 aa, Mycobacterium
LTKLGILSPVTAAADPG

SEQ ID NO: 1334179 - protein, 23 aa, Mycobacterium
LTLTPLWPVWPLEYALQGSLCES

SEQ ID NO: 1334180 - protein, 24 aa, Mycobacterium
LTPDKPFFMYFAPGATHAPHHVPK

SEQ ID NO: 1334181 - protein, 18 aa, Mycobacterium
LTPPPWYPILRGTTQQAL

SEQ ID NO: 1334182 - protein, 17 aa, Mycobacterium
LTRFPKGTYLPIIGVSF

SEQ ID NO: 1334183 - protein, 24 aa, Mycobacterium
LTRLPLPTLVLPPALRLALTPGWM

SEQ ID NO: 1334184 - protein, 18 aa, Mycobacterium
LTRLRLITSLLDRGYNIA

SEQ ID NO: 1334185 - protein, 23 aa, Mycobacterium
LTRNLWPVARRPVELVWGLVSQT

SEQ ID NO: 1334186 - protein, 18 aa, Mycobacterium
LTRWPVVPEIRHGSLGFA

SEQ ID NO: 1334187 - protein, 24 aa, Mycobacterium
LTVTRRRHLLAQFLFRGDAVERPV

SEQ ID NO: 1334188 - protein, 21 aa, Mycobacterium
LTYRELWLWRNRIANALIAAG

SEQ ID NO: 1334189 - protein, 17 aa, Mycobacterium
LVDFWATWCGPCKMVAP

SEQ ID NO: 1334190 - protein, 17 aa, Mycobacterium
LVDPFGHRWMLTGPVTG

SEQ ID NO: 1334191 - protein, 19 aa, Mycobacterium
LVGAALMRLLTTPPGLRVF

SEQ ID NO: 1334192 - protein, 17 aa, Mycobacterium
LVIGVRHRSPVGKLLLG

SEQ ID NO: 1334193 - protein, 18 aa, Mycobacterium
LVIGWWAAPTILEHGSPE

SEQ ID NO: 1334194 - protein, 21 aa, Mycobacterium
LVILLHGFASFWWSWRHQLRG

SEQ ID NO: 1334195 - protein, 21 aa, Mycobacterium
LVILLHGFGSFWWSWRHQLAG

SEQ ID NO: 1334196 - protein, 17 aa, Mycobacterium
LVRLYRPRPEVLDGSWS

SEQ ID NO: 1334197 - protein, 18 aa, Mycobacterium
LVSLLTYWQRHPSLSYLF

SEQ ID NO: 1334198 - protein, 22 aa, Mycobacterium
LVSPPYYRLVLGMPPLAAEAVD

SEQ ID NO: 1334199 - protein, 17 aa, Mycobacterium
LVSTYLFERARVGMVVG

SEQ ID NO: 1334200 - protein, 30 aa, Mycobacterium
LVTLFMGHLYGWIIALRPSGAFFPVEQLLV

SEQ ID NO: 1334201 - protein, 18 aa, Mycobacterium
LVTLVDWGMPPAAVLRAA

SEQ ID NO: 1334202 - protein, 23 aa, Mycobacterium
LVTVGVWPALALPPLVTPVPGLG

SEQ ID NO: 1334203 - protein, 24 aa, Mycobacterium
LVVPLPRRLLWFLPPATLQLSGHA

SEQ ID NO: 1334204 - protein, 26 aa, Mycobacterium
LVVVRPIGFEPMKWIRALAADEPLPA

SEQ ID NO: 1334205 - protein, 21 aa, Mycobacterium
LVYNRRDPLLPDLIVCRPELA

SEQ ID NO: 1334206 - protein, 17 aa, Mycobacterium
LVYYPLSTLMMAGIRDI

SEQ ID NO: 1334207 - protein, 17 aa, Mycobacterium
LWALWRFSNQPEATRLT

SEQ ID NO: 1334208 - protein, 18 aa, Mycobacterium
LWDTILPFAGYAFNKSHA

SEQ ID NO: 1334209 - protein, 17 aa, Mycobacterium
LWEGLRQLYPVGIDHHD

SEQ ID NO: 1334210 - protein, 17 aa, Mycobacterium
LWEMYLIEGLAGGRIAV

SEQ ID NO: 1334211 - protein, 19 aa, Mycobacterium
LWLARLWKEAGLPDGVFNV

SEQ ID NO: 1334212 - protein, 17 aa, Mycobacterium
LWLSRLVSVLIPTHDDR

SEQ ID NO: 1334213 - protein, 17 aa, Mycobacterium
LWRYVLWSRLRVAITLV

SEQ ID NO: 1334214 - protein, 18 aa, Mycobacterium
LYDALDQWAFCTLTRSPG

SEQ ID NO: 1334215 - protein, 18 aa, Mycobacterium
LYQFFTPLMRNLGHSGRV

SEQ ID NO: 1334216 - protein, 22 aa, Mycobacterium
LYSSLWLYLAGVRPIVFGVSAA

SEQ ID NO: 1334217 - protein, 20 aa, Mycobacterium
MAALANFFRIKPAYFTDDEY

SEQ ID NO: 1334218 - protein, 24 aa, Mycobacterium
MAAYLLPAELIPTSAFPLALQDTE

SEQ ID NO: 1334219 - protein, 20 aa, Mycobacterium
MAHFFYIHFGLPTYFKNVFE

SEQ ID NO: 1334220 - protein, 17 aa, Mycobacterium
MAHRLGMKPNWVIDLHN

SEQ ID NO: 1334221 - protein, 17 aa, Mycobacterium
MALLDLFWTSVSGVLHA

SEQ ID NO: 1334222 - protein, 19 aa, Mycobacterium
MASILLTELVRRGVLRAPQ

SEQ ID NO: 1334223 - protein, 18 aa, Mycobacterium
MCDFWETVLFRAGLYRRN

SEQ ID NO: 1334224 - protein, 18 aa, Mycobacterium
MDETPMMLLPTIPTMVWG

SEQ ID NO: 1334225 - protein, 19 aa, Mycobacterium
MDIMTTLAMWKFRQLRPIN

SEQ ID NO: 1334226 - protein, 22 aa, Mycobacterium
MDLILCTLPTSAARHRFFEALP

SEQ ID NO: 1334227 - protein, 22 aa, Mycobacterium
MDPWTVPLYQLTAGHPPVPAPI

SEQ ID NO: 1334228 - protein, 23 aa, Mycobacterium
MDQAWWFPAFAPLPGGDPTVMLA

SEQ ID NO: 1334229 - protein, 23 aa, Mycobacterium
MESRSWLFPKGLATFIGLRDQSC

SEQ ID NO: 1334230 - protein, 17 aa, Mycobacterium
MFFTPIMDFLNNPPPLP

SEQ ID NO: 1334231 - protein, 18 aa, Mycobacterium
MFMDPQHRLLLETAWRAV

SEQ ID NO: 1334232 - protein, 24 aa, Mycobacterium
MFRAVDVVLLNKIDLAPYLDADVA

SEQ ID NO: 1334233 - protein, 17 aa, Mycobacterium
MGGGDMIAALFSAIETN

SEQ ID NO: 1334234 - protein, 18 aa, Mycobacterium
MGHRLTIAMAWQATVRWA

SEQ ID NO: 1334235 - protein, 22 aa, Mycobacterium
MGRKFLTKLGILSPASAAADPG

SEQ ID NO: 1334236 - protein, 17 aa, Mycobacterium
MGRKFLTKLGILSPVTA

SEQ ID NO: 1334237 - protein, 27 aa, Mycobacterium
MGSAYLFNGLFFSLPWFYRCGYDVMLY

SEQ ID NO: 1334238 - protein, 18 aa, Mycobacterium
MHAWELFVATWLRIEAGQ

SEQ ID NO: 1334239 - protein, 18 aa, Mycobacterium
MIPLWRRNGLARTDWDIA

SEQ ID NO: 1334240 - protein, 17 aa, Mycobacterium
MIRFMIRYGLVIARVYS

SEQ ID NO: 1334241 - protein, 20 aa, Mycobacterium
MKPVKLMRPARPLGLRAEVQ

SEQ ID NO: 1334242 - protein, 25 aa, Mycobacterium
MLASFILLRRLLLLAWMGTHSHSKE

SEQ ID NO: 1334243 - protein, 17 aa, Mycobacterium
MLMLPFFNYAEGDHRAI

SEQ ID NO: 1334244 - protein, 17 aa, Mycobacterium
MLSWIRDVPALGAAARG

SEQ ID NO: 1334245 - protein, 19 aa, Mycobacterium
MNERCEVEWIPPPPLDTGQ

SEQ ID NO: 1334246 - protein, 28 aa, Mycobacterium
MNVLGQHRLLFLTWLPLSAHLLYVGKLS

SEQ ID NO: 1334247 - protein, 17 aa, Mycobacterium
MPDVLHWLGIRKIHRFV

SEQ ID NO: 1334248 - protein, 17 aa, Mycobacterium
MPGSLLLVGERLATSPG

SEQ ID NO: 1334249 - protein, 24 aa, Mycobacterium
MPPAPPPVLAPRRKTRQLMVRDVG

SEQ ID NO: 1334250 - protein, 17 aa, Mycobacterium
MPRPELRFGSFAELLLN

SEQ ID NO: 1334251 - protein, 21 aa, Mycobacterium
MPWRLVARLLLVRAYAALGDT

SEQ ID NO: 1334252 - protein, 24 aa, Mycobacterium
MQIAFPALLRRFPTLAPAGEFDDV

SEQ ID NO: 1334253 - protein, 17 aa, Mycobacterium
MRKLLLQEWLRFGWYFL

SEQ ID NO: 1334254 - protein, 18 aa, Mycobacterium
MRYLKGCQYYFIDEAIDV

SEQ ID NO: 1334255 - protein, 23 aa, Mycobacterium
MSHLLREFGLLEPLRARLAEGMP

SEQ ID NO: 1334256 - protein, 22 aa, Mycobacterium
MSSSLPTLFRRAADYQRQITLT

SEQ ID NO: 1334257 - protein, 18 aa, Mycobacterium
MTPWIWPTMHLNPPNWIE

SEQ ID NO: 1334258 - protein, 23 aa, Mycobacterium
MTRRRIFVPILRVTAIEPGAVTL

SEQ ID NO: 1334259 - protein, 23 aa, Mycobacterium
MTVWQKLHFRFGLPKPLLEPLSV

SEQ ID NO: 1334260 - protein, 24 aa, Mycobacterium
MTVWQKLHFRFGLPKPLLEPLSVE

SEQ ID NO: 1334261 - protein, 27 aa, Mycobacterium
MVTRRYWWHAWWWVPQAILRGGVEKVH

SEQ ID NO: 1334262 - protein, 19 aa, Mycobacterium
MVVNHLIFHFATHKLPFGG

SEQ ID NO: 1334263 - protein, 22 aa, Mycobacterium
MWVNARYQFLVLYTVGDDALAN

SEQ ID NO: 1334264 - protein, 24 aa, Mycobacterium
MYDSGLLSYVPWATTILASALIER

SEQ ID NO: 1334265 - protein, 17 aa, Mycobacterium
MYLQTVMLLLRAEGLHS

SEQ ID NO: 1334266 - protein, 19 aa, Mycobacterium
NAELLATFLRFLTAASGMK

SEQ ID NO: 1334267 - protein, 20 aa, Mycobacterium
NAIFLPHVLRYNASLPSKFM

SEQ ID NO: 1334268 - protein, 20 aa, Mycobacterium
NAIFLPLLRVFFNSWFRVEV

SEQ ID NO: 1334269 - protein, 20 aa, Mycobacterium
NAPVLLGLIGLWYSNFFGAE

SEQ ID NO: 1334270 - protein, 19 aa, Mycobacterium
NAQNGAFNLGFGDITFGDK

SEQ ID NO: 1334271 - protein, 19 aa, Mycobacterium
NARELDWMLHWRKMFDGLQ

SEQ ID NO: 1334272 - protein, 21 aa, Mycobacterium
NDLRVIDNVRYFAALYGTGGQ

SEQ ID NO: 1334273 - protein, 24 aa, Mycobacterium
NERERLFPLIRRYALAYHVVFIPS

SEQ ID NO: 1334274 - protein, 20 aa, Mycobacterium
NFIGCHQFRFLDKVDVLGRA

SEQ ID NO: 1334275 - protein, 17 aa, Mycobacterium
NFTAYKLLIADVIDGEL

SEQ ID NO: 1334276 - protein, 19 aa, Mycobacterium
NGDRRFWMLLGVQITDDAV

SEQ ID NO: 1334277 - protein, 17 aa, Mycobacterium
NGHIFLAQPPLYKLKWQ

SEQ ID NO: 1334278 - protein, 20 aa, Mycobacterium
NGWKTFFRGLANDGVQGPSV

SEQ ID NO: 1334279 - protein, 23 aa, Mycobacterium
NIEQLLVLLPQGTAIMGGGVVPN

SEQ ID NO: 1334280 - protein, 21 aa, Mycobacterium
NIPVPYVYPVDLRYLLSPPVS

SEQ ID NO: 1334281 - protein, 21 aa, Mycobacterium
NKAQIYAWRKGIKTLYYIRLR

SEQ ID NO: 1334282 - protein, 21 aa, Mycobacterium
NLAALWKLPVVFIVEDNGWGV

SEQ ID NO: 1334283 - protein, 17 aa, Mycobacterium
NLDKARRLLWPIKQKYG

SEQ ID NO: 1334284 - protein, 17 aa, Mycobacterium
NLKCLCRFHHLLKTFWL

SEQ ID NO: 1334285 - protein, 17 aa, Mycobacterium
NLRRLAHIATLMADSGL

SEQ ID NO: 1334286 - protein, 18 aa, Mycobacterium
NLRRRGERWYWHWDPQFI

SEQ ID NO: 1334287 - protein, 18 aa, Mycobacterium
NMPMAWAAAWIFLHINGI

SEQ ID NO: 1334288 - protein, 17 aa, Mycobacterium
NMRWRTFCAELLAIAEK

SEQ ID NO: 1334289 - protein, 21 aa, Mycobacterium
NNRLWRMNLSYMGYLVPLFEH

SEQ ID NO: 1334290 - protein, 17 aa, Mycobacterium
NNWLWWEDRRRELHFLK

SEQ ID NO: 1334291 - protein, 20 aa, Mycobacterium
NPHDIVLFPAWARRNPLPAS

SEQ ID NO: 1334292 - protein, 31 aa, Mycobacterium
NPIPGHFMDDFLLYWAFLSYALVRGGRRTFG

SEQ ID NO: 1334293 - protein, 17 aa, Mycobacterium
NPIVLVDFWASWCGPCR

SEQ ID NO: 1334294 - protein, 18 aa, Mycobacterium
NPSRLVLISPWLDVSMSD

SEQ ID NO: 1334295 - protein, 21 aa, Mycobacterium
NPVLALPFRPLLKFLTAGFLA

SEQ ID NO: 1334296 - protein, 32 aa, Mycobacterium
NPVPQRFMDDFLLYWSFLAFALVRGGRRTFGP

SEQ ID NO: 1334297 - protein, 28 aa, Mycobacterium
NRAYTPWYLVRYWRLLKFKLANPHIITR

SEQ ID NO: 1334298 - protein, 20 aa, Mycobacterium
NRIILSPYWPESLGVLAIPI

SEQ ID NO: 1334299 - protein, 18 aa, Mycobacterium
NRPGYLRFDFNWQGALTD

SEQ ID NO: 1334300 - protein, 24 aa, Mycobacterium
NRRSKFPHRWWWVTLTDEAFPRFS

SEQ ID NO: 1334301 - protein, 26 aa, Mycobacterium
NSDLINRLLPILAPIVLAYIGRKLSG

SEQ ID NO: 1334302 - protein, 17 aa, Mycobacterium
NSFFFAAPLEWQERLWP

SEQ ID NO: 1334303 - protein, 23 aa, Mycobacterium
NSTLCSYLNKMLWILTGNFAKRG

SEQ ID NO: 1334304 - protein, 17 aa, Mycobacterium
NTLILKPAPDTPWCAAA

SEQ ID NO: 1334305 - protein, 18 aa, Mycobacterium
NTVFAAQIGLLREAVRLG

SEQ ID NO: 1334306 - protein, 25 aa, Mycobacterium
NVARAAELLSWWRSTTPDYVEIAYT

SEQ ID NO: 1334307 - protein, 17 aa, Mycobacterium
NVCGNGFIYDPYRWCKP

SEQ ID NO: 1334308 - protein, 21 aa, Mycobacterium
NVFGALWITQAALPYLREQRG

SEQ ID NO: 1334309 - protein, 23 aa, Mycobacterium
NVGIMDFGFFWVTGVTMEGTIVV

SEQ ID NO: 1334310 - protein, 20 aa, Mycobacterium
NVLSVLSWFHPPTSGAYSAA

SEQ ID NO: 1334311 - protein, 18 aa, Mycobacterium
NWLEALGFQFERSYYPGK

SEQ ID NO: 1334312 - protein, 23 aa, Mycobacterium
NYEYGFFWYLYNDASIEMEVKLT

SEQ ID NO: 1334313 - protein, 21 aa, Mycobacterium
PAALAFLRRLGVAAGLAMGFP

SEQ ID NO: 1334314 - protein, 17 aa, Mycobacterium
PACPKHWTLLISLKRLA

SEQ ID NO: 1334315 - protein, 20 aa, Mycobacterium
PADPFNLLAMLNIGAGILSS

SEQ ID NO: 1334316 - protein, 26 aa, Mycobacterium
PADPPFEGMWWLYVPMAFDDFAIVLI

SEQ ID NO: 1334317 - protein, 17 aa, Mycobacterium
PADYLPLFVAPQPVRFD

SEQ ID NO: 1334318 - protein, 18 aa, Mycobacterium
PAGNGDGWGFWFLGRWIR

SEQ ID NO: 1334319 - protein, 24 aa, Mycobacterium
PAGYLAWLRKLTGPQAWIVIEKIL

SEQ ID NO: 1334320 - protein, 19 aa, Mycobacterium
PAHGWRRWVYRLSFGRINP

SEQ ID NO: 1334321 - protein, 23 aa, Mycobacterium
PAHPADLWRAAADLGWHGLAVAE

SEQ ID NO: 1334322 - protein, 20 aa, Mycobacterium
PAIRYLPYWESLEPVPAPGE

SEQ ID NO: 1334323 - protein, 19 aa, Mycobacterium
PALVFVSWPDSGPLIGADA

SEQ ID NO: 1334324 - protein, 17 aa, Mycobacterium
PALVPLEHPLASVNGAF

SEQ ID NO: 1334325 - protein, 23 aa, Mycobacterium
PAPELPPLLPGQVLRLGPAAGTG

SEQ ID NO: 1334326 - protein, 18 aa, Mycobacterium
PAPLLRWGVGKFNPEARS

SEQ ID NO: 1334327 - protein, 24 aa, Mycobacterium
PAPLLWQRYLAIIFDGLRPDGAHP

SEQ ID NO: 1334328 - protein, 23 aa, Mycobacterium
PAPPAPVLAPRRKTRQLMVRDVG

SEQ ID NO: 1334329 - protein, 19 aa, Mycobacterium
PAPVPIPPNSVPAPPPPPP

SEQ ID NO: 1334330 - protein, 22 aa, Mycobacterium
PAPWVPPWMAPPPAPQPSCVVF

SEQ ID NO: 1334331 - protein, 23 aa, Mycobacterium
PAQRLPLVLLNPSLAPREAELKA

SEQ ID NO: 1334332 - protein, 22 aa, Mycobacterium
PARALQVMFVLPELRAGLHFNA

SEQ ID NO: 1334333 - protein, 26 aa, Mycobacterium
PARVKCALLGWTAFKAALAQAHGPEI

SEQ ID NO: 1334334 - protein, 20 aa, Mycobacterium
PASLRLIALLDPPVEHLRLT

SEQ ID NO: 1334335 - protein, 19 aa, Mycobacterium
PAWLVFDQRYRDRYIFAGL

SEQ ID NO: 1334336 - protein, 25 aa, Mycobacterium
PDAFDCSGLIKWAFLQNGKSLPRSS

SEQ ID NO: 1334337 - protein, 17 aa, Mycobacterium
PDAPWGLFPAQGDDRWV

SEQ ID NO: 1334338 - protein, 26 aa, Mycobacterium
PDDPPFEGMWWLYVPMAFDDFGIVII

SEQ ID NO: 1334339 - protein, 24 aa, Mycobacterium
PDLAYEFLPVVWRVIQHYGIDVGG

SEQ ID NO: 1334340 - protein, 19 aa, Mycobacterium
PDLGPLFLNAMPIQMAEAV

SEQ ID NO: 1334341 - protein, 24 aa, Mycobacterium
PDLPATVLPFILRGVTLAGIDSVL

SEQ ID NO: 1334342 - protein, 23 aa, Mycobacterium
PDPLLVVFLLFDVMRDALRERVV

SEQ ID NO: 1334343 - protein, 18 aa, Mycobacterium
PDQLAFFGVLGALAALGA

SEQ ID NO: 1334344 - protein, 25 aa, Mycobacterium
PDRELAFLHPLPVRRLWGVGAKTAD

SEQ ID NO: 1334345 - protein, 25 aa, Mycobacterium
PDRELAFLHPLPVRRLWGVGEKTAA

SEQ ID NO: 1334346 - protein, 19 aa, Mycobacterium
PDRPAFFFAIDGHSLWANS

SEQ ID NO: 1334347 - protein, 17 aa, Mycobacterium
PDRPAVLVPAFLSRGYH

SEQ ID NO: 1334348 - protein, 17 aa, Mycobacterium
PDRRYVMAISSLDPTGD

SEQ ID NO: 1334349 - protein, 18 aa, Mycobacterium
PDWQLICRIAAELGFGAD

SEQ ID NO: 1334350 - protein, 24 aa, Mycobacterium
PDWTIRGWSWFPDSTRALINEQQR

SEQ ID NO: 1334351 - protein, 20 aa, Mycobacterium
PEAYFQFPVAKYGIALDNWS

SEQ ID NO: 1334352 - protein, 18 aa, Mycobacterium
PECAIAYQAVLLSGAVLV

SEQ ID NO: 1334353 - protein, 25 aa, Mycobacterium
PEEERQLRHVLLRKFPRHLLGSVPL

SEQ ID NO: 1334354 - protein, 19 aa, Mycobacterium
PEIQQLQGWLTDWGVSAAP

SEQ ID NO: 1334355 - protein, 17 aa, Mycobacterium
PEIVLLARSAGFDAVFV

SEQ ID NO: 1334356 - protein, 30 aa, Mycobacterium
PELMATYWRRYILPRRRLAAALLERARELG

SEQ ID NO: 1334357 - protein, 24 aa, Mycobacterium
PENQLLGALLWMPYTRARTFCDLI

SEQ ID NO: 1334358 - protein, 18 aa, Mycobacterium
PEQGAWLQPFRPLSSLLT

SEQ ID NO: 1334359 - protein, 23 aa, Mycobacterium
PERPLVGPLLWDLTAGTATDTTE

SEQ ID NO: 1334360 - protein, 19 aa, Mycobacterium
PERWDWLHAHLSVGRLREL

SEQ ID NO: 1334361 - protein, 26 aa, Mycobacterium
PEYRTMPMVWYIPPLSPVVDAVSRDG

SEQ ID NO: 1334362 - protein, 19 aa, Mycobacterium
PFFASLLEFITSGPVVAAI

SEQ ID NO: 1334363 - protein, 18 aa, Mycobacterium
PFLGMPFWLGRGFGLNLS

SEQ ID NO: 1334364 - protein, 19 aa, Mycobacterium
PFLGMPFWLGRGFGLNLSV

SEQ ID NO: 1334365 - protein, 17 aa, Mycobacterium
PFRWMEFYAFGAHFPDL

SEQ ID NO: 1334366 - protein, 17 aa, Mycobacterium
PFWAITKHADIMAIERA

SEQ ID NO: 1334367 - protein, 17 aa, Mycobacterium
PFYDPWFAKARTSGSIE

SEQ ID NO: 1334368 - protein, 22 aa, Mycobacterium
PGDPLLLRLVGTLAPGVLLPGF

SEQ ID NO: 1334369 - protein, 18 aa, Mycobacterium
PGFIETPLFDAVVGMPGM

SEQ ID NO: 1334370 - protein, 18 aa, Mycobacterium
PGFLFLDPPDHTRLRWLV

SEQ ID NO: 1334371 - protein, 23 aa, Mycobacterium
PGGRDEIWRFTPLRRLRGLHDGS

SEQ ID NO: 1334372 - protein, 17 aa, Mycobacterium
PGHWLLARLGKRVLRPG

SEQ ID NO: 1334373 - protein, 17 aa, Mycobacterium
PGLAAYGDPILHVGPLG

SEQ ID NO: 1334374 - protein, 17 aa, Mycobacterium
PGLDRILQWDLRFGMHV

SEQ ID NO: 1334375 - protein, 17 aa, Mycobacterium
PGLSWPITLGHEIAGTV

SEQ ID NO: 1334376 - protein, 20 aa, Mycobacterium
PGMLTAYYRARSSPSGQTLL

SEQ ID NO: 1334377 - protein, 21 aa, Mycobacterium
PGPGFAMLRRGGLRLLLNVPE

SEQ ID NO: 1334378 - protein, 21 aa, Mycobacterium
PGSRLLFPALCRPTAPVVVSS

SEQ ID NO: 1334379 - protein, 23 aa, Mycobacterium
PGTGLRGLTLPVLRSWLAAQATA

SEQ ID NO: 1334380 - protein, 20 aa, Mycobacterium
PGVRPFLLFGDAPAGVDVPV

SEQ ID NO: 1334381 - protein, 18 aa, Mycobacterium
PHFLTQLRKPLIAAINGA

SEQ ID NO: 1334382 - protein, 18 aa, Mycobacterium
PHFRPPRDGVTPMIMVGP

SEQ ID NO: 1334383 - protein, 19 aa, Mycobacterium
PHRPVAEYFVWFKGDYRVD

SEQ ID NO: 1334384 - protein, 19 aa, Mycobacterium
PHSHFVFLEALRLQGTADQ

SEQ ID NO: 1334385 - protein, 17 aa, Mycobacterium
PITTPFGLYDCDVPCDG

SEQ ID NO: 1334386 - protein, 17 aa, Mycobacterium
PIWLHTYNYHRGHTALG

SEQ ID NO: 1334387 - protein, 19 aa, Mycobacterium
PIYHAAPLRWCGMVHALGG

SEQ ID NO: 1334388 - protein, 23 aa, Mycobacterium
PKETWLRLVIIRAGFPRPETQVP

SEQ ID NO: 1334389 - protein, 23 aa, Mycobacterium
PKLARAFLRFNFQLLYGTTLPER

SEQ ID NO: 1334390 - protein, 19 aa, Mycobacterium
PKQRAVLAVLLLAAGRVVS

SEQ ID NO: 1334391 - protein, 24 aa, Mycobacterium
PKVHSLGLFQPLPGRYLDIITKRV

SEQ ID NO: 1334392 - protein, 17 aa, Mycobacterium
PLAWRTALWFWTTQKAA

SEQ ID NO: 1334393 - protein, 20 aa, Mycobacterium
PLGGLLFPTLATPTAPLPDV

SEQ ID NO: 1334394 - protein, 19 aa, Mycobacterium
PLLVVFFFDVMRDVLRERV

SEQ ID NO: 1334395 - protein, 19 aa, Mycobacterium
PLNGYLYNPVIGQALFEVG

SEQ ID NO: 1334396 - protein, 18 aa, Mycobacterium
PLPFVHQSSPLYLAGGSR

SEQ ID NO: 1334397 - protein, 20 aa, Mycobacterium
PLPPATEPLQWWLRAVAAGG

SEQ ID NO: 1334398 - protein, 23 aa, Mycobacterium
PLPRWQIGLFWRTDGEPLWADES

SEQ ID NO: 1334399 - protein, 23 aa, Mycobacterium
PLPRWQIGLYWRTDGAPLWTDAS

SEQ ID NO: 1334400 - protein, 18 aa, Mycobacterium
PLRTLYRDRLLVLAALDV

SEQ ID NO: 1334401 - protein, 17 aa, Mycobacterium
PLSTWFAAIWLVTSQKN

SEQ ID NO: 1334402 - protein, 17 aa, Mycobacterium
PLTMLLLAKLMAEAGLP

SEQ ID NO: 1334403 - protein, 18 aa, Mycobacterium
PLVALWDETTWVPGSPWL

SEQ ID NO: 1334404 - protein, 19 aa, Mycobacterium
PLVPLYLRRPDAKPPRAVA

SEQ ID NO: 1334405 - protein, 17 aa, Mycobacterium
PLYQVVAKVLPAIAAGC

SEQ ID NO: 1334406 - protein, 23 aa, Mycobacterium
PMAAILLSLLWEGKPLLGLTWLP

SEQ ID NO: 1334407 - protein, 19 aa, Mycobacterium
PMCFGFHPYLQLPGIPRAQ

SEQ ID NO: 1334408 - protein, 19 aa, Mycobacterium
PMFLLYDYSFLPQGAGTKA

SEQ ID NO: 1334409 - protein, 20 aa, Mycobacterium
PMNLLNLFFNTLLSVAFEWG

SEQ ID NO: 1334410 - protein, 26 aa, Mycobacterium
PNAFDCSGLIKWAFLQNGKSLPRSSQ

SEQ ID NO: 1334411 - protein, 23 aa, Mycobacterium
PNGRPHLVAMWYAVLDGEIWFET

SEQ ID NO: 1334412 - protein, 26 aa, Mycobacterium
PPADNSLMLWFETMKPLMSTSAERGA

SEQ ID NO: 1334413 - protein, 22 aa, Mycobacterium
PPALIKAILKAPVDLLWNGGIG

SEQ ID NO: 1334414 - protein, 24 aa, Mycobacterium
PPDATLVSWLPFYHDMGLVLGVCA

SEQ ID NO: 1334415 - protein, 24 aa, Mycobacterium
PPDIDLGWWLMFERFLCESLGFTR

SEQ ID NO: 1334416 - protein, 24 aa, Mycobacterium
PPDMKLPIALALGWPSRVPGAAPA

SEQ ID NO: 1334417 - protein, 25 aa, Mycobacterium
PPDRNLLWLVFMDPAIRELLPDWDA

SEQ ID NO: 1334418 - protein, 22 aa, Mycobacterium
PPELLDDVHLLRFPPGAHVHVA

SEQ ID NO: 1334419 - protein, 21 aa, Mycobacterium
PPHPCPLSFIVAPTLIAHGTP

SEQ ID NO: 1334420 - protein, 22 aa, Mycobacterium
PPLHTLYLDRPLKGALLMQTLA

SEQ ID NO: 1334421 - protein, 20 aa, Mycobacterium
PPSVPPIEFPATVPAVPGGQ

SEQ ID NO: 1334422 - protein, 20 aa, Mycobacterium
PPTFVLFTTGFLEAGYRRFL

SEQ ID NO: 1334423 - protein, 17 aa, Mycobacterium
PPTIPERVLRNAFTDSW

SEQ ID NO: 1334424 - protein, 24 aa, Mycobacterium
PPTVTVFGLPIFKLGGSPVKVVSS

SEQ ID NO: 1334425 - protein, 19 aa, Mycobacterium
PPWWLKYVNKVMIVLNRTG

SEQ ID NO: 1334426 - protein, 17 aa, Mycobacterium
PQHLVANSWRRLARSFW

SEQ ID NO: 1334427 - protein, 19 aa, Mycobacterium
PQMWDWWFGWHGSDTRRYK

SEQ ID NO: 1334428 - protein, 20 aa, Mycobacterium
PQPLWALWRFSNQPEATRLT

SEQ ID NO: 1334429 - protein, 18 aa, Mycobacterium
PRAWRLAVELSREGDQIK

SEQ ID NO: 1334430 - protein, 22 aa, Mycobacterium
PRGLRYLVVINNWDPRDGTYDL

SEQ ID NO: 1334431 - protein, 20 aa, Mycobacterium
PRLHALAPLRYQLVDIPLKF

SEQ ID NO: 1334432 - protein, 24 aa, Mycobacterium
PRRSKPILIPGRPAYLFGAGFMPA

SEQ ID NO: 1334433 - protein, 24 aa, Mycobacterium
PSAHAWIAHIWTPPFTSKRLRRRL

SEQ ID NO: 1334434 - protein, 23 aa, Mycobacterium
PSFRYHGWGPRMWTWVQMMGLRK

SEQ ID NO: 1334435 - protein, 17 aa, Mycobacterium
PSKPLMPSTWGAAPTTA

SEQ ID NO: 1334436 - protein, 17 aa, Mycobacterium
PSLLLPLWDSELGKGFI

SEQ ID NO: 1334437 - protein, 22 aa, Mycobacterium
PSNNVEFFFLRPKDIAIYVGSG

SEQ ID NO: 1334438 - protein, 17 aa, Mycobacterium
PSPYLPTSRRFVNPMYL

SEQ ID NO: 1334439 - protein, 20 aa, Mycobacterium
PSPYMYLLNVPNADGGLDFS

SEQ ID NO: 1334440 - protein, 23 aa, Mycobacterium
PSSRLLFPIEGFSLWPCTVNNGK

SEQ ID NO: 1334441 - protein, 17 aa, Mycobacterium
PTALWTGWALRLSPPAL

SEQ ID NO: 1334442 - protein, 17 aa, Mycobacterium
PTDTRAYFRGECLRRFG

SEQ ID NO: 1334443 - protein, 26 aa, Mycobacterium
PTGEPLPMLLLVTAFMHSLYDGVVDR

SEQ ID NO: 1334444 - protein, 27 aa, Mycobacterium
PTGEPLPMLLLVTAFMHSLYDGVVDRG

SEQ ID NO: 1334445 - protein, 18 aa, Mycobacterium
PTLLLPAPVRRALTPPWL

SEQ ID NO: 1334446 - protein, 24 aa, Mycobacterium
PTLLPSWLAYLPPATTPRIFRMQA

SEQ ID NO: 1334447 - protein, 25 aa, Mycobacterium
PTLPQWLRRRLALLLDLCYGAGARP

SEQ ID NO: 1334448 - protein, 17 aa, Mycobacterium
PTLTWNVLDTENYPLLL

SEQ ID NO: 1334449 - protein, 20 aa, Mycobacterium
PTMTIAATSLYLVCLRIVTS

SEQ ID NO: 1334450 - protein, 24 aa, Mycobacterium
PTRHPYGLALWQKHIERILAEWVD

SEQ ID NO: 1334451 - protein, 17 aa, Mycobacterium
PTRPVAAPPPRRSGRRA

SEQ ID NO: 1334452 - protein, 18 aa, Mycobacterium
PTVFPGHWYSADPSAPLS

SEQ ID NO: 1334453 - protein, 27 aa, Mycobacterium
PVDLAVFPAFLFIPISAGGTMVVPPID

SEQ ID NO: 1334454 - protein, 25 aa, Mycobacterium
PVELAIWLVRFRADSPGWPDLALAD

SEQ ID NO: 1334455 - protein, 26 aa, Mycobacterium
PVEPMGPLINSLWWAVPKSGGRSTND

SEQ ID NO: 1334456 - protein, 21 aa, Mycobacterium
PVGFKWFVDGLIGGSIGFGGE

SEQ ID NO: 1334457 - protein, 19 aa, Mycobacterium
PVGWLMLRRILPPDTVTPD

SEQ ID NO: 1334458 - protein, 19 aa, Mycobacterium
PVIALRRRLLPDSPRITTL

SEQ ID NO: 1334459 - protein, 17 aa, Mycobacterium
PVIEKFWRTSLGPGLSA

SEQ ID NO: 1334460 - protein, 18 aa, Mycobacterium
PVLAHDIPWNSGVMRAIE

SEQ ID NO: 1334461 - protein, 19 aa, Mycobacterium
PVLVDLWATWCGPCRMVSP

SEQ ID NO: 1334462 - protein, 24 aa, Mycobacterium
PVMFSTFLMWVLADLFTTLPEVGD

SEQ ID NO: 1334463 - protein, 17 aa, Mycobacterium
PVQGAWQLLIELAGETD

SEQ ID NO: 1334464 - protein, 23 aa, Mycobacterium
PVTRPRIRLAYRLTPRRVLGEER

SEQ ID NO: 1334465 - protein, 18 aa, Mycobacterium
PVVYMFHKGIMGLSWMSK

SEQ ID NO: 1334466 - protein, 18 aa, Mycobacterium
PVWAFDRVLMPGIVRWGI

SEQ ID NO: 1334467 - protein, 25 aa, Mycobacterium
PVWPVMTWLFAWCFARRGWAERAAT

SEQ ID NO: 1334468 - protein, 25 aa, Mycobacterium
PVWPVMTWLFAWCFARRGWAERARV

SEQ ID NO: 1334469 - protein, 19 aa, Mycobacterium
PVYLYRFDFHTPLLRLVRL

SEQ ID NO: 1334470 - protein, 19 aa, Mycobacterium
PWNFPLNLVVLPAAAAFAA

SEQ ID NO: 1334471 - protein, 19 aa, Mycobacterium
PWPYAPRIILRSLIQQAAD

SEQ ID NO: 1334472 - protein, 18 aa, Mycobacterium
PWRTEALVLLAFSAYARG

SEQ ID NO: 1334473 - protein, 23 aa, Mycobacterium
PWYLVRYWRLLKFKLTNPHVITR

SEQ ID NO: 1334474 - protein, 18 aa, Mycobacterium
PYSIVRLIVEILEPFHGR

SEQ ID NO: 1334475 - protein, 32 aa, Mycobacterium
QAAPGLFLFCAVLAFSRWRFVRFAANERASTT

SEQ ID NO: 1334476 - protein, 24 aa, Mycobacterium
QAEAAGLVWLPIGPSLDVAAHVEE

SEQ ID NO: 1334477 - protein, 22 aa, Mycobacterium
QAIRVLMGCPFLNGLQARRLER

SEQ ID NO: 1334478 - protein, 18 aa, Mycobacterium
QALLLDWGFAPMTVGSRP

SEQ ID NO: 1334479 - protein, 17 aa, Mycobacterium
QARARPIAPLLAGLQSL

SEQ ID NO: 1334480 - protein, 22 aa, Mycobacterium
QDAFLRAWEYRPWRAEALYAVA

SEQ ID NO: 1334481 - protein, 24 aa, Mycobacterium
QDLYRRWPFFATVLSNMAQVLAKS

SEQ ID NO: 1334482 - protein, 23 aa, Mycobacterium
QDLYRRWPFFRTVLSNMAQVLAK

SEQ ID NO: 1334483 - protein, 22 aa, Mycobacterium
QDYRGFYLDFNLNLNVPPACTT

SEQ ID NO: 1334484 - protein, 19 aa, Mycobacterium
QEFVKKLPAWVSWERREHY

SEQ ID NO: 1334485 - protein, 23 aa, Mycobacterium
QEQLWFLNQLLPSSSAYNVAIRV

SEQ ID NO: 1334486 - protein, 18 aa, Mycobacterium
QERIRFRPPQWAHGPRIV

SEQ ID NO: 1334487 - protein, 24 aa, Mycobacterium
QEVREIYAMWRPSPLIRARRFEKA

SEQ ID NO: 1334488 - protein, 25 aa, Mycobacterium
QEYFLVDRHFFLARPDLVNAGRTLF

SEQ ID NO: 1334489 - protein, 24 aa, Mycobacterium
QFNSLFLDPYLWKLQVGGKRLVQK

SEQ ID NO: 1334490 - protein, 18 aa, Mycobacterium
QFPMGLGLVSQFFGRYYT

SEQ ID NO: 1334491 - protein, 17 aa, Mycobacterium
QFWPLWEAAADAGLPVA

SEQ ID NO: 1334492 - protein, 24 aa, Mycobacterium
QGAFFLRVIGWSGGRQRVIVEHIT

SEQ ID NO: 1334493 - protein, 20 aa, Mycobacterium
QGALRMRFNLALYADPRHFD

SEQ ID NO: 1334494 - protein, 19 aa, Mycobacterium
QGQCRFSWPPQIDLPGYKP

SEQ ID NO: 1334495 - protein, 18 aa, Mycobacterium
QGRALLPSLLRYQTPMWP

SEQ ID NO: 1334496 - protein, 25 aa, Mycobacterium
QGSKELFLWPTLRYWEFPKPMIAQV

SEQ ID NO: 1334497 - protein, 25 aa, Mycobacterium
QGWGLGFHLYLIDLPGMRSAGSADW

SEQ ID NO: 1334498 - protein, 17 aa, Mycobacterium
QGWLTDWGVSAAPTSGS

SEQ ID NO: 1334499 - protein, 17 aa, Mycobacterium
QHEADTPFFVWFNSTHM

SEQ ID NO: 1334500 - protein, 17 aa, Mycobacterium
QHRLFLQTVFHAMEDAG

SEQ ID NO: 1334501 - protein, 19 aa, Mycobacterium
QHYALFPHMTVWDNVAYGP

SEQ ID NO: 1334502 - protein, 21 aa, Mycobacterium
QIDRIRRAHLLLAMFNALQPG

SEQ ID NO: 1334503 - protein, 19 aa, Mycobacterium
QIGLLLPCNVAVRADTSAG

SEQ ID NO: 1334504 - protein, 19 aa, Mycobacterium
QIKAIWRVNELLNWQVAAS

SEQ ID NO: 1334505 - protein, 17 aa, Mycobacterium
QIRLPGFRPGKAPRKLL

SEQ ID NO: 1334506 - protein, 23 aa, Mycobacterium
QKADLRLVVIDYLQLMTSGKKVE

SEQ ID NO: 1334507 - protein, 23 aa, Mycobacterium
QKAGLRLIVIDYLQLMTSGKKVE

SEQ ID NO: 1334508 - protein, 17 aa, Mycobacterium
QLELLWIPRAEPTRLFR

SEQ ID NO: 1334509 - protein, 19 aa, Mycobacterium
QLFYLRARGIPENQARRLV

SEQ ID NO: 1334510 - protein, 17 aa, Mycobacterium
QLGPLRLFGHCMGALVG

SEQ ID NO: 1334511 - protein, 20 aa, Mycobacterium
QLLRLWADYLDMPPLRVNPA

SEQ ID NO: 1334512 - protein, 17 aa, Mycobacterium
QLQGWLTDWGVSAAPTS

SEQ ID NO: 1334513 - protein, 21 aa, Mycobacterium
QLRDLMDLHLFGPAALVRAAL

SEQ ID NO: 1334514 - protein, 17 aa, Mycobacterium
QLRGAIAAVFRSWHSAR

SEQ ID NO: 1334515 - protein, 20 aa, Mycobacterium
QLRGRLVLAWRASGPVSPAA

SEQ ID NO: 1334516 - protein, 23 aa, Mycobacterium
QLRTTIPELPWLARKRIQQDWGI

SEQ ID NO: 1334517 - protein, 24 aa, Mycobacterium
QMLPPRGRRWLSRKLGLDRVFLEF

SEQ ID NO: 1334518 - protein, 18 aa, Mycobacterium
QMWGDAVFHCPFCHGWEV

SEQ ID NO: 1334519 - protein, 26 aa, Mycobacterium
QPALRDLGWFRFLIGRLDGPEGPPLL

SEQ ID NO: 1334520 - protein, 17 aa, Mycobacterium
QPLWALWRFSNQPEATR

SEQ ID NO: 1334521 - protein, 19 aa, Mycobacterium
QPLWALWRFSNQPEATRLT

SEQ ID NO: 1334522 - protein, 20 aa, Mycobacterium
QPRLFPWRTVGGNVDMALRY

SEQ ID NO: 1334523 - protein, 24 aa, Mycobacterium
QQADDVWLPLFRPVAGDLGELPAD

SEQ ID NO: 1334524 - protein, 18 aa, Mycobacterium
QQAFLFGPPPLGPGAPPL

SEQ ID NO: 1334525 - protein, 17 aa, Mycobacterium
QQATWDRLWPELGRQVR

SEQ ID NO: 1334526 - protein, 18 aa, Mycobacterium
QQFALLFVAWLNANPAVR

SEQ ID NO: 1334527 - protein, 18 aa, Mycobacterium
QRFALLFLAWLAAHPEVR

SEQ ID NO: 1334528 - protein, 23 aa, Mycobacterium
QRGWRHWLYVMTRINLGLSADEL

SEQ ID NO: 1334529 - protein, 24 aa, Mycobacterium
QRIKELVIPPAWKDVWISPKPSGH

SEQ ID NO: 1334530 - protein, 20 aa, Mycobacterium
QRIMLIARDGGCTKPGCAVG

SEQ ID NO: 1334531 - protein, 18 aa, Mycobacterium
QRLSVFFFDLLHADGVDL

SEQ ID NO: 1334532 - protein, 21 aa, Mycobacterium
QRSWVHVLPSRKEGWGLAVTE

SEQ ID NO: 1334533 - protein, 20 aa, Mycobacterium
QRVFFGWAQVWRTKSREAEA

SEQ ID NO: 1334534 - protein, 18 aa, Mycobacterium
QRVGWFRFYFADERWEWS

SEQ ID NO: 1334535 - protein, 19 aa, Mycobacterium
QRVKTWLQFPQWFYNDTQP

SEQ ID NO: 1334536 - protein, 17 aa, Mycobacterium
QRWRDLLLTLEQRLLLT

SEQ ID NO: 1334537 - protein, 19 aa, Mycobacterium
QRWRPMNLLNLFFNTLLSV

SEQ ID NO: 1334538 - protein, 22 aa, Mycobacterium
QRYRHVPVVLLTPGGRRLCTLD

SEQ ID NO: 1334539 - protein, 22 aa, Mycobacterium
QSAVKPWLVTVAKLLGRIAPGA

SEQ ID NO: 1334540 - protein, 24 aa, Mycobacterium
QSDQGMFMVNWPYVLAAARSAAEE

SEQ ID NO: 1334541 - protein, 22 aa, Mycobacterium
QSHPVPLLFVHGAWHAAWCWDE

SEQ ID NO: 1334542 - protein, 19 aa, Mycobacterium
QSIPRYFYALFAIDLTNKN

SEQ ID NO: 1334543 - protein, 25 aa, Mycobacterium
QSLLVRALVAWFWEEPLRAPLIRHG

SEQ ID NO: 1334544 - protein, 17 aa, Mycobacterium
QSLTMFLVPLDATGVEI

SEQ ID NO: 1334545 - protein, 17 aa, Mycobacterium
QSWSASYLPLTRVLRRL

SEQ ID NO: 1334546 - protein, 18 aa, Mycobacterium
QTFASWRLHELRGVPTAL

SEQ ID NO: 1334547 - protein, 22 aa, Mycobacterium
QTLSLLHRILARVLPEDAKDED

SEQ ID NO: 1334548 - protein, 18 aa, Mycobacterium
QTVGMLFSPGYPGFLRGV

SEQ ID NO: 1334549 - protein, 17 aa, Mycobacterium
QTYVPGYRLLNEPQFDP

SEQ ID NO: 1334550 - protein, 21 aa, Mycobacterium
QVAELLARIRAELPPLAGVAH

SEQ ID NO: 1334551 - protein, 18 aa, Mycobacterium
QVPRRARVAFRWLRAVAL

SEQ ID NO: 1334552 - protein, 22 aa, Mycobacterium
QVRLYRPFPTAAFLESLPATVR

SEQ ID NO: 1334553 - protein, 17 aa, Mycobacterium
QWLLVDRSLFEVGQVRP

SEQ ID NO: 1334554 - protein, 17 aa, Mycobacterium
QWWGRQMLIWGVHVHVG

SEQ ID NO: 1334555 - protein, 28 aa, Mycobacterium
QYALSFDWFPIPLPPLPPFPPLPIFDAA

SEQ ID NO: 1334556 - protein, 24 aa, Mycobacterium
RACSGWFPRTLWSGKLVLTAEGGL

SEQ ID NO: 1334557 - protein, 17 aa, Mycobacterium
RADVVEIFPNPAAFLRL

SEQ ID NO: 1334558 - protein, 24 aa, Mycobacterium
RAEPFPVFTFFRDYNRYLSRGASS

SEQ ID NO: 1334559 - protein, 22 aa, Mycobacterium
RAFYRHFLSKDDLFLALLRQEC

SEQ ID NO: 1334560 - protein, 18 aa, Mycobacterium
RAGFFRGDLPRPVQVVPA

SEQ ID NO: 1334561 - protein, 23 aa, Mycobacterium
RAGGMLSRLRPLFSLGLGARLGN

SEQ ID NO: 1334562 - protein, 25 aa, Mycobacterium
RAGGRIKLAWFLLHAARYLPPQLFA

SEQ ID NO: 1334563 - protein, 21 aa, Mycobacterium
RAGHFPGLQWPITLGHEIAGT

SEQ ID NO: 1334564 - protein, 21 aa, Mycobacterium
RAGMGIQYLLLRSGPMTMPPS

SEQ ID NO: 1334565 - protein, 21 aa, Mycobacterium
RAGRYLPWHPGRCAEIVVGDV

SEQ ID NO: 1334566 - protein, 17 aa, Mycobacterium
RAHKDVVLVPRPALRYL

SEQ ID NO: 1334567 - protein, 25 aa, Mycobacterium
RALAARPRVLLLDEPFAALDAGLRV

SEQ ID NO: 1334568 - protein, 21 aa, Mycobacterium
RALEWMMLHPDSVRAALVLAV

SEQ ID NO: 1334569 - protein, 25 aa, Mycobacterium
RALHPTMWIRMWFTDGEKLHQRGYT

SEQ ID NO: 1334570 - protein, 19 aa, Mycobacterium
RALSFPQWGLATPAAGWGI

SEQ ID NO: 1334571 - protein, 22 aa, Mycobacterium
RANFYYYFRDKAELFIELGTQT

SEQ ID NO: 1334572 - protein, 17 aa, Mycobacterium
RANLFYRGLAFHRYPVL

SEQ ID NO: 1334573 - protein, 26 aa, Mycobacterium
RANPEKVWAWYLWRHYMMDAVQPNNG

SEQ ID NO: 1334574 - protein, 27 aa, Mycobacterium
RAPMEWNLLGWMRRTFFNRPPTIDYDA

SEQ ID NO: 1334575 - protein, 20 aa, Mycobacterium
RAPWLTFVPAYLVGVGVRPE

SEQ ID NO: 1334576 - protein, 24 aa, Mycobacterium
RAQALLYYLWRLHSAGRLPGIPIY

SEQ ID NO: 1334577 - protein, 17 aa, Mycobacterium
RARIVLFRKPIERRAKD

SEQ ID NO: 1334578 - protein, 20 aa, Mycobacterium
RARIVLFRKPIERRAKDTDE

SEQ ID NO: 1334579 - protein, 20 aa, Mycobacterium
RARPIAPLLAGLQSLGVRID

SEQ ID NO: 1334580 - protein, 23 aa, Mycobacterium
RARQMLRFLSSPLWRAYTSTYVE

SEQ ID NO: 1334581 - protein, 19 aa, Mycobacterium
RARRETYIGPWLPDPVDTG

SEQ ID NO: 1334582 - protein, 27 aa, Mycobacterium
RATETWRFPAFFHGLLDAGVYPPPSAY

SEQ ID NO: 1334583 - protein, 29 aa, Mycobacterium
RAVALAPRLWVPDDFGLSRYLAAGLAVLQ

SEQ ID NO: 1334584 - protein, 25 aa, Mycobacterium
RAVVMTYWNPVLRWGIDAFARDLAA

SEQ ID NO: 1334585 - protein, 20 aa, Mycobacterium
RAVVMTYWNPVLSKGVDAFA

SEQ ID NO: 1334586 - protein, 17 aa, Mycobacterium
RAWHRPLPEPGMRSEYT

SEQ ID NO: 1334587 - protein, 19 aa, Mycobacterium
RAYRMWLPPLTDPTPVDEL

SEQ ID NO: 1334588 - protein, 25 aa, Mycobacterium
RDAARFLLLTPPLPLSARAPYGVLA

SEQ ID NO: 1334589 - protein, 17 aa, Mycobacterium
RDEHFFVPEPGPRPDPS

SEQ ID NO: 1334590 - protein, 18 aa, Mycobacterium
RDELLNLWRFDSLLEARV

SEQ ID NO: 1334591 - protein, 22 aa, Mycobacterium
RDFLLTALTLTLASWRIERGQP

SEQ ID NO: 1334592 - protein, 21 aa, Mycobacterium
RDGRWYWHWDPAFLTKPGDDP

SEQ ID NO: 1334593 - protein, 24 aa, Mycobacterium
RDIGRWRIPVILGLRSDVGEDDVR

SEQ ID NO: 1334594 - protein, 19 aa, Mycobacterium
RDIVLAIVRDRPLAPVARI

SEQ ID NO: 1334595 - protein, 24 aa, Mycobacterium
RDKFPRAVLPRTFDYGFATGLMTK

SEQ ID NO: 1334596 - protein, 23 aa, Mycobacterium
RDMGLMLGEYWDLGPLAADCAAD

SEQ ID NO: 1334597 - protein, 21 aa, Mycobacterium
RDRPRFWIAIEPFGNPRIQYT

SEQ ID NO: 1334598 - protein, 23 aa, Mycobacterium
RDSAVMYLIYPYDTPGRMDVTND

SEQ ID NO: 1334599 - protein, 20 aa, Mycobacterium
RDYLTDLFPILELGTSAKML

SEQ ID NO: 1334600 - protein, 27 aa, Mycobacterium
READPIRLVWTLFYVAICYAALRTPEA

SEQ ID NO: 1334601 - protein, 17 aa, Mycobacterium
REAVLTEGWRLHPDSDP

SEQ ID NO: 1334602 - protein, 21 aa, Mycobacterium
REAWPVLRRNLSVLALRGADP

SEQ ID NO: 1334603 - protein, 18 aa, Mycobacterium
REDKFSFGLWTVGWPGVD

SEQ ID NO: 1334604 - protein, 18 aa, Mycobacterium
REGRPIHLLINNAGVMNP

SEQ ID NO: 1334605 - protein, 20 aa, Mycobacterium
REHALLLALRRDPEVEALSV

SEQ ID NO: 1334606 - protein, 17 aa, Mycobacterium
REIGLLTMRLGRDRPHG

SEQ ID NO: 1334607 - protein, 21 aa, Mycobacterium
RELLCELIWSPPGQPALRDLG

SEQ ID NO: 1334608 - protein, 21 aa, Mycobacterium
RELLRLWADYLDMPPLRVDPA

SEQ ID NO: 1334609 - protein, 23 aa, Mycobacterium
REMTRLLRRILELPLPVIAAVDG

SEQ ID NO: 1334610 - protein, 18 aa, Mycobacterium
RENIPVLGAKRFFFAEKT

SEQ ID NO: 1334611 - protein, 23 aa, Mycobacterium
REPVRSLVWIQGRLRDVPIGEVP

SEQ ID NO: 1334612 - protein, 21 aa, Mycobacterium
REYMWHLYWHFGPEYAAKNEL

SEQ ID NO: 1334613 - protein, 17 aa, Mycobacterium
RFAGMLVAGTYLREFVA

SEQ ID NO: 1334614 - protein, 26 aa, Mycobacterium
RFAPEAIRRPRWLLEFARSGRVPDLT

SEQ ID NO: 1334615 - protein, 17 aa, Mycobacterium
RFCTQFIKLGLGGCDIG

SEQ ID NO: 1334616 - protein, 19 aa, Mycobacterium
RFDIVLYLNGMPIAFFELK

SEQ ID NO: 1334617 - protein, 18 aa, Mycobacterium
RFGRIIFIGSVSGMWGIG

SEQ ID NO: 1334618 - protein, 17 aa, Mycobacterium
RFGTLLDEPLIPSSLRA

SEQ ID NO: 1334619 - protein, 17 aa, Mycobacterium
RFGWYFLISRRDPAGFG

SEQ ID NO: 1334620 - protein, 19 aa, Mycobacterium
RFHAWIFDMLAGVDLGPDA

SEQ ID NO: 1334621 - protein, 19 aa, Mycobacterium
RFISLPIAGIMRLADKPEA

SEQ ID NO: 1334622 - protein, 18 aa, Mycobacterium
RFNAPYLRDALLSAGALC

SEQ ID NO: 1334623 - protein, 18 aa, Mycobacterium
RFPELYVELAERGAEIIT

SEQ ID NO: 1334624 - protein, 17 aa, Mycobacterium
RFPKFDWPRIDAPFIRP

SEQ ID NO: 1334625 - protein, 19 aa, Mycobacterium
RFRAPRMLDLSLLVAALPE

SEQ ID NO: 1334626 - protein, 17 aa, Mycobacterium
RFRLRCLMGERIRVRQW

SEQ ID NO: 1334627 - protein, 18 aa, Mycobacterium
RFSAKIVALNLLGALSVS

SEQ ID NO: 1334628 - protein, 19 aa, Mycobacterium
RFWMLLGVQITDDAVRHRV

SEQ ID NO: 1334629 - protein, 21 aa, Mycobacterium
RGATRLVIAPWFLAHGRITDR

SEQ ID NO: 1334630 - protein, 17 aa, Mycobacterium
RGELLGAARAAALAAAT

SEQ ID NO: 1334631 - protein, 24 aa, Mycobacterium
RGKAVLLKLIWRMFRARVFGDRMA

SEQ ID NO: 1334632 - protein, 18 aa, Mycobacterium
RGLDVLFANAGLAVLGPL

SEQ ID NO: 1334633 - protein, 17 aa, Mycobacterium
RGMDTLWDKIYLNDLWD

SEQ ID NO: 1334634 - protein, 17 aa, Mycobacterium
RGRGLDVLFANAGLAVL

SEQ ID NO: 1334635 - protein, 21 aa, Mycobacterium
RGRGLLIGIALRAAAAKPAEA

SEQ ID NO: 1334636 - protein, 22 aa, Mycobacterium
RGSYLQMHFALDAGPTFAAPYE

SEQ ID NO: 1334637 - protein, 22 aa, Mycobacterium
RGSYLQMHFALDGAPTFAEPYE

SEQ ID NO: 1334638 - protein, 23 aa, Mycobacterium
RGVELVVVRAWWSPGAFELPGAN

SEQ ID NO: 1334639 - protein, 17 aa, Mycobacterium
RGWWVLRWAGLDDVRIL

SEQ ID NO: 1334640 - protein, 24 aa, Mycobacterium
RHAFGRRLWELPAGLLDFGGEPPH

SEQ ID NO: 1334641 - protein, 17 aa, Mycobacterium
RHDGRVVFVRYALPGET

SEQ ID NO: 1334642 - protein, 17 aa, Mycobacterium
RHDVWNLILAASRLPAN

SEQ ID NO: 1334643 - protein, 18 aa, Mycobacterium
RHGFVKIFCRPATGVVIG

SEQ ID NO: 1334644 - protein, 17 aa, Mycobacterium
RHLLASWIRLVALTAHH

SEQ ID NO: 1334645 - protein, 17 aa, Mycobacterium
RHNWIPFGRFRGLDKVR

SEQ ID NO: 1334646 - protein, 23 aa, Mycobacterium
RHPLGRRLWELPAGLLDMGGEPP

SEQ ID NO: 1334647 - protein, 18 aa, Mycobacterium
RHSLWWPVDVPAADLAAA

SEQ ID NO: 1334648 - protein, 17 aa, Mycobacterium
RIARILGPRGLMPNPKT

SEQ ID NO: 1334649 - protein, 27 aa, Mycobacterium
RIDHIIGLFRLWWIPKGALPTEGTYVR

SEQ ID NO: 1334650 - protein, 20 aa, Mycobacterium
RIERALALTALLRATLTTVR

SEQ ID NO: 1334651 - protein, 17 aa, Mycobacterium
RIERFLLLWAEGSMTIA

SEQ ID NO: 1334652 - protein, 17 aa, Mycobacterium
RIFVYALDWPGESPLRP

SEQ ID NO: 1334653 - protein, 18 aa, Mycobacterium
RIINAWFGPGLQGSAVFT

SEQ ID NO: 1334654 - protein, 20 aa, Mycobacterium
RIKALPPQTQLLLLAAAAEP

SEQ ID NO: 1334655 - protein, 19 aa, Mycobacterium
RIKLFDGLFAYLVQIAPTA

SEQ ID NO: 1334656 - protein, 18 aa, Mycobacterium
RIKLPKLGWVKFRASRDL

SEQ ID NO: 1334657 - protein, 22 aa, Mycobacterium
RILTAMSVFFFDLIDAPNHLAG

SEQ ID NO: 1334658 - protein, 20 aa, Mycobacterium
RIPLNLVLIKGVHVLGFQFQ

SEQ ID NO: 1334659 - protein, 18 aa, Mycobacterium
RIVLFRKPIERRAKDSDE

SEQ ID NO: 1334660 - protein, 23 aa, Mycobacterium
RIVVHLPPWLEPEPLCWDINNVD

SEQ ID NO: 1334661 - protein, 24 aa, Mycobacterium
RKNLIHDWFTFPFLPEAHEDRPGV

SEQ ID NO: 1334662 - protein, 17 aa, Mycobacterium
RLAARLTGWRIDIRSDD

SEQ ID NO: 1334663 - protein, 18 aa, Mycobacterium
RLAGWLGTLPLPAGKKNP

SEQ ID NO: 1334664 - protein, 18 aa, Mycobacterium
RLATLVRLFLLGTDEPRE

SEQ ID NO: 1334665 - protein, 23 aa, Mycobacterium
RLAVLWPEVYPRLLRVMDADPIC

SEQ ID NO: 1334666 - protein, 18 aa, Mycobacterium
RLERGLLPSPLLLDDPGV

SEQ ID NO: 1334667 - protein, 25 aa, Mycobacterium
RLGIRCFGFAPLRLPPDLDFAALFH

SEQ ID NO: 1334668 - protein, 21 aa, Mycobacterium
RLGVDAMWINPWYPSPMADAG

SEQ ID NO: 1334669 - protein, 19 aa, Mycobacterium
RLHPPLIILMRVAQGEFEV

SEQ ID NO: 1334670 - protein, 19 aa, Mycobacterium
RLHTPLPVLAFTALPEVRS

SEQ ID NO: 1334671 - protein, 24 aa, Mycobacterium
RLHYPDIRLVYWAGGNPFHHHQNI

SEQ ID NO: 1334672 - protein, 17 aa, Mycobacterium
RLIALWDRPLRDVRILF

SEQ ID NO: 1334673 - protein, 18 aa, Mycobacterium
RLILRRETFDDLLSLEVS

SEQ ID NO: 1334674 - protein, 21 aa, Mycobacterium
RLLLAGSAKRRFWWAGTATLG

SEQ ID NO: 1334675 - protein, 18 aa, Mycobacterium
RLLPAYLATYRGPHGGAP

SEQ ID NO: 1334676 - protein, 18 aa, Mycobacterium
RLLPGRGLLVCDVWVGAP

SEQ ID NO: 1334677 - protein, 18 aa, Mycobacterium
RLLRLRWPCPIPGAMPVS

SEQ ID NO: 1334678 - protein, 18 aa, Mycobacterium
RLLVVALRRHPVLNATWV

SEQ ID NO: 1334679 - protein, 20 aa, Mycobacterium
RLNPLDWMNGAWRATLAAAG

SEQ ID NO: 1334680 - protein, 19 aa, Mycobacterium
RLNQWVIGLRRPGQRQRLR

SEQ ID NO: 1334681 - protein, 18 aa, Mycobacterium
RLPGFRPGKAPRKLLEAR

SEQ ID NO: 1334682 - protein, 20 aa, Mycobacterium
RLPVTPYGFRLRPVADIVAA

SEQ ID NO: 1334683 - protein, 17 aa, Mycobacterium
RLQPHYIELAFKAAFTR

SEQ ID NO: 1334684 - protein, 17 aa, Mycobacterium
RLRDEHFFVPEPGPRPD

SEQ ID NO: 1334685 - protein, 20 aa, Mycobacterium
RLRLVKYLAYGWSSLRSRPA

SEQ ID NO: 1334686 - protein, 21 aa, Mycobacterium
RLRPAFAYWGWRAVAGTEPGP

SEQ ID NO: 1334687 - protein, 23 aa, Mycobacterium
RLRRPQFAFPSRGILTSGFGARW

SEQ ID NO: 1334688 - protein, 18 aa, Mycobacterium
RLSAFSVAGWLRAKARTT

SEQ ID NO: 1334689 - protein, 27 aa, Mycobacterium
RLTDLEFNLFFMLLLNAGGDTTRNLVA

SEQ ID NO: 1334690 - protein, 18 aa, Mycobacterium
RLVWAWRTDISGPAARLL

SEQ ID NO: 1334691 - protein, 17 aa, Mycobacterium
RMEIALTYIYGVGRTRS

SEQ ID NO: 1334692 - protein, 23 aa, Mycobacterium
RMVQRARDMLWLNRSRWNRTTTG

SEQ ID NO: 1334693 - protein, 23 aa, Mycobacterium
RMWEFLDRLISISLPRIRDFRGL

SEQ ID NO: 1334694 - protein, 20 aa, Mycobacterium
RNIPLVILYATTLPIGAWPV

SEQ ID NO: 1334695 - protein, 21 aa, Mycobacterium
RNRVFIADYSLGWIRVLDFDD

SEQ ID NO: 1334696 - protein, 17 aa, Mycobacterium
RNRWILDLADRVPAALL

SEQ ID NO: 1334697 - protein, 23 aa, Mycobacterium
RPDAWGWLPLLTGVAVRDAVAEV

SEQ ID NO: 1334698 - protein, 25 aa, Mycobacterium
RPDGLPVWIYQFKVSPHRGIPEAPP

SEQ ID NO: 1334699 - protein, 22 aa, Mycobacterium
RPDIALINWPITAPGLVDLATL

SEQ ID NO: 1334700 - protein, 20 aa, Mycobacterium
RPDLVPLFLNALPVVMADAV

SEQ ID NO: 1334701 - protein, 26 aa, Mycobacterium
RPEFVVALRAIWRLGASAVLLSPAWK

SEQ ID NO: 1334702 - protein, 19 aa, Mycobacterium
RPIVVHCAGGWRSSVAASL

SEQ ID NO: 1334703 - protein, 20 aa, Mycobacterium
RPLLLMLSHPFYWEHFGRLT

SEQ ID NO: 1334704 - protein, 20 aa, Mycobacterium
RPPDPLLVLGPERMPGARLW

SEQ ID NO: 1334705 - protein, 23 aa, Mycobacterium
RPQAYLIYALLVCPTKDGRWLQF

SEQ ID NO: 1334706 - protein, 19 aa, Mycobacterium
RPTAWIAEGLLIYLPPDAQ

SEQ ID NO: 1334707 - protein, 17 aa, Mycobacterium
RPTFVPAYVVFPTFQAK

SEQ ID NO: 1334708 - protein, 20 aa, Mycobacterium
RPVAAPPPRRSGRRAIPVLA

SEQ ID NO: 1334709 - protein, 17 aa, Mycobacterium
RPVVGIIAPWNYPVANA

SEQ ID NO: 1334710 - protein, 18 aa, Mycobacterium
RPWNEWLIVWGYDINDEP

SEQ ID NO: 1334711 - protein, 18 aa, Mycobacterium
RQAALNRLLFPAPTKEFE

SEQ ID NO: 1334712 - protein, 18 aa, Mycobacterium
RQGDWIYIPKACTWRQVP

SEQ ID NO: 1334713 - protein, 24 aa, Mycobacterium
RQLDIALEPILLKLQLPMARNMRE

SEQ ID NO: 1334714 - protein, 18 aa, Mycobacterium
RQLFSRLMGPRWRHGPTV

SEQ ID NO: 1334715 - protein, 27 aa, Mycobacterium
RQLRNSWYILFFQLPGLPERLLPRVIP

SEQ ID NO: 1334716 - protein, 25 aa, Mycobacterium
RQRHDGRWIWRWDPAFIHSNFDFLR

SEQ ID NO: 1334717 - protein, 17 aa, Mycobacterium
RQRPGLLVDWLAGDPAD

SEQ ID NO: 1334718 - protein, 18 aa, Mycobacterium
RRALLDVPRLGPKAFEQC

SEQ ID NO: 1334719 - protein, 27 aa, Mycobacterium
RRDKNWRPTMLWAYDPQAFDGKGRAAV

SEQ ID NO: 1334720 - protein, 21 aa, Mycobacterium
RREIGVPTVFNLLGPLTNPAS

SEQ ID NO: 1334721 - protein, 20 aa, Mycobacterium
RRERMFPSWVPLPVSELAVG

SEQ ID NO: 1334722 - protein, 20 aa, Mycobacterium
RRFQVRLTLPPPSRIQATAF

SEQ ID NO: 1334723 - protein, 17 aa, Mycobacterium
RRGAHLYNFWRDATNPK

SEQ ID NO: 1334724 - protein, 19 aa, Mycobacterium
RRGFLFWPTSCRITEVIPE

SEQ ID NO: 1334725 - protein, 22 aa, Mycobacterium
RRGLARWIFGNSAERLLPRLPC

SEQ ID NO: 1334726 - protein, 21 aa, Mycobacterium
RRLLWPLKKKYGKKLSWSDLI

SEQ ID NO: 1334727 - protein, 25 aa, Mycobacterium
RRLPLPTYPFQHRSYWPKTAGIRSD

SEQ ID NO: 1334728 - protein, 18 aa, Mycobacterium
RRLQLMLVLLSEPNVLVL

SEQ ID NO: 1334729 - protein, 23 aa, Mycobacterium
RRMAWYWARIWIEVTPVRVLWWP

SEQ ID NO: 1334730 - protein, 21 aa, Mycobacterium
RRPHWSLARTWLLQPDLPGFP

SEQ ID NO: 1334731 - protein, 21 aa, Mycobacterium
RRRISIYWTWSYPWEAQRDPA

SEQ ID NO: 1334732 - protein, 20 aa, Mycobacterium
RRRLDLAVSLLAAPPVLFLD

SEQ ID NO: 1334733 - protein, 21 aa, Mycobacterium
RRRVALCKLLLSKPDLLLLDE

SEQ ID NO: 1334734 - protein, 18 aa, Mycobacterium
RRRVLDPAIYREAASRLD

SEQ ID NO: 1334735 - protein, 22 aa, Mycobacterium
RRSLFLLRNSPWPSGPKTAAVI

SEQ ID NO: 1334736 - protein, 17 aa, Mycobacterium
RRWLNAHVPFYANWIRL

SEQ ID NO: 1334737 - protein, 21 aa, Mycobacterium
RSAGAIFVGPWSPVSLGDYCA

SEQ ID NO: 1334738 - protein, 22 aa, Mycobacterium
RSCPYWNLVLAPGAAPVPLDVP

SEQ ID NO: 1334739 - protein, 20 aa, Mycobacterium
RSGFYFYFDSKYAVLAVIVA

SEQ ID NO: 1334740 - protein, 19 aa, Mycobacterium
RSLRAFRHNPLFSPAAIAR

SEQ ID NO: 1334741 - protein, 17 aa, Mycobacterium
RSLSLIPTFPFPNETIE

SEQ ID NO: 1334742 - protein, 19 aa, Mycobacterium
RSLVFPVKRLADLGFRVLA

SEQ ID NO: 1334743 - protein, 26 aa, Mycobacterium
RSMTKLWARMWLLRFTWQRAIDSGDL

SEQ ID NO: 1334744 - protein, 21 aa, Mycobacterium
RSRGRLWLANRPGHALWLETA

SEQ ID NO: 1334745 - protein, 19 aa, Mycobacterium
RSVKFPAFLDGIEAVRRVA

SEQ ID NO: 1334746 - protein, 22 aa, Mycobacterium
RSVWTLLRRRNGVLPAIEQALH

SEQ ID NO: 1334747 - protein, 17 aa, Mycobacterium
RSYLDMFTFFASSALGM

SEQ ID NO: 1334748 - protein, 18 aa, Mycobacterium
RTAWPLVLARMPDAHLTV

SEQ ID NO: 1334749 - protein, 24 aa, Mycobacterium
RTCSGWFPRTLWSGKLVLTAEGGL

SEQ ID NO: 1334750 - protein, 17 aa, Mycobacterium
RTKTFDFLLSNPPFRKM

SEQ ID NO: 1334751 - protein, 19 aa, Mycobacterium
RTLLLDLWREHGFGVLLVT

SEQ ID NO: 1334752 - protein, 22 aa, Mycobacterium
RTLPMRVLVLGGGDIRDLHVTD

SEQ ID NO: 1334753 - protein, 23 aa, Mycobacterium
RTPERWFVVWLGSATNPVDREAA

SEQ ID NO: 1334754 - protein, 18 aa, Mycobacterium
RTPRGWRFHGRALTINAI

SEQ ID NO: 1334755 - protein, 19 aa, Mycobacterium
RTPRQDVLPPSDRLRVIAL

SEQ ID NO: 1334756 - protein, 21 aa, Mycobacterium
RTQLEVILPYFLHYANDEQRD

SEQ ID NO: 1334757 - protein, 19 aa, Mycobacterium
RTRDPTWSPPLKPVSPEFS

SEQ ID NO: 1334758 - protein, 20 aa, Mycobacterium
RTRLIRLFPTVFKGTHVNLD

SEQ ID NO: 1334759 - protein, 20 aa, Mycobacterium
RTRVRFDLLLDLAAPYPGFL

SEQ ID NO: 1334760 - protein, 28 aa, Mycobacterium
RTVYVPARLRPVSWAYGLLPGAARTQVM

SEQ ID NO: 1334761 - protein, 17 aa, Mycobacterium
RTWYRTGDLVRYLPDGQ

SEQ ID NO: 1334762 - protein, 17 aa, Mycobacterium
RVALCKLLLSKPDLLLL

SEQ ID NO: 1334763 - protein, 23 aa, Mycobacterium
RVDGLLQIDWWYDESRLDAYSVE

SEQ ID NO: 1334764 - protein, 18 aa, Mycobacterium
RVDVTEMPFLLPPGEYLE

SEQ ID NO: 1334765 - protein, 18 aa, Mycobacterium
RVEDIYLPFKPKRRTKAQ

SEQ ID NO: 1334766 - protein, 18 aa, Mycobacterium
RVEILPGCHLDSLGRKEN

SEQ ID NO: 1334767 - protein, 19 aa, Mycobacterium
RVFHYPGGLVDFVKHINRT

SEQ ID NO: 1334768 - protein, 19 aa, Mycobacterium
RVFRPLDVDLRWVAALLLR

SEQ ID NO: 1334769 - protein, 24 aa, Mycobacterium
RVKCALLGWMAFKDAVAQASHDSQ

SEQ ID NO: 1334770 - protein, 17 aa, Mycobacterium
RVLALALQLLDRGYFRA

SEQ ID NO: 1334771 - protein, 18 aa, Mycobacterium
RVLHRPALLPVPALGPRI

SEQ ID NO: 1334772 - protein, 17 aa, Mycobacterium
RVRARLARLAGAGLMIP

SEQ ID NO: 1334773 - protein, 21 aa, Mycobacterium
RVRLTFPWLSDEYVSDWARTV

SEQ ID NO: 1334774 - protein, 20 aa, Mycobacterium
RVYGTLPWHPDLWLDSEDAL

SEQ ID NO: 1334775 - protein, 18 aa, Mycobacterium
RVYPFQVLLQAPDSGLAV

SEQ ID NO: 1334776 - protein, 17 aa, Mycobacterium
RWFDIDPCYIFHVANAH

SEQ ID NO: 1334777 - protein, 18 aa, Mycobacterium
RWFYDCPPAFHRKLGDMY

SEQ ID NO: 1334778 - protein, 19 aa, Mycobacterium
RWGGEEFLVFLPNTPLDDA

SEQ ID NO: 1334779 - protein, 17 aa, Mycobacterium
RWLAVLRGDARFVIGTR

SEQ ID NO: 1334780 - protein, 21 aa, Mycobacterium
RWMVVFLQRPGGQAQFSVWAE

SEQ ID NO: 1334781 - protein, 18 aa, Mycobacterium
RWVPPIVDQLGFAPMAVC

SEQ ID NO: 1334782 - protein, 29 aa, Mycobacterium
RYALDLFATLGLQLLIVTPLQKVHVIEPY

SEQ ID NO: 1334783 - protein, 17 aa, Mycobacterium
RYHASLMEPWDGPAAVC

SEQ ID NO: 1334784 - protein, 18 aa, Mycobacterium
RYKWRKWLYFDCNWKVAL

SEQ ID NO: 1334785 - protein, 18 aa, Mycobacterium
RYLVPAQRLPLVLLNPSL

SEQ ID NO: 1334786 - protein, 17 aa, Mycobacterium
RYRSTILAIWRRIASSS

SEQ ID NO: 1334787 - protein, 24 aa, Mycobacterium
RYVWEVPYYPQYYIPLRDVRPGLL

SEQ ID NO: 1334788 - protein, 21 aa, Mycobacterium
SADLWRRYVAILLQGMRSQQG

SEQ ID NO: 1334789 - protein, 21 aa, Mycobacterium
SAELPLFRYVGGPNAHILPVP

SEQ ID NO: 1334790 - protein, 21 aa, Mycobacterium
SAESYLVFEKLLDAAAKSGAN

SEQ ID NO: 1334791 - protein, 23 aa, Mycobacterium
SAEVDIWFPNKKGGPGWVEWGGC

SEQ ID NO: 1334792 - protein, 20 aa, Mycobacterium
SAFALWFPLSEERASYGEMK

SEQ ID NO: 1334793 - protein, 18 aa, Mycobacterium
SAFSVLLEMLTKPALKSA

SEQ ID NO: 1334794 - protein, 21 aa, Mycobacterium
SALLDRLYYLDSEPALRRARL

SEQ ID NO: 1334795 - protein, 17 aa, Mycobacterium
SALLFPGLCAPTTPAAA

SEQ ID NO: 1334796 - protein, 17 aa, Mycobacterium
SAQLARRRLGYGRGARM

SEQ ID NO: 1334797 - protein, 19 aa, Mycobacterium
SARLLPWNFKAILARCARV

SEQ ID NO: 1334798 - protein, 19 aa, Mycobacterium
SARVYPALVPLEHPLASVN

SEQ ID NO: 1334799 - protein, 21 aa, Mycobacterium
SAVGWIPFLLESLDFHYKKYE

SEQ ID NO: 1334800 - protein, 23 aa, Mycobacterium
SAVRLPRQIPYTIACDLLLTGRH

SEQ ID NO: 1334801 - protein, 21 aa, Mycobacterium
SAWTLGFYALHNWMLALFTEQ

SEQ ID NO: 1334802 - protein, 23 aa, Mycobacterium
SDAARVLAARNLLPVPWVEPVDV

SEQ ID NO: 1334803 - protein, 18 aa, Mycobacterium
SDFNFLWPTARIAVIGAE

SEQ ID NO: 1334804 - protein, 25 aa, Mycobacterium
SDFTLWEWIHTLIRPVDPHLDRRKA

SEQ ID NO: 1334805 - protein, 24 aa, Mycobacterium
SDHRPHLLSFLFSPDRGSPTARIA

SEQ ID NO: 1334806 - protein, 25 aa, Mycobacterium
SDLESYLFFNLLFSAGAETTRNAIA

SEQ ID NO: 1334807 - protein, 20 aa, Mycobacterium
SDMKGLWGFVPACSTPDAAD

SEQ ID NO: 1334808 - protein, 20 aa, Mycobacterium
SDVLLPFLVTRQLICGAGKV

SEQ ID NO: 1334809 - protein, 17 aa, Mycobacterium
SEAPLLRPVARTGPPPL

SEQ ID NO: 1334810 - protein, 24 aa, Mycobacterium
SEEPDFRLILLTHNFDFFRTLESR

SEQ ID NO: 1334811 - protein, 22 aa, Mycobacterium
SEKRLKRWASRRYPVSILDGRT

SEQ ID NO: 1334812 - protein, 25 aa, Mycobacterium
SELRAMFELNFFAVLSVLRAALPGM

SEQ ID NO: 1334813 - protein, 25 aa, Mycobacterium
SEPGRPLWPMVILRTPKGWTGPREV

SEQ ID NO: 1334814 - protein, 22 aa, Mycobacterium
SEPLIDAIPLWKRPQDGAVITG

SEQ ID NO: 1334815 - protein, 22 aa, Mycobacterium
SFASLVFYSSWFKLHHPAAFCA

SEQ ID NO: 1334816 - protein, 19 aa, Mycobacterium
SFHLGYHGLPFPGVLPGFG

SEQ ID NO: 1334817 - protein, 26 aa, Mycobacterium
SFQLFPNFVMLFWGQGWYLTYHYWPT

SEQ ID NO: 1334818 - protein, 18 aa, Mycobacterium
SFRRYRWVLPMARLIGNA

SEQ ID NO: 1334819 - protein, 22 aa, Mycobacterium
SGALAFKLLYRCRALLQTGEVP

SEQ ID NO: 1334820 - protein, 22 aa, Mycobacterium
SGDFLVYLLDTAVARNYFFMTA

SEQ ID NO: 1334821 - protein, 21 aa, Mycobacterium
SGGRPEWLWTAAGIPFNRATS

SEQ ID NO: 1334822 - protein, 21 aa, Mycobacterium
SGLFALLLPASHRSPAVRPAG

SEQ ID NO: 1334823 - protein, 20 aa, Mycobacterium
SGLFNSFFWIDRKAGIGAVI

SEQ ID NO: 1334824 - protein, 18 aa, Mycobacterium
SGLWMWVGSYFAGLISAA

SEQ ID NO: 1334825 - protein, 24 aa, Mycobacterium
SGSGPAYFFLMVEALVDAAVASGL

SEQ ID NO: 1334826 - protein, 24 aa, Mycobacterium
SGSGPAYFFLMVEALVDAAVDAGL

SEQ ID NO: 1334827 - protein, 19 aa, Mycobacterium
SGSLIRWFQALIGGPEAVE

SEQ ID NO: 1334828 - protein, 21 aa, Mycobacterium
SGVIFLRRKLDDPLYKFVLRQ

SEQ ID NO: 1334829 - protein, 20 aa, Mycobacterium
SHLIGLMAEQWILAGYGVLV

SEQ ID NO: 1334830 - protein, 20 aa, Mycobacterium
SILCDPWLNPAYFASWFPFP

SEQ ID NO: 1334831 - protein, 20 aa, Mycobacterium
SILPITWAYIRMMGAQGLRS

SEQ ID NO: 1334832 - protein, 17 aa, Mycobacterium
SIPFFLNPALDALIPIL

SEQ ID NO: 1334833 - protein, 21 aa, Mycobacterium
SIVYELLWFLRGDSNVRWLQE

SEQ ID NO: 1334834 - protein, 21 aa, Mycobacterium
SKPMLYLYYGSKEELFGACLN

SEQ ID NO: 1334835 - protein, 24 aa, Mycobacterium
SKYPTYLHSFAPMPFKPVAREGKP

SEQ ID NO: 1334836 - protein, 24 aa, Mycobacterium
SLADPLAFLLRKEGFEATVVADGP

SEQ ID NO: 1334837 - protein, 18 aa, Mycobacterium
SLARFPEPLAPLAAARRS

SEQ ID NO: 1334838 - protein, 18 aa, Mycobacterium
SLDSPPFYDPWFAKARTS

SEQ ID NO: 1334839 - protein, 21 aa, Mycobacterium
SLEIHPIRRNIQHADLLVVRR

SEQ ID NO: 1334840 - protein, 18 aa, Mycobacterium
SLLDAISLGFLPFNRRNF

SEQ ID NO: 1334841 - protein, 19 aa, Mycobacterium
SLLFLMHLISKMQPVKGGE

SEQ ID NO: 1334842 - protein, 20 aa, Mycobacterium
SLLQWIVYEEEYFRAGAPGR

SEQ ID NO: 1334843 - protein, 27 aa, Mycobacterium
SLLSPTGAFLGLIGPGGLLIGNGVLPG

SEQ ID NO: 1334844 - protein, 20 aa, Mycobacterium
SLLSTLPWPKENIDKIVRGD

SEQ ID NO: 1334845 - protein, 24 aa, Mycobacterium
SLRTWLFTVMINIAKTRGLRDRTD

SEQ ID NO: 1334846 - protein, 26 aa, Mycobacterium
SLSYPYLDTLLFILGITRGEIEAADA

SEQ ID NO: 1334847 - protein, 25 aa, Mycobacterium
SLTIPSIPGLPVPLPNEVPVPSDLL

SEQ ID NO: 1334848 - protein, 17 aa, Mycobacterium
SLTLLPKMTARAAGRYF

SEQ ID NO: 1334849 - protein, 20 aa, Mycobacterium
SLTQVLAWDLPLDSKIRAKV

SEQ ID NO: 1334850 - protein, 24 aa, Mycobacterium
SLVKFHWKPRLGVHSLVWEEAQIA

SEQ ID NO: 1334851 - protein, 19 aa, Mycobacterium
SLWPMLTSIWEWERRWVPE

SEQ ID NO: 1334852 - protein, 17 aa, Mycobacterium
SLYLVCLRIVTSGHARA

SEQ ID NO: 1334853 - protein, 23 aa, Mycobacterium
SMDTDWPLPLYDLARIASDRGDV

SEQ ID NO: 1334854 - protein, 18 aa, Mycobacterium
SMDWLNFLVGIHKRLHVD

SEQ ID NO: 1334855 - protein, 17 aa, Mycobacterium
SMEGWYGRIFNGCGFFD

SEQ ID NO: 1334856 - protein, 18 aa, Mycobacterium
SMFQAILPLRGKIINVEK

SEQ ID NO: 1334857 - protein, 24 aa, Mycobacterium
SMLPSMIPTVLGAAGGLLGGAMSS

SEQ ID NO: 1334858 - protein, 17 aa, Mycobacterium
SMLTLLQKNLQGTIFGG

SEQ ID NO: 1334859 - protein, 19 aa, Mycobacterium
SMMRLMVEAPFLLIRAAVP

SEQ ID NO: 1334860 - protein, 23 aa, Mycobacterium
SMPSWHTYFPPIGGFRFSMFTLP

SEQ ID NO: 1334861 - protein, 21 aa, Mycobacterium
SMSLVTPWLLAVPDRFSLMHG

SEQ ID NO: 1334862 - protein, 18 aa, Mycobacterium
SNARMGWLLSQNVLRKAR

SEQ ID NO: 1334863 - protein, 22 aa, Mycobacterium
SPAWGFCMWAITPDQMYSVEIV

SEQ ID NO: 1334864 - protein, 27 aa, Mycobacterium
SPFNFPAMVPMWFFPIAIATGNTVVLK

SEQ ID NO: 1334865 - protein, 24 aa, Mycobacterium
SPKETWLRLLLIDAGFPRPTTQIP

SEQ ID NO: 1334866 - protein, 19 aa, Mycobacterium
SPNYLGTTGFPYTNVVVDN

SEQ ID NO: 1334867 - protein, 23 aa, Mycobacterium
SPPVKWPCFYGIDFATPAELIAN

SEQ ID NO: 1334868 - protein, 22 aa, Mycobacterium
SPQPLWALWRFSTAPEATRLTM

SEQ ID NO: 1334869 - protein, 23 aa, Mycobacterium
SPRETWLRLLLMKDFPRPTTQIP

SEQ ID NO: 1334870 - protein, 24 aa, Mycobacterium
SPRETWLRLLVIRNGFPPPTTQIP

SEQ ID NO: 1334871 - protein, 18 aa, Mycobacterium
SPSPHIPWNRLPVRIVDD

SEQ ID NO: 1334872 - protein, 19 aa, Mycobacterium
SPVFIFYQNHRDKALVKIR

SEQ ID NO: 1334873 - protein, 29 aa, Mycobacterium
SQDERDFYLKWFWTQPLWLDLGDIRVIHA

SEQ ID NO: 1334874 - protein, 25 aa, Mycobacterium
SQEIAWWVWLCWDQQLRKIEPSLLG

SEQ ID NO: 1334875 - protein, 21 aa, Mycobacterium
SQFMQMPMGLLGPLSSSMGGL

SEQ ID NO: 1334876 - protein, 19 aa, Mycobacterium
SQLLYWTQVLMLSRGLSLD

SEQ ID NO: 1334877 - protein, 19 aa, Mycobacterium
SQMSLWQRLWHTRCPKAAS

SEQ ID NO: 1334878 - protein, 19 aa, Mycobacterium
SQQLTALWDLLLNSAGTPG

SEQ ID NO: 1334879 - protein, 24 aa, Mycobacterium
SRDRARRWLPDTPILPVDEVARRA

SEQ ID NO: 1334880 - protein, 24 aa, Mycobacterium
SRERGYAYFLYPPEVPLTETAYDR

SEQ ID NO: 1334881 - protein, 18 aa, Mycobacterium
SRFAGMLVAGTYLREFVA

SEQ ID NO: 1334882 - protein, 22 aa, Mycobacterium
SRGWLYRHFPDKVSLLGAAIVR

SEQ ID NO: 1334883 - protein, 20 aa, Mycobacterium
SRLLGFMYLSRVWHAALRRR

SEQ ID NO: 1334884 - protein, 24 aa, Mycobacterium
SRLLGYMYLSRVWHAALRRTRPER

SEQ ID NO: 1334885 - protein, 23 aa, Mycobacterium
SRLTFLAVRRWYGWSAGRIINID

SEQ ID NO: 1334886 - protein, 20 aa, Mycobacterium
SRPTLYRWFADKPALLEAFG

SEQ ID NO: 1334887 - protein, 24 aa, Mycobacterium
SRPVDPVYPILYIDAIRLKIRDGG

SEQ ID NO: 1334888 - protein, 17 aa, Mycobacterium
SRRHAFLASLLGIRHIV

SEQ ID NO: 1334889 - protein, 20 aa, Mycobacterium
SRSEWLRRWSMVAPWQPRIP

SEQ ID NO: 1334890 - protein, 23 aa, Mycobacterium
SRVLGLHFFNPVPVLPLVELVNT

SEQ ID NO: 1334891 - protein, 19 aa, Mycobacterium
SRYSLPLRRLPFGLSSTRD

SEQ ID NO: 1334892 - protein, 17 aa, Mycobacterium
SSFQLHWAPSLRPDAGV

SEQ ID NO: 1334893 - protein, 19 aa, Mycobacterium
SSLWLYLAGVRPVVFGVSA

SEQ ID NO: 1334894 - protein, 18 aa, Mycobacterium
SSMWFDALGRRLPAPYLP

SEQ ID NO: 1334895 - protein, 20 aa, Mycobacterium
SSPGFLAYPWGVIPDRAIER

SEQ ID NO: 1334896 - protein, 25 aa, Mycobacterium
SSVLSMMMWAFRGMGMWSDERGTNM

SEQ ID NO: 1334897 - protein, 24 aa, Mycobacterium
STFLGGWLGPFLWLRERMPGINRQ

SEQ ID NO: 1334898 - protein, 17 aa, Mycobacterium
STFLRWREGTRGELTEV

SEQ ID NO: 1334899 - protein, 22 aa, Mycobacterium
STFSEALIRLAGKRRDIVAITA

SEQ ID NO: 1334900 - protein, 21 aa, Mycobacterium
STLGLIFHWADQQGLALLDLK

SEQ ID NO: 1334901 - protein, 22 aa, Mycobacterium
STWPRQLPWLTRLGRVFTYDAP

SEQ ID NO: 1334902 - protein, 17 aa, Mycobacterium
SVAGWLRAKARTTAVSD

SEQ ID NO: 1334903 - protein, 20 aa, Mycobacterium
SVEFDLLPIPEFYGGAVYFD

SEQ ID NO: 1334904 - protein, 19 aa, Mycobacterium
SVLLPIGPRRELWAKLGGS

SEQ ID NO: 1334905 - protein, 21 aa, Mycobacterium
SVLPDEFFTDPLPTLAAGALS

SEQ ID NO: 1334906 - protein, 22 aa, Mycobacterium
SVPMYRLRRYFPPDVRPGSKPV

SEQ ID NO: 1334907 - protein, 24 aa, Mycobacterium
SVVAPLLSRSLILQLQPLAPDSIA

SEQ ID NO: 1334908 - protein, 19 aa, Mycobacterium
SVVAPLLSRSLILQLQPLT

SEQ ID NO: 1334909 - protein, 21 aa, Mycobacterium
SVVYELLWFLRGESNVRWLQE

SEQ ID NO: 1334910 - protein, 23 aa, Mycobacterium
SWEPEPLRWLGVRGMYLAYKAAD

SEQ ID NO: 1334911 - protein, 20 aa, Mycobacterium
SWLLPRLVGLARTKRMLLLG

SEQ ID NO: 1334912 - protein, 17 aa, Mycobacterium
SWTPIGPGTYGGFLAIR

SEQ ID NO: 1334913 - protein, 25 aa, Mycobacterium
SYAFDLLRWFRFLHDRLISWERAER

SEQ ID NO: 1334914 - protein, 19 aa, Mycobacterium
SYFVYRLIKRLKKSANAAP

SEQ ID NO: 1334915 - protein, 20 aa, Mycobacterium
SYVVQPLFFPGGNIGDLAVN

SEQ ID NO: 1334916 - protein, 21 aa, Mycobacterium
TAALPVMVWIPGGAFVYGAGQ

SEQ ID NO: 1334917 - protein, 20 aa, Mycobacterium
TAARLFYAYAETLLALGREA

SEQ ID NO: 1334918 - protein, 23 aa, Mycobacterium
TACRYDFLIPNRGVGVLLPDGAQ

SEQ ID NO: 1334919 - protein, 21 aa, Mycobacterium
TAFNFPVAVWAWNTAIALVCG

SEQ ID NO: 1334920 - protein, 20 aa, Mycobacterium
TAGLDLLPRLLMRGGELDLT

SEQ ID NO: 1334921 - protein, 19 aa, Mycobacterium
TAGTPFLLLAGLEPDLRWE

SEQ ID NO: 1334922 - protein, 17 aa, Mycobacterium
TAHGYILGIRQPVTDRL

SEQ ID NO: 1334923 - protein, 18 aa, Mycobacterium
TAIFIYFLGPDNLTYEYS

SEQ ID NO: 1334924 - protein, 25 aa, Mycobacterium
TAMKWMQRWPLRPIASRLWFRTADA

SEQ ID NO: 1334925 - protein, 24 aa, Mycobacterium
TANYRSIWMFLKDLEFRQGFVDIT

SEQ ID NO: 1334926 - protein, 23 aa, Mycobacterium
TARVLAWLHPPGTDFAPALLADV

SEQ ID NO: 1334927 - protein, 20 aa, Mycobacterium
TATLRYSGIFAFGTYSVTYK

SEQ ID NO: 1334928 - protein, 20 aa, Mycobacterium
TAVAETWRRLRPAPLVVDPV

SEQ ID NO: 1334929 - protein, 25 aa, Mycobacterium
TAVEQVFLRRLLTGELRQGALGGVM

SEQ ID NO: 1334930 - protein, 17 aa, Mycobacterium
TAYLWQEILQRDTWLDI

SEQ ID NO: 1334931 - protein, 23 aa, Mycobacterium
TDISWSRITYWRALLASAIDDPP

SEQ ID NO: 1334932 - protein, 21 aa, Mycobacterium
TDPDVLFLAEAFTRPARLFGL

SEQ ID NO: 1334933 - protein, 18 aa, Mycobacterium
TEQLRWDADWYKLIRRAG

SEQ ID NO: 1334934 - protein, 22 aa, Mycobacterium
TEQLSYTFPLIDVLPWGRQEEW

SEQ ID NO: 1334935 - protein, 25 aa, Mycobacterium
TERGLLLSTLWYIREVDPSVLLLTG

SEQ ID NO: 1334936 - protein, 20 aa, Mycobacterium
TETDRTLLRYLRGPGRPALT

SEQ ID NO: 1334937 - protein, 21 aa, Mycobacterium
TFDLYSCFPFPVFAVCDEFGL

SEQ ID NO: 1334938 - protein, 24 aa, Mycobacterium
TFDLYSCFPFPVFVICEALGLSAD

SEQ ID NO: 1334939 - protein, 20 aa, Mycobacterium
TFEYQALLFIPSHAPFDLFN

SEQ ID NO: 1334940 - protein, 19 aa, Mycobacterium
TFFIATTPRYSFVSSSLAK

SEQ ID NO: 1334941 - protein, 20 aa, Mycobacterium
TFPDWRPVDFKVWPAENGFV

SEQ ID NO: 1334942 - protein, 23 aa, Mycobacterium
TGLKVPFFTDGIPPFFLTPGLDV

SEQ ID NO: 1334943 - protein, 18 aa, Mycobacterium
TGMVNVLCSQGVWARHRK

SEQ ID NO: 1334944 - protein, 18 aa, Mycobacterium
TGRPPRWVAPVVDGLGLA

SEQ ID NO: 1334945 - protein, 20 aa, Mycobacterium
TGRQWPLADVRLLAPILASK

SEQ ID NO: 1334946 - protein, 17 aa, Mycobacterium
THHDLHLWLPHPSDKLW

SEQ ID NO: 1334947 - protein, 26 aa, Mycobacterium
THNEPMIPIYIFYSMFGFQRTGDGLW

SEQ ID NO: 1334948 - protein, 17 aa, Mycobacterium
THNTIFPNFSWLGAHST

SEQ ID NO: 1334949 - protein, 22 aa, Mycobacterium
THPGCTVPFYWTEAHHAHDYSR

SEQ ID NO: 1334950 - protein, 20 aa, Mycobacterium
THQASALTWWYALLIWGATA

SEQ ID NO: 1334951 - protein, 24 aa, Mycobacterium
TIDLLRFLLRRAPQSHLLTIGILR

SEQ ID NO: 1334952 - protein, 25 aa, Mycobacterium
TIGVPRWLQLPARLVLSALIGRVRI

SEQ ID NO: 1334953 - protein, 24 aa, Mycobacterium
TIHDYLWRWDTDWFWCSRAFGAQN

SEQ ID NO: 1334954 - protein, 19 aa, Mycobacterium
TIRELLAILSWAIVGTASC

SEQ ID NO: 1334955 - protein, 20 aa, Mycobacterium
TKGSFYWHFADMPAYRAALV

SEQ ID NO: 1334956 - protein, 20 aa, Mycobacterium
TKPWFALLEDALTPLWSRVG

SEQ ID NO: 1334957 - protein, 19 aa, Mycobacterium
TKRFLLGELLGRITRHLLL

SEQ ID NO: 1334958 - protein, 20 aa, Mycobacterium
TLAARLRPVIERLALATGET

SEQ ID NO: 1334959 - protein, 21 aa, Mycobacterium
TLAELPGWAPGPPPGFQPAGD

SEQ ID NO: 1334960 - protein, 18 aa, Mycobacterium
TLALRDLGLEPLVELGMR

SEQ ID NO: 1334961 - protein, 28 aa, Mycobacterium
TLCSCFPWPVLGLPPYWYKDPVFRARAA

SEQ ID NO: 1334962 - protein, 22 aa, Mycobacterium
TLDVPIIFRAPFVHALVMSWTG

SEQ ID NO: 1334963 - protein, 19 aa, Mycobacterium
TLEMPLIDFFSRGGSLKSS

SEQ ID NO: 1334964 - protein, 19 aa, Mycobacterium
TLETVFWGALLQVQSRHID

SEQ ID NO: 1334965 - protein, 19 aa, Mycobacterium
TLFARGFFLTQHDIDWFRA

SEQ ID NO: 1334966 - protein, 22 aa, Mycobacterium
TLGWDGLADLVLAPGPGVRGRP

SEQ ID NO: 1334967 - protein, 17 aa, Mycobacterium
TLLLMLAALRRLPVLDR

SEQ ID NO: 1334968 - protein, 17 aa, Mycobacterium
TLLPLRIIDNMLGVPRE

SEQ ID NO: 1334969 - protein, 19 aa, Mycobacterium
TLMALNYLRPWPTPPEDCF

SEQ ID NO: 1334970 - protein, 19 aa, Mycobacterium
TLSRVHAPFWDSPRLRDNG

SEQ ID NO: 1334971 - protein, 18 aa, Mycobacterium
TLVLLDEYRLTGGVPAGA

SEQ ID NO: 1334972 - protein, 19 aa, Mycobacterium
TLYIQLYLGGFGLELSDIE

SEQ ID NO: 1334973 - protein, 17 aa, Mycobacterium
TMGLILRGSDELKKKVL

SEQ ID NO: 1334974 - protein, 17 aa, Mycobacterium
TNRPECAIAYQAVLLSG

SEQ ID NO: 1334975 - protein, 19 aa, Mycobacterium
TPAQVLLRWSIQLGNVVIA

SEQ ID NO: 1334976 - protein, 26 aa, Mycobacterium
TPDFSTLRLLPWLPGSALVMADLSWT

SEQ ID NO: 1334977 - protein, 20 aa, Mycobacterium
TPFVLVLRLLVVALRRHPVL

SEQ ID NO: 1334978 - protein, 26 aa, Mycobacterium
TPLGMTYIAQLDWPLADAIRWPAQHI

SEQ ID NO: 1334979 - protein, 18 aa, Mycobacterium
TPLGRWWRDMKLARVGGG

SEQ ID NO: 1334980 - protein, 26 aa, Mycobacterium
TPMDFLSDILLWPRLIDKYRGTMTAA

SEQ ID NO: 1334981 - protein, 20 aa, Mycobacterium
TPMMLLPTIPTMVWGGNIRL

SEQ ID NO: 1334982 - protein, 25 aa, Mycobacterium
TPWNYPLPLNIFKVAAALAAGCTVV

SEQ ID NO: 1334983 - protein, 27 aa, Mycobacterium
TPYARMWGAYLTGMWIYRLSLAKVKWH

SEQ ID NO: 1334984 - protein, 21 aa, Mycobacterium
TPYLKLLSQLFGDRLMIANAT

SEQ ID NO: 1334985 - protein, 24 aa, Mycobacterium
TQFEPGFTALIRRLLRLFDEIDAG

SEQ ID NO: 1334986 - protein, 19 aa, Mycobacterium
TQRYFLVSYPRKMDALTRL

SEQ ID NO: 1334987 - protein, 20 aa, Mycobacterium
TQTMLFPRYHQWDAVTRLID

SEQ ID NO: 1334988 - protein, 20 aa, Mycobacterium
TQVRWRPIDFWPANTTVNID

SEQ ID NO: 1334989 - protein, 22 aa, Mycobacterium
TRAFALWARLSGVVPRIAIVKG

SEQ ID NO: 1334990 - protein, 19 aa, Mycobacterium
TRAWRLPWLNDTVIYEVEQ

SEQ ID NO: 1334991 - protein, 17 aa, Mycobacterium
TRDAFEFALLQGALRRQ

SEQ ID NO: 1334992 - protein, 22 aa, Mycobacterium
TREDLLKQVWLWDFGDLSTVTV

SEQ ID NO: 1334993 - protein, 21 aa, Mycobacterium
TRGALYFYFGSKQEVLTALVA

SEQ ID NO: 1334994 - protein, 20 aa, Mycobacterium
TRLIELFELFDPADPEVIAG

SEQ ID NO: 1334995 - protein, 18 aa, Mycobacterium
TRPMVPLIVLAVPSSRGK

SEQ ID NO: 1334996 - protein, 23 aa, Mycobacterium
TRRIRLMRWGLVPPWAKAGDDGS

SEQ ID NO: 1334997 - protein, 26 aa, Mycobacterium
TRRIRTWLSFPQWFYLNVPVNTLTAP

SEQ ID NO: 1334998 - protein, 24 aa, Mycobacterium
TRVEFWAFDILFLDGRSLLRAKYT

SEQ ID NO: 1334999 - protein, 20 aa, Mycobacterium
TRWDPEELLILLFGLGLAWA

SEQ ID NO: 1335000 - protein, 21 aa, Mycobacterium
TRYWAPLCRLFGLFGAADDER

SEQ ID NO: 1335001 - protein, 19 aa, Mycobacterium
TSQLRAYLPNDPGGWYLRT

SEQ ID NO: 1335002 - protein, 19 aa, Mycobacterium
TTELFLERLGLSSLADLPD

SEQ ID NO: 1335003 - protein, 19 aa, Mycobacterium
TTLFRLPVRLALGPTHVAV

SEQ ID NO: 1335004 - protein, 19 aa, Mycobacterium
TTMRMLCVFNPPVTGREIH

SEQ ID NO: 1335005 - protein, 21 aa, Mycobacterium
TTMVSWLPFYHDMGLIQGVFA

SEQ ID NO: 1335006 - protein, 24 aa, Mycobacterium
TTNPPVEGAFYWLNSREVRWRPAE

SEQ ID NO: 1335007 - protein, 21 aa, Mycobacterium
TTRLEFYFRRWKAPALVSEEF

SEQ ID NO: 1335008 - protein, 24 aa, Mycobacterium
TTRRQLLLHLPSPGAWLGAAHEVA

SEQ ID NO: 1335009 - protein, 24 aa, Mycobacterium
TTTLALTTPLTFRPMPLLKNITRN

SEQ ID NO: 1335010 - protein, 24 aa, Mycobacterium
TTTLRFNFFVLKLPIRPPALVAKQ

SEQ ID NO: 1335011 - protein, 25 aa, Mycobacterium
TTVDGLLVRLLRYLPGGTLIDADHL

SEQ ID NO: 1335012 - protein, 22 aa, Mycobacterium
TTVMPFILRGAALLGIDSVLLP

SEQ ID NO: 1335013 - protein, 21 aa, Mycobacterium
TTYRAVLAMLLLTGSMGRNGG

SEQ ID NO: 1335014 - protein, 17 aa, Mycobacterium
TVARRLPLLDPLRYRLI

SEQ ID NO: 1335015 - protein, 20 aa, Mycobacterium
TVDPTLPVLGLAGSVFFTAA

SEQ ID NO: 1335016 - protein, 24 aa, Mycobacterium
TVFKAFYSGLLFWTYEPGRIDDGW

SEQ ID NO: 1335017 - protein, 17 aa, Mycobacterium
TVLPPFQLPWYVPCFKY

SEQ ID NO: 1335018 - protein, 18 aa, Mycobacterium
TVMEGFHYLFHPVTQRAL

SEQ ID NO: 1335019 - protein, 24 aa, Mycobacterium
TVTAPRRAWPTPLLPALGTLLDGG

SEQ ID NO: 1335020 - protein, 17 aa, Mycobacterium
TVTVFGTPIFKLGGSPV

SEQ ID NO: 1335021 - protein, 18 aa, Mycobacterium
TVVLKLFNTVRPDRAYFG

SEQ ID NO: 1335022 - protein, 23 aa, Mycobacterium
TVVRSWLQQLLAKALKEDPSLSD

SEQ ID NO: 1335023 - protein, 20 aa, Mycobacterium
TVVTWLPFYHDMGLIVGVFI

SEQ ID NO: 1335024 - protein, 22 aa, Mycobacterium
TVWQQLHFRFGLPKPLLEPLGV

SEQ ID NO: 1335025 - protein, 25 aa, Mycobacterium
TVYQNLAVVPLMPVWRNFFLGQELR

SEQ ID NO: 1335026 - protein, 21 aa, Mycobacterium
TWQVPKLYWTVTSSSALAAAL

SEQ ID NO: 1335027 - protein, 19 aa, Mycobacterium
TYCFWAITPTPYPIPHDGP

SEQ ID NO: 1335028 - protein, 17 aa, Mycobacterium
TYRFYFCSTACLRQFAD

SEQ ID NO: 1335029 - protein, 17 aa, Mycobacterium
VAALLDRDWRMLIGGDR

SEQ ID NO: 1335030 - protein, 18 aa, Mycobacterium
VADLLRLLGPLTAEEIAQ

SEQ ID NO: 1335031 - protein, 24 aa, Mycobacterium
VADLQRFPLVYFIDAMLQVDDLDL

SEQ ID NO: 1335032 - protein, 24 aa, Mycobacterium
VAHLRFGLRLIYGRLADEFTALGF

SEQ ID NO: 1335033 - protein, 19 aa, Mycobacterium
VAHRAKLNWWESRALYGWT

SEQ ID NO: 1335034 - protein, 17 aa, Mycobacterium
VAKRLMHVLGTSAYVPE

SEQ ID NO: 1335035 - protein, 24 aa, Mycobacterium
VARFLLGLARRYGEQRFFGSGVLG

SEQ ID NO: 1335036 - protein, 27 aa, Mycobacterium
VARPQPLGVFGLPLGYLLIPAGDDTDP

SEQ ID NO: 1335037 - protein, 27 aa, Mycobacterium
VARRLALLLTLPRFLPLTGPVAMRSTA

SEQ ID NO: 1335038 - protein, 28 aa, Mycobacterium
VARRLRRLPWLLRLVAWLPQPDPHRPPA

SEQ ID NO: 1335039 - protein, 19 aa, Mycobacterium
VARWLGPAILYPRLARAVD

SEQ ID NO: 1335040 - protein, 17 aa, Mycobacterium
VATMKFFDYVRTNGWAF

SEQ ID NO: 1335041 - protein, 23 aa, Mycobacterium
VAVPALLHLLAEFPSIRTVMVMV

SEQ ID NO: 1335042 - protein, 17 aa, Mycobacterium
VCVTDHGRWRPPGLYRR

SEQ ID NO: 1335043 - protein, 22 aa, Mycobacterium
VDESWVWLPALLAGRIFTHRVT

SEQ ID NO: 1335044 - protein, 18 aa, Mycobacterium
VDFWASWCGPCRAFAPVF

SEQ ID NO: 1335045 - protein, 18 aa, Mycobacterium
VDGWPNQRFALLFLAWLA

SEQ ID NO: 1335046 - protein, 18 aa, Mycobacterium
VDLFFLLGVADVDALRWL

SEQ ID NO: 1335047 - protein, 20 aa, Mycobacterium
VDQKFLFHRPIVAGDALTGT

SEQ ID NO: 1335048 - protein, 24 aa, Mycobacterium
VDSGLTLSWLLRNLATRGPRSLRV

SEQ ID NO: 1335049 - protein, 17 aa, Mycobacterium
VDTFFIATTPRYSFVSS

SEQ ID NO: 1335050 - protein, 17 aa, Mycobacterium
VDVARIVGLPVLASMRP

SEQ ID NO: 1335051 - protein, 19 aa, Mycobacterium
VEAMPYFAKALFALSPVAA

SEQ ID NO: 1335052 - protein, 22 aa, Mycobacterium
VEAPFLLIRAAVPHMYRNEFGR

SEQ ID NO: 1335053 - protein, 20 aa, Mycobacterium
VEHAFSWILPLMWRMDALYE

SEQ ID NO: 1335054 - protein, 20 aa, Mycobacterium
VEHAFTWILPLMWRMDALYE

SEQ ID NO: 1335055 - protein, 24 aa, Mycobacterium
VELLTRRRIFVPILRVTAIEPSAV

SEQ ID NO: 1335056 - protein, 18 aa, Mycobacterium
VELPGWYRPNPGLARDLA

SEQ ID NO: 1335057 - protein, 18 aa, Mycobacterium
VERALIAAYAGGLVPILC

SEQ ID NO: 1335058 - protein, 24 aa, Mycobacterium
VEYKLRDWLFARQRYWGEPFPIVY

SEQ ID NO: 1335059 - protein, 17 aa, Mycobacterium
VFALLLQGAVPVLGNRW

SEQ ID NO: 1335060 - protein, 19 aa, Mycobacterium
VFANSRFVTAFFSALDAGG

SEQ ID NO: 1335061 - protein, 19 aa, Mycobacterium
VFCRLNIAVIALSISYSKN

SEQ ID NO: 1335062 - protein, 19 aa, Mycobacterium
VFGALWITQAALPYLRAQR

SEQ ID NO: 1335063 - protein, 19 aa, Mycobacterium
VFGQLRRLVVALAGAADSP

SEQ ID NO: 1335064 - protein, 19 aa, Mycobacterium
VFIGYLRRKLEANGAPRLL

SEQ ID NO: 1335065 - protein, 24 aa, Mycobacterium
VFQRTPIWCFPKFDVPLSKTAQTM

SEQ ID NO: 1335066 - protein, 20 aa, Mycobacterium
VFRRYVGVPVKWVLCRYRLQ

SEQ ID NO: 1335067 - protein, 19 aa, Mycobacterium
VFSAILPVLAHDIPWNSGV

SEQ ID NO: 1335068 - protein, 20 aa, Mycobacterium
VFSAILPVLAHDIPWNSGVM

SEQ ID NO: 1335069 - protein, 24 aa, Mycobacterium
VFSEEFLLTRPLLTAIRRTEPTVL

SEQ ID NO: 1335070 - protein, 25 aa, Mycobacterium
VFTSDFFALWGKFAATRTPTIAAVA

SEQ ID NO: 1335071 - protein, 21 aa, Mycobacterium
VGAALASWWRNPPGALDFAAQ

SEQ ID NO: 1335072 - protein, 23 aa, Mycobacterium
VGAITPWNFPLNIPSRKLGPALA

SEQ ID NO: 1335073 - protein, 18 aa, Mycobacterium
VGEEWLYQSWSACYLPLV

SEQ ID NO: 1335074 - protein, 20 aa, Mycobacterium
VGHSYIVYAPLLLGATTVLY

SEQ ID NO: 1335075 - protein, 17 aa, Mycobacterium
VGISLPTCFWYMSEMRA

SEQ ID NO: 1335076 - protein, 19 aa, Mycobacterium
VGLILTQWATSLAAKVITT

SEQ ID NO: 1335077 - protein, 20 aa, Mycobacterium
VGLLHMAVLASPVPHARIRS

SEQ ID NO: 1335078 - protein, 20 aa, Mycobacterium
VGLTAWQALFEIAALRAGQT

SEQ ID NO: 1335079 - protein, 21 aa, Mycobacterium
VGQLPLTRPLLDLGVPPEIVR

SEQ ID NO: 1335080 - protein, 25 aa, Mycobacterium
VGTGGVLLPLLLFASARAAIPFTPL

SEQ ID NO: 1335081 - protein, 20 aa, Mycobacterium
VHFFGPFLYRSQFHAGTEAE

SEQ ID NO: 1335082 - protein, 26 aa, Mycobacterium
VHLDVPLYWQCWKLDSPLVARLTGAV

SEQ ID NO: 1335083 - protein, 25 aa, Mycobacterium
VHRVPSMMFPKITSLPLGVPRPRMV

SEQ ID NO: 1335084 - protein, 22 aa, Mycobacterium
VHSEALFPAWSLALRQVLDDTG

SEQ ID NO: 1335085 - protein, 18 aa, Mycobacterium
VHWAALSGLRRLLFVNGH

SEQ ID NO: 1335086 - protein, 25 aa, Mycobacterium
VIDRILAYVAPILLGGPITAVDDVG

SEQ ID NO: 1335087 - protein, 17 aa, Mycobacterium
VIGGGMCFTFLAAQGLS

SEQ ID NO: 1335088 - protein, 17 aa, Mycobacterium
VIGLRRPGQRQRLREDQ

SEQ ID NO: 1335089 - protein, 18 aa, Mycobacterium
VIGWWAVPTILEHGSPEQ

SEQ ID NO: 1335090 - protein, 19 aa, Mycobacterium
VIIPGLQYKALTTGGRMVP

SEQ ID NO: 1335091 - protein, 17 aa, Mycobacterium
VIQLPPLITPIAGPGYT

SEQ ID NO: 1335092 - protein, 22 aa, Mycobacterium
VITPWNFPMTIAAWGFAPALAA

SEQ ID NO: 1335093 - protein, 18 aa, Mycobacterium
VIVYFYPAASTPGCTKEA

SEQ ID NO: 1335094 - protein, 19 aa, Mycobacterium
VKANLFYRGLTFYRYPVIG

SEQ ID NO: 1335095 - protein, 24 aa, Mycobacterium
VKDSFRKLWFGWSDPARVLVEYAQ

SEQ ID NO: 1335096 - protein, 17 aa, Mycobacterium
VKGVFLLTRALVPLLEA

SEQ ID NO: 1335097 - protein, 20 aa, Mycobacterium
VKLCAVPWLHRLGLLHLLQS

SEQ ID NO: 1335098 - protein, 24 aa, Mycobacterium
VLADALLEPLRFPPAYRAAVLDPQ

SEQ ID NO: 1335099 - protein, 20 aa, Mycobacterium
VLAIYRPLLEPLGLTHPQYL

SEQ ID NO: 1335100 - protein, 24 aa, Mycobacterium
VLAPLRLHYLRWVLFDVGSGLHFQ

SEQ ID NO: 1335101 - protein, 17 aa, Mycobacterium
VLAPLTPAAIFLVATID

SEQ ID NO: 1335102 - protein, 24 aa, Mycobacterium
VLDYLRKYSAPPIPLWVLQADVCD

SEQ ID NO: 1335103 - protein, 20 aa, Mycobacterium
VLFFADVFGLRAPWNGNWRK

SEQ ID NO: 1335104 - protein, 18 aa, Mycobacterium
VLGFLTLLDPSGLRHELF

SEQ ID NO: 1335105 - protein, 17 aa, Mycobacterium
VLGGRVFRPLDVDLRWV

SEQ ID NO: 1335106 - protein, 17 aa, Mycobacterium
VLGIIDPTYFLGGSMGL

SEQ ID NO: 1335107 - protein, 19 aa, Mycobacterium
VLGRLHFALAPRGVLFLGH

SEQ ID NO: 1335108 - protein, 17 aa, Mycobacterium
VLHAWRSWSVELPETVN

SEQ ID NO: 1335109 - protein, 24 aa, Mycobacterium
VLHTRALVRAPIWVYRAGLGFVFG

SEQ ID NO: 1335110 - protein, 17 aa, Mycobacterium
VLLAWRVLTGVELAGTN

SEQ ID NO: 1335111 - protein, 18 aa, Mycobacterium
VLLPKFELKQWADAVREH

SEQ ID NO: 1335112 - protein, 18 aa, Mycobacterium
VLLPLWNAYTFLALYAPS

SEQ ID NO: 1335113 - protein, 19 aa, Mycobacterium
VLLQVAGPPMFKRWCRLVG

SEQ ID NO: 1335114 - protein, 17 aa, Mycobacterium
VLNRFLMQAAIGYPLTV

SEQ ID NO: 1335115 - protein, 23 aa, Mycobacterium
VLRKLREQIPGLPLLLLTAKDSV

SEQ ID NO: 1335116 - protein, 18 aa, Mycobacterium
VLTDFFNYFGALTASRRA

SEQ ID NO: 1335117 - protein, 18 aa, Mycobacterium
VLTPRARLLLPGDQQFKF

SEQ ID NO: 1335118 - protein, 21 aa, Mycobacterium
VLVPLTWVPIVGKPLAIALDP

SEQ ID NO: 1335119 - protein, 25 aa, Mycobacterium
VLWTQNMLMPWLWTHLRGKSVGEGR

SEQ ID NO: 1335120 - protein, 19 aa, Mycobacterium
VMAPHLWRFLQYQPLVAFA

SEQ ID NO: 1335121 - protein, 23 aa, Mycobacterium
VMAQGLMRHLAPTQITALSAGTN

SEQ ID NO: 1335122 - protein, 20 aa, Mycobacterium
VMCDFWETVLFRAGLYRRNA

SEQ ID NO: 1335123 - protein, 22 aa, Mycobacterium
VMFDRLPPLFLEMALSFLAMDP

SEQ ID NO: 1335124 - protein, 18 aa, Mycobacterium
VMLPGHGPVWRGPVRDAV

SEQ ID NO: 1335125 - protein, 18 aa, Mycobacterium
VMNPLAWANAALGFIYVH

SEQ ID NO: 1335126 - protein, 18 aa, Mycobacterium
VMQGLHRLWPPVIDLVRH

SEQ ID NO: 1335127 - protein, 17 aa, Mycobacterium
VMRINFLGMRQFTEALI

SEQ ID NO: 1335128 - protein, 17 aa, Mycobacterium
VMVLLAKVLGRLSPGLP

SEQ ID NO: 1335129 - protein, 21 aa, Mycobacterium
VNGLPWLARLAHGLQQLVLAR

SEQ ID NO: 1335130 - protein, 23 aa, Mycobacterium
VNGQLFIVYGPTVTLMAAPTAER

SEQ ID NO: 1335131 - protein, 22 aa, Mycobacterium
VNLTYLGLIPQIKKSFLAKDVE

SEQ ID NO: 1335132 - protein, 18 aa, Mycobacterium
VNPILLPVLTVSGLTKVT

SEQ ID NO: 1335133 - protein, 23 aa, Mycobacterium
VPAGRVIVLPWDKHIAAGTEIQL

SEQ ID NO: 1335134 - protein, 23 aa, Mycobacterium
VPDTPIPFGVWQRVSVAVRNRPD

SEQ ID NO: 1335135 - protein, 17 aa, Mycobacterium
VPFLHPDVVWDFRLPRV

SEQ ID NO: 1335136 - protein, 25 aa, Mycobacterium
VPFLLAVGDLLLGWLLLHQAETALT

SEQ ID NO: 1335137 - protein, 17 aa, Mycobacterium
VPIWQGSIAPAMGQPGG

SEQ ID NO: 1335138 - protein, 20 aa, Mycobacterium
VPMPSWLRINFAAATVTAMA

SEQ ID NO: 1335139 - protein, 17 aa, Mycobacterium
VPPQWFAMWARRHQHEY

SEQ ID NO: 1335140 - protein, 18 aa, Mycobacterium
VPQLWRDMDTTLAAAPLG

SEQ ID NO: 1335141 - protein, 23 aa, Mycobacterium
VPTIAWLTWHIDYWWSAALASMR

SEQ ID NO: 1335142 - protein, 23 aa, Mycobacterium
VPVETWLTAIADLLARFHSRAER

SEQ ID NO: 1335143 - protein, 26 aa, Mycobacterium
VPWNTPLFIAALKLGPALAAGCTVVL

SEQ ID NO: 1335144 - protein, 18 aa, Mycobacterium
VPYRWLTSYVAGDKVYCI

SEQ ID NO: 1335145 - protein, 21 aa, Mycobacterium
VPYYRVLELAPWLSWPRPNFP

SEQ ID NO: 1335146 - protein, 17 aa, Mycobacterium
VQERALYDALAGGAIKA

SEQ ID NO: 1335147 - protein, 21 aa, Mycobacterium
VQLRRFIAAILMGALAAACSS

SEQ ID NO: 1335148 - protein, 18 aa, Mycobacterium
VQWLLERIGQLRGAGWVA

SEQ ID NO: 1335149 - protein, 17 aa, Mycobacterium
VRAALPLLRAAEWARIV

SEQ ID NO: 1335150 - protein, 19 aa, Mycobacterium
VRALMTGYLLYTLTGDKTY

SEQ ID NO: 1335151 - protein, 20 aa, Mycobacterium
VRAPWLMRAGLLPRGSRQER

SEQ ID NO: 1335152 - protein, 18 aa, Mycobacterium
VRELLLADPLMPALIDVS

SEQ ID NO: 1335153 - protein, 27 aa, Mycobacterium
VRFVLVRFVLLCLLRWIRFGCGGVIGL

SEQ ID NO: 1335154 - protein, 25 aa, Mycobacterium
VRGRPYPDLILTALLRTGADRVQAV

SEQ ID NO: 1335155 - protein, 20 aa, Mycobacterium
VRGYTLRLPLDVLVVASANP

SEQ ID NO: 1335156 - protein, 22 aa, Mycobacterium
VRLPRIPVPFPMYLPGPNRVQI

SEQ ID NO: 1335157 - protein, 19 aa, Mycobacterium
VRRYILDCALRWMRDFHAD

SEQ ID NO: 1335158 - protein, 19 aa, Mycobacterium
VRTRLLRTLGLRGVAHSVR

SEQ ID NO: 1335159 - protein, 23 aa, Mycobacterium
VRVPFEHPLWILFSSGTTGLPKG

SEQ ID NO: 1335160 - protein, 18 aa, Mycobacterium
VRVRLLRELAATGEALVA

SEQ ID NO: 1335161 - protein, 20 aa, Mycobacterium
VSARVYPALVPLDHPLASVN

SEQ ID NO: 1335162 - protein, 23 aa, Mycobacterium
VSDKIDFWLWLDAGFEDQAIEAW

SEQ ID NO: 1335163 - protein, 25 aa, Mycobacterium
VSEVAELLWYPLWDANIRLDHSVRT

SEQ ID NO: 1335164 - protein, 34 aa, Mycobacterium
VSGRLVWFAMTIWQFLHFRFGLPKPLLEPLAVER

SEQ ID NO: 1335165 - protein, 23 aa, Mycobacterium
VSGWAPPSPPIPPDARPVLAAPP

SEQ ID NO: 1335166 - protein, 25 aa, Mycobacterium
VSKGLQFPVVYLPFAFNRNIQTRDV

SEQ ID NO: 1335167 - protein, 24 aa, Mycobacterium
VSNRLRPWLPLLLALTANSAIYRN

SEQ ID NO: 1335168 - protein, 25 aa, Mycobacterium
VSQVAELLWYPLWDANIRLDHSVRT

SEQ ID NO: 1335169 - protein, 23 aa, Mycobacterium
VSRGWLYRHFPDKAELLGAAIVR

SEQ ID NO: 1335170 - protein, 18 aa, Mycobacterium
VSTLFQPLLSTIPMQLFS

SEQ ID NO: 1335171 - protein, 23 aa, Mycobacterium
VSVATPFLLTGLIAPAMVQRGDG

SEQ ID NO: 1335172 - protein, 17 aa, Mycobacterium
VSVHAFNLWLDEDWGFN

SEQ ID NO: 1335173 - protein, 18 aa, Mycobacterium
VTGNYRAWRHFIAMRASE

SEQ ID NO: 1335174 - protein, 19 aa, Mycobacterium
VTGPLLRYLAGCVLAAFPN

SEQ ID NO: 1335175 - protein, 17 aa, Mycobacterium
VTGVFRYTDTWSAAIHL

SEQ ID NO: 1335176 - protein, 18 aa, Mycobacterium
VTGVFRYTDTWSAAIHLV

SEQ ID NO: 1335177 - protein, 26 aa, Mycobacterium
VTKDRWSMEWYYPVLGGALRGPRARA

SEQ ID NO: 1335178 - protein, 17 aa, Mycobacterium
VTPRRFLALSNPGLREL

SEQ ID NO: 1335179 - protein, 17 aa, Mycobacterium
VTSIYWYFRKKDDLLNA

SEQ ID NO: 1335180 - protein, 17 aa, Mycobacterium
VTWLGIPGWIKTFTAAG

SEQ ID NO: 1335181 - protein, 22 aa, Mycobacterium
VTYLFRRHLGVGPLDHLRRIRL

SEQ ID NO: 1335182 - protein, 18 aa, Mycobacterium
VVAPEAYFQFPVAKYGIA

SEQ ID NO: 1335183 - protein, 24 aa, Mycobacterium
VVEFMLLDRLFPRSIFYSLRLAEH

SEQ ID NO: 1335184 - protein, 22 aa, Mycobacterium
VVFEVMVRPLIRLSLGKRQATR

SEQ ID NO: 1335185 - protein, 17 aa, Mycobacterium
VVHKLRRVLSGLDPHQA

SEQ ID NO: 1335186 - protein, 19 aa, Mycobacterium
VVHPLLMTIFDISGLSELV

SEQ ID NO: 1335187 - protein, 19 aa, Mycobacterium
VVLLMWAGILAYLDHSGYD

SEQ ID NO: 1335188 - protein, 17 aa, Mycobacterium
VVLVPRPALRYLEGSPG

SEQ ID NO: 1335189 - protein, 25 aa, Mycobacterium
VVPTGVRLWPAQPLTLLAPWDGEVR

SEQ ID NO: 1335190 - protein, 19 aa, Mycobacterium
VVRPFLKYQIITVAAPETA

SEQ ID NO: 1335191 - protein, 23 aa, Mycobacterium
VVSIPTMILFKDGKPVKRIVGAK

SEQ ID NO: 1335192 - protein, 27 aa, Mycobacterium
VVTPFNFPIAIPAWKIAPALVYGNTVV

SEQ ID NO: 1335193 - protein, 18 aa, Mycobacterium
VVVPWAAVDAWWEEGRRL

SEQ ID NO: 1335194 - protein, 21 aa, Mycobacterium
VWHAALRRTRPERPFTVVIDE

SEQ ID NO: 1335195 - protein, 18 aa, Mycobacterium
VWTFLGPRPAGWWIRRRV

SEQ ID NO: 1335196 - protein, 19 aa, Mycobacterium
WAAYALWVFTLFGHPDVRL

SEQ ID NO: 1335197 - protein, 17 aa, Mycobacterium
WAFTWVVDWPLFEPADD

SEQ ID NO: 1335198 - protein, 19 aa, Mycobacterium
WAGVPFFLRTGKRLPRRVT

SEQ ID NO: 1335199 - protein, 18 aa, Mycobacterium
WALLVMALARVGLGPLRG

SEQ ID NO: 1335200 - protein, 18 aa, Mycobacterium
WARLPAGVYVPLIGLSFG

SEQ ID NO: 1335201 - protein, 17 aa, Mycobacterium
WAVGWRKDAFWGRDALL

SEQ ID NO: 1335202 - protein, 21 aa, Mycobacterium
WDARAWLRRPGLAHGASADLV

SEQ ID NO: 1335203 - protein, 23 aa, Mycobacterium
WDGAPLIPYFRQLTEAPVVLGND

SEQ ID NO: 1335204 - protein, 20 aa, Mycobacterium
WDLLNLLTCAPGAIGDHLLT

SEQ ID NO: 1335205 - protein, 20 aa, Mycobacterium
WDWLDLPNPPASWGWGSMAH

SEQ ID NO: 1335206 - protein, 21 aa, Mycobacterium
WEGFAWFVWQLCEMTATDRGL

SEQ ID NO: 1335207 - protein, 19 aa, Mycobacterium
WFMRAFRADEWLLYDQSSP

SEQ ID NO: 1335208 - protein, 18 aa, Mycobacterium
WFTEVFARLPHVLFDIRI

SEQ ID NO: 1335209 - protein, 18 aa, Mycobacterium
WFTRPLIDSYHTVWFELH

SEQ ID NO: 1335210 - protein, 17 aa, Mycobacterium
WFVMMPTPLWDQIFKPM

SEQ ID NO: 1335211 - protein, 24 aa, Mycobacterium
WGDRERPLWIKPENLQPIGAFKVR

SEQ ID NO: 1335212 - protein, 20 aa, Mycobacterium
WGPTVPLVDAPWFALSERNS

SEQ ID NO: 1335213 - protein, 17 aa, Mycobacterium
WGTFTYRPSKAARHAAA

SEQ ID NO: 1335214 - protein, 17 aa, Mycobacterium
WHFLIFFDQPFPADIGY

SEQ ID NO: 1335215 - protein, 18 aa, Mycobacterium
WHRPLPEPGMRSEYTPDR

SEQ ID NO: 1335216 - protein, 18 aa, Mycobacterium
WHWETFPEFLDALDAGAR

SEQ ID NO: 1335217 - protein, 18 aa, Mycobacterium
WIYIPKACTWRQVPSEET

SEQ ID NO: 1335218 - protein, 19 aa, Mycobacterium
WLAALWKEAGLPDGVFNVL

SEQ ID NO: 1335219 - protein, 17 aa, Mycobacterium
WLAHLYEKWSAELDFAV

SEQ ID NO: 1335220 - protein, 18 aa, Mycobacterium
WLGTPYLRFTREGAFGVC

SEQ ID NO: 1335221 - protein, 18 aa, Mycobacterium
WLHRLGLLHLLQSELRAA

SEQ ID NO: 1335222 - protein, 21 aa, Mycobacterium
WLNAHVPFYANWIRLKSFWGT

SEQ ID NO: 1335223 - protein, 19 aa, Mycobacterium
WLNPAYFASWFPFPDNSDL

SEQ ID NO: 1335224 - protein, 25 aa, Mycobacterium
WLNSFGYWFWGGFVRSIFGVAPVRP

SEQ ID NO: 1335225 - protein, 18 aa, Mycobacterium
WMLHWRKMFDGLQTVGAI

SEQ ID NO: 1335226 - protein, 17 aa, Mycobacterium
WNAAAALGVPFGDFTTD

SEQ ID NO: 1335227 - protein, 21 aa, Mycobacterium
WNAWHWRWNPWVMAARGYAVL

SEQ ID NO: 1335228 - protein, 17 aa, Mycobacterium
WNLARFAETLLPLIHEN

SEQ ID NO: 1335229 - protein, 18 aa, Mycobacterium
WNMQLLSHVLDHGLDPAE

SEQ ID NO: 1335230 - protein, 17 aa, Mycobacterium
WPAFLMSAGIELPKKVF

SEQ ID NO: 1335231 - protein, 17 aa, Mycobacterium
WPAFLTSFLRLSALIRA

SEQ ID NO: 1335232 - protein, 17 aa, Mycobacterium
WPDIRWVIAELLTVRIT

SEQ ID NO: 1335233 - protein, 19 aa, Mycobacterium
WPELADRPGALLRQLILVG

SEQ ID NO: 1335234 - protein, 17 aa, Mycobacterium
WPKLKDVPYLGISVLGE

SEQ ID NO: 1335235 - protein, 22 aa, Mycobacterium
WPSMFRGYLRQDQRYRDSFAGG

SEQ ID NO: 1335236 - protein, 18 aa, Mycobacterium
WQRLLFDNGWLLPAQPPE

SEQ ID NO: 1335237 - protein, 19 aa, Mycobacterium
WQYRRLFMRLPPDAPKHRA

SEQ ID NO: 1335238 - protein, 17 aa, Mycobacterium
WRDLLLTLEQRLLLTQK

SEQ ID NO: 1335239 - protein, 19 aa, Mycobacterium
WRKWLYFDCNWKVALEAFN

SEQ ID NO: 1335240 - protein, 17 aa, Mycobacterium
WRRLTITLAWLSPVNTA

SEQ ID NO: 1335241 - protein, 18 aa, Mycobacterium
WRRNPVLAPLRRVLNTPK

SEQ ID NO: 1335242 - protein, 19 aa, Mycobacterium
WRSVLWARWPSAGPPPHFD

SEQ ID NO: 1335243 - protein, 19 aa, Mycobacterium
WRVEALVLLAFSAYARGDG

SEQ ID NO: 1335244 - protein, 19 aa, Mycobacterium
WSGGRGVILLVLIRKRLGK

SEQ ID NO: 1335245 - protein, 17 aa, Mycobacterium
WSGMTWQYWLATRRFNK

SEQ ID NO: 1335246 - protein, 19 aa, Mycobacterium
WSYLYRRMIPVLVDAGLRA

SEQ ID NO: 1335247 - protein, 23 aa, Mycobacterium
WTEPTWLPARWPVLLCNGAVGIA

SEQ ID NO: 1335248 - protein, 17 aa, Mycobacterium
WTLLKWLDEPVPFLDRH

SEQ ID NO: 1335249 - protein, 18 aa, Mycobacterium
WTTLGQYADWIFCLVRTD

SEQ ID NO: 1335250 - protein, 22 aa, Mycobacterium
WVNLHFSVLPAWRGAAPVQAAL

SEQ ID NO: 1335251 - protein, 18 aa, Mycobacterium
WVSQRRALLKLAPELQTA

SEQ ID NO: 1335252 - protein, 18 aa, Mycobacterium
WWEWAATYERAFTAAYDA

SEQ ID NO: 1335253 - protein, 18 aa, Mycobacterium
WYFYTSRLTVWRVKPTDW

SEQ ID NO: 1335254 - protein, 21 aa, Mycobacterium
YAGLFIRMSWHAAGTYRIFDG

SEQ ID NO: 1335255 - protein, 19 aa, Mycobacterium
YALRDTAGTPFLLLAGLEP

SEQ ID NO: 1335256 - protein, 20 aa, Mycobacterium
YAPKLPWPWGLLDFAARVLK

SEQ ID NO: 1335257 - protein, 20 aa, Mycobacterium
YDALFDLYFPAALGSRTVLD

SEQ ID NO: 1335258 - protein, 19 aa, Mycobacterium
YDFLPTIDRWLVSVPMVHL

SEQ ID NO: 1335259 - protein, 19 aa, Mycobacterium
YDILFFWVARMMMFGTFVA

SEQ ID NO: 1335260 - protein, 18 aa, Mycobacterium
YEYLVYWRLYQDGNIECE

SEQ ID NO: 1335261 - protein, 19 aa, Mycobacterium
YFAALLGLPFIAVMTSSTS

SEQ ID NO: 1335262 - protein, 18 aa, Mycobacterium
YFAMTGWRLGWLLVPDEL

SEQ ID NO: 1335263 - protein, 18 aa, Mycobacterium
YFQWSAMSWFALADAGFA

SEQ ID NO: 1335264 - protein, 17 aa, Mycobacterium
YFVYRLIKRLKKSANNA

SEQ ID NO: 1335265 - protein, 20 aa, Mycobacterium
YGDMGLALPILAPGGVASAL

SEQ ID NO: 1335266 - protein, 18 aa, Mycobacterium
YGFAWNPMTLVGILQNIK

SEQ ID NO: 1335267 - protein, 17 aa, Mycobacterium
YGFAWNPMTLVGILQSI

SEQ ID NO: 1335268 - protein, 21 aa, Mycobacterium
YGLLPQWGLARLLRIAPVSRE

SEQ ID NO: 1335269 - protein, 20 aa, Mycobacterium
YGRFLAIRVFDFWVHERDIT

SEQ ID NO: 1335270 - protein, 18 aa, Mycobacterium
YIALWRALLGLDLMATVD

SEQ ID NO: 1335271 - protein, 19 aa, Mycobacterium
YIDIKGLRLTLTQAAWRLS

SEQ ID NO: 1335272 - protein, 23 aa, Mycobacterium
YIREQLPGLWLLASLYFRADVRG

SEQ ID NO: 1335273 - protein, 19 aa, Mycobacterium
YKRPSRVVFVPAIPRLPSG

SEQ ID NO: 1335274 - protein, 21 aa, Mycobacterium
YKSNTQLLWYRKSHAAAAGVD

SEQ ID NO: 1335275 - protein, 20 aa, Mycobacterium
YKVFTPFFAAWRTHGWRPPA

SEQ ID NO: 1335276 - protein, 23 aa, Mycobacterium
YLAELTMLILWKARQKDPETGYA

SEQ ID NO: 1335277 - protein, 24 aa, Mycobacterium
YLDTGAMYRIVTLGVLRAGVDPAD

SEQ ID NO: 1335278 - protein, 28 aa, Mycobacterium
YLIPTAKLPLVQLLPFLAPMEAELKEMV

SEQ ID NO: 1335279 - protein, 18 aa, Mycobacterium
YLIYRPELYARRTIERLG

SEQ ID NO: 1335280 - protein, 19 aa, Mycobacterium
YLQTLPLRRLTTPAEVARC

SEQ ID NO: 1335281 - protein, 18 aa, Mycobacterium
YLVCLRIVTSGHARALSS

SEQ ID NO: 1335282 - protein, 17 aa, Mycobacterium
YLVQQWLGEAPADVLIT

SEQ ID NO: 1335283 - protein, 19 aa, Mycobacterium
YMNALFDYLLVSLRSLPTV

SEQ ID NO: 1335284 - protein, 18 aa, Mycobacterium
YNEIVISCPLLLTLPAVG

SEQ ID NO: 1335285 - protein, 17 aa, Mycobacterium
YPALVPLDHPLASVNGA

SEQ ID NO: 1335286 - protein, 24 aa, Mycobacterium
YPFEHRAYWFPTTKVHTLPAGGGV

SEQ ID NO: 1335287 - protein, 19 aa, Mycobacterium
YPLLLHEPYVRLYPAQVVK

SEQ ID NO: 1335288 - protein, 19 aa, Mycobacterium
YPVLVRPSYVLGGRGMEIV

SEQ ID NO: 1335289 - protein, 21 aa, Mycobacterium
YPYEDLYMLPAARQFVPIMRN

SEQ ID NO: 1335290 - protein, 21 aa, Mycobacterium
YPYVLPLLDLTTSNPAYVFAA

SEQ ID NO: 1335291 - protein, 17 aa, Mycobacterium
YQEWLAHALPQLLLRAE

SEQ ID NO: 1335292 - protein, 17 aa, Mycobacterium
YQLVMGERRWRAAQLAG

SEQ ID NO: 1335293 - protein, 20 aa, Mycobacterium
YQMARIFPTMFRKALRKMAE

SEQ ID NO: 1335294 - protein, 18 aa, Mycobacterium
YQSWSACYLPLVRVLRTL

SEQ ID NO: 1335295 - protein, 28 aa, Mycobacterium
YRGHIFWDELFIFPVLNLRAPMITRSLL

SEQ ID NO: 1335296 - protein, 21 aa, Mycobacterium
YRGLQFFHATGLPLHDIRRVA

SEQ ID NO: 1335297 - protein, 22 aa, Mycobacterium
YRNRVFIADYSLGWIRVLDFDE

SEQ ID NO: 1335298 - protein, 20 aa, Mycobacterium
YRRLAFTFHTFTRQLTTVGL

SEQ ID NO: 1335299 - protein, 27 aa, Mycobacterium
YRSAAALCRYLWLTRGLTGILEVTRSG

SEQ ID NO: 1335300 - protein, 23 aa, Mycobacterium
YRSLREIVLPLRRLTVITGANGT

SEQ ID NO: 1335301 - protein, 21 aa, Mycobacterium
YRYLVTQLKALQFLRGGRRWI

SEQ ID NO: 1335302 - protein, 17 aa, Mycobacterium
YSGPFFRYERPQAGRYR

SEQ ID NO: 1335303 - protein, 20 aa, Mycobacterium
YSHLTLSWVYDWMAQGVPVV

SEQ ID NO: 1335304 - protein, 17 aa, Mycobacterium
YSIVRLIVEILEPFHGR

SEQ ID NO: 1335305 - protein, 21 aa, Mycobacterium
YSSLWLYLAGVRPIVFGVSAA

SEQ ID NO: 1335306 - protein, 19 aa, Mycobacterium
YSVYPWALLVMALARVGLG

SEQ ID NO: 1335307 - protein, 22 aa, Mycobacterium
YTFMDLWFYHCNPRHHSVALTP

SEQ ID NO: 1335308 - protein, 17 aa, Mycobacterium
YTPLYRGVFVRKGVEVT

SEQ ID NO: 1335309 - protein, 24 aa, Mycobacterium
YTSPSWMMWNFQVAGLLVGATIVC

SEQ ID NO: 1335310 - protein, 18 aa, Mycobacterium
YTSWLFGHRLREAGLLGS

SEQ ID NO: 1335311 - protein, 23 aa, Mycobacterium
YTTGARRFGWDRRPLQSRSLQRN

SEQ ID NO: 1335312 - protein, 18 aa, Mycobacterium
YVDLYLIHWPAGSQGTYV

SEQ ID NO: 1335313 - protein, 29 aa, Mycobacterium
YVFVPTRNLPLLTPLRLIGLGWLADELNE

SEQ ID NO: 1335314 - protein, 17 aa, Mycobacterium
YVGLYWYHRPEDVTIYG

SEQ ID NO: 1335315 - protein, 24 aa, Mycobacterium
YVHPEIEFFLLKPGPDDGTQPIPA

SEQ ID NO: 1335316 - protein, 19 aa, Mycobacterium
YVLEYPIFGDVALIGAHVA

SEQ ID NO: 1335317 - protein, 17 aa, Mycobacterium
YVPGYRLLNEPQFDPPS

SEQ ID NO: 1335318 - protein, 18 aa, Mycobacterium
YVTLRLPLTRGVGIYAAC

SEQ ID NO: 1335319 - protein, 17 aa, Mycobacterium
YWMSDTQVRWRPIDFWP

SEQ ID NO: 1335320 - protein, 18 aa, Mycobacterium
YWNLSLWSDYNVMLMKTD

SEQ ID NO: 1335321 - protein, 17 aa, Mycobacterium
YYEDDVHLWDWAAAALI

SEQ ID NO: 1335322 - protein, 28 aa, Mycobacterium
YYNKAGLWPYLEKLGYYLGGYGCTTCIG

SEQ ID NO: 1335323 - protein, 17 aa, Mycobacterium
YYTWFRSDEPRGAQLLE

SEQ ID NO: 1335324 - protein, 6 aa, Mycobacterium
DAHAGL

SEQ ID NO: 1335325 - protein, 9 aa, Mycobacterium
DQPDAPAVA

SEQ ID NO: 1335326 - protein, 5 aa, Mycobacterium
EGGRV

SEQ ID NO: 1335327 - protein, 6 aa, Mycobacterium
LDSAGP

SEQ ID NO: 1335328 - protein, 4 aa, Mycobacterium
LPGA

SEQ ID NO: 1335329 - protein, 9 aa, Mycobacterium
LSKSQVSRM

SEQ ID NO: 1335330 - protein, 6 aa, Mycobacterium
RKRAES

SEQ ID NO: 1335331 - protein, 6 aa, Mycobacterium
SETGPA

SEQ ID NO: 1335332 - protein, 7 aa, Mycobacterium
VNGDGHR

SEQ ID NO: 1335333 - protein, 9 aa, Mycobacterium
EQNDEWAEG

SEQ ID NO: 1335334 - protein, 5 aa, Mycobacterium
IRRRT

SEQ ID NO: 1335335 - protein, 7 aa, Mycobacterium
NPAERLN

SEQ ID NO: 1335336 - protein, 16 aa, Mycobacterium
TNDNPEIGADDMPALT

SEQ ID NO: 1335337 - protein, 17 aa, Mycobacterium
WGQPTPGRRSQRNGYRH

SEQ ID NO: 1335338 - protein, 16 aa, Mycobacterium
PAGAVTPPAPPAPPAA

SEQ ID NO: 1335339 - protein, 4 aa, Mycobacterium
YSQG

SEQ ID NO: 1335340 - protein, 10 aa, Mycobacterium
ADLGNGPGIQ

SEQ ID NO: 1335341 - protein, 6 aa, Mycobacterium
DGQGRT

SEQ ID NO: 1335342 - protein, 4 aa, Mycobacterium
GQSS

SEQ ID NO: 1335343 - protein, 9 aa, Mycobacterium
AHGTVTGAA

SEQ ID NO: 1335344 - protein, 8 aa, Mycobacterium
EGAEDFEG

SEQ ID NO: 1335345 - protein, 11 aa, Mycobacterium
STGTSNAGLDN

SEQ ID NO: 1335346 - protein, 4 aa, Mycobacterium
AAGA

SEQ ID NO: 1335347 - protein, 4 aa, Mycobacterium
DDRG

SEQ ID NO: 1335348 - protein, 7 aa, Mycobacterium
EGAEGAV

SEQ ID NO: 1335349 - protein, 5 aa, Mycobacterium
GSAPL

SEQ ID NO: 1335350 - protein, 8 aa, Mycobacterium
KEAGRTDV

SEQ ID NO: 1335351 - protein, 4 aa, Mycobacterium
LDES

SEQ ID NO: 1335352 - protein, 5 aa, Mycobacterium
QNGTV

SEQ ID NO: 1335353 - protein, 4 aa, Mycobacterium
RTGQ

SEQ ID NO: 1335354 - protein, 15 aa, Mycobacterium
STGDSVTTYGEPWNM

SEQ ID NO: 1335355 - protein, 19 aa, Mycobacterium
TPAQAAPAGPGNAQNTIEK

SEQ ID NO: 1335356 - protein, 7 aa, Mycobacterium
AAGGTNG

SEQ ID NO: 1335357 - protein, 5 aa, Mycobacterium
ASGSR

SEQ ID NO: 1335358 - protein, 4 aa, Mycobacterium
IDST

SEQ ID NO: 1335359 - protein, 4 aa, Mycobacterium
PATI

SEQ ID NO: 1335360 - protein, 6 aa, Mycobacterium
RAEGVG

SEQ ID NO: 1335361 - protein, 5 aa, Mycobacterium
RGAGA

SEQ ID NO: 1335362 - protein, 7 aa, Mycobacterium
AAGRAGG

SEQ ID NO: 1335363 - protein, 4 aa, Mycobacterium
AALT

SEQ ID NO: 1335364 - protein, 13 aa, Mycobacterium
AATTTSATVTTHA

SEQ ID NO: 1335365 - protein, 10 aa, Mycobacterium
AAVPQAEARD

SEQ ID NO: 1335366 - protein, 5 aa, Mycobacterium
ADNPD

SEQ ID NO: 1335367 - protein, 5 aa, Mycobacterium
AEKNS

SEQ ID NO: 1335368 - protein, 4 aa, Mycobacterium
AGLA

SEQ ID NO: 1335369 - protein, 4 aa, Mycobacterium
AGVG

SEQ ID NO: 1335370 - protein, 4 aa, Mycobacterium
AKGR

SEQ ID NO: 1335371 - protein, 7 aa, Mycobacterium
AKKENNY

SEQ ID NO: 1335372 - protein, 6 aa, Mycobacterium
ANSAEK

SEQ ID NO: 1335373 - protein, 10 aa, Mycobacterium
APAGPGSSVT

SEQ ID NO: 1335374 - protein, 8 aa, Mycobacterium
APPAGADT

SEQ ID NO: 1335375 - protein, 5 aa, Mycobacterium
AQAPK

SEQ ID NO: 1335376 - protein, 8 aa, Mycobacterium
AQDGITRD

SEQ ID NO: 1335377 - protein, 19 aa, Mycobacterium
AQQQRAPSEVDYPPKPPGD

SEQ ID NO: 1335378 - protein, 5 aa, Mycobacterium
ARAGD

SEQ ID NO: 1335379 - protein, 7 aa, Mycobacterium
ARDTSPV

SEQ ID NO: 1335380 - protein, 6 aa, Mycobacterium
ARGPQA

SEQ ID NO: 1335381 - protein, 6 aa, Mycobacterium
ARPPLQ

SEQ ID NO: 1335382 - protein, 19 aa, Mycobacterium
ASKTGTAEHGTDPRNTPPH

SEQ ID NO: 1335383 - protein, 7 aa, Mycobacterium
ASRARLD

SEQ ID NO: 1335384 - protein, 7 aa, Mycobacterium
ASVTDGA

SEQ ID NO: 1335385 - protein, 6 aa, Mycobacterium
ATPTER

SEQ ID NO: 1335386 - protein, 4 aa, Mycobacterium
AVAG

SEQ ID NO: 1335387 - protein, 12 aa, Mycobacterium
CERDPRARTGEG

SEQ ID NO: 1335388 - protein, 8 aa, Mycobacterium
CESGGNWS

SEQ ID NO: 1335389 - protein, 6 aa, Mycobacterium
CNGTDD

SEQ ID NO: 1335390 - protein, 8 aa, Mycobacterium
CSNNYGPY

SEQ ID NO: 1335391 - protein, 4 aa, Mycobacterium
DAAA

SEQ ID NO: 1335392 - protein, 9 aa, Mycobacterium
DESGTTDNF

SEQ ID NO: 1335393 - protein, 10 aa, Mycobacterium
DGELQASQKL

SEQ ID NO: 1335394 - protein, 8 aa, Mycobacterium
DPAKLNET

SEQ ID NO: 1335395 - protein, 7 aa, Mycobacterium
DPGPELE

SEQ ID NO: 1335396 - protein, 6 aa, Mycobacterium
DPYRYP

SEQ ID NO: 1335397 - protein, 4 aa, Mycobacterium
DSSV

SEQ ID NO: 1335398 - protein, 5 aa, Mycobacterium
DTRGD

SEQ ID NO: 1335399 - protein, 13 aa, Mycobacterium
DVIPADRTSVPPD

SEQ ID NO: 1335400 - protein, 7 aa, Mycobacterium
DWPSGTT

SEQ ID NO: 1335401 - protein, 5 aa, Mycobacterium
EAAGV

SEQ ID NO: 1335402 - protein, 6 aa, Mycobacterium
EDFNDN

SEQ ID NO: 1335403 - protein, 7 aa, Mycobacterium
EGGPTYW

SEQ ID NO: 1335404 - protein, 31 aa, Mycobacterium; identical to SEQ ID NO: 900892

SEQ ID NO: 1335405 - protein, 4 aa, Mycobacterium
ENDR

SEQ ID NO: 1335406 - protein, 9 aa, Mycobacterium
EPDGKSSKS

SEQ ID NO: 1335407 - protein, 6 aa, Mycobacterium
EPGVGK

SEQ ID NO: 1335408 - protein, 5 aa, Mycobacterium
EPSTG

SEQ ID NO: 1335409 - protein, 6 aa, Mycobacterium
EPSVED

SEQ ID NO: 1335410 - protein, 12 aa, Mycobacterium
ERDGRADPFGTE

SEQ ID NO: 1335411 - protein, 7 aa, Mycobacterium
ETLPPDA

SEQ ID NO: 1335412 - protein, 5 aa, Mycobacterium
EVDGK

SEQ ID NO: 1335413 - protein, 30 aa, Mycobacterium; identical to SEQ ID NO: 901790

SEQ ID NO: 1335414 - protein, 6 aa, Mycobacterium
EYGEKH

SEQ ID NO: 1335415 - protein, 7 aa, Mycobacterium
FPTRDGQ

SEQ ID NO: 1335416 - protein, 7 aa, Mycobacterium
GADDPER

SEQ ID NO: 1335417 - protein, 5 aa, Mycobacterium
GADPL

SEQ ID NO: 1335418 - protein, 7 aa, Mycobacterium
GAQPDSV

SEQ ID NO: 1335419 - protein, 9 aa, Mycobacterium
GGEGGTGAA

SEQ ID NO: 1335420 - protein, 5 aa, Mycobacterium
GGGPH

SEQ ID NO: 1335421 - protein, 8 aa, Mycobacterium
GGGPTGVE

SEQ ID NO: 1335422 - protein, 4 aa, Mycobacterium
GGHG

SEQ ID NO: 1335423 - protein, 14 aa, Mycobacterium
GGSATAGAFSRPGL

SEQ ID NO: 1335424 - protein, 10 aa, Mycobacterium
GGSVAGVGES

SEQ ID NO: 1335425 - protein, 9 aa, Mycobacterium
GHGASPQAL

SEQ ID NO: 1335426 - protein, 4 aa, Mycobacterium
GMGR

SEQ ID NO: 1335427 - protein, 7 aa, Mycobacterium
GPGPTFD

SEQ ID NO: 1335428 - protein, 7 aa, Mycobacterium
GPPAADQ

SEQ ID NO: 1335429 - protein, 17 aa, Mycobacterium
GPPAGDQFGEAAEGVEA

SEQ ID NO: 1335430 - protein, 9 aa, Mycobacterium
GPPGTGKTT

SEQ ID NO: 1335431 - protein, 11 aa, Mycobacterium
GRLTDGQGRTV

SEQ ID NO: 1335432 - protein, 7 aa, Mycobacterium
GSDLPSS

SEQ ID NO: 1335433 - protein, 4 aa, Mycobacterium
GSDV

SEQ ID NO: 1335434 - protein, 6 aa, Mycobacterium
GSGEIT

SEQ ID NO: 1335435 - protein, 7 aa, Mycobacterium
GSPNPGY

SEQ ID NO: 1335436 - protein, 14 aa, Mycobacterium
GSSNPLGGGEISGD

SEQ ID NO: 1335437 - protein, 5 aa, Mycobacterium
GSVGN

SEQ ID NO: 1335438 - protein, 8 aa, Mycobacterium
GVAPEGGL

SEQ ID NO: 1335439 - protein, 14 aa, Mycobacterium
GVRGQGDRIGEAIT

SEQ ID NO: 1335440 - protein, 16 aa, Mycobacterium
HGVSGGDEIRRSDAPR

SEQ ID NO: 1335441 - protein, 7 aa, Mycobacterium
HHDPASM

SEQ ID NO: 1335442 - protein, 19 aa, Mycobacterium
IEASPTPSQRTPNYYPGGR

SEQ ID NO: 1335443 - protein, 4 aa, Mycobacterium
IGAG

SEQ ID NO: 1335444 - protein, 6 aa, Mycobacterium
IGGPSA

SEQ ID NO: 1335445 - protein, 13 aa, Mycobacterium
ILDTQTETSDSIQ

SEQ ID NO: 1335446 - protein, 7 aa, Mycobacterium
ILNGSDE

SEQ ID NO: 1335447 - protein, 8 aa, Mycobacterium
INTGNGYY

SEQ ID NO: 1335448 - protein, 8 aa, Mycobacterium
KAKEAGHD

SEQ ID NO: 1335449 - protein, 4 aa, Mycobacterium
KETG

SEQ ID NO: 1335450 - protein, 5 aa, Mycobacterium
KGEGN

SEQ ID NO: 1335451 - protein, 9 aa, Mycobacterium
KGISPSGNA

SEQ ID NO: 1335452 - protein, 5 aa, Mycobacterium
KNSAG

SEQ ID NO: 1335453 - protein, 9 aa, Mycobacterium
KQMRADREK

SEQ ID NO: 1335454 - protein, 5 aa, Mycobacterium
KTDSD

SEQ ID NO: 1335455 - protein, 9 aa, Mycobacterium
LAERGADVD

SEQ ID NO: 1335456 - protein, 7 aa, Mycobacterium
LAHDTDK

SEQ ID NO: 1335457 - protein, 10 aa, Mycobacterium
LANRNTKQDY

SEQ ID NO: 1335458 - protein, 14 aa, Mycobacterium
LDGPPRNTAQIGMP

SEQ ID NO: 1335459 - protein, 6 aa, Mycobacterium
LGGNGK

SEQ ID NO: 1335460 - protein, 8 aa, Mycobacterium
LGGPRGRR

SEQ ID NO: 1335461 - protein, 5 aa, Mycobacterium
LGGRG

SEQ ID NO: 1335462 - protein, 4 aa, Mycobacterium
LPGG

SEQ ID NO: 1335463 - protein, 8 aa, Mycobacterium
LRGTTDSE

SEQ ID NO: 1335464 - protein, 6 aa, Mycobacterium
LSPQAI

SEQ ID NO: 1335465 - protein, 6 aa, Mycobacterium
NDAANT

SEQ ID NO: 1335466 - protein, 4 aa, Mycobacterium
NDGI

SEQ ID NO: 1335467 - protein, 7 aa, Mycobacterium
NGKGGQP

SEQ ID NO: 1335468 - protein, 15 aa, Mycobacterium
NGPPGTQFWTFKLQR

SEQ ID NO: 1335469 - protein, 7 aa, Mycobacterium
NPVRGGE

SEQ ID NO: 1335470 - protein, 9 aa, Mycobacterium
NTVNTMPEK

SEQ ID NO: 1335471 - protein, 36 aa, Mycobacterium
PASGVTPPAPPAPGGPAGGSGGAVTPPGPPAPPAAV

SEQ ID NO: 1335472 - protein, 19 aa, Mycobacterium
PINAAKGGEGGKPSCGSLP

SEQ ID NO: 1335473 - protein, 5 aa, Mycobacterium
PIVGN

SEQ ID NO: 1335474 - protein, 10 aa, Mycobacterium
PPDPSPQRLS

SEQ ID NO: 1335475 - protein, 5 aa, Mycobacterium
PPPCR

SEQ ID NO: 1335476 - protein, 7 aa, Mycobacterium
PRPGTPI

SEQ ID NO: 1335477 - protein, 7 aa, Mycobacterium
PRTDTVR

SEQ ID NO: 1335478 - protein, 4 aa, Mycobacterium
PSLP

SEQ ID NO: 1335479 - protein, 18 aa, Mycobacterium
PVPGPVPTSPANNDFKPG

SEQ ID NO: 1335480 - protein, 6 aa, Mycobacterium
QAIPRD

SEQ ID NO: 1335481 - protein, 9 aa, Mycobacterium
QAQGQAKAI

SEQ ID NO: 1335482 - protein, 5 aa, Mycobacterium
QDPGA

SEQ ID NO: 1335483 - protein, 10 aa, Mycobacterium
QDQRGRNGIP

SEQ ID NO: 1335484 - protein, 7 aa, Mycobacterium
QEAGTDR

SEQ ID NO: 1335485 - protein, 10 aa, Mycobacterium
QESGLTNVRG

SEQ ID NO: 1335486 - protein, 6 aa, Mycobacterium
QGERAA

SEQ ID NO: 1335487 - protein, 6 aa, Mycobacterium
QGGGPH

SEQ ID NO: 1335488 - protein, 9 aa, Mycobacterium
QSGNGGPAV

SEQ ID NO: 1335489 - protein, 4 aa, Mycobacterium
QTAN

SEQ ID NO: 1335490 - protein, 5 aa, Mycobacterium
QVPAD

SEQ ID NO: 1335491 - protein, 5 aa, Mycobacterium
RARQG

SEQ ID NO: 1335492 - protein, 7 aa, Mycobacterium
RGTDPGD

SEQ ID NO: 1335493 - protein, 4 aa, Mycobacterium
RNNL

SEQ ID NO: 1335494 - protein, 4 aa, Mycobacterium
RNVG

SEQ ID NO: 1335495 - protein, 5 aa, Mycobacterium
RPERD

SEQ ID NO: 1335496 - protein, 8 aa, Mycobacterium
RPGKRAPT

SEQ ID NO: 1335497 - protein, 9 aa, Mycobacterium
RPGSGREAT

SEQ ID NO: 1335498 - protein, 8 aa, Mycobacterium
RPNPGIGF

SEQ ID NO: 1335499 - protein, 7 aa, Mycobacterium
RRTKNNP

SEQ ID NO: 1335500 - protein, 11 aa, Mycobacterium
RSGDGAPLKNG

SEQ ID NO: 1335501 - protein, 5 aa, Mycobacterium
RSRTA

SEQ ID NO: 1335502 - protein, 12 aa, Mycobacterium
SAAGYPYSASST

SEQ ID NO: 1335503 - protein, 7 aa, Mycobacterium
SAFPTTE

SEQ ID NO: 1335504 - protein, 6 aa, Mycobacterium
SATEDH

SEQ ID NO: 1335505 - protein, 4 aa, Mycobacterium
SDAG

SEQ ID NO: 1335506 - protein, 8 aa, Mycobacterium
SDTKIPAD

SEQ ID NO: 1335507 - protein, 4 aa, Mycobacterium
SGPV

SEQ ID NO: 1335508 - protein, 5 aa, Mycobacterium
SKDNL

SEQ ID NO: 1335509 - protein, 4 aa, Mycobacterium
SPAQ

SEQ ID NO: 1335510 - protein, 4 aa, Mycobacterium
SPIH

SEQ ID NO: 1335511 - protein, 13 aa, Mycobacterium
SQGAKPGLGGHLP

SEQ ID NO: 1335512 - protein, 7 aa, Mycobacterium
SSGLGAG

SEQ ID NO: 1335513 - protein, 9 aa, Mycobacterium
SSTGLERAE

SEQ ID NO: 1335514 - protein, 7 aa, Mycobacterium
SVPPQRV

SEQ ID NO: 1335515 - protein, 4 aa, Mycobacterium
TAAL

SEQ ID NO: 1335516 - protein, 9 aa, Mycobacterium
TDNDTENAA

SEQ ID NO: 1335517 - protein, 6 aa, Mycobacterium
TDPDRA

SEQ ID NO: 1335518 - protein, 8 aa, Mycobacterium
TETDPAIA

SEQ ID NO: 1335519 - protein, 14 aa, Mycobacterium
TGEGGLSDHHRQGG

SEQ ID NO: 1335520 - protein, 4 aa, Mycobacterium
TGFG

SEQ ID NO: 1335521 - protein, 4 aa, Mycobacterium
TGLP

SEQ ID NO: 1335522 - protein, 8 aa, Mycobacterium
TGVGKTEL

SEQ ID NO: 1335523 - protein, 10 aa, Mycobacterium
TGVKNPDYSD

SEQ ID NO: 1335524 - protein, 4 aa, Mycobacterium
TIET

SEQ ID NO: 1335525 - protein, 10 aa, Mycobacterium
TNDPATPYQA

SEQ ID NO: 1335526 - protein, 6 aa, Mycobacterium
TNKEFQ

SEQ ID NO: 1335527 - protein, 4 aa, Mycobacterium
TPSN

SEQ ID NO: 1335528 - protein, 4 aa, Mycobacterium
TRGA

SEQ ID NO: 1335529 - protein, 5 aa, Mycobacterium
TRRGD

SEQ ID NO: 1335530 - protein, 9 aa, Mycobacterium
TSQNTATEV

SEQ ID NO: 1335531 - protein, 6 aa, Mycobacterium
TTLDTG

SEQ ID NO: 1335532 - protein, 7 aa, Mycobacterium
TTNDREW

SEQ ID NO: 1335533 - protein, 5 aa, Mycobacterium
TTNPS

SEQ ID NO: 1335534 - protein, 6 aa, Mycobacterium
TVGGGA

SEQ ID NO: 1335535 - protein, 5 aa, Mycobacterium
TVGQT

SEQ ID NO: 1335536 - protein, 15 aa, Mycobacterium
TYGVPVDDPSGEGYK

SEQ ID NO: 1335537 - protein, 9 aa, Mycobacterium
TYRGTTVGR

SEQ ID NO: 1335538 - protein, 5 aa, Mycobacterium
TYSPP

SEQ ID NO: 1335539 - protein, 8 aa, Mycobacterium
VAGRPVPA

SEQ ID NO: 1335540 - protein, 6 aa, Mycobacterium
VGSQTA

SEQ ID NO: 1335541 - protein, 39 aa, Mycobacterium; identical to SEQ ID NO: 921586

SEQ ID NO: 1335542 - protein, 12 aa, Mycobacterium
VPVPPPPSAGPT

SEQ ID NO: 1335543 - protein, 9 aa, Mycobacterium
VSDTYSAAA

SEQ ID NO: 1335544 - protein, 4 aa, Mycobacterium
YPGD

SEQ ID NO: 1335545 - protein, 4 aa, Mycobacterium
YPQS

SEQ ID NO: 1335546 - protein, 10 aa, Mycobacterium
YRQGGDTELG

SEQ ID NO: 1335547 - protein, 14 aa, Mycobacterium
AAAAAPADTVTVAA

SEQ ID NO: 1335548 - protein, 6 aa, Mycobacterium
AAAASL

SEQ ID NO: 1335549 - protein, 6 aa, Mycobacterium
AAAAVA

SEQ ID NO: 1335550 - protein, 4 aa, Mycobacterium
AAAD

SEQ ID NO: 1335551 - protein, 6 aa, Mycobacterium
AAADGP

SEQ ID NO: 1335552 - protein, 7 aa, Mycobacterium
AAADPGH

SEQ ID NO: 1335553 - protein, 27 aa, Mycobacterium
AAADRLKASQPAGGPRVGSNGITTVTP

SEQ ID NO: 1335554 - protein, 13 aa, Mycobacterium
AAAERSRNDRNRI

SEQ ID NO: 1335555 - protein, 6 aa, Mycobacterium
AAAGRE

SEQ ID NO: 1335556 - protein, 18 aa, Mycobacterium
AAAGTTELGAQDPPSADT

SEQ ID NO: 1335557 - protein, 6 aa, Mycobacterium
AAALGV

SEQ ID NO: 1335558 - protein, 16 aa, Mycobacterium
AAAPAASVPPAAAPTY

SEQ ID NO: 1335559 - protein, 28 aa, Mycobacterium
AAAPAPAPRAVQPPSRPNPNAPAERRVA

SEQ ID NO: 1335560 - protein, 11 aa, Mycobacterium
AAAQPAPPPPY

SEQ ID NO: 1335561 - protein, 38 aa, Mycobacterium
AAAQPNCVTTGQGAYGGSTTQCSSPGNTQIVTSPGQTN

SEQ ID NO: 1335562 - protein, 7 aa, Mycobacterium
AAATSTA

SEQ ID NO: 1335563 - protein, 9 aa, Mycobacterium
AADAAGRDV

SEQ ID NO: 1335564 - protein, 10 aa, Mycobacterium
AADGREYTLN

SEQ ID NO: 1335565 - protein, 6 aa, Mycobacterium
AAEALR

SEQ ID NO: 1335566 - protein, 9 aa, Mycobacterium
AAEEADTRV

SEQ ID NO: 1335567 - protein, 16 aa, Mycobacterium
AAEGGAGYGTRGNRGS

SEQ ID NO: 1335568 - protein, 7 aa, Mycobacterium
AAEGGVD

SEQ ID NO: 1335569 - protein, 17 aa, Mycobacterium
AAERAPRSGREAAENEL

SEQ ID NO: 1335570 - protein, 9 aa, Mycobacterium
AAESDEYDW

SEQ ID NO: 1335571 - protein, 6 aa, Mycobacterium
AAFGGP

SEQ ID NO: 1335572 - protein, 11 aa, Mycobacterium
AAGAADATARI

SEQ ID NO: 1335573 - protein, 7 aa, Mycobacterium
AAGAGSM

SEQ ID NO: 1335574 - protein, 9 aa, Mycobacterium
AAGDDHPEL

SEQ ID NO: 1335575 - protein, 17 aa, Mycobacterium
AAGDYTTAAEDKPALAV

SEQ ID NO: 1335576 - protein, 5 aa, Mycobacterium
AAGEF

SEQ ID NO: 1335577 - protein, 8 aa, Mycobacterium
AAGGALTV

SEQ ID NO: 1335578 - protein, 8 aa, Mycobacterium
AAGGGQSA

SEQ ID NO: 1335579 - protein, 6 aa, Mycobacterium
AAGGHV

SEQ ID NO: 1335580 - protein, 9 aa, Mycobacterium
AAGGPDLDR

SEQ ID NO: 1335581 - protein, 9 aa, Mycobacterium
AAGGWTDGQ

SEQ ID NO: 1335582 - protein, 5 aa, Mycobacterium
AAGHP

SEQ ID NO: 1335583 - protein, 7 aa, Mycobacterium
AAGKLDE

SEQ ID NO: 1335584 - protein, 10 aa, Mycobacterium
AAGPAQAEQQ

SEQ ID NO: 1335585 - protein, 19 aa, Mycobacterium
AAGPEPVELNTETAGKAID

SEQ ID NO: 1335586 - protein, 7 aa, Mycobacterium
AAGPYAV

SEQ ID NO: 1335587 - protein, 10 aa, Mycobacterium
AAGQPERPAP

SEQ ID NO: 1335588 - protein, 7 aa, Mycobacterium
AAGQTPV

SEQ ID NO: 1335589 - protein, 6 aa, Mycobacterium
AAGRDL

SEQ ID NO: 1335590 - protein, 7 aa, Mycobacterium
AAGRPGP

SEQ ID NO: 1335591 - protein, 33 aa, Mycobacterium
AAGRSGRPACPRGSRARWSPRQPCRGGADGPRR

SEQ ID NO: 1335592 - protein, 5 aa, Mycobacterium
AAGST

SEQ ID NO: 1335593 - protein, 4 aa, Mycobacterium
AAGT

SEQ ID NO: 1335594 - protein, 5 aa, Mycobacterium
AAGVT

SEQ ID NO: 1335595 - protein, 14 aa, Mycobacterium
AAHPTTGDETLPDD

SEQ ID NO: 1335596 - protein, 15 aa, Mycobacterium
AAIPATAQPATPTIT

SEQ ID NO: 1335597 - protein, 7 aa, Mycobacterium
AAKAGDW

SEQ ID NO: 1335598 - protein, 7 aa, Mycobacterium
AAKAGLD

SEQ ID NO: 1335599 - protein, 15 aa, Mycobacterium
AAKRLPDTSLSPDGP

SEQ ID NO: 1335600 - protein, 13 aa, Mycobacterium
AALPRPGTSEGRQ

SEQ ID NO: 1335601 - protein, 5 aa, Mycobacterium
AAMTD

SEQ ID NO: 1335602 - protein, 4 aa, Mycobacterium
AANG

SEQ ID NO: 1335603 - protein, 10 aa, Mycobacterium
AANPETDQAL

SEQ ID NO: 1335604 - protein, 11 aa, Mycobacterium
AAPAGTVTRRR

SEQ ID NO: 1335605 - protein, 11 aa, Mycobacterium
AAPASAAPANI

SEQ ID NO: 1335606 - protein, 8 aa, Mycobacterium
AAPGKTSW

SEQ ID NO: 1335607 - protein, 7 aa, Mycobacterium
AAPRTVE

SEQ ID NO: 1335608 - protein, 7 aa, Mycobacterium
AAPSPPD

SEQ ID NO: 1335609 - protein, 8 aa, Mycobacterium
AAQGPEMD

SEQ ID NO: 1335610 - protein, 7 aa, Mycobacterium
AAQRDGR

SEQ ID NO: 1335611 - protein, 15 aa, Mycobacterium
AAQTCPDARPSPPVS

SEQ ID NO: 1335612 - protein, 7 aa, Mycobacterium
AAQTPGA

SEQ ID NO: 1335613 - protein, 8 aa, Mycobacterium
AARAGTLQ

SEQ ID NO: 1335614 - protein, 10 aa, Mycobacterium
AARDRPGAFR

SEQ ID NO: 1335615 - protein, 7 aa, Mycobacterium
AARPTPE

SEQ ID NO: 1335616 - protein, 13 aa, Mycobacterium
AARSGDGPGGASV

SEQ ID NO: 1335617 - protein, 41 aa, Mycobacterium
AASDGAWGKGAGKSFAGGVGEGAKGNEGTSAAIASTPGSIT

SEQ ID NO: 1335618 - protein, 8 aa, Mycobacterium
AASDPAAE

SEQ ID NO: 1335619 - protein, 10 aa, Mycobacterium
AASGQAAGAP

SEQ ID NO: 1335620 - protein, 9 aa, Mycobacterium
AASQPGGSY

SEQ ID NO: 1335621 - protein, 7 aa, Mycobacterium
AATAEAL

SEQ ID NO: 1335622 - protein, 8 aa, Mycobacterium
AATATATL

SEQ ID NO: 1335623 - protein, 12 aa, Mycobacterium
AATATGDGEYVA

SEQ ID NO: 1335624 - protein, 7 aa, Mycobacterium
AATGDAA

SEQ ID NO: 1335625 - protein, 15 aa, Mycobacterium
AATGDGATTARNAPV

SEQ ID NO: 1335626 - protein, 8 aa, Mycobacterium
AATGPLAE

SEQ ID NO: 1335627 - protein, 6 aa, Mycobacterium
AATGTT

SEQ ID NO: 1335628 - protein, 9 aa, Mycobacterium
AATPYDPAK

SEQ ID NO: 1335629 - protein, 5 aa, Mycobacterium
AATTA

SEQ ID NO: 1335630 - protein, 4 aa, Mycobacterium
AAYG

SEQ ID NO: 1335631 - protein, 11 aa, Mycobacterium
ACGGGGGDENT

SEQ ID NO: 1335632 - protein, 26 aa, Mycobacterium
ACGSGGEAPAEQPAESPDAGASAGES

SEQ ID NO: 1335633 - protein, 12 aa, Mycobacterium
ACPPPPPPPGPL

SEQ ID NO: 1335634 - protein, 28 aa, Mycobacterium
ACSGGESSTETTTSAPAPTSAQAFPPSA

SEQ ID NO: 1335635 - protein, 6 aa, Mycobacterium
ADAGNS

SEQ ID NO: 1335636 - protein, 5 aa, Mycobacterium
ADAHR

SEQ ID NO: 1335637 - protein, 6 aa, Mycobacterium
ADARDL

SEQ ID NO: 1335638 - protein, 19 aa, Mycobacterium
ADAVNAPADAHIHEVIVRP

SEQ ID NO: 1335639 - protein, 14 aa, Mycobacterium
ADAVQTRPGDCGRD

SEQ ID NO: 1335640 - protein, 8 aa, Mycobacterium
ADDASETL

SEQ ID NO: 1335641 - protein, 9 aa, Mycobacterium
ADDTTKQVS

SEQ ID NO: 1335642 - protein, 5 aa, Mycobacterium
ADDTV

SEQ ID NO: 1335643 - protein, 4 aa, Mycobacterium
ADEI

SEQ ID NO: 1335644 - protein, 4 aa, Mycobacterium
ADGA

SEQ ID NO: 1335645 - protein, 6 aa, Mycobacterium
ADGAQI

SEQ ID NO: 1335646 - protein, 20 aa, Mycobacterium
ADGAQLNQAALGDPEAFSGN

SEQ ID NO: 1335647 - protein, 5 aa, Mycobacterium
ADGGL

SEQ ID NO: 1335648 - protein, 9 aa, Mycobacterium
ADGGPPTGR

SEQ ID NO: 1335649 - protein, 4 aa, Mycobacterium
ADGK

SEQ ID NO: 1335650 - protein, 5 aa, Mycobacterium
ADGLN

SEQ ID NO: 1335651 - protein, 9 aa, Mycobacterium
ADGREDQIG

SEQ ID NO: 1335652 - protein, 4 aa, Mycobacterium
ADGS

SEQ ID NO: 1335653 - protein, 6 aa, Mycobacterium
ADGSRS

SEQ ID NO: 1335654 - protein, 11 aa, Mycobacterium
ADHPKAADTPR

SEQ ID NO: 1335655 - protein, 7 aa, Mycobacterium
ADKPDSH

SEQ ID NO: 1335656 - protein, 8 aa, Mycobacterium
ADLATREE

SEQ ID NO: 1335657 - protein, 8 aa, Mycobacterium
ADLGAKSV

SEQ ID NO: 1335658 - protein, 7 aa, Mycobacterium
ADLQPTT

SEQ ID NO: 1335659 - protein, 5 aa, Mycobacterium
ADLSG

SEQ ID NO: 1335660 - protein, 16 aa, Mycobacterium
ADPAVPIGAATDDQAP

SEQ ID NO: 1335661 - protein, 8 aa, Mycobacterium
ADPGDPLI

SEQ ID NO: 1335662 - protein, 6 aa, Mycobacterium
ADPGLG

SEQ ID NO: 1335663 - protein, 5 aa, Mycobacterium
ADPKL

SEQ ID NO: 1335664 - protein, 6 aa, Mycobacterium
ADPPAM

SEQ ID NO: 1335665 - protein, 16 aa, Mycobacterium
ADPPPRASVNERGGSD

SEQ ID NO: 1335666 - protein, 8 aa, Mycobacterium
ADPTPTDL

SEQ ID NO: 1335667 - protein, 9 aa, Mycobacterium
ADSPEGPWS

SEQ ID NO: 1335668 - protein, 9 aa, Mycobacterium
ADSRRAGAL

SEQ ID NO: 1335669 - protein, 9 aa, Mycobacterium
ADTAHTRGR

SEQ ID NO: 1335670 - protein, 4 aa, Mycobacterium
ADTY

SEQ ID NO: 1335671 - protein, 14 aa, Mycobacterium
ADVKGQRATQQGAD

SEQ ID NO: 1335672 - protein, 5 aa, Mycobacterium
ADYGG

SEQ ID NO: 1335673 - protein, 17 aa, Mycobacterium
AEAAEADRRRAAGDQRP

SEQ ID NO: 1335674 - protein, 6 aa, Mycobacterium
AEADPT

SEQ ID NO: 1335675 - protein, 13 aa, Mycobacterium
AEAPPSPPQEGPP

SEQ ID NO: 1335676 - protein, 5 aa, Mycobacterium
AEDDP

SEQ ID NO: 1335677 - protein, 7 aa, Mycobacterium
AEDTRRV

SEQ ID NO: 1335678 - protein, 7 aa, Mycobacterium
AEEQPAF

SEQ ID NO: 1335679 - protein, 7 aa, Mycobacterium
AEGERDN

SEQ ID NO: 1335680 - protein, 7 aa, Mycobacterium
AEGPKAA

SEQ ID NO: 1335681 - protein, 7 aa, Mycobacterium
AEGSVTD

SEQ ID NO: 1335682 - protein, 6 aa, Mycobacterium
AEGVQM

SEQ ID NO: 1335683 - protein, 13 aa, Mycobacterium
AEIDTEDAQNLEE

SEQ ID NO: 1335684 - protein, 25 aa, Mycobacterium
AEKIAARTDPWDPASAVADTSGRER

SEQ ID NO: 1335685 - protein, 10 aa, Mycobacterium
AENGIDAEGL

SEQ ID NO: 1335686 - protein, 5 aa, Mycobacterium
AEPDR

SEQ ID NO: 1335687 - protein, 6 aa, Mycobacterium
AETAAT

SEQ ID NO: 1335688 - protein, 6 aa, Mycobacterium
AETGID

SEQ ID NO: 1335689 - protein, 4 aa, Mycobacterium
AEVH

SEQ ID NO: 1335690 - protein, 7 aa, Mycobacterium
AEYAKGP

SEQ ID NO: 1335691 - protein, 10 aa, Mycobacterium
AFNGRGEKFG

SEQ ID NO: 1335692 - protein, 13 aa, Mycobacterium
AGAAAAIEAADRG

SEQ ID NO: 1335693 - protein, 18 aa, Mycobacterium
AGAAFDPNYHTRRDTIDN

SEQ ID NO: 1335694 - protein, 13 aa, Mycobacterium
AGADGEPAGTQVR

SEQ ID NO: 1335695 - protein, 12 aa, Mycobacterium
AGAESGAPAGPA

SEQ ID NO: 1335696 - protein, 10 aa, Mycobacterium
AGAGRDGAPQ

SEQ ID NO: 1335697 - protein, 9 aa, Mycobacterium
AGANPGSGF

SEQ ID NO: 1335698 - protein, 8 aa, Mycobacterium
AGAPGDPL

SEQ ID NO: 1335699 - protein, 13 aa, Mycobacterium
AGAPSDESRIPAG

SEQ ID NO: 1335700 - protein, 10 aa, Mycobacterium
AGARSGDTAR

SEQ ID NO: 1335701 - protein, 11 aa, Mycobacterium
AGARTGGADGA

SEQ ID NO: 1335702 - protein, 5 aa, Mycobacterium
AGARV

SEQ ID NO: 1335703 - protein, 10 aa, Mycobacterium
AGASTSKEIA

SEQ ID NO: 1335704 - protein, 12 aa, Mycobacterium
AGATGDSSMDAG

SEQ ID NO: 1335705 - protein, 8 aa, Mycobacterium
AGATPSIR

SEQ ID NO: 1335706 - protein, 7 aa, Mycobacterium
AGATPTL

SEQ ID NO: 1335707 - protein, 10 aa, Mycobacterium
AGATSGDSIT

SEQ ID NO: 1335708 - protein, 8 aa, Mycobacterium
AGCAGQTT

SEQ ID NO: 1335709 - protein, 20 aa, Mycobacterium
AGEAPRRDDSGGGGSEHSGG

SEQ ID NO: 1335710 - protein, 13 aa, Mycobacterium
AGEPDQLDPHKTS

SEQ ID NO: 1335711 - protein, 8 aa, Mycobacterium
AGEQSRDM

SEQ ID NO: 1335712 - protein, 5 aa, Mycobacterium
AGGAD

SEQ ID NO: 1335713 - protein, 36 aa, Mycobacterium
AGGCSASSEPAAAPSPPQAVTAPSATPRAAAEPPRL

SEQ ID NO: 1335714 - protein, 8 aa, Mycobacterium
AGGDPSTI

SEQ ID NO: 1335715 - protein, 18 aa, Mycobacterium
AGGEVEVDPNEEIDPNEE

SEQ ID NO: 1335716 - protein, 7 aa, Mycobacterium
AGGFNPQ

SEQ ID NO: 1335717 - protein, 6 aa, Mycobacterium
AGGMRS

SEQ ID NO: 1335718 - protein, 5 aa, Mycobacterium
AGGRN

SEQ ID NO: 1335719 - protein, 9 aa, Mycobacterium
AGGSGTLSN

SEQ ID NO: 1335720 - protein, 4 aa, Mycobacterium
AGGV

SEQ ID NO: 1335721 - protein, 7 aa, Mycobacterium
AGGYRGS

SEQ ID NO: 1335722 - protein, 13 aa, Mycobacterium
AGKQGLSGGDETW

SEQ ID NO: 1335723 - protein, 10 aa, Mycobacterium
AGLDADTYTT

SEQ ID NO: 1335724 - protein, 8 aa, Mycobacterium
AGLPAKAV

SEQ ID NO: 1335725 - protein, 16 aa, Mycobacterium
AGNFNRRSARDCTPEE

SEQ ID NO: 1335726 - protein, 21 aa, Mycobacterium
AGNTDPDEQRRAVRADAAARL

SEQ ID NO: 1335727 - protein, 13 aa, Mycobacterium
AGPAPSATAQGCS

SEQ ID NO: 1335728 - protein, 8 aa, Mycobacterium
AGPTPYGR

SEQ ID NO: 1335729 - protein, 13 aa, Mycobacterium
AGQRSAGAVTEDR

SEQ ID NO: 1335730 - protein, 14 aa, Mycobacterium
AGRAATAAGFQPRD

SEQ ID NO: 1335731 - protein, 8 aa, Mycobacterium
AGRPRRPY

SEQ ID NO: 1335732 - protein, 8 aa, Mycobacterium
AGRTAEAN

SEQ ID NO: 1335733 - protein, 11 aa, Mycobacterium
AGRTDSSPGDV

SEQ ID NO: 1335734 - protein, 12 aa, Mycobacterium
AGSAEPDPAKSR

SEQ ID NO: 1335735 - protein, 11 aa, Mycobacterium
AGSGERGAEVS

SEQ ID NO: 1335736 - protein, 8 aa, Mycobacterium
AGSGTPIQ

SEQ ID NO: 1335737 - protein, 9 aa, Mycobacterium
AGSRESLAP

SEQ ID NO: 1335738 - protein, 10 aa, Mycobacterium
AGSRLGYQES

SEQ ID NO: 1335739 - protein, 22 aa, Mycobacterium
AGTAGADVEDVEGDPAAPSAFP

SEQ ID NO: 1335740 - protein, 7 aa, Mycobacterium
AGTANAD

SEQ ID NO: 1335741 - protein, 11 aa, Mycobacterium
AGTANADSGVN

SEQ ID NO: 1335742 - protein, 7 aa, Mycobacterium
AGTGATM

SEQ ID NO: 1335743 - protein, 5 aa, Mycobacterium
AGTLT

SEQ ID NO: 1335744 - protein, 10 aa, Mycobacterium
AGTPAADSCP

SEQ ID NO: 1335745 - protein, 5 aa, Mycobacterium
AGTPE

SEQ ID NO: 1335746 - protein, 7 aa, Mycobacterium
AGVDPQS

SEQ ID NO: 1335747 - protein, 16 aa, Mycobacterium
AGVGPAPTAAAESGGT

SEQ ID NO: 1335748 - protein, 8 aa, Mycobacterium
AGVRATTD

SEQ ID NO: 1335749 - protein, 5 aa, Mycobacterium
AGVSS

SEQ ID NO: 1335750 - protein, 14 aa, Mycobacterium
AGVTGRTVAPEKLP

SEQ ID NO: 1335751 - protein, 13 aa, Mycobacterium
AHPATASADPEWG

SEQ ID NO: 1335752 - protein, 4 aa, Mycobacterium
AHPG

SEQ ID NO: 1335753 - protein, 7 aa, Mycobacterium
AHRESAA

SEQ ID NO: 1335754 - protein, 12 aa, Mycobacterium
AHSPEVKFGGPS

SEQ ID NO: 1335755 - protein, 11 aa, Mycobacterium
AIADPGAVSPG

SEQ ID NO: 1335756 - protein, 10 aa, Mycobacterium
AIGGKTGFTD

SEQ ID NO: 1335757 - protein, 4 aa, Mycobacterium
AIGN

SEQ ID NO: 1335758 - protein, 6 aa, Mycobacterium
AIGTGT

SEQ ID NO: 1335759 - protein, 5 aa, Mycobacterium
AINSR

SEQ ID NO: 1335760 - protein, 8 aa, Mycobacterium
AITGTGNA

SEQ ID NO: 1335761 - protein, 7 aa, Mycobacterium
AITNRSA

SEQ ID NO: 1335762 - protein, 7 aa, Mycobacterium
AKAAADT

SEQ ID NO: 1335763 - protein, 10 aa, Mycobacterium
AKAAQLGAHG

SEQ ID NO: 1335764 - protein, 23 aa, Mycobacterium
AKAGAQPVIGDTPPGPGVPEAGV

SEQ ID NO: 1335765 - protein, 9 aa, Mycobacterium
AKAVGSAGL

SEQ ID NO: 1335766 - protein, 4 aa, Mycobacterium
AKDN

SEQ ID NO: 1335767 - protein, 9 aa, Mycobacterium
AKGGPTDIQ

SEQ ID NO: 1335768 - protein, 13 aa, Mycobacterium
AKGLGSSDRPGCP

SEQ ID NO: 1335769 - protein, 4 aa, Mycobacterium
AKGN

SEQ ID NO: 1335770 - protein, 15 aa, Mycobacterium
AKGRPGSGFVPVGAV

SEQ ID NO: 1335771 - protein, 7 aa, Mycobacterium
AKGVTDD

SEQ ID NO: 1335772 - protein, 7 aa, Mycobacterium
AKHGSGT

SEQ ID NO: 1335773 - protein, 6 aa, Mycobacterium
AKKENN

SEQ ID NO: 1335774 - protein, 9 aa, Mycobacterium
AKNSGLSDR

SEQ ID NO: 1335775 - protein, 7 aa, Mycobacterium
AKPATLA

SEQ ID NO: 1335776 - protein, 15 aa, Mycobacterium
AKPGTEVPPVRAGGT

SEQ ID NO: 1335777 - protein, 13 aa, Mycobacterium
AKSAGCPLGTDPA

SEQ ID NO: 1335778 - protein, 15 aa, Mycobacterium
AKSQTAAYGSLPSEG

SEQ ID NO: 1335779 - protein, 9 aa, Mycobacterium
AKTGGNVSE

SEQ ID NO: 1335780 - protein, 6 aa, Mycobacterium
AKTGNL

SEQ ID NO: 1335781 - protein, 17 aa, Mycobacterium
AKTPVAPGHAAPSRRPD

SEQ ID NO: 1335782 - protein, 18 aa, Mycobacterium
AKYNPGQDTVDKIVSALT

SEQ ID NO: 1335783 - protein, 9 aa, Mycobacterium
ALADPNLGE

SEQ ID NO: 1335784 - protein, 12 aa, Mycobacterium
ALGDDAGNRGAT

SEQ ID NO: 1335785 - protein, 8 aa, Mycobacterium
ALGDPGLG

SEQ ID NO: 1335786 - protein, 21 aa, Mycobacterium
ALGGKARSIPVPDSGATPLPA

SEQ ID NO: 1335787 - protein, 10 aa, Mycobacterium
ALNRPTPDRV

SEQ ID NO: 1335788 - protein, 8 aa, Mycobacterium
ALPDEGTV

SEQ ID NO: 1335789 - protein, 7 aa, Mycobacterium
ALPPDQV

SEQ ID NO: 1335790 - protein, 4 aa, Mycobacterium
ALPS

SEQ ID NO: 1335791 - protein, 5 aa, Mycobacterium
ALPTA

SEQ ID NO: 1335792 - protein, 8 aa, Mycobacterium
ALPTPLPS

SEQ ID NO: 1335793 - protein, 10 aa, Mycobacterium
ALRPPQRTSV

SEQ ID NO: 1335794 - protein, 8 aa, Mycobacterium
ALSGHRDA

SEQ ID NO: 1335795 - protein, 8 aa, Mycobacterium
ALSGQLNP

SEQ ID NO: 1335796 - protein, 7 aa, Mycobacterium
ALTPQQQ

SEQ ID NO: 1335797 - protein, 4 aa, Mycobacterium
ANAA

SEQ ID NO: 1335798 - protein, 7 aa, Mycobacterium
ANADSTV

SEQ ID NO: 1335799 - protein, 15 aa, Mycobacterium
ANAEPATVETPLPNL

SEQ ID NO: 1335800 - protein, 7 aa, Mycobacterium
ANAEPDR

SEQ ID NO: 1335801 - protein, 8 aa, Mycobacterium
ANAGPALT

SEQ ID NO: 1335802 - protein, 9 aa, Mycobacterium
ANANPQVKA

SEQ ID NO: 1335803 - protein, 6 aa, Mycobacterium
ANDPAV

SEQ ID NO: 1335804 - protein, 6 aa, Mycobacterium
ANDTLR

SEQ ID NO: 1335805 - protein, 7 aa, Mycobacterium
ANEAARS

SEQ ID NO: 1335806 - protein, 10 aa, Mycobacterium
ANEAEKYGKD

SEQ ID NO: 1335807 - protein, 14 aa, Mycobacterium
ANETVADRYGGTHV

SEQ ID NO: 1335808 - protein, 5 aa, Mycobacterium
ANGDM

SEQ ID NO: 1335809 - protein, 6 aa, Mycobacterium
ANGTHG

SEQ ID NO: 1335810 - protein, 39 aa, Mycobacterium
ANIPPEKYNQVNGTPGPDQATMATGDAGGRVACGVIRSG

SEQ ID NO: 1335811 - protein, 8 aa, Mycobacterium
ANPQVGSD

SEQ ID NO: 1335812 - protein, 7 aa, Mycobacterium
ANPQVKA

SEQ ID NO: 1335813 - protein, 7 aa, Mycobacterium
ANSRNKL

SEQ ID NO: 1335814 - protein, 7 aa, Mycobacterium
ANSVRPN

SEQ ID NO: 1335815 - protein, 8 aa, Mycobacterium
ANTTPERA

SEQ ID NO: 1335816 - protein, 9 aa, Mycobacterium
APADFDPTS

SEQ ID NO: 1335817 - protein, 7 aa, Mycobacterium
APASQAD

SEQ ID NO: 1335818 - protein, 16 aa, Mycobacterium
APCPGPQSTAQAPDGR

SEQ ID NO: 1335819 - protein, 8 aa, Mycobacterium
APFEESGK

SEQ ID NO: 1335820 - protein, 11 aa, Mycobacterium
APFRPDSATAG

SEQ ID NO: 1335821 - protein, 25 aa, Mycobacterium
APGALADPSNDYHDDPGRYPTDVPG

SEQ ID NO: 1335822 - protein, 7 aa, Mycobacterium
APGATAR

SEQ ID NO: 1335823 - protein, 19 aa, Mycobacterium
APGETGQLNDPGPSAARTA

SEQ ID NO: 1335824 - protein, 5 aa, Mycobacterium
APGSI

SEQ ID NO: 1335825 - protein, 5 aa, Mycobacterium
APGTV

SEQ ID NO: 1335826 - protein, 7 aa, Mycobacterium
APGTVQR

SEQ ID NO: 1335827 - protein, 13 aa, Mycobacterium
APIGDSAALAAGE

SEQ ID NO: 1335828 - protein, 34 aa, Mycobacterium
APKAVAPDEKPAEQSEPEPQKADEPESKPSVKRN

SEQ ID NO: 1335829 - protein, 6 aa, Mycobacterium
APKVSA

SEQ ID NO: 1335830 - protein, 4 aa, Mycobacterium
APLP

SEQ ID NO: 1335831 - protein, 6 aa, Mycobacterium
APLPPH

SEQ ID NO: 1335832 - protein, 4 aa, Mycobacterium
APNV

SEQ ID NO: 1335833 - protein, 11 aa, Mycobacterium
APPAAAGGPAE

SEQ ID NO: 1335834 - protein, 8 aa, Mycobacterium
APPAAPED

SEQ ID NO: 1335835 - protein, 19 aa, Mycobacterium
APPAAPPAATCSSSNRRLP

SEQ ID NO: 1335836 - protein, 8 aa, Mycobacterium
APPAGAGC

SEQ ID NO: 1335837 - protein, 6 aa, Mycobacterium
APPGYI

SEQ ID NO: 1335838 - protein, 5 aa, Mycobacterium
APPLV

SEQ ID NO: 1335839 - protein, 5 aa, Mycobacterium
APPPA

SEQ ID NO: 1335840 - protein, 9 aa, Mycobacterium
APPPPGAPP

SEQ ID NO: 1335841 - protein, 33 aa, Mycobacterium
APPPPPPAAPVPPALPAPAVPPAPVPPAPALPG

SEQ ID NO: 1335842 - protein, 5 aa, Mycobacterium
APPQR

SEQ ID NO: 1335843 - protein, 6 aa, Mycobacterium
APPVTS

SEQ ID NO: 1335844 - protein, 9 aa, Mycobacterium
APPYTGGPV

SEQ ID NO: 1335845 - protein, 12 aa, Mycobacterium
APQTSDYVRPGS

SEQ ID NO: 1335846 - protein, 17 aa, Mycobacterium
APRASSAGCHAGAPGTA

SEQ ID NO: 1335847 - protein, 4 aa, Mycobacterium
APRC

SEQ ID NO: 1335848 - protein, 7 aa, Mycobacterium
APRDFPD

SEQ ID NO: 1335849 - protein, 9 aa, Mycobacterium
APSAAAPPW

SEQ ID NO: 1335850 - protein, 19 aa, Mycobacterium
APSAGAQPSEPATDHNGYV

SEQ ID NO: 1335851 - protein, 15 aa, Mycobacterium
APSWTADYGNETANH

SEQ ID NO: 1335852 - protein, 22 aa, Mycobacterium
APTGETNDATGGTTESGISSNK

SEQ ID NO: 1335853 - protein, 6 aa, Mycobacterium
APTGID

SEQ ID NO: 1335854 - protein, 11 aa, Mycobacterium
APTTADDAETL

SEQ ID NO: 1335855 - protein, 5 aa, Mycobacterium
APVAA

SEQ ID NO: 1335856 - protein, 9 aa, Mycobacterium
APVAPPTAV

SEQ ID NO: 1335857 - protein, 13 aa, Mycobacterium
APVSGGVKGATAG

SEQ ID NO: 1335858 - protein, 8 aa, Mycobacterium
APYPTDPA

SEQ ID NO: 1335859 - protein, 7 aa, Mycobacterium
AQAAPRT

SEQ ID NO: 1335860 - protein, 10 aa, Mycobacterium
AQASSPVPDW

SEQ ID NO: 1335861 - protein, 8 aa, Mycobacterium
AQDAAAGA

SEQ ID NO: 1335862 - protein, 5 aa, Mycobacterium
AQDDF

SEQ ID NO: 1335863 - protein, 6 aa, Mycobacterium
AQDDYN

SEQ ID NO: 1335864 - protein, 9 aa, Mycobacterium
AQDNPDRVG

SEQ ID NO: 1335865 - protein, 5 aa, Mycobacterium
AQEDF

SEQ ID NO: 1335866 - protein, 7 aa, Mycobacterium
AQGANQA

SEQ ID NO: 1335867 - protein, 12 aa, Mycobacterium
AQGHYNNSTDAR

SEQ ID NO: 1335868 - protein, 8 aa, Mycobacterium
AQGNKAGA

SEQ ID NO: 1335869 - protein, 17 aa, Mycobacterium
AQGVNPSTLGQGQETTG

SEQ ID NO: 1335870 - protein, 5 aa, Mycobacterium
AQNPG

SEQ ID NO: 1335871 - protein, 14 aa, Mycobacterium
AQPAPPPPLPPNCT

SEQ ID NO: 1335872 - protein, 10 aa, Mycobacterium
AQPSGDDDGK

SEQ ID NO: 1335873 - protein, 8 aa, Mycobacterium
AQQPQSVK

SEQ ID NO: 1335874 - protein, 9 aa, Mycobacterium
AQQRSGQQA

SEQ ID NO: 1335875 - protein, 18 aa, Mycobacterium
AQQSVDRLGAERDTLSAQ

SEQ ID NO: 1335876 - protein, 6 aa, Mycobacterium
AQRDSA

SEQ ID NO: 1335877 - protein, 7 aa, Mycobacterium
AQRTTAE

SEQ ID NO: 1335878 - protein, 10 aa, Mycobacterium
AQTKTGDTRN

SEQ ID NO: 1335879 - protein, 11 aa, Mycobacterium
AQYRPATGKWT

SEQ ID NO: 1335880 - protein, 26 aa, Mycobacterium
ARAAVASATAGRSVAQRSAAERELDT

SEQ ID NO: 1335881 - protein, 10 aa, Mycobacterium
ARADETAPAE

SEQ ID NO: 1335882 - protein, 10 aa, Mycobacterium
ARAKEAAAQR

SEQ ID NO: 1335883 - protein, 5 aa, Mycobacterium
ARAPW

SEQ ID NO: 1335884 - protein, 9 aa, Mycobacterium
ARARNGETY

SEQ ID NO: 1335885 - protein, 9 aa, Mycobacterium
ARASSSFDR

SEQ ID NO: 1335886 - protein, 12 aa, Mycobacterium
ARATQERSLGDL

SEQ ID NO: 1335887 - protein, 5 aa, Mycobacterium
ARDAG

SEQ ID NO: 1335888 - protein, 8 aa, Mycobacterium
ARDAGERV

SEQ ID NO: 1335889 - protein, 15 aa, Mycobacterium
ARDTSSATTADPPYA

SEQ ID NO: 1335890 - protein, 8 aa, Mycobacterium
AREPEDDA

SEQ ID NO: 1335891 - protein, 6 aa, Mycobacterium
ARGGGS

SEQ ID NO: 1335892 - protein, 6 aa, Mycobacterium
ARGGVQ

SEQ ID NO: 1335893 - protein, 6 aa, Mycobacterium
ARGVEN

SEQ ID NO: 1335894 - protein, 11 aa, Mycobacterium
ARKGYSGWSSQ

SEQ ID NO: 1335895 - protein, 10 aa, Mycobacterium
ARKTDGTTAY

SEQ ID NO: 1335896 - protein, 5 aa, Mycobacterium
ARLTQ

SEQ ID NO: 1335897 - protein, 14 aa, Mycobacterium
ARNATAAEGLDPEE

SEQ ID NO: 1335898 - protein, 14 aa, Mycobacterium
ARPAPTARAAAPPQ

SEQ ID NO: 1335899 - protein, 5 aa, Mycobacterium
ARPDL

SEQ ID NO: 1335900 - protein, 12 aa, Mycobacterium
ARPQADSPVASA

SEQ ID NO: 1335901 - protein, 5 aa, Mycobacterium
ARQRI

SEQ ID NO: 1335902 - protein, 12 aa, Mycobacterium
ARRQYSENTATN

SEQ ID NO: 1335903 - protein, 12 aa, Mycobacterium
ARSDEHDAAAAG

SEQ ID NO: 1335904 - protein, 4 aa, Mycobacterium
ARSE

SEQ ID NO: 1335905 - protein, 12 aa, Mycobacterium
ARSEQPGKLPGT

SEQ ID NO: 1335906 - protein, 11 aa, Mycobacterium
ARSRATGGTGL

SEQ ID NO: 1335907 - protein, 5 aa, Mycobacterium
ARSSP

SEQ ID NO: 1335908 - protein, 14 aa, Mycobacterium
ARSYARPDRTRTIK

SEQ ID NO: 1335909 - protein, 7 aa, Mycobacterium
ARTGDLE

SEQ ID NO: 1335910 - protein, 8 aa, Mycobacterium
ARTQNRPD

SEQ ID NO: 1335911 - protein, 22 aa, Mycobacterium
ASAAPGATPATAPASPVSDRRD

SEQ ID NO: 1335912 - protein, 11 aa, Mycobacterium
ASADDSAQDTI

SEQ ID NO: 1335913 - protein, 11 aa, Mycobacterium
ASASAVADPGT

SEQ ID NO: 1335914 - protein, 8 aa, Mycobacterium
ASATNAEY

SEQ ID NO: 1335915 - protein, 13 aa, Mycobacterium
ASDLDTGSDFGGN

SEQ ID NO: 1335916 - protein, 13 aa, Mycobacterium
ASDVNGDSVPSGF

SEQ ID NO: 1335917 - protein, 9 aa, Mycobacterium
ASGAPNTDD

SEQ ID NO: 1335918 - protein, 7 aa, Mycobacterium
ASGARYS

SEQ ID NO: 1335919 - protein, 8 aa, Mycobacterium
ASGEDSGA

SEQ ID NO: 1335920 - protein, 7 aa, Mycobacterium
ASGESNH

SEQ ID NO: 1335921 - protein, 5 aa, Mycobacterium
ASGIG

SEQ ID NO: 1335922 - protein, 14 aa, Mycobacterium
ASGNAAGDRHRPAP

SEQ ID NO: 1335923 - protein, 7 aa, Mycobacterium
ASGQLEP

SEQ ID NO: 1335924 - protein, 6 aa, Mycobacterium
ASGSAE

SEQ ID NO: 1335925 - protein, 8 aa, Mycobacterium
ASGTGQAA

SEQ ID NO: 1335926 - protein, 4 aa, Mycobacterium
ASHD

SEQ ID NO: 1335927 - protein, 8 aa, Mycobacterium
ASHGANSA

SEQ ID NO: 1335928 - protein, 8 aa, Mycobacterium
ASKAAQEH

SEQ ID NO: 1335929 - protein, 10 aa, Mycobacterium
ASKSKDASAH

SEQ ID NO: 1335930 - protein, 6 aa, Mycobacterium
ASMPGQ

SEQ ID NO: 1335931 - protein, 17 aa, Mycobacterium
ASNGESNFGKIGSPQID

SEQ ID NO: 1335932 - protein, 6 aa, Mycobacterium
ASNNPM

SEQ ID NO: 1335933 - protein, 9 aa, Mycobacterium
ASPDAAIPG

SEQ ID NO: 1335934 - protein, 8 aa, Mycobacterium
ASPGIEKE

SEQ ID NO: 1335935 - protein, 5 aa, Mycobacterium
ASPNF

SEQ ID NO: 1335936 - protein, 20 aa, Mycobacterium
ASPNGSDRVASVTRGADDRQ

SEQ ID NO: 1335937 - protein, 8 aa, Mycobacterium
ASPPERAQ

SEQ ID NO: 1335938 - protein, 8 aa, Mycobacterium
ASPQQRQA

SEQ ID NO: 1335939 - protein, 5 aa, Mycobacterium
ASPRR

SEQ ID NO: 1335940 - protein, 6 aa, Mycobacterium
ASREAV

SEQ ID NO: 1335941 - protein, 11 aa, Mycobacterium
ASRGHGGGYQL

SEQ ID NO: 1335942 - protein, 7 aa, Mycobacterium
ASRGIGA

SEQ ID NO: 1335943 - protein, 8 aa, Mycobacterium
ASRIPTAQ

SEQ ID NO: 1335944 - protein, 15 aa, Mycobacterium
ASSDGTRFTNDRTQR

SEQ ID NO: 1335945 - protein, 6 aa, Mycobacterium
ASSHPL

SEQ ID NO: 1335946 - protein, 10 aa, Mycobacterium
ASSNFDARDE

SEQ ID NO: 1335947 - protein, 6 aa, Mycobacterium
ASSRLN

SEQ ID NO: 1335948 - protein, 9 aa, Mycobacterium
ASSVRSVAS

SEQ ID NO: 1335949 - protein, 6 aa, Mycobacterium
ASTVDE

SEQ ID NO: 1335950 - protein, 18 aa, Mycobacterium
ATAAALPPGNTTGNTGCH

SEQ ID NO: 1335951 - protein, 9 aa, Mycobacterium
ATAASNNPL

SEQ ID NO: 1335952 - protein, 9 aa, Mycobacterium
ATADAAEAL

SEQ ID NO: 1335953 - protein, 9 aa, Mycobacterium
ATADGGGQV

SEQ ID NO: 1335954 - protein, 7 aa, Mycobacterium
ATAPVPV

SEQ ID NO: 1335955 - protein, 8 aa, Mycobacterium
ATASADSV

SEQ ID NO: 1335956 - protein, 28 aa, Mycobacterium
ATDGPTGLRPDAEAPGRDVVGSDGGDID

SEQ ID NO: 1335957 - protein, 6 aa, Mycobacterium
ATEAGL

SEQ ID NO: 1335958 - protein, 31 aa, Mycobacterium
ATEEGKGVGVTASYGASGDQSRGVDSGKPAD

SEQ ID NO: 1335959 - protein, 15 aa, Mycobacterium
ATGAAPTASAAPRCP

SEQ ID NO: 1335960 - protein, 5 aa, Mycobacterium
ATGAD

SEQ ID NO: 1335961 - protein, 6 aa, Mycobacterium
ATGDDK

SEQ ID NO: 1335962 - protein, 5 aa, Mycobacterium
ATGDR

SEQ ID NO: 1335963 - protein, 10 aa, Mycobacterium
ATGGSTSHAP

SEQ ID NO: 1335964 - protein, 8 aa, Mycobacterium
ATGTETDF

SEQ ID NO: 1335965 - protein, 15 aa, Mycobacterium
ATGTGFRAPEGEYET

SEQ ID NO: 1335966 - protein, 6 aa, Mycobacterium
ATGTGR

SEQ ID NO: 1335967 - protein, 8 aa, Mycobacterium
ATKSRVRD

SEQ ID NO: 1335968 - protein, 12 aa, Mycobacterium
ATNATAATIPTA

SEQ ID NO: 1335969 - protein, 7 aa, Mycobacterium
ATNTSNY

SEQ ID NO: 1335970 - protein, 24 aa, Mycobacterium
ATPGTLRTGSRGCCSKEDAGDARR

SEQ ID NO: 1335971 - protein, 10 aa, Mycobacterium
ATPKANASTV

SEQ ID NO: 1335972 - protein, 5 aa, Mycobacterium
ATPQD

SEQ ID NO: 1335973 - protein, 10 aa, Mycobacterium
ATPSASAQAC

SEQ ID NO: 1335974 - protein, 5 aa, Mycobacterium
ATPSR

SEQ ID NO: 1335975 - protein, 9 aa, Mycobacterium
ATQPKDIHN

SEQ ID NO: 1335976 - protein, 15 aa, Mycobacterium
ATQRAGQGVVITAGA

SEQ ID NO: 1335977 - protein, 5 aa, Mycobacterium
ATQSQ

SEQ ID NO: 1335978 - protein, 6 aa, Mycobacterium
ATRASR

SEQ ID NO: 1335979 - protein, 8 aa, Mycobacterium
ATRFGSPD

SEQ ID NO: 1335980 - protein, 5 aa, Mycobacterium
ATRIA

SEQ ID NO: 1335981 - protein, 6 aa, Mycobacterium
ATRPQR

SEQ ID NO: 1335982 - protein, 15 aa, Mycobacterium
ATSAPRPATSPGPGK

SEQ ID NO: 1335983 - protein, 7 aa, Mycobacterium
ATSAQVS

SEQ ID NO: 1335984 - protein, 8 aa, Mycobacterium
ATSKQYPG

SEQ ID NO: 1335985 - protein, 11 aa, Mycobacterium
ATSPRTPQDAG

SEQ ID NO: 1335986 - protein, 15 aa, Mycobacterium
ATSPTGTPAGSLGWG

SEQ ID NO: 1335987 - protein, 5 aa, Mycobacterium
ATSPY

SEQ ID NO: 1335988 - protein, 7 aa, Mycobacterium
ATSTSAE

SEQ ID NO: 1335989 - protein, 5 aa, Mycobacterium
ATVEP

SEQ ID NO: 1335990 - protein, 56 aa, Mycobacterium
AVAPPAPPAPGVPAASSVPAVTPPAPPAPPGGGSATVNVGTPPAPPAPPAGGSTAV

SEQ ID NO: 1335991 - protein, 14 aa, Mycobacterium
AVAPPAPPAPPAAV

SEQ ID NO: 1335992 - protein, 7 aa, Mycobacterium
AVDPDGD

SEQ ID NO: 1335993 - protein, 6 aa, Mycobacterium
AVEGGM

SEQ ID NO: 1335994 - protein, 16 aa, Mycobacterium
AVESAATAVRLLLAQH

SEQ ID NO: 1335995 - protein, 6 aa, Mycobacterium
AVGAPT

SEQ ID NO: 1335996 - protein, 14 aa, Mycobacterium
AVGGELRDAPGQTT

SEQ ID NO: 1335997 - protein, 4 aa, Mycobacterium
AVKA

SEQ ID NO: 1335998 - protein, 12 aa, Mycobacterium
AVLPNDGESVGE

SEQ ID NO: 1335999 - protein, 7 aa, Mycobacterium
AVNPPGS

SEQ ID NO: 1336000 - protein, 17 aa, Mycobacterium
AVPGDPRDTSTPEALGG

SEQ ID NO: 1336001 - protein, 9 aa, Mycobacterium
AVPGVSTKE

SEQ ID NO: 1336002 - protein, 11 aa, Mycobacterium
AVPPPPPPAPG

SEQ ID NO: 1336003 - protein, 6 aa, Mycobacterium
AVPQPL

SEQ ID NO: 1336004 - protein, 6 aa, Mycobacterium
AVQDAG

SEQ ID NO: 1336005 - protein, 8 aa, Mycobacterium
AVQRSDGT

SEQ ID NO: 1336006 - protein, 10 aa, Mycobacterium
AVRPPAPATL

SEQ ID NO: 1336007 - protein, 9 aa, Mycobacterium
AVSGGLNPA

SEQ ID NO: 1336008 - protein, 5 aa, Mycobacterium
AVSGQ

SEQ ID NO: 1336009 - protein, 10 aa, Mycobacterium
AWPDAPSPYT

SEQ ID NO: 1336010 - protein, 13 aa, Mycobacterium
AWPPSAHGAPRTH

SEQ ID NO: 1336011 - protein, 4 aa, Mycobacterium
AWSA

SEQ ID NO: 1336012 - protein, 14 aa, Mycobacterium
AYAASKAGVSSLGE

SEQ ID NO: 1336013 - protein, 8 aa, Mycobacterium
AYGDAAPD

SEQ ID NO: 1336014 - protein, 7 aa, Mycobacterium
AYSSASD

SEQ ID NO: 1336015 - protein, 7 aa, Mycobacterium
AYTPNAC

SEQ ID NO: 1336016 - protein, 8 aa, Mycobacterium
AYTRDGAK

SEQ ID NO: 1336017 - protein, 4 aa, Mycobacterium
CADG

SEQ ID NO: 1336018 - protein, 12 aa, Mycobacterium
CAEAKSDPQDGL

SEQ ID NO: 1336019 - protein, 17 aa, Mycobacterium
CAKQPDCPLGTDPAKAV

SEQ ID NO: 1336020 - protein, 17 aa, Mycobacterium
CDATSGPAASGSAETRQ

SEQ ID NO: 1336021 - protein, 11 aa, Mycobacterium
CDGTPGGGPSI

SEQ ID NO: 1336022 - protein, 15 aa, Mycobacterium
CESGGNWSTNTGNGY

SEQ ID NO: 1336023 - protein, 6 aa, Mycobacterium
CESSGN

SEQ ID NO: 1336024 - protein, 16 aa, Mycobacterium
CGGDAPGTVAKDGSVT

SEQ ID NO: 1336025 - protein, 20 aa, Mycobacterium
CGGGASDVAGSDGGSNAETT

SEQ ID NO: 1336026 - protein, 17 aa, Mycobacterium
CGGPGATVSAEGAPDAG

SEQ ID NO: 1336027 - protein, 17 aa, Mycobacterium
CGGSDSGGGAPSAAPTD

SEQ ID NO: 1336028 - protein, 42 aa, Mycobacterium
CGGSTSSEDNESAAPATTSAQAGTVGEKVSANTASAEEITAG

SEQ ID NO: 1336029 - protein, 18 aa, Mycobacterium
CGSDDKAADETAPAQTGW

SEQ ID NO: 1336030 - protein, 43 aa, Mycobacterium
CGSDNNTSSGSGSGSGESGSAAAGDCGGKEALKASGSSAQANA

SEQ ID NO: 1336031 - protein, 23 aa, Mycobacterium
CGSESSDTNTPTATAGSSGAQVE

SEQ ID NO: 1336032 - protein, 8 aa, Mycobacterium
CGSPEDAD

SEQ ID NO: 1336033 - protein, 6 aa, Mycobacterium
CGSPPV

SEQ ID NO: 1336034 - protein, 13 aa, Mycobacterium
CGTATPPEDDVDT

SEQ ID NO: 1336035 - protein, 9 aa, Mycobacterium
CPDGTAADG

SEQ ID NO: 1336036 - protein, 4 aa, Mycobacterium
CPGI

SEQ ID NO: 1336037 - protein, 8 aa, Mycobacterium
CQAADGAA

SEQ ID NO: 1336038 - protein, 12 aa, Mycobacterium
CRGSGPVSDRGG

SEQ ID NO: 1336039 - protein, 6 aa, Mycobacterium
CRTDPS

SEQ ID NO: 1336040 - protein, 17 aa, Mycobacterium
CSDGGSPAPETQGQAIG

SEQ ID NO: 1336041 - protein, 14 aa, Mycobacterium
CSGAGSLGSSDNEV

SEQ ID NO: 1336042 - protein, 5 aa, Mycobacterium
CSGGH

SEQ ID NO: 1336043 - protein, 21 aa, Mycobacterium
CSKAEGRSDTYSAPTAKVGES

SEQ ID NO: 1336044 - protein, 17 aa, Mycobacterium
CSPNEPVSSEPGTTPSV

SEQ ID NO: 1336045 - protein, 35 aa, Mycobacterium
CSSDSGSSESTTSAESSDTATASASAEATSAPGAA

SEQ ID NO: 1336046 - protein, 9 aa, Mycobacterium
CSSSDDSDE

SEQ ID NO: 1336047 - protein, 12 aa, Mycobacterium
CSSTDDNSGGYT

SEQ ID NO: 1336048 - protein, 7 aa, Mycobacterium
CSTGERV

SEQ ID NO: 1336049 - protein, 29 aa, Mycobacterium
CTGSPGCERSAADVRADAAAAVDAPAPGH

SEQ ID NO: 1336050 - protein, 6 aa, Mycobacterium
CVSPSR

SEQ ID NO: 1336051 - protein, 13 aa, Mycobacterium
DAARTVRESIAGE

SEQ ID NO: 1336052 - protein, 7 aa, Mycobacterium
DAAVERA

SEQ ID NO: 1336053 - protein, 11 aa, Mycobacterium
DADGAPLTGAN

SEQ ID NO: 1336054 - protein, 6 aa, Mycobacterium
DADGPV

SEQ ID NO: 1336055 - protein, 9 aa, Mycobacterium
DADTGACAG

SEQ ID NO: 1336056 - protein, 8 aa, Mycobacterium
DAEVSQSQ

SEQ ID NO: 1336057 - protein, 5 aa, Mycobacterium
DAGAM

SEQ ID NO: 1336058 - protein, 10 aa, Mycobacterium
DAGGTKLAEH

SEQ ID NO: 1336059 - protein, 19 aa, Mycobacterium
DAGKPGEDTSFDGRSDYDG

SEQ ID NO: 1336060 - protein, 6 aa, Mycobacterium
DAGKQR

SEQ ID NO: 1336061 - protein, 7 aa, Mycobacterium
DAGTAAL

SEQ ID NO: 1336062 - protein, 5 aa, Mycobacterium
DAGVD

SEQ ID NO: 1336063 - protein, 7 aa, Mycobacterium
DAGVGDR

SEQ ID NO: 1336064 - protein, 6 aa, Mycobacterium
DAMTGD

SEQ ID NO: 1336065 - protein, 11 aa, Mycobacterium
DANAALRRTTA

SEQ ID NO: 1336066 - protein, 14 aa, Mycobacterium
DANGACPPMKPNAT

SEQ ID NO: 1336067 - protein, 16 aa, Mycobacterium
DANGDGKSDPDNIDDA

SEQ ID NO: 1336068 - protein, 6 aa, Mycobacterium
DAPGVS

SEQ ID NO: 1336069 - protein, 8 aa, Mycobacterium
DAPNAPDI

SEQ ID NO: 1336070 - protein, 9 aa, Mycobacterium
DAPPEELAP

SEQ ID NO: 1336071 - protein, 17 aa, Mycobacterium
DAPSVPALRRAADSCPR

SEQ ID NO: 1336072 - protein, 12 aa, Mycobacterium
DAPVGDRKVLSR

SEQ ID NO: 1336073 - protein, 10 aa, Mycobacterium
DAQGNYTNAA

SEQ ID NO: 1336074 - protein, 18 aa, Mycobacterium
DAQRDAEGRFPRDASPDD

SEQ ID NO: 1336075 - protein, 4 aa, Mycobacterium
DARC

SEQ ID NO: 1336076 - protein, 8 aa, Mycobacterium
DASFTTND

SEQ ID NO: 1336077 - protein, 10 aa, Mycobacterium
DASGSTTSQA

SEQ ID NO: 1336078 - protein, 11 aa, Mycobacterium
DASGTKSSFTV

SEQ ID NO: 1336079 - protein, 5 aa, Mycobacterium
DASPD

SEQ ID NO: 1336080 - protein, 4 aa, Mycobacterium
DATG

SEQ ID NO: 1336081 - protein, 7 aa, Mycobacterium
DATGERI

SEQ ID NO: 1336082 - protein, 7 aa, Mycobacterium
DATSADA

SEQ ID NO: 1336083 - protein, 7 aa, Mycobacterium
DAVSTDD

SEQ ID NO: 1336084 - protein, 14 aa, Mycobacterium
DDAEKDAEGADPDV

SEQ ID NO: 1336085 - protein, 6 aa, Mycobacterium
DDAGRA

SEQ ID NO: 1336086 - protein, 16 aa, Mycobacterium
DDCTPSALPRSDRDNE

SEQ ID NO: 1336087 - protein, 6 aa, Mycobacterium
DDDGRI

SEQ ID NO: 1336088 - protein, 8 aa, Mycobacterium
DDFNPDRY

SEQ ID NO: 1336089 - protein, 10 aa, Mycobacterium
DDGASNLPPR

SEQ ID NO: 1336090 - protein, 8 aa, Mycobacterium
DDIPPPVR

SEQ ID NO: 1336091 - protein, 5 aa, Mycobacterium
DDLDP

SEQ ID NO: 1336092 - protein, 12 aa, Mycobacterium
DDNPRDEDPATI

SEQ ID NO: 1336093 - protein, 8 aa, Mycobacterium
DDPLDPDD

SEQ ID NO: 1336094 - protein, 6 aa, Mycobacterium
DDQGRF

SEQ ID NO: 1336095 - protein, 8 aa, Mycobacterium
DDSPTPGE

SEQ ID NO: 1336096 - protein, 4 aa, Mycobacterium
DDST

SEQ ID NO: 1336097 - protein, 8 aa, Mycobacterium
DDTPWGGK

SEQ ID NO: 1336098 - protein, 6 aa, Mycobacterium
DDTRAI

SEQ ID NO: 1336099 - protein, 11 aa, Mycobacterium
DEAAAKAALDA

SEQ ID NO: 1336100 - protein, 7 aa, Mycobacterium
DEARRRT

SEQ ID NO: 1336101 - protein, 5 aa, Mycobacterium
DEGSD

SEQ ID NO: 1336102 - protein, 6 aa, Mycobacterium
DEGVPV

SEQ ID NO: 1336103 - protein, 4 aa, Mycobacterium
DELG

SEQ ID NO: 1336104 - protein, 16 aa, Mycobacterium
DEPGPGGTAGGPPPML

SEQ ID NO: 1336105 - protein, 7 aa, Mycobacterium
DEPYPAD

SEQ ID NO: 1336106 - protein, 4 aa, Mycobacterium
DEQF

SEQ ID NO: 1336107 - protein, 7 aa, Mycobacterium
DESPTGL

SEQ ID NO: 1336108 - protein, 7 aa, Mycobacterium
DETGGLT

SEQ ID NO: 1336109 - protein, 9 aa, Mycobacterium
DGALSTAAP

SEQ ID NO: 1336110 - protein, 5 aa, Mycobacterium
DGAPH

SEQ ID NO: 1336111 - protein, 11 aa, Mycobacterium
DGAVPDTHDFD

SEQ ID NO: 1336112 - protein, 20 aa, Mycobacterium
DGDQSAATEPVSVPEGSAGV

SEQ ID NO: 1336113 - protein, 7 aa, Mycobacterium
DGELTSD

SEQ ID NO: 1336114 - protein, 4 aa, Mycobacterium
DGEP

SEQ ID NO: 1336115 - protein, 9 aa, Mycobacterium
DGEREIARS

SEQ ID NO: 1336116 - protein, 10 aa, Mycobacterium
DGGEGGTGAA

SEQ ID NO: 1336117 - protein, 6 aa, Mycobacterium
DGGGIP

SEQ ID NO: 1336118 - protein, 8 aa, Mycobacterium
DGGGPATV

SEQ ID NO: 1336119 - protein, 13 aa, Mycobacterium
DGHHGGSPGTDAA

SEQ ID NO: 1336120 - protein, 8 aa, Mycobacterium
DGLGGGAV

SEQ ID NO: 1336121 - protein, 16 aa, Mycobacterium
DGLPPVEKSATPRPHH

SEQ ID NO: 1336122 - protein, 13 aa, Mycobacterium
DGLSGKGKQINTT

SEQ ID NO: 1336123 - protein, 6 aa, Mycobacterium
DGNNNI

SEQ ID NO: 1336124 - protein, 16 aa, Mycobacterium
DGPRGRGNGHWKHGHH

SEQ ID NO: 1336125 - protein, 6 aa, Mycobacterium
DGPSSC

SEQ ID NO: 1336126 - protein, 9 aa, Mycobacterium
DGPVRPDGT

SEQ ID NO: 1336127 - protein, 17 aa, Mycobacterium
DGRDQPSALTTPEAPDL

SEQ ID NO: 1336128 - protein, 11 aa, Mycobacterium
DGRGDISGLGT

SEQ ID NO: 1336129 - protein, 7 aa, Mycobacterium
DGRPTIQ

SEQ ID NO: 1336130 - protein, 5 aa, Mycobacterium
DGRRA

SEQ ID NO: 1336131 - protein, 8 aa, Mycobacterium
DGRSATGD

SEQ ID NO: 1336132 - protein, 5 aa, Mycobacterium
DGRVT

SEQ ID NO: 1336133 - protein, 7 aa, Mycobacterium
DGSATLN

SEQ ID NO: 1336134 - protein, 5 aa, Mycobacterium
DGSGN

SEQ ID NO: 1336135 - protein, 17 aa, Mycobacterium
DGSLENQYSVREWAGAQ

SEQ ID NO: 1336136 - protein, 7 aa, Mycobacterium
DGSQVAL

SEQ ID NO: 1336137 - protein, 9 aa, Mycobacterium
DGSRASQRA

SEQ ID NO: 1336138 - protein, 7 aa, Mycobacterium
DGSSGNL

SEQ ID NO: 1336139 - protein, 6 aa, Mycobacterium
DGSTEV

SEQ ID NO: 1336140 - protein, 6 aa, Mycobacterium
DGSVRD

SEQ ID NO: 1336141 - protein, 9 aa, Mycobacterium
DGTETTVST

SEQ ID NO: 1336142 - protein, 6 aa, Mycobacterium
DGTHIP

SEQ ID NO: 1336143 - protein, 11 aa, Mycobacterium
DGTQSAVSDTV

SEQ ID NO: 1336144 - protein, 9 aa, Mycobacterium
DGTSSARVD

SEQ ID NO: 1336145 - protein, 6 aa, Mycobacterium
DGVGMD

SEQ ID NO: 1336146 - protein, 27 aa, Mycobacterium
DGVPESASTGVDAGVKTAQEDLAEPTK

SEQ ID NO: 1336147 - protein, 4 aa, Mycobacterium
DGYR

SEQ ID NO: 1336148 - protein, 7 aa, Mycobacterium
DHDPDLP

SEQ ID NO: 1336149 - protein, 5 aa, Mycobacterium
DHDQV

SEQ ID NO: 1336150 - protein, 4 aa, Mycobacterium
DHDR

SEQ ID NO: 1336151 - protein, 12 aa, Mycobacterium
DHRNMDRAAEAG

SEQ ID NO: 1336152 - protein, 12 aa, Mycobacterium
DIEARTNEQPPF

SEQ ID NO: 1336153 - protein, 8 aa, Mycobacterium
DIESVRRA

SEQ ID NO: 1336154 - protein, 12 aa, Mycobacterium
DIGSAPPLPGSY

SEQ ID NO: 1336155 - protein, 7 aa, Mycobacterium
DIRASGA

SEQ ID NO: 1336156 - protein, 10 aa, Mycobacterium
DISDDEDTFT

SEQ ID NO: 1336157 - protein, 7 aa, Mycobacterium
DKGTPFG

SEQ ID NO: 1336158 - protein, 7 aa, Mycobacterium
DKIVEQD

SEQ ID NO: 1336159 - protein, 7 aa, Mycobacterium
DKPTPNL

SEQ ID NO: 1336160 - protein, 7 aa, Mycobacterium
DKSEAEV

SEQ ID NO: 1336161 - protein, 7 aa, Mycobacterium
DKVPAGA

SEQ ID NO: 1336162 - protein, 5 aa, Mycobacterium
DLDEA

SEQ ID NO: 1336163 - protein, 17 aa, Mycobacterium
DLGGKTGTAEFGDNTHS

SEQ ID NO: 1336164 - protein, 7 aa, Mycobacterium
DLPSSNL

SEQ ID NO: 1336165 - protein, 5 aa, Mycobacterium
DLPTE

SEQ ID NO: 1336166 - protein, 8 aa, Mycobacterium
DLSGPLNL

SEQ ID NO: 1336167 - protein, 9 aa, Mycobacterium
DLSSSSVNA

SEQ ID NO: 1336168 - protein, 7 aa, Mycobacterium
DLSTPRG

SEQ ID NO: 1336169 - protein, 14 aa, Mycobacterium
DMWGPSSDPAWKRN

SEQ ID NO: 1336170 - protein, 4 aa, Mycobacterium
DNAA

SEQ ID NO: 1336171 - protein, 11 aa, Mycobacterium
DNAPKTPGPEA

SEQ ID NO: 1336172 - protein, 12 aa, Mycobacterium
DNAYQVADLREH

SEQ ID NO: 1336173 - protein, 17 aa, Mycobacterium
DNRGGERNFGAGNTGSY

SEQ ID NO: 1336174 - protein, 14 aa, Mycobacterium
DNTDITGAASLANN

SEQ ID NO: 1336175 - protein, 6 aa, Mycobacterium
DNTGDT

SEQ ID NO: 1336176 - protein, 14 aa, Mycobacterium
DPAAPVVSDAERDT

SEQ ID NO: 1336177 - protein, 8 aa, Mycobacterium
DPAGGLTG

SEQ ID NO: 1336178 - protein, 9 aa, Mycobacterium
DPAGTTGDT

SEQ ID NO: 1336179 - protein, 7 aa, Mycobacterium
DPALTDA

SEQ ID NO: 1336180 - protein, 4 aa, Mycobacterium
DPAR

SEQ ID NO: 1336181 - protein, 5 aa, Mycobacterium
DPDDF

SEQ ID NO: 1336182 - protein, 8 aa, Mycobacterium
DPDGPLDD

SEQ ID NO: 1336183 - protein, 8 aa, Mycobacterium
DPDTQTRL

SEQ ID NO: 1336184 - protein, 10 aa, Mycobacterium
DPDVQGPVKS

SEQ ID NO: 1336185 - protein, 6 aa, Mycobacterium
DPEAAA

SEQ ID NO: 1336186 - protein, 9 aa, Mycobacterium
DPEKAKQEL

SEQ ID NO: 1336187 - protein, 9 aa, Mycobacterium
DPGQPPDPD

SEQ ID NO: 1336188 - protein, 4 aa, Mycobacterium
DPGV

SEQ ID NO: 1336189 - protein, 4 aa, Mycobacterium
DPIA

SEQ ID NO: 1336190 - protein, 4 aa, Mycobacterium
DPLT

SEQ ID NO: 1336191 - protein, 9 aa, Mycobacterium
DPPPSIQDS

SEQ ID NO: 1336192 - protein, 4 aa, Mycobacterium
DPQE

SEQ ID NO: 1336193 - protein, 15 aa, Mycobacterium
DPRDGLREFAFAPLR

SEQ ID NO: 1336194 - protein, 7 aa, Mycobacterium
DPSPFDP

SEQ ID NO: 1336195 - protein, 5 aa, Mycobacterium
DPTGW

SEQ ID NO: 1336196 - protein, 13 aa, Mycobacterium
DPTPATIESGQTP

SEQ ID NO: 1336197 - protein, 6 aa, Mycobacterium
DPVDTT

SEQ ID NO: 1336198 - protein, 7 aa, Mycobacterium
DPVGAAN

SEQ ID NO: 1336199 - protein, 5 aa, Mycobacterium
DPVPG

SEQ ID NO: 1336200 - protein, 17 aa, Mycobacterium
DPVTGKPLKNAAGQEIT

SEQ ID NO: 1336201 - protein, 7 aa, Mycobacterium
DQDHSGT

SEQ ID NO: 1336202 - protein, 8 aa, Mycobacterium
DQGPDNVD

SEQ ID NO: 1336203 - protein, 5 aa, Mycobacterium
DQPGL

SEQ ID NO: 1336204 - protein, 4 aa, Mycobacterium
DQPW

SEQ ID NO: 1336205 - protein, 39 aa, Mycobacterium
DQQNGKPAAGQEKPVTPVNPPVTATPPSESTATPFDSDA

SEQ ID NO: 1336206 - protein, 4 aa, Mycobacterium
DQSQ

SEQ ID NO: 1336207 - protein, 9 aa, Mycobacterium
DQTGELPVT

SEQ ID NO: 1336208 - protein, 5 aa, Mycobacterium
DQTTL

SEQ ID NO: 1336209 - protein, 8 aa, Mycobacterium
DRAGERVE

SEQ ID NO: 1336210 - protein, 5 aa, Mycobacterium
DRAGH

SEQ ID NO: 1336211 - protein, 11 aa, Mycobacterium
DRAGNATQRRL

SEQ ID NO: 1336212 - protein, 22 aa, Mycobacterium
DRARADSRLATDAAATARQPMK

SEQ ID NO: 1336213 - protein, 6 aa, Mycobacterium
DRGHRT

SEQ ID NO: 1336214 - protein, 7 aa, Mycobacterium
DRGMDRA

SEQ ID NO: 1336215 - protein, 4 aa, Mycobacterium
DRGP

SEQ ID NO: 1336216 - protein, 10 aa, Mycobacterium
DRLPTDPTYN

SEQ ID NO: 1336217 - protein, 9 aa, Mycobacterium
DRPAAQRFT

SEQ ID NO: 1336218 - protein, 5 aa, Mycobacterium
DRPGV

SEQ ID NO: 1336219 - protein, 7 aa, Mycobacterium
DRRPGGA

SEQ ID NO: 1336220 - protein, 7 aa, Mycobacterium
DRRVRRS

SEQ ID NO: 1336221 - protein, 8 aa, Mycobacterium
DRSQATPV

SEQ ID NO: 1336222 - protein, 12 aa, Mycobacterium
DRVPNKKNLRPD

SEQ ID NO: 1336223 - protein, 7 aa, Mycobacterium
DRYPEAS

SEQ ID NO: 1336224 - protein, 15 aa, Mycobacterium
DSAPAAASRASRVPL

SEQ ID NO: 1336225 - protein, 18 aa, Mycobacterium
DSATYPKNKPGASAQAGN

SEQ ID NO: 1336226 - protein, 7 aa, Mycobacterium
DSELRTA

SEQ ID NO: 1336227 - protein, 41 aa, Mycobacterium
DSGDSRPPQPPGAPDIGLPGRPGDRPDRPDRPGGGGGIGGG

SEQ ID NO: 1336228 - protein, 5 aa, Mycobacterium
DSGDV

SEQ ID NO: 1336229 - protein, 6 aa, Mycobacterium
DSGGFD

SEQ ID NO: 1336230 - protein, 8 aa, Mycobacterium
DSGKYNAE

SEQ ID NO: 1336231 - protein, 9 aa, Mycobacterium
DSGPATEEL

SEQ ID NO: 1336232 - protein, 24 aa, Mycobacterium
DSKPPLQAGDPASSVLNRVEYGDR

SEQ ID NO: 1336233 - protein, 15 aa, Mycobacterium
DSLGPQVASAKAKGI

SEQ ID NO: 1336234 - protein, 15 aa, Mycobacterium
DSLGPQVASAKEKGI

SEQ ID NO: 1336235 - protein, 7 aa, Mycobacterium
DSPPTGR

SEQ ID NO: 1336236 - protein, 26 aa, Mycobacterium
DSRAGLDAEQQAQLATGGDVGNGRTD

SEQ ID NO: 1336237 - protein, 10 aa, Mycobacterium
DSSDDPPLRR

SEQ ID NO: 1336238 - protein, 9 aa, Mycobacterium
DSTQTTRDL

SEQ ID NO: 1336239 - protein, 7 aa, Mycobacterium
DSVGEPD

SEQ ID NO: 1336240 - protein, 19 aa, Mycobacterium
DSYTTGSNEGGEGAKGWTT

SEQ ID NO: 1336241 - protein, 7 aa, Mycobacterium
DTAATAA

SEQ ID NO: 1336242 - protein, 11 aa, Mycobacterium
DTANWKRDEAV

SEQ ID NO: 1336243 - protein, 8 aa, Mycobacterium
DTDEPPTR

SEQ ID NO: 1336244 - protein, 5 aa, Mycobacterium
DTDRG

SEQ ID NO: 1336245 - protein, 7 aa, Mycobacterium
DTDVPTA

SEQ ID NO: 1336246 - protein, 13 aa, Mycobacterium
DTGAPPATDTYCP

SEQ ID NO: 1336247 - protein, 7 aa, Mycobacterium
DTGPEGL

SEQ ID NO: 1336248 - protein, 11 aa, Mycobacterium
DTGPQNYSDDG

SEQ ID NO: 1336249 - protein, 16 aa, Mycobacterium
DTGSPTAVAVSPDGTR

SEQ ID NO: 1336250 - protein, 14 aa, Mycobacterium
DTGTSNAVTPPRAV

SEQ ID NO: 1336251 - protein, 6 aa, Mycobacterium
DTGYGV

SEQ ID NO: 1336252 - protein, 8 aa, Mycobacterium
DTNKPNGQ

SEQ ID NO: 1336253 - protein, 5 aa, Mycobacterium
DTPAV

SEQ ID NO: 1336254 - protein, 7 aa, Mycobacterium
DTPDVGA

SEQ ID NO: 1336255 - protein, 6 aa, Mycobacterium
DTRAIS

SEQ ID NO: 1336256 - protein, 9 aa, Mycobacterium
DTSPERRRG

SEQ ID NO: 1336257 - protein, 11 aa, Mycobacterium
DTSTPGPSITE

SEQ ID NO: 1336258 - protein, 6 aa, Mycobacterium
DTTPAG

SEQ ID NO: 1336259 - protein, 7 aa, Mycobacterium
DTVASDE

SEQ ID NO: 1336260 - protein, 8 aa, Mycobacterium
DVEGRDPA

SEQ ID NO: 1336261 - protein, 8 aa, Mycobacterium
DVGGPGAA

SEQ ID NO: 1336262 - protein, 7 aa, Mycobacterium
DVGPNLG

SEQ ID NO: 1336263 - protein, 8 aa, Mycobacterium
DVPPSSTL

SEQ ID NO: 1336264 - protein, 9 aa, Mycobacterium
DVPTPESIA

SEQ ID NO: 1336265 - protein, 6 aa, Mycobacterium
DVSEPT

SEQ ID NO: 1336266 - protein, 9 aa, Mycobacterium
DVSTQASQV

SEQ ID NO: 1336267 - protein, 10 aa, Mycobacterium
DVTTPDGSTI

SEQ ID NO: 1336268 - protein, 7 aa, Mycobacterium
DWPGDEL

SEQ ID NO: 1336269 - protein, 5 aa, Mycobacterium
DWSAA

SEQ ID NO: 1336270 - protein, 6 aa, Mycobacterium
DYDNKG

SEQ ID NO: 1336271 - protein, 22 aa, Mycobacterium
DYTNQNSSYATAAGGAISTADD

SEQ ID NO: 1336272 - protein, 14 aa, Mycobacterium
EAAAEQRVRGEQAA

SEQ ID NO: 1336273 - protein, 11 aa, Mycobacterium
EACGAGSECGR

SEQ ID NO: 1336274 - protein, 7 aa, Mycobacterium
EAERQSR

SEQ ID NO: 1336275 - protein, 8 aa, Mycobacterium
EAGPTSWT

SEQ ID NO: 1336276 - protein, 11 aa, Mycobacterium
EAGQDPASLTG

SEQ ID NO: 1336277 - protein, 5 aa, Mycobacterium
EAGRA

SEQ ID NO: 1336278 - protein, 8 aa, Mycobacterium
EAKEGNFT

SEQ ID NO: 1336279 - protein, 19 aa, Mycobacterium
EAPPDPSSEPLRDGDTIPL

SEQ ID NO: 1336280 - protein, 12 aa, Mycobacterium
EARARRAAEAVG

SEQ ID NO: 1336281 - protein, 18 aa, Mycobacterium
EARDSGEISAEEEKAAQR

SEQ ID NO: 1336282 - protein, 6 aa, Mycobacterium
EAREEA

SEQ ID NO: 1336283 - protein, 5 aa, Mycobacterium
EASGV

SEQ ID NO: 1336284 - protein, 6 aa, Mycobacterium
EATGGS

SEQ ID NO: 1336285 - protein, 12 aa, Mycobacterium
EATGTAEQSGDA

SEQ ID NO: 1336286 - protein, 6 aa, Mycobacterium
EDAPAG

SEQ ID NO: 1336287 - protein, 5 aa, Mycobacterium
EDEGR

SEQ ID NO: 1336288 - protein, 8 aa, Mycobacterium
EDEPVRPR

SEQ ID NO: 1336289 - protein, 5 aa, Mycobacterium
EDLER

SEQ ID NO: 1336290 - protein, 20 aa, Mycobacterium
EDLTGTSARVRAKKDDGSWG

SEQ ID NO: 1336291 - protein, 51 aa, Mycobacterium
EDPAPTRRDGPAPARDHRDADTPEALAGPRAEADLPPCPPPGVGAGPESLR

SEQ ID NO: 1336292 - protein, 8 aa, Mycobacterium
EDPKEYPD

SEQ ID NO: 1336293 - protein, 8 aa, Mycobacterium
EDQGRNPV

SEQ ID NO: 1336294 - protein, 5 aa, Mycobacterium
EDRGA

SEQ ID NO: 1336295 - protein, 11 aa, Mycobacterium
EEAGRSPRVEV

SEQ ID NO: 1336296 - protein, 7 aa, Mycobacterium
EEASYEG

SEQ ID NO: 1336297 - protein, 4 aa, Mycobacterium
EEGR

SEQ ID NO: 1336298 - protein, 9 aa, Mycobacterium
EELPPGATV

SEQ ID NO: 1336299 - protein, 10 aa, Mycobacterium
EEPAAEPEPI

SEQ ID NO: 1336300 - protein, 13 aa, Mycobacterium
EEQPTELDETEDV

SEQ ID NO: 1336301 - protein, 6 aa, Mycobacterium
EETSGE

SEQ ID NO: 1336302 - protein, 8 aa, Mycobacterium
EGADDFEG

SEQ ID NO: 1336303 - protein, 15 aa, Mycobacterium
EGAGGTTKLRPGDAI

SEQ ID NO: 1336304 - protein, 8 aa, Mycobacterium
EGDASPAD

SEQ ID NO: 1336305 - protein, 5 aa, Mycobacterium
EGDDR

SEQ ID NO: 1336306 - protein, 9 aa, Mycobacterium
EGDEPLEGG

SEQ ID NO: 1336307 - protein, 7 aa, Mycobacterium
EGEPATA

SEQ ID NO: 1336308 - protein, 13 aa, Mycobacterium
EGGGDQSTALRNG

SEQ ID NO: 1336309 - protein, 7 aa, Mycobacterium
EGLPGLK

SEQ ID NO: 1336310 - protein, 9 aa, Mycobacterium
EGLRQTDGQ

SEQ ID NO: 1336311 - protein, 17 aa, Mycobacterium
EGNGATLAATNAAASAV

SEQ ID NO: 1336312 - protein, 11 aa, Mycobacterium
EGQSRDQIRPQ

SEQ ID NO: 1336313 - protein, 5 aa, Mycobacterium
EGSHN

SEQ ID NO: 1336314 - protein, 17 aa, Mycobacterium
EGSREAAIKQAEGQKQA

SEQ ID NO: 1336315 - protein, 11 aa, Mycobacterium
EGTRSPDGRLY

SEQ ID NO: 1336316 - protein, 14 aa, Mycobacterium
EGVPPPPGDPVPAV

SEQ ID NO: 1336317 - protein, 9 aa, Mycobacterium
EHGESPSVS

SEQ ID NO: 1336318 - protein, 9 aa, Mycobacterium
EIADEQPAA

SEQ ID NO: 1336319 - protein, 7 aa, Mycobacterium
EINGEDM

SEQ ID NO: 1336320 - protein, 5 aa, Mycobacterium
EIPGG

SEQ ID NO: 1336321 - protein, 8 aa, Mycobacterium
EITGTDPQ

SEQ ID NO: 1336322 - protein, 10 aa, Mycobacterium
EKADTSAGAG

SEQ ID NO: 1336323 - protein, 7 aa, Mycobacterium
EKAGTSG

SEQ ID NO: 1336324 - protein, 5 aa, Mycobacterium
EKATV

SEQ ID NO: 1336325 - protein, 7 aa, Mycobacterium
EKDGRPM

SEQ ID NO: 1336326 - protein, 8 aa, Mycobacterium
EKQAPGLD

SEQ ID NO: 1336327 - protein, 15 aa, Mycobacterium
EKTRGGSAEPSASAV

SEQ ID NO: 1336328 - protein, 7 aa, Mycobacterium
EKVGSEE

SEQ ID NO: 1336329 - protein, 9 aa, Mycobacterium
ELAGGTGKH

SEQ ID NO: 1336330 - protein, 5 aa, Mycobacterium
ELDGR

SEQ ID NO: 1336331 - protein, 13 aa, Mycobacterium
ELGPSGGVSDTSV

SEQ ID NO: 1336332 - protein, 7 aa, Mycobacterium
ELPPEQA

SEQ ID NO: 1336333 - protein, 4 aa, Mycobacterium
ELPS

SEQ ID NO: 1336334 - protein, 9 aa, Mycobacterium
ELTARGATD

SEQ ID NO: 1336335 - protein, 11 aa, Mycobacterium
EMNSSPAGQAC

SEQ ID NO: 1336336 - protein, 8 aa, Mycobacterium
EMTSKSAS

SEQ ID NO: 1336337 - protein, 8 aa, Mycobacterium
ENDATSRT

SEQ ID NO: 1336338 - protein, 5 aa, Mycobacterium
ENDDM

SEQ ID NO: 1336339 - protein, 5 aa, Mycobacterium
ENGDV

SEQ ID NO: 1336340 - protein, 13 aa, Mycobacterium
ENPAKTDDPRGLS

SEQ ID NO: 1336341 - protein, 7 aa, Mycobacterium
ENPGQRP

SEQ ID NO: 1336342 - protein, 9 aa, Mycobacterium
ENPGSPGVQ

SEQ ID NO: 1336343 - protein, 9 aa, Mycobacterium
ENPKGGDFA

SEQ ID NO: 1336344 - protein, 7 aa, Mycobacterium
ENQARAK

SEQ ID NO: 1336345 - protein, 11 aa, Mycobacterium
ENSGHSRGSTV

SEQ ID NO: 1336346 - protein, 9 aa, Mycobacterium
EPATVRAET

SEQ ID NO: 1336347 - protein, 4 aa, Mycobacterium
EPDL

SEQ ID NO: 1336348 - protein, 6 aa, Mycobacterium
EPGRQT

SEQ ID NO: 1336349 - protein, 15 aa, Mycobacterium
EPKAPSGSWSDVTGR

SEQ ID NO: 1336350 - protein, 9 aa, Mycobacterium
EPLSRKQDI

SEQ ID NO: 1336351 - protein, 6 aa, Mycobacterium
EPNGTM

SEQ ID NO: 1336352 - protein, 6 aa, Mycobacterium
EPPEAM

SEQ ID NO: 1336353 - protein, 8 aa, Mycobacterium
EPSPIPPG

SEQ ID NO: 1336354 - protein, 8 aa, Mycobacterium
EPVSKESA

SEQ ID NO: 1336355 - protein, 22 aa, Mycobacterium
EQALRDPSSPEEVRRAAARRQQ

SEQ ID NO: 1336356 - protein, 5 aa, Mycobacterium
EQATG

SEQ ID NO: 1336357 - protein, 9 aa, Mycobacterium
EQKDKGQIR

SEQ ID NO: 1336358 - protein, 6 aa, Mycobacterium
EQNNGN

SEQ ID NO: 1336359 - protein, 20 aa, Mycobacterium
EQPTATGTPTIDTQLPDGRR

SEQ ID NO: 1336360 - protein, 10 aa, Mycobacterium
EQQTQQKGAI

SEQ ID NO: 1336361 - protein, 9 aa, Mycobacterium
EQTAADAPR

SEQ ID NO: 1336362 - protein, 12 aa, Mycobacterium
EQVPSGPGSVAG

SEQ ID NO: 1336363 - protein, 6 aa, Mycobacterium
ERAPQL

SEQ ID NO: 1336364 - protein, 8 aa, Mycobacterium
ERDAHAQA

SEQ ID NO: 1336365 - protein, 8 aa, Mycobacterium
ERGRPGER

SEQ ID NO: 1336366 - protein, 14 aa, Mycobacterium
ERHGGNRAQGTAGF

SEQ ID NO: 1336367 - protein, 4 aa, Mycobacterium
ERKL

SEQ ID NO: 1336368 - protein, 6 aa, Mycobacterium
ERLQTG

SEQ ID NO: 1336369 - protein, 17 aa, Mycobacterium
ERLTTSAAKIGADTGDH

SEQ ID NO: 1336370 - protein, 7 aa, Mycobacterium
ERRGDDA

SEQ ID NO: 1336371 - protein, 9 aa, Mycobacterium
ERTEDGFGQ

SEQ ID NO: 1336372 - protein, 5 aa, Mycobacterium
ERYPD

SEQ ID NO: 1336373 - protein, 5 aa, Mycobacterium
ESAGH

SEQ ID NO: 1336374 - protein, 10 aa, Mycobacterium
ESAGVPNAER

SEQ ID NO: 1336375 - protein, 14 aa, Mycobacterium
ESATPNQPTVQPVP

SEQ ID NO: 1336376 - protein, 5 aa, Mycobacterium
ESCGT

SEQ ID NO: 1336377 - protein, 8 aa, Mycobacterium
ESEQEQGA

SEQ ID NO: 1336378 - protein, 18 aa, Mycobacterium
ESGQTDRNGDNAVAGPVG

SEQ ID NO: 1336379 - protein, 10 aa, Mycobacterium
ESIGASAAAG

SEQ ID NO: 1336380 - protein, 7 aa, Mycobacterium
ESIRGTG

SEQ ID NO: 1336381 - protein, 4 aa, Mycobacterium
ESLR

SEQ ID NO: 1336382 - protein, 8 aa, Mycobacterium
ESMTGVPA

SEQ ID NO: 1336383 - protein, 9 aa, Mycobacterium
ESQNATGAR

SEQ ID NO: 1336384 - protein, 11 aa, Mycobacterium
ESSASGDRPRA

SEQ ID NO: 1336385 - protein, 6 aa, Mycobacterium
ESSERE

SEQ ID NO: 1336386 - protein, 4 aa, Mycobacterium
ESSP

SEQ ID NO: 1336387 - protein, 7 aa, Mycobacterium
ESTGEIL

SEQ ID NO: 1336388 - protein, 5 aa, Mycobacterium
ESTPL

SEQ ID NO: 1336389 - protein, 17 aa, Mycobacterium
ESTRPDEFNTEPFPAQG

SEQ ID NO: 1336390 - protein, 11 aa, Mycobacterium
ESYAEGDDEEL

SEQ ID NO: 1336391 - protein, 8 aa, Mycobacterium
ETDVTTPD

SEQ ID NO: 1336392 - protein, 4 aa, Mycobacterium
ETEI

SEQ ID NO: 1336393 - protein, 4 aa, Mycobacterium
ETGR

SEQ ID NO: 1336394 - protein, 19 aa, Mycobacterium
ETMSGTRTNTHAPGCNGEL

SEQ ID NO: 1336395 - protein, 5 aa, Mycobacterium
ETSPV

SEQ ID NO: 1336396 - protein, 5 aa, Mycobacterium
ETTGL

SEQ ID NO: 1336397 - protein, 11 aa, Mycobacterium
ETVAKDAGAVD

SEQ ID NO: 1336398 - protein, 6 aa, Mycobacterium
ETVYPQ

SEQ ID NO: 1336399 - protein, 5 aa, Mycobacterium
ETYPD

SEQ ID NO: 1336400 - protein, 8 aa, Mycobacterium
ETYPPGST

SEQ ID NO: 1336401 - protein, 11 aa, Mycobacterium
EVADELDGRSG

SEQ ID NO: 1336402 - protein, 17 aa, Mycobacterium
EVDSTTADYIRIATERL

SEQ ID NO: 1336403 - protein, 4 aa, Mycobacterium
EVED

SEQ ID NO: 1336404 - protein, 5 aa, Mycobacterium
EVENP

SEQ ID NO: 1336405 - protein, 10 aa, Mycobacterium
EVGDSVSGET

SEQ ID NO: 1336406 - protein, 6 aa, Mycobacterium
EVGQQA

SEQ ID NO: 1336407 - protein, 7 aa, Mycobacterium
EVPAPAG

SEQ ID NO: 1336408 - protein, 16 aa, Mycobacterium
EVRPGRVRGARTPATI

SEQ ID NO: 1336409 - protein, 10 aa, Mycobacterium
EWNNGGSVAT

SEQ ID NO: 1336410 - protein, 6 aa, Mycobacterium
EYPETV

SEQ ID NO: 1336411 - protein, 4 aa, Mycobacterium
EYQT

SEQ ID NO: 1336412 - protein, 9 aa, Mycobacterium
FADPTTPGV

SEQ ID NO: 1336413 - protein, 11 aa, Mycobacterium
FAPAPVDPTYQ

SEQ ID NO: 1336414 - protein, 8 aa, Mycobacterium
FAPQYTDV

SEQ ID NO: 1336415 - protein, 5 aa, Mycobacterium
FDPAE

SEQ ID NO: 1336416 - protein, 9 aa, Mycobacterium
FDPARAQTP

SEQ ID NO: 1336417 - protein, 9 aa, Mycobacterium
FDPQSRTRA

SEQ ID NO: 1336418 - protein, 6 aa, Mycobacterium
FDPTPG

SEQ ID NO: 1336419 - protein, 5 aa, Mycobacterium
FDVGD

SEQ ID NO: 1336420 - protein, 6 aa, Mycobacterium
FDYSGT

SEQ ID NO: 1336421 - protein, 11 aa, Mycobacterium
FEAGADTLRRA

SEQ ID NO: 1336422 - protein, 11 aa, Mycobacterium
FEDNTPDGTTV

SEQ ID NO: 1336423 - protein, 13 aa, Mycobacterium
FEEPGAGRPARSA

SEQ ID NO: 1336424 - protein, 6 aa, Mycobacterium
FESDDG

SEQ ID NO: 1336425 - protein, 16 aa, Mycobacterium
FGDEDAELTVGDAQDH

SEQ ID NO: 1336426 - protein, 8 aa, Mycobacterium
FGGNEPAR

SEQ ID NO: 1336427 - protein, 10 aa, Mycobacterium
FGLPTNSRLG

SEQ ID NO: 1336428 - protein, 9 aa, Mycobacterium
FGPARGPEL

SEQ ID NO: 1336429 - protein, 12 aa, Mycobacterium
FGRGKKAEQLYP

SEQ ID NO: 1336430 - protein, 16 aa, Mycobacterium
FGRNGPASAPRAGQEV

SEQ ID NO: 1336431 - protein, 12 aa, Mycobacterium
FNGPAGAPPNPA

SEQ ID NO: 1336432 - protein, 4 aa, Mycobacterium
FPAP

SEQ ID NO: 1336433 - protein, 4 aa, Mycobacterium
FPDQ

SEQ ID NO: 1336434 - protein, 5 aa, Mycobacterium
FPESA

SEQ ID NO: 1336435 - protein, 5 aa, Mycobacterium
FPPGV

SEQ ID NO: 1336436 - protein, 10 aa, Mycobacterium
FQNPPDGGLI

SEQ ID NO: 1336437 - protein, 7 aa, Mycobacterium
FREKDGR

SEQ ID NO: 1336438 - protein, 17 aa, Mycobacterium
FSDGTPFDSAAAKASFQ

SEQ ID NO: 1336439 - protein, 15 aa, Mycobacterium
FSDPKSEGRETVSGV

SEQ ID NO: 1336440 - protein, 5 aa, Mycobacterium
FSEER

SEQ ID NO: 1336441 - protein, 7 aa, Mycobacterium
FSGPGLR

SEQ ID NO: 1336442 - protein, 8 aa, Mycobacterium
FSSGTGLD

SEQ ID NO: 1336443 - protein, 14 aa, Mycobacterium
FTDSPEVGGLPANG

SEQ ID NO: 1336444 - protein, 4 aa, Mycobacterium
FTKP

SEQ ID NO: 1336445 - protein, 13 aa, Mycobacterium
FTNAASANPQFGG

SEQ ID NO: 1336446 - protein, 6 aa, Mycobacterium
FTRNPD

SEQ ID NO: 1336447 - protein, 14 aa, Mycobacterium
FTSTGAAAPSPYDE

SEQ ID NO: 1336448 - protein, 57 aa, Mycobacterium
FTTGGKKTTPAKDGDQAGDAGGQGDTTGGKQPTPGSTNDASSPADDKTTVDRETDSE

SEQ ID NO: 1336449 - protein, 7 aa, Mycobacterium
GAAAAGI

SEQ ID NO: 1336450 - protein, 8 aa, Mycobacterium
GAAAGAAG

SEQ ID NO: 1336451 - protein, 9 aa, Mycobacterium
GAAARPDLD

SEQ ID NO: 1336452 - protein, 8 aa, Mycobacterium
GAAKALAA

SEQ ID NO: 1336453 - protein, 10 aa, Mycobacterium
GAAPASAGPD

SEQ ID NO: 1336454 - protein, 8 aa, Mycobacterium
GAAQRGNR

SEQ ID NO: 1336455 - protein, 5 aa, Mycobacterium
GAASN

SEQ ID NO: 1336456 - protein, 8 aa, Mycobacterium
GAASTGFQ

SEQ ID NO: 1336457 - protein, 10 aa, Mycobacterium
GAAVAADSAR

SEQ ID NO: 1336458 - protein, 8 aa, Mycobacterium
GADGRRIA

SEQ ID NO: 1336459 - protein, 6 aa, Mycobacterium
GADPAR

SEQ ID NO: 1336460 - protein, 8 aa, Mycobacterium
GADPNRTV

SEQ ID NO: 1336461 - protein, 34 aa, Mycobacterium
GAEEEKTPEQAERWGGEADRPFDPNYHKKEDDLT

SEQ ID NO: 1336462 - protein, 6 aa, Mycobacterium
GAEPGD

SEQ ID NO: 1336463 - protein, 8 aa, Mycobacterium
GAETPDYQ

SEQ ID NO: 1336464 - protein, 8 aa, Mycobacterium
GAGATPID

SEQ ID NO: 1336465 - protein, 14 aa, Mycobacterium
GAGDTAANGDSTRI

SEQ ID NO: 1336466 - protein, 14 aa, Mycobacterium
GAGDTEANSDTTRI

SEQ ID NO: 1336467 - protein, 6 aa, Mycobacterium
GAGKST

SEQ ID NO: 1336468 - protein, 8 aa, Mycobacterium
GAGPGQPN

SEQ ID NO: 1336469 - protein, 8 aa, Mycobacterium
GAGQAQAD

SEQ ID NO: 1336470 - protein, 9 aa, Mycobacterium
GAHRPTPTI

SEQ ID NO: 1336471 - protein, 5 aa, Mycobacterium
GAKRP

SEQ ID NO: 1336472 - protein, 6 aa, Mycobacterium
GANGQD

SEQ ID NO: 1336473 - protein, 7 aa, Mycobacterium
GANSPRD

SEQ ID NO: 1336474 - protein, 7 aa, Mycobacterium
GAPLQQR

SEQ ID NO: 1336475 - protein, 19 aa, Mycobacterium
GAPQAGPSLTIGSAQDDAS

SEQ ID NO: 1336476 - protein, 7 aa, Mycobacterium
GAPRTGE

SEQ ID NO: 1336477 - protein, 15 aa, Mycobacterium
GAPTPGAPGAAANGP

SEQ ID NO: 1336478 - protein, 5 aa, Mycobacterium
GAPYF

SEQ ID NO: 1336479 - protein, 8 aa, Mycobacterium
GAQRDPST

SEQ ID NO: 1336480 - protein, 11 aa, Mycobacterium
GAQRGPGSAAK

SEQ ID NO: 1336481 - protein, 7 aa, Mycobacterium
GAQVDAD

SEQ ID NO: 1336482 - protein, 19 aa, Mycobacterium
GARPGQYGVGQGAGAVTIA

SEQ ID NO: 1336483 - protein, 8 aa, Mycobacterium
GARSTLGR

SEQ ID NO: 1336484 - protein, 4 aa, Mycobacterium
GASG

SEQ ID NO: 1336485 - protein, 13 aa, Mycobacterium
GASPERPSTEAVQ

SEQ ID NO: 1336486 - protein, 9 aa, Mycobacterium
GASSGIGEQ

SEQ ID NO: 1336487 - protein, 9 aa, Mycobacterium
GASSGLGAA

SEQ ID NO: 1336488 - protein, 4 aa, Mycobacterium
GATA

SEQ ID NO: 1336489 - protein, 17 aa, Mycobacterium
GATAQRAARRSPWATTA

SEQ ID NO: 1336490 - protein, 6 aa, Mycobacterium
GATDAS

SEQ ID NO: 1336491 - protein, 17 aa, Mycobacterium
GATGGSATAGAFSRPGL

SEQ ID NO: 1336492 - protein, 13 aa, Mycobacterium
GAYEQITKTSDEI

SEQ ID NO: 1336493 - protein, 7 aa, Mycobacterium
GCNGPCK

SEQ ID NO: 1336494 - protein, 15 aa, Mycobacterium
GCPANYNGCPSRLPA

SEQ ID NO: 1336495 - protein, 11 aa, Mycobacterium
GCPPAGPPPGF

SEQ ID NO: 1336496 - protein, 13 aa, Mycobacterium
GCSGSSNSPTDTA

SEQ ID NO: 1336497 - protein, 5 aa, Mycobacterium
GCTHP

SEQ ID NO: 1336498 - protein, 14 aa, Mycobacterium
GCTPKPNGPEPAAE

SEQ ID NO: 1336499 - protein, 38 aa, Mycobacterium
GCTPTDSSPAPSAPGLPTSSSSESSAPTSAPKENSSAV

SEQ ID NO: 1336500 - protein, 9 aa, Mycobacterium
GDAGGYKSE

SEQ ID NO: 1336501 - protein, 10 aa, Mycobacterium
GDAGTSSRAR

SEQ ID NO: 1336502 - protein, 4 aa, Mycobacterium
GDAI

SEQ ID NO: 1336503 - protein, 7 aa, Mycobacterium
GDFGQDD

SEQ ID NO: 1336504 - protein, 6 aa, Mycobacterium
GDFQGT

SEQ ID NO: 1336505 - protein, 22 aa, Mycobacterium
GDGAAAQRLTATPPAPTDPVRT

SEQ ID NO: 1336506 - protein, 4 aa, Mycobacterium
GDGQ

SEQ ID NO: 1336507 - protein, 4 aa, Mycobacterium
GDGW

SEQ ID NO: 1336508 - protein, 6 aa, Mycobacterium
GDIEAG

SEQ ID NO: 1336509 - protein, 5 aa, Mycobacterium
GDLEG

SEQ ID NO: 1336510 - protein, 14 aa, Mycobacterium
GDLTNTPAVAASGK

SEQ ID NO: 1336511 - protein, 4 aa, Mycobacterium
GDNE

SEQ ID NO: 1336512 - protein, 13 aa, Mycobacterium
GDNPALRARSRDP

SEQ ID NO: 1336513 - protein, 8 aa, Mycobacterium
GDPRRGHP

SEQ ID NO: 1336514 - protein, 10 aa, Mycobacterium
GDQGSPSTQF

SEQ ID NO: 1336515 - protein, 8 aa, Mycobacterium
GDQKRDPG

SEQ ID NO: 1336516 - protein, 23 aa, Mycobacterium
GDQSAPPNPEAGSPRVPEGSAGI

SEQ ID NO: 1336517 - protein, 9 aa, Mycobacterium
GDRHDQRYT

SEQ ID NO: 1336518 - protein, 15 aa, Mycobacterium
GDRTVTTATGNGGYR

SEQ ID NO: 1336519 - protein, 9 aa, Mycobacterium
GDSDTRTGA

SEQ ID NO: 1336520 - protein, 8 aa, Mycobacterium
GDSKRSTG

SEQ ID NO: 1336521 - protein, 18 aa, Mycobacterium
GDSSAPAITVSGNFLRPA

SEQ ID NO: 1336522 - protein, 4 aa, Mycobacterium
GDSV

SEQ ID NO: 1336523 - protein, 16 aa, Mycobacterium
GDTPKAQIRAEAAERG

SEQ ID NO: 1336524 - protein, 4 aa, Mycobacterium
GDTY

SEQ ID NO: 1336525 - protein, 13 aa, Mycobacterium
GDVERGGVDVDQP

SEQ ID NO: 1336526 - protein, 12 aa, Mycobacterium
GEANQDKGDQEP

SEQ ID NO: 1336527 - protein, 8 aa, Mycobacterium
GEDVKTDP

SEQ ID NO: 1336528 - protein, 14 aa, Mycobacterium
GEEGTPMVPAPGDP

SEQ ID NO: 1336529 - protein, 17 aa, Mycobacterium
GEETPGFSASVSTGENV

SEQ ID NO: 1336530 - protein, 11 aa, Mycobacterium
GEGDLDRNVTR

SEQ ID NO: 1336531 - protein, 4 aa, Mycobacterium
GEKS

SEQ ID NO: 1336532 - protein, 8 aa, Mycobacterium
GENQFGYS

SEQ ID NO: 1336533 - protein, 9 aa, Mycobacterium
GEPAHDPDF

SEQ ID NO: 1336534 - protein, 10 aa, Mycobacterium
GEPDGQTAAL

SEQ ID NO: 1336535 - protein, 12 aa, Mycobacterium
GEPHARASDPKS

SEQ ID NO: 1336536 - protein, 4 aa, Mycobacterium
GEQL

SEQ ID NO: 1336537 - protein, 4 aa, Mycobacterium
GERP

SEQ ID NO: 1336538 - protein, 4 aa, Mycobacterium
GERT

SEQ ID NO: 1336539 - protein, 4 aa, Mycobacterium
GESY

SEQ ID NO: 1336540 - protein, 5 aa, Mycobacterium
GEVPE

SEQ ID NO: 1336541 - protein, 13 aa, Mycobacterium
GEVPTYKTSYPTD

SEQ ID NO: 1336542 - protein, 22 aa, Mycobacterium
GEWGTSGVGGGAGGAGGVGGRS

SEQ ID NO: 1336543 - protein, 8 aa, Mycobacterium
GEYAPRAA

SEQ ID NO: 1336544 - protein, 11 aa, Mycobacterium
GFGGDDDDHGR

SEQ ID NO: 1336545 - protein, 4 aa, Mycobacterium
GFGP

SEQ ID NO: 1336546 - protein, 8 aa, Mycobacterium
GFRPSQEN

SEQ ID NO: 1336547 - protein, 7 aa, Mycobacterium
GGAAGEL

SEQ ID NO: 1336548 - protein, 4 aa, Mycobacterium
GGAD

SEQ ID NO: 1336549 - protein, 39 aa, Mycobacterium
GGADEQQAAPAADPPAGSFRSDGCNGVTDEEITKAAEST

SEQ ID NO: 1336550 - protein, 41 aa, Mycobacterium
GGAGGNGGNPGTVGAAGIGGAAGTRRLGGGTAGASGDAGEA

SEQ ID NO: 1336551 - protein, 6 aa, Mycobacterium
GGAHPQ

SEQ ID NO: 1336552 - protein, 6 aa, Mycobacterium
GGARGY

SEQ ID NO: 1336553 - protein, 15 aa, Mycobacterium
GGASGIGRATAGRLA

SEQ ID NO: 1336554 - protein, 4 aa, Mycobacterium
GGDE

SEQ ID NO: 1336555 - protein, 8 aa, Mycobacterium
GGDIRSTV

SEQ ID NO: 1336556 - protein, 11 aa, Mycobacterium
GGEEGDSELVP

SEQ ID NO: 1336557 - protein, 9 aa, Mycobacterium
GGEPIGAPA

SEQ ID NO: 1336558 - protein, 4 aa, Mycobacterium
GGGA

SEQ ID NO: 1336559 - protein, 12 aa, Mycobacterium
GGGDFGGGDFGG

SEQ ID NO: 1336560 - protein, 17 aa, Mycobacterium
GGGDPTLSAAPRGTDSW

SEQ ID NO: 1336561 - protein, 7 aa, Mycobacterium
GGGETAA

SEQ ID NO: 1336562 - protein, 8 aa, Mycobacterium
GGGLGQAG

SEQ ID NO: 1336563 - protein, 11 aa, Mycobacterium
GGGNPAQDIAG

SEQ ID NO: 1336564 - protein, 5 aa, Mycobacterium
GGGSS

SEQ ID NO: 1336565 - protein, 5 aa, Mycobacterium
GGIRS

SEQ ID NO: 1336566 - protein, 15 aa, Mycobacterium
GGNGFRGGNGGNAGF

SEQ ID NO: 1336567 - protein, 11 aa, Mycobacterium
GGNPRNGVSEA

SEQ ID NO: 1336568 - protein, 13 aa, Mycobacterium
GGNRDAGKREPMG

SEQ ID NO: 1336569 - protein, 7 aa, Mycobacterium
GGNREAL

SEQ ID NO: 1336570 - protein, 16 aa, Mycobacterium
GGNVTPTNARLQGKVG

SEQ ID NO: 1336571 - protein, 8 aa, Mycobacterium
GGPAEAAG

SEQ ID NO: 1336572 - protein, 8 aa, Mycobacterium
GGPAGVAD

SEQ ID NO: 1336573 - protein, 90 aa, Mycobacterium
GGPDAPIPGAPPAFGTTRDGNLPGPPNAFDERNPLPPPWYPQPGPPPAPAPGVIPGDPGGSPLSGPAPGPAPAAQAPAPAGPPLPAEAGA

SEQ ID NO: 1336574 - protein, 50 aa, Mycobacterium
GGPKGKHRADTTPAAEPEPSRQDSATNDPADNGTTGTDSDTSTDEKDQPA

SEQ ID NO: 1336575 - protein, 6 aa, Mycobacterium
GGPPAV

SEQ ID NO: 1336576 - protein, 7 aa, Mycobacterium
GGPPRIS

SEQ ID NO: 1336577 - protein, 6 aa, Mycobacterium
GGPTQY

SEQ ID NO: 1336578 - protein, 6 aa, Mycobacterium
GGPYGP

SEQ ID NO: 1336579 - protein, 6 aa, Mycobacterium
GGQTAL

SEQ ID NO: 1336580 - protein, 19 aa, Mycobacterium
GGSESGGGEPDDDAAHSTA

SEQ ID NO: 1336581 - protein, 24 aa, Mycobacterium
GGSGGREPAGGNYPAEMLIDWIRV

SEQ ID NO: 1336582 - protein, 33 aa, Mycobacterium
GGSPDSEEASGPGPSASTISPSEMTDQQRPTDR

SEQ ID NO: 1336583 - protein, 6 aa, Mycobacterium
GGSSEY

SEQ ID NO: 1336584 - protein, 7 aa, Mycobacterium
GGSYGAP

SEQ ID NO: 1336585 - protein, 7 aa, Mycobacterium
GGTAGHV

SEQ ID NO: 1336586 - protein, 14 aa, Mycobacterium
GGTATAGAYSRPGL

SEQ ID NO: 1336587 - protein, 4 aa, Mycobacterium
GGVG

SEQ ID NO: 1336588 - protein, 14 aa, Mycobacterium
GGVLESSDKKDQAQ

SEQ ID NO: 1336589 - protein, 7 aa, Mycobacterium
GGVTGKM

SEQ ID NO: 1336590 - protein, 5 aa, Mycobacterium
GGYRQ

SEQ ID NO: 1336591 - protein, 22 aa, Mycobacterium
GHGPRSTIGAERRTNPFLEGLR

SEQ ID NO: 1336592 - protein, 5 aa, Mycobacterium
GHGRN

SEQ ID NO: 1336593 - protein, 37 aa, Mycobacterium
GHNGANDASISRQVPTGRGGTKDCQASGTSTEDGYPE

SEQ ID NO: 1336594 - protein, 13 aa, Mycobacterium
GIAGPGPDGQPRY

SEQ ID NO: 1336595 - protein, 13 aa, Mycobacterium
GIAPATAAKLADD

SEQ ID NO: 1336596 - protein, 5 aa, Mycobacterium
GIGSR

SEQ ID NO: 1336597 - protein, 7 aa, Mycobacterium
GKAGCST

SEQ ID NO: 1336598 - protein, 13 aa, Mycobacterium
GKDTAQALAEADG

SEQ ID NO: 1336599 - protein, 8 aa, Mycobacterium
GKEGMEAY

SEQ ID NO: 1336600 - protein, 9 aa, Mycobacterium
GKESMNKAV

SEQ ID NO: 1336601 - protein, 9 aa, Mycobacterium
GKGAPLGSG

SEQ ID NO: 1336602 - protein, 4 aa, Mycobacterium
GKPA

SEQ ID NO: 1336603 - protein, 17 aa, Mycobacterium
GKPADISGTGQAEGDNF

SEQ ID NO: 1336604 - protein, 12 aa, Mycobacterium
GKQDFDAASPEI

SEQ ID NO: 1336605 - protein, 4 aa, Mycobacterium
GKRG

SEQ ID NO: 1336606 - protein, 8 aa, Mycobacterium
GLAGQSQL

SEQ ID NO: 1336607 - protein, 8 aa, Mycobacterium
GLASPTGF

SEQ ID NO: 1336608 - protein, 10 aa, Mycobacterium
GLATPQTPVA

SEQ ID NO: 1336609 - protein, 9 aa, Mycobacterium
GLATSPQAM

SEQ ID NO: 1336610 - protein, 11 aa, Mycobacterium
GLDPEAGRPGV

SEQ ID NO: 1336611 - protein, 12 aa, Mycobacterium
GLDTTSAESAAP

SEQ ID NO: 1336612 - protein, 5 aa, Mycobacterium
GLEGS

SEQ ID NO: 1336613 - protein, 9 aa, Mycobacterium
GLETGDPQV

SEQ ID NO: 1336614 - protein, 7 aa, Mycobacterium
GLGSGST

SEQ ID NO: 1336615 - protein, 7 aa, Mycobacterium
GLGTPGL

SEQ ID NO: 1336616 - protein, 7 aa, Mycobacterium
GLPADQK

SEQ ID NO: 1336617 - protein, 21 aa, Mycobacterium
GLPGDDDESAAAGAPTLTEQP

SEQ ID NO: 1336618 - protein, 11 aa, Mycobacterium
GLPGGIGGAGL

SEQ ID NO: 1336619 - protein, 22 aa, Mycobacterium
GLPPGWTTADKTGSGDYGTTND

SEQ ID NO: 1336620 - protein, 7 aa, Mycobacterium
GLPTSGE

SEQ ID NO: 1336621 - protein, 51 aa, Mycobacterium
GLRGAPPVAPPPPPPPPPPPPPPPAAPSIGADGEPEPDAPRQLNPRGADPL

SEQ ID NO: 1336622 - protein, 9 aa, Mycobacterium
GLRTDPRNQ

SEQ ID NO: 1336623 - protein, 7 aa, Mycobacterium
GLSSGQI

SEQ ID NO: 1336624 - protein, 5 aa, Mycobacterium
GLSVD

SEQ ID NO: 1336625 - protein, 6 aa, Mycobacterium
GLTEQD

SEQ ID NO: 1336626 - protein, 5 aa, Mycobacterium
GLTSG

SEQ ID NO: 1336627 - protein, 8 aa, Mycobacterium
GLYGQDDR

SEQ ID NO: 1336628 - protein, 4 aa, Mycobacterium
GMSS

SEQ ID NO: 1336629 - protein, 6 aa, Mycobacterium
GMTPRA

SEQ ID NO: 1336630 - protein, 7 aa, Mycobacterium
GNDNRGN

SEQ ID NO: 1336631 - protein, 9 aa, Mycobacterium
GNDYADDLA

SEQ ID NO: 1336632 - protein, 6 aa, Mycobacterium
GNGAGS

SEQ ID NO: 1336633 - protein, 8 aa, Mycobacterium
GNGEQRLN

SEQ ID NO: 1336634 - protein, 4 aa, Mycobacterium
GNGF

SEQ ID NO: 1336635 - protein, 10 aa, Mycobacterium
GNGQQGLEDN

SEQ ID NO: 1336636 - protein, 6 aa, Mycobacterium
GNLGHP

SEQ ID NO: 1336637 - protein, 9 aa, Mycobacterium
GNTECPGNA

SEQ ID NO: 1336638 - protein, 8 aa, Mycobacterium
GNTGQSVS

SEQ ID NO: 1336639 - protein, 7 aa, Mycobacterium
GNYTPDN

SEQ ID NO: 1336640 - protein, 10 aa, Mycobacterium
GPASDPAWRR

SEQ ID NO: 1336641 - protein, 8 aa, Mycobacterium
GPATEAVA

SEQ ID NO: 1336642 - protein, 10 aa, Mycobacterium
GPAVGNGQTY

SEQ ID NO: 1336643 - protein, 5 aa, Mycobacterium
GPCSG

SEQ ID NO: 1336644 - protein, 15 aa, Mycobacterium
GPDGDFDADTLTPEV

SEQ ID NO: 1336645 - protein, 7 aa, Mycobacterium
GPDGPVV

SEQ ID NO: 1336646 - protein, 4 aa, Mycobacterium
GPEF

SEQ ID NO: 1336647 - protein, 6 aa, Mycobacterium
GPEGRG

SEQ ID NO: 1336648 - protein, 19 aa, Mycobacterium
GPGQQPADPAFADPPVRIA

SEQ ID NO: 1336649 - protein, 24 aa, Mycobacterium
GPKTGSVKVNADGTYTYTPGAGFD

SEQ ID NO: 1336650 - protein, 4 aa, Mycobacterium
GPLT

SEQ ID NO: 1336651 - protein, 11 aa, Mycobacterium
GPMSTTAAESL

SEQ ID NO: 1336652 - protein, 5 aa, Mycobacterium
GPNAV

SEQ ID NO: 1336653 - protein, 5 aa, Mycobacterium
GPNLA

SEQ ID NO: 1336654 - protein, 14 aa, Mycobacterium
GPPPGGGAMGSDAF

SEQ ID NO: 1336655 - protein, 5 aa, Mycobacterium
GPPTC

SEQ ID NO: 1336656 - protein, 4 aa, Mycobacterium
GPRP

SEQ ID NO: 1336657 - protein, 12 aa, Mycobacterium
GPTPDQPKGPFG

SEQ ID NO: 1336658 - protein, 12 aa, Mycobacterium
GPVDPLPRTRAD

SEQ ID NO: 1336659 - protein, 4 aa, Mycobacterium
GPVG

SEQ ID NO: 1336660 - protein, 11 aa, Mycobacterium
GPVPGQATYGA

SEQ ID NO: 1336661 - protein, 7 aa, Mycobacterium
GPYRGGR

SEQ ID NO: 1336662 - protein, 18 aa, Mycobacterium
GQAAPDQVPGDHKTVQGA

SEQ ID NO: 1336663 - protein, 8 aa, Mycobacterium
GQAGPDAV

SEQ ID NO: 1336664 - protein, 6 aa, Mycobacterium
GQAGVA

SEQ ID NO: 1336665 - protein, 7 aa, Mycobacterium
GQDALPG

SEQ ID NO: 1336666 - protein, 8 aa, Mycobacterium
GQDPEAGM

SEQ ID NO: 1336667 - protein, 13 aa, Mycobacterium
GQERTAKATLAPG

SEQ ID NO: 1336668 - protein, 13 aa, Mycobacterium
GQFEGRPEASAAD

SEQ ID NO: 1336669 - protein, 4 aa, Mycobacterium
GQGA

SEQ ID NO: 1336670 - protein, 6 aa, Mycobacterium
GQGATI

SEQ ID NO: 1336671 - protein, 7 aa, Mycobacterium
GQGTEFD

SEQ ID NO: 1336672 - protein, 9 aa, Mycobacterium
GQGVGPGNI

SEQ ID NO: 1336673 - protein, 5 aa, Mycobacterium
GQHTQ

SEQ ID NO: 1336674 - protein, 7 aa, Mycobacterium
GQLGPQI

SEQ ID NO: 1336675 - protein, 5 aa, Mycobacterium
GQLPP

SEQ ID NO: 1336676 - protein, 12 aa, Mycobacterium
GQPGDSGAPVTV

SEQ ID NO: 1336677 - protein, 4 aa, Mycobacterium
GQPQ

SEQ ID NO: 1336678 - protein, 17 aa, Mycobacterium
GQQGGSWRETGCSSPLG

SEQ ID NO: 1336679 - protein, 4 aa, Mycobacterium
GQRM

SEQ ID NO: 1336680 - protein, 5 aa, Mycobacterium
GQRRG

SEQ ID NO: 1336681 - protein, 6 aa, Mycobacterium
GQTPLG

SEQ ID NO: 1336682 - protein, 4 aa, Mycobacterium
GQTS

SEQ ID NO: 1336683 - protein, 4 aa, Mycobacterium
GQTV

SEQ ID NO: 1336684 - protein, 5 aa, Mycobacterium
GQYTT

SEQ ID NO: 1336685 - protein, 5 aa, Mycobacterium
GRAVE

SEQ ID NO: 1336686 - protein, 7 aa, Mycobacterium
GRDDAAA

SEQ ID NO: 1336687 - protein, 9 aa, Mycobacterium
GRDPRGGNV

SEQ ID NO: 1336688 - protein, 5 aa, Mycobacterium
GRDVP

SEQ ID NO: 1336689 - protein, 4 aa, Mycobacterium
GREF

SEQ ID NO: 1336690 - protein, 9 aa, Mycobacterium
GREGLPGVA

SEQ ID NO: 1336691 - protein, 7 aa, Mycobacterium
GRLGGRT

SEQ ID NO: 1336692 - protein, 8 aa, Mycobacterium
GRLPEADL

SEQ ID NO: 1336693 - protein, 13 aa, Mycobacterium
GRNDTTRYAPAST

SEQ ID NO: 1336694 - protein, 6 aa, Mycobacterium
GRPEQE

SEQ ID NO: 1336695 - protein, 6 aa, Mycobacterium
GRPSRT

SEQ ID NO: 1336696 - protein, 9 aa, Mycobacterium
GRQASHRVS

SEQ ID NO: 1336697 - protein, 4 aa, Mycobacterium
GRQG

SEQ ID NO: 1336698 - protein, 6 aa, Mycobacterium
GRQLRE

SEQ ID NO: 1336699 - protein, 15 aa, Mycobacterium
GRRTDPEQVVTGTST

SEQ ID NO: 1336700 - protein, 12 aa, Mycobacterium
GRTDLPGGSGRD

SEQ ID NO: 1336701 - protein, 10 aa, Mycobacterium
GRTESPGAGV

SEQ ID NO: 1336702 - protein, 8 aa, Mycobacterium
GRTGVDAF

SEQ ID NO: 1336703 - protein, 19 aa, Mycobacterium
GRTQAAESAAALAGNDYDG

SEQ ID NO: 1336704 - protein, 24 aa, Mycobacterium
GRTQPVSEESRRSPTPAADAGRAL

SEQ ID NO: 1336705 - protein, 6 aa, Mycobacterium
GRTTGY

SEQ ID NO: 1336706 - protein, 9 aa, Mycobacterium
GRVPDPALP

SEQ ID NO: 1336707 - protein, 12 aa, Mycobacterium
GSACGGGPTAPL

SEQ ID NO: 1336708 - protein, 10 aa, Mycobacterium
GSAPPPPEVD

SEQ ID NO: 1336709 - protein, 6 aa, Mycobacterium
GSDPQF

SEQ ID NO: 1336710 - protein, 4 aa, Mycobacterium
GSDR

SEQ ID NO: 1336711 - protein, 9 aa, Mycobacterium
GSEHWTPER

SEQ ID NO: 1336712 - protein, 11 aa, Mycobacterium
GSGGGSPPGLF

SEQ ID NO: 1336713 - protein, 11 aa, Mycobacterium
GSGGLNPRSDI

SEQ ID NO: 1336714 - protein, 15 aa, Mycobacterium
GSGINASPGLASYSA

SEQ ID NO: 1336715 - protein, 25 aa, Mycobacterium
GSGQISQTATQAPAVNGVNAGTGDV

SEQ ID NO: 1336716 - protein, 9 aa, Mycobacterium
GSGYEQGFA

SEQ ID NO: 1336717 - protein, 7 aa, Mycobacterium
GSHPNKV

SEQ ID NO: 1336718 - protein, 8 aa, Mycobacterium
GSIAGAAK

SEQ ID NO: 1336719 - protein, 9 aa, Mycobacterium
GSITPASGL

SEQ ID NO: 1336720 - protein, 6 aa, Mycobacterium
GSPFTA

SEQ ID NO: 1336721 - protein, 7 aa, Mycobacterium
GSPGRVA

SEQ ID NO: 1336722 - protein, 10 aa, Mycobacterium
GSPTEGPATN

SEQ ID NO: 1336723 - protein, 6 aa, Mycobacterium
GSQNFQ

SEQ ID NO: 1336724 - protein, 14 aa, Mycobacterium
GSRPAALARRGLGP

SEQ ID NO: 1336725 - protein, 11 aa, Mycobacterium
GSRSTREAQLR

SEQ ID NO: 1336726 - protein, 4 aa, Mycobacterium
GSSM

SEQ ID NO: 1336727 - protein, 7 aa, Mycobacterium
GSSPRFT

SEQ ID NO: 1336728 - protein, 7 aa, Mycobacterium
GSSPRVA

SEQ ID NO: 1336729 - protein, 6 aa, Mycobacterium
GSTEEA

SEQ ID NO: 1336730 - protein, 4 aa, Mycobacterium
GSTI

SEQ ID NO: 1336731 - protein, 4 aa, Mycobacterium
GSTT

SEQ ID NO: 1336732 - protein, 23 aa, Mycobacterium
GSVTASATLEQAPNELSGAVGHD

SEQ ID NO: 1336733 - protein, 11 aa, Mycobacterium
GSWARRPEAVT

SEQ ID NO: 1336734 - protein, 9 aa, Mycobacterium
GTADAQPQC

SEQ ID NO: 1336735 - protein, 8 aa, Mycobacterium
GTADRPNA

SEQ ID NO: 1336736 - protein, 10 aa, Mycobacterium
GTAPQGVEGP

SEQ ID NO: 1336737 - protein, 8 aa, Mycobacterium
GTATAGLA

SEQ ID NO: 1336738 - protein, 13 aa, Mycobacterium
GTDAGLSPAHGTN

SEQ ID NO: 1336739 - protein, 8 aa, Mycobacterium
GTDARTRA

SEQ ID NO: 1336740 - protein, 8 aa, Mycobacterium
GTDEPPGI

SEQ ID NO: 1336741 - protein, 6 aa, Mycobacterium
GTDRPC

SEQ ID NO: 1336742 - protein, 9 aa, Mycobacterium
GTDTPTEVS

SEQ ID NO: 1336743 - protein, 6 aa, Mycobacterium
GTERGL

SEQ ID NO: 1336744 - protein, 10 aa, Mycobacterium
GTEVKPTSGH

SEQ ID NO: 1336745 - protein, 9 aa, Mycobacterium
GTGAAPLPD

SEQ ID NO: 1336746 - protein, 14 aa, Mycobacterium
GTGDLKDENDEPDL

SEQ ID NO: 1336747 - protein, 9 aa, Mycobacterium
GTGEAVGVG

SEQ ID NO: 1336748 - protein, 6 aa, Mycobacterium
GTGEEV

SEQ ID NO: 1336749 - protein, 11 aa, Mycobacterium
GTGRDGNPRST

SEQ ID NO: 1336750 - protein, 8 aa, Mycobacterium
GTLESNSP

SEQ ID NO: 1336751 - protein, 10 aa, Mycobacterium
GTPAGRTGTA

SEQ ID NO: 1336752 - protein, 7 aa, Mycobacterium
GTPASDV

SEQ ID NO: 1336753 - protein, 9 aa, Mycobacterium
GTPEAAGFD

SEQ ID NO: 1336754 - protein, 6 aa, Mycobacterium
GTPFTA

SEQ ID NO: 1336755 - protein, 11 aa, Mycobacterium
GTPGRDTTSDL

SEQ ID NO: 1336756 - protein, 4 aa, Mycobacterium
GTQF

SEQ ID NO: 1336757 - protein, 6 aa, Mycobacterium
GTRSAG

SEQ ID NO: 1336758 - protein, 10 aa, Mycobacterium
GTSEPAGIGR

SEQ ID NO: 1336759 - protein, 5 aa, Mycobacterium
GTSFE

SEQ ID NO: 1336760 - protein, 10 aa, Mycobacterium
GTSPDGAKDV

SEQ ID NO: 1336761 - protein, 7 aa, Mycobacterium
GTSPKAI

SEQ ID NO: 1336762 - protein, 7 aa, Mycobacterium
GTTNYGP

SEQ ID NO: 1336763 - protein, 25 aa, Mycobacterium
GTTPEDEDGESTGEPETETSADQLV

SEQ ID NO: 1336764 - protein, 5 aa, Mycobacterium
GTVEA

SEQ ID NO: 1336765 - protein, 6 aa, Mycobacterium
GTVSAE

SEQ ID NO: 1336766 - protein, 5 aa, Mycobacterium
GTVSL

SEQ ID NO: 1336767 - protein, 6 aa, Mycobacterium
GTVSLD

SEQ ID NO: 1336768 - protein, 6 aa, Mycobacterium
GTWSGA

SEQ ID NO: 1336769 - protein, 5 aa, Mycobacterium
GVAKA

SEQ ID NO: 1336770 - protein, 8 aa, Mycobacterium
GVEPGEAI

SEQ ID NO: 1336771 - protein, 7 aa, Mycobacterium
GVHPTDA

SEQ ID NO: 1336772 - protein, 10 aa, Mycobacterium
GVNSDGPSRN

SEQ ID NO: 1336773 - protein, 11 aa, Mycobacterium
GVPANPALPPL

SEQ ID NO: 1336774 - protein, 8 aa, Mycobacterium
GVPGPEIT

SEQ ID NO: 1336775 - protein, 7 aa, Mycobacterium
GVPPRND

SEQ ID NO: 1336776 - protein, 7 aa, Mycobacterium
GVQGGDA

SEQ ID NO: 1336777 - protein, 5 aa, Mycobacterium
GVQQG

SEQ ID NO: 1336778 - protein, 7 aa, Mycobacterium
GVRPADM

SEQ ID NO: 1336779 - protein, 12 aa, Mycobacterium
GVRPDSKPWHPS

SEQ ID NO: 1336780 - protein, 21 aa, Mycobacterium
GVTPPSAVGAKPQQVESGTDL

SEQ ID NO: 1336781 - protein, 7 aa, Mycobacterium
GWDSDAP

SEQ ID NO: 1336782 - protein, 9 aa, Mycobacterium
GYEARRDGA

SEQ ID NO: 1336783 - protein, 10 aa, Mycobacterium
GYGAGGPISH

SEQ ID NO: 1336784 - protein, 10 aa, Mycobacterium
GYGGGATALS

SEQ ID NO: 1336785 - protein, 6 aa, Mycobacterium
GYLNPS

SEQ ID NO: 1336786 - protein, 15 aa, Mycobacterium
GYPGMPAKPGPPVAD

SEQ ID NO: 1336787 - protein, 10 aa, Mycobacterium
GYPPRPPRNQ

SEQ ID NO: 1336788 - protein, 8 aa, Mycobacterium
GYTGDEAL

SEQ ID NO: 1336789 - protein, 5 aa, Mycobacterium
GYTPE

SEQ ID NO: 1336790 - protein, 8 aa, Mycobacterium
GYTQTDDT

SEQ ID NO: 1336791 - protein, 20 aa, Mycobacterium
GYYGDTRGRVTDESAPAGDG

SEQ ID NO: 1336792 - protein, 16 aa, Mycobacterium
GYYSTSQQFAESNPEV

SEQ ID NO: 1336793 - protein, 8 aa, Mycobacterium
HADPDAGD

SEQ ID NO: 1336794 - protein, 4 aa, Mycobacterium
HADT

SEQ ID NO: 1336795 - protein, 8 aa, Mycobacterium
HAEFSDTD

SEQ ID NO: 1336796 - protein, 78 aa, Mycobacterium
HAETESASSASESASGSESSGSVDAGPAKPQAEPDTEADETDDSTEDTSEDKPDKAGADKPSLSQKLRQSAKDFEAEQ

SEQ ID NO: 1336797 - protein, 14 aa, Mycobacterium
HAHGPDRAAGPLRQ

SEQ ID NO: 1336798 - protein, 12 aa, Mycobacterium
HDPRAGSYGDEA

SEQ ID NO: 1336799 - protein, 11 aa, Mycobacterium
HEASEQPAAAA

SEQ ID NO: 1336800 - protein, 5 aa, Mycobacterium
HEPVR

SEQ ID NO: 1336801 - protein, 13 aa, Mycobacterium
HERTGRTAGNGSL

SEQ ID NO: 1336802 - protein, 7 aa, Mycobacterium
HGASGVP

SEQ ID NO: 1336803 - protein, 12 aa, Mycobacterium
HGGAAPLPEDTH

SEQ ID NO: 1336804 - protein, 14 aa, Mycobacterium
HGGVGSPDKAPREY

SEQ ID NO: 1336805 - protein, 9 aa, Mycobacterium
HGLGSTGTN

SEQ ID NO: 1336806 - protein, 4 aa, Mycobacterium
HGNY

SEQ ID NO: 1336807 - protein, 9 aa, Mycobacterium
HGPDTTTYG

SEQ ID NO: 1336808 - protein, 8 aa, Mycobacterium
HGSDEGIE

SEQ ID NO: 1336809 - protein, 5 aa, Mycobacterium
HGSTI

SEQ ID NO: 1336810 - protein, 5 aa, Mycobacterium
HKPGA

SEQ ID NO: 1336811 - protein, 15 aa, Mycobacterium
HLGGNAYSEPEPQTG

SEQ ID NO: 1336812 - protein, 8 aa, Mycobacterium
HNVPPGRR

SEQ ID NO: 1336813 - protein, 18 aa, Mycobacterium
HPGAPSRRELYDAVVRSR

SEQ ID NO: 1336814 - protein, 6 aa, Mycobacterium
HPGSGY

SEQ ID NO: 1336815 - protein, 4 aa, Mycobacterium
HPVD

SEQ ID NO: 1336816 - protein, 7 aa, Mycobacterium
HPVGTGP

SEQ ID NO: 1336817 - protein, 6 aa, Mycobacterium
HRGGGE

SEQ ID NO: 1336818 - protein, 6 aa, Mycobacterium
HRGGGQ

SEQ ID NO: 1336819 - protein, 12 aa, Mycobacterium
HRHPSPNAGVAE

SEQ ID NO: 1336820 - protein, 11 aa, Mycobacterium
HRLGTSPEKDI

SEQ ID NO: 1336821 - protein, 5 aa, Mycobacterium
HRPAT

SEQ ID NO: 1336822 - protein, 10 aa, Mycobacterium
HRVSEDKIRE

SEQ ID NO: 1336823 - protein, 7 aa, Mycobacterium
HSKAERE

SEQ ID NO: 1336824 - protein, 5 aa, Mycobacterium
HTLGD

SEQ ID NO: 1336825 - protein, 15 aa, Mycobacterium
HTNGTSNAQKFSDPE

SEQ ID NO: 1336826 - protein, 8 aa, Mycobacterium
HTPGHTRG

SEQ ID NO: 1336827 - protein, 5 aa, Mycobacterium
HTPLE

SEQ ID NO: 1336828 - protein, 7 aa, Mycobacterium
IAAAEDA

SEQ ID NO: 1336829 - protein, 9 aa, Mycobacterium
IADETPAAF

SEQ ID NO: 1336830 - protein, 10 aa, Mycobacterium
IAENTSDAQV

SEQ ID NO: 1336831 - protein, 4 aa, Mycobacterium
IAGT

SEQ ID NO: 1336832 - protein, 11 aa, Mycobacterium
IANGDNADAKA

SEQ ID NO: 1336833 - protein, 11 aa, Mycobacterium
IAPAPPPPTYS

SEQ ID NO: 1336834 - protein, 12 aa, Mycobacterium
IARQAEAERERR

SEQ ID NO: 1336835 - protein, 8 aa, Mycobacterium
IATRPQAY

SEQ ID NO: 1336836 - protein, 6 aa, Mycobacterium
ICSAGD

SEQ ID NO: 1336837 - protein, 12 aa, Mycobacterium
ICSPADPNTWEG

SEQ ID NO: 1336838 - protein, 4 aa, Mycobacterium
IDAV

SEQ ID NO: 1336839 - protein, 10 aa, Mycobacterium
IDEADAAAGM

SEQ ID NO: 1336840 - protein, 6 aa, Mycobacterium
IDENSA

SEQ ID NO: 1336841 - protein, 5 aa, Mycobacterium
IDPEE

SEQ ID NO: 1336842 - protein, 11 aa, Mycobacterium
IDPGRNKTAPY

SEQ ID NO: 1336843 - protein, 29 aa, Mycobacterium
IDRDDADERPRGHTRRAKDDDGDTKSIRD

SEQ ID NO: 1336844 - protein, 4 aa, Mycobacterium
IDRQ

SEQ ID NO: 1336845 - protein, 13 aa, Mycobacterium
IDSTTTDATARTV

SEQ ID NO: 1336846 - protein, 4 aa, Mycobacterium
IEAA

SEQ ID NO: 1336847 - protein, 4 aa, Mycobacterium
IEDD

SEQ ID NO: 1336848 - protein, 19 aa, Mycobacterium
IEGAPETVTDTAGEQTAPN

SEQ ID NO: 1336849 - protein, 12 aa, Mycobacterium
IEKGTRAAEARY

SEQ ID NO: 1336850 - protein, 8 aa, Mycobacterium
IERRPDGK

SEQ ID NO: 1336851 - protein, 8 aa, Mycobacterium
IGAEAPAD

SEQ ID NO: 1336852 - protein, 8 aa, Mycobacterium
IGDRAAAE

SEQ ID NO: 1336853 - protein, 9 aa, Mycobacterium
IGGKPNPVF

SEQ ID NO: 1336854 - protein, 7 aa, Mycobacterium
IGGTDNT

SEQ ID NO: 1336855 - protein, 8 aa, Mycobacterium
IGPDDDPD

SEQ ID NO: 1336856 - protein, 4 aa, Mycobacterium
IGRT

SEQ ID NO: 1336857 - protein, 10 aa, Mycobacterium
IGSDGAGSVR

SEQ ID NO: 1336858 - protein, 11 aa, Mycobacterium
IGTSTPQGLRA

SEQ ID NO: 1336859 - protein, 12 aa, Mycobacterium
IGYPTGDSSLQN

SEQ ID NO: 1336860 - protein, 6 aa, Mycobacterium
IHSGDS

SEQ ID NO: 1336861 - protein, 10 aa, Mycobacterium
IKDNPNTAVN

SEQ ID NO: 1336862 - protein, 12 aa, Mycobacterium
IKHGDDDARLSE

SEQ ID NO: 1336863 - protein, 9 aa, Mycobacterium
INPPESTVN

SEQ ID NO: 1336864 - protein, 11 aa, Mycobacterium
INPSESCVSGG

SEQ ID NO: 1336865 - protein, 7 aa, Mycobacterium
INTGNGY

SEQ ID NO: 1336866 - protein, 5 aa, Mycobacterium
IPAEP

SEQ ID NO: 1336867 - protein, 5 aa, Mycobacterium
IPAES

SEQ ID NO: 1336868 - protein, 6 aa, Mycobacterium
IPAPGT

SEQ ID NO: 1336869 - protein, 8 aa, Mycobacterium
IPAQAETA

SEQ ID NO: 1336870 - protein, 10 aa, Mycobacterium
IPERAQPDGF

SEQ ID NO: 1336871 - protein, 5 aa, Mycobacterium
IPGGD

SEQ ID NO: 1336872 - protein, 7 aa, Mycobacterium
IPHDPGM

SEQ ID NO: 1336873 - protein, 8 aa, Mycobacterium
IPRTSGDQ

SEQ ID NO: 1336874 - protein, 14 aa, Mycobacterium
IPSASAQPQCTAAG

SEQ ID NO: 1336875 - protein, 18 aa, Mycobacterium
IPTPPGWQPYPGTQFEPG

SEQ ID NO: 1336876 - protein, 24 aa, Mycobacterium
IPTPPYPAAPGASASGSGVTPPGV

SEQ ID NO: 1336877 - protein, 12 aa, Mycobacterium
ISADGGSVPTST

SEQ ID NO: 1336878 - protein, 11 aa, Mycobacterium
ISDPDSTAAAL

SEQ ID NO: 1336879 - protein, 6 aa, Mycobacterium
ISDQTM

SEQ ID NO: 1336880 - protein, 9 aa, Mycobacterium
ISKEQVAKG

SEQ ID NO: 1336881 - protein, 7 aa, Mycobacterium
ISPAGSR

SEQ ID NO: 1336882 - protein, 5 aa, Mycobacterium
ISPPP

SEQ ID NO: 1336883 - protein, 9 aa, Mycobacterium
ITASGGRAL

SEQ ID NO: 1336884 - protein, 10 aa, Mycobacterium
ITDSRKEKVD

SEQ ID NO: 1336885 - protein, 6 aa, Mycobacterium
ITGAGE

SEQ ID NO: 1336886 - protein, 7 aa, Mycobacterium
ITSPEAC

SEQ ID NO: 1336887 - protein, 17 aa, Mycobacterium
ITTTEPVEERRAVTPEV

SEQ ID NO: 1336888 - protein, 21 aa, Mycobacterium
IVPAGKQLSTAAVDQGSQAGD

SEQ ID NO: 1336889 - protein, 6 aa, Mycobacterium
KAAGAE

SEQ ID NO: 1336890 - protein, 7 aa, Mycobacterium
KAASIED

SEQ ID NO: 1336891 - protein, 8 aa, Mycobacterium
KAATGREI

SEQ ID NO: 1336892 - protein, 7 aa, Mycobacterium
KADTADW

SEQ ID NO: 1336893 - protein, 14 aa, Mycobacterium
KAEAEARTPIEGPG

SEQ ID NO: 1336894 - protein, 8 aa, Mycobacterium
KAGGQPLA

SEQ ID NO: 1336895 - protein, 6 aa, Mycobacterium
KAGHTV

SEQ ID NO: 1336896 - protein, 7 aa, Mycobacterium
KAGQEVL

SEQ ID NO: 1336897 - protein, 9 aa, Mycobacterium
KAKAETASA

SEQ ID NO: 1336898 - protein, 9 aa, Mycobacterium
KAKTPTDNG

SEQ ID NO: 1336899 - protein, 15 aa, Mycobacterium
KALNVGGSNNKLTVT

SEQ ID NO: 1336900 - protein, 7 aa, Mycobacterium
KANPAAL

SEQ ID NO: 1336901 - protein, 8 aa, Mycobacterium
KASTDTIP

SEQ ID NO: 1336902 - protein, 6 aa, Mycobacterium
KATERL

SEQ ID NO: 1336903 - protein, 7 aa, Mycobacterium
KATFGGS

SEQ ID NO: 1336904 - protein, 7 aa, Mycobacterium
KATGRSM

SEQ ID NO: 1336905 - protein, 39 aa, Mycobacterium
KCEPNSVAPSGGAPGNFNSAGGHFQTEGKTGHPASGDLT

SEQ ID NO: 1336906 - protein, 8 aa, Mycobacterium
KCGPRGVA

SEQ ID NO: 1336907 - protein, 7 aa, Mycobacterium
KDANSTL

SEQ ID NO: 1336908 - protein, 6 aa, Mycobacterium
KDDGKC

SEQ ID NO: 1336909 - protein, 11 aa, Mycobacterium
KDENDPLGTTT

SEQ ID NO: 1336910 - protein, 17 aa, Mycobacterium
KDGPNTARGGQPVPGTS

SEQ ID NO: 1336911 - protein, 7 aa, Mycobacterium
KDNGRIR

SEQ ID NO: 1336912 - protein, 9 aa, Mycobacterium
KDNPEYKGG

SEQ ID NO: 1336913 - protein, 9 aa, Mycobacterium
KDSPLKPEL

SEQ ID NO: 1336914 - protein, 12 aa, Mycobacterium
KEEDDASKERLE

SEQ ID NO: 1336915 - protein, 13 aa, Mycobacterium
KEPEDYDALFAAT

SEQ ID NO: 1336916 - protein, 10 aa, Mycobacterium
KESPSGQRET

SEQ ID NO: 1336917 - protein, 4 aa, Mycobacterium
KEYR

SEQ ID NO: 1336918 - protein, 13 aa, Mycobacterium
KFPTEDDGQALRN

SEQ ID NO: 1336919 - protein, 10 aa, Mycobacterium
KGDGAEPAPA

SEQ ID NO: 1336920 - protein, 18 aa, Mycobacterium
KGDYEALGAGPDTEVRQE

SEQ ID NO: 1336921 - protein, 8 aa, Mycobacterium
KGGNLPGD

SEQ ID NO: 1336922 - protein, 9 aa, Mycobacterium
KGGTEKAEI

SEQ ID NO: 1336923 - protein, 16 aa, Mycobacterium
KGHETGQTAAGRTHPF

SEQ ID NO: 1336924 - protein, 6 aa, Mycobacterium
KGKTGL

SEQ ID NO: 1336925 - protein, 14 aa, Mycobacterium
KGLADNAGDDHAQN

SEQ ID NO: 1336926 - protein, 10 aa, Mycobacterium
KIDPRDIPGT

SEQ ID NO: 1336927 - protein, 17 aa, Mycobacterium
KIEEAPVKRGAPGAPTV

SEQ ID NO: 1336928 - protein, 8 aa, Mycobacterium
KIEPAGDK

SEQ ID NO: 1336929 - protein, 16 aa, Mycobacterium
KKADDAGIGNSRYNLP

SEQ ID NO: 1336930 - protein, 8 aa, Mycobacterium
KKDDSELR

SEQ ID NO: 1336931 - protein, 10 aa, Mycobacterium
KKGYDTKNGT

SEQ ID NO: 1336932 - protein, 9 aa, Mycobacterium
KKSPSPENL

SEQ ID NO: 1336933 - protein, 12 aa, Mycobacterium
KLAETGRSGGDV

SEQ ID NO: 1336934 - protein, 10 aa, Mycobacterium
KLGRSKPNAP

SEQ ID NO: 1336935 - protein, 5 aa, Mycobacterium
KLTSA

SEQ ID NO: 1336936 - protein, 5 aa, Mycobacterium
KLTTE

SEQ ID NO: 1336937 - protein, 4 aa, Mycobacterium
KMPG

SEQ ID NO: 1336938 - protein, 7 aa, Mycobacterium
KNLETGD

SEQ ID NO: 1336939 - protein, 18 aa, Mycobacterium
KNLGPAGITAPTPPPVDS

SEQ ID NO: 1336940 - protein, 7 aa, Mycobacterium
KPDPDKL

SEQ ID NO: 1336941 - protein, 4 aa, Mycobacterium
KPGW

SEQ ID NO: 1336942 - protein, 8 aa, Mycobacterium
KPIPNARE

SEQ ID NO: 1336943 - protein, 5 aa, Mycobacterium
KPITN

SEQ ID NO: 1336944 - protein, 5 aa, Mycobacterium
KPVDE

SEQ ID NO: 1336945 - protein, 4 aa, Mycobacterium
KRGY

SEQ ID NO: 1336946 - protein, 26 aa, Mycobacterium
KRNTTGAASDDDESDAPAKERPGQRF

SEQ ID NO: 1336947 - protein, 6 aa, Mycobacterium
KRTKAN

SEQ ID NO: 1336948 - protein, 5 aa, Mycobacterium
KSGEF

SEQ ID NO: 1336949 - protein, 5 aa, Mycobacterium
KSGKD

SEQ ID NO: 1336950 - protein, 9 aa, Mycobacterium
KSGKTRCQL

SEQ ID NO: 1336951 - protein, 7 aa, Mycobacterium
KSGPQYS

SEQ ID NO: 1336952 - protein, 9 aa, Mycobacterium
KSPDGKYQY

SEQ ID NO: 1336953 - protein, 6 aa, Mycobacterium
KSPTYN

SEQ ID NO: 1336954 - protein, 6 aa, Mycobacterium
KSYGPL

SEQ ID NO: 1336955 - protein, 5 aa, Mycobacterium
KTANA

SEQ ID NO: 1336956 - protein, 5 aa, Mycobacterium
KTPYH

SEQ ID NO: 1336957 - protein, 10 aa, Mycobacterium
KTRPSARSFG

SEQ ID NO: 1336958 - protein, 14 aa, Mycobacterium
KTTADTPPETLPPG

SEQ ID NO: 1336959 - protein, 5 aa, Mycobacterium
KTVGT

SEQ ID NO: 1336960 - protein, 7 aa, Mycobacterium
KTVQGAD

SEQ ID NO: 1336961 - protein, 11 aa, Mycobacterium
KVAAKSGGRDY

SEQ ID NO: 1336962 - protein, 8 aa, Mycobacterium
KVAPTNNV

SEQ ID NO: 1336963 - protein, 20 aa, Mycobacterium
KVGTGRTGLGPYATRPADVG

SEQ ID NO: 1336964 - protein, 6 aa, Mycobacterium
KVPAGT

SEQ ID NO: 1336965 - protein, 23 aa, Mycobacterium
LAAAAAPTSVPAAPPSVARADEA

SEQ ID NO: 1336966 - protein, 13 aa, Mycobacterium
LAAEAGLNPVKGP

SEQ ID NO: 1336967 - protein, 6 aa, Mycobacterium
LAAEGA

SEQ ID NO: 1336968 - protein, 12 aa, Mycobacterium
LAAGDPAALSRL

SEQ ID NO: 1336969 - protein, 14 aa, Mycobacterium
LAARGDDRSATEVA

SEQ ID NO: 1336970 - protein, 9 aa, Mycobacterium
LAATAQATQ

SEQ ID NO: 1336971 - protein, 6 aa, Mycobacterium
LADAGP

SEQ ID NO: 1336972 - protein, 7 aa, Mycobacterium
LADPGPF

SEQ ID NO: 1336973 - protein, 6 aa, Mycobacterium
LADTEN

SEQ ID NO: 1336974 - protein, 14 aa, Mycobacterium
LADTEPELAADPAR

SEQ ID NO: 1336975 - protein, 10 aa, Mycobacterium
LAEQASSMAE

SEQ ID NO: 1336976 - protein, 10 aa, Mycobacterium
LAGLGGGETI

SEQ ID NO: 1336977 - protein, 6 aa, Mycobacterium
LAGPHG

SEQ ID NO: 1336978 - protein, 8 aa, Mycobacterium
LAGQTPSE

SEQ ID NO: 1336979 - protein, 8 aa, Mycobacterium
LAGRGGGS

SEQ ID NO: 1336980 - protein, 10 aa, Mycobacterium
LAKGEQVDTK

SEQ ID NO: 1336981 - protein, 9 aa, Mycobacterium
LANEAGDGF

SEQ ID NO: 1336982 - protein, 69 aa, Mycobacterium
LAPNPRAGGDGTNGGDGGSGGSGGTGGAGGGTAAGGSGQAGRNGDGGAGGRGGNAGSAGNGGNGGNGLF

SEQ ID NO: 1336983 - protein, 11 aa, Mycobacterium
LAPPAAANEGP

SEQ ID NO: 1336984 - protein, 9 aa, Mycobacterium
LAPPTPAGM

SEQ ID NO: 1336985 - protein, 13 aa, Mycobacterium
LAPPVEPPSADEL

SEQ ID NO: 1336986 - protein, 11 aa, Mycobacterium
LAQARPSDPGV

SEQ ID NO: 1336987 - protein, 12 aa, Mycobacterium
LARPDGTRRGSP

SEQ ID NO: 1336988 - protein, 8 aa, Mycobacterium
LASSPSAN

SEQ ID NO: 1336989 - protein, 8 aa, Mycobacterium
LATSPNTA

SEQ ID NO: 1336990 - protein, 10 aa, Mycobacterium
LDAPGPSAGP

SEQ ID NO: 1336991 - protein, 5 aa, Mycobacterium
LDGPV

SEQ ID NO: 1336992 - protein, 9 aa, Mycobacterium
LDGRDADRF

SEQ ID NO: 1336993 - protein, 8 aa, Mycobacterium
LDGSTPAL

SEQ ID NO: 1336994 - protein, 14 aa, Mycobacterium
LDNGAGDPAHKDPE

SEQ ID NO: 1336995 - protein, 16 aa, Mycobacterium
LDPAAESEVAPQAERP

SEQ ID NO: 1336996 - protein, 13 aa, Mycobacterium
LDPAKAQQKANEV

SEQ ID NO: 1336997 - protein, 8 aa, Mycobacterium
LDPANTRI

SEQ ID NO: 1336998 - protein, 6 aa, Mycobacterium
LDPATD

SEQ ID NO: 1336999 - protein, 8 aa, Mycobacterium
LDPEQKAH

SEQ ID NO: 1337000 - protein, 11 aa, Mycobacterium
LDPIDGATGTV

SEQ ID NO: 1337001 - protein, 10 aa, Mycobacterium
LDSKSARAVL

SEQ ID NO: 1337002 - protein, 7 aa, Mycobacterium
LDSPEVK

SEQ ID NO: 1337003 - protein, 10 aa, Mycobacterium
LDTASAAPVG

SEQ ID NO: 1337004 - protein, 6 aa, Mycobacterium
LDTGPT

SEQ ID NO: 1337005 - protein, 9 aa, Mycobacterium
LDTPPAPIP

SEQ ID NO: 1337006 - protein, 8 aa, Mycobacterium
LEAGRGDT

SEQ ID NO: 1337007 - protein, 5 aa, Mycobacterium
LEDAT

SEQ ID NO: 1337008 - protein, 5 aa, Mycobacterium
LEGGE

SEQ ID NO: 1337009 - protein, 16 aa, Mycobacterium
LEGVGEETAARRGTDP

SEQ ID NO: 1337010 - protein, 9 aa, Mycobacterium
LEKQGLENY

SEQ ID NO: 1337011 - protein, 7 aa, Mycobacterium
LEPGGSH

SEQ ID NO: 1337012 - protein, 9 aa, Mycobacterium
LEPSAGNSV

SEQ ID NO: 1337013 - protein, 4 aa, Mycobacterium
LEPT

SEQ ID NO: 1337014 - protein, 6 aa, Mycobacterium
LEQAPE

SEQ ID NO: 1337015 - protein, 9 aa, Mycobacterium
LEQQAGRKI

SEQ ID NO: 1337016 - protein, 5 aa, Mycobacterium
LERGD

SEQ ID NO: 1337017 - protein, 7 aa, Mycobacterium
LETAPKA

SEQ ID NO: 1337018 - protein, 21 aa, Mycobacterium
LETPDLAGNVQPDDVAAGEQE

SEQ ID NO: 1337019 - protein, 7 aa, Mycobacterium
LGAGGTE

SEQ ID NO: 1337020 - protein, 8 aa, Mycobacterium
LGAGPASR

SEQ ID NO: 1337021 - protein, 15 aa, Mycobacterium
LGAPTSPEAAGEGTA

SEQ ID NO: 1337022 - protein, 8 aa, Mycobacterium
LGDATSGN

SEQ ID NO: 1337023 - protein, 5 aa, Mycobacterium
LGHTP

SEQ ID NO: 1337024 - protein, 5 aa, Mycobacterium
LGLPD

SEQ ID NO: 1337025 - protein, 5 aa, Mycobacterium
LGLPG

SEQ ID NO: 1337026 - protein, 7 aa, Mycobacterium
LGPDPAF

SEQ ID NO: 1337027 - protein, 6 aa, Mycobacterium
LGPERT

SEQ ID NO: 1337028 - protein, 8 aa, Mycobacterium
LGRGGTME

SEQ ID NO: 1337029 - protein, 10 aa, Mycobacterium
LGRPQSFDDA

SEQ ID NO: 1337030 - protein, 21 aa, Mycobacterium
LGRRDAKAAAQQTDDPGAAEP

SEQ ID NO: 1337031 - protein, 4 aa, Mycobacterium
LGSC

SEQ ID NO: 1337032 - protein, 5 aa, Mycobacterium
LGTET

SEQ ID NO: 1337033 - protein, 7 aa, Mycobacterium
LGTGPYT

SEQ ID NO: 1337034 - protein, 9 aa, Mycobacterium
LGTNPDRDY

SEQ ID NO: 1337035 - protein, 11 aa, Mycobacterium
LGTVGDDGTGI

SEQ ID NO: 1337036 - protein, 8 aa, Mycobacterium
LKADQLPK

SEQ ID NO: 1337037 - protein, 7 aa, Mycobacterium
LKTDDRA

SEQ ID NO: 1337038 - protein, 7 aa, Mycobacterium
LLSPDSY

SEQ ID NO: 1337039 - protein, 9 aa, Mycobacterium
LNASQENWR

SEQ ID NO: 1337040 - protein, 7 aa, Mycobacterium
LNDPDTP

SEQ ID NO: 1337041 - protein, 4 aa, Mycobacterium
LNDS

SEQ ID NO: 1337042 - protein, 11 aa, Mycobacterium
LNGDPTQAGAA

SEQ ID NO: 1337043 - protein, 6 aa, Mycobacterium
LNGEGI

SEQ ID NO: 1337044 - protein, 7 aa, Mycobacterium
LNGREDK

SEQ ID NO: 1337045 - protein, 7 aa, Mycobacterium
LNNPIGT

SEQ ID NO: 1337046 - protein, 5 aa, Mycobacterium
LNPPS

SEQ ID NO: 1337047 - protein, 21 aa, Mycobacterium
LNSPDVAASVQPDDVAAGEQE

SEQ ID NO: 1337048 - protein, 10 aa, Mycobacterium
LPADALSTTA

SEQ ID NO: 1337049 - protein, 7 aa, Mycobacterium
LPAPKGP

SEQ ID NO: 1337050 - protein, 5 aa, Mycobacterium
LPDDR

SEQ ID NO: 1337051 - protein, 5 aa, Mycobacterium
LPDQR

SEQ ID NO: 1337052 - protein, 5 aa, Mycobacterium
LPDST

SEQ ID NO: 1337053 - protein, 6 aa, Mycobacterium
LPEDGT

SEQ ID NO: 1337054 - protein, 7 aa, Mycobacterium
LPEQAAS

SEQ ID NO: 1337055 - protein, 10 aa, Mycobacterium
LPGKRSKRIG

SEQ ID NO: 1337056 - protein, 16 aa, Mycobacterium
LPGTARDYDPESNESL

SEQ ID NO: 1337057 - protein, 6 aa, Mycobacterium
LPKEEV

SEQ ID NO: 1337058 - protein, 12 aa, Mycobacterium
LPNSPRTEPRVG

SEQ ID NO: 1337059 - protein, 21 aa, Mycobacterium
LPPASSHTPPVQLERFTAPIN

SEQ ID NO: 1337060 - protein, 7 aa, Mycobacterium
LPPEQAR

SEQ ID NO: 1337061 - protein, 6 aa, Mycobacterium
LPPEQL

SEQ ID NO: 1337062 - protein, 4 aa, Mycobacterium
LPPG

SEQ ID NO: 1337063 - protein, 20 aa, Mycobacterium
LPPTDPRYVDGGPGSQVPSV

SEQ ID NO: 1337064 - protein, 19 aa, Mycobacterium
LPRPSTAAVNSVPDDASPR

SEQ ID NO: 1337065 - protein, 8 aa, Mycobacterium
LPSPTHER

SEQ ID NO: 1337066 - protein, 8 aa, Mycobacterium
LQDAGAPV

SEQ ID NO: 1337067 - protein, 13 aa, Mycobacterium
LQNGATPDTQLTA

SEQ ID NO: 1337068 - protein, 7 aa, Mycobacterium
LQPGDTI

SEQ ID NO: 1337069 - protein, 7 aa, Mycobacterium
LQQGDEK

SEQ ID NO: 1337070 - protein, 11 aa, Mycobacterium
LRGRTRAQPGC

SEQ ID NO: 1337071 - protein, 7 aa, Mycobacterium
LRGTGVS

SEQ ID NO: 1337072 - protein, 7 aa, Mycobacterium
LRNDEAG

SEQ ID NO: 1337073 - protein, 10 aa, Mycobacterium
LRNPDGSMSG

SEQ ID NO: 1337074 - protein, 8 aa, Mycobacterium
LRPDETTF

SEQ ID NO: 1337075 - protein, 5 aa, Mycobacterium
LRPED

SEQ ID NO: 1337076 - protein, 9 aa, Mycobacterium
LRPTRRGDL

SEQ ID NO: 1337077 - protein, 8 aa, Mycobacterium
LRQPDPGH

SEQ ID NO: 1337078 - protein, 22 aa, Mycobacterium
LRTGPGDALGGDGSPAPGDGAH

SEQ ID NO: 1337079 - protein, 8 aa, Mycobacterium
LSAGTENL

SEQ ID NO: 1337080 - protein, 12 aa, Mycobacterium
LSAPTDGPRLGG

SEQ ID NO: 1337081 - protein, 7 aa, Mycobacterium
LSDGWSE

SEQ ID NO: 1337082 - protein, 5 aa, Mycobacterium
LSDPE

SEQ ID NO: 1337083 - protein, 6 aa, Mycobacterium
LSDRTD

SEQ ID NO: 1337084 - protein, 5 aa, Mycobacterium
LSETD

SEQ ID NO: 1337085 - protein, 22 aa, Mycobacterium
LSGQAADPFKIPPGTATQHEAA

SEQ ID NO: 1337086 - protein, 7 aa, Mycobacterium
LSPQGLE

SEQ ID NO: 1337087 - protein, 7 aa, Mycobacterium
LSQIGGK

SEQ ID NO: 1337088 - protein, 8 aa, Mycobacterium
LSTATSAD

SEQ ID NO: 1337089 - protein, 9 aa, Mycobacterium
LSTTDPHSR

SEQ ID NO: 1337090 - protein, 12 aa, Mycobacterium
LSTTPEQVTQAG

SEQ ID NO: 1337091 - protein, 17 aa, Mycobacterium
LTATSGQALADGATYGV

SEQ ID NO: 1337092 - protein, 10 aa, Mycobacterium
LTDPAASVPG

SEQ ID NO: 1337093 - protein, 10 aa, Mycobacterium
LTPDQQRTSP

SEQ ID NO: 1337094 - protein, 14 aa, Mycobacterium
LTPPAPGGYDPDSV

SEQ ID NO: 1337095 - protein, 22 aa, Mycobacterium
LTPREEPPADEGKTRKRRGPSG

SEQ ID NO: 1337096 - protein, 6 aa, Mycobacterium
LTPRGT

SEQ ID NO: 1337097 - protein, 9 aa, Mycobacterium
LTSNTTEVV

SEQ ID NO: 1337098 - protein, 8 aa, Mycobacterium
LTSSAPAT

SEQ ID NO: 1337099 - protein, 6 aa, Mycobacterium
LTTTTV

SEQ ID NO: 1337100 - protein, 7 aa, Mycobacterium
MADGQRG

SEQ ID NO: 1337101 - protein, 7 aa, Mycobacterium
MAEDPPT

SEQ ID NO: 1337102 - protein, 12 aa, Mycobacterium
MAERAAAERSTG

SEQ ID NO: 1337103 - protein, 11 aa, Mycobacterium
MAGTAHSGWAA

SEQ ID NO: 1337104 - protein, 6 aa, Mycobacterium
MARGEA

SEQ ID NO: 1337105 - protein, 5 aa, Mycobacterium
MATPN

SEQ ID NO: 1337106 - protein, 11 aa, Mycobacterium
MDADPQKPWTP

SEQ ID NO: 1337107 - protein, 8 aa, Mycobacterium
MDSDKAVD

SEQ ID NO: 1337108 - protein, 13 aa, Mycobacterium
MEPQTPEATPPES

SEQ ID NO: 1337109 - protein, 8 aa, Mycobacterium
MESSGAWK

SEQ ID NO: 1337110 - protein, 4 aa, Mycobacterium
MGGS

SEQ ID NO: 1337111 - protein, 10 aa, Mycobacterium
MGGTETIGGT

SEQ ID NO: 1337112 - protein, 5 aa, Mycobacterium
MGGYG

SEQ ID NO: 1337113 - protein, 8 aa, Mycobacterium
MKNPADSA

SEQ ID NO: 1337114 - protein, 6 aa, Mycobacterium
MNQEPY

SEQ ID NO: 1337115 - protein, 12 aa, Mycobacterium
MPGTAGHGAGSY

SEQ ID NO: 1337116 - protein, 4 aa, Mycobacterium
MQPQ

SEQ ID NO: 1337117 - protein, 7 aa, Mycobacterium
MQTPDPQ

SEQ ID NO: 1337118 - protein, 5 aa, Mycobacterium
MSGAT

SEQ ID NO: 1337119 - protein, 11 aa, Mycobacterium
MSQGADGQLSG

SEQ ID NO: 1337120 - protein, 9 aa, Mycobacterium
MTATPEAFN

SEQ ID NO: 1337121 - protein, 4 aa, Mycobacterium
MTGD

SEQ ID NO: 1337122 - protein, 12 aa, Mycobacterium
MTNRRSIEHQPI

SEQ ID NO: 1337123 - protein, 6 aa, Mycobacterium
NAAELD

SEQ ID NO: 1337124 - protein, 7 aa, Mycobacterium
NADAEGA

SEQ ID NO: 1337125 - protein, 7 aa, Mycobacterium
NADTSTA

SEQ ID NO: 1337126 - protein, 7 aa, Mycobacterium
NAGASNK

SEQ ID NO: 1337127 - protein, 7 aa, Mycobacterium
NAGEVDG

SEQ ID NO: 1337128 - protein, 7 aa, Mycobacterium
NAGRAGK

SEQ ID NO: 1337129 - protein, 10 aa, Mycobacterium
NAHGTVTGAA

SEQ ID NO: 1337130 - protein, 12 aa, Mycobacterium
NALGQGSTCPPW

SEQ ID NO: 1337131 - protein, 13 aa, Mycobacterium
NAMAGNGDKLRET

SEQ ID NO: 1337132 - protein, 6 aa, Mycobacterium
NAPARS

SEQ ID NO: 1337133 - protein, 10 aa, Mycobacterium
NAPPGPEDLA

SEQ ID NO: 1337134 - protein, 5 aa, Mycobacterium
NAPQT

SEQ ID NO: 1337135 - protein, 12 aa, Mycobacterium
NAQGSAAPLTRE

SEQ ID NO: 1337136 - protein, 10 aa, Mycobacterium
NAQPVEAPEG

SEQ ID NO: 1337137 - protein, 11 aa, Mycobacterium
NARGGPGGRPG

SEQ ID NO: 1337138 - protein, 5 aa, Mycobacterium
NARNA

SEQ ID NO: 1337139 - protein, 9 aa, Mycobacterium
NASAGLANK

SEQ ID NO: 1337140 - protein, 8 aa, Mycobacterium
NATAPEAS

SEQ ID NO: 1337141 - protein, 4 aa, Mycobacterium
NDAA

SEQ ID NO: 1337142 - protein, 10 aa, Mycobacterium
NDAERPFSRD

SEQ ID NO: 1337143 - protein, 4 aa, Mycobacterium
NDAQ

SEQ ID NO: 1337144 - protein, 9 aa, Mycobacterium
NDARGNPVA

SEQ ID NO: 1337145 - protein, 5 aa, Mycobacterium
NDDGD

SEQ ID NO: 1337146 - protein, 9 aa, Mycobacterium
NDEERPFTR

SEQ ID NO: 1337147 - protein, 9 aa, Mycobacterium
NDGETVGVG

SEQ ID NO: 1337148 - protein, 5 aa, Mycobacterium
NDLTN

SEQ ID NO: 1337149 - protein, 6 aa, Mycobacterium
NDMSSR

SEQ ID NO: 1337150 - protein, 5 aa, Mycobacterium
NDPRN

SEQ ID NO: 1337151 - protein, 9 aa, Mycobacterium
NDSPDQPDK

SEQ ID NO: 1337152 - protein, 6 aa, Mycobacterium
NDTDTV

SEQ ID NO: 1337153 - protein, 9 aa, Mycobacterium
NDTHRNSGY

SEQ ID NO: 1337154 - protein, 6 aa, Mycobacterium
NEASRV

SEQ ID NO: 1337155 - protein, 5 aa, Mycobacterium
NEEQL

SEQ ID NO: 1337156 - protein, 14 aa, Mycobacterium
NEGAPGRGPRLAPG

SEQ ID NO: 1337157 - protein, 16 aa, Mycobacterium
NEKAYPYAGRARPVPR

SEQ ID NO: 1337158 - protein, 8 aa, Mycobacterium
NENTPEVG

SEQ ID NO: 1337159 - protein, 4 aa, Mycobacterium
NETF

SEQ ID NO: 1337160 - protein, 8 aa, Mycobacterium
NETSSMRA

SEQ ID NO: 1337161 - protein, 4 aa, Mycobacterium
NFGI

SEQ ID NO: 1337162 - protein, 8 aa, Mycobacterium
NGDHSARV

SEQ ID NO: 1337163 - protein, 9 aa, Mycobacterium
NGDPTESER

SEQ ID NO: 1337164 - protein, 8 aa, Mycobacterium
NGEVTPPI

SEQ ID NO: 1337165 - protein, 29 aa, Mycobacterium
NGGAGGAGAAGVAGVRGGDGGAGGAGGHA

SEQ ID NO: 1337166 - protein, 10 aa, Mycobacterium
NGGGFPTGRE

SEQ ID NO: 1337167 - protein, 29 aa, Mycobacterium
NGGNRLSATGGQVAAPIGRATIAAALREG

SEQ ID NO: 1337168 - protein, 8 aa, Mycobacterium
NGKGGQPV

SEQ ID NO: 1337169 - protein, 6 aa, Mycobacterium
NGNGNQ

SEQ ID NO: 1337170 - protein, 7 aa, Mycobacterium
NGPTSSQ

SEQ ID NO: 1337171 - protein, 25 aa, Mycobacterium
NGTAKDLAGAGDVRGKTGEAEFAGG

SEQ ID NO: 1337172 - protein, 7 aa, Mycobacterium
NGVETGR

SEQ ID NO: 1337173 - protein, 43 aa, Mycobacterium
NGVPAEAPAAEVPAEAPAATPDGAQVPGEAESAETAPADSAPI

SEQ ID NO: 1337174 - protein, 4 aa, Mycobacterium
NHEP

SEQ ID NO: 1337175 - protein, 6 aa, Mycobacterium
NIDGTE

SEQ ID NO: 1337176 - protein, 15 aa, Mycobacterium
NKDSGSITKIYTQAT

SEQ ID NO: 1337177 - protein, 10 aa, Mycobacterium
NKGVNPNRNA

SEQ ID NO: 1337178 - protein, 8 aa, Mycobacterium
NKGVPGVK

SEQ ID NO: 1337179 - protein, 12 aa, Mycobacterium
NLPSPVEANASV

SEQ ID NO: 1337180 - protein, 10 aa, Mycobacterium
NNAGPTGRTA

SEQ ID NO: 1337181 - protein, 11 aa, Mycobacterium
NNDVSTQASQV

SEQ ID NO: 1337182 - protein, 6 aa, Mycobacterium
NNTPVA

SEQ ID NO: 1337183 - protein, 42 aa, Mycobacterium
NPAAEGGVRTTGKGVANAGPSDVRRSRKGAPLPPAGGEVKDS

SEQ ID NO: 1337184 - protein, 4 aa, Mycobacterium
NPAG

SEQ ID NO: 1337185 - protein, 6 aa, Mycobacterium
NPAGDG

SEQ ID NO: 1337186 - protein, 5 aa, Mycobacterium
NPATI

SEQ ID NO: 1337187 - protein, 11 aa, Mycobacterium
NPATKFGNPVN

SEQ ID NO: 1337188 - protein, 12 aa, Mycobacterium
NPATLGPNMRGK

SEQ ID NO: 1337189 - protein, 6 aa, Mycobacterium
NPCRTP

SEQ ID NO: 1337190 - protein, 9 aa, Mycobacterium
NPDAAHPDT

SEQ ID NO: 1337191 - protein, 11 aa, Mycobacterium
NPGGPGASAVD

SEQ ID NO: 1337192 - protein, 5 aa, Mycobacterium
NPKDG

SEQ ID NO: 1337193 - protein, 8 aa, Mycobacterium
NPLGTGGQ

SEQ ID NO: 1337194 - protein, 20 aa, Mycobacterium
NPQTPRVAAPAAAPRPATGC

SEQ ID NO: 1337195 - protein, 7 aa, Mycobacterium
NPRASRT

SEQ ID NO: 1337196 - protein, 34 aa, Mycobacterium
NPRFATDNGARPQGQPETTQQQAGPPAVEAPKNE

SEQ ID NO: 1337197 - protein, 15 aa, Mycobacterium
NPTDGPSSIENEADE

SEQ ID NO: 1337198 - protein, 11 aa, Mycobacterium
NPTGESATGRV

SEQ ID NO: 1337199 - protein, 5 aa, Mycobacterium
NPYRF

SEQ ID NO: 1337200 - protein, 7 aa, Mycobacterium
NQGPGFP

SEQ ID NO: 1337201 - protein, 7 aa, Mycobacterium
NQQREDL

SEQ ID NO: 1337202 - protein, 8 aa, Mycobacterium
NRDGPVKN

SEQ ID NO: 1337203 - protein, 5 aa, Mycobacterium
NRDKR

SEQ ID NO: 1337204 - protein, 9 aa, Mycobacterium
NRGHRADAH

SEQ ID NO: 1337205 - protein, 10 aa, Mycobacterium
NRGQDPRGNA

SEQ ID NO: 1337206 - protein, 5 aa, Mycobacterium
NRPVQ

SEQ ID NO: 1337207 - protein, 6 aa, Mycobacterium
NRSPRY

SEQ ID NO: 1337208 - protein, 4 aa, Mycobacterium
NRTY

SEQ ID NO: 1337209 - protein, 10 aa, Mycobacterium
NSARSGSLDP

SEQ ID NO: 1337210 - protein, 6 aa, Mycobacterium
NSDRCA

SEQ ID NO: 1337211 - protein, 5 aa, Mycobacterium
NSPAM

SEQ ID NO: 1337212 - protein, 9 aa, Mycobacterium
NSPGGGYDL

SEQ ID NO: 1337213 - protein, 5 aa, Mycobacterium
NSSQL

SEQ ID NO: 1337214 - protein, 4 aa, Mycobacterium
NSTV

SEQ ID NO: 1337215 - protein, 4 aa, Mycobacterium
NTCE

SEQ ID NO: 1337216 - protein, 7 aa, Mycobacterium
NTGEGGI

SEQ ID NO: 1337217 - protein, 5 aa, Mycobacterium
NTGVG

SEQ ID NO: 1337218 - protein, 5 aa, Mycobacterium
NTKGS

SEQ ID NO: 1337219 - protein, 5 aa, Mycobacterium
NTKTM

SEQ ID NO: 1337220 - protein, 4 aa, Mycobacterium
NTLA

SEQ ID NO: 1337221 - protein, 10 aa, Mycobacterium
NTNAENPNTR

SEQ ID NO: 1337222 - protein, 8 aa, Mycobacterium
NTNRAGGG

SEQ ID NO: 1337223 - protein, 4 aa, Mycobacterium
NTPV

SEQ ID NO: 1337224 - protein, 5 aa, Mycobacterium
NTTQF

SEQ ID NO: 1337225 - protein, 6 aa, Mycobacterium
NVESGR

SEQ ID NO: 1337226 - protein, 7 aa, Mycobacterium
NVPPGGA

SEQ ID NO: 1337227 - protein, 9 aa, Mycobacterium
PAAAADPLD

SEQ ID NO: 1337228 - protein, 12 aa, Mycobacterium
PAAAAPTSDAQG

SEQ ID NO: 1337229 - protein, 52 aa, Mycobacterium
PAAAPDAVSPSGTSTTATTSSTESTPTTEPTPLPAEQTPAAAADIPAADAPI

SEQ ID NO: 1337230 - protein, 16 aa, Mycobacterium
PAAGATPPAPPAPPAA

SEQ ID NO: 1337231 - protein, 9 aa, Mycobacterium
PAAGGPAPL

SEQ ID NO: 1337232 - protein, 7 aa, Mycobacterium
PAAGYAN

SEQ ID NO: 1337233 - protein, 7 aa, Mycobacterium
PAANSAG

SEQ ID NO: 1337234 - protein, 9 aa, Mycobacterium
PAAPDPKGV

SEQ ID NO: 1337235 - protein, 5 aa, Mycobacterium
PADTE

SEQ ID NO: 1337236 - protein, 10 aa, Mycobacterium
PAEELRSARS

SEQ ID NO: 1337237 - protein, 5 aa, Mycobacterium
PAESE

SEQ ID NO: 1337238 - protein, 4 aa, Mycobacterium
PAGQ

SEQ ID NO: 1337239 - protein, 8 aa, Mycobacterium
PAGQQGEL

SEQ ID NO: 1337240 - protein, 13 aa, Mycobacterium
PAGVSEREYYQTP

SEQ ID NO: 1337241 - protein, 4 aa, Mycobacterium
PAHA

SEQ ID NO: 1337242 - protein, 21 aa, Mycobacterium
PALAPGGAGGSPTPPETPPAV

SEQ ID NO: 1337243 - protein, 7 aa, Mycobacterium
PANSTSQ

SEQ ID NO: 1337244 - protein, 32 aa, Mycobacterium
PAPAAADPFAPTAQPLPIPEGTPAGQNPTPYV

SEQ ID NO: 1337245 - protein, 14 aa, Mycobacterium
PAPADATGPRGAAT

SEQ ID NO: 1337246 - protein, 11 aa, Mycobacterium
PAPAEARATTY

SEQ ID NO: 1337247 - protein, 5 aa, Mycobacterium
PAPAR

SEQ ID NO: 1337248 - protein, 4 aa, Mycobacterium
PAPG

SEQ ID NO: 1337249 - protein, 18 aa, Mycobacterium
PAQAAPAGPGNAQNTIEQ

SEQ ID NO: 1337250 - protein, 24 aa, Mycobacterium
PAQAAPSGTGNAADTISSLDDRGY

SEQ ID NO: 1337251 - protein, 15 aa, Mycobacterium
PARAPKRRGGDGHDG

SEQ ID NO: 1337252 - protein, 10 aa, Mycobacterium
PASSDSTRQA

SEQ ID NO: 1337253 - protein, 10 aa, Mycobacterium
PATSTTDPDP

SEQ ID NO: 1337254 - protein, 11 aa, Mycobacterium
PAYESSGPVLP

SEQ ID NO: 1337255 - protein, 10 aa, Mycobacterium
PDAADDDVDA

SEQ ID NO: 1337256 - protein, 11 aa, Mycobacterium
PDADQPSETGP

SEQ ID NO: 1337257 - protein, 17 aa, Mycobacterium
PDALNGTWKAPQVVKVN

SEQ ID NO: 1337258 - protein, 4 aa, Mycobacterium
PDEA

SEQ ID NO: 1337259 - protein, 10 aa, Mycobacterium
PDGPAARNGA

SEQ ID NO: 1337260 - protein, 4 aa, Mycobacterium
PDGR

SEQ ID NO: 1337261 - protein, 12 aa, Mycobacterium
PDGRKTTMQTTG

SEQ ID NO: 1337262 - protein, 5 aa, Mycobacterium
PDGRR

SEQ ID NO: 1337263 - protein, 27 aa, Mycobacterium
PDGSMTDPASTTLTGEDQTTGPSGACG

SEQ ID NO: 1337264 - protein, 7 aa, Mycobacterium
PDIDGED

SEQ ID NO: 1337265 - protein, 7 aa, Mycobacterium
PDKQPDC

SEQ ID NO: 1337266 - protein, 8 aa, Mycobacterium
PDMGMPSK

SEQ ID NO: 1337267 - protein, 7 aa, Mycobacterium
PDPDGGY

SEQ ID NO: 1337268 - protein, 7 aa, Mycobacterium
PDPEGDE

SEQ ID NO: 1337269 - protein, 4 aa, Mycobacterium
PDVA

SEQ ID NO: 1337270 - protein, 14 aa, Mycobacterium
PDVQPQPAAQESPQ

SEQ ID NO: 1337271 - protein, 4 aa, Mycobacterium
PDVR

SEQ ID NO: 1337272 - protein, 10 aa, Mycobacterium
PEDPSPEKLR

SEQ ID NO: 1337273 - protein, 9 aa, Mycobacterium
PEDQVGEDG

SEQ ID NO: 1337274 - protein, 16 aa, Mycobacterium
PEGVPPAALQREPALP

SEQ ID NO: 1337275 - protein, 11 aa, Mycobacterium
PELDGAPAAYA

SEQ ID NO: 1337276 - protein, 10 aa, Mycobacterium
PELGPAANSY

SEQ ID NO: 1337277 - protein, 4 aa, Mycobacterium
PELT

SEQ ID NO: 1337278 - protein, 21 aa, Mycobacterium
PELTETSDGVDTVDPSPSAGG

SEQ ID NO: 1337279 - protein, 9 aa, Mycobacterium
PEMKSTGEV

SEQ ID NO: 1337280 - protein, 5 aa, Mycobacterium
PEPGW

SEQ ID NO: 1337281 - protein, 7 aa, Mycobacterium
PEPLDGL

SEQ ID NO: 1337282 - protein, 7 aa, Mycobacterium
PEPPRPQ

SEQ ID NO: 1337283 - protein, 4 aa, Mycobacterium
PEQI

SEQ ID NO: 1337284 - protein, 14 aa, Mycobacterium
PERAPGPALNGRPV

SEQ ID NO: 1337285 - protein, 4 aa, Mycobacterium
PESP

SEQ ID NO: 1337286 - protein, 6 aa, Mycobacterium
PESTEV

SEQ ID NO: 1337287 - protein, 11 aa, Mycobacterium
PETVSTDYDTA

SEQ ID NO: 1337288 - protein, 5 aa, Mycobacterium
PFGGP

SEQ ID NO: 1337289 - protein, 16 aa, Mycobacterium
PFGGTTTGAAQQKTEV

SEQ ID NO: 1337290 - protein, 4 aa, Mycobacterium
PFVE

SEQ ID NO: 1337291 - protein, 5 aa, Mycobacterium
PGAAQ

SEQ ID NO: 1337292 - protein, 10 aa, Mycobacterium
PGADATLTTT

SEQ ID NO: 1337293 - protein, 4 aa, Mycobacterium
PGAV

SEQ ID NO: 1337294 - protein, 16 aa, Mycobacterium
PGDPNGACGVASDAGG

SEQ ID NO: 1337295 - protein, 11 aa, Mycobacterium
PGGPGESGVEA

SEQ ID NO: 1337296 - protein, 7 aa, Mycobacterium
PGKESHP

SEQ ID NO: 1337297 - protein, 6 aa, Mycobacterium
PGLDEA

SEQ ID NO: 1337298 - protein, 8 aa, Mycobacterium
PGNPKNIR

SEQ ID NO: 1337299 - protein, 8 aa, Mycobacterium
PGNSHGTW

SEQ ID NO: 1337300 - protein, 11 aa, Mycobacterium
PGPAGPDGNYK

SEQ ID NO: 1337301 - protein, 7 aa, Mycobacterium
PGPSAVT

SEQ ID NO: 1337302 - protein, 7 aa, Mycobacterium
PGQQQER

SEQ ID NO: 1337303 - protein, 5 aa, Mycobacterium
PGQRA

SEQ ID NO: 1337304 - protein, 7 aa, Mycobacterium
PGRANGG

SEQ ID NO: 1337305 - protein, 9 aa, Mycobacterium
PGRGNGAGW

SEQ ID NO: 1337306 - protein, 6 aa, Mycobacterium
PGRGPR

SEQ ID NO: 1337307 - protein, 10 aa, Mycobacterium
PGRPDDDAAA

SEQ ID NO: 1337308 - protein, 7 aa, Mycobacterium
PGSSAHG

SEQ ID NO: 1337309 - protein, 4 aa, Mycobacterium
PGTK

SEQ ID NO: 1337310 - protein, 7 aa, Mycobacterium
PGTPNRV

SEQ ID NO: 1337311 - protein, 15 aa, Mycobacterium
PGTQGQGDQCAPSRQ

SEQ ID NO: 1337312 - protein, 7 aa, Mycobacterium
PGTSEDF

SEQ ID NO: 1337313 - protein, 20 aa, Mycobacterium
PGVASAAPTTTEPVERPLSS

SEQ ID NO: 1337314 - protein, 12 aa, Mycobacterium
PGWQGAKPDGID

SEQ ID NO: 1337315 - protein, 7 aa, Mycobacterium
PHDTSAF

SEQ ID NO: 1337316 - protein, 7 aa, Mycobacterium
PHPYQQS

SEQ ID NO: 1337317 - protein, 8 aa, Mycobacterium
PHRTPGLN

SEQ ID NO: 1337318 - protein, 5 aa, Mycobacterium
PINDP

SEQ ID NO: 1337319 - protein, 7 aa, Mycobacterium
PIPAGPA

SEQ ID NO: 1337320 - protein, 11 aa, Mycobacterium
PIPETDDCNRR

SEQ ID NO: 1337321 - protein, 4 aa, Mycobacterium
PKAV

SEQ ID NO: 1337322 - protein, 4 aa, Mycobacterium
PKNN

SEQ ID NO: 1337323 - protein, 10 aa, Mycobacterium
PKPLGKEGGL

SEQ ID NO: 1337324 - protein, 10 aa, Mycobacterium
PKPQNPPAAQ

SEQ ID NO: 1337325 - protein, 14 aa, Mycobacterium
PLGGSGEINRGKGI

SEQ ID NO: 1337326 - protein, 11 aa, Mycobacterium
PLGQPGDASER

SEQ ID NO: 1337327 - protein, 12 aa, Mycobacterium
PLPGGPGTGGDA

SEQ ID NO: 1337328 - protein, 15 aa, Mycobacterium
PLPGTVGTGSGATTY

SEQ ID NO: 1337329 - protein, 6 aa, Mycobacterium
PLPPGM

SEQ ID NO: 1337330 - protein, 9 aa, Mycobacterium
PLPTPPLPR

SEQ ID NO: 1337331 - protein, 4 aa, Mycobacterium
PLRR

SEQ ID NO: 1337332 - protein, 10 aa, Mycobacterium
PLSGRSGGLA

SEQ ID NO: 1337333 - protein, 7 aa, Mycobacterium
PLSQEPG

SEQ ID NO: 1337334 - protein, 4 aa, Mycobacterium
PMDD

SEQ ID NO: 1337335 - protein, 4 aa, Mycobacterium
PMSA

SEQ ID NO: 1337336 - protein, 9 aa, Mycobacterium
PMTASKEGL

SEQ ID NO: 1337337 - protein, 15 aa, Mycobacterium
PNAHSAPNGPLVERG

SEQ ID NO: 1337338 - protein, 7 aa, Mycobacterium
PNEAEAL

SEQ ID NO: 1337339 - protein, 6 aa, Mycobacterium
PNGSAV

SEQ ID NO: 1337340 - protein, 6 aa, Mycobacterium
PNGTQS

SEQ ID NO: 1337341 - protein, 7 aa, Mycobacterium
PNLTPGM

SEQ ID NO: 1337342 - protein, 16 aa, Mycobacterium
PNPPAGGFSPGGHDGG

SEQ ID NO: 1337343 - protein, 13 aa, Mycobacterium
PNQPGGANYNGVE

SEQ ID NO: 1337344 - protein, 4 aa, Mycobacterium
PNSY

SEQ ID NO: 1337345 - protein, 5 aa, Mycobacterium
PPAFT

SEQ ID NO: 1337346 - protein, 5 aa, Mycobacterium
PPGAI

SEQ ID NO: 1337347 - protein, 16 aa, Mycobacterium
PPGAPEGGYLGQQLLE

SEQ ID NO: 1337348 - protein, 7 aa, Mycobacterium
PPGKPRA

SEQ ID NO: 1337349 - protein, 4 aa, Mycobacterium
PPGS

SEQ ID NO: 1337350 - protein, 14 aa, Mycobacterium
PPGWQDAGDRAPEW

SEQ ID NO: 1337351 - protein, 6 aa, Mycobacterium
PPITGG

SEQ ID NO: 1337352 - protein, 7 aa, Mycobacterium
PPKGTHS

SEQ ID NO: 1337353 - protein, 5 aa, Mycobacterium
PPLGN

SEQ ID NO: 1337354 - protein, 7 aa, Mycobacterium
PPMPAAE

SEQ ID NO: 1337355 - protein, 5 aa, Mycobacterium
PPNWA

SEQ ID NO: 1337356 - protein, 5 aa, Mycobacterium
PPPCT

SEQ ID NO: 1337357 - protein, 9 aa, Mycobacterium
PPPDTPAEK

SEQ ID NO: 1337358 - protein, 5 aa, Mycobacterium
PPPGQ

SEQ ID NO: 1337359 - protein, 6 aa, Mycobacterium
PPPPVG

SEQ ID NO: 1337360 - protein, 57 aa, Mycobacterium
PPPSSTSSSTPRSSSSPSGSATSATPQATPQGSEASPPAAEAVEPGTPGAAPASTEL

SEQ ID NO: 1337361 - protein, 17 aa, Mycobacterium
PPQAIPDLTGGAGEAAY

SEQ ID NO: 1337362 - protein, 10 aa, Mycobacterium
PPQAPGDTLP

SEQ ID NO: 1337363 - protein, 8 aa, Mycobacterium
PPTSEPHE

SEQ ID NO: 1337364 - protein, 7 aa, Mycobacterium
PPVPPGV

SEQ ID NO: 1337365 - protein, 10 aa, Mycobacterium
PQASAQGPVP

SEQ ID NO: 1337366 - protein, 17 aa, Mycobacterium
PQEEVDTNGLANGDNTA

SEQ ID NO: 1337367 - protein, 14 aa, Mycobacterium
PQFAPDSAYEYSNT

SEQ ID NO: 1337368 - protein, 8 aa, Mycobacterium
PQFGADGT

SEQ ID NO: 1337369 - protein, 4 aa, Mycobacterium
PQKM

SEQ ID NO: 1337370 - protein, 6 aa, Mycobacterium
PQLTVG

SEQ ID NO: 1337371 - protein, 4 aa, Mycobacterium
PQNT

SEQ ID NO: 1337372 - protein, 6 aa, Mycobacterium
PQPVRD

SEQ ID NO: 1337373 - protein, 12 aa, Mycobacterium
PQRGRISTSPLA

SEQ ID NO: 1337374 - protein, 4 aa, Mycobacterium
PQSV

SEQ ID NO: 1337375 - protein, 9 aa, Mycobacterium
PRDDRDRTR

SEQ ID NO: 1337376 - protein, 5 aa, Mycobacterium
PRDGE

SEQ ID NO: 1337377 - protein, 10 aa, Mycobacterium
PRGPLDPVAE

SEQ ID NO: 1337378 - protein, 9 aa, Mycobacterium
PRGVASSTP

SEQ ID NO: 1337379 - protein, 4 aa, Mycobacterium
PRKH

SEQ ID NO: 1337380 - protein, 6 aa, Mycobacterium
PRLGEN

SEQ ID NO: 1337381 - protein, 7 aa, Mycobacterium
PRRAAEQ

SEQ ID NO: 1337382 - protein, 5 aa, Mycobacterium
PRRYE

SEQ ID NO: 1337383 - protein, 8 aa, Mycobacterium
PRTSVGKY

SEQ ID NO: 1337384 - protein, 4 aa, Mycobacterium
PSAD

SEQ ID NO: 1337385 - protein, 7 aa, Mycobacterium
PSADHTS

SEQ ID NO: 1337386 - protein, 15 aa, Mycobacterium
PSASGASSQPQLSRE

SEQ ID NO: 1337387 - protein, 9 aa, Mycobacterium
PSATETLAS

SEQ ID NO: 1337388 - protein, 4 aa, Mycobacterium
PSDL

SEQ ID NO: 1337389 - protein, 7 aa, Mycobacterium
PSEPGSY

SEQ ID NO: 1337390 - protein, 18 aa, Mycobacterium
PSGGSTITYTAGGPPGCV

SEQ ID NO: 1337391 - protein, 12 aa, Mycobacterium
PSGSAPPEPKDL

SEQ ID NO: 1337392 - protein, 5 aa, Mycobacterium
PSGSC

SEQ ID NO: 1337393 - protein, 7 aa, Mycobacterium
PSLPSPA

SEQ ID NO: 1337394 - protein, 19 aa, Mycobacterium
PSPAEDKDTVAVSAETAQR

SEQ ID NO: 1337395 - protein, 10 aa, Mycobacterium
PSPLSSGSAK

SEQ ID NO: 1337396 - protein, 6 aa, Mycobacterium
PSQALP

SEQ ID NO: 1337397 - protein, 6 aa, Mycobacterium
PSTLDG

SEQ ID NO: 1337398 - protein, 5 aa, Mycobacterium
PSYDP

SEQ ID NO: 1337399 - protein, 36 aa, Mycobacterium
PTAGAEPVPAPAPAPGPAPAPAPAPIAAASAAPGDV

SEQ ID NO: 1337400 - protein, 9 aa, Mycobacterium
PTAQGARGS

SEQ ID NO: 1337401 - protein, 7 aa, Mycobacterium
PTAREQG

SEQ ID NO: 1337402 - protein, 4 aa, Mycobacterium
PTAS

SEQ ID NO: 1337403 - protein, 4 aa, Mycobacterium
PTDA

SEQ ID NO: 1337404 - protein, 6 aa, Mycobacterium
PTDETL

SEQ ID NO: 1337405 - protein, 7 aa, Mycobacterium
PTITPES

SEQ ID NO: 1337406 - protein, 5 aa, Mycobacterium
PTKAG

SEQ ID NO: 1337407 - protein, 13 aa, Mycobacterium
PTLGDGRAPVPAD

SEQ ID NO: 1337408 - protein, 5 aa, Mycobacterium
PTPHG

SEQ ID NO: 1337409 - protein, 6 aa, Mycobacterium
PTQVNT

SEQ ID NO: 1337410 - protein, 10 aa, Mycobacterium
PTTAQPPPRV

SEQ ID NO: 1337411 - protein, 6 aa, Mycobacterium
PTTEEL

SEQ ID NO: 1337412 - protein, 22 aa, Mycobacterium
PTTWSSHGGRGNPANASRSEQI

SEQ ID NO: 1337413 - protein, 9 aa, Mycobacterium
PTVAQSGSA

SEQ ID NO: 1337414 - protein, 11 aa, Mycobacterium
PTVSGSVPPTV

SEQ ID NO: 1337415 - protein, 9 aa, Mycobacterium
PVAAAGPEE

SEQ ID NO: 1337416 - protein, 13 aa, Mycobacterium
PVAPGTPRGQRTP

SEQ ID NO: 1337417 - protein, 13 aa, Mycobacterium
PVASAQPEPTAPA

SEQ ID NO: 1337418 - protein, 9 aa, Mycobacterium
PVETPNGEI

SEQ ID NO: 1337419 - protein, 5 aa, Mycobacterium
PVPAD

SEQ ID NO: 1337420 - protein, 6 aa, Mycobacterium
PVPGEQ

SEQ ID NO: 1337421 - protein, 9 aa, Mycobacterium
PVSEESSVT

SEQ ID NO: 1337422 - protein, 7 aa, Mycobacterium
PVTGARR

SEQ ID NO: 1337423 - protein, 13 aa, Mycobacterium
PVTGGSDGYGKSK

SEQ ID NO: 1337424 - protein, 10 aa, Mycobacterium
PVTTAPAQST

SEQ ID NO: 1337425 - protein, 10 aa, Mycobacterium
PWPTADPPPA

SEQ ID NO: 1337426 - protein, 10 aa, Mycobacterium
PYGNSGPRID

SEQ ID NO: 1337427 - protein, 8 aa, Mycobacterium
PYPTTLPS

SEQ ID NO: 1337428 - protein, 5 aa, Mycobacterium
QAAQG

SEQ ID NO: 1337429 - protein, 6 aa, Mycobacterium
QADHRG

SEQ ID NO: 1337430 - protein, 11 aa, Mycobacterium
QADRLPSDRST

SEQ ID NO: 1337431 - protein, 13 aa, Mycobacterium
QAEDSLTGSSDEL

SEQ ID NO: 1337432 - protein, 9 aa, Mycobacterium
QAEGTDNVH

SEQ ID NO: 1337433 - protein, 5 aa, Mycobacterium
QAELD

SEQ ID NO: 1337434 - protein, 8 aa, Mycobacterium
QAERGNKI

SEQ ID NO: 1337435 - protein, 8 aa, Mycobacterium
QAETGQTP

SEQ ID NO: 1337436 - protein, 8 aa, Mycobacterium
QAGGAGME

SEQ ID NO: 1337437 - protein, 7 aa, Mycobacterium
QAGVPAR

SEQ ID NO: 1337438 - protein, 9 aa, Mycobacterium
QANPGLPAR

SEQ ID NO: 1337439 - protein, 10 aa, Mycobacterium
QANPRDWGAT

SEQ ID NO: 1337440 - protein, 5 aa, Mycobacterium
QAPGI

SEQ ID NO: 1337441 - protein, 6 aa, Mycobacterium
QAPIGP

SEQ ID NO: 1337442 - protein, 11 aa, Mycobacterium
QAPSMPPYQSA

SEQ ID NO: 1337443 - protein, 13 aa, Mycobacterium
QAPTVDPSTLDAQ

SEQ ID NO: 1337444 - protein, 13 aa, Mycobacterium
QAQADALEDGDVS

SEQ ID NO: 1337445 - protein, 49 aa, Mycobacterium
QASQARGTWRATSATAGYSSAARRAGDRAGRRARLGPSQELAGARTALE

SEQ ID NO: 1337446 - protein, 15 aa, Mycobacterium
QATDTIKGVTDEKDL

SEQ ID NO: 1337447 - protein, 6 aa, Mycobacterium
QATTGI

SEQ ID NO: 1337448 - protein, 43 aa, Mycobacterium
QAVDGQARQTVPTLSAPSGTTRTSPSSTAKPPPTSAPAARAPI

SEQ ID NO: 1337449 - protein, 17 aa, Mycobacterium
QDASGITGTIQRSEEVV

SEQ ID NO: 1337450 - protein, 8 aa, Mycobacterium
QDENETAG

SEQ ID NO: 1337451 - protein, 5 aa, Mycobacterium
QDPDY

SEQ ID NO: 1337452 - protein, 18 aa, Mycobacterium
QDSKPAAATQDYPSGPVT

SEQ ID NO: 1337453 - protein, 11 aa, Mycobacterium
QDTEDAPRVAE

SEQ ID NO: 1337454 - protein, 12 aa, Mycobacterium
QEMNDPARTREQ

SEQ ID NO: 1337455 - protein, 8 aa, Mycobacterium
QFDTGDDQ

SEQ ID NO: 1337456 - protein, 15 aa, Mycobacterium
QGAAGYRDPETARRA

SEQ ID NO: 1337457 - protein, 7 aa, Mycobacterium
QGAGGGQ

SEQ ID NO: 1337458 - protein, 19 aa, Mycobacterium
QGAPCDGSTGVAQSPDGLP

SEQ ID NO: 1337459 - protein, 12 aa, Mycobacterium
QGAPGAGTPPPV

SEQ ID NO: 1337460 - protein, 7 aa, Mycobacterium
QGARTTV

SEQ ID NO: 1337461 - protein, 9 aa, Mycobacterium
QGASAAVQG

SEQ ID NO: 1337462 - protein, 7 aa, Mycobacterium
QGGCQGL

SEQ ID NO: 1337463 - protein, 18 aa, Mycobacterium
QGGGAAASAAEMAQSYAP

SEQ ID NO: 1337464 - protein, 6 aa, Mycobacterium
QGGGTK

SEQ ID NO: 1337465 - protein, 7 aa, Mycobacterium
QGGQLTE

SEQ ID NO: 1337466 - protein, 10 aa, Mycobacterium
QGGSADDIAP

SEQ ID NO: 1337467 - protein, 14 aa, Mycobacterium
QGVSGHPGDGTNRW

SEQ ID NO: 1337468 - protein, 11 aa, Mycobacterium
QHRRKAEGPRV

SEQ ID NO: 1337469 - protein, 19 aa, Mycobacterium
QHSGVDQQPLGMSSPAVAP

SEQ ID NO: 1337470 - protein, 8 aa, Mycobacterium
QIDDGGAI

SEQ ID NO: 1337471 - protein, 8 aa, Mycobacterium
QKKSDELK

SEQ ID NO: 1337472 - protein, 12 aa, Mycobacterium
QLAGQTLGAGTE

SEQ ID NO: 1337473 - protein, 18 aa, Mycobacterium
QLEQRPDGKWGATINGQP

SEQ ID NO: 1337474 - protein, 8 aa, Mycobacterium
QLGPAQPT

SEQ ID NO: 1337475 - protein, 11 aa, Mycobacterium
QLPSDETSERI

SEQ ID NO: 1337476 - protein, 24 aa, Mycobacterium
QMSQAAKAPTDDGPSGDPLELRET

SEQ ID NO: 1337477 - protein, 5 aa, Mycobacterium
QNDDM

SEQ ID NO: 1337478 - protein, 55 aa, Mycobacterium
QNDTSGTAVRSPDSLIEPTEPTVPTPRPSRTSTPAPPPRTLTPAPPSASAPPSAA

SEQ ID NO: 1337479 - protein, 10 aa, Mycobacterium
QNEAADAQGA

SEQ ID NO: 1337480 - protein, 5 aa, Mycobacterium
QNEKN

SEQ ID NO: 1337481 - protein, 6 aa, Mycobacterium
QNFQQG

SEQ ID NO: 1337482 - protein, 4 aa, Mycobacterium
QNGV

SEQ ID NO: 1337483 - protein, 7 aa, Mycobacterium
QNPGHDI

SEQ ID NO: 1337484 - protein, 8 aa, Mycobacterium
QNRPGGIG

SEQ ID NO: 1337485 - protein, 10 aa, Mycobacterium
QNSGIPAPGV

SEQ ID NO: 1337486 - protein, 7 aa, Mycobacterium
QNTGDDG

SEQ ID NO: 1337487 - protein, 5 aa, Mycobacterium
QNVAD

SEQ ID NO: 1337488 - protein, 7 aa, Mycobacterium
QNVTHDP

SEQ ID NO: 1337489 - protein, 4 aa, Mycobacterium
QPAD

SEQ ID NO: 1337490 - protein, 23 aa, Mycobacterium
QPDFRDTDNRAATNVAEAAREAG

SEQ ID NO: 1337491 - protein, 6 aa, Mycobacterium
QPDQDD

SEQ ID NO: 1337492 - protein, 4 aa, Mycobacterium
QPGE

SEQ ID NO: 1337493 - protein, 11 aa, Mycobacterium
QPGQGDRSGDH

SEQ ID NO: 1337494 - protein, 8 aa, Mycobacterium
QPGTGSTF

SEQ ID NO: 1337495 - protein, 5 aa, Mycobacterium
QPLTN

SEQ ID NO: 1337496 - protein, 11 aa, Mycobacterium
QPSRGNGQDYT

SEQ ID NO: 1337497 - protein, 4 aa, Mycobacterium
QPTL

SEQ ID NO: 1337498 - protein, 11 aa, Mycobacterium
QQGMNKPLDQS

SEQ ID NO: 1337499 - protein, 28 aa, Mycobacterium
QQGTGQGNAEVEKDDKTYNIKGNATGVD

SEQ ID NO: 1337500 - protein, 8 aa, Mycobacterium
QQGYQDNS

SEQ ID NO: 1337501 - protein, 5 aa, Mycobacterium
QQLKD

SEQ ID NO: 1337502 - protein, 12 aa, Mycobacterium
QQPGGSGPTDAE

SEQ ID NO: 1337503 - protein, 10 aa, Mycobacterium
QQQAGPASLA

SEQ ID NO: 1337504 - protein, 10 aa, Mycobacterium
QQVPQGPGSV

SEQ ID NO: 1337505 - protein, 6 aa, Mycobacterium
QRDDIN

SEQ ID NO: 1337506 - protein, 10 aa, Mycobacterium
QRGLADDPVP

SEQ ID NO: 1337507 - protein, 6 aa, Mycobacterium
QRPGSD

SEQ ID NO: 1337508 - protein, 6 aa, Mycobacterium
QRPTVA

SEQ ID NO: 1337509 - protein, 13 aa, Mycobacterium
QRWPDDAEQHSYE

SEQ ID NO: 1337510 - protein, 9 aa, Mycobacterium
QSAESATGL

SEQ ID NO: 1337511 - protein, 12 aa, Mycobacterium
QSAPGDPTPPDV

SEQ ID NO: 1337512 - protein, 9 aa, Mycobacterium
QSEGNASGL

SEQ ID NO: 1337513 - protein, 42 aa, Mycobacterium
QSGDSTRVRVPETSDPADATSEITARTDNGSVVIEESDDGWR

SEQ ID NO: 1337514 - protein, 9 aa, Mycobacterium
QSGGANSPG

SEQ ID NO: 1337515 - protein, 6 aa, Mycobacterium
QSGTHS

SEQ ID NO: 1337516 - protein, 10 aa, Mycobacterium
QSKTKEISGN

SEQ ID NO: 1337517 - protein, 6 aa, Mycobacterium
QSLRSN

SEQ ID NO: 1337518 - protein, 18 aa, Mycobacterium
QSNGGSGSPHNASREEQI

SEQ ID NO: 1337519 - protein, 12 aa, Mycobacterium
QSPRAGGSIGAK

SEQ ID NO: 1337520 - protein, 12 aa, Mycobacterium
QSPVGNRAVVSI

SEQ ID NO: 1337521 - protein, 12 aa, Mycobacterium
QSQGGAAAVSSA

SEQ ID NO: 1337522 - protein, 30 aa, Mycobacterium
QTDFGGSDSPLSADKGEYDKAKERCGGSDA

SEQ ID NO: 1337523 - protein, 7 aa, Mycobacterium
QTDGTDV

SEQ ID NO: 1337524 - protein, 7 aa, Mycobacterium
QTDGTID

SEQ ID NO: 1337525 - protein, 23 aa, Mycobacterium
QTDSRPYEPDPTRTHTPASDYGA

SEQ ID NO: 1337526 - protein, 6 aa, Mycobacterium
QTFGDE

SEQ ID NO: 1337527 - protein, 9 aa, Mycobacterium
QTGFSTTAK

SEQ ID NO: 1337528 - protein, 5 aa, Mycobacterium
QTGPL

SEQ ID NO: 1337529 - protein, 9 aa, Mycobacterium
QTKTGSTSD

SEQ ID NO: 1337530 - protein, 8 aa, Mycobacterium
QVAEASGV

SEQ ID NO: 1337531 - protein, 21 aa, Mycobacterium
QVDKGKAPAFGEAFDFSLLES

SEQ ID NO: 1337532 - protein, 13 aa, Mycobacterium
QWQTDPKELPAST

SEQ ID NO: 1337533 - protein, 13 aa, Mycobacterium
QYEHGRDTAPAVT

SEQ ID NO: 1337534 - protein, 7 aa, Mycobacterium
QYEPGTN

SEQ ID NO: 1337535 - protein, 8 aa, Mycobacterium
QYPQRYPT

SEQ ID NO: 1337536 - protein, 6 aa, Mycobacterium
QYRSGD

SEQ ID NO: 1337537 - protein, 6 aa, Mycobacterium
RAAETS

SEQ ID NO: 1337538 - protein, 8 aa, Mycobacterium
RAAKNEPL

SEQ ID NO: 1337539 - protein, 9 aa, Mycobacterium
RAAKQSDQG

SEQ ID NO: 1337540 - protein, 8 aa, Mycobacterium
RAANPDAP

SEQ ID NO: 1337541 - protein, 6 aa, Mycobacterium
RAAPDG

SEQ ID NO: 1337542 - protein, 14 aa, Mycobacterium
RAARIPGSIDGNEF

SEQ ID NO: 1337543 - protein, 5 aa, Mycobacterium
RAATD

SEQ ID NO: 1337544 - protein, 7 aa, Mycobacterium
RADDREE

SEQ ID NO: 1337545 - protein, 9 aa, Mycobacterium
RAEKGKQPV

SEQ ID NO: 1337546 - protein, 14 aa, Mycobacterium
RAFEDAKNRAEQYA

SEQ ID NO: 1337547 - protein, 9 aa, Mycobacterium
RAGDERLAA

SEQ ID NO: 1337548 - protein, 19 aa, Mycobacterium
RAGGMDRPVEASHTGGFNT

SEQ ID NO: 1337549 - protein, 6 aa, Mycobacterium
RAGPAV

SEQ ID NO: 1337550 - protein, 8 aa, Mycobacterium
RALSSPAM

SEQ ID NO: 1337551 - protein, 7 aa, Mycobacterium
RAPAEET

SEQ ID NO: 1337552 - protein, 12 aa, Mycobacterium
RAPAPGPPAAHL

SEQ ID NO: 1337553 - protein, 5 aa, Mycobacterium
RAPGN

SEQ ID NO: 1337554 - protein, 6 aa, Mycobacterium
RAPGPL

SEQ ID NO: 1337555 - protein, 7 aa, Mycobacterium
RAPKTVK

SEQ ID NO: 1337556 - protein, 7 aa, Mycobacterium
RAPSNAD

SEQ ID NO: 1337557 - protein, 10 aa, Mycobacterium
RAQEDANGWD

SEQ ID NO: 1337558 - protein, 10 aa, Mycobacterium
RARDDNSGWD

SEQ ID NO: 1337559 - protein, 8 aa, Mycobacterium
RASRGTGW

SEQ ID NO: 1337560 - protein, 7 aa, Mycobacterium
RATPRAD

SEQ ID NO: 1337561 - protein, 7 aa, Mycobacterium
RAYPTDK

SEQ ID NO: 1337562 - protein, 18 aa, Mycobacterium
RCASPSTAVAYGRTESSR

SEQ ID NO: 1337563 - protein, 13 aa, Mycobacterium
RDAQLRDAQLMEA

SEQ ID NO: 1337564 - protein, 8 aa, Mycobacterium
RDDEPADL

SEQ ID NO: 1337565 - protein, 12 aa, Mycobacterium
RDEHDDATPDVV

SEQ ID NO: 1337566 - protein, 7 aa, Mycobacterium
RDGQTLD

SEQ ID NO: 1337567 - protein, 11 aa, Mycobacterium
RDGSASGTGAV

SEQ ID NO: 1337568 - protein, 8 aa, Mycobacterium
RDGSLEGS

SEQ ID NO: 1337569 - protein, 6 aa, Mycobacterium
RDKQDW

SEQ ID NO: 1337570 - protein, 8 aa, Mycobacterium
RDNPDNPL

SEQ ID NO: 1337571 - protein, 5 aa, Mycobacterium
RDPSV

SEQ ID NO: 1337572 - protein, 10 aa, Mycobacterium
RDQHDAPAVS

SEQ ID NO: 1337573 - protein, 9 aa, Mycobacterium
RDRAAHSRS

SEQ ID NO: 1337574 - protein, 5 aa, Mycobacterium
RDRAT

SEQ ID NO: 1337575 - protein, 8 aa, Mycobacterium
RDSAITRA

SEQ ID NO: 1337576 - protein, 8 aa, Mycobacterium
RDSRITPT

SEQ ID NO: 1337577 - protein, 5 aa, Mycobacterium
RDTGV

SEQ ID NO: 1337578 - protein, 4 aa, Mycobacterium
REAA

SEQ ID NO: 1337579 - protein, 8 aa, Mycobacterium
REDISTTQ

SEQ ID NO: 1337580 - protein, 8 aa, Mycobacterium
REGSQIPL

SEQ ID NO: 1337581 - protein, 9 aa, Mycobacterium
RELAEETGL

SEQ ID NO: 1337582 - protein, 10 aa, Mycobacterium
REQSRAAKER

SEQ ID NO: 1337583 - protein, 23 aa, Mycobacterium
RESRRNRAEPRRSREMNGNPPFG

SEQ ID NO: 1337584 - protein, 22 aa, Mycobacterium
REVTGTARQDPNQPRAAVTEDG

SEQ ID NO: 1337585 - protein, 13 aa, Mycobacterium
RGAGDALGDGVRT

SEQ ID NO: 1337586 - protein, 7 aa, Mycobacterium
RGANSWP

SEQ ID NO: 1337587 - protein, 16 aa, Mycobacterium
RGDLTDPDGIRAGADA

SEQ ID NO: 1337588 - protein, 16 aa, Mycobacterium
RGEADRAERDGNLEKA

SEQ ID NO: 1337589 - protein, 7 aa, Mycobacterium
RGERSLE

SEQ ID NO: 1337590 - protein, 4 aa, Mycobacterium
RGGE

SEQ ID NO: 1337591 - protein, 13 aa, Mycobacterium
RGGPGAGEQSSIA

SEQ ID NO: 1337592 - protein, 4 aa, Mycobacterium
RGHG

SEQ ID NO: 1337593 - protein, 7 aa, Mycobacterium
RGHPSRE

SEQ ID NO: 1337594 - protein, 5 aa, Mycobacterium
RGHRR

SEQ ID NO: 1337595 - protein, 7 aa, Mycobacterium
RGIPQGR

SEQ ID NO: 1337596 - protein, 8 aa, Mycobacterium
RGNQTGAA

SEQ ID NO: 1337597 - protein, 5 aa, Mycobacterium
RGPDL

SEQ ID NO: 1337598 - protein, 12 aa, Mycobacterium
RGPPDDPGDSLA

SEQ ID NO: 1337599 - protein, 5 aa, Mycobacterium
RGQGA

SEQ ID NO: 1337600 - protein, 7 aa, Mycobacterium
RGQLTEG

SEQ ID NO: 1337601 - protein, 8 aa, Mycobacterium
RGRGGEPL

SEQ ID NO: 1337602 - protein, 13 aa, Mycobacterium
RGRSRPAARRRMP

SEQ ID NO: 1337603 - protein, 8 aa, Mycobacterium
RGVGTGGI

SEQ ID NO: 1337604 - protein, 4 aa, Mycobacterium
RHLE

SEQ ID NO: 1337605 - protein, 5 aa, Mycobacterium
RHPYD

SEQ ID NO: 1337606 - protein, 7 aa, Mycobacterium
RIAPNGA

SEQ ID NO: 1337607 - protein, 7 aa, Mycobacterium
RIPLPNS

SEQ ID NO: 1337608 - protein, 6 aa, Mycobacterium
RIQGEQ

SEQ ID NO: 1337609 - protein, 5 aa, Mycobacterium
RIRDT

SEQ ID NO: 1337610 - protein, 21 aa, Mycobacterium
RKGEEVSVTTETCEQAVPEGL

SEQ ID NO: 1337611 - protein, 4 aa, Mycobacterium
RKNK

SEQ ID NO: 1337612 - protein, 8 aa, Mycobacterium
RKQDISNG

SEQ ID NO: 1337613 - protein, 6 aa, Mycobacterium
RLGNGR

SEQ ID NO: 1337614 - protein, 6 aa, Mycobacterium
RLPDTL

SEQ ID NO: 1337615 - protein, 14 aa, Mycobacterium
RLRPPPGYKDTTVP

SEQ ID NO: 1337616 - protein, 8 aa, Mycobacterium
RMGPGGKG

SEQ ID NO: 1337617 - protein, 9 aa, Mycobacterium
RMPPRGLTT

SEQ ID NO: 1337618 - protein, 29 aa, Mycobacterium
RNADGARERAATLGEPHTSAYADVTDEAS

SEQ ID NO: 1337619 - protein, 7 aa, Mycobacterium
RNDERVE

SEQ ID NO: 1337620 - protein, 8 aa, Mycobacterium
RNDGVPPD

SEQ ID NO: 1337621 - protein, 7 aa, Mycobacterium
RNDPTVN

SEQ ID NO: 1337622 - protein, 5 aa, Mycobacterium
RNDTL

SEQ ID NO: 1337623 - protein, 4 aa, Mycobacterium
RNGP

SEQ ID NO: 1337624 - protein, 5 aa, Mycobacterium
RNKAR

SEQ ID NO: 1337625 - protein, 7 aa, Mycobacterium
RNPQTVT

SEQ ID NO: 1337626 - protein, 6 aa, Mycobacterium
RNPRTV

SEQ ID NO: 1337627 - protein, 12 aa, Mycobacterium
RPAATSDPRGLS

SEQ ID NO: 1337628 - protein, 19 aa, Mycobacterium
RPADAPPSAPAPAEHRGPD

SEQ ID NO: 1337629 - protein, 9 aa, Mycobacterium
RPAPTTDAL

SEQ ID NO: 1337630 - protein, 5 aa, Mycobacterium
RPDDG

SEQ ID NO: 1337631 - protein, 5 aa, Mycobacterium
RPDDL

SEQ ID NO: 1337632 - protein, 11 aa, Mycobacterium
RPFPTRAEADA

SEQ ID NO: 1337633 - protein, 6 aa, Mycobacterium
RPGENV

SEQ ID NO: 1337634 - protein, 5 aa, Mycobacterium
RPGQG

SEQ ID NO: 1337635 - protein, 6 aa, Mycobacterium
RPGRRT

SEQ ID NO: 1337636 - protein, 9 aa, Mycobacterium
RPKLYGTGA

SEQ ID NO: 1337637 - protein, 6 aa, Mycobacterium
RPMTPD

SEQ ID NO: 1337638 - protein, 7 aa, Mycobacterium
RPPGQSA

SEQ ID NO: 1337639 - protein, 7 aa, Mycobacterium
RPPVKDR

SEQ ID NO: 1337640 - protein, 7 aa, Mycobacterium
RPQPHSQ

SEQ ID NO: 1337641 - protein, 7 aa, Mycobacterium
RPSAQLD

SEQ ID NO: 1337642 - protein, 11 aa, Mycobacterium
RPYPPDDPNLQ

SEQ ID NO: 1337643 - protein, 8 aa, Mycobacterium
RQQADGMS

SEQ ID NO: 1337644 - protein, 7 aa, Mycobacterium
RQSESHA

SEQ ID NO: 1337645 - protein, 10 aa, Mycobacterium
RRADTGPAES

SEQ ID NO: 1337646 - protein, 7 aa, Mycobacterium
RRELERS

SEQ ID NO: 1337647 - protein, 9 aa, Mycobacterium
RRHPEQPYE

SEQ ID NO: 1337648 - protein, 9 aa, Mycobacterium
RRKEIGRGQ

SEQ ID NO: 1337649 - protein, 8 aa, Mycobacterium
RRPARRGV

SEQ ID NO: 1337650 - protein, 9 aa, Mycobacterium
RRPHPRGDR

SEQ ID NO: 1337651 - protein, 11 aa, Mycobacterium
RRQVEERREGL

SEQ ID NO: 1337652 - protein, 8 aa, Mycobacterium
RRSPRGDE

SEQ ID NO: 1337653 - protein, 12 aa, Mycobacterium
RRVTDDDPYSAE

SEQ ID NO: 1337654 - protein, 4 aa, Mycobacterium
RSES

SEQ ID NO: 1337655 - protein, 6 aa, Mycobacterium
RSGASV

SEQ ID NO: 1337656 - protein, 14 aa, Mycobacterium
RSKKPKTEPQRTDP

SEQ ID NO: 1337657 - protein, 8 aa, Mycobacterium
RSKTDKDI

SEQ ID NO: 1337658 - protein, 9 aa, Mycobacterium
RSPAKGASW

SEQ ID NO: 1337659 - protein, 14 aa, Mycobacterium
RSPDHPAREPISPD

SEQ ID NO: 1337660 - protein, 4 aa, Mycobacterium
RSPE

SEQ ID NO: 1337661 - protein, 10 aa, Mycobacterium
RSQGNEEGAR

SEQ ID NO: 1337662 - protein, 12 aa, Mycobacterium
RSSASADAIAAA

SEQ ID NO: 1337663 - protein, 12 aa, Mycobacterium
RSSTYPSTEQTL

SEQ ID NO: 1337664 - protein, 10 aa, Mycobacterium
RSSVVTTTDG

SEQ ID NO: 1337665 - protein, 15 aa, Mycobacterium
RSTVEANARSGHRRD

SEQ ID NO: 1337666 - protein, 13 aa, Mycobacterium
RSVGQAGGTVSGT

SEQ ID NO: 1337667 - protein, 13 aa, Mycobacterium
RSWAAGSVDGPAL

SEQ ID NO: 1337668 - protein, 12 aa, Mycobacterium
RTAEGGSIPQGE

SEQ ID NO: 1337669 - protein, 5 aa, Mycobacterium
RTAPE

SEQ ID NO: 1337670 - protein, 6 aa, Mycobacterium
RTAPTL

SEQ ID NO: 1337671 - protein, 4 aa, Mycobacterium
RTAQ

SEQ ID NO: 1337672 - protein, 15 aa, Mycobacterium
RTARSLPSAPPNLPK

SEQ ID NO: 1337673 - protein, 8 aa, Mycobacterium
RTCGTGRF

SEQ ID NO: 1337674 - protein, 19 aa, Mycobacterium
RTDTVTVGSGKGPVEVSPR

SEQ ID NO: 1337675 - protein, 13 aa, Mycobacterium
RTGPARNGPGIAG

SEQ ID NO: 1337676 - protein, 4 aa, Mycobacterium
RTGR

SEQ ID NO: 1337677 - protein, 7 aa, Mycobacterium
RTIPNDD

SEQ ID NO: 1337678 - protein, 12 aa, Mycobacterium
RTKGTVPAQLPE

SEQ ID NO: 1337679 - protein, 9 aa, Mycobacterium
RTNPAAAKT

SEQ ID NO: 1337680 - protein, 9 aa, Mycobacterium
RTPPTPSTA

SEQ ID NO: 1337681 - protein, 7 aa, Mycobacterium
RTPTDGR

SEQ ID NO: 1337682 - protein, 6 aa, Mycobacterium
RTQQET

SEQ ID NO: 1337683 - protein, 11 aa, Mycobacterium
RVETDRDARHD

SEQ ID NO: 1337684 - protein, 6 aa, Mycobacterium
RVRDDP

SEQ ID NO: 1337685 - protein, 5 aa, Mycobacterium
RVREP

SEQ ID NO: 1337686 - protein, 4 aa, Mycobacterium
RVSQ

SEQ ID NO: 1337687 - protein, 15 aa, Mycobacterium
RVSRSSALASKATGF

SEQ ID NO: 1337688 - protein, 5 aa, Mycobacterium
RYGPE

SEQ ID NO: 1337689 - protein, 12 aa, Mycobacterium
SAAEGVSRSPLG

SEQ ID NO: 1337690 - protein, 6 aa, Mycobacterium
SAARTG

SEQ ID NO: 1337691 - protein, 5 aa, Mycobacterium
SAASQ

SEQ ID NO: 1337692 - protein, 9 aa, Mycobacterium
SAATRESME

SEQ ID NO: 1337693 - protein, 17 aa, Mycobacterium
SADDSGWPTDRVEDEDT

SEQ ID NO: 1337694 - protein, 6 aa, Mycobacterium
SADFTE

SEQ ID NO: 1337695 - protein, 4 aa, Mycobacterium
SADG

SEQ ID NO: 1337696 - protein, 6 aa, Mycobacterium
SADGYR

SEQ ID NO: 1337697 - protein, 7 aa, Mycobacterium
SADLEKA

SEQ ID NO: 1337698 - protein, 8 aa, Mycobacterium
SAEGAKQA

SEQ ID NO: 1337699 - protein, 7 aa, Mycobacterium
SAEPLGY

SEQ ID NO: 1337700 - protein, 38 aa, Mycobacterium
SAEPVAGQECADPATCERAPEEQPAEKKNNANKAPIQI

SEQ ID NO: 1337701 - protein, 16 aa, Mycobacterium
SAGASAPGAFDGADDF

SEQ ID NO: 1337702 - protein, 9 aa, Mycobacterium
SAGHRRAAR

SEQ ID NO: 1337703 - protein, 20 aa, Mycobacterium
SAGSALDDPAFDAATAERRA

SEQ ID NO: 1337704 - protein, 11 aa, Mycobacterium
SAKATGPGDWT

SEQ ID NO: 1337705 - protein, 10 aa, Mycobacterium
SAKGEGGNSI

SEQ ID NO: 1337706 - protein, 9 aa, Mycobacterium
SAPGDATTD

SEQ ID NO: 1337707 - protein, 8 aa, Mycobacterium
SAPGQPGP

SEQ ID NO: 1337708 - protein, 13 aa, Mycobacterium
SAQPCLDKPRRER

SEQ ID NO: 1337709 - protein, 4 aa, Mycobacterium
SAQQ

SEQ ID NO: 1337710 - protein, 8 aa, Mycobacterium
SARRIAQN

SEQ ID NO: 1337711 - protein, 6 aa, Mycobacterium
SARRQL

SEQ ID NO: 1337712 - protein, 6 aa, Mycobacterium
SARRVE

SEQ ID NO: 1337713 - protein, 10 aa, Mycobacterium
SASGAGGPGV

SEQ ID NO: 1337714 - protein, 23 aa, Mycobacterium
SASVEESIAQSSARESRRQQSLT

SEQ ID NO: 1337715 - protein, 11 aa, Mycobacterium
SATDDPDAENM

SEQ ID NO: 1337716 - protein, 8 aa, Mycobacterium
SATTSEGD

SEQ ID NO: 1337717 - protein, 14 aa, Mycobacterium
SATVYDNSRRRGPR

SEQ ID NO: 1337718 - protein, 7 aa, Mycobacterium
SAVEEAA

SEQ ID NO: 1337719 - protein, 5 aa, Mycobacterium
SDAAD

SEQ ID NO: 1337720 - protein, 9 aa, Mycobacterium
SDFTADGDR

SEQ ID NO: 1337721 - protein, 8 aa, Mycobacterium
SDGRTMTS

SEQ ID NO: 1337722 - protein, 4 aa, Mycobacterium
SDIP

SEQ ID NO: 1337723 - protein, 14 aa, Mycobacterium
SDLAKGGPVHSQAE

SEQ ID NO: 1337724 - protein, 6 aa, Mycobacterium
SDPAAM

SEQ ID NO: 1337725 - protein, 9 aa, Mycobacterium
SDPAGPSIT

SEQ ID NO: 1337726 - protein, 7 aa, Mycobacterium
SDPATIE

SEQ ID NO: 1337727 - protein, 14 aa, Mycobacterium
SDPDGAVGGQGSDL

SEQ ID NO: 1337728 - protein, 7 aa, Mycobacterium
SDPPPLD

SEQ ID NO: 1337729 - protein, 11 aa, Mycobacterium
SDREAATTVAA

SEQ ID NO: 1337730 - protein, 7 aa, Mycobacterium
SDRNESL

SEQ ID NO: 1337731 - protein, 6 aa, Mycobacterium
SDSGRA

SEQ ID NO: 1337732 - protein, 4 aa, Mycobacterium
SDTD

SEQ ID NO: 1337733 - protein, 6 aa, Mycobacterium
SDTQDG

SEQ ID NO: 1337734 - protein, 9 aa, Mycobacterium
SDVVANGSA

SEQ ID NO: 1337735 - protein, 8 aa, Mycobacterium
SEDSELQT

SEQ ID NO: 1337736 - protein, 7 aa, Mycobacterium
SEGWPGE

SEQ ID NO: 1337737 - protein, 7 aa, Mycobacterium
SELPDRA

SEQ ID NO: 1337738 - protein, 4 aa, Mycobacterium
SEPG

SEQ ID NO: 1337739 - protein, 5 aa, Mycobacterium
SERDM

SEQ ID NO: 1337740 - protein, 5 aa, Mycobacterium
SERPA

SEQ ID NO: 1337741 - protein, 7 aa, Mycobacterium
SERSRRG

SEQ ID NO: 1337742 - protein, 16 aa, Mycobacterium
SESPGSTPPTPMPRGE

SEQ ID NO: 1337743 - protein, 5 aa, Mycobacterium
SETAD

SEQ ID NO: 1337744 - protein, 11 aa, Mycobacterium
SFEGGDVEGDL

SEQ ID NO: 1337745 - protein, 17 aa, Mycobacterium
SFGQPTTAAVDGGGTVS

SEQ ID NO: 1337746 - protein, 14 aa, Mycobacterium
SFRDGTRVAGTAPD

SEQ ID NO: 1337747 - protein, 15 aa, Mycobacterium
SGCGQTNTAPADAAY

SEQ ID NO: 1337748 - protein, 6 aa, Mycobacterium
SGDVTT

SEQ ID NO: 1337749 - protein, 6 aa, Mycobacterium
SGEFHP

SEQ ID NO: 1337750 - protein, 12 aa, Mycobacterium
SGEVQGAPDTLT

SEQ ID NO: 1337751 - protein, 12 aa, Mycobacterium
SGGYTQCTGMLT

SEQ ID NO: 1337752 - protein, 12 aa, Mycobacterium
SGINDPKDLEGA

SEQ ID NO: 1337753 - protein, 13 aa, Mycobacterium
SGKTGTTESNRSS

SEQ ID NO: 1337754 - protein, 17 aa, Mycobacterium
SGKVSEDWNKNATKGIP

SEQ ID NO: 1337755 - protein, 13 aa, Mycobacterium
SGLLDGDDELDRA

SEQ ID NO: 1337756 - protein, 4 aa, Mycobacterium
SGLP

SEQ ID NO: 1337757 - protein, 14 aa, Mycobacterium
SGMTARADEPFDQF

SEQ ID NO: 1337758 - protein, 4 aa, Mycobacterium
SGNT

SEQ ID NO: 1337759 - protein, 29 aa, Mycobacterium
SGPAFGHTRNPWSREHTPGGSSGGSAAAV

SEQ ID NO: 1337760 - protein, 5 aa, Mycobacterium
SGPHG

SEQ ID NO: 1337761 - protein, 13 aa, Mycobacterium
SGPRSSNPTVPQP

SEQ ID NO: 1337762 - protein, 9 aa, Mycobacterium
SGRDATDSD

SEQ ID NO: 1337763 - protein, 13 aa, Mycobacterium
SGSDAVQALSGGS

SEQ ID NO: 1337764 - protein, 5 aa, Mycobacterium
SGSGF

SEQ ID NO: 1337765 - protein, 10 aa, Mycobacterium
SGSPMSDPNF

SEQ ID NO: 1337766 - protein, 42 aa, Mycobacterium
SGTDEASKQALADASERYTAAASQIDQATSAKQAQLAKESAV

SEQ ID NO: 1337767 - protein, 10 aa, Mycobacterium
SGTLGDDTDV

SEQ ID NO: 1337768 - protein, 8 aa, Mycobacterium
SGTTGHPK

SEQ ID NO: 1337769 - protein, 5 aa, Mycobacterium
SGVAG

SEQ ID NO: 1337770 - protein, 5 aa, Mycobacterium
SGYRG

SEQ ID NO: 1337771 - protein, 14 aa, Mycobacterium
SHEGPKGALCSQRS

SEQ ID NO: 1337772 - protein, 18 aa, Mycobacterium
SHPGANDAITNAGSGGEA

SEQ ID NO: 1337773 - protein, 14 aa, Mycobacterium
SHSDQRTKAQTPVQ

SEQ ID NO: 1337774 - protein, 8 aa, Mycobacterium
SIPGPSTA

SEQ ID NO: 1337775 - protein, 5 aa, Mycobacterium
SITGG

SEQ ID NO: 1337776 - protein, 7 aa, Mycobacterium
SITTQGD

SEQ ID NO: 1337777 - protein, 6 aa, Mycobacterium
SIYPGD

SEQ ID NO: 1337778 - protein, 6 aa, Mycobacterium
SKEYTE

SEQ ID NO: 1337779 - protein, 9 aa, Mycobacterium
SKGDAYDAQ

SEQ ID NO: 1337780 - protein, 8 aa, Mycobacterium
SKYRGEFE

SEQ ID NO: 1337781 - protein, 11 aa, Mycobacterium
SLDNEQQTAQK

SEQ ID NO: 1337782 - protein, 8 aa, Mycobacterium
SLDRQTGD

SEQ ID NO: 1337783 - protein, 4 aa, Mycobacterium
SLEA

SEQ ID NO: 1337784 - protein, 35 aa, Mycobacterium
SLGGRRGPEPQNVTRAAGGCRRRRTRVSDRSALVI

SEQ ID NO: 1337785 - protein, 10 aa, Mycobacterium
SLSASAGAGC

SEQ ID NO: 1337786 - protein, 10 aa, Mycobacterium
SLSPQRPRPV

SEQ ID NO: 1337787 - protein, 6 aa, Mycobacterium
SLTAPG

SEQ ID NO: 1337788 - protein, 12 aa, Mycobacterium
SLTDEKNGLNQR

SEQ ID NO: 1337789 - protein, 8 aa, Mycobacterium
SMPTRETY

SEQ ID NO: 1337790 - protein, 4 aa, Mycobacterium
SNEY

SEQ ID NO: 1337791 - protein, 7 aa, Mycobacterium
SNGATFA

SEQ ID NO: 1337792 - protein, 5 aa, Mycobacterium
SNGQI

SEQ ID NO: 1337793 - protein, 7 aa, Mycobacterium
SNPPVPG

SEQ ID NO: 1337794 - protein, 7 aa, Mycobacterium
SNPTAQA

SEQ ID NO: 1337795 - protein, 7 aa, Mycobacterium
SNRTPVR

SEQ ID NO: 1337796 - protein, 9 aa, Mycobacterium
SNSDGQAKC

SEQ ID NO: 1337797 - protein, 4 aa, Mycobacterium
SNSI

SEQ ID NO: 1337798 - protein, 5 aa, Mycobacterium
SPAGV

SEQ ID NO: 1337799 - protein, 16 aa, Mycobacterium
SPAPESRLTGGPGGGM

SEQ ID NO: 1337800 - protein, 9 aa, Mycobacterium
SPDADAAPV

SEQ ID NO: 1337801 - protein, 5 aa, Mycobacterium
SPDGR

SEQ ID NO: 1337802 - protein, 9 aa, Mycobacterium
SPDGRTTAQ

SEQ ID NO: 1337803 - protein, 5 aa, Mycobacterium
SPDGS

SEQ ID NO: 1337804 - protein, 6 aa, Mycobacterium
SPDKGL

SEQ ID NO: 1337805 - protein, 22 aa, Mycobacterium
SPDNPPPGTTTTPTAPTGSRGL

SEQ ID NO: 1337806 - protein, 7 aa, Mycobacterium
SPGDRDN

SEQ ID NO: 1337807 - protein, 17 aa, Mycobacterium
SPIGRERKTEELSRTSV

SEQ ID NO: 1337808 - protein, 6 aa, Mycobacterium
SPLGQR

SEQ ID NO: 1337809 - protein, 12 aa, Mycobacterium
SPPAAHAETPYG

SEQ ID NO: 1337810 - protein, 4 aa, Mycobacterium
SPPL

SEQ ID NO: 1337811 - protein, 12 aa, Mycobacterium
SPPLNEAQAGPA

SEQ ID NO: 1337812 - protein, 5 aa, Mycobacterium
SPQTS

SEQ ID NO: 1337813 - protein, 6 aa, Mycobacterium
SPRSEQ

SEQ ID NO: 1337814 - protein, 13 aa, Mycobacterium
SPRSSAPPGTGSA

SEQ ID NO: 1337815 - protein, 5 aa, Mycobacterium
SPSGG

SEQ ID NO: 1337816 - protein, 5 aa, Mycobacterium
SPVNG

SEQ ID NO: 1337817 - protein, 13 aa, Mycobacterium
SQANTGGVRPQRI

SEQ ID NO: 1337818 - protein, 10 aa, Mycobacterium
SQGAKPSLGG

SEQ ID NO: 1337819 - protein, 7 aa, Mycobacterium
SQGARSL

SEQ ID NO: 1337820 - protein, 6 aa, Mycobacterium
SQIRTQ

SEQ ID NO: 1337821 - protein, 17 aa, Mycobacterium
SQKAGTSPAAQQPEADF

SEQ ID NO: 1337822 - protein, 13 aa, Mycobacterium
SQLSGGGGPAVKA

SEQ ID NO: 1337823 - protein, 10 aa, Mycobacterium
SQPPAAPPMA

SEQ ID NO: 1337824 - protein, 9 aa, Mycobacterium
SQPSRGPRR

SEQ ID NO: 1337825 - protein, 20 aa, Mycobacterium
SQPVGPGANALRDGPGARAA

SEQ ID NO: 1337826 - protein, 6 aa, Mycobacterium
SQRDGL

SEQ ID NO: 1337827 - protein, 20 aa, Mycobacterium
SQTGEADAVQAGSSQITAPV

SEQ ID NO: 1337828 - protein, 8 aa, Mycobacterium
SQTKDDFA

SEQ ID NO: 1337829 - protein, 4 aa, Mycobacterium
SRAD

SEQ ID NO: 1337830 - protein, 6 aa, Mycobacterium
SRDGTR

SEQ ID NO: 1337831 - protein, 8 aa, Mycobacterium
SRDSLGRT

SEQ ID NO: 1337832 - protein, 11 aa, Mycobacterium
SREGAGTDLGD

SEQ ID NO: 1337833 - protein, 7 aa, Mycobacterium
SREQDAR

SEQ ID NO: 1337834 - protein, 20 aa, Mycobacterium
SRHGKGALGMTADKAAPAGI

SEQ ID NO: 1337835 - protein, 5 aa, Mycobacterium
SRIPS

SEQ ID NO: 1337836 - protein, 7 aa, Mycobacterium
SRLPAED

SEQ ID NO: 1337837 - protein, 4 aa, Mycobacterium
SRPP

SEQ ID NO: 1337838 - protein, 12 aa, Mycobacterium
SRQGDEKDITTS

SEQ ID NO: 1337839 - protein, 10 aa, Mycobacterium
SRQRGQITAG

SEQ ID NO: 1337840 - protein, 6 aa, Mycobacterium
SRTNGA

SEQ ID NO: 1337841 - protein, 7 aa, Mycobacterium
SRTPDRL

SEQ ID NO: 1337842 - protein, 6 aa, Mycobacterium
SRTPTV

SEQ ID NO: 1337843 - protein, 10 aa, Mycobacterium
SRTTGNGGGK

SEQ ID NO: 1337844 - protein, 5 aa, Mycobacterium
SRTVS

SEQ ID NO: 1337845 - protein, 11 aa, Mycobacterium
SRYDEDRDSYR

SEQ ID NO: 1337846 - protein, 12 aa, Mycobacterium
SRYREDSMRRGG

SEQ ID NO: 1337847 - protein, 13 aa, Mycobacterium
SSALSSVSGQTAA

SEQ ID NO: 1337848 - protein, 7 aa, Mycobacterium
SSAPVDP

SEQ ID NO: 1337849 - protein, 4 aa, Mycobacterium
SSAV

SEQ ID NO: 1337850 - protein, 22 aa, Mycobacterium
SSDSEPAAPGESPQSTQAQQDI

SEQ ID NO: 1337851 - protein, 40 aa, Mycobacterium
SSEEAGSNASSATSAASSAVESATSSAPTSSAAADPAANL

SEQ ID NO: 1337852 - protein, 7 aa, Mycobacterium
SSEPESI

SEQ ID NO: 1337853 - protein, 35 aa, Mycobacterium
SSGDEETPSAGGSAEVGATNDVNPQDVSNLRQGGN

SEQ ID NO: 1337854 - protein, 44 aa, Mycobacterium
SSGDSTVSKTPEATGPSPAPTAPATPSIAPTVGPPPAAGPSDPC

SEQ ID NO: 1337855 - protein, 13 aa, Mycobacterium
SSGGVSSPSDQPE

SEQ ID NO: 1337856 - protein, 21 aa, Mycobacterium
SSLPRDPRSNQAWSPEPVAGN

SEQ ID NO: 1337857 - protein, 7 aa, Mycobacterium
SSLRANN

SEQ ID NO: 1337858 - protein, 13 aa, Mycobacterium
SSLSKGDAKPTLP

SEQ ID NO: 1337859 - protein, 5 aa, Mycobacterium
SSPAN

SEQ ID NO: 1337860 - protein, 8 aa, Mycobacterium
SSPEPQAL

SEQ ID NO: 1337861 - protein, 9 aa, Mycobacterium
SSPSPADPF

SEQ ID NO: 1337862 - protein, 6 aa, Mycobacterium
SSQCPG

SEQ ID NO: 1337863 - protein, 10 aa, Mycobacterium
SSRDAEPLGR

SEQ ID NO: 1337864 - protein, 6 aa, Mycobacterium
SSRGGF

SEQ ID NO: 1337865 - protein, 22 aa, Mycobacterium
SSSKASGRRDAQTLADAKADAR

SEQ ID NO: 1337866 - protein, 14 aa, Mycobacterium
SSSSEDADKPLPDA

SEQ ID NO: 1337867 - protein, 18 aa, Mycobacterium
SSTEPPGQLGAPRPGVTD

SEQ ID NO: 1337868 - protein, 12 aa, Mycobacterium
SSTGASAPLGSH

SEQ ID NO: 1337869 - protein, 7 aa, Mycobacterium
SSTRGID

SEQ ID NO: 1337870 - protein, 8 aa, Mycobacterium
SSTVPGVG

SEQ ID NO: 1337871 - protein, 9 aa, Mycobacterium
SSVRPAAAG

SEQ ID NO: 1337872 - protein, 8 aa, Mycobacterium
SSYGDGTV

SEQ ID NO: 1337873 - protein, 6 aa, Mycobacterium
STADGT

SEQ ID NO: 1337874 - protein, 8 aa, Mycobacterium
STAGAQGP

SEQ ID NO: 1337875 - protein, 5 aa, Mycobacterium
STAGD

SEQ ID NO: 1337876 - protein, 10 aa, Mycobacterium
STDNVSAADQ

SEQ ID NO: 1337877 - protein, 15 aa, Mycobacterium
STGDSVTTYGAPWNM

SEQ ID NO: 1337878 - protein, 21 aa, Mycobacterium
STGDTAAAAELADRPAEARAA

SEQ ID NO: 1337879 - protein, 4 aa, Mycobacterium
STGE

SEQ ID NO: 1337880 - protein, 11 aa, Mycobacterium
STHQDRADGNF

SEQ ID NO: 1337881 - protein, 6 aa, Mycobacterium
STIEGG

SEQ ID NO: 1337882 - protein, 4 aa, Mycobacterium
STPG

SEQ ID NO: 1337883 - protein, 6 aa, Mycobacterium
STPTDN

SEQ ID NO: 1337884 - protein, 6 aa, Mycobacterium
STQGRP

SEQ ID NO: 1337885 - protein, 12 aa, Mycobacterium
STSASSDGDIAS

SEQ ID NO: 1337886 - protein, 4 aa, Mycobacterium
STSG

SEQ ID NO: 1337887 - protein, 12 aa, Mycobacterium
STSRPGSSFGAK

SEQ ID NO: 1337888 - protein, 19 aa, Mycobacterium
STSSSAAPSPETPTETPVP

SEQ ID NO: 1337889 - protein, 16 aa, Mycobacterium
STSTLNPYTNPDGALA

SEQ ID NO: 1337890 - protein, 8 aa, Mycobacterium
STVGPIGD

SEQ ID NO: 1337891 - protein, 11 aa, Mycobacterium
STVPDAVPASY

SEQ ID NO: 1337892 - protein, 17 aa, Mycobacterium
SVDDAREVNAAAAAKGF

SEQ ID NO: 1337893 - protein, 11 aa, Mycobacterium
SVGSQGESNVS

SEQ ID NO: 1337894 - protein, 8 aa, Mycobacterium
SVGSQGIA

SEQ ID NO: 1337895 - protein, 9 aa, Mycobacterium
SVNGQETAK

SEQ ID NO: 1337896 - protein, 13 aa, Mycobacterium
SVPAGGGPAEYGG

SEQ ID NO: 1337897 - protein, 15 aa, Mycobacterium
SVPEGPGINDNGSGV

SEQ ID NO: 1337898 - protein, 13 aa, Mycobacterium
SVPGAGKDGATRQ

SEQ ID NO: 1337899 - protein, 6 aa, Mycobacterium
SVPGRG

SEQ ID NO: 1337900 - protein, 13 aa, Mycobacterium
SVPVRGKADIAPG

SEQ ID NO: 1337901 - protein, 12 aa, Mycobacterium
SVQSRNRTFGER

SEQ ID NO: 1337902 - protein, 15 aa, Mycobacterium
SVSSGPGINDNATGV

SEQ ID NO: 1337903 - protein, 6 aa, Mycobacterium
SVTEPS

SEQ ID NO: 1337904 - protein, 20 aa, Mycobacterium
SWTPGNPAAAKPILPSTTTT

SEQ ID NO: 1337905 - protein, 9 aa, Mycobacterium
SYGDEKISP

SEQ ID NO: 1337906 - protein, 11 aa, Mycobacterium
SYPDGSPQVNA

SEQ ID NO: 1337907 - protein, 6 aa, Mycobacterium
SYSPDE

SEQ ID NO: 1337908 - protein, 9 aa, Mycobacterium
TAAAAEDGA

SEQ ID NO: 1337909 - protein, 6 aa, Mycobacterium
TAAAAR

SEQ ID NO: 1337910 - protein, 12 aa, Mycobacterium
TAAAQPPPPNCT

SEQ ID NO: 1337911 - protein, 9 aa, Mycobacterium
TAAERRRAA

SEQ ID NO: 1337912 - protein, 8 aa, Mycobacterium
TAAGREAA

SEQ ID NO: 1337913 - protein, 14 aa, Mycobacterium
TAAPAGAVDSPIGR

SEQ ID NO: 1337914 - protein, 15 aa, Mycobacterium
TAARTPAKPLTRQDP

SEQ ID NO: 1337915 - protein, 7 aa, Mycobacterium
TADGRQC

SEQ ID NO: 1337916 - protein, 8 aa, Mycobacterium
TADPANRH

SEQ ID NO: 1337917 - protein, 14 aa, Mycobacterium
TADPPDPGPDPRAD

SEQ ID NO: 1337918 - protein, 9 aa, Mycobacterium
TADQPTKAD

SEQ ID NO: 1337919 - protein, 8 aa, Mycobacterium
TAEGRQRY

SEQ ID NO: 1337920 - protein, 8 aa, Mycobacterium
TAEPGATW

SEQ ID NO: 1337921 - protein, 6 aa, Mycobacterium
TAGEAM

SEQ ID NO: 1337922 - protein, 14 aa, Mycobacterium
TAGSNDYAPEDSAG

SEQ ID NO: 1337923 - protein, 7 aa, Mycobacterium
TAGTASA

SEQ ID NO: 1337924 - protein, 8 aa, Mycobacterium
TAGTGPYE

SEQ ID NO: 1337925 - protein, 5 aa, Mycobacterium
TAIAP

SEQ ID NO: 1337926 - protein, 7 aa, Mycobacterium
TALPEDV

SEQ ID NO: 1337927 - protein, 7 aa, Mycobacterium
TAPSDVP

SEQ ID NO: 1337928 - protein, 11 aa, Mycobacterium
TAPTAARNSAP

SEQ ID NO: 1337929 - protein, 10 aa, Mycobacterium
TAQAQPATGL

SEQ ID NO: 1337930 - protein, 5 aa, Mycobacterium
TARDI

SEQ ID NO: 1337931 - protein, 4 aa, Mycobacterium
TARR

SEQ ID NO: 1337932 - protein, 6 aa, Mycobacterium
TARTTH

SEQ ID NO: 1337933 - protein, 9 aa, Mycobacterium
TASNPGPVV

SEQ ID NO: 1337934 - protein, 7 aa, Mycobacterium
TASSGEH

SEQ ID NO: 1337935 - protein, 14 aa, Mycobacterium
TATAGARGLGPAAV

SEQ ID NO: 1337936 - protein, 13 aa, Mycobacterium
TATDEAIQGAATP

SEQ ID NO: 1337937 - protein, 14 aa, Mycobacterium
TATEDQPDPAADPR

SEQ ID NO: 1337938 - protein, 10 aa, Mycobacterium
TATHTAESQR

SEQ ID NO: 1337939 - protein, 5 aa, Mycobacterium
TATNT

SEQ ID NO: 1337940 - protein, 7 aa, Mycobacterium
TATPAIA

SEQ ID NO: 1337941 - protein, 5 aa, Mycobacterium
TATTS

SEQ ID NO: 1337942 - protein, 18 aa, Mycobacterium
TAVRSTPGLDDDSRSPVD

SEQ ID NO: 1337943 - protein, 8 aa, Mycobacterium
TCSDGSPL

SEQ ID NO: 1337944 - protein, 17 aa, Mycobacterium
TDEQTQEYNTMYAAVTG

SEQ ID NO: 1337945 - protein, 5 aa, Mycobacterium
TDGTV

SEQ ID NO: 1337946 - protein, 9 aa, Mycobacterium
TDKNLETGD

SEQ ID NO: 1337947 - protein, 6 aa, Mycobacterium
TDPATR

SEQ ID NO: 1337948 - protein, 8 aa, Mycobacterium
TDPEQVDS

SEQ ID NO: 1337949 - protein, 7 aa, Mycobacterium
TDPKNRA

SEQ ID NO: 1337950 - protein, 7 aa, Mycobacterium
TDPPVTG

SEQ ID NO: 1337951 - protein, 6 aa, Mycobacterium
TDPSMA

SEQ ID NO: 1337952 - protein, 19 aa, Mycobacterium
TDQNVTTMEGANEGGRYAA

SEQ ID NO: 1337953 - protein, 4 aa, Mycobacterium
TDRA

SEQ ID NO: 1337954 - protein, 13 aa, Mycobacterium
TDRDYQNADKPTR

SEQ ID NO: 1337955 - protein, 21 aa, Mycobacterium
TDRGTSATNEWPANAGVRSTG

SEQ ID NO: 1337956 - protein, 18 aa, Mycobacterium
TDRSENRYGIATRGSKSW

SEQ ID NO: 1337957 - protein, 16 aa, Mycobacterium
TDSEKRAAIETTPARK

SEQ ID NO: 1337958 - protein, 9 aa, Mycobacterium
TDTCPTGVA

SEQ ID NO: 1337959 - protein, 6 aa, Mycobacterium
TDTGAV

SEQ ID NO: 1337960 - protein, 14 aa, Mycobacterium
TDTGTEALKNTASA

SEQ ID NO: 1337961 - protein, 5 aa, Mycobacterium
TDTGV

SEQ ID NO: 1337962 - protein, 15 aa, Mycobacterium
TDTPIPADVLDTTPG

SEQ ID NO: 1337963 - protein, 7 aa, Mycobacterium
TEDGDEI

SEQ ID NO: 1337964 - protein, 12 aa, Mycobacterium
TEDGPRILTLPA

SEQ ID NO: 1337965 - protein, 6 aa, Mycobacterium
TEEPRA

SEQ ID NO: 1337966 - protein, 6 aa, Mycobacterium
TEGTAE

SEQ ID NO: 1337967 - protein, 5 aa, Mycobacterium
TEIDN

SEQ ID NO: 1337968 - protein, 10 aa, Mycobacterium
TEIGPPSDGI

SEQ ID NO: 1337969 - protein, 7 aa, Mycobacterium
TEKRREQ

SEQ ID NO: 1337970 - protein, 17 aa, Mycobacterium
TEPAPVDDAAPEAGFTT

SEQ ID NO: 1337971 - protein, 5 aa, Mycobacterium
TERDP

SEQ ID NO: 1337972 - protein, 21 aa, Mycobacterium
TERGRASYTTEGTTGLPAGGD

SEQ ID NO: 1337973 - protein, 8 aa, Mycobacterium
TEVPEDGG

SEQ ID NO: 1337974 - protein, 26 aa, Mycobacterium
TFERESRNRPDSTLQTEKSSEPEGFE

SEQ ID NO: 1337975 - protein, 5 aa, Mycobacterium
TFGEQ

SEQ ID NO: 1337976 - protein, 5 aa, Mycobacterium
TFTPH

SEQ ID NO: 1337977 - protein, 8 aa, Mycobacterium
TGAGSGIG

SEQ ID NO: 1337978 - protein, 16 aa, Mycobacterium
TGAGTAEQAVPEDKTA

SEQ ID NO: 1337979 - protein, 12 aa, Mycobacterium
TGAMNQSGERQQ

SEQ ID NO: 1337980 - protein, 28 aa, Mycobacterium
TGCGDDEKGNPVPAPSTQETAPEAKEFG

SEQ ID NO: 1337981 - protein, 8 aa, Mycobacterium
TGDPVDGY

SEQ ID NO: 1337982 - protein, 5 aa, Mycobacterium
TGDRI

SEQ ID NO: 1337983 - protein, 6 aa, Mycobacterium
TGDSDV

SEQ ID NO: 1337984 - protein, 16 aa, Mycobacterium
TGFGEQAGIPDDEAEK

SEQ ID NO: 1337985 - protein, 9 aa, Mycobacterium
TGGDATRIN

SEQ ID NO: 1337986 - protein, 17 aa, Mycobacterium
TGGMWSGAGSPRGSCDT

SEQ ID NO: 1337987 - protein, 8 aa, Mycobacterium
TGHADRAT

SEQ ID NO: 1337988 - protein, 12 aa, Mycobacterium
TGITSGALRRPT

SEQ ID NO: 1337989 - protein, 15 aa, Mycobacterium
TGIYNQPDGASDWQM

SEQ ID NO: 1337990 - protein, 6 aa, Mycobacterium
TGKAGT

SEQ ID NO: 1337991 - protein, 6 aa, Mycobacterium
TGKSTI

SEQ ID NO: 1337992 - protein, 7 aa, Mycobacterium
TGPADPA

SEQ ID NO: 1337993 - protein, 9 aa, Mycobacterium
TGPAPVTNA

SEQ ID NO: 1337994 - protein, 9 aa, Mycobacterium
TGPGQAERT

SEQ ID NO: 1337995 - protein, 4 aa, Mycobacterium
TGQI

SEQ ID NO: 1337996 - protein, 4 aa, Mycobacterium
TGQN

SEQ ID NO: 1337997 - protein, 5 aa, Mycobacterium
TGQVD

SEQ ID NO: 1337998 - protein, 7 aa, Mycobacterium
TGRDTAS

SEQ ID NO: 1337999 - protein, 15 aa, Mycobacterium
TGRPGDLGGGGDIPG

SEQ ID NO: 1338000 - protein, 5 aa, Mycobacterium
TGRTV

SEQ ID NO: 1338001 - protein, 9 aa, Mycobacterium
TGRYPTTEE

SEQ ID NO: 1338002 - protein, 9 aa, Mycobacterium
TGSLTGTNS

SEQ ID NO: 1338003 - protein, 8 aa, Mycobacterium
TGSPPANQ

SEQ ID NO: 1338004 - protein, 7 aa, Mycobacterium
TGSPTAG

SEQ ID NO: 1338005 - protein, 7 aa, Mycobacterium
TGTPAGI

SEQ ID NO: 1338006 - protein, 15 aa, Mycobacterium
TGTPSELDAGTSGGN

SEQ ID NO: 1338007 - protein, 7 aa, Mycobacterium
TGTRASL

SEQ ID NO: 1338008 - protein, 6 aa, Mycobacterium
TGTRTA

SEQ ID NO: 1338009 - protein, 10 aa, Mycobacterium
TGTSGKTTTT

SEQ ID NO: 1338010 - protein, 6 aa, Mycobacterium
TGVPDT

SEQ ID NO: 1338011 - protein, 12 aa, Mycobacterium
TGVSAGVNASTS

SEQ ID NO: 1338012 - protein, 5 aa, Mycobacterium
TGYAP

SEQ ID NO: 1338013 - protein, 7 aa, Mycobacterium
THRRPGR

SEQ ID NO: 1338014 - protein, 6 aa, Mycobacterium
THSPEN

SEQ ID NO: 1338015 - protein, 6 aa, Mycobacterium
TKETPA

SEQ ID NO: 1338016 - protein, 9 aa, Mycobacterium
TKKAASVRI

SEQ ID NO: 1338017 - protein, 5 aa, Mycobacterium
TLGES

SEQ ID NO: 1338018 - protein, 4 aa, Mycobacterium
TLGG

SEQ ID NO: 1338019 - protein, 7 aa, Mycobacterium
TLNEGRG

SEQ ID NO: 1338020 - protein, 9 aa, Mycobacterium
TLPEERSRE

SEQ ID NO: 1338021 - protein, 6 aa, Mycobacterium
TLPGKG

SEQ ID NO: 1338022 - protein, 9 aa, Mycobacterium
TLPPGPERT

SEQ ID NO: 1338023 - protein, 5 aa, Mycobacterium
TLSEA

SEQ ID NO: 1338024 - protein, 16 aa, Mycobacterium
TLSRTAAVASAQSCPQ

SEQ ID NO: 1338025 - protein, 15 aa, Mycobacterium
TLTSAPPQARAAPRG

SEQ ID NO: 1338026 - protein, 9 aa, Mycobacterium
TLTSRDQIN

SEQ ID NO: 1338027 - protein, 9 aa, Mycobacterium
TMTDQGSNA

SEQ ID NO: 1338028 - protein, 14 aa, Mycobacterium
TNAPVPVTEPGDSC

SEQ ID NO: 1338029 - protein, 6 aa, Mycobacterium
TNDGLR

SEQ ID NO: 1338030 - protein, 6 aa, Mycobacterium
TNEAGE

SEQ ID NO: 1338031 - protein, 6 aa, Mycobacterium
TNEGGR

SEQ ID NO: 1338032 - protein, 13 aa, Mycobacterium
TNPNSLRLFELSV

SEQ ID NO: 1338033 - protein, 5 aa, Mycobacterium
TNRYT

SEQ ID NO: 1338034 - protein, 10 aa, Mycobacterium
TPADRQDAQR

SEQ ID NO: 1338035 - protein, 5 aa, Mycobacterium
TPAEA

SEQ ID NO: 1338036 - protein, 14 aa, Mycobacterium
TPASSLAADQDALA

SEQ ID NO: 1338037 - protein, 4 aa, Mycobacterium
TPEA

SEQ ID NO: 1338038 - protein, 5 aa, Mycobacterium
TPGNL

SEQ ID NO: 1338039 - protein, 9 aa, Mycobacterium
TPGNPKGIR

SEQ ID NO: 1338040 - protein, 14 aa, Mycobacterium
TPNPEIPAKGTLPQ

SEQ ID NO: 1338041 - protein, 14 aa, Mycobacterium
TPPDPLPAGGPGDL

SEQ ID NO: 1338042 - protein, 6 aa, Mycobacterium
TPPIAR

SEQ ID NO: 1338043 - protein, 5 aa, Mycobacterium
TPPKV

SEQ ID NO: 1338044 - protein, 5 aa, Mycobacterium
TPPYS

SEQ ID NO: 1338045 - protein, 12 aa, Mycobacterium
TPQEFGPRQLGP

SEQ ID NO: 1338046 - protein, 13 aa, Mycobacterium
TPQTTEFSAPDQA

SEQ ID NO: 1338047 - protein, 4 aa, Mycobacterium
TPQW

SEQ ID NO: 1338048 - protein, 10 aa, Mycobacterium
TPSGRAGSAY

SEQ ID NO: 1338049 - protein, 6 aa, Mycobacterium
TPTDGL

SEQ ID NO: 1338050 - protein, 15 aa, Mycobacterium
TPTGVAAEETADDPA

SEQ ID NO: 1338051 - protein, 6 aa, Mycobacterium
TPTMSD

SEQ ID NO: 1338052 - protein, 7 aa, Mycobacterium
TPYGAEQ

SEQ ID NO: 1338053 - protein, 8 aa, Mycobacterium
TQAPPRPW

SEQ ID NO: 1338054 - protein, 13 aa, Mycobacterium
TQEDVKTALEEAG

SEQ ID NO: 1338055 - protein, 7 aa, Mycobacterium
TQEVSGS

SEQ ID NO: 1338056 - protein, 7 aa, Mycobacterium
TQLSPEH

SEQ ID NO: 1338057 - protein, 7 aa, Mycobacterium
TQNQAAA

SEQ ID NO: 1338058 - protein, 9 aa, Mycobacterium
TQPTPGAFT

SEQ ID NO: 1338059 - protein, 8 aa, Mycobacterium
TQQTAAPM

SEQ ID NO: 1338060 - protein, 8 aa, Mycobacterium
TRDPGPGM

SEQ ID NO: 1338061 - protein, 5 aa, Mycobacterium
TRDSQ

SEQ ID NO: 1338062 - protein, 9 aa, Mycobacterium
TRDTETGLT

SEQ ID NO: 1338063 - protein, 6 aa, Mycobacterium
TREQEK

SEQ ID NO: 1338064 - protein, 17 aa, Mycobacterium
TRFGTAGTVRPADADAE

SEQ ID NO: 1338065 - protein, 16 aa, Mycobacterium
TRGPGANIQEKYASGK

SEQ ID NO: 1338066 - protein, 9 aa, Mycobacterium
TRGSEQDAV

SEQ ID NO: 1338067 - protein, 9 aa, Mycobacterium
TRIPGPPTR

SEQ ID NO: 1338068 - protein, 21 aa, Mycobacterium
TRKEYRSGQGNLQINRYLEFE

SEQ ID NO: 1338069 - protein, 5 aa, Mycobacterium
TRNQQ

SEQ ID NO: 1338070 - protein, 7 aa, Mycobacterium
TRRRQRD

SEQ ID NO: 1338071 - protein, 13 aa, Mycobacterium
TRSGDTAARLGQS

SEQ ID NO: 1338072 - protein, 4 aa, Mycobacterium
TRSV

SEQ ID NO: 1338073 - protein, 10 aa, Mycobacterium
TRTNRPVGDP

SEQ ID NO: 1338074 - protein, 8 aa, Mycobacterium
TSAGASAG

SEQ ID NO: 1338075 - protein, 6 aa, Mycobacterium
TSAGGS

SEQ ID NO: 1338076 - protein, 8 aa, Mycobacterium
TSAYTGPE

SEQ ID NO: 1338077 - protein, 8 aa, Mycobacterium
TSDGSRAA

SEQ ID NO: 1338078 - protein, 7 aa, Mycobacterium
TSDPFYS

SEQ ID NO: 1338079 - protein, 11 aa, Mycobacterium
TSDPRAEEGRA

SEQ ID NO: 1338080 - protein, 9 aa, Mycobacterium
TSEAGGTDT

SEQ ID NO: 1338081 - protein, 5 aa, Mycobacterium
TSERR

SEQ ID NO: 1338082 - protein, 10 aa, Mycobacterium
TSEVETGKVG

SEQ ID NO: 1338083 - protein, 26 aa, Mycobacterium
TSGCGEDPPLGSSNRGSGSETERTSV

SEQ ID NO: 1338084 - protein, 7 aa, Mycobacterium
TSGDLND

SEQ ID NO: 1338085 - protein, 9 aa, Mycobacterium
TSGVGPDQP

SEQ ID NO: 1338086 - protein, 5 aa, Mycobacterium
TSNIT

SEQ ID NO: 1338087 - protein, 14 aa, Mycobacterium
TSNPALRAHLRQRL

SEQ ID NO: 1338088 - protein, 5 aa, Mycobacterium
TSNPF

SEQ ID NO: 1338089 - protein, 9 aa, Mycobacterium
TSSGSGAGV

SEQ ID NO: 1338090 - protein, 10 aa, Mycobacterium
TSSPAGQAKS

SEQ ID NO: 1338091 - protein, 5 aa, Mycobacterium
TSTDQ

SEQ ID NO: 1338092 - protein, 10 aa, Mycobacterium
TSVGGAVGGV

SEQ ID NO: 1338093 - protein, 11 aa, Mycobacterium
TSVPGAGKGVA

SEQ ID NO: 1338094 - protein, 8 aa, Mycobacterium
TSWTGAGG

SEQ ID NO: 1338095 - protein, 9 aa, Mycobacterium
TSYGTAAEN

SEQ ID NO: 1338096 - protein, 9 aa, Mycobacterium
TTDAAERAY

SEQ ID NO: 1338097 - protein, 22 aa, Mycobacterium
TTDDAGPAVSASSTATPPPLNS

SEQ ID NO: 1338098 - protein, 10 aa, Mycobacterium
TTEHRPAEAG

SEQ ID NO: 1338099 - protein, 11 aa, Mycobacterium
TTGDPATPYEA

SEQ ID NO: 1338100 - protein, 4 aa, Mycobacterium
TTGP

SEQ ID NO: 1338101 - protein, 12 aa, Mycobacterium
TTIPPGVPSETL

SEQ ID NO: 1338102 - protein, 7 aa, Mycobacterium
TTKPGDE

SEQ ID NO: 1338103 - protein, 6 aa, Mycobacterium
TTKTKV

SEQ ID NO: 1338104 - protein, 6 aa, Mycobacterium
TTLQGR

SEQ ID NO: 1338105 - protein, 7 aa, Mycobacterium
TTNPPVE

SEQ ID NO: 1338106 - protein, 5 aa, Mycobacterium
TTPQE

SEQ ID NO: 1338107 - protein, 9 aa, Mycobacterium
TTPTGTSKC

SEQ ID NO: 1338108 - protein, 5 aa, Mycobacterium
TTRKR

SEQ ID NO: 1338109 - protein, 23 aa, Mycobacterium
TTSCTDTIAPGDSAYDNAHAAED

SEQ ID NO: 1338110 - protein, 4 aa, Mycobacterium
TTSL

SEQ ID NO: 1338111 - protein, 7 aa, Mycobacterium
TTTGPET

SEQ ID NO: 1338112 - protein, 12 aa, Mycobacterium
TTVTGNPTWPGA

SEQ ID NO: 1338113 - protein, 6 aa, Mycobacterium
TTYPTV

SEQ ID NO: 1338114 - protein, 25 aa, Mycobacterium
TVEGTAARAGSGGGPSNNDSERQYP

SEQ ID NO: 1338115 - protein, 8 aa, Mycobacterium
TVHGEGDH

SEQ ID NO: 1338116 - protein, 6 aa, Mycobacterium
TVPGGP

SEQ ID NO: 1338117 - protein, 11 aa, Mycobacterium
TVPNRRGGKGI

SEQ ID NO: 1338118 - protein, 12 aa, Mycobacterium
TVTAPQGTIRDR

SEQ ID NO: 1338119 - protein, 9 aa, Mycobacterium
TVTCSGGTI

SEQ ID NO: 1338120 - protein, 9 aa, Mycobacterium
TVTGEGEAI

SEQ ID NO: 1338121 - protein, 16 aa, Mycobacterium
TVTGGPPAPSPVGTDG

SEQ ID NO: 1338122 - protein, 12 aa, Mycobacterium
TYAGRPAYAQPV

SEQ ID NO: 1338123 - protein, 6 aa, Mycobacterium
TYGPDD

SEQ ID NO: 1338124 - protein, 14 aa, Mycobacterium
TYGVPVNSPDGYRT

SEQ ID NO: 1338125 - protein, 11 aa, Mycobacterium
TYNAGASGDGM

SEQ ID NO: 1338126 - protein, 21 aa, Mycobacterium
TYRDGDPKIDDLGSNNKITKQ

SEQ ID NO: 1338127 - protein, 12 aa, Mycobacterium
TYSATSNGEWAK

SEQ ID NO: 1338128 - protein, 7 aa, Mycobacterium
VAAEPRP

SEQ ID NO: 1338129 - protein, 7 aa, Mycobacterium
VAAGARV

SEQ ID NO: 1338130 - protein, 6 aa, Mycobacterium
VAAQRG

SEQ ID NO: 1338131 - protein, 17 aa, Mycobacterium
VAEGGKCQRVAGTNTEM

SEQ ID NO: 1338132 - protein, 6 aa, Mycobacterium
VAELGG

SEQ ID NO: 1338133 - protein, 7 aa, Mycobacterium
VAESTVD

SEQ ID NO: 1338134 - protein, 13 aa, Mycobacterium
VAGGGEAVDTRDM

SEQ ID NO: 1338135 - protein, 8 aa, Mycobacterium
VAGRQDSF

SEQ ID NO: 1338136 - protein, 15 aa, Mycobacterium
VAGTITRDAGPDEFN

SEQ ID NO: 1338137 - protein, 9 aa, Mycobacterium
VAPGPTDTP

SEQ ID NO: 1338138 - protein, 21 aa, Mycobacterium
VAPPASATPEGDATQRYGQPP

SEQ ID NO: 1338139 - protein, 4 aa, Mycobacterium
VAQT

SEQ ID NO: 1338140 - protein, 7 aa, Mycobacterium
VARGDIG

SEQ ID NO: 1338141 - protein, 9 aa, Mycobacterium
VASAQPNLG

SEQ ID NO: 1338142 - protein, 10 aa, Mycobacterium
VASGVSASTS

SEQ ID NO: 1338143 - protein, 30 aa, Mycobacterium
VATPAAAPAQPPVPADPAAPPADAVPAPPG

SEQ ID NO: 1338144 - protein, 14 aa, Mycobacterium
VATRSVSTSTPTVS

SEQ ID NO: 1338145 - protein, 7 aa, Mycobacterium
VATSRPT

SEQ ID NO: 1338146 - protein, 8 aa, Mycobacterium
VDADKDQS

SEQ ID NO: 1338147 - protein, 12 aa, Mycobacterium
VDANGEASDGQI

SEQ ID NO: 1338148 - protein, 11 aa, Mycobacterium
VDDVDTESGRI

SEQ ID NO: 1338149 - protein, 9 aa, Mycobacterium
VDDVPDNGQ

SEQ ID NO: 1338150 - protein, 14 aa, Mycobacterium
VDGNKGFKAADTNA

SEQ ID NO: 1338151 - protein, 12 aa, Mycobacterium
VDPAPAATHSAA

SEQ ID NO: 1338152 - protein, 11 aa, Mycobacterium
VDPDAELERPG

SEQ ID NO: 1338153 - protein, 28 aa, Mycobacterium
VDPDGESDTPSATTQPGAPKLPKPGELA

SEQ ID NO: 1338154 - protein, 10 aa, Mycobacterium
VDPNADPLQA

SEQ ID NO: 1338155 - protein, 8 aa, Mycobacterium
VDPQRGRL

SEQ ID NO: 1338156 - protein, 17 aa, Mycobacterium
VDPSLGPIDESVAQQAG

SEQ ID NO: 1338157 - protein, 21 aa, Mycobacterium
VDPSVAAGQKPLGDAVDAASG

SEQ ID NO: 1338158 - protein, 11 aa, Mycobacterium
VDQNPDYQPTW

SEQ ID NO: 1338159 - protein, 9 aa, Mycobacterium
VDQTAKATG

SEQ ID NO: 1338160 - protein, 14 aa, Mycobacterium
VDSPDSRLNVPVRA

SEQ ID NO: 1338161 - protein, 21 aa, Mycobacterium
VDSSSGVTPPAPAAPPAGVVQ

SEQ ID NO: 1338162 - protein, 5 aa, Mycobacterium
VEAGA

SEQ ID NO: 1338163 - protein, 16 aa, Mycobacterium
VEDSPGCTASDYDGLP

SEQ ID NO: 1338164 - protein, 6 aa, Mycobacterium
VEEQTA

SEQ ID NO: 1338165 - protein, 14 aa, Mycobacterium
VEGNRGVDPDEAAQ

SEQ ID NO: 1338166 - protein, 6 aa, Mycobacterium
VEGVQG

SEQ ID NO: 1338167 - protein, 5 aa, Mycobacterium
VEPDD

SEQ ID NO: 1338168 - protein, 13 aa, Mycobacterium
VERPMKPGSSLTA

SEQ ID NO: 1338169 - protein, 40 aa, Mycobacterium
VESSEEPGTSETALAQEESTKSEGASEPADATAETDPLDD

SEQ ID NO: 1338170 - protein, 4 aa, Mycobacterium
VETE

SEQ ID NO: 1338171 - protein, 5 aa, Mycobacterium
VETSR

SEQ ID NO: 1338172 - protein, 11 aa, Mycobacterium
VFGPPAARAAL

SEQ ID NO: 1338173 - protein, 18 aa, Mycobacterium
VGCDTPEGEVAGDPAVPA

SEQ ID NO: 1338174 - protein, 7 aa, Mycobacterium
VGDDRGA

SEQ ID NO: 1338175 - protein, 7 aa, Mycobacterium
VGEAAPV

SEQ ID NO: 1338176 - protein, 4 aa, Mycobacterium
VGEG

SEQ ID NO: 1338177 - protein, 8 aa, Mycobacterium
VGGESAKS

SEQ ID NO: 1338178 - protein, 12 aa, Mycobacterium
VGGGDGDAHYAA

SEQ ID NO: 1338179 - protein, 17 aa, Mycobacterium
VGGKTSAPNGASEVSGG

SEQ ID NO: 1338180 - protein, 10 aa, Mycobacterium
VGGPSDVDGA

SEQ ID NO: 1338181 - protein, 14 aa, Mycobacterium
VGGTPRPAPVGTDG

SEQ ID NO: 1338182 - protein, 4 aa, Mycobacterium
VGIG

SEQ ID NO: 1338183 - protein, 4 aa, Mycobacterium
VGNG

SEQ ID NO: 1338184 - protein, 7 aa, Mycobacterium
VGPADAP

SEQ ID NO: 1338185 - protein, 6 aa, Mycobacterium
VGRIDP

SEQ ID NO: 1338186 - protein, 8 aa, Mycobacterium
VGSPGAPF

SEQ ID NO: 1338187 - protein, 8 aa, Mycobacterium
VGSPTRPE

SEQ ID NO: 1338188 - protein, 4 aa, Mycobacterium
VGTT

SEQ ID NO: 1338189 - protein, 5 aa, Mycobacterium
VHPGG

SEQ ID NO: 1338190 - protein, 19 aa, Mycobacterium
VKEGTAVAQPAARLPEAAA

SEQ ID NO: 1338191 - protein, 23 aa, Mycobacterium
VKGPATEPLKSRPVAVEGDEVVL

SEQ ID NO: 1338192 - protein, 13 aa, Mycobacterium
VKSDGGKNPQAGL

SEQ ID NO: 1338193 - protein, 17 aa, Mycobacterium
VNAADAPSYGSHNDYGT

SEQ ID NO: 1338194 - protein, 24 aa, Mycobacterium
VNNDGDFNIGGDNDGDFNIGTGNV

SEQ ID NO: 1338195 - protein, 12 aa, Mycobacterium
VNPPAAAQDVSP

SEQ ID NO: 1338196 - protein, 8 aa, Mycobacterium
VNRPTPLT

SEQ ID NO: 1338197 - protein, 14 aa, Mycobacterium
VNTDPEVPPPPVAP

SEQ ID NO: 1338198 - protein, 8 aa, Mycobacterium
VPAASAPV

SEQ ID NO: 1338199 - protein, 7 aa, Mycobacterium
VPAPGFP

SEQ ID NO: 1338200 - protein, 7 aa, Mycobacterium
VPESLRG

SEQ ID NO: 1338201 - protein, 10 aa, Mycobacterium
VPGDPAPSVT

SEQ ID NO: 1338202 - protein, 7 aa, Mycobacterium
VPGGTYA

SEQ ID NO: 1338203 - protein, 14 aa, Mycobacterium
VPISQDAQSVRAGG

SEQ ID NO: 1338204 - protein, 7 aa, Mycobacterium
VPNGENI

SEQ ID NO: 1338205 - protein, 13 aa, Mycobacterium
VPPGSRTSTYTDL

SEQ ID NO: 1338206 - protein, 14 aa, Mycobacterium
VPPPGQWDKPAHWF

SEQ ID NO: 1338207 - protein, 5 aa, Mycobacterium
VPRDG

SEQ ID NO: 1338208 - protein, 5 aa, Mycobacterium
VPSAD

SEQ ID NO: 1338209 - protein, 7 aa, Mycobacterium
VPSPGQI

SEQ ID NO: 1338210 - protein, 4 aa, Mycobacterium
VPTK

SEQ ID NO: 1338211 - protein, 6 aa, Mycobacterium
VPTVAP

SEQ ID NO: 1338212 - protein, 19 aa, Mycobacterium
VPTVTTTSPAAGNDAAHRD

SEQ ID NO: 1338213 - protein, 14 aa, Mycobacterium
VQEGKDVASPSRHT

SEQ ID NO: 1338214 - protein, 7 aa, Mycobacterium
VQSYPTS

SEQ ID NO: 1338215 - protein, 6 aa, Mycobacterium
VQTAAQ

SEQ ID NO: 1338216 - protein, 14 aa, Mycobacterium
VQTADGAVTARDPI

SEQ ID NO: 1338217 - protein, 4 aa, Mycobacterium
VQTP

SEQ ID NO: 1338218 - protein, 20 aa, Mycobacterium
VQTPEFDRYGGTRGGAPRLT

SEQ ID NO: 1338219 - protein, 6 aa, Mycobacterium
VQTSAT

SEQ ID NO: 1338220 - protein, 13 aa, Mycobacterium
VRAGDSGGPVVNS

SEQ ID NO: 1338221 - protein, 10 aa, Mycobacterium
VRASGGRVTA

SEQ ID NO: 1338222 - protein, 9 aa, Mycobacterium
VRPADPDYT

SEQ ID NO: 1338223 - protein, 7 aa, Mycobacterium
VRPENSH

SEQ ID NO: 1338224 - protein, 4 aa, Mycobacterium
VRPG

SEQ ID NO: 1338225 - protein, 16 aa, Mycobacterium
VRRTRAGVADPNRPTG

SEQ ID NO: 1338226 - protein, 14 aa, Mycobacterium
VRSTSGSPGGLPGA

SEQ ID NO: 1338227 - protein, 7 aa, Mycobacterium
VRTDRTR

SEQ ID NO: 1338228 - protein, 14 aa, Mycobacterium
VRTNNMAPYLVRYI

SEQ ID NO: 1338229 - protein, 17 aa, Mycobacterium
VRVTGGTITAANTDPAV

SEQ ID NO: 1338230 - protein, 8 aa, Mycobacterium
VSAPTPTP

SEQ ID NO: 1338231 - protein, 11 aa, Mycobacterium
VSAQNPGVDGE

SEQ ID NO: 1338232 - protein, 11 aa, Mycobacterium
VSASGRPADWR

SEQ ID NO: 1338233 - protein, 9 aa, Mycobacterium
VSDTGRRRK

SEQ ID NO: 1338234 - protein, 9 aa, Mycobacterium
VSGATTQLR

SEQ ID NO: 1338235 - protein, 5 aa, Mycobacterium
VSGNT

SEQ ID NO: 1338236 - protein, 7 aa, Mycobacterium
VSGPDQT

SEQ ID NO: 1338237 - protein, 5 aa, Mycobacterium
VSGQG

SEQ ID NO: 1338238 - protein, 7 aa, Mycobacterium
VSGQLNP

SEQ ID NO: 1338239 - protein, 16 aa, Mycobacterium
VSGSTPAQKIKDEYPG

SEQ ID NO: 1338240 - protein, 6 aa, Mycobacterium
VSIPAD

SEQ ID NO: 1338241 - protein, 11 aa, Mycobacterium
VSKKGDSGGPV

SEQ ID NO: 1338242 - protein, 8 aa, Mycobacterium
VSNTGRDS

SEQ ID NO: 1338243 - protein, 12 aa, Mycobacterium
VSPPPEIGARFS

SEQ ID NO: 1338244 - protein, 14 aa, Mycobacterium
VSPPVASAQPAAAA

SEQ ID NO: 1338245 - protein, 4 aa, Mycobacterium
VSQG

SEQ ID NO: 1338246 - protein, 8 aa, Mycobacterium
VSSAGNAV

SEQ ID NO: 1338247 - protein, 9 aa, Mycobacterium
VSSTAERSA

SEQ ID NO: 1338248 - protein, 13 aa, Mycobacterium
VSVPTGGAPPRGT

SEQ ID NO: 1338249 - protein, 23 aa, Mycobacterium
VTAPGSLSDTELQRAAAESGVDY

SEQ ID NO: 1338250 - protein, 10 aa, Mycobacterium
VTDESSVETA

SEQ ID NO: 1338251 - protein, 8 aa, Mycobacterium
VTEGTAAE

SEQ ID NO: 1338252 - protein, 6 aa, Mycobacterium
VTGEPV

SEQ ID NO: 1338253 - protein, 12 aa, Mycobacterium
VTGGAASGVRVQ

SEQ ID NO: 1338254 - protein, 23 aa, Mycobacterium
VTGGASIGANTDKTDDAAGGDET

SEQ ID NO: 1338255 - protein, 8 aa, Mycobacterium
VTGGDAPR

SEQ ID NO: 1338256 - protein, 13 aa, Mycobacterium
VTGPGGLNNTTTR

SEQ ID NO: 1338257 - protein, 15 aa, Mycobacterium
VTPDTEVSNSGGVRL

SEQ ID NO: 1338258 - protein, 8 aa, Mycobacterium
VTPPQRGV

SEQ ID NO: 1338259 - protein, 10 aa, Mycobacterium
VTPSGLDGPG

SEQ ID NO: 1338260 - protein, 20 aa, Mycobacterium
VTPTGDAYEPRNTDAPDALQ

SEQ ID NO: 1338261 - protein, 18 aa, Mycobacterium
VTRADGGKTGVGRGYGGA

SEQ ID NO: 1338262 - protein, 10 aa, Mycobacterium
VTRPGGEAVA

SEQ ID NO: 1338263 - protein, 9 aa, Mycobacterium
VTSEGTDQT

SEQ ID NO: 1338264 - protein, 8 aa, Mycobacterium
VTSGQADA

SEQ ID NO: 1338265 - protein, 14 aa, Mycobacterium
VTSGSGQVDREAAP

SEQ ID NO: 1338266 - protein, 4 aa, Mycobacterium
VTTA

SEQ ID NO: 1338267 - protein, 6 aa, Mycobacterium
VVETGG

SEQ ID NO: 1338268 - protein, 9 aa, Mycobacterium
VVGPGGVAQ

SEQ ID NO: 1338269 - protein, 6 aa, Mycobacterium
VVPTPG

SEQ ID NO: 1338270 - protein, 19 aa, Mycobacterium
VYTPDDKAVQTPNSDTPYS

SEQ ID NO: 1338271 - protein, 6 aa, Mycobacterium
WAARAG

SEQ ID NO: 1338272 - protein, 8 aa, Mycobacterium
WDSPGRWT

SEQ ID NO: 1338273 - protein, 8 aa, Mycobacterium
WDTPGRWT

SEQ ID NO: 1338274 - protein, 5 aa, Mycobacterium
WGADE

SEQ ID NO: 1338275 - protein, 9 aa, Mycobacterium
WGAGQTGTA

SEQ ID NO: 1338276 - protein, 9 aa, Mycobacterium
WGAPPAKAD

SEQ ID NO: 1338277 - protein, 10 aa, Mycobacterium
WGPGEDPGTI

SEQ ID NO: 1338278 - protein, 7 aa, Mycobacterium
WGRDPAT

SEQ ID NO: 1338279 - protein, 7 aa, Mycobacterium
WKRDEAV

SEQ ID NO: 1338280 - protein, 12 aa, Mycobacterium
WPPRTSPGGPDP

SEQ ID NO: 1338281 - protein, 12 aa, Mycobacterium
WRNPTSDRIPNK

SEQ ID NO: 1338282 - protein, 12 aa, Mycobacterium
WTEPDDWQQPRP

SEQ ID NO: 1338283 - protein, 6 aa, Mycobacterium
WTESPD

SEQ ID NO: 1338284 - protein, 11 aa, Mycobacterium
WTTTASPGIPP

SEQ ID NO: 1338285 - protein, 20 aa, Mycobacterium
WVPPGDENPWVGPEYDINPY

SEQ ID NO: 1338286 - protein, 9 aa, Mycobacterium
YADGRPADA

SEQ ID NO: 1338287 - protein, 8 aa, Mycobacterium
YADPDGDV

SEQ ID NO: 1338288 - protein, 8 aa, Mycobacterium
YAGAPPAD

SEQ ID NO: 1338289 - protein, 9 aa, Mycobacterium
YAGGPEGKR

SEQ ID NO: 1338290 - protein, 10 aa, Mycobacterium
YARSTGGGYT

SEQ ID NO: 1338291 - protein, 6 aa, Mycobacterium
YASSRT

SEQ ID NO: 1338292 - protein, 4 aa, Mycobacterium
YDET

SEQ ID NO: 1338293 - protein, 4 aa, Mycobacterium
YDNP

SEQ ID NO: 1338294 - protein, 11 aa, Mycobacterium
YDPDAEDVTAT

SEQ ID NO: 1338295 - protein, 6 aa, Mycobacterium
YDPDND

SEQ ID NO: 1338296 - protein, 9 aa, Mycobacterium
YDQPDGAQA

SEQ ID NO: 1338297 - protein, 9 aa, Mycobacterium
YDSSNPDNQ

SEQ ID NO: 1338298 - protein, 14 aa, Mycobacterium
YEGQSAVKTARTID

SEQ ID NO: 1338299 - protein, 9 aa, Mycobacterium
YEGRDYNPA

SEQ ID NO: 1338300 - protein, 9 aa, Mycobacterium
YERGETPNP

SEQ ID NO: 1338301 - protein, 5 aa, Mycobacterium
YGASA

SEQ ID NO: 1338302 - protein, 7 aa, Mycobacterium
YGDDPVA

SEQ ID NO: 1338303 - protein, 10 aa, Mycobacterium
YGGDDAASRL

SEQ ID NO: 1338304 - protein, 6 aa, Mycobacterium
YGGTAG

SEQ ID NO: 1338305 - protein, 13 aa, Mycobacterium
YGPGDGPFNQPGL

SEQ ID NO: 1338306 - protein, 6 aa, Mycobacterium
YGPPDM

SEQ ID NO: 1338307 - protein, 6 aa, Mycobacterium
YGPQGQ

SEQ ID NO: 1338308 - protein, 5 aa, Mycobacterium
YGSPP

SEQ ID NO: 1338309 - protein, 12 aa, Mycobacterium
YGTDYANPPLYG

SEQ ID NO: 1338310 - protein, 14 aa, Mycobacterium
YGTGTRVEPTADPL

SEQ ID NO: 1338311 - protein, 9 aa, Mycobacterium
YKVPANATA

SEQ ID NO: 1338312 - protein, 6 aa, Mycobacterium
YNDGGQ

SEQ ID NO: 1338313 - protein, 7 aa, Mycobacterium
YPDPEVA

SEQ ID NO: 1338314 - protein, 11 aa, Mycobacterium
YPDRPAAGRGT

SEQ ID NO: 1338315 - protein, 4 aa, Mycobacterium
YPED

SEQ ID NO: 1338316 - protein, 7 aa, Mycobacterium
YPKLNSS

SEQ ID NO: 1338317 - protein, 11 aa, Mycobacterium
YPNATGDLGDG

SEQ ID NO: 1338318 - protein, 15 aa, Mycobacterium
YPPADPSVWHWGHNA

SEQ ID NO: 1338319 - protein, 27 aa, Mycobacterium
YPPDKSKDEIDEANTADFRNSEANAEY

SEQ ID NO: 1338320 - protein, 6 aa, Mycobacterium
YPPGST

SEQ ID NO: 1338321 - protein, 15 aa, Mycobacterium
YQRRDASGHYANRQD

SEQ ID NO: 1338322 - protein, 10 aa, Mycobacterium
YRAAGGSNAT

SEQ ID NO: 1338323 - protein, 10 aa, Mycobacterium
YRGKDDQVSV

SEQ ID NO: 1338324 - protein, 10 aa, Mycobacterium
YRNTDDSKFQ

SEQ ID NO: 1338325 - protein, 9 aa, Mycobacterium
YSDDNGQNW

SEQ ID NO: 1338326 - protein, 10 aa, Mycobacterium
YSNGTPVGVA

SEQ ID NO: 1338327 - protein, 14 aa, Mycobacterium
YSTDLTARAREGQL

SEQ ID NO: 1338328 - protein, 10 aa, Mycobacterium
YTDKDGYDIP

SEQ ID NO: 1338329 - protein, 9 aa, Mycobacterium
YTPPAPEDA

SEQ ID NO: 1338330 - protein, 19 aa, Mycobacterium
YTPSPDEGRPPAEDDSEEV

SEQ ID NO: 1338331 - protein, 4 aa, Mycobacterium
AAAA

SEQ ID NO: 1338332 - protein, 10 aa, Mycobacterium
AAAAAPAAAA

SEQ ID NO: 1338333 - protein, 9 aa, Mycobacterium
AAAAATPHD

SEQ ID NO: 1338334 - protein, 7 aa, Mycobacterium
AAAATLT

SEQ ID NO: 1338335 - protein, 6 aa, Mycobacterium
AAADAG

SEQ ID NO: 1338336 - protein, 9 aa, Mycobacterium
AAADPNNAA

SEQ ID NO: 1338337 - protein, 113 aa, Mycobacterium
AAADPSADAAGTDVSAHAPADTRQDDHTEKADEETDAPEDNAEDIPEDSAEDEAEDEAAPVEDEDTDAKTGHRDADDEEPTEDPVDEPVADDPVEDNEVDPEEPAESPAPVAT

SEQ ID NO: 1338338 - protein, 25 aa, Mycobacterium
AAAGSGIGPASADPGWKPDKDRHDQ

SEQ ID NO: 1338339 - protein, 8 aa, Mycobacterium
AAAKQYGL

SEQ ID NO: 1338340 - protein, 8 aa, Mycobacterium
AAARENAA

SEQ ID NO: 1338341 - protein, 9 aa, Mycobacterium
AAARSGDVT

SEQ ID NO: 1338342 - protein, 11 aa, Mycobacterium
AAATANPMDCP

SEQ ID NO: 1338343 - protein, 6 aa, Mycobacterium
AAATST

SEQ ID NO: 1338344 - protein, 9 aa, Mycobacterium
AADDDSRGT

SEQ ID NO: 1338345 - protein, 5 aa, Mycobacterium
AADNA

SEQ ID NO: 1338346 - protein, 12 aa, Mycobacterium
AADNLRGQGPAI

SEQ ID NO: 1338347 - protein, 19 aa, Mycobacterium
AADQGEIAGASAAGSPTAW

SEQ ID NO: 1338348 - protein, 5 aa, Mycobacterium
AADRA

SEQ ID NO: 1338349 - protein, 116 aa, Mycobacterium
AADSSDSSGASSESSSQASPSKESSTEASEPDREATTSDDEDQTEDQTDEDDEALDDSGSDDPAEEEPAEEPQLEKPVEEPQLDDETETTPDTPRRSTPSNRGDDDPIEDSTEDTA

SEQ ID NO: 1338350 - protein, 10 aa, Mycobacterium
AAEAGRPSSF

SEQ ID NO: 1338351 - protein, 9 aa, Mycobacterium
AAEATGEVG

SEQ ID NO: 1338352 - protein, 8 aa, Mycobacterium
AAEHGTSH

SEQ ID NO: 1338353 - protein, 5 aa, Mycobacterium
AAERA

SEQ ID NO: 1338354 - protein, 18 aa, Mycobacterium
AAESRSDAADAARATAER

SEQ ID NO: 1338355 - protein, 4 aa, Mycobacterium
AAGD

SEQ ID NO: 1338356 - protein, 11 aa, Mycobacterium
AAGETRVTADP

SEQ ID NO: 1338357 - protein, 8 aa, Mycobacterium
AAGGPGSA

SEQ ID NO: 1338358 - protein, 6 aa, Mycobacterium
AAGGPS

SEQ ID NO: 1338359 - protein, 28 aa, Mycobacterium
AAGPGRAADRYPRSSDRRANDQGAPSCR

SEQ ID NO: 1338360 - protein, 19 aa, Mycobacterium
AAGPSASTPDAMPDDETEN

SEQ ID NO: 1338361 - protein, 6 aa, Mycobacterium
AAGSKV

SEQ ID NO: 1338362 - protein, 167 aa, Mycobacterium
AAGVTPPGPPAPGGPSVSSVENVSPPAPPAPPAATVDSASGVTPPAPPAPGGPSVSSVENVSPPAPPAPGGGSSSTVERFSPPAPPAPAVPAANSVEAVTPPAPPAPGGPSVSSVENVSPPAPPAPGGGSSSTVERFSPPAPPAPAVPAANSVEAVTPPAPPAPPAA

SEQ ID NO: 1338363 - protein, 7 aa, Mycobacterium
AAKAEGE

SEQ ID NO: 1338364 - protein, 7 aa, Mycobacterium
AANGETV

SEQ ID NO: 1338365 - protein, 15 aa, Mycobacterium
AANPNAARDALGNRP

SEQ ID NO: 1338366 - protein, 7 aa, Mycobacterium
AANPSTV

SEQ ID NO: 1338367 - protein, 8 aa, Mycobacterium
AAPAAPPA

SEQ ID NO: 1338368 - protein, 17 aa, Mycobacterium
AAPAFADTTGQASDVGL

SEQ ID NO: 1338369 - protein, 9 aa, Mycobacterium
AAPAPADAG

SEQ ID NO: 1338370 - protein, 18 aa, Mycobacterium
AAPAPQASAAAARSTDAV

SEQ ID NO: 1338371 - protein, 4 aa, Mycobacterium
AAPD

SEQ ID NO: 1338372 - protein, 5 aa, Mycobacterium
AAPDV

SEQ ID NO: 1338373 - protein, 15 aa, Mycobacterium
AAPPAPQPGAGCAPA

SEQ ID NO: 1338374 - protein, 14 aa, Mycobacterium
AAPPPSCSAPALPG

SEQ ID NO: 1338375 - protein, 7 aa, Mycobacterium
AAPQNLK

SEQ ID NO: 1338376 - protein, 7 aa, Mycobacterium
AAPYDQL

SEQ ID NO: 1338377 - protein, 9 aa, Mycobacterium
AAQPGGPYG

SEQ ID NO: 1338378 - protein, 15 aa, Mycobacterium
AAQPPAPAPPPAPNV

SEQ ID NO: 1338379 - protein, 5 aa, Mycobacterium
AAQRR

SEQ ID NO: 1338380 - protein, 4 aa, Mycobacterium
AARE

SEQ ID NO: 1338381 - protein, 12 aa, Mycobacterium
AARRTGLDNDAA

SEQ ID NO: 1338382 - protein, 11 aa, Mycobacterium
AASAAGNPQIA

SEQ ID NO: 1338383 - protein, 18 aa, Mycobacterium
AASAATGCSDGYSALGTH

SEQ ID NO: 1338384 - protein, 16 aa, Mycobacterium
AASDAPTDDATPVDLG

SEQ ID NO: 1338385 - protein, 13 aa, Mycobacterium
AATEAEDSRPGTA

SEQ ID NO: 1338386 - protein, 6 aa, Mycobacterium
AATGAA

SEQ ID NO: 1338387 - protein, 8 aa, Mycobacterium
AATGTPLV

SEQ ID NO: 1338388 - protein, 12 aa, Mycobacterium
AATGTVRVGGAE

SEQ ID NO: 1338389 - protein, 6 aa, Mycobacterium
AATKNA

SEQ ID NO: 1338390 - protein, 32 aa, Mycobacterium
AATPAAPPVGAPPAGGPAAPAMAPTIFPVSAL

SEQ ID NO: 1338391 - protein, 13 aa, Mycobacterium
AATPGQPVYAAQS

SEQ ID NO: 1338392 - protein, 8 aa, Mycobacterium
AATPPTPG

SEQ ID NO: 1338393 - protein, 13 aa, Mycobacterium
AATSDGQVYGFAP

SEQ ID NO: 1338394 - protein, 10 aa, Mycobacterium
AAVPPGATVP

SEQ ID NO: 1338395 - protein, 16 aa, Mycobacterium
AAWGPAGERMSPAAAA

SEQ ID NO: 1338396 - protein, 13 aa, Mycobacterium
ACSPASDPGVHGR

SEQ ID NO: 1338397 - protein, 7 aa, Mycobacterium
ADAADLK

SEQ ID NO: 1338398 - protein, 16 aa, Mycobacterium
ADAEGPAGGASSSVND

SEQ ID NO: 1338399 - protein, 8 aa, Mycobacterium
ADALGGDR

SEQ ID NO: 1338400 - protein, 9 aa, Mycobacterium
ADDATKTMT

SEQ ID NO: 1338401 - protein, 5 aa, Mycobacterium
ADDDY

SEQ ID NO: 1338402 - protein, 5 aa, Mycobacterium
ADDVP

SEQ ID NO: 1338403 - protein, 11 aa, Mycobacterium
ADEDDEPYYPI

SEQ ID NO: 1338404 - protein, 8 aa, Mycobacterium
ADGAALGD

SEQ ID NO: 1338405 - protein, 7 aa, Mycobacterium
ADGADSL

SEQ ID NO: 1338406 - protein, 7 aa, Mycobacterium
ADGESVP

SEQ ID NO: 1338407 - protein, 6 aa, Mycobacterium
ADGGMT

SEQ ID NO: 1338408 - protein, 6 aa, Mycobacterium
ADGLSG

SEQ ID NO: 1338409 - protein, 7 aa, Mycobacterium
ADGPHSA

SEQ ID NO: 1338410 - protein, 16 aa, Mycobacterium
ADGRTVNSYPLPEATG

SEQ ID NO: 1338411 - protein, 6 aa, Mycobacterium
ADHSPD

SEQ ID NO: 1338412 - protein, 11 aa, Mycobacterium
ADLQSKQSRLQ

SEQ ID NO: 1338413 - protein, 5 aa, Mycobacterium
ADNGY

SEQ ID NO: 1338414 - protein, 12 aa, Mycobacterium
ADNLRGQGANIR

SEQ ID NO: 1338415 - protein, 4 aa, Mycobacterium
ADNP

SEQ ID NO: 1338416 - protein, 4 aa, Mycobacterium
ADPA

SEQ ID NO: 1338417 - protein, 7 aa, Mycobacterium
ADPAADA

SEQ ID NO: 1338418 - protein, 9 aa, Mycobacterium
ADPAAERGS

SEQ ID NO: 1338419 - protein, 8 aa, Mycobacterium
ADPADDAL

SEQ ID NO: 1338420 - protein, 8 aa, Mycobacterium
ADPPPVTG

SEQ ID NO: 1338421 - protein, 14 aa, Mycobacterium
ADPPQSGQQTTSGR

SEQ ID NO: 1338422 - protein, 8 aa, Mycobacterium
ADPSPEEA

SEQ ID NO: 1338423 - protein, 13 aa, Mycobacterium
ADPTPAGSSQLPA

SEQ ID NO: 1338424 - protein, 5 aa, Mycobacterium
ADREA

SEQ ID NO: 1338425 - protein, 6 aa, Mycobacterium
ADSPQQ

SEQ ID NO: 1338426 - protein, 5 aa, Mycobacterium
ADTAV

SEQ ID NO: 1338427 - protein, 92 aa, Mycobacterium
ADTDTDGDADTDTDIDTGTDTENEPVDEPEDQLEEDETTVEDDTTVEDEDASETEPADDTADTEDTADTKDTGDTGDTKDGDTGESGAGDKA

SEQ ID NO: 1338428 - protein, 12 aa, Mycobacterium
ADTFDGNGDSFR

SEQ ID NO: 1338429 - protein, 9 aa, Mycobacterium
ADTPEGPWS

SEQ ID NO: 1338430 - protein, 11 aa, Mycobacterium
ADTVSGNAVRP

SEQ ID NO: 1338431 - protein, 4 aa, Mycobacterium
AEAI

SEQ ID NO: 1338432 - protein, 4 aa, Mycobacterium
AEAQ

SEQ ID NO: 1338433 - protein, 6 aa, Mycobacterium
AEASSH

SEQ ID NO: 1338434 - protein, 9 aa, Mycobacterium
AEDGGDKAE

SEQ ID NO: 1338435 - protein, 10 aa, Mycobacterium
AEDPTASKIA

SEQ ID NO: 1338436 - protein, 7 aa, Mycobacterium
AEGKNAL

SEQ ID NO: 1338437 - protein, 6 aa, Mycobacterium
AEIPEP

SEQ ID NO: 1338438 - protein, 12 aa, Mycobacterium
AELKSPDGTTVA

SEQ ID NO: 1338439 - protein, 4 aa, Mycobacterium
AELT

SEQ ID NO: 1338440 - protein, 52 aa, Mycobacterium
AENGTAGGNGGVGGAGGLGGSISGTGGTGGTGGTGGAGGNGGAGGNGVHGAD

SEQ ID NO: 1338441 - protein, 5 aa, Mycobacterium
AEPNY

SEQ ID NO: 1338442 - protein, 5 aa, Mycobacterium
AERDA

SEQ ID NO: 1338443 - protein, 11 aa, Mycobacterium
AEREHRQQTRL

SEQ ID NO: 1338444 - protein, 15 aa, Mycobacterium
AEREQRAEYAAAARQ

SEQ ID NO: 1338445 - protein, 12 aa, Mycobacterium
AERLSTAEPVAA

SEQ ID NO: 1338446 - protein, 17 aa, Mycobacterium
AERNTAAATCPAAPPAA

SEQ ID NO: 1338447 - protein, 14 aa, Mycobacterium
AERRRRRAAETAGI

SEQ ID NO: 1338448 - protein, 14 aa, Mycobacterium
AETDNTKAANRLAS

SEQ ID NO: 1338449 - protein, 9 aa, Mycobacterium
AETDRAGRI

SEQ ID NO: 1338450 - protein, 7 aa, Mycobacterium
AETKKLP

SEQ ID NO: 1338451 - protein, 4 aa, Mycobacterium
AEYG

SEQ ID NO: 1338452 - protein, 17 aa, Mycobacterium
AEYNRTPRNFAKDGPHV

SEQ ID NO: 1338453 - protein, 7 aa, Mycobacterium
AFSPDGK

SEQ ID NO: 1338454 - protein, 5 aa, Mycobacterium
AGAAG

SEQ ID NO: 1338455 - protein, 7 aa, Mycobacterium
AGAAQAD

SEQ ID NO: 1338456 - protein, 9 aa, Mycobacterium
AGADTGDRV

SEQ ID NO: 1338457 - protein, 6 aa, Mycobacterium
AGAETI

SEQ ID NO: 1338458 - protein, 4 aa, Mycobacterium
AGAH

SEQ ID NO: 1338459 - protein, 16 aa, Mycobacterium
AGAPLADDAPDPGCGF

SEQ ID NO: 1338460 - protein, 11 aa, Mycobacterium
AGAYPSTEQTL

SEQ ID NO: 1338461 - protein, 14 aa, Mycobacterium
AGCSGSGGGGDTAA

SEQ ID NO: 1338462 - protein, 6 aa, Mycobacterium
AGCTND

SEQ ID NO: 1338463 - protein, 4 aa, Mycobacterium
AGDA

SEQ ID NO: 1338464 - protein, 6 aa, Mycobacterium
AGDGTQ

SEQ ID NO: 1338465 - protein, 8 aa, Mycobacterium
AGEPSNAV

SEQ ID NO: 1338466 - protein, 7 aa, Mycobacterium
AGFGPPG

SEQ ID NO: 1338467 - protein, 4 aa, Mycobacterium
AGFS

SEQ ID NO: 1338468 - protein, 9 aa, Mycobacterium
AGGFGSAGA

SEQ ID NO: 1338469 - protein, 9 aa, Mycobacterium
AGGGPGAKL

SEQ ID NO: 1338470 - protein, 8 aa, Mycobacterium
AGGLPRDK

SEQ ID NO: 1338471 - protein, 4 aa, Mycobacterium
AGGS

SEQ ID NO: 1338472 - protein, 7 aa, Mycobacterium
AGIDTTN

SEQ ID NO: 1338473 - protein, 6 aa, Mycobacterium
AGIPMT

SEQ ID NO: 1338474 - protein, 6 aa, Mycobacterium
AGLGTP

SEQ ID NO: 1338475 - protein, 7 aa, Mycobacterium
AGNGRYA

SEQ ID NO: 1338476 - protein, 16 aa, Mycobacterium
AGPAKIPAPGPGPGQT

SEQ ID NO: 1338477 - protein, 8 aa, Mycobacterium
AGPGGSVA

SEQ ID NO: 1338478 - protein, 7 aa, Mycobacterium
AGPKVGP

SEQ ID NO: 1338479 - protein, 7 aa, Mycobacterium
AGPTTGA

SEQ ID NO: 1338480 - protein, 26 aa, Mycobacterium
AGQKSVDDALAQSQEYAEVVGRTYQE

SEQ ID NO: 1338481 - protein, 18 aa, Mycobacterium
AGRAVKDAAQDDIQRGEN

SEQ ID NO: 1338482 - protein, 6 aa, Mycobacterium
AGRGRT

SEQ ID NO: 1338483 - protein, 7 aa, Mycobacterium
AGRPIPT

SEQ ID NO: 1338484 - protein, 5 aa, Mycobacterium
AGRTT

SEQ ID NO: 1338485 - protein, 7 aa, Mycobacterium
AGSANEY

SEQ ID NO: 1338486 - protein, 8 aa, Mycobacterium
AGSDAADG

SEQ ID NO: 1338487 - protein, 6 aa, Mycobacterium
AGSGSI

SEQ ID NO: 1338488 - protein, 7 aa, Mycobacterium
AGSPYKN

SEQ ID NO: 1338489 - protein, 9 aa, Mycobacterium
AGSSGTLNM

SEQ ID NO: 1338490 - protein, 5 aa, Mycobacterium
AGTEK

SEQ ID NO: 1338491 - protein, 4 aa, Mycobacterium
AGTP

SEQ ID NO: 1338492 - protein, 5 aa, Mycobacterium
AGTRF

SEQ ID NO: 1338493 - protein, 14 aa, Mycobacterium
AGVAPPAPPAPPAA

SEQ ID NO: 1338494 - protein, 6 aa, Mycobacterium
AGVNPA

SEQ ID NO: 1338495 - protein, 8 aa, Mycobacterium
AGYPDEQA

SEQ ID NO: 1338496 - protein, 27 aa, Mycobacterium
AHADPEPSPPPAPPAPASTIEKDGTYK

SEQ ID NO: 1338497 - protein, 9 aa, Mycobacterium
AHADPGGPL

SEQ ID NO: 1338498 - protein, 8 aa, Mycobacterium
AHGATPDA

SEQ ID NO: 1338499 - protein, 255 aa, Mycobacterium
AHGGGGAGTFGSAGMDGGNGGAGGLGGSTSGNGGNGGAGGNGGNGGLGGNGGNGKSGDGYLDPGQQGGNGGEGGFAGDGGVGGAGGAALGSGDGGAGGVGGSGGIGGKGGAGGHGGQNGDQPLPDGPIGGVAPDAGHGGTGASGGHGGFGGSGGAGGAAHGSGNGGAGGKAGAAGAGGSGGSGGAGGLDEDNYETYGGRGGSAGDGGPGGFAGTGGAGGAAMGAGNGGAGGDGGAGANGGVGGRGGDGGSSEGWM

SEQ ID NO: 1338500 - protein, 5 aa, Mycobacterium
AHPGH

SEQ ID NO: 1338501 - protein, 12 aa, Mycobacterium
AHSAEPDETASL

SEQ ID NO: 1338502 - protein, 10 aa, Mycobacterium
AHTGGGNKIP

SEQ ID NO: 1338503 - protein, 14 aa, Mycobacterium
AHVPAPGAVPGTQA

SEQ ID NO: 1338504 - protein, 15 aa, Mycobacterium
AIAAPTGGNADATIS

SEQ ID NO: 1338505 - protein, 7 aa, Mycobacterium
AIGGGEV

SEQ ID NO: 1338506 - protein, 7 aa, Mycobacterium
AIGGGPA

SEQ ID NO: 1338507 - protein, 8 aa, Mycobacterium
AIPEGNPW

SEQ ID NO: 1338508 - protein, 5 aa, Mycobacterium
AIPSD

SEQ ID NO: 1338509 - protein, 7 aa, Mycobacterium
AKDETQA

SEQ ID NO: 1338510 - protein, 8 aa, Mycobacterium
AKEPDESV

SEQ ID NO: 1338511 - protein, 8 aa, Mycobacterium
AKFPTPQG

SEQ ID NO: 1338512 - protein, 10 aa, Mycobacterium
AKGETDQPVS

SEQ ID NO: 1338513 - protein, 12 aa, Mycobacterium
AKGNAYETTEGV

SEQ ID NO: 1338514 - protein, 8 aa, Mycobacterium
AKNPAGPH

SEQ ID NO: 1338515 - protein, 7 aa, Mycobacterium
AKVPPIA

SEQ ID NO: 1338516 - protein, 16 aa, Mycobacterium
ALAAPAAATPPRDTQG

SEQ ID NO: 1338517 - protein, 100 aa, Mycobacterium
ALAGAGAAAAETESDGSGPSPAASNSEPADPGPAADAPADDTTPQDAEPEPEPGPEDEDENLDEGLEEELGDEVEEVGEVEEELGEDPVENDPTEEPVDE

SEQ ID NO: 1338518 - protein, 7 aa, Mycobacterium
ALEDNPD

SEQ ID NO: 1338519 - protein, 11 aa, Mycobacterium
ALGDHSGDTFS

SEQ ID NO: 1338520 - protein, 7 aa, Mycobacterium
ALPQPPR

SEQ ID NO: 1338521 - protein, 12 aa, Mycobacterium
ALQPTQPGGVST

SEQ ID NO: 1338522 - protein, 5 aa, Mycobacterium
ALRDP

SEQ ID NO: 1338523 - protein, 31 aa, Mycobacterium; identical to SEQ ID NO: 1191779

SEQ ID NO: 1338524 - protein, 11 aa, Mycobacterium
ALTKGDQPTVA

SEQ ID NO: 1338525 - protein, 9 aa, Mycobacterium
ALTPGPADI

SEQ ID NO: 1338526 - protein, 4 aa, Mycobacterium
AMPL

SEQ ID NO: 1338527 - protein, 4 aa, Mycobacterium
AMQG

SEQ ID NO: 1338528 - protein, 8 aa, Mycobacterium
ANAQSPAG

SEQ ID NO: 1338529 - protein, 10 aa, Mycobacterium
ANDGQASRFD

SEQ ID NO: 1338530 - protein, 10 aa, Mycobacterium
ANDSTVNEDA

SEQ ID NO: 1338531 - protein, 12 aa, Mycobacterium
ANGKPQLTSDAS

SEQ ID NO: 1338532 - protein, 7 aa, Mycobacterium
ANPNVPE

SEQ ID NO: 1338533 - protein, 9 aa, Mycobacterium
ANRGGYSDV

SEQ ID NO: 1338534 - protein, 4 aa, Mycobacterium
ANRV

SEQ ID NO: 1338535 - protein, 9 aa, Mycobacterium
ANSAAPDAA

SEQ ID NO: 1338536 - protein, 11 aa, Mycobacterium
ANSGIQAIPRD

SEQ ID NO: 1338537 - protein, 14 aa, Mycobacterium
ANTGTLGASGTLAR

SEQ ID NO: 1338538 - protein, 5 aa, Mycobacterium
ANTPT

SEQ ID NO: 1338539 - protein, 9 aa, Mycobacterium
ANTTAPETA

SEQ ID NO: 1338540 - protein, 19 aa, Mycobacterium
APAAAPAAVPESATTRGIP

SEQ ID NO: 1338541 - protein, 11 aa, Mycobacterium
APAGTRSAPDV

SEQ ID NO: 1338542 - protein, 4 aa, Mycobacterium
APAP

SEQ ID NO: 1338543 - protein, 61 aa, Mycobacterium; identical to SEQ ID NO: 1192106

SEQ ID NO: 1338544 - protein, 9 aa, Mycobacterium
APAPNWQRG

SEQ ID NO: 1338545 - protein, 23 aa, Mycobacterium
APAQAAPAGPGNAQDTINSLEDR

SEQ ID NO: 1338546 - protein, 5 aa, Mycobacterium
APAQP

SEQ ID NO: 1338547 - protein, 12 aa, Mycobacterium
APENVPPEMRPQ

SEQ ID NO: 1338548 - protein, 11 aa, Mycobacterium
APGGSTGWHSH

SEQ ID NO: 1338549 - protein, 5 aa, Mycobacterium
APGLP

SEQ ID NO: 1338550 - protein, 18 aa, Mycobacterium
APGRDVPNVKAGVGVPTR

SEQ ID NO: 1338551 - protein, 13 aa, Mycobacterium
APIPAGPSAPATL

SEQ ID NO: 1338552 - protein, 15 aa, Mycobacterium
APKEKATARFAIRTD

SEQ ID NO: 1338553 - protein, 17 aa, Mycobacterium
APLPEAPPDQPPAAFTG

SEQ ID NO: 1338554 - protein, 17 aa, Mycobacterium
APLPPAGGESKDSLRAV

SEQ ID NO: 1338555 - protein, 11 aa, Mycobacterium
APLSQGRGGEE

SEQ ID NO: 1338556 - protein, 6 aa, Mycobacterium
APNKAV

SEQ ID NO: 1338557 - protein, 12 aa, Mycobacterium
APNVETPADPVA

SEQ ID NO: 1338558 - protein, 29 aa, Mycobacterium
APPEKESGGGETDSGVQVGEATSAADFGG

SEQ ID NO: 1338559 - protein, 12 aa, Mycobacterium
APPGISDDAKQA

SEQ ID NO: 1338560 - protein, 4 aa, Mycobacterium
APPI

SEQ ID NO: 1338561 - protein, 8 aa, Mycobacterium
APPPVSGV

SEQ ID NO: 1338562 - protein, 9 aa, Mycobacterium
APPQGEPEI

SEQ ID NO: 1338563 - protein, 7 aa, Mycobacterium
APPTTWD

SEQ ID NO: 1338564 - protein, 5 aa, Mycobacterium
APQCP

SEQ ID NO: 1338565 - protein, 5 aa, Mycobacterium
APRPG

SEQ ID NO: 1338566 - protein, 9 aa, Mycobacterium
APRTAVRRG

SEQ ID NO: 1338567 - protein, 7 aa, Mycobacterium
APSAVAA

SEQ ID NO: 1338568 - protein, 13 aa, Mycobacterium
APSHADPAEPGVD

SEQ ID NO: 1338569 - protein, 13 aa, Mycobacterium
APTATAECTESGG

SEQ ID NO: 1338570 - protein, 7 aa, Mycobacterium
APTGKAA

SEQ ID NO: 1338571 - protein, 5 aa, Mycobacterium
APVRT

SEQ ID NO: 1338572 - protein, 12 aa, Mycobacterium
AQAQPPTPVPGP

SEQ ID NO: 1338573 - protein, 9 aa, Mycobacterium
AQESPTDAT

SEQ ID NO: 1338574 - protein, 20 aa, Mycobacterium
AQGVDPGKGVKFGPGPVNNG

SEQ ID NO: 1338575 - protein, 13 aa, Mycobacterium
AQLGPQQGSMQGP

SEQ ID NO: 1338576 - protein, 6 aa, Mycobacterium
AQNPYG

SEQ ID NO: 1338577 - protein, 5 aa, Mycobacterium
AQPDV

SEQ ID NO: 1338578 - protein, 26 aa, Mycobacterium
AQQSGAAQPAAPAAASPVSPAAATGH

SEQ ID NO: 1338579 - protein, 10 aa, Mycobacterium
AQQTAEVPPE

SEQ ID NO: 1338580 - protein, 17 aa, Mycobacterium
AQRGADAPDADGPANLR

SEQ ID NO: 1338581 - protein, 12 aa, Mycobacterium
AQRLGGSGRTAS

SEQ ID NO: 1338582 - protein, 28 aa, Mycobacterium
AQSGETDEPAPASSSAPPAAVSPEEARA

SEQ ID NO: 1338583 - protein, 13 aa, Mycobacterium
AQSVQRSAFPDAY

SEQ ID NO: 1338584 - protein, 8 aa, Mycobacterium
AQVDAGPL

SEQ ID NO: 1338585 - protein, 7 aa, Mycobacterium
AQYGIGP

SEQ ID NO: 1338586 - protein, 9 aa, Mycobacterium
ARAAGGGAD

SEQ ID NO: 1338587 - protein, 10 aa, Mycobacterium
ARADEQGSGA

SEQ ID NO: 1338588 - protein, 7 aa, Mycobacterium
ARAESAR

SEQ ID NO: 1338589 - protein, 6 aa, Mycobacterium
ARAESR

SEQ ID NO: 1338590 - protein, 10 aa, Mycobacterium
ARAGKLDPTR

SEQ ID NO: 1338591 - protein, 8 aa, Mycobacterium
ARAQNDRA

SEQ ID NO: 1338592 - protein, 18 aa, Mycobacterium
ARASGEQPDKERKRSQHE

SEQ ID NO: 1338593 - protein, 9 aa, Mycobacterium
AREPDEGNQ

SEQ ID NO: 1338594 - protein, 7 aa, Mycobacterium
ARGRPAD

SEQ ID NO: 1338595 - protein, 4 aa, Mycobacterium
ARGV

SEQ ID NO: 1338596 - protein, 4 aa, Mycobacterium
ARLA

SEQ ID NO: 1338597 - protein, 9 aa, Mycobacterium
ARNGSGVNT

SEQ ID NO: 1338598 - protein, 6 aa, Mycobacterium
ARPGGP

SEQ ID NO: 1338599 - protein, 8 aa, Mycobacterium
ARPPLAGS

SEQ ID NO: 1338600 - protein, 32 aa, Mycobacterium
ARPRTTPAPDAETALPTDSDLDTPGAVRSQAY

SEQ ID NO: 1338601 - protein, 21 aa, Mycobacterium
ARRQGRDVSALTSSDCDITDT

SEQ ID NO: 1338602 - protein, 8 aa, Mycobacterium
ARTADGGL

SEQ ID NO: 1338603 - protein, 18 aa, Mycobacterium
ARTVQTSDFTVDGKPVDV

SEQ ID NO: 1338604 - protein, 7 aa, Mycobacterium
ARVPGNG

SEQ ID NO: 1338605 - protein, 18 aa, Mycobacterium
ASAQPLPNPPLPPPGAEC

SEQ ID NO: 1338606 - protein, 7 aa, Mycobacterium
ASEPGVA

SEQ ID NO: 1338607 - protein, 21 aa, Mycobacterium
ASEQSAQPPSTSAATATTTGL

SEQ ID NO: 1338608 - protein, 8 aa, Mycobacterium
ASESAPAV

SEQ ID NO: 1338609 - protein, 13 aa, Mycobacterium
ASHSGEGESVAPE

SEQ ID NO: 1338610 - protein, 7 aa, Mycobacterium
ASKPPVI

SEQ ID NO: 1338611 - protein, 8 aa, Mycobacterium
ASLQNRPP

SEQ ID NO: 1338612 - protein, 9 aa, Mycobacterium
ASPAAAVPC

SEQ ID NO: 1338613 - protein, 10 aa, Mycobacterium
ASPAHADSAA

SEQ ID NO: 1338614 - protein, 5 aa, Mycobacterium
ASPRA

SEQ ID NO: 1338615 - protein, 9 aa, Mycobacterium
ASPRSDEPW

SEQ ID NO: 1338616 - protein, 6 aa, Mycobacterium
ASPSLR

SEQ ID NO: 1338617 - protein, 27 aa, Mycobacterium
ASQMGTPYSWGGGKPNGPSRGVDSGAN

SEQ ID NO: 1338618 - protein, 7 aa, Mycobacterium
ASSGIGA

SEQ ID NO: 1338619 - protein, 10 aa, Mycobacterium
ASSVKSGDSV

SEQ ID NO: 1338620 - protein, 4 aa, Mycobacterium
ASTA

SEQ ID NO: 1338621 - protein, 4 aa, Mycobacterium
ASTD

SEQ ID NO: 1338622 - protein, 14 aa, Mycobacterium
ASTNPSLDPKAPQV

SEQ ID NO: 1338623 - protein, 16 aa, Mycobacterium
ASTPDGIDGTQPGGVY

SEQ ID NO: 1338624 - protein, 7 aa, Mycobacterium
ASVPAGP

SEQ ID NO: 1338625 - protein, 9 aa, Mycobacterium
ASVTSPDGQ

SEQ ID NO: 1338626 - protein, 4 aa, Mycobacterium
ATAD

SEQ ID NO: 1338627 - protein, 11 aa, Mycobacterium
ATADDSTKTLT

SEQ ID NO: 1338628 - protein, 6 aa, Mycobacterium
ATAEPV

SEQ ID NO: 1338629 - protein, 26 aa, Mycobacterium
ATAKGANARAEVRADRSVAEATGDGA

SEQ ID NO: 1338630 - protein, 18 aa, Mycobacterium
ATAPGADPSITQTDETTA

SEQ ID NO: 1338631 - protein, 4 aa, Mycobacterium
ATAT

SEQ ID NO: 1338632 - protein, 10 aa, Mycobacterium
ATEKRPADAA

SEQ ID NO: 1338633 - protein, 6 aa, Mycobacterium
ATGASI

SEQ ID NO: 1338634 - protein, 20 aa, Mycobacterium
ATGCDGAPGGTLTYPFRLVR

SEQ ID NO: 1338635 - protein, 6 aa, Mycobacterium
ATGEPI

SEQ ID NO: 1338636 - protein, 8 aa, Mycobacterium
ATNPVDRE

SEQ ID NO: 1338637 - protein, 5 aa, Mycobacterium
ATPPM

SEQ ID NO: 1338638 - protein, 8 aa, Mycobacterium
ATPPTAQR

SEQ ID NO: 1338639 - protein, 9 aa, Mycobacterium
ATPTDASAR

SEQ ID NO: 1338640 - protein, 25 aa, Mycobacterium
ATQPIEQPAPQRAAAPQGAAPAPVV

SEQ ID NO: 1338641 - protein, 6 aa, Mycobacterium
ATRNEG

SEQ ID NO: 1338642 - protein, 11 aa, Mycobacterium
ATRSGTLSSSF

SEQ ID NO: 1338643 - protein, 5 aa, Mycobacterium
ATSAM

SEQ ID NO: 1338644 - protein, 7 aa, Mycobacterium
ATSPCSG

SEQ ID NO: 1338645 - protein, 11 aa, Mycobacterium
ATTGDETTRRR

SEQ ID NO: 1338646 - protein, 6 aa, Mycobacterium
ATTPER

SEQ ID NO: 1338647 - protein, 24 aa, Mycobacterium
ATTTAPQLDGPRVGGAASASGSVG

SEQ ID NO: 1338648 - protein, 6 aa, Mycobacterium
ATVPGR

SEQ ID NO: 1338649 - protein, 8 aa, Mycobacterium
ATYNDPAT

SEQ ID NO: 1338650 - protein, 16 aa, Mycobacterium
AVAPATAPDLASSRGV

SEQ ID NO: 1338651 - protein, 9 aa, Mycobacterium
AVDEPGSDA

SEQ ID NO: 1338652 - protein, 6 aa, Mycobacterium
AVGPGN

SEQ ID NO: 1338653 - protein, 8 aa, Mycobacterium
AVNTGDDG

SEQ ID NO: 1338654 - protein, 9 aa, Mycobacterium
AVPAADATD

SEQ ID NO: 1338655 - protein, 8 aa, Mycobacterium
AVPQGGSA

SEQ ID NO: 1338656 - protein, 8 aa, Mycobacterium
AVRPASPV

SEQ ID NO: 1338657 - protein, 7 aa, Mycobacterium
AVSGSGP

SEQ ID NO: 1338658 - protein, 4 aa, Mycobacterium
AYAP

SEQ ID NO: 1338659 - protein, 23 aa, Mycobacterium
AYGGDGGNGGRLAGNGGRGGDAY

SEQ ID NO: 1338660 - protein, 13 aa, Mycobacterium
AYPRPEEVDDEPS

SEQ ID NO: 1338661 - protein, 8 aa, Mycobacterium
AYTGGPVM

SEQ ID NO: 1338662 - protein, 20 aa, Mycobacterium
AYTPPPPGAGPPPPLPPGYT

SEQ ID NO: 1338663 - protein, 25 aa, Mycobacterium
CAGSGGSGDEQSSSGLGDIPTDTNA

SEQ ID NO: 1338664 - protein, 14 aa, Mycobacterium
CAGVPNSSAPQAIG

SEQ ID NO: 1338665 - protein, 6 aa, Mycobacterium
CAREGD

SEQ ID NO: 1338666 - protein, 4 aa, Mycobacterium
CDTR

SEQ ID NO: 1338667 - protein, 8 aa, Mycobacterium
CGDGLTPR

SEQ ID NO: 1338668 - protein, 39 aa, Mycobacterium
CGSDSSSSEETSTSEETSTSAPQTPAAAESTAPEQPGPA

SEQ ID NO: 1338669 - protein, 7 aa, Mycobacterium
CGSGGGG

SEQ ID NO: 1338670 - protein, 7 aa, Mycobacterium
CGTDGTM

SEQ ID NO: 1338671 - protein, 18 aa, Mycobacterium
CGTSGGGGALSAETPVAG

SEQ ID NO: 1338672 - protein, 5 aa, Mycobacterium
CNEEL

SEQ ID NO: 1338673 - protein, 25 aa, Mycobacterium
CRNTTDHRDDGKTVGRDVTPELLSG

SEQ ID NO: 1338674 - protein, 18 aa, Mycobacterium
CSASGVANTVSTVTGSAR

SEQ ID NO: 1338675 - protein, 14 aa, Mycobacterium
CSPPEPALGTRTAQ

SEQ ID NO: 1338676 - protein, 58 aa, Mycobacterium
CSSGGDDASTPSSSQASSQVEASPTTTEARSAAPGAVEVSPGGVTTAVGAPAESTEDE

SEQ ID NO: 1338677 - protein, 4 aa, Mycobacterium
CTAD

SEQ ID NO: 1338678 - protein, 11 aa, Mycobacterium
DAAPLRRGEPD

SEQ ID NO: 1338679 - protein, 16 aa, Mycobacterium
DAARDCTGTACNGGRG

SEQ ID NO: 1338680 - protein, 15 aa, Mycobacterium
DAATAWSDPGTPLDD

SEQ ID NO: 1338681 - protein, 6 aa, Mycobacterium
DADEFD

SEQ ID NO: 1338682 - protein, 5 aa, Mycobacterium
DAGEG

SEQ ID NO: 1338683 - protein, 10 aa, Mycobacterium
DAGNGGNAGW

SEQ ID NO: 1338684 - protein, 4 aa, Mycobacterium
DAGV

SEQ ID NO: 1338685 - protein, 11 aa, Mycobacterium
DAHDAGAAPIV

SEQ ID NO: 1338686 - protein, 16 aa, Mycobacterium
DAHGGNRALSTPGYDA

SEQ ID NO: 1338687 - protein, 6 aa, Mycobacterium
DAKGAA

SEQ ID NO: 1338688 - protein, 7 aa, Mycobacterium
DAPAPLS

SEQ ID NO: 1338689 - protein, 7 aa, Mycobacterium
DAPATEA

SEQ ID NO: 1338690 - protein, 7 aa, Mycobacterium
DAPLSQA

SEQ ID NO: 1338691 - protein, 9 aa, Mycobacterium
DAQAAGTTP

SEQ ID NO: 1338692 - protein, 11 aa, Mycobacterium
DASDPAGSAQK

SEQ ID NO: 1338693 - protein, 10 aa, Mycobacterium
DASGAPARIP

SEQ ID NO: 1338694 - protein, 6 aa, Mycobacterium
DASPRA

SEQ ID NO: 1338695 - protein, 7 aa, Mycobacterium
DATNLSY

SEQ ID NO: 1338696 - protein, 29 aa, Mycobacterium
DATTRAAAAEQASARSAQDAKTAAEQAAQ

SEQ ID NO: 1338697 - protein, 7 aa, Mycobacterium
DATVPGD

SEQ ID NO: 1338698 - protein, 10 aa, Mycobacterium
DAVNGKPVAT

SEQ ID NO: 1338699 - protein, 9 aa, Mycobacterium
DCAPGQKRA

SEQ ID NO: 1338700 - protein, 8 aa, Mycobacterium
DDAPDEDA

SEQ ID NO: 1338701 - protein, 6 aa, Mycobacterium
DDDTPV

SEQ ID NO: 1338702 - protein, 8 aa, Mycobacterium
DDGSTLPI

SEQ ID NO: 1338703 - protein, 4 aa, Mycobacterium
DDPA

SEQ ID NO: 1338704 - protein, 5 aa, Mycobacterium
DDPAF

SEQ ID NO: 1338705 - protein, 9 aa, Mycobacterium
DDPDAAAKA

SEQ ID NO: 1338706 - protein, 9 aa, Mycobacterium
DDPDAVGNA

SEQ ID NO: 1338707 - protein, 6 aa, Mycobacterium
DDPEGY

SEQ ID NO: 1338708 - protein, 19 aa, Mycobacterium
DDPSDNVANYAQQAPLSPQ

SEQ ID NO: 1338709 - protein, 7 aa, Mycobacterium
DDPTFEQ

SEQ ID NO: 1338710 - protein, 8 aa, Mycobacterium
DDQDSGRW

SEQ ID NO: 1338711 - protein, 8 aa, Mycobacterium
DDRPGTDE

SEQ ID NO: 1338712 - protein, 9 aa, Mycobacterium
DDSGRPDLT

SEQ ID NO: 1338713 - protein, 21 aa, Mycobacterium
DDTHKRRQGEVGPALAGARGL

SEQ ID NO: 1338714 - protein, 6 aa, Mycobacterium
DDTSGT

SEQ ID NO: 1338715 - protein, 8 aa, Mycobacterium
DDVKVERG

SEQ ID NO: 1338716 - protein, 4 aa, Mycobacterium
DEDA

SEQ ID NO: 1338717 - protein, 4 aa, Mycobacterium
DEGQ

SEQ ID NO: 1338718 - protein, 5 aa, Mycobacterium
DEHPE

SEQ ID NO: 1338719 - protein, 6 aa, Mycobacterium
DEPPVR

SEQ ID NO: 1338720 - protein, 7 aa, Mycobacterium
DGAPLDD

SEQ ID NO: 1338721 - protein, 41 aa, Mycobacterium
DGAQSQPFTTEPELRPGPTSSEPPPPPLPAKPFPKACPAPG

SEQ ID NO: 1338722 - protein, 6 aa, Mycobacterium
DGDENP

SEQ ID NO: 1338723 - protein, 14 aa, Mycobacterium
DGDPICSDGRNPFA

SEQ ID NO: 1338724 - protein, 6 aa, Mycobacterium
DGDTTL

SEQ ID NO: 1338725 - protein, 8 aa, Mycobacterium
DGEPRAPL

SEQ ID NO: 1338726 - protein, 5 aa, Mycobacterium
DGGEM

SEQ ID NO: 1338727 - protein, 5 aa, Mycobacterium
DGGGS

SEQ ID NO: 1338728 - protein, 5 aa, Mycobacterium
DGGPD

SEQ ID NO: 1338729 - protein, 10 aa, Mycobacterium
DGIGSSPQQL

SEQ ID NO: 1338730 - protein, 8 aa, Mycobacterium
DGLDPQNY

SEQ ID NO: 1338731 - protein, 7 aa, Mycobacterium
DGNGPVS

SEQ ID NO: 1338732 - protein, 19 aa, Mycobacterium
DGPGRWSGAAYGREATADW

SEQ ID NO: 1338733 - protein, 4 aa, Mycobacterium
DGQL

SEQ ID NO: 1338734 - protein, 9 aa, Mycobacterium
DGQRAPRVA

SEQ ID NO: 1338735 - protein, 7 aa, Mycobacterium
DGRAPAE

SEQ ID NO: 1338736 - protein, 5 aa, Mycobacterium
DGRRV

SEQ ID NO: 1338737 - protein, 8 aa, Mycobacterium
DGSAHYGG

SEQ ID NO: 1338738 - protein, 6 aa, Mycobacterium
DGSIDD

SEQ ID NO: 1338739 - protein, 6 aa, Mycobacterium
DGSNGN

SEQ ID NO: 1338740 - protein, 8 aa, Mycobacterium
DGSRAEMD

SEQ ID NO: 1338741 - protein, 9 aa, Mycobacterium
DGSRPIDSD

SEQ ID NO: 1338742 - protein, 10 aa, Mycobacterium
DGTALGVQGT

SEQ ID NO: 1338743 - protein, 6 aa, Mycobacterium
DGTSFY

SEQ ID NO: 1338744 - protein, 5 aa, Mycobacterium
DGTTP

SEQ ID NO: 1338745 - protein, 19 aa, Mycobacterium
DGWESSDVAATDPGAFAGA

SEQ ID NO: 1338746 - protein, 17 aa, Mycobacterium
DGYDDDRASSDPQAAAT

SEQ ID NO: 1338747 - protein, 6 aa, Mycobacterium
DGYGEE

SEQ ID NO: 1338748 - protein, 15 aa, Mycobacterium
DHADKDFSAIIETLR

SEQ ID NO: 1338749 - protein, 7 aa, Mycobacterium
DIDDDTW

SEQ ID NO: 1338750 - protein, 25 aa, Mycobacterium
DIDPERTADELTEQVQKAIDGKGLI

SEQ ID NO: 1338751 - protein, 9 aa, Mycobacterium
DIRPGGQTV

SEQ ID NO: 1338752 - protein, 10 aa, Mycobacterium
DISEKGGPGY

SEQ ID NO: 1338753 - protein, 7 aa, Mycobacterium
DKGTPYA

SEQ ID NO: 1338754 - protein, 5 aa, Mycobacterium
DKTGR

SEQ ID NO: 1338755 - protein, 5 aa, Mycobacterium
DLGEQ

SEQ ID NO: 1338756 - protein, 9 aa, Mycobacterium
DLGSQTEGR

SEQ ID NO: 1338757 - protein, 12 aa, Mycobacterium
DNFARANRSHTE

SEQ ID NO: 1338758 - protein, 5 aa, Mycobacterium
DNGHM

SEQ ID NO: 1338759 - protein, 6 aa, Mycobacterium
DNNRQA

SEQ ID NO: 1338760 - protein, 6 aa, Mycobacterium
DNPADR

SEQ ID NO: 1338761 - protein, 9 aa, Mycobacterium
DPAAAQRRA

SEQ ID NO: 1338762 - protein, 6 aa, Mycobacterium
DPADAL

SEQ ID NO: 1338763 - protein, 6 aa, Mycobacterium
DPDETR

SEQ ID NO: 1338764 - protein, 10 aa, Mycobacterium
DPDGGYGHPD

SEQ ID NO: 1338765 - protein, 9 aa, Mycobacterium
DPDPYTGQR

SEQ ID NO: 1338766 - protein, 10 aa, Mycobacterium
DPGSPHPALG

SEQ ID NO: 1338767 - protein, 7 aa, Mycobacterium
DPGSTSG

SEQ ID NO: 1338768 - protein, 4 aa, Mycobacterium
DPNR

SEQ ID NO: 1338769 - protein, 5 aa, Mycobacterium
DPNVP

SEQ ID NO: 1338770 - protein, 30 aa, Mycobacterium
DPPAMKHRSADPDPSRPVARPGQGPPEDVD

SEQ ID NO: 1338771 - protein, 24 aa, Mycobacterium
DPQRFTESTPYNPSSPYSSTKAAA

SEQ ID NO: 1338772 - protein, 6 aa, Mycobacterium
DPRSRL

SEQ ID NO: 1338773 - protein, 7 aa, Mycobacterium
DPSGRDL

SEQ ID NO: 1338774 - protein, 7 aa, Mycobacterium
DPSLTGA

SEQ ID NO: 1338775 - protein, 12 aa, Mycobacterium
DPSQAPVGQPTI

SEQ ID NO: 1338776 - protein, 5 aa, Mycobacterium
DQHPD

SEQ ID NO: 1338777 - protein, 4 aa, Mycobacterium
DQLG

SEQ ID NO: 1338778 - protein, 9 aa, Mycobacterium
DQPDTASDR

SEQ ID NO: 1338779 - protein, 7 aa, Mycobacterium
DRADDTS

SEQ ID NO: 1338780 - protein, 6 aa, Mycobacterium
DRARYR

SEQ ID NO: 1338781 - protein, 6 aa, Mycobacterium
DREAGR

SEQ ID NO: 1338782 - protein, 7 aa, Mycobacterium
DRGVRSG

SEQ ID NO: 1338783 - protein, 6 aa, Mycobacterium
DRLPEL

SEQ ID NO: 1338784 - protein, 10 aa, Mycobacterium
DRSWRGDDRD

SEQ ID NO: 1338785 - protein, 9 aa, Mycobacterium
DRTPTGDRL

SEQ ID NO: 1338786 - protein, 5 aa, Mycobacterium
DRVED

SEQ ID NO: 1338787 - protein, 25 aa, Mycobacterium
DSAPTEEAQSTQPPPATPQSDVPPP

SEQ ID NO: 1338788 - protein, 10 aa, Mycobacterium
DSAQPEQLAE

SEQ ID NO: 1338789 - protein, 6 aa, Mycobacterium
DSAYDG

SEQ ID NO: 1338790 - protein, 7 aa, Mycobacterium
DSDQLAT

SEQ ID NO: 1338791 - protein, 6 aa, Mycobacterium
DSGADV

SEQ ID NO: 1338792 - protein, 7 aa, Mycobacterium
DSGEEVG

SEQ ID NO: 1338793 - protein, 9 aa, Mycobacterium
DSGPGDAAA

SEQ ID NO: 1338794 - protein, 4 aa, Mycobacterium
DSGR

SEQ ID NO: 1338795 - protein, 8 aa, Mycobacterium
DSGSAAEV

SEQ ID NO: 1338796 - protein, 7 aa, Mycobacterium
DSHLPGI

SEQ ID NO: 1338797 - protein, 4 aa, Mycobacterium
DSIE

SEQ ID NO: 1338798 - protein, 4 aa, Mycobacterium
DSKV

SEQ ID NO: 1338799 - protein, 13 aa, Mycobacterium
DSPYRPGQRSPDW

SEQ ID NO: 1338800 - protein, 10 aa, Mycobacterium
DSVTTRSDDG

SEQ ID NO: 1338801 - protein, 4 aa, Mycobacterium
DTAG

SEQ ID NO: 1338802 - protein, 11 aa, Mycobacterium
DTDPDWAGGDY

SEQ ID NO: 1338803 - protein, 6 aa, Mycobacterium
DTFQGP

SEQ ID NO: 1338804 - protein, 11 aa, Mycobacterium
DTGASGSGDIT

SEQ ID NO: 1338805 - protein, 13 aa, Mycobacterium
DTGEVTGRTALPG

SEQ ID NO: 1338806 - protein, 6 aa, Mycobacterium
DTGSGS

SEQ ID NO: 1338807 - protein, 8 aa, Mycobacterium
DTQNEAAA

SEQ ID NO: 1338808 - protein, 17 aa, Mycobacterium
DTTDGPLADAAPQASVE

SEQ ID NO: 1338809 - protein, 12 aa, Mycobacterium
DTVAKAGLDGLA

SEQ ID NO: 1338810 - protein, 8 aa, Mycobacterium
DTVNQSQE

SEQ ID NO: 1338811 - protein, 7 aa, Mycobacterium
DVDGTTY

SEQ ID NO: 1338812 - protein, 5 aa, Mycobacterium
DVDRE

SEQ ID NO: 1338813 - protein, 12 aa, Mycobacterium
DVEAQPKNSAAS

SEQ ID NO: 1338814 - protein, 8 aa, Mycobacterium
DVIKSGGE

SEQ ID NO: 1338815 - protein, 12 aa, Mycobacterium
DVKTGAKVDPDT

SEQ ID NO: 1338816 - protein, 6 aa, Mycobacterium
DVSTGA

SEQ ID NO: 1338817 - protein, 45 aa, Mycobacterium
DVTSTAQPPPAALPDQSADRGSDLPTPPDGAGQPGAVTVTGQQRG

SEQ ID NO: 1338818 - protein, 4 aa, Mycobacterium
DWPD

SEQ ID NO: 1338819 - protein, 12 aa, Mycobacterium
EAAANADTDTAE

SEQ ID NO: 1338820 - protein, 16 aa, Mycobacterium
EAAPGSRPESQQTRST

SEQ ID NO: 1338821 - protein, 5 aa, Mycobacterium
EAARS

SEQ ID NO: 1338822 - protein, 8 aa, Mycobacterium
EADPPTVQ

SEQ ID NO: 1338823 - protein, 5 aa, Mycobacterium
EAGGN

SEQ ID NO: 1338824 - protein, 7 aa, Mycobacterium
EAGLQPN

SEQ ID NO: 1338825 - protein, 9 aa, Mycobacterium
EALTPRQRE

SEQ ID NO: 1338826 - protein, 22 aa, Mycobacterium
EANKGLGPGAPVNATGLPADDP

SEQ ID NO: 1338827 - protein, 9 aa, Mycobacterium
EAQPVGDAA

SEQ ID NO: 1338828 - protein, 11 aa, Mycobacterium
EASRAAAADGV

SEQ ID NO: 1338829 - protein, 5 aa, Mycobacterium
EATQR

SEQ ID NO: 1338830 - protein, 13 aa, Mycobacterium
EAVATSAGKPWET

SEQ ID NO: 1338831 - protein, 10 aa, Mycobacterium
EDAAARSGAD

SEQ ID NO: 1338832 - protein, 8 aa, Mycobacterium
EDATDAAA

SEQ ID NO: 1338833 - protein, 10 aa, Mycobacterium
EDAYGAADSS

SEQ ID NO: 1338834 - protein, 9 aa, Mycobacterium
EDLTGGEGT

SEQ ID NO: 1338835 - protein, 8 aa, Mycobacterium
EDRVAESD

SEQ ID NO: 1338836 - protein, 5 aa, Mycobacterium
EDSSE

SEQ ID NO: 1338837 - protein, 16 aa, Mycobacterium
EEMRTGASVDAEARAP

SEQ ID NO: 1338838 - protein, 6 aa, Mycobacterium
EEPLPN

SEQ ID NO: 1338839 - protein, 4 aa, Mycobacterium
EESR

SEQ ID NO: 1338840 - protein, 4 aa, Mycobacterium
EETS

SEQ ID NO: 1338841 - protein, 9 aa, Mycobacterium
EFKDPDGTW

SEQ ID NO: 1338842 - protein, 7 aa, Mycobacterium
EGEIDGL

SEQ ID NO: 1338843 - protein, 9 aa, Mycobacterium
EGGQGAGTV

SEQ ID NO: 1338844 - protein, 10 aa, Mycobacterium
EGGTETRSHA

SEQ ID NO: 1338845 - protein, 14 aa, Mycobacterium
EGKITGEEDRYSKT

SEQ ID NO: 1338846 - protein, 5 aa, Mycobacterium
EIHPD

SEQ ID NO: 1338847 - protein, 9 aa, Mycobacterium
EKEISDNAT

SEQ ID NO: 1338848 - protein, 84 aa, Mycobacterium
EKIDETETDPVAEVQDPGDSGSAAEDVEEPASDSEDEEPQEVADDKSVDDPSDADQPDADQGEGAEQESAAKTAETSSGENGSG

SEQ ID NO: 1338849 - protein, 6 aa, Mycobacterium
EKPNSG

SEQ ID NO: 1338850 - protein, 4 aa, Mycobacterium
EKYP

SEQ ID NO: 1338851 - protein, 19 aa, Mycobacterium
ELDPGAGAVRRSTPLPGGY

SEQ ID NO: 1338852 - protein, 27 aa, Mycobacterium
ELNDAAAGNKSVADALRDAQAAAERIQ

SEQ ID NO: 1338853 - protein, 19 aa, Mycobacterium
ELPERGPQRGPNPAPADDV

SEQ ID NO: 1338854 - protein, 8 aa, Mycobacterium
ELSGGVDG

SEQ ID NO: 1338855 - protein, 12 aa, Mycobacterium
ENLSQVSGALKL

SEQ ID NO: 1338856 - protein, 131 aa, Mycobacterium
EPAGAATPPAPAGPPAGVVEPAAGAVPPAPAGPPAGVVEPAAGAVPPAPAGPPAGVVEPAAGAVPPAPAGPPAGVVEPAAGAAPAAAAGPGAPGGGSGGVGAPPAPPAPPAAAVQPAAAAVPPAPPAPPAA

SEQ ID NO: 1338857 - protein, 15 aa, Mycobacterium
EPATSATDVSPTEPV

SEQ ID NO: 1338858 - protein, 19 aa, Mycobacterium
EPDNPANQYRQVERKDKIE

SEQ ID NO: 1338859 - protein, 9 aa, Mycobacterium
EPDNPARDY

SEQ ID NO: 1338860 - protein, 4 aa, Mycobacterium
EPGT

SEQ ID NO: 1338861 - protein, 7 aa, Mycobacterium
EPNPLSA

SEQ ID NO: 1338862 - protein, 9 aa, Mycobacterium
EPPARPADV

SEQ ID NO: 1338863 - protein, 6 aa, Mycobacterium
EPQPTQ

SEQ ID NO: 1338864 - protein, 6 aa, Mycobacterium
EPSTAL

SEQ ID NO: 1338865 - protein, 6 aa, Mycobacterium
EPVGEQ

SEQ ID NO: 1338866 - protein, 9 aa, Mycobacterium
EQAPPPRRT

SEQ ID NO: 1338867 - protein, 4 aa, Mycobacterium
EQFP

SEQ ID NO: 1338868 - protein, 13 aa, Mycobacterium
EQGLAEAAAAGLP

SEQ ID NO: 1338869 - protein, 8 aa, Mycobacterium
EQTEGGQY

SEQ ID NO: 1338870 - protein, 5 aa, Mycobacterium
EQYAR

SEQ ID NO: 1338871 - protein, 16 aa, Mycobacterium
ERAARAVEAAAQQGQL

SEQ ID NO: 1338872 - protein, 9 aa, Mycobacterium
ERADVSPPT

SEQ ID NO: 1338873 - protein, 6 aa, Mycobacterium
ERAVRS

SEQ ID NO: 1338874 - protein, 5 aa, Mycobacterium
ERDHP

SEQ ID NO: 1338875 - protein, 10 aa, Mycobacterium
ERGASTHARP

SEQ ID NO: 1338876 - protein, 5 aa, Mycobacterium
ERGND

SEQ ID NO: 1338877 - protein, 6 aa, Mycobacterium
ERSSGV

SEQ ID NO: 1338878 - protein, 8 aa, Mycobacterium
ERTTGAVK

SEQ ID NO: 1338879 - protein, 10 aa, Mycobacterium
ESAPTPTDAG

SEQ ID NO: 1338880 - protein, 11 aa, Mycobacterium
ESASQSWDDAG

SEQ ID NO: 1338881 - protein, 5 aa, Mycobacterium
ESDEE

SEQ ID NO: 1338882 - protein, 18 aa, Mycobacterium
ESGHASGGATDSRGTAVT

SEQ ID NO: 1338883 - protein, 18 aa, Mycobacterium
ESLNAPNANSIPPTLGGG

SEQ ID NO: 1338884 - protein, 6 aa, Mycobacterium
ESPQRR

SEQ ID NO: 1338885 - protein, 15 aa, Mycobacterium
ESREQEASKKAAELA

SEQ ID NO: 1338886 - protein, 11 aa, Mycobacterium
ESTADLDNTLG

SEQ ID NO: 1338887 - protein, 9 aa, Mycobacterium
ESVEPAEPL

SEQ ID NO: 1338888 - protein, 9 aa, Mycobacterium
ESVPPGAAS

SEQ ID NO: 1338889 - protein, 4 aa, Mycobacterium
ETDW

SEQ ID NO: 1338890 - protein, 6 aa, Mycobacterium
ETEDFE

SEQ ID NO: 1338891 - protein, 9 aa, Mycobacterium
ETPASTTSR

SEQ ID NO: 1338892 - protein, 6 aa, Mycobacterium
ETPGFG

SEQ ID NO: 1338893 - protein, 8 aa, Mycobacterium
ETSGPGQV

SEQ ID NO: 1338894 - protein, 11 aa, Mycobacterium
ETSGRAGNQRT

SEQ ID NO: 1338895 - protein, 12 aa, Mycobacterium
ETSPRNSAGPSV

SEQ ID NO: 1338896 - protein, 4 aa, Mycobacterium
ETTQ

SEQ ID NO: 1338897 - protein, 7 aa, Mycobacterium
EVAQAPD

SEQ ID NO: 1338898 - protein, 6 aa, Mycobacterium
EVGPDD

SEQ ID NO: 1338899 - protein, 7 aa, Mycobacterium
EVGPDDI

SEQ ID NO: 1338900 - protein, 9 aa, Mycobacterium
EVHSTSAIG

SEQ ID NO: 1338901 - protein, 18 aa, Mycobacterium
EYSAPAGTPREVKGANHN

SEQ ID NO: 1338902 - protein, 5 aa, Mycobacterium
FAGQG

SEQ ID NO: 1338903 - protein, 6 aa, Mycobacterium
FAPGTT

SEQ ID NO: 1338904 - protein, 11 aa, Mycobacterium
FASGSGGVPTG

SEQ ID NO: 1338905 - protein, 5 aa, Mycobacterium
FDRSG

SEQ ID NO: 1338906 - protein, 9 aa, Mycobacterium
FEGHPDNAA

SEQ ID NO: 1338907 - protein, 5 aa, Mycobacterium
FEQQA

SEQ ID NO: 1338908 - protein, 10 aa, Mycobacterium
FGGASPHPYE

SEQ ID NO: 1338909 - protein, 20 aa, Mycobacterium
FGQAPNQASAAISRSGQDAA

SEQ ID NO: 1338910 - protein, 8 aa, Mycobacterium
FGRGPGQL

SEQ ID NO: 1338911 - protein, 5 aa, Mycobacterium
FGSEG

SEQ ID NO: 1338912 - protein, 5 aa, Mycobacterium
FPEQR

SEQ ID NO: 1338913 - protein, 13 aa, Mycobacterium
FPGADEHYGGGHH

SEQ ID NO: 1338914 - protein, 4 aa, Mycobacterium
FPTA

SEQ ID NO: 1338915 - protein, 10 aa, Mycobacterium
FRGGAGRGVR

SEQ ID NO: 1338916 - protein, 15 aa, Mycobacterium
FSPATSSAAPADPIA

SEQ ID NO: 1338917 - protein, 25 aa, Mycobacterium
FTAPESSTPALAPDPAVAGPPLPEG

SEQ ID NO: 1338918 - protein, 7 aa, Mycobacterium
FTNTDRE

SEQ ID NO: 1338919 - protein, 7 aa, Mycobacterium
GAAAAAA

SEQ ID NO: 1338920 - protein, 8 aa, Mycobacterium
GAAGVRRR

SEQ ID NO: 1338921 - protein, 10 aa, Mycobacterium
GAAPSGAAHA

SEQ ID NO: 1338922 - protein, 6 aa, Mycobacterium
GAAPVP

SEQ ID NO: 1338923 - protein, 11 aa, Mycobacterium
GAATGRFDATG

SEQ ID NO: 1338924 - protein, 6 aa, Mycobacterium
GADGTD

SEQ ID NO: 1338925 - protein, 6 aa, Mycobacterium
GADNAT

SEQ ID NO: 1338926 - protein, 34 aa, Mycobacterium; identical to SEQ ID NO: 1203351

SEQ ID NO: 1338927 - protein, 7 aa, Mycobacterium
GAGKESY

SEQ ID NO: 1338928 - protein, 79 aa, Mycobacterium
GAIPGGPGGVAGPQGAAGAIPGGPGGVAGPQGAAGAIPGGPGGAAGPQGATGAIPGGSSGTAGPGGATGCIPGVGCATT

SEQ ID NO: 1338929 - protein, 18 aa, Mycobacterium
GAKSTRASSPSGLDGPGW

SEQ ID NO: 1338930 - protein, 9 aa, Mycobacterium
GALNSEQSC

SEQ ID NO: 1338931 - protein, 4 aa, Mycobacterium
GALR

SEQ ID NO: 1338932 - protein, 28 aa, Mycobacterium
GANGDGGAGARGGDAGTPGDGGDGKAGD

SEQ ID NO: 1338933 - protein, 6 aa, Mycobacterium
GAPDMQ

SEQ ID NO: 1338934 - protein, 7 aa, Mycobacterium
GAPGEDG

SEQ ID NO: 1338935 - protein, 10 aa, Mycobacterium
GAPGPRDARG

SEQ ID NO: 1338936 - protein, 9 aa, Mycobacterium
GAPSSADGM

SEQ ID NO: 1338937 - protein, 8 aa, Mycobacterium
GAPTTPRI

SEQ ID NO: 1338938 - protein, 6 aa, Mycobacterium
GAQPEG

SEQ ID NO: 1338939 - protein, 7 aa, Mycobacterium
GARNDGG

SEQ ID NO: 1338940 - protein, 8 aa, Mycobacterium
GARRSLGD

SEQ ID NO: 1338941 - protein, 17 aa, Mycobacterium
GASSGIGEATARELARR

SEQ ID NO: 1338942 - protein, 5 aa, Mycobacterium
GATGL

SEQ ID NO: 1338943 - protein, 13 aa, Mycobacterium
GAYRNKPGKYADP

SEQ ID NO: 1338944 - protein, 36 aa, Mycobacterium
GCGSDNPPAPPPSPVASSPAAPPAPPVPAPLPPPSA

SEQ ID NO: 1338945 - protein, 34 aa, Mycobacterium
GCSSNPVDAPPPTITPATAAVSPPVTGAPAGTVR

SEQ ID NO: 1338946 - protein, 93 aa, Mycobacterium
GDGADGGNGGDPGTRGAGGSRGAAGTGGYADSGNAGAAGVDGAAVTSGGNGGNGGNGADGELVGNGGNGGNGGAVGNGGNGGNGGNGAAGAAG

SEQ ID NO: 1338947 - protein, 64 aa, Mycobacterium
GDGGIGGAAGSGGRGGNGVNGADATIAGAAGGRGGDGGRGGDGGSGGAGGIGGAGGSAGAQRGF

SEQ ID NO: 1338948 - protein, 13 aa, Mycobacterium
GDGKLEAVDPIPN

SEQ ID NO: 1338949 - protein, 5 aa, Mycobacterium
GDGLA

SEQ ID NO: 1338950 - protein, 8 aa, Mycobacterium
GDGPAALA

SEQ ID NO: 1338951 - protein, 9 aa, Mycobacterium
GDHSDTDAG

SEQ ID NO: 1338952 - protein, 4 aa, Mycobacterium
GDID

SEQ ID NO: 1338953 - protein, 15 aa, Mycobacterium
GDLAGPDAADPPTGV

SEQ ID NO: 1338954 - protein, 7 aa, Mycobacterium
GDPDEFE

SEQ ID NO: 1338955 - protein, 6 aa, Mycobacterium
GDPGPF

SEQ ID NO: 1338956 - protein, 8 aa, Mycobacterium
GDPVRTTR

SEQ ID NO: 1338957 - protein, 6 aa, Mycobacterium
GDSMTG

SEQ ID NO: 1338958 - protein, 13 aa, Mycobacterium
GDTDTRGGSTLEQ

SEQ ID NO: 1338959 - protein, 5 aa, Mycobacterium
GDTGV

SEQ ID NO: 1338960 - protein, 8 aa, Mycobacterium
GDTLRTGH

SEQ ID NO: 1338961 - protein, 12 aa, Mycobacterium
GDTVTGKAAEAQ

SEQ ID NO: 1338962 - protein, 6 aa, Mycobacterium
GDVPKP

SEQ ID NO: 1338963 - protein, 8 aa, Mycobacterium
GEAGTRGL

SEQ ID NO: 1338964 - protein, 6 aa, Mycobacterium
GEDRGG

SEQ ID NO: 1338965 - protein, 6 aa, Mycobacterium
GEEGEV

SEQ ID NO: 1338966 - protein, 11 aa, Mycobacterium
GEGALPDPGPI

SEQ ID NO: 1338967 - protein, 9 aa, Mycobacterium
GEIDGPDAG

SEQ ID NO: 1338968 - protein, 5 aa, Mycobacterium
GEIVG

SEQ ID NO: 1338969 - protein, 5 aa, Mycobacterium
GEPAL

SEQ ID NO: 1338970 - protein, 6 aa, Mycobacterium
GEPART

SEQ ID NO: 1338971 - protein, 8 aa, Mycobacterium
GEPPHGGW

SEQ ID NO: 1338972 - protein, 4 aa, Mycobacterium
GEPY

SEQ ID NO: 1338973 - protein, 4 aa, Mycobacterium
GERF

SEQ ID NO: 1338974 - protein, 4 aa, Mycobacterium
GERV

SEQ ID NO: 1338975 - protein, 7 aa, Mycobacterium
GEWTDDT

SEQ ID NO: 1338976 - protein, 7 aa, Mycobacterium
GFSPTVG

SEQ ID NO: 1338977 - protein, 19 aa, Mycobacterium
GGARPVRAEPMQQAGTIDK

SEQ ID NO: 1338978 - protein, 20 aa, Mycobacterium
GGATNGRLDNPRTQRTGDDG

SEQ ID NO: 1338979 - protein, 14 aa, Mycobacterium
GGDRAAEGDDDPLA

SEQ ID NO: 1338980 - protein, 10 aa, Mycobacterium
GGGNPAQVQS

SEQ ID NO: 1338981 - protein, 37 aa, Mycobacterium
GGGNTAGPTLGNPGGSSAPAPAAPPPGAIPVDGTNGA

SEQ ID NO: 1338982 - protein, 6 aa, Mycobacterium
GGGSDI

SEQ ID NO: 1338983 - protein, 21 aa, Mycobacterium
GGGSPATNEAALATPQCSQQM

SEQ ID NO: 1338984 - protein, 15 aa, Mycobacterium
GGGTAEQHAGGYHDS

SEQ ID NO: 1338985 - protein, 13 aa, Mycobacterium
GGGYPEGATTGGA

SEQ ID NO: 1338986 - protein, 16 aa, Mycobacterium
GGGYPTPSSHPRRRRT

SEQ ID NO: 1338987 - protein, 5 aa, Mycobacterium
GGLNA

SEQ ID NO: 1338988 - protein, 18 aa, Mycobacterium
GGMPTMQPKQGGIALPAG

SEQ ID NO: 1338989 - protein, 7 aa, Mycobacterium
GGNIGGG

SEQ ID NO: 1338990 - protein, 24 aa, Mycobacterium
GGPEERRRTGTARSWSADPPGDVD

SEQ ID NO: 1338991 - protein, 30 aa, Mycobacterium; identical to SEQ ID NO: 903494

SEQ ID NO: 1338992 - protein, 8 aa, Mycobacterium
GGPGGRSC

SEQ ID NO: 1338993 - protein, 8 aa, Mycobacterium
GGQGAGTV

SEQ ID NO: 1338994 - protein, 18 aa, Mycobacterium
GGRAAQALEGKSLSRPSW

SEQ ID NO: 1338995 - protein, 7 aa, Mycobacterium
GGRKYGG

SEQ ID NO: 1338996 - protein, 6 aa, Mycobacterium
GGSAGL

SEQ ID NO: 1338997 - protein, 8 aa, Mycobacterium
GGSGAVNG

SEQ ID NO: 1338998 - protein, 6 aa, Mycobacterium
GGSSAK

SEQ ID NO: 1338999 - protein, 22 aa, Mycobacterium
GGTEGGGYRASKNAGIDATNAR

SEQ ID NO: 1339000 - protein, 6 aa, Mycobacterium
GGTTGL

SEQ ID NO: 1339001 - protein, 6 aa, Mycobacterium
GGVGQV

SEQ ID NO: 1339002 - protein, 5 aa, Mycobacterium
GGVRG

SEQ ID NO: 1339003 - protein, 7 aa, Mycobacterium
GHSDQFG

SEQ ID NO: 1339004 - protein, 5 aa, Mycobacterium
GIAGP

SEQ ID NO: 1339005 - protein, 11 aa, Mycobacterium
GIGIDKDDQER

SEQ ID NO: 1339006 - protein, 12 aa, Mycobacterium
GIGNGGAGGDAE

SEQ ID NO: 1339007 - protein, 4 aa, Mycobacterium
GING

SEQ ID NO: 1339008 - protein, 15 aa, Mycobacterium
GIPQDPATRCRAEQT

SEQ ID NO: 1339009 - protein, 8 aa, Mycobacterium
GKAGGQQL

SEQ ID NO: 1339010 - protein, 6 aa, Mycobacterium
GKESLS

SEQ ID NO: 1339011 - protein, 10 aa, Mycobacterium
GKRVGTPFAS

SEQ ID NO: 1339012 - protein, 6 aa, Mycobacterium
GKVDAR

SEQ ID NO: 1339013 - protein, 16 aa, Mycobacterium
GKVGEPQVAEGEPGQP

SEQ ID NO: 1339014 - protein, 8 aa, Mycobacterium
GLAPRGTQ

SEQ ID NO: 1339015 - protein, 6 aa, Mycobacterium
GLGQHT

SEQ ID NO: 1339016 - protein, 12 aa, Mycobacterium
GLNQPGVNPGDL

SEQ ID NO: 1339017 - protein, 6 aa, Mycobacterium
GLPAPR

SEQ ID NO: 1339018 - protein, 12 aa, Mycobacterium
GLSGTRPPGDGR

SEQ ID NO: 1339019 - protein, 7 aa, Mycobacterium
GLVGGQE

SEQ ID NO: 1339020 - protein, 4 aa, Mycobacterium
GMQN

SEQ ID NO: 1339021 - protein, 4 aa, Mycobacterium
GMRN

SEQ ID NO: 1339022 - protein, 24 aa, Mycobacterium
GNGGAGGAGEAGSNNGAGGRGGRG

SEQ ID NO: 1339023 - protein, 22 aa, Mycobacterium
GNGGHGGRATATAAAGDGGRGG

SEQ ID NO: 1339024 - protein, 83 aa, Mycobacterium
GNPGISTGRTVADTDDEDPGTSALRTRAAQSEDDNDEAAVTRSEKNDDASNSDSGHKASDKAGDTRAAKASDDKGDGNEGGDD

SEQ ID NO: 1339025 - protein, 26 aa, Mycobacterium
GNQRRPDESCAAGPAPVDPGPPEREV

SEQ ID NO: 1339026 - protein, 6 aa, Mycobacterium
GNTGGA

SEQ ID NO: 1339027 - protein, 4 aa, Mycobacterium
GPAA

SEQ ID NO: 1339028 - protein, 8 aa, Mycobacterium
GPAATDTF

SEQ ID NO: 1339029 - protein, 9 aa, Mycobacterium
GPAPAPDVT

SEQ ID NO: 1339030 - protein, 9 aa, Mycobacterium
GPDSEAYVT

SEQ ID NO: 1339031 - protein, 22 aa, Mycobacterium
GPGATQIQPAGSRIPKDRTEPA

SEQ ID NO: 1339032 - protein, 8 aa, Mycobacterium
GPGGEAAT

SEQ ID NO: 1339033 - protein, 16 aa, Mycobacterium
GPGGGPAWKRNDPTVN

SEQ ID NO: 1339034 - protein, 7 aa, Mycobacterium
GPGHPDV

SEQ ID NO: 1339035 - protein, 10 aa, Mycobacterium
GPLAAPPARR

SEQ ID NO: 1339036 - protein, 17 aa, Mycobacterium
GPLPAGATPPAPGPEVA

SEQ ID NO: 1339037 - protein, 7 aa, Mycobacterium
GPNRIGQ

SEQ ID NO: 1339038 - protein, 6 aa, Mycobacterium
GPPDIT

SEQ ID NO: 1339039 - protein, 7 aa, Mycobacterium
GPPGVGK

SEQ ID NO: 1339040 - protein, 12 aa, Mycobacterium
GPPQLPPGSTVT

SEQ ID NO: 1339041 - protein, 7 aa, Mycobacterium
GPRPEMA

SEQ ID NO: 1339042 - protein, 16 aa, Mycobacterium
GPSFPSTGSAVPRTEL

SEQ ID NO: 1339043 - protein, 15 aa, Mycobacterium
GPTAGTGTPTRDYGI

SEQ ID NO: 1339044 - protein, 7 aa, Mycobacterium
GPTASAA

SEQ ID NO: 1339045 - protein, 7 aa, Mycobacterium
GPYPSSD

SEQ ID NO: 1339046 - protein, 5 aa, Mycobacterium
GPYRY

SEQ ID NO: 1339047 - protein, 6 aa, Mycobacterium
GQDGQM

SEQ ID NO: 1339048 - protein, 8 aa, Mycobacterium
GQDQNIQG

SEQ ID NO: 1339049 - protein, 6 aa, Mycobacterium
GQGAYN

SEQ ID NO: 1339050 - protein, 6 aa, Mycobacterium
GQSGDI

SEQ ID NO: 1339051 - protein, 34 aa, Mycobacterium; identical to SEQ ID NO: 1206974

SEQ ID NO: 1339052 - protein, 4 aa, Mycobacterium
GQYP

SEQ ID NO: 1339053 - protein, 8 aa, Mycobacterium
GRAATKTV

SEQ ID NO: 1339054 - protein, 6 aa, Mycobacterium
GRDDDR

SEQ ID NO: 1339055 - protein, 6 aa, Mycobacterium
GRDTTA

SEQ ID NO: 1339056 - protein, 7 aa, Mycobacterium
GRGGDLK

SEQ ID NO: 1339057 - protein, 6 aa, Mycobacterium
GRKTRK

SEQ ID NO: 1339058 - protein, 7 aa, Mycobacterium
GRPAPNH

SEQ ID NO: 1339059 - protein, 7 aa, Mycobacterium
GRPQERR

SEQ ID NO: 1339060 - protein, 11 aa, Mycobacterium
GRQRPPRPGVH

SEQ ID NO: 1339061 - protein, 11 aa, Mycobacterium
GRRQYSENTAT

SEQ ID NO: 1339062 - protein, 7 aa, Mycobacterium
GRSTTPD

SEQ ID NO: 1339063 - protein, 5 aa, Mycobacterium
GRSYP

SEQ ID NO: 1339064 - protein, 29 aa, Mycobacterium
GRTSAGRVGVDPTAARSPAPPAAQHPGGW

SEQ ID NO: 1339065 - protein, 12 aa, Mycobacterium
GRVAGVRTSDGV

SEQ ID NO: 1339066 - protein, 6 aa, Mycobacterium
GSAGSK

SEQ ID NO: 1339067 - protein, 4 aa, Mycobacterium
GSAP

SEQ ID NO: 1339068 - protein, 14 aa, Mycobacterium
GSAVGEDGKAVPVS

SEQ ID NO: 1339069 - protein, 22 aa, Mycobacterium
GSDSGGSEATTTDDGGPAGGTL

SEQ ID NO: 1339070 - protein, 9 aa, Mycobacterium
GSEGAPGNI

SEQ ID NO: 1339071 - protein, 10 aa, Mycobacterium
GSFSPSDEQF

SEQ ID NO: 1339072 - protein, 9 aa, Mycobacterium
GSGAGPVEF

SEQ ID NO: 1339073 - protein, 17 aa, Mycobacterium
GSGAPLTGSRERDEPDF

SEQ ID NO: 1339074 - protein, 16 aa, Mycobacterium
GSGGGTEPAKTDGGLD

SEQ ID NO: 1339075 - protein, 6 aa, Mycobacterium
GSGKPV

SEQ ID NO: 1339076 - protein, 4 aa, Mycobacterium
GSMG

SEQ ID NO: 1339077 - protein, 13 aa, Mycobacterium
GSNTPVLDTTRDD

SEQ ID NO: 1339078 - protein, 4 aa, Mycobacterium
GSPV

SEQ ID NO: 1339079 - protein, 10 aa, Mycobacterium
GSRDQTAEQI

SEQ ID NO: 1339080 - protein, 8 aa, Mycobacterium
GSRMSPEE

SEQ ID NO: 1339081 - protein, 8 aa, Mycobacterium
GSVGTTAE

SEQ ID NO: 1339082 - protein, 11 aa, Mycobacterium
GTAAAHAQPVP

SEQ ID NO: 1339083 - protein, 5 aa, Mycobacterium
GTAAV

SEQ ID NO: 1339084 - protein, 5 aa, Mycobacterium
GTAYH

SEQ ID NO: 1339085 - protein, 6 aa, Mycobacterium
GTDPAS

SEQ ID NO: 1339086 - protein, 7 aa, Mycobacterium
GTDTMEE

SEQ ID NO: 1339087 - protein, 5 aa, Mycobacterium
GTFDD

SEQ ID NO: 1339088 - protein, 15 aa, Mycobacterium
GTGAGVQVIGDAAEP

SEQ ID NO: 1339089 - protein, 10 aa, Mycobacterium
GTGDSPDYGI

SEQ ID NO: 1339090 - protein, 21 aa, Mycobacterium
GTGGAGGAGGIGANGADGIDG

SEQ ID NO: 1339091 - protein, 15 aa, Mycobacterium
GTGTITGDGEVGSIG

SEQ ID NO: 1339092 - protein, 14 aa, Mycobacterium
GTITVGEDGTASVT

SEQ ID NO: 1339093 - protein, 4 aa, Mycobacterium
GTLA

SEQ ID NO: 1339094 - protein, 6 aa, Mycobacterium
GTLAGQ

SEQ ID NO: 1339095 - protein, 11 aa, Mycobacterium
GTNGDIKVNDT

SEQ ID NO: 1339096 - protein, 7 aa, Mycobacterium
GTPGEDG

SEQ ID NO: 1339097 - protein, 10 aa, Mycobacterium
GTPGPAAEQK

SEQ ID NO: 1339098 - protein, 20 aa, Mycobacterium
GTQTVEQSLENAQASWDSAT

SEQ ID NO: 1339099 - protein, 7 aa, Mycobacterium
GTSADNL

SEQ ID NO: 1339100 - protein, 7 aa, Mycobacterium
GTSSAAR

SEQ ID NO: 1339101 - protein, 9 aa, Mycobacterium
GTTEAPGVG

SEQ ID NO: 1339102 - protein, 8 aa, Mycobacterium
GTTQRVPT

SEQ ID NO: 1339103 - protein, 4 aa, Mycobacterium
GTTR

SEQ ID NO: 1339104 - protein, 7 aa, Mycobacterium
GTVEGTP

SEQ ID NO: 1339105 - protein, 14 aa, Mycobacterium
GTVTPANARMQGTV

SEQ ID NO: 1339106 - protein, 5 aa, Mycobacterium
GTYRE

SEQ ID NO: 1339107 - protein, 25 aa, Mycobacterium
GVGGDGGAAGLVGNGGAGGRGGQYD

SEQ ID NO: 1339108 - protein, 13 aa, Mycobacterium
GVPADPSGTSAVA

SEQ ID NO: 1339109 - protein, 8 aa, Mycobacterium
GVRPDARL

SEQ ID NO: 1339110 - protein, 8 aa, Mycobacterium
GVSRGATI

SEQ ID NO: 1339111 - protein, 12 aa, Mycobacterium
GVVNAGPSEVRA

SEQ ID NO: 1339112 - protein, 4 aa, Mycobacterium
GWAR

SEQ ID NO: 1339113 - protein, 13 aa, Mycobacterium
GWNGPNGPGQTGY

SEQ ID NO: 1339114 - protein, 13 aa, Mycobacterium
GYDRPTDGKYAAT

SEQ ID NO: 1339115 - protein, 16 aa, Mycobacterium
GYEHPGDPTQPDNTHR

SEQ ID NO: 1339116 - protein, 10 aa, Mycobacterium
GYERSCRKGD

SEQ ID NO: 1339117 - protein, 5 aa, Mycobacterium
GYRPD

SEQ ID NO: 1339118 - protein, 39 aa, Mycobacterium
HADPKPNPPVPGHDGWRPGDPPGHNPFGPPGQVKKDPAL

SEQ ID NO: 1339119 - protein, 16 aa, Mycobacterium
HAVTTDRQQPASPVTS

SEQ ID NO: 1339120 - protein, 5 aa, Mycobacterium
HDDYQ

SEQ ID NO: 1339121 - protein, 7 aa, Mycobacterium
HEGEASP

SEQ ID NO: 1339122 - protein, 5 aa, Mycobacterium
HETGG

SEQ ID NO: 1339123 - protein, 17 aa, Mycobacterium
HGATGDGITDDSRAVQA

SEQ ID NO: 1339124 - protein, 6 aa, Mycobacterium
HGPEGQ

SEQ ID NO: 1339125 - protein, 5 aa, Mycobacterium
HGRGG

SEQ ID NO: 1339126 - protein, 6 aa, Mycobacterium
HGRPWR

SEQ ID NO: 1339127 - protein, 4 aa, Mycobacterium
HGSA

SEQ ID NO: 1339128 - protein, 7 aa, Mycobacterium
HGSPGHP

SEQ ID NO: 1339129 - protein, 4 aa, Mycobacterium
HGTE

SEQ ID NO: 1339130 - protein, 7 aa, Mycobacterium
HGTVGDR

SEQ ID NO: 1339131 - protein, 9 aa, Mycobacterium
HPDLPSELD

SEQ ID NO: 1339132 - protein, 6 aa, Mycobacterium
HPGANQ

SEQ ID NO: 1339133 - protein, 12 aa, Mycobacterium
HQPQRAAAMPAS

SEQ ID NO: 1339134 - protein, 8 aa, Mycobacterium
HRDGSGPA

SEQ ID NO: 1339135 - protein, 7 aa, Mycobacterium
HRGTRHR

SEQ ID NO: 1339136 - protein, 6 aa, Mycobacterium
HRSDEE

SEQ ID NO: 1339137 - protein, 5 aa, Mycobacterium
HTADD

SEQ ID NO: 1339138 - protein, 10 aa, Mycobacterium
HTDPADVDGP

SEQ ID NO: 1339139 - protein, 21 aa, Mycobacterium
IATSTDADGVRRPTRRGADLT

SEQ ID NO: 1339140 - protein, 4 aa, Mycobacterium
IDGG

SEQ ID NO: 1339141 - protein, 6 aa, Mycobacterium
IDGSAA

SEQ ID NO: 1339142 - protein, 6 aa, Mycobacterium
IDPGVA

SEQ ID NO: 1339143 - protein, 6 aa, Mycobacterium
IDTSNR

SEQ ID NO: 1339144 - protein, 9 aa, Mycobacterium
IEKGGAAAG

SEQ ID NO: 1339145 - protein, 7 aa, Mycobacterium
IEPQPER

SEQ ID NO: 1339146 - protein, 10 aa, Mycobacterium
IGDEDRATVE

SEQ ID NO: 1339147 - protein, 7 aa, Mycobacterium
IGDTQRQ

SEQ ID NO: 1339148 - protein, 83 aa, Mycobacterium; identical to SEQ ID NO: 1210081

SEQ ID NO: 1339149 - protein, 19 aa, Mycobacterium
IGGSSASAGVAPGRVRGPQ

SEQ ID NO: 1339150 - protein, 15 aa, Mycobacterium
ILPTTDSQDPDRMKG

SEQ ID NO: 1339151 - protein, 5 aa, Mycobacterium
INADK

SEQ ID NO: 1339152 - protein, 15 aa, Mycobacterium
IPAAPTTLTARPGQR

SEQ ID NO: 1339153 - protein, 4 aa, Mycobacterium
IPAD

SEQ ID NO: 1339154 - protein, 6 aa, Mycobacterium
IPEDRT

SEQ ID NO: 1339155 - protein, 8 aa, Mycobacterium
IPGYGEDK

SEQ ID NO: 1339156 - protein, 12 aa, Mycobacterium
IPHSRGLGSSAA

SEQ ID NO: 1339157 - protein, 9 aa, Mycobacterium
IQERVNEGA

SEQ ID NO: 1339158 - protein, 6 aa, Mycobacterium
IQPRSY

SEQ ID NO: 1339159 - protein, 10 aa, Mycobacterium
IQRGGEPDPF

SEQ ID NO: 1339160 - protein, 11 aa, Mycobacterium
IRAAAGSEGTI

SEQ ID NO: 1339161 - protein, 8 aa, Mycobacterium
IRDGETDT

SEQ ID NO: 1339162 - protein, 9 aa, Mycobacterium
IRDSGDRGE

SEQ ID NO: 1339163 - protein, 6 aa, Mycobacterium
IREAGG

SEQ ID NO: 1339164 - protein, 11 aa, Mycobacterium
ITAGTSSPGEL

SEQ ID NO: 1339165 - protein, 10 aa, Mycobacterium
ITRDARGAAY

SEQ ID NO: 1339166 - protein, 10 aa, Mycobacterium
ITSPNTPDGE

SEQ ID NO: 1339167 - protein, 4 aa, Mycobacterium
ITTP

SEQ ID NO: 1339168 - protein, 13 aa, Mycobacterium
KAAKSDPTYQAGD

SEQ ID NO: 1339169 - protein, 8 aa, Mycobacterium
KAAQGPEI

SEQ ID NO: 1339170 - protein, 8 aa, Mycobacterium
KANSTVQN

SEQ ID NO: 1339171 - protein, 6 aa, Mycobacterium
KAPGNY

SEQ ID NO: 1339172 - protein, 6 aa, Mycobacterium
KAQEDV

SEQ ID NO: 1339173 - protein, 9 aa, Mycobacterium
KARSETAEE

SEQ ID NO: 1339174 - protein, 6 aa, Mycobacterium
KARWGG

SEQ ID NO: 1339175 - protein, 12 aa, Mycobacterium
KATAAGKTYAAT

SEQ ID NO: 1339176 - protein, 18 aa, Mycobacterium
KAVPEQTAAAATDQVSTV

SEQ ID NO: 1339177 - protein, 28 aa, Mycobacterium
KDAGVEPVAKRDSASDDAAADADEEALE

SEQ ID NO: 1339178 - protein, 8 aa, Mycobacterium
KDAPHPAA

SEQ ID NO: 1339179 - protein, 7 aa, Mycobacterium
KDGYDAS

SEQ ID NO: 1339180 - protein, 9 aa, Mycobacterium
KDSSQLTPA

SEQ ID NO: 1339181 - protein, 6 aa, Mycobacterium
KEFTGA

SEQ ID NO: 1339182 - protein, 9 aa, Mycobacterium
KFPSSGPYK

SEQ ID NO: 1339183 - protein, 4 aa, Mycobacterium
KGAA

SEQ ID NO: 1339184 - protein, 7 aa, Mycobacterium
KGADAAQ

SEQ ID NO: 1339185 - protein, 16 aa, Mycobacterium
KGANGVPPRDRRDRDR

SEQ ID NO: 1339186 - protein, 9 aa, Mycobacterium
KGRADSPVA

SEQ ID NO: 1339187 - protein, 6 aa, Mycobacterium
KHPDRA

SEQ ID NO: 1339188 - protein, 19 aa, Mycobacterium
KHQEGTATASSIGTGADDW

SEQ ID NO: 1339189 - protein, 6 aa, Mycobacterium
KLAGER

SEQ ID NO: 1339190 - protein, 6 aa, Mycobacterium
KLPAGA

SEQ ID NO: 1339191 - protein, 8 aa, Mycobacterium
KLPPGRQS

SEQ ID NO: 1339192 - protein, 8 aa, Mycobacterium
KMTKDSKI

SEQ ID NO: 1339193 - protein, 11 aa, Mycobacterium
KNDGFTSDPEA

SEQ ID NO: 1339194 - protein, 10 aa, Mycobacterium
KNSTPTNNGT

SEQ ID NO: 1339195 - protein, 7 aa, Mycobacterium
KPAPPEV

SEQ ID NO: 1339196 - protein, 5 aa, Mycobacterium
KPEYR

SEQ ID NO: 1339197 - protein, 6 aa, Mycobacterium
KPFPDP

SEQ ID NO: 1339198 - protein, 10 aa, Mycobacterium
KPGSGDAPSV

SEQ ID NO: 1339199 - protein, 6 aa, Mycobacterium
KPHSGD

SEQ ID NO: 1339200 - protein, 6 aa, Mycobacterium
KPKTNN

SEQ ID NO: 1339201 - protein, 4 aa, Mycobacterium
KPLG

SEQ ID NO: 1339202 - protein, 8 aa, Mycobacterium
KPLPPNTR

SEQ ID NO: 1339203 - protein, 8 aa, Mycobacterium
KPLSPEDV

SEQ ID NO: 1339204 - protein, 14 aa, Mycobacterium
KPVMDSQAETADSI

SEQ ID NO: 1339205 - protein, 9 aa, Mycobacterium
KPYTEPPDP

SEQ ID NO: 1339206 - protein, 7 aa, Mycobacterium
KPYTSPP

SEQ ID NO: 1339207 - protein, 8 aa, Mycobacterium
KQSDLDVP

SEQ ID NO: 1339208 - protein, 4 aa, Mycobacterium
KRGD

SEQ ID NO: 1339209 - protein, 17 aa, Mycobacterium
KSAPGWPAQYGDAANSS

SEQ ID NO: 1339210 - protein, 5 aa, Mycobacterium
KSPAG

SEQ ID NO: 1339211 - protein, 6 aa, Mycobacterium
KSPSAF

SEQ ID NO: 1339212 - protein, 9 aa, Mycobacterium
KSQGSQARE

SEQ ID NO: 1339213 - protein, 7 aa, Mycobacterium
KTDPPVE

SEQ ID NO: 1339214 - protein, 12 aa, Mycobacterium
KTGKRDESAREV

SEQ ID NO: 1339215 - protein, 10 aa, Mycobacterium
KTHEEVKRGT

SEQ ID NO: 1339216 - protein, 13 aa, Mycobacterium
KVAHPGRSGLSVR

SEQ ID NO: 1339217 - protein, 7 aa, Mycobacterium
KVSATGA

SEQ ID NO: 1339218 - protein, 9 aa, Mycobacterium
KYSEDTGSI

SEQ ID NO: 1339219 - protein, 11 aa, Mycobacterium
LAEGSAPDAPV

SEQ ID NO: 1339220 - protein, 11 aa, Mycobacterium
LAGHGAGAGNC

SEQ ID NO: 1339221 - protein, 9 aa, Mycobacterium
LAPAGADPG

SEQ ID NO: 1339222 - protein, 6 aa, Mycobacterium
LAPDAA

SEQ ID NO: 1339223 - protein, 8 aa, Mycobacterium
LAPGRFAT

SEQ ID NO: 1339224 - protein, 43 aa, Mycobacterium
LAQADSTSGSDSSSASQPAKGDTGASTDGDQSSRDDGDGTRRF

SEQ ID NO: 1339225 - protein, 10 aa, Mycobacterium
LAQGQSSSGK

SEQ ID NO: 1339226 - protein, 9 aa, Mycobacterium
LARDGKPTL

SEQ ID NO: 1339227 - protein, 10 aa, Mycobacterium
LARNTVSASD

SEQ ID NO: 1339228 - protein, 6 aa, Mycobacterium
LDATGL

SEQ ID NO: 1339229 - protein, 5 aa, Mycobacterium
LDDPT

SEQ ID NO: 1339230 - protein, 31 aa, Mycobacterium; identical to SEQ ID NO: 1212529

SEQ ID NO: 1339231 - protein, 8 aa, Mycobacterium
LDKGTASL

SEQ ID NO: 1339232 - protein, 40 aa, Mycobacterium
LDPAATPPPGVPAGPQAPVAPAPEPVPPPAPAPAPAPAPV

SEQ ID NO: 1339233 - protein, 5 aa, Mycobacterium
LDTNT

SEQ ID NO: 1339234 - protein, 5 aa, Mycobacterium
LEPEA

SEQ ID NO: 1339235 - protein, 16 aa, Mycobacterium
LESSGSAGKVTVSPVR

SEQ ID NO: 1339236 - protein, 8 aa, Mycobacterium
LGADAESA

SEQ ID NO: 1339237 - protein, 5 aa, Mycobacterium
LGADH

SEQ ID NO: 1339238 - protein, 5 aa, Mycobacterium
LGADT

SEQ ID NO: 1339239 - protein, 6 aa, Mycobacterium
LGARDD

SEQ ID NO: 1339240 - protein, 4 aa, Mycobacterium
LGGR

SEQ ID NO: 1339241 - protein, 4 aa, Mycobacterium
LGGV

SEQ ID NO: 1339242 - protein, 8 aa, Mycobacterium
LGSAGTDL

SEQ ID NO: 1339243 - protein, 9 aa, Mycobacterium
LGSSPVARG

SEQ ID NO: 1339244 - protein, 11 aa, Mycobacterium
LGTRDGSNLTV

SEQ ID NO: 1339245 - protein, 6 aa, Mycobacterium
LKDGGN

SEQ ID NO: 1339246 - protein, 7 aa, Mycobacterium
LKPGEAQ

SEQ ID NO: 1339247 - protein, 14 aa, Mycobacterium
LNDPAGASGARAGQ

SEQ ID NO: 1339248 - protein, 4 aa, Mycobacterium
LNGP

SEQ ID NO: 1339249 - protein, 10 aa, Mycobacterium
LNGRQPASGM

SEQ ID NO: 1339250 - protein, 9 aa, Mycobacterium
LNQKDGGGV

SEQ ID NO: 1339251 - protein, 7 aa, Mycobacterium
LNSVPDS

SEQ ID NO: 1339252 - protein, 11 aa, Mycobacterium
LPDGRDEQPSY

SEQ ID NO: 1339253 - protein, 5 aa, Mycobacterium
LPDNA

SEQ ID NO: 1339254 - protein, 7 aa, Mycobacterium
LPDSTTT

SEQ ID NO: 1339255 - protein, 6 aa, Mycobacterium
LPEGPA

SEQ ID NO: 1339256 - protein, 10 aa, Mycobacterium
LPGETGVTNG

SEQ ID NO: 1339257 - protein, 11 aa, Mycobacterium
LPGKNAKLPAT

SEQ ID NO: 1339258 - protein, 7 aa, Mycobacterium
LPGTDGL

SEQ ID NO: 1339259 - protein, 13 aa, Mycobacterium
LPGTQGQGQGSYT

SEQ ID NO: 1339260 - protein, 23 aa, Mycobacterium
LPHSSQALARGGQPVSTDQMQPG

SEQ ID NO: 1339261 - protein, 21 aa, Mycobacterium
LPPAPAVPAPAAAPPANDPGV

SEQ ID NO: 1339262 - protein, 6 aa, Mycobacterium
LPPGGR

SEQ ID NO: 1339263 - protein, 11 aa, Mycobacterium
LPPGKAPEDRL

SEQ ID NO: 1339264 - protein, 5 aa, Mycobacterium
LPPPE

SEQ ID NO: 1339265 - protein, 28 aa, Mycobacterium
LPPPPPPPPPPPPPGAPPPPPPPPPPPV

SEQ ID NO: 1339266 - protein, 7 aa, Mycobacterium
LPPVSGE

SEQ ID NO: 1339267 - protein, 5 aa, Mycobacterium
LPQGE

SEQ ID NO: 1339268 - protein, 8 aa, Mycobacterium
LPSPYTAR

SEQ ID NO: 1339269 - protein, 11 aa, Mycobacterium
LPTRTTGAEVP

SEQ ID NO: 1339270 - protein, 5 aa, Mycobacterium
LPTSN

SEQ ID NO: 1339271 - protein, 9 aa, Mycobacterium
LQAKTGIDQ

SEQ ID NO: 1339272 - protein, 11 aa, Mycobacterium
LQDDKQDLQNQ

SEQ ID NO: 1339273 - protein, 19 aa, Mycobacterium
LQGHPGAGTYSAAKAAVRS

SEQ ID NO: 1339274 - protein, 8 aa, Mycobacterium
LQGSEAAV

SEQ ID NO: 1339275 - protein, 7 aa, Mycobacterium
LQHGARD

SEQ ID NO: 1339276 - protein, 18 aa, Mycobacterium
LQTDANRKAAGSLPDGAE

SEQ ID NO: 1339277 - protein, 11 aa, Mycobacterium
LRDAKGRTPYD

SEQ ID NO: 1339278 - protein, 5 aa, Mycobacterium
LRDDE

SEQ ID NO: 1339279 - protein, 5 aa, Mycobacterium
LRKPA

SEQ ID NO: 1339280 - protein, 7 aa, Mycobacterium
LRPGDRH

SEQ ID NO: 1339281 - protein, 16 aa, Mycobacterium
LRPGRPAGCSAGDYGA

SEQ ID NO: 1339282 - protein, 12 aa, Mycobacterium
LRPSADPAPGYP

SEQ ID NO: 1339283 - protein, 4 aa, Mycobacterium
LRRG

SEQ ID NO: 1339284 - protein, 7 aa, Mycobacterium
LRTDDNG

SEQ ID NO: 1339285 - protein, 6 aa, Mycobacterium
LSADEA

SEQ ID NO: 1339286 - protein, 12 aa, Mycobacterium
LSAPSAAAEPCP

SEQ ID NO: 1339287 - protein, 7 aa, Mycobacterium
LSGDDGA

SEQ ID NO: 1339288 - protein, 18 aa, Mycobacterium
LSGISSALTQSQREATPA

SEQ ID NO: 1339289 - protein, 5 aa, Mycobacterium
LSGMG

SEQ ID NO: 1339290 - protein, 6 aa, Mycobacterium
LSGNAV

SEQ ID NO: 1339291 - protein, 4 aa, Mycobacterium
LSPQ

SEQ ID NO: 1339292 - protein, 12 aa, Mycobacterium
LSRQAEQTTEAM

SEQ ID NO: 1339293 - protein, 7 aa, Mycobacterium
LTDNGGV

SEQ ID NO: 1339294 - protein, 7 aa, Mycobacterium
LTGNDTS

SEQ ID NO: 1339295 - protein, 54 aa, Mycobacterium
LTGSGMPAAAPAAPAAPATAPGATASITLPQTPALPGTASALPGTPAATSPLPG

SEQ ID NO: 1339296 - protein, 8 aa, Mycobacterium
LTPDGEHI

SEQ ID NO: 1339297 - protein, 7 aa, Mycobacterium
LTRNPAT

SEQ ID NO: 1339298 - protein, 5 aa, Mycobacterium
LTSRG

SEQ ID NO: 1339299 - protein, 10 aa, Mycobacterium
LTTSSRAGRL

SEQ ID NO: 1339300 - protein, 4 aa, Mycobacterium
LYPS

SEQ ID NO: 1339301 - protein, 11 aa, Mycobacterium
MAAATAEGEGN

SEQ ID NO: 1339302 - protein, 12 aa, Mycobacterium
MAPQTHDGEMKT

SEQ ID NO: 1339303 - protein, 8 aa, Mycobacterium
MEETQENL

SEQ ID NO: 1339304 - protein, 4 aa, Mycobacterium
MGST

SEQ ID NO: 1339305 - protein, 8 aa, Mycobacterium
MKDKTATI

SEQ ID NO: 1339306 - protein, 6 aa, Mycobacterium
MPDSPH

SEQ ID NO: 1339307 - protein, 5 aa, Mycobacterium
MPGAR

SEQ ID NO: 1339308 - protein, 11 aa, Mycobacterium
MPKPGRQRAPI

SEQ ID NO: 1339309 - protein, 13 aa, Mycobacterium
MPVPPHADADPAS

SEQ ID NO: 1339310 - protein, 17 aa, Mycobacterium
MRPGSSSGWHTHPGPEH

SEQ ID NO: 1339311 - protein, 24 aa, Mycobacterium
MSEPTGGGGDQVADPMTDEQAEAQ

SEQ ID NO: 1339312 - protein, 18 aa, Mycobacterium
MSKDDTGAGTAAGAAGSV

SEQ ID NO: 1339313 - protein, 11 aa, Mycobacterium
MSRDGDKFSGA

SEQ ID NO: 1339314 - protein, 10 aa, Mycobacterium
MSRGNDNALG

SEQ ID NO: 1339315 - protein, 8 aa, Mycobacterium
MSSGPITR

SEQ ID NO: 1339316 - protein, 13 aa, Mycobacterium
MTPGGPTGFPGDA

SEQ ID NO: 1339317 - protein, 10 aa, Mycobacterium
NAAADAEGPL

SEQ ID NO: 1339318 - protein, 6 aa, Mycobacterium
NADAHG

SEQ ID NO: 1339319 - protein, 5 aa, Mycobacterium
NAEGS

SEQ ID NO: 1339320 - protein, 8 aa, Mycobacterium
NAKNPGDI

SEQ ID NO: 1339321 - protein, 6 aa, Mycobacterium
NALPTP

SEQ ID NO: 1339322 - protein, 5 aa, Mycobacterium
NAMQG

SEQ ID NO: 1339323 - protein, 14 aa, Mycobacterium
NAPPPSAPAPQDPA

SEQ ID NO: 1339324 - protein, 13 aa, Mycobacterium
NAPPQPLPAGARA

SEQ ID NO: 1339325 - protein, 10 aa, Mycobacterium
NATPAGVPET

SEQ ID NO: 1339326 - protein, 5 aa, Mycobacterium
NDARQ

SEQ ID NO: 1339327 - protein, 43 aa, Mycobacterium; identical to SEQ ID NO: 1214969

SEQ ID NO: 1339328 - protein, 15 aa, Mycobacterium
NDKQAAQQAAEARHA

SEQ ID NO: 1339329 - protein, 8 aa, Mycobacterium
NDPYPSAR

SEQ ID NO: 1339330 - protein, 9 aa, Mycobacterium
NDQGEPPYR

SEQ ID NO: 1339331 - protein, 9 aa, Mycobacterium
NDSRSDLDA

SEQ ID NO: 1339332 - protein, 9 aa, Mycobacterium
NDVEHTSGY

SEQ ID NO: 1339333 - protein, 9 aa, Mycobacterium
NEPTEVGDA

SEQ ID NO: 1339334 - protein, 7 aa, Mycobacterium
NGADREV

SEQ ID NO: 1339335 - protein, 8 aa, Mycobacterium
NGGNGGIA

SEQ ID NO: 1339336 - protein, 5 aa, Mycobacterium
NGHTT

SEQ ID NO: 1339337 - protein, 59 aa, Mycobacterium
NGRASGGGKAGDGGRGGSGGLGGDGGDSALGPAGAGGTGGNANAGGEGGNGGNGGTGGF

SEQ ID NO: 1339338 - protein, 103 aa, Mycobacterium
NGSGIAHADEGAGSAPSASASQDDRGGSQESTNDDDDNQNNKNDEDNEPTEDSDTDDGDTAKDVTAEDDETPDLDDTDELNDDTELDAEDDLGTGDELDAGDF

SEQ ID NO: 1339339 - protein, 9 aa, Mycobacterium
NGTNPGMGH

SEQ ID NO: 1339340 - protein, 20 aa, Mycobacterium
NIPEPQTQTITASGTEEKSV

SEQ ID NO: 1339341 - protein, 9 aa, Mycobacterium
NKDSQRFSP

SEQ ID NO: 1339342 - protein, 7 aa, Mycobacterium
NKRSHEY

SEQ ID NO: 1339343 - protein, 10 aa, Mycobacterium
NKTAGDAERL

SEQ ID NO: 1339344 - protein, 14 aa, Mycobacterium
NLPENSTAKVAQTS

SEQ ID NO: 1339345 - protein, 17 aa, Mycobacterium
NLPGYENLGDGSESELS

SEQ ID NO: 1339346 - protein, 10 aa, Mycobacterium
NLPKGADDQR

SEQ ID NO: 1339347 - protein, 13 aa, Mycobacterium
NNLQAAQDAFAPS

SEQ ID NO: 1339348 - protein, 5 aa, Mycobacterium
NPDEA

SEQ ID NO: 1339349 - protein, 5 aa, Mycobacterium
NPEDV

SEQ ID NO: 1339350 - protein, 8 aa, Mycobacterium
NPESPEGI

SEQ ID NO: 1339351 - protein, 5 aa, Mycobacterium
NPQEY

SEQ ID NO: 1339352 - protein, 11 aa, Mycobacterium
NQQYGSGDGPL

SEQ ID NO: 1339353 - protein, 13 aa, Mycobacterium
NQRYTSVEGGLPA

SEQ ID NO: 1339354 - protein, 8 aa, Mycobacterium
NREAAGIA

SEQ ID NO: 1339355 - protein, 7 aa, Mycobacterium
NRPETLD

SEQ ID NO: 1339356 - protein, 7 aa, Mycobacterium
NRQFQSE

SEQ ID NO: 1339357 - protein, 27 aa, Mycobacterium
NRSLGGDTGSDGSTPQQRAEAAGFRGG

SEQ ID NO: 1339358 - protein, 12 aa, Mycobacterium
NRVSSTLTELGL

SEQ ID NO: 1339359 - protein, 27 aa, Mycobacterium
NSAQPDAASQDEINAANQQRGKSTAPD

SEQ ID NO: 1339360 - protein, 5 aa, Mycobacterium
NSDGV

SEQ ID NO: 1339361 - protein, 5 aa, Mycobacterium
NSDGY

SEQ ID NO: 1339362 - protein, 24 aa, Mycobacterium
NSEAAPPSPSAIATGPAPISGPPE

SEQ ID NO: 1339363 - protein, 5 aa, Mycobacterium
NSHPE

SEQ ID NO: 1339364 - protein, 7 aa, Mycobacterium
NSTGQFK

SEQ ID NO: 1339365 - protein, 17 aa, Mycobacterium
NSTSSRFADYEKRPDRA

SEQ ID NO: 1339366 - protein, 10 aa, Mycobacterium
NSVADDVNET

SEQ ID NO: 1339367 - protein, 6 aa, Mycobacterium
NTAPHD

SEQ ID NO: 1339368 - protein, 6 aa, Mycobacterium
NTESDR

SEQ ID NO: 1339369 - protein, 11 aa, Mycobacterium
NTKAPIEDPAR

SEQ ID NO: 1339370 - protein, 15 aa, Mycobacterium
NTLELPDPAPGDPPY

SEQ ID NO: 1339371 - protein, 7 aa, Mycobacterium
NTNVGSG

SEQ ID NO: 1339372 - protein, 14 aa, Mycobacterium
NTRGLGRANAPITG

SEQ ID NO: 1339373 - protein, 10 aa, Mycobacterium
NTRNEQRDAH

SEQ ID NO: 1339374 - protein, 9 aa, Mycobacterium
NTTEGGAQF

SEQ ID NO: 1339375 - protein, 7 aa, Mycobacterium
NTWERNG

SEQ ID NO: 1339376 - protein, 8 aa, Mycobacterium
NTWERNGG

SEQ ID NO: 1339377 - protein, 6 aa, Mycobacterium
NVAGDP

SEQ ID NO: 1339378 - protein, 10 aa, Mycobacterium
PAAADDPTID

SEQ ID NO: 1339379 - protein, 19 aa, Mycobacterium
PAAAQPDAPPAPVPGPPAV

SEQ ID NO: 1339380 - protein, 10 aa, Mycobacterium
PAAAQQHHPN

SEQ ID NO: 1339381 - protein, 37 aa, Mycobacterium
PAAATAPASPGAGPAPATPTPTTPLPPPLPAEAGHRG

SEQ ID NO: 1339382 - protein, 32 aa, Mycobacterium
PAAEPVAGDAAPPPPEGAVPSTPPSHTGTPDG

SEQ ID NO: 1339383 - protein, 35 aa, Mycobacterium
PAAGAVPPAPSAVGAPAGGSGGAGAPAAPPAPPAA

SEQ ID NO: 1339384 - protein, 10 aa, Mycobacterium
PAAPAPPAPA

SEQ ID NO: 1339385 - protein, 5 aa, Mycobacterium
PAFSA

SEQ ID NO: 1339386 - protein, 7 aa, Mycobacterium
PAGIPAA

SEQ ID NO: 1339387 - protein, 9 aa, Mycobacterium
PAGITGPMA

SEQ ID NO: 1339388 - protein, 6 aa, Mycobacterium
PAGSPL

SEQ ID NO: 1339389 - protein, 7 aa, Mycobacterium
PAHAETY

SEQ ID NO: 1339390 - protein, 7 aa, Mycobacterium
PAHPNAR

SEQ ID NO: 1339391 - protein, 4 aa, Mycobacterium
PAKT

SEQ ID NO: 1339392 - protein, 17 aa, Mycobacterium
PALAQPAPPPPPPAPVD

SEQ ID NO: 1339393 - protein, 11 aa, Mycobacterium
PAMPYAKPPLS

SEQ ID NO: 1339394 - protein, 7 aa, Mycobacterium
PANEAAT

SEQ ID NO: 1339395 - protein, 110 aa, Mycobacterium
PAPAGSSGTPLPAGSSGTPLPATSSGTPLPAGSSGTPLPATSSGTPLPAGSQGTPALAPGAPAPAPAVPAQPAPQPASSGPAPVPVSTGDQAPVPHGQGVPTPTPTPVPV

SEQ ID NO: 1339396 - protein, 13 aa, Mycobacterium
PAPGRVSAGGASQ

SEQ ID NO: 1339397 - protein, 27 aa, Mycobacterium
PAPKLGPPNNPLNLGPPNNPFNLPKIG

SEQ ID NO: 1339398 - protein, 10 aa, Mycobacterium
PAPRADSPEC

SEQ ID NO: 1339399 - protein, 4 aa, Mycobacterium
PAPS

SEQ ID NO: 1339400 - protein, 6 aa, Mycobacterium
PAQGTV

SEQ ID NO: 1339401 - protein, 7 aa, Mycobacterium
PARPPQL

SEQ ID NO: 1339402 - protein, 14 aa, Mycobacterium
PASLGSQGNSNVTN

SEQ ID NO: 1339403 - protein, 9 aa, Mycobacterium
PASPDWPRA

SEQ ID NO: 1339404 - protein, 8 aa, Mycobacterium
PASRADYV

SEQ ID NO: 1339405 - protein, 4 aa, Mycobacterium
PATA

SEQ ID NO: 1339406 - protein, 5 aa, Mycobacterium
PATAA

SEQ ID NO: 1339407 - protein, 12 aa, Mycobacterium
PATAAAAANSAM

SEQ ID NO: 1339408 - protein, 12 aa, Mycobacterium
PATASPSYGSNG

SEQ ID NO: 1339409 - protein, 6 aa, Mycobacterium
PATLPK

SEQ ID NO: 1339410 - protein, 15 aa, Mycobacterium
PATPATAAPDPCAAS

SEQ ID NO: 1339411 - protein, 4 aa, Mycobacterium
PAVD

SEQ ID NO: 1339412 - protein, 24 aa, Mycobacterium
PAVDAQRVAEGGAVTRKGSLTDPK

SEQ ID NO: 1339413 - protein, 14 aa, Mycobacterium
PAVGSADATDDYPI

SEQ ID NO: 1339414 - protein, 16 aa, Mycobacterium
PAWRSTDASLAPYNGM

SEQ ID NO: 1339415 - protein, 8 aa, Mycobacterium
PAYTGGPV

SEQ ID NO: 1339416 - protein, 20 aa, Mycobacterium
PDCGQRVREATDAVAASRGL

SEQ ID NO: 1339417 - protein, 10 aa, Mycobacterium
PDDETLTTGG

SEQ ID NO: 1339418 - protein, 10 aa, Mycobacterium
PDGQPYRDSE

SEQ ID NO: 1339419 - protein, 9 aa, Mycobacterium
PDGRPYDED

SEQ ID NO: 1339420 - protein, 10 aa, Mycobacterium
PDGTPGPRKD

SEQ ID NO: 1339421 - protein, 5 aa, Mycobacterium
PDLQA

SEQ ID NO: 1339422 - protein, 8 aa, Mycobacterium
PDMLPTDE

SEQ ID NO: 1339423 - protein, 4 aa, Mycobacterium
PDPA

SEQ ID NO: 1339424 - protein, 5 aa, Mycobacterium
PDTVG

SEQ ID NO: 1339425 - protein, 10 aa, Mycobacterium
PEATARADEQ

SEQ ID NO: 1339426 - protein, 13 aa, Mycobacterium
PEPVEDSPDGSAW

SEQ ID NO: 1339427 - protein, 5 aa, Mycobacterium
PEQVN

SEQ ID NO: 1339428 - protein, 5 aa, Mycobacterium
PERDE

SEQ ID NO: 1339429 - protein, 6 aa, Mycobacterium
PERGGT

SEQ ID NO: 1339430 - protein, 7 aa, Mycobacterium
PESGAAP

SEQ ID NO: 1339431 - protein, 11 aa, Mycobacterium
PFAPPPPPANP

SEQ ID NO: 1339432 - protein, 6 aa, Mycobacterium
PGADKP

SEQ ID NO: 1339433 - protein, 9 aa, Mycobacterium
PGAGTVNAS

SEQ ID NO: 1339434 - protein, 8 aa, Mycobacterium
PGAHPNRA

SEQ ID NO: 1339435 - protein, 9 aa, Mycobacterium
PGAPEVRND

SEQ ID NO: 1339436 - protein, 11 aa, Mycobacterium
PGDIAGKTGFT

SEQ ID NO: 1339437 - protein, 9 aa, Mycobacterium
PGESPLRRS

SEQ ID NO: 1339438 - protein, 21 aa, Mycobacterium
PGFGSTVKRPTGLPWKGPDPV

SEQ ID NO: 1339439 - protein, 9 aa, Mycobacterium
PGGESQSQI

SEQ ID NO: 1339440 - protein, 22 aa, Mycobacterium
PGGLRTSYEPVRPSVRAGQTVR

SEQ ID NO: 1339441 - protein, 5 aa, Mycobacterium
PGGSQ

SEQ ID NO: 1339442 - protein, 5 aa, Mycobacterium
PGHWD

SEQ ID NO: 1339443 - protein, 4 aa, Mycobacterium
PGLA

SEQ ID NO: 1339444 - protein, 7 aa, Mycobacterium
PGLNDED

SEQ ID NO: 1339445 - protein, 19 aa, Mycobacterium
PGRPVRTATRKSNAPTGHD

SEQ ID NO: 1339446 - protein, 7 aa, Mycobacterium
PGSPIDT

SEQ ID NO: 1339447 - protein, 5 aa, Mycobacterium
PGSSL

SEQ ID NO: 1339448 - protein, 4 aa, Mycobacterium
PGTR

SEQ ID NO: 1339449 - protein, 11 aa, Mycobacterium
PGVQPGDPARV

SEQ ID NO: 1339450 - protein, 11 aa, Mycobacterium
PHDASEAPNGT

SEQ ID NO: 1339451 - protein, 4 aa, Mycobacterium
PHVP

SEQ ID NO: 1339452 - protein, 4 aa, Mycobacterium
PHWP

SEQ ID NO: 1339453 - protein, 16 aa, Mycobacterium
PIDRTDADSAKSALTT

SEQ ID NO: 1339454 - protein, 9 aa, Mycobacterium
PINGPVPAM

SEQ ID NO: 1339455 - protein, 8 aa, Mycobacterium
PIPGGKSA

SEQ ID NO: 1339456 - protein, 4 aa, Mycobacterium
PITT

SEQ ID NO: 1339457 - protein, 10 aa, Mycobacterium
PKGAKNPDGA

SEQ ID NO: 1339458 - protein, 9 aa, Mycobacterium
PKGATGNTG

SEQ ID NO: 1339459 - protein, 11 aa, Mycobacterium
PKSDDAPAERD

SEQ ID NO: 1339460 - protein, 5 aa, Mycobacterium
PLAGN

SEQ ID NO: 1339461 - protein, 7 aa, Mycobacterium
PLETGGA

SEQ ID NO: 1339462 - protein, 14 aa, Mycobacterium
PLGQSGEIDRTKGI

SEQ ID NO: 1339463 - protein, 6 aa, Mycobacterium
PLPNTG

SEQ ID NO: 1339464 - protein, 7 aa, Mycobacterium
PLSPLSR

SEQ ID NO: 1339465 - protein, 7 aa, Mycobacterium
PLTPGSD

SEQ ID NO: 1339466 - protein, 11 aa, Mycobacterium
PMSAPSPDRLS

SEQ ID NO: 1339467 - protein, 8 aa, Mycobacterium
PNEGLGHD

SEQ ID NO: 1339468 - protein, 5 aa, Mycobacterium
PNPVT

SEQ ID NO: 1339469 - protein, 5 aa, Mycobacterium
PNTLN

SEQ ID NO: 1339470 - protein, 6 aa, Mycobacterium
PNVPGA

SEQ ID NO: 1339471 - protein, 33 aa, Mycobacterium
PPAAPTEPAVAEEPVATDPSAGLPGLMVPAGGG

SEQ ID NO: 1339472 - protein, 13 aa, Mycobacterium
PPASAQIEADGPD

SEQ ID NO: 1339473 - protein, 10 aa, Mycobacterium
PPDQIKSAGF

SEQ ID NO: 1339474 - protein, 13 aa, Mycobacterium
PPEGVTNPPNDTS

SEQ ID NO: 1339475 - protein, 5 aa, Mycobacterium
PPGQA

SEQ ID NO: 1339476 - protein, 7 aa, Mycobacterium
PPPPGVA

SEQ ID NO: 1339477 - protein, 15 aa, Mycobacterium
PPPPPPPPGAPMSVT

SEQ ID NO: 1339478 - protein, 14 aa, Mycobacterium
PPQSRGRPGPIRGP

SEQ ID NO: 1339479 - protein, 8 aa, Mycobacterium
PPSEQATV

SEQ ID NO: 1339480 - protein, 16 aa, Mycobacterium
PPTDTDGRSDPDPTKW

SEQ ID NO: 1339481 - protein, 12 aa, Mycobacterium
PPTDVRPAGKLR

SEQ ID NO: 1339482 - protein, 17 aa, Mycobacterium
PPVGKLPSGRLQPGTTL

SEQ ID NO: 1339483 - protein, 8 aa, Mycobacterium
PPVSPAEY

SEQ ID NO: 1339484 - protein, 9 aa, Mycobacterium
PQDSGPTPI

SEQ ID NO: 1339485 - protein, 7 aa, Mycobacterium
PQGCSDG

SEQ ID NO: 1339486 - protein, 4 aa, Mycobacterium
PQGI

SEQ ID NO: 1339487 - protein, 5 aa, Mycobacterium
PQGRF

SEQ ID NO: 1339488 - protein, 10 aa, Mycobacterium
PQIGATGPVP

SEQ ID NO: 1339489 - protein, 7 aa, Mycobacterium
PQPPTTW

SEQ ID NO: 1339490 - protein, 8 aa, Mycobacterium
PQPPVPGP

SEQ ID NO: 1339491 - protein, 9 aa, Mycobacterium
PQQRRPSAE

SEQ ID NO: 1339492 - protein, 8 aa, Mycobacterium
PQRDQSQV

SEQ ID NO: 1339493 - protein, 157 aa, Mycobacterium
PQTLPGANSALTNTAPPSGPIPPAGSTNGIASATPPSVGIPPAGSLNGTASATPPSVAIPPAGSLNGTAAATPPRPPVPSAPVTSSSQSVTPPSGPLPPTARVDTASGATPPAPGAPGVPAAGAGGGAVPPAPAAPGAPVAASGGVGAPAAPPAVPA

SEQ ID NO: 1339494 - protein, 12 aa, Mycobacterium
PQTPPSVSPDGS

SEQ ID NO: 1339495 - protein, 14 aa, Mycobacterium
PRAAAEASRWSADR

SEQ ID NO: 1339496 - protein, 8 aa, Mycobacterium
PRDTPYSG

SEQ ID NO: 1339497 - protein, 4 aa, Mycobacterium
PRLT

SEQ ID NO: 1339498 - protein, 5 aa, Mycobacterium
PRPAE

SEQ ID NO: 1339499 - protein, 83 aa, Mycobacterium
PRPAPPSSTPAPAPAPEPEPQPTQEPQPTQEPEPEPTVAPEPEPTVVPEPTVAPEPESTAAPEPSAEAPAEPQPECVPDAETV

SEQ ID NO: 1339500 - protein, 7 aa, Mycobacterium
PRPEPRE

SEQ ID NO: 1339501 - protein, 9 aa, Mycobacterium
PRRNAELDD

SEQ ID NO: 1339502 - protein, 14 aa, Mycobacterium
PSCAGSVSAEAQLT

SEQ ID NO: 1339503 - protein, 7 aa, Mycobacterium
PSDAPGC

SEQ ID NO: 1339504 - protein, 4 aa, Mycobacterium
PSDG

SEQ ID NO: 1339505 - protein, 9 aa, Mycobacterium
PSDKEAQDF

SEQ ID NO: 1339506 - protein, 15 aa, Mycobacterium
PSGTAEPMEDRGGLT

SEQ ID NO: 1339507 - protein, 4 aa, Mycobacterium
PSHL

SEQ ID NO: 1339508 - protein, 15 aa, Mycobacterium
PSIAPSATAYSRDGL

SEQ ID NO: 1339509 - protein, 5 aa, Mycobacterium
PSTAL

SEQ ID NO: 1339510 - protein, 10 aa, Mycobacterium
PTAAAPDSPQ

SEQ ID NO: 1339511 - protein, 8 aa, Mycobacterium
PTAGAAGP

SEQ ID NO: 1339512 - protein, 14 aa, Mycobacterium
PTAPFPGKTLTNQN

SEQ ID NO: 1339513 - protein, 5 aa, Mycobacterium
PTDGR

SEQ ID NO: 1339514 - protein, 5 aa, Mycobacterium
PTFDP

SEQ ID NO: 1339515 - protein, 7 aa, Mycobacterium
PTGEDTV

SEQ ID NO: 1339516 - protein, 4 aa, Mycobacterium
PTHG

SEQ ID NO: 1339517 - protein, 9 aa, Mycobacterium
PTKHTGSSH

SEQ ID NO: 1339518 - protein, 4 aa, Mycobacterium
PTRW

SEQ ID NO: 1339519 - protein, 15 aa, Mycobacterium
PTTAGRRAAGQVGTV

SEQ ID NO: 1339520 - protein, 7 aa, Mycobacterium
PTVDSPS

SEQ ID NO: 1339521 - protein, 5 aa, Mycobacterium
PTYSQ

SEQ ID NO: 1339522 - protein, 35 aa, Mycobacterium
PVAEAAGALPGPAPAPAPAPTPGPPGFGPDAPPTQ

SEQ ID NO: 1339523 - protein, 4 aa, Mycobacterium
PVAG

SEQ ID NO: 1339524 - protein, 7 aa, Mycobacterium
PVAPATA

SEQ ID NO: 1339525 - protein, 7 aa, Mycobacterium
PVAPVNT

SEQ ID NO: 1339526 - protein, 14 aa, Mycobacterium
PVPGAPYGLAGSSG

SEQ ID NO: 1339527 - protein, 4 aa, Mycobacterium
PVQP

SEQ ID NO: 1339528 - protein, 5 aa, Mycobacterium
PVRAE

SEQ ID NO: 1339529 - protein, 5 aa, Mycobacterium
PVSGY

SEQ ID NO: 1339530 - protein, 4 aa, Mycobacterium
PVYA

SEQ ID NO: 1339531 - protein, 8 aa, Mycobacterium
PWRPGSSM

SEQ ID NO: 1339532 - protein, 11 aa, Mycobacterium
PWSTGSQGYAN

SEQ ID NO: 1339533 - protein, 16 aa, Mycobacterium
QAAVGPDGPPMDYVAA

SEQ ID NO: 1339534 - protein, 6 aa, Mycobacterium
QAGAPK

SEQ ID NO: 1339535 - protein, 7 aa, Mycobacterium
QAGGLYQ

SEQ ID NO: 1339536 - protein, 13 aa, Mycobacterium
QAGLQPYVARIIE

SEQ ID NO: 1339537 - protein, 10 aa, Mycobacterium
QALTDSTDDI

SEQ ID NO: 1339538 - protein, 9 aa, Mycobacterium
QARPNEITY

SEQ ID NO: 1339539 - protein, 14 aa, Mycobacterium
QASVPRAALAPILA

SEQ ID NO: 1339540 - protein, 15 aa, Mycobacterium
QCTDSGKPPLQPTGF

SEQ ID NO: 1339541 - protein, 11 aa, Mycobacterium
QDAARRAEDRG

SEQ ID NO: 1339542 - protein, 6 aa, Mycobacterium
QDGFPG

SEQ ID NO: 1339543 - protein, 13 aa, Mycobacterium
QDGTEPDHHTHQR

SEQ ID NO: 1339544 - protein, 22 aa, Mycobacterium
QDPAPTGGEVTTPSTSKPQVNI

SEQ ID NO: 1339545 - protein, 7 aa, Mycobacterium
QDRDPIG

SEQ ID NO: 1339546 - protein, 5 aa, Mycobacterium
QDTRG

SEQ ID NO: 1339547 - protein, 25 aa, Mycobacterium
QEAYTAATDGEGPELEYSNESGPTE

SEQ ID NO: 1339548 - protein, 38 aa, Mycobacterium
QEPADEPADESVSAAAAAPVPWSPDPFRPDDPDPQDMP

SEQ ID NO: 1339549 - protein, 4 aa, Mycobacterium
QESG

SEQ ID NO: 1339550 - protein, 8 aa, Mycobacterium
QGANAASD

SEQ ID NO: 1339551 - protein, 7 aa, Mycobacterium
QGGERLP

SEQ ID NO: 1339552 - protein, 9 aa, Mycobacterium
QGGGGASPL

SEQ ID NO: 1339553 - protein, 6 aa, Mycobacterium
QGGGPR

SEQ ID NO: 1339554 - protein, 4 aa, Mycobacterium
QGKA

SEQ ID NO: 1339555 - protein, 11 aa, Mycobacterium
QGKPVAGALNQ

SEQ ID NO: 1339556 - protein, 20 aa, Mycobacterium
QGLGGTTSTSATFETHSPEN

SEQ ID NO: 1339557 - protein, 4 aa, Mycobacterium
QGNT

SEQ ID NO: 1339558 - protein, 6 aa, Mycobacterium
QGNTNL

SEQ ID NO: 1339559 - protein, 8 aa, Mycobacterium
QGRPVSPH

SEQ ID NO: 1339560 - protein, 14 aa, Mycobacterium
QGTDSAGPGTFGTP

SEQ ID NO: 1339561 - protein, 31 aa, Mycobacterium
QGYDQGFDQGQDPGADGGWDGGDSGGGWGDF

SEQ ID NO: 1339562 - protein, 9 aa, Mycobacterium
QIGSPTSAH

SEQ ID NO: 1339563 - protein, 7 aa, Mycobacterium
QIPAAAP

SEQ ID NO: 1339564 - protein, 7 aa, Mycobacterium
QIPPGYI

SEQ ID NO: 1339565 - protein, 5 aa, Mycobacterium
QLASV

SEQ ID NO: 1339566 - protein, 13 aa, Mycobacterium
QLPPGTDTDTYAR

SEQ ID NO: 1339567 - protein, 9 aa, Mycobacterium
QNAGDAAAN

SEQ ID NO: 1339568 - protein, 8 aa, Mycobacterium
QNAGVQHA

SEQ ID NO: 1339569 - protein, 8 aa, Mycobacterium
QNGLSPND

SEQ ID NO: 1339570 - protein, 17 aa, Mycobacterium
QNKKATDYLAGNWASAI

SEQ ID NO: 1339571 - protein, 9 aa, Mycobacterium
QNTVEKDAT

SEQ ID NO: 1339572 - protein, 14 aa, Mycobacterium
QPAAQSVTTTMSRL

SEQ ID NO: 1339573 - protein, 11 aa, Mycobacterium
QPDSVDTDLTA

SEQ ID NO: 1339574 - protein, 29 aa, Mycobacterium
QPFSTTTAANTSARHTTASSSTATPATTV

SEQ ID NO: 1339575 - protein, 4 aa, Mycobacterium
QPQR

SEQ ID NO: 1339576 - protein, 6 aa, Mycobacterium
QPSQAA

SEQ ID NO: 1339577 - protein, 10 aa, Mycobacterium
QPTEPGEVST

SEQ ID NO: 1339578 - protein, 20 aa, Mycobacterium
QPTTVNQAPTTTAMSGMGSG

SEQ ID NO: 1339579 - protein, 12 aa, Mycobacterium
QPVAQADNRRFN

SEQ ID NO: 1339580 - protein, 13 aa, Mycobacterium
QPYGGYISPGSTL

SEQ ID NO: 1339581 - protein, 8 aa, Mycobacterium
QQATGGAL

SEQ ID NO: 1339582 - protein, 8 aa, Mycobacterium
QQNPAGNA

SEQ ID NO: 1339583 - protein, 6 aa, Mycobacterium
QRDADG

SEQ ID NO: 1339584 - protein, 8 aa, Mycobacterium
QRGEDRQR

SEQ ID NO: 1339585 - protein, 4 aa, Mycobacterium
QRYP

SEQ ID NO: 1339586 - protein, 6 aa, Mycobacterium
QSAEPA

SEQ ID NO: 1339587 - protein, 9 aa, Mycobacterium
QSAQGTLTG

SEQ ID NO: 1339588 - protein, 8 aa, Mycobacterium
QSDEPPCC

SEQ ID NO: 1339589 - protein, 6 aa, Mycobacterium
QSGRFP

SEQ ID NO: 1339590 - protein, 6 aa, Mycobacterium
QSGTGE

SEQ ID NO: 1339591 - protein, 7 aa, Mycobacterium
QSPNARL

SEQ ID NO: 1339592 - protein, 4 aa, Mycobacterium
QSRG

SEQ ID NO: 1339593 - protein, 6 aa, Mycobacterium
QTFAND

SEQ ID NO: 1339594 - protein, 14 aa, Mycobacterium
QTGPFRPANTIRGA

SEQ ID NO: 1339595 - protein, 5 aa, Mycobacterium
QTSDA

SEQ ID NO: 1339596 - protein, 16 aa, Mycobacterium
QTSLPAADDTTMPTPY

SEQ ID NO: 1339597 - protein, 21 aa, Mycobacterium
QTVTGTVAQTTEPGPPIPDAT

SEQ ID NO: 1339598 - protein, 126 aa, Mycobacterium
QVGTAAADTAGETTTSSNAPSSDDDARSTSTDQSDDTDDQDAEDAEAEDAEDADEEDAEDAEDEEDPDEEDEEDAPEGLEDEDPDEDTLDQDDEDDEESAADDDKRAARGTTEDVAAETVSQPQAR

SEQ ID NO: 1339599 - protein, 10 aa, Mycobacterium
QVRDADPGVA

SEQ ID NO: 1339600 - protein, 9 aa, Mycobacterium
QYDGASDVP

SEQ ID NO: 1339601 - protein, 17 aa, Mycobacterium
RAADTYLGQAQDPLNTN

SEQ ID NO: 1339602 - protein, 11 aa, Mycobacterium
RAAEAQARRAM

SEQ ID NO: 1339603 - protein, 6 aa, Mycobacterium
RAAGEG

SEQ ID NO: 1339604 - protein, 7 aa, Mycobacterium
RADEANA

SEQ ID NO: 1339605 - protein, 6 aa, Mycobacterium
RAERRV

SEQ ID NO: 1339606 - protein, 13 aa, Mycobacterium
RAGAHAADGLGQP

SEQ ID NO: 1339607 - protein, 8 aa, Mycobacterium
RAGDDPAV

SEQ ID NO: 1339608 - protein, 9 aa, Mycobacterium
RAGNDTDTV

SEQ ID NO: 1339609 - protein, 40 aa, Mycobacterium
RAIETPAEPVADAPAQTAPDPADDVESADAPPPSVDPTPV

SEQ ID NO: 1339610 - protein, 8 aa, Mycobacterium
RANSTVQN

SEQ ID NO: 1339611 - protein, 12 aa, Mycobacterium
RAPTAEPTPVGT

SEQ ID NO: 1339612 - protein, 9 aa, Mycobacterium
RASADELRR

SEQ ID NO: 1339613 - protein, 6 aa, Mycobacterium
RASIEG

SEQ ID NO: 1339614 - protein, 31 aa, Mycobacterium; identical to SEQ ID NO: 1221444

SEQ ID NO: 1339615 - protein, 8 aa, Mycobacterium
RCGGPRYD

SEQ ID NO: 1339616 - protein, 7 aa, Mycobacterium
RDAGNRV

SEQ ID NO: 1339617 - protein, 6 aa, Mycobacterium
RDDPAG

SEQ ID NO: 1339618 - protein, 12 aa, Mycobacterium
RDEELTAPLPGD

SEQ ID NO: 1339619 - protein, 9 aa, Mycobacterium
RDLRPQSSR

SEQ ID NO: 1339620 - protein, 5 aa, Mycobacterium
RDLSG

SEQ ID NO: 1339621 - protein, 7 aa, Mycobacterium
RDPASQF

SEQ ID NO: 1339622 - protein, 8 aa, Mycobacterium
RDPGSRST

SEQ ID NO: 1339623 - protein, 4 aa, Mycobacterium
RDRL

SEQ ID NO: 1339624 - protein, 11 aa, Mycobacterium
RDRSSDPALQG

SEQ ID NO: 1339625 - protein, 5 aa, Mycobacterium
RDSAD

SEQ ID NO: 1339626 - protein, 15 aa, Mycobacterium
RDTIGATSDKLTSVS

SEQ ID NO: 1339627 - protein, 5 aa, Mycobacterium
RDTRL

SEQ ID NO: 1339628 - protein, 13 aa, Mycobacterium
RDYADRDAEALAT

SEQ ID NO: 1339629 - protein, 7 aa, Mycobacterium
REAGISP

SEQ ID NO: 1339630 - protein, 4 aa, Mycobacterium
REAL

SEQ ID NO: 1339631 - protein, 24 aa, Mycobacterium
REALNASAAAAGYATRYGATATLP

SEQ ID NO: 1339632 - protein, 8 aa, Mycobacterium
REAPDAAD

SEQ ID NO: 1339633 - protein, 5 aa, Mycobacterium
REDGS

SEQ ID NO: 1339634 - protein, 15 aa, Mycobacterium
REISGTPPAAPGATW

SEQ ID NO: 1339635 - protein, 6 aa, Mycobacterium
REPERV

SEQ ID NO: 1339636 - protein, 4 aa, Mycobacterium
RESG

SEQ ID NO: 1339637 - protein, 7 aa, Mycobacterium
RFPGEAV

SEQ ID NO: 1339638 - protein, 7 aa, Mycobacterium
RFPRDKA

SEQ ID NO: 1339639 - protein, 10 aa, Mycobacterium
RGAGAAEEAR

SEQ ID NO: 1339640 - protein, 5 aa, Mycobacterium
RGEPV

SEQ ID NO: 1339641 - protein, 10 aa, Mycobacterium
RGGETVSATD

SEQ ID NO: 1339642 - protein, 5 aa, Mycobacterium
RGGLR

SEQ ID NO: 1339643 - protein, 14 aa, Mycobacterium
RGHGQSGEAPPDTY

SEQ ID NO: 1339644 - protein, 8 aa, Mycobacterium
RGHGSGDF

SEQ ID NO: 1339645 - protein, 4 aa, Mycobacterium
RGPY

SEQ ID NO: 1339646 - protein, 7 aa, Mycobacterium
RGQGKGR

SEQ ID NO: 1339647 - protein, 6 aa, Mycobacterium
RGSRGV

SEQ ID NO: 1339648 - protein, 25 aa, Mycobacterium
RGVGGMSAAQTSTFSTVSPAGQTSV

SEQ ID NO: 1339649 - protein, 9 aa, Mycobacterium
RGVGHSTPQ

SEQ ID NO: 1339650 - protein, 9 aa, Mycobacterium
RGVSPSGNA

SEQ ID NO: 1339651 - protein, 6 aa, Mycobacterium
RHGRGR

SEQ ID NO: 1339652 - protein, 16 aa, Mycobacterium
RIGSPYSWGGSGPNAF

SEQ ID NO: 1339653 - protein, 4 aa, Mycobacterium
RIPD

SEQ ID NO: 1339654 - protein, 11 aa, Mycobacterium
RISSTPDYQPD

SEQ ID NO: 1339655 - protein, 22 aa, Mycobacterium
RITGTVASSNPTAAPTRTRSGL

SEQ ID NO: 1339656 - protein, 8 aa, Mycobacterium
RKDPQHPV

SEQ ID NO: 1339657 - protein, 10 aa, Mycobacterium
RLGTQEVEGE

SEQ ID NO: 1339658 - protein, 10 aa, Mycobacterium
RLNPADEDAF

SEQ ID NO: 1339659 - protein, 6 aa, Mycobacterium
RLSEAD

SEQ ID NO: 1339660 - protein, 6 aa, Mycobacterium
RLTSAT

SEQ ID NO: 1339661 - protein, 15 aa, Mycobacterium
RNDDRPPWGWGPPPP

SEQ ID NO: 1339662 - protein, 5 aa, Mycobacterium
RNGFQ

SEQ ID NO: 1339663 - protein, 6 aa, Mycobacterium
RNGTFR

SEQ ID NO: 1339664 - protein, 8 aa, Mycobacterium
RNPAPNVE

SEQ ID NO: 1339665 - protein, 9 aa, Mycobacterium
RNTERSEAG

SEQ ID NO: 1339666 - protein, 8 aa, Mycobacterium
RNTGGPRL

SEQ ID NO: 1339667 - protein, 14 aa, Mycobacterium
RNTGQIVSNGNNRG

SEQ ID NO: 1339668 - protein, 19 aa, Mycobacterium
RPADTDPSTHPTTDEVSEG

SEQ ID NO: 1339669 - protein, 38 aa, Mycobacterium
RPANQRGTGAAPASAQTTSEPAPSTTQPLAAAAAPSGV

SEQ ID NO: 1339670 - protein, 17 aa, Mycobacterium
RPDGTSTPMADRGGDVA

SEQ ID NO: 1339671 - protein, 12 aa, Mycobacterium
RPDPIGGHGDGR

SEQ ID NO: 1339672 - protein, 4 aa, Mycobacterium
RPFE

SEQ ID NO: 1339673 - protein, 4 aa, Mycobacterium
RPGA

SEQ ID NO: 1339674 - protein, 5 aa, Mycobacterium
RPGDP

SEQ ID NO: 1339675 - protein, 18 aa, Mycobacterium
RPGESDGSCGGGAPSAGT

SEQ ID NO: 1339676 - protein, 11 aa, Mycobacterium
RPGKRAPTAKM

SEQ ID NO: 1339677 - protein, 6 aa, Mycobacterium
RPGQTP

SEQ ID NO: 1339678 - protein, 10 aa, Mycobacterium
RPGTSGDPRF

SEQ ID NO: 1339679 - protein, 6 aa, Mycobacterium
RPNEVT

SEQ ID NO: 1339680 - protein, 14 aa, Mycobacterium
RPNPQFQPTRHANR

SEQ ID NO: 1339681 - protein, 6 aa, Mycobacterium
RPPGDE

SEQ ID NO: 1339682 - protein, 14 aa, Mycobacterium
RPTAGDPSLAPPGR

SEQ ID NO: 1339683 - protein, 4 aa, Mycobacterium
RPVQ

SEQ ID NO: 1339684 - protein, 14 aa, Mycobacterium
RQAPDTGAVTGQPE

SEQ ID NO: 1339685 - protein, 8 aa, Mycobacterium
RQESTDGV

SEQ ID NO: 1339686 - protein, 9 aa, Mycobacterium
RQGRPEQRP

SEQ ID NO: 1339687 - protein, 4 aa, Mycobacterium
RQPD

SEQ ID NO: 1339688 - protein, 16 aa, Mycobacterium
RQRRQDDAINPRPRRW

SEQ ID NO: 1339689 - protein, 7 aa, Mycobacterium
RRDNASR

SEQ ID NO: 1339690 - protein, 9 aa, Mycobacterium
RRDRPEGKL

SEQ ID NO: 1339691 - protein, 7 aa, Mycobacterium
RREREPL

SEQ ID NO: 1339692 - protein, 26 aa, Mycobacterium
RRGDTDDDHIDNDDHHNKDGAAPEED

SEQ ID NO: 1339693 - protein, 5 aa, Mycobacterium
RRGEQ

SEQ ID NO: 1339694 - protein, 4 aa, Mycobacterium
RRNG

SEQ ID NO: 1339695 - protein, 10 aa, Mycobacterium
RRPDGPVAPL

SEQ ID NO: 1339696 - protein, 7 aa, Mycobacterium
RRPGTLD

SEQ ID NO: 1339697 - protein, 8 aa, Mycobacterium
RRPRSGPA

SEQ ID NO: 1339698 - protein, 4 aa, Mycobacterium
RRRH

SEQ ID NO: 1339699 - protein, 8 aa, Mycobacterium
RRTTSPVA

SEQ ID NO: 1339700 - protein, 9 aa, Mycobacterium
RSADGRVTA

SEQ ID NO: 1339701 - protein, 10 aa, Mycobacterium
RSAESGTALA

SEQ ID NO: 1339702 - protein, 10 aa, Mycobacterium
RSDDAPPLKN

SEQ ID NO: 1339703 - protein, 7 aa, Mycobacterium
RSDGTDR

SEQ ID NO: 1339704 - protein, 7 aa, Mycobacterium
RSGIGSS

SEQ ID NO: 1339705 - protein, 22 aa, Mycobacterium
RSGSRSRSSASSREEKKEATRR

SEQ ID NO: 1339706 - protein, 5 aa, Mycobacterium
RSIRR

SEQ ID NO: 1339707 - protein, 17 aa, Mycobacterium
RSISNPGEAAQAPASAS

SEQ ID NO: 1339708 - protein, 11 aa, Mycobacterium
RSKDGSETGRR

SEQ ID NO: 1339709 - protein, 8 aa, Mycobacterium
RSPEGKVL

SEQ ID NO: 1339710 - protein, 5 aa, Mycobacterium
RTAPA

SEQ ID NO: 1339711 - protein, 9 aa, Mycobacterium
RTDSPSSGV

SEQ ID NO: 1339712 - protein, 7 aa, Mycobacterium
RTETPEL

SEQ ID NO: 1339713 - protein, 7 aa, Mycobacterium
RTEVSQA

SEQ ID NO: 1339714 - protein, 7 aa, Mycobacterium
RTHPGTT

SEQ ID NO: 1339715 - protein, 11 aa, Mycobacterium
RTLGGKPALDI

SEQ ID NO: 1339716 - protein, 14 aa, Mycobacterium
RTPAALAQPQPAGA

SEQ ID NO: 1339717 - protein, 7 aa, Mycobacterium
RTPDGGW

SEQ ID NO: 1339718 - protein, 10 aa, Mycobacterium
RTPPGRTGGD

SEQ ID NO: 1339719 - protein, 14 aa, Mycobacterium
RTPTGPAHPRPANR

SEQ ID NO: 1339720 - protein, 6 aa, Mycobacterium
RTRAAL

SEQ ID NO: 1339721 - protein, 4 aa, Mycobacterium
RTSV

SEQ ID NO: 1339722 - protein, 7 aa, Mycobacterium
RTTQHRA

SEQ ID NO: 1339723 - protein, 17 aa, Mycobacterium
RVNQSTTPLDANGMPGV

SEQ ID NO: 1339724 - protein, 19 aa, Mycobacterium
RVPGGRVRPAYGPGRDLAD

SEQ ID NO: 1339725 - protein, 6 aa, Mycobacterium
RYPGDL

SEQ ID NO: 1339726 - protein, 18 aa, Mycobacterium
SAAASALPRASAASRRWS

SEQ ID NO: 1339727 - protein, 6 aa, Mycobacterium
SAAQDD

SEQ ID NO: 1339728 - protein, 9 aa, Mycobacterium
SADDPETVR

SEQ ID NO: 1339729 - protein, 7 aa, Mycobacterium
SADGSTV

SEQ ID NO: 1339730 - protein, 19 aa, Mycobacterium
SADPEPSGPPAPGQTYPNW

SEQ ID NO: 1339731 - protein, 7 aa, Mycobacterium
SAERAPR

SEQ ID NO: 1339732 - protein, 38 aa, Mycobacterium
SAFTGGGDVPPPAGWGTPPGPPGTYAPHGLPANPTPAL

SEQ ID NO: 1339733 - protein, 25 aa, Mycobacterium
SAGGQVLSDDGERVTLTDTPEHRAA

SEQ ID NO: 1339734 - protein, 15 aa, Mycobacterium
SAGRYAPAAAAAAPT

SEQ ID NO: 1339735 - protein, 5 aa, Mycobacterium
SAGSV

SEQ ID NO: 1339736 - protein, 12 aa, Mycobacterium
SAHADPGPFSDG

SEQ ID NO: 1339737 - protein, 17 aa, Mycobacterium
SAHAKNGDTHITGTGLS

SEQ ID NO: 1339738 - protein, 8 aa, Mycobacterium
SALGGREA

SEQ ID NO: 1339739 - protein, 5 aa, Mycobacterium
SAPDR

SEQ ID NO: 1339740 - protein, 21 aa, Mycobacterium
SAPPRTVPTPATATAMAGTDD

SEQ ID NO: 1339741 - protein, 27 aa, Mycobacterium
SAQTLGGALDRAGENLANSFSADNPFG

SEQ ID NO: 1339742 - protein, 4 aa, Mycobacterium
SARH

SEQ ID NO: 1339743 - protein, 8 aa, Mycobacterium
SARVGQPL

SEQ ID NO: 1339744 - protein, 14 aa, Mycobacterium
SARVTSPDPEGSYQ

SEQ ID NO: 1339745 - protein, 6 aa, Mycobacterium
SATESI

SEQ ID NO: 1339746 - protein, 8 aa, Mycobacterium
SATTPAAA

SEQ ID NO: 1339747 - protein, 4 aa, Mycobacterium
SDAK

SEQ ID NO: 1339748 - protein, 13 aa, Mycobacterium
SDAVEKGPLASPV

SEQ ID NO: 1339749 - protein, 23 aa, Mycobacterium
SDDPAGLAEADATANTLPGPLET

SEQ ID NO: 1339750 - protein, 8 aa, Mycobacterium
SDDTEAPL

SEQ ID NO: 1339751 - protein, 4 aa, Mycobacterium
SDEN

SEQ ID NO: 1339752 - protein, 17 aa, Mycobacterium
SDERVEGIDAPTLKESG

SEQ ID NO: 1339753 - protein, 13 aa, Mycobacterium
SDGGSGTQCALRA

SEQ ID NO: 1339754 - protein, 18 aa, Mycobacterium
SDGLSASVRTGISAAGAA

SEQ ID NO: 1339755 - protein, 7 aa, Mycobacterium
SDGQTVG

SEQ ID NO: 1339756 - protein, 6 aa, Mycobacterium
SDGRAV

SEQ ID NO: 1339757 - protein, 9 aa, Mycobacterium
SDGSRRAEM

SEQ ID NO: 1339758 - protein, 18 aa, Mycobacterium
SDKAAGDRLSDARQLGPR

SEQ ID NO: 1339759 - protein, 14 aa, Mycobacterium
SDQPAGAAEARATI

SEQ ID NO: 1339760 - protein, 4 aa, Mycobacterium
SDTA

SEQ ID NO: 1339761 - protein, 6 aa, Mycobacterium
SDTSRM

SEQ ID NO: 1339762 - protein, 6 aa, Mycobacterium
SDTTDE

SEQ ID NO: 1339763 - protein, 6 aa, Mycobacterium
SDTTVG

SEQ ID NO: 1339764 - protein, 7 aa, Mycobacterium
SESDAEQ

SEQ ID NO: 1339765 - protein, 6 aa, Mycobacterium
SETGNA

SEQ ID NO: 1339766 - protein, 7 aa, Mycobacterium
SFPPRDV

SEQ ID NO: 1339767 - protein, 14 aa, Mycobacterium
SGCSSGDDAVAQGG

SEQ ID NO: 1339768 - protein, 5 aa, Mycobacterium
SGDFP

SEQ ID NO: 1339769 - protein, 19 aa, Mycobacterium
SGDQYNTGRKVPTSQAKRG

SEQ ID NO: 1339770 - protein, 7 aa, Mycobacterium
SGEGADE

SEQ ID NO: 1339771 - protein, 10 aa, Mycobacterium
SGGFGSLTQR

SEQ ID NO: 1339772 - protein, 6 aa, Mycobacterium
SGGRLT

SEQ ID NO: 1339773 - protein, 13 aa, Mycobacterium
SGGVAPEIGPVDT

SEQ ID NO: 1339774 - protein, 5 aa, Mycobacterium
SGIPG

SEQ ID NO: 1339775 - protein, 6 aa, Mycobacterium
SGLEED

SEQ ID NO: 1339776 - protein, 19 aa, Mycobacterium
SGLGEDTATVARSTVQPAA

SEQ ID NO: 1339777 - protein, 6 aa, Mycobacterium
SGLSRT

SEQ ID NO: 1339778 - protein, 12 aa, Mycobacterium
SGMADTPARHQP

SEQ ID NO: 1339779 - protein, 5 aa, Mycobacterium
SGMTN

SEQ ID NO: 1339780 - protein, 17 aa, Mycobacterium
SGNSGPTTCTQSRGRDA

SEQ ID NO: 1339781 - protein, 8 aa, Mycobacterium
SGPAGLSA

SEQ ID NO: 1339782 - protein, 13 aa, Mycobacterium
SGPANRQKSDARL

SEQ ID NO: 1339783 - protein, 13 aa, Mycobacterium
SGPCCGEGCPCCR

SEQ ID NO: 1339784 - protein, 8 aa, Mycobacterium
SGPGGRSA

SEQ ID NO: 1339785 - protein, 10 aa, Mycobacterium
SGPGSPGGGP

SEQ ID NO: 1339786 - protein, 8 aa, Mycobacterium
SGPVNNGK

SEQ ID NO: 1339787 - protein, 55 aa, Mycobacterium
SGSGGWGGDGGDASWGGAGGAGGAAHGTGSGGVGGAGDVGGVGGLGGDGGHGGAY

SEQ ID NO: 1339788 - protein, 4 aa, Mycobacterium
SGSM

SEQ ID NO: 1339789 - protein, 6 aa, Mycobacterium
SGSSGD

SEQ ID NO: 1339790 - protein, 34 aa, Mycobacterium
SGVPTEGSRPPVEGLPPPAEPQRAPAPTTPVPGR

SEQ ID NO: 1339791 - protein, 15 aa, Mycobacterium
SHTYDDSKSIAAEET

SEQ ID NO: 1339792 - protein, 5 aa, Mycobacterium
SIGYG

SEQ ID NO: 1339793 - protein, 18 aa, Mycobacterium
SIYDADGKPTLNTEQAAR

SEQ ID NO: 1339794 - protein, 14 aa, Mycobacterium
SKAMRAVQGNSDPL

SEQ ID NO: 1339795 - protein, 5 aa, Mycobacterium
SKIEE

SEQ ID NO: 1339796 - protein, 49 aa, Mycobacterium
SLADASRSRAADDSSDAGTTGTGSPANEGAASDGDTAPAAPSADAPAAN

SEQ ID NO: 1339797 - protein, 13 aa, Mycobacterium
SLAGQTVRDNSHR

SEQ ID NO: 1339798 - protein, 15 aa, Mycobacterium
SLPGLPGGPPPPIGQ

SEQ ID NO: 1339799 - protein, 6 aa, Mycobacterium
SLQPDN

SEQ ID NO: 1339800 - protein, 16 aa, Mycobacterium
SLRPEDPAAPDGQQYG

SEQ ID NO: 1339801 - protein, 7 aa, Mycobacterium
SMTDDSA

SEQ ID NO: 1339802 - protein, 28 aa, Mycobacterium
SNAVYGARNPHRHKAPVTAETPPNPTEL

SEQ ID NO: 1339803 - protein, 5 aa, Mycobacterium
SNDRN

SEQ ID NO: 1339804 - protein, 5 aa, Mycobacterium
SNETI

SEQ ID NO: 1339805 - protein, 4 aa, Mycobacterium
SNGT

SEQ ID NO: 1339806 - protein, 6 aa, Mycobacterium
SNSNEQ

SEQ ID NO: 1339807 - protein, 17 aa, Mycobacterium
SNTAPPPGWTGSTGTVS

SEQ ID NO: 1339808 - protein, 6 aa, Mycobacterium
SNTRGQ

SEQ ID NO: 1339809 - protein, 18 aa, Mycobacterium
SPDDLAKAAEGDVDGDAI

SEQ ID NO: 1339810 - protein, 5 aa, Mycobacterium
SPDNA

SEQ ID NO: 1339811 - protein, 5 aa, Mycobacterium
SPFQT

SEQ ID NO: 1339812 - protein, 6 aa, Mycobacterium
SPGGKT

SEQ ID NO: 1339813 - protein, 5 aa, Mycobacterium
SPGSL

SEQ ID NO: 1339814 - protein, 8 aa, Mycobacterium
SPLTGTPP

SEQ ID NO: 1339815 - protein, 6 aa, Mycobacterium
SPMRTQ

SEQ ID NO: 1339816 - protein, 9 aa, Mycobacterium
SPQDRMAGT

SEQ ID NO: 1339817 - protein, 19 aa, Mycobacterium
SPSAGTAPAAVAPPAPTIL

SEQ ID NO: 1339818 - protein, 7 aa, Mycobacterium
SPSDGGI

SEQ ID NO: 1339819 - protein, 12 aa, Mycobacterium
SPSTAEGDPTWT

SEQ ID NO: 1339820 - protein, 9 aa, Mycobacterium
SQGADVAGD

SEQ ID NO: 1339821 - protein, 6 aa, Mycobacterium
SQMGGR

SEQ ID NO: 1339822 - protein, 21 aa, Mycobacterium
SQMTDAQQLSSEFEKENPGTK

SEQ ID NO: 1339823 - protein, 10 aa, Mycobacterium
SQPRPQAEAD

SEQ ID NO: 1339824 - protein, 4 aa, Mycobacterium
SQQR

SEQ ID NO: 1339825 - protein, 13 aa, Mycobacterium
SQTAGRLGDSRTD

SEQ ID NO: 1339826 - protein, 15 aa, Mycobacterium
SREGDQIKMSKVEFV

SEQ ID NO: 1339827 - protein, 10 aa, Mycobacterium
SRNGVGPVDS

SEQ ID NO: 1339828 - protein, 13 aa, Mycobacterium
SRNPYEPHAPAST

SEQ ID NO: 1339829 - protein, 8 aa, Mycobacterium
SRNQTAEQ

SEQ ID NO: 1339830 - protein, 8 aa, Mycobacterium
SRPRASRS

SEQ ID NO: 1339831 - protein, 8 aa, Mycobacterium
SRRRRGDN

SEQ ID NO: 1339832 - protein, 6 aa, Mycobacterium
SRTGNK

SEQ ID NO: 1339833 - protein, 6 aa, Mycobacterium
SRTTWQ

SEQ ID NO: 1339834 - protein, 9 aa, Mycobacterium
SSANLGPGF

SEQ ID NO: 1339835 - protein, 10 aa, Mycobacterium
SSCGGAAESV

SEQ ID NO: 1339836 - protein, 7 aa, Mycobacterium
SSDDSAA

SEQ ID NO: 1339837 - protein, 6 aa, Mycobacterium
SSDNMA

SEQ ID NO: 1339838 - protein, 11 aa, Mycobacterium
SSEAVQTREAV

SEQ ID NO: 1339839 - protein, 7 aa, Mycobacterium
SSFTNSI

SEQ ID NO: 1339840 - protein, 6 aa, Mycobacterium
SSGPDR

SEQ ID NO: 1339841 - protein, 39 aa, Mycobacterium
SSNGEGGDSETSSTTSGTSESSAAAAAPSPEAQKAATEY

SEQ ID NO: 1339842 - protein, 16 aa, Mycobacterium
SSPAPPPDVTGGDLAG

SEQ ID NO: 1339843 - protein, 8 aa, Mycobacterium
SSPPGAVP

SEQ ID NO: 1339844 - protein, 9 aa, Mycobacterium
SSSESPVRE

SEQ ID NO: 1339845 - protein, 9 aa, Mycobacterium
SSSRTTEAA

SEQ ID NO: 1339846 - protein, 18 aa, Mycobacterium
SSSTPAENSGAEADPASR

SEQ ID NO: 1339847 - protein, 16 aa, Mycobacterium
SSSVDPHDFEPAPKDA

SEQ ID NO: 1339848 - protein, 29 aa, Mycobacterium
STEQPQSEGSTSHAHSETAGDAHAPHNAD

SEQ ID NO: 1339849 - protein, 16 aa, Mycobacterium
STGGAPGSGSTGSSAL

SEQ ID NO: 1339850 - protein, 5 aa, Mycobacterium
STGNM

SEQ ID NO: 1339851 - protein, 10 aa, Mycobacterium
STGTSHAGLD

SEQ ID NO: 1339852 - protein, 5 aa, Mycobacterium
STGVD

SEQ ID NO: 1339853 - protein, 17 aa, Mycobacterium
STPAATAAMAGALRAVM

SEQ ID NO: 1339854 - protein, 13 aa, Mycobacterium
STPGIAVDEAAPA

SEQ ID NO: 1339855 - protein, 22 aa, Mycobacterium
STPRAQCESAAEDDVSCSDADV

SEQ ID NO: 1339856 - protein, 12 aa, Mycobacterium
STRLAGDARANL

SEQ ID NO: 1339857 - protein, 17 aa, Mycobacterium
STSNGVSLTGTAGLNPS

SEQ ID NO: 1339858 - protein, 13 aa, Mycobacterium
STSQRLKAGDRAG

SEQ ID NO: 1339859 - protein, 8 aa, Mycobacterium
STTSVAGA

SEQ ID NO: 1339860 - protein, 5 aa, Mycobacterium
STYAD

SEQ ID NO: 1339861 - protein, 4 aa, Mycobacterium
STYK

SEQ ID NO: 1339862 - protein, 24 aa, Mycobacterium
SVATGSAAISTPPAVTSIAPGTGD

SEQ ID NO: 1339863 - protein, 8 aa, Mycobacterium
SVDPRSAA

SEQ ID NO: 1339864 - protein, 11 aa, Mycobacterium
SVGSQGQSNVS

SEQ ID NO: 1339865 - protein, 6 aa, Mycobacterium
SVPPPI

SEQ ID NO: 1339866 - protein, 9 aa, Mycobacterium
SVSGGNAAS

SEQ ID NO: 1339867 - protein, 6 aa, Mycobacterium
SVTDEG

SEQ ID NO: 1339868 - protein, 8 aa, Mycobacterium
SVVQNADG

SEQ ID NO: 1339869 - protein, 9 aa, Mycobacterium
TAAAEAKTQ

SEQ ID NO: 1339870 - protein, 19 aa, Mycobacterium
TAAEDNGISTFESGTEAVA

SEQ ID NO: 1339871 - protein, 13 aa, Mycobacterium
TAAGGSASAIPAN

SEQ ID NO: 1339872 - protein, 5 aa, Mycobacterium
TAAGT

SEQ ID NO: 1339873 - protein, 7 aa, Mycobacterium
TAAPANS

SEQ ID NO: 1339874 - protein, 7 aa, Mycobacterium
TAASPQQ

SEQ ID NO: 1339875 - protein, 13 aa, Mycobacterium
TADDSGGFTAENG

SEQ ID NO: 1339876 - protein, 7 aa, Mycobacterium
TADGAAK

SEQ ID NO: 1339877 - protein, 4 aa, Mycobacterium
TAER

SEQ ID NO: 1339878 - protein, 62 aa, Mycobacterium
TAFAETGEPTSQTPPDDSPKPAAEQDDPGQEQAEERAEEQAEEPDPEALEGLPDDDGDEPVV

SEQ ID NO: 1339879 - protein, 11 aa, Mycobacterium
TAGTGSSLPTQ

SEQ ID NO: 1339880 - protein, 9 aa, Mycobacterium
TAMDTTAAQ

SEQ ID NO: 1339881 - protein, 12 aa, Mycobacterium
TAPVDGADTDQT

SEQ ID NO: 1339882 - protein, 14 aa, Mycobacterium
TARSSLEVRPDDRE

SEQ ID NO: 1339883 - protein, 8 aa, Mycobacterium
TASKNVDA

SEQ ID NO: 1339884 - protein, 12 aa, Mycobacterium
TDASARGVDPDR

SEQ ID NO: 1339885 - protein, 6 aa, Mycobacterium
TDGGAG

SEQ ID NO: 1339886 - protein, 8 aa, Mycobacterium
TDGGPTAG

SEQ ID NO: 1339887 - protein, 11 aa, Mycobacterium
TDGPPPGKKPF

SEQ ID NO: 1339888 - protein, 12 aa, Mycobacterium
TDLSRPDERAAL

SEQ ID NO: 1339889 - protein, 6 aa, Mycobacterium
TDRGDF

SEQ ID NO: 1339890 - protein, 7 aa, Mycobacterium
TDRRAEG

SEQ ID NO: 1339891 - protein, 6 aa, Mycobacterium
TDSDQV

SEQ ID NO: 1339892 - protein, 7 aa, Mycobacterium
TDSGADG

SEQ ID NO: 1339893 - protein, 21 aa, Mycobacterium
TDVQTDGAAASAAVRAASEGT

SEQ ID NO: 1339894 - protein, 53 aa, Mycobacterium
TDVTDDEESLTDDEEASPAQDESENTSEEAGDAGAGADEPGSGDAPSADAEAT

SEQ ID NO: 1339895 - protein, 7 aa, Mycobacterium
TEAGRHS

SEQ ID NO: 1339896 - protein, 20 aa, Mycobacterium
TEAPTATAPTSTAAPATPAT

SEQ ID NO: 1339897 - protein, 14 aa, Mycobacterium
TECTGTVRSDQGWE

SEQ ID NO: 1339898 - protein, 8 aa, Mycobacterium
TEDLDGFD

SEQ ID NO: 1339899 - protein, 11 aa, Mycobacterium
TEGKEGMDTYA

SEQ ID NO: 1339900 - protein, 7 aa, Mycobacterium
TEGRPSF

SEQ ID NO: 1339901 - protein, 9 aa, Mycobacterium
TEGSVPQQI

SEQ ID NO: 1339902 - protein, 9 aa, Mycobacterium
TEPGGLRAG

SEQ ID NO: 1339903 - protein, 6 aa, Mycobacterium
TEPLGY

SEQ ID NO: 1339904 - protein, 9 aa, Mycobacterium
TEPNPGGGL

SEQ ID NO: 1339905 - protein, 16 aa, Mycobacterium
TEPPSRADFDADSSRY

SEQ ID NO: 1339906 - protein, 9 aa, Mycobacterium
TESAQRYNT

SEQ ID NO: 1339907 - protein, 4 aa, Mycobacterium
TETV

SEQ ID NO: 1339908 - protein, 6 aa, Mycobacterium
TFETGR

SEQ ID NO: 1339909 - protein, 6 aa, Mycobacterium
TFPGGR

SEQ ID NO: 1339910 - protein, 11 aa, Mycobacterium
TGAGAAPDPTF

SEQ ID NO: 1339911 - protein, 8 aa, Mycobacterium
TGAPQKQI

SEQ ID NO: 1339912 - protein, 17 aa, Mycobacterium
TGARPRGFAAYLRATVS

SEQ ID NO: 1339913 - protein, 12 aa, Mycobacterium
TGATLSGTDGLG

SEQ ID NO: 1339914 - protein, 8 aa, Mycobacterium
TGAVPGQV

SEQ ID NO: 1339915 - protein, 18 aa, Mycobacterium
TGDAGNPGAAADPASQAG

SEQ ID NO: 1339916 - protein, 104 aa, Mycobacterium
TGEETDPDAEQTPLDEQKPADDAGDQGLGGDDLGEEELGEEDLGEEDLDEEELPGDDVSGDVTEETAEESEDGGEEAGEAGDAGDAGGETGGDTGGETANAPST

SEQ ID NO: 1339917 - protein, 9 aa, Mycobacterium
TGEPATQEP

SEQ ID NO: 1339918 - protein, 13 aa, Mycobacterium
TGFAGHRGGYGYH

SEQ ID NO: 1339919 - protein, 8 aa, Mycobacterium
TGFSATTR

SEQ ID NO: 1339920 - protein, 9 aa, Mycobacterium
TGGGGGIGA

SEQ ID NO: 1339921 - protein, 12 aa, Mycobacterium
TGGPGTGKTTTV

SEQ ID NO: 1339922 - protein, 10 aa, Mycobacterium
TGGVGTTSTG

SEQ ID NO: 1339923 - protein, 23 aa, Mycobacterium
TGKSGSATLKPRSDINPEGPTTL

SEQ ID NO: 1339924 - protein, 8 aa, Mycobacterium
TGLVEDTQ

SEQ ID NO: 1339925 - protein, 13 aa, Mycobacterium
TGNGNNLSGYSNA

SEQ ID NO: 1339926 - protein, 4 aa, Mycobacterium
TGNV

SEQ ID NO: 1339927 - protein, 10 aa, Mycobacterium
TGPASGAAEE

SEQ ID NO: 1339928 - protein, 41 aa, Mycobacterium; identical to SEQ ID NO: 919254

SEQ ID NO: 1339929 - protein, 8 aa, Mycobacterium
TGPPGADW

SEQ ID NO: 1339930 - protein, 22 aa, Mycobacterium
TGRNSDAQAAKPLPTPATANPA

SEQ ID NO: 1339931 - protein, 22 aa, Mycobacterium
TGRVPAADTAAQRVENGIGQGT

SEQ ID NO: 1339932 - protein, 31 aa, Mycobacterium
TGSPSPSAAPGQGEEGGSGSEGQGEGGQKLT

SEQ ID NO: 1339933 - protein, 25 aa, Mycobacterium
TGTAKGSFADNPTGAAEAKYEITTR

SEQ ID NO: 1339934 - protein, 5 aa, Mycobacterium
TGTGV

SEQ ID NO: 1339935 - protein, 11 aa, Mycobacterium
TGTPVASAQTA

SEQ ID NO: 1339936 - protein, 16 aa, Mycobacterium
TGTTGQTVLRRNGFAA

SEQ ID NO: 1339937 - protein, 8 aa, Mycobacterium
TGTTVVPD

SEQ ID NO: 1339938 - protein, 4 aa, Mycobacterium
TGTV

SEQ ID NO: 1339939 - protein, 4 aa, Mycobacterium
TGVA

SEQ ID NO: 1339940 - protein, 7 aa, Mycobacterium
THPEPKV

SEQ ID NO: 1339941 - protein, 12 aa, Mycobacterium
TIAPNGDVTPPI

SEQ ID NO: 1339942 - protein, 10 aa, Mycobacterium
TKAPPGSTVS

SEQ ID NO: 1339943 - protein, 5 aa, Mycobacterium
TKNGW

SEQ ID NO: 1339944 - protein, 14 aa, Mycobacterium
TKNSGGDMTRPKLD

SEQ ID NO: 1339945 - protein, 5 aa, Mycobacterium
TLASG

SEQ ID NO: 1339946 - protein, 9 aa, Mycobacterium
TLDPATQVN

SEQ ID NO: 1339947 - protein, 9 aa, Mycobacterium
TLGGDNGYA

SEQ ID NO: 1339948 - protein, 6 aa, Mycobacterium
TLPQNS

SEQ ID NO: 1339949 - protein, 8 aa, Mycobacterium
TLQPNSRV

SEQ ID NO: 1339950 - protein, 8 aa, Mycobacterium
TLSTGEDV

SEQ ID NO: 1339951 - protein, 18 aa, Mycobacterium
TLVDPQGNEFSADPECPA

SEQ ID NO: 1339952 - protein, 10 aa, Mycobacterium
TNNVDKSVGS

SEQ ID NO: 1339953 - protein, 7 aa, Mycobacterium
TNPSRTM

SEQ ID NO: 1339954 - protein, 16 aa, Mycobacterium
TNRMNRNAIKAAAAQG

SEQ ID NO: 1339955 - protein, 14 aa, Mycobacterium
TNTVAGAASGGPQA

SEQ ID NO: 1339956 - protein, 4 aa, Mycobacterium
TPAG

SEQ ID NO: 1339957 - protein, 5 aa, Mycobacterium
TPAVD

SEQ ID NO: 1339958 - protein, 11 aa, Mycobacterium
TPAYSSGPAMA

SEQ ID NO: 1339959 - protein, 4 aa, Mycobacterium
TPDE

SEQ ID NO: 1339960 - protein, 7 aa, Mycobacterium
TPESTVA

SEQ ID NO: 1339961 - protein, 12 aa, Mycobacterium
TPGPGCLPPPGH

SEQ ID NO: 1339962 - protein, 20 aa, Mycobacterium
TPGYTGGPTLQNNATIPRAR

SEQ ID NO: 1339963 - protein, 43 aa, Mycobacterium; identical to SEQ ID NO: 1230770

SEQ ID NO: 1339964 - protein, 12 aa, Mycobacterium
TPLGPATPDPRP

SEQ ID NO: 1339965 - protein, 12 aa, Mycobacterium
TPLGRAGQPEDV

SEQ ID NO: 1339966 - protein, 8 aa, Mycobacterium
TPNLGYGN

SEQ ID NO: 1339967 - protein, 6 aa, Mycobacterium
TPPGAD

SEQ ID NO: 1339968 - protein, 13 aa, Mycobacterium
TPPVERPSAVVCG

SEQ ID NO: 1339969 - protein, 14 aa, Mycobacterium
TPQSVSSPASEPAM

SEQ ID NO: 1339970 - protein, 8 aa, Mycobacterium
TPTIPTAT

SEQ ID NO: 1339971 - protein, 4 aa, Mycobacterium
TPVR

SEQ ID NO: 1339972 - protein, 12 aa, Mycobacterium
TQAQWGEQQVPA

SEQ ID NO: 1339973 - protein, 7 aa, Mycobacterium
TQIPTSG

SEQ ID NO: 1339974 - protein, 4 aa, Mycobacterium
TQNP

SEQ ID NO: 1339975 - protein, 7 aa, Mycobacterium
TQSPGNV

SEQ ID NO: 1339976 - protein, 5 aa, Mycobacterium
TRAQE

SEQ ID NO: 1339977 - protein, 7 aa, Mycobacterium
TRATAVG

SEQ ID NO: 1339978 - protein, 8 aa, Mycobacterium
TREDPSRP

SEQ ID NO: 1339979 - protein, 10 aa, Mycobacterium
TRGAQEARAE

SEQ ID NO: 1339980 - protein, 9 aa, Mycobacterium
TRGNESEGL

SEQ ID NO: 1339981 - protein, 4 aa, Mycobacterium
TRGY

SEQ ID NO: 1339982 - protein, 4 aa, Mycobacterium
TRPG

SEQ ID NO: 1339983 - protein, 25 aa, Mycobacterium
TRPYYDSAGSARATATVRTAGSQVT

SEQ ID NO: 1339984 - protein, 6 aa, Mycobacterium
TRRDDG

SEQ ID NO: 1339985 - protein, 10 aa, Mycobacterium
TRSDPALTGA

SEQ ID NO: 1339986 - protein, 7 aa, Mycobacterium
TSAAAAS

SEQ ID NO: 1339987 - protein, 4 aa, Mycobacterium
TSDG

SEQ ID NO: 1339988 - protein, 4 aa, Mycobacterium
TSFG

SEQ ID NO: 1339989 - protein, 7 aa, Mycobacterium
TSPAIEQ

SEQ ID NO: 1339990 - protein, 109 aa, Mycobacterium
TSPGYGGDGHNGGNGGAGGNGGWGGDGGDSGADAGGAGGNGGDGAAGGSGGAAGLGGTGNQWGAEPGGPGNPGLAGQPGSGGSAGIGGTGGSGTSAGAPGDHGEEGPNG

SEQ ID NO: 1339991 - protein, 33 aa, Mycobacterium; identical to SEQ ID NO: 1231448

SEQ ID NO: 1339992 - protein, 4 aa, Mycobacterium
TSRG

SEQ ID NO: 1339993 - protein, 16 aa, Mycobacterium
TSRVTNAAGAKQEPRA

SEQ ID NO: 1339994 - protein, 13 aa, Mycobacterium
TSSGEIPTNWPGP

SEQ ID NO: 1339995 - protein, 11 aa, Mycobacterium
TSSGKPGPTAI

SEQ ID NO: 1339996 - protein, 12 aa, Mycobacterium
TSSPAAAPTPDV

SEQ ID NO: 1339997 - protein, 6 aa, Mycobacterium
TSTAAN

SEQ ID NO: 1339998 - protein, 8 aa, Mycobacterium
TSTAGGLG

SEQ ID NO: 1339999 - protein, 20 aa, Mycobacterium
TSTQSGGEQFPPTNQPGGWP

SEQ ID NO: 1340000 - protein, 4 aa, Mycobacterium
TTAD

SEQ ID NO: 1340001 - protein, 6 aa, Mycobacterium
TTADQM

SEQ ID NO: 1340002 - protein, 12 aa, Mycobacterium
TTAGEGPTHQVA

SEQ ID NO: 1340003 - protein, 4 aa, Mycobacterium
TTAT

SEQ ID NO: 1340004 - protein, 17 aa, Mycobacterium
TTDANARDELDGMMHPG

SEQ ID NO: 1340005 - protein, 8 aa, Mycobacterium
TTDAPTGF

SEQ ID NO: 1340006 - protein, 13 aa, Mycobacterium
TTGPTLSGTDGLG

SEQ ID NO: 1340007 - protein, 5 aa, Mycobacterium
TTLSN

SEQ ID NO: 1340008 - protein, 9 aa, Mycobacterium
TTPLGDNAP

SEQ ID NO: 1340009 - protein, 5 aa, Mycobacterium
TTTEK

SEQ ID NO: 1340010 - protein, 16 aa, Mycobacterium
TTTSRERPDASQTASS

SEQ ID NO: 1340011 - protein, 15 aa, Mycobacterium
TVGAGGTPAPVESPA

SEQ ID NO: 1340012 - protein, 10 aa, Mycobacterium
TVGDGKATID

SEQ ID NO: 1340013 - protein, 4 aa, Mycobacterium
TVPR

SEQ ID NO: 1340014 - protein, 35 aa, Mycobacterium
TVPTPGADGDTGEEPTDATVDEATDAKKEEAATDV

SEQ ID NO: 1340015 - protein, 8 aa, Mycobacterium
TVSSPPPA

SEQ ID NO: 1340016 - protein, 11 aa, Mycobacterium
TVTESDSADLT

SEQ ID NO: 1340017 - protein, 8 aa, Mycobacterium
TVTGPKVR

SEQ ID NO: 1340018 - protein, 20 aa, Mycobacterium
TVTSDSAEMTDHSGDVSDPG

SEQ ID NO: 1340019 - protein, 6 aa, Mycobacterium
TYDPRR

SEQ ID NO: 1340020 - protein, 9 aa, Mycobacterium
TYGPGSNTD

SEQ ID NO: 1340021 - protein, 6 aa, Mycobacterium
TYGTPV

SEQ ID NO: 1340022 - protein, 14 aa, Mycobacterium
TYGVPVNSPNGYRT

SEQ ID NO: 1340023 - protein, 9 aa, Mycobacterium
TYPGGDAAA

SEQ ID NO: 1340024 - protein, 16 aa, Mycobacterium
TYSAEGDQTQTANPTM

SEQ ID NO: 1340025 - protein, 15 aa, Mycobacterium
TYTNGSNIKASDATA

SEQ ID NO: 1340026 - protein, 7 aa, Mycobacterium
VAADDGA

SEQ ID NO: 1340027 - protein, 28 aa, Mycobacterium
VADGTSSVNSGSRAGTVVGTNPSGQTIP

SEQ ID NO: 1340028 - protein, 9 aa, Mycobacterium
VAGDPEARG

SEQ ID NO: 1340029 - protein, 5 aa, Mycobacterium
VAGGR

SEQ ID NO: 1340030 - protein, 6 aa, Mycobacterium
VAGPGA

SEQ ID NO: 1340031 - protein, 20 aa, Mycobacterium
VAPPLSDAARAATSSLTTSD

SEQ ID NO: 1340032 - protein, 5 aa, Mycobacterium
VASPE

SEQ ID NO: 1340033 - protein, 27 aa, Mycobacterium
VATTTTGVVTTPKTGGETARTGPVGGQ

SEQ ID NO: 1340034 - protein, 4 aa, Mycobacterium
VDNQ

SEQ ID NO: 1340035 - protein, 5 aa, Mycobacterium
VDPAT

SEQ ID NO: 1340036 - protein, 6 aa, Mycobacterium
VDPGGD

SEQ ID NO: 1340037 - protein, 5 aa, Mycobacterium
VDPPE

SEQ ID NO: 1340038 - protein, 10 aa, Mycobacterium
VDPRNSERGL

SEQ ID NO: 1340039 - protein, 6 aa, Mycobacterium
VDPTTG

SEQ ID NO: 1340040 - protein, 12 aa, Mycobacterium
VDTSGQDAGKQT

SEQ ID NO: 1340041 - protein, 15 aa, Mycobacterium
VEAAKTRSEQLGITS

SEQ ID NO: 1340042 - protein, 14 aa, Mycobacterium
VEEAPVQDDVTDVT

SEQ ID NO: 1340043 - protein, 4 aa, Mycobacterium
VEEQ

SEQ ID NO: 1340044 - protein, 8 aa, Mycobacterium
VEGEADTD

SEQ ID NO: 1340045 - protein, 10 aa, Mycobacterium
VEHDSSGRVE

SEQ ID NO: 1340046 - protein, 8 aa, Mycobacterium
VEPRSGQE

SEQ ID NO: 1340047 - protein, 17 aa, Mycobacterium
VERPAPPSLPKPTPGMD

SEQ ID NO: 1340048 - protein, 9 aa, Mycobacterium
VEVAPGEEG

SEQ ID NO: 1340049 - protein, 4 aa, Mycobacterium
VGDD

SEQ ID NO: 1340050 - protein, 11 aa, Mycobacterium
VGGANTTPRTA

SEQ ID NO: 1340051 - protein, 11 aa, Mycobacterium
VGGDGLYSSNA

SEQ ID NO: 1340052 - protein, 20 aa, Mycobacterium
VGGEDTPAEEADDDTKDHVE

SEQ ID NO: 1340053 - protein, 52 aa, Mycobacterium
VGNGGDGGAGFSPTAAGASGGDGGAGGHGGAIGNGGAGGAGGNGAAGTNGSN

SEQ ID NO: 1340054 - protein, 9 aa, Mycobacterium
VGPLGGGNG

SEQ ID NO: 1340055 - protein, 17 aa, Mycobacterium
VGPRGRKEYRVTTAGRA

SEQ ID NO: 1340056 - protein, 5 aa, Mycobacterium
VGPTP

SEQ ID NO: 1340057 - protein, 7 aa, Mycobacterium
VGSGVAA

SEQ ID NO: 1340058 - protein, 10 aa, Mycobacterium
VGSNPAQYGN

SEQ ID NO: 1340059 - protein, 56 aa, Mycobacterium
VKARRSGSSSGSDSDDGDEPAKKAPAKKSAAEKAPAKKAAKKTAAKKAPAKKASAK

SEQ ID NO: 1340060 - protein, 6 aa, Mycobacterium
VKGDLG

SEQ ID NO: 1340061 - protein, 10 aa, Mycobacterium
VKTGATVEPR

SEQ ID NO: 1340062 - protein, 9 aa, Mycobacterium
VKTVDGEFR

SEQ ID NO: 1340063 - protein, 7 aa, Mycobacterium
VLPPGPS

SEQ ID NO: 1340064 - protein, 7 aa, Mycobacterium
VLSPDGT

SEQ ID NO: 1340065 - protein, 8 aa, Mycobacterium
VNARRSDV

SEQ ID NO: 1340066 - protein, 10 aa, Mycobacterium
VNATSGKQEG

SEQ ID NO: 1340067 - protein, 7 aa, Mycobacterium
VNGGLDD

SEQ ID NO: 1340068 - protein, 8 aa, Mycobacterium
VNNNGFDQ

SEQ ID NO: 1340069 - protein, 17 aa, Mycobacterium
VPAAPGPNTGPPAGVDR

SEQ ID NO: 1340070 - protein, 5 aa, Mycobacterium
VPGAE

SEQ ID NO: 1340071 - protein, 17 aa, Mycobacterium
VPGTTQTNPQADPAKPV

SEQ ID NO: 1340072 - protein, 11 aa, Mycobacterium
VPMQPASTNKV

SEQ ID NO: 1340073 - protein, 5 aa, Mycobacterium
VPPHK

SEQ ID NO: 1340074 - protein, 6 aa, Mycobacterium
VPPPAR

SEQ ID NO: 1340075 - protein, 58 aa, Mycobacterium; identical to SEQ ID NO: 921659

SEQ ID NO: 1340076 - protein, 16 aa, Mycobacterium
VPTGAPARGDSPDVCR

SEQ ID NO: 1340077 - protein, 6 aa, Mycobacterium
VPVPAD

SEQ ID NO: 1340078 - protein, 11 aa, Mycobacterium
VQPAGLAPVGD

SEQ ID NO: 1340079 - protein, 14 aa, Mycobacterium
VQSPGAARLQDPGY

SEQ ID NO: 1340080 - protein, 11 aa, Mycobacterium
VQSPGAQYLGD

SEQ ID NO: 1340081 - protein, 10 aa, Mycobacterium
VQSTAAKCRG

SEQ ID NO: 1340082 - protein, 20 aa, Mycobacterium
VRAEPKVKTTIPVDPSGDGG

SEQ ID NO: 1340083 - protein, 12 aa, Mycobacterium
VRATRPSSMRTS

SEQ ID NO: 1340084 - protein, 9 aa, Mycobacterium
VRDGTGAGG

SEQ ID NO: 1340085 - protein, 6 aa, Mycobacterium
VRNRTA

SEQ ID NO: 1340086 - protein, 7 aa, Mycobacterium
VRRSGIE

SEQ ID NO: 1340087 - protein, 8 aa, Mycobacterium
VRSSPQTG

SEQ ID NO: 1340088 - protein, 11 aa, Mycobacterium
VRTDAGDRIPT

SEQ ID NO: 1340089 - protein, 9 aa, Mycobacterium
VSAEAADVG

SEQ ID NO: 1340090 - protein, 7 aa, Mycobacterium
VSNDPKE

SEQ ID NO: 1340091 - protein, 4 aa, Mycobacterium
VSPD

SEQ ID NO: 1340092 - protein, 12 aa, Mycobacterium
VSPEQAAPGLRT

SEQ ID NO: 1340093 - protein, 5 aa, Mycobacterium
VSPSN

SEQ ID NO: 1340094 - protein, 12 aa, Mycobacterium
VSSTAGAGIDPV

SEQ ID NO: 1340095 - protein, 5 aa, Mycobacterium
VTAES

SEQ ID NO: 1340096 - protein, 17 aa, Mycobacterium
VTDPGPSAGKLKEGDAI

SEQ ID NO: 1340097 - protein, 7 aa, Mycobacterium
VTEAGGT

SEQ ID NO: 1340098 - protein, 12 aa, Mycobacterium
VTEKNGKPIYDG

SEQ ID NO: 1340099 - protein, 13 aa, Mycobacterium
VTPKQGGPDQQFG

SEQ ID NO: 1340100 - protein, 11 aa, Mycobacterium
VTSPAGTTAAG

SEQ ID NO: 1340101 - protein, 6 aa, Mycobacterium
VTTDDV

SEQ ID NO: 1340102 - protein, 10 aa, Mycobacterium
VTTNPPTEGS

SEQ ID NO: 1340103 - protein, 9 aa, Mycobacterium
VTVTAGDGV

SEQ ID NO: 1340104 - protein, 10 aa, Mycobacterium
VTYRGTKVGR

SEQ ID NO: 1340105 - protein, 6 aa, Mycobacterium
VVPARE

SEQ ID NO: 1340106 - protein, 5 aa, Mycobacterium
VYGSR

SEQ ID NO: 1340107 - protein, 33 aa, Mycobacterium; identical to SEQ ID NO: 1234309

SEQ ID NO: 1340108 - protein, 12 aa, Mycobacterium
WAPRKPAENWAG

SEQ ID NO: 1340109 - protein, 21 aa, Mycobacterium
WCNPPGRALGTPPTTATGHPQ

SEQ ID NO: 1340110 - protein, 8 aa, Mycobacterium
WGDPARRS

SEQ ID NO: 1340111 - protein, 31 aa, Mycobacterium
WKGDPNATLSGQDIPQLAPSPDPAPAAPPPI

SEQ ID NO: 1340112 - protein, 5 aa, Mycobacterium
WPPGG

SEQ ID NO: 1340113 - protein, 7 aa, Mycobacterium
WPPNTEY

SEQ ID NO: 1340114 - protein, 8 aa, Mycobacterium
WQAGPDTE

SEQ ID NO: 1340115 - protein, 9 aa, Mycobacterium
WSAGEREPR

SEQ ID NO: 1340116 - protein, 8 aa, Mycobacterium
WSAQPPQC

SEQ ID NO: 1340117 - protein, 26 aa, Mycobacterium
WSPPGAAPPKPDTCTPADGPTPDTVQ

SEQ ID NO: 1340118 - protein, 18 aa, Mycobacterium
WTDDNSAPGGHNGCDTRN

SEQ ID NO: 1340119 - protein, 7 aa, Mycobacterium
YAEDGGL

SEQ ID NO: 1340120 - protein, 11 aa, Mycobacterium
YAKNTPGYDED

SEQ ID NO: 1340121 - protein, 9 aa, Mycobacterium
YARGDDEAE

SEQ ID NO: 1340122 - protein, 13 aa, Mycobacterium
YASDGDGDGRADV

SEQ ID NO: 1340123 - protein, 12 aa, Mycobacterium
YDDTPPVGQVSD

SEQ ID NO: 1340124 - protein, 17 aa, Mycobacterium
YDNDGDFNIGGDNEGGF

SEQ ID NO: 1340125 - protein, 15 aa, Mycobacterium
YDPATGEYLGPDGKI

SEQ ID NO: 1340126 - protein, 16 aa, Mycobacterium
YDTTRLDRAGHTGTQI

SEQ ID NO: 1340127 - protein, 12 aa, Mycobacterium
YGAGGDITSPHD

SEQ ID NO: 1340128 - protein, 5 aa, Mycobacterium
YGANG

SEQ ID NO: 1340129 - protein, 20 aa, Mycobacterium
YGAPGSRVEIPTGKGRATAR

SEQ ID NO: 1340130 - protein, 25 aa, Mycobacterium
YGAVGDGVTDDSAAIKAAEAALASG

SEQ ID NO: 1340131 - protein, 26 aa, Mycobacterium
YGKPGGTAPSDFTRGYAGGVADARTG

SEQ ID NO: 1340132 - protein, 23 aa, Mycobacterium
YGTGGKGGRGGELVGNGGDGGIA

SEQ ID NO: 1340133 - protein, 11 aa, Mycobacterium
YGTPPAPDGPH

SEQ ID NO: 1340134 - protein, 13 aa, Mycobacterium
YKAADESAIEYEP

SEQ ID NO: 1340135 - protein, 8 aa, Mycobacterium
YMGGRTDG

SEQ ID NO: 1340136 - protein, 15 aa, Mycobacterium
YNDGLGMEDNPAIPL

SEQ ID NO: 1340137 - protein, 6 aa, Mycobacterium
YNPDGD

SEQ ID NO: 1340138 - protein, 13 aa, Mycobacterium
YPKGDGVTATNDL

SEQ ID NO: 1340139 - protein, 9 aa, Mycobacterium
YPSAGLASA

SEQ ID NO: 1340140 - protein, 4 aa, Mycobacterium
YPTT

SEQ ID NO: 1340141 - protein, 14 aa, Mycobacterium
YRTPAGSSPAGTSM

SEQ ID NO: 1340142 - protein, 9 aa, Mycobacterium
YSPRGTPVS

SEQ ID NO: 1340143 - protein, 11 aa, Mycobacterium
YSTGRSASDVA

SEQ ID NO: 1340144 - protein, 8 aa, Mycobacterium
YTATTCPA

SEQ ID NO: 1340145 - protein, 12 aa, Mycobacterium
YTPAGPQASGYG

SEQ ID NO: 1340146 - protein, 7 aa, Mycobacterium
YTSITSD

SEQ ID NO: 1340147 - protein, 5 aa, Mycobacterium
AAAAG

SEQ ID NO: 1340148 - protein, 7 aa, Mycobacterium
AAAAGLP

SEQ ID NO: 1340149 - protein, 19 aa, Mycobacterium
AAAANIDTSGLGLSDTGPT

SEQ ID NO: 1340150 - protein, 9 aa, Mycobacterium
AAAAPGVST

SEQ ID NO: 1340151 - protein, 8 aa, Mycobacterium
AAAAPSGV

SEQ ID NO: 1340152 - protein, 10 aa, Mycobacterium
AAAAPTAGET

SEQ ID NO: 1340153 - protein, 9 aa, Mycobacterium
AAAAPVGSQ

SEQ ID NO: 1340154 - protein, 9 aa, Mycobacterium
AAADLPPTV

SEQ ID NO: 1340155 - protein, 8 aa, Mycobacterium
AAADPDAL

SEQ ID NO: 1340156 - protein, 101 aa, Mycobacterium
AAADPSADAAGTDVSAHAPADTRQDDHTEKADEETDAPEDNAEDIPEDSAEDEAEDEDTDAKTGHRDADDEEPTEDPVDEPVADDPVADNEDDPEEPAEWP

SEQ ID NO: 1340157 - protein, 13 aa, Mycobacterium
AAAEAEDSRPGTA

SEQ ID NO: 1340158 - protein, 8 aa, Mycobacterium
AAAEDAHT

SEQ ID NO: 1340159 - protein, 8 aa, Mycobacterium
AAAEGIGP

SEQ ID NO: 1340160 - protein, 6 aa, Mycobacterium
AAAEPA

SEQ ID NO: 1340161 - protein, 9 aa, Mycobacterium
AAAEPTPAA

SEQ ID NO: 1340162 - protein, 6 aa, Mycobacterium
AAAERW

SEQ ID NO: 1340163 - protein, 55 aa, Mycobacterium
AAAETPAAQTPAPAETPAPAEGAAPEGESGTGAGLGAPEGTGAADDGSVPLPSDE

SEQ ID NO: 1340164 - protein, 4 aa, Mycobacterium
AAAG

SEQ ID NO: 1340165 - protein, 5 aa, Mycobacterium
AAAGA

SEQ ID NO: 1340166 - protein, 11 aa, Mycobacterium
AAAGGPTPNPV

SEQ ID NO: 1340167 - protein, 8 aa, Mycobacterium
AAAGSPLA

SEQ ID NO: 1340168 - protein, 12 aa, Mycobacterium
AAAGVPAGHTAA

SEQ ID NO: 1340169 - protein, 13 aa, Mycobacterium
AAAGYPDAATARR

SEQ ID NO: 1340170 - protein, 4 aa, Mycobacterium
AAAN

SEQ ID NO: 1340171 - protein, 9 aa, Mycobacterium
AAAPARQGF

SEQ ID NO: 1340172 - protein, 6 aa, Mycobacterium
AAAPIG

SEQ ID NO: 1340173 - protein, 5 aa, Mycobacterium
AAAQL

SEQ ID NO: 1340174 - protein, 8 aa, Mycobacterium
AAAQPEEM

SEQ ID NO: 1340175 - protein, 8 aa, Mycobacterium
AAAQPQTT

SEQ ID NO: 1340176 - protein, 16 aa, Mycobacterium
AAAQPTPPPPPPAPDI

SEQ ID NO: 1340177 - protein, 12 aa, Mycobacterium
AAAQRGPLPDEM

SEQ ID NO: 1340178 - protein, 6 aa, Mycobacterium
AAARAG

SEQ ID NO: 1340179 - protein, 6 aa, Mycobacterium
AAARDG

SEQ ID NO: 1340180 - protein, 20 aa, Mycobacterium
AAARHGAAAAAASTADRTDT

SEQ ID NO: 1340181 - protein, 6 aa, Mycobacterium
AAARQT

SEQ ID NO: 1340182 - protein, 19 aa, Mycobacterium
AAARSGDVTASRARAESAR

SEQ ID NO: 1340183 - protein, 4 aa, Mycobacterium
AAAS

SEQ ID NO: 1340184 - protein, 10 aa, Mycobacterium
AAASADNERN

SEQ ID NO: 1340185 - protein, 7 aa, Mycobacterium
AAASRAG

SEQ ID NO: 1340186 - protein, 6 aa, Mycobacterium
AAATAA

SEQ ID NO: 1340187 - protein, 6 aa, Mycobacterium
AAATAG

SEQ ID NO: 1340188 - protein, 5 aa, Mycobacterium
AAAVR

SEQ ID NO: 1340189 - protein, 15 aa, Mycobacterium
AADAEESATAAPRQT

SEQ ID NO: 1340190 - protein, 9 aa, Mycobacterium
AADALGGDR

SEQ ID NO: 1340191 - protein, 14 aa, Mycobacterium
AADAPGHLEKDGVN

SEQ ID NO: 1340192 - protein, 15 aa, Mycobacterium
AADDCQGDACNGGDG

SEQ ID NO: 1340193 - protein, 6 aa, Mycobacterium
AADEHR

SEQ ID NO: 1340194 - protein, 7 aa, Mycobacterium
AADFPDN

SEQ ID NO: 1340195 - protein, 7 aa, Mycobacterium
AADGGTA

SEQ ID NO: 1340196 - protein, 7 aa, Mycobacterium
AADGKTM

SEQ ID NO: 1340197 - protein, 6 aa, Mycobacterium
AADGLP

SEQ ID NO: 1340198 - protein, 9 aa, Mycobacterium
AADGPPAEA

SEQ ID NO: 1340199 - protein, 7 aa, Mycobacterium
AADGRRL

SEQ ID NO: 1340200 - protein, 4 aa, Mycobacterium
AADL

SEQ ID NO: 1340201 - protein, 5 aa, Mycobacterium
AADPR

SEQ ID NO: 1340202 - protein, 159 aa, Mycobacterium
AADPTDDSTAGESSAKADQSDAAGVGSQDPGDTSSETDDVGSEDADSDDPDAEESDDLAEHGSPEGDDEDTATPPGEVAAEPPADDATPAAEPNDESQQADRHQAHSPVDEETDGDADPEADGLDTGPEPTDAPAGHRGADEAVTPDAAPPAVEPATPT

SEQ ID NO: 1340203 - protein, 5 aa, Mycobacterium
AADRR

SEQ ID NO: 1340204 - protein, 10 aa, Mycobacterium
AADRTGLDND

SEQ ID NO: 1340205 - protein, 10 aa, Mycobacterium
AADSPGPVWG

SEQ ID NO: 1340206 - protein, 121 aa, Mycobacterium
AADSSDSSGASSESSSQASPSKESSTEASEPDREATRSDDEDQTEDQTEDQTDEDDEALDDSGSDDPAEEEPAEEPQLEKPVEEPQLDDETETIPDTPRPSTPSNRGDDDPIEESAEDTAV

SEQ ID NO: 1340207 - protein, 12 aa, Mycobacterium
AADSTERGRSSL

SEQ ID NO: 1340208 - protein, 13 aa, Mycobacterium
AADTSGGRTPSAM

SEQ ID NO: 1340209 - protein, 11 aa, Mycobacterium
AAEAAGRDAGD

SEQ ID NO: 1340210 - protein, 6 aa, Mycobacterium
AAEDPA

SEQ ID NO: 1340211 - protein, 14 aa, Mycobacterium
AAEEALDDGRRPAP

SEQ ID NO: 1340212 - protein, 9 aa, Mycobacterium
AAEGNSGIT

SEQ ID NO: 1340213 - protein, 13 aa, Mycobacterium
AAEHQLGAGARDR

SEQ ID NO: 1340214 - protein, 11 aa, Mycobacterium
AAEPAGPDGVP

SEQ ID NO: 1340215 - protein, 6 aa, Mycobacterium
AAEPAL

SEQ ID NO: 1340216 - protein, 8 aa, Mycobacterium
AAEPGRYD

SEQ ID NO: 1340217 - protein, 5 aa, Mycobacterium
AAEPL

SEQ ID NO: 1340218 - protein, 7 aa, Mycobacterium
AAEQAGV

SEQ ID NO: 1340219 - protein, 8 aa, Mycobacterium
AAERAGNA

SEQ ID NO: 1340220 - protein, 12 aa, Mycobacterium
AAERARNDRRAV

SEQ ID NO: 1340221 - protein, 13 aa, Mycobacterium
AAESQVSDLPDAD

SEQ ID NO: 1340222 - protein, 8 aa, Mycobacterium
AAESTHAQ

SEQ ID NO: 1340223 - protein, 18 aa, Mycobacterium
AAEYNRTPRNFAKDGPHV

SEQ ID NO: 1340224 - protein, 7 aa, Mycobacterium
AAGAAAQ

SEQ ID NO: 1340225 - protein, 15 aa, Mycobacterium
AAGAAGEPGGPAKTK

SEQ ID NO: 1340226 - protein, 5 aa, Mycobacterium
AAGAE

SEQ ID NO: 1340227 - protein, 7 aa, Mycobacterium
AAGAGDQ

SEQ ID NO: 1340228 - protein, 18 aa, Mycobacterium
AAGAVPPERNTGKRMTPD

SEQ ID NO: 1340229 - protein, 27 aa, Mycobacterium
AAGDYTTAAEDKPAVAVTERTADEWGG

SEQ ID NO: 1340230 - protein, 9 aa, Mycobacterium
AAGEATNLP

SEQ ID NO: 1340231 - protein, 18 aa, Mycobacterium
AAGGASTAHSMTKPSTAD

SEQ ID NO: 1340232 - protein, 6 aa, Mycobacterium
AAGGPY

SEQ ID NO: 1340233 - protein, 5 aa, Mycobacterium
AAGGR

SEQ ID NO: 1340234 - protein, 6 aa, Mycobacterium
AAGGRN

SEQ ID NO: 1340235 - protein, 4 aa, Mycobacterium
AAGH

SEQ ID NO: 1340236 - protein, 9 aa, Mycobacterium
AAGHGTSHG

SEQ ID NO: 1340237 - protein, 8 aa, Mycobacterium
AAGKLDEY

SEQ ID NO: 1340238 - protein, 4 aa, Mycobacterium
AAGL

SEQ ID NO: 1340239 - protein, 9 aa, Mycobacterium
AAGPAADTL

SEQ ID NO: 1340240 - protein, 7 aa, Mycobacterium
AAGPPIT

SEQ ID NO: 1340241 - protein, 13 aa, Mycobacterium
AAGPPRPPADPSG

SEQ ID NO: 1340242 - protein, 10 aa, Mycobacterium
AAGPRAPQGA

SEQ ID NO: 1340243 - protein, 9 aa, Mycobacterium
AAGPSLTRS

SEQ ID NO: 1340244 - protein, 9 aa, Mycobacterium
AAGPVPAAA

SEQ ID NO: 1340245 - protein, 8 aa, Mycobacterium
AAGQDPTQ

SEQ ID NO: 1340246 - protein, 7 aa, Mycobacterium
AAGRADA

SEQ ID NO: 1340247 - protein, 8 aa, Mycobacterium
AAGRGNDR

SEQ ID NO: 1340248 - protein, 6 aa, Mycobacterium
AAGSGY

SEQ ID NO: 1340249 - protein, 7 aa, Mycobacterium
AAGSTYN

SEQ ID NO: 1340250 - protein, 11 aa, Mycobacterium
AAGTANADSVN

SEQ ID NO: 1340251 - protein, 10 aa, Mycobacterium
AAGTKSTFSV

SEQ ID NO: 1340252 - protein, 13 aa, Mycobacterium
AAGTPTAQAAGAR

SEQ ID NO: 1340253 - protein, 16 aa, Mycobacterium
AAGTTFGPREAPDAAD

SEQ ID NO: 1340254 - protein, 15 aa, Mycobacterium
AAGVAPPAPPAPPAA

SEQ ID NO: 1340255 - protein, 9 aa, Mycobacterium
AAGVSSVPQ

SEQ ID NO: 1340256 - protein, 6 aa, Mycobacterium
AAHAEA

SEQ ID NO: 1340257 - protein, 7 aa, Mycobacterium
AAHPKAA

SEQ ID NO: 1340258 - protein, 12 aa, Mycobacterium
AAIADGNGQAMK

SEQ ID NO: 1340259 - protein, 12 aa, Mycobacterium
AAIEDPAGAGVR

SEQ ID NO: 1340260 - protein, 11 aa, Mycobacterium
AAINPGNSGGA

SEQ ID NO: 1340261 - protein, 4 aa, Mycobacterium
AAIS

SEQ ID NO: 1340262 - protein, 7 aa, Mycobacterium
AAKAADG

SEQ ID NO: 1340263 - protein, 7 aa, Mycobacterium
AAKATGV

SEQ ID NO: 1340264 - protein, 22 aa, Mycobacterium
AAKGGPGGAPGCGSLPDATKNF

SEQ ID NO: 1340265 - protein, 6 aa, Mycobacterium
AAKTGH

SEQ ID NO: 1340266 - protein, 8 aa, Mycobacterium
AALADPEG

SEQ ID NO: 1340267 - protein, 8 aa, Mycobacterium
AALRPGST

SEQ ID NO: 1340268 - protein, 7 aa, Mycobacterium
AANAQLA

SEQ ID NO: 1340269 - protein, 11 aa, Mycobacterium
AANDSSVNEDA

SEQ ID NO: 1340270 - protein, 12 aa, Mycobacterium
AANESDPSPADL

SEQ ID NO: 1340271 - protein, 8 aa, Mycobacterium
AANGESYA

SEQ ID NO: 1340272 - protein, 14 aa, Mycobacterium
AANGLAAQTDSTLM

SEQ ID NO: 1340273 - protein, 8 aa, Mycobacterium
AANGQSCA

SEQ ID NO: 1340274 - protein, 7 aa, Mycobacterium
AANNFTD

SEQ ID NO: 1340275 - protein, 8 aa, Mycobacterium
AANPPLEA

SEQ ID NO: 1340276 - protein, 6 aa, Mycobacterium
AANPSA

SEQ ID NO: 1340277 - protein, 8 aa, Mycobacterium
AANPVSAA

SEQ ID NO: 1340278 - protein, 11 aa, Mycobacterium
AANSQGPKVRP

SEQ ID NO: 1340279 - protein, 4 aa, Mycobacterium
AAPA

SEQ ID NO: 1340280 - protein, 13 aa, Mycobacterium
AAPAAAAPYGSNG

SEQ ID NO: 1340281 - protein, 8 aa, Mycobacterium
AAPAAEAA

SEQ ID NO: 1340282 - protein, 28 aa, Mycobacterium
AAPAATAQPAPCSASSLTGTVSSVTAAA

SEQ ID NO: 1340283 - protein, 5 aa, Mycobacterium
AAPAG

SEQ ID NO: 1340284 - protein, 7 aa, Mycobacterium
AAPAGGA

SEQ ID NO: 1340285 - protein, 11 aa, Mycobacterium
AAPANAQEDRN

SEQ ID NO: 1340286 - protein, 10 aa, Mycobacterium
AAPAPADAGV

SEQ ID NO: 1340287 - protein, 8 aa, Mycobacterium
AAPAPPPA

SEQ ID NO: 1340288 - protein, 18 aa, Mycobacterium
AAPAPQASAAAARSTDRV

SEQ ID NO: 1340289 - protein, 13 aa, Mycobacterium
AAPAQADTAASTI

SEQ ID NO: 1340290 - protein, 6 aa, Mycobacterium
AAPAQP

SEQ ID NO: 1340291 - protein, 10 aa, Mycobacterium
AAPASAQPCP

SEQ ID NO: 1340292 - protein, 13 aa, Mycobacterium
AAPASARPSDPGV

SEQ ID NO: 1340293 - protein, 6 aa, Mycobacterium
AAPAVA

SEQ ID NO: 1340294 - protein, 7 aa, Mycobacterium
AAPAVGD

SEQ ID NO: 1340295 - protein, 5 aa, Mycobacterium
AAPDM

SEQ ID NO: 1340296 - protein, 22 aa, Mycobacterium
AAPDPATGQVTGRVTATDRDGD

SEQ ID NO: 1340297 - protein, 12 aa, Mycobacterium
AAPESPAVQRAE

SEQ ID NO: 1340298 - protein, 12 aa, Mycobacterium
AAPGAALPAARA

SEQ ID NO: 1340299 - protein, 43 aa, Mycobacterium
AAPGETETVSATESDTPSDAAPAETSAPDTEHEDEQSAPEHGI

SEQ ID NO: 1340300 - protein, 14 aa, Mycobacterium
AAPGGGVRRPGARH

SEQ ID NO: 1340301 - protein, 10 aa, Mycobacterium
AAPGPVPPVD

SEQ ID NO: 1340302 - protein, 8 aa, Mycobacterium
AAPKRVHG

SEQ ID NO: 1340303 - protein, 6 aa, Mycobacterium
AAPLEA

SEQ ID NO: 1340304 - protein, 5 aa, Mycobacterium
AAPMA

SEQ ID NO: 1340305 - protein, 12 aa, Mycobacterium
AAPMPGGDAAET

SEQ ID NO: 1340306 - protein, 9 aa, Mycobacterium
AAPNGAAQA

SEQ ID NO: 1340307 - protein, 10 aa, Mycobacterium
AAPNPEGAQE

SEQ ID NO: 1340308 - protein, 8 aa, Mycobacterium
AAPPAGAG

SEQ ID NO: 1340309 - protein, 12 aa, Mycobacterium
AAPPAPSGETAD

SEQ ID NO: 1340310 - protein, 21 aa, Mycobacterium
AAPPGAIPPGDIAPPPGGATR

SEQ ID NO: 1340311 - protein, 21 aa, Mycobacterium
AAPPGAMPPGDIAPPPGGATR

SEQ ID NO: 1340312 - protein, 6 aa, Mycobacterium
AAPPIG

SEQ ID NO: 1340313 - protein, 14 aa, Mycobacterium
AAPPPPPPPPPPNV

SEQ ID NO: 1340314 - protein, 20 aa, Mycobacterium
AAPPPPPPPPPPPPPPPPPV

SEQ ID NO: 1340315 - protein, 27 aa, Mycobacterium
AAPPPVEPAPPAPPEPPPTAPTDVAPA

SEQ ID NO: 1340316 - protein, 15 aa, Mycobacterium
AAPPSVPETLDTAAN

SEQ ID NO: 1340317 - protein, 6 aa, Mycobacterium
AAPQCP

SEQ ID NO: 1340318 - protein, 12 aa, Mycobacterium
AAPSARSANPSF

SEQ ID NO: 1340319 - protein, 10 aa, Mycobacterium
AAPSASAAEI

SEQ ID NO: 1340320 - protein, 8 aa, Mycobacterium
AAPSEGAV

SEQ ID NO: 1340321 - protein, 6 aa, Mycobacterium
AAPSRP

SEQ ID NO: 1340322 - protein, 10 aa, Mycobacterium
AAPTAGAAGP

SEQ ID NO: 1340323 - protein, 7 aa, Mycobacterium
AAPVESA

SEQ ID NO: 1340324 - protein, 7 aa, Mycobacterium
AAPVGGA

SEQ ID NO: 1340325 - protein, 13 aa, Mycobacterium
AAPVPGAAAVPTL

SEQ ID NO: 1340326 - protein, 12 aa, Mycobacterium
AAQAGARTVETN

SEQ ID NO: 1340327 - protein, 4 aa, Mycobacterium
AAQD

SEQ ID NO: 1340328 - protein, 7 aa, Mycobacterium
AAQGGTG

SEQ ID NO: 1340329 - protein, 8 aa, Mycobacterium
AAQGGTGA

SEQ ID NO: 1340330 - protein, 4 aa, Mycobacterium
AAQQ

SEQ ID NO: 1340331 - protein, 7 aa, Mycobacterium
AAQSPGA

SEQ ID NO: 1340332 - protein, 8 aa, Mycobacterium
AAQYGIGP

SEQ ID NO: 1340333 - protein, 6 aa, Mycobacterium
AARDSV

SEQ ID NO: 1340334 - protein, 8 aa, Mycobacterium
AARGQGAA

SEQ ID NO: 1340335 - protein, 8 aa, Mycobacterium
AARNTVDA

SEQ ID NO: 1340336 - protein, 9 aa, Mycobacterium
AARPHTGRT

SEQ ID NO: 1340337 - protein, 12 aa, Mycobacterium
AARQLKAGRSRS

SEQ ID NO: 1340338 - protein, 7 aa, Mycobacterium
AARQTDQ

SEQ ID NO: 1340339 - protein, 4 aa, Mycobacterium
AARR

SEQ ID NO: 1340340 - protein, 9 aa, Mycobacterium
AARSLTSAA

SEQ ID NO: 1340341 - protein, 4 aa, Mycobacterium
AART

SEQ ID NO: 1340342 - protein, 5 aa, Mycobacterium
AARVD

SEQ ID NO: 1340343 - protein, 6 aa, Mycobacterium
AASADA

SEQ ID NO: 1340344 - protein, 5 aa, Mycobacterium
AASAS

SEQ ID NO: 1340345 - protein, 6 aa, Mycobacterium
AASASI

SEQ ID NO: 1340346 - protein, 15 aa, Mycobacterium
AASDAPTDDATRVDL

SEQ ID NO: 1340347 - protein, 41 aa, Mycobacterium
AASDGAWGKGAGKSFAGGVGEGAKGNEGTSAAIKNTPGSIT

SEQ ID NO: 1340348 - protein, 8 aa, Mycobacterium
AASGIGEA

SEQ ID NO: 1340349 - protein, 12 aa, Mycobacterium
AASGSDAPVGPA

SEQ ID NO: 1340350 - protein, 7 aa, Mycobacterium
AASPEDI

SEQ ID NO: 1340351 - protein, 5 aa, Mycobacterium
AASPT

SEQ ID NO: 1340352 - protein, 21 aa, Mycobacterium
AASPVSGDDLRRAANRIAAVL

SEQ ID NO: 1340353 - protein, 8 aa, Mycobacterium
AASQTGDL

SEQ ID NO: 1340354 - protein, 9 aa, Mycobacterium
AASRPDRPL

SEQ ID NO: 1340355 - protein, 6 aa, Mycobacterium
AASRPL

SEQ ID NO: 1340356 - protein, 44 aa, Mycobacterium
AASSAPEVQHNASVSAANHGVPPNADGDPACPPSQAWGRQPEGR

SEQ ID NO: 1340357 - protein, 15 aa, Mycobacterium
AASSTSYPAYPAPVD

SEQ ID NO: 1340358 - protein, 52 aa, Mycobacterium
AASTDEDPTRQSRTRTEEAPSADADDADAADAAAAADGEADADAAEDGEAAL

SEQ ID NO: 1340359 - protein, 21 aa, Mycobacterium
AASTPPGPDPEPPDGPGVPGS

SEQ ID NO: 1340360 - protein, 13 aa, Mycobacterium
AASVTGPTNAAAQ

SEQ ID NO: 1340361 - protein, 11 aa, Mycobacterium
AATAAGNPQIA

SEQ ID NO: 1340362 - protein, 18 aa, Mycobacterium
AATAGPASAEPGPTAPAD

SEQ ID NO: 1340363 - protein, 16 aa, Mycobacterium
AATAGVPNTDPVQADR

SEQ ID NO: 1340364 - protein, 12 aa, Mycobacterium
AATDAPGSDKVD

SEQ ID NO: 1340365 - protein, 20 aa, Mycobacterium
AATDHAAGDREAGAARLDQA

SEQ ID NO: 1340366 - protein, 12 aa, Mycobacterium
AATGDPARAVGA

SEQ ID NO: 1340367 - protein, 9 aa, Mycobacterium
AATGGTDTF

SEQ ID NO: 1340368 - protein, 7 aa, Mycobacterium
AATGPGV

SEQ ID NO: 1340369 - protein, 9 aa, Mycobacterium
AATGPVPGT

SEQ ID NO: 1340370 - protein, 22 aa, Mycobacterium
AATGRVDSTTDAATVEAGDSLG

SEQ ID NO: 1340371 - protein, 13 aa, Mycobacterium
AATGTVRVGGAED

SEQ ID NO: 1340372 - protein, 9 aa, Mycobacterium
AATPAEGDV

SEQ ID NO: 1340373 - protein, 11 aa, Mycobacterium
AATPTTESTTV

SEQ ID NO: 1340374 - protein, 13 aa, Mycobacterium
AATQPASISASPV

SEQ ID NO: 1340375 - protein, 10 aa, Mycobacterium
AATSAADAPV

SEQ ID NO: 1340376 - protein, 6 aa, Mycobacterium
AATSGA

SEQ ID NO: 1340377 - protein, 10 aa, Mycobacterium
AAVAESAPAG

SEQ ID NO: 1340378 - protein, 8 aa, Mycobacterium
AAVESRRA

SEQ ID NO: 1340379 - protein, 4 aa, Mycobacterium
AAVG

SEQ ID NO: 1340380 - protein, 9 aa, Mycobacterium
AAVGSAAGM

SEQ ID NO: 1340381 - protein, 7 aa, Mycobacterium
AAVPAGP

SEQ ID NO: 1340382 - protein, 10 aa, Mycobacterium
AAVPAKHPGV

SEQ ID NO: 1340383 - protein, 10 aa, Mycobacterium
AAVRAQGGVP

SEQ ID NO: 1340384 - protein, 11 aa, Mycobacterium
AAVSGAPGAAV

SEQ ID NO: 1340385 - protein, 6 aa, Mycobacterium
AAWPAN

SEQ ID NO: 1340386 - protein, 18 aa, Mycobacterium
ACGGGDGGGGGAGGGGDT

SEQ ID NO: 1340387 - protein, 17 aa, Mycobacterium
ACGGSTSEESPAAAGGV

SEQ ID NO: 1340388 - protein, 5 aa, Mycobacterium
ACGKS

SEQ ID NO: 1340389 - protein, 24 aa, Mycobacterium
ACSGGTSKRPAGEELTSTADVPVG

SEQ ID NO: 1340390 - protein, 28 aa, Mycobacterium
ACSSGGDNAESAGTSEPTSPVQSAPIPE

SEQ ID NO: 1340391 - protein, 23 aa, Mycobacterium
ACTSGSTTTDATSPSQPAPETTT

SEQ ID NO: 1340392 - protein, 12 aa, Mycobacterium
ADAADPAQTAAA

SEQ ID NO: 1340393 - protein, 6 aa, Mycobacterium
ADAALR

SEQ ID NO: 1340394 - protein, 14 aa, Mycobacterium
ADAANTSSSPVEGA

SEQ ID NO: 1340395 - protein, 8 aa, Mycobacterium
ADAAPDVS

SEQ ID NO: 1340396 - protein, 8 aa, Mycobacterium
ADACTPVD

SEQ ID NO: 1340397 - protein, 4 aa, Mycobacterium
ADAD

SEQ ID NO: 1340398 - protein, 30 aa, Mycobacterium
ADADEEAAAAGATESEGTDSGDPAPAQTQA

SEQ ID NO: 1340399 - protein, 14 aa, Mycobacterium
ADADGGRVTGTAQA

SEQ ID NO: 1340400 - protein, 7 aa, Mycobacterium
ADADGRA

SEQ ID NO: 1340401 - protein, 7 aa, Mycobacterium
ADAEQRA

SEQ ID NO: 1340402 - protein, 10 aa, Mycobacterium
ADAGASQETI

SEQ ID NO: 1340403 - protein, 6 aa, Mycobacterium
ADAGPA

SEQ ID NO: 1340404 - protein, 8 aa, Mycobacterium
ADAGPSMT

SEQ ID NO: 1340405 - protein, 16 aa, Mycobacterium
ADAKTPAAGAEGTDKA

SEQ ID NO: 1340406 - protein, 8 aa, Mycobacterium
ADAPPGVN

SEQ ID NO: 1340407 - protein, 49 aa, Mycobacterium
ADAPPQAPPSPSSSTSQKSTATRPSATRTPTSTRTTSAAPQPAAVTPVT

SEQ ID NO: 1340408 - protein, 4 aa, Mycobacterium
ADAR

SEQ ID NO: 1340409 - protein, 9 aa, Mycobacterium
ADASGPVTN

SEQ ID NO: 1340410 - protein, 7 aa, Mycobacterium
ADASPRA

SEQ ID NO: 1340411 - protein, 6 aa, Mycobacterium
ADATEA

SEQ ID NO: 1340412 - protein, 5 aa, Mycobacterium
ADATL

SEQ ID NO: 1340413 - protein, 10 aa, Mycobacterium
ADATPSQRAI

SEQ ID NO: 1340414 - protein, 17 aa, Mycobacterium
ADCGKSAGQQAIPEGVK

SEQ ID NO: 1340415 - protein, 7 aa, Mycobacterium
ADDDDAV

SEQ ID NO: 1340416 - protein, 4 aa, Mycobacterium
ADDE

SEQ ID NO: 1340417 - protein, 30 aa, Mycobacterium; identical to SEQ ID NO: 1104216

SEQ ID NO: 1340418 - protein, 8 aa, Mycobacterium
ADDGSTTL

SEQ ID NO: 1340419 - protein, 17 aa, Mycobacterium
ADDNGGNRALGEPGYDA

SEQ ID NO: 1340420 - protein, 10 aa, Mycobacterium
ADDPQKVART

SEQ ID NO: 1340421 - protein, 9 aa, Mycobacterium
ADDPRIART

SEQ ID NO: 1340422 - protein, 6 aa, Mycobacterium
ADDVPG

SEQ ID NO: 1340423 - protein, 10 aa, Mycobacterium
ADEAEEADDI

SEQ ID NO: 1340424 - protein, 18 aa, Mycobacterium
ADEAESCADARPSPPASF

SEQ ID NO: 1340425 - protein, 27 aa, Mycobacterium
ADEAPAVPPSPTPADAPPPLGTPGRAY

SEQ ID NO: 1340426 - protein, 17 aa, Mycobacterium
ADEDDEPYYPINTESDR

SEQ ID NO: 1340427 - protein, 8 aa, Mycobacterium
ADESGAVR

SEQ ID NO: 1340428 - protein, 12 aa, Mycobacterium
ADESGGFTAENG

SEQ ID NO: 1340429 - protein, 27 aa, Mycobacterium
ADESQPRTQRDAISARDRRDADTPEAL

SEQ ID NO: 1340430 - protein, 5 aa, Mycobacterium
ADETP

SEQ ID NO: 1340431 - protein, 7 aa, Mycobacterium
ADEVVPT

SEQ ID NO: 1340432 - protein, 9 aa, Mycobacterium
ADEYGTERT

SEQ ID NO: 1340433 - protein, 5 aa, Mycobacterium
ADFPA

SEQ ID NO: 1340434 - protein, 19 aa, Mycobacterium
ADGAKLSPTALGDPAAFQG

SEQ ID NO: 1340435 - protein, 12 aa, Mycobacterium
ADGAPFSTSPAR

SEQ ID NO: 1340436 - protein, 9 aa, Mycobacterium
ADGATTSGV

SEQ ID NO: 1340437 - protein, 7 aa, Mycobacterium
ADGDYEY

SEQ ID NO: 1340438 - protein, 7 aa, Mycobacterium
ADGERDN

SEQ ID NO: 1340439 - protein, 8 aa, Mycobacterium
ADGESVPG

SEQ ID NO: 1340440 - protein, 9 aa, Mycobacterium
ADGGPATGR

SEQ ID NO: 1340441 - protein, 9 aa, Mycobacterium
ADGGSPDAE

SEQ ID NO: 1340442 - protein, 12 aa, Mycobacterium
ADGHTPETEEYG

SEQ ID NO: 1340443 - protein, 8 aa, Mycobacterium
ADGKTAPF

SEQ ID NO: 1340444 - protein, 8 aa, Mycobacterium
ADGPDFNN

SEQ ID NO: 1340445 - protein, 9 aa, Mycobacterium
ADGPGQKVG

SEQ ID NO: 1340446 - protein, 9 aa, Mycobacterium
ADGRDGSDL

SEQ ID NO: 1340447 - protein, 6 aa, Mycobacterium
ADGRVD

SEQ ID NO: 1340448 - protein, 6 aa, Mycobacterium
ADGSGW

SEQ ID NO: 1340449 - protein, 7 aa, Mycobacterium
ADGSRAA

SEQ ID NO: 1340450 - protein, 11 aa, Mycobacterium
ADGSVPEDNPF

SEQ ID NO: 1340451 - protein, 31 aa, Mycobacterium
ADGTATFDRETRISGEENANLQATVTQVIPG

SEQ ID NO: 1340452 - protein, 5 aa, Mycobacterium
ADGTV

SEQ ID NO: 1340453 - protein, 4 aa, Mycobacterium
ADGV

SEQ ID NO: 1340454 - protein, 10 aa, Mycobacterium
ADGVHGPESV

SEQ ID NO: 1340455 - protein, 14 aa, Mycobacterium
ADGVSPAAQANRAR

SEQ ID NO: 1340456 - protein, 6 aa, Mycobacterium
ADHPTE

SEQ ID NO: 1340457 - protein, 10 aa, Mycobacterium
ADIQSKQEGF

SEQ ID NO: 1340458 - protein, 7 aa, Mycobacterium
ADKATAA

SEQ ID NO: 1340459 - protein, 10 aa, Mycobacterium
ADKPEGPWSS

SEQ ID NO: 1340460 - protein, 7 aa, Mycobacterium
ADLAPES

SEQ ID NO: 1340461 - protein, 7 aa, Mycobacterium
ADLEPRI

SEQ ID NO: 1340462 - protein, 18 aa, Mycobacterium
ADLGDEDAELTVGDAQDH

SEQ ID NO: 1340463 - protein, 8 aa, Mycobacterium
ADNASRIS

SEQ ID NO: 1340464 - protein, 9 aa, Mycobacterium
ADNGDHDPL

SEQ ID NO: 1340465 - protein, 23 aa, Mycobacterium
ADNGSGIVSGGAGPTVEAARDDA

SEQ ID NO: 1340466 - protein, 11 aa, Mycobacterium
ADNLRGEGANI

SEQ ID NO: 1340467 - protein, 11 aa, Mycobacterium
ADNLRGQGANI

SEQ ID NO: 1340468 - protein, 12 aa, Mycobacterium
ADNMRGQGGAIR

SEQ ID NO: 1340469 - protein, 7 aa, Mycobacterium
ADNPDKV

SEQ ID NO: 1340470 - protein, 7 aa, Mycobacterium
ADNPTPN

SEQ ID NO: 1340471 - protein, 15 aa, Mycobacterium
ADNSPETNVGGEHPN

SEQ ID NO: 1340472 - protein, 18 aa, Mycobacterium
ADPAKVTIGGGSNPGGPD

SEQ ID NO: 1340473 - protein, 18 aa, Mycobacterium
ADPANVTIGGGSSPGGPD

SEQ ID NO: 1340474 - protein, 8 aa, Mycobacterium
ADPARDAR

SEQ ID NO: 1340475 - protein, 8 aa, Mycobacterium
ADPDNDAT

SEQ ID NO: 1340476 - protein, 22 aa, Mycobacterium
ADPDNNRRPRQEVQPTEDETVE

SEQ ID NO: 1340477 - protein, 101 aa, Mycobacterium
ADPDTSSSPSTDTATASPADAGQSVTPTRTDAETDTEKESLSDNEDGDEPTDDVLTESEDDTEAPPTDDDAPASSDRDTAVSSLTRTAEDKSGDAEDDEPV

SEQ ID NO: 1340478 - protein, 10 aa, Mycobacterium
ADPEAPAPAP

SEQ ID NO: 1340479 - protein, 12 aa, Mycobacterium
ADPELPAPSPVA

SEQ ID NO: 1340480 - protein, 18 aa, Mycobacterium
ADPFGARARADNPSLTTG

SEQ ID NO: 1340481 - protein, 9 aa, Mycobacterium
ADPGASDDT

SEQ ID NO: 1340482 - protein, 6 aa, Mycobacterium
ADPGAV

SEQ ID NO: 1340483 - protein, 7 aa, Mycobacterium
ADPNATF

SEQ ID NO: 1340484 - protein, 15 aa, Mycobacterium
ADPNRAWANPDGVAD

SEQ ID NO: 1340485 - protein, 10 aa, Mycobacterium
ADPNWRPGRE

SEQ ID NO: 1340486 - protein, 7 aa, Mycobacterium
ADPSSDI

SEQ ID NO: 1340487 - protein, 33 aa, Mycobacterium
ADPSTSGVVTDTGATVPAPPPILTAGSNDPECV

SEQ ID NO: 1340488 - protein, 6 aa, Mycobacterium
ADPTGY

SEQ ID NO: 1340489 - protein, 6 aa, Mycobacterium
ADPVRA

SEQ ID NO: 1340490 - protein, 4 aa, Mycobacterium
ADPW

SEQ ID NO: 1340491 - protein, 14 aa, Mycobacterium
ADQGELPVTPSDPV

SEQ ID NO: 1340492 - protein, 28 aa, Mycobacterium
ADQPTAGADHRPHRRHSRRGGSCRTGSV

SEQ ID NO: 1340493 - protein, 8 aa, Mycobacterium
ADQRPSAE

SEQ ID NO: 1340494 - protein, 7 aa, Mycobacterium
ADQSSGL

SEQ ID NO: 1340495 - protein, 12 aa, Mycobacterium
ADQTKDYVQPGT

SEQ ID NO: 1340496 - protein, 6 aa, Mycobacterium
ADRAGR

SEQ ID NO: 1340497 - protein, 12 aa, Mycobacterium
ADRGARQTAGER

SEQ ID NO: 1340498 - protein, 6 aa, Mycobacterium
ADRGEE

SEQ ID NO: 1340499 - protein, 7 aa, Mycobacterium
ADSAGSA

SEQ ID NO: 1340500 - protein, 10 aa, Mycobacterium
ADSDEEPLTT

SEQ ID NO: 1340501 - protein, 8 aa, Mycobacterium
ADSGLGAD

SEQ ID NO: 1340502 - protein, 12 aa, Mycobacterium
ADSGYNNAAAKG

SEQ ID NO: 1340503 - protein, 9 aa, Mycobacterium
ADSPQDDNV

SEQ ID NO: 1340504 - protein, 8 aa, Mycobacterium
ADSPSMNQ

SEQ ID NO: 1340505 - protein, 10 aa, Mycobacterium
ADSPSVAPDG

SEQ ID NO: 1340506 - protein, 4 aa, Mycobacterium
ADST

SEQ ID NO: 1340507 - protein, 10 aa, Mycobacterium
ADSVNQSKEN

SEQ ID NO: 1340508 - protein, 9 aa, Mycobacterium
ADTDRAGRI

SEQ ID NO: 1340509 - protein, 12 aa, Mycobacterium
ADTGAREVSDEV

SEQ ID NO: 1340510 - protein, 4 aa, Mycobacterium
ADTS

SEQ ID NO: 1340511 - protein, 7 aa, Mycobacterium
ADTVTVN

SEQ ID NO: 1340512 - protein, 6 aa, Mycobacterium
ADVESA

SEQ ID NO: 1340513 - protein, 7 aa, Mycobacterium
ADVPPDV

SEQ ID NO: 1340514 - protein, 12 aa, Mycobacterium
ADVPPPRGAAAD

SEQ ID NO: 1340515 - protein, 12 aa, Mycobacterium
ADVTPVDNDAAL

SEQ ID NO: 1340516 - protein, 7 aa, Mycobacterium
ADVTQPR

SEQ ID NO: 1340517 - protein, 8 aa, Mycobacterium
ADYSPGGV

SEQ ID NO: 1340518 - protein, 5 aa, Mycobacterium
AEAAA

SEQ ID NO: 1340519 - protein, 7 aa, Mycobacterium
AEAASGV

SEQ ID NO: 1340520 - protein, 12 aa, Mycobacterium
AEAATREDKQDT

SEQ ID NO: 1340521 - protein, 13 aa, Mycobacterium
AEADEVAGALSAP

SEQ ID NO: 1340522 - protein, 7 aa, Mycobacterium
AEADGGE

SEQ ID NO: 1340523 - protein, 16 aa, Mycobacterium
AEADTISAASAVVAPQ

SEQ ID NO: 1340524 - protein, 18 aa, Mycobacterium
AEAGGPGDEAPDQFDDGC

SEQ ID NO: 1340525 - protein, 10 aa, Mycobacterium
AEAGPPDGQP

SEQ ID NO: 1340526 - protein, 29 aa, Mycobacterium
AEAGQGGWRTVPGSERDAGHAEGRQSQIS

SEQ ID NO: 1340527 - protein, 8 aa, Mycobacterium
AEAGQGRW

SEQ ID NO: 1340528 - protein, 11 aa, Mycobacterium
AEAGTRRGTGL

SEQ ID NO: 1340529 - protein, 9 aa, Mycobacterium
AEAPRADAD

SEQ ID NO: 1340530 - protein, 10 aa, Mycobacterium
AEARERAPKV

SEQ ID NO: 1340531 - protein, 16 aa, Mycobacterium
AEARTAASRPFAPSWD

SEQ ID NO: 1340532 - protein, 11 aa, Mycobacterium
AEATAPAPDGV

SEQ ID NO: 1340533 - protein, 7 aa, Mycobacterium
AEATDPQ

SEQ ID NO: 1340534 - protein, 9 aa, Mycobacterium
AECGSPDAI

SEQ ID NO: 1340535 - protein, 6 aa, Mycobacterium
AECPGA

SEQ ID NO: 1340536 - protein, 9 aa, Mycobacterium
AEDDRAEVE

SEQ ID NO: 1340537 - protein, 7 aa, Mycobacterium
AEDEQDA

SEQ ID NO: 1340538 - protein, 7 aa, Mycobacterium
AEDGGLD

SEQ ID NO: 1340539 - protein, 5 aa, Mycobacterium
AEDGR

SEQ ID NO: 1340540 - protein, 8 aa, Mycobacterium
AEDGTPSV

SEQ ID NO: 1340541 - protein, 10 aa, Mycobacterium
AEDLTGGEGT

SEQ ID NO: 1340542 - protein, 7 aa, Mycobacterium
AEDPETT

SEQ ID NO: 1340543 - protein, 34 aa, Mycobacterium; identical to SEQ ID NO: 1189679

SEQ ID NO: 1340544 - protein, 35 aa, Mycobacterium
AEDSDDGVAVGGDGGDGGRIGDGGDGGKATGTFAG

SEQ ID NO: 1340545 - protein, 12 aa, Mycobacterium
AEDTLTGTSDEL

SEQ ID NO: 1340546 - protein, 5 aa, Mycobacterium
AEEEP

SEQ ID NO: 1340547 - protein, 4 aa, Mycobacterium
AEEN

SEQ ID NO: 1340548 - protein, 6 aa, Mycobacterium
AEEYPQ

SEQ ID NO: 1340549 - protein, 11 aa, Mycobacterium
AEFATDGDGEA

SEQ ID NO: 1340550 - protein, 4 aa, Mycobacterium
AEGA

SEQ ID NO: 1340551 - protein, 11 aa, Mycobacterium
AEGAENTGPVG

SEQ ID NO: 1340552 - protein, 10 aa, Mycobacterium
AEGAEPGYQS

SEQ ID NO: 1340553 - protein, 5 aa, Mycobacterium
AEGAG

SEQ ID NO: 1340554 - protein, 7 aa, Mycobacterium
AEGAKQA

SEQ ID NO: 1340555 - protein, 13 aa, Mycobacterium
AEGAMADPTSDTL

SEQ ID NO: 1340556 - protein, 5 aa, Mycobacterium
AEGIQ

SEQ ID NO: 1340557 - protein, 9 aa, Mycobacterium
AEGKNASAR

SEQ ID NO: 1340558 - protein, 11 aa, Mycobacterium
AEGLRAEAAGQ

SEQ ID NO: 1340559 - protein, 6 aa, Mycobacterium
AEGNGD

SEQ ID NO: 1340560 - protein, 7 aa, Mycobacterium
AEGQPRH

SEQ ID NO: 1340561 - protein, 5 aa, Mycobacterium
AEGVE

SEQ ID NO: 1340562 - protein, 7 aa, Mycobacterium
AEGVQRS

SEQ ID NO: 1340563 - protein, 11 aa, Mycobacterium
AEHPARSPSRA

SEQ ID NO: 1340564 - protein, 8 aa, Mycobacterium
AEHRAGEH

SEQ ID NO: 1340565 - protein, 5 aa, Mycobacterium
AEIPE

SEQ ID NO: 1340566 - protein, 20 aa, Mycobacterium
AEIPSPGAEPVEAPASTSVT

SEQ ID NO: 1340567 - protein, 4 aa, Mycobacterium
AELD

SEQ ID NO: 1340568 - protein, 13 aa, Mycobacterium
AENDNTKAAQRLA

SEQ ID NO: 1340569 - protein, 8 aa, Mycobacterium
AENEKATG

SEQ ID NO: 1340570 - protein, 52 aa, Mycobacterium
AENGTAGGNGGVGGAGGLGGSISGDGGTGGTGGTGGAGGNGGAGGNGVHGAD

SEQ ID NO: 1340571 - protein, 11 aa, Mycobacterium
AENPDLAGKTL

SEQ ID NO: 1340572 - protein, 10 aa, Mycobacterium
AENREPVGTA

SEQ ID NO: 1340573 - protein, 9 aa, Mycobacterium
AEPADAPPF

SEQ ID NO: 1340574 - protein, 18 aa, Mycobacterium
AEPANVTIGGGSSPGGPD

SEQ ID NO: 1340575 - protein, 11 aa, Mycobacterium
AEPDEPDTSVG

SEQ ID NO: 1340576 - protein, 10 aa, Mycobacterium
AEPGPRSAKE

SEQ ID NO: 1340577 - protein, 13 aa, Mycobacterium
AEPIGENDSWEII

SEQ ID NO: 1340578 - protein, 5 aa, Mycobacterium
AEPPC

SEQ ID NO: 1340579 - protein, 12 aa, Mycobacterium
AEPSLAPAPREA

SEQ ID NO: 1340580 - protein, 7 aa, Mycobacterium
AEPTPRE

SEQ ID NO: 1340581 - protein, 4 aa, Mycobacterium
AEPV

SEQ ID NO: 1340582 - protein, 9 aa, Mycobacterium
AEPVAPEPV

SEQ ID NO: 1340583 - protein, 7 aa, Mycobacterium
AEPVGPG

SEQ ID NO: 1340584 - protein, 10 aa, Mycobacterium
AEPVNVDPAP

SEQ ID NO: 1340585 - protein, 64 aa, Mycobacterium; identical to SEQ ID NO: 1178267

SEQ ID NO: 1340586 - protein, 4 aa, Mycobacterium
AEQA

SEQ ID NO: 1340587 - protein, 5 aa, Mycobacterium
AEQAE

SEQ ID NO: 1340588 - protein, 13 aa, Mycobacterium
AEQAPTDDVEDAE

SEQ ID NO: 1340589 - protein, 4 aa, Mycobacterium
AEQL

SEQ ID NO: 1340590 - protein, 5 aa, Mycobacterium
AERAG

SEQ ID NO: 1340591 - protein, 5 aa, Mycobacterium
AERAP

SEQ ID NO: 1340592 - protein, 62 aa, Mycobacterium
AERARAQAKLQEARTPAAPTGGAPAAAPTGATTPAPGSSAAPAPGGASPNWDVDPATGNRET

SEQ ID NO: 1340593 - protein, 28 aa, Mycobacterium
AERQAEPSPTAPPPASTTPAAPAAGTAR

SEQ ID NO: 1340594 - protein, 7 aa, Mycobacterium
AERRSAE

SEQ ID NO: 1340595 - protein, 7 aa, Mycobacterium
AERSAGV

SEQ ID NO: 1340596 - protein, 9 aa, Mycobacterium
AERTTGAVK

SEQ ID NO: 1340597 - protein, 4 aa, Mycobacterium
AESE

SEQ ID NO: 1340598 - protein, 7 aa, Mycobacterium
AESEGVR

SEQ ID NO: 1340599 - protein, 6 aa, Mycobacterium
AESGAV

SEQ ID NO: 1340600 - protein, 15 aa, Mycobacterium
AESGTNLLTTSKDSL

SEQ ID NO: 1340601 - protein, 9 aa, Mycobacterium
AESPDSVEG

SEQ ID NO: 1340602 - protein, 13 aa, Mycobacterium
AESSASAGANAEL

SEQ ID NO: 1340603 - protein, 13 aa, Mycobacterium
AESSASTPGRAAG

SEQ ID NO: 1340604 - protein, 105 aa, Mycobacterium
AESSDSASQDTSAPDPGEASGDDTADSEPDHESAPSAGESDSADDDSADDDGPVDLPTGDAGSIDIPDTAESDRGNHGDDTMTAAPSEETADDLSHTQSDPDLSA

SEQ ID NO: 1340605 - protein, 10 aa, Mycobacterium
AETAAPSALG

SEQ ID NO: 1340606 - protein, 6 aa, Mycobacterium
AETDPH

SEQ ID NO: 1340607 - protein, 6 aa, Mycobacterium
AETGSK

SEQ ID NO: 1340608 - protein, 6 aa, Mycobacterium
AETPPE

SEQ ID NO: 1340609 - protein, 16 aa, Mycobacterium
AEVPRRPGLPRRPRHP

SEQ ID NO: 1340610 - protein, 9 aa, Mycobacterium
AEYAADPEE

SEQ ID NO: 1340611 - protein, 34 aa, Mycobacterium
AFAATEEGKGVAVTGSYGASGDQSRAVESGKPAD

SEQ ID NO: 1340612 - protein, 6 aa, Mycobacterium
AFADET

SEQ ID NO: 1340613 - protein, 11 aa, Mycobacterium
AFAPEPGESSA

SEQ ID NO: 1340614 - protein, 60 aa, Mycobacterium
AFESGYGDGFQDGLDQGQLEGGDAGGGDWGGGDAGGGDWGGGWDSGGGGDWGGGDFGGFE

SEQ ID NO: 1340615 - protein, 8 aa, Mycobacterium
AFSPDGKR

SEQ ID NO: 1340616 - protein, 4 aa, Mycobacterium
AFSS

SEQ ID NO: 1340617 - protein, 8 aa, Mycobacterium
AFTGREND

SEQ ID NO: 1340618 - protein, 6 aa, Mycobacterium
AFTPTD

SEQ ID NO: 1340619 - protein, 16 aa, Mycobacterium
AFTRTGTNGVAQVDTE

SEQ ID NO: 1340620 - protein, 10 aa, Mycobacterium
AGAAAAATLG

SEQ ID NO: 1340621 - protein, 9 aa, Mycobacterium
AGAAEGVAT

SEQ ID NO: 1340622 - protein, 8 aa, Mycobacterium
AGAAPGSK

SEQ ID NO: 1340623 - protein, 11 aa, Mycobacterium
AGAAPQAQAFS

SEQ ID NO: 1340624 - protein, 24 aa, Mycobacterium
AGAATEPRTVAGGLPDDRSPDLRG

SEQ ID NO: 1340625 - protein, 9 aa, Mycobacterium
AGADGQPVY

SEQ ID NO: 1340626 - protein, 9 aa, Mycobacterium
AGADPLGCE

SEQ ID NO: 1340627 - protein, 9 aa, Mycobacterium
AGAEDGSAV

SEQ ID NO: 1340628 - protein, 12 aa, Mycobacterium
AGAEQCSSDEVT

SEQ ID NO: 1340629 - protein, 8 aa, Mycobacterium
AGAESRLE

SEQ ID NO: 1340630 - protein, 9 aa, Mycobacterium
AGAGDPRYA

SEQ ID NO: 1340631 - protein, 4 aa, Mycobacterium
AGAI

SEQ ID NO: 1340632 - protein, 7 aa, Mycobacterium
AGALGAV

SEQ ID NO: 1340633 - protein, 9 aa, Mycobacterium
AGALPDPGP

SEQ ID NO: 1340634 - protein, 6 aa, Mycobacterium
AGANDA

SEQ ID NO: 1340635 - protein, 13 aa, Mycobacterium
AGAPAPVPAAPAV

SEQ ID NO: 1340636 - protein, 8 aa, Mycobacterium
AGAPFDAP

SEQ ID NO: 1340637 - protein, 8 aa, Mycobacterium
AGAPGDPI

SEQ ID NO: 1340638 - protein, 13 aa, Mycobacterium
AGAPISEASGPGY

SEQ ID NO: 1340639 - protein, 11 aa, Mycobacterium
AGAQGPPPLPP

SEQ ID NO: 1340640 - protein, 35 aa, Mycobacterium
AGAQPAPEPPPAPPADAPPAEGPKTTIDANGSYAV

SEQ ID NO: 1340641 - protein, 29 aa, Mycobacterium
AGAQPAPPPAPVQGEVPPAWAPPKPAETW

SEQ ID NO: 1340642 - protein, 82 aa, Mycobacterium
AGAQPAPPPPPPAPSPAAPAPPPPGPGPVPPPPPADPNAAPPPAGQLPPPPPADPNAPPPADPNAPPPPAPEPGRVDNAAGG

SEQ ID NO: 1340643 - protein, 7 aa, Mycobacterium
AGAQPRE

SEQ ID NO: 1340644 - protein, 82 aa, Mycobacterium
AGAQPTPPPPPPAPSPAAPAPPPPGPGPVPPPPPADPNAAPPPAGQLPPPPPADPNAPPPADPNAPPPPAPEPGRVDNAAGG

SEQ ID NO: 1340645 - protein, 4 aa, Mycobacterium
AGAS

SEQ ID NO: 1340646 - protein, 6 aa, Mycobacterium
AGASTR

SEQ ID NO: 1340647 - protein, 5 aa, Mycobacterium
AGASV

SEQ ID NO: 1340648 - protein, 11 aa, Mycobacterium
AGATGESAMDA

SEQ ID NO: 1340649 - protein, 11 aa, Mycobacterium
AGATGRTYAAT

SEQ ID NO: 1340650 - protein, 8 aa, Mycobacterium
AGATTYGV

SEQ ID NO: 1340651 - protein, 10 aa, Mycobacterium
AGAVRGTVEP

SEQ ID NO: 1340652 - protein, 6 aa, Mycobacterium
AGAVSG

SEQ ID NO: 1340653 - protein, 7 aa, Mycobacterium
AGAWPRD

SEQ ID NO: 1340654 - protein, 8 aa, Mycobacterium
AGAYAGHS

SEQ ID NO: 1340655 - protein, 8 aa, Mycobacterium
AGCGDASS

SEQ ID NO: 1340656 - protein, 10 aa, Mycobacterium
AGCPGEGPGT

SEQ ID NO: 1340657 - protein, 6 aa, Mycobacterium
AGDAAR

SEQ ID NO: 1340658 - protein, 8 aa, Mycobacterium
AGDALGAP

SEQ ID NO: 1340659 - protein, 24 aa, Mycobacterium
AGDDEPLPEPDDKVTEEPGNAGIP

SEQ ID NO: 1340660 - protein, 5 aa, Mycobacterium
AGDGY

SEQ ID NO: 1340661 - protein, 8 aa, Mycobacterium
AGDHEAAR

SEQ ID NO: 1340662 - protein, 7 aa, Mycobacterium
AGDNRVD

SEQ ID NO: 1340663 - protein, 22 aa, Mycobacterium
AGDPAPPPAPPLVGPPPVPQVQ

SEQ ID NO: 1340664 - protein, 21 aa, Mycobacterium
AGDPAPPPAPPPVGPPPVPQV

SEQ ID NO: 1340665 - protein, 6 aa, Mycobacterium
AGDPQW

SEQ ID NO: 1340666 - protein, 5 aa, Mycobacterium
AGDQA

SEQ ID NO: 1340667 - protein, 17 aa, Mycobacterium
AGDTISPADPATNPAGD

SEQ ID NO: 1340668 - protein, 13 aa, Mycobacterium
AGDTITAADLDGE

SEQ ID NO: 1340669 - protein, 8 aa, Mycobacterium
AGDTNRDT

SEQ ID NO: 1340670 - protein, 22 aa, Mycobacterium
AGEAPRREEAAGSGGSAGEGGG

SEQ ID NO: 1340671 - protein, 6 aa, Mycobacterium
AGEGGG

SEQ ID NO: 1340672 - protein, 5 aa, Mycobacterium
AGEKI

SEQ ID NO: 1340673 - protein, 7 aa, Mycobacterium
AGEPTGV

SEQ ID NO: 1340674 - protein, 7 aa, Mycobacterium
AGEQGVP

SEQ ID NO: 1340675 - protein, 7 aa, Mycobacterium
AGEQTRD

SEQ ID NO: 1340676 - protein, 11 aa, Mycobacterium
AGESGTADGQT

SEQ ID NO: 1340677 - protein, 10 aa, Mycobacterium
AGETMSAGTE

SEQ ID NO: 1340678 - protein, 5 aa, Mycobacterium
AGETY

SEQ ID NO: 1340679 - protein, 4 aa, Mycobacterium
AGEV

SEQ ID NO: 1340680 - protein, 12 aa, Mycobacterium
AGGAASAAGLPS

SEQ ID NO: 1340681 - protein, 13 aa, Mycobacterium
AGGALSNFGPASD

SEQ ID NO: 1340682 - protein, 5 aa, Mycobacterium
AGGFD

SEQ ID NO: 1340683 - protein, 5 aa, Mycobacterium
AGGFN

SEQ ID NO: 1340684 - protein, 6 aa, Mycobacterium
AGGFSS

SEQ ID NO: 1340685 - protein, 4 aa, Mycobacterium
AGGH

SEQ ID NO: 1340686 - protein, 6 aa, Mycobacterium
AGGKNG

SEQ ID NO: 1340687 - protein, 4 aa, Mycobacterium
AGGL

SEQ ID NO: 1340688 - protein, 5 aa, Mycobacterium
AGGLE

SEQ ID NO: 1340689 - protein, 8 aa, Mycobacterium
AGGLPREQ

SEQ ID NO: 1340690 - protein, 7 aa, Mycobacterium
AGGLRAG

SEQ ID NO: 1340691 - protein, 8 aa, Mycobacterium
AGGPGGMV

SEQ ID NO: 1340692 - protein, 174 aa, Mycobacterium
AGGQGVASATPDDASAGSSPSASADDNSSGTSDTSGADSSSQAGAGTDNEPDSDADADSSPVTDSETESLTETVDADDGVTGEEDAVTGEESESEEPQSGPALDAGGEAAPTAQTASQNQDPGDNAESAAVSEQSVTPDESVTPPNDELPSAQTEDDAAPSVTPTSASQPEGAA

SEQ ID NO: 1340693 - protein, 13 aa, Mycobacterium
AGGQIPEDRTTPA

SEQ ID NO: 1340694 - protein, 8 aa, Mycobacterium
AGGRTSQN

SEQ ID NO: 1340695 - protein, 32 aa, Mycobacterium
AGGSGSSTPAPSSTPKPTPLPPPLPAEVGGDG

SEQ ID NO: 1340696 - protein, 8 aa, Mycobacterium
AGGSTGSR

SEQ ID NO: 1340697 - protein, 4 aa, Mycobacterium
AGGT

SEQ ID NO: 1340698 - protein, 7 aa, Mycobacterium
AGGTDTF

SEQ ID NO: 1340699 - protein, 6 aa, Mycobacterium
AGGTLV

SEQ ID NO: 1340700 - protein, 8 aa, Mycobacterium
AGGTVTGS

SEQ ID NO: 1340701 - protein, 10 aa, Mycobacterium
AGGYPTTEET

SEQ ID NO: 1340702 - protein, 9 aa, Mycobacterium
AGHSATTTV

SEQ ID NO: 1340703 - protein, 14 aa, Mycobacterium
AGHSPSDVVINASA

SEQ ID NO: 1340704 - protein, 8 aa, Mycobacterium
AGIDTTGA

SEQ ID NO: 1340705 - protein, 8 aa, Mycobacterium
AGIRTQGG

SEQ ID NO: 1340706 - protein, 6 aa, Mycobacterium
AGITPA

SEQ ID NO: 1340707 - protein, 4 aa, Mycobacterium
AGKG

SEQ ID NO: 1340708 - protein, 17 aa, Mycobacterium
AGKPAQDTSFNGRSDYD

SEQ ID NO: 1340709 - protein, 10 aa, Mycobacterium
AGKQGLSGGN

SEQ ID NO: 1340710 - protein, 11 aa, Mycobacterium
AGKTGTAQQIN

SEQ ID NO: 1340711 - protein, 5 aa, Mycobacterium
AGLAA

SEQ ID NO: 1340712 - protein, 8 aa, Mycobacterium
AGLATRQG

SEQ ID NO: 1340713 - protein, 9 aa, Mycobacterium
AGLDQDTYT

SEQ ID NO: 1340714 - protein, 4 aa, Mycobacterium
AGLG

SEQ ID NO: 1340715 - protein, 8 aa, Mycobacterium
AGLGGQGL

SEQ ID NO: 1340716 - protein, 9 aa, Mycobacterium
AGLRGGERA

SEQ ID NO: 1340717 - protein, 8 aa, Mycobacterium
AGNAAQPV

SEQ ID NO: 1340718 - protein, 8 aa, Mycobacterium
AGNAPQPV

SEQ ID NO: 1340719 - protein, 9 aa, Mycobacterium
AGNATIDDD

SEQ ID NO: 1340720 - protein, 10 aa, Mycobacterium
AGNGLSREQA

SEQ ID NO: 1340721 - protein, 7 aa, Mycobacterium
AGNLPGD

SEQ ID NO: 1340722 - protein, 41 aa, Mycobacterium
AGNSQTPGNGTPEIAESSTVRNSSIAQSDPPPVDGSTGGTM

SEQ ID NO: 1340723 - protein, 10 aa, Mycobacterium
AGPADLAAGR

SEQ ID NO: 1340724 - protein, 9 aa, Mycobacterium
AGPAERPLE

SEQ ID NO: 1340725 - protein, 10 aa, Mycobacterium
AGPAGSAAAA

SEQ ID NO: 1340726 - protein, 14 aa, Mycobacterium
AGPALADSTEDYPI

SEQ ID NO: 1340727 - protein, 15 aa, Mycobacterium
AGPALPDVATAPAAA

SEQ ID NO: 1340728 - protein, 14 aa, Mycobacterium
AGPAPSDPRVAQQI

SEQ ID NO: 1340729 - protein, 26 aa, Mycobacterium
AGPAVAAPSATGDAQSTISELQAGGN

SEQ ID NO: 1340730 - protein, 18 aa, Mycobacterium
AGPAYAAPTGPGNANDAI

SEQ ID NO: 1340731 - protein, 9 aa, Mycobacterium
AGPEGVSGP

SEQ ID NO: 1340732 - protein, 7 aa, Mycobacterium
AGPFSEE

SEQ ID NO: 1340733 - protein, 4 aa, Mycobacterium
AGPG

SEQ ID NO: 1340734 - protein, 5 aa, Mycobacterium
AGPGG

SEQ ID NO: 1340735 - protein, 9 aa, Mycobacterium
AGPGPFDPR

SEQ ID NO: 1340736 - protein, 5 aa, Mycobacterium
AGPLA

SEQ ID NO: 1340737 - protein, 10 aa, Mycobacterium
AGPNSSSYPR

SEQ ID NO: 1340738 - protein, 10 aa, Mycobacterium
AGPNTYAASD

SEQ ID NO: 1340739 - protein, 9 aa, Mycobacterium
AGPPGAQPA

SEQ ID NO: 1340740 - protein, 9 aa, Mycobacterium
AGPRPEMDK

SEQ ID NO: 1340741 - protein, 25 aa, Mycobacterium
AGPRPHPPSAVPDTPTARPVAPDPR

SEQ ID NO: 1340742 - protein, 6 aa, Mycobacterium
AGPSVR

SEQ ID NO: 1340743 - protein, 5 aa, Mycobacterium
AGPSY

SEQ ID NO: 1340744 - protein, 10 aa, Mycobacterium
AGPTGRQTLT

SEQ ID NO: 1340745 - protein, 9 aa, Mycobacterium
AGPTTATDA

SEQ ID NO: 1340746 - protein, 7 aa, Mycobacterium
AGPVEPV

SEQ ID NO: 1340747 - protein, 6 aa, Mycobacterium
AGQHQP

SEQ ID NO: 1340748 - protein, 15 aa, Mycobacterium
AGQKSVDDALAQAQE

SEQ ID NO: 1340749 - protein, 23 aa, Mycobacterium
AGQPPGQRVSGPDGRVDESGSLG

SEQ ID NO: 1340750 - protein, 13 aa, Mycobacterium
AGQRTAGTVTEDR

SEQ ID NO: 1340751 - protein, 24 aa, Mycobacterium
AGQTITKSTVPAEVGPALDAANNG

SEQ ID NO: 1340752 - protein, 6 aa, Mycobacterium
AGQVQG

SEQ ID NO: 1340753 - protein, 7 aa, Mycobacterium
AGQVTPD

SEQ ID NO: 1340754 - protein, 4 aa, Mycobacterium
AGRA

SEQ ID NO: 1340755 - protein, 6 aa, Mycobacterium
AGRAYP

SEQ ID NO: 1340756 - protein, 6 aa, Mycobacterium
AGREKD

SEQ ID NO: 1340757 - protein, 9 aa, Mycobacterium
AGRESPAEL

SEQ ID NO: 1340758 - protein, 4 aa, Mycobacterium
AGRF

SEQ ID NO: 1340759 - protein, 6 aa, Mycobacterium
AGRGRQ

SEQ ID NO: 1340760 - protein, 4 aa, Mycobacterium
AGRP

SEQ ID NO: 1340761 - protein, 5 aa, Mycobacterium
AGRPD

SEQ ID NO: 1340762 - protein, 8 aa, Mycobacterium
AGRPRRNY

SEQ ID NO: 1340763 - protein, 7 aa, Mycobacterium
AGRPTPE

SEQ ID NO: 1340764 - protein, 6 aa, Mycobacterium
AGRPVQ

SEQ ID NO: 1340765 - protein, 8 aa, Mycobacterium
AGRQGSHR

SEQ ID NO: 1340766 - protein, 8 aa, Mycobacterium
AGRREADG

SEQ ID NO: 1340767 - protein, 4 aa, Mycobacterium
AGRS

SEQ ID NO: 1340768 - protein, 13 aa, Mycobacterium
AGRVAGVRTSDGV

SEQ ID NO: 1340769 - protein, 10 aa, Mycobacterium
AGRVNDPRLP

SEQ ID NO: 1340770 - protein, 4 aa, Mycobacterium
AGSA

SEQ ID NO: 1340771 - protein, 10 aa, Mycobacterium
AGSDTSGRSV

SEQ ID NO: 1340772 - protein, 5 aa, Mycobacterium
AGSEI

SEQ ID NO: 1340773 - protein, 23 aa, Mycobacterium
AGSGGPEQAEATGTGEVSTDVSG

SEQ ID NO: 1340774 - protein, 10 aa, Mycobacterium
AGSGIPPATY

SEQ ID NO: 1340775 - protein, 6 aa, Mycobacterium
AGSGLT

SEQ ID NO: 1340776 - protein, 11 aa, Mycobacterium
AGSMPIPDGPA

SEQ ID NO: 1340777 - protein, 6 aa, Mycobacterium
AGSPRA

SEQ ID NO: 1340778 - protein, 6 aa, Mycobacterium
AGSRKH

SEQ ID NO: 1340779 - protein, 4 aa, Mycobacterium
AGST

SEQ ID NO: 1340780 - protein, 4 aa, Mycobacterium
AGSV

SEQ ID NO: 1340781 - protein, 4 aa, Mycobacterium
AGTA

SEQ ID NO: 1340782 - protein, 8 aa, Mycobacterium
AGTAAYGM

SEQ ID NO: 1340783 - protein, 10 aa, Mycobacterium
AGTADGAADG

SEQ ID NO: 1340784 - protein, 25 aa, Mycobacterium
AGTADGFETGNPSFRTTGTFQIKIA

SEQ ID NO: 1340785 - protein, 9 aa, Mycobacterium
AGTAGGAAD

SEQ ID NO: 1340786 - protein, 10 aa, Mycobacterium
AGTAPDHPHS

SEQ ID NO: 1340787 - protein, 33 aa, Mycobacterium
AGTASVSGIDTAEDDTVDQTGSITDTPREPDSI

SEQ ID NO: 1340788 - protein, 15 aa, Mycobacterium
AGTDGSVTYDRGSDG

SEQ ID NO: 1340789 - protein, 8 aa, Mycobacterium
AGTDTGPI

SEQ ID NO: 1340790 - protein, 5 aa, Mycobacterium
AGTED

SEQ ID NO: 1340791 - protein, 11 aa, Mycobacterium
AGTEDAPSPEH

SEQ ID NO: 1340792 - protein, 6 aa, Mycobacterium
AGTEKN

SEQ ID NO: 1340793 - protein, 7 aa, Mycobacterium
AGTENEE

SEQ ID NO: 1340794 - protein, 29 aa, Mycobacterium
AGTFPKGGTYHDGGEGATVEPAPDPTTLA

SEQ ID NO: 1340795 - protein, 12 aa, Mycobacterium
AGTGHGTARERE

SEQ ID NO: 1340796 - protein, 9 aa, Mycobacterium
AGTNTDTSL

SEQ ID NO: 1340797 - protein, 9 aa, Mycobacterium
AGTPTDPAG

SEQ ID NO: 1340798 - protein, 8 aa, Mycobacterium
AGTRAQFD

SEQ ID NO: 1340799 - protein, 11 aa, Mycobacterium
AGTRMKSDTPK

SEQ ID NO: 1340800 - protein, 18 aa, Mycobacterium
AGTVQTSDFTVDGKPVDV

SEQ ID NO: 1340801 - protein, 4 aa, Mycobacterium
AGVD

SEQ ID NO: 1340802 - protein, 6 aa, Mycobacterium
AGVDRQ

SEQ ID NO: 1340803 - protein, 8 aa, Mycobacterium
AGVGGGGP

SEQ ID NO: 1340804 - protein, 8 aa, Mycobacterium
AGVGPDAV

SEQ ID NO: 1340805 - protein, 4 aa, Mycobacterium
AGVT

SEQ ID NO: 1340806 - protein, 13 aa, Mycobacterium
AGYDTATLTDRAG

SEQ ID NO: 1340807 - protein, 4 aa, Mycobacterium
AGYP

SEQ ID NO: 1340808 - protein, 5 aa, Mycobacterium
AGYQA

SEQ ID NO: 1340809 - protein, 8 aa, Mycobacterium
AGYSPTVG

SEQ ID NO: 1340810 - protein, 12 aa, Mycobacterium
AHAAARGGPVLL

SEQ ID NO: 1340811 - protein, 27 aa, Mycobacterium
AHADPEPSPPPAPPAPASTIDKDGTYK

SEQ ID NO: 1340812 - protein, 12 aa, Mycobacterium
AHAETQDEKFTN

SEQ ID NO: 1340813 - protein, 6 aa, Mycobacterium
AHDADG

SEQ ID NO: 1340814 - protein, 5 aa, Mycobacterium
AHGFD

SEQ ID NO: 1340815 - protein, 15 aa, Mycobacterium
AHNTTPDIGQGGCSA

SEQ ID NO: 1340816 - protein, 9 aa, Mycobacterium
AHPGANQAV

SEQ ID NO: 1340817 - protein, 7 aa, Mycobacterium
AHPGSKS

SEQ ID NO: 1340818 - protein, 8 aa, Mycobacterium
AHPGTSAV

SEQ ID NO: 1340819 - protein, 7 aa, Mycobacterium
AHPNPAF

SEQ ID NO: 1340820 - protein, 4 aa, Mycobacterium
AHRA

SEQ ID NO: 1340821 - protein, 12 aa, Mycobacterium
AHSAGPDETASL

SEQ ID NO: 1340822 - protein, 5 aa, Mycobacterium
AHSAP

SEQ ID NO: 1340823 - protein, 11 aa, Mycobacterium
AHSPDPPSPDD

SEQ ID NO: 1340824 - protein, 5 aa, Mycobacterium
AHTDS

SEQ ID NO: 1340825 - protein, 9 aa, Mycobacterium
AHTGGGNRL

SEQ ID NO: 1340826 - protein, 10 aa, Mycobacterium
AHTNSATASL

SEQ ID NO: 1340827 - protein, 7 aa, Mycobacterium
AIADGDS

SEQ ID NO: 1340828 - protein, 9 aa, Mycobacterium
AIASDGADA

SEQ ID NO: 1340829 - protein, 11 aa, Mycobacterium
AIDDPDAPSLR

SEQ ID NO: 1340830 - protein, 6 aa, Mycobacterium
AIGPGR

SEQ ID NO: 1340831 - protein, 9 aa, Mycobacterium
AINAGSSNR

SEQ ID NO: 1340832 - protein, 7 aa, Mycobacterium
AINNDGS

SEQ ID NO: 1340833 - protein, 10 aa, Mycobacterium
AIPDQGTPEF

SEQ ID NO: 1340834 - protein, 5 aa, Mycobacterium
AIPQE

SEQ ID NO: 1340835 - protein, 17 aa, Mycobacterium
AITDELNTSYSSIDQTV

SEQ ID NO: 1340836 - protein, 7 aa, Mycobacterium
AITDQGA

SEQ ID NO: 1340837 - protein, 9 aa, Mycobacterium
AITGTASGL

SEQ ID NO: 1340838 - protein, 25 aa, Mycobacterium
AITPATQTTTGTMSGIDEDGNPVDI

SEQ ID NO: 1340839 - protein, 6 aa, Mycobacterium
AKAEGE

SEQ ID NO: 1340840 - protein, 10 aa, Mycobacterium
AKDASGAKNV

SEQ ID NO: 1340841 - protein, 6 aa, Mycobacterium
AKDGRA

SEQ ID NO: 1340842 - protein, 8 aa, Mycobacterium
AKDPQVTS

SEQ ID NO: 1340843 - protein, 9 aa, Mycobacterium
AKDQSDEAK

SEQ ID NO: 1340844 - protein, 7 aa, Mycobacterium
AKEAELK

SEQ ID NO: 1340845 - protein, 9 aa, Mycobacterium
AKGTPNPPA

SEQ ID NO: 1340846 - protein, 6 aa, Mycobacterium
AKKSNV

SEQ ID NO: 1340847 - protein, 6 aa, Mycobacterium
AKLGED

SEQ ID NO: 1340848 - protein, 7 aa, Mycobacterium
AKLGEDV

SEQ ID NO: 1340849 - protein, 6 aa, Mycobacterium
AKNAAL

SEQ ID NO: 1340850 - protein, 8 aa, Mycobacterium
AKPEGAQA

SEQ ID NO: 1340851 - protein, 23 aa, Mycobacterium
AKPGEFGPPAAPTPQPREHGTSQ

SEQ ID NO: 1340852 - protein, 16 aa, Mycobacterium
AKPGTEVPPVSNGGTW

SEQ ID NO: 1340853 - protein, 8 aa, Mycobacterium
AKPKTTQR

SEQ ID NO: 1340854 - protein, 8 aa, Mycobacterium
AKPQRVDG

SEQ ID NO: 1340855 - protein, 6 aa, Mycobacterium
AKPVGL

SEQ ID NO: 1340856 - protein, 13 aa, Mycobacterium
AKSELGRQIAGGT

SEQ ID NO: 1340857 - protein, 13 aa, Mycobacterium
ALAESAGAAAGHT

SEQ ID NO: 1340858 - protein, 98 aa, Mycobacterium
ALAGAGAAAAETESDGSGPSPAASNSEPADPGPAADAPADDTTPQDAEPEPEPGPEDEDLDEGLEEELGDEVEEVGEVEEELGEDPVENDPTEEPVDE

SEQ ID NO: 1340859 - protein, 25 aa, Mycobacterium
ALAGGRPSAAKTGTNQLGDTDANRD

SEQ ID NO: 1340860 - protein, 10 aa, Mycobacterium
ALAPPAAAAP

SEQ ID NO: 1340861 - protein, 10 aa, Mycobacterium
ALAPTAAAAP

SEQ ID NO: 1340862 - protein, 9 aa, Mycobacterium
ALASGEQGL

SEQ ID NO: 1340863 - protein, 7 aa, Mycobacterium
ALATGDT

SEQ ID NO: 1340864 - protein, 7 aa, Mycobacterium
ALDATGL

SEQ ID NO: 1340865 - protein, 8 aa, Mycobacterium
ALDGSEPI

SEQ ID NO: 1340866 - protein, 4 aa, Mycobacterium
ALDP

SEQ ID NO: 1340867 - protein, 6 aa, Mycobacterium
ALEDGD

SEQ ID NO: 1340868 - protein, 18 aa, Mycobacterium
ALEDTDNESFPKPEEIGG

SEQ ID NO: 1340869 - protein, 10 aa, Mycobacterium
ALGAGTAAEQ

SEQ ID NO: 1340870 - protein, 9 aa, Mycobacterium
ALGDNSTNI

SEQ ID NO: 1340871 - protein, 5 aa, Mycobacterium
ALGDP

SEQ ID NO: 1340872 - protein, 7 aa, Mycobacterium
ALGEQTQ

SEQ ID NO: 1340873 - protein, 7 aa, Mycobacterium
ALGPDSP

SEQ ID NO: 1340874 - protein, 12 aa, Mycobacterium
ALGRGGPDVSRS

SEQ ID NO: 1340875 - protein, 6 aa, Mycobacterium
ALKAAD

SEQ ID NO: 1340876 - protein, 7 aa, Mycobacterium
ALNPSEG

SEQ ID NO: 1340877 - protein, 16 aa, Mycobacterium
ALPAGGTIPVTRTQPA

SEQ ID NO: 1340878 - protein, 6 aa, Mycobacterium
ALPDGR

SEQ ID NO: 1340879 - protein, 11 aa, Mycobacterium
ALPDLSGHTGN

SEQ ID NO: 1340880 - protein, 18 aa, Mycobacterium
ALPGDPRDTSTPRALGDG

SEQ ID NO: 1340881 - protein, 14 aa, Mycobacterium
ALPPGRPGDPERDD

SEQ ID NO: 1340882 - protein, 7 aa, Mycobacterium
ALPPNTR

SEQ ID NO: 1340883 - protein, 15 aa, Mycobacterium
ALPQPQPEPATVPPA

SEQ ID NO: 1340884 - protein, 7 aa, Mycobacterium
ALPSTPA

SEQ ID NO: 1340885 - protein, 8 aa, Mycobacterium
ALQESRDR

SEQ ID NO: 1340886 - protein, 7 aa, Mycobacterium
ALQGYSD

SEQ ID NO: 1340887 - protein, 7 aa, Mycobacterium
ALRPGST

SEQ ID NO: 1340888 - protein, 6 aa, Mycobacterium
ALRQGS

SEQ ID NO: 1340889 - protein, 12 aa, Mycobacterium
ALSASRTPGLAP

SEQ ID NO: 1340890 - protein, 9 aa, Mycobacterium
ALSDPASAR

SEQ ID NO: 1340891 - protein, 18 aa, Mycobacterium
ALSGPGSFAGGKASYVQG

SEQ ID NO: 1340892 - protein, 10 aa, Mycobacterium
ALSKNKGEFD

SEQ ID NO: 1340893 - protein, 10 aa, Mycobacterium
ALSSSSAEAI

SEQ ID NO: 1340894 - protein, 4 aa, Mycobacterium
ALTA

SEQ ID NO: 1340895 - protein, 7 aa, Mycobacterium
ALTAPAT

SEQ ID NO: 1340896 - protein, 5 aa, Mycobacterium
ALTDE

SEQ ID NO: 1340897 - protein, 104 aa, Mycobacterium
ALTGAGSAHADESAADPSSSSASSVSSSEDANESRAVSSGADPDDATEDRDPPESEAPESQADTDDSATAEAAVPEETATETDIVDGGGRRAHPGSDAESRAAA

SEQ ID NO: 1340898 - protein, 6 aa, Mycobacterium
ALTPAP

SEQ ID NO: 1340899 - protein, 8 aa, Mycobacterium
ALTSPTLA

SEQ ID NO: 1340900 - protein, 9 aa, Mycobacterium
AMAQPSPGV

SEQ ID NO: 1340901 - protein, 10 aa, Mycobacterium
AMEPQSSRDF

SEQ ID NO: 1340902 - protein, 21 aa, Mycobacterium
AMGPTGGPTVGANGVTTVTPT

SEQ ID NO: 1340903 - protein, 5 aa, Mycobacterium
AMSRS

SEQ ID NO: 1340904 - protein, 11 aa, Mycobacterium
ANAAAAAGDTP

SEQ ID NO: 1340905 - protein, 8 aa, Mycobacterium
ANAGPSMT

SEQ ID NO: 1340906 - protein, 13 aa, Mycobacterium
ANAMEGNGEKLRE

SEQ ID NO: 1340907 - protein, 6 aa, Mycobacterium
ANDGLA

SEQ ID NO: 1340908 - protein, 4 aa, Mycobacterium
ANDM

SEQ ID NO: 1340909 - protein, 7 aa, Mycobacterium
ANDPTSV

SEQ ID NO: 1340910 - protein, 6 aa, Mycobacterium
ANDPTV

SEQ ID NO: 1340911 - protein, 8 aa, Mycobacterium
ANDSESLR

SEQ ID NO: 1340912 - protein, 5 aa, Mycobacterium
ANGIE

SEQ ID NO: 1340913 - protein, 7 aa, Mycobacterium
ANGSLTG

SEQ ID NO: 1340914 - protein, 5 aa, Mycobacterium
ANHNG

SEQ ID NO: 1340915 - protein, 8 aa, Mycobacterium
ANKRSHEY

SEQ ID NO: 1340916 - protein, 7 aa, Mycobacterium
ANLGPNQ

SEQ ID NO: 1340917 - protein, 7 aa, Mycobacterium
ANNDATL

SEQ ID NO: 1340918 - protein, 18 aa, Mycobacterium
ANNDGDVSADNIDDAALS

SEQ ID NO: 1340919 - protein, 18 aa, Mycobacterium
ANNDGIVSPDNVDDAALS

SEQ ID NO: 1340920 - protein, 18 aa, Mycobacterium
ANNDGVVSPDNVDDAALS

SEQ ID NO: 1340921 - protein, 18 aa, Mycobacterium
ANNGRDNVAYPEPGPSYG

SEQ ID NO: 1340922 - protein, 7 aa, Mycobacterium
ANPAAAT

SEQ ID NO: 1340923 - protein, 7 aa, Mycobacterium
ANPADRD

SEQ ID NO: 1340924 - protein, 5 aa, Mycobacterium
ANPAG

SEQ ID NO: 1340925 - protein, 9 aa, Mycobacterium
ANPAQYGNQ

SEQ ID NO: 1340926 - protein, 4 aa, Mycobacterium
ANPL

SEQ ID NO: 1340927 - protein, 8 aa, Mycobacterium
ANPNIGPN

SEQ ID NO: 1340928 - protein, 14 aa, Mycobacterium
ANPNYWDGPPGVSG

SEQ ID NO: 1340929 - protein, 8 aa, Mycobacterium
ANPQTDQA

SEQ ID NO: 1340930 - protein, 6 aa, Mycobacterium
ANPQVA

SEQ ID NO: 1340931 - protein, 9 aa, Mycobacterium
ANPTPTVRP

SEQ ID NO: 1340932 - protein, 7 aa, Mycobacterium
ANQGGSP

SEQ ID NO: 1340933 - protein, 7 aa, Mycobacterium
ANQYAQS

SEQ ID NO: 1340934 - protein, 8 aa, Mycobacterium
ANRDAASS

SEQ ID NO: 1340935 - protein, 7 aa, Mycobacterium
ANRDPDV

SEQ ID NO: 1340936 - protein, 19 aa, Mycobacterium
ANRPHSAHGELTPGASRGV

SEQ ID NO: 1340937 - protein, 7 aa, Mycobacterium
ANRPRTR

SEQ ID NO: 1340938 - protein, 10 aa, Mycobacterium
ANSAPAGQAC

SEQ ID NO: 1340939 - protein, 8 aa, Mycobacterium
ANSATPDA

SEQ ID NO: 1340940 - protein, 5 aa, Mycobacterium
ANSDG

SEQ ID NO: 1340941 - protein, 7 aa, Mycobacterium
ANSDKFS

SEQ ID NO: 1340942 - protein, 5 aa, Mycobacterium
ANSPV

SEQ ID NO: 1340943 - protein, 27 aa, Mycobacterium
ANSQPAPDCSASNVAGTVSSVAASEGA

SEQ ID NO: 1340944 - protein, 5 aa, Mycobacterium
ANTRG

SEQ ID NO: 1340945 - protein, 8 aa, Mycobacterium
ANTSPRSN

SEQ ID NO: 1340946 - protein, 11 aa, Mycobacterium
ANTVRNGQQAA

SEQ ID NO: 1340947 - protein, 19 aa, Mycobacterium
ANVAPTATAGVQNPDAATG

SEQ ID NO: 1340948 - protein, 11 aa, Mycobacterium
ANVNSAQPTLL

SEQ ID NO: 1340949 - protein, 5 aa, Mycobacterium
ANVPV

SEQ ID NO: 1340950 - protein, 19 aa, Mycobacterium
ANYGPAGIGDINYSAIGFM

SEQ ID NO: 1340951 - protein, 7 aa, Mycobacterium
APAAADD

SEQ ID NO: 1340952 - protein, 12 aa, Mycobacterium
APAAADPDTAFT

SEQ ID NO: 1340953 - protein, 29 aa, Mycobacterium
APAAADPNTVPAAPPEQSEPPISTDPAAG

SEQ ID NO: 1340954 - protein, 5 aa, Mycobacterium
APAAG

SEQ ID NO: 1340955 - protein, 9 aa, Mycobacterium
APAAGAQSA

SEQ ID NO: 1340956 - protein, 6 aa, Mycobacterium
APAANA

SEQ ID NO: 1340957 - protein, 10 aa, Mycobacterium
APAASADPCP

SEQ ID NO: 1340958 - protein, 21 aa, Mycobacterium
APADGSGTGTLAEGSQIPIER

SEQ ID NO: 1340959 - protein, 12 aa, Mycobacterium
APADTTDPRGLS

SEQ ID NO: 1340960 - protein, 10 aa, Mycobacterium
APAGAGKTTA

SEQ ID NO: 1340961 - protein, 5 aa, Mycobacterium
APAIS

SEQ ID NO: 1340962 - protein, 10 aa, Mycobacterium
APAKTGRTAR

SEQ ID NO: 1340963 - protein, 6 aa, Mycobacterium
APALGA

SEQ ID NO: 1340964 - protein, 6 aa, Mycobacterium
APAPLR

SEQ ID NO: 1340965 - protein, 14 aa, Mycobacterium
APAPPPGAPAPEAP

SEQ ID NO: 1340966 - protein, 24 aa, Mycobacterium
APAQAAPAGPGNAQDTINSLEDRG

SEQ ID NO: 1340967 - protein, 15 aa, Mycobacterium
APASAQPESGQWDPT

SEQ ID NO: 1340968 - protein, 22 aa, Mycobacterium
APASGPGPARLTDDGVADVEPA

SEQ ID NO: 1340969 - protein, 13 aa, Mycobacterium
APASNTGEEARPR

SEQ ID NO: 1340970 - protein, 9 aa, Mycobacterium
APASPGADL

SEQ ID NO: 1340971 - protein, 5 aa, Mycobacterium
APATA

SEQ ID NO: 1340972 - protein, 26 aa, Mycobacterium
APATAGATPPEGDVERTELGQGTTNA

SEQ ID NO: 1340973 - protein, 6 aa, Mycobacterium
APATEA

SEQ ID NO: 1340974 - protein, 14 aa, Mycobacterium
APATSSAAPADPIA

SEQ ID NO: 1340975 - protein, 4 aa, Mycobacterium
APAV

SEQ ID NO: 1340976 - protein, 12 aa, Mycobacterium
APAVNPSNLNAQ

SEQ ID NO: 1340977 - protein, 4 aa, Mycobacterium
APDA

SEQ ID NO: 1340978 - protein, 19 aa, Mycobacterium
APDAGETTSQQYADYPTPP

SEQ ID NO: 1340979 - protein, 8 aa, Mycobacterium
APDAGGTM

SEQ ID NO: 1340980 - protein, 4 aa, Mycobacterium
APDG

SEQ ID NO: 1340981 - protein, 7 aa, Mycobacterium
APDGAQD

SEQ ID NO: 1340982 - protein, 8 aa, Mycobacterium
APDGPEDL

SEQ ID NO: 1340983 - protein, 8 aa, Mycobacterium
APDPAPEL

SEQ ID NO: 1340984 - protein, 8 aa, Mycobacterium
APDTGAPR

SEQ ID NO: 1340985 - protein, 13 aa, Mycobacterium
APDTQSAAAVPPS

SEQ ID NO: 1340986 - protein, 15 aa, Mycobacterium
APFDTGQRAATSGID

SEQ ID NO: 1340987 - protein, 4 aa, Mycobacterium
APFN

SEQ ID NO: 1340988 - protein, 6 aa, Mycobacterium
APFPGS

SEQ ID NO: 1340989 - protein, 6 aa, Mycobacterium
APGARC

SEQ ID NO: 1340990 - protein, 22 aa, Mycobacterium
APGASAQPTTQAEEPPAPRISP

SEQ ID NO: 1340991 - protein, 8 aa, Mycobacterium
APGDPGGL

SEQ ID NO: 1340992 - protein, 21 aa, Mycobacterium
APGESRYDADEQRLAAKPPIE

SEQ ID NO: 1340993 - protein, 8 aa, Mycobacterium
APGHTPGS

SEQ ID NO: 1340994 - protein, 7 aa, Mycobacterium
APGPAGY

SEQ ID NO: 1340995 - protein, 11 aa, Mycobacterium
APGPPSDLPGD

SEQ ID NO: 1340996 - protein, 7 aa, Mycobacterium
APGPQTV

SEQ ID NO: 1340997 - protein, 25 aa, Mycobacterium
APGQGSVKVNSDGTFTYTPGSDFDG

SEQ ID NO: 1340998 - protein, 8 aa, Mycobacterium
APGQTTKA

SEQ ID NO: 1340999 - protein, 7 aa, Mycobacterium
APGRSGR

SEQ ID NO: 1341000 - protein, 4 aa, Mycobacterium
APGT

SEQ ID NO: 1341001 - protein, 65 aa, Mycobacterium
APGTAFAETGEPTSQTPPDDSPKPAAEQDDPGQEQAEERAEEQAEEPDPEALEGLPDDDGDEPVV

SEQ ID NO: 1341002 - protein, 12 aa, Mycobacterium
APGVARADPPAL

SEQ ID NO: 1341003 - protein, 10 aa, Mycobacterium
APGVTPASLS

SEQ ID NO: 1341004 - protein, 15 aa, Mycobacterium
APGVTPPDPAAAEAD

SEQ ID NO: 1341005 - protein, 15 aa, Mycobacterium
APGVTPPDPAKAQED

SEQ ID NO: 1341006 - protein, 6 aa, Mycobacterium
APHGAG

SEQ ID NO: 1341007 - protein, 6 aa, Mycobacterium
APHPGT

SEQ ID NO: 1341008 - protein, 11 aa, Mycobacterium
APIAGPASVQS

SEQ ID NO: 1341009 - protein, 11 aa, Mycobacterium
APIGADEPPVR

SEQ ID NO: 1341010 - protein, 13 aa, Mycobacterium
APISAADGLDPAK

SEQ ID NO: 1341011 - protein, 11 aa, Mycobacterium
APKDAAPEGRL

SEQ ID NO: 1341012 - protein, 11 aa, Mycobacterium
APKDAPAGVAP

SEQ ID NO: 1341013 - protein, 8 aa, Mycobacterium
APKENAEN

SEQ ID NO: 1341014 - protein, 13 aa, Mycobacterium
APLAEADADQTIR

SEQ ID NO: 1341015 - protein, 11 aa, Mycobacterium
APLTQGPSGEE

SEQ ID NO: 1341016 - protein, 6 aa, Mycobacterium
APLTTP

SEQ ID NO: 1341017 - protein, 12 aa, Mycobacterium
APMPPEPGPGSL

SEQ ID NO: 1341018 - protein, 11 aa, Mycobacterium
APNEFKDESGK

SEQ ID NO: 1341019 - protein, 25 aa, Mycobacterium
APNETRNLPGFEGADKGEPSNLGGF

SEQ ID NO: 1341020 - protein, 7 aa, Mycobacterium
APNTDVG

SEQ ID NO: 1341021 - protein, 4 aa, Mycobacterium
APPA

SEQ ID NO: 1341022 - protein, 8 aa, Mycobacterium
APPAIAQP

SEQ ID NO: 1341023 - protein, 11 aa, Mycobacterium
APPAPSRETVS

SEQ ID NO: 1341024 - protein, 13 aa, Mycobacterium
APPASAQANCQEA

SEQ ID NO: 1341025 - protein, 7 aa, Mycobacterium
APPDPRD

SEQ ID NO: 1341026 - protein, 14 aa, Mycobacterium
APPEPTDGPLPSPP

SEQ ID NO: 1341027 - protein, 11 aa, Mycobacterium
APPGISDQDRA

SEQ ID NO: 1341028 - protein, 6 aa, Mycobacterium
APPGYV

SEQ ID NO: 1341029 - protein, 5 aa, Mycobacterium
APPHR

SEQ ID NO: 1341030 - protein, 11 aa, Mycobacterium
APPKSTGTAAT

SEQ ID NO: 1341031 - protein, 19 aa, Mycobacterium
APPLPDAARAATSSVTTSD

SEQ ID NO: 1341032 - protein, 12 aa, Mycobacterium
APPLPDAKVPTL

SEQ ID NO: 1341033 - protein, 10 aa, Mycobacterium
APPNPTGELK

SEQ ID NO: 1341034 - protein, 7 aa, Mycobacterium
APPPPGH

SEQ ID NO: 1341035 - protein, 13 aa, Mycobacterium
APPPRPAQAEGAW

SEQ ID NO: 1341036 - protein, 11 aa, Mycobacterium
APPQDEPEIGK

SEQ ID NO: 1341037 - protein, 13 aa, Mycobacterium
APPRTPDAPSESP

SEQ ID NO: 1341038 - protein, 4 aa, Mycobacterium
APPT

SEQ ID NO: 1341039 - protein, 14 aa, Mycobacterium
APPTDEAPQGRLKE

SEQ ID NO: 1341040 - protein, 5 aa, Mycobacterium
APPVA

SEQ ID NO: 1341041 - protein, 131 aa, Mycobacterium
APQDETAVDETTDEADQEQPAAEVPDETPAAEVPDEAPDAEDEGKTETGAPAETKPEAGVDEAEDKPDTVETEDKVTETDDAEKPSTGGKHRKADGADASTASQDGGAESKSDTDSNKESAGASSGGADSG

SEQ ID NO: 1341042 - protein, 6 aa, Mycobacterium
APRAGD

SEQ ID NO: 1341043 - protein, 19 aa, Mycobacterium
APRAGSPRGQEVSAAGPVP

SEQ ID NO: 1341044 - protein, 19 aa, Mycobacterium
APRGSSAVTGPETHEENRH

SEQ ID NO: 1341045 - protein, 11 aa, Mycobacterium
APRMAERGGGA

SEQ ID NO: 1341046 - protein, 6 aa, Mycobacterium
APRPGQ

SEQ ID NO: 1341047 - protein, 4 aa, Mycobacterium
APRT

SEQ ID NO: 1341048 - protein, 12 aa, Mycobacterium
APSADDRSGPSV

SEQ ID NO: 1341049 - protein, 9 aa, Mycobacterium
APSARGAPR

SEQ ID NO: 1341050 - protein, 33 aa, Mycobacterium
APSASADPAAPAPAPLPVPGPAVPDSAPLPAPV

SEQ ID NO: 1341051 - protein, 4 aa, Mycobacterium
APSC

SEQ ID NO: 1341052 - protein, 77 aa, Mycobacterium
APSEDVESRTPEPASDEAETREESAAPESEATEPEISASQSEESEVETETTEETTTAGTTGDDDTDETDDGAAVKEA

SEQ ID NO: 1341053 - protein, 29 aa, Mycobacterium
APSEGPEDSVAAQQKPPGTPTAAPETVRT

SEQ ID NO: 1341054 - protein, 9 aa, Mycobacterium
APSGAPGFA

SEQ ID NO: 1341055 - protein, 31 aa, Mycobacterium
APSHADPAEPGGDTLVGPSASGTEPSSAPFD

SEQ ID NO: 1341056 - protein, 6 aa, Mycobacterium
APSNIT

SEQ ID NO: 1341057 - protein, 9 aa, Mycobacterium
APSPGATSS

SEQ ID NO: 1341058 - protein, 6 aa, Mycobacterium
APSTQA

SEQ ID NO: 1341059 - protein, 4 aa, Mycobacterium
APSV

SEQ ID NO: 1341060 - protein, 6 aa, Mycobacterium
APSYDP

SEQ ID NO: 1341061 - protein, 13 aa, Mycobacterium
APTAAAAPECTDV

SEQ ID NO: 1341062 - protein, 7 aa, Mycobacterium
APTAAAD

SEQ ID NO: 1341063 - protein, 22 aa, Mycobacterium
APTAPAEPGPMYPDNPGRYATD

SEQ ID NO: 1341064 - protein, 7 aa, Mycobacterium
APTASAA

SEQ ID NO: 1341065 - protein, 12 aa, Mycobacterium
APTGHTYTTYPG

SEQ ID NO: 1341066 - protein, 20 aa, Mycobacterium
APTGRDDDDVAPVGPGDADL

SEQ ID NO: 1341067 - protein, 6 aa, Mycobacterium
APTHGT

SEQ ID NO: 1341068 - protein, 12 aa, Mycobacterium
APTISASPDGTQ

SEQ ID NO: 1341069 - protein, 15 aa, Mycobacterium
APTKGTVTVDASGNF

SEQ ID NO: 1341070 - protein, 9 aa, Mycobacterium
APTPNWQRG

SEQ ID NO: 1341071 - protein, 13 aa, Mycobacterium
APTRPVTAPLDGP

SEQ ID NO: 1341072 - protein, 9 aa, Mycobacterium
APTTQTVNG

SEQ ID NO: 1341073 - protein, 9 aa, Mycobacterium
APTTSGPAL

SEQ ID NO: 1341074 - protein, 14 aa, Mycobacterium
APTVSSGPEARIPG

SEQ ID NO: 1341075 - protein, 11 aa, Mycobacterium
APVDSSSTTTV

SEQ ID NO: 1341076 - protein, 12 aa, Mycobacterium
APVGADDASARI

SEQ ID NO: 1341077 - protein, 38 aa, Mycobacterium
APVGSGNVTVNSRGSFTYTPSAAARHAAAATSGEDRDT

SEQ ID NO: 1341078 - protein, 6 aa, Mycobacterium
APVGSQ

SEQ ID NO: 1341079 - protein, 13 aa, Mycobacterium
APVSGGIKGATAG

SEQ ID NO: 1341080 - protein, 18 aa, Mycobacterium
APVTEETPAKTTTARPDA

SEQ ID NO: 1341081 - protein, 4 aa, Mycobacterium
APYT

SEQ ID NO: 1341082 - protein, 7 aa, Mycobacterium
APYTGSQ

SEQ ID NO: 1341083 - protein, 5 aa, Mycobacterium
AQAAA

SEQ ID NO: 1341084 - protein, 20 aa, Mycobacterium
AQAANDVAGASLTQAVTLTF

SEQ ID NO: 1341085 - protein, 4 aa, Mycobacterium
AQAC

SEQ ID NO: 1341086 - protein, 64 aa, Mycobacterium
AQADPPSPRPDNPGNSDNPGNSGNAGGNGNAGNAGGNGNPGPRPDTVTGPGVNAGDPGTPLPPG

SEQ ID NO: 1341087 - protein, 4 aa, Mycobacterium
AQAL

SEQ ID NO: 1341088 - protein, 13 aa, Mycobacterium
AQAPSSFRVTPGQ

SEQ ID NO: 1341089 - protein, 10 aa, Mycobacterium
AQAQDPVCPE

SEQ ID NO: 1341090 - protein, 16 aa, Mycobacterium
AQAQSPAGGASSSVND

SEQ ID NO: 1341091 - protein, 10 aa, Mycobacterium
AQASQPASNV

SEQ ID NO: 1341092 - protein, 33 aa, Mycobacterium
AQAVQTREAVTAAQRDADARLAEQTAAEDRHRA

SEQ ID NO: 1341093 - protein, 8 aa, Mycobacterium
AQCPTAAA

SEQ ID NO: 1341094 - protein, 8 aa, Mycobacterium
AQDAAAMG

SEQ ID NO: 1341095 - protein, 5 aa, Mycobacterium
AQDDQ

SEQ ID NO: 1341096 - protein, 7 aa, Mycobacterium
AQDDYNG

SEQ ID NO: 1341097 - protein, 6 aa, Mycobacterium
AQEDYN

SEQ ID NO: 1341098 - protein, 6 aa, Mycobacterium
AQGALS

SEQ ID NO: 1341099 - protein, 6 aa, Mycobacterium
AQGAVS

SEQ ID NO: 1341100 - protein, 4 aa, Mycobacterium
AQGC

SEQ ID NO: 1341101 - protein, 7 aa, Mycobacterium
AQGDGST

SEQ ID NO: 1341102 - protein, 5 aa, Mycobacterium
AQGDS

SEQ ID NO: 1341103 - protein, 12 aa, Mycobacterium
AQGHYSNDTDSR

SEQ ID NO: 1341104 - protein, 13 aa, Mycobacterium
AQGNCPPLKASAA

SEQ ID NO: 1341105 - protein, 6 aa, Mycobacterium
AQGRGY

SEQ ID NO: 1341106 - protein, 12 aa, Mycobacterium
AQHDPDARPGMS

SEQ ID NO: 1341107 - protein, 5 aa, Mycobacterium
AQHQP

SEQ ID NO: 1341108 - protein, 12 aa, Mycobacterium
AQLADGGTLAAL

SEQ ID NO: 1341109 - protein, 10 aa, Mycobacterium
AQLEGGNRAL

SEQ ID NO: 1341110 - protein, 6 aa, Mycobacterium
AQLGSA

SEQ ID NO: 1341111 - protein, 11 aa, Mycobacterium
AQLPSPDRDLT

SEQ ID NO: 1341112 - protein, 12 aa, Mycobacterium
AQNGTKYSRDGN

SEQ ID NO: 1341113 - protein, 8 aa, Mycobacterium
AQNQDGQT

SEQ ID NO: 1341114 - protein, 16 aa, Mycobacterium
AQPAPEPGSPPAVDGV

SEQ ID NO: 1341115 - protein, 79 aa, Mycobacterium
AQPAPPPSPAPPPAVEAPPVPPPPVDPNAPVPPPPVDPNAPVPPPPPVDPNAPVPPPADPNAPVPPAPEPGRIDNAAGG

SEQ ID NO: 1341116 - protein, 8 aa, Mycobacterium
AQPAQADG

SEQ ID NO: 1341117 - protein, 6 aa, Mycobacterium
AQPAYG

SEQ ID NO: 1341118 - protein, 14 aa, Mycobacterium
AQPDVSAGTVTAPF

SEQ ID NO: 1341119 - protein, 18 aa, Mycobacterium
AQPHPASAPQQPSPAAQA

SEQ ID NO: 1341120 - protein, 5 aa, Mycobacterium
AQPMA

SEQ ID NO: 1341121 - protein, 7 aa, Mycobacterium
AQPPFPD

SEQ ID NO: 1341122 - protein, 15 aa, Mycobacterium
AQPPGPATAATERIA

SEQ ID NO: 1341123 - protein, 8 aa, Mycobacterium
AQPSPAIP

SEQ ID NO: 1341124 - protein, 17 aa, Mycobacterium
AQPSPRRLAATSSPEQV

SEQ ID NO: 1341125 - protein, 7 aa, Mycobacterium
AQPSYGW

SEQ ID NO: 1341126 - protein, 8 aa, Mycobacterium
AQQQRSPV

SEQ ID NO: 1341127 - protein, 23 aa, Mycobacterium
AQQSGAAQPAAPAAASPAAATGH

SEQ ID NO: 1341128 - protein, 6 aa, Mycobacterium
AQQTGV

SEQ ID NO: 1341129 - protein, 13 aa, Mycobacterium
AQRGALETRSADL

SEQ ID NO: 1341130 - protein, 7 aa, Mycobacterium
AQRKGAS

SEQ ID NO: 1341131 - protein, 5 aa, Mycobacterium
AQRRG

SEQ ID NO: 1341132 - protein, 9 aa, Mycobacterium
AQRSAHAEA

SEQ ID NO: 1341133 - protein, 11 aa, Mycobacterium
AQRSVSANQAA

SEQ ID NO: 1341134 - protein, 6 aa, Mycobacterium
AQRTAD

SEQ ID NO: 1341135 - protein, 28 aa, Mycobacterium
AQSGQTDEPAPATSSAPPAAVSPEEARA

SEQ ID NO: 1341136 - protein, 5 aa, Mycobacterium
AQSPV

SEQ ID NO: 1341137 - protein, 7 aa, Mycobacterium
AQSPYPT

SEQ ID NO: 1341138 - protein, 9 aa, Mycobacterium
AQSRTGKAV

SEQ ID NO: 1341139 - protein, 17 aa, Mycobacterium
AQSSGPAPAPASQTTAR

SEQ ID NO: 1341140 - protein, 8 aa, Mycobacterium
AQSTQRQS

SEQ ID NO: 1341141 - protein, 5 aa, Mycobacterium
AQTDD

SEQ ID NO: 1341142 - protein, 24 aa, Mycobacterium
AQTEAENAQADQAGPLANARAQKD

SEQ ID NO: 1341143 - protein, 18 aa, Mycobacterium
AQTPGERLGSARDRAVAE

SEQ ID NO: 1341144 - protein, 6 aa, Mycobacterium
AQVAPA

SEQ ID NO: 1341145 - protein, 9 aa, Mycobacterium
AQVDAGPLR

SEQ ID NO: 1341146 - protein, 7 aa, Mycobacterium
AQVGESL

SEQ ID NO: 1341147 - protein, 8 aa, Mycobacterium
AQVGPDQQ

SEQ ID NO: 1341148 - protein, 20 aa, Mycobacterium
AQVNEDTENAQRACAEAGTR

SEQ ID NO: 1341149 - protein, 7 aa, Mycobacterium
AQVPQGS

SEQ ID NO: 1341150 - protein, 8 aa, Mycobacterium
ARAAAAER

SEQ ID NO: 1341151 - protein, 25 aa, Mycobacterium
ARAALTSATGGKSIAERSAAEKQLD

SEQ ID NO: 1341152 - protein, 5 aa, Mycobacterium
ARAEE

SEQ ID NO: 1341153 - protein, 9 aa, Mycobacterium
ARAEGQRQA

SEQ ID NO: 1341154 - protein, 8 aa, Mycobacterium
ARAENGDT

SEQ ID NO: 1341155 - protein, 33 aa, Mycobacterium
ARAGGAPTPARDGSDRAPHAVDRRPGKRDAPHA

SEQ ID NO: 1341156 - protein, 7 aa, Mycobacterium
ARAGRPW

SEQ ID NO: 1341157 - protein, 5 aa, Mycobacterium
ARAHG

SEQ ID NO: 1341158 - protein, 10 aa, Mycobacterium
ARAKDDPALA

SEQ ID NO: 1341159 - protein, 9 aa, Mycobacterium
ARANESHTR

SEQ ID NO: 1341160 - protein, 9 aa, Mycobacterium
ARARNGDTY

SEQ ID NO: 1341161 - protein, 6 aa, Mycobacterium
ARARTA

SEQ ID NO: 1341162 - protein, 26 aa, Mycobacterium
ARATESRPAAEPVPSLKPAAAVPDSL

SEQ ID NO: 1341163 - protein, 4 aa, Mycobacterium
ARAW

SEQ ID NO: 1341164 - protein, 5 aa, Mycobacterium
ARCTA

SEQ ID NO: 1341165 - protein, 10 aa, Mycobacterium
ARDDNSGWDI

SEQ ID NO: 1341166 - protein, 5 aa, Mycobacterium
ARDRD

SEQ ID NO: 1341167 - protein, 21 aa, Mycobacterium
ARDSATFSSRDPLQEASSAPS

SEQ ID NO: 1341168 - protein, 5 aa, Mycobacterium
ARDTG

SEQ ID NO: 1341169 - protein, 6 aa, Mycobacterium
ARDTGA

SEQ ID NO: 1341170 - protein, 6 aa, Mycobacterium
ARDTSP

SEQ ID NO: 1341171 - protein, 4 aa, Mycobacterium
AREA

SEQ ID NO: 1341172 - protein, 14 aa, Mycobacterium
AREFSTSEPDAADT

SEQ ID NO: 1341173 - protein, 5 aa, Mycobacterium
AREPW

SEQ ID NO: 1341174 - protein, 16 aa, Mycobacterium
ARETDDRSAASAARAA

SEQ ID NO: 1341175 - protein, 6 aa, Mycobacterium
ARETGA

SEQ ID NO: 1341176 - protein, 6 aa, Mycobacterium
ARETRL

SEQ ID NO: 1341177 - protein, 7 aa, Mycobacterium
ARGEDNR

SEQ ID NO: 1341178 - protein, 17 aa, Mycobacterium
ARGEPGRGPSGREPEAE

SEQ ID NO: 1341179 - protein, 8 aa, Mycobacterium
ARGETPNP

SEQ ID NO: 1341180 - protein, 5 aa, Mycobacterium
ARGGE

SEQ ID NO: 1341181 - protein, 12 aa, Mycobacterium
ARGGLDDAADAA

SEQ ID NO: 1341182 - protein, 8 aa, Mycobacterium
ARGIPPSA

SEQ ID NO: 1341183 - protein, 9 aa, Mycobacterium
ARGKEGTEV

SEQ ID NO: 1341184 - protein, 4 aa, Mycobacterium
ARGL

SEQ ID NO: 1341185 - protein, 9 aa, Mycobacterium
ARGLATSGD

SEQ ID NO: 1341186 - protein, 5 aa, Mycobacterium
ARGQI

SEQ ID NO: 1341187 - protein, 4 aa, Mycobacterium
ARGY

SEQ ID NO: 1341188 - protein, 12 aa, Mycobacterium
ARHPGSAPAPSV

SEQ ID NO: 1341189 - protein, 15 aa, Mycobacterium
ARHQASAEDATPDEL

SEQ ID NO: 1341190 - protein, 9 aa, Mycobacterium
ARHSGTGHE

SEQ ID NO: 1341191 - protein, 5 aa, Mycobacterium
ARITP

SEQ ID NO: 1341192 - protein, 13 aa, Mycobacterium
ARMATEEAAEAGA

SEQ ID NO: 1341193 - protein, 14 aa, Mycobacterium
ARMATEEAAEAGAD

SEQ ID NO: 1341194 - protein, 9 aa, Mycobacterium
ARPANPVNP

SEQ ID NO: 1341195 - protein, 9 aa, Mycobacterium
ARPAPGLPE

SEQ ID NO: 1341196 - protein, 8 aa, Mycobacterium
ARPASGWA

SEQ ID NO: 1341197 - protein, 7 aa, Mycobacterium
ARPNEIT

SEQ ID NO: 1341198 - protein, 17 aa, Mycobacterium
ARPNEVTYSEDRLRPGH

SEQ ID NO: 1341199 - protein, 17 aa, Mycobacterium
ARPPGEAQLPGPGGAAS

SEQ ID NO: 1341200 - protein, 7 aa, Mycobacterium
ARPPLAK

SEQ ID NO: 1341201 - protein, 33 aa, Mycobacterium
ARPRDTTPAPDAGTALPTDSDLDTPGAVRSQAY

SEQ ID NO: 1341202 - protein, 7 aa, Mycobacterium
ARPTFGR

SEQ ID NO: 1341203 - protein, 6 aa, Mycobacterium
ARPTVD

SEQ ID NO: 1341204 - protein, 8 aa, Mycobacterium
ARQDGFPG

SEQ ID NO: 1341205 - protein, 6 aa, Mycobacterium
ARQGAK

SEQ ID NO: 1341206 - protein, 12 aa, Mycobacterium
ARQGNGPGGASV

SEQ ID NO: 1341207 - protein, 4 aa, Mycobacterium
ARQR

SEQ ID NO: 1341208 - protein, 20 aa, Mycobacterium
ARQTAELPQAADPAAAQRRA

SEQ ID NO: 1341209 - protein, 8 aa, Mycobacterium
ARRDPSTT

SEQ ID NO: 1341210 - protein, 19 aa, Mycobacterium
ARRDTTGAACSATAAAGSG

SEQ ID NO: 1341211 - protein, 7 aa, Mycobacterium
ARRQQKA

SEQ ID NO: 1341212 - protein, 4 aa, Mycobacterium
ARRT

SEQ ID NO: 1341213 - protein, 6 aa, Mycobacterium
ARRTGP

SEQ ID NO: 1341214 - protein, 6 aa, Mycobacterium
ARRTSR

SEQ ID NO: 1341215 - protein, 4 aa, Mycobacterium
ARRV

SEQ ID NO: 1341216 - protein, 9 aa, Mycobacterium
ARSDNASIN

SEQ ID NO: 1341217 - protein, 9 aa, Mycobacterium
ARSDNASVN

SEQ ID NO: 1341218 - protein, 8 aa, Mycobacterium
ARSDTIRG

SEQ ID NO: 1341219 - protein, 8 aa, Mycobacterium
ARSGMGSS

SEQ ID NO: 1341220 - protein, 5 aa, Mycobacterium
ARSPL

SEQ ID NO: 1341221 - protein, 8 aa, Mycobacterium
ARTADGGV

SEQ ID NO: 1341222 - protein, 11 aa, Mycobacterium
ARTAGRHWPPE

SEQ ID NO: 1341223 - protein, 7 aa, Mycobacterium
ARTEESL

SEQ ID NO: 1341224 - protein, 6 aa, Mycobacterium
ARTEPG

SEQ ID NO: 1341225 - protein, 33 aa, Mycobacterium
ARTEQANRASTARAAQQRADQAAADAEQSQQAA

SEQ ID NO: 1341226 - protein, 7 aa, Mycobacterium
ARTSAGG

SEQ ID NO: 1341227 - protein, 5 aa, Mycobacterium
ARTSG

SEQ ID NO: 1341228 - protein, 7 aa, Mycobacterium
ARTSPAL

SEQ ID NO: 1341229 - protein, 9 aa, Mycobacterium
ASAAPAPTF

SEQ ID NO: 1341230 - protein, 10 aa, Mycobacterium
ASAAPEVQHN

SEQ ID NO: 1341231 - protein, 186 aa, Mycobacterium
ASAAPGDASNSQDSSAGTGDTGDGGNTVEPGAGTVTSVEDEGSDPDEAPADDTQDDTEDVDDAVDPDGDDPTNDEPANDGAEPVDDESEPEPTEEPDEDTSPDTPADDQEPAEPSQDPATPAPSTESSAPEPEATESSALPESGSADTAEDSADPVTTESPSSTGADASDDGNATAESAVEVDPAQ

SEQ ID NO: 1341232 - protein, 9 aa, Mycobacterium
ASAARGGAV

SEQ ID NO: 1341233 - protein, 5 aa, Mycobacterium
ASAGI

SEQ ID NO: 1341234 - protein, 7 aa, Mycobacterium
ASAGVGA

SEQ ID NO: 1341235 - protein, 5 aa, Mycobacterium
ASAHA

SEQ ID NO: 1341236 - protein, 6 aa, Mycobacterium
ASAHPE

SEQ ID NO: 1341237 - protein, 22 aa, Mycobacterium
ASALTAPPAPSAPAAAAPPSIT

SEQ ID NO: 1341238 - protein, 7 aa, Mycobacterium
ASANQTL

SEQ ID NO: 1341239 - protein, 7 aa, Mycobacterium
ASAPADA

SEQ ID NO: 1341240 - protein, 9 aa, Mycobacterium
ASAPANGGT

SEQ ID NO: 1341241 - protein, 15 aa, Mycobacterium
ASAPGSAGGVDQARY

SEQ ID NO: 1341242 - protein, 23 aa, Mycobacterium
ASAPPPAPAVPTVAPAPQLLGLQ

SEQ ID NO: 1341243 - protein, 9 aa, Mycobacterium
ASAQPGNGP

SEQ ID NO: 1341244 - protein, 16 aa, Mycobacterium
ASAQRVKDANAAIAAA

SEQ ID NO: 1341245 - protein, 7 aa, Mycobacterium
ASASASV

SEQ ID NO: 1341246 - protein, 5 aa, Mycobacterium
ASDAA

SEQ ID NO: 1341247 - protein, 9 aa, Mycobacterium
ASDADGPAH

SEQ ID NO: 1341248 - protein, 24 aa, Mycobacterium
ASDDVASDEVVEDDDDEPSGYSET

SEQ ID NO: 1341249 - protein, 7 aa, Mycobacterium
ASDPGAR

SEQ ID NO: 1341250 - protein, 10 aa, Mycobacterium
ASEPGDDNEH

SEQ ID NO: 1341251 - protein, 4 aa, Mycobacterium
ASEQ

SEQ ID NO: 1341252 - protein, 9 aa, Mycobacterium
ASESAPAVT

SEQ ID NO: 1341253 - protein, 8 aa, Mycobacterium
ASGAGQAA

SEQ ID NO: 1341254 - protein, 5 aa, Mycobacterium
ASGAK

SEQ ID NO: 1341255 - protein, 8 aa, Mycobacterium
ASGDDPGA

SEQ ID NO: 1341256 - protein, 18 aa, Mycobacterium
ASGGFTYTPGAAAAGRAD

SEQ ID NO: 1341257 - protein, 9 aa, Mycobacterium
ASGGPNCRG

SEQ ID NO: 1341258 - protein, 6 aa, Mycobacterium
ASGGVS

SEQ ID NO: 1341259 - protein, 8 aa, Mycobacterium
ASGGVSSL

SEQ ID NO: 1341260 - protein, 4 aa, Mycobacterium
ASGI

SEQ ID NO: 1341261 - protein, 10 aa, Mycobacterium
ASGPTNEAAS

SEQ ID NO: 1341262 - protein, 14 aa, Mycobacterium
ASGQLTDETFPAAE

SEQ ID NO: 1341263 - protein, 5 aa, Mycobacterium
ASGQP

SEQ ID NO: 1341264 - protein, 6 aa, Mycobacterium
ASGRAA

SEQ ID NO: 1341265 - protein, 6 aa, Mycobacterium
ASGSGD

SEQ ID NO: 1341266 - protein, 6 aa, Mycobacterium
ASGVDH

SEQ ID NO: 1341267 - protein, 5 aa, Mycobacterium
ASGYD

SEQ ID NO: 1341268 - protein, 13 aa, Mycobacterium
ASHSGEGEPVAPE

SEQ ID NO: 1341269 - protein, 21 aa, Mycobacterium
ASIEESAASSSARESERQTSL

SEQ ID NO: 1341270 - protein, 7 aa, Mycobacterium
ASKAALS

SEQ ID NO: 1341271 - protein, 7 aa, Mycobacterium
ASKATAA

SEQ ID NO: 1341272 - protein, 8 aa, Mycobacterium
ASKVPGAI

SEQ ID NO: 1341273 - protein, 10 aa, Mycobacterium
ASLAPAEPRA

SEQ ID NO: 1341274 - protein, 6 aa, Mycobacterium
ASMPTE

SEQ ID NO: 1341275 - protein, 7 aa, Mycobacterium
ASMPTEW

SEQ ID NO: 1341276 - protein, 17 aa, Mycobacterium
ASNGESNYGKIGSPQVD

SEQ ID NO: 1341277 - protein, 6 aa, Mycobacterium
ASNPVG

SEQ ID NO: 1341278 - protein, 7 aa, Mycobacterium
ASNTVTD

SEQ ID NO: 1341279 - protein, 9 aa, Mycobacterium
ASPAAAIPC

SEQ ID NO: 1341280 - protein, 14 aa, Mycobacterium
ASPAAEGEPHAAPE

SEQ ID NO: 1341281 - protein, 6 aa, Mycobacterium
ASPACT

SEQ ID NO: 1341282 - protein, 11 aa, Mycobacterium
ASPGGATATAT

SEQ ID NO: 1341283 - protein, 4 aa, Mycobacterium
ASPL

SEQ ID NO: 1341284 - protein, 7 aa, Mycobacterium
ASPPAGS

SEQ ID NO: 1341285 - protein, 7 aa, Mycobacterium
ASPPDFE

SEQ ID NO: 1341286 - protein, 5 aa, Mycobacterium
ASPQQ

SEQ ID NO: 1341287 - protein, 6 aa, Mycobacterium
ASPSGA

SEQ ID NO: 1341288 - protein, 13 aa, Mycobacterium
ASPVATAAADNPL

SEQ ID NO: 1341289 - protein, 8 aa, Mycobacterium
ASPVPAPL

SEQ ID NO: 1341290 - protein, 10 aa, Mycobacterium
ASPWEGGADI

SEQ ID NO: 1341291 - protein, 6 aa, Mycobacterium
ASQDIA

SEQ ID NO: 1341292 - protein, 10 aa, Mycobacterium
ASQDSGTTWQ

SEQ ID NO: 1341293 - protein, 11 aa, Mycobacterium
ASQEPAYVPGQ

SEQ ID NO: 1341294 - protein, 22 aa, Mycobacterium
ASQESPSESGPSSSSPSGHGSY

SEQ ID NO: 1341295 - protein, 4 aa, Mycobacterium
ASQG

SEQ ID NO: 1341296 - protein, 11 aa, Mycobacterium
ASQGTPPGPIP

SEQ ID NO: 1341297 - protein, 5 aa, Mycobacterium
ASQIN

SEQ ID NO: 1341298 - protein, 5 aa, Mycobacterium
ASQLP

SEQ ID NO: 1341299 - protein, 6 aa, Mycobacterium
ASQQTQ

SEQ ID NO: 1341300 - protein, 9 aa, Mycobacterium
ASQTTTADK

SEQ ID NO: 1341301 - protein, 5 aa, Mycobacterium
ASRAS

SEQ ID NO: 1341302 - protein, 10 aa, Mycobacterium
ASRHGAEQSA

SEQ ID NO: 1341303 - protein, 9 aa, Mycobacterium
ASRLGAEQA

SEQ ID NO: 1341304 - protein, 10 aa, Mycobacterium
ASRLNGEQSA

SEQ ID NO: 1341305 - protein, 10 aa, Mycobacterium
ASRLNNEQSA

SEQ ID NO: 1341306 - protein, 10 aa, Mycobacterium
ASRMNGEQSA

SEQ ID NO: 1341307 - protein, 8 aa, Mycobacterium
ASRQGAPT

SEQ ID NO: 1341308 - protein, 5 aa, Mycobacterium
ASRRR

SEQ ID NO: 1341309 - protein, 12 aa, Mycobacterium
ASRSRADTPGGD

SEQ ID NO: 1341310 - protein, 6 aa, Mycobacterium
ASSALT

SEQ ID NO: 1341311 - protein, 12 aa, Mycobacterium
ASSAPDETPSMA

SEQ ID NO: 1341312 - protein, 4 aa, Mycobacterium
ASSL

SEQ ID NO: 1341313 - protein, 8 aa, Mycobacterium
ASSPGPGK

SEQ ID NO: 1341314 - protein, 11 aa, Mycobacterium
ASSSSADGKVV

SEQ ID NO: 1341315 - protein, 7 aa, Mycobacterium
ASSYCSG

SEQ ID NO: 1341316 - protein, 10 aa, Mycobacterium
ASTASAQPMI

SEQ ID NO: 1341317 - protein, 11 aa, Mycobacterium
ASTATSAWGSS

SEQ ID NO: 1341318 - protein, 11 aa, Mycobacterium
ASTEVAPAGET

SEQ ID NO: 1341319 - protein, 11 aa, Mycobacterium
ASTGHGGGYQL

SEQ ID NO: 1341320 - protein, 7 aa, Mycobacterium
ASTNPVL

SEQ ID NO: 1341321 - protein, 11 aa, Mycobacterium
ASTPTAPDGMV

SEQ ID NO: 1341322 - protein, 9 aa, Mycobacterium
ASTTPGPGV

SEQ ID NO: 1341323 - protein, 8 aa, Mycobacterium
ASVQDGAV

SEQ ID NO: 1341324 - protein, 33 aa, Mycobacterium
ASVSAANHGVPPNADGDPACPPSQAWGRQPEGR

SEQ ID NO: 1341325 - protein, 11 aa, Mycobacterium
ASVTESDSGTK

SEQ ID NO: 1341326 - protein, 12 aa, Mycobacterium
ATAASNTATSSI

SEQ ID NO: 1341327 - protein, 15 aa, Mycobacterium
ATADSSAPPVSGGPQ

SEQ ID NO: 1341328 - protein, 8 aa, Mycobacterium
ATADVPVG

SEQ ID NO: 1341329 - protein, 10 aa, Mycobacterium
ATAEPAPGLP

SEQ ID NO: 1341330 - protein, 5 aa, Mycobacterium
ATAER

SEQ ID NO: 1341331 - protein, 17 aa, Mycobacterium
ATAGAGALGDAPPTVNV

SEQ ID NO: 1341332 - protein, 5 aa, Mycobacterium
ATAGE

SEQ ID NO: 1341333 - protein, 11 aa, Mycobacterium
ATAGGAGGKGG

SEQ ID NO: 1341334 - protein, 7 aa, Mycobacterium
ATAGTAA

SEQ ID NO: 1341335 - protein, 8 aa, Mycobacterium
ATANQRDS

SEQ ID NO: 1341336 - protein, 9 aa, Mycobacterium
ATAPPHAVD

SEQ ID NO: 1341337 - protein, 8 aa, Mycobacterium
ATAQGDGL

SEQ ID NO: 1341338 - protein, 10 aa, Mycobacterium
ATASAQPSNP

SEQ ID NO: 1341339 - protein, 12 aa, Mycobacterium
ATATAEPAPGLP

SEQ ID NO: 1341340 - protein, 18 aa, Mycobacterium
ATATAQPAPAPAPAPEIP

SEQ ID NO: 1341341 - protein, 4 aa, Mycobacterium
ATAV

SEQ ID NO: 1341342 - protein, 9 aa, Mycobacterium
ATDEDFEGE

SEQ ID NO: 1341343 - protein, 4 aa, Mycobacterium
ATDR

SEQ ID NO: 1341344 - protein, 4 aa, Mycobacterium
ATDV

SEQ ID NO: 1341345 - protein, 5 aa, Mycobacterium
ATEAA

SEQ ID NO: 1341346 - protein, 7 aa, Mycobacterium
ATEPPLD

SEQ ID NO: 1341347 - protein, 97 aa, Mycobacterium
ATEPVEDEADQDEAALDGAAEDEAAQDGAAEDESAPDSDSEESDSDSGSDGSDETAAEEPEETSGGEDTPVTGESGDEGDGDSGSDTAADSSGDESS

SEQ ID NO: 1341348 - protein, 5 aa, Mycobacterium
ATEQT

SEQ ID NO: 1341349 - protein, 6 aa, Mycobacterium
ATETGA

SEQ ID NO: 1341350 - protein, 24 aa, Mycobacterium
ATEYADGAADTITGITTDDGTGDI

SEQ ID NO: 1341351 - protein, 13 aa, Mycobacterium
ATGADLRDPAAQD

SEQ ID NO: 1341352 - protein, 15 aa, Mycobacterium
ATGARTPTASAAAPT

SEQ ID NO: 1341353 - protein, 10 aa, Mycobacterium
ATGATDATGR

SEQ ID NO: 1341354 - protein, 20 aa, Mycobacterium
ATGCGGRQDAPTADSGGEIT

SEQ ID NO: 1341355 - protein, 8 aa, Mycobacterium
ATGDDKAN

SEQ ID NO: 1341356 - protein, 8 aa, Mycobacterium
ATGERRQL

SEQ ID NO: 1341357 - protein, 4 aa, Mycobacterium
ATGG

SEQ ID NO: 1341358 - protein, 5 aa, Mycobacterium
ATGGA

SEQ ID NO: 1341359 - protein, 10 aa, Mycobacterium
ATGGDDPVAT

SEQ ID NO: 1341360 - protein, 5 aa, Mycobacterium
ATGGH

SEQ ID NO: 1341361 - protein, 7 aa, Mycobacterium
ATGHPNC

SEQ ID NO: 1341362 - protein, 5 aa, Mycobacterium
ATGLD

SEQ ID NO: 1341363 - protein, 10 aa, Mycobacterium
ATGLVEDTQA

SEQ ID NO: 1341364 - protein, 8 aa, Mycobacterium
ATGNATKA

SEQ ID NO: 1341365 - protein, 21 aa, Mycobacterium
ATGNGTATAGVDYTAKSGTVT

SEQ ID NO: 1341366 - protein, 20 aa, Mycobacterium
ATGPHADLAGTAAALRDSGA

SEQ ID NO: 1341367 - protein, 20 aa, Mycobacterium
ATGPHADLAGTAAALRESGA

SEQ ID NO: 1341368 - protein, 5 aa, Mycobacterium
ATGQE

SEQ ID NO: 1341369 - protein, 4 aa, Mycobacterium
ATGR

SEQ ID NO: 1341370 - protein, 5 aa, Mycobacterium
ATGRD

SEQ ID NO: 1341371 - protein, 9 aa, Mycobacterium
ATGRGSRTP

SEQ ID NO: 1341372 - protein, 11 aa, Mycobacterium
ATGSDAVAQGG

SEQ ID NO: 1341373 - protein, 10 aa, Mycobacterium
ATGSSGTLNL

SEQ ID NO: 1341374 - protein, 7 aa, Mycobacterium
ATGTETA

SEQ ID NO: 1341375 - protein, 6 aa, Mycobacterium
ATGTSI

SEQ ID NO: 1341376 - protein, 5 aa, Mycobacterium
ATGTT

SEQ ID NO: 1341377 - protein, 6 aa, Mycobacterium
ATIGQT

SEQ ID NO: 1341378 - protein, 8 aa, Mycobacterium
ATITTGDG

SEQ ID NO: 1341379 - protein, 10 aa, Mycobacterium
ATKSRSRNVK

SEQ ID NO: 1341380 - protein, 16 aa, Mycobacterium
ATLAGAAPALSGPFPT

SEQ ID NO: 1341381 - protein, 15 aa, Mycobacterium
ATLESREAKHEPRSF

SEQ ID NO: 1341382 - protein, 7 aa, Mycobacterium
ATLGTAE

SEQ ID NO: 1341383 - protein, 4 aa, Mycobacterium
ATLH

SEQ ID NO: 1341384 - protein, 6 aa, Mycobacterium
ATLTDD

SEQ ID NO: 1341385 - protein, 7 aa, Mycobacterium
ATLTPTA

SEQ ID NO: 1341386 - protein, 10 aa, Mycobacterium
ATLTSTLADR

SEQ ID NO: 1341387 - protein, 5 aa, Mycobacterium
ATNAG

SEQ ID NO: 1341388 - protein, 10 aa, Mycobacterium
ATNKGLDLTP

SEQ ID NO: 1341389 - protein, 6 aa, Mycobacterium
ATNPRD

SEQ ID NO: 1341390 - protein, 16 aa, Mycobacterium
ATNTNVEPPGGSGDIA

SEQ ID NO: 1341391 - protein, 21 aa, Mycobacterium
ATPADLRAAPDTAGRAADGTE

SEQ ID NO: 1341392 - protein, 7 aa, Mycobacterium
ATPASSA

SEQ ID NO: 1341393 - protein, 6 aa, Mycobacterium
ATPDGK

SEQ ID NO: 1341394 - protein, 5 aa, Mycobacterium
ATPER

SEQ ID NO: 1341395 - protein, 12 aa, Mycobacterium
ATPEVSKHVSGQ

SEQ ID NO: 1341396 - protein, 17 aa, Mycobacterium
ATPGGVPIDPPAAPTSL

SEQ ID NO: 1341397 - protein, 16 aa, Mycobacterium
ATPGPKTIGGVSEGAP

SEQ ID NO: 1341398 - protein, 5 aa, Mycobacterium
ATPHQ

SEQ ID NO: 1341399 - protein, 4 aa, Mycobacterium
ATPL

SEQ ID NO: 1341400 - protein, 17 aa, Mycobacterium
ATPLPQQPSQCDPNYSG

SEQ ID NO: 1341401 - protein, 9 aa, Mycobacterium
ATPPTAQRT

SEQ ID NO: 1341402 - protein, 7 aa, Mycobacterium
ATPQPDR

SEQ ID NO: 1341403 - protein, 9 aa, Mycobacterium
ATPRSDEPW

SEQ ID NO: 1341404 - protein, 4 aa, Mycobacterium
ATPS

SEQ ID NO: 1341405 - protein, 9 aa, Mycobacterium
ATPSTTTDG

SEQ ID NO: 1341406 - protein, 4 aa, Mycobacterium
ATPV

SEQ ID NO: 1341407 - protein, 10 aa, Mycobacterium
ATPVPLGGGS

SEQ ID NO: 1341408 - protein, 9 aa, Mycobacterium
ATQAPARSI

SEQ ID NO: 1341409 - protein, 11 aa, Mycobacterium
ATQPEPESQAA

SEQ ID NO: 1341410 - protein, 25 aa, Mycobacterium
ATQPIEQPAPQQAAAPQGGAPAPVV

SEQ ID NO: 1341411 - protein, 9 aa, Mycobacterium
ATQQRDPRV

SEQ ID NO: 1341412 - protein, 13 aa, Mycobacterium
ATQSDTAGGSTTW

SEQ ID NO: 1341413 - protein, 6 aa, Mycobacterium
ATQSQL

SEQ ID NO: 1341414 - protein, 7 aa, Mycobacterium
ATQYAQP

SEQ ID NO: 1341415 - protein, 10 aa, Mycobacterium
ATRPAGGLNR

SEQ ID NO: 1341416 - protein, 13 aa, Mycobacterium
ATRPAPADAAYGA

SEQ ID NO: 1341417 - protein, 10 aa, Mycobacterium
ATRPGKRAPT

SEQ ID NO: 1341418 - protein, 10 aa, Mycobacterium
ATRREEDSAT

SEQ ID NO: 1341419 - protein, 31 aa, Mycobacterium
ATRSGTLSSSFATGCDGAPGGTLTYPFRLVR

SEQ ID NO: 1341420 - protein, 14 aa, Mycobacterium
ATSAASTVFDGPPR

SEQ ID NO: 1341421 - protein, 10 aa, Mycobacterium
ATSGPGEQTP

SEQ ID NO: 1341422 - protein, 5 aa, Mycobacterium
ATSGR

SEQ ID NO: 1341423 - protein, 17 aa, Mycobacterium
ATSNGTATAGSDFTATS

SEQ ID NO: 1341424 - protein, 19 aa, Mycobacterium
ATSNGTATGGSDFAATSGT

SEQ ID NO: 1341425 - protein, 11 aa, Mycobacterium
ATSPPAAADPC

SEQ ID NO: 1341426 - protein, 4 aa, Mycobacterium
ATSV

SEQ ID NO: 1341427 - protein, 15 aa, Mycobacterium
ATTAELSVTGADAAT

SEQ ID NO: 1341428 - protein, 14 aa, Mycobacterium
ATTAPTEERRAVTE

SEQ ID NO: 1341429 - protein, 11 aa, Mycobacterium
ATTDGDRGQMT

SEQ ID NO: 1341430 - protein, 8 aa, Mycobacterium
ATTDLSNG

SEQ ID NO: 1341431 - protein, 7 aa, Mycobacterium
ATTDPDT

SEQ ID NO: 1341432 - protein, 16 aa, Mycobacterium
ATTGATVTASDLNDQN

SEQ ID NO: 1341433 - protein, 6 aa, Mycobacterium
ATTNQQ

SEQ ID NO: 1341434 - protein, 22 aa, Mycobacterium
ATTTAPQLDGPGVGGAASAFGS

SEQ ID NO: 1341435 - protein, 24 aa, Mycobacterium
ATTVQETDELPARSKKCTDAGQPA

SEQ ID NO: 1341436 - protein, 7 aa, Mycobacterium
ATVEQAG

SEQ ID NO: 1341437 - protein, 9 aa, Mycobacterium
ATVESARLP

SEQ ID NO: 1341438 - protein, 5 aa, Mycobacterium
ATVPR

SEQ ID NO: 1341439 - protein, 11 aa, Mycobacterium
ATVQSEASWAT

SEQ ID NO: 1341440 - protein, 8 aa, Mycobacterium
ATVSENAL

SEQ ID NO: 1341441 - protein, 10 aa, Mycobacterium
ATVTDRSGPG

SEQ ID NO: 1341442 - protein, 8 aa, Mycobacterium
ATVTERDG

SEQ ID NO: 1341443 - protein, 6 aa, Mycobacterium
AVAAER

SEQ ID NO: 1341444 - protein, 15 aa, Mycobacterium
AVAAPSAGDAQSTIS

SEQ ID NO: 1341445 - protein, 15 aa, Mycobacterium
AVAAPTGGNADATIS

SEQ ID NO: 1341446 - protein, 15 aa, Mycobacterium
AVAAPTGGNADTTIS

SEQ ID NO: 1341447 - protein, 24 aa, Mycobacterium
AVAGQPDCTVSAPGNSLCESAGNA

SEQ ID NO: 1341448 - protein, 8 aa, Mycobacterium
AVAQDGRT

SEQ ID NO: 1341449 - protein, 10 aa, Mycobacterium
AVARNAESYR

SEQ ID NO: 1341450 - protein, 13 aa, Mycobacterium
AVASADATDDYPI

SEQ ID NO: 1341451 - protein, 9 aa, Mycobacterium
AVATRDPRG

SEQ ID NO: 1341452 - protein, 12 aa, Mycobacterium
AVDAASARAERA

SEQ ID NO: 1341453 - protein, 9 aa, Mycobacterium
AVDDSEAAL

SEQ ID NO: 1341454 - protein, 8 aa, Mycobacterium
AVDPDGDR

SEQ ID NO: 1341455 - protein, 18 aa, Mycobacterium
AVDPHDYEPAPSDAADFE

SEQ ID NO: 1341456 - protein, 25 aa, Mycobacterium
AVDPRMSDDDVRGMREQAARQAGED

SEQ ID NO: 1341457 - protein, 8 aa, Mycobacterium
AVDTTGGW

SEQ ID NO: 1341458 - protein, 12 aa, Mycobacterium
AVERTRKALADQ

SEQ ID NO: 1341459 - protein, 21 aa, Mycobacterium
AVESAGADLTESTETESPSDY

SEQ ID NO: 1341460 - protein, 7 aa, Mycobacterium
AVGGRPV

SEQ ID NO: 1341461 - protein, 6 aa, Mycobacterium
AVGPDG

SEQ ID NO: 1341462 - protein, 23 aa, Mycobacterium
AVGPQNPQRPPLARSSVTATPTV

SEQ ID NO: 1341463 - protein, 9 aa, Mycobacterium
AVGSTAHPL

SEQ ID NO: 1341464 - protein, 13 aa, Mycobacterium
AVPDRIPGTRARP

SEQ ID NO: 1341465 - protein, 5 aa, Mycobacterium
AVPGG

SEQ ID NO: 1341466 - protein, 14 aa, Mycobacterium
AVPGGTEEATEPEV

SEQ ID NO: 1341467 - protein, 5 aa, Mycobacterium
AVPGN

SEQ ID NO: 1341468 - protein, 25 aa, Mycobacterium
AVPGTRAPNVADTIPRNNRTGIILS

SEQ ID NO: 1341469 - protein, 18 aa, Mycobacterium
AVPNSQPSITSTRVSSPG

SEQ ID NO: 1341470 - protein, 11 aa, Mycobacterium
AVPPGPTRSEL

SEQ ID NO: 1341471 - protein, 16 aa, Mycobacterium
AVPPPPLAAPAPQDPA

SEQ ID NO: 1341472 - protein, 7 aa, Mycobacterium
AVPRTEL

SEQ ID NO: 1341473 - protein, 36 aa, Mycobacterium
AVQDSTSEEATSDDVAGRDSSAEAESEAAADGGNSL

SEQ ID NO: 1341474 - protein, 7 aa, Mycobacterium
AVQRPDG

SEQ ID NO: 1341475 - protein, 6 aa, Mycobacterium
AVRDGD

SEQ ID NO: 1341476 - protein, 8 aa, Mycobacterium
AVSPERTI

SEQ ID NO: 1341477 - protein, 27 aa, Mycobacterium
AVTAPEDAPTGDPAPDVAPPTGPEADT

SEQ ID NO: 1341478 - protein, 9 aa, Mycobacterium
AVTGGDAPR

SEQ ID NO: 1341479 - protein, 10 aa, Mycobacterium
AVYSDGKPIT

SEQ ID NO: 1341480 - protein, 10 aa, Mycobacterium
AVYSDGKPVT

SEQ ID NO: 1341481 - protein, 11 aa, Mycobacterium
AVYSDGKPVTC

SEQ ID NO: 1341482 - protein, 14 aa, Mycobacterium
AWTEPDDWQDPRPT

SEQ ID NO: 1341483 - protein, 11 aa, Mycobacterium
AWTPDTAPSWA

SEQ ID NO: 1341484 - protein, 10 aa, Mycobacterium
AYAEGDEDEL

SEQ ID NO: 1341485 - protein, 7 aa, Mycobacterium
AYAGLPN

SEQ ID NO: 1341486 - protein, 10 aa, Mycobacterium
AYAGTGDDNT

SEQ ID NO: 1341487 - protein, 6 aa, Mycobacterium
AYDSAE

SEQ ID NO: 1341488 - protein, 12 aa, Mycobacterium
AYEDGDTATALT

SEQ ID NO: 1341489 - protein, 9 aa, Mycobacterium
AYESDDGQT

SEQ ID NO: 1341490 - protein, 13 aa, Mycobacterium
AYGGGGDITSPHD

SEQ ID NO: 1341491 - protein, 10 aa, Mycobacterium
AYGGGPDGRR

SEQ ID NO: 1341492 - protein, 7 aa, Mycobacterium
AYGPAGQ

SEQ ID NO: 1341493 - protein, 5 aa, Mycobacterium
AYGSA

SEQ ID NO: 1341494 - protein, 7 aa, Mycobacterium
AYPPVNP

SEQ ID NO: 1341495 - protein, 5 aa, Mycobacterium
AYQTY

SEQ ID NO: 1341496 - protein, 19 aa, Mycobacterium
AYRDTGFTGGPGSRSTQNL

SEQ ID NO: 1341497 - protein, 22 aa, Mycobacterium
AYRTGDGPKMPDGGVIPSDRTA

SEQ ID NO: 1341498 - protein, 10 aa, Mycobacterium
AYSPNGSAVS

SEQ ID NO: 1341499 - protein, 7 aa, Mycobacterium
AYSTSKT

SEQ ID NO: 1341500 - protein, 8 aa, Mycobacterium
AYSTSKTA

SEQ ID NO: 1341501 - protein, 13 aa, Mycobacterium
AYTPTSAAQTTST

SEQ ID NO: 1341502 - protein, 13 aa, Mycobacterium
CAAGSGNGPAYVS

SEQ ID NO: 1341503 - protein, 4 aa, Mycobacterium
CAAQ

SEQ ID NO: 1341504 - protein, 9 aa, Mycobacterium
CADDTADAV

SEQ ID NO: 1341505 - protein, 17 aa, Mycobacterium
CADGKSLNVGGSNNTLT

SEQ ID NO: 1341506 - protein, 11 aa, Mycobacterium
CAEAKTADADG

SEQ ID NO: 1341507 - protein, 19 aa, Mycobacterium
CAGGCPTELTDGQQITAEI

SEQ ID NO: 1341508 - protein, 4 aa, Mycobacterium
CAKT

SEQ ID NO: 1341509 - protein, 12 aa, Mycobacterium
CAPGQKKARVSF

SEQ ID NO: 1341510 - protein, 30 aa, Mycobacterium
CAPPEKDNSNAQTESGVNAAEATSAGDFGG

SEQ ID NO: 1341511 - protein, 10 aa, Mycobacterium
CAPTSPGNIL

SEQ ID NO: 1341512 - protein, 5 aa, Mycobacterium
CATTA

SEQ ID NO: 1341513 - protein, 11 aa, Mycobacterium
CDGAPNGGPNL

SEQ ID NO: 1341514 - protein, 13 aa, Mycobacterium
CDKNDDTGGPLTA

SEQ ID NO: 1341515 - protein, 6 aa, Mycobacterium
CDPADR

SEQ ID NO: 1341516 - protein, 5 aa, Mycobacterium
CDPAQ

SEQ ID NO: 1341517 - protein, 6 aa, Mycobacterium
CDQPQT

SEQ ID NO: 1341518 - protein, 6 aa, Mycobacterium
CEAGGN

SEQ ID NO: 1341519 - protein, 15 aa, Mycobacterium
CESGGDWSISTGNGY

SEQ ID NO: 1341520 - protein, 6 aa, Mycobacterium
CESGGN

SEQ ID NO: 1341521 - protein, 5 aa, Mycobacterium
CESQA

SEQ ID NO: 1341522 - protein, 9 aa, Mycobacterium
CGAGPTTSL

SEQ ID NO: 1341523 - protein, 9 aa, Mycobacterium
CGATDSGRA

SEQ ID NO: 1341524 - protein, 7 aa, Mycobacterium
CGGDGTL

SEQ ID NO: 1341525 - protein, 10 aa, Mycobacterium
CGGGGDTTRG

SEQ ID NO: 1341526 - protein, 24 aa, Mycobacterium
CGGPDGADGPASGPDAQSAGPGFE

SEQ ID NO: 1341527 - protein, 6 aa, Mycobacterium
CGGPGA

SEQ ID NO: 1341528 - protein, 7 aa, Mycobacterium
CGGPRYD

SEQ ID NO: 1341529 - protein, 9 aa, Mycobacterium
CGGSSDSAV

SEQ ID NO: 1341530 - protein, 11 aa, Mycobacterium
CGIGPNGGPVG

SEQ ID NO: 1341531 - protein, 12 aa, Mycobacterium
CGPQPNPNETDT

SEQ ID NO: 1341532 - protein, 8 aa, Mycobacterium
CGRQSEIA

SEQ ID NO: 1341533 - protein, 39 aa, Mycobacterium
CGSDSSSSDETSTSEETSTSAPQTPAAAESTAPAQPGPA

SEQ ID NO: 1341534 - protein, 36 aa, Mycobacterium
CGSDSTDEKPSAASSSATSETAASPASPTPAAGPGI

SEQ ID NO: 1341535 - protein, 45 aa, Mycobacterium
CGSGADSGDTSAQTSAESTAATSEAGTETGTETSAAAPADGQTVG

SEQ ID NO: 1341536 - protein, 17 aa, Mycobacterium
CGSGGGTEPAKTDGGLD

SEQ ID NO: 1341537 - protein, 11 aa, Mycobacterium
CGSGSQSEDAD

SEQ ID NO: 1341538 - protein, 8 aa, Mycobacterium
CGSNPTRI

SEQ ID NO: 1341539 - protein, 16 aa, Mycobacterium
CGSNSDSGSTEARSGK

SEQ ID NO: 1341540 - protein, 25 aa, Mycobacterium
CGSSGNDTADGPGQRAVETSTTRIA

SEQ ID NO: 1341541 - protein, 15 aa, Mycobacterium
CGSTDADPAASAPMS

SEQ ID NO: 1341542 - protein, 22 aa, Mycobacterium
CGSTSDDTNSPTATAGTSGAQV

SEQ ID NO: 1341543 - protein, 26 aa, Mycobacterium
CGTEGAEPAASSTPAPSPASDVPPPL

SEQ ID NO: 1341544 - protein, 6 aa, Mycobacterium
CGVSPG

SEQ ID NO: 1341545 - protein, 12 aa, Mycobacterium
CLPGQGNGEADS

SEQ ID NO: 1341546 - protein, 13 aa, Mycobacterium
CNTGDPVCSRGED

SEQ ID NO: 1341547 - protein, 6 aa, Mycobacterium
CPFGGK

SEQ ID NO: 1341548 - protein, 5 aa, Mycobacterium
CPQPT

SEQ ID NO: 1341549 - protein, 34 aa, Mycobacterium
CQRTTEGAVAQTTQPGPPLTSAPTTSSRAPGIPG

SEQ ID NO: 1341550 - protein, 4 aa, Mycobacterium
CRPG

SEQ ID NO: 1341551 - protein, 9 aa, Mycobacterium
CSAEPGDSA

SEQ ID NO: 1341552 - protein, 8 aa, Mycobacterium
CSEPQRRD

SEQ ID NO: 1341553 - protein, 22 aa, Mycobacterium
CSGGGDSAAPSAQPGGECPTEP

SEQ ID NO: 1341554 - protein, 22 aa, Mycobacterium
CSGGGDSAAPSEQPGGECPTEP

SEQ ID NO: 1341555 - protein, 16 aa, Mycobacterium
CSGSSSKDSGKELPDA

SEQ ID NO: 1341556 - protein, 9 aa, Mycobacterium
CSGVSPDTY

SEQ ID NO: 1341557 - protein, 19 aa, Mycobacterium
CSKGSPAAEQSLQSATEGT

SEQ ID NO: 1341558 - protein, 15 aa, Mycobacterium
CSNVTTGTPMADPDQ

SEQ ID NO: 1341559 - protein, 9 aa, Mycobacterium
CSPDPADSA

SEQ ID NO: 1341560 - protein, 43 aa, Mycobacterium
CSPGDSTVSKTPDQRTPAAAASASAQPPAPAGPLPGPAPVDDP

SEQ ID NO: 1341561 - protein, 14 aa, Mycobacterium
CSPPEPAVGTRTAQ

SEQ ID NO: 1341562 - protein, 12 aa, Mycobacterium
CSSADAASVVFV

SEQ ID NO: 1341563 - protein, 11 aa, Mycobacterium
CSSDSEEQAQQ

SEQ ID NO: 1341564 - protein, 12 aa, Mycobacterium
CSSDSEEQAQQV

SEQ ID NO: 1341565 - protein, 35 aa, Mycobacterium
CSSGQNDVPSTGGSAELGATADINPQDPATLQQGG

SEQ ID NO: 1341566 - protein, 34 aa, Mycobacterium
CSSGTDTPPASSATSVTTTAAEPPAAAAPVPPGE

SEQ ID NO: 1341567 - protein, 8 aa, Mycobacterium
CSSGTLQD

SEQ ID NO: 1341568 - protein, 13 aa, Mycobacterium
CSSNAPESPPPAV

SEQ ID NO: 1341569 - protein, 8 aa, Mycobacterium
CSSSEEED

SEQ ID NO: 1341570 - protein, 8 aa, Mycobacterium
CSTDGPRT

SEQ ID NO: 1341571 - protein, 39 aa, Mycobacterium
CSTESETPEESTTTTTTTTTTTTPPLSPTEKAPNPGAPG

SEQ ID NO: 1341572 - protein, 12 aa, Mycobacterium
CSTGDDAVAQGG

SEQ ID NO: 1341573 - protein, 8 aa, Mycobacterium
CSTNGPRT

SEQ ID NO: 1341574 - protein, 26 aa, Mycobacterium
CSTPEPALGGTTATVTIDGSDTGGAH

SEQ ID NO: 1341575 - protein, 7 aa, Mycobacterium
CSTTLQG

SEQ ID NO: 1341576 - protein, 12 aa, Mycobacterium
CSYPGECTGTVD

SEQ ID NO: 1341577 - protein, 12 aa, Mycobacterium
CTGGTAASATGE

SEQ ID NO: 1341578 - protein, 13 aa, Mycobacterium
CTGTAPPTCKDAN

SEQ ID NO: 1341579 - protein, 10 aa, Mycobacterium
CTSAGGTTIC

SEQ ID NO: 1341580 - protein, 11 aa, Mycobacterium
CTTRSTDIARG

SEQ ID NO: 1341581 - protein, 53 aa, Mycobacterium
CTTSTTGTGEIASSESTGATTSSETTSTRATAAPPTGRITPRQEAPEGPAPTI

SEQ ID NO: 1341582 - protein, 12 aa, Mycobacterium
DAAAPASSRDVA

SEQ ID NO: 1341583 - protein, 13 aa, Mycobacterium
DAAAPASSRDVAS

SEQ ID NO: 1341584 - protein, 9 aa, Mycobacterium
DAAATAAAL

SEQ ID NO: 1341585 - protein, 10 aa, Mycobacterium
DAADAVRAGT

SEQ ID NO: 1341586 - protein, 19 aa, Mycobacterium
DAAERAPRSGREAAENELS

SEQ ID NO: 1341587 - protein, 13 aa, Mycobacterium
DAAESGRPSSFAN

SEQ ID NO: 1341588 - protein, 4 aa, Mycobacterium
DAAG

SEQ ID NO: 1341589 - protein, 7 aa, Mycobacterium
DAAGNAV

SEQ ID NO: 1341590 - protein, 9 aa, Mycobacterium
DAAGSGAVT

SEQ ID NO: 1341591 - protein, 6 aa, Mycobacterium
DAAIPG

SEQ ID NO: 1341592 - protein, 5 aa, Mycobacterium
DAAPD

SEQ ID NO: 1341593 - protein, 6 aa, Mycobacterium
DAAPEE

SEQ ID NO: 1341594 - protein, 10 aa, Mycobacterium
DAAPEVNAGP

SEQ ID NO: 1341595 - protein, 11 aa, Mycobacterium
DAAPLRRAEPD

SEQ ID NO: 1341596 - protein, 14 aa, Mycobacterium
DAAPPEDSIPAEEA

SEQ ID NO: 1341597 - protein, 11 aa, Mycobacterium
DAARRYSPRAG

SEQ ID NO: 1341598 - protein, 44 aa, Mycobacterium
DAAVGTAEAERDAQIQSAKARQAGAVAQAEADTAIATANQKRDV

SEQ ID NO: 1341599 - protein, 14 aa, Mycobacterium
DACDDAAHESISGQ

SEQ ID NO: 1341600 - protein, 4 aa, Mycobacterium
DADA

SEQ ID NO: 1341601 - protein, 9 aa, Mycobacterium
DADAPDKDQ

SEQ ID NO: 1341602 - protein, 6 aa, Mycobacterium
DADENP

SEQ ID NO: 1341603 - protein, 5 aa, Mycobacterium
DADGI

SEQ ID NO: 1341604 - protein, 7 aa, Mycobacterium
DADGRQV

SEQ ID NO: 1341605 - protein, 6 aa, Mycobacterium
DADGTW

SEQ ID NO: 1341606 - protein, 19 aa, Mycobacterium
DADNDRLRADPQVDYSPEG

SEQ ID NO: 1341607 - protein, 20 aa, Mycobacterium
DADNDRLRADPQVDYSPEGV

SEQ ID NO: 1341608 - protein, 7 aa, Mycobacterium
DADPALG

SEQ ID NO: 1341609 - protein, 5 aa, Mycobacterium
DADPQ

SEQ ID NO: 1341610 - protein, 4 aa, Mycobacterium
DADR

SEQ ID NO: 1341611 - protein, 13 aa, Mycobacterium
DADRGPACQASGS

SEQ ID NO: 1341612 - protein, 8 aa, Mycobacterium
DADRPTPP

SEQ ID NO: 1341613 - protein, 8 aa, Mycobacterium
DADRPYVQ

SEQ ID NO: 1341614 - protein, 10 aa, Mycobacterium
DADSGNTCTP

SEQ ID NO: 1341615 - protein, 5 aa, Mycobacterium
DADTM

SEQ ID NO: 1341616 - protein, 4 aa, Mycobacterium
DAEP

SEQ ID NO: 1341617 - protein, 4 aa, Mycobacterium
DAER

SEQ ID NO: 1341618 - protein, 7 aa, Mycobacterium
DAESAAA

SEQ ID NO: 1341619 - protein, 9 aa, Mycobacterium
DAESRTGAV

SEQ ID NO: 1341620 - protein, 7 aa, Mycobacterium
DAETGTV

SEQ ID NO: 1341621 - protein, 38 aa, Mycobacterium
DAEVTGRDGSYTITGKADGTFAGKPSEAVTAEFRIQAN

SEQ ID NO: 1341622 - protein, 9 aa, Mycobacterium
DAFPSATAR

SEQ ID NO: 1341623 - protein, 7 aa, Mycobacterium
DAFTDPA

SEQ ID NO: 1341624 - protein, 10 aa, Mycobacterium
DAGATPDNYK

SEQ ID NO: 1341625 - protein, 5 aa, Mycobacterium
DAGDG

SEQ ID NO: 1341626 - protein, 11 aa, Mycobacterium
DAGDPDPAAAA

SEQ ID NO: 1341627 - protein, 4 aa, Mycobacterium
DAGG

SEQ ID NO: 1341628 - protein, 8 aa, Mycobacterium
DAGGAHRP

SEQ ID NO: 1341629 - protein, 7 aa, Mycobacterium
DAGGGGV

SEQ ID NO: 1341630 - protein, 7 aa, Mycobacterium
DAGIPMT

SEQ ID NO: 1341631 - protein, 7 aa, Mycobacterium
DAGPALT

SEQ ID NO: 1341632 - protein, 19 aa, Mycobacterium
DAGSSGPAVDAAGRFLRAI

SEQ ID NO: 1341633 - protein, 5 aa, Mycobacterium
DAGVP

SEQ ID NO: 1341634 - protein, 8 aa, Mycobacterium
DAGVSPED

SEQ ID NO: 1341635 - protein, 10 aa, Mycobacterium
DAHDAGAAPI

SEQ ID NO: 1341636 - protein, 16 aa, Mycobacterium
DAHGGNRALGTPGYDA

SEQ ID NO: 1341637 - protein, 7 aa, Mycobacterium
DAKGAAG

SEQ ID NO: 1341638 - protein, 5 aa, Mycobacterium
DALDE

SEQ ID NO: 1341639 - protein, 12 aa, Mycobacterium
DALDGNGEKLRD

SEQ ID NO: 1341640 - protein, 7 aa, Mycobacterium
DALGAEA

SEQ ID NO: 1341641 - protein, 6 aa, Mycobacterium
DALTDA

SEQ ID NO: 1341642 - protein, 9 aa, Mycobacterium
DAMSADSPV

SEQ ID NO: 1341643 - protein, 8 aa, Mycobacterium
DANGKTVT

SEQ ID NO: 1341644 - protein, 8 aa, Mycobacterium
DANGQVTG

SEQ ID NO: 1341645 - protein, 8 aa, Mycobacterium
DANPEAAR

SEQ ID NO: 1341646 - protein, 7 aa, Mycobacterium
DANTGEL

SEQ ID NO: 1341647 - protein, 6 aa, Mycobacterium
DAPAPV

SEQ ID NO: 1341648 - protein, 7 aa, Mycobacterium
DAPDGEV

SEQ ID NO: 1341649 - protein, 9 aa, Mycobacterium
DAPERPPGD

SEQ ID NO: 1341650 - protein, 4 aa, Mycobacterium
DAPG

SEQ ID NO: 1341651 - protein, 7 aa, Mycobacterium
DAPLSEA

SEQ ID NO: 1341652 - protein, 9 aa, Mycobacterium
DAPPEDLAP

SEQ ID NO: 1341653 - protein, 11 aa, Mycobacterium
DAPPPHQPGSY

SEQ ID NO: 1341654 - protein, 5 aa, Mycobacterium
DAPPS

SEQ ID NO: 1341655 - protein, 7 aa, Mycobacterium
DAPSFEG

SEQ ID NO: 1341656 - protein, 4 aa, Mycobacterium
DAPT

SEQ ID NO: 1341657 - protein, 7 aa, Mycobacterium
DAPTGYQ

SEQ ID NO: 1341658 - protein, 5 aa, Mycobacterium
DAQDG

SEQ ID NO: 1341659 - protein, 18 aa, Mycobacterium
DAQRDAQGRFPRDASPDD

SEQ ID NO: 1341660 - protein, 7 aa, Mycobacterium
DAQRGRL

SEQ ID NO: 1341661 - protein, 17 aa, Mycobacterium
DAQSGPSLEPGADSRQV

SEQ ID NO: 1341662 - protein, 9 aa, Mycobacterium
DAQTPEAVR

SEQ ID NO: 1341663 - protein, 6 aa, Mycobacterium
DARDAS

SEQ ID NO: 1341664 - protein, 15 aa, Mycobacterium
DARRGASLPPVPRTP

SEQ ID NO: 1341665 - protein, 9 aa, Mycobacterium
DARSGDTNR

SEQ ID NO: 1341666 - protein, 10 aa, Mycobacterium
DASDQTKERL

SEQ ID NO: 1341667 - protein, 7 aa, Mycobacterium
DASGGRL

SEQ ID NO: 1341668 - protein, 10 aa, Mycobacterium
DASGQPARIP

SEQ ID NO: 1341669 - protein, 7 aa, Mycobacterium
DASGYGG

SEQ ID NO: 1341670 - protein, 9 aa, Mycobacterium
DASTNLDET

SEQ ID NO: 1341671 - protein, 13 aa, Mycobacterium
DASVTEGVPGTGV

SEQ ID NO: 1341672 - protein, 8 aa, Mycobacterium
DATAAHRP

SEQ ID NO: 1341673 - protein, 8 aa, Mycobacterium
DATAAPRE

SEQ ID NO: 1341674 - protein, 11 aa, Mycobacterium
DATAPDGTDQW

SEQ ID NO: 1341675 - protein, 8 aa, Mycobacterium
DATGAPLA

SEQ ID NO: 1341676 - protein, 4 aa, Mycobacterium
DATQ

SEQ ID NO: 1341677 - protein, 6 aa, Mycobacterium
DATRAK

SEQ ID NO: 1341678 - protein, 6 aa, Mycobacterium
DATTGA

SEQ ID NO: 1341679 - protein, 11 aa, Mycobacterium
DAVATNTAGDG

SEQ ID NO: 1341680 - protein, 16 aa, Mycobacterium
DAVPQGVTPAPMPPAL

SEQ ID NO: 1341681 - protein, 5 aa, Mycobacterium
DAVPT

SEQ ID NO: 1341682 - protein, 8 aa, Mycobacterium
DAVSTDDS

SEQ ID NO: 1341683 - protein, 7 aa, Mycobacterium
DAVSTGG

SEQ ID NO: 1341684 - protein, 19 aa, Mycobacterium
DAYPGADDELSMRDNNTSA

SEQ ID NO: 1341685 - protein, 15 aa, Mycobacterium
DCGSYAAGGFGSAGA

SEQ ID NO: 1341686 - protein, 21 aa, Mycobacterium
DDADSVPSRVQAAAEAEVSPA

SEQ ID NO: 1341687 - protein, 7 aa, Mycobacterium
DDAQEVD

SEQ ID NO: 1341688 - protein, 5 aa, Mycobacterium
DDASG

SEQ ID NO: 1341689 - protein, 38 aa, Mycobacterium
DDASKQALADASERYTAASSQIDQATTARQAELAKESA

SEQ ID NO: 1341690 - protein, 7 aa, Mycobacterium
DDAWPDP

SEQ ID NO: 1341691 - protein, 16 aa, Mycobacterium
DDCTPSALPRSGRDDE

SEQ ID NO: 1341692 - protein, 8 aa, Mycobacterium
DDDPTFEQ

SEQ ID NO: 1341693 - protein, 9 aa, Mycobacterium
DDEGDPNQI

SEQ ID NO: 1341694 - protein, 32 aa, Mycobacterium
DDEGTTGRVESAPGPTANGPQRSVSSDPQGGQ

SEQ ID NO: 1341695 - protein, 9 aa, Mycobacterium
DDEPDRKRI

SEQ ID NO: 1341696 - protein, 8 aa, Mycobacterium
DDEPESQR

SEQ ID NO: 1341697 - protein, 13 aa, Mycobacterium
DDFNPDRYHDDYQ

SEQ ID NO: 1341698 - protein, 29 aa, Mycobacterium
DDGARRERKCAEGRQSSGLNGPQRNIGDS

SEQ ID NO: 1341699 - protein, 17 aa, Mycobacterium
DDGEPEPNSDQVADDPV

SEQ ID NO: 1341700 - protein, 9 aa, Mycobacterium
DDGGESADA

SEQ ID NO: 1341701 - protein, 5 aa, Mycobacterium
DDGSE

SEQ ID NO: 1341702 - protein, 7 aa, Mycobacterium
DDGSEKW

SEQ ID NO: 1341703 - protein, 5 aa, Mycobacterium
DDGSG

SEQ ID NO: 1341704 - protein, 7 aa, Mycobacterium
DDGSQDD

SEQ ID NO: 1341705 - protein, 5 aa, Mycobacterium
DDITG

SEQ ID NO: 1341706 - protein, 4 aa, Mycobacterium
DDLA

SEQ ID NO: 1341707 - protein, 12 aa, Mycobacterium
DDLYPAADTPVH

SEQ ID NO: 1341708 - protein, 15 aa, Mycobacterium
DDNTAIVDDGSNNRI

SEQ ID NO: 1341709 - protein, 8 aa, Mycobacterium
DDPRVNPI

SEQ ID NO: 1341710 - protein, 10 aa, Mycobacterium
DDPSNRASPV

SEQ ID NO: 1341711 - protein, 19 aa, Mycobacterium
DDPTDNVANYAQQTPLSPQ

SEQ ID NO: 1341712 - protein, 19 aa, Mycobacterium
DDQISAQAAALDTAVNELG

SEQ ID NO: 1341713 - protein, 14 aa, Mycobacterium
DDQRIEGGQSHRTL

SEQ ID NO: 1341714 - protein, 15 aa, Mycobacterium
DDQTRSGGYEDAKSH

SEQ ID NO: 1341715 - protein, 6 aa, Mycobacterium
DDRGYS

SEQ ID NO: 1341716 - protein, 7 aa, Mycobacterium
DDRIAAA

SEQ ID NO: 1341717 - protein, 8 aa, Mycobacterium
DDRMRPDY

SEQ ID NO: 1341718 - protein, 9 aa, Mycobacterium
DDRPGTDEV

SEQ ID NO: 1341719 - protein, 6 aa, Mycobacterium
DDRPTE

SEQ ID NO: 1341720 - protein, 12 aa, Mycobacterium
DDSAGAAEWGAA

SEQ ID NO: 1341721 - protein, 26 aa, Mycobacterium
DDSEATAAASTTQNAQVGTTSAAATG

SEQ ID NO: 1341722 - protein, 19 aa, Mycobacterium
DDSGWASPDGANPADPNYE

SEQ ID NO: 1341723 - protein, 10 aa, Mycobacterium
DDSRGINGET

SEQ ID NO: 1341724 - protein, 7 aa, Mycobacterium
DDTSGNP

SEQ ID NO: 1341725 - protein, 11 aa, Mycobacterium
DDTSPLTTSSL

SEQ ID NO: 1341726 - protein, 6 aa, Mycobacterium
DDTTSD

SEQ ID NO: 1341727 - protein, 12 aa, Mycobacterium
DDTTTSQLQNTI

SEQ ID NO: 1341728 - protein, 7 aa, Mycobacterium
DDTVESD

SEQ ID NO: 1341729 - protein, 10 aa, Mycobacterium
DDVDAPDAED

SEQ ID NO: 1341730 - protein, 9 aa, Mycobacterium
DDVKVERGK

SEQ ID NO: 1341731 - protein, 8 aa, Mycobacterium
DDVSQSGV

SEQ ID NO: 1341732 - protein, 5 aa, Mycobacterium
DDYPL

SEQ ID NO: 1341733 - protein, 6 aa, Mycobacterium
DEAAGS

SEQ ID NO: 1341734 - protein, 18 aa, Mycobacterium
DEADIATGLGPEDGAGDL

SEQ ID NO: 1341735 - protein, 6 aa, Mycobacterium
DEAFER

SEQ ID NO: 1341736 - protein, 7 aa, Mycobacterium
DEAGGDL

SEQ ID NO: 1341737 - protein, 7 aa, Mycobacterium
DEAGGSR

SEQ ID NO: 1341738 - protein, 11 aa, Mycobacterium
DEDLGNSPDFS

SEQ ID NO: 1341739 - protein, 14 aa, Mycobacterium
DEDLQNEDLKEEDV

SEQ ID NO: 1341740 - protein, 7 aa, Mycobacterium
DEETRDR

SEQ ID NO: 1341741 - protein, 4 aa, Mycobacterium
DEGK

SEQ ID NO: 1341742 - protein, 4 aa, Mycobacterium
DEHD

SEQ ID NO: 1341743 - protein, 51 aa, Mycobacterium
DEIEDTTETEGVDAGAADEDAADDADDAGADGESSAADTSADSDAGSDTDS

SEQ ID NO: 1341744 - protein, 5 aa, Mycobacterium
DEIGK

SEQ ID NO: 1341745 - protein, 9 aa, Mycobacterium
DEISPGIAQ

SEQ ID NO: 1341746 - protein, 5 aa, Mycobacterium
DEITG

SEQ ID NO: 1341747 - protein, 18 aa, Mycobacterium
DEKQTHTVTTSSGADHGE

SEQ ID NO: 1341748 - protein, 99 aa, Mycobacterium; identical to SEQ ID NO: 1179575

SEQ ID NO: 1341749 - protein, 4 aa, Mycobacterium
DEKT

SEQ ID NO: 1341750 - protein, 7 aa, Mycobacterium
DELGSNA

SEQ ID NO: 1341751 - protein, 10 aa, Mycobacterium
DELTDEPPVK

SEQ ID NO: 1341752 - protein, 14 aa, Mycobacterium
DEMTDTSADVSNPE

SEQ ID NO: 1341753 - protein, 4 aa, Mycobacterium
DENN

SEQ ID NO: 1341754 - protein, 9 aa, Mycobacterium
DEPAEGLPP

SEQ ID NO: 1341755 - protein, 4 aa, Mycobacterium
DEPP

SEQ ID NO: 1341756 - protein, 4 aa, Mycobacterium
DEPY

SEQ ID NO: 1341757 - protein, 5 aa, Mycobacterium
DEQDN

SEQ ID NO: 1341758 - protein, 6 aa, Mycobacterium
DEQDNL

SEQ ID NO: 1341759 - protein, 6 aa, Mycobacterium
DEQYGQ

SEQ ID NO: 1341760 - protein, 7 aa, Mycobacterium
DERATPP

SEQ ID NO: 1341761 - protein, 7 aa, Mycobacterium
DESAGSR

SEQ ID NO: 1341762 - protein, 8 aa, Mycobacterium
DESGNEFP

SEQ ID NO: 1341763 - protein, 5 aa, Mycobacterium
DESND

SEQ ID NO: 1341764 - protein, 15 aa, Mycobacterium
DESPYQDQAVRAPAD

SEQ ID NO: 1341765 - protein, 10 aa, Mycobacterium
DESTTGTEQF

SEQ ID NO: 1341766 - protein, 7 aa, Mycobacterium
DETAGLK

SEQ ID NO: 1341767 - protein, 9 aa, Mycobacterium
DETETPIGE

SEQ ID NO: 1341768 - protein, 4 aa, Mycobacterium
DETF

SEQ ID NO: 1341769 - protein, 61 aa, Mycobacterium
DETGTSASSPAGENTTSGPGTAADAPTETDVDEQDEAAVDEPEQPAEENDADAVETVRDRQ

SEQ ID NO: 1341770 - protein, 16 aa, Mycobacterium
DEVPEEPQPDYSARRA

SEQ ID NO: 1341771 - protein, 8 aa, Mycobacterium
DEVSTNTD

SEQ ID NO: 1341772 - protein, 35 aa, Mycobacterium
DEVTVDDEDADSETTDDTDTGAAEVDDTSVDTAAA

SEQ ID NO: 1341773 - protein, 18 aa, Mycobacterium
DEWGSNRVGPGESDGGYE

SEQ ID NO: 1341774 - protein, 12 aa, Mycobacterium
DFDGPAKDGSTY

SEQ ID NO: 1341775 - protein, 7 aa, Mycobacterium
DFDNNGT

SEQ ID NO: 1341776 - protein, 9 aa, Mycobacterium
DFESLSDDQ

SEQ ID NO: 1341777 - protein, 7 aa, Mycobacterium
DFGPDGA

SEQ ID NO: 1341778 - protein, 6 aa, Mycobacterium
DFPDEP

SEQ ID NO: 1341779 - protein, 6 aa, Mycobacterium
DFPPGV

SEQ ID NO: 1341780 - protein, 20 aa, Mycobacterium
DFTDRTYQNTVTGSLYYVDV

SEQ ID NO: 1341781 - protein, 20 aa, Mycobacterium
DFTDRTYQQTVTGSVYYLDV

SEQ ID NO: 1341782 - protein, 20 aa, Mycobacterium
DFTDRTYQQTVTGSVYYVDV

SEQ ID NO: 1341783 - protein, 18 aa, Mycobacterium
DFTETGGVDVTRDGRALN

SEQ ID NO: 1341784 - protein, 10 aa, Mycobacterium
DFTPAEQERL

SEQ ID NO: 1341785 - protein, 7 aa, Mycobacterium
DGAADYS

SEQ ID NO: 1341786 - protein, 7 aa, Mycobacterium
DGADGVM

SEQ ID NO: 1341787 - protein, 14 aa, Mycobacterium
DGAEPDHQTQQRRR

SEQ ID NO: 1341788 - protein, 10 aa, Mycobacterium
DGAGAQARYA

SEQ ID NO: 1341789 - protein, 7 aa, Mycobacterium
DGAGSIT

SEQ ID NO: 1341790 - protein, 7 aa, Mycobacterium
DGANAGE

SEQ ID NO: 1341791 - protein, 8 aa, Mycobacterium
DGAPFTSA

SEQ ID NO: 1341792 - protein, 7 aa, Mycobacterium
DGARSAV

SEQ ID NO: 1341793 - protein, 6 aa, Mycobacterium
DGARTK

SEQ ID NO: 1341794 - protein, 7 aa, Mycobacterium
DGASAGD

SEQ ID NO: 1341795 - protein, 11 aa, Mycobacterium
DGASAYGNKMT

SEQ ID NO: 1341796 - protein, 7 aa, Mycobacterium
DGATIAT

SEQ ID NO: 1341797 - protein, 9 aa, Mycobacterium
DGAVESRQA

SEQ ID NO: 1341798 - protein, 8 aa, Mycobacterium
DGAVPAEP

SEQ ID NO: 1341799 - protein, 8 aa, Mycobacterium
DGDAALAR

SEQ ID NO: 1341800 - protein, 9 aa, Mycobacterium
DGDDESSLH

SEQ ID NO: 1341801 - protein, 10 aa, Mycobacterium
DGDEARGGVD

SEQ ID NO: 1341802 - protein, 8 aa, Mycobacterium
DGDPAPAG

SEQ ID NO: 1341803 - protein, 15 aa, Mycobacterium
DGDPICSDGRNPFAH

SEQ ID NO: 1341804 - protein, 8 aa, Mycobacterium
DGDRSESS

SEQ ID NO: 1341805 - protein, 9 aa, Mycobacterium
DGDSTTAIG

SEQ ID NO: 1341806 - protein, 5 aa, Mycobacterium
DGEGC

SEQ ID NO: 1341807 - protein, 7 aa, Mycobacterium
DGEHAPE

SEQ ID NO: 1341808 - protein, 7 aa, Mycobacterium
DGERRWD

SEQ ID NO: 1341809 - protein, 4 aa, Mycobacterium
DGET

SEQ ID NO: 1341810 - protein, 11 aa, Mycobacterium
DGETKSRTTIG

SEQ ID NO: 1341811 - protein, 6 aa, Mycobacterium
DGFSTL

SEQ ID NO: 1341812 - protein, 8 aa, Mycobacterium
DGGDSIEY

SEQ ID NO: 1341813 - protein, 7 aa, Mycobacterium
DGGGGYQ

SEQ ID NO: 1341814 - protein, 6 aa, Mycobacterium
DGGGSS

SEQ ID NO: 1341815 - protein, 6 aa, Mycobacterium
DGGGSY

SEQ ID NO: 1341816 - protein, 273 aa, Mycobacterium
DGGKGGTGGRAISAEGPANGGNGGRGGNAGVLGGDAGGGGDGGRGYSEKGPASGGAGGAGAAASTVGNGGSGGKGGSAQGAGSANGGAGGSGGAGGFVSGDGGAGGGGGTALSAAGTGSGGSGGDGGNARGAGGGGRGGVGALGQSKDARGFGGVGGAGGRSGVTGTGGAGGAGGSGVSDTLDAAGGSGGDGGDGSRGGIGGTGGAAHSKSGNAQGGFAGDGGTGSRGSGGDGGDGGIGTSTTGKGRGGNGGNGGGGIRAAPVGKAAKARRAA

SEQ ID NO: 1341817 - protein, 5 aa, Mycobacterium
DGGNG

SEQ ID NO: 1341818 - protein, 5 aa, Mycobacterium
DGGPV

SEQ ID NO: 1341819 - protein, 6 aa, Mycobacterium
DGGPVM

SEQ ID NO: 1341820 - protein, 9 aa, Mycobacterium
DGGQASNVI

SEQ ID NO: 1341821 - protein, 10 aa, Mycobacterium
DGGQSKDEVC

SEQ ID NO: 1341822 - protein, 16 aa, Mycobacterium
DGGSVLDNGESGALNE

SEQ ID NO: 1341823 - protein, 8 aa, Mycobacterium
DGGTVNTY

SEQ ID NO: 1341824 - protein, 9 aa, Mycobacterium
DGGYTAGRD

SEQ ID NO: 1341825 - protein, 11 aa, Mycobacterium
DGHGGATTETV

SEQ ID NO: 1341826 - protein, 6 aa, Mycobacterium
DGHGGM

SEQ ID NO: 1341827 - protein, 9 aa, Mycobacterium
DGHGGTDTV

SEQ ID NO: 1341828 - protein, 8 aa, Mycobacterium
DGHGGTTT

SEQ ID NO: 1341829 - protein, 17 aa, Mycobacterium
DGKPKTAGSRLTNPAYA

SEQ ID NO: 1341830 - protein, 8 aa, Mycobacterium
DGKTYQAE

SEQ ID NO: 1341831 - protein, 4 aa, Mycobacterium
DGLE

SEQ ID NO: 1341832 - protein, 4 aa, Mycobacterium
DGMD

SEQ ID NO: 1341833 - protein, 9 aa, Mycobacterium
DGMGPQQRT

SEQ ID NO: 1341834 - protein, 15 aa, Mycobacterium
DGMPETQTFTTPQPH

SEQ ID NO: 1341835 - protein, 11 aa, Mycobacterium
DGNKGFKAYDD

SEQ ID NO: 1341836 - protein, 11 aa, Mycobacterium
DGNPDDGNPGY

SEQ ID NO: 1341837 - protein, 12 aa, Mycobacterium
DGNSSTEATPVN

SEQ ID NO: 1341838 - protein, 4 aa, Mycobacterium
DGNT

SEQ ID NO: 1341839 - protein, 11 aa, Mycobacterium
DGPQAAYGTPE

SEQ ID NO: 1341840 - protein, 6 aa, Mycobacterium
DGPSAC

SEQ ID NO: 1341841 - protein, 15 aa, Mycobacterium
DGPSVGESVDVGTPN

SEQ ID NO: 1341842 - protein, 9 aa, Mycobacterium
DGPVQPDGT

SEQ ID NO: 1341843 - protein, 8 aa, Mycobacterium
DGQDPDMR

SEQ ID NO: 1341844 - protein, 9 aa, Mycobacterium
DGQDQNIQG

SEQ ID NO: 1341845 - protein, 8 aa, Mycobacterium
DGQGEVKT

SEQ ID NO: 1341846 - protein, 8 aa, Mycobacterium
DGQITKQS

SEQ ID NO: 1341847 - protein, 14 aa, Mycobacterium
DGQLPEGRASGCRK

SEQ ID NO: 1341848 - protein, 6 aa, Mycobacterium
DGQTVG

SEQ ID NO: 1341849 - protein, 5 aa, Mycobacterium
DGRAV

SEQ ID NO: 1341850 - protein, 10 aa, Mycobacterium
DGRDYTPEEY

SEQ ID NO: 1341851 - protein, 5 aa, Mycobacterium
DGREH

SEQ ID NO: 1341852 - protein, 14 aa, Mycobacterium
DGRLPEDRADGCEA

SEQ ID NO: 1341853 - protein, 10 aa, Mycobacterium
DGRPGARKDT

SEQ ID NO: 1341854 - protein, 7 aa, Mycobacterium
DGRPTVR

SEQ ID NO: 1341855 - protein, 12 aa, Mycobacterium
DGRPTVSCGGAN

SEQ ID NO: 1341856 - protein, 7 aa, Mycobacterium
DGRRASA

SEQ ID NO: 1341857 - protein, 5 aa, Mycobacterium
DGRRG

SEQ ID NO: 1341858 - protein, 5 aa, Mycobacterium
DGRVS

SEQ ID NO: 1341859 - protein, 5 aa, Mycobacterium
DGSAA

SEQ ID NO: 1341860 - protein, 9 aa, Mycobacterium
DGSAHYGGQ

SEQ ID NO: 1341861 - protein, 7 aa, Mycobacterium
DGSDRAV

SEQ ID NO: 1341862 - protein, 7 aa, Mycobacterium
DGSGDGG

SEQ ID NO: 1341863 - protein, 6 aa, Mycobacterium
DGSGPL

SEQ ID NO: 1341864 - protein, 8 aa, Mycobacterium
DGSHSDTM

SEQ ID NO: 1341865 - protein, 7 aa, Mycobacterium
DGSIASN

SEQ ID NO: 1341866 - protein, 9 aa, Mycobacterium
DGSPGFGTL

SEQ ID NO: 1341867 - protein, 12 aa, Mycobacterium
DGSPIPALGPGL

SEQ ID NO: 1341868 - protein, 9 aa, Mycobacterium
DGSRAEMDS

SEQ ID NO: 1341869 - protein, 6 aa, Mycobacterium
DGSRHY

SEQ ID NO: 1341870 - protein, 5 aa, Mycobacterium
DGSRL

SEQ ID NO: 1341871 - protein, 10 aa, Mycobacterium
DGSRPIDSDY

SEQ ID NO: 1341872 - protein, 6 aa, Mycobacterium
DGSRVD

SEQ ID NO: 1341873 - protein, 11 aa, Mycobacterium
DGSSGLSADDK

SEQ ID NO: 1341874 - protein, 7 aa, Mycobacterium
DGSSLGQ

SEQ ID NO: 1341875 - protein, 9 aa, Mycobacterium
DGSVSPPTP

SEQ ID NO: 1341876 - protein, 5 aa, Mycobacterium
DGTEE

SEQ ID NO: 1341877 - protein, 10 aa, Mycobacterium
DGTKPLENQW

SEQ ID NO: 1341878 - protein, 7 aa, Mycobacterium
DGTLPGN

SEQ ID NO: 1341879 - protein, 5 aa, Mycobacterium
DGTQI

SEQ ID NO: 1341880 - protein, 7 aa, Mycobacterium
DGTSGPL

SEQ ID NO: 1341881 - protein, 7 aa, Mycobacterium
DGTYTYT

SEQ ID NO: 1341882 - protein, 5 aa, Mycobacterium
DGVGG

SEQ ID NO: 1341883 - protein, 30 aa, Mycobacterium
DGVGMDPDALRSGPGDALSDGAPASEGAGA

SEQ ID NO: 1341884 - protein, 10 aa, Mycobacterium
DGVGSSPAQI

SEQ ID NO: 1341885 - protein, 14 aa, Mycobacterium
DGVPPPPGDAVPQI

SEQ ID NO: 1341886 - protein, 12 aa, Mycobacterium
DGVTLDDGAALD

SEQ ID NO: 1341887 - protein, 7 aa, Mycobacterium
DHDKDQS

SEQ ID NO: 1341888 - protein, 18 aa, Mycobacterium
DHEAPPAEPDTAPATTRA

SEQ ID NO: 1341889 - protein, 4 aa, Mycobacterium
DHEQ

SEQ ID NO: 1341890 - protein, 28 aa, Mycobacterium
DIATTAADLQPQYNSDSTSITAYRATNS

SEQ ID NO: 1341891 - protein, 5 aa, Mycobacterium
DIDEA

SEQ ID NO: 1341892 - protein, 10 aa, Mycobacterium
DIGEHSNIGA

SEQ ID NO: 1341893 - protein, 4 aa, Mycobacterium
DINS

SEQ ID NO: 1341894 - protein, 5 aa, Mycobacterium
DIPTA

SEQ ID NO: 1341895 - protein, 10 aa, Mycobacterium
DIQGGSTITQ

SEQ ID NO: 1341896 - protein, 9 aa, Mycobacterium
DISDEGGAL

SEQ ID NO: 1341897 - protein, 5 aa, Mycobacterium
DISST

SEQ ID NO: 1341898 - protein, 4 aa, Mycobacterium
DITG

SEQ ID NO: 1341899 - protein, 5 aa, Mycobacterium
DITTP

SEQ ID NO: 1341900 - protein, 5 aa, Mycobacterium
DKADS

SEQ ID NO: 1341901 - protein, 15 aa, Mycobacterium
DKAYSRNDAPPAGAL

SEQ ID NO: 1341902 - protein, 7 aa, Mycobacterium
DKDNGRI

SEQ ID NO: 1341903 - protein, 15 aa, Mycobacterium
DKENGTITKIYKQAT

SEQ ID NO: 1341904 - protein, 9 aa, Mycobacterium
DKGPGGAEE

SEQ ID NO: 1341905 - protein, 6 aa, Mycobacterium
DKGTPF

SEQ ID NO: 1341906 - protein, 4 aa, Mycobacterium
DKPV

SEQ ID NO: 1341907 - protein, 7 aa, Mycobacterium
DKRPNGI

SEQ ID NO: 1341908 - protein, 6 aa, Mycobacterium
DLAAPS

SEQ ID NO: 1341909 - protein, 7 aa, Mycobacterium
DLAPGAL

SEQ ID NO: 1341910 - protein, 7 aa, Mycobacterium
DLATREE

SEQ ID NO: 1341911 - protein, 6 aa, Mycobacterium
DLDAPG

SEQ ID NO: 1341912 - protein, 5 aa, Mycobacterium
DLDDD

SEQ ID NO: 1341913 - protein, 6 aa, Mycobacterium
DLDDPE

SEQ ID NO: 1341914 - protein, 19 aa, Mycobacterium
DLDGAQPKGWSGQSRPVTE

SEQ ID NO: 1341915 - protein, 11 aa, Mycobacterium
DLDSDGHEHDA

SEQ ID NO: 1341916 - protein, 4 aa, Mycobacterium
DLEG

SEQ ID NO: 1341917 - protein, 5 aa, Mycobacterium
DLEND

SEQ ID NO: 1341918 - protein, 7 aa, Mycobacterium
DLEPGQK

SEQ ID NO: 1341919 - protein, 5 aa, Mycobacterium
DLGPH

SEQ ID NO: 1341920 - protein, 15 aa, Mycobacterium
DLKSTGAAVSVGPEE

SEQ ID NO: 1341921 - protein, 13 aa, Mycobacterium
DLPANATATVGQT

SEQ ID NO: 1341922 - protein, 12 aa, Mycobacterium
DLPANSTVSLGQ

SEQ ID NO: 1341923 - protein, 13 aa, Mycobacterium
DLPANSTVSLGQT

SEQ ID NO: 1341924 - protein, 28 aa, Mycobacterium
DLPAPDPDAAVPDVDAASDESTNSRSYQ

SEQ ID NO: 1341925 - protein, 6 aa, Mycobacterium
DLPRGD

SEQ ID NO: 1341926 - protein, 6 aa, Mycobacterium
DLRKPI

SEQ ID NO: 1341927 - protein, 5 aa, Mycobacterium
DLSPQ

SEQ ID NO: 1341928 - protein, 12 aa, Mycobacterium
DLTAANQQVPTT

SEQ ID NO: 1341929 - protein, 11 aa, Mycobacterium
DLTPGTELAES

SEQ ID NO: 1341930 - protein, 12 aa, Mycobacterium
DLTSKGDRTGYL

SEQ ID NO: 1341931 - protein, 17 aa, Mycobacterium
DMDGASPATPDIDGGAD

SEQ ID NO: 1341932 - protein, 17 aa, Mycobacterium
DMDGATPATPNIDPSSN

SEQ ID NO: 1341933 - protein, 17 aa, Mycobacterium
DMDGATPATPNIDPSST

SEQ ID NO: 1341934 - protein, 16 aa, Mycobacterium
DMDTERALEQRAGRTL

SEQ ID NO: 1341935 - protein, 12 aa, Mycobacterium
DNAATTELSPDE

SEQ ID NO: 1341936 - protein, 6 aa, Mycobacterium
DNDATP

SEQ ID NO: 1341937 - protein, 15 aa, Mycobacterium
DNDPVISGSSGQGVS

SEQ ID NO: 1341938 - protein, 7 aa, Mycobacterium
DNDTKQM

SEQ ID NO: 1341939 - protein, 10 aa, Mycobacterium
DNDVEHTSGY

SEQ ID NO: 1341940 - protein, 6 aa, Mycobacterium
DNGTAS

SEQ ID NO: 1341941 - protein, 6 aa, Mycobacterium
DNKNGA

SEQ ID NO: 1341942 - protein, 38 aa, Mycobacterium; identical to SEQ ID NO: 1197656

SEQ ID NO: 1341943 - protein, 10 aa, Mycobacterium
DNLRGEGANI

SEQ ID NO: 1341944 - protein, 8 aa, Mycobacterium
DNNAELGQ

SEQ ID NO: 1341945 - protein, 6 aa, Mycobacterium
DNNREA

SEQ ID NO: 1341946 - protein, 5 aa, Mycobacterium
DNNSQ

SEQ ID NO: 1341947 - protein, 5 aa, Mycobacterium
DNPNL

SEQ ID NO: 1341948 - protein, 6 aa, Mycobacterium
DNRARQ

SEQ ID NO: 1341949 - protein, 8 aa, Mycobacterium
DNRDTARD

SEQ ID NO: 1341950 - protein, 14 aa, Mycobacterium
DNSDDLSRNPGAPT

SEQ ID NO: 1341951 - protein, 6 aa, Mycobacterium
DNSGHG

SEQ ID NO: 1341952 - protein, 13 aa, Mycobacterium
DNTDITGEASLEN

SEQ ID NO: 1341953 - protein, 19 aa, Mycobacterium
DNTFDPSQDIGKQDNRQIG

SEQ ID NO: 1341954 - protein, 7 aa, Mycobacterium
DNTGAAI

SEQ ID NO: 1341955 - protein, 4 aa, Mycobacterium
DPAA

SEQ ID NO: 1341956 - protein, 9 aa, Mycobacterium
DPAEPGGYD

SEQ ID NO: 1341957 - protein, 25 aa, Mycobacterium
DPAGAPGRKLTDGPADSEPAPSPDL

SEQ ID NO: 1341958 - protein, 8 aa, Mycobacterium
DPAHPNAR

SEQ ID NO: 1341959 - protein, 13 aa, Mycobacterium
DPALPYAKPPLSK

SEQ ID NO: 1341960 - protein, 8 aa, Mycobacterium
DPAQGVAA

SEQ ID NO: 1341961 - protein, 24 aa, Mycobacterium
DPARFTDATPYNPSSPYSSTKAAA

SEQ ID NO: 1341962 - protein, 7 aa, Mycobacterium
DPARRTR

SEQ ID NO: 1341963 - protein, 6 aa, Mycobacterium
DPASGA

SEQ ID NO: 1341964 - protein, 5 aa, Mycobacterium
DPATA

SEQ ID NO: 1341965 - protein, 12 aa, Mycobacterium
DPATAIAGDDDG

SEQ ID NO: 1341966 - protein, 9 aa, Mycobacterium
DPATPDDLA

SEQ ID NO: 1341967 - protein, 5 aa, Mycobacterium
DPATR

SEQ ID NO: 1341968 - protein, 5 aa, Mycobacterium
DPATT

SEQ ID NO: 1341969 - protein, 10 aa, Mycobacterium
DPDAELERPT

SEQ ID NO: 1341970 - protein, 10 aa, Mycobacterium
DPDAEPAGTV

SEQ ID NO: 1341971 - protein, 7 aa, Mycobacterium
DPDEVST

SEQ ID NO: 1341972 - protein, 7 aa, Mycobacterium
DPDGGTI

SEQ ID NO: 1341973 - protein, 15 aa, Mycobacterium
DPDKGGKLALDPTTG

SEQ ID NO: 1341974 - protein, 4 aa, Mycobacterium
DPDL

SEQ ID NO: 1341975 - protein, 10 aa, Mycobacterium
DPDNAATFGT

SEQ ID NO: 1341976 - protein, 7 aa, Mycobacterium
DPDPFDP

SEQ ID NO: 1341977 - protein, 9 aa, Mycobacterium
DPDREETGR

SEQ ID NO: 1341978 - protein, 6 aa, Mycobacterium
DPDRFG

SEQ ID NO: 1341979 - protein, 7 aa, Mycobacterium
DPDSSAM

SEQ ID NO: 1341980 - protein, 4 aa, Mycobacterium
DPEA

SEQ ID NO: 1341981 - protein, 30 aa, Mycobacterium
DPEHPEDPTPFDGELPPSSEEGTEGSDATT

SEQ ID NO: 1341982 - protein, 4 aa, Mycobacterium
DPEN

SEQ ID NO: 1341983 - protein, 4 aa, Mycobacterium
DPEP

SEQ ID NO: 1341984 - protein, 8 aa, Mycobacterium
DPEPAPRW

SEQ ID NO: 1341985 - protein, 6 aa, Mycobacterium
DPERRT

SEQ ID NO: 1341986 - protein, 6 aa, Mycobacterium
DPESIR

SEQ ID NO: 1341987 - protein, 5 aa, Mycobacterium
DPGAM

SEQ ID NO: 1341988 - protein, 7 aa, Mycobacterium
DPGATAD

SEQ ID NO: 1341989 - protein, 8 aa, Mycobacterium
DPGECADP

SEQ ID NO: 1341990 - protein, 7 aa, Mycobacterium
DPGRAFA

SEQ ID NO: 1341991 - protein, 12 aa, Mycobacterium
DPGSPDPALAPG

SEQ ID NO: 1341992 - protein, 10 aa, Mycobacterium
DPGTGTVNAS

SEQ ID NO: 1341993 - protein, 17 aa, Mycobacterium
DPGTPGATSNSIYTSEG

SEQ ID NO: 1341994 - protein, 6 aa, Mycobacterium
DPIADN

SEQ ID NO: 1341995 - protein, 13 aa, Mycobacterium
DPICSDGRNPFAH

SEQ ID NO: 1341996 - protein, 5 aa, Mycobacterium
DPKEA

SEQ ID NO: 1341997 - protein, 19 aa, Mycobacterium
DPKNGGVKAYYGGSDANGF

SEQ ID NO: 1341998 - protein, 14 aa, Mycobacterium
DPKVAPVDETQRGT

SEQ ID NO: 1341999 - protein, 4 aa, Mycobacterium
DPLA

SEQ ID NO: 1342000 - protein, 6 aa, Mycobacterium
DPLGDR

SEQ ID NO: 1342001 - protein, 9 aa, Mycobacterium
DPLPPEQRR

SEQ ID NO: 1342002 - protein, 15 aa, Mycobacterium
DPMGEQQGTGPAAAV

SEQ ID NO: 1342003 - protein, 9 aa, Mycobacterium
DPNEPGDYD

SEQ ID NO: 1342004 - protein, 8 aa, Mycobacterium
DPNLTRKD

SEQ ID NO: 1342005 - protein, 9 aa, Mycobacterium
DPNPPPAGE

SEQ ID NO: 1342006 - protein, 4 aa, Mycobacterium
DPPA

SEQ ID NO: 1342007 - protein, 17 aa, Mycobacterium
DPPDKRGTPGPLSGPDL

SEQ ID NO: 1342008 - protein, 15 aa, Mycobacterium
DPPQTRGSIGDLTGP

SEQ ID NO: 1342009 - protein, 17 aa, Mycobacterium
DPPSTRGTIGNLSGPDL

SEQ ID NO: 1342010 - protein, 6 aa, Mycobacterium
DPPTWA

SEQ ID NO: 1342011 - protein, 5 aa, Mycobacterium
DPQAQ

SEQ ID NO: 1342012 - protein, 6 aa, Mycobacterium
DPRDTR

SEQ ID NO: 1342013 - protein, 4 aa, Mycobacterium
DPRN

SEQ ID NO: 1342014 - protein, 24 aa, Mycobacterium
DPRRFTESTPYNPSSPYSSTKAAA

SEQ ID NO: 1342015 - protein, 5 aa, Mycobacterium
DPRVD

SEQ ID NO: 1342016 - protein, 10 aa, Mycobacterium
DPSAQSSPAL

SEQ ID NO: 1342017 - protein, 9 aa, Mycobacterium
DPSATPQDT

SEQ ID NO: 1342018 - protein, 6 aa, Mycobacterium
DPSMDN

SEQ ID NO: 1342019 - protein, 9 aa, Mycobacterium
DPSNQSPTV

SEQ ID NO: 1342020 - protein, 5 aa, Mycobacterium
DPTFD

SEQ ID NO: 1342021 - protein, 11 aa, Mycobacterium
DPTGSAGRDCG

SEQ ID NO: 1342022 - protein, 16 aa, Mycobacterium
DPVCGPGGSTTAHASY

SEQ ID NO: 1342023 - protein, 15 aa, Mycobacterium
DPVCSSGDDRPAHSQ

SEQ ID NO: 1342024 - protein, 7 aa, Mycobacterium
DPYARGS

SEQ ID NO: 1342025 - protein, 7 aa, Mycobacterium
DQAEKQM

SEQ ID NO: 1342026 - protein, 11 aa, Mycobacterium
DQAKATVAAQR

SEQ ID NO: 1342027 - protein, 14 aa, Mycobacterium
DQAPNELSGAVGHD

SEQ ID NO: 1342028 - protein, 20 aa, Mycobacterium
DQDEGKTEELTYSNDKTTVE

SEQ ID NO: 1342029 - protein, 8 aa, Mycobacterium
DQDPQAFE

SEQ ID NO: 1342030 - protein, 6 aa, Mycobacterium
DQDSAR

SEQ ID NO: 1342031 - protein, 12 aa, Mycobacterium
DQEAPRSATSSL

SEQ ID NO: 1342032 - protein, 4 aa, Mycobacterium
DQEW

SEQ ID NO: 1342033 - protein, 7 aa, Mycobacterium
DQGGQLT

SEQ ID NO: 1342034 - protein, 6 aa, Mycobacterium
DQHPDL

SEQ ID NO: 1342035 - protein, 6 aa, Mycobacterium
DQNGPV

SEQ ID NO: 1342036 - protein, 15 aa, Mycobacterium
DQPGLGQKNPDGTMS

SEQ ID NO: 1342037 - protein, 7 aa, Mycobacterium
DQPGLRE

SEQ ID NO: 1342038 - protein, 12 aa, Mycobacterium
DQPLVEYDCGIA

SEQ ID NO: 1342039 - protein, 7 aa, Mycobacterium
DQPQRRA

SEQ ID NO: 1342040 - protein, 6 aa, Mycobacterium
DQPWRS

SEQ ID NO: 1342041 - protein, 7 aa, Mycobacterium
DQQDGPT

SEQ ID NO: 1342042 - protein, 8 aa, Mycobacterium
DQQRGTGH

SEQ ID NO: 1342043 - protein, 7 aa, Mycobacterium
DQRNNLA

SEQ ID NO: 1342044 - protein, 4 aa, Mycobacterium
DQSL

SEQ ID NO: 1342045 - protein, 15 aa, Mycobacterium
DQSPSMQPYQSPPGR

SEQ ID NO: 1342046 - protein, 7 aa, Mycobacterium
DQSPVNA

SEQ ID NO: 1342047 - protein, 4 aa, Mycobacterium
DQTH

SEQ ID NO: 1342048 - protein, 8 aa, Mycobacterium
DRADVADE

SEQ ID NO: 1342049 - protein, 11 aa, Mycobacterium
DRAESEPERAH

SEQ ID NO: 1342050 - protein, 5 aa, Mycobacterium
DRAEV

SEQ ID NO: 1342051 - protein, 7 aa, Mycobacterium
DRAHGTR

SEQ ID NO: 1342052 - protein, 11 aa, Mycobacterium
DRAQPRDWSRG

SEQ ID NO: 1342053 - protein, 13 aa, Mycobacterium
DRAQRTRHRAAVG

SEQ ID NO: 1342054 - protein, 10 aa, Mycobacterium
DRARSDSRLA

SEQ ID NO: 1342055 - protein, 7 aa, Mycobacterium
DRARYRA

SEQ ID NO: 1342056 - protein, 12 aa, Mycobacterium
DRAVRDDAPAAC

SEQ ID NO: 1342057 - protein, 8 aa, Mycobacterium
DRAYPEST

SEQ ID NO: 1342058 - protein, 8 aa, Mycobacterium
DRDATRDY

SEQ ID NO: 1342059 - protein, 8 aa, Mycobacterium
DRDLSSAP

SEQ ID NO: 1342060 - protein, 10 aa, Mycobacterium
DRDVGPGVAT

SEQ ID NO: 1342061 - protein, 7 aa, Mycobacterium
DRDVPPS

SEQ ID NO: 1342062 - protein, 9 aa, Mycobacterium
DREGAPERT

SEQ ID NO: 1342063 - protein, 6 aa, Mycobacterium
DRERVA

SEQ ID NO: 1342064 - protein, 6 aa, Mycobacterium
DRESGR

SEQ ID NO: 1342065 - protein, 6 aa, Mycobacterium
DRGHRP

SEQ ID NO: 1342066 - protein, 7 aa, Mycobacterium
DRGLGPD

SEQ ID NO: 1342067 - protein, 7 aa, Mycobacterium
DRIPGPG

SEQ ID NO: 1342068 - protein, 6 aa, Mycobacterium
DRITGT

SEQ ID NO: 1342069 - protein, 6 aa, Mycobacterium
DRITTG

SEQ ID NO: 1342070 - protein, 9 aa, Mycobacterium
DRKEDVSNG

SEQ ID NO: 1342071 - protein, 7 aa, Mycobacterium
DRLQTGN

SEQ ID NO: 1342072 - protein, 18 aa, Mycobacterium
DRLSGPATGSAELPADPV

SEQ ID NO: 1342073 - protein, 9 aa, Mycobacterium
DRLTTSAEK

SEQ ID NO: 1342074 - protein, 4 aa, Mycobacterium
DRPQ

SEQ ID NO: 1342075 - protein, 9 aa, Mycobacterium
DRQTNPGIA

SEQ ID NO: 1342076 - protein, 8 aa, Mycobacterium
DRRPPDEL

SEQ ID NO: 1342077 - protein, 7 aa, Mycobacterium
DRRSREV

SEQ ID NO: 1342078 - protein, 5 aa, Mycobacterium
DRSQV

SEQ ID NO: 1342079 - protein, 6 aa, Mycobacterium
DRTAPA

SEQ ID NO: 1342080 - protein, 8 aa, Mycobacterium
DRTPTADR

SEQ ID NO: 1342081 - protein, 8 aa, Mycobacterium
DRTTPAYQ

SEQ ID NO: 1342082 - protein, 5 aa, Mycobacterium
DRVEA

SEQ ID NO: 1342083 - protein, 10 aa, Mycobacterium
DSAARGKPLN

SEQ ID NO: 1342084 - protein, 11 aa, Mycobacterium
DSAATPQERQR

SEQ ID NO: 1342085 - protein, 33 aa, Mycobacterium; identical to SEQ ID NO: 1180052

SEQ ID NO: 1342086 - protein, 23 aa, Mycobacterium
DSAKRRSTEIEGYDYSSDPNYVA

SEQ ID NO: 1342087 - protein, 7 aa, Mycobacterium
DSAQPEQ

SEQ ID NO: 1342088 - protein, 41 aa, Mycobacterium
DSAQSQPFTTEPQLAPGPTSTPPPPPPLPAKPFPKDCPAPG

SEQ ID NO: 1342089 - protein, 4 aa, Mycobacterium
DSAR

SEQ ID NO: 1342090 - protein, 5 aa, Mycobacterium
DSDHG

SEQ ID NO: 1342091 - protein, 21 aa, Mycobacterium
DSDPAELDPPADTEPGPAPAV

SEQ ID NO: 1342092 - protein, 19 aa, Mycobacterium
DSDSGASIQQKAASQGVKT

SEQ ID NO: 1342093 - protein, 12 aa, Mycobacterium
DSENRTPEPIDT

SEQ ID NO: 1342094 - protein, 11 aa, Mycobacterium
DSEPPADPVAS

SEQ ID NO: 1342095 - protein, 6 aa, Mycobacterium
DSFPGS

SEQ ID NO: 1342096 - protein, 7 aa, Mycobacterium
DSGADVN

SEQ ID NO: 1342097 - protein, 8 aa, Mycobacterium
DSGLHGPK

SEQ ID NO: 1342098 - protein, 6 aa, Mycobacterium
DSGSDR

SEQ ID NO: 1342099 - protein, 8 aa, Mycobacterium
DSGVTPAA

SEQ ID NO: 1342100 - protein, 19 aa, Mycobacterium
DSIQGPLSDPSRPAPPAGL

SEQ ID NO: 1342101 - protein, 10 aa, Mycobacterium
DSIRNGDTQV

SEQ ID NO: 1342102 - protein, 14 aa, Mycobacterium
DSKATNPHAAQASV

SEQ ID NO: 1342103 - protein, 4 aa, Mycobacterium
DSKQ

SEQ ID NO: 1342104 - protein, 8 aa, Mycobacterium
DSLGRTGE

SEQ ID NO: 1342105 - protein, 13 aa, Mycobacterium
DSMQPSGSGQLSP

SEQ ID NO: 1342106 - protein, 5 aa, Mycobacterium
DSNTH

SEQ ID NO: 1342107 - protein, 4 aa, Mycobacterium
DSNV

SEQ ID NO: 1342108 - protein, 6 aa, Mycobacterium
DSPFTT

SEQ ID NO: 1342109 - protein, 5 aa, Mycobacterium
DSPIQ

SEQ ID NO: 1342110 - protein, 6 aa, Mycobacterium
DSPVTV

SEQ ID NO: 1342111 - protein, 18 aa, Mycobacterium
DSQDGGDLGAGTLGESTD

SEQ ID NO: 1342112 - protein, 4 aa, Mycobacterium
DSQM

SEQ ID NO: 1342113 - protein, 9 aa, Mycobacterium
DSRADGTVF

SEQ ID NO: 1342114 - protein, 11 aa, Mycobacterium
DSRTGETQKFD

SEQ ID NO: 1342115 - protein, 6 aa, Mycobacterium
DSSARF

SEQ ID NO: 1342116 - protein, 8 aa, Mycobacterium
DSSGALEA

SEQ ID NO: 1342117 - protein, 8 aa, Mycobacterium
DSSPQVTA

SEQ ID NO: 1342118 - protein, 13 aa, Mycobacterium
DSSRSSAAEDAAR

SEQ ID NO: 1342119 - protein, 6 aa, Mycobacterium
DSSSPR

SEQ ID NO: 1342120 - protein, 12 aa, Mycobacterium
DSTAPDAPTRRA

SEQ ID NO: 1342121 - protein, 8 aa, Mycobacterium
DSTDTEGD

SEQ ID NO: 1342122 - protein, 8 aa, Mycobacterium
DSTNNPIR

SEQ ID NO: 1342123 - protein, 11 aa, Mycobacterium
DSTPQRAATQD

SEQ ID NO: 1342124 - protein, 9 aa, Mycobacterium
DSTQTTGDT

SEQ ID NO: 1342125 - protein, 8 aa, Mycobacterium
DSVNQTKE

SEQ ID NO: 1342126 - protein, 6 aa, Mycobacterium
DSVPSQ

SEQ ID NO: 1342127 - protein, 7 aa, Mycobacterium
DSVTEDG

SEQ ID NO: 1342128 - protein, 11 aa, Mycobacterium
DTAASLTADIP

SEQ ID NO: 1342129 - protein, 5 aa, Mycobacterium
DTADA

SEQ ID NO: 1342130 - protein, 9 aa, Mycobacterium
DTAGVSDET

SEQ ID NO: 1342131 - protein, 7 aa, Mycobacterium
DTANSEQ

SEQ ID NO: 1342132 - protein, 8 aa, Mycobacterium
DTAPAYAE

SEQ ID NO: 1342133 - protein, 4 aa, Mycobacterium
DTDA

SEQ ID NO: 1342134 - protein, 14 aa, Mycobacterium
DTDPDWAGGDNERI

SEQ ID NO: 1342135 - protein, 24 aa, Mycobacterium
DTDPEPVAASDDAPETEPEPEPAV

SEQ ID NO: 1342136 - protein, 6 aa, Mycobacterium
DTDYAR

SEQ ID NO: 1342137 - protein, 8 aa, Mycobacterium
DTEGTTLN

SEQ ID NO: 1342138 - protein, 18 aa, Mycobacterium
DTFQNATGTLAPRPAVPT

SEQ ID NO: 1342139 - protein, 11 aa, Mycobacterium
DTGASGGGDIT

SEQ ID NO: 1342140 - protein, 4 aa, Mycobacterium
DTGG

SEQ ID NO: 1342141 - protein, 10 aa, Mycobacterium
DTGGINPGDK

SEQ ID NO: 1342142 - protein, 4 aa, Mycobacterium
DTGI

SEQ ID NO: 1342143 - protein, 5 aa, Mycobacterium
DTGLT

SEQ ID NO: 1342144 - protein, 10 aa, Mycobacterium
DTGPERGRGY

SEQ ID NO: 1342145 - protein, 8 aa, Mycobacterium
DTGRGESE

SEQ ID NO: 1342146 - protein, 17 aa, Mycobacterium
DTGYRAERDQSLNDGEG

SEQ ID NO: 1342147 - protein, 11 aa, Mycobacterium
DTIETSDPIDG

SEQ ID NO: 1342148 - protein, 9 aa, Mycobacterium
DTIGKRDEQ

SEQ ID NO: 1342149 - protein, 17 aa, Mycobacterium
DTISSADAAGSARPTRT

SEQ ID NO: 1342150 - protein, 24 aa, Mycobacterium
DTKPPLQAGDPASSVLNRVEYGDR

SEQ ID NO: 1342151 - protein, 16 aa, Mycobacterium
DTKSSVRWETKDRPAL

SEQ ID NO: 1342152 - protein, 9 aa, Mycobacterium
DTKTRAPMK

SEQ ID NO: 1342153 - protein, 5 aa, Mycobacterium
DTLGA

SEQ ID NO: 1342154 - protein, 14 aa, Mycobacterium
DTLQPTEPGGVSPL

SEQ ID NO: 1342155 - protein, 5 aa, Mycobacterium
DTPAT

SEQ ID NO: 1342156 - protein, 8 aa, Mycobacterium
DTPDPDLT

SEQ ID NO: 1342157 - protein, 10 aa, Mycobacterium
DTPDSTQIVP

SEQ ID NO: 1342158 - protein, 13 aa, Mycobacterium
DTPETEAKARTPV

SEQ ID NO: 1342159 - protein, 6 aa, Mycobacterium
DTPLDQ

SEQ ID NO: 1342160 - protein, 5 aa, Mycobacterium
DTRGG

SEQ ID NO: 1342161 - protein, 4 aa, Mycobacterium
DTSA

SEQ ID NO: 1342162 - protein, 8 aa, Mycobacterium
DTSAPPTA

SEQ ID NO: 1342163 - protein, 5 aa, Mycobacterium
DTSDE

SEQ ID NO: 1342164 - protein, 129 aa, Mycobacterium
DTSVPEGDAEIEQDAASPDSAAEEVAEPEETTEPESNEATEPEEASEPEPAETTEAEEASATADEAETTEAEEASATADEAETTEAEAASESESDEAETSDTAEKSDTAEKSDTAEKSDNAGTSDKAAA

SEQ ID NO: 1342165 - protein, 17 aa, Mycobacterium
DTTDGPLADPAPQASVE

SEQ ID NO: 1342166 - protein, 14 aa, Mycobacterium
DTTQIGPPGTVGPY

SEQ ID NO: 1342167 - protein, 6 aa, Mycobacterium
DTVDES

SEQ ID NO: 1342168 - protein, 16 aa, Mycobacterium
DTVGAGGTPAPVESPA

SEQ ID NO: 1342169 - protein, 8 aa, Mycobacterium
DTVNQTRE

SEQ ID NO: 1342170 - protein, 6 aa, Mycobacterium
DTVPSE

SEQ ID NO: 1342171 - protein, 10 aa, Mycobacterium
DTYSDPATFA

SEQ ID NO: 1342172 - protein, 7 aa, Mycobacterium
DVAPDAT

SEQ ID NO: 1342173 - protein, 4 aa, Mycobacterium
DVDP

SEQ ID NO: 1342174 - protein, 10 aa, Mycobacterium
DVGPLGGGNG

SEQ ID NO: 1342175 - protein, 32 aa, Mycobacterium
DVGTQSADHDHTTHQHEAEHETMPAGGAHTDA

SEQ ID NO: 1342176 - protein, 6 aa, Mycobacterium
DVKPAE

SEQ ID NO: 1342177 - protein, 9 aa, Mycobacterium
DVKPTGSAA

SEQ ID NO: 1342178 - protein, 11 aa, Mycobacterium
DVNGASVPSGF

SEQ ID NO: 1342179 - protein, 20 aa, Mycobacterium
DVPEDNITETTNTKGGRTTS

SEQ ID NO: 1342180 - protein, 17 aa, Mycobacterium
DVPEEEEPAEDDVTDVT

SEQ ID NO: 1342181 - protein, 5 aa, Mycobacterium
DVPGT

SEQ ID NO: 1342182 - protein, 7 aa, Mycobacterium
DVPPENI

SEQ ID NO: 1342183 - protein, 7 aa, Mycobacterium
DVPPPVA

SEQ ID NO: 1342184 - protein, 18 aa, Mycobacterium
DVPPRADGVYSPGGGPVE

SEQ ID NO: 1342185 - protein, 5 aa, Mycobacterium
DVQTP

SEQ ID NO: 1342186 - protein, 23 aa, Mycobacterium
DVSGTDDSESADTPSAVDVDTAT

SEQ ID NO: 1342187 - protein, 19 aa, Mycobacterium
DVTDGAVGDEGAVGDEGVV

SEQ ID NO: 1342188 - protein, 4 aa, Mycobacterium
DVTN

SEQ ID NO: 1342189 - protein, 6 aa, Mycobacterium
DVTPEA

SEQ ID NO: 1342190 - protein, 45 aa, Mycobacterium
DVTSTAQPPPAALPDQSADRGSDLPTPPDGAEQPGAVTVTGQQRG

SEQ ID NO: 1342191 - protein, 9 aa, Mycobacterium
DVTTPDGDT

SEQ ID NO: 1342192 - protein, 7 aa, Mycobacterium
DWPDRPD

SEQ ID NO: 1342193 - protein, 13 aa, Mycobacterium
DYIEDQAGQQELT

SEQ ID NO: 1342194 - protein, 14 aa, Mycobacterium
DYNESGDVAPDGKT

SEQ ID NO: 1342195 - protein, 8 aa, Mycobacterium
DYRPDGTA

SEQ ID NO: 1342196 - protein, 12 aa, Mycobacterium
DYSDRPAQGEGT

SEQ ID NO: 1342197 - protein, 8 aa, Mycobacterium
DYTGLGTP

SEQ ID NO: 1342198 - protein, 9 aa, Mycobacterium
EAAADAREL

SEQ ID NO: 1342199 - protein, 9 aa, Mycobacterium
EAAAGPDAR

SEQ ID NO: 1342200 - protein, 4 aa, Mycobacterium
EAAD

SEQ ID NO: 1342201 - protein, 12 aa, Mycobacterium
EAAGESMTGVPA

SEQ ID NO: 1342202 - protein, 7 aa, Mycobacterium
EAAGGSL

SEQ ID NO: 1342203 - protein, 9 aa, Mycobacterium
EAAGKKEIA

SEQ ID NO: 1342204 - protein, 11 aa, Mycobacterium
EAAKAKGAKVF

SEQ ID NO: 1342205 - protein, 11 aa, Mycobacterium
EAAKATGDPDY

SEQ ID NO: 1342206 - protein, 9 aa, Mycobacterium
EAAPALPPV

SEQ ID NO: 1342207 - protein, 10 aa, Mycobacterium
EAAPWTGKDD

SEQ ID NO: 1342208 - protein, 4 aa, Mycobacterium
EAAR

SEQ ID NO: 1342209 - protein, 9 aa, Mycobacterium
EAARAAQAA

SEQ ID NO: 1342210 - protein, 6 aa, Mycobacterium
EAARSA

SEQ ID NO: 1342211 - protein, 14 aa, Mycobacterium
EAATEQRVKGEQAA

SEQ ID NO: 1342212 - protein, 6 aa, Mycobacterium
EAATGE

SEQ ID NO: 1342213 - protein, 10 aa, Mycobacterium
EADGSTPRSW

SEQ ID NO: 1342214 - protein, 9 aa, Mycobacterium
EADPPTVQS

SEQ ID NO: 1342215 - protein, 7 aa, Mycobacterium
EADRQSR

SEQ ID NO: 1342216 - protein, 9 aa, Mycobacterium
EAEGGEDAE

SEQ ID NO: 1342217 - protein, 7 aa, Mycobacterium
EAEKGSQ

SEQ ID NO: 1342218 - protein, 11 aa, Mycobacterium
EAELEGASPDA

SEQ ID NO: 1342219 - protein, 5 aa, Mycobacterium
EAEPL

SEQ ID NO: 1342220 - protein, 13 aa, Mycobacterium
EAEYPDRERNGDK

SEQ ID NO: 1342221 - protein, 13 aa, Mycobacterium
EAFDDSGDYRNEA

SEQ ID NO: 1342222 - protein, 8 aa, Mycobacterium
EAGASAAD

SEQ ID NO: 1342223 - protein, 7 aa, Mycobacterium
EAGATRV

SEQ ID NO: 1342224 - protein, 15 aa, Mycobacterium
EAGDPDPRRSALNSE

SEQ ID NO: 1342225 - protein, 19 aa, Mycobacterium
EAGDSDEQLANSSGRPIHG

SEQ ID NO: 1342226 - protein, 4 aa, Mycobacterium
EAGG

SEQ ID NO: 1342227 - protein, 4 aa, Mycobacterium
EAGI

SEQ ID NO: 1342228 - protein, 5 aa, Mycobacterium
EAGIK

SEQ ID NO: 1342229 - protein, 4 aa, Mycobacterium
EAGL

SEQ ID NO: 1342230 - protein, 14 aa, Mycobacterium
EAGPSDQVRIPPGA

SEQ ID NO: 1342231 - protein, 6 aa, Mycobacterium
EAGSSA

SEQ ID NO: 1342232 - protein, 9 aa, Mycobacterium
EAITEDEPS

SEQ ID NO: 1342233 - protein, 4 aa, Mycobacterium
EALA

SEQ ID NO: 1342234 - protein, 23 aa, Mycobacterium
EALGVTSDKLASVSQAVTDSLDD

SEQ ID NO: 1342235 - protein, 10 aa, Mycobacterium
EALSTNGWTA

SEQ ID NO: 1342236 - protein, 10 aa, Mycobacterium
EALTGQARQD

SEQ ID NO: 1342237 - protein, 4 aa, Mycobacterium
EANP

SEQ ID NO: 1342238 - protein, 9 aa, Mycobacterium
EANPEANRA

SEQ ID NO: 1342239 - protein, 6 aa, Mycobacterium
EANQRV

SEQ ID NO: 1342240 - protein, 10 aa, Mycobacterium
EAPATPAPVA

SEQ ID NO: 1342241 - protein, 8 aa, Mycobacterium
EAPDGGQD

SEQ ID NO: 1342242 - protein, 7 aa, Mycobacterium
EAPDYGE

SEQ ID NO: 1342243 - protein, 12 aa, Mycobacterium
EAPGEREAADEV

SEQ ID NO: 1342244 - protein, 10 aa, Mycobacterium
EAPGESGAGG

SEQ ID NO: 1342245 - protein, 11 aa, Mycobacterium
EAPPSPFGGPD

SEQ ID NO: 1342246 - protein, 10 aa, Mycobacterium
EAPTASAASK

SEQ ID NO: 1342247 - protein, 4 aa, Mycobacterium
EAPY

SEQ ID NO: 1342248 - protein, 8 aa, Mycobacterium
EAQAAGGE

SEQ ID NO: 1342249 - protein, 6 aa, Mycobacterium
EAQPEQ

SEQ ID NO: 1342250 - protein, 5 aa, Mycobacterium
EAQPS

SEQ ID NO: 1342251 - protein, 4 aa, Mycobacterium
EARA

SEQ ID NO: 1342252 - protein, 6 aa, Mycobacterium
EARGAT

SEQ ID NO: 1342253 - protein, 6 aa, Mycobacterium
EARPDL

SEQ ID NO: 1342254 - protein, 8 aa, Mycobacterium
EASGKGFT

SEQ ID NO: 1342255 - protein, 4 aa, Mycobacterium
EASP

SEQ ID NO: 1342256 - protein, 11 aa, Mycobacterium
EASRGRGKRPV

SEQ ID NO: 1342257 - protein, 5 aa, Mycobacterium
EASSH

SEQ ID NO: 1342258 - protein, 15 aa, Mycobacterium
EATLARDTVQSELDS

SEQ ID NO: 1342259 - protein, 11 aa, Mycobacterium
EATPKRDAAER

SEQ ID NO: 1342260 - protein, 11 aa, Mycobacterium
EATRAAAADGV

SEQ ID NO: 1342261 - protein, 10 aa, Mycobacterium
EATTAQASID

SEQ ID NO: 1342262 - protein, 13 aa, Mycobacterium
EAVATGAGKSWED

SEQ ID NO: 1342263 - protein, 8 aa, Mycobacterium
EAYPPGST

SEQ ID NO: 1342264 - protein, 16 aa, Mycobacterium
ECPEQSPRPGKGDTFE

SEQ ID NO: 1342265 - protein, 11 aa, Mycobacterium
ECSGGDSGLTT

SEQ ID NO: 1342266 - protein, 6 aa, Mycobacterium
EDAAEA

SEQ ID NO: 1342267 - protein, 7 aa, Mycobacterium
EDAPAGT

SEQ ID NO: 1342268 - protein, 9 aa, Mycobacterium
EDASARYGV

SEQ ID NO: 1342269 - protein, 9 aa, Mycobacterium
EDDAPDEDA

SEQ ID NO: 1342270 - protein, 14 aa, Mycobacterium
EDGEAVSGKLSQDG

SEQ ID NO: 1342271 - protein, 15 aa, Mycobacterium
EDGEAVSGKLSQDGL

SEQ ID NO: 1342272 - protein, 7 aa, Mycobacterium
EDGELGE

SEQ ID NO: 1342273 - protein, 14 aa, Mycobacterium
EDGEPVAGQLSEDG

SEQ ID NO: 1342274 - protein, 18 aa, Mycobacterium
EDGGPGRPITDAQKQAAR

SEQ ID NO: 1342275 - protein, 6 aa, Mycobacterium
EDGNPI

SEQ ID NO: 1342276 - protein, 4 aa, Mycobacterium
EDGP

SEQ ID NO: 1342277 - protein, 16 aa, Mycobacterium
EDHADKDFSAIIETLR

SEQ ID NO: 1342278 - protein, 29 aa, Mycobacterium
EDLQDDDAATVDLPTDVGGSAAANTEPTA

SEQ ID NO: 1342279 - protein, 5 aa, Mycobacterium
EDNDF

SEQ ID NO: 1342280 - protein, 9 aa, Mycobacterium
EDPAAPLER

SEQ ID NO: 1342281 - protein, 7 aa, Mycobacterium
EDPDPKI

SEQ ID NO: 1342282 - protein, 9 aa, Mycobacterium
EDPGNPGVQ

SEQ ID NO: 1342283 - protein, 9 aa, Mycobacterium
EDPQAAAEA

SEQ ID NO: 1342284 - protein, 10 aa, Mycobacterium
EDPRSEAARD

SEQ ID NO: 1342285 - protein, 9 aa, Mycobacterium
EDPRTGHTS

SEQ ID NO: 1342286 - protein, 9 aa, Mycobacterium
EDPVYESTG

SEQ ID NO: 1342287 - protein, 15 aa, Mycobacterium
EDQAAPPDAPRESEP

SEQ ID NO: 1342288 - protein, 8 aa, Mycobacterium
EDQRPADD

SEQ ID NO: 1342289 - protein, 16 aa, Mycobacterium
EDQTGELPVTEDSTRS

SEQ ID NO: 1342290 - protein, 9 aa, Mycobacterium
EDRGVRADD

SEQ ID NO: 1342291 - protein, 7 aa, Mycobacterium
EDVPPGA

SEQ ID NO: 1342292 - protein, 11 aa, Mycobacterium
EEAAAAAAQLG

SEQ ID NO: 1342293 - protein, 6 aa, Mycobacterium
EEADAQ

SEQ ID NO: 1342294 - protein, 8 aa, Mycobacterium
EEADGEVR

SEQ ID NO: 1342295 - protein, 25 aa, Mycobacterium
EEAPDDDTDVTDADGEQTPAPEGAD

SEQ ID NO: 1342296 - protein, 8 aa, Mycobacterium
EEAPGWDE

SEQ ID NO: 1342297 - protein, 7 aa, Mycobacterium
EEDKRQL

SEQ ID NO: 1342298 - protein, 11 aa, Mycobacterium
EEEGAEPGYQS

SEQ ID NO: 1342299 - protein, 6 aa, Mycobacterium
EEEVGG

SEQ ID NO: 1342300 - protein, 7 aa, Mycobacterium
EEGTVSL

SEQ ID NO: 1342301 - protein, 17 aa, Mycobacterium
EEIPGGVRTTTESDSAD

SEQ ID NO: 1342302 - protein, 16 aa, Mycobacterium
EEMRTGASLDAEARAP

SEQ ID NO: 1342303 - protein, 6 aa, Mycobacterium
EEPATV

SEQ ID NO: 1342304 - protein, 9 aa, Mycobacterium
EEPAYAGTG

SEQ ID NO: 1342305 - protein, 12 aa, Mycobacterium
EEPGEQEAAEEV

SEQ ID NO: 1342306 - protein, 7 aa, Mycobacterium
EEPKTAN

SEQ ID NO: 1342307 - protein, 13 aa, Mycobacterium
EEPVAAPAPAPVE

SEQ ID NO: 1342308 - protein, 5 aa, Mycobacterium
EEPYT

SEQ ID NO: 1342309 - protein, 21 aa, Mycobacterium
EEQGVDPAVAEPEAQAAGREQ

SEQ ID NO: 1342310 - protein, 8 aa, Mycobacterium
EETADDPN

SEQ ID NO: 1342311 - protein, 9 aa, Mycobacterium
EETAELGGK

SEQ ID NO: 1342312 - protein, 97 aa, Mycobacterium
EETASLDRSRPAESAGEETTAPETDVEAGDTAAAVATDDTTDGEGTATVEEDGVAPEDVAGDEEQAVAEDVSGADGAEDATEEATDVVTEETTDVVT

SEQ ID NO: 1342313 - protein, 9 aa, Mycobacterium
EETERGHSA

SEQ ID NO: 1342314 - protein, 4 aa, Mycobacterium
EETL

SEQ ID NO: 1342315 - protein, 5 aa, Mycobacterium
EFGSD

SEQ ID NO: 1342316 - protein, 7 aa, Mycobacterium
EGAEYAH

SEQ ID NO: 1342317 - protein, 15 aa, Mycobacterium
EGAGATTTLKPGETI

SEQ ID NO: 1342318 - protein, 6 aa, Mycobacterium
EGAGGL

SEQ ID NO: 1342319 - protein, 6 aa, Mycobacterium
EGATPT

SEQ ID NO: 1342320 - protein, 8 aa, Mycobacterium
EGATRESF

SEQ ID NO: 1342321 - protein, 6 aa, Mycobacterium
EGAWSI

SEQ ID NO: 1342322 - protein, 15 aa, Mycobacterium
EGDLTQSPAVAAKGT

SEQ ID NO: 1342323 - protein, 10 aa, Mycobacterium
EGDSAGTSDP

SEQ ID NO: 1342324 - protein, 8 aa, Mycobacterium
EGDSSPAD

SEQ ID NO: 1342325 - protein, 9 aa, Mycobacterium
EGDYTTPDD

SEQ ID NO: 1342326 - protein, 11 aa, Mycobacterium
EGEGSGQVPLD

SEQ ID NO: 1342327 - protein, 8 aa, Mycobacterium
EGEIDGVD

SEQ ID NO: 1342328 - protein, 5 aa, Mycobacterium
EGEIV

SEQ ID NO: 1342329 - protein, 21 aa, Mycobacterium
EGGEAFTTEEQPQELDETEDV

SEQ ID NO: 1342330 - protein, 4 aa, Mycobacterium
EGGV

SEQ ID NO: 1342331 - protein, 9 aa, Mycobacterium
EGIEGGCNT

SEQ ID NO: 1342332 - protein, 4 aa, Mycobacterium
EGIG

SEQ ID NO: 1342333 - protein, 12 aa, Mycobacterium
EGIGQGKVTASP

SEQ ID NO: 1342334 - protein, 4 aa, Mycobacterium
EGLL

SEQ ID NO: 1342335 - protein, 10 aa, Mycobacterium
EGLRGNGDDV

SEQ ID NO: 1342336 - protein, 7 aa, Mycobacterium
EGNPVRV

SEQ ID NO: 1342337 - protein, 4 aa, Mycobacterium
EGNV

SEQ ID NO: 1342338 - protein, 8 aa, Mycobacterium
EGPGPRVD

SEQ ID NO: 1342339 - protein, 8 aa, Mycobacterium
EGPPGAQL

SEQ ID NO: 1342340 - protein, 15 aa, Mycobacterium
EGPPMPAQCRHGSVP

SEQ ID NO: 1342341 - protein, 8 aa, Mycobacterium
EGRRPPSV

SEQ ID NO: 1342342 - protein, 7 aa, Mycobacterium
EGSASGY

SEQ ID NO: 1342343 - protein, 4 aa, Mycobacterium
EGSG

SEQ ID NO: 1342344 - protein, 5 aa, Mycobacterium
EGSGN

SEQ ID NO: 1342345 - protein, 6 aa, Mycobacterium
EGSPGV

SEQ ID NO: 1342346 - protein, 18 aa, Mycobacterium
EGSREAAIKQAEGQKQAQ

SEQ ID NO: 1342347 - protein, 11 aa, Mycobacterium
EGTARDGIPYR

SEQ ID NO: 1342348 - protein, 11 aa, Mycobacterium
EGTGQAGQSQM

SEQ ID NO: 1342349 - protein, 14 aa, Mycobacterium
EGTGQPKGTTQTAF

SEQ ID NO: 1342350 - protein, 7 aa, Mycobacterium
EGTGSVD

SEQ ID NO: 1342351 - protein, 8 aa, Mycobacterium
EGTGTADA

SEQ ID NO: 1342352 - protein, 5 aa, Mycobacterium
EGTPI

SEQ ID NO: 1342353 - protein, 5 aa, Mycobacterium
EGTTY

SEQ ID NO: 1342354 - protein, 6 aa, Mycobacterium
EGVEPG

SEQ ID NO: 1342355 - protein, 15 aa, Mycobacterium
EGVGDTKKLNPGSTI

SEQ ID NO: 1342356 - protein, 13 aa, Mycobacterium
EHAARADLDAEAT

SEQ ID NO: 1342357 - protein, 9 aa, Mycobacterium
EHATDEGKA

SEQ ID NO: 1342358 - protein, 8 aa, Mycobacterium
EHDGRETY

SEQ ID NO: 1342359 - protein, 7 aa, Mycobacterium
EHDRTDT

SEQ ID NO: 1342360 - protein, 4 aa, Mycobacterium
EHGD

SEQ ID NO: 1342361 - protein, 12 aa, Mycobacterium
EHGGAALDTAEA

SEQ ID NO: 1342362 - protein, 4 aa, Mycobacterium
EHGP

SEQ ID NO: 1342363 - protein, 17 aa, Mycobacterium
EHSPTGASEQALPTRAA

SEQ ID NO: 1342364 - protein, 5 aa, Mycobacterium
EIAPG

SEQ ID NO: 1342365 - protein, 16 aa, Mycobacterium
EIDPNQHSCGSVSPHG

SEQ ID NO: 1342366 - protein, 4 aa, Mycobacterium
EIEG

SEQ ID NO: 1342367 - protein, 10 aa, Mycobacterium
EIENGQSPDV

SEQ ID NO: 1342368 - protein, 13 aa, Mycobacterium
EIEPRGSEALQSN

SEQ ID NO: 1342369 - protein, 5 aa, Mycobacterium
EIGPE

SEQ ID NO: 1342370 - protein, 6 aa, Mycobacterium
EIKDSM

SEQ ID NO: 1342371 - protein, 6 aa, Mycobacterium
EINGDD

SEQ ID NO: 1342372 - protein, 5 aa, Mycobacterium
EIPAA

SEQ ID NO: 1342373 - protein, 19 aa, Mycobacterium
EIPGGVRTTTESDSPDLTA

SEQ ID NO: 1342374 - protein, 12 aa, Mycobacterium
EISTDGGGTEQV

SEQ ID NO: 1342375 - protein, 45 aa, Mycobacterium
EITDPDVDEPTTTPEPPAEPADPPEPVPAEPTDTAVDEPVTTQPV

SEQ ID NO: 1342376 - protein, 8 aa, Mycobacterium
EKANADAF

SEQ ID NO: 1342377 - protein, 5 aa, Mycobacterium
EKAQS

SEQ ID NO: 1342378 - protein, 12 aa, Mycobacterium
EKARAASAQMRE

SEQ ID NO: 1342379 - protein, 8 aa, Mycobacterium
EKEKGRAV

SEQ ID NO: 1342380 - protein, 8 aa, Mycobacterium
EKGATTEQ

SEQ ID NO: 1342381 - protein, 4 aa, Mycobacterium
EKNP

SEQ ID NO: 1342382 - protein, 6 aa, Mycobacterium
EKPAEG

SEQ ID NO: 1342383 - protein, 10 aa, Mycobacterium
EKPAKAPDPD

SEQ ID NO: 1342384 - protein, 7 aa, Mycobacterium
EKPFPDP

SEQ ID NO: 1342385 - protein, 4 aa, Mycobacterium
EKPR

SEQ ID NO: 1342386 - protein, 11 aa, Mycobacterium
EKQKEGKKRMK

SEQ ID NO: 1342387 - protein, 29 aa, Mycobacterium
EKQPAPASVSTETAPPTDTPPADPPPGVD

SEQ ID NO: 1342388 - protein, 5 aa, Mycobacterium
EKRTG

SEQ ID NO: 1342389 - protein, 8 aa, Mycobacterium
EKSFKGSD

SEQ ID NO: 1342390 - protein, 11 aa, Mycobacterium
EKSGHSRGSTV

SEQ ID NO: 1342391 - protein, 4 aa, Mycobacterium
EKTG

SEQ ID NO: 1342392 - protein, 7 aa, Mycobacterium
EKTHSYK

SEQ ID NO: 1342393 - protein, 5 aa, Mycobacterium
EKVAG

SEQ ID NO: 1342394 - protein, 8 aa, Mycobacterium
ELADNDAL

SEQ ID NO: 1342395 - protein, 14 aa, Mycobacterium
ELAGEDPAGTPHDP

SEQ ID NO: 1342396 - protein, 5 aa, Mycobacterium
ELDEM

SEQ ID NO: 1342397 - protein, 12 aa, Mycobacterium
ELDPAKARTLAN

SEQ ID NO: 1342398 - protein, 19 aa, Mycobacterium
ELDPGTGAVRRSTPLPGGY

SEQ ID NO: 1342399 - protein, 7 aa, Mycobacterium
ELDPRRT

SEQ ID NO: 1342400 - protein, 9 aa, Mycobacterium
ELEPGATVS

SEQ ID NO: 1342401 - protein, 9 aa, Mycobacterium
ELGGTVDAE

SEQ ID NO: 1342402 - protein, 13 aa, Mycobacterium
ELGPQADVSGTSI

SEQ ID NO: 1342403 - protein, 13 aa, Mycobacterium
ELPANATATLGQT

SEQ ID NO: 1342404 - protein, 6 aa, Mycobacterium
ELPDGP

SEQ ID NO: 1342405 - protein, 4 aa, Mycobacterium
ELPG

SEQ ID NO: 1342406 - protein, 20 aa, Mycobacterium
ELPRDPRSNQGWNPEPLAGN

SEQ ID NO: 1342407 - protein, 17 aa, Mycobacterium
ELSDPSVGQPGTPPLPV

SEQ ID NO: 1342408 - protein, 9 aa, Mycobacterium
ELSGGVDGR

SEQ ID NO: 1342409 - protein, 9 aa, Mycobacterium
ELSGHDGPR

SEQ ID NO: 1342410 - protein, 5 aa, Mycobacterium
ELTES

SEQ ID NO: 1342411 - protein, 7 aa, Mycobacterium
ELTPGEQ

SEQ ID NO: 1342412 - protein, 6 aa, Mycobacterium
ELTSRG

SEQ ID NO: 1342413 - protein, 19 aa, Mycobacterium
EMPPEPARAPTAADDDCDP

SEQ ID NO: 1342414 - protein, 15 aa, Mycobacterium
EMQATTQAAEAGAEI

SEQ ID NO: 1342415 - protein, 15 aa, Mycobacterium
ENAADIERTAGPAVD

SEQ ID NO: 1342416 - protein, 6 aa, Mycobacterium
ENAGAL

SEQ ID NO: 1342417 - protein, 11 aa, Mycobacterium
ENAVADKSAYE

SEQ ID NO: 1342418 - protein, 8 aa, Mycobacterium
ENDPDVGF

SEQ ID NO: 1342419 - protein, 20 aa, Mycobacterium
ENDTAGSAAKATFADGTTVS

SEQ ID NO: 1342420 - protein, 5 aa, Mycobacterium
ENGDF

SEQ ID NO: 1342421 - protein, 10 aa, Mycobacterium
ENGSDKTEEF

SEQ ID NO: 1342422 - protein, 9 aa, Mycobacterium
ENGSSPFNS

SEQ ID NO: 1342423 - protein, 8 aa, Mycobacterium
ENIAPDEI

SEQ ID NO: 1342424 - protein, 5 aa, Mycobacterium
ENNPA

SEQ ID NO: 1342425 - protein, 25 aa, Mycobacterium
ENPENRSGPDDGGPERALPGTVDEA

SEQ ID NO: 1342426 - protein, 10 aa, Mycobacterium
ENPNGGDFAR

SEQ ID NO: 1342427 - protein, 4 aa, Mycobacterium
ENQV

SEQ ID NO: 1342428 - protein, 9 aa, Mycobacterium
ENRETLKPA

SEQ ID NO: 1342429 - protein, 15 aa, Mycobacterium
ENSNPSSSSSVGSAD

SEQ ID NO: 1342430 - protein, 15 aa, Mycobacterium
ENSPPGSVSEATFDG

SEQ ID NO: 1342431 - protein, 16 aa, Mycobacterium
ENSPPGSVSKATFDGN

SEQ ID NO: 1342432 - protein, 14 aa, Mycobacterium
ENTRPAAGIDNPRL

SEQ ID NO: 1342433 - protein, 12 aa, Mycobacterium
EPADHGHGGHGS

SEQ ID NO: 1342434 - protein, 93 aa, Mycobacterium
EPAGAATPPAPAGPPAGVVEPAAGAVPPAPAGPPAGVVEPAAGAAPAAPAGPGAPGGGSGGAGAPPAPPAPPAAAVQPAAAAVPPAPPAPPAA

SEQ ID NO: 1342435 - protein, 8 aa, Mycobacterium
EPANGALT

SEQ ID NO: 1342436 - protein, 7 aa, Mycobacterium
EPAPATA

SEQ ID NO: 1342437 - protein, 5 aa, Mycobacterium
EPAPI

SEQ ID NO: 1342438 - protein, 8 aa, Mycobacterium
EPARQRYE

SEQ ID NO: 1342439 - protein, 36 aa, Mycobacterium
EPASGVTPPAPPAPGGPAGGSGGAVTPPGPPAPPAA

SEQ ID NO: 1342440 - protein, 9 aa, Mycobacterium
EPATIRAET

SEQ ID NO: 1342441 - protein, 16 aa, Mycobacterium
EPCPTGGDAGPGPETL

SEQ ID NO: 1342442 - protein, 5 aa, Mycobacterium
EPDGN

SEQ ID NO: 1342443 - protein, 18 aa, Mycobacterium
EPDNPADAYKDVERRDKV

SEQ ID NO: 1342444 - protein, 6 aa, Mycobacterium
EPDTVD

SEQ ID NO: 1342445 - protein, 7 aa, Mycobacterium
EPEAEHG

SEQ ID NO: 1342446 - protein, 12 aa, Mycobacterium
EPEDRTRPGSRA

SEQ ID NO: 1342447 - protein, 4 aa, Mycobacterium
EPEG

SEQ ID NO: 1342448 - protein, 4 aa, Mycobacterium
EPET

SEQ ID NO: 1342449 - protein, 4 aa, Mycobacterium
EPFT

SEQ ID NO: 1342450 - protein, 9 aa, Mycobacterium
EPGDTVGLG

SEQ ID NO: 1342451 - protein, 7 aa, Mycobacterium
EPGPIPA

SEQ ID NO: 1342452 - protein, 10 aa, Mycobacterium
EPGQENADIS

SEQ ID NO: 1342453 - protein, 9 aa, Mycobacterium
EPGQNAANV

SEQ ID NO: 1342454 - protein, 11 aa, Mycobacterium
EPHPPYQRPPL

SEQ ID NO: 1342455 - protein, 16 aa, Mycobacterium
EPIDPDDEGMSDYSGP

SEQ ID NO: 1342456 - protein, 12 aa, Mycobacterium
EPIEDSPDGSAW

SEQ ID NO: 1342457 - protein, 8 aa, Mycobacterium
EPKPVQKP

SEQ ID NO: 1342458 - protein, 8 aa, Mycobacterium
EPLAPQSE

SEQ ID NO: 1342459 - protein, 5 aa, Mycobacterium
EPLGY

SEQ ID NO: 1342460 - protein, 11 aa, Mycobacterium
EPLSRKQDIGA

SEQ ID NO: 1342461 - protein, 6 aa, Mycobacterium
EPNGTF

SEQ ID NO: 1342462 - protein, 28 aa, Mycobacterium
EPPAPAAEPPPGPAAEPPPGPAAEPVPA

SEQ ID NO: 1342463 - protein, 9 aa, Mycobacterium
EPPPRPADV

SEQ ID NO: 1342464 - protein, 7 aa, Mycobacterium
EPPSGIT

SEQ ID NO: 1342465 - protein, 7 aa, Mycobacterium
EPPTLEP

SEQ ID NO: 1342466 - protein, 6 aa, Mycobacterium
EPQPDR

SEQ ID NO: 1342467 - protein, 8 aa, Mycobacterium
EPQPDRAK

SEQ ID NO: 1342468 - protein, 20 aa, Mycobacterium
EPSADRAADAAALATEADSV

SEQ ID NO: 1342469 - protein, 6 aa, Mycobacterium
EPSAPA

SEQ ID NO: 1342470 - protein, 6 aa, Mycobacterium
EPSLTV

SEQ ID NO: 1342471 - protein, 17 aa, Mycobacterium
EPTAAVSTTVASPPEVP

SEQ ID NO: 1342472 - protein, 5 aa, Mycobacterium
EPTGT

SEQ ID NO: 1342473 - protein, 6 aa, Mycobacterium
EPTPRE

SEQ ID NO: 1342474 - protein, 6 aa, Mycobacterium
EPTRRG

SEQ ID NO: 1342475 - protein, 9 aa, Mycobacterium
EPVAPPPPA

SEQ ID NO: 1342476 - protein, 5 aa, Mycobacterium
EPVGE

SEQ ID NO: 1342477 - protein, 9 aa, Mycobacterium
EQAPPPQKT

SEQ ID NO: 1342478 - protein, 9 aa, Mycobacterium
EQARALNPA

SEQ ID NO: 1342479 - protein, 8 aa, Mycobacterium
EQATAQWS

SEQ ID NO: 1342480 - protein, 21 aa, Mycobacterium
EQATTYTATYTASSGANLAQV

SEQ ID NO: 1342481 - protein, 8 aa, Mycobacterium
EQDGSKQW

SEQ ID NO: 1342482 - protein, 7 aa, Mycobacterium
EQDGSRQ

SEQ ID NO: 1342483 - protein, 44 aa, Mycobacterium
EQEENVTDDGAEDLDADAEDADITDGGQDADPETDTAAPEEKVA

SEQ ID NO: 1342484 - protein, 5 aa, Mycobacterium
EQFPE

SEQ ID NO: 1342485 - protein, 6 aa, Mycobacterium
EQGLAE

SEQ ID NO: 1342486 - protein, 5 aa, Mycobacterium
EQGNG

SEQ ID NO: 1342487 - protein, 18 aa, Mycobacterium
EQGVNPSTLAQGQKTTGK

SEQ ID NO: 1342488 - protein, 5 aa, Mycobacterium
EQIER

SEQ ID NO: 1342489 - protein, 14 aa, Mycobacterium
EQIPTLPSGKLDRR

SEQ ID NO: 1342490 - protein, 22 aa, Mycobacterium
EQISAATDGRVKATAAETGASV

SEQ ID NO: 1342491 - protein, 7 aa, Mycobacterium
EQITAQR

SEQ ID NO: 1342492 - protein, 5 aa, Mycobacterium
EQKPV

SEQ ID NO: 1342493 - protein, 6 aa, Mycobacterium
EQLPPG

SEQ ID NO: 1342494 - protein, 11 aa, Mycobacterium
EQLTKSGARYS

SEQ ID NO: 1342495 - protein, 9 aa, Mycobacterium
EQNDKGQIR

SEQ ID NO: 1342496 - protein, 6 aa, Mycobacterium
EQNSGN

SEQ ID NO: 1342497 - protein, 9 aa, Mycobacterium
EQQATPQQI

SEQ ID NO: 1342498 - protein, 5 aa, Mycobacterium
EQRAT

SEQ ID NO: 1342499 - protein, 6 aa, Mycobacterium
EQREQL

SEQ ID NO: 1342500 - protein, 14 aa, Mycobacterium
EQRGRSVATPESAH

SEQ ID NO: 1342501 - protein, 6 aa, Mycobacterium
EQRQQE

SEQ ID NO: 1342502 - protein, 4 aa, Mycobacterium
EQSE

SEQ ID NO: 1342503 - protein, 128 aa, Mycobacterium
EQSHAEDEPVQTADTGPGAPEPDAGTDAHADVAEGPDDDEALEPVDNQPSDRPAARNHDDDPDTDNATIAASADPAGAATGNDATEAEGAQARDGQSGRIDEADDEPDAAGSDPANSSGAARDVKNDE

SEQ ID NO: 1342504 - protein, 8 aa, Mycobacterium
EQTAGGNY

SEQ ID NO: 1342505 - protein, 4 aa, Mycobacterium
EQWG

SEQ ID NO: 1342506 - protein, 4 aa, Mycobacterium
ERAN

SEQ ID NO: 1342507 - protein, 8 aa, Mycobacterium
ERARRAQG

SEQ ID NO: 1342508 - protein, 6 aa, Mycobacterium
EREGDI

SEQ ID NO: 1342509 - protein, 6 aa, Mycobacterium
EREIET

SEQ ID NO: 1342510 - protein, 8 aa, Mycobacterium
EREPTFGR

SEQ ID NO: 1342511 - protein, 9 aa, Mycobacterium
ERGATPVPT

SEQ ID NO: 1342512 - protein, 5 aa, Mycobacterium
ERGHP

SEQ ID NO: 1342513 - protein, 7 aa, Mycobacterium
ERGLPGR

SEQ ID NO: 1342514 - protein, 13 aa, Mycobacterium
ERGPNYQPRPGIG

SEQ ID NO: 1342515 - protein, 6 aa, Mycobacterium
ERHRRE

SEQ ID NO: 1342516 - protein, 7 aa, Mycobacterium
ERIPGKG

SEQ ID NO: 1342517 - protein, 7 aa, Mycobacterium
ERLGPDR

SEQ ID NO: 1342518 - protein, 27 aa, Mycobacterium
ERMQEVPSGAAHGAGSPEQRRLRPEND

SEQ ID NO: 1342519 - protein, 9 aa, Mycobacterium
ERNPDLGTR

SEQ ID NO: 1342520 - protein, 12 aa, Mycobacterium
ERNPGKRGGEFD

SEQ ID NO: 1342521 - protein, 4 aa, Mycobacterium
ERPD

SEQ ID NO: 1342522 - protein, 7 aa, Mycobacterium
ERPPAAD

SEQ ID NO: 1342523 - protein, 12 aa, Mycobacterium
ERPYASAQPTRT

SEQ ID NO: 1342524 - protein, 5 aa, Mycobacterium
ERQPM

SEQ ID NO: 1342525 - protein, 5 aa, Mycobacterium
ERQSD

SEQ ID NO: 1342526 - protein, 9 aa, Mycobacterium
ERREQAPDR

SEQ ID NO: 1342527 - protein, 8 aa, Mycobacterium
ERRLGGRT

SEQ ID NO: 1342528 - protein, 4 aa, Mycobacterium
ERSD

SEQ ID NO: 1342529 - protein, 12 aa, Mycobacterium
ERSGPCASESPA

SEQ ID NO: 1342530 - protein, 4 aa, Mycobacterium
ERST

SEQ ID NO: 1342531 - protein, 11 aa, Mycobacterium
ERTQPAMSSRA

SEQ ID NO: 1342532 - protein, 4 aa, Mycobacterium
ERTY

SEQ ID NO: 1342533 - protein, 6 aa, Mycobacterium
ERYTPE

SEQ ID NO: 1342534 - protein, 18 aa, Mycobacterium
ESAADRGLPFDEQADAQM

SEQ ID NO: 1342535 - protein, 14 aa, Mycobacterium
ESAAPTSGPNAKTM

SEQ ID NO: 1342536 - protein, 9 aa, Mycobacterium
ESAATTPDS

SEQ ID NO: 1342537 - protein, 5 aa, Mycobacterium
ESAEG

SEQ ID NO: 1342538 - protein, 8 aa, Mycobacterium
ESASNVAT

SEQ ID NO: 1342539 - protein, 11 aa, Mycobacterium
ESASSTWDDAG

SEQ ID NO: 1342540 - protein, 10 aa, Mycobacterium
ESATGADPSR

SEQ ID NO: 1342541 - protein, 11 aa, Mycobacterium
ESAYNRPSADI

SEQ ID NO: 1342542 - protein, 7 aa, Mycobacterium
ESCGTIE

SEQ ID NO: 1342543 - protein, 7 aa, Mycobacterium
ESDGWDP

SEQ ID NO: 1342544 - protein, 7 aa, Mycobacterium
ESDQEQA

SEQ ID NO: 1342545 - protein, 9 aa, Mycobacterium
ESGAQRPVE

SEQ ID NO: 1342546 - protein, 14 aa, Mycobacterium
ESGLGRDTVTPSDV

SEQ ID NO: 1342547 - protein, 10 aa, Mycobacterium
ESGPQARAEA

SEQ ID NO: 1342548 - protein, 6 aa, Mycobacterium
ESGSCA

SEQ ID NO: 1342549 - protein, 16 aa, Mycobacterium
ESGSYARVRPGAQPEV

SEQ ID NO: 1342550 - protein, 14 aa, Mycobacterium
ESGVARHQTGHNSG

SEQ ID NO: 1342551 - protein, 6 aa, Mycobacterium
ESGVER

SEQ ID NO: 1342552 - protein, 8 aa, Mycobacterium
ESIEPEPH

SEQ ID NO: 1342553 - protein, 4 aa, Mycobacterium
ESKW

SEQ ID NO: 1342554 - protein, 19 aa, Mycobacterium
ESLNAPNANSIPPTLGGGN

SEQ ID NO: 1342555 - protein, 7 aa, Mycobacterium
ESLSSGP

SEQ ID NO: 1342556 - protein, 7 aa, Mycobacterium
ESPGIDK

SEQ ID NO: 1342557 - protein, 28 aa, Mycobacterium
ESPPPTENSGATTESAASAQPATPKRPW

SEQ ID NO: 1342558 - protein, 15 aa, Mycobacterium
ESQQSVDRLGAERDS

SEQ ID NO: 1342559 - protein, 16 aa, Mycobacterium
ESREQEASKKAAELAG

SEQ ID NO: 1342560 - protein, 17 aa, Mycobacterium
ESSQPEELSTPGGYPAP

SEQ ID NO: 1342561 - protein, 8 aa, Mycobacterium
ESSRSDWD

SEQ ID NO: 1342562 - protein, 11 aa, Mycobacterium
ESTAGNAAPGM

SEQ ID NO: 1342563 - protein, 9 aa, Mycobacterium
ESTALNERI

SEQ ID NO: 1342564 - protein, 5 aa, Mycobacterium
ESTDD

SEQ ID NO: 1342565 - protein, 6 aa, Mycobacterium
ESTYAD

SEQ ID NO: 1342566 - protein, 23 aa, Mycobacterium
ESVDTTQTTGSRNPAVTAPATTM

SEQ ID NO: 1342567 - protein, 21 aa, Mycobacterium
ESWTDDTTAPGGHNGCDTRND

SEQ ID NO: 1342568 - protein, 5 aa, Mycobacterium
ETADR

SEQ ID NO: 1342569 - protein, 14 aa, Mycobacterium
ETAGAAEATATRLR

SEQ ID NO: 1342570 - protein, 6 aa, Mycobacterium
ETAPAG

SEQ ID NO: 1342571 - protein, 13 aa, Mycobacterium
ETAPVDGADTDQT

SEQ ID NO: 1342572 - protein, 97 aa, Mycobacterium
ETDDPQTADPAAAPTEPADTIDGEEGGESADTIDGEEGGESADTIDGEDGGEPADTIDGEDGGEPETDDGQDGGEPETDDGQGTGESAGTENSDPAT

SEQ ID NO: 1342573 - protein, 8 aa, Mycobacterium
ETDRSAGI

SEQ ID NO: 1342574 - protein, 9 aa, Mycobacterium
ETEASSEAV

SEQ ID NO: 1342575 - protein, 7 aa, Mycobacterium
ETEDFEA

SEQ ID NO: 1342576 - protein, 6 aa, Mycobacterium
ETELPA

SEQ ID NO: 1342577 - protein, 5 aa, Mycobacterium
ETFPA

SEQ ID NO: 1342578 - protein, 4 aa, Mycobacterium
ETGV

SEQ ID NO: 1342579 - protein, 10 aa, Mycobacterium
ETLPSDAKSF

SEQ ID NO: 1342580 - protein, 13 aa, Mycobacterium
ETLQPTEPGGVST

SEQ ID NO: 1342581 - protein, 8 aa, Mycobacterium
ETLRQTDG

SEQ ID NO: 1342582 - protein, 108 aa, Mycobacterium
ETLSDNDSRQSSEPARETVTAQTVEEAGHRDDDPAAPGEDDDDATEVVQDDDEAAEVGQDDGAVDADPAVDESAGAEDSVGNDDAVAAADPEGGLTTDAADGSGEESS

SEQ ID NO: 1342583 - protein, 6 aa, Mycobacterium
ETNGSV

SEQ ID NO: 1342584 - protein, 10 aa, Mycobacterium
ETPASTTSRF

SEQ ID NO: 1342585 - protein, 4 aa, Mycobacterium
ETRA

SEQ ID NO: 1342586 - protein, 18 aa, Mycobacterium
ETRDPEKAARIQEEDDAM

SEQ ID NO: 1342587 - protein, 6 aa, Mycobacterium
ETRKSF

SEQ ID NO: 1342588 - protein, 8 aa, Mycobacterium
ETSRGTAT

SEQ ID NO: 1342589 - protein, 4 aa, Mycobacterium
ETTV

SEQ ID NO: 1342590 - protein, 5 aa, Mycobacterium
ETYQG

SEQ ID NO: 1342591 - protein, 5 aa, Mycobacterium
EVAAG

SEQ ID NO: 1342592 - protein, 20 aa, Mycobacterium
EVAGGEEAQSPGAEPGDGVP

SEQ ID NO: 1342593 - protein, 11 aa, Mycobacterium
EVDGDTSPAPG

SEQ ID NO: 1342594 - protein, 5 aa, Mycobacterium
EVDRD

SEQ ID NO: 1342595 - protein, 7 aa, Mycobacterium
EVEGREG

SEQ ID NO: 1342596 - protein, 12 aa, Mycobacterium
EVEGTIGIEGTQ

SEQ ID NO: 1342597 - protein, 6 aa, Mycobacterium
EVENPD

SEQ ID NO: 1342598 - protein, 10 aa, Mycobacterium
EVEPTETGAR

SEQ ID NO: 1342599 - protein, 6 aa, Mycobacterium
EVGDLT

SEQ ID NO: 1342600 - protein, 26 aa, Mycobacterium
EVPPPTGAVPPPAGAVPSGPAGTVLT

SEQ ID NO: 1342601 - protein, 8 aa, Mycobacterium
EVRDGRRI

SEQ ID NO: 1342602 - protein, 12 aa, Mycobacterium
EVRGQRGYGVFR

SEQ ID NO: 1342603 - protein, 12 aa, Mycobacterium
EVRTTANAYRTE

SEQ ID NO: 1342604 - protein, 5 aa, Mycobacterium
EVSPD

SEQ ID NO: 1342605 - protein, 4 aa, Mycobacterium
EVTG

SEQ ID NO: 1342606 - protein, 8 aa, Mycobacterium
EVTNENPF

SEQ ID NO: 1342607 - protein, 4 aa, Mycobacterium
EVTR

SEQ ID NO: 1342608 - protein, 5 aa, Mycobacterium
EVTRD

SEQ ID NO: 1342609 - protein, 10 aa, Mycobacterium
EWGDPARRNE

SEQ ID NO: 1342610 - protein, 12 aa, Mycobacterium
EWGPGSAAEYAA

SEQ ID NO: 1342611 - protein, 7 aa, Mycobacterium
EYAGDAA

SEQ ID NO: 1342612 - protein, 10 aa, Mycobacterium
EYARGDDEAE

SEQ ID NO: 1342613 - protein, 40 aa, Mycobacterium
EYDPASGEYVGPDGKVYTQSNLADGASGERPWQSMLVPPG

SEQ ID NO: 1342614 - protein, 21 aa, Mycobacterium
EYDPATGSYIGPDGRSYTQAD

SEQ ID NO: 1342615 - protein, 10 aa, Mycobacterium
EYGDPADRRY

SEQ ID NO: 1342616 - protein, 6 aa, Mycobacterium
EYPDRA

SEQ ID NO: 1342617 - protein, 11 aa, Mycobacterium
EYRYSDTASFT

SEQ ID NO: 1342618 - protein, 5 aa, Mycobacterium
EYTPE

SEQ ID NO: 1342619 - protein, 8 aa, Mycobacterium
FAADTSDE

SEQ ID NO: 1342620 - protein, 9 aa, Mycobacterium
FAATGGVAR

SEQ ID NO: 1342621 - protein, 18 aa, Mycobacterium
FADDNREAIGTATDTLAS

SEQ ID NO: 1342622 - protein, 6 aa, Mycobacterium
FADPTF

SEQ ID NO: 1342623 - protein, 18 aa, Mycobacterium
FAEPSAITATSVGKGADA

SEQ ID NO: 1342624 - protein, 15 aa, Mycobacterium
FAGGDEEYAPSAHGH

SEQ ID NO: 1342625 - protein, 7 aa, Mycobacterium
FAGREDD

SEQ ID NO: 1342626 - protein, 9 aa, Mycobacterium
FAGRGSGSI

SEQ ID NO: 1342627 - protein, 15 aa, Mycobacterium
FAPGGPTAAVPPGAW

SEQ ID NO: 1342628 - protein, 7 aa, Mycobacterium
FAPSNAS

SEQ ID NO: 1342629 - protein, 8 aa, Mycobacterium
FASGSGDR

SEQ ID NO: 1342630 - protein, 4 aa, Mycobacterium
FATG

SEQ ID NO: 1342631 - protein, 6 aa, Mycobacterium
FATGDA

SEQ ID NO: 1342632 - protein, 9 aa, Mycobacterium
FDAPSSRSR

SEQ ID NO: 1342633 - protein, 17 aa, Mycobacterium
FDATTGSLAPQAAVPPG

SEQ ID NO: 1342634 - protein, 6 aa, Mycobacterium
FDDPTS

SEQ ID NO: 1342635 - protein, 7 aa, Mycobacterium
FDGGDPL

SEQ ID NO: 1342636 - protein, 11 aa, Mycobacterium
FDGGSSPPEAW

SEQ ID NO: 1342637 - protein, 23 aa, Mycobacterium
FDGNTDPDSARRAVREDADERIT

SEQ ID NO: 1342638 - protein, 11 aa, Mycobacterium
FDGPAGGRPSA

SEQ ID NO: 1342639 - protein, 21 aa, Mycobacterium
FDGPGRWSGAAYGREATADWA

SEQ ID NO: 1342640 - protein, 4 aa, Mycobacterium
FDNE

SEQ ID NO: 1342641 - protein, 11 aa, Mycobacterium
FDNKEDADKAV

SEQ ID NO: 1342642 - protein, 6 aa, Mycobacterium
FDNPDH

SEQ ID NO: 1342643 - protein, 5 aa, Mycobacterium
FDPEA

SEQ ID NO: 1342644 - protein, 6 aa, Mycobacterium
FDPESL

SEQ ID NO: 1342645 - protein, 5 aa, Mycobacterium
FDPRR

SEQ ID NO: 1342646 - protein, 7 aa, Mycobacterium
FDPSTDK

SEQ ID NO: 1342647 - protein, 7 aa, Mycobacterium
FDSAAPT

SEQ ID NO: 1342648 - protein, 8 aa, Mycobacterium
FEGRGRPA

SEQ ID NO: 1342649 - protein, 4 aa, Mycobacterium
FEPA

SEQ ID NO: 1342650 - protein, 5 aa, Mycobacterium
FEPPD

SEQ ID NO: 1342651 - protein, 8 aa, Mycobacterium
FERGETPI

SEQ ID NO: 1342652 - protein, 9 aa, Mycobacterium
FESGTEAVA

SEQ ID NO: 1342653 - protein, 6 aa, Mycobacterium
FEVGER

SEQ ID NO: 1342654 - protein, 8 aa, Mycobacterium
FGAGTGER

SEQ ID NO: 1342655 - protein, 22 aa, Mycobacterium
FGAPTPPPVAPPAPSVPTPGGG

SEQ ID NO: 1342656 - protein, 4 aa, Mycobacterium
FGAR

SEQ ID NO: 1342657 - protein, 4 aa, Mycobacterium
FGDG

SEQ ID NO: 1342658 - protein, 4 aa, Mycobacterium
FGDK

SEQ ID NO: 1342659 - protein, 17 aa, Mycobacterium
FGGDPGKVTVAGESAGA

SEQ ID NO: 1342660 - protein, 6 aa, Mycobacterium
FGGGPI

SEQ ID NO: 1342661 - protein, 9 aa, Mycobacterium
FGGSDMSPA

SEQ ID NO: 1342662 - protein, 10 aa, Mycobacterium
FGGSTGSVLP

SEQ ID NO: 1342663 - protein, 6 aa, Mycobacterium
FGPDGS

SEQ ID NO: 1342664 - protein, 8 aa, Mycobacterium
FGPDGTPY

SEQ ID NO: 1342665 - protein, 13 aa, Mycobacterium
FGPTTPELERTDL

SEQ ID NO: 1342666 - protein, 41 aa, Mycobacterium
FGQPRTEIGDSGTPTGTTELVDPGAAAVPEPGEVTKGDPGI

SEQ ID NO: 1342667 - protein, 7 aa, Mycobacterium
FGRGSNR

SEQ ID NO: 1342668 - protein, 5 aa, Mycobacterium
FGVGG

SEQ ID NO: 1342669 - protein, 14 aa, Mycobacterium
FKPDSDDVRDSPAL

SEQ ID NO: 1342670 - protein, 19 aa, Mycobacterium
FNDRTYQNTVTGSLYYVDV

SEQ ID NO: 1342671 - protein, 10 aa, Mycobacterium
FNGKDVTGEV

SEQ ID NO: 1342672 - protein, 11 aa, Mycobacterium
FNGRGEKFGQT

SEQ ID NO: 1342673 - protein, 10 aa, Mycobacterium
FNQPTDPGGF

SEQ ID NO: 1342674 - protein, 6 aa, Mycobacterium
FPAKNG

SEQ ID NO: 1342675 - protein, 5 aa, Mycobacterium
FPATN

SEQ ID NO: 1342676 - protein, 8 aa, Mycobacterium
FPDGNPSI

SEQ ID NO: 1342677 - protein, 55 aa, Mycobacterium; identical to SEQ ID NO: 1202945

SEQ ID NO: 1342678 - protein, 4 aa, Mycobacterium
FPDR

SEQ ID NO: 1342679 - protein, 19 aa, Mycobacterium
FPEVGSERQDIRQYPGGSL

SEQ ID NO: 1342680 - protein, 6 aa, Mycobacterium
FPGQGA

SEQ ID NO: 1342681 - protein, 5 aa, Mycobacterium
FPGRA

SEQ ID NO: 1342682 - protein, 10 aa, Mycobacterium
FPKAGAQPVI

SEQ ID NO: 1342683 - protein, 6 aa, Mycobacterium
FPPDTG

SEQ ID NO: 1342684 - protein, 9 aa, Mycobacterium
FPSPYTRAN

SEQ ID NO: 1342685 - protein, 8 aa, Mycobacterium
FPSSGPYK

SEQ ID NO: 1342686 - protein, 4 aa, Mycobacterium
FPTE

SEQ ID NO: 1342687 - protein, 5 aa, Mycobacterium
FPTRS

SEQ ID NO: 1342688 - protein, 14 aa, Mycobacterium
FQAEGGPGSPVDTR

SEQ ID NO: 1342689 - protein, 9 aa, Mycobacterium
FQGRQGDTG

SEQ ID NO: 1342690 - protein, 9 aa, Mycobacterium
FQPGETSKT

SEQ ID NO: 1342691 - protein, 10 aa, Mycobacterium
FQSGDDPVAN

SEQ ID NO: 1342692 - protein, 8 aa, Mycobacterium
FQSPDETS

SEQ ID NO: 1342693 - protein, 8 aa, Mycobacterium
FQSSSPTY

SEQ ID NO: 1342694 - protein, 10 aa, Mycobacterium
FREKDGKPLT

SEQ ID NO: 1342695 - protein, 7 aa, Mycobacterium
FRGREED

SEQ ID NO: 1342696 - protein, 5 aa, Mycobacterium
FRPVN

SEQ ID NO: 1342697 - protein, 7 aa, Mycobacterium
FRTSDEF

SEQ ID NO: 1342698 - protein, 6 aa, Mycobacterium
FRTSDY

SEQ ID NO: 1342699 - protein, 5 aa, Mycobacterium
FRTTD

SEQ ID NO: 1342700 - protein, 8 aa, Mycobacterium
FSAGSGLD

SEQ ID NO: 1342701 - protein, 4 aa, Mycobacterium
FSAP

SEQ ID NO: 1342702 - protein, 8 aa, Mycobacterium
FSAPAQAA

SEQ ID NO: 1342703 - protein, 8 aa, Mycobacterium
FSASGEGG

SEQ ID NO: 1342704 - protein, 7 aa, Mycobacterium
FSDTPPE

SEQ ID NO: 1342705 - protein, 4 aa, Mycobacterium
FSEE

SEQ ID NO: 1342706 - protein, 9 aa, Mycobacterium
FSGDPRAGL

SEQ ID NO: 1342707 - protein, 12 aa, Mycobacterium
FSGGEANCATAG

SEQ ID NO: 1342708 - protein, 7 aa, Mycobacterium
FSNTATQ

SEQ ID NO: 1342709 - protein, 5 aa, Mycobacterium
FSPRR

SEQ ID NO: 1342710 - protein, 5 aa, Mycobacterium
FSPRS

SEQ ID NO: 1342711 - protein, 15 aa, Mycobacterium
FTDGDAAVAEGEAPL

SEQ ID NO: 1342712 - protein, 10 aa, Mycobacterium
FTDSKEREQQ

SEQ ID NO: 1342713 - protein, 7 aa, Mycobacterium
FTENGSG

SEQ ID NO: 1342714 - protein, 11 aa, Mycobacterium
FTGPGATPRGN

SEQ ID NO: 1342715 - protein, 14 aa, Mycobacterium
FTGSYNDGLGGEAT

SEQ ID NO: 1342716 - protein, 14 aa, Mycobacterium
FTNGSKARASDATA

SEQ ID NO: 1342717 - protein, 8 aa, Mycobacterium
FTNTDREL

SEQ ID NO: 1342718 - protein, 5 aa, Mycobacterium
FTPAA

SEQ ID NO: 1342719 - protein, 23 aa, Mycobacterium
FTPGDTITAAGGGFESASWPVPA

SEQ ID NO: 1342720 - protein, 23 aa, Mycobacterium
FTTSDTVPSSVPAAAAPTPLPPK

SEQ ID NO: 1342721 - protein, 11 aa, Mycobacterium
FTYTPSDAARH

SEQ ID NO: 1342722 - protein, 25 aa, Mycobacterium
FTYTPTAAARHAAANAGATEADKHD

SEQ ID NO: 1342723 - protein, 5 aa, Mycobacterium
FYSNP

SEQ ID NO: 1342724 - protein, 4 aa, Mycobacterium
GAAA

SEQ ID NO: 1342725 - protein, 8 aa, Mycobacterium
GAAAAAGL

SEQ ID NO: 1342726 - protein, 15 aa, Mycobacterium
GAAADAAAAAIGNGA

SEQ ID NO: 1342727 - protein, 8 aa, Mycobacterium
GAAAEQLS

SEQ ID NO: 1342728 - protein, 14 aa, Mycobacterium
GAAAPSTTTPTRDS

SEQ ID NO: 1342729 - protein, 9 aa, Mycobacterium
GAAASPPAI

SEQ ID NO: 1342730 - protein, 6 aa, Mycobacterium
GAADAR

SEQ ID NO: 1342731 - protein, 10 aa, Mycobacterium
GAADEQADVR

SEQ ID NO: 1342732 - protein, 7 aa, Mycobacterium
GAAGADI

SEQ ID NO: 1342733 - protein, 5 aa, Mycobacterium
GAAID

SEQ ID NO: 1342734 - protein, 5 aa, Mycobacterium
GAALD

SEQ ID NO: 1342735 - protein, 5 aa, Mycobacterium
GAAPG

SEQ ID NO: 1342736 - protein, 6 aa, Mycobacterium
GAAQTV

SEQ ID NO: 1342737 - protein, 7 aa, Mycobacterium
GAARNGR

SEQ ID NO: 1342738 - protein, 4 aa, Mycobacterium
GAAS

SEQ ID NO: 1342739 - protein, 9 aa, Mycobacterium
GAASAGPQA

SEQ ID NO: 1342740 - protein, 4 aa, Mycobacterium
GAAT

SEQ ID NO: 1342741 - protein, 9 aa, Mycobacterium
GAATDTPVE

SEQ ID NO: 1342742 - protein, 5 aa, Mycobacterium
GADAR

SEQ ID NO: 1342743 - protein, 4 aa, Mycobacterium
GADD

SEQ ID NO: 1342744 - protein, 13 aa, Mycobacterium
GADGGPGQDGGRG

SEQ ID NO: 1342745 - protein, 6 aa, Mycobacterium
GADMSN

SEQ ID NO: 1342746 - protein, 5 aa, Mycobacterium
GADNA

SEQ ID NO: 1342747 - protein, 9 aa, Mycobacterium
GADTGDPVT

SEQ ID NO: 1342748 - protein, 5 aa, Mycobacterium
GADVG

SEQ ID NO: 1342749 - protein, 11 aa, Mycobacterium
GAEAAAKKDNI

SEQ ID NO: 1342750 - protein, 5 aa, Mycobacterium
GAEIT

SEQ ID NO: 1342751 - protein, 6 aa, Mycobacterium
GAEPDA

SEQ ID NO: 1342752 - protein, 6 aa, Mycobacterium
GAEPGT

SEQ ID NO: 1342753 - protein, 8 aa, Mycobacterium
GAEQARYD

SEQ ID NO: 1342754 - protein, 33 aa, Mycobacterium
GAEQQQPETTESVTGKAEASQNPEGPAPESGGS

SEQ ID NO: 1342755 - protein, 8 aa, Mycobacterium
GAERLPDL

SEQ ID NO: 1342756 - protein, 15 aa, Mycobacterium
GAGAGDGDGDGDDPA

SEQ ID NO: 1342757 - protein, 4 aa, Mycobacterium
GAGH

SEQ ID NO: 1342758 - protein, 8 aa, Mycobacterium
GAGHWSAE

SEQ ID NO: 1342759 - protein, 4 aa, Mycobacterium
GAGL

SEQ ID NO: 1342760 - protein, 5 aa, Mycobacterium
GAGRL

SEQ ID NO: 1342761 - protein, 10 aa, Mycobacterium
GAGSASADAE

SEQ ID NO: 1342762 - protein, 17 aa, Mycobacterium
GAGSPPPADYAPPELRG

SEQ ID NO: 1342763 - protein, 9 aa, Mycobacterium
GAGSPRGSC

SEQ ID NO: 1342764 - protein, 8 aa, Mycobacterium
GAGSPYKN

SEQ ID NO: 1342765 - protein, 10 aa, Mycobacterium
GAGTAAASPV

SEQ ID NO: 1342766 - protein, 8 aa, Mycobacterium
GAGTTAQL

SEQ ID NO: 1342767 - protein, 4 aa, Mycobacterium
GAHR

SEQ ID NO: 1342768 - protein, 8 aa, Mycobacterium
GAIGGQQG

SEQ ID NO: 1342769 - protein, 96 aa, Mycobacterium
GAIPGGPGGVAGPQGAAGAIPGGPGGVAGPQGAAGAIPGGPGGVAGPQGAAGAIPGGPGGAAGPQGATGAIPGGPSGTAGPGGATGCIPGVGCATT

SEQ ID NO: 1342770 - protein, 11 aa, Mycobacterium
GAKARPNEITY

SEQ ID NO: 1342771 - protein, 4 aa, Mycobacterium
GAKG

SEQ ID NO: 1342772 - protein, 8 aa, Mycobacterium
GAKPSFPS

SEQ ID NO: 1342773 - protein, 10 aa, Mycobacterium
GAKQKQISSA

SEQ ID NO: 1342774 - protein, 8 aa, Mycobacterium
GAKTAARP

SEQ ID NO: 1342775 - protein, 13 aa, Mycobacterium
GALASGELGGTDR

SEQ ID NO: 1342776 - protein, 4 aa, Mycobacterium
GALP

SEQ ID NO: 1342777 - protein, 15 aa, Mycobacterium
GALPPGRPGDPERDD

SEQ ID NO: 1342778 - protein, 4 aa, Mycobacterium
GALS

SEQ ID NO: 1342779 - protein, 9 aa, Mycobacterium
GANDASKRV

SEQ ID NO: 1342780 - protein, 29 aa, Mycobacterium
GANGDGGAGARGGDAGTPGDGGDGKAGDA

SEQ ID NO: 1342781 - protein, 7 aa, Mycobacterium
GANGKSI

SEQ ID NO: 1342782 - protein, 21 aa, Mycobacterium
GANTLTPAAPGGHDPDSPRVQ

SEQ ID NO: 1342783 - protein, 7 aa, Mycobacterium
GAPAALA

SEQ ID NO: 1342784 - protein, 7 aa, Mycobacterium
GAPAPTV

SEQ ID NO: 1342785 - protein, 9 aa, Mycobacterium
GAPAVEPET

SEQ ID NO: 1342786 - protein, 5 aa, Mycobacterium
GAPAY

SEQ ID NO: 1342787 - protein, 7 aa, Mycobacterium
GAPCPPE

SEQ ID NO: 1342788 - protein, 13 aa, Mycobacterium
GAPDDEDSADAEG

SEQ ID NO: 1342789 - protein, 14 aa, Mycobacterium
GAPGAGMAPPAPGV

SEQ ID NO: 1342790 - protein, 7 aa, Mycobacterium
GAPGQWS

SEQ ID NO: 1342791 - protein, 9 aa, Mycobacterium
GAPIPGPPN

SEQ ID NO: 1342792 - protein, 18 aa, Mycobacterium
GAPLPPAGGESKDSLRAV

SEQ ID NO: 1342793 - protein, 13 aa, Mycobacterium
GAPPATADNADWG

SEQ ID NO: 1342794 - protein, 21 aa, Mycobacterium
GAPPHPCRQAEATQRNCESKP

SEQ ID NO: 1342795 - protein, 9 aa, Mycobacterium
GAPPPDPAQ

SEQ ID NO: 1342796 - protein, 8 aa, Mycobacterium
GAPPVKPD

SEQ ID NO: 1342797 - protein, 7 aa, Mycobacterium
GAPRAQA

SEQ ID NO: 1342798 - protein, 7 aa, Mycobacterium
GAPRPAY

SEQ ID NO: 1342799 - protein, 24 aa, Mycobacterium
GAPSALAQPAPAPAPAPPPPPPAN

SEQ ID NO: 1342800 - protein, 14 aa, Mycobacterium
GAPTATAECTESGG

SEQ ID NO: 1342801 - protein, 8 aa, Mycobacterium
GAPTGWTP

SEQ ID NO: 1342802 - protein, 14 aa, Mycobacterium
GAPVLDGTDPSEGY

SEQ ID NO: 1342803 - protein, 17 aa, Mycobacterium
GAQADPQDGGSLATGDN

SEQ ID NO: 1342804 - protein, 10 aa, Mycobacterium
GAQLPPGQSL

SEQ ID NO: 1342805 - protein, 5 aa, Mycobacterium
GARAE

SEQ ID NO: 1342806 - protein, 4 aa, Mycobacterium
GARI

SEQ ID NO: 1342807 - protein, 19 aa, Mycobacterium
GARSTRASSPSGLDGPGWE

SEQ ID NO: 1342808 - protein, 9 aa, Mycobacterium
GASAGLGAA

SEQ ID NO: 1342809 - protein, 14 aa, Mycobacterium
GASAPAGAYSRPGL

SEQ ID NO: 1342810 - protein, 7 aa, Mycobacterium
GASASSV

SEQ ID NO: 1342811 - protein, 9 aa, Mycobacterium
GASDAQDAV

SEQ ID NO: 1342812 - protein, 10 aa, Mycobacterium
GASDDAPTVG

SEQ ID NO: 1342813 - protein, 15 aa, Mycobacterium
GASGPGQCAHGNGIN

SEQ ID NO: 1342814 - protein, 7 aa, Mycobacterium
GASGTSL

SEQ ID NO: 1342815 - protein, 7 aa, Mycobacterium
GASNKEI

SEQ ID NO: 1342816 - protein, 7 aa, Mycobacterium
GASTRAI

SEQ ID NO: 1342817 - protein, 9 aa, Mycobacterium
GASTTSSTV

SEQ ID NO: 1342818 - protein, 5 aa, Mycobacterium
GASVT

SEQ ID NO: 1342819 - protein, 25 aa, Mycobacterium
GATAPDGRCKTFDDDADGYGRGEGA

SEQ ID NO: 1342820 - protein, 5 aa, Mycobacterium
GATFT

SEQ ID NO: 1342821 - protein, 6 aa, Mycobacterium
GATNRI

SEQ ID NO: 1342822 - protein, 5 aa, Mycobacterium
GATPA

SEQ ID NO: 1342823 - protein, 9 aa, Mycobacterium
GATPDNGDL

SEQ ID NO: 1342824 - protein, 9 aa, Mycobacterium
GATRQSPSL

SEQ ID NO: 1342825 - protein, 8 aa, Mycobacterium
GATSPALQ

SEQ ID NO: 1342826 - protein, 6 aa, Mycobacterium
GATTAQ

SEQ ID NO: 1342827 - protein, 13 aa, Mycobacterium
GATTPGAGERAVD

SEQ ID NO: 1342828 - protein, 13 aa, Mycobacterium
GAVDAAERVRRGA

SEQ ID NO: 1342829 - protein, 8 aa, Mycobacterium
GAVDAVTT

SEQ ID NO: 1342830 - protein, 4 aa, Mycobacterium
GAVG

SEQ ID NO: 1342831 - protein, 9 aa, Mycobacterium
GAYGATDST

SEQ ID NO: 1342832 - protein, 17 aa, Mycobacterium
GAYGCSGPIPAAPGGAN

SEQ ID NO: 1342833 - protein, 18 aa, Mycobacterium
GAYGCSGPIPAAPGGANL

SEQ ID NO: 1342834 - protein, 5 aa, Mycobacterium
GAYLN

SEQ ID NO: 1342835 - protein, 7 aa, Mycobacterium
GCDGPCT

SEQ ID NO: 1342836 - protein, 8 aa, Mycobacterium
GCDPAGFD

SEQ ID NO: 1342837 - protein, 12 aa, Mycobacterium
GCGDPPPPPDLD

SEQ ID NO: 1342838 - protein, 36 aa, Mycobacterium
GCGSDKSETSGETSQAAAAEGKSTVTIDGADQEVQG

SEQ ID NO: 1342839 - protein, 13 aa, Mycobacterium
GCGSTDADPAASA

SEQ ID NO: 1342840 - protein, 7 aa, Mycobacterium
GCNGQTT

SEQ ID NO: 1342841 - protein, 10 aa, Mycobacterium
GCQDTRNAAS

SEQ ID NO: 1342842 - protein, 11 aa, Mycobacterium
GCSGEALSDEG

SEQ ID NO: 1342843 - protein, 18 aa, Mycobacterium
GCSGSDGSEASGDSGFPA

SEQ ID NO: 1342844 - protein, 13 aa, Mycobacterium
GCSGSGGGGDTAA

SEQ ID NO: 1342845 - protein, 8 aa, Mycobacterium
GCSPGDRV

SEQ ID NO: 1342846 - protein, 24 aa, Mycobacterium
GCSSSSEEPVEEGSPTAAAPAEKV

SEQ ID NO: 1342847 - protein, 9 aa, Mycobacterium
GDAGGYDAN

SEQ ID NO: 1342848 - protein, 8 aa, Mycobacterium
GDAGGYKA

SEQ ID NO: 1342849 - protein, 6 aa, Mycobacterium
GDAGPD

SEQ ID NO: 1342850 - protein, 8 aa, Mycobacterium
GDAGTRGL

SEQ ID NO: 1342851 - protein, 16 aa, Mycobacterium
GDAPPPGPSGPGLPEA

SEQ ID NO: 1342852 - protein, 9 aa, Mycobacterium
GDAQSPEAM

SEQ ID NO: 1342853 - protein, 6 aa, Mycobacterium
GDASGE

SEQ ID NO: 1342854 - protein, 6 aa, Mycobacterium
GDATTG

SEQ ID NO: 1342855 - protein, 6 aa, Mycobacterium
GDDGAE

SEQ ID NO: 1342856 - protein, 11 aa, Mycobacterium
GDDGHVDPESV

SEQ ID NO: 1342857 - protein, 7 aa, Mycobacterium
GDDNDAF

SEQ ID NO: 1342858 - protein, 6 aa, Mycobacterium
GDEDVD

SEQ ID NO: 1342859 - protein, 5 aa, Mycobacterium
GDEPR

SEQ ID NO: 1342860 - protein, 6 aa, Mycobacterium
GDESSV

SEQ ID NO: 1342861 - protein, 350 aa, Mycobacterium
GDGADGGNGGDPGTRGAGGSRGAAGTGGYADSGNAGAAGVDGAAVTSGGNGGNGGNGADGELVGNGGNGGNGGAVGNGGNGGNGGDGAAGAAGAHAAHGGGGAGTSGSAGMDGGNGGAGGLGGSTSGNGGNGGAGGNGGNGGLGGNGGNGKSGDGYLDPGQQGGNGGEGGFAGDGGVGGAGGAALGSGDGGAGGVGGSGGIGGKGGAGGHGGQNGDQPLPDGPIGGVAPDAGHGGTGASGGHGGFGGSGGAGGAAHGSGNGGAGGKAGAAGAGGSGGSGGAGGLDEDNYETYGGHGGSAGDGGPGGFAGTGGAGGAAMGAGNGGAGGDGGAGANGGVGGRGGDGGSSEGW

SEQ ID NO: 1342862 - protein, 8 aa, Mycobacterium
GDGAEVAD

SEQ ID NO: 1342863 - protein, 23 aa, Mycobacterium
GDGAPGAPAPDHSRGRLSKDGAP

SEQ ID NO: 1342864 - protein, 6 aa, Mycobacterium
GDGAPL

SEQ ID NO: 1342865 - protein, 10 aa, Mycobacterium
GDGAYTGAGT

SEQ ID NO: 1342866 - protein, 59 aa, Mycobacterium
GDGGIGGAAGTGGRGGNGVNGADATIAGAAGGRGGDGGSGGAGGIGGAGGSAGAQRGFG

SEQ ID NO: 1342867 - protein, 4 aa, Mycobacterium
GDGK

SEQ ID NO: 1342868 - protein, 4 aa, Mycobacterium
GDGS

SEQ ID NO: 1342869 - protein, 10 aa, Mycobacterium
GDGSPYRDSE

SEQ ID NO: 1342870 - protein, 5 aa, Mycobacterium
GDHRT

SEQ ID NO: 1342871 - protein, 20 aa, Mycobacterium
GDHSDTDAGMDTVFVNATRD

SEQ ID NO: 1342872 - protein, 7 aa, Mycobacterium
GDIDEDE

SEQ ID NO: 1342873 - protein, 4 aa, Mycobacterium
GDIK

SEQ ID NO: 1342874 - protein, 33 aa, Mycobacterium; identical to SEQ ID NO: 1181114

SEQ ID NO: 1342875 - protein, 4 aa, Mycobacterium
GDIT

SEQ ID NO: 1342876 - protein, 8 aa, Mycobacterium
GDKGEPCW

SEQ ID NO: 1342877 - protein, 9 aa, Mycobacterium
GDLANGATA

SEQ ID NO: 1342878 - protein, 8 aa, Mycobacterium
GDLATPQG

SEQ ID NO: 1342879 - protein, 7 aa, Mycobacterium
GDLGDAS

SEQ ID NO: 1342880 - protein, 4 aa, Mycobacterium
GDMA

SEQ ID NO: 1342881 - protein, 10 aa, Mycobacterium
GDNAEPPQAQ

SEQ ID NO: 1342882 - protein, 8 aa, Mycobacterium
GDPAGYNA

SEQ ID NO: 1342883 - protein, 11 aa, Mycobacterium
GDPDDPQAPGI

SEQ ID NO: 1342884 - protein, 6 aa, Mycobacterium
GDPGAM

SEQ ID NO: 1342885 - protein, 6 aa, Mycobacterium
GDPGIS

SEQ ID NO: 1342886 - protein, 9 aa, Mycobacterium
GDPGPGEFG

SEQ ID NO: 1342887 - protein, 8 aa, Mycobacterium
GDPGWPGV

SEQ ID NO: 1342888 - protein, 7 aa, Mycobacterium
GDPIDGA

SEQ ID NO: 1342889 - protein, 7 aa, Mycobacterium
GDPPKPI

SEQ ID NO: 1342890 - protein, 6 aa, Mycobacterium
GDPPTL

SEQ ID NO: 1342891 - protein, 12 aa, Mycobacterium
GDQEPGAAADLG

SEQ ID NO: 1342892 - protein, 9 aa, Mycobacterium
GDQKGGTES

SEQ ID NO: 1342893 - protein, 17 aa, Mycobacterium
GDQYNAGRKVPPAQAKR

SEQ ID NO: 1342894 - protein, 13 aa, Mycobacterium
GDREIARNEDCPG

SEQ ID NO: 1342895 - protein, 5 aa, Mycobacterium
GDRRE

SEQ ID NO: 1342896 - protein, 6 aa, Mycobacterium
GDRRST

SEQ ID NO: 1342897 - protein, 6 aa, Mycobacterium
GDRTTI

SEQ ID NO: 1342898 - protein, 4 aa, Mycobacterium
GDRW

SEQ ID NO: 1342899 - protein, 7 aa, Mycobacterium
GDSTNPA

SEQ ID NO: 1342900 - protein, 9 aa, Mycobacterium
GDTAVEANE

SEQ ID NO: 1342901 - protein, 4 aa, Mycobacterium
GDTD

SEQ ID NO: 1342902 - protein, 8 aa, Mycobacterium
GDTGYTKS

SEQ ID NO: 1342903 - protein, 14 aa, Mycobacterium
GDTIGLESTTAAAT

SEQ ID NO: 1342904 - protein, 13 aa, Mycobacterium
GDTITGTAAESQE

SEQ ID NO: 1342905 - protein, 13 aa, Mycobacterium
GDTITGTATWPGA

SEQ ID NO: 1342906 - protein, 8 aa, Mycobacterium
GDTLPTRT

SEQ ID NO: 1342907 - protein, 16 aa, Mycobacterium
GDTPKPAIREEAARRG

SEQ ID NO: 1342908 - protein, 14 aa, Mycobacterium
GDTPTGIAVSPGGT

SEQ ID NO: 1342909 - protein, 8 aa, Mycobacterium
GDTRNRGQ

SEQ ID NO: 1342910 - protein, 6 aa, Mycobacterium
GDTRRA

SEQ ID NO: 1342911 - protein, 5 aa, Mycobacterium
GDTTL

SEQ ID NO: 1342912 - protein, 13 aa, Mycobacterium
GDTVTGKAAEAQA

SEQ ID NO: 1342913 - protein, 7 aa, Mycobacterium
GDVDDAP

SEQ ID NO: 1342914 - protein, 5 aa, Mycobacterium
GDVEA

SEQ ID NO: 1342915 - protein, 13 aa, Mycobacterium
GDVNQDKGDKQPS

SEQ ID NO: 1342916 - protein, 8 aa, Mycobacterium
GDVSGPAQ

SEQ ID NO: 1342917 - protein, 10 aa, Mycobacterium
GDYGGPPFGG

SEQ ID NO: 1342918 - protein, 5 aa, Mycobacterium
GEATH

SEQ ID NO: 1342919 - protein, 10 aa, Mycobacterium
GEDGASEPTV

SEQ ID NO: 1342920 - protein, 11 aa, Mycobacterium
GEDYTPLGSTD

SEQ ID NO: 1342921 - protein, 7 aa, Mycobacterium
GEEDRLR

SEQ ID NO: 1342922 - protein, 7 aa, Mycobacterium
GEEGPGN

SEQ ID NO: 1342923 - protein, 15 aa, Mycobacterium
GEERVEGVDAPTLTE

SEQ ID NO: 1342924 - protein, 5 aa, Mycobacterium
GEFDG

SEQ ID NO: 1342925 - protein, 11 aa, Mycobacterium
GEFQPANAGPW

SEQ ID NO: 1342926 - protein, 4 aa, Mycobacterium
GEGD

SEQ ID NO: 1342927 - protein, 8 aa, Mycobacterium
GEGGEDGA

SEQ ID NO: 1342928 - protein, 16 aa, Mycobacterium
GEGGVTTALQTNDGPV

SEQ ID NO: 1342929 - protein, 5 aa, Mycobacterium
GEHPE

SEQ ID NO: 1342930 - protein, 10 aa, Mycobacterium
GEIDGPDAGL

SEQ ID NO: 1342931 - protein, 7 aa, Mycobacterium
GEINDEE

SEQ ID NO: 1342932 - protein, 5 aa, Mycobacterium
GEKGV

SEQ ID NO: 1342933 - protein, 5 aa, Mycobacterium
GEKTG

SEQ ID NO: 1342934 - protein, 5 aa, Mycobacterium
GEMTV

SEQ ID NO: 1342935 - protein, 13 aa, Mycobacterium
GEPDQLDPHKTTS

SEQ ID NO: 1342936 - protein, 19 aa, Mycobacterium
GEPGVPDRTPEPLPSSVDE

SEQ ID NO: 1342937 - protein, 9 aa, Mycobacterium
GEPPNGGWP

SEQ ID NO: 1342938 - protein, 7 aa, Mycobacterium
GEPQTYP

SEQ ID NO: 1342939 - protein, 6 aa, Mycobacterium
GEPRRG

SEQ ID NO: 1342940 - protein, 4 aa, Mycobacterium
GEPT

SEQ ID NO: 1342941 - protein, 5 aa, Mycobacterium
GEPYN

SEQ ID NO: 1342942 - protein, 7 aa, Mycobacterium
GEQATSA

SEQ ID NO: 1342943 - protein, 7 aa, Mycobacterium
GEQTGAA

SEQ ID NO: 1342944 - protein, 5 aa, Mycobacterium
GERDA

SEQ ID NO: 1342945 - protein, 12 aa, Mycobacterium
GERLRGQQGAPA

SEQ ID NO: 1342946 - protein, 7 aa, Mycobacterium
GERQETL

SEQ ID NO: 1342947 - protein, 6 aa, Mycobacterium
GERSGQ

SEQ ID NO: 1342948 - protein, 8 aa, Mycobacterium
GESLPERT

SEQ ID NO: 1342949 - protein, 14 aa, Mycobacterium
GESRDQEAAAKVEE

SEQ ID NO: 1342950 - protein, 5 aa, Mycobacterium
GETKP

SEQ ID NO: 1342951 - protein, 8 aa, Mycobacterium
GETRSYGQ

SEQ ID NO: 1342952 - protein, 4 aa, Mycobacterium
GETS

SEQ ID NO: 1342953 - protein, 17 aa, Mycobacterium
GEVRGSTGGGGPSGPYV

SEQ ID NO: 1342954 - protein, 7 aa, Mycobacterium
GEVSADA

SEQ ID NO: 1342955 - protein, 16 aa, Mycobacterium
GEVSAREPAPATRRTS

SEQ ID NO: 1342956 - protein, 12 aa, Mycobacterium
GEVSDDESLGGA

SEQ ID NO: 1342957 - protein, 10 aa, Mycobacterium
GFDPEAAKRE

SEQ ID NO: 1342958 - protein, 6 aa, Mycobacterium
GFDPRD

SEQ ID NO: 1342959 - protein, 4 aa, Mycobacterium
GFEA

SEQ ID NO: 1342960 - protein, 6 aa, Mycobacterium
GFPEEY

SEQ ID NO: 1342961 - protein, 8 aa, Mycobacterium
GGAAAAAA

SEQ ID NO: 1342962 - protein, 8 aa, Mycobacterium
GGAAATEV

SEQ ID NO: 1342963 - protein, 5 aa, Mycobacterium
GGAAS

SEQ ID NO: 1342964 - protein, 14 aa, Mycobacterium
GGAATGPSRGIDTG

SEQ ID NO: 1342965 - protein, 9 aa, Mycobacterium
GGADGVRRR

SEQ ID NO: 1342966 - protein, 7 aa, Mycobacterium
GGADNAA

SEQ ID NO: 1342967 - protein, 15 aa, Mycobacterium
GGADPRREGMVMGDG

SEQ ID NO: 1342968 - protein, 7 aa, Mycobacterium
GGAGGNF

SEQ ID NO: 1342969 - protein, 14 aa, Mycobacterium
GGAGMARPGAVSRA

SEQ ID NO: 1342970 - protein, 10 aa, Mycobacterium
GGAIPLPGGA

SEQ ID NO: 1342971 - protein, 18 aa, Mycobacterium
GGANARAREADSDQQTVG

SEQ ID NO: 1342972 - protein, 7 aa, Mycobacterium
GGAQPVS

SEQ ID NO: 1342973 - protein, 5 aa, Mycobacterium
GGARV

SEQ ID NO: 1342974 - protein, 8 aa, Mycobacterium
GGASIHQP

SEQ ID NO: 1342975 - protein, 11 aa, Mycobacterium
GGATDSRGTAV

SEQ ID NO: 1342976 - protein, 4 aa, Mycobacterium
GGAV

SEQ ID NO: 1342977 - protein, 8 aa, Mycobacterium
GGAVPADP

SEQ ID NO: 1342978 - protein, 20 aa, Mycobacterium
GGDDTSAMDTSAAPDCPTTP

SEQ ID NO: 1342979 - protein, 56 aa, Mycobacterium
GGDEHGADGPEGDEPEAEIETEPGAEAEQQRETSSPTVAESGSPEGVAPDGAEGVA

SEQ ID NO: 1342980 - protein, 7 aa, Mycobacterium
GGDHNPI

SEQ ID NO: 1342981 - protein, 20 aa, Mycobacterium
GGDIGSDGSTAQDRANKAGF

SEQ ID NO: 1342982 - protein, 5 aa, Mycobacterium
GGDLA

SEQ ID NO: 1342983 - protein, 9 aa, Mycobacterium
GGDLATPKG

SEQ ID NO: 1342984 - protein, 7 aa, Mycobacterium
GGDPDTV

SEQ ID NO: 1342985 - protein, 11 aa, Mycobacterium
GGDSTSVVKDT

SEQ ID NO: 1342986 - protein, 10 aa, Mycobacterium
GGDTRHGSET

SEQ ID NO: 1342987 - protein, 4 aa, Mycobacterium
GGEA

SEQ ID NO: 1342988 - protein, 10 aa, Mycobacterium
GGEGQTPDAD

SEQ ID NO: 1342989 - protein, 7 aa, Mycobacterium
GGERRAA

SEQ ID NO: 1342990 - protein, 8 aa, Mycobacterium
GGESPAAA

SEQ ID NO: 1342991 - protein, 19 aa, Mycobacterium
GGGAGAAGPGPAAPGSSPA

SEQ ID NO: 1342992 - protein, 20 aa, Mycobacterium
GGGASDVVGEEGGNSDAETT

SEQ ID NO: 1342993 - protein, 4 aa, Mycobacterium
GGGD

SEQ ID NO: 1342994 - protein, 31 aa, Mycobacterium
GGGGASGPSKGTVAVPEAEPALPDQAEVDAQ

SEQ ID NO: 1342995 - protein, 14 aa, Mycobacterium
GGGHNYAEASSSRG

SEQ ID NO: 1342996 - protein, 6 aa, Mycobacterium
GGGLSS

SEQ ID NO: 1342997 - protein, 19 aa, Mycobacterium
GGGNANGPARGIDQGANTV

SEQ ID NO: 1342998 - protein, 19 aa, Mycobacterium
GGGNANGPSRGIDQGANTV

SEQ ID NO: 1342999 - protein, 19 aa, Mycobacterium
GGGNASGPSRGIDQGAGTV

SEQ ID NO: 1343000 - protein, 37 aa, Mycobacterium
GGGNTAGPTLGNPGGSSAPAPAAAPPGAIPVDGTNGA

SEQ ID NO: 1343001 - protein, 4 aa, Mycobacterium
GGGP

SEQ ID NO: 1343002 - protein, 8 aa, Mycobacterium
GGGPGSRL

SEQ ID NO: 1343003 - protein, 11 aa, Mycobacterium
GGGRGLNSGVP

SEQ ID NO: 1343004 - protein, 9 aa, Mycobacterium
GGGRLDGPI

SEQ ID NO: 1343005 - protein, 45 aa, Mycobacterium
GGGSEQSPETVTVTSTTQAAPAYTPPAPVAPTKQQEVAPAPEASS

SEQ ID NO: 1343006 - protein, 15 aa, Mycobacterium
GGGTAEQQAGGYHDS

SEQ ID NO: 1343007 - protein, 8 aa, Mycobacterium
GGGTGIGR

SEQ ID NO: 1343008 - protein, 15 aa, Mycobacterium
GGGTGLARPGAVSRA

SEQ ID NO: 1343009 - protein, 9 aa, Mycobacterium
GGGTSQSAP

SEQ ID NO: 1343010 - protein, 4 aa, Mycobacterium
GGGV

SEQ ID NO: 1343011 - protein, 5 aa, Mycobacterium
GGIGD

SEQ ID NO: 1343012 - protein, 5 aa, Mycobacterium
GGIGG

SEQ ID NO: 1343013 - protein, 10 aa, Mycobacterium
GGIGPNAPWA

SEQ ID NO: 1343014 - protein, 5 aa, Mycobacterium
GGIGQ

SEQ ID NO: 1343015 - protein, 9 aa, Mycobacterium
GGIRDDDSL

SEQ ID NO: 1343016 - protein, 5 aa, Mycobacterium
GGITN

SEQ ID NO: 1343017 - protein, 5 aa, Mycobacterium
GGLGP

SEQ ID NO: 1343018 - protein, 6 aa, Mycobacterium
GGLGPE

SEQ ID NO: 1343019 - protein, 5 aa, Mycobacterium
GGLGQ

SEQ ID NO: 1343020 - protein, 5 aa, Mycobacterium
GGLKS

SEQ ID NO: 1343021 - protein, 5 aa, Mycobacterium
GGLNG

SEQ ID NO: 1343022 - protein, 5 aa, Mycobacterium
GGLPP

SEQ ID NO: 1343023 - protein, 10 aa, Mycobacterium
GGMADGNAEL

SEQ ID NO: 1343024 - protein, 17 aa, Mycobacterium
GGMPTAQTTEFEAPENA

SEQ ID NO: 1343025 - protein, 5 aa, Mycobacterium
GGMQN

SEQ ID NO: 1343026 - protein, 8 aa, Mycobacterium
GGNASQVL

SEQ ID NO: 1343027 - protein, 7 aa, Mycobacterium
GGNATRI

SEQ ID NO: 1343028 - protein, 12 aa, Mycobacterium
GGNAVDNAGPGY

SEQ ID NO: 1343029 - protein, 10 aa, Mycobacterium
GGNGGDGDAV

SEQ ID NO: 1343030 - protein, 13 aa, Mycobacterium
GGNPRNGKTEARQ

SEQ ID NO: 1343031 - protein, 13 aa, Mycobacterium
GGPAPVASAQPCP

SEQ ID NO: 1343032 - protein, 13 aa, Mycobacterium
GGPAWQRNDPTVN

SEQ ID NO: 1343033 - protein, 6 aa, Mycobacterium
GGPAYG

SEQ ID NO: 1343034 - protein, 12 aa, Mycobacterium
GGPGDSGGPVTV

SEQ ID NO: 1343035 - protein, 5 aa, Mycobacterium
GGPIR

SEQ ID NO: 1343036 - protein, 14 aa, Mycobacterium
GGPLGEDAGNQGAT

SEQ ID NO: 1343037 - protein, 7 aa, Mycobacterium
GGQDAHD

SEQ ID NO: 1343038 - protein, 7 aa, Mycobacterium
GGQRLTP

SEQ ID NO: 1343039 - protein, 21 aa, Mycobacterium
GGQSDGADDSQSGSNEPEAPL

SEQ ID NO: 1343040 - protein, 20 aa, Mycobacterium
GGQSPPPSIPVGAPADPESQ

SEQ ID NO: 1343041 - protein, 4 aa, Mycobacterium
GGRD

SEQ ID NO: 1343042 - protein, 6 aa, Mycobacterium
GGRGAT

SEQ ID NO: 1343043 - protein, 5 aa, Mycobacterium
GGRGG

SEQ ID NO: 1343044 - protein, 5 aa, Mycobacterium
GGRGM

SEQ ID NO: 1343045 - protein, 9 aa, Mycobacterium
GGRSDVSPV

SEQ ID NO: 1343046 - protein, 6 aa, Mycobacterium
GGRTAN

SEQ ID NO: 1343047 - protein, 6 aa, Mycobacterium
GGRTGE

SEQ ID NO: 1343048 - protein, 13 aa, Mycobacterium
GGSDRRSAAQSAV

SEQ ID NO: 1343049 - protein, 32 aa, Mycobacterium
GGSGAGADADAAAPADVNAAKEQAKQFRTAGM

SEQ ID NO: 1343050 - protein, 24 aa, Mycobacterium
GGSGGREPAGGTYPAEMLVDWIRV

SEQ ID NO: 1343051 - protein, 15 aa, Mycobacterium
GGSHATAQPPPTQAA

SEQ ID NO: 1343052 - protein, 18 aa, Mycobacterium
GGSLTGPSRGVDGGADTV

SEQ ID NO: 1343053 - protein, 18 aa, Mycobacterium
GGSLTGPSRGVDQGAGTV

SEQ ID NO: 1343054 - protein, 10 aa, Mycobacterium
GGSPGEPRGE

SEQ ID NO: 1343055 - protein, 9 aa, Mycobacterium
GGSPQGRAL

SEQ ID NO: 1343056 - protein, 5 aa, Mycobacterium
GGSPV

SEQ ID NO: 1343057 - protein, 4 aa, Mycobacterium
GGSQ

SEQ ID NO: 1343058 - protein, 28 aa, Mycobacterium
GGTAPAPDRWDRQTPAGATAPADTSQWD

SEQ ID NO: 1343059 - protein, 18 aa, Mycobacterium
GGTAQASHDGTSHSGSQI

SEQ ID NO: 1343060 - protein, 5 aa, Mycobacterium
GGTAY

SEQ ID NO: 1343061 - protein, 5 aa, Mycobacterium
GGTDT

SEQ ID NO: 1343062 - protein, 5 aa, Mycobacterium
GGTGA

SEQ ID NO: 1343063 - protein, 31 aa, Mycobacterium
GGTQIGTPYSWGGGKPNGPSRGIDSGANTVG

SEQ ID NO: 1343064 - protein, 9 aa, Mycobacterium
GGTRVGPGG

SEQ ID NO: 1343065 - protein, 7 aa, Mycobacterium
GGTTVAG

SEQ ID NO: 1343066 - protein, 4 aa, Mycobacterium
GGTV

SEQ ID NO: 1343067 - protein, 6 aa, Mycobacterium
GGVADG

SEQ ID NO: 1343068 - protein, 7 aa, Mycobacterium
GGVARSQ

SEQ ID NO: 1343069 - protein, 5 aa, Mycobacterium
GGVPT

SEQ ID NO: 1343070 - protein, 17 aa, Mycobacterium
GGVPYENPSNAAHDKAP

SEQ ID NO: 1343071 - protein, 7 aa, Mycobacterium
GGVTSSQ

SEQ ID NO: 1343072 - protein, 17 aa, Mycobacterium
GGVTSTSATFETHSPDN

SEQ ID NO: 1343073 - protein, 8 aa, Mycobacterium
GGYGSPFG

SEQ ID NO: 1343074 - protein, 4 aa, Mycobacterium
GGYQ

SEQ ID NO: 1343075 - protein, 4 aa, Mycobacterium
GGYR

SEQ ID NO: 1343076 - protein, 12 aa, Mycobacterium
GGYTSTSDMTYD

SEQ ID NO: 1343077 - protein, 5 aa, Mycobacterium
GHDAS

SEQ ID NO: 1343078 - protein, 6 aa, Mycobacterium
GHDASA

SEQ ID NO: 1343079 - protein, 6 aa, Mycobacterium
GHDPGE

SEQ ID NO: 1343080 - protein, 5 aa, Mycobacterium
GHEPV

SEQ ID NO: 1343081 - protein, 8 aa, Mycobacterium
GHETTASS

SEQ ID NO: 1343082 - protein, 6 aa, Mycobacterium
GHGATR

SEQ ID NO: 1343083 - protein, 7 aa, Mycobacterium
GHGGIRT

SEQ ID NO: 1343084 - protein, 5 aa, Mycobacterium
GHGGV

SEQ ID NO: 1343085 - protein, 7 aa, Mycobacterium
GHGGVTP

SEQ ID NO: 1343086 - protein, 5 aa, Mycobacterium
GHHGN

SEQ ID NO: 1343087 - protein, 7 aa, Mycobacterium
GHLDRTQ

SEQ ID NO: 1343088 - protein, 35 aa, Mycobacterium
GHNGSNDASISRQVPTGRGGTKDCQASGTSTEDGF

SEQ ID NO: 1343089 - protein, 13 aa, Mycobacterium
GHPDPADRQQPPH

SEQ ID NO: 1343090 - protein, 9 aa, Mycobacterium
GHQAQKGLG

SEQ ID NO: 1343091 - protein, 9 aa, Mycobacterium
GHQPQPGKF

SEQ ID NO: 1343092 - protein, 17 aa, Mycobacterium
GHRARGHSPRPGGLTPR

SEQ ID NO: 1343093 - protein, 6 aa, Mycobacterium
GHSDQF

SEQ ID NO: 1343094 - protein, 9 aa, Mycobacterium
GHSGGTVSA

SEQ ID NO: 1343095 - protein, 5 aa, Mycobacterium
GHTGD

SEQ ID NO: 1343096 - protein, 5 aa, Mycobacterium
GHTTG

SEQ ID NO: 1343097 - protein, 5 aa, Mycobacterium
GIAET

SEQ ID NO: 1343098 - protein, 12 aa, Mycobacterium
GIATDSKGSGTA

SEQ ID NO: 1343099 - protein, 11 aa, Mycobacterium
GIEASDDLPPV

SEQ ID NO: 1343100 - protein, 5 aa, Mycobacterium
GIGAG

SEQ ID NO: 1343101 - protein, 7 aa, Mycobacterium
GIGGHPD

SEQ ID NO: 1343102 - protein, 4 aa, Mycobacterium
GIGQ

SEQ ID NO: 1343103 - protein, 20 aa, Mycobacterium
GIHRSTDNGTTFEAFYAFDA

SEQ ID NO: 1343104 - protein, 13 aa, Mycobacterium
GILNSSKKKEDAQ

SEQ ID NO: 1343105 - protein, 13 aa, Mycobacterium
GIPADPSGTSAVA

SEQ ID NO: 1343106 - protein, 5 aa, Mycobacterium
GIPFS

SEQ ID NO: 1343107 - protein, 6 aa, Mycobacterium
GIPGSQ

SEQ ID NO: 1343108 - protein, 8 aa, Mycobacterium
GIPPTAPI

SEQ ID NO: 1343109 - protein, 11 aa, Mycobacterium
GISCTSEPSGM

SEQ ID NO: 1343110 - protein, 6 aa, Mycobacterium
GISEPM

SEQ ID NO: 1343111 - protein, 13 aa, Mycobacterium
GITDADVTEAAGS

SEQ ID NO: 1343112 - protein, 14 aa, Mycobacterium
GITPSVTPTGLGNT

SEQ ID NO: 1343113 - protein, 14 aa, Mycobacterium
GITSRGAATQMPED

SEQ ID NO: 1343114 - protein, 4 aa, Mycobacterium
GIYA

SEQ ID NO: 1343115 - protein, 7 aa, Mycobacterium
GKAGVAN

SEQ ID NO: 1343116 - protein, 17 aa, Mycobacterium
GKAQARPPATTPADTDA

SEQ ID NO: 1343117 - protein, 10 aa, Mycobacterium
GKATGDQGRA

SEQ ID NO: 1343118 - protein, 5 aa, Mycobacterium
GKESL

SEQ ID NO: 1343119 - protein, 8 aa, Mycobacterium
GKGADAAQ

SEQ ID NO: 1343120 - protein, 10 aa, Mycobacterium
GKGNPSNSVV

SEQ ID NO: 1343121 - protein, 8 aa, Mycobacterium
GKGPGVPQ

SEQ ID NO: 1343122 - protein, 13 aa, Mycobacterium
GKHRSPEPMTQHR

SEQ ID NO: 1343123 - protein, 5 aa, Mycobacterium
GKIEK

SEQ ID NO: 1343124 - protein, 5 aa, Mycobacterium
GKLAE

SEQ ID NO: 1343125 - protein, 9 aa, Mycobacterium
GKLSPDAAG

SEQ ID NO: 1343126 - protein, 10 aa, Mycobacterium
GKNSTPTNNG

SEQ ID NO: 1343127 - protein, 12 aa, Mycobacterium
GKPAARVDTQRA

SEQ ID NO: 1343128 - protein, 16 aa, Mycobacterium
GKPAEVNGNVAGNNLP

SEQ ID NO: 1343129 - protein, 13 aa, Mycobacterium
GKPAQGEQGDPTL

SEQ ID NO: 1343130 - protein, 8 aa, Mycobacterium
GKPGSPAW

SEQ ID NO: 1343131 - protein, 13 aa, Mycobacterium
GKPTSVNPATDPI

SEQ ID NO: 1343132 - protein, 26 aa, Mycobacterium
GKPTSVNPATDPIGAAEAARPHTGRT

SEQ ID NO: 1343133 - protein, 16 aa, Mycobacterium
GKQPPANPAPPAPLPS

SEQ ID NO: 1343134 - protein, 17 aa, Mycobacterium
GKQPPANPAPPAPLPSY

SEQ ID NO: 1343135 - protein, 14 aa, Mycobacterium
GKRVSTGSPGSGTE

SEQ ID NO: 1343136 - protein, 6 aa, Mycobacterium
GKSGPY

SEQ ID NO: 1343137 - protein, 8 aa, Mycobacterium
GKSSGTAT

SEQ ID NO: 1343138 - protein, 7 aa, Mycobacterium
GKSSNVG

SEQ ID NO: 1343139 - protein, 6 aa, Mycobacterium
GKSTLA

SEQ ID NO: 1343140 - protein, 6 aa, Mycobacterium
GKTGDG

SEQ ID NO: 1343141 - protein, 8 aa, Mycobacterium
GKTGTAEY

SEQ ID NO: 1343142 - protein, 15 aa, Mycobacterium
GKVDENWNAGPNKGI

SEQ ID NO: 1343143 - protein, 14 aa, Mycobacterium
GLANNGTATFEPAA

SEQ ID NO: 1343144 - protein, 13 aa, Mycobacterium
GLASRGLDARKPF

SEQ ID NO: 1343145 - protein, 16 aa, Mycobacterium
GLATAQPARSATNQKA

SEQ ID NO: 1343146 - protein, 6 aa, Mycobacterium
GLDADT

SEQ ID NO: 1343147 - protein, 5 aa, Mycobacterium
GLDHP

SEQ ID NO: 1343148 - protein, 9 aa, Mycobacterium
GLDPDGDQL

SEQ ID NO: 1343149 - protein, 8 aa, Mycobacterium
GLDPQDPM

SEQ ID NO: 1343150 - protein, 10 aa, Mycobacterium
GLDTDQVSDS

SEQ ID NO: 1343151 - protein, 16 aa, Mycobacterium
GLEGTAGGSAYNASKG

SEQ ID NO: 1343152 - protein, 6 aa, Mycobacterium
GLESSP

SEQ ID NO: 1343153 - protein, 5 aa, Mycobacterium
GLFPG

SEQ ID NO: 1343154 - protein, 13 aa, Mycobacterium
GLGAPSAAAQPCP

SEQ ID NO: 1343155 - protein, 5 aa, Mycobacterium
GLGEH

SEQ ID NO: 1343156 - protein, 10 aa, Mycobacterium
GLGHGTTPDD

SEQ ID NO: 1343157 - protein, 15 aa, Mycobacterium
GLGIPGPGPDGRPRY

SEQ ID NO: 1343158 - protein, 5 aa, Mycobacterium
GLGQH

SEQ ID NO: 1343159 - protein, 9 aa, Mycobacterium
GLNGPSDDG

SEQ ID NO: 1343160 - protein, 5 aa, Mycobacterium
GLNHP

SEQ ID NO: 1343161 - protein, 10 aa, Mycobacterium
GLNPESDVAA

SEQ ID NO: 1343162 - protein, 4 aa, Mycobacterium
GLPA

SEQ ID NO: 1343163 - protein, 7 aa, Mycobacterium
GLPAKGS

SEQ ID NO: 1343164 - protein, 5 aa, Mycobacterium
GLPAT

SEQ ID NO: 1343165 - protein, 10 aa, Mycobacterium
GLPDYTANPE

SEQ ID NO: 1343166 - protein, 5 aa, Mycobacterium
GLPEA

SEQ ID NO: 1343167 - protein, 7 aa, Mycobacterium
GLPEKKG

SEQ ID NO: 1343168 - protein, 9 aa, Mycobacterium
GLPESEVDP

SEQ ID NO: 1343169 - protein, 5 aa, Mycobacterium
GLPGG

SEQ ID NO: 1343170 - protein, 16 aa, Mycobacterium
GLPHRDQWTDNQSEAV

SEQ ID NO: 1343171 - protein, 9 aa, Mycobacterium
GLPPDERRA

SEQ ID NO: 1343172 - protein, 12 aa, Mycobacterium
GLPPGDIAPPPL

SEQ ID NO: 1343173 - protein, 9 aa, Mycobacterium
GLPRDTPPV

SEQ ID NO: 1343174 - protein, 7 aa, Mycobacterium
GLPTGSS

SEQ ID NO: 1343175 - protein, 12 aa, Mycobacterium
GLQDDKQDLQNQ

SEQ ID NO: 1343176 - protein, 9 aa, Mycobacterium
GLQDGGAPV

SEQ ID NO: 1343177 - protein, 8 aa, Mycobacterium
GLQPDAPV

SEQ ID NO: 1343178 - protein, 9 aa, Mycobacterium
GLQTPNPST

SEQ ID NO: 1343179 - protein, 9 aa, Mycobacterium
GLRSDPRNQ

SEQ ID NO: 1343180 - protein, 8 aa, Mycobacterium
GLSDEQDR

SEQ ID NO: 1343181 - protein, 21 aa, Mycobacterium
GLSTGSAHAAPPVEISEQSEQ

SEQ ID NO: 1343182 - protein, 5 aa, Mycobacterium
GLTDA

SEQ ID NO: 1343183 - protein, 5 aa, Mycobacterium
GLTGE

SEQ ID NO: 1343184 - protein, 14 aa, Mycobacterium
GLTGSEPASLSPPA

SEQ ID NO: 1343185 - protein, 5 aa, Mycobacterium
GLTPN

SEQ ID NO: 1343186 - protein, 18 aa, Mycobacterium
GMAPTGTESAMEDNSGIM

SEQ ID NO: 1343187 - protein, 9 aa, Mycobacterium
GMEGPRDGL

SEQ ID NO: 1343188 - protein, 6 aa, Mycobacterium
GMGATQ

SEQ ID NO: 1343189 - protein, 6 aa, Mycobacterium
GMSGDL

SEQ ID NO: 1343190 - protein, 6 aa, Mycobacterium
GNAPLD

SEQ ID NO: 1343191 - protein, 7 aa, Mycobacterium
GNATDEA

SEQ ID NO: 1343192 - protein, 5 aa, Mycobacterium
GNCPG

SEQ ID NO: 1343193 - protein, 40 aa, Mycobacterium
GNDRRPDESCAPEPARLDDGPPDREVRNATGHGVSPPIPE

SEQ ID NO: 1343194 - protein, 10 aa, Mycobacterium
GNDYADDLAA

SEQ ID NO: 1343195 - protein, 5 aa, Mycobacterium
GNEEA

SEQ ID NO: 1343196 - protein, 8 aa, Mycobacterium
GNFPGNDD

SEQ ID NO: 1343197 - protein, 9 aa, Mycobacterium
GNGALKGKP

SEQ ID NO: 1343198 - protein, 35 aa, Mycobacterium
GNGANSGNALGTNNRTTAIGNGAAASAGYGDDNTA

SEQ ID NO: 1343199 - protein, 25 aa, Mycobacterium
GNGGAGGAGEAGSNNGAGGRGGRGG

SEQ ID NO: 1343200 - protein, 10 aa, Mycobacterium
GNGQTGLEEN

SEQ ID NO: 1343201 - protein, 8 aa, Mycobacterium
GNIQQNSR

SEQ ID NO: 1343202 - protein, 4 aa, Mycobacterium
GNKL

SEQ ID NO: 1343203 - protein, 13 aa, Mycobacterium
GNMAAATAEGEGN

SEQ ID NO: 1343204 - protein, 12 aa, Mycobacterium
GNMAATTAEGDG

SEQ ID NO: 1343205 - protein, 14 aa, Mycobacterium
GNMPPGHGDMPGGP

SEQ ID NO: 1343206 - protein, 15 aa, Mycobacterium
GNNSRGGVGAGDRNS

SEQ ID NO: 1343207 - protein, 7 aa, Mycobacterium
GNPAEGI

SEQ ID NO: 1343208 - protein, 6 aa, Mycobacterium
GNPEDG

SEQ ID NO: 1343209 - protein, 82 aa, Mycobacterium
GNPGISTGRTVADTEDEDPGTSALRTRAAQSEDDNDDDAAVTRSEKNDDASTSDSTSTDKAGDTRAAKASDDKGDGNEGGDD

SEQ ID NO: 1343210 - protein, 6 aa, Mycobacterium
GNPSTK

SEQ ID NO: 1343211 - protein, 10 aa, Mycobacterium
GNPSTKIGRP

SEQ ID NO: 1343212 - protein, 10 aa, Mycobacterium
GNQSTPDVDT

SEQ ID NO: 1343213 - protein, 23 aa, Mycobacterium
GNQSTPPGQGEGVPRVPEGSAGI

SEQ ID NO: 1343214 - protein, 4 aa, Mycobacterium
GNRD

SEQ ID NO: 1343215 - protein, 4 aa, Mycobacterium
GNRT

SEQ ID NO: 1343216 - protein, 7 aa, Mycobacterium
GNSGAQR

SEQ ID NO: 1343217 - protein, 12 aa, Mycobacterium
GNSNGLGTQQTG

SEQ ID NO: 1343218 - protein, 11 aa, Mycobacterium
GNSPENPSMES

SEQ ID NO: 1343219 - protein, 4 aa, Mycobacterium
GNTD

SEQ ID NO: 1343220 - protein, 6 aa, Mycobacterium
GNTGSA

SEQ ID NO: 1343221 - protein, 6 aa, Mycobacterium
GNTPPI

SEQ ID NO: 1343222 - protein, 41 aa, Mycobacterium
GNTTADGNTTTDGTTTTDGNTTPPATTNAPTATDETDENYD

SEQ ID NO: 1343223 - protein, 7 aa, Mycobacterium
GNVADSS

SEQ ID NO: 1343224 - protein, 5 aa, Mycobacterium
GNVDS

SEQ ID NO: 1343225 - protein, 15 aa, Mycobacterium
GNWPGPPDATTPNPS

SEQ ID NO: 1343226 - protein, 14 aa, Mycobacterium
GNYGWPQAEGNCTG

SEQ ID NO: 1343227 - protein, 7 aa, Mycobacterium
GNYPTDE

SEQ ID NO: 1343228 - protein, 22 aa, Mycobacterium
GPAAAQPPAPVPVPETPTGTPA

SEQ ID NO: 1343229 - protein, 12 aa, Mycobacterium
GPAAGTATAAPP

SEQ ID NO: 1343230 - protein, 17 aa, Mycobacterium
GPAASVRAEPEAPDAGT

SEQ ID NO: 1343231 - protein, 7 aa, Mycobacterium
GPADLAG

SEQ ID NO: 1343232 - protein, 5 aa, Mycobacterium
GPAEA

SEQ ID NO: 1343233 - protein, 9 aa, Mycobacterium
GPAETDPAW

SEQ ID NO: 1343234 - protein, 12 aa, Mycobacterium
GPAGVSAAETFR

SEQ ID NO: 1343235 - protein, 12 aa, Mycobacterium
GPAPAPPAARYS

SEQ ID NO: 1343236 - protein, 21 aa, Mycobacterium
GPAPDAAVPATSEPHPHGGEH

SEQ ID NO: 1343237 - protein, 7 aa, Mycobacterium
GPAPVAG

SEQ ID NO: 1343238 - protein, 15 aa, Mycobacterium
GPDGDFDADSLSPQM

SEQ ID NO: 1343239 - protein, 7 aa, Mycobacterium
GPDGQLQ

SEQ ID NO: 1343240 - protein, 15 aa, Mycobacterium
GPDGTPYATLTGADQ

SEQ ID NO: 1343241 - protein, 5 aa, Mycobacterium
GPDIT

SEQ ID NO: 1343242 - protein, 18 aa, Mycobacterium
GPDTASHLHGPDSPEAIE

SEQ ID NO: 1343243 - protein, 9 aa, Mycobacterium
GPDVNAGSR

SEQ ID NO: 1343244 - protein, 6 aa, Mycobacterium
GPDVRG

SEQ ID NO: 1343245 - protein, 8 aa, Mycobacterium
GPEDSGSA

SEQ ID NO: 1343246 - protein, 22 aa, Mycobacterium
GPEKRNEWSYTTDGTATAAGDD

SEQ ID NO: 1343247 - protein, 7 aa, Mycobacterium
GPESGYI

SEQ ID NO: 1343248 - protein, 4 aa, Mycobacterium
GPET

SEQ ID NO: 1343249 - protein, 79 aa, Mycobacterium; identical to SEQ ID NO: 1206507

SEQ ID NO: 1343250 - protein, 14 aa, Mycobacterium
GPGAASAQAAESCP

SEQ ID NO: 1343251 - protein, 9 aa, Mycobacterium
GPGAGEYSP

SEQ ID NO: 1343252 - protein, 10 aa, Mycobacterium
GPGDDPADHP

SEQ ID NO: 1343253 - protein, 8 aa, Mycobacterium
GPGEDGPT

SEQ ID NO: 1343254 - protein, 4 aa, Mycobacterium
GPGF

SEQ ID NO: 1343255 - protein, 8 aa, Mycobacterium
GPGGPTTL

SEQ ID NO: 1343256 - protein, 7 aa, Mycobacterium
GPGGRGM

SEQ ID NO: 1343257 - protein, 8 aa, Mycobacterium
GPGGTLTG

SEQ ID NO: 1343258 - protein, 8 aa, Mycobacterium
GPGHPDVA

SEQ ID NO: 1343259 - protein, 14 aa, Mycobacterium
GPGPHGGAVESAAA

SEQ ID NO: 1343260 - protein, 10 aa, Mycobacterium
GPGSAQADTW

SEQ ID NO: 1343261 - protein, 10 aa, Mycobacterium
GPGSASDPFT

SEQ ID NO: 1343262 - protein, 9 aa, Mycobacterium
GPIASGATG

SEQ ID NO: 1343263 - protein, 4 aa, Mycobacterium
GPKE

SEQ ID NO: 1343264 - protein, 5 aa, Mycobacterium
GPKYA

SEQ ID NO: 1343265 - protein, 8 aa, Mycobacterium
GPLPEGMR

SEQ ID NO: 1343266 - protein, 15 aa, Mycobacterium
GPMPAGLAEKASAAA

SEQ ID NO: 1343267 - protein, 6 aa, Mycobacterium
GPPEAP

SEQ ID NO: 1343268 - protein, 8 aa, Mycobacterium
GPPEAPGR

SEQ ID NO: 1343269 - protein, 8 aa, Mycobacterium
GPPGIGKT

SEQ ID NO: 1343270 - protein, 14 aa, Mycobacterium
GPPPATDSRGTRIS

SEQ ID NO: 1343271 - protein, 6 aa, Mycobacterium
GPPPDA

SEQ ID NO: 1343272 - protein, 47 aa, Mycobacterium; identical to SEQ ID NO: 1102446

SEQ ID NO: 1343273 - protein, 9 aa, Mycobacterium
GPQADTNAI

SEQ ID NO: 1343274 - protein, 6 aa, Mycobacterium
GPQGLA

SEQ ID NO: 1343275 - protein, 4 aa, Mycobacterium
GPQQ

SEQ ID NO: 1343276 - protein, 9 aa, Mycobacterium
GPQRDQSQV

SEQ ID NO: 1343277 - protein, 17 aa, Mycobacterium
GPRGRKEYRITDAGRAE

SEQ ID NO: 1343278 - protein, 5 aa, Mycobacterium
GPRQR

SEQ ID NO: 1343279 - protein, 4 aa, Mycobacterium
GPSA

SEQ ID NO: 1343280 - protein, 9 aa, Mycobacterium
GPSAANGAV

SEQ ID NO: 1343281 - protein, 9 aa, Mycobacterium
GPSADLPAE

SEQ ID NO: 1343282 - protein, 9 aa, Mycobacterium
GPSGVLGPD

SEQ ID NO: 1343283 - protein, 12 aa, Mycobacterium
GPSPLSEPETRN

SEQ ID NO: 1343284 - protein, 109 aa, Mycobacterium
GPSPMAEADTGTETSVSTGPEKATAEQSGSGEADAPDDAEDEANEDSDELDDADATDDPDDPDDADATDDVDDVDEADDAVGEATDGDRDDEGGEAAAGGADPAADGDV

SEQ ID NO: 1343285 - protein, 8 aa, Mycobacterium
GPSPTGWQ

SEQ ID NO: 1343286 - protein, 5 aa, Mycobacterium
GPSRA

SEQ ID NO: 1343287 - protein, 4 aa, Mycobacterium
GPSV

SEQ ID NO: 1343288 - protein, 8 aa, Mycobacterium
GPSVGYQS

SEQ ID NO: 1343289 - protein, 6 aa, Mycobacterium
GPTELR

SEQ ID NO: 1343290 - protein, 11 aa, Mycobacterium
GPTPWSTPNNL

SEQ ID NO: 1343291 - protein, 4 aa, Mycobacterium
GPTQ

SEQ ID NO: 1343292 - protein, 7 aa, Mycobacterium
GPTRAGH

SEQ ID NO: 1343293 - protein, 4 aa, Mycobacterium
GPTV

SEQ ID NO: 1343294 - protein, 22 aa, Mycobacterium
GPVGPGPVGPGPVGPGPLGPGP

SEQ ID NO: 1343295 - protein, 12 aa, Mycobacterium
GPVPYPGAPPYG

SEQ ID NO: 1343296 - protein, 6 aa, Mycobacterium
GPVTGT

SEQ ID NO: 1343297 - protein, 6 aa, Mycobacterium
GPYRYD

SEQ ID NO: 1343298 - protein, 7 aa, Mycobacterium
GQAAADP

SEQ ID NO: 1343299 - protein, 9 aa, Mycobacterium
GQAAGDPCV

SEQ ID NO: 1343300 - protein, 8 aa, Mycobacterium
GQAAPEQV

SEQ ID NO: 1343301 - protein, 8 aa, Mycobacterium
GQADQARQ

SEQ ID NO: 1343302 - protein, 12 aa, Mycobacterium
GQAGSETEYGSA

SEQ ID NO: 1343303 - protein, 8 aa, Mycobacterium
GQAKDVTN

SEQ ID NO: 1343304 - protein, 5 aa, Mycobacterium
GQALG

SEQ ID NO: 1343305 - protein, 9 aa, Mycobacterium
GQDDASTRF

SEQ ID NO: 1343306 - protein, 14 aa, Mycobacterium
GQDGRIAGQGVGDR

SEQ ID NO: 1343307 - protein, 6 aa, Mycobacterium
GQERTA

SEQ ID NO: 1343308 - protein, 5 aa, Mycobacterium
GQGAT

SEQ ID NO: 1343309 - protein, 7 aa, Mycobacterium
GQGAYNA

SEQ ID NO: 1343310 - protein, 6 aa, Mycobacterium
GQGDTI

SEQ ID NO: 1343311 - protein, 6 aa, Mycobacterium
GQGGRE

SEQ ID NO: 1343312 - protein, 6 aa, Mycobacterium
GQGGTL

SEQ ID NO: 1343313 - protein, 6 aa, Mycobacterium
GQGRTL

SEQ ID NO: 1343314 - protein, 10 aa, Mycobacterium
GQIASPAPEF

SEQ ID NO: 1343315 - protein, 7 aa, Mycobacterium
GQITKQS

SEQ ID NO: 1343316 - protein, 9 aa, Mycobacterium
GQKNAVQAV

SEQ ID NO: 1343317 - protein, 17 aa, Mycobacterium
GQLDEKQIDRSDQNKPG

SEQ ID NO: 1343318 - protein, 6 aa, Mycobacterium
GQLGSA

SEQ ID NO: 1343319 - protein, 5 aa, Mycobacterium
GQLPD

SEQ ID NO: 1343320 - protein, 6 aa, Mycobacterium
GQLPGA

SEQ ID NO: 1343321 - protein, 9 aa, Mycobacterium
GQLSPDGVT

SEQ ID NO: 1343322 - protein, 6 aa, Mycobacterium
GQLTAD

SEQ ID NO: 1343323 - protein, 9 aa, Mycobacterium
GQNAGVQHA

SEQ ID NO: 1343324 - protein, 6 aa, Mycobacterium
GQPAQA

SEQ ID NO: 1343325 - protein, 6 aa, Mycobacterium
GQPGEL

SEQ ID NO: 1343326 - protein, 5 aa, Mycobacterium
GQPQV

SEQ ID NO: 1343327 - protein, 10 aa, Mycobacterium
GQPSAPMTVA

SEQ ID NO: 1343328 - protein, 24 aa, Mycobacterium
GQPSPPSPATPTTEAAGPIDPSRM

SEQ ID NO: 1343329 - protein, 24 aa, Mycobacterium
GQPSPQSPATLTTEAAGPIDPSRM

SEQ ID NO: 1343330 - protein, 17 aa, Mycobacterium
GQQGGSWKSTGCSSPLG

SEQ ID NO: 1343331 - protein, 6 aa, Mycobacterium
GQQPDS

SEQ ID NO: 1343332 - protein, 7 aa, Mycobacterium
GQQRKVP

SEQ ID NO: 1343333 - protein, 14 aa, Mycobacterium
GQQRPANAQAHGPL

SEQ ID NO: 1343334 - protein, 9 aa, Mycobacterium
GQRAPRVSG

SEQ ID NO: 1343335 - protein, 10 aa, Mycobacterium
GQRPEPATRK

SEQ ID NO: 1343336 - protein, 9 aa, Mycobacterium
GQSAALDQI

SEQ ID NO: 1343337 - protein, 10 aa, Mycobacterium
GQSARPNELT

SEQ ID NO: 1343338 - protein, 9 aa, Mycobacterium
GQSQANADG

SEQ ID NO: 1343339 - protein, 10 aa, Mycobacterium
GQSQGGGAAV

SEQ ID NO: 1343340 - protein, 26 aa, Mycobacterium
GQSVSQPSLSVSDGSVSEGNSGTSTV

SEQ ID NO: 1343341 - protein, 6 aa, Mycobacterium
GQTAAV

SEQ ID NO: 1343342 - protein, 12 aa, Mycobacterium
GQTELSPEDRKS

SEQ ID NO: 1343343 - protein, 5 aa, Mycobacterium
GQTFT

SEQ ID NO: 1343344 - protein, 4 aa, Mycobacterium
GQTQ

SEQ ID NO: 1343345 - protein, 5 aa, Mycobacterium
GQTQA

SEQ ID NO: 1343346 - protein, 26 aa, Mycobacterium
GQTSVTSLNADGTKSEHALRAGEGAT

SEQ ID NO: 1343347 - protein, 4 aa, Mycobacterium
GQTT

SEQ ID NO: 1343348 - protein, 7 aa, Mycobacterium
GQTTTPY

SEQ ID NO: 1343349 - protein, 10 aa, Mycobacterium
GQVQGTPDTL

SEQ ID NO: 1343350 - protein, 12 aa, Mycobacterium
GQVRATDPDRDK

SEQ ID NO: 1343351 - protein, 9 aa, Mycobacterium
GRAATKTVD

SEQ ID NO: 1343352 - protein, 11 aa, Mycobacterium
GRAGEAVQGRA

SEQ ID NO: 1343353 - protein, 15 aa, Mycobacterium
GRAKPRQSNAQQCLH

SEQ ID NO: 1343354 - protein, 15 aa, Mycobacterium
GRALGARPTTNTGNP

SEQ ID NO: 1343355 - protein, 10 aa, Mycobacterium
GRALTDGSSM

SEQ ID NO: 1343356 - protein, 5 aa, Mycobacterium
GRASD

SEQ ID NO: 1343357 - protein, 9 aa, Mycobacterium
GRAVDPAAV

SEQ ID NO: 1343358 - protein, 4 aa, Mycobacterium
GRDG

SEQ ID NO: 1343359 - protein, 6 aa, Mycobacterium
GRDGPM

SEQ ID NO: 1343360 - protein, 10 aa, Mycobacterium
GRDPADDREL

SEQ ID NO: 1343361 - protein, 10 aa, Mycobacterium
GRDPRGGTVA

SEQ ID NO: 1343362 - protein, 14 aa, Mycobacterium
GRDQPLEPKPDDVL

SEQ ID NO: 1343363 - protein, 5 aa, Mycobacterium
GRESH

SEQ ID NO: 1343364 - protein, 8 aa, Mycobacterium
GRETPGRS

SEQ ID NO: 1343365 - protein, 6 aa, Mycobacterium
GRFGPP

SEQ ID NO: 1343366 - protein, 18 aa, Mycobacterium
GRGDAGDRGHEARSPVDP

SEQ ID NO: 1343367 - protein, 8 aa, Mycobacterium
GRGPGGEA

SEQ ID NO: 1343368 - protein, 9 aa, Mycobacterium
GRGQPKVVR

SEQ ID NO: 1343369 - protein, 6 aa, Mycobacterium
GRGTEA

SEQ ID NO: 1343370 - protein, 16 aa, Mycobacterium
GRGTGYRTGPDGAGTR

SEQ ID NO: 1343371 - protein, 7 aa, Mycobacterium
GRHDGNQ

SEQ ID NO: 1343372 - protein, 11 aa, Mycobacterium
GRKDPPVAEDY

SEQ ID NO: 1343373 - protein, 47 aa, Mycobacterium; identical to SEQ ID NO: 1181710

SEQ ID NO: 1343374 - protein, 9 aa, Mycobacterium
GRKQDISNS

SEQ ID NO: 1343375 - protein, 4 aa, Mycobacterium
GRLG

SEQ ID NO: 1343376 - protein, 7 aa, Mycobacterium
GRPEAAA

SEQ ID NO: 1343377 - protein, 5 aa, Mycobacterium
GRPEE

SEQ ID NO: 1343378 - protein, 7 aa, Mycobacterium
GRPEEIA

SEQ ID NO: 1343379 - protein, 4 aa, Mycobacterium
GRPG

SEQ ID NO: 1343380 - protein, 12 aa, Mycobacterium
GRPRYRTSGVPK

SEQ ID NO: 1343381 - protein, 8 aa, Mycobacterium
GRPTSPGV

SEQ ID NO: 1343382 - protein, 4 aa, Mycobacterium
GRPV

SEQ ID NO: 1343383 - protein, 8 aa, Mycobacterium
GRQAGDKL

SEQ ID NO: 1343384 - protein, 5 aa, Mycobacterium
GRQRR

SEQ ID NO: 1343385 - protein, 6 aa, Mycobacterium
GRQVPG

SEQ ID NO: 1343386 - protein, 11 aa, Mycobacterium
GRRDDPTDQPH

SEQ ID NO: 1343387 - protein, 26 aa, Mycobacterium
GRRGDTDDHIDNDDHHSKDGAAPEED

SEQ ID NO: 1343388 - protein, 6 aa, Mycobacterium
GRRPAT

SEQ ID NO: 1343389 - protein, 18 aa, Mycobacterium
GRRSYDAGLGRRGLPEQL

SEQ ID NO: 1343390 - protein, 5 aa, Mycobacterium
GRRTR

SEQ ID NO: 1343391 - protein, 12 aa, Mycobacterium
GRSESKGPEPEG

SEQ ID NO: 1343392 - protein, 5 aa, Mycobacterium
GRSGT

SEQ ID NO: 1343393 - protein, 8 aa, Mycobacterium
GRSRSPGK

SEQ ID NO: 1343394 - protein, 6 aa, Mycobacterium
GRSTGY

SEQ ID NO: 1343395 - protein, 27 aa, Mycobacterium
GRSVTPAPAAPESPGPEETTETTAALA

SEQ ID NO: 1343396 - protein, 6 aa, Mycobacterium
GRSYPA

SEQ ID NO: 1343397 - protein, 15 aa, Mycobacterium
GRTEDPDSAWKRNDP

SEQ ID NO: 1343398 - protein, 5 aa, Mycobacterium
GRTGA

SEQ ID NO: 1343399 - protein, 5 aa, Mycobacterium
GRTHR

SEQ ID NO: 1343400 - protein, 6 aa, Mycobacterium
GRTPEL

SEQ ID NO: 1343401 - protein, 6 aa, Mycobacterium
GRTPVA

SEQ ID NO: 1343402 - protein, 29 aa, Mycobacterium
GRTSAGRVGVDPTATRSPAPPAAQHPGGW

SEQ ID NO: 1343403 - protein, 21 aa, Mycobacterium
GRTSAGRVGVDPTGSDPATGW

SEQ ID NO: 1343404 - protein, 10 aa, Mycobacterium
GRTTPDADDV

SEQ ID NO: 1343405 - protein, 9 aa, Mycobacterium
GRVGGRSVG

SEQ ID NO: 1343406 - protein, 14 aa, Mycobacterium
GRVTATDSDTPTLT

SEQ ID NO: 1343407 - protein, 4 aa, Mycobacterium
GSAA

SEQ ID NO: 1343408 - protein, 17 aa, Mycobacterium
GSAAAEPPLPGPPAPID

SEQ ID NO: 1343409 - protein, 12 aa, Mycobacterium
GSAAATPAEGDV

SEQ ID NO: 1343410 - protein, 10 aa, Mycobacterium
GSAAEDPGWS

SEQ ID NO: 1343411 - protein, 8 aa, Mycobacterium
GSAAPAAA

SEQ ID NO: 1343412 - protein, 7 aa, Mycobacterium
GSADFTE

SEQ ID NO: 1343413 - protein, 12 aa, Mycobacterium
GSADGSGTRPWR

SEQ ID NO: 1343414 - protein, 9 aa, Mycobacterium
GSADLSPDA

SEQ ID NO: 1343415 - protein, 12 aa, Mycobacterium
GSAPGNDIDGDT

SEQ ID NO: 1343416 - protein, 6 aa, Mycobacterium
GSAPLE

SEQ ID NO: 1343417 - protein, 7 aa, Mycobacterium
GSAPLSE

SEQ ID NO: 1343418 - protein, 15 aa, Mycobacterium
GSARVTSPDPEGSYQ

SEQ ID NO: 1343419 - protein, 15 aa, Mycobacterium
GSARVTSPDPEGTYQ

SEQ ID NO: 1343420 - protein, 8 aa, Mycobacterium
GSATAAGI

SEQ ID NO: 1343421 - protein, 20 aa, Mycobacterium
GSDAQRNRTDSGTWSRPENA

SEQ ID NO: 1343422 - protein, 14 aa, Mycobacterium
GSDDATANDQGFPE

SEQ ID NO: 1343423 - protein, 17 aa, Mycobacterium
GSDDSSGGGGGSGGDIT

SEQ ID NO: 1343424 - protein, 40 aa, Mycobacterium
GSDNNTASSGSGEGGTAAPAGDCGGKESLKASGSSAQANA

SEQ ID NO: 1343425 - protein, 9 aa, Mycobacterium
GSDPETPEL

SEQ ID NO: 1343426 - protein, 22 aa, Mycobacterium
GSDSGGSESTTTDDGGPAGGTL

SEQ ID NO: 1343427 - protein, 21 aa, Mycobacterium
GSDSGTSSTTSEASGPASGTL

SEQ ID NO: 1343428 - protein, 5 aa, Mycobacterium
GSDTA

SEQ ID NO: 1343429 - protein, 5 aa, Mycobacterium
GSDTR

SEQ ID NO: 1343430 - protein, 14 aa, Mycobacterium
GSEKPGAIASDGSV

SEQ ID NO: 1343431 - protein, 9 aa, Mycobacterium
GSEQTAAER

SEQ ID NO: 1343432 - protein, 5 aa, Mycobacterium
GSETT

SEQ ID NO: 1343433 - protein, 21 aa, Mycobacterium
GSGAATGPTASAQPAQAPAEA

SEQ ID NO: 1343434 - protein, 17 aa, Mycobacterium
GSGAPLTGSREHDEPDF

SEQ ID NO: 1343435 - protein, 22 aa, Mycobacterium
GSGAVEPANAGPYVDRTRTDPG

SEQ ID NO: 1343436 - protein, 6 aa, Mycobacterium
GSGDLS

SEQ ID NO: 1343437 - protein, 4 aa, Mycobacterium
GSGE

SEQ ID NO: 1343438 - protein, 6 aa, Mycobacterium
GSGGIY

SEQ ID NO: 1343439 - protein, 9 aa, Mycobacterium
GSGPNPEVP

SEQ ID NO: 1343440 - protein, 11 aa, Mycobacterium
GSGSAASNTAL

SEQ ID NO: 1343441 - protein, 21 aa, Mycobacterium
GSGSVDTMSRPTDGSTPPPFG

SEQ ID NO: 1343442 - protein, 7 aa, Mycobacterium
GSGSYSA

SEQ ID NO: 1343443 - protein, 9 aa, Mycobacterium
GSGVTGNGS

SEQ ID NO: 1343444 - protein, 9 aa, Mycobacterium
GSGYPRGLP

SEQ ID NO: 1343445 - protein, 9 aa, Mycobacterium
GSHPDRPQG

SEQ ID NO: 1343446 - protein, 6 aa, Mycobacterium
GSHPNK

SEQ ID NO: 1343447 - protein, 24 aa, Mycobacterium
GSKASETDSANAESCVDTSGSTIK

SEQ ID NO: 1343448 - protein, 7 aa, Mycobacterium
GSLAGQR

SEQ ID NO: 1343449 - protein, 7 aa, Mycobacterium
GSLPPGV

SEQ ID NO: 1343450 - protein, 9 aa, Mycobacterium
GSNPAQYGN

SEQ ID NO: 1343451 - protein, 9 aa, Mycobacterium
GSNTPVLDT

SEQ ID NO: 1343452 - protein, 17 aa, Mycobacterium
GSPCPQRQSAAQAPDGR

SEQ ID NO: 1343453 - protein, 7 aa, Mycobacterium
GSPDAVT

SEQ ID NO: 1343454 - protein, 5 aa, Mycobacterium
GSPGG

SEQ ID NO: 1343455 - protein, 13 aa, Mycobacterium
GSPGQVPGDTGER

SEQ ID NO: 1343456 - protein, 10 aa, Mycobacterium
GSPLDGDRDP

SEQ ID NO: 1343457 - protein, 9 aa, Mycobacterium
GSPLEGDHD

SEQ ID NO: 1343458 - protein, 10 aa, Mycobacterium
GSPLSGTDGL

SEQ ID NO: 1343459 - protein, 15 aa, Mycobacterium
GSPPAPPAPTEPPPY

SEQ ID NO: 1343460 - protein, 9 aa, Mycobacterium
GSPTDNNAT

SEQ ID NO: 1343461 - protein, 8 aa, Mycobacterium
GSPVPDRD

SEQ ID NO: 1343462 - protein, 10 aa, Mycobacterium
GSPVTDPAPC

SEQ ID NO: 1343463 - protein, 6 aa, Mycobacterium
GSPYAS

SEQ ID NO: 1343464 - protein, 10 aa, Mycobacterium
GSQASRRAAV

SEQ ID NO: 1343465 - protein, 8 aa, Mycobacterium
GSQEDVKT

SEQ ID NO: 1343466 - protein, 8 aa, Mycobacterium
GSQGAKGT

SEQ ID NO: 1343467 - protein, 4 aa, Mycobacterium
GSQI

SEQ ID NO: 1343468 - protein, 8 aa, Mycobacterium
GSQTLEER

SEQ ID NO: 1343469 - protein, 13 aa, Mycobacterium
GSRPYPGDHPVRE

SEQ ID NO: 1343470 - protein, 8 aa, Mycobacterium
GSRQGAPT

SEQ ID NO: 1343471 - protein, 12 aa, Mycobacterium
GSSDDNQPKNPS

SEQ ID NO: 1343472 - protein, 7 aa, Mycobacterium
GSSDLSQ

SEQ ID NO: 1343473 - protein, 25 aa, Mycobacterium
GSSNPSANARTSTVAPALADGTRWA

SEQ ID NO: 1343474 - protein, 25 aa, Mycobacterium
GSSNRSANARTSTVAPALADGTRWA

SEQ ID NO: 1343475 - protein, 13 aa, Mycobacterium
GSSPADQQALAEP

SEQ ID NO: 1343476 - protein, 17 aa, Mycobacterium
GSSPTKGSVTSFDPTTG

SEQ ID NO: 1343477 - protein, 9 aa, Mycobacterium
GSSPVARGL

SEQ ID NO: 1343478 - protein, 10 aa, Mycobacterium
GSTEDKPEVA

SEQ ID NO: 1343479 - protein, 9 aa, Mycobacterium
GSTGAGKST

SEQ ID NO: 1343480 - protein, 5 aa, Mycobacterium
GSTGR

SEQ ID NO: 1343481 - protein, 6 aa, Mycobacterium
GSTKAV

SEQ ID NO: 1343482 - protein, 4 aa, Mycobacterium
GSTL

SEQ ID NO: 1343483 - protein, 5 aa, Mycobacterium
GSTLP

SEQ ID NO: 1343484 - protein, 6 aa, Mycobacterium
GSTPAQ

SEQ ID NO: 1343485 - protein, 7 aa, Mycobacterium
GSTPEVA

SEQ ID NO: 1343486 - protein, 7 aa, Mycobacterium
GSTPGGL

SEQ ID NO: 1343487 - protein, 5 aa, Mycobacterium
GSTSG

SEQ ID NO: 1343488 - protein, 9 aa, Mycobacterium
GSVGTTAEV

SEQ ID NO: 1343489 - protein, 15 aa, Mycobacterium
GSVKGSGTSGLAGGT

SEQ ID NO: 1343490 - protein, 8 aa, Mycobacterium
GSVPAPTI

SEQ ID NO: 1343491 - protein, 7 aa, Mycobacterium
GSVPGYQ

SEQ ID NO: 1343492 - protein, 4 aa, Mycobacterium
GSVR

SEQ ID NO: 1343493 - protein, 4 aa, Mycobacterium
GSVS

SEQ ID NO: 1343494 - protein, 4 aa, Mycobacterium
GSWN

SEQ ID NO: 1343495 - protein, 4 aa, Mycobacterium
GSYG

SEQ ID NO: 1343496 - protein, 4 aa, Mycobacterium
GSYS

SEQ ID NO: 1343497 - protein, 7 aa, Mycobacterium
GSYTPDQ

SEQ ID NO: 1343498 - protein, 18 aa, Mycobacterium
GTAEAQAYAGSGSTAVRD

SEQ ID NO: 1343499 - protein, 9 aa, Mycobacterium
GTAEPAGLG

SEQ ID NO: 1343500 - protein, 10 aa, Mycobacterium
GTAGDGYELT

SEQ ID NO: 1343501 - protein, 23 aa, Mycobacterium
GTAMAQPGSSPLAKYSQARANGY

SEQ ID NO: 1343502 - protein, 5 aa, Mycobacterium
GTANA

SEQ ID NO: 1343503 - protein, 14 aa, Mycobacterium
GTAPMGDEDDPRAV

SEQ ID NO: 1343504 - protein, 7 aa, Mycobacterium
GTATAAR

SEQ ID NO: 1343505 - protein, 8 aa, Mycobacterium
GTATVEQY

SEQ ID NO: 1343506 - protein, 5 aa, Mycobacterium
GTAVT

SEQ ID NO: 1343507 - protein, 20 aa, Mycobacterium
GTDADGDGLTYSGPTATAKG

SEQ ID NO: 1343508 - protein, 15 aa, Mycobacterium
GTDAIERNSADPTRF

SEQ ID NO: 1343509 - protein, 9 aa, Mycobacterium
GTDARTRAQ

SEQ ID NO: 1343510 - protein, 8 aa, Mycobacterium
GTDEPPGL

SEQ ID NO: 1343511 - protein, 9 aa, Mycobacterium
GTDEPPGLG

SEQ ID NO: 1343512 - protein, 7 aa, Mycobacterium
GTDNQGS

SEQ ID NO: 1343513 - protein, 29 aa, Mycobacterium
GTDSSAPEDTSTSSAPETAAAVSPEEARA

SEQ ID NO: 1343514 - protein, 21 aa, Mycobacterium
GTEARAVDGTRVHDDRGNTYD

SEQ ID NO: 1343515 - protein, 9 aa, Mycobacterium
GTEGNPGNL

SEQ ID NO: 1343516 - protein, 9 aa, Mycobacterium
GTELGAAGK

SEQ ID NO: 1343517 - protein, 15 aa, Mycobacterium
GTENIEGRQIPNDDN

SEQ ID NO: 1343518 - protein, 10 aa, Mycobacterium
GTEQTAADTA

SEQ ID NO: 1343519 - protein, 7 aa, Mycobacterium
GTESKVP

SEQ ID NO: 1343520 - protein, 12 aa, Mycobacterium
GTFGGKTGYTDL

SEQ ID NO: 1343521 - protein, 13 aa, Mycobacterium
GTFRDNTPDGMTV

SEQ ID NO: 1343522 - protein, 8 aa, Mycobacterium
GTGAEPGL

SEQ ID NO: 1343523 - protein, 9 aa, Mycobacterium
GTGAGRGGM

SEQ ID NO: 1343524 - protein, 20 aa, Mycobacterium
GTGAPSGHEGHGMGGDPSAH

SEQ ID NO: 1343525 - protein, 8 aa, Mycobacterium
GTGFGTDG

SEQ ID NO: 1343526 - protein, 4 aa, Mycobacterium
GTGG

SEQ ID NO: 1343527 - protein, 21 aa, Mycobacterium
GTGGAGGAGGMGANGADGIDG

SEQ ID NO: 1343528 - protein, 9 aa, Mycobacterium
GTGGDGSGF

SEQ ID NO: 1343529 - protein, 22 aa, Mycobacterium
GTGGTGLGPASALARAGPATPA

SEQ ID NO: 1343530 - protein, 4 aa, Mycobacterium
GTGS

SEQ ID NO: 1343531 - protein, 10 aa, Mycobacterium
GTGSPGSPQN

SEQ ID NO: 1343532 - protein, 8 aa, Mycobacterium
GTGSTAAQ

SEQ ID NO: 1343533 - protein, 76 aa, Mycobacterium
GTGTATADAPSSASDTGDPSSGAAVRGDTDHDAVTASAESVDADEDPRDDEDPRDDVAGQTVSSASSGEKTDEIDD

SEQ ID NO: 1343534 - protein, 7 aa, Mycobacterium
GTGTHNI

SEQ ID NO: 1343535 - protein, 15 aa, Mycobacterium
GTGTISGDGKVGSIG

SEQ ID NO: 1343536 - protein, 14 aa, Mycobacterium
GTGTITGDGEVGSI

SEQ ID NO: 1343537 - protein, 6 aa, Mycobacterium
GTGVSG

SEQ ID NO: 1343538 - protein, 4 aa, Mycobacterium
GTKT

SEQ ID NO: 1343539 - protein, 7 aa, Mycobacterium
GTLASGA

SEQ ID NO: 1343540 - protein, 7 aa, Mycobacterium
GTLGGQQ

SEQ ID NO: 1343541 - protein, 12 aa, Mycobacterium
GTLGKTYTTEGN

SEQ ID NO: 1343542 - protein, 6 aa, Mycobacterium
GTLPSA

SEQ ID NO: 1343543 - protein, 10 aa, Mycobacterium
GTNGDIKVND

SEQ ID NO: 1343544 - protein, 10 aa, Mycobacterium
GTNGKTTTTS

SEQ ID NO: 1343545 - protein, 14 aa, Mycobacterium
GTPAAQADNRRLNE

SEQ ID NO: 1343546 - protein, 20 aa, Mycobacterium
GTPAPVENPLPHTQSLTADG

SEQ ID NO: 1343547 - protein, 8 aa, Mycobacterium
GTPDKAGF

SEQ ID NO: 1343548 - protein, 5 aa, Mycobacterium
GTPEC

SEQ ID NO: 1343549 - protein, 127 aa, Mycobacterium
GTPGIARAEPEADSTTSSSTDSDASEASEAVTTDQEASETEEAPESEDVLESDTGETAATEDDAEAEAEAEADAEAEAAAEAEADAEAEAEAEGGTADEDETARASGDAVEQPTATTEYTGGSTTEP

SEQ ID NO: 1343550 - protein, 5 aa, Mycobacterium
GTPHS

SEQ ID NO: 1343551 - protein, 5 aa, Mycobacterium
GTPIA

SEQ ID NO: 1343552 - protein, 10 aa, Mycobacterium
GTPLDSTNTL

SEQ ID NO: 1343553 - protein, 5 aa, Mycobacterium
GTPLP

SEQ ID NO: 1343554 - protein, 6 aa, Mycobacterium
GTPLTA

SEQ ID NO: 1343555 - protein, 9 aa, Mycobacterium
GTPNLGYGN

SEQ ID NO: 1343556 - protein, 5 aa, Mycobacterium
GTPSQ

SEQ ID NO: 1343557 - protein, 12 aa, Mycobacterium
GTQASGFYGAPG

SEQ ID NO: 1343558 - protein, 7 aa, Mycobacterium
GTQATPA

SEQ ID NO: 1343559 - protein, 4 aa, Mycobacterium
GTQI

SEQ ID NO: 1343560 - protein, 13 aa, Mycobacterium
GTQIGSDSRAAIR

SEQ ID NO: 1343561 - protein, 5 aa, Mycobacterium
GTRAA

SEQ ID NO: 1343562 - protein, 6 aa, Mycobacterium
GTRHRT

SEQ ID NO: 1343563 - protein, 11 aa, Mycobacterium
GTRVGADGNKA

SEQ ID NO: 1343564 - protein, 11 aa, Mycobacterium
GTSEPPGVGGV

SEQ ID NO: 1343565 - protein, 10 aa, Mycobacterium
GTSEPPGVGR

SEQ ID NO: 1343566 - protein, 5 aa, Mycobacterium
GTSFG

SEQ ID NO: 1343567 - protein, 7 aa, Mycobacterium
GTSGAGD

SEQ ID NO: 1343568 - protein, 6 aa, Mycobacterium
GTSGFS

SEQ ID NO: 1343569 - protein, 8 aa, Mycobacterium
GTSHAGLD

SEQ ID NO: 1343570 - protein, 17 aa, Mycobacterium
GTSNTVREIPGTPDGAK

SEQ ID NO: 1343571 - protein, 10 aa, Mycobacterium
GTTATAHADS

SEQ ID NO: 1343572 - protein, 8 aa, Mycobacterium
GTTEPGAF

SEQ ID NO: 1343573 - protein, 9 aa, Mycobacterium
GTTGRPKGV

SEQ ID NO: 1343574 - protein, 21 aa, Mycobacterium
GTTGTPKGAKRSAGSGGASDL

SEQ ID NO: 1343575 - protein, 8 aa, Mycobacterium
GTTNTSLE

SEQ ID NO: 1343576 - protein, 5 aa, Mycobacterium
GTTPR

SEQ ID NO: 1343577 - protein, 12 aa, Mycobacterium
GTTSAARTQLSH

SEQ ID NO: 1343578 - protein, 5 aa, Mycobacterium
GTVAE

SEQ ID NO: 1343579 - protein, 7 aa, Mycobacterium
GTVDNRD

SEQ ID NO: 1343580 - protein, 11 aa, Mycobacterium
GTVGDGKATID

SEQ ID NO: 1343581 - protein, 12 aa, Mycobacterium
GTVPNSTNKPGA

SEQ ID NO: 1343582 - protein, 6 aa, Mycobacterium
GTVTGT

SEQ ID NO: 1343583 - protein, 6 aa, Mycobacterium
GTYREN

SEQ ID NO: 1343584 - protein, 18 aa, Mycobacterium
GVAGPNRRTFGHGGSGGS

SEQ ID NO: 1343585 - protein, 8 aa, Mycobacterium
GVANNQPT

SEQ ID NO: 1343586 - protein, 5 aa, Mycobacterium
GVAPG

SEQ ID NO: 1343587 - protein, 5 aa, Mycobacterium
GVARY

SEQ ID NO: 1343588 - protein, 11 aa, Mycobacterium
GVASGVSAASS

SEQ ID NO: 1343589 - protein, 6 aa, Mycobacterium
GVDPKV

SEQ ID NO: 1343590 - protein, 4 aa, Mycobacterium
GVEK

SEQ ID NO: 1343591 - protein, 15 aa, Mycobacterium
GVEPQGEQSPVEESA

SEQ ID NO: 1343592 - protein, 6 aa, Mycobacterium
GVETGR

SEQ ID NO: 1343593 - protein, 9 aa, Mycobacterium
GVGADTQAR

SEQ ID NO: 1343594 - protein, 6 aa, Mycobacterium
GVGDPT

SEQ ID NO: 1343595 - protein, 7 aa, Mycobacterium
GVGEDGA

SEQ ID NO: 1343596 - protein, 5 aa, Mycobacterium
GVGSG

SEQ ID NO: 1343597 - protein, 8 aa, Mycobacterium
GVGSPRVD

SEQ ID NO: 1343598 - protein, 5 aa, Mycobacterium
GVGTT

SEQ ID NO: 1343599 - protein, 8 aa, Mycobacterium
GVHTTSDR

SEQ ID NO: 1343600 - protein, 11 aa, Mycobacterium
GVKTADEIHPE

SEQ ID NO: 1343601 - protein, 7 aa, Mycobacterium
GVPANPA

SEQ ID NO: 1343602 - protein, 7 aa, Mycobacterium
GVPAPAD

SEQ ID NO: 1343603 - protein, 5 aa, Mycobacterium
GVPDP

SEQ ID NO: 1343604 - protein, 8 aa, Mycobacterium
GVPDPLSG

SEQ ID NO: 1343605 - protein, 7 aa, Mycobacterium
GVPGGDA

SEQ ID NO: 1343606 - protein, 25 aa, Mycobacterium
GVPGISASGAAPGMPAASVPAGSVE

SEQ ID NO: 1343607 - protein, 34 aa, Mycobacterium
GVPGPDVASAQTVGMSGTATTVVEGGTETRSHSE

SEQ ID NO: 1343608 - protein, 6 aa, Mycobacterium
GVPGRS

SEQ ID NO: 1343609 - protein, 14 aa, Mycobacterium
GVPGTKAAYSASKA

SEQ ID NO: 1343610 - protein, 5 aa, Mycobacterium
GVPGV

SEQ ID NO: 1343611 - protein, 19 aa, Mycobacterium
GVPNTGADPSESRTSAENH

SEQ ID NO: 1343612 - protein, 7 aa, Mycobacterium
GVPNTPY

SEQ ID NO: 1343613 - protein, 7 aa, Mycobacterium
GVPPQSA

SEQ ID NO: 1343614 - protein, 23 aa, Mycobacterium
GVPQAPPPRPTQTSTLVPTPSET

SEQ ID NO: 1343615 - protein, 12 aa, Mycobacterium
GVPSSSSPQAIG

SEQ ID NO: 1343616 - protein, 8 aa, Mycobacterium
GVRNGTGL

SEQ ID NO: 1343617 - protein, 4 aa, Mycobacterium
GVRP

SEQ ID NO: 1343618 - protein, 7 aa, Mycobacterium
GVRPGEP

SEQ ID NO: 1343619 - protein, 8 aa, Mycobacterium
GVRPGRDV

SEQ ID NO: 1343620 - protein, 17 aa, Mycobacterium
GVSGGVPGWASSPAPIF

SEQ ID NO: 1343621 - protein, 24 aa, Mycobacterium
GVSRGATITYSAEGDQTQTANPTM

SEQ ID NO: 1343622 - protein, 12 aa, Mycobacterium
GVTAPITEQANN

SEQ ID NO: 1343623 - protein, 11 aa, Mycobacterium
GVTLDDGAALD

SEQ ID NO: 1343624 - protein, 6 aa, Mycobacterium
GVTPAS

SEQ ID NO: 1343625 - protein, 16 aa, Mycobacterium
GVTPGSQGITFSTDGS

SEQ ID NO: 1343626 - protein, 9 aa, Mycobacterium
GVTPQPDTV

SEQ ID NO: 1343627 - protein, 8 aa, Mycobacterium
GVTPSSDL

SEQ ID NO: 1343628 - protein, 13 aa, Mycobacterium
GVVNAGASEVRAA

SEQ ID NO: 1343629 - protein, 6 aa, Mycobacterium
GWGAAN

SEQ ID NO: 1343630 - protein, 51 aa, Mycobacterium
GWGGDGGDASGGGAGGAGGAAHGTGSGGVGGAGDVGGVGGLGGDGGHGGAY

SEQ ID NO: 1343631 - protein, 14 aa, Mycobacterium
GWQAGKFNGVGFTP

SEQ ID NO: 1343632 - protein, 7 aa, Mycobacterium
GWSDDGM

SEQ ID NO: 1343633 - protein, 17 aa, Mycobacterium
GWSPAPSGAPVAPIPPD

SEQ ID NO: 1343634 - protein, 13 aa, Mycobacterium
GWTAPTDGYPTGR

SEQ ID NO: 1343635 - protein, 5 aa, Mycobacterium
GWTPM

SEQ ID NO: 1343636 - protein, 16 aa, Mycobacterium
GYDEDRASSDPQAAAT

SEQ ID NO: 1343637 - protein, 13 aa, Mycobacterium
GYEPTPGDIRKAA

SEQ ID NO: 1343638 - protein, 6 aa, Mycobacterium
GYETRA

SEQ ID NO: 1343639 - protein, 5 aa, Mycobacterium
GYGPD

SEQ ID NO: 1343640 - protein, 10 aa, Mycobacterium
GYGPGGPLSH

SEQ ID NO: 1343641 - protein, 7 aa, Mycobacterium
GYHYSNT

SEQ ID NO: 1343642 - protein, 38 aa, Mycobacterium; identical to SEQ ID NO: 1181997

SEQ ID NO: 1343643 - protein, 16 aa, Mycobacterium
GYNDGLGMEDNPAIPL

SEQ ID NO: 1343644 - protein, 13 aa, Mycobacterium
GYPGMPAKPGPAV

SEQ ID NO: 1343645 - protein, 12 aa, Mycobacterium
GYPRGGRVDAGT

SEQ ID NO: 1343646 - protein, 17 aa, Mycobacterium
GYPSRGGGHGGPRTRDQ

SEQ ID NO: 1343647 - protein, 6 aa, Mycobacterium
GYPTSV

SEQ ID NO: 1343648 - protein, 4 aa, Mycobacterium
GYQP

SEQ ID NO: 1343649 - protein, 4 aa, Mycobacterium
GYRQ

SEQ ID NO: 1343650 - protein, 12 aa, Mycobacterium
GYSRNDDPLTAP

SEQ ID NO: 1343651 - protein, 8 aa, Mycobacterium
GYTSITSD

SEQ ID NO: 1343652 - protein, 21 aa, Mycobacterium
HAAADATDEYPIPSKQIETQC

SEQ ID NO: 1343653 - protein, 5 aa, Mycobacterium
HAAGR

SEQ ID NO: 1343654 - protein, 10 aa, Mycobacterium
HADDQPTSVA

SEQ ID NO: 1343655 - protein, 6 aa, Mycobacterium
HADPDT

SEQ ID NO: 1343656 - protein, 39 aa, Mycobacterium
HADPKPNPPVPGHDGWRPGDPPGHNPFGPPGQVKKDPAV

SEQ ID NO: 1343657 - protein, 8 aa, Mycobacterium
HAEPAAPT

SEQ ID NO: 1343658 - protein, 20 aa, Mycobacterium
HAEPSTPVAEIPDPQGPDCG

SEQ ID NO: 1343659 - protein, 16 aa, Mycobacterium
HAFAGDTSLTGYGATK

SEQ ID NO: 1343660 - protein, 16 aa, Mycobacterium
HAQSGGGAPMTCTPGG

SEQ ID NO: 1343661 - protein, 8 aa, Mycobacterium
HARLGGPG

SEQ ID NO: 1343662 - protein, 7 aa, Mycobacterium
HCAREGD

SEQ ID NO: 1343663 - protein, 20 aa, Mycobacterium
HCTRGGGSAVSDHDSGATGA

SEQ ID NO: 1343664 - protein, 9 aa, Mycobacterium
HDDTTSEQT

SEQ ID NO: 1343665 - protein, 12 aa, Mycobacterium
HDEEGNPIYSPE

SEQ ID NO: 1343666 - protein, 9 aa, Mycobacterium
HDGSDPRLR

SEQ ID NO: 1343667 - protein, 10 aa, Mycobacterium
HDHGREPTTI

SEQ ID NO: 1343668 - protein, 6 aa, Mycobacterium
HDKDEV

SEQ ID NO: 1343669 - protein, 10 aa, Mycobacterium
HDQEPIDDDR

SEQ ID NO: 1343670 - protein, 7 aa, Mycobacterium
HDSQSGT

SEQ ID NO: 1343671 - protein, 7 aa, Mycobacterium
HDTPPDV

SEQ ID NO: 1343672 - protein, 4 aa, Mycobacterium
HDVT

SEQ ID NO: 1343673 - protein, 6 aa, Mycobacterium
HDYPNS

SEQ ID NO: 1343674 - protein, 11 aa, Mycobacterium
HDYSRGGRTDI

SEQ ID NO: 1343675 - protein, 8 aa, Mycobacterium
HEAHGKTT

SEQ ID NO: 1343676 - protein, 5 aa, Mycobacterium
HEASG

SEQ ID NO: 1343677 - protein, 4 aa, Mycobacterium
HEGG

SEQ ID NO: 1343678 - protein, 10 aa, Mycobacterium
HERSADDHQK

SEQ ID NO: 1343679 - protein, 6 aa, Mycobacterium
HETDRT

SEQ ID NO: 1343680 - protein, 8 aa, Mycobacterium
HETDRTAT

SEQ ID NO: 1343681 - protein, 9 aa, Mycobacterium
HETDRTATA

SEQ ID NO: 1343682 - protein, 6 aa, Mycobacterium
HETGGM

SEQ ID NO: 1343683 - protein, 11 aa, Mycobacterium
HFGPPGSGAPP

SEQ ID NO: 1343684 - protein, 4 aa, Mycobacterium
HGAG

SEQ ID NO: 1343685 - protein, 8 aa, Mycobacterium
HGKTSWPR

SEQ ID NO: 1343686 - protein, 10 aa, Mycobacterium
HGPAETDNSV

SEQ ID NO: 1343687 - protein, 6 aa, Mycobacterium
HGPDGQ

SEQ ID NO: 1343688 - protein, 15 aa, Mycobacterium
HGPDYTDEQRGAAET

SEQ ID NO: 1343689 - protein, 6 aa, Mycobacterium
HGPTAA

SEQ ID NO: 1343690 - protein, 6 aa, Mycobacterium
HGRGGF

SEQ ID NO: 1343691 - protein, 5 aa, Mycobacterium
HGSAF

SEQ ID NO: 1343692 - protein, 16 aa, Mycobacterium
HGSDHEESDATPSPDD

SEQ ID NO: 1343693 - protein, 37 aa, Mycobacterium
HGSTGGTGTAAGTLTISGDKATYTPPADWNGETAYTD

SEQ ID NO: 1343694 - protein, 12 aa, Mycobacterium
HGTATASSSERS

SEQ ID NO: 1343695 - protein, 10 aa, Mycobacterium
HGTGTPLGDP

SEQ ID NO: 1343696 - protein, 12 aa, Mycobacterium
HGTGTPTGDPVE

SEQ ID NO: 1343697 - protein, 7 aa, Mycobacterium
HGYRPEQ

SEQ ID NO: 1343698 - protein, 11 aa, Mycobacterium
HHGGSPGADAA

SEQ ID NO: 1343699 - protein, 10 aa, Mycobacterium
HHGSDTETVT

SEQ ID NO: 1343700 - protein, 20 aa, Mycobacterium
HHGTYRGSTVAADGEVTPPI

SEQ ID NO: 1343701 - protein, 8 aa, Mycobacterium
HKRSREDS

SEQ ID NO: 1343702 - protein, 11 aa, Mycobacterium
HLYGGDSPEYA

SEQ ID NO: 1343703 - protein, 11 aa, Mycobacterium
HNFTGDPVDGY

SEQ ID NO: 1343704 - protein, 36 aa, Mycobacterium
HNSAPVSGTPTYGPPDPSTGAIGGSVTATDPDGDRI

SEQ ID NO: 1343705 - protein, 8 aa, Mycobacterium
HNSEEGIE

SEQ ID NO: 1343706 - protein, 8 aa, Mycobacterium
HPAPDAEE

SEQ ID NO: 1343707 - protein, 7 aa, Mycobacterium
HPAPDDR

SEQ ID NO: 1343708 - protein, 5 aa, Mycobacterium
HPDDV

SEQ ID NO: 1343709 - protein, 5 aa, Mycobacterium
HPDPA

SEQ ID NO: 1343710 - protein, 6 aa, Mycobacterium
HPGIGP

SEQ ID NO: 1343711 - protein, 18 aa, Mycobacterium
HPGSGDASALGQVVYVAV

SEQ ID NO: 1343712 - protein, 9 aa, Mycobacterium
HPNCTPGIQ

SEQ ID NO: 1343713 - protein, 14 aa, Mycobacterium
HPRLGKQRDPIPGV

SEQ ID NO: 1343714 - protein, 6 aa, Mycobacterium
HPSDWQ

SEQ ID NO: 1343715 - protein, 5 aa, Mycobacterium
HPTEP

SEQ ID NO: 1343716 - protein, 6 aa, Mycobacterium
HPTNVD

SEQ ID NO: 1343717 - protein, 16 aa, Mycobacterium
HQEGDVDDPVTDEAAA

SEQ ID NO: 1343718 - protein, 13 aa, Mycobacterium
HQGPKGALCSIRK

SEQ ID NO: 1343719 - protein, 16 aa, Mycobacterium
HQNRSPYSFGPPLPDG

SEQ ID NO: 1343720 - protein, 14 aa, Mycobacterium
HRAADGSPGSSAAP

SEQ ID NO: 1343721 - protein, 9 aa, Mycobacterium
HRDGSGPAT

SEQ ID NO: 1343722 - protein, 7 aa, Mycobacterium
HRGELSP

SEQ ID NO: 1343723 - protein, 13 aa, Mycobacterium
HRGGRGETTEESL

SEQ ID NO: 1343724 - protein, 15 aa, Mycobacterium
HRPDDIDRNGGRPDA

SEQ ID NO: 1343725 - protein, 6 aa, Mycobacterium
HRSEPL

SEQ ID NO: 1343726 - protein, 9 aa, Mycobacterium
HRSGTTDHS

SEQ ID NO: 1343727 - protein, 4 aa, Mycobacterium
HRTS

SEQ ID NO: 1343728 - protein, 7 aa, Mycobacterium
HSAYGSS

SEQ ID NO: 1343729 - protein, 7 aa, Mycobacterium
HSDQYAR

SEQ ID NO: 1343730 - protein, 8 aa, Mycobacterium
HSGAQATW

SEQ ID NO: 1343731 - protein, 18 aa, Mycobacterium
HSGIDQEPLGVGSPAVAP

SEQ ID NO: 1343732 - protein, 12 aa, Mycobacterium
HSGNGNNLPRYR

SEQ ID NO: 1343733 - protein, 6 aa, Mycobacterium
HSNADV

SEQ ID NO: 1343734 - protein, 5 aa, Mycobacterium
HSPST

SEQ ID NO: 1343735 - protein, 9 aa, Mycobacterium
HTAEVSNPD

SEQ ID NO: 1343736 - protein, 13 aa, Mycobacterium
HTDDYSQGGRTDI

SEQ ID NO: 1343737 - protein, 13 aa, Mycobacterium
HTDDYSRGGRTDI

SEQ ID NO: 1343738 - protein, 8 aa, Mycobacterium
HTDGDGEA

SEQ ID NO: 1343739 - protein, 15 aa, Mycobacterium
HTDGTSNAQKFSDPE

SEQ ID NO: 1343740 - protein, 14 aa, Mycobacterium
HTEGEPQAAPPELP

SEQ ID NO: 1343741 - protein, 12 aa, Mycobacterium
HTPAPDLNGPAD

SEQ ID NO: 1343742 - protein, 6 aa, Mycobacterium
HTPEEL

SEQ ID NO: 1343743 - protein, 12 aa, Mycobacterium
HTPSGKKPLPVP

SEQ ID NO: 1343744 - protein, 8 aa, Mycobacterium
HTQSGSQW

SEQ ID NO: 1343745 - protein, 14 aa, Mycobacterium
HTTGRSYQNFPDPE

SEQ ID NO: 1343746 - protein, 14 aa, Mycobacterium
HYGRNADGSLTGQG

SEQ ID NO: 1343747 - protein, 9 aa, Mycobacterium
IAAGTSGLG

SEQ ID NO: 1343748 - protein, 9 aa, Mycobacterium
IAAPTASAA

SEQ ID NO: 1343749 - protein, 12 aa, Mycobacterium
IADADDSKRPSY

SEQ ID NO: 1343750 - protein, 25 aa, Mycobacterium
IADGSGVGTIRNDDIDQAPATPPTV

SEQ ID NO: 1343751 - protein, 7 aa, Mycobacterium
IAEPEQV

SEQ ID NO: 1343752 - protein, 4 aa, Mycobacterium
IAET

SEQ ID NO: 1343753 - protein, 13 aa, Mycobacterium
IAGGSTSIAPPPQ

SEQ ID NO: 1343754 - protein, 10 aa, Mycobacterium
IAGGTSGFLT

SEQ ID NO: 1343755 - protein, 10 aa, Mycobacterium
IAGQTSPGGI

SEQ ID NO: 1343756 - protein, 6 aa, Mycobacterium
IAGSEE

SEQ ID NO: 1343757 - protein, 8 aa, Mycobacterium
IAPATSGT

SEQ ID NO: 1343758 - protein, 15 aa, Mycobacterium
IAPDGTRTEEERPEG

SEQ ID NO: 1343759 - protein, 7 aa, Mycobacterium
IAPEDQE

SEQ ID NO: 1343760 - protein, 10 aa, Mycobacterium
IAPPPPPANP

SEQ ID NO: 1343761 - protein, 18 aa, Mycobacterium
IAPSPPPPGFGYPPRAPR

SEQ ID NO: 1343762 - protein, 18 aa, Mycobacterium
IASSQRTEIDTMNQILKS

SEQ ID NO: 1343763 - protein, 8 aa, Mycobacterium
IATGNSTG

SEQ ID NO: 1343764 - protein, 19 aa, Mycobacterium
IATNPADGLPGLMVPSGDG

SEQ ID NO: 1343765 - protein, 5 aa, Mycobacterium
IATRT

SEQ ID NO: 1343766 - protein, 8 aa, Mycobacterium
ICSPSQPA

SEQ ID NO: 1343767 - protein, 6 aa, Mycobacterium
IDAPGA

SEQ ID NO: 1343768 - protein, 10 aa, Mycobacterium
IDDDGNEVPL

SEQ ID NO: 1343769 - protein, 100 aa, Mycobacterium
IDEDDQGSVPEEATSDQQAAEDQQAAEETQEPEEAQEPEEAQEPEEAAEEAEEAAEPEAEEAEAPEAEEAEEAQEDPEDSSGTDDTPAQDSSSGDSSGGD

SEQ ID NO: 1343770 - protein, 16 aa, Mycobacterium
IDEKGPSKGKLQAGDA

SEQ ID NO: 1343771 - protein, 11 aa, Mycobacterium
IDGNNQPSQPY

SEQ ID NO: 1343772 - protein, 9 aa, Mycobacterium
IDNGQFPDT

SEQ ID NO: 1343773 - protein, 4 aa, Mycobacterium
IDPA

SEQ ID NO: 1343774 - protein, 15 aa, Mycobacterium
IDPAAAANPLINPPA

SEQ ID NO: 1343775 - protein, 39 aa, Mycobacterium
IDPGPPGIGAPGRPDIGGPGRPGGGRPGGGGGGIGGGRG

SEQ ID NO: 1343776 - protein, 12 aa, Mycobacterium
IDPKAQRAAEEA

SEQ ID NO: 1343777 - protein, 11 aa, Mycobacterium
IDPNADPVEAD

SEQ ID NO: 1343778 - protein, 10 aa, Mycobacterium
IDPPPSIQDS

SEQ ID NO: 1343779 - protein, 10 aa, Mycobacterium
IDPPTPESDY

SEQ ID NO: 1343780 - protein, 6 aa, Mycobacterium
IDPQRD

SEQ ID NO: 1343781 - protein, 5 aa, Mycobacterium
IDPRV

SEQ ID NO: 1343782 - protein, 5 aa, Mycobacterium
IDRET

SEQ ID NO: 1343783 - protein, 5 aa, Mycobacterium
IDSAG

SEQ ID NO: 1343784 - protein, 78 aa, Mycobacterium
IDSSGTTAGDGPQLTPADVEDPDVDVDSAGEDEADHTDVDSAAESIDDAGAESADDANDDDSTVNSADQSTDSTSTDD

SEQ ID NO: 1343785 - protein, 8 aa, Mycobacterium
IDSTPDYD

SEQ ID NO: 1343786 - protein, 6 aa, Mycobacterium
IDVPSD

SEQ ID NO: 1343787 - protein, 7 aa, Mycobacterium
IDYGPSG

SEQ ID NO: 1343788 - protein, 7 aa, Mycobacterium
IEDDSQL

SEQ ID NO: 1343789 - protein, 4 aa, Mycobacterium
IEGT

SEQ ID NO: 1343790 - protein, 10 aa, Mycobacterium
IEKGGAAAGM

SEQ ID NO: 1343791 - protein, 7 aa, Mycobacterium
IENPDGG

SEQ ID NO: 1343792 - protein, 11 aa, Mycobacterium
IEPADAAEAKV

SEQ ID NO: 1343793 - protein, 5 aa, Mycobacterium
IEPEE

SEQ ID NO: 1343794 - protein, 7 aa, Mycobacterium
IEPEGPD

SEQ ID NO: 1343795 - protein, 6 aa, Mycobacterium
IEPGPD

SEQ ID NO: 1343796 - protein, 13 aa, Mycobacterium
IEQGTRAAAQRHG

SEQ ID NO: 1343797 - protein, 5 aa, Mycobacterium
IERAR

SEQ ID NO: 1343798 - protein, 4 aa, Mycobacterium
IERQ

SEQ ID NO: 1343799 - protein, 5 aa, Mycobacterium
IESGA

SEQ ID NO: 1343800 - protein, 10 aa, Mycobacterium
IESPGAGQIG

SEQ ID NO: 1343801 - protein, 20 aa, Mycobacterium
IESTKCSDTGPAFPSDPQYP

SEQ ID NO: 1343802 - protein, 10 aa, Mycobacterium
IGAEPTAERR

SEQ ID NO: 1343803 - protein, 14 aa, Mycobacterium
IGAPSWTADYGSET

SEQ ID NO: 1343804 - protein, 8 aa, Mycobacterium
IGDPRSRL

SEQ ID NO: 1343805 - protein, 5 aa, Mycobacterium
IGEIR

SEQ ID NO: 1343806 - protein, 14 aa, Mycobacterium
IGESEDDSENTVQP

SEQ ID NO: 1343807 - protein, 7 aa, Mycobacterium
IGGADNK

SEQ ID NO: 1343808 - protein, 6 aa, Mycobacterium
IGGGNG

SEQ ID NO: 1343809 - protein, 6 aa, Mycobacterium
IGGRPT

SEQ ID NO: 1343810 - protein, 21 aa, Mycobacterium
IGITGAPDEVPGADGEPSAPN

SEQ ID NO: 1343811 - protein, 9 aa, Mycobacterium
IGPAATDTF

SEQ ID NO: 1343812 - protein, 6 aa, Mycobacterium
IGPAEA

SEQ ID NO: 1343813 - protein, 8 aa, Mycobacterium
IGPDDDPE

SEQ ID NO: 1343814 - protein, 7 aa, Mycobacterium
IGPDGGR

SEQ ID NO: 1343815 - protein, 5 aa, Mycobacterium
IGPDL

SEQ ID NO: 1343816 - protein, 5 aa, Mycobacterium
IGPER

SEQ ID NO: 1343817 - protein, 16 aa, Mycobacterium
IGPSKGTVTVDPGGTF

SEQ ID NO: 1343818 - protein, 12 aa, Mycobacterium
IGQQPSPYTAGN

SEQ ID NO: 1343819 - protein, 9 aa, Mycobacterium
IGQQSDRFD

SEQ ID NO: 1343820 - protein, 9 aa, Mycobacterium
IGRSRSPGK

SEQ ID NO: 1343821 - protein, 9 aa, Mycobacterium
IGRSRTPGK

SEQ ID NO: 1343822 - protein, 11 aa, Mycobacterium
IGSDDAAPAGL

SEQ ID NO: 1343823 - protein, 7 aa, Mycobacterium
IGSGRSV

SEQ ID NO: 1343824 - protein, 5 aa, Mycobacterium
IGVPH

SEQ ID NO: 1343825 - protein, 10 aa, Mycobacterium
IHDQATEKGL

SEQ ID NO: 1343826 - protein, 9 aa, Mycobacterium
IHSDTAPLT

SEQ ID NO: 1343827 - protein, 5 aa, Mycobacterium
IHTQG

SEQ ID NO: 1343828 - protein, 8 aa, Mycobacterium
IKETDRSA

SEQ ID NO: 1343829 - protein, 8 aa, Mycobacterium
IKKGRGDT

SEQ ID NO: 1343830 - protein, 9 aa, Mycobacterium
IKPSIANTQ

SEQ ID NO: 1343831 - protein, 18 aa, Mycobacterium
IKPTQTRSPGDAPNPVAT

SEQ ID NO: 1343832 - protein, 9 aa, Mycobacterium
INATSGKDK

SEQ ID NO: 1343833 - protein, 5 aa, Mycobacterium
INDPD

SEQ ID NO: 1343834 - protein, 9 aa, Mycobacterium
INDPGPGAD

SEQ ID NO: 1343835 - protein, 7 aa, Mycobacterium
INPPVPP

SEQ ID NO: 1343836 - protein, 6 aa, Mycobacterium
INPSDD

SEQ ID NO: 1343837 - protein, 7 aa, Mycobacterium
INQRDEQ

SEQ ID NO: 1343838 - protein, 8 aa, Mycobacterium
IPAASSPV

SEQ ID NO: 1343839 - protein, 22 aa, Mycobacterium
IPADDDDPATERAVEATTESTS

SEQ ID NO: 1343840 - protein, 5 aa, Mycobacterium
IPAER

SEQ ID NO: 1343841 - protein, 7 aa, Mycobacterium
IPAPGDP

SEQ ID NO: 1343842 - protein, 5 aa, Mycobacterium
IPEDR

SEQ ID NO: 1343843 - protein, 7 aa, Mycobacterium
IPEGNPW

SEQ ID NO: 1343844 - protein, 5 aa, Mycobacterium
IPEGP

SEQ ID NO: 1343845 - protein, 6 aa, Mycobacterium
IPERDE

SEQ ID NO: 1343846 - protein, 18 aa, Mycobacterium
IPGDPEYAVTDSAAGATA

SEQ ID NO: 1343847 - protein, 5 aa, Mycobacterium
IPGGA

SEQ ID NO: 1343848 - protein, 6 aa, Mycobacterium
IPGRPT

SEQ ID NO: 1343849 - protein, 6 aa, Mycobacterium
IPGTGS

SEQ ID NO: 1343850 - protein, 9 aa, Mycobacterium
IPGYGEDKI

SEQ ID NO: 1343851 - protein, 7 aa, Mycobacterium
IPKPASI

SEQ ID NO: 1343852 - protein, 8 aa, Mycobacterium
IPNPPKSF

SEQ ID NO: 1343853 - protein, 6 aa, Mycobacterium
IPPADN

SEQ ID NO: 1343854 - protein, 14 aa, Mycobacterium
IPPAPAQPDTRVPP

SEQ ID NO: 1343855 - protein, 7 aa, Mycobacterium
IPPDTPF

SEQ ID NO: 1343856 - protein, 35 aa, Mycobacterium
IPPQPGSAAPPPPAGAPQPAAGAPQPPAGAPLPPA

SEQ ID NO: 1343857 - protein, 20 aa, Mycobacterium
IPQSTPLDADATNNPPPASG

SEQ ID NO: 1343858 - protein, 7 aa, Mycobacterium
IPRPDDP

SEQ ID NO: 1343859 - protein, 11 aa, Mycobacterium
IPSAGAPGDPV

SEQ ID NO: 1343860 - protein, 4 aa, Mycobacterium
IPSG

SEQ ID NO: 1343861 - protein, 7 aa, Mycobacterium
IPSRGPH

SEQ ID NO: 1343862 - protein, 4 aa, Mycobacterium
IPTA

SEQ ID NO: 1343863 - protein, 37 aa, Mycobacterium
IPTGAGEACSGYNTDGCDINEEQSYTPITAPDLDNPA

SEQ ID NO: 1343864 - protein, 5 aa, Mycobacterium
IQPDT

SEQ ID NO: 1343865 - protein, 6 aa, Mycobacterium
IQPDTT

SEQ ID NO: 1343866 - protein, 4 aa, Mycobacterium
IQPK

SEQ ID NO: 1343867 - protein, 7 aa, Mycobacterium
IQQNSRV

SEQ ID NO: 1343868 - protein, 9 aa, Mycobacterium
IQRGEDRQR

SEQ ID NO: 1343869 - protein, 10 aa, Mycobacterium
IQRRGEPDPF

SEQ ID NO: 1343870 - protein, 17 aa, Mycobacterium
IRGGGPLPQMSGTYGSK

SEQ ID NO: 1343871 - protein, 8 aa, Mycobacterium
IRGGTGPA

SEQ ID NO: 1343872 - protein, 5 aa, Mycobacterium
IRNPH

SEQ ID NO: 1343873 - protein, 7 aa, Mycobacterium
IRPEPTR

SEQ ID NO: 1343874 - protein, 38 aa, Mycobacterium
IRPKTAAEIAQQDVEDDEDDRDFDEQWPENPSAGEDSG

SEQ ID NO: 1343875 - protein, 14 aa, Mycobacterium
IRSTAGAPMRSSEG

SEQ ID NO: 1343876 - protein, 5 aa, Mycobacterium
ISDET

SEQ ID NO: 1343877 - protein, 8 aa, Mycobacterium
ISDPLPAE

SEQ ID NO: 1343878 - protein, 7 aa, Mycobacterium
ISESRVA

SEQ ID NO: 1343879 - protein, 12 aa, Mycobacterium
ISGGDANGSAAD

SEQ ID NO: 1343880 - protein, 10 aa, Mycobacterium
ISGGYSTTYG

SEQ ID NO: 1343881 - protein, 10 aa, Mycobacterium
ISGKTARNHV

SEQ ID NO: 1343882 - protein, 16 aa, Mycobacterium
ISGLDTDQLSDSLSTV

SEQ ID NO: 1343883 - protein, 6 aa, Mycobacterium
ISGQLN

SEQ ID NO: 1343884 - protein, 12 aa, Mycobacterium
ISGQLQSQDPAV

SEQ ID NO: 1343885 - protein, 15 aa, Mycobacterium
ISLPGTEGGGSGSYT

SEQ ID NO: 1343886 - protein, 6 aa, Mycobacterium
ISNPSW

SEQ ID NO: 1343887 - protein, 6 aa, Mycobacterium
ISPAYE

SEQ ID NO: 1343888 - protein, 5 aa, Mycobacterium
ISPDT

SEQ ID NO: 1343889 - protein, 20 aa, Mycobacterium
ISPGGVTTAVGAPAESTEDD

SEQ ID NO: 1343890 - protein, 5 aa, Mycobacterium
ISPGL

SEQ ID NO: 1343891 - protein, 12 aa, Mycobacterium
ISPGNNAGDMTE

SEQ ID NO: 1343892 - protein, 11 aa, Mycobacterium
ISQPSTQTSPY

SEQ ID NO: 1343893 - protein, 7 aa, Mycobacterium
ISQRESE

SEQ ID NO: 1343894 - protein, 5 aa, Mycobacterium
ISSGP

SEQ ID NO: 1343895 - protein, 8 aa, Mycobacterium
ISSRQASE

SEQ ID NO: 1343896 - protein, 7 aa, Mycobacterium
ISSSPYP

SEQ ID NO: 1343897 - protein, 10 aa, Mycobacterium
ITDARKEKVS

SEQ ID NO: 1343898 - protein, 10 aa, Mycobacterium
ITDEGVEQQY

SEQ ID NO: 1343899 - protein, 9 aa, Mycobacterium
ITDNGQPVT

SEQ ID NO: 1343900 - protein, 12 aa, Mycobacterium
ITEGAKAVGSSA

SEQ ID NO: 1343901 - protein, 12 aa, Mycobacterium
ITGKPGDPRYPY

SEQ ID NO: 1343902 - protein, 35 aa, Mycobacterium
ITGKPGDPRYPYREPPPAPPPGGPPPGPPIPTEQI

SEQ ID NO: 1343903 - protein, 33 aa, Mycobacterium
ITGKPGDPRYPYRPPLPQPPPGGPPPGPPAEDG

SEQ ID NO: 1343904 - protein, 12 aa, Mycobacterium
ITGNPGDPRYPY

SEQ ID NO: 1343905 - protein, 7 aa, Mycobacterium
ITGPEST

SEQ ID NO: 1343906 - protein, 12 aa, Mycobacterium
ITGQQKSSDQYR

SEQ ID NO: 1343907 - protein, 7 aa, Mycobacterium
ITGSDAD

SEQ ID NO: 1343908 - protein, 7 aa, Mycobacterium
ITKDSRV

SEQ ID NO: 1343909 - protein, 12 aa, Mycobacterium
ITPADTSVPPNV

SEQ ID NO: 1343910 - protein, 9 aa, Mycobacterium
ITPEGGVGA

SEQ ID NO: 1343911 - protein, 10 aa, Mycobacterium
ITPEGGVGAD

SEQ ID NO: 1343912 - protein, 8 aa, Mycobacterium
ITPEGTET

SEQ ID NO: 1343913 - protein, 8 aa, Mycobacterium
ITQDPEAF

SEQ ID NO: 1343914 - protein, 7 aa, Mycobacterium
ITQPGLG

SEQ ID NO: 1343915 - protein, 5 aa, Mycobacterium
ITRAT

SEQ ID NO: 1343916 - protein, 6 aa, Mycobacterium
ITRPYS

SEQ ID NO: 1343917 - protein, 7 aa, Mycobacterium
ITRSTTK

SEQ ID NO: 1343918 - protein, 4 aa, Mycobacterium
ITSG

SEQ ID NO: 1343919 - protein, 6 aa, Mycobacterium
ITSPAA

SEQ ID NO: 1343920 - protein, 9 aa, Mycobacterium
ITSSNPYAT

SEQ ID NO: 1343921 - protein, 8 aa, Mycobacterium
ITSSTGET

SEQ ID NO: 1343922 - protein, 9 aa, Mycobacterium
ITSTPERQA

SEQ ID NO: 1343923 - protein, 6 aa, Mycobacterium
ITTANG

SEQ ID NO: 1343924 - protein, 10 aa, Mycobacterium
ITTAPGERSS

SEQ ID NO: 1343925 - protein, 16 aa, Mycobacterium
ITTGPNPTDVVSTDTR

SEQ ID NO: 1343926 - protein, 6 aa, Mycobacterium
ITTGVS

SEQ ID NO: 1343927 - protein, 4 aa, Mycobacterium
ITVG

SEQ ID NO: 1343928 - protein, 15 aa, Mycobacterium
ITVTPKQGVPDQQFG

SEQ ID NO: 1343929 - protein, 12 aa, Mycobacterium
ITWPSDKTQQVI

SEQ ID NO: 1343930 - protein, 5 aa, Mycobacterium
ITYRP

SEQ ID NO: 1343931 - protein, 21 aa, Mycobacterium
IYGPPGSRVEIPTGKGRATAR

SEQ ID NO: 1343932 - protein, 15 aa, Mycobacterium
IYSTEKGGTVTITSG

SEQ ID NO: 1343933 - protein, 17 aa, Mycobacterium
IYTSTDNGATVNVLTAV

SEQ ID NO: 1343934 - protein, 6 aa, Mycobacterium
KAAGRE

SEQ ID NO: 1343935 - protein, 9 aa, Mycobacterium
KAAKNPDGA

SEQ ID NO: 1343936 - protein, 9 aa, Mycobacterium
KAAQDPEIK

SEQ ID NO: 1343937 - protein, 8 aa, Mycobacterium
KAAQQAGH

SEQ ID NO: 1343938 - protein, 23 aa, Mycobacterium
KAARTSGLHADGNNIAVNDGKAA

SEQ ID NO: 1343939 - protein, 22 aa, Mycobacterium
KAATLGAYGTNAGSPSGIDGPG

SEQ ID NO: 1343940 - protein, 47 aa, Mycobacterium
KAEAEARAPVAGTLDAPRQYPPLSQQAQPPATDYAQQPPVPRHGAPD

SEQ ID NO: 1343941 - protein, 13 aa, Mycobacterium
KAFTAATEGSGVK

SEQ ID NO: 1343942 - protein, 8 aa, Mycobacterium
KAGADRRQ

SEQ ID NO: 1343943 - protein, 6 aa, Mycobacterium
KAGCST

SEQ ID NO: 1343944 - protein, 8 aa, Mycobacterium
KAGLNNLT

SEQ ID NO: 1343945 - protein, 10 aa, Mycobacterium
KAKTPTDNGT

SEQ ID NO: 1343946 - protein, 6 aa, Mycobacterium
KANGKV

SEQ ID NO: 1343947 - protein, 7 aa, Mycobacterium
KAPATPV

SEQ ID NO: 1343948 - protein, 6 aa, Mycobacterium
KAPGWG

SEQ ID NO: 1343949 - protein, 4 aa, Mycobacterium
KAPI

SEQ ID NO: 1343950 - protein, 13 aa, Mycobacterium
KAPVAASRGSRLP

SEQ ID NO: 1343951 - protein, 10 aa, Mycobacterium
KARSETAEEL

SEQ ID NO: 1343952 - protein, 9 aa, Mycobacterium
KASSNTSTV

SEQ ID NO: 1343953 - protein, 7 aa, Mycobacterium
KASTETV

SEQ ID NO: 1343954 - protein, 8 aa, Mycobacterium
KASTETVT

SEQ ID NO: 1343955 - protein, 8 aa, Mycobacterium
KASTTPVT

SEQ ID NO: 1343956 - protein, 5 aa, Mycobacterium
KATAT

SEQ ID NO: 1343957 - protein, 7 aa, Mycobacterium
KATGETM

SEQ ID NO: 1343958 - protein, 8 aa, Mycobacterium
KATHPDTA

SEQ ID NO: 1343959 - protein, 7 aa, Mycobacterium
KATHTGN

SEQ ID NO: 1343960 - protein, 7 aa, Mycobacterium
KAVNDTR

SEQ ID NO: 1343961 - protein, 26 aa, Mycobacterium
KAVPEQTAAAATDQVSTVTGAVPGQV

SEQ ID NO: 1343962 - protein, 9 aa, Mycobacterium
KCNADPRTV

SEQ ID NO: 1343963 - protein, 28 aa, Mycobacterium
KDADVEPVAKRDSASDDAAADADEEALE

SEQ ID NO: 1343964 - protein, 12 aa, Mycobacterium
KDAGADEVADAG

SEQ ID NO: 1343965 - protein, 7 aa, Mycobacterium
KDANSSM

SEQ ID NO: 1343966 - protein, 5 aa, Mycobacterium
KDCPG

SEQ ID NO: 1343967 - protein, 9 aa, Mycobacterium
KDDSITGYR

SEQ ID NO: 1343968 - protein, 8 aa, Mycobacterium
KDDTELRT

SEQ ID NO: 1343969 - protein, 8 aa, Mycobacterium
KDESGVTR

SEQ ID NO: 1343970 - protein, 15 aa, Mycobacterium
KDKYGADKPTSDPME

SEQ ID NO: 1343971 - protein, 8 aa, Mycobacterium
KDLDRDGL

SEQ ID NO: 1343972 - protein, 9 aa, Mycobacterium
KDMPSVEST

SEQ ID NO: 1343973 - protein, 10 aa, Mycobacterium
KDNPKNITGI

SEQ ID NO: 1343974 - protein, 9 aa, Mycobacterium
KDSGGQHTW

SEQ ID NO: 1343975 - protein, 13 aa, Mycobacterium
KDSQLPPSGSVPP

SEQ ID NO: 1343976 - protein, 6 aa, Mycobacterium
KDSSAE

SEQ ID NO: 1343977 - protein, 9 aa, Mycobacterium
KDVIKSGGE

SEQ ID NO: 1343978 - protein, 12 aa, Mycobacterium
KDYQGNAVRGAR

SEQ ID NO: 1343979 - protein, 5 aa, Mycobacterium
KEAAD

SEQ ID NO: 1343980 - protein, 6 aa, Mycobacterium
KEDGNC

SEQ ID NO: 1343981 - protein, 11 aa, Mycobacterium
KEFEGTDPRVT

SEQ ID NO: 1343982 - protein, 6 aa, Mycobacterium
KEGIDS

SEQ ID NO: 1343983 - protein, 6 aa, Mycobacterium
KEGNLK

SEQ ID NO: 1343984 - protein, 16 aa, Mycobacterium
KEHADKDFSAIIEALR

SEQ ID NO: 1343985 - protein, 7 aa, Mycobacterium
KEKLQES

SEQ ID NO: 1343986 - protein, 5 aa, Mycobacterium
KERLQ

SEQ ID NO: 1343987 - protein, 15 aa, Mycobacterium
KERLSADTATALTSA

SEQ ID NO: 1343988 - protein, 12 aa, Mycobacterium
KESDAASKDRLE

SEQ ID NO: 1343989 - protein, 6 aa, Mycobacterium
KETGST

SEQ ID NO: 1343990 - protein, 12 aa, Mycobacterium
KEVSQVQGVIAP

SEQ ID NO: 1343991 - protein, 5 aa, Mycobacterium
KEYPG

SEQ ID NO: 1343992 - protein, 22 aa, Mycobacterium
KFPSDRRNLPAQNREAKPDPFG

SEQ ID NO: 1343993 - protein, 6 aa, Mycobacterium
KFPTPE

SEQ ID NO: 1343994 - protein, 7 aa, Mycobacterium
KGASAPV

SEQ ID NO: 1343995 - protein, 9 aa, Mycobacterium
KGAVGEAAP

SEQ ID NO: 1343996 - protein, 30 aa, Mycobacterium
KGDPNATSSGQPVPQLPPAAGPQAAPPALA

SEQ ID NO: 1343997 - protein, 11 aa, Mycobacterium
KGEYTEGEDPW

SEQ ID NO: 1343998 - protein, 32 aa, Mycobacterium
KGFTKGNVGNNDGAKVTASQVQAAKTDDLGAQ

SEQ ID NO: 1343999 - protein, 7 aa, Mycobacterium
KGGAQQD

SEQ ID NO: 1344000 - protein, 8 aa, Mycobacterium
KGGDIRST

SEQ ID NO: 1344001 - protein, 6 aa, Mycobacterium
KGGSVK

SEQ ID NO: 1344002 - protein, 6 aa, Mycobacterium
KGHAYD

SEQ ID NO: 1344003 - protein, 9 aa, Mycobacterium
KGHDDSPVA

SEQ ID NO: 1344004 - protein, 8 aa, Mycobacterium
KGLAPGGH

SEQ ID NO: 1344005 - protein, 7 aa, Mycobacterium
KGLAPNG

SEQ ID NO: 1344006 - protein, 7 aa, Mycobacterium
KGLPTSF

SEQ ID NO: 1344007 - protein, 5 aa, Mycobacterium
KGPDL

SEQ ID NO: 1344008 - protein, 7 aa, Mycobacterium
KGPHPAT

SEQ ID NO: 1344009 - protein, 4 aa, Mycobacterium
KGRV

SEQ ID NO: 1344010 - protein, 7 aa, Mycobacterium
KGSPLAQ

SEQ ID NO: 1344011 - protein, 7 aa, Mycobacterium
KGTTSLE

SEQ ID NO: 1344012 - protein, 9 aa, Mycobacterium
KGVADGSGA

SEQ ID NO: 1344013 - protein, 10 aa, Mycobacterium
KGVDPNRNAA

SEQ ID NO: 1344014 - protein, 8 aa, Mycobacterium
KGVTGNTG

SEQ ID NO: 1344015 - protein, 7 aa, Mycobacterium
KGYPLGG

SEQ ID NO: 1344016 - protein, 5 aa, Mycobacterium
KHTPR

SEQ ID NO: 1344017 - protein, 6 aa, Mycobacterium
KHVSAT

SEQ ID NO: 1344018 - protein, 14 aa, Mycobacterium
KIAAQSQQTATYTY

SEQ ID NO: 1344019 - protein, 87 aa, Mycobacterium
KIDETETETDPAAEVQAPGDSGSAAEDVEEPASDSEDEESQEVADDPSVDDPSDADQPDADQAEGESAEQESAAKTAETSSGENGSG

SEQ ID NO: 1344020 - protein, 7 aa, Mycobacterium
KIDPGVA

SEQ ID NO: 1344021 - protein, 8 aa, Mycobacterium
KIEPEGTL

SEQ ID NO: 1344022 - protein, 8 aa, Mycobacterium
KIEPQPKQ

SEQ ID NO: 1344023 - protein, 10 aa, Mycobacterium
KIGASGSAVR

SEQ ID NO: 1344024 - protein, 6 aa, Mycobacterium
KIGSDE

SEQ ID NO: 1344025 - protein, 5 aa, Mycobacterium
KIPAD

SEQ ID NO: 1344026 - protein, 5 aa, Mycobacterium
KIPGL

SEQ ID NO: 1344027 - protein, 11 aa, Mycobacterium
KISATDRDGDA

SEQ ID NO: 1344028 - protein, 12 aa, Mycobacterium
KITGSDSDGDPL

SEQ ID NO: 1344029 - protein, 6 aa, Mycobacterium
KITPRE

SEQ ID NO: 1344030 - protein, 6 aa, Mycobacterium
KKPELE

SEQ ID NO: 1344031 - protein, 7 aa, Mycobacterium
KKRRNPS

SEQ ID NO: 1344032 - protein, 5 aa, Mycobacterium
KKVTA

SEQ ID NO: 1344033 - protein, 18 aa, Mycobacterium
KLAPGGAGPGDPPEPFPS

SEQ ID NO: 1344034 - protein, 10 aa, Mycobacterium
KLGKSTPKPP

SEQ ID NO: 1344035 - protein, 6 aa, Mycobacterium
KLGRQG

SEQ ID NO: 1344036 - protein, 8 aa, Mycobacterium
KLNGPDAR

SEQ ID NO: 1344037 - protein, 4 aa, Mycobacterium
KLPA

SEQ ID NO: 1344038 - protein, 6 aa, Mycobacterium
KLPPGL

SEQ ID NO: 1344039 - protein, 7 aa, Mycobacterium
KLTEAQL

SEQ ID NO: 1344040 - protein, 8 aa, Mycobacterium
KMEESGAW

SEQ ID NO: 1344041 - protein, 5 aa, Mycobacterium
KMSNE

SEQ ID NO: 1344042 - protein, 8 aa, Mycobacterium
KNAPMGTT

SEQ ID NO: 1344043 - protein, 8 aa, Mycobacterium
KNETTNAP

SEQ ID NO: 1344044 - protein, 6 aa, Mycobacterium
KNGDCD

SEQ ID NO: 1344045 - protein, 9 aa, Mycobacterium
KNGKPIYDG

SEQ ID NO: 1344046 - protein, 16 aa, Mycobacterium
KNGPGPTTPPHPPVHD

SEQ ID NO: 1344047 - protein, 17 aa, Mycobacterium
KNLGPAGITAPTPPPLD

SEQ ID NO: 1344048 - protein, 10 aa, Mycobacterium
KNLRGQGDQM

SEQ ID NO: 1344049 - protein, 5 aa, Mycobacterium
KNPDL

SEQ ID NO: 1344050 - protein, 13 aa, Mycobacterium
KNSGGDMTRPKLD

SEQ ID NO: 1344051 - protein, 13 aa, Mycobacterium
KNYSDDGRNVLNG

SEQ ID NO: 1344052 - protein, 7 aa, Mycobacterium
KPATPAL

SEQ ID NO: 1344053 - protein, 6 aa, Mycobacterium
KPDAMQ

SEQ ID NO: 1344054 - protein, 5 aa, Mycobacterium
KPDGT

SEQ ID NO: 1344055 - protein, 6 aa, Mycobacterium
KPEYQG

SEQ ID NO: 1344056 - protein, 4 aa, Mycobacterium
KPGM

SEQ ID NO: 1344057 - protein, 16 aa, Mycobacterium
KPGNATPTATVRTSSS

SEQ ID NO: 1344058 - protein, 11 aa, Mycobacterium
KPGSGDAPSVT

SEQ ID NO: 1344059 - protein, 5 aa, Mycobacterium
KPGTK

SEQ ID NO: 1344060 - protein, 12 aa, Mycobacterium
KPGTSTTGTSAY

SEQ ID NO: 1344061 - protein, 5 aa, Mycobacterium
KPGTT

SEQ ID NO: 1344062 - protein, 6 aa, Mycobacterium
KPGTTV

SEQ ID NO: 1344063 - protein, 22 aa, Mycobacterium
KPGWPTPSDYTRGYDGGVADAR

SEQ ID NO: 1344064 - protein, 22 aa, Mycobacterium
KPGWPTPSDYTRGYSGGVADAR

SEQ ID NO: 1344065 - protein, 5 aa, Mycobacterium
KPMIA

SEQ ID NO: 1344066 - protein, 23 aa, Mycobacterium
KPNDVVRTEKGGAAIRQSTLQDP

SEQ ID NO: 1344067 - protein, 14 aa, Mycobacterium
KPQPPMPSAPYDQH

SEQ ID NO: 1344068 - protein, 6 aa, Mycobacterium
KPSGPF

SEQ ID NO: 1344069 - protein, 6 aa, Mycobacterium
KPSPTV

SEQ ID NO: 1344070 - protein, 8 aa, Mycobacterium
KPSVPEGL

SEQ ID NO: 1344071 - protein, 9 aa, Mycobacterium
KPTEPGGVS

SEQ ID NO: 1344072 - protein, 4 aa, Mycobacterium
KPVI

SEQ ID NO: 1344073 - protein, 14 aa, Mycobacterium
KPVLDSQTETGDSI

SEQ ID NO: 1344074 - protein, 6 aa, Mycobacterium
KQAGTT

SEQ ID NO: 1344075 - protein, 9 aa, Mycobacterium
KQDPEYKGG

SEQ ID NO: 1344076 - protein, 16 aa, Mycobacterium
KQPEHGSASYSSGSQI

SEQ ID NO: 1344077 - protein, 8 aa, Mycobacterium
KQRMPSGQ

SEQ ID NO: 1344078 - protein, 30 aa, Mycobacterium
KQVAPAPRAPAPAPARVPAPAPAPAPAPSM

SEQ ID NO: 1344079 - protein, 7 aa, Mycobacterium
KRGIDPQ

SEQ ID NO: 1344080 - protein, 5 aa, Mycobacterium
KRGMA

SEQ ID NO: 1344081 - protein, 9 aa, Mycobacterium
KRNDPTENL

SEQ ID NO: 1344082 - protein, 9 aa, Mycobacterium
KRNTKQDYM

SEQ ID NO: 1344083 - protein, 11 aa, Mycobacterium
KRQGPGAAGER

SEQ ID NO: 1344084 - protein, 4 aa, Mycobacterium
KRRN

SEQ ID NO: 1344085 - protein, 12 aa, Mycobacterium
KRRNTRAHNRSR

SEQ ID NO: 1344086 - protein, 6 aa, Mycobacterium
KRTWDQ

SEQ ID NO: 1344087 - protein, 7 aa, Mycobacterium
KSAVMGP

SEQ ID NO: 1344088 - protein, 9 aa, Mycobacterium
KSDADPQVA

SEQ ID NO: 1344089 - protein, 10 aa, Mycobacterium
KSGDANCATA

SEQ ID NO: 1344090 - protein, 7 aa, Mycobacterium
KSGDSIS

SEQ ID NO: 1344091 - protein, 6 aa, Mycobacterium
KSGIPG

SEQ ID NO: 1344092 - protein, 9 aa, Mycobacterium
KSGSEADIS

SEQ ID NO: 1344093 - protein, 23 aa, Mycobacterium
KSGTSGGGGGGGATSGTKSGTGT

SEQ ID NO: 1344094 - protein, 10 aa, Mycobacterium
KSGYDTKNGT

SEQ ID NO: 1344095 - protein, 6 aa, Mycobacterium
KSITKD

SEQ ID NO: 1344096 - protein, 6 aa, Mycobacterium
KSPPQF

SEQ ID NO: 1344097 - protein, 5 aa, Mycobacterium
KSPVD

SEQ ID NO: 1344098 - protein, 5 aa, Mycobacterium
KSQLT

SEQ ID NO: 1344099 - protein, 8 aa, Mycobacterium
KSRTRGYA

SEQ ID NO: 1344100 - protein, 5 aa, Mycobacterium
KSSGI

SEQ ID NO: 1344101 - protein, 12 aa, Mycobacterium
KSTYQNPPGGGL

SEQ ID NO: 1344102 - protein, 14 aa, Mycobacterium
KSWGDTAPADPVES

SEQ ID NO: 1344103 - protein, 7 aa, Mycobacterium
KTAGEGS

SEQ ID NO: 1344104 - protein, 14 aa, Mycobacterium
KTEGMQCPDGSWEP

SEQ ID NO: 1344105 - protein, 4 aa, Mycobacterium
KTEL

SEQ ID NO: 1344106 - protein, 9 aa, Mycobacterium
KTEVPGTTT

SEQ ID NO: 1344107 - protein, 4 aa, Mycobacterium
KTFQ

SEQ ID NO: 1344108 - protein, 7 aa, Mycobacterium
KTFTAPA

SEQ ID NO: 1344109 - protein, 11 aa, Mycobacterium
KTGYRPAAGET

SEQ ID NO: 1344110 - protein, 11 aa, Mycobacterium
KTHEEVKRGTL

SEQ ID NO: 1344111 - protein, 10 aa, Mycobacterium
KTLSSPTTLN

SEQ ID NO: 1344112 - protein, 9 aa, Mycobacterium
KTPEGRQRY

SEQ ID NO: 1344113 - protein, 4 aa, Mycobacterium
KTPV

SEQ ID NO: 1344114 - protein, 10 aa, Mycobacterium
KTSGANVSPL

SEQ ID NO: 1344115 - protein, 14 aa, Mycobacterium
KTSSFSNSLADNNQ

SEQ ID NO: 1344116 - protein, 8 aa, Mycobacterium
KTTGSYST

SEQ ID NO: 1344117 - protein, 7 aa, Mycobacterium
KTTPPVE

SEQ ID NO: 1344118 - protein, 9 aa, Mycobacterium
KVEREDKQE

SEQ ID NO: 1344119 - protein, 6 aa, Mycobacterium
KVPADA

SEQ ID NO: 1344120 - protein, 8 aa, Mycobacterium
KVPADANA

SEQ ID NO: 1344121 - protein, 17 aa, Mycobacterium
KVPNGTTGLGPDGESVP

SEQ ID NO: 1344122 - protein, 6 aa, Mycobacterium
KVTSGG

SEQ ID NO: 1344123 - protein, 12 aa, Mycobacterium
KWATPEGQEKVQ

SEQ ID NO: 1344124 - protein, 6 aa, Mycobacterium
KYGGVR

SEQ ID NO: 1344125 - protein, 6 aa, Mycobacterium
KYRGEF

SEQ ID NO: 1344126 - protein, 10 aa, Mycobacterium
KYSDGTPIKA

SEQ ID NO: 1344127 - protein, 10 aa, Mycobacterium
LAAASGKPVT

SEQ ID NO: 1344128 - protein, 9 aa, Mycobacterium
LAADDGSEF

SEQ ID NO: 1344129 - protein, 13 aa, Mycobacterium
LAARGDDASATRV

SEQ ID NO: 1344130 - protein, 9 aa, Mycobacterium
LAARTGGNP

SEQ ID NO: 1344131 - protein, 16 aa, Mycobacterium
LAASGNQLGNPAKAAE

SEQ ID NO: 1344132 - protein, 15 aa, Mycobacterium
LAASQPPPPPAPNCS

SEQ ID NO: 1344133 - protein, 4 aa, Mycobacterium
LAAT

SEQ ID NO: 1344134 - protein, 12 aa, Mycobacterium
LAATAASALGTA

SEQ ID NO: 1344135 - protein, 10 aa, Mycobacterium
LADAGKPTLD

SEQ ID NO: 1344136 - protein, 10 aa, Mycobacterium
LADGGDGNGW

SEQ ID NO: 1344137 - protein, 6 aa, Mycobacterium
LADPEP

SEQ ID NO: 1344138 - protein, 6 aa, Mycobacterium
LADPSV

SEQ ID NO: 1344139 - protein, 4 aa, Mycobacterium
LADQ

SEQ ID NO: 1344140 - protein, 7 aa, Mycobacterium
LADQDEV

SEQ ID NO: 1344141 - protein, 7 aa, Mycobacterium
LADTEDK

SEQ ID NO: 1344142 - protein, 10 aa, Mycobacterium
LAEETGDPDV

SEQ ID NO: 1344143 - protein, 5 aa, Mycobacterium
LAEGE

SEQ ID NO: 1344144 - protein, 4 aa, Mycobacterium
LAEQ

SEQ ID NO: 1344145 - protein, 12 aa, Mycobacterium
LAEQAAPPAESV

SEQ ID NO: 1344146 - protein, 10 aa, Mycobacterium
LAEQSGKRIR

SEQ ID NO: 1344147 - protein, 4 aa, Mycobacterium
LAER

SEQ ID NO: 1344148 - protein, 8 aa, Mycobacterium
LAESSETL

SEQ ID NO: 1344149 - protein, 4 aa, Mycobacterium
LAET

SEQ ID NO: 1344150 - protein, 6 aa, Mycobacterium
LAETSE

SEQ ID NO: 1344151 - protein, 8 aa, Mycobacterium
LAGEPRDD

SEQ ID NO: 1344152 - protein, 6 aa, Mycobacterium
LAGPDG

SEQ ID NO: 1344153 - protein, 5 aa, Mycobacterium
LAGSD

SEQ ID NO: 1344154 - protein, 12 aa, Mycobacterium
LAGSGIEAPPFP

SEQ ID NO: 1344155 - protein, 10 aa, Mycobacterium
LAPASDDINT

SEQ ID NO: 1344156 - protein, 8 aa, Mycobacterium
LAPGATAR

SEQ ID NO: 1344157 - protein, 5 aa, Mycobacterium
LAPNG

SEQ ID NO: 1344158 - protein, 9 aa, Mycobacterium
LAPNPPDTI

SEQ ID NO: 1344159 - protein, 22 aa, Mycobacterium
LAPPAPPAPAPAGAAAPAAANP

SEQ ID NO: 1344160 - protein, 6 aa, Mycobacterium
LAPPAV

SEQ ID NO: 1344161 - protein, 7 aa, Mycobacterium
LAPPSLT

SEQ ID NO: 1344162 - protein, 9 aa, Mycobacterium
LAPPTPAGL

SEQ ID NO: 1344163 - protein, 4 aa, Mycobacterium
LAPT

SEQ ID NO: 1344164 - protein, 9 aa, Mycobacterium
LAPTAAAAP

SEQ ID NO: 1344165 - protein, 44 aa, Mycobacterium
LAQADSTSGSDSSSASQPAKGDTGASTDGDQSSRDDGDGKRRFG

SEQ ID NO: 1344166 - protein, 12 aa, Mycobacterium
LAQAGATDPENP

SEQ ID NO: 1344167 - protein, 19 aa, Mycobacterium
LAQGAPAGQTWQTMLLPPG

SEQ ID NO: 1344168 - protein, 8 aa, Mycobacterium
LAQGPDDN

SEQ ID NO: 1344169 - protein, 9 aa, Mycobacterium
LAQGQQTSG

SEQ ID NO: 1344170 - protein, 4 aa, Mycobacterium
LAQL

SEQ ID NO: 1344171 - protein, 6 aa, Mycobacterium
LAQPGQ

SEQ ID NO: 1344172 - protein, 13 aa, Mycobacterium
LARDTTAEGRMPD

SEQ ID NO: 1344173 - protein, 10 aa, Mycobacterium
LARPRTDPAA

SEQ ID NO: 1344174 - protein, 6 aa, Mycobacterium
LASAGE

SEQ ID NO: 1344175 - protein, 6 aa, Mycobacterium
LASDGV

SEQ ID NO: 1344176 - protein, 11 aa, Mycobacterium
LASGSGGVPTG

SEQ ID NO: 1344177 - protein, 9 aa, Mycobacterium
LASQADYET

SEQ ID NO: 1344178 - protein, 12 aa, Mycobacterium
LASRGLDARKPF

SEQ ID NO: 1344179 - protein, 5 aa, Mycobacterium
LATAT

SEQ ID NO: 1344180 - protein, 6 aa, Mycobacterium
LATGEP

SEQ ID NO: 1344181 - protein, 8 aa, Mycobacterium
LATGGITP

SEQ ID NO: 1344182 - protein, 9 aa, Mycobacterium
LATGGRGGS

SEQ ID NO: 1344183 - protein, 9 aa, Mycobacterium
LDARPNQGP

SEQ ID NO: 1344184 - protein, 14 aa, Mycobacterium
LDDAEAEAQAVPTD

SEQ ID NO: 1344185 - protein, 4 aa, Mycobacterium
LDDP

SEQ ID NO: 1344186 - protein, 4 aa, Mycobacterium
LDDV

SEQ ID NO: 1344187 - protein, 6 aa, Mycobacterium
LDEPTR

SEQ ID NO: 1344188 - protein, 37 aa, Mycobacterium
LDGDPAGGTDEQGQSDNLAQEESNDESLQDDLNDDEL

SEQ ID NO: 1344189 - protein, 7 aa, Mycobacterium
LDGGGCA

SEQ ID NO: 1344190 - protein, 11 aa, Mycobacterium
LDGNNAPSEPY

SEQ ID NO: 1344191 - protein, 6 aa, Mycobacterium
LDGPPQ

SEQ ID NO: 1344192 - protein, 14 aa, Mycobacterium
LDGPPRNTSQIGQP

SEQ ID NO: 1344193 - protein, 4 aa, Mycobacterium
LDGR

SEQ ID NO: 1344194 - protein, 38 aa, Mycobacterium
LDPAATPPPGVPAGPQAPVAPAPEPVPPPAPAPAPAPV

SEQ ID NO: 1344195 - protein, 9 aa, Mycobacterium
LDPEQKSHR

SEQ ID NO: 1344196 - protein, 17 aa, Mycobacterium
LDPGNAADYAANAAEYR

SEQ ID NO: 1344197 - protein, 18 aa, Mycobacterium
LDPHGDDAVDSDELAERE

SEQ ID NO: 1344198 - protein, 11 aa, Mycobacterium
LDPINGATGTV

SEQ ID NO: 1344199 - protein, 7 aa, Mycobacterium
LDPRARD

SEQ ID NO: 1344200 - protein, 10 aa, Mycobacterium
LDPSGTSAVA

SEQ ID NO: 1344201 - protein, 9 aa, Mycobacterium
LDPSSAAEM

SEQ ID NO: 1344202 - protein, 12 aa, Mycobacterium
LDPTNPDGIPAN

SEQ ID NO: 1344203 - protein, 9 aa, Mycobacterium
LDPTTQSRL

SEQ ID NO: 1344204 - protein, 12 aa, Mycobacterium
LDQDGNGTGCEN

SEQ ID NO: 1344205 - protein, 11 aa, Mycobacterium
LDRPEGIGPGL

SEQ ID NO: 1344206 - protein, 4 aa, Mycobacterium
LDRT

SEQ ID NO: 1344207 - protein, 9 aa, Mycobacterium
LDSDDPSLR

SEQ ID NO: 1344208 - protein, 9 aa, Mycobacterium
LDSHGDPVH

SEQ ID NO: 1344209 - protein, 13 aa, Mycobacterium
LDSPTTSGEAGLS

SEQ ID NO: 1344210 - protein, 7 aa, Mycobacterium
LDTDDVA

SEQ ID NO: 1344211 - protein, 11 aa, Mycobacterium
LDTGTPSADAI

SEQ ID NO: 1344212 - protein, 66 aa, Mycobacterium
LDVSESAEDPDVSEAAQDPDVSESAADRDGRAVTHDPDVPESGEDPDARESTNDSADDSAQRQEAG

SEQ ID NO: 1344213 - protein, 8 aa, Mycobacterium
LEAASDEL

SEQ ID NO: 1344214 - protein, 6 aa, Mycobacterium
LEADGN

SEQ ID NO: 1344215 - protein, 6 aa, Mycobacterium
LEEETG

SEQ ID NO: 1344216 - protein, 4 aa, Mycobacterium
LENP

SEQ ID NO: 1344217 - protein, 7 aa, Mycobacterium
LEPGPEL

SEQ ID NO: 1344218 - protein, 18 aa, Mycobacterium
LEPRPYRDPLPATSAAAR

SEQ ID NO: 1344219 - protein, 9 aa, Mycobacterium
LEPSPGNSV

SEQ ID NO: 1344220 - protein, 10 aa, Mycobacterium
LERSTNPELT

SEQ ID NO: 1344221 - protein, 6 aa, Mycobacterium
LESNSP

SEQ ID NO: 1344222 - protein, 7 aa, Mycobacterium
LESPNPP

SEQ ID NO: 1344223 - protein, 11 aa, Mycobacterium
LESSGSAGKVT

SEQ ID NO: 1344224 - protein, 31 aa, Mycobacterium
LETSPGTTSATPTSSRSPFEPTTTPPPVPTG

SEQ ID NO: 1344225 - protein, 29 aa, Mycobacterium
LEVPDEPAGEDDVQASGEDTPAPDETTDS

SEQ ID NO: 1344226 - protein, 9 aa, Mycobacterium
LGAAPTVAG

SEQ ID NO: 1344227 - protein, 9 aa, Mycobacterium
LGADAGSAF

SEQ ID NO: 1344228 - protein, 8 aa, Mycobacterium
LGAEKAGD

SEQ ID NO: 1344229 - protein, 4 aa, Mycobacterium
LGAG

SEQ ID NO: 1344230 - protein, 6 aa, Mycobacterium
LGAGAA

SEQ ID NO: 1344231 - protein, 9 aa, Mycobacterium
LGAGGNEEQ

SEQ ID NO: 1344232 - protein, 7 aa, Mycobacterium
LGAGRTA

SEQ ID NO: 1344233 - protein, 21 aa, Mycobacterium
LGARATLTDDSPTALTASAQQ

SEQ ID NO: 1344234 - protein, 5 aa, Mycobacterium
LGASG

SEQ ID NO: 1344235 - protein, 20 aa, Mycobacterium
LGATESRPGQLGEEDSTDVH

SEQ ID NO: 1344236 - protein, 5 aa, Mycobacterium
LGATS

SEQ ID NO: 1344237 - protein, 8 aa, Mycobacterium
LGATTDTL

SEQ ID NO: 1344238 - protein, 7 aa, Mycobacterium
LGDAQRS

SEQ ID NO: 1344239 - protein, 7 aa, Mycobacterium
LGDGGAA

SEQ ID NO: 1344240 - protein, 5 aa, Mycobacterium
LGDHS

SEQ ID NO: 1344241 - protein, 6 aa, Mycobacterium
LGDHSD

SEQ ID NO: 1344242 - protein, 8 aa, Mycobacterium
LGDQNDQF

SEQ ID NO: 1344243 - protein, 8 aa, Mycobacterium
LGDQSTQF

SEQ ID NO: 1344244 - protein, 4 aa, Mycobacterium
LGED

SEQ ID NO: 1344245 - protein, 9 aa, Mycobacterium
LGEGDGAAA

SEQ ID NO: 1344246 - protein, 18 aa, Mycobacterium
LGGATTTTATFETHSPDN

SEQ ID NO: 1344247 - protein, 8 aa, Mycobacterium
LGGDAGDV

SEQ ID NO: 1344248 - protein, 10 aa, Mycobacterium
LGGGRADGPL

SEQ ID NO: 1344249 - protein, 8 aa, Mycobacterium
LGGQPDSI

SEQ ID NO: 1344250 - protein, 7 aa, Mycobacterium
LGGQTDR

SEQ ID NO: 1344251 - protein, 4 aa, Mycobacterium
LGGS

SEQ ID NO: 1344252 - protein, 13 aa, Mycobacterium
LGGSRTTVAPGRR

SEQ ID NO: 1344253 - protein, 4 aa, Mycobacterium
LGGT

SEQ ID NO: 1344254 - protein, 10 aa, Mycobacterium
LGKPPPTGPR

SEQ ID NO: 1344255 - protein, 4 aa, Mycobacterium
LGNY

SEQ ID NO: 1344256 - protein, 7 aa, Mycobacterium
LGPDPRF

SEQ ID NO: 1344257 - protein, 12 aa, Mycobacterium
LGPEAGVSDTSV

SEQ ID NO: 1344258 - protein, 13 aa, Mycobacterium
LGPLPGPAPAPLA

SEQ ID NO: 1344259 - protein, 17 aa, Mycobacterium
LGPNDSRQAPSSAGENV

SEQ ID NO: 1344260 - protein, 15 aa, Mycobacterium
LGQRTGVGLPGESAG

SEQ ID NO: 1344261 - protein, 7 aa, Mycobacterium
LGRPLGP

SEQ ID NO: 1344262 - protein, 10 aa, Mycobacterium
LGRPRRTEEP

SEQ ID NO: 1344263 - protein, 8 aa, Mycobacterium
LGRQTDED

SEQ ID NO: 1344264 - protein, 8 aa, Mycobacterium
LGSATPAT

SEQ ID NO: 1344265 - protein, 13 aa, Mycobacterium
LGSDPGAFGEPTR

SEQ ID NO: 1344266 - protein, 26 aa, Mycobacterium
LGSGTAGADVEEIGPGPTVTSRQATE

SEQ ID NO: 1344267 - protein, 5 aa, Mycobacterium
LGSTW

SEQ ID NO: 1344268 - protein, 24 aa, Mycobacterium
LGTATSIAQPPPPPPPAPALGEPV

SEQ ID NO: 1344269 - protein, 6 aa, Mycobacterium
LGTPAA

SEQ ID NO: 1344270 - protein, 6 aa, Mycobacterium
LGTPDI

SEQ ID NO: 1344271 - protein, 7 aa, Mycobacterium
LGTPSPL

SEQ ID NO: 1344272 - protein, 10 aa, Mycobacterium
LGTRDGSNLT

SEQ ID NO: 1344273 - protein, 4 aa, Mycobacterium
LGTT

SEQ ID NO: 1344274 - protein, 6 aa, Mycobacterium
LGVPGG

SEQ ID NO: 1344275 - protein, 4 aa, Mycobacterium
LGYG

SEQ ID NO: 1344276 - protein, 6 aa, Mycobacterium
LGYTPD

SEQ ID NO: 1344277 - protein, 9 aa, Mycobacterium
LHGSAGPIS

SEQ ID NO: 1344278 - protein, 6 aa, Mycobacterium
LHTNTD

SEQ ID NO: 1344279 - protein, 9 aa, Mycobacterium
LITPDDDDW

SEQ ID NO: 1344280 - protein, 5 aa, Mycobacterium
LKAPT

SEQ ID NO: 1344281 - protein, 20 aa, Mycobacterium
LKDERTTDGLNAQTFCFVKS

SEQ ID NO: 1344282 - protein, 35 aa, Mycobacterium
LKDPSYRLQTTTAEKIASRRDPWDPTTVEADNTGR

SEQ ID NO: 1344283 - protein, 18 aa, Mycobacterium
LKNGPGDGDIAMSGSPSV

SEQ ID NO: 1344284 - protein, 6 aa, Mycobacterium
LKNQQR

SEQ ID NO: 1344285 - protein, 6 aa, Mycobacterium
LKPSSD

SEQ ID NO: 1344286 - protein, 7 aa, Mycobacterium
LKPSSDV

SEQ ID NO: 1344287 - protein, 14 aa, Mycobacterium
LLPTPADDADHAAR

SEQ ID NO: 1344288 - protein, 8 aa, Mycobacterium
LNADAGEA

SEQ ID NO: 1344289 - protein, 9 aa, Mycobacterium
LNAKDSGGV

SEQ ID NO: 1344290 - protein, 4 aa, Mycobacterium
LNAT

SEQ ID NO: 1344291 - protein, 16 aa, Mycobacterium
LNDSKTTALDRCDAAY

SEQ ID NO: 1344292 - protein, 12 aa, Mycobacterium
LNEPGSGPAAGK

SEQ ID NO: 1344293 - protein, 5 aa, Mycobacterium
LNGDS

SEQ ID NO: 1344294 - protein, 8 aa, Mycobacterium
LNGREDDL

SEQ ID NO: 1344295 - protein, 5 aa, Mycobacterium
LNGTQ

SEQ ID NO: 1344296 - protein, 9 aa, Mycobacterium
LNNKPDAKT

SEQ ID NO: 1344297 - protein, 11 aa, Mycobacterium
LNPLSANHNAT

SEQ ID NO: 1344298 - protein, 7 aa, Mycobacterium
LNPPTRR

SEQ ID NO: 1344299 - protein, 10 aa, Mycobacterium
LNQKDGGGVH

SEQ ID NO: 1344300 - protein, 9 aa, Mycobacterium
LNRPTPDRV

SEQ ID NO: 1344301 - protein, 9 aa, Mycobacterium
LNSNRDTLA

SEQ ID NO: 1344302 - protein, 14 aa, Mycobacterium
LNTAAVDQGSQAGD

SEQ ID NO: 1344303 - protein, 10 aa, Mycobacterium
LPAAPAPELQ

SEQ ID NO: 1344304 - protein, 9 aa, Mycobacterium
LPAATTTIK

SEQ ID NO: 1344305 - protein, 39 aa, Mycobacterium
LPAEPGLPSEPEPEPEPEPEPEEPQTDPEPEGETAPLTS

SEQ ID NO: 1344306 - protein, 11 aa, Mycobacterium
LPAGQTEEVDR

SEQ ID NO: 1344307 - protein, 11 aa, Mycobacterium
LPAGVAPENGL

SEQ ID NO: 1344308 - protein, 21 aa, Mycobacterium
LPAGYTSADKTGSGDYGTTND

SEQ ID NO: 1344309 - protein, 4 aa, Mycobacterium
LPAN

SEQ ID NO: 1344310 - protein, 9 aa, Mycobacterium
LPANATARV

SEQ ID NO: 1344311 - protein, 12 aa, Mycobacterium
LPANTTAAIGQT

SEQ ID NO: 1344312 - protein, 9 aa, Mycobacterium
LPAPGSPTS

SEQ ID NO: 1344313 - protein, 5 aa, Mycobacterium
LPAPR

SEQ ID NO: 1344314 - protein, 11 aa, Mycobacterium
LPDAPAAGSPL

SEQ ID NO: 1344315 - protein, 7 aa, Mycobacterium
LPDSAIK

SEQ ID NO: 1344316 - protein, 8 aa, Mycobacterium
LPDSTATL

SEQ ID NO: 1344317 - protein, 12 aa, Mycobacterium
LPDVPSKQYGGS

SEQ ID NO: 1344318 - protein, 12 aa, Mycobacterium
LPEAPPDEPAAT

SEQ ID NO: 1344319 - protein, 6 aa, Mycobacterium
LPEDSP

SEQ ID NO: 1344320 - protein, 6 aa, Mycobacterium
LPEETA

SEQ ID NO: 1344321 - protein, 11 aa, Mycobacterium
LPEGSDAQPAY

SEQ ID NO: 1344322 - protein, 8 aa, Mycobacterium
LPEPQRRE

SEQ ID NO: 1344323 - protein, 6 aa, Mycobacterium
LPGANS

SEQ ID NO: 1344324 - protein, 12 aa, Mycobacterium
LPGGEGAVRQPA

SEQ ID NO: 1344325 - protein, 8 aa, Mycobacterium
LPGGSPLG

SEQ ID NO: 1344326 - protein, 8 aa, Mycobacterium
LPGGTADT

SEQ ID NO: 1344327 - protein, 7 aa, Mycobacterium
LPGNDTM

SEQ ID NO: 1344328 - protein, 10 aa, Mycobacterium
LPGPDDGDAV

SEQ ID NO: 1344329 - protein, 5 aa, Mycobacterium
LPGTH

SEQ ID NO: 1344330 - protein, 15 aa, Mycobacterium
LPKGSTAELRSATPL

SEQ ID NO: 1344331 - protein, 12 aa, Mycobacterium
LPLPGDGEPKTV

SEQ ID NO: 1344332 - protein, 17 aa, Mycobacterium
LPNANSADTAESRFAAP

SEQ ID NO: 1344333 - protein, 4 aa, Mycobacterium
LPPA

SEQ ID NO: 1344334 - protein, 9 aa, Mycobacterium
LPPARTAAR

SEQ ID NO: 1344335 - protein, 9 aa, Mycobacterium
LPPDGLTKA

SEQ ID NO: 1344336 - protein, 13 aa, Mycobacterium
LPPDPSPQKLKSG

SEQ ID NO: 1344337 - protein, 4 aa, Mycobacterium
LPPE

SEQ ID NO: 1344338 - protein, 17 aa, Mycobacterium
LPPEGAPPDAQPPNDTS

SEQ ID NO: 1344339 - protein, 7 aa, Mycobacterium
LPPPEGV

SEQ ID NO: 1344340 - protein, 12 aa, Mycobacterium
LPPPGQGGPMPQ

SEQ ID NO: 1344341 - protein, 30 aa, Mycobacterium
LPPPPPPPPPPPPGAPPPPPPPPPPPPPPV

SEQ ID NO: 1344342 - protein, 6 aa, Mycobacterium
LPPRDQ

SEQ ID NO: 1344343 - protein, 6 aa, Mycobacterium
LPPTAG

SEQ ID NO: 1344344 - protein, 11 aa, Mycobacterium
LPPTTGTDTGL

SEQ ID NO: 1344345 - protein, 4 aa, Mycobacterium
LPQT

SEQ ID NO: 1344346 - protein, 13 aa, Mycobacterium
LPREERAGNEIPR

SEQ ID NO: 1344347 - protein, 8 aa, Mycobacterium
LPRSSGEM

SEQ ID NO: 1344348 - protein, 9 aa, Mycobacterium
LPSPYTAGN

SEQ ID NO: 1344349 - protein, 19 aa, Mycobacterium
LPTNGNNLSRANIAENNAK

SEQ ID NO: 1344350 - protein, 6 aa, Mycobacterium
LPTPGI

SEQ ID NO: 1344351 - protein, 16 aa, Mycobacterium
LPTRNTDVPEVPAPAN

SEQ ID NO: 1344352 - protein, 13 aa, Mycobacterium
LQAGATPDTQLTA

SEQ ID NO: 1344353 - protein, 11 aa, Mycobacterium
LQATAVATQTA

SEQ ID NO: 1344354 - protein, 12 aa, Mycobacterium
LQATNVATQTTL

SEQ ID NO: 1344355 - protein, 10 aa, Mycobacterium
LQDPPDQPSL

SEQ ID NO: 1344356 - protein, 8 aa, Mycobacterium
LQGSQTAV

SEQ ID NO: 1344357 - protein, 5 aa, Mycobacterium
LQGTL

SEQ ID NO: 1344358 - protein, 6 aa, Mycobacterium
LQQDPS

SEQ ID NO: 1344359 - protein, 8 aa, Mycobacterium
LRAEGATK

SEQ ID NO: 1344360 - protein, 14 aa, Mycobacterium
LRAPNDSGATLSAG

SEQ ID NO: 1344361 - protein, 6 aa, Mycobacterium
LRDDES

SEQ ID NO: 1344362 - protein, 10 aa, Mycobacterium
LRDDKQDMRQ

SEQ ID NO: 1344363 - protein, 6 aa, Mycobacterium
LRDEDA

SEQ ID NO: 1344364 - protein, 8 aa, Mycobacterium
LRDGPPPL

SEQ ID NO: 1344365 - protein, 9 aa, Mycobacterium
LRDPAATAA

SEQ ID NO: 1344366 - protein, 6 aa, Mycobacterium
LRDPSQ

SEQ ID NO: 1344367 - protein, 8 aa, Mycobacterium
LRESRDRV

SEQ ID NO: 1344368 - protein, 8 aa, Mycobacterium
LRETGVSA

SEQ ID NO: 1344369 - protein, 8 aa, Mycobacterium
LRGGDPAG

SEQ ID NO: 1344370 - protein, 11 aa, Mycobacterium
LRGKTRSQPGC

SEQ ID NO: 1344371 - protein, 12 aa, Mycobacterium
LRGSGGISTPSP

SEQ ID NO: 1344372 - protein, 6 aa, Mycobacterium
LRNGRL

SEQ ID NO: 1344373 - protein, 5 aa, Mycobacterium
LRPDA

SEQ ID NO: 1344374 - protein, 7 aa, Mycobacterium
LRPDETT

SEQ ID NO: 1344375 - protein, 6 aa, Mycobacterium
LRPEAG

SEQ ID NO: 1344376 - protein, 15 aa, Mycobacterium
LRPEDPAAPDGQQYG

SEQ ID NO: 1344377 - protein, 5 aa, Mycobacterium
LRPGG

SEQ ID NO: 1344378 - protein, 17 aa, Mycobacterium
LRPGRPAGCSAGDYGGV

SEQ ID NO: 1344379 - protein, 6 aa, Mycobacterium
LRPIGG

SEQ ID NO: 1344380 - protein, 7 aa, Mycobacterium
LRPTTRG

SEQ ID NO: 1344381 - protein, 7 aa, Mycobacterium
LRRNGKD

SEQ ID NO: 1344382 - protein, 12 aa, Mycobacterium
LRRSESQDPVAD

SEQ ID NO: 1344383 - protein, 9 aa, Mycobacterium
LRSEYASGP

SEQ ID NO: 1344384 - protein, 15 aa, Mycobacterium
LRSGAANTAGWSRSL

SEQ ID NO: 1344385 - protein, 8 aa, Mycobacterium
LRSNSQDV

SEQ ID NO: 1344386 - protein, 8 aa, Mycobacterium
LRSPDSDD

SEQ ID NO: 1344387 - protein, 8 aa, Mycobacterium
LRTDDNGL

SEQ ID NO: 1344388 - protein, 10 aa, Mycobacterium
LSAATRESME

SEQ ID NO: 1344389 - protein, 8 aa, Mycobacterium
LSADGTTV

SEQ ID NO: 1344390 - protein, 22 aa, Mycobacterium
LSADPADENRLYTSTDNAYGPS

SEQ ID NO: 1344391 - protein, 7 aa, Mycobacterium
LSANGED

SEQ ID NO: 1344392 - protein, 6 aa, Mycobacterium
LSAPRL

SEQ ID NO: 1344393 - protein, 9 aa, Mycobacterium
LSAPTPDRL

SEQ ID NO: 1344394 - protein, 10 aa, Mycobacterium
LSASTGKLST

SEQ ID NO: 1344395 - protein, 9 aa, Mycobacterium
LSATGSTVA

SEQ ID NO: 1344396 - protein, 5 aa, Mycobacterium
LSDEG

SEQ ID NO: 1344397 - protein, 8 aa, Mycobacterium
LSDGVDGR

SEQ ID NO: 1344398 - protein, 6 aa, Mycobacterium
LSDHST

SEQ ID NO: 1344399 - protein, 6 aa, Mycobacterium
LSDYPA

SEQ ID NO: 1344400 - protein, 13 aa, Mycobacterium
LSEDGQGGPPNNG

SEQ ID NO: 1344401 - protein, 10 aa, Mycobacterium
LSEETPAGFE

SEQ ID NO: 1344402 - protein, 7 aa, Mycobacterium
LSEQESL

SEQ ID NO: 1344403 - protein, 9 aa, Mycobacterium
LSGEPCEEP

SEQ ID NO: 1344404 - protein, 18 aa, Mycobacterium
LSGISSALTQSQREVKLA

SEQ ID NO: 1344405 - protein, 5 aa, Mycobacterium
LSGPE

SEQ ID NO: 1344406 - protein, 11 aa, Mycobacterium
LSGPGSGEPTA

SEQ ID NO: 1344407 - protein, 22 aa, Mycobacterium
LSGQAADPFKIPPGTATQHEGA

SEQ ID NO: 1344408 - protein, 8 aa, Mycobacterium
LSGREPEV

SEQ ID NO: 1344409 - protein, 18 aa, Mycobacterium
LSKDDTGAGTAAGAAGSV

SEQ ID NO: 1344410 - protein, 6 aa, Mycobacterium
LSKPRG

SEQ ID NO: 1344411 - protein, 7 aa, Mycobacterium
LSNNGVP

SEQ ID NO: 1344412 - protein, 4 aa, Mycobacterium
LSNP

SEQ ID NO: 1344413 - protein, 19 aa, Mycobacterium
LSPAGRTRTAPATDAPASS

SEQ ID NO: 1344414 - protein, 19 aa, Mycobacterium
LSPDDLAKAAEGDVDGDAI

SEQ ID NO: 1344415 - protein, 7 aa, Mycobacterium
LSPDGAS

SEQ ID NO: 1344416 - protein, 6 aa, Mycobacterium
LSPDRM

SEQ ID NO: 1344417 - protein, 7 aa, Mycobacterium
LSPGEEA

SEQ ID NO: 1344418 - protein, 7 aa, Mycobacterium
LSPGRAH

SEQ ID NO: 1344419 - protein, 6 aa, Mycobacterium
LSPLSR

SEQ ID NO: 1344420 - protein, 4 aa, Mycobacterium
LSPN

SEQ ID NO: 1344421 - protein, 7 aa, Mycobacterium
LSPPRAA

SEQ ID NO: 1344422 - protein, 6 aa, Mycobacterium
LSRGGG

SEQ ID NO: 1344423 - protein, 8 aa, Mycobacterium
LSRNPGTA

SEQ ID NO: 1344424 - protein, 10 aa, Mycobacterium
LSSDRDPIGT

SEQ ID NO: 1344425 - protein, 11 aa, Mycobacterium
LSSTSRPGNGR

SEQ ID NO: 1344426 - protein, 10 aa, Mycobacterium
LSTTGAQSGD

SEQ ID NO: 1344427 - protein, 8 aa, Mycobacterium
LTAAGQPA

SEQ ID NO: 1344428 - protein, 10 aa, Mycobacterium
LTATGSTSDT

SEQ ID NO: 1344429 - protein, 7 aa, Mycobacterium
LTDEPRR

SEQ ID NO: 1344430 - protein, 15 aa, Mycobacterium
LTDPPVGQPATPALP

SEQ ID NO: 1344431 - protein, 5 aa, Mycobacterium
LTDRS

SEQ ID NO: 1344432 - protein, 5 aa, Mycobacterium
LTDTG

SEQ ID NO: 1344433 - protein, 10 aa, Mycobacterium
LTDTGRGESE

SEQ ID NO: 1344434 - protein, 9 aa, Mycobacterium
LTEDATADR

SEQ ID NO: 1344435 - protein, 19 aa, Mycobacterium
LTEDRNALNEKLSAAGDFD

SEQ ID NO: 1344436 - protein, 15 aa, Mycobacterium
LTEPGTADQAVPEDR

SEQ ID NO: 1344437 - protein, 5 aa, Mycobacterium
LTEPT

SEQ ID NO: 1344438 - protein, 13 aa, Mycobacterium
LTEQPPGVVVLVT

SEQ ID NO: 1344439 - protein, 21 aa, Mycobacterium
LTESDDSALVTSARSKLPGLP

SEQ ID NO: 1344440 - protein, 9 aa, Mycobacterium
LTGAPQKQI

SEQ ID NO: 1344441 - protein, 6 aa, Mycobacterium
LTGATA

SEQ ID NO: 1344442 - protein, 6 aa, Mycobacterium
LTGDDG

SEQ ID NO: 1344443 - protein, 7 aa, Mycobacterium
LTGERPV

SEQ ID NO: 1344444 - protein, 9 aa, Mycobacterium
LTGNPNPVP

SEQ ID NO: 1344445 - protein, 11 aa, Mycobacterium
LTGPASGAAEE

SEQ ID NO: 1344446 - protein, 5 aa, Mycobacterium
LTGPK

SEQ ID NO: 1344447 - protein, 20 aa, Mycobacterium
LTGSTTDTSDIVTYAGQVKV

SEQ ID NO: 1344448 - protein, 9 aa, Mycobacterium
LTIGPEKAA

SEQ ID NO: 1344449 - protein, 10 aa, Mycobacterium
LTKKDTPTLV

SEQ ID NO: 1344450 - protein, 8 aa, Mycobacterium
LTNGRAEA

SEQ ID NO: 1344451 - protein, 4 aa, Mycobacterium
LTPA

SEQ ID NO: 1344452 - protein, 8 aa, Mycobacterium
LTPAGKRL

SEQ ID NO: 1344453 - protein, 11 aa, Mycobacterium
LTPDERIASND

SEQ ID NO: 1344454 - protein, 8 aa, Mycobacterium
LTPDGQHI

SEQ ID NO: 1344455 - protein, 10 aa, Mycobacterium
LTPDSDFDQA

SEQ ID NO: 1344456 - protein, 7 aa, Mycobacterium
LTPEEAE

SEQ ID NO: 1344457 - protein, 10 aa, Mycobacterium
LTPEEVAGQL

SEQ ID NO: 1344458 - protein, 10 aa, Mycobacterium
LTPEQQRTSP

SEQ ID NO: 1344459 - protein, 6 aa, Mycobacterium
LTPGGV

SEQ ID NO: 1344460 - protein, 12 aa, Mycobacterium
LTPGPGRGFNPD

SEQ ID NO: 1344461 - protein, 13 aa, Mycobacterium
LTPNGPTGFPGDT

SEQ ID NO: 1344462 - protein, 8 aa, Mycobacterium
LTPPSRAK

SEQ ID NO: 1344463 - protein, 9 aa, Mycobacterium
LTPPSRAKQ

SEQ ID NO: 1344464 - protein, 5 aa, Mycobacterium
LTPQD

SEQ ID NO: 1344465 - protein, 8 aa, Mycobacterium
LTPQDVAG

SEQ ID NO: 1344466 - protein, 6 aa, Mycobacterium
LTPTHP

SEQ ID NO: 1344467 - protein, 15 aa, Mycobacterium
LTRTGAVDANGDEHD

SEQ ID NO: 1344468 - protein, 16 aa, Mycobacterium
LTSRDGVEVTPGRNGA

SEQ ID NO: 1344469 - protein, 40 aa, Mycobacterium; identical to SEQ ID NO: 1102789

SEQ ID NO: 1344470 - protein, 14 aa, Mycobacterium
LTTVPDGAAVDPTA

SEQ ID NO: 1344471 - protein, 6 aa, Mycobacterium
LVETSR

SEQ ID NO: 1344472 - protein, 8 aa, Mycobacterium
LVSSRRQG

SEQ ID NO: 1344473 - protein, 12 aa, Mycobacterium
LVSSTRPHARRR

SEQ ID NO: 1344474 - protein, 4 aa, Mycobacterium
LYEG

SEQ ID NO: 1344475 - protein, 5 aa, Mycobacterium
LYPGG

SEQ ID NO: 1344476 - protein, 7 aa, Mycobacterium
MADPRTQ

SEQ ID NO: 1344477 - protein, 6 aa, Mycobacterium
MAGPAE

SEQ ID NO: 1344478 - protein, 6 aa, Mycobacterium
MAKGEA

SEQ ID NO: 1344479 - protein, 12 aa, Mycobacterium
MAPDDAPPGPAP

SEQ ID NO: 1344480 - protein, 7 aa, Mycobacterium
MAPEQKK

SEQ ID NO: 1344481 - protein, 12 aa, Mycobacterium
MAPQSLTPEEEH

SEQ ID NO: 1344482 - protein, 20 aa, Mycobacterium
MAQGQRPAVSPQAALVTRYT

SEQ ID NO: 1344483 - protein, 6 aa, Mycobacterium
MASTAG

SEQ ID NO: 1344484 - protein, 8 aa, Mycobacterium
MERRPEPG

SEQ ID NO: 1344485 - protein, 13 aa, Mycobacterium
MGADAGAQQGGSI

SEQ ID NO: 1344486 - protein, 4 aa, Mycobacterium
MGAG

SEQ ID NO: 1344487 - protein, 20 aa, Mycobacterium
MGAKSGSAEVKVDGDTYTIT

SEQ ID NO: 1344488 - protein, 6 aa, Mycobacterium
MGGNTN

SEQ ID NO: 1344489 - protein, 33 aa, Mycobacterium
MGGSDGDDESSATATTVTTTTTTSAAPEEPARP

SEQ ID NO: 1344490 - protein, 7 aa, Mycobacterium
MGPGGKG

SEQ ID NO: 1344491 - protein, 7 aa, Mycobacterium
MGPPGIG

SEQ ID NO: 1344492 - protein, 12 aa, Mycobacterium
MGSDPPTQTASS

SEQ ID NO: 1344493 - protein, 8 aa, Mycobacterium
MGTEAPLT

SEQ ID NO: 1344494 - protein, 8 aa, Mycobacterium
MGTLSGRG

SEQ ID NO: 1344495 - protein, 6 aa, Mycobacterium
MNEEPY

SEQ ID NO: 1344496 - protein, 16 aa, Mycobacterium
MPAGQGAPIIANTSPQ

SEQ ID NO: 1344497 - protein, 13 aa, Mycobacterium
MPEGIPPPAGAPV

SEQ ID NO: 1344498 - protein, 13 aa, Mycobacterium
MPEGIPPPSGAPV

SEQ ID NO: 1344499 - protein, 12 aa, Mycobacterium
MPESDDTPSRRD

SEQ ID NO: 1344500 - protein, 15 aa, Mycobacterium
MPGAGGALQATVPRS

SEQ ID NO: 1344501 - protein, 4 aa, Mycobacterium
MPGM

SEQ ID NO: 1344502 - protein, 24 aa, Mycobacterium
MPGPNAPGGDMGPHHGGTSSGPMM

SEQ ID NO: 1344503 - protein, 12 aa, Mycobacterium
MPGTAGHGNGSY

SEQ ID NO: 1344504 - protein, 5 aa, Mycobacterium
MPGVA

SEQ ID NO: 1344505 - protein, 12 aa, Mycobacterium
MPNSDDAPAERD

SEQ ID NO: 1344506 - protein, 8 aa, Mycobacterium
MPPPSSGG

SEQ ID NO: 1344507 - protein, 17 aa, Mycobacterium
MPPTDTDGRSDPDPTKW

SEQ ID NO: 1344508 - protein, 9 aa, Mycobacterium
MPRDTPYSG

SEQ ID NO: 1344509 - protein, 5 aa, Mycobacterium
MPSPY

SEQ ID NO: 1344510 - protein, 8 aa, Mycobacterium
MPSPYTAG

SEQ ID NO: 1344511 - protein, 25 aa, Mycobacterium
MPTTTKGTNQGPNPSLPEMPEVLVA

SEQ ID NO: 1344512 - protein, 4 aa, Mycobacterium
MPYT

SEQ ID NO: 1344513 - protein, 5 aa, Mycobacterium
MQPQR

SEQ ID NO: 1344514 - protein, 6 aa, Mycobacterium
MRGEEP

SEQ ID NO: 1344515 - protein, 5 aa, Mycobacterium
MRPNG

SEQ ID NO: 1344516 - protein, 11 aa, Mycobacterium
MRPSLDPSTVK

SEQ ID NO: 1344517 - protein, 6 aa, Mycobacterium
MSETAG

SEQ ID NO: 1344518 - protein, 9 aa, Mycobacterium
MSGAEAARR

SEQ ID NO: 1344519 - protein, 5 aa, Mycobacterium
MSGTE

SEQ ID NO: 1344520 - protein, 17 aa, Mycobacterium
MSGTRKITHNGNCGTAP

SEQ ID NO: 1344521 - protein, 12 aa, Mycobacterium
MSRANTRSRRAQ

SEQ ID NO: 1344522 - protein, 11 aa, Mycobacterium
MSRGDDTGLGP

SEQ ID NO: 1344523 - protein, 11 aa, Mycobacterium
MSRGNDNALGP

SEQ ID NO: 1344524 - protein, 9 aa, Mycobacterium
MSSYPSRSD

SEQ ID NO: 1344525 - protein, 6 aa, Mycobacterium
MTAKAN

SEQ ID NO: 1344526 - protein, 5 aa, Mycobacterium
MTGTG

SEQ ID NO: 1344527 - protein, 8 aa, Mycobacterium
MTGTGDKH

SEQ ID NO: 1344528 - protein, 6 aa, Mycobacterium
MTPLRG

SEQ ID NO: 1344529 - protein, 6 aa, Mycobacterium
MTPTET

SEQ ID NO: 1344530 - protein, 6 aa, Mycobacterium
MTTPDG

SEQ ID NO: 1344531 - protein, 16 aa, Mycobacterium
MTTTSPTRAAAPPTPA

SEQ ID NO: 1344532 - protein, 4 aa, Mycobacterium
MVNG

SEQ ID NO: 1344533 - protein, 6 aa, Mycobacterium
NAAAAS

SEQ ID NO: 1344534 - protein, 38 aa, Mycobacterium
NAAEDLQRARTEQTNRNSAARQARQRADASLNSARRRQ

SEQ ID NO: 1344535 - protein, 11 aa, Mycobacterium
NAARGNDISDA

SEQ ID NO: 1344536 - protein, 17 aa, Mycobacterium
NAATEDAYGAAESTPQV

SEQ ID NO: 1344537 - protein, 19 aa, Mycobacterium
NADAEPSPPPPPPVPPAAN

SEQ ID NO: 1344538 - protein, 6 aa, Mycobacterium
NADDGL

SEQ ID NO: 1344539 - protein, 14 aa, Mycobacterium
NADESTAPRTRRSN

SEQ ID NO: 1344540 - protein, 7 aa, Mycobacterium
NADGTLE

SEQ ID NO: 1344541 - protein, 7 aa, Mycobacterium
NADPHSF

SEQ ID NO: 1344542 - protein, 5 aa, Mycobacterium
NADPL

SEQ ID NO: 1344543 - protein, 6 aa, Mycobacterium
NADYET

SEQ ID NO: 1344544 - protein, 13 aa, Mycobacterium
NAETTMAAAQPGC

SEQ ID NO: 1344545 - protein, 6 aa, Mycobacterium
NAEVSG

SEQ ID NO: 1344546 - protein, 4 aa, Mycobacterium
NAFE

SEQ ID NO: 1344547 - protein, 6 aa, Mycobacterium
NAGEQN

SEQ ID NO: 1344548 - protein, 9 aa, Mycobacterium
NAGGGETKS

SEQ ID NO: 1344549 - protein, 17 aa, Mycobacterium
NAGGSPVTVGDVSSDNG

SEQ ID NO: 1344550 - protein, 8 aa, Mycobacterium
NAGIRSRT

SEQ ID NO: 1344551 - protein, 6 aa, Mycobacterium
NAGTGQ

SEQ ID NO: 1344552 - protein, 8 aa, Mycobacterium
NAKKPGDI

SEQ ID NO: 1344553 - protein, 7 aa, Mycobacterium
NANKATA

SEQ ID NO: 1344554 - protein, 10 aa, Mycobacterium
NAPADAQGPI

SEQ ID NO: 1344555 - protein, 23 aa, Mycobacterium
NAPNASGAVTGSVTVTDPEGRPL

SEQ ID NO: 1344556 - protein, 6 aa, Mycobacterium
NAQGVD

SEQ ID NO: 1344557 - protein, 7 aa, Mycobacterium
NAQGVEA

SEQ ID NO: 1344558 - protein, 26 aa, Mycobacterium
NARDAAAAARRDVQASEQGLADANAA

SEQ ID NO: 1344559 - protein, 7 aa, Mycobacterium
NARSFSD

SEQ ID NO: 1344560 - protein, 8 aa, Mycobacterium
NARSFSDA

SEQ ID NO: 1344561 - protein, 15 aa, Mycobacterium
NARSGEISTAITETS

SEQ ID NO: 1344562 - protein, 34 aa, Mycobacterium
NASAPAATATATPATPVTGPGATASISLPQPADV

SEQ ID NO: 1344563 - protein, 7 aa, Mycobacterium
NASGGVM

SEQ ID NO: 1344564 - protein, 5 aa, Mycobacterium
NASQH

SEQ ID NO: 1344565 - protein, 6 aa, Mycobacterium
NASQHE

SEQ ID NO: 1344566 - protein, 7 aa, Mycobacterium
NASRQGV

SEQ ID NO: 1344567 - protein, 11 aa, Mycobacterium
NASYEYDDASD

SEQ ID NO: 1344568 - protein, 5 aa, Mycobacterium
NATEA

SEQ ID NO: 1344569 - protein, 7 aa, Mycobacterium
NATGTSA

SEQ ID NO: 1344570 - protein, 9 aa, Mycobacterium
NATIGTGTK

SEQ ID NO: 1344571 - protein, 10 aa, Mycobacterium
NATPTGIPET

SEQ ID NO: 1344572 - protein, 8 aa, Mycobacterium
NAYPEPQF

SEQ ID NO: 1344573 - protein, 11 aa, Mycobacterium
NDAAGQPLTGA

SEQ ID NO: 1344574 - protein, 5 aa, Mycobacterium
NDAEW

SEQ ID NO: 1344575 - protein, 6 aa, Mycobacterium
NDAGDD

SEQ ID NO: 1344576 - protein, 10 aa, Mycobacterium
NDAKCDVASN

SEQ ID NO: 1344577 - protein, 15 aa, Mycobacterium
NDAPASSSDYTVDPR

SEQ ID NO: 1344578 - protein, 8 aa, Mycobacterium
NDDTPARA

SEQ ID NO: 1344579 - protein, 8 aa, Mycobacterium
NDETAGQF

SEQ ID NO: 1344580 - protein, 4 aa, Mycobacterium
NDGA

SEQ ID NO: 1344581 - protein, 10 aa, Mycobacterium
NDGLDDANGE

SEQ ID NO: 1344582 - protein, 6 aa, Mycobacterium
NDGQVE

SEQ ID NO: 1344583 - protein, 8 aa, Mycobacterium
NDNPPEQI

SEQ ID NO: 1344584 - protein, 7 aa, Mycobacterium
NDPAATN

SEQ ID NO: 1344585 - protein, 8 aa, Mycobacterium
NDPDEVAN

SEQ ID NO: 1344586 - protein, 6 aa, Mycobacterium
NDPDPL

SEQ ID NO: 1344587 - protein, 4 aa, Mycobacterium
NDPL

SEQ ID NO: 1344588 - protein, 9 aa, Mycobacterium
NDPSTNGPV

SEQ ID NO: 1344589 - protein, 6 aa, Mycobacterium
NDPYRF

SEQ ID NO: 1344590 - protein, 9 aa, Mycobacterium
NDSLGPEAV

SEQ ID NO: 1344591 - protein, 10 aa, Mycobacterium
NDSSLTDEAA

SEQ ID NO: 1344592 - protein, 28 aa, Mycobacterium
NDVRNKRKLGPAGPIEFPPDSGPRASIN

SEQ ID NO: 1344593 - protein, 7 aa, Mycobacterium
NEAGVDG

SEQ ID NO: 1344594 - protein, 14 aa, Mycobacterium
NEAVAGKKSVDDAL

SEQ ID NO: 1344595 - protein, 8 aa, Mycobacterium
NEGGDDGL

SEQ ID NO: 1344596 - protein, 12 aa, Mycobacterium
NEGSPGRGPYLA

SEQ ID NO: 1344597 - protein, 7 aa, Mycobacterium
NELSGRT

SEQ ID NO: 1344598 - protein, 9 aa, Mycobacterium
NEMDTGNVT

SEQ ID NO: 1344599 - protein, 16 aa, Mycobacterium
NEPHNGTWGGGGATDW

SEQ ID NO: 1344600 - protein, 13 aa, Mycobacterium
NEPRDDNVERPPA

SEQ ID NO: 1344601 - protein, 19 aa, Mycobacterium
NEQQRPDDVTGPGSPDTPW

SEQ ID NO: 1344602 - protein, 6 aa, Mycobacterium
NEQTDD

SEQ ID NO: 1344603 - protein, 8 aa, Mycobacterium
NERATGKQ

SEQ ID NO: 1344604 - protein, 6 aa, Mycobacterium
NERDAQ

SEQ ID NO: 1344605 - protein, 7 aa, Mycobacterium
NERDPEL

SEQ ID NO: 1344606 - protein, 11 aa, Mycobacterium
NFGSGSTGRKL

SEQ ID NO: 1344607 - protein, 4 aa, Mycobacterium
NFPN

SEQ ID NO: 1344608 - protein, 4 aa, Mycobacterium
NFQN

SEQ ID NO: 1344609 - protein, 7 aa, Mycobacterium
NGASFEQ

SEQ ID NO: 1344610 - protein, 19 aa, Mycobacterium
NGCTTDPKRDRRLDEAARR

SEQ ID NO: 1344611 - protein, 9 aa, Mycobacterium
NGDEPGENG

SEQ ID NO: 1344612 - protein, 8 aa, Mycobacterium
NGDNEVGA

SEQ ID NO: 1344613 - protein, 9 aa, Mycobacterium
NGDTALTTT

SEQ ID NO: 1344614 - protein, 11 aa, Mycobacterium
NGEEQARAELP

SEQ ID NO: 1344615 - protein, 20 aa, Mycobacterium
NGEQPQTTSTSRDDTGGRDV

SEQ ID NO: 1344616 - protein, 33 aa, Mycobacterium
NGGAGGKGGDAVYQNGVKKNGALAGGRGGDSGY

SEQ ID NO: 1344617 - protein, 6 aa, Mycobacterium
NGGAVT

SEQ ID NO: 1344618 - protein, 13 aa, Mycobacterium
NGGDGANGGVGGA

SEQ ID NO: 1344619 - protein, 14 aa, Mycobacterium
NGGDGANGGVGGAA

SEQ ID NO: 1344620 - protein, 12 aa, Mycobacterium
NGGGSPDGEPGF

SEQ ID NO: 1344621 - protein, 14 aa, Mycobacterium
NGGNGAHGGTGGDG

SEQ ID NO: 1344622 - protein, 45 aa, Mycobacterium
NGGNGGAGGSDSNNLNVADDPATTNVNESAQNNAAGGAGGAGGVG

SEQ ID NO: 1344623 - protein, 29 aa, Mycobacterium
NGGNRLSATGGALAAPIGRATIAAALREA

SEQ ID NO: 1344624 - protein, 34 aa, Mycobacterium
NGGRGGDALTSGGPAGRGGDAGLFGNGGDGGTGF

SEQ ID NO: 1344625 - protein, 8 aa, Mycobacterium
NGGRKYGG

SEQ ID NO: 1344626 - protein, 8 aa, Mycobacterium
NGGRPDRF

SEQ ID NO: 1344627 - protein, 7 aa, Mycobacterium
NGGTAAD

SEQ ID NO: 1344628 - protein, 7 aa, Mycobacterium
NGGYGGV

SEQ ID NO: 1344629 - protein, 4 aa, Mycobacterium
NGHN

SEQ ID NO: 1344630 - protein, 16 aa, Mycobacterium
NGIEESPVKRGDPGAP

SEQ ID NO: 1344631 - protein, 217 aa, Mycobacterium
NGNGGHGGDGGSADSANGNATGGSGGRGGLAHSNAGGTGGNGGNGGDAEADDAGKTAKGGNGGAGGTSGTGQGGSGGNGGNAVGDDAHAVGGSGGAGGGVRLGTGGDGGDGGDAVSEDGNATGGKGGDGGSVDLTGGGGGAGGEGGDADGDEKATGGSGGSGGTGGLGGDGGAGGDGGDAVADDEGGATAGSGGDGGFGGTDGDDGSASDGADAPAT

SEQ ID NO: 1344632 - protein, 6 aa, Mycobacterium
NGNTPA

SEQ ID NO: 1344633 - protein, 15 aa, Mycobacterium
NGPAGSGWHTHPGPE

SEQ ID NO: 1344634 - protein, 11 aa, Mycobacterium
NGPAGSPPNPA

SEQ ID NO: 1344635 - protein, 6 aa, Mycobacterium
NGPLPS

SEQ ID NO: 1344636 - protein, 9 aa, Mycobacterium
NGPQDVADA

SEQ ID NO: 1344637 - protein, 5 aa, Mycobacterium
NGPTV

SEQ ID NO: 1344638 - protein, 13 aa, Mycobacterium
NGQPNELGGGDLP

SEQ ID NO: 1344639 - protein, 7 aa, Mycobacterium
NGQTGAG

SEQ ID NO: 1344640 - protein, 6 aa, Mycobacterium
NGRAQE

SEQ ID NO: 1344641 - protein, 59 aa, Mycobacterium
NGRASGGGKAGDGGRGGSGGLGGDGGDSALGPAGAGGTGGNANAGGKGGNGGNGGTGGF

SEQ ID NO: 1344642 - protein, 9 aa, Mycobacterium
NGRQPASGM

SEQ ID NO: 1344643 - protein, 103 aa, Mycobacterium
NGSGIAHADEGAGSAPSASASQDDRGGSQESTNDDDNQNNKNDEDNEPTEDNGPTGDGDTDEDDTDEDDETPDLDDTDELDDDTELDAEDDLGTGDELGAGDF

SEQ ID NO: 1344644 - protein, 12 aa, Mycobacterium
NGSLTGYGGGLD

SEQ ID NO: 1344645 - protein, 12 aa, Mycobacterium
NGSTPERPLPAG

SEQ ID NO: 1344646 - protein, 13 aa, Mycobacterium
NGSVPFGGNTTQV

SEQ ID NO: 1344647 - protein, 9 aa, Mycobacterium
NGTAGATQS

SEQ ID NO: 1344648 - protein, 80 aa, Mycobacterium
NGTAGPGGAAGAIPGGPAGEAGPGGASGVIPGGPGGAAGPEGATGAIPGGPAGTAGPGGASGSLNPGGIGGSAGPDGASG

SEQ ID NO: 1344649 - protein, 5 aa, Mycobacterium
NGTIP

SEQ ID NO: 1344650 - protein, 5 aa, Mycobacterium
NGTKV

SEQ ID NO: 1344651 - protein, 32 aa, Mycobacterium
NGTPTPKTPAAAPPGQAGEDLANEPEVGTGYR

SEQ ID NO: 1344652 - protein, 7 aa, Mycobacterium
NGTSGPL

SEQ ID NO: 1344653 - protein, 8 aa, Mycobacterium
NGTTAAST

SEQ ID NO: 1344654 - protein, 7 aa, Mycobacterium
NGTTGEI

SEQ ID NO: 1344655 - protein, 4 aa, Mycobacterium
NGVP

SEQ ID NO: 1344656 - protein, 13 aa, Mycobacterium
NGVPPRDRRDRDR

SEQ ID NO: 1344657 - protein, 11 aa, Mycobacterium
NGVSQSASRLG

SEQ ID NO: 1344658 - protein, 6 aa, Mycobacterium
NGWEGS

SEQ ID NO: 1344659 - protein, 25 aa, Mycobacterium
NGYDPAEVTAPATQAAFGGAADPVS

SEQ ID NO: 1344660 - protein, 10 aa, Mycobacterium
NHPNCTPGIQ

SEQ ID NO: 1344661 - protein, 7 aa, Mycobacterium
NIEPNSR

SEQ ID NO: 1344662 - protein, 7 aa, Mycobacterium
NIERNSR

SEQ ID NO: 1344663 - protein, 19 aa, Mycobacterium
NIQSPGPWRRNATPEQTAG

SEQ ID NO: 1344664 - protein, 7 aa, Mycobacterium
NISPTGH

SEQ ID NO: 1344665 - protein, 26 aa, Mycobacterium
NISRTGGQEQGPGRRTLDEILQRLEK

SEQ ID NO: 1344666 - protein, 9 aa, Mycobacterium
NKKTEDPDL

SEQ ID NO: 1344667 - protein, 8 aa, Mycobacterium
NKNQSAQV

SEQ ID NO: 1344668 - protein, 17 aa, Mycobacterium
NKRAGQVPVTGQDATVE

SEQ ID NO: 1344669 - protein, 6 aa, Mycobacterium
NKRDEH

SEQ ID NO: 1344670 - protein, 10 aa, Mycobacterium
NKRERSDTFD

SEQ ID NO: 1344671 - protein, 9 aa, Mycobacterium
NKSAATADS

SEQ ID NO: 1344672 - protein, 27 aa, Mycobacterium
NLDNARDTDPVPLNRGAQHALDQLGAA

SEQ ID NO: 1344673 - protein, 7 aa, Mycobacterium
NLPENST

SEQ ID NO: 1344674 - protein, 15 aa, Mycobacterium
NLPENSTAKVAQTSL

SEQ ID NO: 1344675 - protein, 18 aa, Mycobacterium
NLPGYENLGDGSESELSG

SEQ ID NO: 1344676 - protein, 8 aa, Mycobacterium
NLRGSGAD

SEQ ID NO: 1344677 - protein, 5 aa, Mycobacterium
NLRPG

SEQ ID NO: 1344678 - protein, 6 aa, Mycobacterium
NLTTGY

SEQ ID NO: 1344679 - protein, 6 aa, Mycobacterium
NNAAER

SEQ ID NO: 1344680 - protein, 14 aa, Mycobacterium
NNAPPQPLPAGARA

SEQ ID NO: 1344681 - protein, 10 aa, Mycobacterium
NNGQSATAIS

SEQ ID NO: 1344682 - protein, 4 aa, Mycobacterium
NNGT

SEQ ID NO: 1344683 - protein, 6 aa, Mycobacterium
NNIDAP

SEQ ID NO: 1344684 - protein, 9 aa, Mycobacterium
NNIDKSVGS

SEQ ID NO: 1344685 - protein, 8 aa, Mycobacterium
NNIQPNSR

SEQ ID NO: 1344686 - protein, 8 aa, Mycobacterium
NNSGYADD

SEQ ID NO: 1344687 - protein, 13 aa, Mycobacterium
NNTMSDEPHNEVD

SEQ ID NO: 1344688 - protein, 7 aa, Mycobacterium
NNTPGDK

SEQ ID NO: 1344689 - protein, 42 aa, Mycobacterium; identical to SEQ ID NO: 1183325

SEQ ID NO: 1344690 - protein, 51 aa, Mycobacterium
NPAEAPAPITPTSTSETSSTETTTPTTPTSTETPPPAPAEAPTVPAAEAPI

SEQ ID NO: 1344691 - protein, 5 aa, Mycobacterium
NPAEY

SEQ ID NO: 1344692 - protein, 6 aa, Mycobacterium
NPAGDD

SEQ ID NO: 1344693 - protein, 4 aa, Mycobacterium
NPAL

SEQ ID NO: 1344694 - protein, 15 aa, Mycobacterium
NPASSGAQGNSNVTN

SEQ ID NO: 1344695 - protein, 6 aa, Mycobacterium
NPATTT

SEQ ID NO: 1344696 - protein, 13 aa, Mycobacterium
NPDAARAALNGAP

SEQ ID NO: 1344697 - protein, 6 aa, Mycobacterium
NPDLDW

SEQ ID NO: 1344698 - protein, 8 aa, Mycobacterium
NPEDVNGL

SEQ ID NO: 1344699 - protein, 10 aa, Mycobacterium
NPENKFGGDD

SEQ ID NO: 1344700 - protein, 7 aa, Mycobacterium
NPETRTV

SEQ ID NO: 1344701 - protein, 5 aa, Mycobacterium
NPGAS

SEQ ID NO: 1344702 - protein, 4 aa, Mycobacterium
NPGD

SEQ ID NO: 1344703 - protein, 9 aa, Mycobacterium
NPGGGHGRT

SEQ ID NO: 1344704 - protein, 8 aa, Mycobacterium
NPGRKYGG

SEQ ID NO: 1344705 - protein, 11 aa, Mycobacterium
NPHRSRPANVD

SEQ ID NO: 1344706 - protein, 5 aa, Mycobacterium
NPIGL

SEQ ID NO: 1344707 - protein, 5 aa, Mycobacterium
NPKVA

SEQ ID NO: 1344708 - protein, 9 aa, Mycobacterium
NPLRSDNGK

SEQ ID NO: 1344709 - protein, 6 aa, Mycobacterium
NPNGVT

SEQ ID NO: 1344710 - protein, 39 aa, Mycobacterium
NPNPQPPAPPSPAAVAAPAPAAPVPPPPVPPPPVPFGPQ

SEQ ID NO: 1344711 - protein, 6 aa, Mycobacterium
NPPATP

SEQ ID NO: 1344712 - protein, 7 aa, Mycobacterium
NPPNPVL

SEQ ID NO: 1344713 - protein, 24 aa, Mycobacterium
NPQRDRRDVEYGGGSAFDGDDDDD

SEQ ID NO: 1344714 - protein, 6 aa, Mycobacterium
NPQVED

SEQ ID NO: 1344715 - protein, 4 aa, Mycobacterium
NPQW

SEQ ID NO: 1344716 - protein, 8 aa, Mycobacterium
NPRTSTVG

SEQ ID NO: 1344717 - protein, 18 aa, Mycobacterium
NPSAKFGSPVSARGTFAG

SEQ ID NO: 1344718 - protein, 10 aa, Mycobacterium
NPSARVGQPL

SEQ ID NO: 1344719 - protein, 21 aa, Mycobacterium
NPSPEPPIAPAEANGEGAAQP

SEQ ID NO: 1344720 - protein, 8 aa, Mycobacterium
NPSRPNGG

SEQ ID NO: 1344721 - protein, 4 aa, Mycobacterium
NPTA

SEQ ID NO: 1344722 - protein, 11 aa, Mycobacterium
NPTIGTNSPAC

SEQ ID NO: 1344723 - protein, 7 aa, Mycobacterium
NPTPTTQ

SEQ ID NO: 1344724 - protein, 8 aa, Mycobacterium
NPTSQAGI

SEQ ID NO: 1344725 - protein, 13 aa, Mycobacterium
NPVAQAKNGDTHI

SEQ ID NO: 1344726 - protein, 26 aa, Mycobacterium
NPVNEEEGAAGEEIPGQTGNPVPWSG

SEQ ID NO: 1344727 - protein, 9 aa, Mycobacterium
NPVPNGDRL

SEQ ID NO: 1344728 - protein, 13 aa, Mycobacterium
NPWTGDPDPNAPF

SEQ ID NO: 1344729 - protein, 19 aa, Mycobacterium
NPYTPGYETINPENPSEYQ

SEQ ID NO: 1344730 - protein, 7 aa, Mycobacterium
NQAGDAA

SEQ ID NO: 1344731 - protein, 34 aa, Mycobacterium
NQAPTNGSYSVGQPNPASGKVAGTVSATDPERDA

SEQ ID NO: 1344732 - protein, 12 aa, Mycobacterium
NQIVDSAGNPVQ

SEQ ID NO: 1344733 - protein, 9 aa, Mycobacterium
NQLGGRTVG

SEQ ID NO: 1344734 - protein, 7 aa, Mycobacterium
NQPGEVD

SEQ ID NO: 1344735 - protein, 10 aa, Mycobacterium
NQPRPAAEAN

SEQ ID NO: 1344736 - protein, 5 aa, Mycobacterium
NQQAG

SEQ ID NO: 1344737 - protein, 23 aa, Mycobacterium
NQRDEEFTPPGAEEGDLPQPPTG

SEQ ID NO: 1344738 - protein, 16 aa, Mycobacterium
NQRPTADATTSGPGLD

SEQ ID NO: 1344739 - protein, 7 aa, Mycobacterium
NQSNALQ

SEQ ID NO: 1344740 - protein, 8 aa, Mycobacterium
NRAQLKPA

SEQ ID NO: 1344741 - protein, 7 aa, Mycobacterium
NRCRGDA

SEQ ID NO: 1344742 - protein, 5 aa, Mycobacterium
NRDYP

SEQ ID NO: 1344743 - protein, 7 aa, Mycobacterium
NRGFTQE

SEQ ID NO: 1344744 - protein, 23 aa, Mycobacterium
NRNINGDIGSDGSTPQDRANAAG

SEQ ID NO: 1344745 - protein, 6 aa, Mycobacterium
NRPAQD

SEQ ID NO: 1344746 - protein, 7 aa, Mycobacterium
NRPQFKP

SEQ ID NO: 1344747 - protein, 9 aa, Mycobacterium
NRQPPRAPE

SEQ ID NO: 1344748 - protein, 7 aa, Mycobacterium
NRQRDDI

SEQ ID NO: 1344749 - protein, 8 aa, Mycobacterium
NRSETLDE

SEQ ID NO: 1344750 - protein, 9 aa, Mycobacterium
NRTPPKTQA

SEQ ID NO: 1344751 - protein, 14 aa, Mycobacterium
NRTSPGHTTTPPDS

SEQ ID NO: 1344752 - protein, 6 aa, Mycobacterium
NRYSGR

SEQ ID NO: 1344753 - protein, 13 aa, Mycobacterium
NSAPLGAADASGR

SEQ ID NO: 1344754 - protein, 27 aa, Mycobacterium
NSAQPDASSQDEINAANQQKGRSSAPD

SEQ ID NO: 1344755 - protein, 8 aa, Mycobacterium
NSATGTDS

SEQ ID NO: 1344756 - protein, 9 aa, Mycobacterium
NSDADHDRL

SEQ ID NO: 1344757 - protein, 9 aa, Mycobacterium
NSDSPEGIA

SEQ ID NO: 1344758 - protein, 7 aa, Mycobacterium
NSFPSGA

SEQ ID NO: 1344759 - protein, 10 aa, Mycobacterium
NSGEAEKPRT

SEQ ID NO: 1344760 - protein, 5 aa, Mycobacterium
NSGGT

SEQ ID NO: 1344761 - protein, 31 aa, Mycobacterium
NSGNDAAASPAPAPAPVQTSSAAPAASHNQT

SEQ ID NO: 1344762 - protein, 5 aa, Mycobacterium
NSGRL

SEQ ID NO: 1344763 - protein, 4 aa, Mycobacterium
NSHP

SEQ ID NO: 1344764 - protein, 14 aa, Mycobacterium
NSKGEPHLTGTVRG

SEQ ID NO: 1344765 - protein, 9 aa, Mycobacterium
NSKGGTTTS

SEQ ID NO: 1344766 - protein, 7 aa, Mycobacterium
NSNAPAD

SEQ ID NO: 1344767 - protein, 10 aa, Mycobacterium
NSNDFAGEGV

SEQ ID NO: 1344768 - protein, 5 aa, Mycobacterium
NSPAG

SEQ ID NO: 1344769 - protein, 6 aa, Mycobacterium
NSPAMA

SEQ ID NO: 1344770 - protein, 10 aa, Mycobacterium
NSPDKVAPAT

SEQ ID NO: 1344771 - protein, 4 aa, Mycobacterium
NSQG

SEQ ID NO: 1344772 - protein, 110 aa, Mycobacterium
NSSGVAYADSDTESSVSSSGADATPAGSSTPGGADESPEAQTGPDSGGDADDDEDGEDAEAGDTDEPGDVLDPDSDPESGADDEQAAEESGDNSAAPGDSGETSGTAPVV

SEQ ID NO: 1344773 - protein, 122 aa, Mycobacterium
NSSSGLAYADDGSDAGSGAGTSVASGSSEPGGESSSGAGERTQSPDDHEESELGDANDDDPDDLTEQSGETPSANDDDPDDLTEESEETPSADDDEHTGAVEAEPPLDDRIDPTGDESLEPR

SEQ ID NO: 1344774 - protein, 8 aa, Mycobacterium
NSTAGGAY

SEQ ID NO: 1344775 - protein, 8 aa, Mycobacterium
NSTSLTVT

SEQ ID NO: 1344776 - protein, 4 aa, Mycobacterium
NSTY

SEQ ID NO: 1344777 - protein, 6 aa, Mycobacterium
NSVPGP

SEQ ID NO: 1344778 - protein, 7 aa, Mycobacterium
NSVPTSL

SEQ ID NO: 1344779 - protein, 13 aa, Mycobacterium
NSYAQASGAGSRA

SEQ ID NO: 1344780 - protein, 5 aa, Mycobacterium
NSYMT

SEQ ID NO: 1344781 - protein, 7 aa, Mycobacterium
NTAADQL

SEQ ID NO: 1344782 - protein, 9 aa, Mycobacterium
NTAAPANSL

SEQ ID NO: 1344783 - protein, 26 aa, Mycobacterium
NTAPTAPVPATVPAATPGRANGCATM

SEQ ID NO: 1344784 - protein, 18 aa, Mycobacterium
NTDGGMYTQPDGASDWQM

SEQ ID NO: 1344785 - protein, 6 aa, Mycobacterium
NTDQLS

SEQ ID NO: 1344786 - protein, 4 aa, Mycobacterium
NTFD

SEQ ID NO: 1344787 - protein, 4 aa, Mycobacterium
NTGA

SEQ ID NO: 1344788 - protein, 6 aa, Mycobacterium
NTGTSF

SEQ ID NO: 1344789 - protein, 6 aa, Mycobacterium
NTIDES

SEQ ID NO: 1344790 - protein, 15 aa, Mycobacterium
NTLELPDPAPGGPPY

SEQ ID NO: 1344791 - protein, 14 aa, Mycobacterium
NTNIVTDSSGNPYP

SEQ ID NO: 1344792 - protein, 4 aa, Mycobacterium
NTNS

SEQ ID NO: 1344793 - protein, 10 aa, Mycobacterium
NTNSENPNTR

SEQ ID NO: 1344794 - protein, 6 aa, Mycobacterium
NTNVGS

SEQ ID NO: 1344795 - protein, 13 aa, Mycobacterium
NTPLGRAGQPEDV

SEQ ID NO: 1344796 - protein, 9 aa, Mycobacterium
NTPQGLRAK

SEQ ID NO: 1344797 - protein, 8 aa, Mycobacterium
NTQGVVNS

SEQ ID NO: 1344798 - protein, 7 aa, Mycobacterium
NTSPDVA

SEQ ID NO: 1344799 - protein, 40 aa, Mycobacterium
NTTAPSTTTTSPSPTTRARVPDPTPSAPRSPGVPAPGGLA

SEQ ID NO: 1344800 - protein, 41 aa, Mycobacterium
NTTAPSTTTTSPSPTTRARVPDPTPSAPRSPGVPAPGGLAA

SEQ ID NO: 1344801 - protein, 17 aa, Mycobacterium
NTTSITPANVNTSTQNV

SEQ ID NO: 1344802 - protein, 4 aa, Mycobacterium
NTVE

SEQ ID NO: 1344803 - protein, 10 aa, Mycobacterium
NTVPEAIKST

SEQ ID NO: 1344804 - protein, 6 aa, Mycobacterium
NVDPAP

SEQ ID NO: 1344805 - protein, 8 aa, Mycobacterium
NVEGNSCG

SEQ ID NO: 1344806 - protein, 15 aa, Mycobacterium
NVESGRIATQPVGTG

SEQ ID NO: 1344807 - protein, 19 aa, Mycobacterium
NVPQEAPQEFASAITDVTR

SEQ ID NO: 1344808 - protein, 10 aa, Mycobacterium
NVQIDDGGAV

SEQ ID NO: 1344809 - protein, 10 aa, Mycobacterium
NVRQAGGRVT

SEQ ID NO: 1344810 - protein, 21 aa, Mycobacterium
NWKGDPNATLSGEPIPDVPPD

SEQ ID NO: 1344811 - protein, 9 aa, Mycobacterium
NWTHSGPDT

SEQ ID NO: 1344812 - protein, 15 aa, Mycobacterium
NYGKTVANAQGTYAG

SEQ ID NO: 1344813 - protein, 9 aa, Mycobacterium
NYPEDSGYV

SEQ ID NO: 1344814 - protein, 8 aa, Mycobacterium
NYPQLNSS

SEQ ID NO: 1344815 - protein, 4 aa, Mycobacterium
NYTQ

SEQ ID NO: 1344816 - protein, 4 aa, Mycobacterium
PAAA

SEQ ID NO: 1344817 - protein, 10 aa, Mycobacterium
PAAAEGPDGS

SEQ ID NO: 1344818 - protein, 10 aa, Mycobacterium
PAAAEPSPGV

SEQ ID NO: 1344819 - protein, 17 aa, Mycobacterium
PAAAPAPVPGAPVATPV

SEQ ID NO: 1344820 - protein, 18 aa, Mycobacterium
PAAAPAPVPGAPVATPVA

SEQ ID NO: 1344821 - protein, 37 aa, Mycobacterium
PAAATAPASPGPGPAPATPTPTTPLPPPLPAEAGHRG

SEQ ID NO: 1344822 - protein, 9 aa, Mycobacterium
PAADPDRYA

SEQ ID NO: 1344823 - protein, 9 aa, Mycobacterium
PAAEPGRPR

SEQ ID NO: 1344824 - protein, 4 aa, Mycobacterium
PAAF

SEQ ID NO: 1344825 - protein, 17 aa, Mycobacterium
PAAGATPPAPPAPPAAV

SEQ ID NO: 1344826 - protein, 17 aa, Mycobacterium
PAAGATPPGPPAPPAAV

SEQ ID NO: 1344827 - protein, 35 aa, Mycobacterium
PAAGAVPPAPRAVGAPAGGSGGAGAPAAPPAPPAA

SEQ ID NO: 1344828 - protein, 7 aa, Mycobacterium
PAAGPEF

SEQ ID NO: 1344829 - protein, 5 aa, Mycobacterium
PAAKA

SEQ ID NO: 1344830 - protein, 7 aa, Mycobacterium
PAAPAAT

SEQ ID NO: 1344831 - protein, 14 aa, Mycobacterium
PAAPAPAAPACGDP

SEQ ID NO: 1344832 - protein, 40 aa, Mycobacterium
PAAPREDDAPPTEPDEDTGSAAAVASSETGSSEADGVEPA

SEQ ID NO: 1344833 - protein, 4 aa, Mycobacterium
PAAQ

SEQ ID NO: 1344834 - protein, 19 aa, Mycobacterium
PAAQAAPAGPGNAADTIAS

SEQ ID NO: 1344835 - protein, 12 aa, Mycobacterium
PAASAEPTGGPW

SEQ ID NO: 1344836 - protein, 7 aa, Mycobacterium
PADDAAA

SEQ ID NO: 1344837 - protein, 8 aa, Mycobacterium
PADDAAAG

SEQ ID NO: 1344838 - protein, 6 aa, Mycobacterium
PADLAA

SEQ ID NO: 1344839 - protein, 12 aa, Mycobacterium
PADPQAAAAAGA

SEQ ID NO: 1344840 - protein, 21 aa, Mycobacterium
PADQQPYADESEYQAAPDQPE

SEQ ID NO: 1344841 - protein, 7 aa, Mycobacterium
PADTEVD

SEQ ID NO: 1344842 - protein, 10 aa, Mycobacterium
PAEAQRAADI

SEQ ID NO: 1344843 - protein, 10 aa, Mycobacterium
PAEDSDGVPL

SEQ ID NO: 1344844 - protein, 8 aa, Mycobacterium
PAEELGGG

SEQ ID NO: 1344845 - protein, 9 aa, Mycobacterium
PAEIDQRRG

SEQ ID NO: 1344846 - protein, 11 aa, Mycobacterium
PAENSADMRAS

SEQ ID NO: 1344847 - protein, 6 aa, Mycobacterium
PAETPV

SEQ ID NO: 1344848 - protein, 21 aa, Mycobacterium
PAFTPQGDGADWGNGNPPPIV

SEQ ID NO: 1344849 - protein, 11 aa, Mycobacterium
PAGAGGPTACR

SEQ ID NO: 1344850 - protein, 7 aa, Mycobacterium
PAGDGDV

SEQ ID NO: 1344851 - protein, 16 aa, Mycobacterium
PAGKSQSLDVTLGKAG

SEQ ID NO: 1344852 - protein, 10 aa, Mycobacterium
PAGNDPERYG

SEQ ID NO: 1344853 - protein, 26 aa, Mycobacterium
PAGPPPPPAPALPGMPPAPGPAPGPV

SEQ ID NO: 1344854 - protein, 6 aa, Mycobacterium
PAHADP

SEQ ID NO: 1344855 - protein, 11 aa, Mycobacterium
PAHAQPPNCTA

SEQ ID NO: 1344856 - protein, 4 aa, Mycobacterium
PAHG

SEQ ID NO: 1344857 - protein, 4 aa, Mycobacterium
PAHR

SEQ ID NO: 1344858 - protein, 4 aa, Mycobacterium
PAIR

SEQ ID NO: 1344859 - protein, 6 aa, Mycobacterium
PAITDR

SEQ ID NO: 1344860 - protein, 13 aa, Mycobacterium
PAKIGEKGMSPNH

SEQ ID NO: 1344861 - protein, 7 aa, Mycobacterium
PAKLNET

SEQ ID NO: 1344862 - protein, 9 aa, Mycobacterium
PAKNRNGTL

SEQ ID NO: 1344863 - protein, 15 aa, Mycobacterium
PALAQPAPPPPPPVP

SEQ ID NO: 1344864 - protein, 9 aa, Mycobacterium
PALGTAGGS

SEQ ID NO: 1344865 - protein, 9 aa, Mycobacterium
PALPAPATV

SEQ ID NO: 1344866 - protein, 23 aa, Mycobacterium
PALPPSPAAVPSSPPGYLATPDG

SEQ ID NO: 1344867 - protein, 12 aa, Mycobacterium
PAMPTDTGIPTT

SEQ ID NO: 1344868 - protein, 12 aa, Mycobacterium
PANAAPTATARS

SEQ ID NO: 1344869 - protein, 11 aa, Mycobacterium
PANAAPTDAAT

SEQ ID NO: 1344870 - protein, 10 aa, Mycobacterium
PANCRTDSFG

SEQ ID NO: 1344871 - protein, 7 aa, Mycobacterium
PANSAPA

SEQ ID NO: 1344872 - protein, 10 aa, Mycobacterium
PANSAPRAKA

SEQ ID NO: 1344873 - protein, 10 aa, Mycobacterium
PANTASAAGG

SEQ ID NO: 1344874 - protein, 29 aa, Mycobacterium
PAPAAPAAPAAPAAPAAPPPPPGNSLNGV

SEQ ID NO: 1344875 - protein, 17 aa, Mycobacterium
PAPAAPAAPPPPGNSLN

SEQ ID NO: 1344876 - protein, 18 aa, Mycobacterium
PAPADSEADELSAAGEAL

SEQ ID NO: 1344877 - protein, 122 aa, Mycobacterium
PAPAGSSGTPLPAGSSGTPLPATSSGTPLPAGSSGTPLPATSSGTPLPAGSSGTPLPATSAGTPALAPGAPAPAPAAPAVPAQPAPQPASSGPAPVPVSTGDQAPVPHGQGVPTPTPTPVPV

SEQ ID NO: 1344878 - protein, 8 aa, Mycobacterium
PAPAPDVT

SEQ ID NO: 1344879 - protein, 4 aa, Mycobacterium
PAPD

SEQ ID NO: 1344880 - protein, 5 aa, Mycobacterium
PAPFQ

SEQ ID NO: 1344881 - protein, 6 aa, Mycobacterium
PAPGDA

SEQ ID NO: 1344882 - protein, 6 aa, Mycobacterium
PAPGRA

SEQ ID NO: 1344883 - protein, 13 aa, Mycobacterium
PAPGRLSAGGASR

SEQ ID NO: 1344884 - protein, 6 aa, Mycobacterium
PAPKGP

SEQ ID NO: 1344885 - protein, 27 aa, Mycobacterium
PAPKLGPPNNPLNLGPPTNPFNLPKIG

SEQ ID NO: 1344886 - protein, 8 aa, Mycobacterium
PAPKPGRQ

SEQ ID NO: 1344887 - protein, 12 aa, Mycobacterium
PAPMPAPPPGDT

SEQ ID NO: 1344888 - protein, 13 aa, Mycobacterium
PAPPSVSTIRSRR

SEQ ID NO: 1344889 - protein, 16 aa, Mycobacterium
PAPPTFPESPEELSTP

SEQ ID NO: 1344890 - protein, 11 aa, Mycobacterium
PAPQGDPDAPA

SEQ ID NO: 1344891 - protein, 6 aa, Mycobacterium
PAPQPV

SEQ ID NO: 1344892 - protein, 5 aa, Mycobacterium
PAPSA

SEQ ID NO: 1344893 - protein, 17 aa, Mycobacterium
PAPSAWPAERDRRELTG

SEQ ID NO: 1344894 - protein, 7 aa, Mycobacterium
PAPSRDV

SEQ ID NO: 1344895 - protein, 49 aa, Mycobacterium
PAPSVNNGQNPLPADQLPPPQSLAPVSDPLSPPGSGTVRCSGQQPNPCA

SEQ ID NO: 1344896 - protein, 57 aa, Mycobacterium
PAQGTAWADTPASDTTSSTADTDPKPSDATTKVDPQAQDSAADADTKDESKLEEPDL

SEQ ID NO: 1344897 - protein, 9 aa, Mycobacterium
PAQPQPQTV

SEQ ID NO: 1344898 - protein, 10 aa, Mycobacterium
PAQSTPPLAE

SEQ ID NO: 1344899 - protein, 10 aa, Mycobacterium
PAQYSAADGT

SEQ ID NO: 1344900 - protein, 10 aa, Mycobacterium
PARAAGVPTV

SEQ ID NO: 1344901 - protein, 6 aa, Mycobacterium
PARDKL

SEQ ID NO: 1344902 - protein, 20 aa, Mycobacterium
PARGARTVDEIGRDSGVPAA

SEQ ID NO: 1344903 - protein, 8 aa, Mycobacterium
PARPSGGV

SEQ ID NO: 1344904 - protein, 5 aa, Mycobacterium
PARTA

SEQ ID NO: 1344905 - protein, 17 aa, Mycobacterium
PASAAPPGGDDASGDID

SEQ ID NO: 1344906 - protein, 6 aa, Mycobacterium
PASAGV

SEQ ID NO: 1344907 - protein, 8 aa, Mycobacterium
PASAVQSV

SEQ ID NO: 1344908 - protein, 12 aa, Mycobacterium
PASGAFTSPDFP

SEQ ID NO: 1344909 - protein, 6 aa, Mycobacterium
PASGPR

SEQ ID NO: 1344910 - protein, 35 aa, Mycobacterium
PASGVTPPAPPAPGGPSVSSVENVSPPGPPAPPAA

SEQ ID NO: 1344911 - protein, 7 aa, Mycobacterium
PASRADY

SEQ ID NO: 1344912 - protein, 6 aa, Mycobacterium
PASSGT

SEQ ID NO: 1344913 - protein, 7 aa, Mycobacterium
PASSGTI

SEQ ID NO: 1344914 - protein, 11 aa, Mycobacterium
PASVSEALPRQ

SEQ ID NO: 1344915 - protein, 15 aa, Mycobacterium
PATAPVDAPDLASSR

SEQ ID NO: 1344916 - protein, 11 aa, Mycobacterium
PATASPSYGSN

SEQ ID NO: 1344917 - protein, 29 aa, Mycobacterium
PATDGPTGVRPNAEPPARDVEGTDGGAID

SEQ ID NO: 1344918 - protein, 16 aa, Mycobacterium
PATPATAAPDPCAASQ

SEQ ID NO: 1344919 - protein, 44 aa, Mycobacterium
PAVASPAGDSAQVPTDAAPPLPAEAQPTNPSDGLQGMMVPPGAG

SEQ ID NO: 1344920 - protein, 5 aa, Mycobacterium
PAVDG

SEQ ID NO: 1344921 - protein, 18 aa, Mycobacterium
PAVDPGTARGWSASGPGG

SEQ ID NO: 1344922 - protein, 18 aa, Mycobacterium
PAVDSSTVRGFSASGEGG

SEQ ID NO: 1344923 - protein, 10 aa, Mycobacterium
PAWRSTDASL

SEQ ID NO: 1344924 - protein, 11 aa, Mycobacterium
PAYAQSRSATN

SEQ ID NO: 1344925 - protein, 13 aa, Mycobacterium
PAYTEGPTIGNDA

SEQ ID NO: 1344926 - protein, 10 aa, Mycobacterium
PAYTGGPVMP

SEQ ID NO: 1344927 - protein, 11 aa, Mycobacterium
PAYTSGPAMQD

SEQ ID NO: 1344928 - protein, 14 aa, Mycobacterium
PCAPADPRNCSCPG

SEQ ID NO: 1344929 - protein, 10 aa, Mycobacterium
PDAADNDVDG

SEQ ID NO: 1344930 - protein, 10 aa, Mycobacterium
PDAAVDEDSE

SEQ ID NO: 1344931 - protein, 8 aa, Mycobacterium
PDAENRFS

SEQ ID NO: 1344932 - protein, 15 aa, Mycobacterium
PDALNGSWRSPQPER

SEQ ID NO: 1344933 - protein, 10 aa, Mycobacterium
PDAPAAGSPL

SEQ ID NO: 1344934 - protein, 8 aa, Mycobacterium
PDASARAD

SEQ ID NO: 1344935 - protein, 15 aa, Mycobacterium
PDATAAMNQTNERQQ

SEQ ID NO: 1344936 - protein, 9 aa, Mycobacterium
PDATSYQYQ

SEQ ID NO: 1344937 - protein, 7 aa, Mycobacterium
PDAVGGD

SEQ ID NO: 1344938 - protein, 8 aa, Mycobacterium
PDDRVGTA

SEQ ID NO: 1344939 - protein, 9 aa, Mycobacterium
PDDSGDGAG

SEQ ID NO: 1344940 - protein, 30 aa, Mycobacterium
PDDVKGQRPTQQGTEIEVTGSGGDIAVNET

SEQ ID NO: 1344941 - protein, 14 aa, Mycobacterium
PDEDGQPDPESVQS

SEQ ID NO: 1344942 - protein, 7 aa, Mycobacterium
PDELASA

SEQ ID NO: 1344943 - protein, 4 aa, Mycobacterium
PDEV

SEQ ID NO: 1344944 - protein, 15 aa, Mycobacterium
PDEVTSANGNDSVSA

SEQ ID NO: 1344945 - protein, 6 aa, Mycobacterium
PDGAQL

SEQ ID NO: 1344946 - protein, 15 aa, Mycobacterium
PDGGGATGAEAPKVL

SEQ ID NO: 1344947 - protein, 8 aa, Mycobacterium
PDGPQSPL

SEQ ID NO: 1344948 - protein, 5 aa, Mycobacterium
PDGPV

SEQ ID NO: 1344949 - protein, 5 aa, Mycobacterium
PDGRA

SEQ ID NO: 1344950 - protein, 8 aa, Mycobacterium
PDGSATGV

SEQ ID NO: 1344951 - protein, 5 aa, Mycobacterium
PDGTI

SEQ ID NO: 1344952 - protein, 7 aa, Mycobacterium
PDGTSFY

SEQ ID NO: 1344953 - protein, 8 aa, Mycobacterium
PDGTTAPG

SEQ ID NO: 1344954 - protein, 4 aa, Mycobacterium
PDIE

SEQ ID NO: 1344955 - protein, 10 aa, Mycobacterium
PDISPDGKTY

SEQ ID NO: 1344956 - protein, 16 aa, Mycobacterium
PDLADDPRFATNSDRC

SEQ ID NO: 1344957 - protein, 4 aa, Mycobacterium
PDLP

SEQ ID NO: 1344958 - protein, 7 aa, Mycobacterium
PDLPPGP

SEQ ID NO: 1344959 - protein, 4 aa, Mycobacterium
PDML

SEQ ID NO: 1344960 - protein, 5 aa, Mycobacterium
PDPGT

SEQ ID NO: 1344961 - protein, 6 aa, Mycobacterium
PDPNVP

SEQ ID NO: 1344962 - protein, 4 aa, Mycobacterium
PDQQ

SEQ ID NO: 1344963 - protein, 7 aa, Mycobacterium
PDQSEYS

SEQ ID NO: 1344964 - protein, 5 aa, Mycobacterium
PDQVN

SEQ ID NO: 1344965 - protein, 6 aa, Mycobacterium
PDQVNA

SEQ ID NO: 1344966 - protein, 9 aa, Mycobacterium
PDREPEGAP

SEQ ID NO: 1344967 - protein, 8 aa, Mycobacterium
PDREYTGR

SEQ ID NO: 1344968 - protein, 6 aa, Mycobacterium
PDRGFT

SEQ ID NO: 1344969 - protein, 8 aa, Mycobacterium
PDSDHSGT

SEQ ID NO: 1344970 - protein, 7 aa, Mycobacterium
PDSEGTV

SEQ ID NO: 1344971 - protein, 12 aa, Mycobacterium
PDSSLSNPDIDD

SEQ ID NO: 1344972 - protein, 10 aa, Mycobacterium
PDSTDTNGNV

SEQ ID NO: 1344973 - protein, 44 aa, Mycobacterium
PDTAPAALGQPGVTPATTGAAAVPAGVSAGVGAPAAPALPTRPV

SEQ ID NO: 1344974 - protein, 5 aa, Mycobacterium
PDTKP

SEQ ID NO: 1344975 - protein, 5 aa, Mycobacterium
PDVAD

SEQ ID NO: 1344976 - protein, 8 aa, Mycobacterium
PDVEPGSF

SEQ ID NO: 1344977 - protein, 12 aa, Mycobacterium
PDVESAKGKAVV

SEQ ID NO: 1344978 - protein, 8 aa, Mycobacterium
PDVRETTT

SEQ ID NO: 1344979 - protein, 7 aa, Mycobacterium
PDYSDPL

SEQ ID NO: 1344980 - protein, 4 aa, Mycobacterium
PEAA

SEQ ID NO: 1344981 - protein, 18 aa, Mycobacterium
PEAAAALPPAYKAADGGW

SEQ ID NO: 1344982 - protein, 28 aa, Mycobacterium
PEAEPTADEADDEADGGDPAEVAEPGVA

SEQ ID NO: 1344983 - protein, 11 aa, Mycobacterium
PEAESGPPLTS

SEQ ID NO: 1344984 - protein, 4 aa, Mycobacterium
PEAM

SEQ ID NO: 1344985 - protein, 5 aa, Mycobacterium
PEAQW

SEQ ID NO: 1344986 - protein, 5 aa, Mycobacterium
PEEAS

SEQ ID NO: 1344987 - protein, 5 aa, Mycobacterium
PEEGV

SEQ ID NO: 1344988 - protein, 4 aa, Mycobacterium
PEEV

SEQ ID NO: 1344989 - protein, 4 aa, Mycobacterium
PEGH

SEQ ID NO: 1344990 - protein, 4 aa, Mycobacterium
PEGL

SEQ ID NO: 1344991 - protein, 15 aa, Mycobacterium
PEGNRAPKAGSPAYT

SEQ ID NO: 1344992 - protein, 4 aa, Mycobacterium
PEGQ

SEQ ID NO: 1344993 - protein, 7 aa, Mycobacterium
PEGSPYQ

SEQ ID NO: 1344994 - protein, 6 aa, Mycobacterium
PEGTQS

SEQ ID NO: 1344995 - protein, 9 aa, Mycobacterium
PEHPSTDRL

SEQ ID NO: 1344996 - protein, 4 aa, Mycobacterium
PEIA

SEQ ID NO: 1344997 - protein, 10 aa, Mycobacterium
PEKAHGDAPD

SEQ ID NO: 1344998 - protein, 11 aa, Mycobacterium
PELAEDGKRLG

SEQ ID NO: 1344999 - protein, 11 aa, Mycobacterium
PELSGRAAGTL

SEQ ID NO: 1345000 - protein, 5 aa, Mycobacterium
PENPV

SEQ ID NO: 1345001 - protein, 5 aa, Mycobacterium
PEPET

SEQ ID NO: 1345002 - protein, 5 aa, Mycobacterium
PEPFD

SEQ ID NO: 1345003 - protein, 12 aa, Mycobacterium
PEPGSPGDVERD

SEQ ID NO: 1345004 - protein, 6 aa, Mycobacterium
PEPGWS

SEQ ID NO: 1345005 - protein, 4 aa, Mycobacterium
PEQA

SEQ ID NO: 1345006 - protein, 4 aa, Mycobacterium
PEQR

SEQ ID NO: 1345007 - protein, 7 aa, Mycobacterium
PERAAAE

SEQ ID NO: 1345008 - protein, 4 aa, Mycobacterium
PERC

SEQ ID NO: 1345009 - protein, 8 aa, Mycobacterium
PESGAAPV

SEQ ID NO: 1345010 - protein, 22 aa, Mycobacterium
PESIPGDSGAPVWQPASDGTAT

SEQ ID NO: 1345011 - protein, 4 aa, Mycobacterium
PESY

SEQ ID NO: 1345012 - protein, 12 aa, Mycobacterium
PETGAVTGDPEV

SEQ ID NO: 1345013 - protein, 11 aa, Mycobacterium
PETGGLYPRGN

SEQ ID NO: 1345014 - protein, 6 aa, Mycobacterium
PETHPE

SEQ ID NO: 1345015 - protein, 6 aa, Mycobacterium
PEVSPE

SEQ ID NO: 1345016 - protein, 5 aa, Mycobacterium
PEWKG

SEQ ID NO: 1345017 - protein, 7 aa, Mycobacterium
PEYGSDK

SEQ ID NO: 1345018 - protein, 6 aa, Mycobacterium
PEYKGR

SEQ ID NO: 1345019 - protein, 4 aa, Mycobacterium
PEYP

SEQ ID NO: 1345020 - protein, 20 aa, Mycobacterium
PEYPNGQALSPGAEVKADSV

SEQ ID NO: 1345021 - protein, 13 aa, Mycobacterium
PFPPDAPTPRPAA

SEQ ID NO: 1345022 - protein, 11 aa, Mycobacterium
PFPSPTDTAAR

SEQ ID NO: 1345023 - protein, 4 aa, Mycobacterium
PFRP

SEQ ID NO: 1345024 - protein, 18 aa, Mycobacterium
PGAAADPEIHADPQGPQE

SEQ ID NO: 1345025 - protein, 6 aa, Mycobacterium
PGAAHS

SEQ ID NO: 1345026 - protein, 5 aa, Mycobacterium
PGAAI

SEQ ID NO: 1345027 - protein, 14 aa, Mycobacterium
PGAAVERPILDVPV

SEQ ID NO: 1345028 - protein, 11 aa, Mycobacterium
PGAGSRTDPDL

SEQ ID NO: 1345029 - protein, 11 aa, Mycobacterium
PGAGYTATGRG

SEQ ID NO: 1345030 - protein, 12 aa, Mycobacterium
PGAGYTATGRGC

SEQ ID NO: 1345031 - protein, 6 aa, Mycobacterium
PGAPDM

SEQ ID NO: 1345032 - protein, 8 aa, Mycobacterium
PGAPQNAN

SEQ ID NO: 1345033 - protein, 11 aa, Mycobacterium
PGASPTDSAVL

SEQ ID NO: 1345034 - protein, 11 aa, Mycobacterium
PGATALPGGNM

SEQ ID NO: 1345035 - protein, 8 aa, Mycobacterium
PGATPVEV

SEQ ID NO: 1345036 - protein, 11 aa, Mycobacterium
PGDLAGKTGFT

SEQ ID NO: 1345037 - protein, 7 aa, Mycobacterium
PGEDHAG

SEQ ID NO: 1345038 - protein, 17 aa, Mycobacterium
PGETGQLNDPGPSAART

SEQ ID NO: 1345039 - protein, 9 aa, Mycobacterium
PGETPESRI

SEQ ID NO: 1345040 - protein, 6 aa, Mycobacterium
PGETTR

SEQ ID NO: 1345041 - protein, 8 aa, Mycobacterium
PGEWTDDT

SEQ ID NO: 1345042 - protein, 4 aa, Mycobacterium
PGFG

SEQ ID NO: 1345043 - protein, 4 aa, Mycobacterium
PGGD

SEQ ID NO: 1345044 - protein, 11 aa, Mycobacterium
PGGFDSTGDTT

SEQ ID NO: 1345045 - protein, 5 aa, Mycobacterium
PGGFG

SEQ ID NO: 1345046 - protein, 9 aa, Mycobacterium
PGGHRAQPL

SEQ ID NO: 1345047 - protein, 5 aa, Mycobacterium
PGGKT

SEQ ID NO: 1345048 - protein, 10 aa, Mycobacterium
PGGLRTTYEP

SEQ ID NO: 1345049 - protein, 11 aa, Mycobacterium
PGGNDDDLRGE

SEQ ID NO: 1345050 - protein, 10 aa, Mycobacterium
PGGPGASAVN

SEQ ID NO: 1345051 - protein, 13 aa, Mycobacterium
PGGPGKSGKESAA

SEQ ID NO: 1345052 - protein, 4 aa, Mycobacterium
PGGQ

SEQ ID NO: 1345053 - protein, 5 aa, Mycobacterium
PGGQT

SEQ ID NO: 1345054 - protein, 5 aa, Mycobacterium
PGGSE

SEQ ID NO: 1345055 - protein, 5 aa, Mycobacterium
PGGSF

SEQ ID NO: 1345056 - protein, 6 aa, Mycobacterium
PGGSQH

SEQ ID NO: 1345057 - protein, 7 aa, Mycobacterium
PGGSQHE

SEQ ID NO: 1345058 - protein, 6 aa, Mycobacterium
PGGTTG

SEQ ID NO: 1345059 - protein, 4 aa, Mycobacterium
PGHE

SEQ ID NO: 1345060 - protein, 14 aa, Mycobacterium
PGHGSGSGDTHAGS

SEQ ID NO: 1345061 - protein, 4 aa, Mycobacterium
PGHW

SEQ ID NO: 1345062 - protein, 8 aa, Mycobacterium
PGINANDV

SEQ ID NO: 1345063 - protein, 14 aa, Mycobacterium
PGIPSTPPGRPTIS

SEQ ID NO: 1345064 - protein, 19 aa, Mycobacterium
PGKRAASPKECRSDEPYVP

SEQ ID NO: 1345065 - protein, 8 aa, Mycobacterium
PGKRAPTW

SEQ ID NO: 1345066 - protein, 5 aa, Mycobacterium
PGLAA

SEQ ID NO: 1345067 - protein, 35 aa, Mycobacterium
PGLPGAGPSSVPAPGEPAPAPLAPATGDPAPAEDG

SEQ ID NO: 1345068 - protein, 13 aa, Mycobacterium
PGLPGGPPPPIGQ

SEQ ID NO: 1345069 - protein, 31 aa, Mycobacterium; identical to SEQ ID NO: 911568

SEQ ID NO: 1345070 - protein, 11 aa, Mycobacterium
PGPAGATESEL

SEQ ID NO: 1345071 - protein, 7 aa, Mycobacterium
PGPDGSA

SEQ ID NO: 1345072 - protein, 6 aa, Mycobacterium
PGPIDT

SEQ ID NO: 1345073 - protein, 8 aa, Mycobacterium
PGPSFPSI

SEQ ID NO: 1345074 - protein, 8 aa, Mycobacterium
PGPTERRT

SEQ ID NO: 1345075 - protein, 11 aa, Mycobacterium
PGPVTSAASAG

SEQ ID NO: 1345076 - protein, 5 aa, Mycobacterium
PGQAP

SEQ ID NO: 1345077 - protein, 7 aa, Mycobacterium
PGQAYTT

SEQ ID NO: 1345078 - protein, 8 aa, Mycobacterium
PGQSPMRR

SEQ ID NO: 1345079 - protein, 14 aa, Mycobacterium
PGREAYTRGGWSAR

SEQ ID NO: 1345080 - protein, 8 aa, Mycobacterium
PGRGPRRY

SEQ ID NO: 1345081 - protein, 19 aa, Mycobacterium
PGRPVRTATRNPAAPTGHD

SEQ ID NO: 1345082 - protein, 7 aa, Mycobacterium
PGRSREA

SEQ ID NO: 1345083 - protein, 5 aa, Mycobacterium
PGSDG

SEQ ID NO: 1345084 - protein, 4 aa, Mycobacterium
PGSF

SEQ ID NO: 1345085 - protein, 8 aa, Mycobacterium
PGSGATAV

SEQ ID NO: 1345086 - protein, 8 aa, Mycobacterium
PGSIASEA

SEQ ID NO: 1345087 - protein, 4 aa, Mycobacterium
PGSL

SEQ ID NO: 1345088 - protein, 9 aa, Mycobacterium
PGSPAYTYP

SEQ ID NO: 1345089 - protein, 7 aa, Mycobacterium
PGSPPEP

SEQ ID NO: 1345090 - protein, 5 aa, Mycobacterium
PGSPW

SEQ ID NO: 1345091 - protein, 6 aa, Mycobacterium
PGTAQG

SEQ ID NO: 1345092 - protein, 10 aa, Mycobacterium
PGTGTPDSDV

SEQ ID NO: 1345093 - protein, 9 aa, Mycobacterium
PGTPEVRND

SEQ ID NO: 1345094 - protein, 5 aa, Mycobacterium
PGTPR

SEQ ID NO: 1345095 - protein, 4 aa, Mycobacterium
PGTQ

SEQ ID NO: 1345096 - protein, 14 aa, Mycobacterium
PGTTTTPPAQQLPE

SEQ ID NO: 1345097 - protein, 4 aa, Mycobacterium
PGVE

SEQ ID NO: 1345098 - protein, 10 aa, Mycobacterium
PGVQGTGPGA

SEQ ID NO: 1345099 - protein, 7 aa, Mycobacterium
PGVVDPA

SEQ ID NO: 1345100 - protein, 9 aa, Mycobacterium
PGWADRSRD

SEQ ID NO: 1345101 - protein, 16 aa, Mycobacterium
PGWDGPTTGTPSELGG

SEQ ID NO: 1345102 - protein, 12 aa, Mycobacterium
PGWQGEKPEGID

SEQ ID NO: 1345103 - protein, 4 aa, Mycobacterium
PGYA

SEQ ID NO: 1345104 - protein, 17 aa, Mycobacterium
PGYEHPGDPTQPDNTHR

SEQ ID NO: 1345105 - protein, 4 aa, Mycobacterium
PGYS

SEQ ID NO: 1345106 - protein, 5 aa, Mycobacterium
PHDAV

SEQ ID NO: 1345107 - protein, 5 aa, Mycobacterium
PHPGT

SEQ ID NO: 1345108 - protein, 6 aa, Mycobacterium
PHPTSS

SEQ ID NO: 1345109 - protein, 6 aa, Mycobacterium
PHQPAV

SEQ ID NO: 1345110 - protein, 14 aa, Mycobacterium
PHRGEPDQQETTPT

SEQ ID NO: 1345111 - protein, 17 aa, Mycobacterium
PHRRTYGRASRRGADRT

SEQ ID NO: 1345112 - protein, 5 aa, Mycobacterium
PHWPR

SEQ ID NO: 1345113 - protein, 8 aa, Mycobacterium
PIAAQGPG

SEQ ID NO: 1345114 - protein, 15 aa, Mycobacterium
PIADDSGTAPIGGSA

SEQ ID NO: 1345115 - protein, 11 aa, Mycobacterium
PICNPTAPENW

SEQ ID NO: 1345116 - protein, 17 aa, Mycobacterium
PIDRTDADSAKSALTTA

SEQ ID NO: 1345117 - protein, 21 aa, Mycobacterium
PIEPGDIRPHSPVTEPRVGTS

SEQ ID NO: 1345118 - protein, 4 aa, Mycobacterium
PIGL

SEQ ID NO: 1345119 - protein, 7 aa, Mycobacterium
PIGRERK

SEQ ID NO: 1345120 - protein, 8 aa, Mycobacterium
PIGTSADN

SEQ ID NO: 1345121 - protein, 8 aa, Mycobacterium
PIKPGVPA

SEQ ID NO: 1345122 - protein, 12 aa, Mycobacterium
PIPAPTPAPAPR

SEQ ID NO: 1345123 - protein, 12 aa, Mycobacterium
PIPDPNTPTGSR

SEQ ID NO: 1345124 - protein, 7 aa, Mycobacterium
PIPSFPP

SEQ ID NO: 1345125 - protein, 7 aa, Mycobacterium
PIREGLD

SEQ ID NO: 1345126 - protein, 8 aa, Mycobacterium
PIREGLDG

SEQ ID NO: 1345127 - protein, 5 aa, Mycobacterium
PISDP

SEQ ID NO: 1345128 - protein, 16 aa, Mycobacterium
PISPPSGHPTGPPTGP

SEQ ID NO: 1345129 - protein, 11 aa, Mycobacterium
PISTNDSSIEG

SEQ ID NO: 1345130 - protein, 7 aa, Mycobacterium
PITAPAE

SEQ ID NO: 1345131 - protein, 5 aa, Mycobacterium
PITGE

SEQ ID NO: 1345132 - protein, 7 aa, Mycobacterium
PKAPEAV

SEQ ID NO: 1345133 - protein, 6 aa, Mycobacterium
PKDDPL

SEQ ID NO: 1345134 - protein, 20 aa, Mycobacterium
PKLAPGGAGPGDPPEMPPTV

SEQ ID NO: 1345135 - protein, 7 aa, Mycobacterium
PKNPDNW

SEQ ID NO: 1345136 - protein, 8 aa, Mycobacterium
PKNPPALS

SEQ ID NO: 1345137 - protein, 10 aa, Mycobacterium
PKTPAPEGGW

SEQ ID NO: 1345138 - protein, 9 aa, Mycobacterium
PKVGGRSVG

SEQ ID NO: 1345139 - protein, 7 aa, Mycobacterium
PKVPFDP

SEQ ID NO: 1345140 - protein, 11 aa, Mycobacterium
PLAAPPVPPVD

SEQ ID NO: 1345141 - protein, 53 aa, Mycobacterium
PLAPPPPPVEAPAAPSAPPVAVPDTSDPSEARRLDRGGDPREALRQLLRDAAA

SEQ ID NO: 1345142 - protein, 13 aa, Mycobacterium
PLASDGGHWTGEE

SEQ ID NO: 1345143 - protein, 8 aa, Mycobacterium
PLEPGQQT

SEQ ID NO: 1345144 - protein, 5 aa, Mycobacterium
PLGEQ

SEQ ID NO: 1345145 - protein, 7 aa, Mycobacterium
PLGETLP

SEQ ID NO: 1345146 - protein, 9 aa, Mycobacterium
PLGPDPKAA

SEQ ID NO: 1345147 - protein, 13 aa, Mycobacterium
PLGQSGEIDRTKG

SEQ ID NO: 1345148 - protein, 8 aa, Mycobacterium
PLGSTDMG

SEQ ID NO: 1345149 - protein, 7 aa, Mycobacterium
PLGTDPA

SEQ ID NO: 1345150 - protein, 9 aa, Mycobacterium
PLGTDPAKA

SEQ ID NO: 1345151 - protein, 10 aa, Mycobacterium
PLHGDSGPIT

SEQ ID NO: 1345152 - protein, 10 aa, Mycobacterium
PLKSAGARVQ

SEQ ID NO: 1345153 - protein, 17 aa, Mycobacterium
PLPAAGAAAAELPPGPA

SEQ ID NO: 1345154 - protein, 22 aa, Mycobacterium
PLPAPAPGGPPPGPPALQPVGP

SEQ ID NO: 1345155 - protein, 27 aa, Mycobacterium
PLPAPPPGGPPPGPPDPVLPAPTHGPV

SEQ ID NO: 1345156 - protein, 13 aa, Mycobacterium
PLPAPSGGSGGYT

SEQ ID NO: 1345157 - protein, 6 aa, Mycobacterium
PLPARP

SEQ ID NO: 1345158 - protein, 15 aa, Mycobacterium
PLPGANGPSPAAGGF

SEQ ID NO: 1345159 - protein, 13 aa, Mycobacterium
PLPGAVGRGPDAV

SEQ ID NO: 1345160 - protein, 22 aa, Mycobacterium
PLPGGGVPKRSGPFPIKGTDRE

SEQ ID NO: 1345161 - protein, 13 aa, Mycobacterium
PLPGTAGGGPGSF

SEQ ID NO: 1345162 - protein, 14 aa, Mycobacterium
PLPGTAGGGSGAYT

SEQ ID NO: 1345163 - protein, 15 aa, Mycobacterium
PLPGVNGPSPAAGGF

SEQ ID NO: 1345164 - protein, 17 aa, Mycobacterium
PLPIPEGTPAGQNPNPF

SEQ ID NO: 1345165 - protein, 5 aa, Mycobacterium
PLPNP

SEQ ID NO: 1345166 - protein, 5 aa, Mycobacterium
PLPNT

SEQ ID NO: 1345167 - protein, 7 aa, Mycobacterium
PLPPESV

SEQ ID NO: 1345168 - protein, 8 aa, Mycobacterium
PLPPGDRH

SEQ ID NO: 1345169 - protein, 8 aa, Mycobacterium
PLPPNTPD

SEQ ID NO: 1345170 - protein, 12 aa, Mycobacterium
PLPPQQLPPPCT

SEQ ID NO: 1345171 - protein, 27 aa, Mycobacterium
PLPPVPAVPASAPAPVPAAAPLPPPVA

SEQ ID NO: 1345172 - protein, 9 aa, Mycobacterium
PLPQAKRAA

SEQ ID NO: 1345173 - protein, 11 aa, Mycobacterium
PLPTPTSPGAQ

SEQ ID NO: 1345174 - protein, 4 aa, Mycobacterium
PLQP

SEQ ID NO: 1345175 - protein, 7 aa, Mycobacterium
PLQPGSD

SEQ ID NO: 1345176 - protein, 7 aa, Mycobacterium
PLQPNYP

SEQ ID NO: 1345177 - protein, 4 aa, Mycobacterium
PLSE

SEQ ID NO: 1345178 - protein, 5 aa, Mycobacterium
PLSET

SEQ ID NO: 1345179 - protein, 30 aa, Mycobacterium
PLSSSPSAGMPAGPQPVAPPAPAPVAPPVV

SEQ ID NO: 1345180 - protein, 14 aa, Mycobacterium
PLTPAPPSTPVPPV

SEQ ID NO: 1345181 - protein, 21 aa, Mycobacterium
PMGPGQPASDLAFADPPTHIN

SEQ ID NO: 1345182 - protein, 13 aa, Mycobacterium
PMGPSRPVSARSR

SEQ ID NO: 1345183 - protein, 12 aa, Mycobacterium
PMPGTEGGGPGS

SEQ ID NO: 1345184 - protein, 5 aa, Mycobacterium
PMPTA

SEQ ID NO: 1345185 - protein, 10 aa, Mycobacterium
PMQPASTNKV

SEQ ID NO: 1345186 - protein, 19 aa, Mycobacterium
PMSAESTTDESDVPADVPD

SEQ ID NO: 1345187 - protein, 7 aa, Mycobacterium
PMSGPVG

SEQ ID NO: 1345188 - protein, 13 aa, Mycobacterium
PMTGTAHSGWAAG

SEQ ID NO: 1345189 - protein, 6 aa, Mycobacterium
PNADKP

SEQ ID NO: 1345190 - protein, 10 aa, Mycobacterium
PNDGETVGVG

SEQ ID NO: 1345191 - protein, 10 aa, Mycobacterium
PNDPNGACGV

SEQ ID NO: 1345192 - protein, 13 aa, Mycobacterium
PNDPVNRRGVPQG

SEQ ID NO: 1345193 - protein, 10 aa, Mycobacterium
PNGDPVAGTP

SEQ ID NO: 1345194 - protein, 8 aa, Mycobacterium
PNGGSVTG

SEQ ID NO: 1345195 - protein, 25 aa, Mycobacterium
PNPCNAGGPGTAGNPLIAPYRWDQG

SEQ ID NO: 1345196 - protein, 13 aa, Mycobacterium
PNPDGSFSGERTI

SEQ ID NO: 1345197 - protein, 10 aa, Mycobacterium
PNPGDIRTNQ

SEQ ID NO: 1345198 - protein, 6 aa, Mycobacterium
PNPVTP

SEQ ID NO: 1345199 - protein, 12 aa, Mycobacterium
PNQNNDNPMPYG

SEQ ID NO: 1345200 - protein, 12 aa, Mycobacterium
PNSNGPTDTMPY

SEQ ID NO: 1345201 - protein, 9 aa, Mycobacterium
PNSTDTGGI

SEQ ID NO: 1345202 - protein, 11 aa, Mycobacterium
PNSVADDVNET

SEQ ID NO: 1345203 - protein, 6 aa, Mycobacterium
PPAAAR

SEQ ID NO: 1345204 - protein, 26 aa, Mycobacterium
PPAAPAPAPAPAGPLGLTPAPGPAPL

SEQ ID NO: 1345205 - protein, 13 aa, Mycobacterium
PPAAPPADQPQAV

SEQ ID NO: 1345206 - protein, 17 aa, Mycobacterium
PPADRGRPGALSGPDLL

SEQ ID NO: 1345207 - protein, 7 aa, Mycobacterium
PPAGADT

SEQ ID NO: 1345208 - protein, 6 aa, Mycobacterium
PPALPG

SEQ ID NO: 1345209 - protein, 10 aa, Mycobacterium
PPAPAATATW

SEQ ID NO: 1345210 - protein, 139 aa, Mycobacterium
PPAPATGSAGSGASGYGSEASPSAAADTATPETPGTTPAAETPTSVVPTPVAAPAGSSGTPLPEGSSGTPLPEGSSGTPLPAGAAPVEAGPAPVPAGVAPAPHGSSGTPLPAGAPAVEGVQPAPAPGAPTTTVVVPAPP

SEQ ID NO: 1345211 - protein, 14 aa, Mycobacterium
PPAPPPPTQEGAPA

SEQ ID NO: 1345212 - protein, 4 aa, Mycobacterium
PPAR

SEQ ID NO: 1345213 - protein, 13 aa, Mycobacterium
PPASAQIEADGSD

SEQ ID NO: 1345214 - protein, 5 aa, Mycobacterium
PPATV

SEQ ID NO: 1345215 - protein, 19 aa, Mycobacterium
PPAVAPDSDAPKADPAKAD

SEQ ID NO: 1345216 - protein, 36 aa, Mycobacterium
PPAVPPAPEPVAAEPGPLPAEAGSEPAPVPTDPAQG

SEQ ID NO: 1345217 - protein, 7 aa, Mycobacterium
PPDGTHG

SEQ ID NO: 1345218 - protein, 26 aa, Mycobacterium
PPDKSREEIDEANTRDFRDSEDSAEY

SEQ ID NO: 1345219 - protein, 11 aa, Mycobacterium
PPDTVQTGLSA

SEQ ID NO: 1345220 - protein, 41 aa, Mycobacterium
PPDVQSPTDTEVTTGSPAVSAETDTTAPAEPTPQPAPTGAV

SEQ ID NO: 1345221 - protein, 5 aa, Mycobacterium
PPDWG

SEQ ID NO: 1345222 - protein, 5 aa, Mycobacterium
PPEKL

SEQ ID NO: 1345223 - protein, 5 aa, Mycobacterium
PPEQA

SEQ ID NO: 1345224 - protein, 10 aa, Mycobacterium
PPEQNRPEPI

SEQ ID NO: 1345225 - protein, 5 aa, Mycobacterium
PPGAG

SEQ ID NO: 1345226 - protein, 5 aa, Mycobacterium
PPGAV

SEQ ID NO: 1345227 - protein, 4 aa, Mycobacterium
PPGH

SEQ ID NO: 1345228 - protein, 14 aa, Mycobacterium
PPGHEPDYGNDPPP

SEQ ID NO: 1345229 - protein, 7 aa, Mycobacterium
PPGMPGY

SEQ ID NO: 1345230 - protein, 19 aa, Mycobacterium
PPKRAGEAGVGMNRAGEGG

SEQ ID NO: 1345231 - protein, 5 aa, Mycobacterium
PPLDE

SEQ ID NO: 1345232 - protein, 5 aa, Mycobacterium
PPLGD

SEQ ID NO: 1345233 - protein, 31 aa, Mycobacterium
PPLGDEPKGRLQPGSTLPLNASSTYPTTEQT

SEQ ID NO: 1345234 - protein, 8 aa, Mycobacterium
PPLPADYG

SEQ ID NO: 1345235 - protein, 5 aa, Mycobacterium
PPLSR

SEQ ID NO: 1345236 - protein, 6 aa, Mycobacterium
PPNGTH

SEQ ID NO: 1345237 - protein, 8 aa, Mycobacterium
PPNPTGNT

SEQ ID NO: 1345238 - protein, 11 aa, Mycobacterium
PPPAAYAPLPE

SEQ ID NO: 1345239 - protein, 157 aa, Mycobacterium
PPPAPPAPAAGGSAPYRGTPSASSPAQDTEAAPAAVPPAAETPMTPAPASVGTPLTPGSVGTPLPTGSAGTPLPTGDAVAPGSTPAPAGSPSVTTTPDISTGTPLPAETPAPATAAAPAPTATPAGSAGTPLPAPEVAPAAGAGTPAAPVTTTPVPM

SEQ ID NO: 1345240 - protein, 7 aa, Mycobacterium
PPPAPQP

SEQ ID NO: 1345241 - protein, 8 aa, Mycobacterium
PPPAPQPS

SEQ ID NO: 1345242 - protein, 6 aa, Mycobacterium
PPPAVP

SEQ ID NO: 1345243 - protein, 7 aa, Mycobacterium
PPPPAAP

SEQ ID NO: 1345244 - protein, 30 aa, Mycobacterium
PPPPPPPPPGLPPPGAPVPPPPAMPVPAPA

SEQ ID NO: 1345245 - protein, 6 aa, Mycobacterium
PPPPVP

SEQ ID NO: 1345246 - protein, 8 aa, Mycobacterium
PPPSVQPG

SEQ ID NO: 1345247 - protein, 8 aa, Mycobacterium
PPPVESQY

SEQ ID NO: 1345248 - protein, 32 aa, Mycobacterium
PPQGNPGGSPPPAPAPAVAPTGPLLPAEGMPP

SEQ ID NO: 1345249 - protein, 9 aa, Mycobacterium
PPQSTAIPR

SEQ ID NO: 1345250 - protein, 12 aa, Mycobacterium
PPRGDDDFDAAT

SEQ ID NO: 1345251 - protein, 7 aa, Mycobacterium
PPRPAHQ

SEQ ID NO: 1345252 - protein, 10 aa, Mycobacterium
PPRTPPTRPG

SEQ ID NO: 1345253 - protein, 5 aa, Mycobacterium
PPSFE

SEQ ID NO: 1345254 - protein, 25 aa, Mycobacterium
PPTGGPAGSPGRAGAAEAADTSGSM

SEQ ID NO: 1345255 - protein, 92 aa, Mycobacterium
PPTPEPSQEPAPSPTQQPQTSPEPSPNPEPSPTPEPSPTPTPEPSPTPEPSPTPTQEPQPQPDPAPQASSSPQEPSEEPAPVTECVPAPDTV

SEQ ID NO: 1345256 - protein, 5 aa, Mycobacterium
PPTYT

SEQ ID NO: 1345257 - protein, 4 aa, Mycobacterium
PPVD

SEQ ID NO: 1345258 - protein, 7 aa, Mycobacterium
PPVDGGE

SEQ ID NO: 1345259 - protein, 5 aa, Mycobacterium
PPVEQ

SEQ ID NO: 1345260 - protein, 17 aa, Mycobacterium
PPVGKMPSGRLQPGTTL

SEQ ID NO: 1345261 - protein, 21 aa, Mycobacterium
PPVPDTPPPAVTSTPAGSAPL

SEQ ID NO: 1345262 - protein, 14 aa, Mycobacterium
PPVVDPTPAPAAAS

SEQ ID NO: 1345263 - protein, 21 aa, Mycobacterium
PPYTGAAPAAPPDTDGDGMPD

SEQ ID NO: 1345264 - protein, 20 aa, Mycobacterium
PQACRTDGAGAECAAARAPK

SEQ ID NO: 1345265 - protein, 13 aa, Mycobacterium
PQADDGPTPPTPV

SEQ ID NO: 1345266 - protein, 19 aa, Mycobacterium
PQADPGQPWPGRLPEPSPT

SEQ ID NO: 1345267 - protein, 4 aa, Mycobacterium
PQAF

SEQ ID NO: 1345268 - protein, 7 aa, Mycobacterium
PQDSAQG

SEQ ID NO: 1345269 - protein, 4 aa, Mycobacterium
PQFQ

SEQ ID NO: 1345270 - protein, 4 aa, Mycobacterium
PQGC

SEQ ID NO: 1345271 - protein, 6 aa, Mycobacterium
PQGDHQ

SEQ ID NO: 1345272 - protein, 6 aa, Mycobacterium
PQGGGG

SEQ ID NO: 1345273 - protein, 7 aa, Mycobacterium
PQGINPA

SEQ ID NO: 1345274 - protein, 10 aa, Mycobacterium
PQGSPYEEGR

SEQ ID NO: 1345275 - protein, 5 aa, Mycobacterium
PQLPT

SEQ ID NO: 1345276 - protein, 4 aa, Mycobacterium
PQPA

SEQ ID NO: 1345277 - protein, 10 aa, Mycobacterium
PQPDNPASPK

SEQ ID NO: 1345278 - protein, 10 aa, Mycobacterium
PQPPDRQNCG

SEQ ID NO: 1345279 - protein, 4 aa, Mycobacterium
PQQA

SEQ ID NO: 1345280 - protein, 5 aa, Mycobacterium
PQREQ

SEQ ID NO: 1345281 - protein, 16 aa, Mycobacterium
PQSKGMRAAQGNPDPL

SEQ ID NO: 1345282 - protein, 9 aa, Mycobacterium
PQSSGVGGG

SEQ ID NO: 1345283 - protein, 8 aa, Mycobacterium
PQSVSVPR

SEQ ID NO: 1345284 - protein, 7 aa, Mycobacterium
PQTDRGA

SEQ ID NO: 1345285 - protein, 157 aa, Mycobacterium
PQTLPGANSALTNTAPPSGPIPPAGSTNGIASATPPSVGIPPAGSLNGTASATPPSVAIPPAGSLNGTAAATPPRPPVPSAPVTSSSQSVTPPSGPLPPTARVDTASGATPPAPGAPGVPAAGAGGGAVPPAPAAPGAPVGASGGVGAPAAPPAVPA

SEQ ID NO: 1345286 - protein, 14 aa, Mycobacterium
PQVTSSRGSEPAMR

SEQ ID NO: 1345287 - protein, 10 aa, Mycobacterium
PRAAADGRSA

SEQ ID NO: 1345288 - protein, 8 aa, Mycobacterium
PRAGSTFT

SEQ ID NO: 1345289 - protein, 15 aa, Mycobacterium
PRASWNQERREPLRG

SEQ ID NO: 1345290 - protein, 5 aa, Mycobacterium
PRAVD

SEQ ID NO: 1345291 - protein, 12 aa, Mycobacterium
PRDDQPRPDQPR

SEQ ID NO: 1345292 - protein, 9 aa, Mycobacterium
PRDGRPKDP

SEQ ID NO: 1345293 - protein, 16 aa, Mycobacterium
PRDPNYSEANRAFDGD

SEQ ID NO: 1345294 - protein, 15 aa, Mycobacterium
PRDSNIRQSSDLSGK

SEQ ID NO: 1345295 - protein, 5 aa, Mycobacterium
PREAE

SEQ ID NO: 1345296 - protein, 4 aa, Mycobacterium
PRER

SEQ ID NO: 1345297 - protein, 10 aa, Mycobacterium
PRGDGPPDES

SEQ ID NO: 1345298 - protein, 7 aa, Mycobacterium
PRGEFAS

SEQ ID NO: 1345299 - protein, 13 aa, Mycobacterium
PRGELGYRRNTKD

SEQ ID NO: 1345300 - protein, 15 aa, Mycobacterium
PRGSTGKILRNELRG

SEQ ID NO: 1345301 - protein, 11 aa, Mycobacterium
PRGVAESTPAV

SEQ ID NO: 1345302 - protein, 10 aa, Mycobacterium
PRGVGHSTPE

SEQ ID NO: 1345303 - protein, 10 aa, Mycobacterium
PRGVGHSTPQ

SEQ ID NO: 1345304 - protein, 7 aa, Mycobacterium
PRIQGEQ

SEQ ID NO: 1345305 - protein, 13 aa, Mycobacterium
PRKRSQPGRSGLS

SEQ ID NO: 1345306 - protein, 5 aa, Mycobacterium
PRLTT

SEQ ID NO: 1345307 - protein, 13 aa, Mycobacterium
PRPAPPGEGPRWN

SEQ ID NO: 1345308 - protein, 83 aa, Mycobacterium
PRPAPPSSTPAPAPAPEPEPQPTQEPQPTQEPEPEPTVAPEPEPTVVPEPTVAPQPEPTAAPEPSAEAPAEPQPECVPDAETV

SEQ ID NO: 1345309 - protein, 8 aa, Mycobacterium
PRPGPDEA

SEQ ID NO: 1345310 - protein, 4 aa, Mycobacterium
PRPL

SEQ ID NO: 1345311 - protein, 13 aa, Mycobacterium
PRPLADDGLGGMP

SEQ ID NO: 1345312 - protein, 5 aa, Mycobacterium
PRQQD

SEQ ID NO: 1345313 - protein, 11 aa, Mycobacterium
PRRAQKTPEIT

SEQ ID NO: 1345314 - protein, 5 aa, Mycobacterium
PRRGI

SEQ ID NO: 1345315 - protein, 5 aa, Mycobacterium
PRRYA

SEQ ID NO: 1345316 - protein, 4 aa, Mycobacterium
PRSA

SEQ ID NO: 1345317 - protein, 9 aa, Mycobacterium
PRSAGPDGL

SEQ ID NO: 1345318 - protein, 6 aa, Mycobacterium
PRSRGR

SEQ ID NO: 1345319 - protein, 9 aa, Mycobacterium
PRSSVPRTA

SEQ ID NO: 1345320 - protein, 4 aa, Mycobacterium
PRTL

SEQ ID NO: 1345321 - protein, 5 aa, Mycobacterium
PRTPD

SEQ ID NO: 1345322 - protein, 18 aa, Mycobacterium
PRVPPLAEQPPGVVVAVT

SEQ ID NO: 1345323 - protein, 15 aa, Mycobacterium
PSALDPAVDPEGAAD

SEQ ID NO: 1345324 - protein, 8 aa, Mycobacterium
PSAPFPGK

SEQ ID NO: 1345325 - protein, 7 aa, Mycobacterium
PSAPGEG

SEQ ID NO: 1345326 - protein, 12 aa, Mycobacterium
PSAQADNRRLNE

SEQ ID NO: 1345327 - protein, 6 aa, Mycobacterium
PSARFG

SEQ ID NO: 1345328 - protein, 15 aa, Mycobacterium
PSASAQPAPPPPNCT

SEQ ID NO: 1345329 - protein, 17 aa, Mycobacterium
PSASPAPPYDDQGYIDS

SEQ ID NO: 1345330 - protein, 8 aa, Mycobacterium
PSATALNG

SEQ ID NO: 1345331 - protein, 14 aa, Mycobacterium
PSATGSSSQPQLAP

SEQ ID NO: 1345332 - protein, 8 aa, Mycobacterium
PSATTLNG

SEQ ID NO: 1345333 - protein, 10 aa, Mycobacterium
PSDEEDTPEL

SEQ ID NO: 1345334 - protein, 7 aa, Mycobacterium
PSDGTHS

SEQ ID NO: 1345335 - protein, 5 aa, Mycobacterium
PSDRL

SEQ ID NO: 1345336 - protein, 8 aa, Mycobacterium
PSDWPEGK

SEQ ID NO: 1345337 - protein, 4 aa, Mycobacterium
PSFA

SEQ ID NO: 1345338 - protein, 8 aa, Mycobacterium
PSGGEHGW

SEQ ID NO: 1345339 - protein, 7 aa, Mycobacterium
PSGGTHD

SEQ ID NO: 1345340 - protein, 4 aa, Mycobacterium
PSGR

SEQ ID NO: 1345341 - protein, 4 aa, Mycobacterium
PSGS

SEQ ID NO: 1345342 - protein, 12 aa, Mycobacterium
PSGSAPKEPSEL

SEQ ID NO: 1345343 - protein, 15 aa, Mycobacterium
PSGTTLAAPSASDLQ

SEQ ID NO: 1345344 - protein, 5 aa, Mycobacterium
PSHVE

SEQ ID NO: 1345345 - protein, 6 aa, Mycobacterium
PSLPAA

SEQ ID NO: 1345346 - protein, 8 aa, Mycobacterium
PSMAAGPA

SEQ ID NO: 1345347 - protein, 16 aa, Mycobacterium
PSNPACTSGEVEQKGQ

SEQ ID NO: 1345348 - protein, 19 aa, Mycobacterium
PSPAEDKDTLAVSAETAQR

SEQ ID NO: 1345349 - protein, 9 aa, Mycobacterium
PSPLSSGAA

SEQ ID NO: 1345350 - protein, 6 aa, Mycobacterium
PSPSMA

SEQ ID NO: 1345351 - protein, 18 aa, Mycobacterium
PSPVDETSARPDDDSDEV

SEQ ID NO: 1345352 - protein, 7 aa, Mycobacterium
PSQGALT

SEQ ID NO: 1345353 - protein, 10 aa, Mycobacterium
PSRGLTGGDA

SEQ ID NO: 1345354 - protein, 10 aa, Mycobacterium
PSRSNGQTYT

SEQ ID NO: 1345355 - protein, 7 aa, Mycobacterium
PSSGDYS

SEQ ID NO: 1345356 - protein, 10 aa, Mycobacterium
PSSTNGRSPL

SEQ ID NO: 1345357 - protein, 10 aa, Mycobacterium
PSSYDAGDTI

SEQ ID NO: 1345358 - protein, 4 aa, Mycobacterium
PSTQ

SEQ ID NO: 1345359 - protein, 21 aa, Mycobacterium
PSVPPRESDALEEADESAVDA

SEQ ID NO: 1345360 - protein, 6 aa, Mycobacterium
PSVTPN

SEQ ID NO: 1345361 - protein, 23 aa, Mycobacterium
PSYREGGGPTMGDGGTIPESRTA

SEQ ID NO: 1345362 - protein, 9 aa, Mycobacterium
PTAAEKLAA

SEQ ID NO: 1345363 - protein, 17 aa, Mycobacterium
PTAASTPDTDASSPALE

SEQ ID NO: 1345364 - protein, 14 aa, Mycobacterium
PTADPGTRPSAEQI

SEQ ID NO: 1345365 - protein, 8 aa, Mycobacterium
PTAEDAEQ

SEQ ID NO: 1345366 - protein, 21 aa, Mycobacterium
PTANARQNAQAPDATAADRAD

SEQ ID NO: 1345367 - protein, 9 aa, Mycobacterium
PTASAQPGF

SEQ ID NO: 1345368 - protein, 19 aa, Mycobacterium
PTCGGSVSAEAQAAPVQTY

SEQ ID NO: 1345369 - protein, 4 aa, Mycobacterium
PTDE

SEQ ID NO: 1345370 - protein, 9 aa, Mycobacterium
PTDPGIPVT

SEQ ID NO: 1345371 - protein, 7 aa, Mycobacterium
PTDVPYP

SEQ ID NO: 1345372 - protein, 10 aa, Mycobacterium
PTDVTKADQC

SEQ ID NO: 1345373 - protein, 15 aa, Mycobacterium
PTECTGTVRSDQGWE

SEQ ID NO: 1345374 - protein, 14 aa, Mycobacterium
PTGAPAAVPAPPLG

SEQ ID NO: 1345375 - protein, 10 aa, Mycobacterium
PTGKTVVPDP

SEQ ID NO: 1345376 - protein, 30 aa, Mycobacterium
PTGPTAPVTAAPAGAPAPAPAPLFTPLSAL

SEQ ID NO: 1345377 - protein, 7 aa, Mycobacterium
PTGVPDT

SEQ ID NO: 1345378 - protein, 6 aa, Mycobacterium
PTHGVP

SEQ ID NO: 1345379 - protein, 8 aa, Mycobacterium
PTIAQSGS

SEQ ID NO: 1345380 - protein, 5 aa, Mycobacterium
PTKTR

SEQ ID NO: 1345381 - protein, 18 aa, Mycobacterium
PTLAKGYRNTVQPDPFAE

SEQ ID NO: 1345382 - protein, 7 aa, Mycobacterium
PTLSESN

SEQ ID NO: 1345383 - protein, 20 aa, Mycobacterium
PTPAPANPPPPSGPPLPAEA

SEQ ID NO: 1345384 - protein, 6 aa, Mycobacterium
PTPKPR

SEQ ID NO: 1345385 - protein, 5 aa, Mycobacterium
PTPLR

SEQ ID NO: 1345386 - protein, 7 aa, Mycobacterium
PTPMPPN

SEQ ID NO: 1345387 - protein, 7 aa, Mycobacterium
PTPRETA

SEQ ID NO: 1345388 - protein, 17 aa, Mycobacterium
PTPSARRTSGHAGTAAL

SEQ ID NO: 1345389 - protein, 8 aa, Mycobacterium
PTPTGITN

SEQ ID NO: 1345390 - protein, 7 aa, Mycobacterium
PTPTTTP

SEQ ID NO: 1345391 - protein, 21 aa, Mycobacterium
PTRETEDSTGGTTESGISSNT

SEQ ID NO: 1345392 - protein, 7 aa, Mycobacterium
PTRIDRA

SEQ ID NO: 1345393 - protein, 8 aa, Mycobacterium
PTRPGKGL

SEQ ID NO: 1345394 - protein, 22 aa, Mycobacterium
PTSAQPAAEPAAAQPLPDGPAE

SEQ ID NO: 1345395 - protein, 8 aa, Mycobacterium
PTSGNHDW

SEQ ID NO: 1345396 - protein, 12 aa, Mycobacterium
PTSGTTGTPKGA

SEQ ID NO: 1345397 - protein, 6 aa, Mycobacterium
PTSLPT

SEQ ID NO: 1345398 - protein, 6 aa, Mycobacterium
PTSQAR

SEQ ID NO: 1345399 - protein, 5 aa, Mycobacterium
PTSVP

SEQ ID NO: 1345400 - protein, 15 aa, Mycobacterium
PTTAGRQAAGQVGTV

SEQ ID NO: 1345401 - protein, 9 aa, Mycobacterium
PTTEGARGS

SEQ ID NO: 1345402 - protein, 8 aa, Mycobacterium
PTTPGPEG

SEQ ID NO: 1345403 - protein, 14 aa, Mycobacterium
PTTTLDGKHPREQA

SEQ ID NO: 1345404 - protein, 6 aa, Mycobacterium
PTVAPG

SEQ ID NO: 1345405 - protein, 5 aa, Mycobacterium
PTVDP

SEQ ID NO: 1345406 - protein, 16 aa, Mycobacterium
PTVDTTPAPAPPQPLS

SEQ ID NO: 1345407 - protein, 20 aa, Mycobacterium
PTVPPDVAQTQNQTTGPNGL

SEQ ID NO: 1345408 - protein, 18 aa, Mycobacterium
PTYAGSMSEDSNKSDPKI

SEQ ID NO: 1345409 - protein, 13 aa, Mycobacterium
PVAAGGDARNQNT

SEQ ID NO: 1345410 - protein, 19 aa, Mycobacterium
PVADSGGVLEPTEPKSGGV

SEQ ID NO: 1345411 - protein, 7 aa, Mycobacterium
PVAGEYK

SEQ ID NO: 1345412 - protein, 9 aa, Mycobacterium
PVAPPPVEA

SEQ ID NO: 1345413 - protein, 10 aa, Mycobacterium
PVAPTNSMPD

SEQ ID NO: 1345414 - protein, 23 aa, Mycobacterium
PVASAQPADPATTDAAAAPPETQ

SEQ ID NO: 1345415 - protein, 4 aa, Mycobacterium
PVAT

SEQ ID NO: 1345416 - protein, 10 aa, Mycobacterium
PVDASPQGRL

SEQ ID NO: 1345417 - protein, 8 aa, Mycobacterium
PVDDDDTN

SEQ ID NO: 1345418 - protein, 10 aa, Mycobacterium
PVDPEGDLDL

SEQ ID NO: 1345419 - protein, 13 aa, Mycobacterium
PVDPNTAPGMLPP

SEQ ID NO: 1345420 - protein, 10 aa, Mycobacterium
PVDSTLSDTR

SEQ ID NO: 1345421 - protein, 9 aa, Mycobacterium
PVEPGPAPV

SEQ ID NO: 1345422 - protein, 12 aa, Mycobacterium
PVEQVGKPLEPN

SEQ ID NO: 1345423 - protein, 8 aa, Mycobacterium
PVGDAPQY

SEQ ID NO: 1345424 - protein, 53 aa, Mycobacterium
PVGNGGDGGAGFSPTAAGASGGDGGAGGHGGAIGNGGAGGAGGNGAAGTNGSN

SEQ ID NO: 1345425 - protein, 11 aa, Mycobacterium
PVGPDNDAHLD

SEQ ID NO: 1345426 - protein, 9 aa, Mycobacterium
PVGPTHPSN

SEQ ID NO: 1345427 - protein, 13 aa, Mycobacterium
PVLPANSSVTVRT

SEQ ID NO: 1345428 - protein, 7 aa, Mycobacterium
PVPAPGA

SEQ ID NO: 1345429 - protein, 17 aa, Mycobacterium
PVPDAPYAVAGSRDDDG

SEQ ID NO: 1345430 - protein, 4 aa, Mycobacterium
PVPG

SEQ ID NO: 1345431 - protein, 5 aa, Mycobacterium
PVPGE

SEQ ID NO: 1345432 - protein, 58 aa, Mycobacterium
PVPGPAAAAPGPVQQRTVTKQAAPRPAPAPAAAPVAAPAPAPPAAAPAPAPAPAQPQI

SEQ ID NO: 1345433 - protein, 6 aa, Mycobacterium
PVPPDA

SEQ ID NO: 1345434 - protein, 5 aa, Mycobacterium
PVQPL

SEQ ID NO: 1345435 - protein, 8 aa, Mycobacterium
PVQQPDRF

SEQ ID NO: 1345436 - protein, 16 aa, Mycobacterium
PVRSSGMTPYVTRLIE

SEQ ID NO: 1345437 - protein, 16 aa, Mycobacterium
PVRTGGMTPYVTRIIE

SEQ ID NO: 1345438 - protein, 16 aa, Mycobacterium
PVRTSGMTPFVTRMIE

SEQ ID NO: 1345439 - protein, 11 aa, Mycobacterium
PVSAPSPDRLS

SEQ ID NO: 1345440 - protein, 31 aa, Mycobacterium
PVTGAGGHSGGMPGMSGTPGMPGVPGVGGVG

SEQ ID NO: 1345441 - protein, 10 aa, Mycobacterium
PVTVSAGDGV

SEQ ID NO: 1345442 - protein, 10 aa, Mycobacterium
PVTVTAGDGV

SEQ ID NO: 1345443 - protein, 116 aa, Mycobacterium
PVVDPESDQSGTAAADDATAQPTDDATVQPTDDATVQPTDVPAPSDEAVGNREQEDDRNAATGNGEVAPAGDDAAAAEPEENESVAPAPDEAMADDGADSAGPSSSTSDDAPDAIG

SEQ ID NO: 1345444 - protein, 5 aa, Mycobacterium
PVVPP

SEQ ID NO: 1345445 - protein, 9 aa, Mycobacterium
PVYGSGLPS

SEQ ID NO: 1345446 - protein, 4 aa, Mycobacterium
PWRA

SEQ ID NO: 1345447 - protein, 10 aa, Mycobacterium
PWRPGSSMSH

SEQ ID NO: 1345448 - protein, 6 aa, Mycobacterium
PWSGET

SEQ ID NO: 1345449 - protein, 38 aa, Mycobacterium
PWTPPPPPPPADPNAPVPPADPNAPPPDPNAPAPRPAV

SEQ ID NO: 1345450 - protein, 6 aa, Mycobacterium
PWYGDP

SEQ ID NO: 1345451 - protein, 12 aa, Mycobacterium
PYGTTKLGYSTG

SEQ ID NO: 1345452 - protein, 4 aa, Mycobacterium
PYIP

SEQ ID NO: 1345453 - protein, 5 aa, Mycobacterium
PYPAG

SEQ ID NO: 1345454 - protein, 13 aa, Mycobacterium
PYPRTGQGGEPHL

SEQ ID NO: 1345455 - protein, 14 aa, Mycobacterium
PYPRTGQGGEPNLT

SEQ ID NO: 1345456 - protein, 13 aa, Mycobacterium
PYPRTGQGGEPRL

SEQ ID NO: 1345457 - protein, 7 aa, Mycobacterium
PYQPNTE

SEQ ID NO: 1345458 - protein, 7 aa, Mycobacterium
PYRSKDK

SEQ ID NO: 1345459 - protein, 17 aa, Mycobacterium
QAAADGVPATELSSFRP

SEQ ID NO: 1345460 - protein, 4 aa, Mycobacterium
QAAE

SEQ ID NO: 1345461 - protein, 5 aa, Mycobacterium
QAAGG

SEQ ID NO: 1345462 - protein, 8 aa, Mycobacterium
QAAGGGNG

SEQ ID NO: 1345463 - protein, 4 aa, Mycobacterium
QAAK

SEQ ID NO: 1345464 - protein, 7 aa, Mycobacterium
QAAPRTV

SEQ ID NO: 1345465 - protein, 12 aa, Mycobacterium
QAASAAGNPQIA

SEQ ID NO: 1345466 - protein, 16 aa, Mycobacterium
QAAVGPDGPPMDYGLP

SEQ ID NO: 1345467 - protein, 7 aa, Mycobacterium
QADGLSG

SEQ ID NO: 1345468 - protein, 8 aa, Mycobacterium
QADNAQGE

SEQ ID NO: 1345469 - protein, 13 aa, Mycobacterium
QAEADARKAAADA

SEQ ID NO: 1345470 - protein, 4 aa, Mycobacterium
QAEF

SEQ ID NO: 1345471 - protein, 4 aa, Mycobacterium
QAGA

SEQ ID NO: 1345472 - protein, 19 aa, Mycobacterium
QAGGLYSGGNVTYRGTEVG

SEQ ID NO: 1345473 - protein, 5 aa, Mycobacterium
QAGPD

SEQ ID NO: 1345474 - protein, 12 aa, Mycobacterium
QAGSSYTSAEPG

SEQ ID NO: 1345475 - protein, 10 aa, Mycobacterium
QAGVSAPDFS

SEQ ID NO: 1345476 - protein, 42 aa, Mycobacterium
QAKEEAPAASEEGGSTAPAQVTVEASDDACELSGTEGKTGAN

SEQ ID NO: 1345477 - protein, 11 aa, Mycobacterium
QAKTFTPVGAQ

SEQ ID NO: 1345478 - protein, 11 aa, Mycobacterium
QALADPKRNTA

SEQ ID NO: 1345479 - protein, 5 aa, Mycobacterium
QANQR

SEQ ID NO: 1345480 - protein, 9 aa, Mycobacterium
QAPAQAAAA

SEQ ID NO: 1345481 - protein, 8 aa, Mycobacterium
QAPDEVKA

SEQ ID NO: 1345482 - protein, 5 aa, Mycobacterium
QAPSV

SEQ ID NO: 1345483 - protein, 13 aa, Mycobacterium
QAPYNPGGQPGPD

SEQ ID NO: 1345484 - protein, 9 aa, Mycobacterium
QAQAPLPVA

SEQ ID NO: 1345485 - protein, 6 aa, Mycobacterium
QAQGSN

SEQ ID NO: 1345486 - protein, 8 aa, Mycobacterium
QAQGSNRT

SEQ ID NO: 1345487 - protein, 10 aa, Mycobacterium
QAQPAETPDG

SEQ ID NO: 1345488 - protein, 15 aa, Mycobacterium
QASAEPITQAMEAVD

SEQ ID NO: 1345489 - protein, 13 aa, Mycobacterium
QASAPADPGFTNG

SEQ ID NO: 1345490 - protein, 10 aa, Mycobacterium
QASAPVQPTV

SEQ ID NO: 1345491 - protein, 8 aa, Mycobacterium
QASGLQDE

SEQ ID NO: 1345492 - protein, 15 aa, Mycobacterium
QASGSSDQAAIENAQ

SEQ ID NO: 1345493 - protein, 10 aa, Mycobacterium
QASKETGGQD

SEQ ID NO: 1345494 - protein, 12 aa, Mycobacterium
QASPGGASATAT

SEQ ID NO: 1345495 - protein, 6 aa, Mycobacterium
QATRDQ

SEQ ID NO: 1345496 - protein, 5 aa, Mycobacterium
QAYAP

SEQ ID NO: 1345497 - protein, 5 aa, Mycobacterium
QCDEA

SEQ ID NO: 1345498 - protein, 7 aa, Mycobacterium
QCPPGQT

SEQ ID NO: 1345499 - protein, 18 aa, Mycobacterium
QCTDSGKPPLQPTGFPSV

SEQ ID NO: 1345500 - protein, 9 aa, Mycobacterium
QDAAAPGWG

SEQ ID NO: 1345501 - protein, 9 aa, Mycobacterium
QDATGFSAT

SEQ ID NO: 1345502 - protein, 6 aa, Mycobacterium
QDEAID

SEQ ID NO: 1345503 - protein, 7 aa, Mycobacterium
QDENESA

SEQ ID NO: 1345504 - protein, 4 aa, Mycobacterium
QDGN

SEQ ID NO: 1345505 - protein, 5 aa, Mycobacterium
QDGRG

SEQ ID NO: 1345506 - protein, 6 aa, Mycobacterium
QDGRRT

SEQ ID NO: 1345507 - protein, 14 aa, Mycobacterium
QDKRVETTLTDLGL

SEQ ID NO: 1345508 - protein, 11 aa, Mycobacterium
QDNAGGVTFDA

SEQ ID NO: 1345509 - protein, 7 aa, Mycobacterium
QDPGGAV

SEQ ID NO: 1345510 - protein, 5 aa, Mycobacterium
QDPLH

SEQ ID NO: 1345511 - protein, 10 aa, Mycobacterium
QDQAPQRVGE

SEQ ID NO: 1345512 - protein, 4 aa, Mycobacterium
QDQH

SEQ ID NO: 1345513 - protein, 7 aa, Mycobacterium
QDSPLNV

SEQ ID NO: 1345514 - protein, 4 aa, Mycobacterium
QDST

SEQ ID NO: 1345515 - protein, 5 aa, Mycobacterium
QDTPV

SEQ ID NO: 1345516 - protein, 6 aa, Mycobacterium
QEAADQ

SEQ ID NO: 1345517 - protein, 9 aa, Mycobacterium
QEDARKSAL

SEQ ID NO: 1345518 - protein, 11 aa, Mycobacterium
QEGNPLGPDGE

SEQ ID NO: 1345519 - protein, 8 aa, Mycobacterium
QEGYQDNS

SEQ ID NO: 1345520 - protein, 10 aa, Mycobacterium
QENSGEDNAV

SEQ ID NO: 1345521 - protein, 38 aa, Mycobacterium
QEPADESADESVSAAAAAPVPWSPDPFRPDDPDPQDMP

SEQ ID NO: 1345522 - protein, 6 aa, Mycobacterium
QEPSLG

SEQ ID NO: 1345523 - protein, 10 aa, Mycobacterium
QERSRAAAGD

SEQ ID NO: 1345524 - protein, 9 aa, Mycobacterium
QESAPEPEK

SEQ ID NO: 1345525 - protein, 8 aa, Mycobacterium
QETKDDFA

SEQ ID NO: 1345526 - protein, 6 aa, Mycobacterium
QEVSGS

SEQ ID NO: 1345527 - protein, 15 aa, Mycobacterium
QFPRDKACGDGLTPR

SEQ ID NO: 1345528 - protein, 6 aa, Mycobacterium
QGAQHA

SEQ ID NO: 1345529 - protein, 11 aa, Mycobacterium
QGEGEGRPLAP

SEQ ID NO: 1345530 - protein, 6 aa, Mycobacterium
QGENVD

SEQ ID NO: 1345531 - protein, 5 aa, Mycobacterium
QGGAV

SEQ ID NO: 1345532 - protein, 8 aa, Mycobacterium
QGGCQGLE

SEQ ID NO: 1345533 - protein, 6 aa, Mycobacterium
QGGKIN

SEQ ID NO: 1345534 - protein, 16 aa, Mycobacterium
QGGTVNVTGAGNDLKV

SEQ ID NO: 1345535 - protein, 6 aa, Mycobacterium
QGIEAQ

SEQ ID NO: 1345536 - protein, 10 aa, Mycobacterium
QGLAGRGEKF

SEQ ID NO: 1345537 - protein, 5 aa, Mycobacterium
QGLDT

SEQ ID NO: 1345538 - protein, 9 aa, Mycobacterium
QGLNPRSDI

SEQ ID NO: 1345539 - protein, 12 aa, Mycobacterium
QGLNTDSAQTAA

SEQ ID NO: 1345540 - protein, 6 aa, Mycobacterium
QGLPTR

SEQ ID NO: 1345541 - protein, 8 aa, Mycobacterium
QGMASGTP

SEQ ID NO: 1345542 - protein, 4 aa, Mycobacterium
QGPD

SEQ ID NO: 1345543 - protein, 4 aa, Mycobacterium
QGPL

SEQ ID NO: 1345544 - protein, 6 aa, Mycobacterium
QGPLDQ

SEQ ID NO: 1345545 - protein, 8 aa, Mycobacterium
QGQDEPCC

SEQ ID NO: 1345546 - protein, 7 aa, Mycobacterium
QGQGATI

SEQ ID NO: 1345547 - protein, 7 aa, Mycobacterium
QGQGGTI

SEQ ID NO: 1345548 - protein, 7 aa, Mycobacterium
QGQGPTI

SEQ ID NO: 1345549 - protein, 30 aa, Mycobacterium
QGQPASDEAGESGVTASRPAPQVRHDTEEL

SEQ ID NO: 1345550 - protein, 4 aa, Mycobacterium
QGRF

SEQ ID NO: 1345551 - protein, 5 aa, Mycobacterium
QGRSD

SEQ ID NO: 1345552 - protein, 5 aa, Mycobacterium
QGSEV

SEQ ID NO: 1345553 - protein, 5 aa, Mycobacterium
QGSSN

SEQ ID NO: 1345554 - protein, 11 aa, Mycobacterium
QGSTPTASRRP

SEQ ID NO: 1345555 - protein, 6 aa, Mycobacterium
QGTEFD

SEQ ID NO: 1345556 - protein, 15 aa, Mycobacterium
QGTPAALGATPPEIA

SEQ ID NO: 1345557 - protein, 7 aa, Mycobacterium
QGTTGGS

SEQ ID NO: 1345558 - protein, 15 aa, Mycobacterium
QGVNRTDTDMSSAEE

SEQ ID NO: 1345559 - protein, 29 aa, Mycobacterium
QGVPSTDASRPVSEPAAAVAASTSGQSIE

SEQ ID NO: 1345560 - protein, 30 aa, Mycobacterium
QGYDQGFDQGQDPGADGGWDGGDSGGGWGD

SEQ ID NO: 1345561 - protein, 7 aa, Mycobacterium
QHGRPAV

SEQ ID NO: 1345562 - protein, 8 aa, Mycobacterium
QHIPDGPI

SEQ ID NO: 1345563 - protein, 13 aa, Mycobacterium
QIAGQADVEGTPN

SEQ ID NO: 1345564 - protein, 9 aa, Mycobacterium
QIGATGPVP

SEQ ID NO: 1345565 - protein, 10 aa, Mycobacterium
QIQGQQEGVN

SEQ ID NO: 1345566 - protein, 4 aa, Mycobacterium
QIRE

SEQ ID NO: 1345567 - protein, 10 aa, Mycobacterium
QITPPTSALQ

SEQ ID NO: 1345568 - protein, 4 aa, Mycobacterium
QKDH

SEQ ID NO: 1345569 - protein, 15 aa, Mycobacterium
QKPSPGAALTPQTSA

SEQ ID NO: 1345570 - protein, 5 aa, Mycobacterium
QKPVV

SEQ ID NO: 1345571 - protein, 16 aa, Mycobacterium
QKTADAAGIGNSRYNL

SEQ ID NO: 1345572 - protein, 6 aa, Mycobacterium
QKYGPD

SEQ ID NO: 1345573 - protein, 17 aa, Mycobacterium
QLEEARAKSEEAPDPKR

SEQ ID NO: 1345574 - protein, 7 aa, Mycobacterium
QLEGGDR

SEQ ID NO: 1345575 - protein, 12 aa, Mycobacterium
QLPGDDRRELAG

SEQ ID NO: 1345576 - protein, 8 aa, Mycobacterium
QLPSPRPD

SEQ ID NO: 1345577 - protein, 13 aa, Mycobacterium
QLRSSHARSTGRF

SEQ ID NO: 1345578 - protein, 17 aa, Mycobacterium
QLSPDGTSWSSAEPLGY

SEQ ID NO: 1345579 - protein, 9 aa, Mycobacterium
QLSPDGVSW

SEQ ID NO: 1345580 - protein, 8 aa, Mycobacterium
QLSPDGVT

SEQ ID NO: 1345581 - protein, 17 aa, Mycobacterium
QMPGQTAASLSRTGQEV

SEQ ID NO: 1345582 - protein, 10 aa, Mycobacterium
QNAEGSADTM

SEQ ID NO: 1345583 - protein, 13 aa, Mycobacterium
QNAGTSGSPSPEN

SEQ ID NO: 1345584 - protein, 7 aa, Mycobacterium
QNCDPAG

SEQ ID NO: 1345585 - protein, 6 aa, Mycobacterium
QNEKGA

SEQ ID NO: 1345586 - protein, 6 aa, Mycobacterium
QNEPPL

SEQ ID NO: 1345587 - protein, 7 aa, Mycobacterium
QNGLSAN

SEQ ID NO: 1345588 - protein, 8 aa, Mycobacterium
QNGSPVTV

SEQ ID NO: 1345589 - protein, 14 aa, Mycobacterium
QNKFTGKVTSEVNG

SEQ ID NO: 1345590 - protein, 7 aa, Mycobacterium
QNNETTA

SEQ ID NO: 1345591 - protein, 16 aa, Mycobacterium
QNPACGSGEVAKKGQT

SEQ ID NO: 1345592 - protein, 7 aa, Mycobacterium
QNPFSTD

SEQ ID NO: 1345593 - protein, 6 aa, Mycobacterium
QNPIEY

SEQ ID NO: 1345594 - protein, 11 aa, Mycobacterium
QNSAADAEGPL

SEQ ID NO: 1345595 - protein, 5 aa, Mycobacterium
QNSGA

SEQ ID NO: 1345596 - protein, 8 aa, Mycobacterium
QNSGCTTD

SEQ ID NO: 1345597 - protein, 7 aa, Mycobacterium
QNTRKRQ

SEQ ID NO: 1345598 - protein, 8 aa, Mycobacterium
QNTVEKDA

SEQ ID NO: 1345599 - protein, 17 aa, Mycobacterium
QPAAAAPTGPDSVQDTV

SEQ ID NO: 1345600 - protein, 5 aa, Mycobacterium
QPAAQ

SEQ ID NO: 1345601 - protein, 12 aa, Mycobacterium
QPAGDDAARRTI

SEQ ID NO: 1345602 - protein, 14 aa, Mycobacterium
QPAGGQIDPENACG

SEQ ID NO: 1345603 - protein, 5 aa, Mycobacterium
QPAIT

SEQ ID NO: 1345604 - protein, 16 aa, Mycobacterium
QPAPPPCFNPDGTPCA

SEQ ID NO: 1345605 - protein, 6 aa, Mycobacterium
QPDELR

SEQ ID NO: 1345606 - protein, 6 aa, Mycobacterium
QPDGSR

SEQ ID NO: 1345607 - protein, 8 aa, Mycobacterium
QPDTARDR

SEQ ID NO: 1345608 - protein, 11 aa, Mycobacterium
QPEATARADEQ

SEQ ID NO: 1345609 - protein, 4 aa, Mycobacterium
QPES

SEQ ID NO: 1345610 - protein, 29 aa, Mycobacterium
QPFSTTTAAHTSARHTTASSSTATPATTV

SEQ ID NO: 1345611 - protein, 7 aa, Mycobacterium
QPGTYQT

SEQ ID NO: 1345612 - protein, 4 aa, Mycobacterium
QPLG

SEQ ID NO: 1345613 - protein, 9 aa, Mycobacterium
QPLPTPEQP

SEQ ID NO: 1345614 - protein, 6 aa, Mycobacterium
QPNAPQ

SEQ ID NO: 1345615 - protein, 7 aa, Mycobacterium
QPNTGEF

SEQ ID NO: 1345616 - protein, 5 aa, Mycobacterium
QPPPC

SEQ ID NO: 1345617 - protein, 7 aa, Mycobacterium
QPQQQPE

SEQ ID NO: 1345618 - protein, 5 aa, Mycobacterium
QPRDR

SEQ ID NO: 1345619 - protein, 15 aa, Mycobacterium
QPRPPGVSVSTSTPL

SEQ ID NO: 1345620 - protein, 9 aa, Mycobacterium
QPSEPGGVA

SEQ ID NO: 1345621 - protein, 6 aa, Mycobacterium
QPSNIP

SEQ ID NO: 1345622 - protein, 11 aa, Mycobacterium
QPSRGNGQNYT

SEQ ID NO: 1345623 - protein, 5 aa, Mycobacterium
QPSTG

SEQ ID NO: 1345624 - protein, 10 aa, Mycobacterium
QPTGPASGGI

SEQ ID NO: 1345625 - protein, 18 aa, Mycobacterium
QPTGTAMAQPHSETETRN

SEQ ID NO: 1345626 - protein, 9 aa, Mycobacterium
QPTQPGGIS

SEQ ID NO: 1345627 - protein, 4 aa, Mycobacterium
QPTT

SEQ ID NO: 1345628 - protein, 8 aa, Mycobacterium
QPTTPGGG

SEQ ID NO: 1345629 - protein, 21 aa, Mycobacterium
QPTTVNQAPTTTALSGLGPGG

SEQ ID NO: 1345630 - protein, 29 aa, Mycobacterium
QPTVGTLSGTTQTSTGKLTYSDPDGDAPV

SEQ ID NO: 1345631 - protein, 6 aa, Mycobacterium
QPVEDD

SEQ ID NO: 1345632 - protein, 13 aa, Mycobacterium
QPVLDSQTRTSEA

SEQ ID NO: 1345633 - protein, 8 aa, Mycobacterium
QQAAPTLD

SEQ ID NO: 1345634 - protein, 25 aa, Mycobacterium
QQELTASEQALTASQTDIDNAQSRF

SEQ ID NO: 1345635 - protein, 34 aa, Mycobacterium
QQGGDDGGGGADEENENAAQHPQADGDGRLDRDD

SEQ ID NO: 1345636 - protein, 5 aa, Mycobacterium
QQGRV

SEQ ID NO: 1345637 - protein, 5 aa, Mycobacterium
QQKPD

SEQ ID NO: 1345638 - protein, 6 aa, Mycobacterium
QQLNTE

SEQ ID NO: 1345639 - protein, 5 aa, Mycobacterium
QQLRP

SEQ ID NO: 1345640 - protein, 8 aa, Mycobacterium
QQNPNGGA

SEQ ID NO: 1345641 - protein, 12 aa, Mycobacterium
QQPLGARRVLSV

SEQ ID NO: 1345642 - protein, 14 aa, Mycobacterium
QQPSWPASGVSGER

SEQ ID NO: 1345643 - protein, 5 aa, Mycobacterium
QQQGR

SEQ ID NO: 1345644 - protein, 4 aa, Mycobacterium
QQQN

SEQ ID NO: 1345645 - protein, 13 aa, Mycobacterium
QQRDADATQAREQ

SEQ ID NO: 1345646 - protein, 14 aa, Mycobacterium
QQREIDAMKQILGS

SEQ ID NO: 1345647 - protein, 9 aa, Mycobacterium
QQRSSTAET

SEQ ID NO: 1345648 - protein, 9 aa, Mycobacterium
QQSDNAAAN

SEQ ID NO: 1345649 - protein, 6 aa, Mycobacterium
QQTGVP

SEQ ID NO: 1345650 - protein, 13 aa, Mycobacterium
QRAADGLADDPDA

SEQ ID NO: 1345651 - protein, 4 aa, Mycobacterium
QRCP

SEQ ID NO: 1345652 - protein, 22 aa, Mycobacterium
QRDEWSRPGVTEAGDTVAANLD

SEQ ID NO: 1345653 - protein, 50 aa, Mycobacterium; identical to SEQ ID NO: 1220427

SEQ ID NO: 1345654 - protein, 6 aa, Mycobacterium
QREAAL

SEQ ID NO: 1345655 - protein, 11 aa, Mycobacterium
QREHTGPAGQV

SEQ ID NO: 1345656 - protein, 4 aa, Mycobacterium
QREN

SEQ ID NO: 1345657 - protein, 9 aa, Mycobacterium
QRESKPEDF

SEQ ID NO: 1345658 - protein, 10 aa, Mycobacterium
QRGLTDDPAA

SEQ ID NO: 1345659 - protein, 4 aa, Mycobacterium
QRGV

SEQ ID NO: 1345660 - protein, 7 aa, Mycobacterium
QRLSDAD

SEQ ID NO: 1345661 - protein, 6 aa, Mycobacterium
QRPHRV

SEQ ID NO: 1345662 - protein, 5 aa, Mycobacterium
QRPYP

SEQ ID NO: 1345663 - protein, 5 aa, Mycobacterium
QRQTL

SEQ ID NO: 1345664 - protein, 10 aa, Mycobacterium
QRRAEQSQAA

SEQ ID NO: 1345665 - protein, 9 aa, Mycobacterium
QRRRNRSEK

SEQ ID NO: 1345666 - protein, 4 aa, Mycobacterium
QRSD

SEQ ID NO: 1345667 - protein, 7 aa, Mycobacterium
QRTDAAA

SEQ ID NO: 1345668 - protein, 15 aa, Mycobacterium
QRTDAYGGSPQNRAR

SEQ ID NO: 1345669 - protein, 6 aa, Mycobacterium
QRVAPG

SEQ ID NO: 1345670 - protein, 15 aa, Mycobacterium
QSADERDPEYQRDSA

SEQ ID NO: 1345671 - protein, 16 aa, Mycobacterium
QSAKNAGSSAKIGTFD

SEQ ID NO: 1345672 - protein, 4 aa, Mycobacterium
QSAL

SEQ ID NO: 1345673 - protein, 35 aa, Mycobacterium
QSANGTPSGPTSPGPQVGLGPTGPAWAPNQGNPMI

SEQ ID NO: 1345674 - protein, 12 aa, Mycobacterium
QSAPSAGPGTFD

SEQ ID NO: 1345675 - protein, 8 aa, Mycobacterium
QSARTERA

SEQ ID NO: 1345676 - protein, 34 aa, Mycobacterium
QSATVDSASLAHTSGTPMGPARVSRRTPTSATRW

SEQ ID NO: 1345677 - protein, 8 aa, Mycobacterium
QSDPYSRS

SEQ ID NO: 1345678 - protein, 8 aa, Mycobacterium
QSEDEPTL

SEQ ID NO: 1345679 - protein, 7 aa, Mycobacterium
QSEHARM

SEQ ID NO: 1345680 - protein, 4 aa, Mycobacterium
QSGG

SEQ ID NO: 1345681 - protein, 9 aa, Mycobacterium
QSGGPNAPG

SEQ ID NO: 1345682 - protein, 9 aa, Mycobacterium
QSGGPNSPA

SEQ ID NO: 1345683 - protein, 8 aa, Mycobacterium
QSGPQGPN

SEQ ID NO: 1345684 - protein, 8 aa, Mycobacterium
QSGQPVAT

SEQ ID NO: 1345685 - protein, 9 aa, Mycobacterium
QSGQPVATA

SEQ ID NO: 1345686 - protein, 4 aa, Mycobacterium
QSGS

SEQ ID NO: 1345687 - protein, 9 aa, Mycobacterium
QSGSEADIS

SEQ ID NO: 1345688 - protein, 5 aa, Mycobacterium
QSLSN

SEQ ID NO: 1345689 - protein, 18 aa, Mycobacterium
QSNGGSGSPHHASREEQI

SEQ ID NO: 1345690 - protein, 17 aa, Mycobacterium
QSPRADASVKVGEKPQT

SEQ ID NO: 1345691 - protein, 24 aa, Mycobacterium
QSPRAGGTIRAKSQPAVGVNRPNK

SEQ ID NO: 1345692 - protein, 10 aa, Mycobacterium
QSQTKEISGN

SEQ ID NO: 1345693 - protein, 10 aa, Mycobacterium
QSRGPQAEQP

SEQ ID NO: 1345694 - protein, 6 aa, Mycobacterium
QSRPTV

SEQ ID NO: 1345695 - protein, 5 aa, Mycobacterium
QSSTD

SEQ ID NO: 1345696 - protein, 43 aa, Mycobacterium
QSVGGEAESSRPSAATPPVTTSPAPTPPASQQPTAAPAQGASI

SEQ ID NO: 1345697 - protein, 11 aa, Mycobacterium
QSVRDTRRHPV

SEQ ID NO: 1345698 - protein, 9 aa, Mycobacterium
QSWGRDPAT

SEQ ID NO: 1345699 - protein, 10 aa, Mycobacterium
QTDDGTRWGR

SEQ ID NO: 1345700 - protein, 29 aa, Mycobacterium
QTDFGGSDSPLNAEKGEIEKAKERCGGSE

SEQ ID NO: 1345701 - protein, 7 aa, Mycobacterium
QTDGGID

SEQ ID NO: 1345702 - protein, 5 aa, Mycobacterium
QTDVP

SEQ ID NO: 1345703 - protein, 6 aa, Mycobacterium
QTEDAM

SEQ ID NO: 1345704 - protein, 18 aa, Mycobacterium
QTEGSVPEQIRSAAEQAG

SEQ ID NO: 1345705 - protein, 12 aa, Mycobacterium
QTFNGAPTPMPA

SEQ ID NO: 1345706 - protein, 4 aa, Mycobacterium
QTGL

SEQ ID NO: 1345707 - protein, 10 aa, Mycobacterium
QTGPFRPANT

SEQ ID NO: 1345708 - protein, 10 aa, Mycobacterium
QTGSASRASL

SEQ ID NO: 1345709 - protein, 9 aa, Mycobacterium
QTIDARDAQ

SEQ ID NO: 1345710 - protein, 4 aa, Mycobacterium
QTIG

SEQ ID NO: 1345711 - protein, 8 aa, Mycobacterium
QTKTGSTA

SEQ ID NO: 1345712 - protein, 6 aa, Mycobacterium
QTNGKL

SEQ ID NO: 1345713 - protein, 14 aa, Mycobacterium
QTNGSGRIAEADEI

SEQ ID NO: 1345714 - protein, 7 aa, Mycobacterium
QTNPDGA

SEQ ID NO: 1345715 - protein, 20 aa, Mycobacterium
QTNSRPYEPDPKRTHLPASD

SEQ ID NO: 1345716 - protein, 5 aa, Mycobacterium
QTPGM

SEQ ID NO: 1345717 - protein, 6 aa, Mycobacterium
QTPNAR

SEQ ID NO: 1345718 - protein, 9 aa, Mycobacterium
QTPPSVTPG

SEQ ID NO: 1345719 - protein, 6 aa, Mycobacterium
QTRDDH

SEQ ID NO: 1345720 - protein, 4 aa, Mycobacterium
QTRI

SEQ ID NO: 1345721 - protein, 15 aa, Mycobacterium
QTSLPAADDTTMPTP

SEQ ID NO: 1345722 - protein, 10 aa, Mycobacterium
QTSPVVPTPS

SEQ ID NO: 1345723 - protein, 7 aa, Mycobacterium
QTSSMRA

SEQ ID NO: 1345724 - protein, 15 aa, Mycobacterium
QTSTISEADDQYTGC

SEQ ID NO: 1345725 - protein, 6 aa, Mycobacterium
QTTMSD

SEQ ID NO: 1345726 - protein, 5 aa, Mycobacterium
QTTQA

SEQ ID NO: 1345727 - protein, 7 aa, Mycobacterium
QTTTTGL

SEQ ID NO: 1345728 - protein, 26 aa, Mycobacterium
QTVAGTAAKSGSGDVPRNDNSERKYP

SEQ ID NO: 1345729 - protein, 7 aa, Mycobacterium
QTVPDSD

SEQ ID NO: 1345730 - protein, 9 aa, Mycobacterium
QTWDAATQA

SEQ ID NO: 1345731 - protein, 5 aa, Mycobacterium
QTYPA

SEQ ID NO: 1345732 - protein, 4 aa, Mycobacterium
QVAG

SEQ ID NO: 1345733 - protein, 18 aa, Mycobacterium
QVDNSPWSVSGPLDTGAL

SEQ ID NO: 1345734 - protein, 16 aa, Mycobacterium
QVDTEGKFKEAADSYK

SEQ ID NO: 1345735 - protein, 5 aa, Mycobacterium
QVEGD

SEQ ID NO: 1345736 - protein, 26 aa, Mycobacterium
QVETPGGSAGFDPQPDPPAPRITVVA

SEQ ID NO: 1345737 - protein, 123 aa, Mycobacterium
QVGTAAADTAGETTTSSNAPSSGDDARSTSTDQSDDTDDQDTEDADEEDAEDADEEDAEDAEDAEDEDEDAPEDLEDEDPDEDTLDQDDEDDEESAADDDDKRAARGTTEDVAAETVSQPQAR

SEQ ID NO: 1345738 - protein, 10 aa, Mycobacterium
QVKATDPDGG

SEQ ID NO: 1345739 - protein, 4 aa, Mycobacterium
QVNA

SEQ ID NO: 1345740 - protein, 21 aa, Mycobacterium
QVRSPSDPGYVPTAPPALGTE

SEQ ID NO: 1345741 - protein, 7 aa, Mycobacterium
QVSISDG

SEQ ID NO: 1345742 - protein, 22 aa, Mycobacterium
QVSTVDAKTGLRGPSRTSYADR

SEQ ID NO: 1345743 - protein, 8 aa, Mycobacterium
QVTQQKGA

SEQ ID NO: 1345744 - protein, 21 aa, Mycobacterium
QVTSEPAPQPEPTPAAPMGGS

SEQ ID NO: 1345745 - protein, 8 aa, Mycobacterium
QVTSGDAI

SEQ ID NO: 1345746 - protein, 12 aa, Mycobacterium
QVTTQGRYGHTT

SEQ ID NO: 1345747 - protein, 5 aa, Mycobacterium
QYDGL

SEQ ID NO: 1345748 - protein, 6 aa, Mycobacterium
QYGGVD

SEQ ID NO: 1345749 - protein, 7 aa, Mycobacterium
QYGPGQL

SEQ ID NO: 1345750 - protein, 10 aa, Mycobacterium
QYKTDPDLQA

SEQ ID NO: 1345751 - protein, 7 aa, Mycobacterium
QYPQRYP

SEQ ID NO: 1345752 - protein, 17 aa, Mycobacterium
QYRSDQACDDQYRSDCP

SEQ ID NO: 1345753 - protein, 11 aa, Mycobacterium
RAADPDGDRLT

SEQ ID NO: 1345754 - protein, 10 aa, Mycobacterium
RAADTYLGQA

SEQ ID NO: 1345755 - protein, 5 aa, Mycobacterium
RAAEA

SEQ ID NO: 1345756 - protein, 11 aa, Mycobacterium
RAAEAQARRAI

SEQ ID NO: 1345757 - protein, 8 aa, Mycobacterium
RAAESDNV

SEQ ID NO: 1345758 - protein, 7 aa, Mycobacterium
RAAESGM

SEQ ID NO: 1345759 - protein, 9 aa, Mycobacterium
RAAGDAAVA

SEQ ID NO: 1345760 - protein, 17 aa, Mycobacterium
RAAGERLRERPPGRRPD

SEQ ID NO: 1345761 - protein, 8 aa, Mycobacterium
RAAGGGAD

SEQ ID NO: 1345762 - protein, 13 aa, Mycobacterium
RAAGLDTPEDLEP

SEQ ID NO: 1345763 - protein, 10 aa, Mycobacterium
RAAPATSKGV

SEQ ID NO: 1345764 - protein, 30 aa, Mycobacterium
RAAPTTSVTSSTGALTTTTTASVPAPTAED

SEQ ID NO: 1345765 - protein, 7 aa, Mycobacterium
RAARSHA

SEQ ID NO: 1345766 - protein, 8 aa, Mycobacterium
RAATGRDI

SEQ ID NO: 1345767 - protein, 8 aa, Mycobacterium
RADAADLK

SEQ ID NO: 1345768 - protein, 8 aa, Mycobacterium
RADAASRG

SEQ ID NO: 1345769 - protein, 17 aa, Mycobacterium
RADEPFDPNYHKASDTL

SEQ ID NO: 1345770 - protein, 9 aa, Mycobacterium
RADGTSRGA

SEQ ID NO: 1345771 - protein, 7 aa, Mycobacterium
RADGVPV

SEQ ID NO: 1345772 - protein, 4 aa, Mycobacterium
RADP

SEQ ID NO: 1345773 - protein, 4 aa, Mycobacterium
RADQ

SEQ ID NO: 1345774 - protein, 7 aa, Mycobacterium
RADSRDE

SEQ ID NO: 1345775 - protein, 7 aa, Mycobacterium
RAELGEY

SEQ ID NO: 1345776 - protein, 4 aa, Mycobacterium
RAEN

SEQ ID NO: 1345777 - protein, 4 aa, Mycobacterium
RAEP

SEQ ID NO: 1345778 - protein, 14 aa, Mycobacterium
RAFEDAKDRAAQYA

SEQ ID NO: 1345779 - protein, 13 aa, Mycobacterium
RAGAHAAGGLGQP

SEQ ID NO: 1345780 - protein, 21 aa, Mycobacterium
RAGAPGSGDWAATRGGSSGRA

SEQ ID NO: 1345781 - protein, 11 aa, Mycobacterium
RAGDGSGADGV

SEQ ID NO: 1345782 - protein, 8 aa, Mycobacterium
RAGDPALP

SEQ ID NO: 1345783 - protein, 8 aa, Mycobacterium
RAGDPLSR

SEQ ID NO: 1345784 - protein, 7 aa, Mycobacterium
RAGFTGK

SEQ ID NO: 1345785 - protein, 6 aa, Mycobacterium
RAGKED

SEQ ID NO: 1345786 - protein, 9 aa, Mycobacterium
RAGLPSEIG

SEQ ID NO: 1345787 - protein, 6 aa, Mycobacterium
RAGSWE

SEQ ID NO: 1345788 - protein, 15 aa, Mycobacterium
RAGTFNDEEGESTDV

SEQ ID NO: 1345789 - protein, 5 aa, Mycobacterium
RAGTG

SEQ ID NO: 1345790 - protein, 11 aa, Mycobacterium
RAGTGSPYDAL

SEQ ID NO: 1345791 - protein, 6 aa, Mycobacterium
RAIDST

SEQ ID NO: 1345792 - protein, 40 aa, Mycobacterium
RAIETPAEPVADAPAQTAPDPADDVESADAPPPSVAPTPV

SEQ ID NO: 1345793 - protein, 4 aa, Mycobacterium
RAPA

SEQ ID NO: 1345794 - protein, 5 aa, Mycobacterium
RAPAP

SEQ ID NO: 1345795 - protein, 5 aa, Mycobacterium
RAPDP

SEQ ID NO: 1345796 - protein, 6 aa, Mycobacterium
RAPERV

SEQ ID NO: 1345797 - protein, 4 aa, Mycobacterium
RAPF

SEQ ID NO: 1345798 - protein, 5 aa, Mycobacterium
RAPLG

SEQ ID NO: 1345799 - protein, 6 aa, Mycobacterium
RAPTRA

SEQ ID NO: 1345800 - protein, 35 aa, Mycobacterium
RAQAGQQSDAHHRGTAGARGDPVPRAGAGAPEDVP

SEQ ID NO: 1345801 - protein, 11 aa, Mycobacterium
RAQPGMGGATG

SEQ ID NO: 1345802 - protein, 12 aa, Mycobacterium
RAQRTRHRAAVG

SEQ ID NO: 1345803 - protein, 9 aa, Mycobacterium
RAQSDGYQY

SEQ ID NO: 1345804 - protein, 9 aa, Mycobacterium
RARDNGAER

SEQ ID NO: 1345805 - protein, 4 aa, Mycobacterium
RARG

SEQ ID NO: 1345806 - protein, 37 aa, Mycobacterium
RARTEQVNRESAARLAKKQADDAVKAAETSQQDAVSA

SEQ ID NO: 1345807 - protein, 11 aa, Mycobacterium
RASAPLPEGMR

SEQ ID NO: 1345808 - protein, 8 aa, Mycobacterium
RASGELEA

SEQ ID NO: 1345809 - protein, 9 aa, Mycobacterium
RASGTVSDK

SEQ ID NO: 1345810 - protein, 9 aa, Mycobacterium
RASQQRGTP

SEQ ID NO: 1345811 - protein, 6 aa, Mycobacterium
RASTEA

SEQ ID NO: 1345812 - protein, 7 aa, Mycobacterium
RATARAD

SEQ ID NO: 1345813 - protein, 6 aa, Mycobacterium
RATGEL

SEQ ID NO: 1345814 - protein, 6 aa, Mycobacterium
RATPSK

SEQ ID NO: 1345815 - protein, 8 aa, Mycobacterium
RATREGRA

SEQ ID NO: 1345816 - protein, 19 aa, Mycobacterium
RATTPSVGSTGPAGAAAPG

SEQ ID NO: 1345817 - protein, 6 aa, Mycobacterium
RAVDAG

SEQ ID NO: 1345818 - protein, 4 aa, Mycobacterium
RAYV

SEQ ID NO: 1345819 - protein, 6 aa, Mycobacterium
RCATTA

SEQ ID NO: 1345820 - protein, 7 aa, Mycobacterium
RCPGGDV

SEQ ID NO: 1345821 - protein, 4 aa, Mycobacterium
RCQS

SEQ ID NO: 1345822 - protein, 12 aa, Mycobacterium
RCSPSRAVGPQR

SEQ ID NO: 1345823 - protein, 14 aa, Mycobacterium
RDAEAASTAVSDRC

SEQ ID NO: 1345824 - protein, 5 aa, Mycobacterium
RDAGA

SEQ ID NO: 1345825 - protein, 14 aa, Mycobacterium
RDAGAPAPADEAPD

SEQ ID NO: 1345826 - protein, 8 aa, Mycobacterium
RDAGGPVP

SEQ ID NO: 1345827 - protein, 8 aa, Mycobacterium
RDAGNRVQ

SEQ ID NO: 1345828 - protein, 7 aa, Mycobacterium
RDALPDG

SEQ ID NO: 1345829 - protein, 8 aa, Mycobacterium
RDAPHPAA

SEQ ID NO: 1345830 - protein, 7 aa, Mycobacterium
RDASNRL

SEQ ID NO: 1345831 - protein, 6 aa, Mycobacterium
RDATNR

SEQ ID NO: 1345832 - protein, 8 aa, Mycobacterium
RDDEPAEL

SEQ ID NO: 1345833 - protein, 5 aa, Mycobacterium
RDDES

SEQ ID NO: 1345834 - protein, 8 aa, Mycobacterium
RDDLPGVA

SEQ ID NO: 1345835 - protein, 8 aa, Mycobacterium
RDDPGSPL

SEQ ID NO: 1345836 - protein, 10 aa, Mycobacterium
RDDSPEAAAE

SEQ ID NO: 1345837 - protein, 15 aa, Mycobacterium
RDEASGAQEAPETVP

SEQ ID NO: 1345838 - protein, 6 aa, Mycobacterium
RDEGSD

SEQ ID NO: 1345839 - protein, 15 aa, Mycobacterium
RDEPGVESSSGTGHV

SEQ ID NO: 1345840 - protein, 8 aa, Mycobacterium
RDESSPAA

SEQ ID NO: 1345841 - protein, 10 aa, Mycobacterium
RDESTPATLA

SEQ ID NO: 1345842 - protein, 5 aa, Mycobacterium
RDETQ

SEQ ID NO: 1345843 - protein, 9 aa, Mycobacterium
RDETRRERI

SEQ ID NO: 1345844 - protein, 9 aa, Mycobacterium
RDGAPGDEA

SEQ ID NO: 1345845 - protein, 12 aa, Mycobacterium
RDGFEGTDTSSC

SEQ ID NO: 1345846 - protein, 7 aa, Mycobacterium
RDGGGIP

SEQ ID NO: 1345847 - protein, 5 aa, Mycobacterium
RDGGV

SEQ ID NO: 1345848 - protein, 6 aa, Mycobacterium
RDGGVR

SEQ ID NO: 1345849 - protein, 6 aa, Mycobacterium
RDGRSA

SEQ ID NO: 1345850 - protein, 9 aa, Mycobacterium
RDGSATGTA

SEQ ID NO: 1345851 - protein, 9 aa, Mycobacterium
RDGSGTPFD

SEQ ID NO: 1345852 - protein, 6 aa, Mycobacterium
RDGSRM

SEQ ID NO: 1345853 - protein, 9 aa, Mycobacterium
RDGTRRERI

SEQ ID NO: 1345854 - protein, 17 aa, Mycobacterium
RDIPATRNLDGSAAGEW

SEQ ID NO: 1345855 - protein, 24 aa, Mycobacterium
RDKPGNLGQATTNTSGTNAPEGSF

SEQ ID NO: 1345856 - protein, 5 aa, Mycobacterium
RDLST

SEQ ID NO: 1345857 - protein, 6 aa, Mycobacterium
RDLTAE

SEQ ID NO: 1345858 - protein, 13 aa, Mycobacterium
RDLTAGEGDARSI

SEQ ID NO: 1345859 - protein, 20 aa, Mycobacterium
RDNEPALRERTTEQSNAAHA

SEQ ID NO: 1345860 - protein, 5 aa, Mycobacterium
RDNPD

SEQ ID NO: 1345861 - protein, 16 aa, Mycobacterium
RDPDALQAATDAAVTD

SEQ ID NO: 1345862 - protein, 9 aa, Mycobacterium
RDPETTARM

SEQ ID NO: 1345863 - protein, 9 aa, Mycobacterium
RDPGPPPVG

SEQ ID NO: 1345864 - protein, 5 aa, Mycobacterium
RDPSQ

SEQ ID NO: 1345865 - protein, 5 aa, Mycobacterium
RDRGT

SEQ ID NO: 1345866 - protein, 8 aa, Mycobacterium
RDRMPGTT

SEQ ID NO: 1345867 - protein, 4 aa, Mycobacterium
RDRP

SEQ ID NO: 1345868 - protein, 8 aa, Mycobacterium
RDRPASAA

SEQ ID NO: 1345869 - protein, 9 aa, Mycobacterium
RDRQYPDGT

SEQ ID NO: 1345870 - protein, 10 aa, Mycobacterium
RDRSSDPALQ

SEQ ID NO: 1345871 - protein, 12 aa, Mycobacterium
RDRVGGRSYTGT

SEQ ID NO: 1345872 - protein, 5 aa, Mycobacterium
RDRYE

SEQ ID NO: 1345873 - protein, 5 aa, Mycobacterium
RDSKD

SEQ ID NO: 1345874 - protein, 10 aa, Mycobacterium
RDSRAGDPDL

SEQ ID NO: 1345875 - protein, 10 aa, Mycobacterium
RDSTSATAEM

SEQ ID NO: 1345876 - protein, 22 aa, Mycobacterium
RDTAKARLDAARPQTPPDNTAP

SEQ ID NO: 1345877 - protein, 6 aa, Mycobacterium
RDTAPV

SEQ ID NO: 1345878 - protein, 7 aa, Mycobacterium
RDTASEG

SEQ ID NO: 1345879 - protein, 7 aa, Mycobacterium
RDVPTGE

SEQ ID NO: 1345880 - protein, 13 aa, Mycobacterium
RDYAARDAEALAT

SEQ ID NO: 1345881 - protein, 15 aa, Mycobacterium
REAAPDGLGAPYNYT

SEQ ID NO: 1345882 - protein, 24 aa, Mycobacterium
REALNASAAAAGYTTRYGATATLP

SEQ ID NO: 1345883 - protein, 7 aa, Mycobacterium
REAPSDD

SEQ ID NO: 1345884 - protein, 5 aa, Mycobacterium
REDDD

SEQ ID NO: 1345885 - protein, 5 aa, Mycobacterium
REDRL

SEQ ID NO: 1345886 - protein, 5 aa, Mycobacterium
REFTE

SEQ ID NO: 1345887 - protein, 5 aa, Mycobacterium
REGDG

SEQ ID NO: 1345888 - protein, 10 aa, Mycobacterium
REGGRGTAIG

SEQ ID NO: 1345889 - protein, 4 aa, Mycobacterium
REGR

SEQ ID NO: 1345890 - protein, 5 aa, Mycobacterium
REGRL

SEQ ID NO: 1345891 - protein, 5 aa, Mycobacterium
REGVT

SEQ ID NO: 1345892 - protein, 4 aa, Mycobacterium
REGW

SEQ ID NO: 1345893 - protein, 5 aa, Mycobacterium
REHGE

SEQ ID NO: 1345894 - protein, 6 aa, Mycobacterium
RELDGP

SEQ ID NO: 1345895 - protein, 8 aa, Mycobacterium
RELQAQQE

SEQ ID NO: 1345896 - protein, 10 aa, Mycobacterium
REPEARGATV

SEQ ID NO: 1345897 - protein, 13 aa, Mycobacterium
REPLGTATEKFSS

SEQ ID NO: 1345898 - protein, 10 aa, Mycobacterium
REQPVPGWTA

SEQ ID NO: 1345899 - protein, 6 aa, Mycobacterium
RERDRV

SEQ ID NO: 1345900 - protein, 9 aa, Mycobacterium
RERGGPVDA

SEQ ID NO: 1345901 - protein, 5 aa, Mycobacterium
RERLP

SEQ ID NO: 1345902 - protein, 7 aa, Mycobacterium
RERNQQS

SEQ ID NO: 1345903 - protein, 4 aa, Mycobacterium
RERR

SEQ ID NO: 1345904 - protein, 14 aa, Mycobacterium
RESLGTTSDKLAGV

SEQ ID NO: 1345905 - protein, 17 aa, Mycobacterium
RESLGTTSDKLASVSTA

SEQ ID NO: 1345906 - protein, 13 aa, Mycobacterium
RESRGDLGQRATN

SEQ ID NO: 1345907 - protein, 13 aa, Mycobacterium
RFEPSDAGRSGLE

SEQ ID NO: 1345908 - protein, 6 aa, Mycobacterium
RFSTGG

SEQ ID NO: 1345909 - protein, 17 aa, Mycobacterium
RGAADRAERDGDLAKAA

SEQ ID NO: 1345910 - protein, 15 aa, Mycobacterium
RGAAPESFDGVPQPS

SEQ ID NO: 1345911 - protein, 15 aa, Mycobacterium
RGAAPESLDGVPQPS

SEQ ID NO: 1345912 - protein, 5 aa, Mycobacterium
RGAEP

SEQ ID NO: 1345913 - protein, 20 aa, Mycobacterium
RGAGGQSGPIPLERTTSPYQ

SEQ ID NO: 1345914 - protein, 6 aa, Mycobacterium
RGAGYA

SEQ ID NO: 1345915 - protein, 5 aa, Mycobacterium
RGAHD

SEQ ID NO: 1345916 - protein, 12 aa, Mycobacterium
RGALPGGPLQSI

SEQ ID NO: 1345917 - protein, 5 aa, Mycobacterium
RGAQR

SEQ ID NO: 1345918 - protein, 5 aa, Mycobacterium
RGARE

SEQ ID NO: 1345919 - protein, 19 aa, Mycobacterium
RGDADGSNITSARATTKAA

SEQ ID NO: 1345920 - protein, 15 aa, Mycobacterium
RGDHPGGRVGRADVN

SEQ ID NO: 1345921 - protein, 9 aa, Mycobacterium
RGDPGAPTI

SEQ ID NO: 1345922 - protein, 14 aa, Mycobacterium
RGDTDTRGGSTLEQ

SEQ ID NO: 1345923 - protein, 4 aa, Mycobacterium
RGDY

SEQ ID NO: 1345924 - protein, 7 aa, Mycobacterium
RGEDVTA

SEQ ID NO: 1345925 - protein, 5 aa, Mycobacterium
RGEEN

SEQ ID NO: 1345926 - protein, 5 aa, Mycobacterium
RGEES

SEQ ID NO: 1345927 - protein, 9 aa, Mycobacterium
RGEQGGQQV

SEQ ID NO: 1345928 - protein, 22 aa, Mycobacterium
RGGGQVSATTTARQAADPTRRL

SEQ ID NO: 1345929 - protein, 5 aa, Mycobacterium
RGGGR

SEQ ID NO: 1345930 - protein, 6 aa, Mycobacterium
RGGGRH

SEQ ID NO: 1345931 - protein, 5 aa, Mycobacterium
RGGIR

SEQ ID NO: 1345932 - protein, 15 aa, Mycobacterium
RGGQDWSSPPSEQDI

SEQ ID NO: 1345933 - protein, 7 aa, Mycobacterium
RGGYSGQ

SEQ ID NO: 1345934 - protein, 14 aa, Mycobacterium
RGHGQSGDAPPETY

SEQ ID NO: 1345935 - protein, 15 aa, Mycobacterium
RGHGQSGEAPPDTYT

SEQ ID NO: 1345936 - protein, 5 aa, Mycobacterium
RGIGR

SEQ ID NO: 1345937 - protein, 15 aa, Mycobacterium
RGKESVTLNTKTAGG

SEQ ID NO: 1345938 - protein, 8 aa, Mycobacterium
RGKPSVTV

SEQ ID NO: 1345939 - protein, 4 aa, Mycobacterium
RGLS

SEQ ID NO: 1345940 - protein, 11 aa, Mycobacterium
RGPATGNGTTY

SEQ ID NO: 1345941 - protein, 5 aa, Mycobacterium
RGPAV

SEQ ID NO: 1345942 - protein, 17 aa, Mycobacterium
RGPDEPGTWADDTDDPG

SEQ ID NO: 1345943 - protein, 19 aa, Mycobacterium
RGPGAPTSLGQADANSPVS

SEQ ID NO: 1345944 - protein, 4 aa, Mycobacterium
RGPL

SEQ ID NO: 1345945 - protein, 8 aa, Mycobacterium
RGPRGELA

SEQ ID NO: 1345946 - protein, 6 aa, Mycobacterium
RGPRGI

SEQ ID NO: 1345947 - protein, 7 aa, Mycobacterium
RGPVHTG

SEQ ID NO: 1345948 - protein, 6 aa, Mycobacterium
RGPYEL

SEQ ID NO: 1345949 - protein, 7 aa, Mycobacterium
RGQDPFG

SEQ ID NO: 1345950 - protein, 7 aa, Mycobacterium
RGQGTGR

SEQ ID NO: 1345951 - protein, 25 aa, Mycobacterium
RGQQQEAVTPVRKPPTPPPPSVPTD

SEQ ID NO: 1345952 - protein, 11 aa, Mycobacterium
RGQQVTAGTAL

SEQ ID NO: 1345953 - protein, 5 aa, Mycobacterium
RGRAE

SEQ ID NO: 1345954 - protein, 9 aa, Mycobacterium
RGRAPLANT

SEQ ID NO: 1345955 - protein, 7 aa, Mycobacterium
RGRARTE

SEQ ID NO: 1345956 - protein, 8 aa, Mycobacterium
RGRPAPNH

SEQ ID NO: 1345957 - protein, 4 aa, Mycobacterium
RGRQ

SEQ ID NO: 1345958 - protein, 7 aa, Mycobacterium
RGRSGAM

SEQ ID NO: 1345959 - protein, 25 aa, Mycobacterium
RGVGGMSAAQTSTFSTVSPADQTSV

SEQ ID NO: 1345960 - protein, 7 aa, Mycobacterium
RGVRRER

SEQ ID NO: 1345961 - protein, 9 aa, Mycobacterium
RGVSPNGNA

SEQ ID NO: 1345962 - protein, 8 aa, Mycobacterium
RGVSRTGN

SEQ ID NO: 1345963 - protein, 8 aa, Mycobacterium
RGWETDGG

SEQ ID NO: 1345964 - protein, 5 aa, Mycobacterium
RGYAP

SEQ ID NO: 1345965 - protein, 5 aa, Mycobacterium
RHAPD

SEQ ID NO: 1345966 - protein, 11 aa, Mycobacterium
RHDQPGDSRPY

SEQ ID NO: 1345967 - protein, 5 aa, Mycobacterium
RHGRG

SEQ ID NO: 1345968 - protein, 4 aa, Mycobacterium
RHHR

SEQ ID NO: 1345969 - protein, 8 aa, Mycobacterium
RHPAPDDR

SEQ ID NO: 1345970 - protein, 7 aa, Mycobacterium
RHRAQAA

SEQ ID NO: 1345971 - protein, 8 aa, Mycobacterium
RHRAQAAA

SEQ ID NO: 1345972 - protein, 10 aa, Mycobacterium
RIASGARSAC

SEQ ID NO: 1345973 - protein, 5 aa, Mycobacterium
RIGAA

SEQ ID NO: 1345974 - protein, 11 aa, Mycobacterium
RIGPGPDQTPR

SEQ ID NO: 1345975 - protein, 6 aa, Mycobacterium
RIPAGD

SEQ ID NO: 1345976 - protein, 5 aa, Mycobacterium
RITQS

SEQ ID NO: 1345977 - protein, 8 aa, Mycobacterium
RKAEDAEA

SEQ ID NO: 1345978 - protein, 5 aa, Mycobacterium
RKAPN

SEQ ID NO: 1345979 - protein, 7 aa, Mycobacterium
RKERVQE

SEQ ID NO: 1345980 - protein, 8 aa, Mycobacterium
RKNRPAKP

SEQ ID NO: 1345981 - protein, 37 aa, Mycobacterium
RKPAPKTTAAEAAQSDAAVAPDTAPTAAAAPAAAGAT

SEQ ID NO: 1345982 - protein, 32 aa, Mycobacterium
RKRPGSAAAEAAAAAGAGAGAAAEDQGPEATG

SEQ ID NO: 1345983 - protein, 6 aa, Mycobacterium
RKTGRD

SEQ ID NO: 1345984 - protein, 11 aa, Mycobacterium
RKTNSEGGTTT

SEQ ID NO: 1345985 - protein, 10 aa, Mycobacterium
RLGDRTEAAI

SEQ ID NO: 1345986 - protein, 11 aa, Mycobacterium
RLGDRTEAAIK

SEQ ID NO: 1345987 - protein, 7 aa, Mycobacterium
RLGEGAI

SEQ ID NO: 1345988 - protein, 6 aa, Mycobacterium
RLGGAQ

SEQ ID NO: 1345989 - protein, 13 aa, Mycobacterium
RLGKDANGNYVDG

SEQ ID NO: 1345990 - protein, 15 aa, Mycobacterium
RLKAGSAVTGWPGEP

SEQ ID NO: 1345991 - protein, 7 aa, Mycobacterium
RLNAEQS

SEQ ID NO: 1345992 - protein, 14 aa, Mycobacterium
RLPASERDDTERDA

SEQ ID NO: 1345993 - protein, 10 aa, Mycobacterium
RLPEGSRESL

SEQ ID NO: 1345994 - protein, 4 aa, Mycobacterium
RLTD

SEQ ID NO: 1345995 - protein, 9 aa, Mycobacterium
RLTDPQSRV

SEQ ID NO: 1345996 - protein, 7 aa, Mycobacterium
RLTSATQ

SEQ ID NO: 1345997 - protein, 9 aa, Mycobacterium
RMDDDGQRG

SEQ ID NO: 1345998 - protein, 4 aa, Mycobacterium
RMPD

SEQ ID NO: 1345999 - protein, 5 aa, Mycobacterium
RMPTA

SEQ ID NO: 1346000 - protein, 5 aa, Mycobacterium
RMTDP

SEQ ID NO: 1346001 - protein, 6 aa, Mycobacterium
RNAGRD

SEQ ID NO: 1346002 - protein, 9 aa, Mycobacterium
RNAPAPDPL

SEQ ID NO: 1346003 - protein, 10 aa, Mycobacterium
RNDGTTPGRL

SEQ ID NO: 1346004 - protein, 7 aa, Mycobacterium
RNEAEYS

SEQ ID NO: 1346005 - protein, 7 aa, Mycobacterium
RNEDGTN

SEQ ID NO: 1346006 - protein, 6 aa, Mycobacterium
RNEGAE

SEQ ID NO: 1346007 - protein, 7 aa, Mycobacterium
RNGVPQA

SEQ ID NO: 1346008 - protein, 6 aa, Mycobacterium
RNITTY

SEQ ID NO: 1346009 - protein, 7 aa, Mycobacterium
RNKARSV

SEQ ID NO: 1346010 - protein, 7 aa, Mycobacterium
RNPAPNV

SEQ ID NO: 1346011 - protein, 5 aa, Mycobacterium
RNPQQ

SEQ ID NO: 1346012 - protein, 4 aa, Mycobacterium
RNQP

SEQ ID NO: 1346013 - protein, 4 aa, Mycobacterium
RNQT

SEQ ID NO: 1346014 - protein, 11 aa, Mycobacterium
RNRHDAVDGST

SEQ ID NO: 1346015 - protein, 7 aa, Mycobacterium
RNSGRAR

SEQ ID NO: 1346016 - protein, 10 aa, Mycobacterium
RNSPGGHDMP

SEQ ID NO: 1346017 - protein, 9 aa, Mycobacterium
RNTADETAV

SEQ ID NO: 1346018 - protein, 12 aa, Mycobacterium
RNTGQLVTNGNG

SEQ ID NO: 1346019 - protein, 9 aa, Mycobacterium
RNTKRAEAG

SEQ ID NO: 1346020 - protein, 6 aa, Mycobacterium
RPAAQD

SEQ ID NO: 1346021 - protein, 12 aa, Mycobacterium
RPAATSDPRGLG

SEQ ID NO: 1346022 - protein, 4 aa, Mycobacterium
RPAE

SEQ ID NO: 1346023 - protein, 12 aa, Mycobacterium
RPAGEDPAAETV

SEQ ID NO: 1346024 - protein, 29 aa, Mycobacterium
RPANQRGTGAAPASAQTTSESAPSTTQPF

SEQ ID NO: 1346025 - protein, 10 aa, Mycobacterium
RPAPLAETPY

SEQ ID NO: 1346026 - protein, 5 aa, Mycobacterium
RPDDA

SEQ ID NO: 1346027 - protein, 5 aa, Mycobacterium
RPDDR

SEQ ID NO: 1346028 - protein, 10 aa, Mycobacterium
RPDEDVRPWQ

SEQ ID NO: 1346029 - protein, 12 aa, Mycobacterium
RPDLDRPPTRAE

SEQ ID NO: 1346030 - protein, 4 aa, Mycobacterium
RPDR

SEQ ID NO: 1346031 - protein, 4 aa, Mycobacterium
RPEG

SEQ ID NO: 1346032 - protein, 6 aa, Mycobacterium
RPEGCA

SEQ ID NO: 1346033 - protein, 8 aa, Mycobacterium
RPEGGQFA

SEQ ID NO: 1346034 - protein, 6 aa, Mycobacterium
RPETES

SEQ ID NO: 1346035 - protein, 8 aa, Mycobacterium
RPETTEDA

SEQ ID NO: 1346036 - protein, 33 aa, Mycobacterium
RPGANYTSTGRGCASKGNPPQPYCQENGPFSAT

SEQ ID NO: 1346037 - protein, 13 aa, Mycobacterium
RPGESDGACRGFP

SEQ ID NO: 1346038 - protein, 9 aa, Mycobacterium
RPGNPKNIR

SEQ ID NO: 1346039 - protein, 7 aa, Mycobacterium
RPGPYAR

SEQ ID NO: 1346040 - protein, 9 aa, Mycobacterium
RPGQTPQLT

SEQ ID NO: 1346041 - protein, 4 aa, Mycobacterium
RPGT

SEQ ID NO: 1346042 - protein, 9 aa, Mycobacterium
RPHNGGTVA

SEQ ID NO: 1346043 - protein, 7 aa, Mycobacterium
RPHRRPD

SEQ ID NO: 1346044 - protein, 15 aa, Mycobacterium
RPKEGGITVAPEGTH

SEQ ID NO: 1346045 - protein, 5 aa, Mycobacterium
RPLAG

SEQ ID NO: 1346046 - protein, 9 aa, Mycobacterium
RPLPTEAEQ

SEQ ID NO: 1346047 - protein, 16 aa, Mycobacterium
RPLYSRASGSHLLLGF

SEQ ID NO: 1346048 - protein, 6 aa, Mycobacterium
RPNEIT

SEQ ID NO: 1346049 - protein, 6 aa, Mycobacterium
RPNPGI

SEQ ID NO: 1346050 - protein, 4 aa, Mycobacterium
RPPA

SEQ ID NO: 1346051 - protein, 9 aa, Mycobacterium
RPPDQTAPL

SEQ ID NO: 1346052 - protein, 8 aa, Mycobacterium
RPPLKRPG

SEQ ID NO: 1346053 - protein, 9 aa, Mycobacterium
RPPPPPAPA

SEQ ID NO: 1346054 - protein, 5 aa, Mycobacterium
RPPPV

SEQ ID NO: 1346055 - protein, 10 aa, Mycobacterium
RPPRTPADRH

SEQ ID NO: 1346056 - protein, 4 aa, Mycobacterium
RPQA

SEQ ID NO: 1346057 - protein, 8 aa, Mycobacterium
RPQGCSDG

SEQ ID NO: 1346058 - protein, 10 aa, Mycobacterium
RPQVGTDGAP

SEQ ID NO: 1346059 - protein, 13 aa, Mycobacterium
RPTATDPTLAPAG

SEQ ID NO: 1346060 - protein, 9 aa, Mycobacterium
RPTEPGGVS

SEQ ID NO: 1346061 - protein, 5 aa, Mycobacterium
RPTGC

SEQ ID NO: 1346062 - protein, 19 aa, Mycobacterium
RPTGREVSASPVEWTVLAE

SEQ ID NO: 1346063 - protein, 5 aa, Mycobacterium
RPTPF

SEQ ID NO: 1346064 - protein, 5 aa, Mycobacterium
RPTPN

SEQ ID NO: 1346065 - protein, 5 aa, Mycobacterium
RPTVD

SEQ ID NO: 1346066 - protein, 12 aa, Mycobacterium
RPTVEDGGGYRK

SEQ ID NO: 1346067 - protein, 6 aa, Mycobacterium
RPVEGD

SEQ ID NO: 1346068 - protein, 4 aa, Mycobacterium
RPVP

SEQ ID NO: 1346069 - protein, 7 aa, Mycobacterium
RPVTGPP

SEQ ID NO: 1346070 - protein, 8 aa, Mycobacterium
RQAEADGI

SEQ ID NO: 1346071 - protein, 7 aa, Mycobacterium
RQAGDKL

SEQ ID NO: 1346072 - protein, 11 aa, Mycobacterium
RQANGDAATDQ

SEQ ID NO: 1346073 - protein, 4 aa, Mycobacterium
RQAR

SEQ ID NO: 1346074 - protein, 9 aa, Mycobacterium
RQDDPPVRS

SEQ ID NO: 1346075 - protein, 12 aa, Mycobacterium
RQDQQARATQRK

SEQ ID NO: 1346076 - protein, 7 aa, Mycobacterium
RQGQKAT

SEQ ID NO: 1346077 - protein, 5 aa, Mycobacterium
RQGSG

SEQ ID NO: 1346078 - protein, 7 aa, Mycobacterium
RQGTATD

SEQ ID NO: 1346079 - protein, 4 aa, Mycobacterium
RQGW

SEQ ID NO: 1346080 - protein, 5 aa, Mycobacterium
RQLPP

SEQ ID NO: 1346081 - protein, 6 aa, Mycobacterium
RQNRRD

SEQ ID NO: 1346082 - protein, 6 aa, Mycobacterium
RQPGGK

SEQ ID NO: 1346083 - protein, 12 aa, Mycobacterium
RQPKPRQYAQPV

SEQ ID NO: 1346084 - protein, 9 aa, Mycobacterium
RQPTRAIGT

SEQ ID NO: 1346085 - protein, 13 aa, Mycobacterium
RQQSSSLDQISGN

SEQ ID NO: 1346086 - protein, 15 aa, Mycobacterium
RQRRQDDAINPRPRR

SEQ ID NO: 1346087 - protein, 13 aa, Mycobacterium
RQRRQDDAITPRR

SEQ ID NO: 1346088 - protein, 11 aa, Mycobacterium
RQRRSAEQAGI

SEQ ID NO: 1346089 - protein, 9 aa, Mycobacterium
RQSRPVGAG

SEQ ID NO: 1346090 - protein, 4 aa, Mycobacterium
RRAD

SEQ ID NO: 1346091 - protein, 8 aa, Mycobacterium
RRAPRGDE

SEQ ID NO: 1346092 - protein, 10 aa, Mycobacterium
RRDGRMATAS

SEQ ID NO: 1346093 - protein, 9 aa, Mycobacterium
RRDGSSVYS

SEQ ID NO: 1346094 - protein, 14 aa, Mycobacterium
RREEPLKATAADVE

SEQ ID NO: 1346095 - protein, 4 aa, Mycobacterium
RREG

SEQ ID NO: 1346096 - protein, 5 aa, Mycobacterium
RRGDG

SEQ ID NO: 1346097 - protein, 6 aa, Mycobacterium
RRGELG

SEQ ID NO: 1346098 - protein, 4 aa, Mycobacterium
RRGF

SEQ ID NO: 1346099 - protein, 13 aa, Mycobacterium
RRGRHRRGRPRRL

SEQ ID NO: 1346100 - protein, 7 aa, Mycobacterium
RRGVPSA

SEQ ID NO: 1346101 - protein, 8 aa, Mycobacterium
RRIGTPFA

SEQ ID NO: 1346102 - protein, 12 aa, Mycobacterium
RRKIKDPRAFDA

SEQ ID NO: 1346103 - protein, 8 aa, Mycobacterium
RRNAELDD

SEQ ID NO: 1346104 - protein, 6 aa, Mycobacterium
RRNGKD

SEQ ID NO: 1346105 - protein, 11 aa, Mycobacterium
RRNPQDRPAAP

SEQ ID NO: 1346106 - protein, 7 aa, Mycobacterium
RRPDGPV

SEQ ID NO: 1346107 - protein, 10 aa, Mycobacterium
RRPELYGTGA

SEQ ID NO: 1346108 - protein, 8 aa, Mycobacterium
RRPGTLDK

SEQ ID NO: 1346109 - protein, 20 aa, Mycobacterium
RRPSESAASQKSAAAGTSAL

SEQ ID NO: 1346110 - protein, 9 aa, Mycobacterium
RRRESQARC

SEQ ID NO: 1346111 - protein, 22 aa, Mycobacterium
RRRGRGPQHRRPPPHPRPERRL

SEQ ID NO: 1346112 - protein, 9 aa, Mycobacterium
RRRSGRRVS

SEQ ID NO: 1346113 - protein, 11 aa, Mycobacterium
RRRYRSKLSGP

SEQ ID NO: 1346114 - protein, 14 aa, Mycobacterium
RRSAAAPATAHALA

SEQ ID NO: 1346115 - protein, 7 aa, Mycobacterium
RRSAPDL

SEQ ID NO: 1346116 - protein, 6 aa, Mycobacterium
RRSAVA

SEQ ID NO: 1346117 - protein, 14 aa, Mycobacterium
RRTAPSASPSITTF

SEQ ID NO: 1346118 - protein, 8 aa, Mycobacterium
RRTASTAQ

SEQ ID NO: 1346119 - protein, 6 aa, Mycobacterium
RRTDIS

SEQ ID NO: 1346120 - protein, 5 aa, Mycobacterium
RRTDQ

SEQ ID NO: 1346121 - protein, 4 aa, Mycobacterium
RRVR

SEQ ID NO: 1346122 - protein, 8 aa, Mycobacterium
RSADGPMR

SEQ ID NO: 1346123 - protein, 9 aa, Mycobacterium
RSADGPVLK

SEQ ID NO: 1346124 - protein, 12 aa, Mycobacterium
RSADHMAPSEQA

SEQ ID NO: 1346125 - protein, 23 aa, Mycobacterium
RSADPDPSRPVARPGQGPPEDVD

SEQ ID NO: 1346126 - protein, 8 aa, Mycobacterium
RSADTAVA

SEQ ID NO: 1346127 - protein, 12 aa, Mycobacterium
RSASSGTALAQG

SEQ ID NO: 1346128 - protein, 7 aa, Mycobacterium
RSAVDDD

SEQ ID NO: 1346129 - protein, 10 aa, Mycobacterium
RSDAALSNAV

SEQ ID NO: 1346130 - protein, 5 aa, Mycobacterium
RSDAE

SEQ ID NO: 1346131 - protein, 33 aa, Mycobacterium; identical to SEQ ID NO: 1103291

SEQ ID NO: 1346132 - protein, 10 aa, Mycobacterium
RSDEHDAAAA

SEQ ID NO: 1346133 - protein, 6 aa, Mycobacterium
RSDGGV

SEQ ID NO: 1346134 - protein, 5 aa, Mycobacterium
RSDGT

SEQ ID NO: 1346135 - protein, 9 aa, Mycobacterium
RSDPDGDQV

SEQ ID NO: 1346136 - protein, 9 aa, Mycobacterium
RSDYSEPTR

SEQ ID NO: 1346137 - protein, 5 aa, Mycobacterium
RSEAR

SEQ ID NO: 1346138 - protein, 7 aa, Mycobacterium
RSEDGYR

SEQ ID NO: 1346139 - protein, 17 aa, Mycobacterium
RSEDTPGCTADDYNGLP

SEQ ID NO: 1346140 - protein, 6 aa, Mycobacterium
RSEGSV

SEQ ID NO: 1346141 - protein, 18 aa, Mycobacterium
RSEPTADWQRSRQPTIAR

SEQ ID NO: 1346142 - protein, 9 aa, Mycobacterium
RSFGADPTA

SEQ ID NO: 1346143 - protein, 10 aa, Mycobacterium
RSGDARPLRD

SEQ ID NO: 1346144 - protein, 8 aa, Mycobacterium
RSGGAPTV

SEQ ID NO: 1346145 - protein, 10 aa, Mycobacterium
RSGGLYPTGN

SEQ ID NO: 1346146 - protein, 8 aa, Mycobacterium
RSGLPDHA

SEQ ID NO: 1346147 - protein, 11 aa, Mycobacterium
RSHDDAGRAVA

SEQ ID NO: 1346148 - protein, 7 aa, Mycobacterium
RSHQPGS

SEQ ID NO: 1346149 - protein, 4 aa, Mycobacterium
RSKG

SEQ ID NO: 1346150 - protein, 8 aa, Mycobacterium
RSKTGKSV

SEQ ID NO: 1346151 - protein, 5 aa, Mycobacterium
RSLPG

SEQ ID NO: 1346152 - protein, 11 aa, Mycobacterium
RSMTRADRSIA

SEQ ID NO: 1346153 - protein, 8 aa, Mycobacterium
RSPAGEVL

SEQ ID NO: 1346154 - protein, 6 aa, Mycobacterium
RSPEDF

SEQ ID NO: 1346155 - protein, 6 aa, Mycobacterium
RSPEEI

SEQ ID NO: 1346156 - protein, 6 aa, Mycobacterium
RSPGEG

SEQ ID NO: 1346157 - protein, 7 aa, Mycobacterium
RSPHYQD

SEQ ID NO: 1346158 - protein, 10 aa, Mycobacterium
RSPQQSNPSW

SEQ ID NO: 1346159 - protein, 4 aa, Mycobacterium
RSQG

SEQ ID NO: 1346160 - protein, 14 aa, Mycobacterium
RSRADADGTPSSLA

SEQ ID NO: 1346161 - protein, 4 aa, Mycobacterium
RSRD

SEQ ID NO: 1346162 - protein, 7 aa, Mycobacterium
RSRDAVT

SEQ ID NO: 1346163 - protein, 7 aa, Mycobacterium
RSRDQID

SEQ ID NO: 1346164 - protein, 32 aa, Mycobacterium
RSRFDNPPRTPSRSASCGPDSTLQMSSGPGVS

SEQ ID NO: 1346165 - protein, 6 aa, Mycobacterium
RSRHRS

SEQ ID NO: 1346166 - protein, 5 aa, Mycobacterium
RSRPA

SEQ ID NO: 1346167 - protein, 9 aa, Mycobacterium
RSRRGGQFD

SEQ ID NO: 1346168 - protein, 14 aa, Mycobacterium
RSSAESCHAGAPGV

SEQ ID NO: 1346169 - protein, 12 aa, Mycobacterium
RSSAGAGPNGNG

SEQ ID NO: 1346170 - protein, 12 aa, Mycobacterium
RSSETTKAQTSA

SEQ ID NO: 1346171 - protein, 5 aa, Mycobacterium
RSSGG

SEQ ID NO: 1346172 - protein, 5 aa, Mycobacterium
RSSKK

SEQ ID NO: 1346173 - protein, 13 aa, Mycobacterium
RSTDFPDGAQLVS

SEQ ID NO: 1346174 - protein, 9 aa, Mycobacterium
RSTDGARTF

SEQ ID NO: 1346175 - protein, 24 aa, Mycobacterium
RSTVQGDDSASQQVITGKVYYVDV

SEQ ID NO: 1346176 - protein, 4 aa, Mycobacterium
RTAA

SEQ ID NO: 1346177 - protein, 5 aa, Mycobacterium
RTADA

SEQ ID NO: 1346178 - protein, 5 aa, Mycobacterium
RTAEL

SEQ ID NO: 1346179 - protein, 14 aa, Mycobacterium
RTAGMTPYVIRIIE

SEQ ID NO: 1346180 - protein, 13 aa, Mycobacterium
RTAPSASPSITTF

SEQ ID NO: 1346181 - protein, 10 aa, Mycobacterium
RTARQEADEL

SEQ ID NO: 1346182 - protein, 6 aa, Mycobacterium
RTASTV

SEQ ID NO: 1346183 - protein, 9 aa, Mycobacterium
RTGEEGKPC

SEQ ID NO: 1346184 - protein, 5 aa, Mycobacterium
RTGGE

SEQ ID NO: 1346185 - protein, 10 aa, Mycobacterium
RTGQGGEPRM

SEQ ID NO: 1346186 - protein, 11 aa, Mycobacterium
RTGRAASAGRV

SEQ ID NO: 1346187 - protein, 7 aa, Mycobacterium
RTGVSDH

SEQ ID NO: 1346188 - protein, 4 aa, Mycobacterium
RTHR

SEQ ID NO: 1346189 - protein, 11 aa, Mycobacterium
RTIEAQQERER

SEQ ID NO: 1346190 - protein, 4 aa, Mycobacterium
RTKP

SEQ ID NO: 1346191 - protein, 13 aa, Mycobacterium
RTLAGETVLAELP

SEQ ID NO: 1346192 - protein, 10 aa, Mycobacterium
RTLGGDNGYA

SEQ ID NO: 1346193 - protein, 18 aa, Mycobacterium
RTLGGKPALDIAGNGRYA

SEQ ID NO: 1346194 - protein, 12 aa, Mycobacterium
RTNDRISSLVAP

SEQ ID NO: 1346195 - protein, 8 aa, Mycobacterium
RTPESTVA

SEQ ID NO: 1346196 - protein, 7 aa, Mycobacterium
RTPNPAA

SEQ ID NO: 1346197 - protein, 6 aa, Mycobacterium
RTPQGY

SEQ ID NO: 1346198 - protein, 8 aa, Mycobacterium
RTQETAAP

SEQ ID NO: 1346199 - protein, 7 aa, Mycobacterium
RTQTGEL

SEQ ID NO: 1346200 - protein, 19 aa, Mycobacterium
RTRDGKSFNTRRVTASQDG

SEQ ID NO: 1346201 - protein, 14 aa, Mycobacterium
RTREGSRSAGGEHA

SEQ ID NO: 1346202 - protein, 5 aa, Mycobacterium
RTRTP

SEQ ID NO: 1346203 - protein, 17 aa, Mycobacterium
RTSADSATHAAGALSGY

SEQ ID NO: 1346204 - protein, 22 aa, Mycobacterium
RTSLSDQPKPPPQKPPKLGPPN

SEQ ID NO: 1346205 - protein, 22 aa, Mycobacterium
RTSLSDQPKPPPQKQPKLPPPN

SEQ ID NO: 1346206 - protein, 13 aa, Mycobacterium
RTSSTGATAADQA

SEQ ID NO: 1346207 - protein, 8 aa, Mycobacterium
RTSTGRGD

SEQ ID NO: 1346208 - protein, 18 aa, Mycobacterium
RTTSTTEKVREPIGTGPY

SEQ ID NO: 1346209 - protein, 6 aa, Mycobacterium
RTVAAA

SEQ ID NO: 1346210 - protein, 12 aa, Mycobacterium
RTVTESDSADLT

SEQ ID NO: 1346211 - protein, 10 aa, Mycobacterium
RVASGARSAC

SEQ ID NO: 1346212 - protein, 6 aa, Mycobacterium
RVDGDR

SEQ ID NO: 1346213 - protein, 7 aa, Mycobacterium
RVDGERG

SEQ ID NO: 1346214 - protein, 14 aa, Mycobacterium
RVDPQVGQKATPAL

SEQ ID NO: 1346215 - protein, 8 aa, Mycobacterium
RVDVGPDT

SEQ ID NO: 1346216 - protein, 16 aa, Mycobacterium
RVETDEAARKEQYAGA

SEQ ID NO: 1346217 - protein, 4 aa, Mycobacterium
RVNA

SEQ ID NO: 1346218 - protein, 7 aa, Mycobacterium
RVNPSSL

SEQ ID NO: 1346219 - protein, 5 aa, Mycobacterium
RVPQE

SEQ ID NO: 1346220 - protein, 17 aa, Mycobacterium
RVPTEAEPWPRAAEPRR

SEQ ID NO: 1346221 - protein, 12 aa, Mycobacterium
RVQPGKRPRSTM

SEQ ID NO: 1346222 - protein, 11 aa, Mycobacterium
RVQSTAAKCRG

SEQ ID NO: 1346223 - protein, 4 aa, Mycobacterium
RVSG

SEQ ID NO: 1346224 - protein, 11 aa, Mycobacterium
RVSSDPEAPED

SEQ ID NO: 1346225 - protein, 11 aa, Mycobacterium
RVTDDDPHRDE

SEQ ID NO: 1346226 - protein, 15 aa, Mycobacterium
RVTDPSSATDADLDA

SEQ ID NO: 1346227 - protein, 5 aa, Mycobacterium
RVTPV

SEQ ID NO: 1346228 - protein, 11 aa, Mycobacterium
RWAQDNPQQWA

SEQ ID NO: 1346229 - protein, 8 aa, Mycobacterium
RWETSGDY

SEQ ID NO: 1346230 - protein, 6 aa, Mycobacterium
RWGDQN

SEQ ID NO: 1346231 - protein, 15 aa, Mycobacterium
RWGQSAGENQYYTDG

SEQ ID NO: 1346232 - protein, 5 aa, Mycobacterium
RWSPD

SEQ ID NO: 1346233 - protein, 7 aa, Mycobacterium
RWSPTGD

SEQ ID NO: 1346234 - protein, 11 aa, Mycobacterium
RWTTGSAKTTL

SEQ ID NO: 1346235 - protein, 14 aa, Mycobacterium
RYASDGDGDGKADV

SEQ ID NO: 1346236 - protein, 15 aa, Mycobacterium
RYDGGGLPGGVGGDD

SEQ ID NO: 1346237 - protein, 5 aa, Mycobacterium
RYPQN

SEQ ID NO: 1346238 - protein, 12 aa, Mycobacterium
RYRDDSAQRGGP

SEQ ID NO: 1346239 - protein, 7 aa, Mycobacterium
RYTPADD

SEQ ID NO: 1346240 - protein, 4 aa, Mycobacterium
SAAA

SEQ ID NO: 1346241 - protein, 8 aa, Mycobacterium
SAAAAPQD

SEQ ID NO: 1346242 - protein, 6 aa, Mycobacterium
SAAADP

SEQ ID NO: 1346243 - protein, 8 aa, Mycobacterium
SAAAEGVP

SEQ ID NO: 1346244 - protein, 15 aa, Mycobacterium
SAAAETDTATASTGL

SEQ ID NO: 1346245 - protein, 9 aa, Mycobacterium
SAAAETEDL

SEQ ID NO: 1346246 - protein, 18 aa, Mycobacterium
SAAAPAPELNGPRGAEDS

SEQ ID NO: 1346247 - protein, 10 aa, Mycobacterium
SAADDDPRGT

SEQ ID NO: 1346248 - protein, 12 aa, Mycobacterium
SAAEGVARSPVG

SEQ ID NO: 1346249 - protein, 7 aa, Mycobacterium
SAAGGAV

SEQ ID NO: 1346250 - protein, 6 aa, Mycobacterium
SAAGTD

SEQ ID NO: 1346251 - protein, 20 aa, Mycobacterium
SAAGTNAASGGTGGAGGNGG

SEQ ID NO: 1346252 - protein, 10 aa, Mycobacterium
SAALASQAYN

SEQ ID NO: 1346253 - protein, 12 aa, Mycobacterium
SAAPAQADPTTD

SEQ ID NO: 1346254 - protein, 6 aa, Mycobacterium
SAAPAS

SEQ ID NO: 1346255 - protein, 7 aa, Mycobacterium
SAAPVGA

SEQ ID NO: 1346256 - protein, 4 aa, Mycobacterium
SAAQ

SEQ ID NO: 1346257 - protein, 5 aa, Mycobacterium
SAAQD

SEQ ID NO: 1346258 - protein, 7 aa, Mycobacterium
SAAQFSA

SEQ ID NO: 1346259 - protein, 8 aa, Mycobacterium
SAARFSDA

SEQ ID NO: 1346260 - protein, 19 aa, Mycobacterium
SAASAQMRHRGPDEPGTWN

SEQ ID NO: 1346261 - protein, 17 aa, Mycobacterium
SAASGAGTGGGAWTPTF

SEQ ID NO: 1346262 - protein, 10 aa, Mycobacterium
SAASRVYSGK

SEQ ID NO: 1346263 - protein, 5 aa, Mycobacterium
SAATS

SEQ ID NO: 1346264 - protein, 10 aa, Mycobacterium
SAATTLSDEI

SEQ ID NO: 1346265 - protein, 5 aa, Mycobacterium
SADCT

SEQ ID NO: 1346266 - protein, 6 aa, Mycobacterium
SADDGC

SEQ ID NO: 1346267 - protein, 5 aa, Mycobacterium
SADDI

SEQ ID NO: 1346268 - protein, 8 aa, Mycobacterium
SADDPDTV

SEQ ID NO: 1346269 - protein, 7 aa, Mycobacterium
SADEAVQ

SEQ ID NO: 1346270 - protein, 6 aa, Mycobacterium
SADGST

SEQ ID NO: 1346271 - protein, 5 aa, Mycobacterium
SADGV

SEQ ID NO: 1346272 - protein, 12 aa, Mycobacterium
SADMQDRVNEGA

SEQ ID NO: 1346273 - protein, 5 aa, Mycobacterium
SADPR

SEQ ID NO: 1346274 - protein, 11 aa, Mycobacterium
SADSALDDTRF

SEQ ID NO: 1346275 - protein, 6 aa, Mycobacterium
SAEATA

SEQ ID NO: 1346276 - protein, 14 aa, Mycobacterium
SAEPAVPDAGQLTS

SEQ ID NO: 1346277 - protein, 7 aa, Mycobacterium
SAEPGTD

SEQ ID NO: 1346278 - protein, 8 aa, Mycobacterium
SAEPGTDA

SEQ ID NO: 1346279 - protein, 9 aa, Mycobacterium
SAERGEADR

SEQ ID NO: 1346280 - protein, 8 aa, Mycobacterium
SAETTGTR

SEQ ID NO: 1346281 - protein, 4 aa, Mycobacterium
SAFP

SEQ ID NO: 1346282 - protein, 27 aa, Mycobacterium
SAFTGGGDVPPPSGWGTPPGPSAPATL

SEQ ID NO: 1346283 - protein, 6 aa, Mycobacterium
SAGADG

SEQ ID NO: 1346284 - protein, 9 aa, Mycobacterium
SAGCGDASS

SEQ ID NO: 1346285 - protein, 13 aa, Mycobacterium
SAGGGLAAGTAGY

SEQ ID NO: 1346286 - protein, 7 aa, Mycobacterium
SAGPIDG

SEQ ID NO: 1346287 - protein, 8 aa, Mycobacterium
SAGPQRNI

SEQ ID NO: 1346288 - protein, 7 aa, Mycobacterium
SAGPVDV

SEQ ID NO: 1346289 - protein, 11 aa, Mycobacterium
SAGQSADLSNA

SEQ ID NO: 1346290 - protein, 25 aa, Mycobacterium
SAGQVSQTATQEPAVNGTSATAGPI

SEQ ID NO: 1346291 - protein, 7 aa, Mycobacterium
SAGRQGQ

SEQ ID NO: 1346292 - protein, 24 aa, Mycobacterium
SAGRTAPEGDAAALDAPPGQRRDQ

SEQ ID NO: 1346293 - protein, 11 aa, Mycobacterium
SAHADPGPFSD

SEQ ID NO: 1346294 - protein, 4 aa, Mycobacterium
SAID

SEQ ID NO: 1346295 - protein, 19 aa, Mycobacterium
SAKAPTPPPPPPPSDPTFA

SEQ ID NO: 1346296 - protein, 10 aa, Mycobacterium
SAKGESPGRW

SEQ ID NO: 1346297 - protein, 5 aa, Mycobacterium
SAKHK

SEQ ID NO: 1346298 - protein, 10 aa, Mycobacterium
SALAARAEEM

SEQ ID NO: 1346299 - protein, 5 aa, Mycobacterium
SALQQ

SEQ ID NO: 1346300 - protein, 7 aa, Mycobacterium
SAMPRGG

SEQ ID NO: 1346301 - protein, 6 aa, Mycobacterium
SANRDG

SEQ ID NO: 1346302 - protein, 16 aa, Mycobacterium
SAPAGTPRELKGANHN

SEQ ID NO: 1346303 - protein, 6 aa, Mycobacterium
SAPAKP

SEQ ID NO: 1346304 - protein, 7 aa, Mycobacterium
SAPAVAT

SEQ ID NO: 1346305 - protein, 8 aa, Mycobacterium
SAPAYSAA

SEQ ID NO: 1346306 - protein, 7 aa, Mycobacterium
SAPEARY

SEQ ID NO: 1346307 - protein, 20 aa, Mycobacterium
SAPEPVAPAPVPPAPGEAAP

SEQ ID NO: 1346308 - protein, 24 aa, Mycobacterium
SAPGTLRTGSRGCCSKEDAGDARR

SEQ ID NO: 1346309 - protein, 85 aa, Mycobacterium
SAPGVAHAEPSAPSASSESSSTTTTSNEESSAKVGTTADDGAAAPDDEAEKEVAEADDEEVVDEDEDEDEEAQDVEAQDVEAQDA

SEQ ID NO: 1346310 - protein, 8 aa, Mycobacterium
SAPMPTDA

SEQ ID NO: 1346311 - protein, 10 aa, Mycobacterium
SAPPVSGGAI

SEQ ID NO: 1346312 - protein, 5 aa, Mycobacterium
SAPRC

SEQ ID NO: 1346313 - protein, 9 aa, Mycobacterium
SAPRGLRTS

SEQ ID NO: 1346314 - protein, 19 aa, Mycobacterium
SAPRPRASTVNAPVPATGV

SEQ ID NO: 1346315 - protein, 20 aa, Mycobacterium
SAPSQPPPPSTPSSAVPSVG

SEQ ID NO: 1346316 - protein, 4 aa, Mycobacterium
SAPT

SEQ ID NO: 1346317 - protein, 33 aa, Mycobacterium
SAQGEVRDGTKAVVGSKSRPFRGGFPAGPAIGD

SEQ ID NO: 1346318 - protein, 27 aa, Mycobacterium
SAQTLGGALDRAGESLANSFSADNPFG

SEQ ID NO: 1346319 - protein, 6 aa, Mycobacterium
SAREHF

SEQ ID NO: 1346320 - protein, 26 aa, Mycobacterium
SARPTPAPAPAAPATAQPALESDPAR

SEQ ID NO: 1346321 - protein, 27 aa, Mycobacterium
SARRGSAEPGEAAAEVPNSAPSVTTSV

SEQ ID NO: 1346322 - protein, 10 aa, Mycobacterium
SASAPTGELP

SEQ ID NO: 1346323 - protein, 130 aa, Mycobacterium
SASGATPPAPPAPGGPSVSSVENVSPPAPPAPGGGSSSTVERFSPPAPPAPAVPAANSVEAVTPPAPPAPGGPSVSSVENVSPPAPPAPGGGSSSTVERFSPPAPPAPAVPAANSVEAVTPPAPPAPPAA

SEQ ID NO: 1346324 - protein, 9 aa, Mycobacterium
SASGTNAEK

SEQ ID NO: 1346325 - protein, 12 aa, Mycobacterium
SASGWDTKSVRE

SEQ ID NO: 1346326 - protein, 7 aa, Mycobacterium
SASSAEH

SEQ ID NO: 1346327 - protein, 10 aa, Mycobacterium
SASSEDPSQY

SEQ ID NO: 1346328 - protein, 9 aa, Mycobacterium
SASTESTVV

SEQ ID NO: 1346329 - protein, 11 aa, Mycobacterium
SATADKAAAAA

SEQ ID NO: 1346330 - protein, 10 aa, Mycobacterium
SATASADEIG

SEQ ID NO: 1346331 - protein, 8 aa, Mycobacterium
SATEEANA

SEQ ID NO: 1346332 - protein, 14 aa, Mycobacterium
SATPCPQRSCSGPR

SEQ ID NO: 1346333 - protein, 8 aa, Mycobacterium
SATRRDLD

SEQ ID NO: 1346334 - protein, 5 aa, Mycobacterium
SATVP

SEQ ID NO: 1346335 - protein, 8 aa, Mycobacterium
SAVGPGPF

SEQ ID NO: 1346336 - protein, 23 aa, Mycobacterium
SAVGTVTNDDVATPTPGNSSATL

SEQ ID NO: 1346337 - protein, 4 aa, Mycobacterium
SAVI

SEQ ID NO: 1346338 - protein, 11 aa, Mycobacterium
SAWAGDAGPNM

SEQ ID NO: 1346339 - protein, 41 aa, Mycobacterium; identical to SEQ ID NO: 916280

SEQ ID NO: 1346340 - protein, 10 aa, Mycobacterium
SCGAGDGDGI

SEQ ID NO: 1346341 - protein, 34 aa, Mycobacterium
SCSGPTVVNTDESTVPPRPSASAAPTTTRPSNAH

SEQ ID NO: 1346342 - protein, 6 aa, Mycobacterium
SCSTAA

SEQ ID NO: 1346343 - protein, 20 aa, Mycobacterium
SDAAAQRITATGAEAVRGDL

SEQ ID NO: 1346344 - protein, 4 aa, Mycobacterium
SDAD

SEQ ID NO: 1346345 - protein, 21 aa, Mycobacterium
SDADNDRLRADPQVDYSPEGV

SEQ ID NO: 1346346 - protein, 9 aa, Mycobacterium
SDAEDRLES

SEQ ID NO: 1346347 - protein, 13 aa, Mycobacterium
SDAEQAPPTPPPV

SEQ ID NO: 1346348 - protein, 8 aa, Mycobacterium
SDAPGDPV

SEQ ID NO: 1346349 - protein, 4 aa, Mycobacterium
SDAT

SEQ ID NO: 1346350 - protein, 12 aa, Mycobacterium
SDAVGGGPLASP

SEQ ID NO: 1346351 - protein, 6 aa, Mycobacterium
SDDFSG

SEQ ID NO: 1346352 - protein, 14 aa, Mycobacterium
SDDGTELMSLVAPH

SEQ ID NO: 1346353 - protein, 9 aa, Mycobacterium
SDDGTVSKI

SEQ ID NO: 1346354 - protein, 36 aa, Mycobacterium
SDDKSGPSPSPSESSQSSAAAAPQASTGGKTEVKVD

SEQ ID NO: 1346355 - protein, 6 aa, Mycobacterium
SDDSAA

SEQ ID NO: 1346356 - protein, 6 aa, Mycobacterium
SDDSAS

SEQ ID NO: 1346357 - protein, 10 aa, Mycobacterium
SDDTKAPLRI

SEQ ID NO: 1346358 - protein, 4 aa, Mycobacterium
SDDY

SEQ ID NO: 1346359 - protein, 5 aa, Mycobacterium
SDEAA

SEQ ID NO: 1346360 - protein, 13 aa, Mycobacterium
SDEGVPNKKNIRP

SEQ ID NO: 1346361 - protein, 5 aa, Mycobacterium
SDEPQ

SEQ ID NO: 1346362 - protein, 6 aa, Mycobacterium
SDGAAS

SEQ ID NO: 1346363 - protein, 13 aa, Mycobacterium
SDGEKTNTTTQKI

SEQ ID NO: 1346364 - protein, 9 aa, Mycobacterium
SDGFGGTAQ

SEQ ID NO: 1346365 - protein, 8 aa, Mycobacterium
SDGGAATH

SEQ ID NO: 1346366 - protein, 9 aa, Mycobacterium
SDGGGPATV

SEQ ID NO: 1346367 - protein, 5 aa, Mycobacterium
SDGGS

SEQ ID NO: 1346368 - protein, 7 aa, Mycobacterium
SDGLASA

SEQ ID NO: 1346369 - protein, 19 aa, Mycobacterium
SDGLSASVRTGVSAAGAAE

SEQ ID NO: 1346370 - protein, 4 aa, Mycobacterium
SDGR

SEQ ID NO: 1346371 - protein, 27 aa, Mycobacterium
SDGREGLTPEQQAELATGGDLGASRTD

SEQ ID NO: 1346372 - protein, 10 aa, Mycobacterium
SDGRGGTATT

SEQ ID NO: 1346373 - protein, 11 aa, Mycobacterium
SDGRGGVTSST

SEQ ID NO: 1346374 - protein, 9 aa, Mycobacterium
SDGRTREAD

SEQ ID NO: 1346375 - protein, 6 aa, Mycobacterium
SDGSEI

SEQ ID NO: 1346376 - protein, 15 aa, Mycobacterium
SDGSGAADQAASVDA

SEQ ID NO: 1346377 - protein, 5 aa, Mycobacterium
SDGTP

SEQ ID NO: 1346378 - protein, 8 aa, Mycobacterium
SDGYGGSI

SEQ ID NO: 1346379 - protein, 18 aa, Mycobacterium
SDKTAGERLTDARQLGPR

SEQ ID NO: 1346380 - protein, 4 aa, Mycobacterium
SDNM

SEQ ID NO: 1346381 - protein, 9 aa, Mycobacterium
SDPAANGDL

SEQ ID NO: 1346382 - protein, 13 aa, Mycobacterium
SDPAFAGADPAPR

SEQ ID NO: 1346383 - protein, 7 aa, Mycobacterium
SDPASQF

SEQ ID NO: 1346384 - protein, 17 aa, Mycobacterium
SDPDGDEVLGSATISAA

SEQ ID NO: 1346385 - protein, 7 aa, Mycobacterium
SDPLNDT

SEQ ID NO: 1346386 - protein, 4 aa, Mycobacterium
SDPQ

SEQ ID NO: 1346387 - protein, 5 aa, Mycobacterium
SDQVD

SEQ ID NO: 1346388 - protein, 6 aa, Mycobacterium
SDRNGY

SEQ ID NO: 1346389 - protein, 13 aa, Mycobacterium
SDSAFGEGSVPSG

SEQ ID NO: 1346390 - protein, 21 aa, Mycobacterium
SDSEPTGPVVPSTEAPQQSVS

SEQ ID NO: 1346391 - protein, 14 aa, Mycobacterium
SDSRAELSGDTAAG

SEQ ID NO: 1346392 - protein, 17 aa, Mycobacterium
SDSRTDAHGNPLSDEER

SEQ ID NO: 1346393 - protein, 8 aa, Mycobacterium
SDTAPVSR

SEQ ID NO: 1346394 - protein, 6 aa, Mycobacterium
SDTPEG

SEQ ID NO: 1346395 - protein, 7 aa, Mycobacterium
SDTPLSR

SEQ ID NO: 1346396 - protein, 10 aa, Mycobacterium
SDTPRPGPCA

SEQ ID NO: 1346397 - protein, 14 aa, Mycobacterium
SDTPVPQDVLDAAN

SEQ ID NO: 1346398 - protein, 9 aa, Mycobacterium
SDVKTNAVT

SEQ ID NO: 1346399 - protein, 10 aa, Mycobacterium
SEADDAEARV

SEQ ID NO: 1346400 - protein, 8 aa, Mycobacterium
SEADGPVP

SEQ ID NO: 1346401 - protein, 6 aa, Mycobacterium
SEADRA

SEQ ID NO: 1346402 - protein, 9 aa, Mycobacterium
SEARVGDAG

SEQ ID NO: 1346403 - protein, 5 aa, Mycobacterium
SEDVK

SEQ ID NO: 1346404 - protein, 8 aa, Mycobacterium
SEETRSVE

SEQ ID NO: 1346405 - protein, 4 aa, Mycobacterium
SEFR

SEQ ID NO: 1346406 - protein, 4 aa, Mycobacterium
SEHL

SEQ ID NO: 1346407 - protein, 19 aa, Mycobacterium
SEKNPDGSQNADGPSGQET

SEQ ID NO: 1346408 - protein, 13 aa, Mycobacterium
SELADQKEKLSEL

SEQ ID NO: 1346409 - protein, 10 aa, Mycobacterium
SENAPPGTVS

SEQ ID NO: 1346410 - protein, 7 aa, Mycobacterium
SENTVGA

SEQ ID NO: 1346411 - protein, 7 aa, Mycobacterium
SEPDPDC

SEQ ID NO: 1346412 - protein, 7 aa, Mycobacterium
SEPDQLA

SEQ ID NO: 1346413 - protein, 14 aa, Mycobacterium
SEPGPCADDIGETP

SEQ ID NO: 1346414 - protein, 14 aa, Mycobacterium
SEPGPCEDDIGETP

SEQ ID NO: 1346415 - protein, 5 aa, Mycobacterium
SEPLG

SEQ ID NO: 1346416 - protein, 29 aa, Mycobacterium
SEQESPTGIPSTAPVTPSEAPQPVGDRPG

SEQ ID NO: 1346417 - protein, 6 aa, Mycobacterium
SEQLTG

SEQ ID NO: 1346418 - protein, 4 aa, Mycobacterium
SEQT

SEQ ID NO: 1346419 - protein, 6 aa, Mycobacterium
SEQYAR

SEQ ID NO: 1346420 - protein, 14 aa, Mycobacterium
SERIDYTPNPATGD

SEQ ID NO: 1346421 - protein, 4 aa, Mycobacterium
SERR

SEQ ID NO: 1346422 - protein, 4 aa, Mycobacterium
SERT

SEQ ID NO: 1346423 - protein, 12 aa, Mycobacterium
SESGGPTPPVPM

SEQ ID NO: 1346424 - protein, 14 aa, Mycobacterium
SESLHTTKAPSGID

SEQ ID NO: 1346425 - protein, 9 aa, Mycobacterium
SESSVDGKS

SEQ ID NO: 1346426 - protein, 7 aa, Mycobacterium
SETAGGF

SEQ ID NO: 1346427 - protein, 8 aa, Mycobacterium
SETGTDQY

SEQ ID NO: 1346428 - protein, 25 aa, Mycobacterium
SEVEPAHGRPTAALPGPGTAESTSN

SEQ ID NO: 1346429 - protein, 10 aa, Mycobacterium
SEVSPTEAGF

SEQ ID NO: 1346430 - protein, 16 aa, Mycobacterium
SFASPCTGTVGPAPHT

SEQ ID NO: 1346431 - protein, 7 aa, Mycobacterium
SFGGGPI

SEQ ID NO: 1346432 - protein, 6 aa, Mycobacterium
SFGTTA

SEQ ID NO: 1346433 - protein, 10 aa, Mycobacterium
SFNPSNGSIV

SEQ ID NO: 1346434 - protein, 7 aa, Mycobacterium
SFPDDLD

SEQ ID NO: 1346435 - protein, 5 aa, Mycobacterium
SFPSE

SEQ ID NO: 1346436 - protein, 14 aa, Mycobacterium
SFRDGTRVAATAPD

SEQ ID NO: 1346437 - protein, 7 aa, Mycobacterium
SGAAAVA

SEQ ID NO: 1346438 - protein, 8 aa, Mycobacterium
SGADPGEL

SEQ ID NO: 1346439 - protein, 11 aa, Mycobacterium
SGAEDKMSAEQ

SEQ ID NO: 1346440 - protein, 9 aa, Mycobacterium
SGAELNEPD

SEQ ID NO: 1346441 - protein, 5 aa, Mycobacterium
SGAGP

SEQ ID NO: 1346442 - protein, 6 aa, Mycobacterium
SGAGPA

SEQ ID NO: 1346443 - protein, 5 aa, Mycobacterium
SGATT

SEQ ID NO: 1346444 - protein, 6 aa, Mycobacterium
SGATVD

SEQ ID NO: 1346445 - protein, 19 aa, Mycobacterium
SGAVQAYDGREVAPAAATE

SEQ ID NO: 1346446 - protein, 10 aa, Mycobacterium
SGAWRPDGSE

SEQ ID NO: 1346447 - protein, 20 aa, Mycobacterium
SGDDPEASGRGRESRAPSTD

SEQ ID NO: 1346448 - protein, 6 aa, Mycobacterium
SGDFPP

SEQ ID NO: 1346449 - protein, 6 aa, Mycobacterium
SGDGKL

SEQ ID NO: 1346450 - protein, 14 aa, Mycobacterium
SGDIEAAKAQYPTS

SEQ ID NO: 1346451 - protein, 38 aa, Mycobacterium
SGDKTSTDGVAAEDAPKEPTVTYQPADAAEDVAPTGNV

SEQ ID NO: 1346452 - protein, 14 aa, Mycobacterium
SGDLPGRLGAALAE

SEQ ID NO: 1346453 - protein, 7 aa, Mycobacterium
SGDNGSY

SEQ ID NO: 1346454 - protein, 18 aa, Mycobacterium
SGDQYNTGRKVPVQQAKR

SEQ ID NO: 1346455 - protein, 19 aa, Mycobacterium
SGDQYTAGRQVPPSEAKRG

SEQ ID NO: 1346456 - protein, 5 aa, Mycobacterium
SGDSA

SEQ ID NO: 1346457 - protein, 8 aa, Mycobacterium
SGEEPTCS

SEQ ID NO: 1346458 - protein, 12 aa, Mycobacterium
SGELPSTDTYCP

SEQ ID NO: 1346459 - protein, 8 aa, Mycobacterium
SGEPSPDG

SEQ ID NO: 1346460 - protein, 4 aa, Mycobacterium
SGEQ

SEQ ID NO: 1346461 - protein, 12 aa, Mycobacterium
SGEQRGEVGEAD

SEQ ID NO: 1346462 - protein, 4 aa, Mycobacterium
SGEV

SEQ ID NO: 1346463 - protein, 6 aa, Mycobacterium
SGEWSK

SEQ ID NO: 1346464 - protein, 4 aa, Mycobacterium
SGGA

SEQ ID NO: 1346465 - protein, 18 aa, Mycobacterium
SGGAAPPAAPSAEGPGDE

SEQ ID NO: 1346466 - protein, 8 aa, Mycobacterium
SGGAGLQA

SEQ ID NO: 1346467 - protein, 11 aa, Mycobacterium
SGGGQPPTDAA

SEQ ID NO: 1346468 - protein, 11 aa, Mycobacterium
SGGGRPPTDAA

SEQ ID NO: 1346469 - protein, 12 aa, Mycobacterium
SGGGTPPGEPGF

SEQ ID NO: 1346470 - protein, 40 aa, Mycobacterium
SGGHAEQGQEHAGEDGHGHAEEGQEHAGEQGQELGDEGNP

SEQ ID NO: 1346471 - protein, 9 aa, Mycobacterium
SGGRGPAER

SEQ ID NO: 1346472 - protein, 8 aa, Mycobacterium
SGGRTCSS

SEQ ID NO: 1346473 - protein, 5 aa, Mycobacterium
SGGSA

SEQ ID NO: 1346474 - protein, 10 aa, Mycobacterium
SGGTESPTGM

SEQ ID NO: 1346475 - protein, 7 aa, Mycobacterium
SGGVPGL

SEQ ID NO: 1346476 - protein, 27 aa, Mycobacterium
SGGVVTKTTSARSGATALAATSAATGT

SEQ ID NO: 1346477 - protein, 6 aa, Mycobacterium
SGGYGC

SEQ ID NO: 1346478 - protein, 9 aa, Mycobacterium
SGHADLRGA

SEQ ID NO: 1346479 - protein, 14 aa, Mycobacterium
SGHPGENDRDAPPH

SEQ ID NO: 1346480 - protein, 8 aa, Mycobacterium
SGHSATAT

SEQ ID NO: 1346481 - protein, 7 aa, Mycobacterium
SGIADPY

SEQ ID NO: 1346482 - protein, 5 aa, Mycobacterium
SGING

SEQ ID NO: 1346483 - protein, 8 aa, Mycobacterium
SGKTGEGV

SEQ ID NO: 1346484 - protein, 5 aa, Mycobacterium
SGLES

SEQ ID NO: 1346485 - protein, 6 aa, Mycobacterium
SGLKDG

SEQ ID NO: 1346486 - protein, 6 aa, Mycobacterium
SGLKSD

SEQ ID NO: 1346487 - protein, 7 aa, Mycobacterium
SGLPDHA

SEQ ID NO: 1346488 - protein, 11 aa, Mycobacterium
SGLPDHAGDQL

SEQ ID NO: 1346489 - protein, 4 aa, Mycobacterium
SGLR

SEQ ID NO: 1346490 - protein, 4 aa, Mycobacterium
SGMG

SEQ ID NO: 1346491 - protein, 5 aa, Mycobacterium
SGMGD

SEQ ID NO: 1346492 - protein, 6 aa, Mycobacterium
SGMTGG

SEQ ID NO: 1346493 - protein, 6 aa, Mycobacterium
SGNDGG

SEQ ID NO: 1346494 - protein, 8 aa, Mycobacterium
SGNPTRWG

SEQ ID NO: 1346495 - protein, 4 aa, Mycobacterium
SGPD

SEQ ID NO: 1346496 - protein, 10 aa, Mycobacterium
SGPGSPGGAP

SEQ ID NO: 1346497 - protein, 8 aa, Mycobacterium
SGPNRIGQ

SEQ ID NO: 1346498 - protein, 16 aa, Mycobacterium
SGPSSSYLTATDPTDI

SEQ ID NO: 1346499 - protein, 24 aa, Mycobacterium
SGQSRAARRADDVNQSVNSGPSKL

SEQ ID NO: 1346500 - protein, 10 aa, Mycobacterium
SGQSSSAGRT

SEQ ID NO: 1346501 - protein, 9 aa, Mycobacterium
SGRSTPVEE

SEQ ID NO: 1346502 - protein, 9 aa, Mycobacterium
SGSESPVRE

SEQ ID NO: 1346503 - protein, 6 aa, Mycobacterium
SGSMTE

SEQ ID NO: 1346504 - protein, 9 aa, Mycobacterium
SGSQGDNME

SEQ ID NO: 1346505 - protein, 16 aa, Mycobacterium
SGSQYNAGRKIPSAQM

SEQ ID NO: 1346506 - protein, 17 aa, Mycobacterium
SGSQYNAGRKVPSSQMR

SEQ ID NO: 1346507 - protein, 9 aa, Mycobacterium
SGSTADPKG

SEQ ID NO: 1346508 - protein, 15 aa, Mycobacterium
SGSTPAQKIKDKYQG

SEQ ID NO: 1346509 - protein, 12 aa, Mycobacterium
SGSTSTEKGTVT

SEQ ID NO: 1346510 - protein, 7 aa, Mycobacterium
SGTPLSQ

SEQ ID NO: 1346511 - protein, 7 aa, Mycobacterium
SGTPQDM

SEQ ID NO: 1346512 - protein, 8 aa, Mycobacterium
SGTPQDMA

SEQ ID NO: 1346513 - protein, 17 aa, Mycobacterium
SGTQYNSGRKIPSSQMR

SEQ ID NO: 1346514 - protein, 9 aa, Mycobacterium
SGTRLGPGG

SEQ ID NO: 1346515 - protein, 5 aa, Mycobacterium
SGTRR

SEQ ID NO: 1346516 - protein, 6 aa, Mycobacterium
SGTVTA

SEQ ID NO: 1346517 - protein, 25 aa, Mycobacterium
SGTWGQPSPAGADGVPAIGEKHAAA

SEQ ID NO: 1346518 - protein, 34 aa, Mycobacterium
SGTYSRHPNTLGDNVGRPSNGEAVTEAGASGNEV

SEQ ID NO: 1346519 - protein, 13 aa, Mycobacterium
SGVGGHSGGMPGM

SEQ ID NO: 1346520 - protein, 15 aa, Mycobacterium
SGVRASGGGFVVGRN

SEQ ID NO: 1346521 - protein, 8 aa, Mycobacterium
SGYAESTQ

SEQ ID NO: 1346522 - protein, 10 aa, Mycobacterium
SGYEARRDGA

SEQ ID NO: 1346523 - protein, 8 aa, Mycobacterium
SGYPAGRV

SEQ ID NO: 1346524 - protein, 6 aa, Mycobacterium
SGYTES

SEQ ID NO: 1346525 - protein, 11 aa, Mycobacterium
SHGTDMPEREE

SEQ ID NO: 1346526 - protein, 8 aa, Mycobacterium
SHPSPEVA

SEQ ID NO: 1346527 - protein, 4 aa, Mycobacterium
SHRD

SEQ ID NO: 1346528 - protein, 7 aa, Mycobacterium
SHTEPDG

SEQ ID NO: 1346529 - protein, 6 aa, Mycobacterium
SHTGYQ

SEQ ID NO: 1346530 - protein, 14 aa, Mycobacterium
SIAPSATAYSRDGL

SEQ ID NO: 1346531 - protein, 5 aa, Mycobacterium
SIAQQ

SEQ ID NO: 1346532 - protein, 13 aa, Mycobacterium
SIARQAEAERERR

SEQ ID NO: 1346533 - protein, 8 aa, Mycobacterium
SIDPRAED

SEQ ID NO: 1346534 - protein, 8 aa, Mycobacterium
SIEPQPES

SEQ ID NO: 1346535 - protein, 23 aa, Mycobacterium
SIGPSATGAASPVPPVSDAARAA

SEQ ID NO: 1346536 - protein, 13 aa, Mycobacterium
SIGSAPPLPGGLT

SEQ ID NO: 1346537 - protein, 8 aa, Mycobacterium
SINNNRTP

SEQ ID NO: 1346538 - protein, 4 aa, Mycobacterium
SIPG

SEQ ID NO: 1346539 - protein, 15 aa, Mycobacterium
SISSGGDGSDTRADV

SEQ ID NO: 1346540 - protein, 4 aa, Mycobacterium
SITS

SEQ ID NO: 1346541 - protein, 6 aa, Mycobacterium
SIYDAD

SEQ ID NO: 1346542 - protein, 6 aa, Mycobacterium
SKAALS

SEQ ID NO: 1346543 - protein, 9 aa, Mycobacterium
SKAGQEVLE

SEQ ID NO: 1346544 - protein, 8 aa, Mycobacterium
SKAPGDKV

SEQ ID NO: 1346545 - protein, 6 aa, Mycobacterium
SKATEQ

SEQ ID NO: 1346546 - protein, 13 aa, Mycobacterium
SKDGAPRWGRGDD

SEQ ID NO: 1346547 - protein, 9 aa, Mycobacterium
SKDGEEFSG

SEQ ID NO: 1346548 - protein, 7 aa, Mycobacterium
SKDKPGL

SEQ ID NO: 1346549 - protein, 8 aa, Mycobacterium
SKDSLGRT

SEQ ID NO: 1346550 - protein, 5 aa, Mycobacterium
SKDVK

SEQ ID NO: 1346551 - protein, 8 aa, Mycobacterium
SKGPDAVV

SEQ ID NO: 1346552 - protein, 6 aa, Mycobacterium
SKGYSA

SEQ ID NO: 1346553 - protein, 8 aa, Mycobacterium
SKISGEED

SEQ ID NO: 1346554 - protein, 7 aa, Mycobacterium
SKNDREQ

SEQ ID NO: 1346555 - protein, 13 aa, Mycobacterium
SKNPYGTYAPAST

SEQ ID NO: 1346556 - protein, 7 aa, Mycobacterium
SKPITNG

SEQ ID NO: 1346557 - protein, 8 aa, Mycobacterium
SKPLPERT

SEQ ID NO: 1346558 - protein, 7 aa, Mycobacterium
SKPLSAT

SEQ ID NO: 1346559 - protein, 9 aa, Mycobacterium
SKPSSLTAR

SEQ ID NO: 1346560 - protein, 31 aa, Mycobacterium
SKQVAPAPRAPAPAPARVPAPAPAPAPAPSM

SEQ ID NO: 1346561 - protein, 33 aa, Mycobacterium
SKQVAPAPRAPAPARVPAPAPAPAPAPAPAPSM

SEQ ID NO: 1346562 - protein, 5 aa, Mycobacterium
SKRGD

SEQ ID NO: 1346563 - protein, 6 aa, Mycobacterium
SKTVSG

SEQ ID NO: 1346564 - protein, 6 aa, Mycobacterium
SKVEEA

SEQ ID NO: 1346565 - protein, 8 aa, Mycobacterium
SKVPPVTS

SEQ ID NO: 1346566 - protein, 9 aa, Mycobacterium
SKVTEVPSE

SEQ ID NO: 1346567 - protein, 10 aa, Mycobacterium
SKYSEDTGSI

SEQ ID NO: 1346568 - protein, 49 aa, Mycobacterium
SLADASRSRAADDSSDARTTGTGSPANEGAASDGDTAPAAPSADAPAAN

SEQ ID NO: 1346569 - protein, 12 aa, Mycobacterium
SLAERRTDISNS

SEQ ID NO: 1346570 - protein, 12 aa, Mycobacterium
SLAGQGAGAGNC

SEQ ID NO: 1346571 - protein, 9 aa, Mycobacterium
SLDNERSVA

SEQ ID NO: 1346572 - protein, 7 aa, Mycobacterium
SLDRQTD

SEQ ID NO: 1346573 - protein, 10 aa, Mycobacterium
SLGPPGEVGN

SEQ ID NO: 1346574 - protein, 12 aa, Mycobacterium
SLKDAKGRTPYE

SEQ ID NO: 1346575 - protein, 4 aa, Mycobacterium
SLNT

SEQ ID NO: 1346576 - protein, 5 aa, Mycobacterium
SLPAN

SEQ ID NO: 1346577 - protein, 4 aa, Mycobacterium
SLPD

SEQ ID NO: 1346578 - protein, 16 aa, Mycobacterium
SLPLPGTEGGGDGAYT

SEQ ID NO: 1346579 - protein, 6 aa, Mycobacterium
SLPPDW

SEQ ID NO: 1346580 - protein, 6 aa, Mycobacterium
SLPPRT

SEQ ID NO: 1346581 - protein, 6 aa, Mycobacterium
SLQAPD

SEQ ID NO: 1346582 - protein, 16 aa, Mycobacterium
SLQRERDLATARGASV

SEQ ID NO: 1346583 - protein, 10 aa, Mycobacterium
SLRGDPGPFL

SEQ ID NO: 1346584 - protein, 20 aa, Mycobacterium
SLSGGSAVAPASPAEEESLE

SEQ ID NO: 1346585 - protein, 7 aa, Mycobacterium
SLSGNAV

SEQ ID NO: 1346586 - protein, 11 aa, Mycobacterium
SLSPPGTPGAT

SEQ ID NO: 1346587 - protein, 6 aa, Mycobacterium
SLTDTR

SEQ ID NO: 1346588 - protein, 14 aa, Mycobacterium
SLTGGRAADPTDES

SEQ ID NO: 1346589 - protein, 6 aa, Mycobacterium
SLTGTR

SEQ ID NO: 1346590 - protein, 7 aa, Mycobacterium
SLTRPSW

SEQ ID NO: 1346591 - protein, 6 aa, Mycobacterium
SLYPDR

SEQ ID NO: 1346592 - protein, 5 aa, Mycobacterium
SMGYG

SEQ ID NO: 1346593 - protein, 7 aa, Mycobacterium
SMNNGDD

SEQ ID NO: 1346594 - protein, 12 aa, Mycobacterium
SMRPSHDPSTVK

SEQ ID NO: 1346595 - protein, 6 aa, Mycobacterium
SMTPDD

SEQ ID NO: 1346596 - protein, 11 aa, Mycobacterium
SMTRGTPDALD

SEQ ID NO: 1346597 - protein, 11 aa, Mycobacterium
SNDPEAPNQAN

SEQ ID NO: 1346598 - protein, 9 aa, Mycobacterium
SNDPGEVGQ

SEQ ID NO: 1346599 - protein, 11 aa, Mycobacterium
SNDSERPFSRD

SEQ ID NO: 1346600 - protein, 12 aa, Mycobacterium
SNEQGDAQNPQT

SEQ ID NO: 1346601 - protein, 5 aa, Mycobacterium
SNGTH

SEQ ID NO: 1346602 - protein, 8 aa, Mycobacterium
SNIEPNSR

SEQ ID NO: 1346603 - protein, 8 aa, Mycobacterium
SNPEANAD

SEQ ID NO: 1346604 - protein, 20 aa, Mycobacterium
SNPSGATVSDGSATGTITND

SEQ ID NO: 1346605 - protein, 17 aa, Mycobacterium
SNPTADGREEVKGAQTV

SEQ ID NO: 1346606 - protein, 5 aa, Mycobacterium
SNPTY

SEQ ID NO: 1346607 - protein, 12 aa, Mycobacterium
SNPVTSGTGQAT

SEQ ID NO: 1346608 - protein, 6 aa, Mycobacterium
SNREFQ

SEQ ID NO: 1346609 - protein, 6 aa, Mycobacterium
SNRPLD

SEQ ID NO: 1346610 - protein, 7 aa, Mycobacterium
SNRPLDV

SEQ ID NO: 1346611 - protein, 8 aa, Mycobacterium
SNRQFQSE

SEQ ID NO: 1346612 - protein, 14 aa, Mycobacterium
SNSATTSGQRDSTG

SEQ ID NO: 1346613 - protein, 18 aa, Mycobacterium
SNSNNPGDDGWKEMLAPA

SEQ ID NO: 1346614 - protein, 13 aa, Mycobacterium
SNSRDSRGTTDYR

SEQ ID NO: 1346615 - protein, 7 aa, Mycobacterium
SNTAEEF

SEQ ID NO: 1346616 - protein, 30 aa, Mycobacterium
SNTAGNEASSTASPAPVQTSAATPAASHNQ

SEQ ID NO: 1346617 - protein, 8 aa, Mycobacterium
SNTGSTTC

SEQ ID NO: 1346618 - protein, 17 aa, Mycobacterium
SNTPPPPGWTGSTGTVS

SEQ ID NO: 1346619 - protein, 14 aa, Mycobacterium
SNVTTGTPMADPDQ

SEQ ID NO: 1346620 - protein, 11 aa, Mycobacterium
SPAAADDPTID

SEQ ID NO: 1346621 - protein, 12 aa, Mycobacterium
SPAASPQTSVRG

SEQ ID NO: 1346622 - protein, 5 aa, Mycobacterium
SPAKV

SEQ ID NO: 1346623 - protein, 8 aa, Mycobacterium
SPAPAVDV

SEQ ID NO: 1346624 - protein, 8 aa, Mycobacterium
SPARSLRS

SEQ ID NO: 1346625 - protein, 14 aa, Mycobacterium
SPASAAADPGITNG

SEQ ID NO: 1346626 - protein, 16 aa, Mycobacterium
SPAVTGDDANPNIGDN

SEQ ID NO: 1346627 - protein, 7 aa, Mycobacterium
SPDAPDE

SEQ ID NO: 1346628 - protein, 5 aa, Mycobacterium
SPDFD

SEQ ID NO: 1346629 - protein, 5 aa, Mycobacterium
SPDGN

SEQ ID NO: 1346630 - protein, 8 aa, Mycobacterium
SPDGQITP

SEQ ID NO: 1346631 - protein, 5 aa, Mycobacterium
SPDGT

SEQ ID NO: 1346632 - protein, 9 aa, Mycobacterium
SPDNPDVAD

SEQ ID NO: 1346633 - protein, 7 aa, Mycobacterium
SPDPSGE

SEQ ID NO: 1346634 - protein, 5 aa, Mycobacterium
SPEGA

SEQ ID NO: 1346635 - protein, 17 aa, Mycobacterium
SPELDHGAATEDPDTGI

SEQ ID NO: 1346636 - protein, 6 aa, Mycobacterium
SPELPE

SEQ ID NO: 1346637 - protein, 18 aa, Mycobacterium
SPENLPPGTSTTPTQQSR

SEQ ID NO: 1346638 - protein, 11 aa, Mycobacterium
SPEPKPSDGLG

SEQ ID NO: 1346639 - protein, 21 aa, Mycobacterium
SPESPSESGPSSSSPSGHGSY

SEQ ID NO: 1346640 - protein, 5 aa, Mycobacterium
SPFKP

SEQ ID NO: 1346641 - protein, 8 aa, Mycobacterium
SPGDGGPG

SEQ ID NO: 1346642 - protein, 6 aa, Mycobacterium
SPGGQP

SEQ ID NO: 1346643 - protein, 4 aa, Mycobacterium
SPGI

SEQ ID NO: 1346644 - protein, 41 aa, Mycobacterium
SPGLAANPRFATDSGAGPQGSPQTSDQPPGPPGVEAPKNDL

SEQ ID NO: 1346645 - protein, 7 aa, Mycobacterium
SPGNPEK

SEQ ID NO: 1346646 - protein, 24 aa, Mycobacterium
SPGPAPAAPDAPQATSSAPVTQNG

SEQ ID NO: 1346647 - protein, 24 aa, Mycobacterium
SPGPAPAAPEAPQATSSAPVTQNG

SEQ ID NO: 1346648 - protein, 9 aa, Mycobacterium
SPGPIEPDP

SEQ ID NO: 1346649 - protein, 5 aa, Mycobacterium
SPHNA

SEQ ID NO: 1346650 - protein, 8 aa, Mycobacterium
SPHNYEGE

SEQ ID NO: 1346651 - protein, 7 aa, Mycobacterium
SPIPPEG

SEQ ID NO: 1346652 - protein, 4 aa, Mycobacterium
SPIT

SEQ ID NO: 1346653 - protein, 9 aa, Mycobacterium
SPKAGSTFT

SEQ ID NO: 1346654 - protein, 8 aa, Mycobacterium
SPKEAEAL

SEQ ID NO: 1346655 - protein, 19 aa, Mycobacterium
SPKGSSMVTGPETHEPDRH

SEQ ID NO: 1346656 - protein, 7 aa, Mycobacterium
SPLPDGV

SEQ ID NO: 1346657 - protein, 8 aa, Mycobacterium
SPNGQAQE

SEQ ID NO: 1346658 - protein, 8 aa, Mycobacterium
SPNGSERV

SEQ ID NO: 1346659 - protein, 8 aa, Mycobacterium
SPNPPRKL

SEQ ID NO: 1346660 - protein, 10 aa, Mycobacterium
SPPAGAAPVG

SEQ ID NO: 1346661 - protein, 6 aa, Mycobacterium
SPPALA

SEQ ID NO: 1346662 - protein, 4 aa, Mycobacterium
SPPF

SEQ ID NO: 1346663 - protein, 13 aa, Mycobacterium
SPPLNAAQAGPSV

SEQ ID NO: 1346664 - protein, 10 aa, Mycobacterium
SPQDRMAGTT

SEQ ID NO: 1346665 - protein, 4 aa, Mycobacterium
SPQL

SEQ ID NO: 1346666 - protein, 4 aa, Mycobacterium
SPQT

SEQ ID NO: 1346667 - protein, 7 aa, Mycobacterium
SPQTAQT

SEQ ID NO: 1346668 - protein, 8 aa, Mycobacterium
SPQYEGQD

SEQ ID NO: 1346669 - protein, 5 aa, Mycobacterium
SPRTR

SEQ ID NO: 1346670 - protein, 6 aa, Mycobacterium
SPSDGG

SEQ ID NO: 1346671 - protein, 4 aa, Mycobacterium
SPSG

SEQ ID NO: 1346672 - protein, 11 aa, Mycobacterium
SPSGGNRAPTA

SEQ ID NO: 1346673 - protein, 7 aa, Mycobacterium
SPSLPGT

SEQ ID NO: 1346674 - protein, 6 aa, Mycobacterium
SPSMGR

SEQ ID NO: 1346675 - protein, 16 aa, Mycobacterium
SPTAATIGDGSATGTI

SEQ ID NO: 1346676 - protein, 12 aa, Mycobacterium
SPTAVPPEGRLR

SEQ ID NO: 1346677 - protein, 5 aa, Mycobacterium
SPVEP

SEQ ID NO: 1346678 - protein, 10 aa, Mycobacterium
SPVRAEAPDL

SEQ ID NO: 1346679 - protein, 14 aa, Mycobacterium
SPVTPTHKLGTGSD

SEQ ID NO: 1346680 - protein, 8 aa, Mycobacterium
SPVTVAQT

SEQ ID NO: 1346681 - protein, 4 aa, Mycobacterium
SPYQ

SEQ ID NO: 1346682 - protein, 7 aa, Mycobacterium
SQDAATN

SEQ ID NO: 1346683 - protein, 7 aa, Mycobacterium
SQDPQAD

SEQ ID NO: 1346684 - protein, 5 aa, Mycobacterium
SQDWD

SEQ ID NO: 1346685 - protein, 12 aa, Mycobacterium
SQEDNSGEQRID

SEQ ID NO: 1346686 - protein, 4 aa, Mycobacterium
SQGA

SEQ ID NO: 1346687 - protein, 5 aa, Mycobacterium
SQGDG

SEQ ID NO: 1346688 - protein, 8 aa, Mycobacterium
SQGNPLTG

SEQ ID NO: 1346689 - protein, 11 aa, Mycobacterium
SQGRASEEGSG

SEQ ID NO: 1346690 - protein, 8 aa, Mycobacterium
SQGTGGGV

SEQ ID NO: 1346691 - protein, 7 aa, Mycobacterium
SQIPAAA

SEQ ID NO: 1346692 - protein, 8 aa, Mycobacterium
SQLTQQGN

SEQ ID NO: 1346693 - protein, 21 aa, Mycobacterium
SQMTDAQQLSSEFEKKNPGTK

SEQ ID NO: 1346694 - protein, 9 aa, Mycobacterium
SQPDYDGRP

SEQ ID NO: 1346695 - protein, 7 aa, Mycobacterium
SQQPANG

SEQ ID NO: 1346696 - protein, 10 aa, Mycobacterium
SQQQGGPQSV

SEQ ID NO: 1346697 - protein, 7 aa, Mycobacterium
SQRDGLT

SEQ ID NO: 1346698 - protein, 13 aa, Mycobacterium
SQRDSAAPPPRSV

SEQ ID NO: 1346699 - protein, 5 aa, Mycobacterium
SQRLA

SEQ ID NO: 1346700 - protein, 6 aa, Mycobacterium
SQSAIG

SEQ ID NO: 1346701 - protein, 6 aa, Mycobacterium
SQSGRY

SEQ ID NO: 1346702 - protein, 25 aa, Mycobacterium
SQSPSAGEEVSEDSPPELEVARPNG

SEQ ID NO: 1346703 - protein, 20 aa, Mycobacterium
SQSTSNGKPALDVAGNGRYA

SEQ ID NO: 1346704 - protein, 14 aa, Mycobacterium
SQTAEQDAALRSGL

SEQ ID NO: 1346705 - protein, 6 aa, Mycobacterium
SRAGRG

SEQ ID NO: 1346706 - protein, 6 aa, Mycobacterium
SRAGYA

SEQ ID NO: 1346707 - protein, 7 aa, Mycobacterium
SRAYNTD

SEQ ID NO: 1346708 - protein, 6 aa, Mycobacterium
SRDHEH

SEQ ID NO: 1346709 - protein, 10 aa, Mycobacterium
SRDQPTPPQA

SEQ ID NO: 1346710 - protein, 16 aa, Mycobacterium
SRDSLTTSTPDGQTTT

SEQ ID NO: 1346711 - protein, 9 aa, Mycobacterium
SRDVPGPTT

SEQ ID NO: 1346712 - protein, 5 aa, Mycobacterium
SREPF

SEQ ID NO: 1346713 - protein, 12 aa, Mycobacterium
SRERAQPAWLAF

SEQ ID NO: 1346714 - protein, 7 aa, Mycobacterium
SRGAARS

SEQ ID NO: 1346715 - protein, 22 aa, Mycobacterium
SRGDAPAAAALTGDEAAASDTL

SEQ ID NO: 1346716 - protein, 4 aa, Mycobacterium
SRGQ

SEQ ID NO: 1346717 - protein, 8 aa, Mycobacterium
SRIEPGTD

SEQ ID NO: 1346718 - protein, 10 aa, Mycobacterium
SRIGGRTWTD

SEQ ID NO: 1346719 - protein, 7 aa, Mycobacterium
SRLESKG

SEQ ID NO: 1346720 - protein, 8 aa, Mycobacterium
SRLGAEES

SEQ ID NO: 1346721 - protein, 8 aa, Mycobacterium
SRLGAEQA

SEQ ID NO: 1346722 - protein, 8 aa, Mycobacterium
SRLKTGDT

SEQ ID NO: 1346723 - protein, 9 aa, Mycobacterium
SRLNNEQSA

SEQ ID NO: 1346724 - protein, 20 aa, Mycobacterium
SRNADPAPQPVRDQAAAAEF

SEQ ID NO: 1346725 - protein, 10 aa, Mycobacterium
SRNGAGPVEG

SEQ ID NO: 1346726 - protein, 6 aa, Mycobacterium
SRNQSG

SEQ ID NO: 1346727 - protein, 9 aa, Mycobacterium
SRPASTPAH

SEQ ID NO: 1346728 - protein, 8 aa, Mycobacterium
SRPLTSPE

SEQ ID NO: 1346729 - protein, 9 aa, Mycobacterium
SRPTEPPAF

SEQ ID NO: 1346730 - protein, 20 aa, Mycobacterium
SRPTEPPAFEPAVPGWPAQA

SEQ ID NO: 1346731 - protein, 10 aa, Mycobacterium
SRQDGRPKLD

SEQ ID NO: 1346732 - protein, 6 aa, Mycobacterium
SRQELG

SEQ ID NO: 1346733 - protein, 11 aa, Mycobacterium
SRQRGQISAGG

SEQ ID NO: 1346734 - protein, 4 aa, Mycobacterium
SRRG

SEQ ID NO: 1346735 - protein, 8 aa, Mycobacterium
SRRRRGGN

SEQ ID NO: 1346736 - protein, 10 aa, Mycobacterium
SRSDVASRFG

SEQ ID NO: 1346737 - protein, 6 aa, Mycobacterium
SRSVST

SEQ ID NO: 1346738 - protein, 9 aa, Mycobacterium
SRTAAIPDR

SEQ ID NO: 1346739 - protein, 10 aa, Mycobacterium
SRTAGNGGGR

SEQ ID NO: 1346740 - protein, 10 aa, Mycobacterium
SRTGGAAHLT

SEQ ID NO: 1346741 - protein, 4 aa, Mycobacterium
SRTQ

SEQ ID NO: 1346742 - protein, 6 aa, Mycobacterium
SRVREP

SEQ ID NO: 1346743 - protein, 15 aa, Mycobacterium
SSAASAAAASAPPGL

SEQ ID NO: 1346744 - protein, 15 aa, Mycobacterium
SSAASAAAASAPTGL

SEQ ID NO: 1346745 - protein, 5 aa, Mycobacterium
SSAAT

SEQ ID NO: 1346746 - protein, 18 aa, Mycobacterium
SSAATSRSVPEAPAPGEQ

SEQ ID NO: 1346747 - protein, 10 aa, Mycobacterium
SSAGAQGLTA

SEQ ID NO: 1346748 - protein, 9 aa, Mycobacterium
SSAPGGDGL

SEQ ID NO: 1346749 - protein, 9 aa, Mycobacterium
SSDAGQSWE

SEQ ID NO: 1346750 - protein, 10 aa, Mycobacterium
SSDGVSDSVI

SEQ ID NO: 1346751 - protein, 11 aa, Mycobacterium
SSDNSGQSGTF

SEQ ID NO: 1346752 - protein, 10 aa, Mycobacterium
SSDRGEVTRD

SEQ ID NO: 1346753 - protein, 7 aa, Mycobacterium
SSDTLET

SEQ ID NO: 1346754 - protein, 4 aa, Mycobacterium
SSEF

SEQ ID NO: 1346755 - protein, 10 aa, Mycobacterium
SSEVSPTTVD

SEQ ID NO: 1346756 - protein, 4 aa, Mycobacterium
SSFM

SEQ ID NO: 1346757 - protein, 7 aa, Mycobacterium
SSFPAPY

SEQ ID NO: 1346758 - protein, 15 aa, Mycobacterium
SSGDSVTTYGEPWNM

SEQ ID NO: 1346759 - protein, 12 aa, Mycobacterium
SSGESLWVRGDN

SEQ ID NO: 1346760 - protein, 12 aa, Mycobacterium
SSGGAFPSTEQT

SEQ ID NO: 1346761 - protein, 25 aa, Mycobacterium
SSGGEGHAGAPTTTTETESREEAET

SEQ ID NO: 1346762 - protein, 12 aa, Mycobacterium
SSGGRYPSTEQT

SEQ ID NO: 1346763 - protein, 4 aa, Mycobacterium
SSGL

SEQ ID NO: 1346764 - protein, 5 aa, Mycobacterium
SSGLP

SEQ ID NO: 1346765 - protein, 10 aa, Mycobacterium
SSGQPAPEEY

SEQ ID NO: 1346766 - protein, 12 aa, Mycobacterium
SSGRAYPTTEQT

SEQ ID NO: 1346767 - protein, 14 aa, Mycobacterium
SSGSAAAEQPSGNH

SEQ ID NO: 1346768 - protein, 7 aa, Mycobacterium
SSGTNEV

SEQ ID NO: 1346769 - protein, 16 aa, Mycobacterium
SSGWPLPPPEPAGTAP

SEQ ID NO: 1346770 - protein, 17 aa, Mycobacterium
SSHQDRADGNFADAGGN

SEQ ID NO: 1346771 - protein, 7 aa, Mycobacterium
SSHSERF

SEQ ID NO: 1346772 - protein, 8 aa, Mycobacterium
SSKQPGLV

SEQ ID NO: 1346773 - protein, 19 aa, Mycobacterium
SSLLDTKAARSLLDTPTGR

SEQ ID NO: 1346774 - protein, 6 aa, Mycobacterium
SSLTST

SEQ ID NO: 1346775 - protein, 8 aa, Mycobacterium
SSNPPVPG

SEQ ID NO: 1346776 - protein, 28 aa, Mycobacterium
SSNPVDAPPPTIEPARAADSPPVTAAPP

SEQ ID NO: 1346777 - protein, 5 aa, Mycobacterium
SSNRE

SEQ ID NO: 1346778 - protein, 11 aa, Mycobacterium
SSPAAAPQPEV

SEQ ID NO: 1346779 - protein, 22 aa, Mycobacterium
SSPAGATIADPTGAGTIVDRVI

SEQ ID NO: 1346780 - protein, 8 aa, Mycobacterium
SSPAHEDG

SEQ ID NO: 1346781 - protein, 17 aa, Mycobacterium
SSPAPPPDVTGGDLAGK

SEQ ID NO: 1346782 - protein, 6 aa, Mycobacterium
SSPELA

SEQ ID NO: 1346783 - protein, 8 aa, Mycobacterium
SSPFEPGS

SEQ ID NO: 1346784 - protein, 5 aa, Mycobacterium
SSPGW

SEQ ID NO: 1346785 - protein, 6 aa, Mycobacterium
SSPLEV

SEQ ID NO: 1346786 - protein, 31 aa, Mycobacterium
SSPTGATIADGTATGTITDDDGGTTPTPVDS

SEQ ID NO: 1346787 - protein, 19 aa, Mycobacterium
SSPTTPPTGDPAAATTGAG

SEQ ID NO: 1346788 - protein, 8 aa, Mycobacterium
SSQPAPGL

SEQ ID NO: 1346789 - protein, 7 aa, Mycobacterium
SSQPDKL

SEQ ID NO: 1346790 - protein, 13 aa, Mycobacterium
SSQPPEYQPPPGA

SEQ ID NO: 1346791 - protein, 11 aa, Mycobacterium
SSRAYPSTEQA

SEQ ID NO: 1346792 - protein, 6 aa, Mycobacterium
SSRHRD

SEQ ID NO: 1346793 - protein, 5 aa, Mycobacterium
SSRQK

SEQ ID NO: 1346794 - protein, 11 aa, Mycobacterium
SSRRRSDATRV

SEQ ID NO: 1346795 - protein, 7 aa, Mycobacterium
SSSDNMA

SEQ ID NO: 1346796 - protein, 15 aa, Mycobacterium
SSSPPAGSTLTAGTP

SEQ ID NO: 1346797 - protein, 10 aa, Mycobacterium
SSSRTTEAAP

SEQ ID NO: 1346798 - protein, 18 aa, Mycobacterium
SSSTPAENSGTEADPASR

SEQ ID NO: 1346799 - protein, 9 aa, Mycobacterium
SSTAPEPTP

SEQ ID NO: 1346800 - protein, 7 aa, Mycobacterium
SSTDTAD

SEQ ID NO: 1346801 - protein, 25 aa, Mycobacterium
SSTETTEGATADEESAPEAEGEDVV

SEQ ID NO: 1346802 - protein, 23 aa, Mycobacterium
SSTGGAPEQSGDGGGGGTVDTPR

SEQ ID NO: 1346803 - protein, 12 aa, Mycobacterium
SSTGSSAPLGTH

SEQ ID NO: 1346804 - protein, 7 aa, Mycobacterium
SSTPLSQ

SEQ ID NO: 1346805 - protein, 10 aa, Mycobacterium
SSTRPHARRR

SEQ ID NO: 1346806 - protein, 10 aa, Mycobacterium
SSTSAQLTAD

SEQ ID NO: 1346807 - protein, 15 aa, Mycobacterium
SSTTEAATTETPSEF

SEQ ID NO: 1346808 - protein, 6 aa, Mycobacterium
SSTVGT

SEQ ID NO: 1346809 - protein, 7 aa, Mycobacterium
SSVTDGA

SEQ ID NO: 1346810 - protein, 4 aa, Mycobacterium
SSYD

SEQ ID NO: 1346811 - protein, 34 aa, Mycobacterium
STAAAQPGWTPPPTPPAGPNTGQPPAWAPPKPVD

SEQ ID NO: 1346812 - protein, 9 aa, Mycobacterium
STAADPIGT

SEQ ID NO: 1346813 - protein, 9 aa, Mycobacterium
STATAPPPP

SEQ ID NO: 1346814 - protein, 8 aa, Mycobacterium
STATGYGC

SEQ ID NO: 1346815 - protein, 11 aa, Mycobacterium
STDLGPAREQS

SEQ ID NO: 1346816 - protein, 7 aa, Mycobacterium
STDPADV

SEQ ID NO: 1346817 - protein, 9 aa, Mycobacterium
STDPSRADE

SEQ ID NO: 1346818 - protein, 17 aa, Mycobacterium
STDTDASAARSVESADI

SEQ ID NO: 1346819 - protein, 22 aa, Mycobacterium
STDTQDEAPAESTDTPKATSPI

SEQ ID NO: 1346820 - protein, 6 aa, Mycobacterium
STELPR

SEQ ID NO: 1346821 - protein, 8 aa, Mycobacterium
STENANTF

SEQ ID NO: 1346822 - protein, 4 aa, Mycobacterium
STEV

SEQ ID NO: 1346823 - protein, 13 aa, Mycobacterium
STFTPRDAPDAAS

SEQ ID NO: 1346824 - protein, 6 aa, Mycobacterium
STGEGL

SEQ ID NO: 1346825 - protein, 17 aa, Mycobacterium
STGNISAQDRSADPPRA

SEQ ID NO: 1346826 - protein, 10 aa, Mycobacterium
STGPPGTRGP

SEQ ID NO: 1346827 - protein, 5 aa, Mycobacterium
STGPV

SEQ ID NO: 1346828 - protein, 10 aa, Mycobacterium
STGVRADGDG

SEQ ID NO: 1346829 - protein, 11 aa, Mycobacterium
STGVRADGDGY

SEQ ID NO: 1346830 - protein, 7 aa, Mycobacterium
STHGPTP

SEQ ID NO: 1346831 - protein, 11 aa, Mycobacterium
STHPDPTGNED

SEQ ID NO: 1346832 - protein, 7 aa, Mycobacterium
STKPGDT

SEQ ID NO: 1346833 - protein, 7 aa, Mycobacterium
STKTGTL

SEQ ID NO: 1346834 - protein, 7 aa, Mycobacterium
STLGDHS

SEQ ID NO: 1346835 - protein, 10 aa, Mycobacterium
STLPEERSRE

SEQ ID NO: 1346836 - protein, 7 aa, Mycobacterium
STLPQNS

SEQ ID NO: 1346837 - protein, 8 aa, Mycobacterium
STLPQNSP

SEQ ID NO: 1346838 - protein, 20 aa, Mycobacterium
STPAAAPAPDVITDKGTPYA

SEQ ID NO: 1346839 - protein, 7 aa, Mycobacterium
STPDGVP

SEQ ID NO: 1346840 - protein, 14 aa, Mycobacterium
STPPAGGFSPGGHN

SEQ ID NO: 1346841 - protein, 15 aa, Mycobacterium
STPQAQSDGPADDVA

SEQ ID NO: 1346842 - protein, 22 aa, Mycobacterium
STPRAQGESAADDDVSCSDADV

SEQ ID NO: 1346843 - protein, 12 aa, Mycobacterium
STPSGDNGDRTL

SEQ ID NO: 1346844 - protein, 4 aa, Mycobacterium
STQG

SEQ ID NO: 1346845 - protein, 9 aa, Mycobacterium
STQIAGGAQ

SEQ ID NO: 1346846 - protein, 6 aa, Mycobacterium
STRDKL

SEQ ID NO: 1346847 - protein, 5 aa, Mycobacterium
STSLA

SEQ ID NO: 1346848 - protein, 15 aa, Mycobacterium
STSLRGDGKGNGPVR

SEQ ID NO: 1346849 - protein, 5 aa, Mycobacterium
STSNG

SEQ ID NO: 1346850 - protein, 8 aa, Mycobacterium
STTNVAEG

SEQ ID NO: 1346851 - protein, 15 aa, Mycobacterium
STTQIPVEEYLKTHP

SEQ ID NO: 1346852 - protein, 6 aa, Mycobacterium
STTSNA

SEQ ID NO: 1346853 - protein, 11 aa, Mycobacterium
STTSPSGRGLA

SEQ ID NO: 1346854 - protein, 5 aa, Mycobacterium
STVDQ

SEQ ID NO: 1346855 - protein, 8 aa, Mycobacterium
STVGPIAD

SEQ ID NO: 1346856 - protein, 5 aa, Mycobacterium
STVGT

SEQ ID NO: 1346857 - protein, 17 aa, Mycobacterium
SVADEHHNDPTTRRDER

SEQ ID NO: 1346858 - protein, 8 aa, Mycobacterium
SVDPGRKF

SEQ ID NO: 1346859 - protein, 6 aa, Mycobacterium
SVDSPK

SEQ ID NO: 1346860 - protein, 48 aa, Mycobacterium
SVDTGMKSAGLPGSSLGNSQQAAGPLVTSNSRYGISAGAEPPQPTNAG

SEQ ID NO: 1346861 - protein, 5 aa, Mycobacterium
SVEGA

SEQ ID NO: 1346862 - protein, 15 aa, Mycobacterium
SVEGNQGVDPDEAAR

SEQ ID NO: 1346863 - protein, 9 aa, Mycobacterium
SVETPADAG

SEQ ID NO: 1346864 - protein, 15 aa, Mycobacterium
SVGGTTLSTDADGTW

SEQ ID NO: 1346865 - protein, 8 aa, Mycobacterium
SVGSQGVA

SEQ ID NO: 1346866 - protein, 48 aa, Mycobacterium
SVKARKAQGTQKDEPAAEKPAAKKPAAKKSPAKKTAAKKAPAKKAPAK

SEQ ID NO: 1346867 - protein, 7 aa, Mycobacterium
SVKGTVP

SEQ ID NO: 1346868 - protein, 13 aa, Mycobacterium
SVKPNTGHLEGGA

SEQ ID NO: 1346869 - protein, 4 aa, Mycobacterium
SVNL

SEQ ID NO: 1346870 - protein, 4 aa, Mycobacterium
SVPG

SEQ ID NO: 1346871 - protein, 7 aa, Mycobacterium
SVRSSAN

SEQ ID NO: 1346872 - protein, 17 aa, Mycobacterium
SVSANNSAAAIETTGGA

SEQ ID NO: 1346873 - protein, 8 aa, Mycobacterium
SVSAPSYH

SEQ ID NO: 1346874 - protein, 12 aa, Mycobacterium
SVSGDDNDGDSF

SEQ ID NO: 1346875 - protein, 17 aa, Mycobacterium
SVSHDPAIENKGDEPFA

SEQ ID NO: 1346876 - protein, 14 aa, Mycobacterium
SVSNPDDSSHRAQK

SEQ ID NO: 1346877 - protein, 10 aa, Mycobacterium
SVSTANPLAT

SEQ ID NO: 1346878 - protein, 5 aa, Mycobacterium
SVTTP

SEQ ID NO: 1346879 - protein, 6 aa, Mycobacterium
SWDRPE

SEQ ID NO: 1346880 - protein, 10 aa, Mycobacterium
SWPGTSAREA

SEQ ID NO: 1346881 - protein, 10 aa, Mycobacterium
SYDPDDDDTL

SEQ ID NO: 1346882 - protein, 6 aa, Mycobacterium
SYGAGN

SEQ ID NO: 1346883 - protein, 10 aa, Mycobacterium
SYGDEKVSPS

SEQ ID NO: 1346884 - protein, 6 aa, Mycobacterium
SYGEGN

SEQ ID NO: 1346885 - protein, 14 aa, Mycobacterium
SYPGGFDDSPDLGS

SEQ ID NO: 1346886 - protein, 6 aa, Mycobacterium
SYPTSV

SEQ ID NO: 1346887 - protein, 6 aa, Mycobacterium
SYRSTV

SEQ ID NO: 1346888 - protein, 6 aa, Mycobacterium
SYSPEE

SEQ ID NO: 1346889 - protein, 9 aa, Mycobacterium
SYTATTCPA

SEQ ID NO: 1346890 - protein, 9 aa, Mycobacterium
TAAAADGPA

SEQ ID NO: 1346891 - protein, 9 aa, Mycobacterium
TAAAPANVE

SEQ ID NO: 1346892 - protein, 9 aa, Mycobacterium
TAAAPLGGR

SEQ ID NO: 1346893 - protein, 11 aa, Mycobacterium
TAAAPTGAVAT

SEQ ID NO: 1346894 - protein, 15 aa, Mycobacterium
TAAARDAASSPFKRS

SEQ ID NO: 1346895 - protein, 6 aa, Mycobacterium
TAAARH

SEQ ID NO: 1346896 - protein, 16 aa, Mycobacterium
TAAASRVKASTKPCAG

SEQ ID NO: 1346897 - protein, 20 aa, Mycobacterium
TAADAVEGKGSFDGEKQPIQ

SEQ ID NO: 1346898 - protein, 8 aa, Mycobacterium
TAADGRRG

SEQ ID NO: 1346899 - protein, 9 aa, Mycobacterium
TAAEDNGIA

SEQ ID NO: 1346900 - protein, 18 aa, Mycobacterium
TAAGAQRVGGQDAKPVGD

SEQ ID NO: 1346901 - protein, 10 aa, Mycobacterium
TAAGPTSAYA

SEQ ID NO: 1346902 - protein, 5 aa, Mycobacterium
TAAGR

SEQ ID NO: 1346903 - protein, 9 aa, Mycobacterium
TAANGVGNG

SEQ ID NO: 1346904 - protein, 8 aa, Mycobacterium
TAAPLPPA

SEQ ID NO: 1346905 - protein, 7 aa, Mycobacterium
TAAPRRA

SEQ ID NO: 1346906 - protein, 38 aa, Mycobacterium; identical to SEQ ID NO: 1228623

SEQ ID NO: 1346907 - protein, 38 aa, Mycobacterium
TAAQREADARRAAQTAAEERHRADADALAGANAELAPY

SEQ ID NO: 1346908 - protein, 14 aa, Mycobacterium
TAAQYGANPAQAAG

SEQ ID NO: 1346909 - protein, 12 aa, Mycobacterium
TAASSVSATESH

SEQ ID NO: 1346910 - protein, 8 aa, Mycobacterium
TAATDANR

SEQ ID NO: 1346911 - protein, 7 aa, Mycobacterium
TAATGQA

SEQ ID NO: 1346912 - protein, 8 aa, Mycobacterium
TAAVEAAT

SEQ ID NO: 1346913 - protein, 14 aa, Mycobacterium
TADAAAADTTTTAV

SEQ ID NO: 1346914 - protein, 11 aa, Mycobacterium
TADAATPTWSG

SEQ ID NO: 1346915 - protein, 6 aa, Mycobacterium
TADDAT

SEQ ID NO: 1346916 - protein, 10 aa, Mycobacterium
TADDATKTMT

SEQ ID NO: 1346917 - protein, 15 aa, Mycobacterium
TADEQTLRAPGAPEA

SEQ ID NO: 1346918 - protein, 5 aa, Mycobacterium
TADEV

SEQ ID NO: 1346919 - protein, 8 aa, Mycobacterium
TADGAGDK

SEQ ID NO: 1346920 - protein, 5 aa, Mycobacterium
TADGG

SEQ ID NO: 1346921 - protein, 10 aa, Mycobacterium
TADTPEGPWS

SEQ ID NO: 1346922 - protein, 10 aa, Mycobacterium
TAEDGRGLPA

SEQ ID NO: 1346923 - protein, 8 aa, Mycobacterium
TAEDPEER

SEQ ID NO: 1346924 - protein, 14 aa, Mycobacterium
TAEGPRGALCSVRH

SEQ ID NO: 1346925 - protein, 10 aa, Mycobacterium
TAEHGTGAVP

SEQ ID NO: 1346926 - protein, 8 aa, Mycobacterium
TAELSTSL

SEQ ID NO: 1346927 - protein, 12 aa, Mycobacterium
TAEPPGVGGTGQ

SEQ ID NO: 1346928 - protein, 5 aa, Mycobacterium
TAERH

SEQ ID NO: 1346929 - protein, 28 aa, Mycobacterium
TAFATDNEPTPGGGGCTYTDADGYPIPI

SEQ ID NO: 1346930 - protein, 17 aa, Mycobacterium
TAFDGKRDGVAATATRY

SEQ ID NO: 1346931 - protein, 7 aa, Mycobacterium
TAGAGWP

SEQ ID NO: 1346932 - protein, 15 aa, Mycobacterium
TAGEETVDNRLTKKP

SEQ ID NO: 1346933 - protein, 7 aa, Mycobacterium
TAGGEEH

SEQ ID NO: 1346934 - protein, 5 aa, Mycobacterium
TAGGI

SEQ ID NO: 1346935 - protein, 6 aa, Mycobacterium
TAGLTG

SEQ ID NO: 1346936 - protein, 21 aa, Mycobacterium
TAGRRTARPTERGGADPLAAA

SEQ ID NO: 1346937 - protein, 21 aa, Mycobacterium
TAGRRTPGPTERGGADPLAAA

SEQ ID NO: 1346938 - protein, 8 aa, Mycobacterium
TAGSAGLN

SEQ ID NO: 1346939 - protein, 5 aa, Mycobacterium
TAGTA

SEQ ID NO: 1346940 - protein, 4 aa, Mycobacterium
TAIA

SEQ ID NO: 1346941 - protein, 16 aa, Mycobacterium
TAKGRPGSGFVPVGAT

SEQ ID NO: 1346942 - protein, 6 aa, Mycobacterium
TAKIGE

SEQ ID NO: 1346943 - protein, 10 aa, Mycobacterium
TAKLQTPATS

SEQ ID NO: 1346944 - protein, 9 aa, Mycobacterium
TAKRPADAA

SEQ ID NO: 1346945 - protein, 6 aa, Mycobacterium
TAKTSV

SEQ ID NO: 1346946 - protein, 14 aa, Mycobacterium
TALAQSASAAGYSS

SEQ ID NO: 1346947 - protein, 8 aa, Mycobacterium
TALGLPPG

SEQ ID NO: 1346948 - protein, 11 aa, Mycobacterium
TAMSSGPPLDY

SEQ ID NO: 1346949 - protein, 15 aa, Mycobacterium
TANGTATAGVDYTAA

SEQ ID NO: 1346950 - protein, 9 aa, Mycobacterium
TANPAAADT

SEQ ID NO: 1346951 - protein, 4 aa, Mycobacterium
TAPA

SEQ ID NO: 1346952 - protein, 8 aa, Mycobacterium
TAPAAPAM

SEQ ID NO: 1346953 - protein, 11 aa, Mycobacterium
TAPPAMAAPPT

SEQ ID NO: 1346954 - protein, 9 aa, Mycobacterium
TAPPAMAQP

SEQ ID NO: 1346955 - protein, 8 aa, Mycobacterium
TAPRDEPG

SEQ ID NO: 1346956 - protein, 13 aa, Mycobacterium
TAPSGAPHSSTQC

SEQ ID NO: 1346957 - protein, 24 aa, Mycobacterium
TAPTAFTQPPAPVAGSESPGDTIR

SEQ ID NO: 1346958 - protein, 8 aa, Mycobacterium
TAPTASAS

SEQ ID NO: 1346959 - protein, 7 aa, Mycobacterium
TAQAAGT

SEQ ID NO: 1346960 - protein, 12 aa, Mycobacterium
TAQDRLAAKQTE

SEQ ID NO: 1346961 - protein, 16 aa, Mycobacterium
TAQSHGTTAYNASGDL

SEQ ID NO: 1346962 - protein, 8 aa, Mycobacterium
TAQTASQL

SEQ ID NO: 1346963 - protein, 10 aa, Mycobacterium
TARDDAAAAQ

SEQ ID NO: 1346964 - protein, 6 aa, Mycobacterium
TAREDT

SEQ ID NO: 1346965 - protein, 4 aa, Mycobacterium
TARN

SEQ ID NO: 1346966 - protein, 4 aa, Mycobacterium
TARP

SEQ ID NO: 1346967 - protein, 5 aa, Mycobacterium
TARSL

SEQ ID NO: 1346968 - protein, 11 aa, Mycobacterium
TARTLSPVPPP

SEQ ID NO: 1346969 - protein, 9 aa, Mycobacterium
TASDPEGDR

SEQ ID NO: 1346970 - protein, 8 aa, Mycobacterium
TASDQRDG

SEQ ID NO: 1346971 - protein, 9 aa, Mycobacterium
TASGSRMRP

SEQ ID NO: 1346972 - protein, 9 aa, Mycobacterium
TASGTPVIR

SEQ ID NO: 1346973 - protein, 16 aa, Mycobacterium
TASKGAAECGVDDEGT

SEQ ID NO: 1346974 - protein, 13 aa, Mycobacterium
TASPTAKGGTVTI

SEQ ID NO: 1346975 - protein, 8 aa, Mycobacterium
TASPTENP

SEQ ID NO: 1346976 - protein, 5 aa, Mycobacterium
TASSR

SEQ ID NO: 1346977 - protein, 22 aa, Mycobacterium
TATDAPEPEAVDESAGPAEDEV

SEQ ID NO: 1346978 - protein, 8 aa, Mycobacterium
TATDEAIA

SEQ ID NO: 1346979 - protein, 11 aa, Mycobacterium
TATDTGGANPW

SEQ ID NO: 1346980 - protein, 5 aa, Mycobacterium
TATNS

SEQ ID NO: 1346981 - protein, 8 aa, Mycobacterium
TATNTAVA

SEQ ID NO: 1346982 - protein, 8 aa, Mycobacterium
TATQYGRE

SEQ ID NO: 1346983 - protein, 13 aa, Mycobacterium
TATSDGQVYGFAP

SEQ ID NO: 1346984 - protein, 9 aa, Mycobacterium
TATSSRGAT

SEQ ID NO: 1346985 - protein, 27 aa, Mycobacterium
TATTTDPDGDDLSGSLNTSNNGNGDPW

SEQ ID NO: 1346986 - protein, 9 aa, Mycobacterium
TAVADGDSM

SEQ ID NO: 1346987 - protein, 8 aa, Mycobacterium
TAVEPGGL

SEQ ID NO: 1346988 - protein, 7 aa, Mycobacterium
TAVGETE

SEQ ID NO: 1346989 - protein, 10 aa, Mycobacterium
TAVRQDGDGY

SEQ ID NO: 1346990 - protein, 7 aa, Mycobacterium
TAYGPYR

SEQ ID NO: 1346991 - protein, 8 aa, Mycobacterium
TAYSSTDI

SEQ ID NO: 1346992 - protein, 11 aa, Mycobacterium
TCTPGPLGTEP

SEQ ID NO: 1346993 - protein, 9 aa, Mycobacterium
TCTTADGST

SEQ ID NO: 1346994 - protein, 6 aa, Mycobacterium
TDAANR

SEQ ID NO: 1346995 - protein, 6 aa, Mycobacterium
TDADEV

SEQ ID NO: 1346996 - protein, 14 aa, Mycobacterium
TDAGTKGALCSMRP

SEQ ID NO: 1346997 - protein, 8 aa, Mycobacterium
TDAPDGTV

SEQ ID NO: 1346998 - protein, 10 aa, Mycobacterium
TDAPPRRAQI

SEQ ID NO: 1346999 - protein, 14 aa, Mycobacterium
TDDAGQGHTDAETL

SEQ ID NO: 1347000 - protein, 10 aa, Mycobacterium
TDDAIGPATE

SEQ ID NO: 1347001 - protein, 10 aa, Mycobacterium
TDDPGTKQTA

SEQ ID NO: 1347002 - protein, 4 aa, Mycobacterium
TDEA

SEQ ID NO: 1347003 - protein, 7 aa, Mycobacterium
TDEDEDA

SEQ ID NO: 1347004 - protein, 7 aa, Mycobacterium
TDEELRR

SEQ ID NO: 1347005 - protein, 17 aa, Mycobacterium
TDEQTQEYNTAYAAVTG

SEQ ID NO: 1347006 - protein, 6 aa, Mycobacterium
TDERRR

SEQ ID NO: 1347007 - protein, 4 aa, Mycobacterium
TDET

SEQ ID NO: 1347008 - protein, 7 aa, Mycobacterium
TDFESGL

SEQ ID NO: 1347009 - protein, 7 aa, Mycobacterium
TDGGATA

SEQ ID NO: 1347010 - protein, 11 aa, Mycobacterium
TDGGATPTATA

SEQ ID NO: 1347011 - protein, 19 aa, Mycobacterium
TDGGGYPTGNESYFIASMQ

SEQ ID NO: 1347012 - protein, 10 aa, Mycobacterium
TDGHGGSATV

SEQ ID NO: 1347013 - protein, 4 aa, Mycobacterium
TDGQ

SEQ ID NO: 1347014 - protein, 5 aa, Mycobacterium
TDGSV

SEQ ID NO: 1347015 - protein, 8 aa, Mycobacterium
TDGTATQL

SEQ ID NO: 1347016 - protein, 6 aa, Mycobacterium
TDGTRA

SEQ ID NO: 1347017 - protein, 6 aa, Mycobacterium
TDGTVT

SEQ ID NO: 1347018 - protein, 4 aa, Mycobacterium
TDHC

SEQ ID NO: 1347019 - protein, 4 aa, Mycobacterium
TDIN

SEQ ID NO: 1347020 - protein, 13 aa, Mycobacterium
TDLSRPDERAALP

SEQ ID NO: 1347021 - protein, 7 aa, Mycobacterium
TDLTSGA

SEQ ID NO: 1347022 - protein, 8 aa, Mycobacterium
TDNAPIGA

SEQ ID NO: 1347023 - protein, 105 aa, Mycobacterium
TDPDEEDDLDSEPTDSEPVDGTDDGTDDVDLGGDTDEGDDSDLEESVDVTGGDEDAGDEDGGEDEGADANDGGSDNGGTAGDNTSDNGSEGDSSSSNDKGSEGSD

SEQ ID NO: 1347024 - protein, 6 aa, Mycobacterium
TDPGAA

SEQ ID NO: 1347025 - protein, 9 aa, Mycobacterium
TDPNGDSLT

SEQ ID NO: 1347026 - protein, 8 aa, Mycobacterium
TDPPKHEI

SEQ ID NO: 1347027 - protein, 22 aa, Mycobacterium
TDPVPGDRFGGSPVNADRPSFS

SEQ ID NO: 1347028 - protein, 4 aa, Mycobacterium
TDQR

SEQ ID NO: 1347029 - protein, 9 aa, Mycobacterium
TDRCPTGVA

SEQ ID NO: 1347030 - protein, 7 aa, Mycobacterium
TDRGVEG

SEQ ID NO: 1347031 - protein, 4 aa, Mycobacterium
TDRP

SEQ ID NO: 1347032 - protein, 8 aa, Mycobacterium
TDRRAEGA

SEQ ID NO: 1347033 - protein, 6 aa, Mycobacterium
TDRRFP

SEQ ID NO: 1347034 - protein, 7 aa, Mycobacterium
TDRSRPT

SEQ ID NO: 1347035 - protein, 18 aa, Mycobacterium
TDRTPPKPDARASGRSIG

SEQ ID NO: 1347036 - protein, 7 aa, Mycobacterium
TDSACGT

SEQ ID NO: 1347037 - protein, 4 aa, Mycobacterium
TDSG

SEQ ID NO: 1347038 - protein, 6 aa, Mycobacterium
TDSGGR

SEQ ID NO: 1347039 - protein, 6 aa, Mycobacterium
TDSGGS

SEQ ID NO: 1347040 - protein, 6 aa, Mycobacterium
TDSGIT

SEQ ID NO: 1347041 - protein, 4 aa, Mycobacterium
TDSH

SEQ ID NO: 1347042 - protein, 16 aa, Mycobacterium
TDSSGLSTTTYKDVNP

SEQ ID NO: 1347043 - protein, 9 aa, Mycobacterium
TDTAAKELP

SEQ ID NO: 1347044 - protein, 8 aa, Mycobacterium
TDTPAQTL

SEQ ID NO: 1347045 - protein, 55 aa, Mycobacterium
TDVTDDEESLTDDEEASPAQDESENTSEEAGDADAGAGADEPGSGDAPSADSEAT

SEQ ID NO: 1347046 - protein, 5 aa, Mycobacterium
TEADT

SEQ ID NO: 1347047 - protein, 19 aa, Mycobacterium
TEAPRAATALDERPAAQQK

SEQ ID NO: 1347048 - protein, 21 aa, Mycobacterium
TEAPTATAPTSTAAPATPATV

SEQ ID NO: 1347049 - protein, 19 aa, Mycobacterium
TEAREVAGQTVRDDHGRRH

SEQ ID NO: 1347050 - protein, 24 aa, Mycobacterium
TEATRTAGIDPATAGGTQSMNYSR

SEQ ID NO: 1347051 - protein, 95 aa, Mycobacterium
TEDAAGETTAESGATTSEPADDGDAVEPADDGDTVEQVESDDDDEAVGQVEPEEEAEADEDEAVVEPDEDEVAPDVEEAADADGAPSEDGDGGFQ

SEQ ID NO: 1347052 - protein, 6 aa, Mycobacterium
TEDSGR

SEQ ID NO: 1347053 - protein, 36 aa, Mycobacterium
TEEPRTDKDSPQRSLAETESVPLGATAETTPSRAPS

SEQ ID NO: 1347054 - protein, 8 aa, Mycobacterium
TEERAAGG

SEQ ID NO: 1347055 - protein, 6 aa, Mycobacterium
TEESRE

SEQ ID NO: 1347056 - protein, 12 aa, Mycobacterium
TEGASKRSGARL

SEQ ID NO: 1347057 - protein, 9 aa, Mycobacterium
TEGDKSPAD

SEQ ID NO: 1347058 - protein, 10 aa, Mycobacterium
TEGKEGMDTY

SEQ ID NO: 1347059 - protein, 12 aa, Mycobacterium
TEGSSTNPTGAG

SEQ ID NO: 1347060 - protein, 4 aa, Mycobacterium
TEHG

SEQ ID NO: 1347061 - protein, 4 aa, Mycobacterium
TEHP

SEQ ID NO: 1347062 - protein, 8 aa, Mycobacterium
TEIADGAN

SEQ ID NO: 1347063 - protein, 4 aa, Mycobacterium
TEID

SEQ ID NO: 1347064 - protein, 7 aa, Mycobacterium
TEKDNGF

SEQ ID NO: 1347065 - protein, 7 aa, Mycobacterium
TENKPVG

SEQ ID NO: 1347066 - protein, 4 aa, Mycobacterium
TEPA

SEQ ID NO: 1347067 - protein, 7 aa, Mycobacterium
TEPELPA

SEQ ID NO: 1347068 - protein, 8 aa, Mycobacterium
TEPNPALD

SEQ ID NO: 1347069 - protein, 6 aa, Mycobacterium
TEPSTV

SEQ ID NO: 1347070 - protein, 12 aa, Mycobacterium
TEPVGSPTPEPR

SEQ ID NO: 1347071 - protein, 4 aa, Mycobacterium
TEQP

SEQ ID NO: 1347072 - protein, 4 aa, Mycobacterium
TERG

SEQ ID NO: 1347073 - protein, 8 aa, Mycobacterium
TESEGQVR

SEQ ID NO: 1347074 - protein, 4 aa, Mycobacterium
TESN

SEQ ID NO: 1347075 - protein, 22 aa, Mycobacterium
TESVRNRAPASTITKDSALAER

SEQ ID NO: 1347076 - protein, 12 aa, Mycobacterium
TETASGTRAGAD

SEQ ID NO: 1347077 - protein, 11 aa, Mycobacterium
TETGADGDSKT

SEQ ID NO: 1347078 - protein, 5 aa, Mycobacterium
TETVD

SEQ ID NO: 1347079 - protein, 7 aa, Mycobacterium
TETVPNQ

SEQ ID NO: 1347080 - protein, 9 aa, Mycobacterium
TEVDAGHSR

SEQ ID NO: 1347081 - protein, 11 aa, Mycobacterium
TEVDAGHSRYA

SEQ ID NO: 1347082 - protein, 10 aa, Mycobacterium
TEVDTGRDQE

SEQ ID NO: 1347083 - protein, 6 aa, Mycobacterium
TEVGDV

SEQ ID NO: 1347084 - protein, 11 aa, Mycobacterium
TEVTPPDSPYE

SEQ ID NO: 1347085 - protein, 6 aa, Mycobacterium
TEYEVS

SEQ ID NO: 1347086 - protein, 4 aa, Mycobacterium
TFDA

SEQ ID NO: 1347087 - protein, 7 aa, Mycobacterium
TFDQNSG

SEQ ID NO: 1347088 - protein, 5 aa, Mycobacterium
TFGAS

SEQ ID NO: 1347089 - protein, 48 aa, Mycobacterium; identical to SEQ ID NO: 1113707

SEQ ID NO: 1347090 - protein, 10 aa, Mycobacterium
TFPDPPSTGW

SEQ ID NO: 1347091 - protein, 8 aa, Mycobacterium
TFQTGSGT

SEQ ID NO: 1347092 - protein, 11 aa, Mycobacterium
TFRGGAGRGVR

SEQ ID NO: 1347093 - protein, 11 aa, Mycobacterium
TGAAAGPVNSP

SEQ ID NO: 1347094 - protein, 22 aa, Mycobacterium
TGAARRDTHTETTAPAAAAATD

SEQ ID NO: 1347095 - protein, 7 aa, Mycobacterium
TGADGAV

SEQ ID NO: 1347096 - protein, 13 aa, Mycobacterium
TGADPLRSTAGDF

SEQ ID NO: 1347097 - protein, 8 aa, Mycobacterium
TGAEPNPY

SEQ ID NO: 1347098 - protein, 115 aa, Mycobacterium
TGAGTASAGTDGDTSPTSSAAADVDTASTATEATEATDEMDVETTDEVAEDEPVAEDEPVAEDEPVAEDEPVAEDEPVAEDEPVAEDAGQNRGTRHGAAPAEVEPESVDEEPTDA

SEQ ID NO: 1347099 - protein, 24 aa, Mycobacterium
TGAPASERAAKLAGGQSAVPTADN

SEQ ID NO: 1347100 - protein, 6 aa, Mycobacterium
TGAPKL

SEQ ID NO: 1347101 - protein, 4 aa, Mycobacterium
TGAR

SEQ ID NO: 1347102 - protein, 17 aa, Mycobacterium
TGARPRGFADYLRAAWS

SEQ ID NO: 1347103 - protein, 4 aa, Mycobacterium
TGAS

SEQ ID NO: 1347104 - protein, 19 aa, Mycobacterium
TGCDGAPGGAFTYPFSLVR

SEQ ID NO: 1347105 - protein, 14 aa, Mycobacterium
TGCTTGEDAVAQGG

SEQ ID NO: 1347106 - protein, 8 aa, Mycobacterium
TGDADTAK

SEQ ID NO: 1347107 - protein, 8 aa, Mycobacterium
TGDAGAVC

SEQ ID NO: 1347108 - protein, 17 aa, Mycobacterium
TGDAGNPALAADPGSLA

SEQ ID NO: 1347109 - protein, 7 aa, Mycobacterium
TGDDPAV

SEQ ID NO: 1347110 - protein, 4 aa, Mycobacterium
TGDG

SEQ ID NO: 1347111 - protein, 5 aa, Mycobacterium
TGDRE

SEQ ID NO: 1347112 - protein, 9 aa, Mycobacterium
TGDRGQLRA

SEQ ID NO: 1347113 - protein, 6 aa, Mycobacterium
TGDRTL

SEQ ID NO: 1347114 - protein, 10 aa, Mycobacterium
TGDTTRPTPT

SEQ ID NO: 1347115 - protein, 10 aa, Mycobacterium
TGEATTRPVT

SEQ ID NO: 1347116 - protein, 5 aa, Mycobacterium
TGEEA

SEQ ID NO: 1347117 - protein, 104 aa, Mycobacterium
TGEETDPDAEQTPLNEQKPADDAGDQGLGGDDLGEEELGEEDLGEEDLDEEELPGDDVSGDVTEETAEESEDGGEEAGEAGDAGDAGGETGGDTGGETANAPST

SEQ ID NO: 1347118 - protein, 10 aa, Mycobacterium
TGEMSPSGAT

SEQ ID NO: 1347119 - protein, 11 aa, Mycobacterium
TGEPPQTTLSA

SEQ ID NO: 1347120 - protein, 15 aa, Mycobacterium
TGGAAGSGSSGSSAM

SEQ ID NO: 1347121 - protein, 16 aa, Mycobacterium
TGGAPRRLPVDGPRPD

SEQ ID NO: 1347122 - protein, 21 aa, Mycobacterium
TGGATNGRLDNPRTQRTGDDG

SEQ ID NO: 1347123 - protein, 11 aa, Mycobacterium
TGGDFTKPSGR

SEQ ID NO: 1347124 - protein, 9 aa, Mycobacterium
TGGDVTAES

SEQ ID NO: 1347125 - protein, 9 aa, Mycobacterium
TGGEQDQVG

SEQ ID NO: 1347126 - protein, 8 aa, Mycobacterium
TGGGGWGN

SEQ ID NO: 1347127 - protein, 5 aa, Mycobacterium
TGGNV

SEQ ID NO: 1347128 - protein, 9 aa, Mycobacterium
TGGPAEGEV

SEQ ID NO: 1347129 - protein, 8 aa, Mycobacterium
TGGRTRDS

SEQ ID NO: 1347130 - protein, 15 aa, Mycobacterium
TGGSATAGAFSRPGL

SEQ ID NO: 1347131 - protein, 5 aa, Mycobacterium
TGIGR

SEQ ID NO: 1347132 - protein, 6 aa, Mycobacterium
TGIYPG

SEQ ID NO: 1347133 - protein, 6 aa, Mycobacterium
TGIYTG

SEQ ID NO: 1347134 - protein, 11 aa, Mycobacterium
TGKANATDPNW

SEQ ID NO: 1347135 - protein, 15 aa, Mycobacterium
TGKASDFDSDATVGN

SEQ ID NO: 1347136 - protein, 4 aa, Mycobacterium
TGLA

SEQ ID NO: 1347137 - protein, 5 aa, Mycobacterium
TGLDE

SEQ ID NO: 1347138 - protein, 5 aa, Mycobacterium
TGLEN

SEQ ID NO: 1347139 - protein, 8 aa, Mycobacterium
TGLPANDP

SEQ ID NO: 1347140 - protein, 6 aa, Mycobacterium
TGLPPT

SEQ ID NO: 1347141 - protein, 5 aa, Mycobacterium
TGNGH

SEQ ID NO: 1347142 - protein, 5 aa, Mycobacterium
TGNGY

SEQ ID NO: 1347143 - protein, 8 aa, Mycobacterium
TGNNQSYT

SEQ ID NO: 1347144 - protein, 9 aa, Mycobacterium
TGNYPTTEQ

SEQ ID NO: 1347145 - protein, 9 aa, Mycobacterium
TGPAGSAWR

SEQ ID NO: 1347146 - protein, 16 aa, Mycobacterium
TGPASAAPDDGQWDPT

SEQ ID NO: 1347147 - protein, 5 aa, Mycobacterium
TGPDG

SEQ ID NO: 1347148 - protein, 10 aa, Mycobacterium
TGPEEDAADQ

SEQ ID NO: 1347149 - protein, 6 aa, Mycobacterium
TGPEGL

SEQ ID NO: 1347150 - protein, 9 aa, Mycobacterium
TGPGGRGMT

SEQ ID NO: 1347151 - protein, 11 aa, Mycobacterium
TGPGGTAVGSE

SEQ ID NO: 1347152 - protein, 9 aa, Mycobacterium
TGPGPSAGP

SEQ ID NO: 1347153 - protein, 41 aa, Mycobacterium
TGPLSTGKGELVDNGDGTFTYTPTAAAREAASDPDAPDDAR

SEQ ID NO: 1347154 - protein, 6 aa, Mycobacterium
TGPNGL

SEQ ID NO: 1347155 - protein, 13 aa, Mycobacterium
TGPPQLPPGSTVT

SEQ ID NO: 1347156 - protein, 5 aa, Mycobacterium
TGQAQ

SEQ ID NO: 1347157 - protein, 5 aa, Mycobacterium
TGQSP

SEQ ID NO: 1347158 - protein, 10 aa, Mycobacterium
TGRDAVAQGG

SEQ ID NO: 1347159 - protein, 9 aa, Mycobacterium
TGREEDVAD

SEQ ID NO: 1347160 - protein, 6 aa, Mycobacterium
TGRGQP

SEQ ID NO: 1347161 - protein, 20 aa, Mycobacterium
TGRGTDAQDRPDGTPLPGTA

SEQ ID NO: 1347162 - protein, 10 aa, Mycobacterium
TGRLSDDRDW

SEQ ID NO: 1347163 - protein, 15 aa, Mycobacterium
TGRNNTATIDDGSNN

SEQ ID NO: 1347164 - protein, 22 aa, Mycobacterium
TGRNSDAQAAKPLPAPATANPA

SEQ ID NO: 1347165 - protein, 16 aa, Mycobacterium
TGRPGELGGGGDVPGQ

SEQ ID NO: 1347166 - protein, 8 aa, Mycobacterium
TGRSAPSR

SEQ ID NO: 1347167 - protein, 23 aa, Mycobacterium
TGRVPAADTAAQRVENGIGQGTV

SEQ ID NO: 1347168 - protein, 20 aa, Mycobacterium
TGSGSNTSHPPGSGPSRAED

SEQ ID NO: 1347169 - protein, 8 aa, Mycobacterium
TGSGSYAD

SEQ ID NO: 1347170 - protein, 43 aa, Mycobacterium
TGSPSPSAAPGQGEEGGSGSEGQGEGGQKLTAELKSPDGTTVA

SEQ ID NO: 1347171 - protein, 8 aa, Mycobacterium
TGSSATDT

SEQ ID NO: 1347172 - protein, 16 aa, Mycobacterium
TGTAGQTVLRRNGFAA

SEQ ID NO: 1347173 - protein, 25 aa, Mycobacterium
TGTAKGSFADNPTGAAEAKYEITTT

SEQ ID NO: 1347174 - protein, 7 aa, Mycobacterium
TGTDGRL

SEQ ID NO: 1347175 - protein, 6 aa, Mycobacterium
TGTERG

SEQ ID NO: 1347176 - protein, 9 aa, Mycobacterium
TGTGGSDAK

SEQ ID NO: 1347177 - protein, 11 aa, Mycobacterium
TGTGGTAVGSE

SEQ ID NO: 1347178 - protein, 21 aa, Mycobacterium
TGTGSRATVNSSDSRATVEGD

SEQ ID NO: 1347179 - protein, 22 aa, Mycobacterium
TGTGSRATVNSSDSRATVEGDG

SEQ ID NO: 1347180 - protein, 7 aa, Mycobacterium
TGTPANV

SEQ ID NO: 1347181 - protein, 12 aa, Mycobacterium
TGTPASSSRTYT

SEQ ID NO: 1347182 - protein, 15 aa, Mycobacterium
TGTPSDLDNGTPGNN

SEQ ID NO: 1347183 - protein, 4 aa, Mycobacterium
TGTT

SEQ ID NO: 1347184 - protein, 15 aa, Mycobacterium
TGTVTGAGSTELSGG

SEQ ID NO: 1347185 - protein, 18 aa, Mycobacterium
TGVATATHETRPSPNTDL

SEQ ID NO: 1347186 - protein, 8 aa, Mycobacterium
TGVATQNP

SEQ ID NO: 1347187 - protein, 17 aa, Mycobacterium
TGVDGADTRLTGPAQYP

SEQ ID NO: 1347188 - protein, 11 aa, Mycobacterium
TGVKDSHPQFA

SEQ ID NO: 1347189 - protein, 6 aa, Mycobacterium
TGVNPK

SEQ ID NO: 1347190 - protein, 8 aa, Mycobacterium
TGVPADER

SEQ ID NO: 1347191 - protein, 8 aa, Mycobacterium
TGVPTQAD

SEQ ID NO: 1347192 - protein, 14 aa, Mycobacterium
TGVSTYPGDGSNRW

SEQ ID NO: 1347193 - protein, 14 aa, Mycobacterium
TGVTRDGKAVLTPT

SEQ ID NO: 1347194 - protein, 4 aa, Mycobacterium
TGWG

SEQ ID NO: 1347195 - protein, 10 aa, Mycobacterium
TGWPGTPTHS

SEQ ID NO: 1347196 - protein, 9 aa, Mycobacterium
TGYKENAAD

SEQ ID NO: 1347197 - protein, 4 aa, Mycobacterium
THEY

SEQ ID NO: 1347198 - protein, 6 aa, Mycobacterium
THEYTE

SEQ ID NO: 1347199 - protein, 5 aa, Mycobacterium
THPAG

SEQ ID NO: 1347200 - protein, 6 aa, Mycobacterium
THPEPK

SEQ ID NO: 1347201 - protein, 18 aa, Mycobacterium
THPGPDSAPEPRYTPSPA

SEQ ID NO: 1347202 - protein, 5 aa, Mycobacterium
THPQE

SEQ ID NO: 1347203 - protein, 10 aa, Mycobacterium
THSGTRTGRF

SEQ ID NO: 1347204 - protein, 7 aa, Mycobacterium
THTQSGS

SEQ ID NO: 1347205 - protein, 8 aa, Mycobacterium
TIDPRAED

SEQ ID NO: 1347206 - protein, 12 aa, Mycobacterium
TIDTNRKAVTGP

SEQ ID NO: 1347207 - protein, 8 aa, Mycobacterium
TIETTNGG

SEQ ID NO: 1347208 - protein, 8 aa, Mycobacterium
TIGPEKAA

SEQ ID NO: 1347209 - protein, 12 aa, Mycobacterium
TINGAQGSTAGY

SEQ ID NO: 1347210 - protein, 18 aa, Mycobacterium
TINGQDAGTTESVQCDPA

SEQ ID NO: 1347211 - protein, 6 aa, Mycobacterium
TINPQV

SEQ ID NO: 1347212 - protein, 7 aa, Mycobacterium
TIPGGKQ

SEQ ID NO: 1347213 - protein, 4 aa, Mycobacterium
TIPV

SEQ ID NO: 1347214 - protein, 17 aa, Mycobacterium
TISQVPPQFRPTTSKWT

SEQ ID NO: 1347215 - protein, 8 aa, Mycobacterium
TKATRLPE

SEQ ID NO: 1347216 - protein, 10 aa, Mycobacterium
TKDGTLNGPN

SEQ ID NO: 1347217 - protein, 10 aa, Mycobacterium
TKIPKPPTRV

SEQ ID NO: 1347218 - protein, 6 aa, Mycobacterium
TKPGAE

SEQ ID NO: 1347219 - protein, 8 aa, Mycobacterium
TKQDYKGQ

SEQ ID NO: 1347220 - protein, 4 aa, Mycobacterium
TKSL

SEQ ID NO: 1347221 - protein, 20 aa, Mycobacterium
TKSQNPDNPDEDEGGFQPNY

SEQ ID NO: 1347222 - protein, 4 aa, Mycobacterium
TKTT

SEQ ID NO: 1347223 - protein, 4 aa, Mycobacterium
TLAS

SEQ ID NO: 1347224 - protein, 9 aa, Mycobacterium
TLASTGSAY

SEQ ID NO: 1347225 - protein, 5 aa, Mycobacterium
TLDPA

SEQ ID NO: 1347226 - protein, 10 aa, Mycobacterium
TLDPDTGEVT

SEQ ID NO: 1347227 - protein, 11 aa, Mycobacterium
TLGDRTEAAVK

SEQ ID NO: 1347228 - protein, 5 aa, Mycobacterium
TLNRS

SEQ ID NO: 1347229 - protein, 10 aa, Mycobacterium
TLNTPEAKRA

SEQ ID NO: 1347230 - protein, 8 aa, Mycobacterium
TLPPGAER

SEQ ID NO: 1347231 - protein, 8 aa, Mycobacterium
TLRDPYTN

SEQ ID NO: 1347232 - protein, 6 aa, Mycobacterium
TLRTGH

SEQ ID NO: 1347233 - protein, 11 aa, Mycobacterium
TLSEGQPASAA

SEQ ID NO: 1347234 - protein, 12 aa, Mycobacterium
TLSRRMDARRPF

SEQ ID NO: 1347235 - protein, 10 aa, Mycobacterium
TLTGDGEVPV

SEQ ID NO: 1347236 - protein, 5 aa, Mycobacterium
TLTPA

SEQ ID NO: 1347237 - protein, 11 aa, Mycobacterium
TLTSRDQINGQ

SEQ ID NO: 1347238 - protein, 18 aa, Mycobacterium
TLVDPQGNEFSADPESPA

SEQ ID NO: 1347239 - protein, 13 aa, Mycobacterium
TMAQKGDLAPGDL

SEQ ID NO: 1347240 - protein, 9 aa, Mycobacterium
TNAAGPGSL

SEQ ID NO: 1347241 - protein, 17 aa, Mycobacterium
TNAAPTYSGITGQNTDA

SEQ ID NO: 1347242 - protein, 7 aa, Mycobacterium
TNAEVSG

SEQ ID NO: 1347243 - protein, 16 aa, Mycobacterium
TNAGGKTVAGSLNRDR

SEQ ID NO: 1347244 - protein, 10 aa, Mycobacterium
TNAPPGSTVS

SEQ ID NO: 1347245 - protein, 8 aa, Mycobacterium
TNAQQTFK

SEQ ID NO: 1347246 - protein, 8 aa, Mycobacterium
TNATSEAV

SEQ ID NO: 1347247 - protein, 6 aa, Mycobacterium
TNCTGF

SEQ ID NO: 1347248 - protein, 8 aa, Mycobacterium
TNDGLRSR

SEQ ID NO: 1347249 - protein, 6 aa, Mycobacterium
TNGGAG

SEQ ID NO: 1347250 - protein, 13 aa, Mycobacterium
TNGPGDGGMMGGP

SEQ ID NO: 1347251 - protein, 15 aa, Mycobacterium
TNGSTQLTTTPPPWN

SEQ ID NO: 1347252 - protein, 13 aa, Mycobacterium
TNIRAAAGSEGTI

SEQ ID NO: 1347253 - protein, 4 aa, Mycobacterium
TNPD

SEQ ID NO: 1347254 - protein, 7 aa, Mycobacterium
TNPIPQA

SEQ ID NO: 1347255 - protein, 8 aa, Mycobacterium
TNPNSGVI

SEQ ID NO: 1347256 - protein, 7 aa, Mycobacterium
TNPSKTM

SEQ ID NO: 1347257 - protein, 8 aa, Mycobacterium
TNQSTERA

SEQ ID NO: 1347258 - protein, 5 aa, Mycobacterium
TNRGA

SEQ ID NO: 1347259 - protein, 23 aa, Mycobacterium
TNRTPPGYQAAAANESDPSPADL

SEQ ID NO: 1347260 - protein, 23 aa, Mycobacterium
TNRTPPGYQATAANESDPSPADL

SEQ ID NO: 1347261 - protein, 7 aa, Mycobacterium
TNRVGEG

SEQ ID NO: 1347262 - protein, 10 aa, Mycobacterium
TNSAETKKLP

SEQ ID NO: 1347263 - protein, 6 aa, Mycobacterium
TNSPAM

SEQ ID NO: 1347264 - protein, 8 aa, Mycobacterium
TNSTLGTM

SEQ ID NO: 1347265 - protein, 4 aa, Mycobacterium
TNTL

SEQ ID NO: 1347266 - protein, 7 aa, Mycobacterium
TNTLADR

SEQ ID NO: 1347267 - protein, 10 aa, Mycobacterium
TNTPPNTPTS

SEQ ID NO: 1347268 - protein, 17 aa, Mycobacterium
TPAAGQACDGGGISADL

SEQ ID NO: 1347269 - protein, 13 aa, Mycobacterium
TPAGAAPDPCAAS

SEQ ID NO: 1347270 - protein, 16 aa, Mycobacterium
TPAGRAAADKAETSCA

SEQ ID NO: 1347271 - protein, 21 aa, Mycobacterium
TPAPVTQAPPTATVPPTTQPV

SEQ ID NO: 1347272 - protein, 22 aa, Mycobacterium
TPAPVTQAPPTATVPPTTQPVT

SEQ ID NO: 1347273 - protein, 4 aa, Mycobacterium
TPAQ

SEQ ID NO: 1347274 - protein, 17 aa, Mycobacterium
TPASTRMDTTAPAPAAV

SEQ ID NO: 1347275 - protein, 12 aa, Mycobacterium
TPATEAKAETPV

SEQ ID NO: 1347276 - protein, 5 aa, Mycobacterium
TPATL

SEQ ID NO: 1347277 - protein, 17 aa, Mycobacterium
TPATRSSDGAFTATTDG

SEQ ID NO: 1347278 - protein, 4 aa, Mycobacterium
TPAV

SEQ ID NO: 1347279 - protein, 9 aa, Mycobacterium
TPAYSGGPI

SEQ ID NO: 1347280 - protein, 4 aa, Mycobacterium
TPDG

SEQ ID NO: 1347281 - protein, 9 aa, Mycobacterium
TPDKVYSGG

SEQ ID NO: 1347282 - protein, 4 aa, Mycobacterium
TPDL

SEQ ID NO: 1347283 - protein, 4 aa, Mycobacterium
TPDP

SEQ ID NO: 1347284 - protein, 7 aa, Mycobacterium
TPDSMRE

SEQ ID NO: 1347285 - protein, 9 aa, Mycobacterium
TPDVQAQGD

SEQ ID NO: 1347286 - protein, 9 aa, Mycobacterium
TPEEVAGQL

SEQ ID NO: 1347287 - protein, 8 aa, Mycobacterium
TPEGGVGA

SEQ ID NO: 1347288 - protein, 6 aa, Mycobacterium
TPESGT

SEQ ID NO: 1347289 - protein, 5 aa, Mycobacterium
TPEYR

SEQ ID NO: 1347290 - protein, 12 aa, Mycobacterium
TPGGVAGPGPVD

SEQ ID NO: 1347291 - protein, 12 aa, Mycobacterium
TPGLEADAKRQG

SEQ ID NO: 1347292 - protein, 6 aa, Mycobacterium
TPGPEI

SEQ ID NO: 1347293 - protein, 8 aa, Mycobacterium
TPGQPYTT

SEQ ID NO: 1347294 - protein, 9 aa, Mycobacterium
TPGQPYTTR

SEQ ID NO: 1347295 - protein, 4 aa, Mycobacterium
TPGR

SEQ ID NO: 1347296 - protein, 5 aa, Mycobacterium
TPGRI

SEQ ID NO: 1347297 - protein, 6 aa, Mycobacterium
TPGTIR

SEQ ID NO: 1347298 - protein, 5 aa, Mycobacterium
TPLED

SEQ ID NO: 1347299 - protein, 18 aa, Mycobacterium
TPLTTSRRDHKCPAFCGA

SEQ ID NO: 1347300 - protein, 6 aa, Mycobacterium
TPNASI

SEQ ID NO: 1347301 - protein, 16 aa, Mycobacterium
TPNPNSVPGGPLIERS

SEQ ID NO: 1347302 - protein, 7 aa, Mycobacterium
TPPAHED

SEQ ID NO: 1347303 - protein, 6 aa, Mycobacterium
TPPDAE

SEQ ID NO: 1347304 - protein, 4 aa, Mycobacterium
TPPH

SEQ ID NO: 1347305 - protein, 26 aa, Mycobacterium
TPPPEEALPPPAQGGAPSSLTGVPAQ

SEQ ID NO: 1347306 - protein, 11 aa, Mycobacterium
TPPPPGTPPLP

SEQ ID NO: 1347307 - protein, 7 aa, Mycobacterium
TPPSPAY

SEQ ID NO: 1347308 - protein, 9 aa, Mycobacterium
TPPYRGDGP

SEQ ID NO: 1347309 - protein, 6 aa, Mycobacterium
TPQDHP

SEQ ID NO: 1347310 - protein, 8 aa, Mycobacterium
TPQKQGEL

SEQ ID NO: 1347311 - protein, 9 aa, Mycobacterium
TPRGDGRLA

SEQ ID NO: 1347312 - protein, 5 aa, Mycobacterium
TPRPR

SEQ ID NO: 1347313 - protein, 16 aa, Mycobacterium
TPRRYAGRARRRATTA

SEQ ID NO: 1347314 - protein, 24 aa, Mycobacterium
TPSATARHAAAADGASTEAKTDTF

SEQ ID NO: 1347315 - protein, 25 aa, Mycobacterium
TPSDEARHRAGADDATQADKQDTFT

SEQ ID NO: 1347316 - protein, 7 aa, Mycobacterium
TPSGTAT

SEQ ID NO: 1347317 - protein, 6 aa, Mycobacterium
TPSVDS

SEQ ID NO: 1347318 - protein, 7 aa, Mycobacterium
TPSVDSK

SEQ ID NO: 1347319 - protein, 5 aa, Mycobacterium
TPTDL

SEQ ID NO: 1347320 - protein, 6 aa, Mycobacterium
TPTDTD

SEQ ID NO: 1347321 - protein, 6 aa, Mycobacterium
TPTDTQ

SEQ ID NO: 1347322 - protein, 17 aa, Mycobacterium
TPTPPPNTRALHDPSSH

SEQ ID NO: 1347323 - protein, 18 aa, Mycobacterium
TPTTQARENAHGTPGEDT

SEQ ID NO: 1347324 - protein, 13 aa, Mycobacterium
TPTTTATGGTFTP

SEQ ID NO: 1347325 - protein, 9 aa, Mycobacterium
TPTTTSGRV

SEQ ID NO: 1347326 - protein, 4 aa, Mycobacterium
TPVN

SEQ ID NO: 1347327 - protein, 8 aa, Mycobacterium
TPVPPGRV

SEQ ID NO: 1347328 - protein, 46 aa, Mycobacterium; identical to SEQ ID NO: 1186521

SEQ ID NO: 1347329 - protein, 6 aa, Mycobacterium
TPVRSS

SEQ ID NO: 1347330 - protein, 6 aa, Mycobacterium
TPVSGY

SEQ ID NO: 1347331 - protein, 53 aa, Mycobacterium
TPVSSTTEQTPETDPAAGAVADEETEVPAESEATPEVEDPTDPVVDETTDDVV

SEQ ID NO: 1347332 - protein, 25 aa, Mycobacterium
TPVTPSSQTPDSPELPESSPPEGSS

SEQ ID NO: 1347333 - protein, 10 aa, Mycobacterium
TPWAPQPPST

SEQ ID NO: 1347334 - protein, 5 aa, Mycobacterium
TPYGA

SEQ ID NO: 1347335 - protein, 9 aa, Mycobacterium
TQARPNEVT

SEQ ID NO: 1347336 - protein, 5 aa, Mycobacterium
TQAYS

SEQ ID NO: 1347337 - protein, 6 aa, Mycobacterium
TQAYSG

SEQ ID NO: 1347338 - protein, 4 aa, Mycobacterium
TQGD

SEQ ID NO: 1347339 - protein, 11 aa, Mycobacterium
TQGVKTGTTQS

SEQ ID NO: 1347340 - protein, 8 aa, Mycobacterium
TQIPTSGI

SEQ ID NO: 1347341 - protein, 9 aa, Mycobacterium
TQLQTQDQT

SEQ ID NO: 1347342 - protein, 6 aa, Mycobacterium
TQLSAG

SEQ ID NO: 1347343 - protein, 9 aa, Mycobacterium
TQPLEVREG

SEQ ID NO: 1347344 - protein, 9 aa, Mycobacterium
TQPNPGGGL

SEQ ID NO: 1347345 - protein, 5 aa, Mycobacterium
TQQPE

SEQ ID NO: 1347346 - protein, 23 aa, Mycobacterium
TQQVGGTAVRPAPAADEGSLSPI

SEQ ID NO: 1347347 - protein, 10 aa, Mycobacterium
TQRDPAETIA

SEQ ID NO: 1347348 - protein, 4 aa, Mycobacterium
TQRE

SEQ ID NO: 1347349 - protein, 4 aa, Mycobacterium
TQRR

SEQ ID NO: 1347350 - protein, 5 aa, Mycobacterium
TQSDA

SEQ ID NO: 1347351 - protein, 8 aa, Mycobacterium
TQSPGNVA

SEQ ID NO: 1347352 - protein, 13 aa, Mycobacterium
TQTGGDGSSPLTS

SEQ ID NO: 1347353 - protein, 4 aa, Mycobacterium
TRAC

SEQ ID NO: 1347354 - protein, 8 aa, Mycobacterium
TRARTTAV

SEQ ID NO: 1347355 - protein, 10 aa, Mycobacterium
TRDEQGRVTS

SEQ ID NO: 1347356 - protein, 7 aa, Mycobacterium
TREATRS

SEQ ID NO: 1347357 - protein, 10 aa, Mycobacterium
TRGAQQAAAE

SEQ ID NO: 1347358 - protein, 12 aa, Mycobacterium
TRGEGANIQEKY

SEQ ID NO: 1347359 - protein, 7 aa, Mycobacterium
TRGEQTG

SEQ ID NO: 1347360 - protein, 14 aa, Mycobacterium
TRGGPTSARLGQPV

SEQ ID NO: 1347361 - protein, 6 aa, Mycobacterium
TRGGRS

SEQ ID NO: 1347362 - protein, 7 aa, Mycobacterium
TRGGRSY

SEQ ID NO: 1347363 - protein, 13 aa, Mycobacterium
TRGLGRANAPITG

SEQ ID NO: 1347364 - protein, 12 aa, Mycobacterium
TRGLGRTNAAVT

SEQ ID NO: 1347365 - protein, 6 aa, Mycobacterium
TRGNTT

SEQ ID NO: 1347366 - protein, 4 aa, Mycobacterium
TRIG

SEQ ID NO: 1347367 - protein, 5 aa, Mycobacterium
TRLAR

SEQ ID NO: 1347368 - protein, 5 aa, Mycobacterium
TRPLP

SEQ ID NO: 1347369 - protein, 5 aa, Mycobacterium
TRPPL

SEQ ID NO: 1347370 - protein, 7 aa, Mycobacterium
TRPPYQL

SEQ ID NO: 1347371 - protein, 9 aa, Mycobacterium
TRPSPFSHT

SEQ ID NO: 1347372 - protein, 26 aa, Mycobacterium
TRPYYDSAGSARATATVRTAGSQVTA

SEQ ID NO: 1347373 - protein, 8 aa, Mycobacterium
TRRGRSAW

SEQ ID NO: 1347374 - protein, 15 aa, Mycobacterium
TRRTRDGGVHRPDQA

SEQ ID NO: 1347375 - protein, 4 aa, Mycobacterium
TRSA

SEQ ID NO: 1347376 - protein, 8 aa, Mycobacterium
TRSDPALT

SEQ ID NO: 1347377 - protein, 8 aa, Mycobacterium
TRSPGPGM

SEQ ID NO: 1347378 - protein, 5 aa, Mycobacterium
TRSVR

SEQ ID NO: 1347379 - protein, 10 aa, Mycobacterium
TRSYPTTEQT

SEQ ID NO: 1347380 - protein, 9 aa, Mycobacterium
TRTGAANEY

SEQ ID NO: 1347381 - protein, 9 aa, Mycobacterium
TRTGADRSC

SEQ ID NO: 1347382 - protein, 10 aa, Mycobacterium
TRTPSAPLAP

SEQ ID NO: 1347383 - protein, 5 aa, Mycobacterium
TRTQG

SEQ ID NO: 1347384 - protein, 17 aa, Mycobacterium
TRTTDSVHTRPGDCGRD

SEQ ID NO: 1347385 - protein, 11 aa, Mycobacterium
TRTTGDGGQEH

SEQ ID NO: 1347386 - protein, 9 aa, Mycobacterium
TSAAVGGLG

SEQ ID NO: 1347387 - protein, 21 aa, Mycobacterium
TSADDGQTWQPGHSLNNKPQA

SEQ ID NO: 1347388 - protein, 9 aa, Mycobacterium
TSADPDADP

SEQ ID NO: 1347389 - protein, 6 aa, Mycobacterium
TSAGAA

SEQ ID NO: 1347390 - protein, 20 aa, Mycobacterium
TSAGPEPVELSTESAGKAID

SEQ ID NO: 1347391 - protein, 4 aa, Mycobacterium
TSAP

SEQ ID NO: 1347392 - protein, 21 aa, Mycobacterium
TSAPAPNPDTTAPSTSDVTTA

SEQ ID NO: 1347393 - protein, 13 aa, Mycobacterium
TSASQQDRVTGAR

SEQ ID NO: 1347394 - protein, 10 aa, Mycobacterium
TSDADGTQQT

SEQ ID NO: 1347395 - protein, 23 aa, Mycobacterium
TSDAPQPATPATETAAPGADEVT

SEQ ID NO: 1347396 - protein, 10 aa, Mycobacterium
TSDDDPRRER

SEQ ID NO: 1347397 - protein, 10 aa, Mycobacterium
TSDPANVSLD

SEQ ID NO: 1347398 - protein, 6 aa, Mycobacterium
TSDPKE

SEQ ID NO: 1347399 - protein, 22 aa, Mycobacterium
TSDPTEPSTASSTGGSRPEEAP

SEQ ID NO: 1347400 - protein, 4 aa, Mycobacterium
TSEE

SEQ ID NO: 1347401 - protein, 6 aa, Mycobacterium
TSEEQW

SEQ ID NO: 1347402 - protein, 8 aa, Mycobacterium
TSEGQTGT

SEQ ID NO: 1347403 - protein, 10 aa, Mycobacterium
TSEPARPPQL

SEQ ID NO: 1347404 - protein, 10 aa, Mycobacterium
TSEPNANLYS

SEQ ID NO: 1347405 - protein, 14 aa, Mycobacterium
TSEPVPVNEPTDQC

SEQ ID NO: 1347406 - protein, 14 aa, Mycobacterium
TSEQIGGLRPGQSV

SEQ ID NO: 1347407 - protein, 7 aa, Mycobacterium
TSFDDEG

SEQ ID NO: 1347408 - protein, 16 aa, Mycobacterium
TSFPTDATFPGPHATG

SEQ ID NO: 1347409 - protein, 8 aa, Mycobacterium
TSGARAVA

SEQ ID NO: 1347410 - protein, 6 aa, Mycobacterium
TSGCGW

SEQ ID NO: 1347411 - protein, 7 aa, Mycobacterium
TSGEVTT

SEQ ID NO: 1347412 - protein, 7 aa, Mycobacterium
TSGGGLS

SEQ ID NO: 1347413 - protein, 10 aa, Mycobacterium
TSGPGQTVRG

SEQ ID NO: 1347414 - protein, 14 aa, Mycobacterium
TSGPPQVEAATAGK

SEQ ID NO: 1347415 - protein, 18 aa, Mycobacterium
TSGQQSGEDPSSGGTGTI

SEQ ID NO: 1347416 - protein, 7 aa, Mycobacterium
TSGRLPV

SEQ ID NO: 1347417 - protein, 16 aa, Mycobacterium
TSGTGDVGARLEGPDG

SEQ ID NO: 1347418 - protein, 6 aa, Mycobacterium
TSGTHS

SEQ ID NO: 1347419 - protein, 20 aa, Mycobacterium
TSIAQPPPPPPPAPALGEPV

SEQ ID NO: 1347420 - protein, 12 aa, Mycobacterium
TSKALKSGDRAG

SEQ ID NO: 1347421 - protein, 24 aa, Mycobacterium
TSKSSQKRNAASLADAKADARRTI

SEQ ID NO: 1347422 - protein, 8 aa, Mycobacterium
TSLDPEAT

SEQ ID NO: 1347423 - protein, 10 aa, Mycobacterium
TSNAQAATSI

SEQ ID NO: 1347424 - protein, 8 aa, Mycobacterium
TSNGEWAR

SEQ ID NO: 1347425 - protein, 7 aa, Mycobacterium
TSPAARD

SEQ ID NO: 1347426 - protein, 6 aa, Mycobacterium
TSPAIE

SEQ ID NO: 1347427 - protein, 7 aa, Mycobacterium
TSPAIKQ

SEQ ID NO: 1347428 - protein, 16 aa, Mycobacterium
TSPASAAPDDGQWDPT

SEQ ID NO: 1347429 - protein, 20 aa, Mycobacterium
TSPGAAAPGAFDGAADYEAN

SEQ ID NO: 1347430 - protein, 8 aa, Mycobacterium
TSPGAPVQ

SEQ ID NO: 1347431 - protein, 109 aa, Mycobacterium
TSPGYGGQGHNGGNGGAGGNGGWGGDGGDSGADAGGAGGNGGDGAAGGSGGAAGLGGTGNQWGAEPGGPGNPGLAGQPGSGGSAGIGGTGGSGTSAGAPGDHGEEGPNG

SEQ ID NO: 1347432 - protein, 4 aa, Mycobacterium
TSPI

SEQ ID NO: 1347433 - protein, 10 aa, Mycobacterium
TSPPPPPGVS

SEQ ID NO: 1347434 - protein, 6 aa, Mycobacterium
TSPSGN

SEQ ID NO: 1347435 - protein, 5 aa, Mycobacterium
TSPVD

SEQ ID NO: 1347436 - protein, 22 aa, Mycobacterium
TSPVQSVASNTWAGGGFDGPPV

SEQ ID NO: 1347437 - protein, 8 aa, Mycobacterium
TSQHPDQA

SEQ ID NO: 1347438 - protein, 7 aa, Mycobacterium
TSRGPHA

SEQ ID NO: 1347439 - protein, 7 aa, Mycobacterium
TSRTDDA

SEQ ID NO: 1347440 - protein, 5 aa, Mycobacterium
TSRTF

SEQ ID NO: 1347441 - protein, 8 aa, Mycobacterium
TSSDTELT

SEQ ID NO: 1347442 - protein, 10 aa, Mycobacterium
TSSERQGDAG

SEQ ID NO: 1347443 - protein, 8 aa, Mycobacterium
TSSVTDGA

SEQ ID NO: 1347444 - protein, 10 aa, Mycobacterium
TSTDLTGAAR

SEQ ID NO: 1347445 - protein, 6 aa, Mycobacterium
TSTDPQ

SEQ ID NO: 1347446 - protein, 17 aa, Mycobacterium
TSTDRTARLDGRHRDGT

SEQ ID NO: 1347447 - protein, 30 aa, Mycobacterium
TSTEQPQTEGSTSHAHSETAGDAQAPHNAD

SEQ ID NO: 1347448 - protein, 5 aa, Mycobacterium
TSTKV

SEQ ID NO: 1347449 - protein, 18 aa, Mycobacterium
TSTPATAGPPPAPRNQLG

SEQ ID NO: 1347450 - protein, 12 aa, Mycobacterium
TSTPDMGAGPEE

SEQ ID NO: 1347451 - protein, 7 aa, Mycobacterium
TSTPNVV

SEQ ID NO: 1347452 - protein, 18 aa, Mycobacterium
TSTVDGTAVRPDAAPSAV

SEQ ID NO: 1347453 - protein, 5 aa, Mycobacterium
TSTWP

SEQ ID NO: 1347454 - protein, 11 aa, Mycobacterium
TSVADTPDPAA

SEQ ID NO: 1347455 - protein, 9 aa, Mycobacterium
TSVGEGVTN

SEQ ID NO: 1347456 - protein, 9 aa, Mycobacterium
TSWQGAGGI

SEQ ID NO: 1347457 - protein, 7 aa, Mycobacterium
TSYGTAA

SEQ ID NO: 1347458 - protein, 7 aa, Mycobacterium
TTAAGTA

SEQ ID NO: 1347459 - protein, 9 aa, Mycobacterium
TTAAPDVPS

SEQ ID NO: 1347460 - protein, 5 aa, Mycobacterium
TTADG

SEQ ID NO: 1347461 - protein, 10 aa, Mycobacterium
TTADGLARSL

SEQ ID NO: 1347462 - protein, 13 aa, Mycobacterium
TTADNLRGEGANI

SEQ ID NO: 1347463 - protein, 38 aa, Mycobacterium
TTADQMKEYRSTRERAAAAAAASERSAADARAAAERAA

SEQ ID NO: 1347464 - protein, 9 aa, Mycobacterium
TTAPGERSS

SEQ ID NO: 1347465 - protein, 9 aa, Mycobacterium
TTAPKTGGI

SEQ ID NO: 1347466 - protein, 32 aa, Mycobacterium
TTAPPRQPQPSQPSAAEQDPTPSMAAPPPTEA

SEQ ID NO: 1347467 - protein, 5 aa, Mycobacterium
TTARG

SEQ ID NO: 1347468 - protein, 19 aa, Mycobacterium
TTASTTGGNGGVGVGDANG

SEQ ID NO: 1347469 - protein, 19 aa, Mycobacterium
TTASTTGGNGGVGVGNANG

SEQ ID NO: 1347470 - protein, 11 aa, Mycobacterium
TTDGDSVPTEW

SEQ ID NO: 1347471 - protein, 9 aa, Mycobacterium
TTDGGQSWT

SEQ ID NO: 1347472 - protein, 12 aa, Mycobacterium
TTELTPDHVYTL

SEQ ID NO: 1347473 - protein, 10 aa, Mycobacterium
TTEPSAAPNI

SEQ ID NO: 1347474 - protein, 4 aa, Mycobacterium
TTES

SEQ ID NO: 1347475 - protein, 12 aa, Mycobacterium
TTETLEKSEENL

SEQ ID NO: 1347476 - protein, 7 aa, Mycobacterium
TTFTTSD

SEQ ID NO: 1347477 - protein, 11 aa, Mycobacterium
TTGDPATPYQA

SEQ ID NO: 1347478 - protein, 8 aa, Mycobacterium
TTGDVNGG

SEQ ID NO: 1347479 - protein, 14 aa, Mycobacterium
TTGGGYPDGDEVYF

SEQ ID NO: 1347480 - protein, 20 aa, Mycobacterium
TTGPTRDRGRDRDRGHGLDI

SEQ ID NO: 1347481 - protein, 25 aa, Mycobacterium
TTHRPGNGRTEWTPPKEQDTGQPRI

SEQ ID NO: 1347482 - protein, 25 aa, Mycobacterium
TTHRPGNGRTQWTPPEDHDTGQPRI

SEQ ID NO: 1347483 - protein, 25 aa, Mycobacterium
TTHRPGNGRTQWTPPKEQDTGQPRI

SEQ ID NO: 1347484 - protein, 14 aa, Mycobacterium
TTIGGRAEIGPDTT

SEQ ID NO: 1347485 - protein, 7 aa, Mycobacterium
TTKPDPI

SEQ ID NO: 1347486 - protein, 6 aa, Mycobacterium
TTLPGQ

SEQ ID NO: 1347487 - protein, 13 aa, Mycobacterium
TTPAGPAQAAPAN

SEQ ID NO: 1347488 - protein, 7 aa, Mycobacterium
TTPEHTG

SEQ ID NO: 1347489 - protein, 8 aa, Mycobacterium
TTPLAGRG

SEQ ID NO: 1347490 - protein, 6 aa, Mycobacterium
TTPQTA

SEQ ID NO: 1347491 - protein, 5 aa, Mycobacterium
TTQGP

SEQ ID NO: 1347492 - protein, 9 aa, Mycobacterium
TTQNQKAAE

SEQ ID NO: 1347493 - protein, 8 aa, Mycobacterium
TTQPRDGW

SEQ ID NO: 1347494 - protein, 4 aa, Mycobacterium
TTRL

SEQ ID NO: 1347495 - protein, 8 aa, Mycobacterium
TTRPNELT

SEQ ID NO: 1347496 - protein, 23 aa, Mycobacterium
TTSCTDTIAPGDSAYDNSHAAED

SEQ ID NO: 1347497 - protein, 11 aa, Mycobacterium
TTSEQGPRTGE

SEQ ID NO: 1347498 - protein, 7 aa, Mycobacterium
TTSTVSQ

SEQ ID NO: 1347499 - protein, 5 aa, Mycobacterium
TTTCT

SEQ ID NO: 1347500 - protein, 4 aa, Mycobacterium
TTTD

SEQ ID NO: 1347501 - protein, 9 aa, Mycobacterium
TTTGGERGL

SEQ ID NO: 1347502 - protein, 5 aa, Mycobacterium
TTTLG

SEQ ID NO: 1347503 - protein, 13 aa, Mycobacterium
TTVNAESTTPTRT

SEQ ID NO: 1347504 - protein, 12 aa, Mycobacterium
TTVNSRGAKTTT

SEQ ID NO: 1347505 - protein, 7 aa, Mycobacterium
TTVPPGG

SEQ ID NO: 1347506 - protein, 6 aa, Mycobacterium
TTVQPD

SEQ ID NO: 1347507 - protein, 5 aa, Mycobacterium
TTYSG

SEQ ID NO: 1347508 - protein, 13 aa, Mycobacterium
TVAASAPGTFEPS

SEQ ID NO: 1347509 - protein, 10 aa, Mycobacterium
TVANGGGLGQ

SEQ ID NO: 1347510 - protein, 9 aa, Mycobacterium
TVDPTSQVS

SEQ ID NO: 1347511 - protein, 5 aa, Mycobacterium
TVGDG

SEQ ID NO: 1347512 - protein, 19 aa, Mycobacterium
TVGDTFGGGAGDGLPERGA

SEQ ID NO: 1347513 - protein, 8 aa, Mycobacterium
TVGDTLGD

SEQ ID NO: 1347514 - protein, 11 aa, Mycobacterium
TVGQPDSTTGV

SEQ ID NO: 1347515 - protein, 11 aa, Mycobacterium
TVGRAQPAGPR

SEQ ID NO: 1347516 - protein, 9 aa, Mycobacterium
TVGSSADLR

SEQ ID NO: 1347517 - protein, 10 aa, Mycobacterium
TVGTDRAEYT

SEQ ID NO: 1347518 - protein, 9 aa, Mycobacterium
TVLTTGTNA

SEQ ID NO: 1347519 - protein, 9 aa, Mycobacterium
TVNARRSDV

SEQ ID NO: 1347520 - protein, 9 aa, Mycobacterium
TVNKTKDNL

SEQ ID NO: 1347521 - protein, 4 aa, Mycobacterium
TVNT

SEQ ID NO: 1347522 - protein, 23 aa, Mycobacterium
TVPAGTASRLSARARDLSPAGDQ

SEQ ID NO: 1347523 - protein, 4 aa, Mycobacterium
TVPE

SEQ ID NO: 1347524 - protein, 12 aa, Mycobacterium
TVPEDDQARPVR

SEQ ID NO: 1347525 - protein, 21 aa, Mycobacterium
TVPGSERDAGHAQGRQSQISG

SEQ ID NO: 1347526 - protein, 11 aa, Mycobacterium
TVPPDAPEEKK

SEQ ID NO: 1347527 - protein, 13 aa, Mycobacterium
TVPSGEASWSTSQ

SEQ ID NO: 1347528 - protein, 5 aa, Mycobacterium
TVPTD

SEQ ID NO: 1347529 - protein, 35 aa, Mycobacterium
TVPTPGADGDTGGEPTDDTVDEATDAKKEEAATDV

SEQ ID NO: 1347530 - protein, 7 aa, Mycobacterium
TVQESSD

SEQ ID NO: 1347531 - protein, 7 aa, Mycobacterium
TVQQPNS

SEQ ID NO: 1347532 - protein, 5 aa, Mycobacterium
TVRPG

SEQ ID NO: 1347533 - protein, 4 aa, Mycobacterium
TVRS

SEQ ID NO: 1347534 - protein, 14 aa, Mycobacterium
TVSLQSPDHGAGEM

SEQ ID NO: 1347535 - protein, 8 aa, Mycobacterium
TVSNAGPT

SEQ ID NO: 1347536 - protein, 8 aa, Mycobacterium
TVSPDGAT

SEQ ID NO: 1347537 - protein, 23 aa, Mycobacterium
TVSSRQAGSVSGDATFGEVRGPD

SEQ ID NO: 1347538 - protein, 13 aa, Mycobacterium
TVTAKDADKDTLG

SEQ ID NO: 1347539 - protein, 7 aa, Mycobacterium
TVTDDDY

SEQ ID NO: 1347540 - protein, 21 aa, Mycobacterium
TVTGTAQRSDAGVPDPDRSYG

SEQ ID NO: 1347541 - protein, 4 aa, Mycobacterium
TVTP

SEQ ID NO: 1347542 - protein, 7 aa, Mycobacterium
TVTPDGN

SEQ ID NO: 1347543 - protein, 8 aa, Mycobacterium
TVTTDDVR

SEQ ID NO: 1347544 - protein, 5 aa, Mycobacterium
TWDPE

SEQ ID NO: 1347545 - protein, 13 aa, Mycobacterium
TWPRPEAAVANQS

SEQ ID NO: 1347546 - protein, 5 aa, Mycobacterium
TWYTD

SEQ ID NO: 1347547 - protein, 17 aa, Mycobacterium
TYEPDRAGWEKDDSAFP

SEQ ID NO: 1347548 - protein, 7 aa, Mycobacterium
TYEPETS

SEQ ID NO: 1347549 - protein, 10 aa, Mycobacterium
TYGGEAGNRF

SEQ ID NO: 1347550 - protein, 10 aa, Mycobacterium
TYGSSAPYMS

SEQ ID NO: 1347551 - protein, 5 aa, Mycobacterium
TYGSV

SEQ ID NO: 1347552 - protein, 14 aa, Mycobacterium
TYGVPANSPDGYRT

SEQ ID NO: 1347553 - protein, 14 aa, Mycobacterium
TYGVPANSPNGYRT

SEQ ID NO: 1347554 - protein, 13 aa, Mycobacterium
TYHPSDAARRRAA

SEQ ID NO: 1347555 - protein, 20 aa, Mycobacterium
TYRDGDPKVNDTGSNNSISR

SEQ ID NO: 1347556 - protein, 6 aa, Mycobacterium
TYRGTQ

SEQ ID NO: 1347557 - protein, 8 aa, Mycobacterium
TYSPEAAR

SEQ ID NO: 1347558 - protein, 5 aa, Mycobacterium
TYTPT

SEQ ID NO: 1347559 - protein, 8 aa, Mycobacterium
TYTPTPVA

SEQ ID NO: 1347560 - protein, 4 aa, Mycobacterium
TYTS

SEQ ID NO: 1347561 - protein, 5 aa, Mycobacterium
TYTTS

SEQ ID NO: 1347562 - protein, 57 aa, Mycobacterium
VAAADDTGGAGTASSQGEAGPARDDDTTDTAATDPGEATDPAPDEPVADEPAPDESV

SEQ ID NO: 1347563 - protein, 8 aa, Mycobacterium
VAAAQQQN

SEQ ID NO: 1347564 - protein, 5 aa, Mycobacterium
VAADN

SEQ ID NO: 1347565 - protein, 8 aa, Mycobacterium
VAAKPDGG

SEQ ID NO: 1347566 - protein, 8 aa, Mycobacterium
VAAPAGGA

SEQ ID NO: 1347567 - protein, 9 aa, Mycobacterium
VAAPGDPVA

SEQ ID NO: 1347568 - protein, 8 aa, Mycobacterium
VAARGGPQ

SEQ ID NO: 1347569 - protein, 8 aa, Mycobacterium
VAARPDAA

SEQ ID NO: 1347570 - protein, 10 aa, Mycobacterium
VAASSGGRDY

SEQ ID NO: 1347571 - protein, 4 aa, Mycobacterium
VAAT

SEQ ID NO: 1347572 - protein, 14 aa, Mycobacterium
VAATDPGAADGAAA

SEQ ID NO: 1347573 - protein, 9 aa, Mycobacterium
VAATTRGKL

SEQ ID NO: 1347574 - protein, 24 aa, Mycobacterium
VADAEARRPHSGRTVSTTLTADRA

SEQ ID NO: 1347575 - protein, 6 aa, Mycobacterium
VADASA

SEQ ID NO: 1347576 - protein, 28 aa, Mycobacterium
VADGTSSVNSSSRAGTVVGTNPSGQTIP

SEQ ID NO: 1347577 - protein, 10 aa, Mycobacterium
VADNATSAMQ

SEQ ID NO: 1347578 - protein, 5 aa, Mycobacterium
VADQA

SEQ ID NO: 1347579 - protein, 7 aa, Mycobacterium
VADRPTR

SEQ ID NO: 1347580 - protein, 92 aa, Mycobacterium
VADTDTDGDAETDTDIDTGTDTENEPVDEPEDQLEEDETTDERETTVEDEDASEAEASEAEPADTEDTADTKDTGDTKDTGDTGESGAGEKA

SEQ ID NO: 1347581 - protein, 12 aa, Mycobacterium
VAEETVTAAEAA

SEQ ID NO: 1347582 - protein, 14 aa, Mycobacterium
VAEGPGINDNGSGV

SEQ ID NO: 1347583 - protein, 6 aa, Mycobacterium
VAGGRT

SEQ ID NO: 1347584 - protein, 12 aa, Mycobacterium
VAGGTAAAQPPL

SEQ ID NO: 1347585 - protein, 7 aa, Mycobacterium
VAGITPD

SEQ ID NO: 1347586 - protein, 7 aa, Mycobacterium
VAGPGAA

SEQ ID NO: 1347587 - protein, 9 aa, Mycobacterium
VAGPTRRGE

SEQ ID NO: 1347588 - protein, 26 aa, Mycobacterium
VAGTDSWPTAAGDGQPPAGETGTTTT

SEQ ID NO: 1347589 - protein, 12 aa, Mycobacterium
VANSGGGGYDPD

SEQ ID NO: 1347590 - protein, 6 aa, Mycobacterium
VAPDAP

SEQ ID NO: 1347591 - protein, 5 aa, Mycobacterium
VAPDG

SEQ ID NO: 1347592 - protein, 7 aa, Mycobacterium
VAPGGAG

SEQ ID NO: 1347593 - protein, 13 aa, Mycobacterium
VAPGGSAHAQPAE

SEQ ID NO: 1347594 - protein, 11 aa, Mycobacterium
VAPGLDQGPLS

SEQ ID NO: 1347595 - protein, 16 aa, Mycobacterium
VAPGPTVKSRQASENS

SEQ ID NO: 1347596 - protein, 11 aa, Mycobacterium
VAPKSGGSEEY

SEQ ID NO: 1347597 - protein, 8 aa, Mycobacterium
VAPNGQSC

SEQ ID NO: 1347598 - protein, 9 aa, Mycobacterium
VAPPSSASF

SEQ ID NO: 1347599 - protein, 9 aa, Mycobacterium
VAPVNTERA

SEQ ID NO: 1347600 - protein, 6 aa, Mycobacterium
VAQAPD

SEQ ID NO: 1347601 - protein, 10 aa, Mycobacterium
VAQESPTDAR

SEQ ID NO: 1347602 - protein, 10 aa, Mycobacterium
VAQESPTDAT

SEQ ID NO: 1347603 - protein, 7 aa, Mycobacterium
VAQNPAP

SEQ ID NO: 1347604 - protein, 11 aa, Mycobacterium
VAREPDGDNDH

SEQ ID NO: 1347605 - protein, 10 aa, Mycobacterium
VARPNGGFGT

SEQ ID NO: 1347606 - protein, 9 aa, Mycobacterium
VARRTREAL

SEQ ID NO: 1347607 - protein, 7 aa, Mycobacterium
VASAAAN

SEQ ID NO: 1347608 - protein, 16 aa, Mycobacterium
VASGPRTITTGPPSFG

SEQ ID NO: 1347609 - protein, 5 aa, Mycobacterium
VASGQ

SEQ ID NO: 1347610 - protein, 7 aa, Mycobacterium
VASGSQA

SEQ ID NO: 1347611 - protein, 59 aa, Mycobacterium
VASPSEASEPSSSSQSGDTADAGPSTASQTPTTADADPEAEAEAEPDPDPGPDAEPDLA

SEQ ID NO: 1347612 - protein, 9 aa, Mycobacterium
VASPTPYGR

SEQ ID NO: 1347613 - protein, 10 aa, Mycobacterium
VATAGPGAAV

SEQ ID NO: 1347614 - protein, 15 aa, Mycobacterium
VATANEGDWKGGTRG

SEQ ID NO: 1347615 - protein, 110 aa, Mycobacterium
VATATTDSQTSDATSTSTSEPSAQSEPEADHSDEAEDAGESDEAEDVESDDAEDVESDEADGPEAEGVEAGDTEADDADDDSGNESGDRPLAPAAREDDVADPGDEAVDE

SEQ ID NO: 1347616 - protein, 7 aa, Mycobacterium
VATDSEA

SEQ ID NO: 1347617 - protein, 6 aa, Mycobacterium
VATGKT

SEQ ID NO: 1347618 - protein, 24 aa, Mycobacterium
VATGPAKRALDTTPITVQGDSITR

SEQ ID NO: 1347619 - protein, 8 aa, Mycobacterium
VATPKGDI

SEQ ID NO: 1347620 - protein, 9 aa, Mycobacterium
VATSPDDWN

SEQ ID NO: 1347621 - protein, 11 aa, Mycobacterium
VATTKGPKSLV

SEQ ID NO: 1347622 - protein, 147 aa, Mycobacterium
VATTPGVARAEDSPSSVTDSTGVSSPSGGEQARTTTGDDTTPDDDQSEIVDDGDAEDPAESEDAEESEDLAEDEDPDEGEDLDEPDGIGDPLEPAQPPAEPVEEPDVPAEPAVETPVDTGTPAQETGGPAGDDAGQAADPADTTLTD

SEQ ID NO: 1347623 - protein, 17 aa, Mycobacterium
VCSGGDDIAAHSNYGPG

SEQ ID NO: 1347624 - protein, 9 aa, Mycobacterium
VDADGDAVT

SEQ ID NO: 1347625 - protein, 10 aa, Mycobacterium
VDAPASTPYP

SEQ ID NO: 1347626 - protein, 8 aa, Mycobacterium
VDAPDPNT

SEQ ID NO: 1347627 - protein, 8 aa, Mycobacterium
VDARDESD

SEQ ID NO: 1347628 - protein, 12 aa, Mycobacterium
VDDDPDTASPAD

SEQ ID NO: 1347629 - protein, 11 aa, Mycobacterium
VDDIDSESGRI

SEQ ID NO: 1347630 - protein, 9 aa, Mycobacterium
VDDNTKTLT

SEQ ID NO: 1347631 - protein, 4 aa, Mycobacterium
VDDP

SEQ ID NO: 1347632 - protein, 122 aa, Mycobacterium
VDEDDEVEEVGEVTDAAADDIDAAADKASDDISDIDDESASSAVDSEEDAGDGADTESGDTDGGDLLDDSSEEDSADDSTGGSAPDSDDSASEPTSGAGDDSSAPSASEADSDSGSDAEGSA

SEQ ID NO: 1347633 - protein, 10 aa, Mycobacterium
VDEDIAEPAE

SEQ ID NO: 1347634 - protein, 8 aa, Mycobacterium
VDEEGGRV

SEQ ID NO: 1347635 - protein, 5 aa, Mycobacterium
VDEPL

SEQ ID NO: 1347636 - protein, 4 aa, Mycobacterium
VDEQ

SEQ ID NO: 1347637 - protein, 9 aa, Mycobacterium
VDGDPAPAG

SEQ ID NO: 1347638 - protein, 10 aa, Mycobacterium
VDGDPAPAGR

SEQ ID NO: 1347639 - protein, 5 aa, Mycobacterium
VDGDV

SEQ ID NO: 1347640 - protein, 8 aa, Mycobacterium
VDGGRVRA

SEQ ID NO: 1347641 - protein, 6 aa, Mycobacterium
VDGPAD

SEQ ID NO: 1347642 - protein, 6 aa, Mycobacterium
VDGQTG

SEQ ID NO: 1347643 - protein, 4 aa, Mycobacterium
VDGS

SEQ ID NO: 1347644 - protein, 6 aa, Mycobacterium
VDGSDY

SEQ ID NO: 1347645 - protein, 8 aa, Mycobacterium
VDGVKDGS

SEQ ID NO: 1347646 - protein, 16 aa, Mycobacterium
VDNGGQHGDDSGKPTI

SEQ ID NO: 1347647 - protein, 11 aa, Mycobacterium
VDNSAATGTQL

SEQ ID NO: 1347648 - protein, 16 aa, Mycobacterium
VDNTATPFAPGEEFSD

SEQ ID NO: 1347649 - protein, 20 aa, Mycobacterium
VDPAGRAVPTGPPDGGPTRF

SEQ ID NO: 1347650 - protein, 6 aa, Mycobacterium
VDPDAG

SEQ ID NO: 1347651 - protein, 8 aa, Mycobacterium
VDPDGDAL

SEQ ID NO: 1347652 - protein, 7 aa, Mycobacterium
VDPDPSF

SEQ ID NO: 1347653 - protein, 12 aa, Mycobacterium
VDPGASPGQRQL

SEQ ID NO: 1347654 - protein, 4 aa, Mycobacterium
VDPP

SEQ ID NO: 1347655 - protein, 12 aa, Mycobacterium
VDPSLDPITESL

SEQ ID NO: 1347656 - protein, 10 aa, Mycobacterium
VDPTDSERGL

SEQ ID NO: 1347657 - protein, 8 aa, Mycobacterium
VDQVPGSA

SEQ ID NO: 1347658 - protein, 12 aa, Mycobacterium
VDRAESEPERAH

SEQ ID NO: 1347659 - protein, 5 aa, Mycobacterium
VDRND

SEQ ID NO: 1347660 - protein, 17 aa, Mycobacterium
VDRPAPPSLPKPTPAMD

SEQ ID NO: 1347661 - protein, 17 aa, Mycobacterium
VDSAGRVRAADDGAPVD

SEQ ID NO: 1347662 - protein, 9 aa, Mycobacterium
VDSEGAEQT

SEQ ID NO: 1347663 - protein, 7 aa, Mycobacterium
VDSNVGT

SEQ ID NO: 1347664 - protein, 11 aa, Mycobacterium
VDSPQARPESL

SEQ ID NO: 1347665 - protein, 8 aa, Mycobacterium
VDTAGSAE

SEQ ID NO: 1347666 - protein, 13 aa, Mycobacterium
VDTAKGRVTVNGN

SEQ ID NO: 1347667 - protein, 7 aa, Mycobacterium
VDTGAAA

SEQ ID NO: 1347668 - protein, 7 aa, Mycobacterium
VDTGTPT

SEQ ID NO: 1347669 - protein, 17 aa, Mycobacterium
VDVEDTDSVDVDDAEYA

SEQ ID NO: 1347670 - protein, 6 aa, Mycobacterium
VDVSGT

SEQ ID NO: 1347671 - protein, 14 aa, Mycobacterium
VEAGNPEQSATPQE

SEQ ID NO: 1347672 - protein, 15 aa, Mycobacterium
VEAGTTPTGSPGIAT

SEQ ID NO: 1347673 - protein, 5 aa, Mycobacterium
VEATG

SEQ ID NO: 1347674 - protein, 4 aa, Mycobacterium
VEAY

SEQ ID NO: 1347675 - protein, 13 aa, Mycobacterium
VEESPAEAVAEPV

SEQ ID NO: 1347676 - protein, 36 aa, Mycobacterium
VEETNSSTRESDPPKQEPPHAEVEANPAKARAAEEV

SEQ ID NO: 1347677 - protein, 10 aa, Mycobacterium
VEGEGAGQVA

SEQ ID NO: 1347678 - protein, 24 aa, Mycobacterium
VEGSPDLDGAQPKGWSGQPRPVTE

SEQ ID NO: 1347679 - protein, 5 aa, Mycobacterium
VEGVD

SEQ ID NO: 1347680 - protein, 7 aa, Mycobacterium
VEHEDKQ

SEQ ID NO: 1347681 - protein, 4 aa, Mycobacterium
VENQ

SEQ ID NO: 1347682 - protein, 7 aa, Mycobacterium
VEPAGSR

SEQ ID NO: 1347683 - protein, 7 aa, Mycobacterium
VEPLPPL

SEQ ID NO: 1347684 - protein, 14 aa, Mycobacterium
VEQGKDVASPSRHT

SEQ ID NO: 1347685 - protein, 24 aa, Mycobacterium
VEQPAEVSDDAPEPVESPISAPSS

SEQ ID NO: 1347686 - protein, 9 aa, Mycobacterium
VERGSGGRV

SEQ ID NO: 1347687 - protein, 7 aa, Mycobacterium
VERRQEG

SEQ ID NO: 1347688 - protein, 4 aa, Mycobacterium
VERT

SEQ ID NO: 1347689 - protein, 5 aa, Mycobacterium
VESRR

SEQ ID NO: 1347690 - protein, 5 aa, Mycobacterium
VESTN

SEQ ID NO: 1347691 - protein, 7 aa, Mycobacterium
VETTDAG

SEQ ID NO: 1347692 - protein, 10 aa, Mycobacterium
VGAAPSPAMA

SEQ ID NO: 1347693 - protein, 12 aa, Mycobacterium
VGAATGRAAAAD

SEQ ID NO: 1347694 - protein, 6 aa, Mycobacterium
VGADDA

SEQ ID NO: 1347695 - protein, 11 aa, Mycobacterium
VGADDTPRVDV

SEQ ID NO: 1347696 - protein, 10 aa, Mycobacterium
VGAGDDNTVT

SEQ ID NO: 1347697 - protein, 21 aa, Mycobacterium
VGAPSAHAKNGDTHITGTGLS

SEQ ID NO: 1347698 - protein, 11 aa, Mycobacterium
VGAPSEFQTRQ

SEQ ID NO: 1347699 - protein, 10 aa, Mycobacterium
VGAQGESNVS

SEQ ID NO: 1347700 - protein, 9 aa, Mycobacterium
VGASTSDHP

SEQ ID NO: 1347701 - protein, 6 aa, Mycobacterium
VGATGL

SEQ ID NO: 1347702 - protein, 11 aa, Mycobacterium
VGATSKGLSGQ

SEQ ID NO: 1347703 - protein, 9 aa, Mycobacterium
VGATSPALQ

SEQ ID NO: 1347704 - protein, 22 aa, Mycobacterium
VGDGVTDDSAAIKAAEAALASG

SEQ ID NO: 1347705 - protein, 5 aa, Mycobacterium
VGDYP

SEQ ID NO: 1347706 - protein, 7 aa, Mycobacterium
VGEGTEN

SEQ ID NO: 1347707 - protein, 23 aa, Mycobacterium
VGEPRGVPQAGALAGASRAVPGG

SEQ ID NO: 1347708 - protein, 8 aa, Mycobacterium
VGERQSGY

SEQ ID NO: 1347709 - protein, 35 aa, Mycobacterium
VGGAEPEDSEVADAEDSEVEDPQATEPAVAEEVSE

SEQ ID NO: 1347710 - protein, 19 aa, Mycobacterium
VGGAGSAGAQPAPTEPAPA

SEQ ID NO: 1347711 - protein, 5 aa, Mycobacterium
VGGAP

SEQ ID NO: 1347712 - protein, 5 aa, Mycobacterium
VGGDG

SEQ ID NO: 1347713 - protein, 11 aa, Mycobacterium
VGGDHNPIHTN

SEQ ID NO: 1347714 - protein, 19 aa, Mycobacterium
VGGEDTPAEEADDDTRDHV

SEQ ID NO: 1347715 - protein, 10 aa, Mycobacterium
VGGNGLYSSN

SEQ ID NO: 1347716 - protein, 137 aa, Mycobacterium
VGGPDLPAEPEPAVPDESVEPAVPEQDPESVEYDGGRAAGEGSAGEGSAGAESVDRVEPDAAPVESDPAPVEADPAPVEADPAPEKSDPAPVEADPAPEKSDPGSDASADDGEAGAATTPTETDEADEPPDEDTAEA

SEQ ID NO: 1347717 - protein, 14 aa, Mycobacterium
VGGQSEADPVAKPH

SEQ ID NO: 1347718 - protein, 6 aa, Mycobacterium
VGGQTV

SEQ ID NO: 1347719 - protein, 15 aa, Mycobacterium
VGGSATAGAFSRPGL

SEQ ID NO: 1347720 - protein, 11 aa, Mycobacterium
VGGSDGYGRSK

SEQ ID NO: 1347721 - protein, 7 aa, Mycobacterium
VGGSNGH

SEQ ID NO: 1347722 - protein, 5 aa, Mycobacterium
VGGTM

SEQ ID NO: 1347723 - protein, 8 aa, Mycobacterium
VGKGSSAH

SEQ ID NO: 1347724 - protein, 6 aa, Mycobacterium
VGKGTR

SEQ ID NO: 1347725 - protein, 10 aa, Mycobacterium
VGNDGKAVPL

SEQ ID NO: 1347726 - protein, 6 aa, Mycobacterium
VGNDPA

SEQ ID NO: 1347727 - protein, 9 aa, Mycobacterium
VGNHRNRPH

SEQ ID NO: 1347728 - protein, 17 aa, Mycobacterium
VGNPAGATANSTYTANG

SEQ ID NO: 1347729 - protein, 23 aa, Mycobacterium
VGNTTTVPQTAPAAAPASPLSGL

SEQ ID NO: 1347730 - protein, 7 aa, Mycobacterium
VGPAGID

SEQ ID NO: 1347731 - protein, 5 aa, Mycobacterium
VGPAT

SEQ ID NO: 1347732 - protein, 6 aa, Mycobacterium
VGPATQ

SEQ ID NO: 1347733 - protein, 4 aa, Mycobacterium
VGPD

SEQ ID NO: 1347734 - protein, 10 aa, Mycobacterium
VGPDADDAGH

SEQ ID NO: 1347735 - protein, 16 aa, Mycobacterium
VGPDGGTHTGTGADGL

SEQ ID NO: 1347736 - protein, 6 aa, Mycobacterium
VGPDSE

SEQ ID NO: 1347737 - protein, 9 aa, Mycobacterium
VGPGGNSRR

SEQ ID NO: 1347738 - protein, 18 aa, Mycobacterium
VGPRGRKEYRVTSAGRAE

SEQ ID NO: 1347739 - protein, 7 aa, Mycobacterium
VGPSPIA

SEQ ID NO: 1347740 - protein, 6 aa, Mycobacterium
VGQRSA

SEQ ID NO: 1347741 - protein, 7 aa, Mycobacterium
VGQRSAL

SEQ ID NO: 1347742 - protein, 10 aa, Mycobacterium
VGRDSPTNFT

SEQ ID NO: 1347743 - protein, 12 aa, Mycobacterium
VGRSASEHRPDD

SEQ ID NO: 1347744 - protein, 14 aa, Mycobacterium
VGSAGASATPGEGV

SEQ ID NO: 1347745 - protein, 6 aa, Mycobacterium
VGSDWA

SEQ ID NO: 1347746 - protein, 13 aa, Mycobacterium
VGSERGGLGGITR

SEQ ID NO: 1347747 - protein, 4 aa, Mycobacterium
VGSG

SEQ ID NO: 1347748 - protein, 6 aa, Mycobacterium
VGSGVR

SEQ ID NO: 1347749 - protein, 11 aa, Mycobacterium
VGSNPAQYGNS

SEQ ID NO: 1347750 - protein, 9 aa, Mycobacterium
VGSQGYSNV

SEQ ID NO: 1347751 - protein, 7 aa, Mycobacterium
VGSTPPV

SEQ ID NO: 1347752 - protein, 6 aa, Mycobacterium
VGTESV

SEQ ID NO: 1347753 - protein, 20 aa, Mycobacterium
VGTTSSAFEGEWPVGPGIGD

SEQ ID NO: 1347754 - protein, 6 aa, Mycobacterium
VGVDPT

SEQ ID NO: 1347755 - protein, 7 aa, Mycobacterium
VHGEGDH

SEQ ID NO: 1347756 - protein, 12 aa, Mycobacterium
VIGGGQPTLTGP

SEQ ID NO: 1347757 - protein, 4 aa, Mycobacterium
VIGP

SEQ ID NO: 1347758 - protein, 13 aa, Mycobacterium
VIGTTSDKLTSIS

SEQ ID NO: 1347759 - protein, 7 aa, Mycobacterium
VKAAEKI

SEQ ID NO: 1347760 - protein, 56 aa, Mycobacterium
VKARRSGSSSGSDSDDGDSADDKPAKKAPAKKSAAKKTAAKKAPAKKAAKKAASKK

SEQ ID NO: 1347761 - protein, 8 aa, Mycobacterium
VKEPARGS

SEQ ID NO: 1347762 - protein, 10 aa, Mycobacterium
VKGRADSPVA

SEQ ID NO: 1347763 - protein, 9 aa, Mycobacterium
VKSAESKGI

SEQ ID NO: 1347764 - protein, 15 aa, Mycobacterium
VKSGSGSAITDENGY

SEQ ID NO: 1347765 - protein, 7 aa, Mycobacterium
VKSRYSD

SEQ ID NO: 1347766 - protein, 9 aa, Mycobacterium
VKTDPKGVA

SEQ ID NO: 1347767 - protein, 12 aa, Mycobacterium
VLEQRGDELVAL

SEQ ID NO: 1347768 - protein, 21 aa, Mycobacterium
VLPPSQLTDPQTGQPGTPALP

SEQ ID NO: 1347769 - protein, 10 aa, Mycobacterium
VLSPDGTRLY

SEQ ID NO: 1347770 - protein, 10 aa, Mycobacterium
VNADPAADAL

SEQ ID NO: 1347771 - protein, 24 aa, Mycobacterium
VNAPATPTTATAAPPPLPSQAPLR

SEQ ID NO: 1347772 - protein, 12 aa, Mycobacterium
VNATDPDGDPLT

SEQ ID NO: 1347773 - protein, 9 aa, Mycobacterium
VNATSGKEG

SEQ ID NO: 1347774 - protein, 7 aa, Mycobacterium
VNDQTGD

SEQ ID NO: 1347775 - protein, 9 aa, Mycobacterium
VNEAHSGAT

SEQ ID NO: 1347776 - protein, 20 aa, Mycobacterium
VNGLSGNSAYTKNGAGNGGI

SEQ ID NO: 1347777 - protein, 7 aa, Mycobacterium
VNGPGGL

SEQ ID NO: 1347778 - protein, 7 aa, Mycobacterium
VNGPPQA

SEQ ID NO: 1347779 - protein, 9 aa, Mycobacterium
VNKTSGDAM

SEQ ID NO: 1347780 - protein, 7 aa, Mycobacterium
VNNTPVA

SEQ ID NO: 1347781 - protein, 8 aa, Mycobacterium
VNPADGAL

SEQ ID NO: 1347782 - protein, 7 aa, Mycobacterium
VNPGMGH

SEQ ID NO: 1347783 - protein, 14 aa, Mycobacterium
VNPKVTDCNVPQPS

SEQ ID NO: 1347784 - protein, 10 aa, Mycobacterium
VNPVSGPPPV

SEQ ID NO: 1347785 - protein, 6 aa, Mycobacterium
VNSGQI

SEQ ID NO: 1347786 - protein, 5 aa, Mycobacterium
VNSQS

SEQ ID NO: 1347787 - protein, 12 aa, Mycobacterium
VNTRNEQRDGHL

SEQ ID NO: 1347788 - protein, 4 aa, Mycobacterium
VNVD

SEQ ID NO: 1347789 - protein, 12 aa, Mycobacterium
VNVSPDGDSLVL

SEQ ID NO: 1347790 - protein, 7 aa, Mycobacterium
VPAAADT

SEQ ID NO: 1347791 - protein, 19 aa, Mycobacterium
VPAAAQPAPCDDPTCTPGI

SEQ ID NO: 1347792 - protein, 16 aa, Mycobacterium
VPAAPGPVSEPPPGMD

SEQ ID NO: 1347793 - protein, 32 aa, Mycobacterium
VPADEAETVESDTVVPDSSADVADGDVQLSRA

SEQ ID NO: 1347794 - protein, 5 aa, Mycobacterium
VPAEN

SEQ ID NO: 1347795 - protein, 14 aa, Mycobacterium
VPAENSADLKASYE

SEQ ID NO: 1347796 - protein, 11 aa, Mycobacterium
VPAGGQGPAPV

SEQ ID NO: 1347797 - protein, 15 aa, Mycobacterium
VPALPAAQNVGVTAT

SEQ ID NO: 1347798 - protein, 17 aa, Mycobacterium
VPAPPAAASPVPGPPPY

SEQ ID NO: 1347799 - protein, 14 aa, Mycobacterium
VPAPPSPDATASRV

SEQ ID NO: 1347800 - protein, 7 aa, Mycobacterium
VPAQAQP

SEQ ID NO: 1347801 - protein, 6 aa, Mycobacterium
VPASVT

SEQ ID NO: 1347802 - protein, 4 aa, Mycobacterium
VPAT

SEQ ID NO: 1347803 - protein, 7 aa, Mycobacterium
VPDPDGG

SEQ ID NO: 1347804 - protein, 9 aa, Mycobacterium
VPDTGRSRL

SEQ ID NO: 1347805 - protein, 6 aa, Mycobacterium
VPDWDN

SEQ ID NO: 1347806 - protein, 12 aa, Mycobacterium
VPEDGPGAYVSY

SEQ ID NO: 1347807 - protein, 11 aa, Mycobacterium
VPEGPGSVQGM

SEQ ID NO: 1347808 - protein, 6 aa, Mycobacterium
VPEQPS

SEQ ID NO: 1347809 - protein, 7 aa, Mycobacterium
VPESLRD

SEQ ID NO: 1347810 - protein, 12 aa, Mycobacterium
VPETATAEGPPF

SEQ ID NO: 1347811 - protein, 6 aa, Mycobacterium
VPGAAD

SEQ ID NO: 1347812 - protein, 11 aa, Mycobacterium
VPGAPFGSYAS

SEQ ID NO: 1347813 - protein, 4 aa, Mycobacterium
VPGD

SEQ ID NO: 1347814 - protein, 16 aa, Mycobacterium
VPGGEQDAEEDAEEDA

SEQ ID NO: 1347815 - protein, 10 aa, Mycobacterium
VPGGGAKPHY

SEQ ID NO: 1347816 - protein, 7 aa, Mycobacterium
VPGNGAD

SEQ ID NO: 1347817 - protein, 16 aa, Mycobacterium
VPGPAPVAPLPGTPAL

SEQ ID NO: 1347818 - protein, 5 aa, Mycobacterium
VPGPH

SEQ ID NO: 1347819 - protein, 21 aa, Mycobacterium
VPGVGGTGSSTLLGGDAGDVS

SEQ ID NO: 1347820 - protein, 14 aa, Mycobacterium
VPLPGGPGSGSERT

SEQ ID NO: 1347821 - protein, 6 aa, Mycobacterium
VPLQQS

SEQ ID NO: 1347822 - protein, 14 aa, Mycobacterium
VPLSPPGAPLTLQA

SEQ ID NO: 1347823 - protein, 4 aa, Mycobacterium
VPNG

SEQ ID NO: 1347824 - protein, 7 aa, Mycobacterium
VPNPSAL

SEQ ID NO: 1347825 - protein, 18 aa, Mycobacterium
VPNTGADPSESRTSAENH

SEQ ID NO: 1347826 - protein, 13 aa, Mycobacterium
VPPANPSPDPLRA

SEQ ID NO: 1347827 - protein, 12 aa, Mycobacterium
VPPEDAPPQPEL

SEQ ID NO: 1347828 - protein, 7 aa, Mycobacterium
VPPEGNR

SEQ ID NO: 1347829 - protein, 12 aa, Mycobacterium
VPPGGGRAEPFA

SEQ ID NO: 1347830 - protein, 8 aa, Mycobacterium
VPPGPPVP

SEQ ID NO: 1347831 - protein, 4 aa, Mycobacterium
VPPN

SEQ ID NO: 1347832 - protein, 12 aa, Mycobacterium
VPPNPDAPTDSP

SEQ ID NO: 1347833 - protein, 8 aa, Mycobacterium
VPPPPGVA

SEQ ID NO: 1347834 - protein, 8 aa, Mycobacterium
VPPPPPPV

SEQ ID NO: 1347835 - protein, 26 aa, Mycobacterium
VPPPQAPLNDPAPVESPLPAEAPATN

SEQ ID NO: 1347836 - protein, 5 aa, Mycobacterium
VPPQN

SEQ ID NO: 1347837 - protein, 13 aa, Mycobacterium
VPPQSPPPPADVR

SEQ ID NO: 1347838 - protein, 7 aa, Mycobacterium
VPPSAEM

SEQ ID NO: 1347839 - protein, 5 aa, Mycobacterium
VPPSE

SEQ ID NO: 1347840 - protein, 19 aa, Mycobacterium
VPQPSAPAAPVDAVAPTSG

SEQ ID NO: 1347841 - protein, 7 aa, Mycobacterium
VPRASAE

SEQ ID NO: 1347842 - protein, 15 aa, Mycobacterium
VPSAPGSAPAAPPHL

SEQ ID NO: 1347843 - protein, 6 aa, Mycobacterium
VPSGAA

SEQ ID NO: 1347844 - protein, 9 aa, Mycobacterium
VPSGTAADR

SEQ ID NO: 1347845 - protein, 7 aa, Mycobacterium
VPSPSMG

SEQ ID NO: 1347846 - protein, 8 aa, Mycobacterium
VPSTTRGE

SEQ ID NO: 1347847 - protein, 21 aa, Mycobacterium
VPTAPNPADGLQGLMVPAGAG

SEQ ID NO: 1347848 - protein, 7 aa, Mycobacterium
VPTGNGD

SEQ ID NO: 1347849 - protein, 12 aa, Mycobacterium
VPTTGSPPPAGP

SEQ ID NO: 1347850 - protein, 6 aa, Mycobacterium
VPVADT

SEQ ID NO: 1347851 - protein, 4 aa, Mycobacterium
VPVD

SEQ ID NO: 1347852 - protein, 10 aa, Mycobacterium
VPVDDPASGV

SEQ ID NO: 1347853 - protein, 24 aa, Mycobacterium
VPVPDPPDPPPPPGALPAFPGAEG

SEQ ID NO: 1347854 - protein, 11 aa, Mycobacterium
VPYGQTPSDPG

SEQ ID NO: 1347855 - protein, 8 aa, Mycobacterium
VQAPGPVT

SEQ ID NO: 1347856 - protein, 4 aa, Mycobacterium
VQET

SEQ ID NO: 1347857 - protein, 26 aa, Mycobacterium
VQPATAAGQLGRKYPAQEEPSSEFTR

SEQ ID NO: 1347858 - protein, 10 aa, Mycobacterium
VQPENSHPFA

SEQ ID NO: 1347859 - protein, 18 aa, Mycobacterium
VQPGPIDTDANPDNGDFA

SEQ ID NO: 1347860 - protein, 4 aa, Mycobacterium
VQPV

SEQ ID NO: 1347861 - protein, 5 aa, Mycobacterium
VQPVT

SEQ ID NO: 1347862 - protein, 4 aa, Mycobacterium
VQQD

SEQ ID NO: 1347863 - protein, 6 aa, Mycobacterium
VQQRPD

SEQ ID NO: 1347864 - protein, 10 aa, Mycobacterium
VQQSSANPAL

SEQ ID NO: 1347865 - protein, 8 aa, Mycobacterium
VQSERNAV

SEQ ID NO: 1347866 - protein, 14 aa, Mycobacterium
VQSPGAEHLSDPRH

SEQ ID NO: 1347867 - protein, 15 aa, Mycobacterium
VQSRQSRDGRGGQAD

SEQ ID NO: 1347868 - protein, 9 aa, Mycobacterium
VRAGDDPAV

SEQ ID NO: 1347869 - protein, 10 aa, Mycobacterium
VRAGDDTDTV

SEQ ID NO: 1347870 - protein, 11 aa, Mycobacterium
VRAGDSGGPVV

SEQ ID NO: 1347871 - protein, 12 aa, Mycobacterium
VRATRPNSMRTS

SEQ ID NO: 1347872 - protein, 9 aa, Mycobacterium
VRDTATAER

SEQ ID NO: 1347873 - protein, 6 aa, Mycobacterium
VREDGS

SEQ ID NO: 1347874 - protein, 6 aa, Mycobacterium
VRERTA

SEQ ID NO: 1347875 - protein, 7 aa, Mycobacterium
VRGNDYR

SEQ ID NO: 1347876 - protein, 15 aa, Mycobacterium
VRGQGPRMGEATTGL

SEQ ID NO: 1347877 - protein, 8 aa, Mycobacterium
VRGQPQDV

SEQ ID NO: 1347878 - protein, 7 aa, Mycobacterium
VRHPGAA

SEQ ID NO: 1347879 - protein, 10 aa, Mycobacterium
VRNEGPGDAH

SEQ ID NO: 1347880 - protein, 5 aa, Mycobacterium
VRPGT

SEQ ID NO: 1347881 - protein, 5 aa, Mycobacterium
VRPVR

SEQ ID NO: 1347882 - protein, 27 aa, Mycobacterium
VRQSKVGDTVTTARNGAKEALTGYREP

SEQ ID NO: 1347883 - protein, 15 aa, Mycobacterium
VRQTDSGDSLETARP

SEQ ID NO: 1347884 - protein, 15 aa, Mycobacterium
VRRDEGGDVVSEGQA

SEQ ID NO: 1347885 - protein, 6 aa, Mycobacterium
VRRGDQ

SEQ ID NO: 1347886 - protein, 9 aa, Mycobacterium
VRRSGIEPT

SEQ ID NO: 1347887 - protein, 16 aa, Mycobacterium
VRRSRAGVADPNRPTG

SEQ ID NO: 1347888 - protein, 8 aa, Mycobacterium
VRSDGSDR

SEQ ID NO: 1347889 - protein, 8 aa, Mycobacterium
VRSSTAET

SEQ ID NO: 1347890 - protein, 10 aa, Mycobacterium
VRTDSPSAGI

SEQ ID NO: 1347891 - protein, 6 aa, Mycobacterium
VRTGSD

SEQ ID NO: 1347892 - protein, 14 aa, Mycobacterium
VRTKDMTPYLVRII

SEQ ID NO: 1347893 - protein, 4 aa, Mycobacterium
VRTP

SEQ ID NO: 1347894 - protein, 15 aa, Mycobacterium
VRTSGMTPYAVRFIE

SEQ ID NO: 1347895 - protein, 10 aa, Mycobacterium
VSAGPDRGPL

SEQ ID NO: 1347896 - protein, 54 aa, Mycobacterium
VSAPPGGGHSGPPPEGAPGPPPEGAGGPPGSPADGAGGPPGSPADGSPPPAPLG

SEQ ID NO: 1347897 - protein, 9 aa, Mycobacterium
VSASADTAV

SEQ ID NO: 1347898 - protein, 7 aa, Mycobacterium
VSATPGD

SEQ ID NO: 1347899 - protein, 6 aa, Mycobacterium
VSDAPM

SEQ ID NO: 1347900 - protein, 10 aa, Mycobacterium
VSDDNGETWT

SEQ ID NO: 1347901 - protein, 33 aa, Mycobacterium
VSDGVPVADPSQPAAVQATPTTVPSASPDPLPG

SEQ ID NO: 1347902 - protein, 9 aa, Mycobacterium
VSDSTQLSY

SEQ ID NO: 1347903 - protein, 6 aa, Mycobacterium
VSEGTP

SEQ ID NO: 1347904 - protein, 5 aa, Mycobacterium
VSGPS

SEQ ID NO: 1347905 - protein, 6 aa, Mycobacterium
VSGQLN

SEQ ID NO: 1347906 - protein, 7 aa, Mycobacterium
VSGQSLG

SEQ ID NO: 1347907 - protein, 9 aa, Mycobacterium
VSGSGGSVA

SEQ ID NO: 1347908 - protein, 11 aa, Mycobacterium
VSHNDARGLAR

SEQ ID NO: 1347909 - protein, 5 aa, Mycobacterium
VSHTD

SEQ ID NO: 1347910 - protein, 10 aa, Mycobacterium
VSLPPATTSW

SEQ ID NO: 1347911 - protein, 18 aa, Mycobacterium
VSPEQAAPGLRTATVPGR

SEQ ID NO: 1347912 - protein, 8 aa, Mycobacterium
VSPPASAD

SEQ ID NO: 1347913 - protein, 24 aa, Mycobacterium
VSPPPAPQSTETPQTTPPPAPKAT

SEQ ID NO: 1347914 - protein, 21 aa, Mycobacterium
VSPPSTPTETPAPPTDEAPPQ

SEQ ID NO: 1347915 - protein, 7 aa, Mycobacterium
VSPRGAT

SEQ ID NO: 1347916 - protein, 12 aa, Mycobacterium
VSPRGDGEQREA

SEQ ID NO: 1347917 - protein, 11 aa, Mycobacterium
VSPRPDDVTGE

SEQ ID NO: 1347918 - protein, 11 aa, Mycobacterium
VSPRPDGVSGE

SEQ ID NO: 1347919 - protein, 7 aa, Mycobacterium
VSQGVES

SEQ ID NO: 1347920 - protein, 6 aa, Mycobacterium
VSQSRS

SEQ ID NO: 1347921 - protein, 9 aa, Mycobacterium
VSRDDDDRL

SEQ ID NO: 1347922 - protein, 6 aa, Mycobacterium
VSRDSW

SEQ ID NO: 1347923 - protein, 5 aa, Mycobacterium
VSRGD

SEQ ID NO: 1347924 - protein, 19 aa, Mycobacterium
VSRKGDSGGPVYTPTPDGR

SEQ ID NO: 1347925 - protein, 10 aa, Mycobacterium
VSRPDGGFGT

SEQ ID NO: 1347926 - protein, 8 aa, Mycobacterium
VSRRGRDR

SEQ ID NO: 1347927 - protein, 12 aa, Mycobacterium
VSSANTSGRTGL

SEQ ID NO: 1347928 - protein, 6 aa, Mycobacterium
VSSGPF

SEQ ID NO: 1347929 - protein, 20 aa, Mycobacterium
VSSSSGVDAFNPTAPSEGNS

SEQ ID NO: 1347930 - protein, 11 aa, Mycobacterium
VSSTKTEATET

SEQ ID NO: 1347931 - protein, 9 aa, Mycobacterium
VSTAGAQGP

SEQ ID NO: 1347932 - protein, 17 aa, Mycobacterium
VSTPDGAHEDAAIPATE

SEQ ID NO: 1347933 - protein, 17 aa, Mycobacterium
VSTPDKGAVTVSRGENG

SEQ ID NO: 1347934 - protein, 11 aa, Mycobacterium
VSVEGEARPLP

SEQ ID NO: 1347935 - protein, 10 aa, Mycobacterium
VSYNGTVPGP

SEQ ID NO: 1347936 - protein, 20 aa, Mycobacterium
VTADDADGDPLTYSGSTVTV

SEQ ID NO: 1347937 - protein, 9 aa, Mycobacterium
VTAERREWP

SEQ ID NO: 1347938 - protein, 4 aa, Mycobacterium
VTAP

SEQ ID NO: 1347939 - protein, 17 aa, Mycobacterium
VTAPQPTNNPDDSYGPG

SEQ ID NO: 1347940 - protein, 10 aa, Mycobacterium
VTAPTAGAQG

SEQ ID NO: 1347941 - protein, 12 aa, Mycobacterium
VTDKAKESVYDG

SEQ ID NO: 1347942 - protein, 6 aa, Mycobacterium
VTDPDG

SEQ ID NO: 1347943 - protein, 60 aa, Mycobacterium
VTDPEPSERRSDDGDGDGDAQPSAADTDIAEGEPDADIAEGEPDADGVEDEPDAPEPADV

SEQ ID NO: 1347944 - protein, 11 aa, Mycobacterium
VTDPGAPTATV

SEQ ID NO: 1347945 - protein, 27 aa, Mycobacterium
VTDPGPSAGKLKEGDAIDAVNGKPVAT

SEQ ID NO: 1347946 - protein, 8 aa, Mycobacterium
VTDPPRSE

SEQ ID NO: 1347947 - protein, 8 aa, Mycobacterium
VTEDGTEL

SEQ ID NO: 1347948 - protein, 7 aa, Mycobacterium
VTEDTAV

SEQ ID NO: 1347949 - protein, 8 aa, Mycobacterium
VTEGNGDH

SEQ ID NO: 1347950 - protein, 9 aa, Mycobacterium
VTEPERQEL

SEQ ID NO: 1347951 - protein, 7 aa, Mycobacterium
VTEPGER

SEQ ID NO: 1347952 - protein, 5 aa, Mycobacterium
VTEPV

SEQ ID NO: 1347953 - protein, 6 aa, Mycobacterium
VTEPVE

SEQ ID NO: 1347954 - protein, 16 aa, Mycobacterium
VTEPVEQADTDGATPV

SEQ ID NO: 1347955 - protein, 6 aa, Mycobacterium
VTETGN

SEQ ID NO: 1347956 - protein, 8 aa, Mycobacterium
VTGADQTR

SEQ ID NO: 1347957 - protein, 5 aa, Mycobacterium
VTGAG

SEQ ID NO: 1347958 - protein, 11 aa, Mycobacterium
VTGAGQAGNRV

SEQ ID NO: 1347959 - protein, 17 aa, Mycobacterium
VTGDGQAMEGRDPATGA

SEQ ID NO: 1347960 - protein, 9 aa, Mycobacterium
VTGDGTGAF

SEQ ID NO: 1347961 - protein, 6 aa, Mycobacterium
VTGGGL

SEQ ID NO: 1347962 - protein, 8 aa, Mycobacterium
VTGQTQNG

SEQ ID NO: 1347963 - protein, 10 aa, Mycobacterium
VTGRVGDDDR

SEQ ID NO: 1347964 - protein, 8 aa, Mycobacterium
VTINAGNQ

SEQ ID NO: 1347965 - protein, 6 aa, Mycobacterium
VTPDGT

SEQ ID NO: 1347966 - protein, 19 aa, Mycobacterium
VTPGRDVPNVKAGVGVPTR

SEQ ID NO: 1347967 - protein, 9 aa, Mycobacterium
VTPGRTYTT

SEQ ID NO: 1347968 - protein, 5 aa, Mycobacterium
VTPPL

SEQ ID NO: 1347969 - protein, 12 aa, Mycobacterium
VTPPPESAAAYS

SEQ ID NO: 1347970 - protein, 13 aa, Mycobacterium
VTPQISEPTYPVQ

SEQ ID NO: 1347971 - protein, 13 aa, Mycobacterium
VTPRIEEPHYPVQ

SEQ ID NO: 1347972 - protein, 13 aa, Mycobacterium
VTPSPLPRPRPAE

SEQ ID NO: 1347973 - protein, 18 aa, Mycobacterium
VTPTGDAYESRNSDAPDA

SEQ ID NO: 1347974 - protein, 12 aa, Mycobacterium
VTPTPISAALTD

SEQ ID NO: 1347975 - protein, 8 aa, Mycobacterium
VTQDGADG

SEQ ID NO: 1347976 - protein, 8 aa, Mycobacterium
VTRGVDDR

SEQ ID NO: 1347977 - protein, 10 aa, Mycobacterium
VTRRGEDARI

SEQ ID NO: 1347978 - protein, 13 aa, Mycobacterium
VTSDLDTGSDFGR

SEQ ID NO: 1347979 - protein, 6 aa, Mycobacterium
VTSGSL

SEQ ID NO: 1347980 - protein, 8 aa, Mycobacterium
VTSGSLGQ

SEQ ID NO: 1347981 - protein, 6 aa, Mycobacterium
VTSPDT

SEQ ID NO: 1347982 - protein, 17 aa, Mycobacterium
VTSQKKEIDTMKQILDS

SEQ ID NO: 1347983 - protein, 4 aa, Mycobacterium
VTSR

SEQ ID NO: 1347984 - protein, 31 aa, Mycobacterium
VTSSSLSTGLTRNQTATGTIGATDADGDPLT

SEQ ID NO: 1347985 - protein, 11 aa, Mycobacterium
VTSTSTPATSA

SEQ ID NO: 1347986 - protein, 7 aa, Mycobacterium
VTTDDVR

SEQ ID NO: 1347987 - protein, 7 aa, Mycobacterium
VTTDNYK

SEQ ID NO: 1347988 - protein, 8 aa, Mycobacterium
VTTDPPVE

SEQ ID NO: 1347989 - protein, 9 aa, Mycobacterium
VTTTPPVEG

SEQ ID NO: 1347990 - protein, 13 aa, Mycobacterium
VTVPTPQQTEAAS

SEQ ID NO: 1347991 - protein, 6 aa, Mycobacterium
VVGDEG

SEQ ID NO: 1347992 - protein, 10 aa, Mycobacterium
VVGGNRQALT

SEQ ID NO: 1347993 - protein, 8 aa, Mycobacterium
VVGPGAQQ

SEQ ID NO: 1347994 - protein, 4 aa, Mycobacterium
VVGS

SEQ ID NO: 1347995 - protein, 8 aa, Mycobacterium
VVGTGSSA

SEQ ID NO: 1347996 - protein, 10 aa, Mycobacterium
VVKDERTAHN

SEQ ID NO: 1347997 - protein, 6 aa, Mycobacterium
VVPARD

SEQ ID NO: 1347998 - protein, 16 aa, Mycobacterium
VVPGTGGVNSGNPGDA

SEQ ID NO: 1347999 - protein, 4 aa, Mycobacterium
VVTE

SEQ ID NO: 1348000 - protein, 7 aa, Mycobacterium
VYGAPGQ

SEQ ID NO: 1348001 - protein, 4 aa, Mycobacterium
VYPP

SEQ ID NO: 1348002 - protein, 8 aa, Mycobacterium
WADPPDRP

SEQ ID NO: 1348003 - protein, 18 aa, Mycobacterium
WAEHGGRGNPADAARTEQ

SEQ ID NO: 1348004 - protein, 4 aa, Mycobacterium
WAEP

SEQ ID NO: 1348005 - protein, 105 aa, Mycobacterium
WAEPSDAASSSSADNTKAEDTAEDSTAADDARPDDAVDDEVNSGEDHDEEAPQSEDGGDGSDEDGGQPEKKTRGSYGSNRSEGELTGEDADEARADREDTDTEAD

SEQ ID NO: 1348006 - protein, 7 aa, Mycobacterium
WAGDYGS

SEQ ID NO: 1348007 - protein, 5 aa, Mycobacterium
WAPDG

SEQ ID NO: 1348008 - protein, 10 aa, Mycobacterium
WAPPPRPADC

SEQ ID NO: 1348009 - protein, 5 aa, Mycobacterium
WATAD

SEQ ID NO: 1348010 - protein, 11 aa, Mycobacterium
WEDAGGDTPEW

SEQ ID NO: 1348011 - protein, 8 aa, Mycobacterium
WEQTSPNE

SEQ ID NO: 1348012 - protein, 6 aa, Mycobacterium
WGHEPT

SEQ ID NO: 1348013 - protein, 7 aa, Mycobacterium
WGHEPTP

SEQ ID NO: 1348014 - protein, 17 aa, Mycobacterium
WGPGGGPAWKRNDPTVN

SEQ ID NO: 1348015 - protein, 9 aa, Mycobacterium
WGPGQEPGT

SEQ ID NO: 1348016 - protein, 12 aa, Mycobacterium
WGPSSDPAWKRN

SEQ ID NO: 1348017 - protein, 9 aa, Mycobacterium
WGPSSDPVW

SEQ ID NO: 1348018 - protein, 16 aa, Mycobacterium
WGQPTPGRRAQRNGYR

SEQ ID NO: 1348019 - protein, 6 aa, Mycobacterium
WGSETR

SEQ ID NO: 1348020 - protein, 4 aa, Mycobacterium
WGSG

SEQ ID NO: 1348021 - protein, 4 aa, Mycobacterium
WGTG

SEQ ID NO: 1348022 - protein, 11 aa, Mycobacterium
WKESPSAQREN

SEQ ID NO: 1348023 - protein, 10 aa, Mycobacterium
WNPKVAANQT

SEQ ID NO: 1348024 - protein, 19 aa, Mycobacterium
WPDDSSNATAARNARAGQN

SEQ ID NO: 1348025 - protein, 5 aa, Mycobacterium
WPEPP

SEQ ID NO: 1348026 - protein, 13 aa, Mycobacterium
WPPGTIPGADEPV

SEQ ID NO: 1348027 - protein, 8 aa, Mycobacterium
WPRSPEWT

SEQ ID NO: 1348028 - protein, 6 aa, Mycobacterium
WQGEPE

SEQ ID NO: 1348029 - protein, 4 aa, Mycobacterium
WQGG

SEQ ID NO: 1348030 - protein, 5 aa, Mycobacterium
WQGGQ

SEQ ID NO: 1348031 - protein, 7 aa, Mycobacterium
WQQRAEV

SEQ ID NO: 1348032 - protein, 14 aa, Mycobacterium
WRSPADTSTAPLPS

SEQ ID NO: 1348033 - protein, 17 aa, Mycobacterium
WSANGGVGNPAAAPRHE

SEQ ID NO: 1348034 - protein, 6 aa, Mycobacterium
WSDTAS

SEQ ID NO: 1348035 - protein, 12 aa, Mycobacterium
WSKKSDYATDRE

SEQ ID NO: 1348036 - protein, 22 aa, Mycobacterium
WSPPAPPPTSTAAECGPGPAAD

SEQ ID NO: 1348037 - protein, 8 aa, Mycobacterium
WSSSSQTQ

SEQ ID NO: 1348038 - protein, 9 aa, Mycobacterium
WSTGASSAY

SEQ ID NO: 1348039 - protein, 5 aa, Mycobacterium
WTAEQ

SEQ ID NO: 1348040 - protein, 19 aa, Mycobacterium
WTDDNSALGGHNGCDTRND

SEQ ID NO: 1348041 - protein, 11 aa, Mycobacterium
WTSGESSFRTE

SEQ ID NO: 1348042 - protein, 7 aa, Mycobacterium
WTSSSRK

SEQ ID NO: 1348043 - protein, 8 aa, Mycobacterium
YAAPAGVS

SEQ ID NO: 1348044 - protein, 28 aa, Mycobacterium
YAAPGTNLPHDDAHTGRDDRTTGQRNHD

SEQ ID NO: 1348045 - protein, 26 aa, Mycobacterium
YAAPGTNLPHDDTHTGRDDRTTGQRH

SEQ ID NO: 1348046 - protein, 26 aa, Mycobacterium
YAAPGTNRPHDDTHTGRDDRTTGQRH

SEQ ID NO: 1348047 - protein, 7 aa, Mycobacterium
YADAGPD

SEQ ID NO: 1348048 - protein, 121 aa, Mycobacterium
YADDTGTASSETTATENSSAEGPARQGAASDSDVGTGADDEASDVGTVADDEASDVGTVADDEASDVGTVADDGASDVETAEDDEASDVEEQQSGGGTGEDSTTPAEPVDTADDTASLSAP

SEQ ID NO: 1348049 - protein, 8 aa, Mycobacterium
YAEDGGLD

SEQ ID NO: 1348050 - protein, 11 aa, Mycobacterium
YAENTPGYDQD

SEQ ID NO: 1348051 - protein, 10 aa, Mycobacterium
YAGDKARALT

SEQ ID NO: 1348052 - protein, 7 aa, Mycobacterium
YAGLGTP

SEQ ID NO: 1348053 - protein, 6 aa, Mycobacterium
YAGRDD

SEQ ID NO: 1348054 - protein, 7 aa, Mycobacterium
YAGSGEL

SEQ ID NO: 1348055 - protein, 11 aa, Mycobacterium
YAGSRESLRGV

SEQ ID NO: 1348056 - protein, 10 aa, Mycobacterium
YAGTATTGTV

SEQ ID NO: 1348057 - protein, 9 aa, Mycobacterium
YAKGRPADQ

SEQ ID NO: 1348058 - protein, 12 aa, Mycobacterium
YASNGGKDPQAG

SEQ ID NO: 1348059 - protein, 7 aa, Mycobacterium
YATSGSS

SEQ ID NO: 1348060 - protein, 9 aa, Mycobacterium
YATSNGTAI

SEQ ID NO: 1348061 - protein, 12 aa, Mycobacterium
YDDTPPVGQISD

SEQ ID NO: 1348062 - protein, 9 aa, Mycobacterium
YDESTGKSY

SEQ ID NO: 1348063 - protein, 6 aa, Mycobacterium
YDGGGD

SEQ ID NO: 1348064 - protein, 9 aa, Mycobacterium
YDGGGGGDQ

SEQ ID NO: 1348065 - protein, 15 aa, Mycobacterium
YDGNPISSDPSRYRP

SEQ ID NO: 1348066 - protein, 7 aa, Mycobacterium
YDGYSAK

SEQ ID NO: 1348067 - protein, 17 aa, Mycobacterium
YDNDGDFNIGGDNEGNF

SEQ ID NO: 1348068 - protein, 10 aa, Mycobacterium
YDPAAPPPDQ

SEQ ID NO: 1348069 - protein, 10 aa, Mycobacterium
YDPADPPKIT

SEQ ID NO: 1348070 - protein, 4 aa, Mycobacterium
YDPN

SEQ ID NO: 1348071 - protein, 8 aa, Mycobacterium
YDPNGDPL

SEQ ID NO: 1348072 - protein, 6 aa, Mycobacterium
YDPNRD

SEQ ID NO: 1348073 - protein, 5 aa, Mycobacterium
YDPPG

SEQ ID NO: 1348074 - protein, 7 aa, Mycobacterium
YDRPTTT

SEQ ID NO: 1348075 - protein, 7 aa, Mycobacterium
YDSEPAD

SEQ ID NO: 1348076 - protein, 9 aa, Mycobacterium
YDSEPDDVA

SEQ ID NO: 1348077 - protein, 9 aa, Mycobacterium
YDSESSLRR

SEQ ID NO: 1348078 - protein, 10 aa, Mycobacterium
YEEAGEQEAD

SEQ ID NO: 1348079 - protein, 4 aa, Mycobacterium
YEGQ

SEQ ID NO: 1348080 - protein, 13 aa, Mycobacterium
YEGQSAVKTARTI

SEQ ID NO: 1348081 - protein, 11 aa, Mycobacterium
YEGSSETDGLG

SEQ ID NO: 1348082 - protein, 6 aa, Mycobacterium
YEQGGI

SEQ ID NO: 1348083 - protein, 7 aa, Mycobacterium
YESRRDR

SEQ ID NO: 1348084 - protein, 4 aa, Mycobacterium
YFGQ

SEQ ID NO: 1348085 - protein, 10 aa, Mycobacterium
YGAGTDIHSP

SEQ ID NO: 1348086 - protein, 6 aa, Mycobacterium
YGDAGR

SEQ ID NO: 1348087 - protein, 9 aa, Mycobacterium
YGDSSGGSY

SEQ ID NO: 1348088 - protein, 16 aa, Mycobacterium
YGHRGDAFAAAVRAAI

SEQ ID NO: 1348089 - protein, 25 aa, Mycobacterium
YGKPGGTAPSDFTRGYAGGVADART

SEQ ID NO: 1348090 - protein, 12 aa, Mycobacterium
YGNAASLTTTVE

SEQ ID NO: 1348091 - protein, 8 aa, Mycobacterium
YGPGGTPL

SEQ ID NO: 1348092 - protein, 5 aa, Mycobacterium
YGRAP

SEQ ID NO: 1348093 - protein, 11 aa, Mycobacterium
YGRGRADNPCA

SEQ ID NO: 1348094 - protein, 18 aa, Mycobacterium
YGTLTATPDGYDYNPTAE

SEQ ID NO: 1348095 - protein, 4 aa, Mycobacterium
YGVN

SEQ ID NO: 1348096 - protein, 9 aa, Mycobacterium
YKPSEPGAY

SEQ ID NO: 1348097 - protein, 7 aa, Mycobacterium
YKVPADA

SEQ ID NO: 1348098 - protein, 7 aa, Mycobacterium
YLGPDVD

SEQ ID NO: 1348099 - protein, 13 aa, Mycobacterium
YLQPSRKQSLRRK

SEQ ID NO: 1348100 - protein, 10 aa, Mycobacterium
YNQSDPYARS

SEQ ID NO: 1348101 - protein, 6 aa, Mycobacterium
YPAGGR

SEQ ID NO: 1348102 - protein, 8 aa, Mycobacterium
YPAGGTTG

SEQ ID NO: 1348103 - protein, 5 aa, Mycobacterium
YPAGT

SEQ ID NO: 1348104 - protein, 7 aa, Mycobacterium
YPDAEVA

SEQ ID NO: 1348105 - protein, 4 aa, Mycobacterium
YPDI

SEQ ID NO: 1348106 - protein, 6 aa, Mycobacterium
YPDRPV

SEQ ID NO: 1348107 - protein, 11 aa, Mycobacterium
YPDSENSDAID

SEQ ID NO: 1348108 - protein, 23 aa, Mycobacterium
YPEGDPGRIPDAGEDDASEGDED

SEQ ID NO: 1348109 - protein, 5 aa, Mycobacterium
YPETV

SEQ ID NO: 1348110 - protein, 17 aa, Mycobacterium
YPGADDELSMRDNNTSA

SEQ ID NO: 1348111 - protein, 11 aa, Mycobacterium
YPGAPIPAPPN

SEQ ID NO: 1348112 - protein, 5 aa, Mycobacterium
YPGDL

SEQ ID NO: 1348113 - protein, 12 aa, Mycobacterium
YPGNDPLANPDV

SEQ ID NO: 1348114 - protein, 7 aa, Mycobacterium
YPGPDMD

SEQ ID NO: 1348115 - protein, 8 aa, Mycobacterium
YPGRGGAT

SEQ ID NO: 1348116 - protein, 8 aa, Mycobacterium
YPGSPVDT

SEQ ID NO: 1348117 - protein, 13 aa, Mycobacterium
YPKGNGVTATNDL

SEQ ID NO: 1348118 - protein, 9 aa, Mycobacterium
YPPGGTTFS

SEQ ID NO: 1348119 - protein, 7 aa, Mycobacterium
YPPGSTF

SEQ ID NO: 1348120 - protein, 7 aa, Mycobacterium
YPPGVRP

SEQ ID NO: 1348121 - protein, 17 aa, Mycobacterium
YPQPPGPATAATERIAR

SEQ ID NO: 1348122 - protein, 8 aa, Mycobacterium
YPRSDLPE

SEQ ID NO: 1348123 - protein, 15 aa, Mycobacterium
YPTDDAAAQPVEPRT

SEQ ID NO: 1348124 - protein, 16 aa, Mycobacterium
YPTDDTAARPVEPRTM

SEQ ID NO: 1348125 - protein, 7 aa, Mycobacterium
YPTDSAP

SEQ ID NO: 1348126 - protein, 7 aa, Mycobacterium
YPTRPQA

SEQ ID NO: 1348127 - protein, 5 aa, Mycobacterium
YPTTV

SEQ ID NO: 1348128 - protein, 21 aa, Mycobacterium
YPVGDGSQSCPGSGDTTYDGV

SEQ ID NO: 1348129 - protein, 6 aa, Mycobacterium
YQAGRQ

SEQ ID NO: 1348130 - protein, 8 aa, Mycobacterium
YQPAPETE

SEQ ID NO: 1348131 - protein, 8 aa, Mycobacterium
YQPATVPG

SEQ ID NO: 1348132 - protein, 7 aa, Mycobacterium
YQPGDPS

SEQ ID NO: 1348133 - protein, 16 aa, Mycobacterium
YQQRDRNGHYKNRQDA

SEQ ID NO: 1348134 - protein, 28 aa, Mycobacterium
YQSGAGQGEAKAEKDGKTYKISGTATGV

SEQ ID NO: 1348135 - protein, 20 aa, Mycobacterium
YQTAANPATSQQGALVGASR

SEQ ID NO: 1348136 - protein, 6 aa, Mycobacterium
YQTDQT

SEQ ID NO: 1348137 - protein, 10 aa, Mycobacterium
YQTGRGGGQV

SEQ ID NO: 1348138 - protein, 11 aa, Mycobacterium
YRAGGTGGAQL

SEQ ID NO: 1348139 - protein, 14 aa, Mycobacterium
YRAPTGPSPAGTSM

SEQ ID NO: 1348140 - protein, 12 aa, Mycobacterium
YRARPRRAVRQV

SEQ ID NO: 1348141 - protein, 11 aa, Mycobacterium
YRDDGEQGLET

SEQ ID NO: 1348142 - protein, 8 aa, Mycobacterium
YRNTQTPQ

SEQ ID NO: 1348143 - protein, 8 aa, Mycobacterium
YRSAPTGF

SEQ ID NO: 1348144 - protein, 5 aa, Mycobacterium
YSAED

SEQ ID NO: 1348145 - protein, 7 aa, Mycobacterium
YSATSGT

SEQ ID NO: 1348146 - protein, 14 aa, Mycobacterium
YSDPKELAPLPEEE

SEQ ID NO: 1348147 - protein, 12 aa, Mycobacterium
YSGEGDDRGEHV

SEQ ID NO: 1348148 - protein, 9 aa, Mycobacterium
YSGSKGLTS

SEQ ID NO: 1348149 - protein, 13 aa, Mycobacterium
YSNGTGATIGTPQ

SEQ ID NO: 1348150 - protein, 7 aa, Mycobacterium
YSPGQTF

SEQ ID NO: 1348151 - protein, 14 aa, Mycobacterium
YSPQPGAAPSHGQR

SEQ ID NO: 1348152 - protein, 6 aa, Mycobacterium
YSQGAA

SEQ ID NO: 1348153 - protein, 15 aa, Mycobacterium
YSTDLTARAREGKLD

SEQ ID NO: 1348154 - protein, 11 aa, Mycobacterium
YSTPASRSDTF

SEQ ID NO: 1348155 - protein, 19 aa, Mycobacterium
YSTSNGTATAAGGDYAPAV

SEQ ID NO: 1348156 - protein, 16 aa, Mycobacterium
YSTTGPGIDDRPYAIP

SEQ ID NO: 1348157 - protein, 5 aa, Mycobacterium
YTAGG

SEQ ID NO: 1348158 - protein, 16 aa, Mycobacterium
YTASATAKGGTVTIDG

SEQ ID NO: 1348159 - protein, 4 aa, Mycobacterium
YTDD

SEQ ID NO: 1348160 - protein, 8 aa, Mycobacterium
YTDRQQEA

SEQ ID NO: 1348161 - protein, 7 aa, Mycobacterium
YTDTPGA

SEQ ID NO: 1348162 - protein, 5 aa, Mycobacterium
YTGDG

SEQ ID NO: 1348163 - protein, 12 aa, Mycobacterium
YTGPGAGLDGSD

SEQ ID NO: 1348164 - protein, 7 aa, Mycobacterium
YTGPPAP

SEQ ID NO: 1348165 - protein, 6 aa, Mycobacterium
YTGPRA

SEQ ID NO: 1348166 - protein, 7 aa, Mycobacterium
YTGSYTE

SEQ ID NO: 1348167 - protein, 9 aa, Mycobacterium
YTNAAAGSI

SEQ ID NO: 1348168 - protein, 9 aa, Mycobacterium
YTNAAAGSL

SEQ ID NO: 1348169 - protein, 12 aa, Mycobacterium
YTPAGPQGSGYG

SEQ ID NO: 1348170 - protein, 26 aa, Mycobacterium
YTPAQGPPGTTAGYSPSSGEVVGPDG

SEQ ID NO: 1348171 - protein, 18 aa, Mycobacterium
YTPEDTAIQTPNSDTPYS

SEQ ID NO: 1348172 - protein, 12 aa, Mycobacterium
YTPGGAKAGGYG

SEQ ID NO: 1348173 - protein, 21 aa, Mycobacterium
YTPSAAARHAAAATDVTPVRA

SEQ ID NO: 1348174 - protein, 8 aa, Mycobacterium
YTSGTTKA

SEQ ID NO: 1348175 - protein, 10 aa, Mycobacterium
YTSSGSGAGV

SEQ ID NO: 1348176 - protein, 5 aa, Mycobacterium
YTTGA

SEQ ID NO: 1348177 - protein, 13 aa, Mycobacterium
YTVQPPDDREMTA

SEQ ID NO: 1348178 - protein, 7 aa, Mycobacterium
YVESPGI

SEQ ID NO: 1348179 - protein, 6 aa, Mycobacterium
YVTPDD

SEQ ID NO: 1348180 - protein, 24 aa, Mycobacterium
ANLMSICPKSMWPAVKAMLHSVYD

SEQ ID NO: 1348181 - protein, 26 aa, Mycobacterium
AANLPGAAWQRCRTHYAANLMSICPK

SEQ ID NO: 1348182 - protein, 25 aa, Mycobacterium
VPKLRKGTYFPDWLLERRKRAESAL

SEQ ID NO: 1348183 - protein, 19 aa, Mycobacterium
WLLERRKRAESALITVVAD

SEQ ID NO: 1348184 - protein, 24 aa, Mycobacterium
EWAEGRRYLGLDILARCRLTTITN

SEQ ID NO: 1348185 - protein, 17 aa, Mycobacterium
PAWNEFFADLVARGLAG

SEQ ID NO: 1348186 - protein, 23 aa, Mycobacterium
AGGVLLRPYARLIASTGDSVTTY

SEQ ID NO: 1348187 - protein, 18 aa, Mycobacterium
PLDQSSIVSVRYDNDDRV

SEQ ID NO: 1348188 - protein, 23 aa, Mycobacterium
SSTVERFSPPAPPAPAVPAANSV

SEQ ID NO: 1348189 - protein, 20 aa, Mycobacterium
NRLTREWFHSGRAKYIVAGE

SEQ ID NO: 1348190 - protein, 24 aa, Mycobacterium
RAGQRLEPMRAWFLTVAVRTGIDV

SEQ ID NO: 1348191 - protein, 17 aa, Mycobacterium
VAAIGQRFGPAGLLGAV

SEQ ID NO: 1348192 - protein, 24 aa, Mycobacterium
AGAFSRPGLPVEYLMVPSAGMGRD

SEQ ID NO: 1348193 - protein, 17 aa, Mycobacterium
CVTRPGKRAPTVKMCES

SEQ ID NO: 1348194 - protein, 22 aa, Mycobacterium
DPYRYPDHRPINAAKGGEGGKP

SEQ ID NO: 1348195 - protein, 20 aa, Mycobacterium
ERLFGRRLADFFTGRDPRGG

SEQ ID NO: 1348196 - protein, 34 aa, Mycobacterium
FEGSLELGYQIGFPWSLGVGINFSYTTPNIAFDG

SEQ ID NO: 1348197 - protein, 20 aa, Mycobacterium
FPGYANYFPVTRAVPEPPSI

SEQ ID NO: 1348198 - protein, 18 aa, Mycobacterium
GATGNCWAVHTNCPVPGP

SEQ ID NO: 1348199 - protein, 29 aa, Mycobacterium
GFGTGLDWRPNPGIGFPGYANYFPVTRAV

SEQ ID NO: 1348200 - protein, 27 aa, Mycobacterium
GNMIKPMLARGELRLVGATTLDEYRKY

SEQ ID NO: 1348201 - protein, 17 aa, Mycobacterium
IAFGLVNVPVKVYSATE

SEQ ID NO: 1348202 - protein, 18 aa, Mycobacterium
IQSISLFGAKYVDLVYPP

SEQ ID NO: 1348203 - protein, 20 aa, Mycobacterium
KALAEFLFDDERAMVRIDMS

SEQ ID NO: 1348204 - protein, 19 aa, Mycobacterium
KERYEVHHGVRITDSALVS

SEQ ID NO: 1348205 - protein, 21 aa, Mycobacterium
KQDYKGLFLSFNLNLNVPPPC

SEQ ID NO: 1348206 - protein, 19 aa, Mycobacterium
LARLTRGATTLAIDTRNNL

SEQ ID NO: 1348207 - protein, 20 aa, Mycobacterium
LEGETAKLLRMEDELGKRVV

SEQ ID NO: 1348208 - protein, 19 aa, Mycobacterium
LNVPPPCRTGYLPAQQQRA

SEQ ID NO: 1348209 - protein, 17 aa, Mycobacterium
LQLAIFAMVTVVAGGSM

SEQ ID NO: 1348210 - protein, 17 aa, Mycobacterium
NELCPAQIWQLRQSAAG

SEQ ID NO: 1348211 - protein, 21 aa, Mycobacterium
NSEGLKNWLFGPLDGPPRNTA

SEQ ID NO: 1348212 - protein, 23 aa, Mycobacterium
PDRARELILEFADFTRYSFRAAG

SEQ ID NO: 1348213 - protein, 23 aa, Mycobacterium
PGPMPYPGAPPYGAPQYGPDGTP

SEQ ID NO: 1348214 - protein, 25 aa, Mycobacterium
PRNTPPHAWYIAFAPAQAPKVAVAV

SEQ ID NO: 1348215 - protein, 19 aa, Mycobacterium
PTGSFMFLGPTGVGKTELA

SEQ ID NO: 1348216 - protein, 17 aa, Mycobacterium
SLPDVAQNFPVRQLIAN

SEQ ID NO: 1348217 - protein, 29 aa, Mycobacterium
SMAFAYLRLPSLLFGVGRYQVTMKLQDAA

SEQ ID NO: 1348218 - protein, 18 aa, Mycobacterium
TDGAWPAFWLINDNPVRG

SEQ ID NO: 1348219 - protein, 23 aa, Mycobacterium
TNVRGARNLPCVTRPGKRAPTVK

SEQ ID NO: 1348220 - protein, 20 aa, Mycobacterium
TRGATTLAIDTRNNLPALTT

SEQ ID NO: 1348221 - protein, 18 aa, Mycobacterium
VQPTLPILLANLVSLGQV

SEQ ID NO: 1348222 - protein, 21 aa, Mycobacterium
AAAAAPVPWSPDPFRPDDPDP

SEQ ID NO: 1348223 - protein, 20 aa, Mycobacterium
AAAFADLINAIAIGIDGGIE

SEQ ID NO: 1348224 - protein, 20 aa, Mycobacterium
AAALPRPGTSEGRQLRRWLT

SEQ ID NO: 1348225 - protein, 25 aa, Mycobacterium
AACAALGMGIGLGIFVAAPTAGAEP

SEQ ID NO: 1348226 - protein, 20 aa, Mycobacterium
AAEERLRYLADHDDLTGLHN

SEQ ID NO: 1348227 - protein, 26 aa, Mycobacterium
AAEGLNRFAGILARSRDSLGRTLDTL

SEQ ID NO: 1348228 - protein, 17 aa, Mycobacterium
AAEGRYISVQGRDIHYV

SEQ ID NO: 1348229 - protein, 24 aa, Mycobacterium
AAELEAVSGWVARQPKVWWDTPQM

SEQ ID NO: 1348230 - protein, 18 aa, Mycobacterium
AAFPAVHLDPDVLYVDEG

SEQ ID NO: 1348231 - protein, 24 aa, Mycobacterium
AAGDQRPLLGIPIAVKDDVDIAGV

SEQ ID NO: 1348232 - protein, 24 aa, Mycobacterium
AAGGVLLRPFARLISSTGDSVTTY

SEQ ID NO: 1348233 - protein, 25 aa, Mycobacterium
AAGMLRATMPRAFRIAADGSATLNT

SEQ ID NO: 1348234 - protein, 25 aa, Mycobacterium
AAGRPGPVAVLFFDLDRLKAVNDYL

SEQ ID NO: 1348235 - protein, 19 aa, Mycobacterium
AAHPLRRPDVVAVAVPAHW

SEQ ID NO: 1348236 - protein, 17 aa, Mycobacterium
AAIMLWVTMNVDNSHPE

SEQ ID NO: 1348237 - protein, 19 aa, Mycobacterium
AALAARAGDHVDFLAHDRV

SEQ ID NO: 1348238 - protein, 19 aa, Mycobacterium
AALLAAPFGLAWYLHVRGL

SEQ ID NO: 1348239 - protein, 18 aa, Mycobacterium
AALRSFAIVGSRILSQTK

SEQ ID NO: 1348240 - protein, 17 aa, Mycobacterium
AALSAALDQTTLTTTVF

SEQ ID NO: 1348241 - protein, 17 aa, Mycobacterium
AAPDMALPPELGPAANS

SEQ ID NO: 1348242 - protein, 19 aa, Mycobacterium
AAPRCPDIEVIFARGTDEP

SEQ ID NO: 1348243 - protein, 20 aa, Mycobacterium
AAPVTLPWRRQFTVTADSRF

SEQ ID NO: 1348244 - protein, 22 aa, Mycobacterium
AAQRRIGWVFNICDVVLAPTTA

SEQ ID NO: 1348245 - protein, 18 aa, Mycobacterium
AARREFFEQIVVCDYDEA

SEQ ID NO: 1348246 - protein, 20 aa, Mycobacterium
AASGARYSYQVSRVAEGGKC

SEQ ID NO: 1348247 - protein, 18 aa, Mycobacterium
AASGIGWATARALAADGF

SEQ ID NO: 1348248 - protein, 23 aa, Mycobacterium
AATPPRPPVPSAPVTSSSQSVTP

SEQ ID NO: 1348249 - protein, 17 aa, Mycobacterium
AAVAALGVAAWGLSTVR

SEQ ID NO: 1348250 - protein, 20 aa, Mycobacterium
AAVAAMFAVPALALSACSPN

SEQ ID NO: 1348251 - protein, 19 aa, Mycobacterium
AAVDLRWDGDLVYARVSSR

SEQ ID NO: 1348252 - protein, 20 aa, Mycobacterium
ACTSMGGNLNIAIGQATTGI

SEQ ID NO: 1348253 - protein, 21 aa, Mycobacterium
ACVDTPRWVEWYDDGPRGRGN

SEQ ID NO: 1348254 - protein, 20 aa, Mycobacterium
ADAAVAYIRERGRLIVGLDI

SEQ ID NO: 1348255 - protein, 24 aa, Mycobacterium
ADAEARVLLARRFHNDAVRDTLAL

SEQ ID NO: 1348256 - protein, 23 aa, Mycobacterium
ADAQGAIAFNGLYPPGSTFKTIT

SEQ ID NO: 1348257 - protein, 17 aa, Mycobacterium
ADFVKRQNIGSFTLGPI

SEQ ID NO: 1348258 - protein, 23 aa, Mycobacterium
ADGRPADALREWAAERAPQLGIP

SEQ ID NO: 1348259 - protein, 31 aa, Mycobacterium
ADLRAAVARCVEGLPDRWIAIGVGAVDEVLT

SEQ ID NO: 1348260 - protein, 22 aa, Mycobacterium
ADLYRFVFTSSIATIGIADSGP

SEQ ID NO: 1348261 - protein, 20 aa, Mycobacterium
ADMRARVRAGDDPAVVAGEW

SEQ ID NO: 1348262 - protein, 24 aa, Mycobacterium
ADPDYTVGMSWNFLSRSTSGLLDW

SEQ ID NO: 1348263 - protein, 24 aa, Mycobacterium
ADQQYLYWNLSTWDDYQVKLMRTD

SEQ ID NO: 1348264 - protein, 22 aa, Mycobacterium
ADSPEGPWSAPITLVTSSKMPG

SEQ ID NO: 1348265 - protein, 24 aa, Mycobacterium
ADVVVCAAGFWGAELARQVDLVLP

SEQ ID NO: 1348266 - protein, 24 aa, Mycobacterium
AEALAGACTVVFAVPAQSLRSNLE

SEQ ID NO: 1348267 - protein, 19 aa, Mycobacterium
AEALRAAKNEPLGVLPVPN

SEQ ID NO: 1348268 - protein, 20 aa, Mycobacterium
AEAQAVFDKLDAVGIDLRDV

SEQ ID NO: 1348269 - protein, 20 aa, Mycobacterium
AEARAHFGFADDARVLLVFG

SEQ ID NO: 1348270 - protein, 28 aa, Mycobacterium
AEAVKASFDRRLAVDQGPAYMVADVESI

SEQ ID NO: 1348271 - protein, 18 aa, Mycobacterium
AEEVVEYRPYPPDDPNLQ

SEQ ID NO: 1348272 - protein, 25 aa, Mycobacterium
AEGISVNVTLIFSVERHRAVMDAYL

SEQ ID NO: 1348273 - protein, 17 aa, Mycobacterium
AEMLRRNGIPCDEVRKH

SEQ ID NO: 1348274 - protein, 18 aa, Mycobacterium
AEPAAWVITVARNRLRDR

SEQ ID NO: 1348275 - protein, 29 aa, Mycobacterium
AEPAFRLLQRRALRPPVAIDRLRRHTEDA

SEQ ID NO: 1348276 - protein, 23 aa, Mycobacterium
AEQIREFLGRLDVFTDELNQQRE

SEQ ID NO: 1348277 - protein, 25 aa, Mycobacterium
AERRAVASMVHLRWATNGLAVRPEN

SEQ ID NO: 1348278 - protein, 25 aa, Mycobacterium
AESALKPLIRALIRNLPKPLGKEGG

SEQ ID NO: 1348279 - protein, 18 aa, Mycobacterium
AESCCGFGGTFALKNADT

SEQ ID NO: 1348280 - protein, 18 aa, Mycobacterium
AETLPPGPERTSWLTFAV

SEQ ID NO: 1348281 - protein, 17 aa, Mycobacterium
AEVAEALTVPGGPDVVW

SEQ ID NO: 1348282 - protein, 26 aa, Mycobacterium
AEVMCMSSSLPTLFRNADGYRRRLTL

SEQ ID NO: 1348283 - protein, 18 aa, Mycobacterium
AFAAKGRDLALCARRVDR

SEQ ID NO: 1348284 - protein, 25 aa, Mycobacterium
AFHFQRARLSEQWGDQVRMVFYDQR

SEQ ID NO: 1348285 - protein, 19 aa, Mycobacterium
AFTAIRCVDAPYPTDPAAW

SEQ ID NO: 1348286 - protein, 19 aa, Mycobacterium
AGACAVLALSACGTDTPTE

SEQ ID NO: 1348287 - protein, 19 aa, Mycobacterium
AGARAAAVGMTGRIELTVD

SEQ ID NO: 1348288 - protein, 17 aa, Mycobacterium
AGAVALGLGVAVANGSG

SEQ ID NO: 1348289 - protein, 24 aa, Mycobacterium
AGDGFLAQLCVDWEAATAAAAEDG

SEQ ID NO: 1348290 - protein, 17 aa, Mycobacterium
AGFWTAPDPIATVDEVL

SEQ ID NO: 1348291 - protein, 23 aa, Mycobacterium
AGGGFWTTYSPFAPLLLTSADPT

SEQ ID NO: 1348292 - protein, 17 aa, Mycobacterium
AGGNYPAEMLIDWIRVF

SEQ ID NO: 1348293 - protein, 26 aa, Mycobacterium
AGGSAGAQRGFGRVGANGDGGAGARG

SEQ ID NO: 1348294 - protein, 18 aa, Mycobacterium
AGGTVLVLRRIRAEMDTW

SEQ ID NO: 1348295 - protein, 30 aa, Mycobacterium
AGIRGMGEAIAWKFTLDDLLVDVGVAGGVS

SEQ ID NO: 1348296 - protein, 28 aa, Mycobacterium
AGLESAGVPNAERWAEEVVEYRPYPPDD

SEQ ID NO: 1348297 - protein, 25 aa, Mycobacterium
AGLRPMTPDGLPLVEWLDERTLVAA

SEQ ID NO: 1348298 - protein, 19 aa, Mycobacterium
AGRCPDTRLVLGGYSLGAA

SEQ ID NO: 1348299 - protein, 22 aa, Mycobacterium
AGRGGGSIEIIARDEGSDCVIT

SEQ ID NO: 1348300 - protein, 25 aa, Mycobacterium
AGSECGRCRRTLRAIIEAHNVNGCP

SEQ ID NO: 1348301 - protein, 25 aa, Mycobacterium
AGTILGGGLLFTAGLGLANAQPVEA

SEQ ID NO: 1348302 - protein, 26 aa, Mycobacterium
AGWQLYKRLSTNTVVAYFSDTLALYP

SEQ ID NO: 1348303 - protein, 17 aa, Mycobacterium
AGYLCYTGKDLSTPRGW

SEQ ID NO: 1348304 - protein, 19 aa, Mycobacterium
AIETTPARKLREIRMALTL

SEQ ID NO: 1348305 - protein, 19 aa, Mycobacterium
AIHLVTLLEALPMQETLEA

SEQ ID NO: 1348306 - protein, 30 aa, Mycobacterium
AKAEYFTGTGLKGWFQRWFYTVAGQVPIDR

SEQ ID NO: 1348307 - protein, 24 aa, Mycobacterium
AKAVGNIEQVEWEKLAQIALAAAW

SEQ ID NO: 1348308 - protein, 26 aa, Mycobacterium
AKCDALRPLMDALRHTELTVVELDGV

SEQ ID NO: 1348309 - protein, 18 aa, Mycobacterium
AKGIPLVPVNAALNSPDV

SEQ ID NO: 1348310 - protein, 30 aa, Mycobacterium
AKGLGSSDRPGCPAATWCVSNAGGYRGSMN

SEQ ID NO: 1348311 - protein, 17 aa, Mycobacterium
AKLEGGEAFAVEEQPTE

SEQ ID NO: 1348312 - protein, 20 aa, Mycobacterium
AKSRVCFTMEEVRETVGELG

SEQ ID NO: 1348313 - protein, 18 aa, Mycobacterium
ALAEPVVVLPGLREVEAG

SEQ ID NO: 1348314 - protein, 19 aa, Mycobacterium
ALAGFVMGYNKLRAADVRV

SEQ ID NO: 1348315 - protein, 23 aa, Mycobacterium
ALEMRPALAESWEVSPDQRVWTF

SEQ ID NO: 1348316 - protein, 22 aa, Mycobacterium
ALGKRVCPMLVEPGKDFAKVVA

SEQ ID NO: 1348317 - protein, 17 aa, Mycobacterium
ALGPCVDERAALANSVR

SEQ ID NO: 1348318 - protein, 23 aa, Mycobacterium
ALINHFAVALGLEIDLEAGGEVE

SEQ ID NO: 1348319 - protein, 20 aa, Mycobacterium
ALPTPLPSPFGFVQQLPPVV

SEQ ID NO: 1348320 - protein, 26 aa, Mycobacterium
ALRNKTRLAALRVKDFSKRDVMMIHT

SEQ ID NO: 1348321 - protein, 18 aa, Mycobacterium
ALRPELAGEVGVRALRQR

SEQ ID NO: 1348322 - protein, 20 aa, Mycobacterium
ALRQRLGIHPVFKTVDTCAA

SEQ ID NO: 1348323 - protein, 28 aa, Mycobacterium
ALTDLDYYHVFLGLLGPADVKGQRATQQ

SEQ ID NO: 1348324 - protein, 18 aa, Mycobacterium
ALTLAVLASAVACSSTDD

SEQ ID NO: 1348325 - protein, 20 aa, Mycobacterium
ALVAAFAGWQLYKRLSTNTV

SEQ ID NO: 1348326 - protein, 26 aa, Mycobacterium
AMEQGCNGPCKGSVVALEPSTGKILA

SEQ ID NO: 1348327 - protein, 17 aa, Mycobacterium
AMPSMLPFTDDDFAPAW

SEQ ID NO: 1348328 - protein, 27 aa, Mycobacterium
AMRALRPGRRTELYWAARLTLVNRADD

SEQ ID NO: 1348329 - protein, 17 aa, Mycobacterium
ANAEFDFSGGYATVTVQ

SEQ ID NO: 1348330 - protein, 27 aa, Mycobacterium
ANGVDAPTLWPGLPIRPVKGEVLRLRW

SEQ ID NO: 1348331 - protein, 27 aa, Mycobacterium
ANLDSDPWVGIIGFPFVTQAMDHEFGE

SEQ ID NO: 1348332 - protein, 24 aa, Mycobacterium
ANMTGDWRSNVLLISTDNDLTNGL

SEQ ID NO: 1348333 - protein, 19 aa, Mycobacterium
ANNDFKPGFATALMNKDLG

SEQ ID NO: 1348334 - protein, 17 aa, Mycobacterium
ANPRASRTVPFVSKATA

SEQ ID NO: 1348335 - protein, 23 aa, Mycobacterium
ANYAKLIAFTQFVPVLSEMTDEL

SEQ ID NO: 1348336 - protein, 32 aa, Mycobacterium
APEASRICAEYLGPALRLLNFNYLPMPINAYL

SEQ ID NO: 1348337 - protein, 20 aa, Mycobacterium
APGQLPPVNAFWSLTMYEMP

SEQ ID NO: 1348338 - protein, 20 aa, Mycobacterium
APGRGPRLAPGSVLAIEPML

SEQ ID NO: 1348339 - protein, 21 aa, Mycobacterium
APIQIPESWSREVAKNVANLP

SEQ ID NO: 1348340 - protein, 20 aa, Mycobacterium
APLSTCAFWPVPPTSEPHEL

SEQ ID NO: 1348341 - protein, 29 aa, Mycobacterium
APPNLPKAFSGLLAAVGLAPLIANLPAAP

SEQ ID NO: 1348342 - protein, 22 aa, Mycobacterium
APWASFKIDFNLANIGGPSAGL

SEQ ID NO: 1348343 - protein, 19 aa, Mycobacterium
AQALTLWMSGREQLVPREL

SEQ ID NO: 1348344 - protein, 22 aa, Mycobacterium
AQMSGYRAGLLGSIAASCTAAW

SEQ ID NO: 1348345 - protein, 22 aa, Mycobacterium
AQNARIYLIDTVLDPAAAPDAV

SEQ ID NO: 1348346 - protein, 23 aa, Mycobacterium
AQPATGLVGPGCTAYAQQVPQGP

SEQ ID NO: 1348347 - protein, 19 aa, Mycobacterium
AQPGCPTCMPMTDRYTYGI

SEQ ID NO: 1348348 - protein, 17 aa, Mycobacterium
AQPQCPDVHWIGAAGSG

SEQ ID NO: 1348349 - protein, 26 aa, Mycobacterium
ARAFGIGVDYVIPGLTTVTGRVPAAD

SEQ ID NO: 1348350 - protein, 17 aa, Mycobacterium
ARETIRNPVEWDKPFNM

SEQ ID NO: 1348351 - protein, 26 aa, Mycobacterium
ARGPELPVEMVGGGVWEPGEWTDDTS

SEQ ID NO: 1348352 - protein, 21 aa, Mycobacterium
ARIPIGGLFGEITYPITSPLA

SEQ ID NO: 1348353 - protein, 18 aa, Mycobacterium
ARVAVNCVDRPPVKDRDK

SEQ ID NO: 1348354 - protein, 17 aa, Mycobacterium
ARVRRRAYRVVWLNPRA

SEQ ID NO: 1348355 - protein, 20 aa, Mycobacterium
ARWATEFSSGTGLDYRGVVA

SEQ ID NO: 1348356 - protein, 24 aa, Mycobacterium
ASFQRRIDMAAGPSYMLADVRDMQ

SEQ ID NO: 1348357 - protein, 23 aa, Mycobacterium
ASLAGLMPWHPDPVYSLGKHGVV

SEQ ID NO: 1348358 - protein, 20 aa, Mycobacterium
ASNLPPRRAVLVADVEGAAA

SEQ ID NO: 1348359 - protein, 23 aa, Mycobacterium
ASPRRAAEQLGFRAVVDPRDGLR

SEQ ID NO: 1348360 - protein, 28 aa, Mycobacterium
ASSDSTRQAFAWKPTHVGLIDDLEQGHY

SEQ ID NO: 1348361 - protein, 25 aa, Mycobacterium
ASTTSRFAGVTLRNIHAEVDADVGP

SEQ ID NO: 1348362 - protein, 22 aa, Mycobacterium
ATDIRASGAIGAIRYVSDRRPG

SEQ ID NO: 1348363 - protein, 18 aa, Mycobacterium
ATEPLKSRPVAVEGDEVV

SEQ ID NO: 1348364 - protein, 18 aa, Mycobacterium
ATGDRIGSMVINPGGPGE

SEQ ID NO: 1348365 - protein, 17 aa, Mycobacterium
ATGTGFRAPEGEYETIG

SEQ ID NO: 1348366 - protein, 18 aa, Mycobacterium
ATIRAAIMAGARAAGGGA

SEQ ID NO: 1348367 - protein, 22 aa, Mycobacterium
ATLAETLCKPALDEALAGQTPS

SEQ ID NO: 1348368 - protein, 17 aa, Mycobacterium
ATLDRFERYMALADPTL

SEQ ID NO: 1348369 - protein, 26 aa, Mycobacterium
ATLNRLTTTIPWMFVAGPAGVSEREY

SEQ ID NO: 1348370 - protein, 29 aa, Mycobacterium
ATPLPAEHGFRFFPGFYRNVTDTMRRIPF

SEQ ID NO: 1348371 - protein, 25 aa, Mycobacterium
ATSAPRCVGNTLLLNGRTYSPPYVI

SEQ ID NO: 1348372 - protein, 18 aa, Mycobacterium
ATTDEFVFTVGKMQLIAL

SEQ ID NO: 1348373 - protein, 21 aa, Mycobacterium
AVADSFYLPLVVSRRITFLAK

SEQ ID NO: 1348374 - protein, 27 aa, Mycobacterium
AVERARPVLEPMAGKVVHCGASGTGQA

SEQ ID NO: 1348375 - protein, 31 aa, Mycobacterium
AVGADFGTAIYAEYRWSRTLRDVANLDSDPW

SEQ ID NO: 1348376 - protein, 22 aa, Mycobacterium
AVGDDRGAGWLAAHTAGTGPYE

SEQ ID NO: 1348377 - protein, 18 aa, Mycobacterium
AVGDLEFWEQLTDLMRDT

SEQ ID NO: 1348378 - protein, 19 aa, Mycobacterium
AVGLPAVYVPLPIGNGEQR

SEQ ID NO: 1348379 - protein, 17 aa, Mycobacterium
AVGVQFGGLGGDFGQDD

SEQ ID NO: 1348380 - protein, 19 aa, Mycobacterium
AVIDLDFDGVFRFNSDLVD

SEQ ID NO: 1348381 - protein, 18 aa, Mycobacterium
AVLEHVRSFGLQERFVGG

SEQ ID NO: 1348382 - protein, 17 aa, Mycobacterium
AVLLDLAHACLIRPAVD

SEQ ID NO: 1348383 - protein, 28 aa, Mycobacterium
AVPLAKACARIMLGASIAQLREEGVLAA

SEQ ID NO: 1348384 - protein, 23 aa, Mycobacterium
AVRRRPYTVVLFDEIEKAHPDVF

SEQ ID NO: 1348385 - protein, 18 aa, Mycobacterium
AVTAGLAACGLAFALTAC

SEQ ID NO: 1348386 - protein, 26 aa, Mycobacterium
AVVLVDRGECPFGVKQAVAAQRGAVA

SEQ ID NO: 1348387 - protein, 21 aa, Mycobacterium
AWAAQCVAIGCPAAPDPKGVV

SEQ ID NO: 1348388 - protein, 25 aa, Mycobacterium
AWALSALLALGSRRELERSVATRSV

SEQ ID NO: 1348389 - protein, 17 aa, Mycobacterium
AYCAAKAGLSMLTQVAA

SEQ ID NO: 1348390 - protein, 25 aa, Mycobacterium
AYVRARPRLKFYAYYEGTAQLVNGR

SEQ ID NO: 1348391 - protein, 17 aa, Mycobacterium
CAAVRSGSVLGIVDLKQ

SEQ ID NO: 1348392 - protein, 22 aa, Mycobacterium
CAQTIAWYLAMTYRSQGNEEGA

SEQ ID NO: 1348393 - protein, 21 aa, Mycobacterium
CGAIGAAIWLWVKRRQLAVAA

SEQ ID NO: 1348394 - protein, 28 aa, Mycobacterium
CGGSDAWNLPAVFGPIAITYNLEGVDGV

SEQ ID NO: 1348395 - protein, 22 aa, Mycobacterium
CHRAQGFLLSRPVPGEQMERLL

SEQ ID NO: 1348396 - protein, 19 aa, Mycobacterium
CINLSPANAQWFFDNFGSG

SEQ ID NO: 1348397 - protein, 19 aa, Mycobacterium
CNEKIKFSALAGRALALGF

SEQ ID NO: 1348398 - protein, 17 aa, Mycobacterium
CPAHGPVDPLPRTRADL

SEQ ID NO: 1348399 - protein, 17 aa, Mycobacterium
CPDVHWIGAAGSGERGA

SEQ ID NO: 1348400 - protein, 19 aa, Mycobacterium
CSQSPRAGGSIGAKTSIVV

SEQ ID NO: 1348401 - protein, 17 aa, Mycobacterium
CTLDHPDGWAFNQVGGL

SEQ ID NO: 1348402 - protein, 20 aa, Mycobacterium
CVDERAALANSVRPNAIVSV

SEQ ID NO: 1348403 - protein, 21 aa, Mycobacterium
CVDRMGVEFLANVGTAAAARD

SEQ ID NO: 1348404 - protein, 20 aa, Mycobacterium
DADVPYTRIHEFRHFHPERA

SEQ ID NO: 1348405 - protein, 21 aa, Mycobacterium
DAGDLLGVLAVVTTRDPGPGM

SEQ ID NO: 1348406 - protein, 20 aa, Mycobacterium
DAPLTVVFAHGFCLRMGAFH

SEQ ID NO: 1348407 - protein, 19 aa, Mycobacterium
DAPSPYTWGHISWDADGGL

SEQ ID NO: 1348408 - protein, 19 aa, Mycobacterium
DARTRAALRNTLQDNRFGE

SEQ ID NO: 1348409 - protein, 24 aa, Mycobacterium
DASPRAVAFQAFVEELWAHQQPGG

SEQ ID NO: 1348410 - protein, 24 aa, Mycobacterium
DASVVCGGVKTANATVYLIDTVLM

SEQ ID NO: 1348411 - protein, 25 aa, Mycobacterium
DDHPELRPLVDLLPIAGGSGTLSNR

SEQ ID NO: 1348412 - protein, 19 aa, Mycobacterium
DDPFRVAGMVATDGPTGLR

SEQ ID NO: 1348413 - protein, 20 aa, Mycobacterium
DDRLSRWLPDVPHADRVTLG

SEQ ID NO: 1348414 - protein, 29 aa, Mycobacterium
DDVAFMFIAAPFVPNGGVYSRFPGLRLPG

SEQ ID NO: 1348415 - protein, 23 aa, Mycobacterium
DEARELLDAPVLGIAQAAMHGAA

SEQ ID NO: 1348416 - protein, 17 aa, Mycobacterium
DEHRCVPHLLDVLRDAC

SEQ ID NO: 1348417 - protein, 21 aa, Mycobacterium
DEPPVRVAAAAFDDPAVLDTA

SEQ ID NO: 1348418 - protein, 19 aa, Mycobacterium
DESLRLAVTPSNDYWYLAL

SEQ ID NO: 1348419 - protein, 24 aa, Mycobacterium
DETACDAWVGRIRCGDMDRVTLFR

SEQ ID NO: 1348420 - protein, 18 aa, Mycobacterium
DFFSVVKSLALFVNALYR

SEQ ID NO: 1348421 - protein, 20 aa, Mycobacterium
DFTRYSFRAAGQYTTLAEEL

SEQ ID NO: 1348422 - protein, 19 aa, Mycobacterium
DFYVTVPIDALPLLEPTYL

SEQ ID NO: 1348423 - protein, 18 aa, Mycobacterium
DGALARRNLVLDTMIENL

SEQ ID NO: 1348424 - protein, 40 aa, Mycobacterium
DGDRLDVLDPEFLESIGAIRQDWLSSIEELQRLFNDVSNT

SEQ ID NO: 1348425 - protein, 20 aa, Mycobacterium
DGGVHMDSMLGGNPVIQLSA

SEQ ID NO: 1348426 - protein, 18 aa, Mycobacterium
DGLRDCVSSALSVQNTVE

SEQ ID NO: 1348427 - protein, 19 aa, Mycobacterium
DGLSGEWTIFPSCVPTVGD

SEQ ID NO: 1348428 - protein, 23 aa, Mycobacterium
DGLWPTLVGFAMRDSGGFDATAM

SEQ ID NO: 1348429 - protein, 17 aa, Mycobacterium
DGPHVVTGPIFVEGAEP

SEQ ID NO: 1348430 - protein, 18 aa, Mycobacterium
DGRQLVIRDVLFDALSTR

SEQ ID NO: 1348431 - protein, 32 aa, Mycobacterium
DGSAWYRRPGALFAGAACLAALAATGLILTSQ

SEQ ID NO: 1348432 - protein, 23 aa, Mycobacterium
DGTEASMWWDFSGLTISDVTIHN

SEQ ID NO: 1348433 - protein, 28 aa, Mycobacterium
DGTNRWPAVHRLDAAALFRRAVEDAPAG

SEQ ID NO: 1348434 - protein, 24 aa, Mycobacterium
DGTRRGSPEFFDWMNGGKHCITVD

SEQ ID NO: 1348435 - protein, 21 aa, Mycobacterium
DGTVKDCLSAIISDWTTAGNF

SEQ ID NO: 1348436 - protein, 18 aa, Mycobacterium
DHAARAYINAGMVNQAAD

SEQ ID NO: 1348437 - protein, 28 aa, Mycobacterium
DHRNGGVVLLMWAGILAYLDRCGYDYVT

SEQ ID NO: 1348438 - protein, 24 aa, Mycobacterium
DIAEVVSAWTGIPAGRMLEGETAK

SEQ ID NO: 1348439 - protein, 31 aa, Mycobacterium
DIFEGLRTSTRWDFTLGNPLGTGGQWAIPWG

SEQ ID NO: 1348440 - protein, 20 aa, Mycobacterium
DKPTRFSLITPPDRIIETAA

SEQ ID NO: 1348441 - protein, 35 aa, Mycobacterium
DKTILQAIELWKIVDRPNLLIKIPATEAGLPAITA

SEQ ID NO: 1348442 - protein, 18 aa, Mycobacterium
DLAARLWDLPAWAAQGRR

SEQ ID NO: 1348443 - protein, 30 aa, Mycobacterium
DLQQPEWKGRWGAPPAKADFQAIVAALLQL

SEQ ID NO: 1348444 - protein, 24 aa, Mycobacterium
DLTVSIPTPPGWQPYPGTQFEPGT

SEQ ID NO: 1348445 - protein, 19 aa, Mycobacterium
DNNIELVWNSANLDVSTQA

SEQ ID NO: 1348446 - protein, 24 aa, Mycobacterium
DNRFGELREGVWLRPDNLDTALPE

SEQ ID NO: 1348447 - protein, 17 aa, Mycobacterium
DPAFGQVACKLGRTTGY

SEQ ID NO: 1348448 - protein, 18 aa, Mycobacterium
DPEEARVLLFDGGDRVLK

SEQ ID NO: 1348449 - protein, 18 aa, Mycobacterium
DPFRAEVPNWKTFVNQPV

SEQ ID NO: 1348450 - protein, 25 aa, Mycobacterium
DPFRAFAEALGRRDAKAAAQQTDDP

SEQ ID NO: 1348451 - protein, 22 aa, Mycobacterium
DPKNRAAVLAAIDVDALVKQTY

SEQ ID NO: 1348452 - protein, 26 aa, Mycobacterium
DPTSHCAREGDTFRLLGNARWLPFVI

SEQ ID NO: 1348453 - protein, 28 aa, Mycobacterium
DPVDGYRAPLCLLTRPAAEALRRAQQEF

SEQ ID NO: 1348454 - protein, 24 aa, Mycobacterium
DQARRIAADIGYPVLVRPSYVLGG

SEQ ID NO: 1348455 - protein, 17 aa, Mycobacterium
DQPHFRCELAVDGVVVA

SEQ ID NO: 1348456 - protein, 27 aa, Mycobacterium
DQTLAYRWTLAPGREFGYEATGTAEQS

SEQ ID NO: 1348457 - protein, 24 aa, Mycobacterium
DRAPEWSYSAMIFADPAMAEDPPT

SEQ ID NO: 1348458 - protein, 18 aa, Mycobacterium
DRDRLVVIIAGYSADIDR

SEQ ID NO: 1348459 - protein, 19 aa, Mycobacterium
DRDYGYLGIGVIDAPWASF

SEQ ID NO: 1348460 - protein, 19 aa, Mycobacterium
DSAITFGVGPLIPVDEALS

SEQ ID NO: 1348461 - protein, 17 aa, Mycobacterium
DTMLALADLYMRRDAQG

SEQ ID NO: 1348462 - protein, 20 aa, Mycobacterium
DTNLCTLGFVDVQQRVAYTA

SEQ ID NO: 1348463 - protein, 25 aa, Mycobacterium
DTYAKAKNIELVWNSANNDVSTQAS

SEQ ID NO: 1348464 - protein, 17 aa, Mycobacterium
DVTLPIVDPTTFERESR

SEQ ID NO: 1348465 - protein, 24 aa, Mycobacterium
DYDEGRLGWRTLDFELEVLETGDF

SEQ ID NO: 1348466 - protein, 24 aa, Mycobacterium
DYKEKLAELTTRWQNEKNAIDIVR

SEQ ID NO: 1348467 - protein, 23 aa, Mycobacterium
DYVRPGSDVELLFVATNDSPDQP

SEQ ID NO: 1348468 - protein, 20 aa, Mycobacterium
EADLPPCPPPGVGAGPESLR

SEQ ID NO: 1348469 - protein, 19 aa, Mycobacterium
EAFARSCNTAFVELGTDTG

SEQ ID NO: 1348470 - protein, 22 aa, Mycobacterium
EAFSGNGYMLLGLQIDGLASRY

SEQ ID NO: 1348471 - protein, 24 aa, Mycobacterium
EAGVKRIVYLGGFVPTDETLSEHL

SEQ ID NO: 1348472 - protein, 25 aa, Mycobacterium
EAHCTRLGVRWAPPVDDLAAVDDVD

SEQ ID NO: 1348473 - protein, 20 aa, Mycobacterium
EAMLAIGCIQALKCHTDTCP

SEQ ID NO: 1348474 - protein, 20 aa, Mycobacterium
EARYQRGFGIVDGYGGHGIG

SEQ ID NO: 1348475 - protein, 25 aa, Mycobacterium
EAVAESIGGIGLRCDVTDPEQVDSA

SEQ ID NO: 1348476 - protein, 17 aa, Mycobacterium
EAVLGRHLAAVAAGSAF

SEQ ID NO: 1348477 - protein, 26 aa, Mycobacterium
EAVNKMKNWISGFGPQINGVVAENDD

SEQ ID NO: 1348478 - protein, 19 aa, Mycobacterium
EAYAKDNNIELVWNSANLD

SEQ ID NO: 1348479 - protein, 26 aa, Mycobacterium
EDAAPHWPRRRTLRRRPHPRGDRIDL

SEQ ID NO: 1348480 - protein, 17 aa, Mycobacterium
EDLRLLGQWLEDAAPHW

SEQ ID NO: 1348481 - protein, 20 aa, Mycobacterium
EDPPTIIALMSKLTGPADPA

SEQ ID NO: 1348482 - protein, 17 aa, Mycobacterium
EDSRPGTAIALRDKDLE

SEQ ID NO: 1348483 - protein, 28 aa, Mycobacterium
EDTGSITYRYTWHLPKERTWTYDGQLNM

SEQ ID NO: 1348484 - protein, 28 aa, Mycobacterium
EELKAAGARVQRPLWASTGVKNPDYSDT

SEQ ID NO: 1348485 - protein, 17 aa, Mycobacterium
EELRSARSVQELISLVR

SEQ ID NO: 1348486 - protein, 21 aa, Mycobacterium
EESIFGWKEYELELMRDRHDN

SEQ ID NO: 1348487 - protein, 30 aa, Mycobacterium
EFLNRTEGLPGLKEKYGLDIAPSNFVAISD

SEQ ID NO: 1348488 - protein, 23 aa, Mycobacterium
EFMAARINGLGWLNEIRADRVPN

SEQ ID NO: 1348489 - protein, 21 aa, Mycobacterium
EFMSALLHRAASPAVLLNPLR

SEQ ID NO: 1348490 - protein, 17 aa, Mycobacterium
EFVNFGPSWAWPKPVQA

SEQ ID NO: 1348491 - protein, 33 aa, Mycobacterium
EGSLELGYQIGFPWSLGVGINFSYTTPNIAFDG

SEQ ID NO: 1348492 - protein, 19 aa, Mycobacterium
EIAARYLIDVVVPPPDTRC

SEQ ID NO: 1348493 - protein, 19 aa, Mycobacterium
EIHEPLWIKQNFQHGTLNF

SEQ ID NO: 1348494 - protein, 29 aa, Mycobacterium
EILKNPALEAVRFAARYAPGTVHRTRGVA

SEQ ID NO: 1348495 - protein, 17 aa, Mycobacterium
EILNFALRYAPVLPSER

SEQ ID NO: 1348496 - protein, 18 aa, Mycobacterium
EKGIPLLAVNAALETPDL

SEQ ID NO: 1348497 - protein, 17 aa, Mycobacterium
ELAKALAEFLFDDERAM

SEQ ID NO: 1348498 - protein, 18 aa, Mycobacterium
ELARELGVRVQQGVQQGI

SEQ ID NO: 1348499 - protein, 19 aa, Mycobacterium
ELESLLAGPLAGFVDTVLD

SEQ ID NO: 1348500 - protein, 27 aa, Mycobacterium
ELLDAPVLDGTLLRRAKNSGLSDRQIA

SEQ ID NO: 1348501 - protein, 31 aa, Mycobacterium
ELLQKYARLAGRWRAPLPVRGIDTSVVAQLS

SEQ ID NO: 1348502 - protein, 22 aa, Mycobacterium
ELRKRLTGLLGAFRAFSYGSLY

SEQ ID NO: 1348503 - protein, 35 aa, Mycobacterium
ELRNFLADKVVRWWLPERWTFVDEIPRTSVGKYDK

SEQ ID NO: 1348504 - protein, 20 aa, Mycobacterium
EMLILVIAGLVILGPERLPG

SEQ ID NO: 1348505 - protein, 26 aa, Mycobacterium
ENSWRVNCLGPFLGIQAVLEHLKAAD

SEQ ID NO: 1348506 - protein, 28 aa, Mycobacterium
ENTIGWDRGELLPALRAANGDMGVAMVL

SEQ ID NO: 1348507 - protein, 19 aa, Mycobacterium
EPAMQWIADRFKGVPTASN

SEQ ID NO: 1348508 - protein, 19 aa, Mycobacterium
EPGFHGMHVHQVGKCEPNS

SEQ ID NO: 1348509 - protein, 19 aa, Mycobacterium
EPGTNWSYAHTNYVLLGLA

SEQ ID NO: 1348510 - protein, 25 aa, Mycobacterium
EPPTRIIYLQHGFLANGTMYSHTAA

SEQ ID NO: 1348511 - protein, 23 aa, Mycobacterium
EQMPTPCQWLFAESQTFGDEVEE

SEQ ID NO: 1348512 - protein, 21 aa, Mycobacterium
EQVVKRAAPDMALPPELGPAA

SEQ ID NO: 1348513 - protein, 21 aa, Mycobacterium
ERLPGAIRWTSNALRQARDYV

SEQ ID NO: 1348514 - protein, 22 aa, Mycobacterium
ERRRAAPFYGARLKNWTEQCLL

SEQ ID NO: 1348515 - protein, 25 aa, Mycobacterium
ESAELCAQYLAPILDALKFNFPPFG

SEQ ID NO: 1348516 - protein, 29 aa, Mycobacterium
ESDGLPLVRPLRLLPGGDIVADAIEPTLT

SEQ ID NO: 1348517 - protein, 24 aa, Mycobacterium
ESGRITSVLALADLIGGARPGQYG

SEQ ID NO: 1348518 - protein, 22 aa, Mycobacterium
ETIRNPVEWDKPFNMGRYVTDQ

SEQ ID NO: 1348519 - protein, 28 aa, Mycobacterium
ETLMSWNSSEFDGMFCGIDTIDLVNAGF

SEQ ID NO: 1348520 - protein, 26 aa, Mycobacterium
ETLTKFMFRHLQPYFNQDIFAVVEQE

SEQ ID NO: 1348521 - protein, 19 aa, Mycobacterium
EVPNWKTFVNQPVSQVLAQ

SEQ ID NO: 1348522 - protein, 24 aa, Mycobacterium
EVPPVRAGGTWDALAQCEAGGNWS

SEQ ID NO: 1348523 - protein, 24 aa, Mycobacterium
EVVDVCLTGGFVVAKHAGRQLREG

SEQ ID NO: 1348524 - protein, 25 aa, Mycobacterium
EVVEALRPMMRLVVTNGTAKDLAGA

SEQ ID NO: 1348525 - protein, 18 aa, Mycobacterium
EVVLDPASPWVFDTTLVD

SEQ ID NO: 1348526 - protein, 18 aa, Mycobacterium
EVVRRLRAAGAVIVGKTN

SEQ ID NO: 1348527 - protein, 27 aa, Mycobacterium
EWTIFPSCVPTVGDLREPLYLPVACRL

SEQ ID NO: 1348528 - protein, 19 aa, Mycobacterium
EYLGKYVVLYGDGNNNIRL

SEQ ID NO: 1348529 - protein, 19 aa, Mycobacterium
FAAPMPAAVVPRIAAVTVF

SEQ ID NO: 1348530 - protein, 23 aa, Mycobacterium
FADDARVLLVFGGSQGARSLNNV

SEQ ID NO: 1348531 - protein, 17 aa, Mycobacterium
FAETEQAWIPIGLSDPD

SEQ ID NO: 1348532 - protein, 17 aa, Mycobacterium
FAGPYLITGQSLLVRND

SEQ ID NO: 1348533 - protein, 24 aa, Mycobacterium
FAKLPPEQLEALKANPAALTDLDY

SEQ ID NO: 1348534 - protein, 23 aa, Mycobacterium
FAPNEIKNLPGYENLGDGSESEL

SEQ ID NO: 1348535 - protein, 19 aa, Mycobacterium
FASPLSYPLVADRLPPLLA

SEQ ID NO: 1348536 - protein, 20 aa, Mycobacterium
FATYPVEDHIAFLLKDDFDD

SEQ ID NO: 1348537 - protein, 19 aa, Mycobacterium
FDAQIAPRVLRDTLGGKSV

SEQ ID NO: 1348538 - protein, 20 aa, Mycobacterium
FDPTPGLFTEMTWELGDEVA

SEQ ID NO: 1348539 - protein, 20 aa, Mycobacterium
FEPHNPWPFGGPRPLLVYGP

SEQ ID NO: 1348540 - protein, 18 aa, Mycobacterium
FEPTLDYVVVKAPRFAFE

SEQ ID NO: 1348541 - protein, 18 aa, Mycobacterium
FETGLAWVSAAQALSQIG

SEQ ID NO: 1348542 - protein, 17 aa, Mycobacterium
FFAGIAIQMYCPQMVSS

SEQ ID NO: 1348543 - protein, 21 aa, Mycobacterium
FFNTGEFNFGVGNTGVGNVGF

SEQ ID NO: 1348544 - protein, 18 aa, Mycobacterium
FGGLQFKPTTWSSHGGRG

SEQ ID NO: 1348545 - protein, 17 aa, Mycobacterium
FGLAGCGSESSDTNTPT

SEQ ID NO: 1348546 - protein, 17 aa, Mycobacterium
FLPNQTRLLDALKSTVA

SEQ ID NO: 1348547 - protein, 20 aa, Mycobacterium
FLSRSTSGLLDWAERLGYGV

SEQ ID NO: 1348548 - protein, 20 aa, Mycobacterium
FMSVKSWDTPGRWTTNYSAI

SEQ ID NO: 1348549 - protein, 25 aa, Mycobacterium
FNFPSNGTHAWGYWGQQLQQMKPDI

SEQ ID NO: 1348550 - protein, 21 aa, Mycobacterium
FNSLRIEKGYRSWGTDMTTEH

SEQ ID NO: 1348551 - protein, 26 aa, Mycobacterium
FPASDIRILYGLGCREFAESREQEAS

SEQ ID NO: 1348552 - protein, 21 aa, Mycobacterium
FPVPDIRVTGVTLRGQDALPG

SEQ ID NO: 1348553 - protein, 18 aa, Mycobacterium
FQAETGQTPMQWVTGVRV

SEQ ID NO: 1348554 - protein, 18 aa, Mycobacterium
FRAFSYGSLYPALRRMQV

SEQ ID NO: 1348555 - protein, 19 aa, Mycobacterium
FREAAPFLSYGPFTGYAPR

SEQ ID NO: 1348556 - protein, 25 aa, Mycobacterium
FSADNPFGVPALLRAAGDHLAAGDL

SEQ ID NO: 1348557 - protein, 23 aa, Mycobacterium
FSSILRRCDFSTRPYYDSAGSAR

SEQ ID NO: 1348558 - protein, 17 aa, Mycobacterium
FTAALGRAVNRPTPLTV

SEQ ID NO: 1348559 - protein, 17 aa, Mycobacterium
FTAGLGLANAQPVEAPE

SEQ ID NO: 1348560 - protein, 25 aa, Mycobacterium
FTALFRPGLDVLHADLPVTGGSDGY

SEQ ID NO: 1348561 - protein, 18 aa, Mycobacterium
FTEFTGYQHRVFALHNGQ

SEQ ID NO: 1348562 - protein, 24 aa, Mycobacterium
FTEPQCPHCAALQADFGSELASYV

SEQ ID NO: 1348563 - protein, 21 aa, Mycobacterium
FTHPDVNAFFTGLKGLPKEEV

SEQ ID NO: 1348564 - protein, 25 aa, Mycobacterium
FTLLKVLGTDLGWVPTLPNSVADDV

SEQ ID NO: 1348565 - protein, 17 aa, Mycobacterium
FTRFEGLAGNRFIERAV

SEQ ID NO: 1348566 - protein, 18 aa, Mycobacterium
FVGVQYPAELPVDPSVAA

SEQ ID NO: 1348567 - protein, 21 aa, Mycobacterium
FVMGYNKLRAADVRVAEALAG

SEQ ID NO: 1348568 - protein, 17 aa, Mycobacterium
FVYDFLDPVVNDALNPA

SEQ ID NO: 1348569 - protein, 19 aa, Mycobacterium
FYNLGLAGRAMRRIGAVEF

SEQ ID NO: 1348570 - protein, 19 aa, Mycobacterium
GAAVIDMLAGVPPLGNRIG

SEQ ID NO: 1348571 - protein, 18 aa, Mycobacterium
GADSSFLAPNPRAGGDGT

SEQ ID NO: 1348572 - protein, 25 aa, Mycobacterium
GAIYDAWGSLGFERGALGLPTSGEI

SEQ ID NO: 1348573 - protein, 24 aa, Mycobacterium
GAPPADLKALFPFIDGSMLVGAVG

SEQ ID NO: 1348574 - protein, 23 aa, Mycobacterium
GASPNFAGALLIADGDRLPTDPT

SEQ ID NO: 1348575 - protein, 19 aa, Mycobacterium
GATGPVPAVAWIEEEGSHN

SEQ ID NO: 1348576 - protein, 18 aa, Mycobacterium
GAYFIWQYGPPGWIEDLN

SEQ ID NO: 1348577 - protein, 28 aa, Mycobacterium
GAYLPGRGNGAGWGVRLLQVHDLDVANI

SEQ ID NO: 1348578 - protein, 19 aa, Mycobacterium
GDDCTPSALPRSDRDNEYL

SEQ ID NO: 1348579 - protein, 19 aa, Mycobacterium
GDIIREFNATLNGREDKLR

SEQ ID NO: 1348580 - protein, 17 aa, Mycobacterium
GDPAPSVTISLDRAVQT

SEQ ID NO: 1348581 - protein, 24 aa, Mycobacterium
GDTYPIAMLLVFELTGQFDPAEAI

SEQ ID NO: 1348582 - protein, 21 aa, Mycobacterium
GEAAMAVPLEPGRQTVGFSVT

SEQ ID NO: 1348583 - protein, 17 aa, Mycobacterium
GEADRPFDPNYHKKEDD

SEQ ID NO: 1348584 - protein, 17 aa, Mycobacterium
GEDGVRYLYAFGTPSGR

SEQ ID NO: 1348585 - protein, 29 aa, Mycobacterium
GEGGISRFHRCGGELIFQIGTAYFGCRDD

SEQ ID NO: 1348586 - protein, 25 aa, Mycobacterium
GEIVCPCHGSRFGLDGSVVKGPATE

SEQ ID NO: 1348587 - protein, 22 aa, Mycobacterium
GELGLPVVVRPSFTMGGLGSGM

SEQ ID NO: 1348588 - protein, 25 aa, Mycobacterium
GEPVKAIRVAEQWTEPDDWQQPRPT

SEQ ID NO: 1348589 - protein, 18 aa, Mycobacterium
GESSFLMYRKDLFEQAGI

SEQ ID NO: 1348590 - protein, 25 aa, Mycobacterium
GEVDGGVIYHYYWFRDQSKTKEISG

SEQ ID NO: 1348591 - protein, 31 aa, Mycobacterium
GEVLRTAGLPAPRFGLATTFDQARRIAADIG

SEQ ID NO: 1348592 - protein, 23 aa, Mycobacterium
GEYETIGGLVLQELGHIPEVGDS

SEQ ID NO: 1348593 - protein, 29 aa, Mycobacterium
GFTALATAGACWIVQLFNPATAIADPGAV

SEQ ID NO: 1348594 - protein, 17 aa, Mycobacterium
GGAPGNFNSAGGHFQTE

SEQ ID NO: 1348595 - protein, 24 aa, Mycobacterium
GGDETWSALATMILPVGGAPYVVM

SEQ ID NO: 1348596 - protein, 24 aa, Mycobacterium
GGEGAKGWTTRAWQLLAAQGLPVR

SEQ ID NO: 1348597 - protein, 18 aa, Mycobacterium
GGGARIPIVTQRLSEALR

SEQ ID NO: 1348598 - protein, 19 aa, Mycobacterium
GGGLAGLASAVWLAEAGRD

SEQ ID NO: 1348599 - protein, 21 aa, Mycobacterium
GGGPTAPLREAFARSCNTAFV

SEQ ID NO: 1348600 - protein, 18 aa, Mycobacterium
GGGYTWTSPLYQLLGPAA

SEQ ID NO: 1348601 - protein, 25 aa, Mycobacterium
GGLLSRLKPLFGLGLGARLGNGRQY

SEQ ID NO: 1348602 - protein, 25 aa, Mycobacterium
GGLQVKTIWAARAIGVMFPEIKTIG

SEQ ID NO: 1348603 - protein, 24 aa, Mycobacterium
GGNLPGDLTFSWYAVDHTGQPWVV

SEQ ID NO: 1348604 - protein, 17 aa, Mycobacterium
GGSVMRAAAAAGREVFG

SEQ ID NO: 1348605 - protein, 29 aa, Mycobacterium
GGTLRVSNWPLYMADGFVAAFQTASGITV

SEQ ID NO: 1348606 - protein, 17 aa, Mycobacterium
GGTWFIDTMVIPYTTQN

SEQ ID NO: 1348607 - protein, 27 aa, Mycobacterium
GGVYSRFPGLRLPGFTSTGAAAPSPYD

SEQ ID NO: 1348608 - protein, 18 aa, Mycobacterium
GHDLRYAIDPSVLYDELG

SEQ ID NO: 1348609 - protein, 22 aa, Mycobacterium
GHGRNGFLLAPWTAERVSAELQ

SEQ ID NO: 1348610 - protein, 18 aa, Mycobacterium
GHTVRGFDPVPALRTAAE

SEQ ID NO: 1348611 - protein, 19 aa, Mycobacterium
GIDTIDLVNAGFCLEENTI

SEQ ID NO: 1348612 - protein, 19 aa, Mycobacterium
GIHPVFKTVDTCAAEFEAK

SEQ ID NO: 1348613 - protein, 17 aa, Mycobacterium
GIRVNAVAPGFVHTPLT

SEQ ID NO: 1348614 - protein, 24 aa, Mycobacterium
GISYQRFGPNAAMYYHGGELPGFN

SEQ ID NO: 1348615 - protein, 18 aa, Mycobacterium
GKFLEGLVELTEKNLETG

SEQ ID NO: 1348616 - protein, 48 aa, Mycobacterium
GKGQHRRKAEGPRVLPVSGWLSAGAVTVAMGAAMIAGAGLAQADSTSG

SEQ ID NO: 1348617 - protein, 22 aa, Mycobacterium
GKHDAFMLGAYFIWQYGPPGWI

SEQ ID NO: 1348618 - protein, 19 aa, Mycobacterium
GKQRFAELVADTGPQNYSD

SEQ ID NO: 1348619 - protein, 25 aa, Mycobacterium
GKRSKRIGHQYGWPVANRDRAAHSR

SEQ ID NO: 1348620 - protein, 19 aa, Mycobacterium
GKSGDGYLDPGQQGGNGGE

SEQ ID NO: 1348621 - protein, 18 aa, Mycobacterium
GKVVHCGASGTGQAAKLC

SEQ ID NO: 1348622 - protein, 18 aa, Mycobacterium
GLAANPRFATDNGARPQG

SEQ ID NO: 1348623 - protein, 19 aa, Mycobacterium
GLAEIMRLGIALGAKPATL

SEQ ID NO: 1348624 - protein, 17 aa, Mycobacterium
GLARLALETGMPVIPVA

SEQ ID NO: 1348625 - protein, 18 aa, Mycobacterium
GLDSLRLWHGGFLEGLPD

SEQ ID NO: 1348626 - protein, 26 aa, Mycobacterium
GLLDGRRATTHWMAADAFRAAFPAVH

SEQ ID NO: 1348627 - protein, 25 aa, Mycobacterium
GLNKGWKQIIAPGVQSFPDQIGGYY

SEQ ID NO: 1348628 - protein, 20 aa, Mycobacterium
GLPTCVVKYIPLHTPAVTMS

SEQ ID NO: 1348629 - protein, 24 aa, Mycobacterium
GLSYACAAYGASVLVLPEASREAV

SEQ ID NO: 1348630 - protein, 17 aa, Mycobacterium
GMLACNCYVLAQRPGSD

SEQ ID NO: 1348631 - protein, 31 aa, Mycobacterium
GNGTADRPNAGLLLGNGYSYTATTCPASTVC

SEQ ID NO: 1348632 - protein, 19 aa, Mycobacterium
GNRFIALAVETNAPVPVTE

SEQ ID NO: 1348633 - protein, 25 aa, Mycobacterium
GNTYLCNAQRAWVPQPPLVGVRTQG

SEQ ID NO: 1348634 - protein, 29 aa, Mycobacterium
GPFTGYAPRDVCGLWPVPATSAPRPATSP

SEQ ID NO: 1348635 - protein, 25 aa, Mycobacterium
GPMQFIPETWRLYGVDANGDGKSDP

SEQ ID NO: 1348636 - protein, 19 aa, Mycobacterium
GPPAARAALSAALDQTTLT

SEQ ID NO: 1348637 - protein, 20 aa, Mycobacterium
GQIRVLPPFLSRKHLPSRLA

SEQ ID NO: 1348638 - protein, 18 aa, Mycobacterium
GQPLMTWQTVALVNLDRA

SEQ ID NO: 1348639 - protein, 36 aa, Mycobacterium
GQPWVVSFQLNWPRYRSRTAASWLLSIVHQTFAMVP

SEQ ID NO: 1348640 - protein, 18 aa, Mycobacterium
GQTPMQWVTGVRVRHAQQ

SEQ ID NO: 1348641 - protein, 19 aa, Mycobacterium
GQVACKLGRTTGYSCGVTW

SEQ ID NO: 1348642 - protein, 20 aa, Mycobacterium
GRAISTWTRDSQGWINSLPV

SEQ ID NO: 1348643 - protein, 18 aa, Mycobacterium
GRDYCKELGLPELPPEFV

SEQ ID NO: 1348644 - protein, 20 aa, Mycobacterium
GRGGEPLQCKWIPNQWPPVY

SEQ ID NO: 1348645 - protein, 19 aa, Mycobacterium
GRGGFAGMLLGSVSTAVVQ

SEQ ID NO: 1348646 - protein, 17 aa, Mycobacterium
GRLPFIDARDIGRTAAH

SEQ ID NO: 1348647 - protein, 18 aa, Mycobacterium
GRLVPVVVSRSISVSLNC

SEQ ID NO: 1348648 - protein, 17 aa, Mycobacterium
GRPLLCVGARGWQPTVL

SEQ ID NO: 1348649 - protein, 17 aa, Mycobacterium
GRRLVVVLMHGLVKEGG

SEQ ID NO: 1348650 - protein, 22 aa, Mycobacterium
GRVAGLIGTVGIRIDGRDQPSA

SEQ ID NO: 1348651 - protein, 19 aa, Mycobacterium
GSKMWRFGKVEVKFGKPMD

SEQ ID NO: 1348652 - protein, 25 aa, Mycobacterium
GSMRLSEAAALPWADHGVRVSILRL

SEQ ID NO: 1348653 - protein, 17 aa, Mycobacterium
GSPGCERSAADVRADAA

SEQ ID NO: 1348654 - protein, 20 aa, Mycobacterium
GSSPRFTLSTADGLNGVLSA

SEQ ID NO: 1348655 - protein, 27 aa, Mycobacterium
GSVRIPAAWCHLVGIKPQRGRISTSPL

SEQ ID NO: 1348656 - protein, 19 aa, Mycobacterium
GTEKAEIEPLLATEWTESP

SEQ ID NO: 1348657 - protein, 20 aa, Mycobacterium
GTFLPFSSILRRCDFSTRPY

SEQ ID NO: 1348658 - protein, 24 aa, Mycobacterium
GTQACRVLRAEGLTVTLINSNPAT

SEQ ID NO: 1348659 - protein, 25 aa, Mycobacterium
GTSFGEAGITFVKQVTLVPAVAFVL

SEQ ID NO: 1348660 - protein, 24 aa, Mycobacterium
GTTKLRPGDAIPLDRTAPALDLDA

SEQ ID NO: 1348661 - protein, 19 aa, Mycobacterium
GTVATWKLQATKSRVRDVK

SEQ ID NO: 1348662 - protein, 24 aa, Mycobacterium
GVASDAGGVVGWWVNPQAPGIDAC

SEQ ID NO: 1348663 - protein, 21 aa, Mycobacterium
GVATQNAWLARGLVPDVKAER

SEQ ID NO: 1348664 - protein, 26 aa, Mycobacterium
GVEAVYRGSQIVPWVNVVVPAYKIVP

SEQ ID NO: 1348665 - protein, 24 aa, Mycobacterium
GVEIPAESTVSFGQPTTAAVDGGG

SEQ ID NO: 1348666 - protein, 18 aa, Mycobacterium
GVIDRVSLGDALPHTVVV

SEQ ID NO: 1348667 - protein, 29 aa, Mycobacterium
GVLDEATNRWGLRVARVELRAIDPPPSIQ

SEQ ID NO: 1348668 - protein, 19 aa, Mycobacterium
GVLGPRPGVVITPQPDMLP

SEQ ID NO: 1348669 - protein, 17 aa, Mycobacterium
GVLPEAVNRACIAIGVF

SEQ ID NO: 1348670 - protein, 17 aa, Mycobacterium
GVLQFNQILAVAGFRCN

SEQ ID NO: 1348671 - protein, 18 aa, Mycobacterium
GVPPRIITRGQWGADESM

SEQ ID NO: 1348672 - protein, 20 aa, Mycobacterium
GVPVLDVAYEYNINSSAPVD

SEQ ID NO: 1348673 - protein, 19 aa, Mycobacterium
GVTMRPYLVDSLRGPDLAN

SEQ ID NO: 1348674 - protein, 25 aa, Mycobacterium
GWATARALAADGFRIVLADRNADGA

SEQ ID NO: 1348675 - protein, 17 aa, Mycobacterium
GYAHVGVIHELRDRGYE

SEQ ID NO: 1348676 - protein, 25 aa, Mycobacterium
HALRRNFPVLARFRYLLESIGPELR

SEQ ID NO: 1348677 - protein, 26 aa, Mycobacterium
HAVPRDGRIRLTLHTDRAGERVETVH

SEQ ID NO: 1348678 - protein, 19 aa, Mycobacterium
HELEIRPTLGDGRAPVPAD

SEQ ID NO: 1348679 - protein, 19 aa, Mycobacterium
HFGAPVDGFTQYFFTTPSG

SEQ ID NO: 1348680 - protein, 19 aa, Mycobacterium
HGDRIGIGSYCHRPMPVDM

SEQ ID NO: 1348681 - protein, 23 aa, Mycobacterium
HGFGLPLSPAWAIVGQSQGGAAA

SEQ ID NO: 1348682 - protein, 19 aa, Mycobacterium
HGGELPGFNSFMGYDPDND

SEQ ID NO: 1348683 - protein, 24 aa, Mycobacterium
HGNHEPGWVVAPGMQGVDVQPFTA

SEQ ID NO: 1348684 - protein, 20 aa, Mycobacterium
HGVGVVGLLNVQYALKDDVL

SEQ ID NO: 1348685 - protein, 23 aa, Mycobacterium
HHAAYGSAKWALRGLTQVTAAEL

SEQ ID NO: 1348686 - protein, 23 aa, Mycobacterium
HRLGRSVCAAFAVTAAGGVAAAA

SEQ ID NO: 1348687 - protein, 23 aa, Mycobacterium
HSMPTRETYSWDEVSLVGTIDSV

SEQ ID NO: 1348688 - protein, 25 aa, Mycobacterium
HSWFAGYRGDLAFAALIVGGGSSEY

SEQ ID NO: 1348689 - protein, 18 aa, Mycobacterium
HWRPERYFAPGTKVTVAA

SEQ ID NO: 1348690 - protein, 19 aa, Mycobacterium
HYAEVGFDGFASVVDAVGG

SEQ ID NO: 1348691 - protein, 17 aa, Mycobacterium
IADAVLLALGAPMSAAG

SEQ ID NO: 1348692 - protein, 21 aa, Mycobacterium
IAGAMLFGAVPAMAQPAPPPP

SEQ ID NO: 1348693 - protein, 24 aa, Mycobacterium
IAQALRPVQTAGIAAIDSTTTDAT

SEQ ID NO: 1348694 - protein, 23 aa, Mycobacterium
IATSLSMVFGELVPKNLAVARPA

SEQ ID NO: 1348695 - protein, 20 aa, Mycobacterium
IATTCPDTRIVLGGFSQGAV

SEQ ID NO: 1348696 - protein, 28 aa, Mycobacterium
IAVTDWFGGEPFGVWPWARGQLGPAQPT

SEQ ID NO: 1348697 - protein, 27 aa, Mycobacterium
IAYSEDRLRPPPGYKDTTVPGIFSRDT

SEQ ID NO: 1348698 - protein, 19 aa, Mycobacterium
IDLPGAKVLGGPRGRRHAF

SEQ ID NO: 1348699 - protein, 17 aa, Mycobacterium
IEMPRLELPALPEGVDL

SEQ ID NO: 1348700 - protein, 21 aa, Mycobacterium
IEQDRYYSLQFINGYTNNIAY

SEQ ID NO: 1348701 - protein, 26 aa, Mycobacterium
IETALEMFKRTGAGHLVLISSVLGNK

SEQ ID NO: 1348702 - protein, 29 aa, Mycobacterium
IFDFTIPRLKRGLFLGTRWGEEGTPMVPA

SEQ ID NO: 1348703 - protein, 20 aa, Mycobacterium
IGAPAWPEWTPAPLVQHWPA

SEQ ID NO: 1348704 - protein, 18 aa, Mycobacterium
IGDFPAYANPLSLANALA

SEQ ID NO: 1348705 - protein, 22 aa, Mycobacterium
IGGTTLSFWTPPGVYTVLDKDN

SEQ ID NO: 1348706 - protein, 17 aa, Mycobacterium
IGSTGFGDLDWQPLPPE

SEQ ID NO: 1348707 - protein, 27 aa, Mycobacterium
IGVTVYDMSSFITAGKEGMEAYAKDNN

SEQ ID NO: 1348708 - protein, 21 aa, Mycobacterium
IIAGGLATAFLGLATPAQAAP

SEQ ID NO: 1348709 - protein, 17 aa, Mycobacterium
IIAGGLATGFLAFAAPA

SEQ ID NO: 1348710 - protein, 21 aa, Mycobacterium
IIAGGLATGFLALATPAQAAP

SEQ ID NO: 1348711 - protein, 21 aa, Mycobacterium
IKFSALAGRALALGFDALATG

SEQ ID NO: 1348712 - protein, 19 aa, Mycobacterium
IKHGPFFPQCGGISDQTMS

SEQ ID NO: 1348713 - protein, 19 aa, Mycobacterium
IKVSYRQGGDTELGNQLVA

SEQ ID NO: 1348714 - protein, 17 aa, Mycobacterium
ILDWAGFISSVDAGTAA

SEQ ID NO: 1348715 - protein, 20 aa, Mycobacterium
IMAAGRYLAANGFTRNPDAA

SEQ ID NO: 1348716 - protein, 28 aa, Mycobacterium
IMWDGGIRLGERFVHVAFGDTFANANMT

SEQ ID NO: 1348717 - protein, 25 aa, Mycobacterium
INANRFDPLVPWAPAMQLGRDWCAQ

SEQ ID NO: 1348718 - protein, 17 aa, Mycobacterium
INKAAKIAGFWHNTGEG

SEQ ID NO: 1348719 - protein, 18 aa, Mycobacterium
INTTCTYDQVIAALNDQH

SEQ ID NO: 1348720 - protein, 18 aa, Mycobacterium
IPAAHWRLGDACEISVLE

SEQ ID NO: 1348721 - protein, 17 aa, Mycobacterium
IPAGGLFSGAEEEKTPE

SEQ ID NO: 1348722 - protein, 17 aa, Mycobacterium
IPGTLQYAAQNPGVVIR

SEQ ID NO: 1348723 - protein, 22 aa, Mycobacterium
IPHVRARGGGSLIAVTTTGVTM

SEQ ID NO: 1348724 - protein, 22 aa, Mycobacterium
IPSGDTRAFLGARIGVRRGAVV

SEQ ID NO: 1348725 - protein, 27 aa, Mycobacterium
IQDPGSWARRPEAVTGIDNLFLAGEWV

SEQ ID NO: 1348726 - protein, 17 aa, Mycobacterium
IQKLMDRNARFVAVAGL

SEQ ID NO: 1348727 - protein, 22 aa, Mycobacterium
IQKNFDEYATWVAQTDGTDVEF

SEQ ID NO: 1348728 - protein, 25 aa, Mycobacterium
IQSTFVGAVCRWQAANPAGLVDITR

SEQ ID NO: 1348729 - protein, 22 aa, Mycobacterium
IRLFPEQIEFVAYEAEDRVLIA

SEQ ID NO: 1348730 - protein, 18 aa, Mycobacterium
IRNLPKPLGKEGGLIDQV

SEQ ID NO: 1348731 - protein, 18 aa, Mycobacterium
IRQAAAFQTAFNDYAADC

SEQ ID NO: 1348732 - protein, 19 aa, Mycobacterium
IRQALTALGVRTAMSRGND

SEQ ID NO: 1348733 - protein, 19 aa, Mycobacterium
IRRSDAPRLVDLVREAQQS

SEQ ID NO: 1348734 - protein, 22 aa, Mycobacterium
ISETYPPGSTFKVITTAAALQN

SEQ ID NO: 1348735 - protein, 20 aa, Mycobacterium
ISLAAVFLALAIGVALGSGL

SEQ ID NO: 1348736 - protein, 23 aa, Mycobacterium
ISSLRLVGCGGSAVPVSLMKAFE

SEQ ID NO: 1348737 - protein, 19 aa, Mycobacterium
ISTVATWLASIARTGRYHR

SEQ ID NO: 1348738 - protein, 20 aa, Mycobacterium
ITDEAYAAVAGRQDSFTDLV

SEQ ID NO: 1348739 - protein, 17 aa, Mycobacterium
IVDNYRVQYAYYVNKDN

SEQ ID NO: 1348740 - protein, 27 aa, Mycobacterium
IVDPRPHAIESWGRLPDDRQISVRFTA

SEQ ID NO: 1348741 - protein, 20 aa, Mycobacterium
IVLLVGAWAYQTAHRLDRLH

SEQ ID NO: 1348742 - protein, 26 aa, Mycobacterium
IVPTFLPGRCAIQLDAGAEMRFTVAN

SEQ ID NO: 1348743 - protein, 24 aa, Mycobacterium
IWVSEPHRTPGLNKGWKQIIAPGV

SEQ ID NO: 1348744 - protein, 17 aa, Mycobacterium
KALRQAIAKGIDRQTIA

SEQ ID NO: 1348745 - protein, 22 aa, Mycobacterium
KDPELCPPLLTPPFYSIDISAD

SEQ ID NO: 1348746 - protein, 17 aa, Mycobacterium
KDWAVALQDIYGGDDAA

SEQ ID NO: 1348747 - protein, 25 aa, Mycobacterium
KELALPRLGSFAVMNRTIDIAQAAL

SEQ ID NO: 1348748 - protein, 21 aa, Mycobacterium
KETPACFEPTLDYVVVKAPRF

SEQ ID NO: 1348749 - protein, 19 aa, Mycobacterium
KFGRLDVLANIAGYHQMRH

SEQ ID NO: 1348750 - protein, 22 aa, Mycobacterium
KGPAVARLEFQSAPGDPTPPDV

SEQ ID NO: 1348751 - protein, 30 aa, Mycobacterium
KLADVALLRTEWMNGLMFYLRERVDVTKGH

SEQ ID NO: 1348752 - protein, 26 aa, Mycobacterium
KLGRTTGYSCGVTWGPGEDPGTIVNQ

SEQ ID NO: 1348753 - protein, 26 aa, Mycobacterium
KLMDRNARFVAVAGLGLLAPGETGQL

SEQ ID NO: 1348754 - protein, 18 aa, Mycobacterium
KNASAFPTTERVLASIAT

SEQ ID NO: 1348755 - protein, 26 aa, Mycobacterium
KNELSWRECTDQVFGDAAVDPVPGVT

SEQ ID NO: 1348756 - protein, 18 aa, Mycobacterium
KQFVNFMSVKSWDTPGRW

SEQ ID NO: 1348757 - protein, 17 aa, Mycobacterium
KQPDCAYVRARPRLKFY

SEQ ID NO: 1348758 - protein, 34 aa, Mycobacterium
KQYPQFGVVGALDLVKCLNWPSGSAPPEPKDLPV

SEQ ID NO: 1348759 - protein, 18 aa, Mycobacterium
KQYVVRFGLGYTEEPRAE

SEQ ID NO: 1348760 - protein, 21 aa, Mycobacterium
KRWRVAAALAATASLLAGCGG

SEQ ID NO: 1348761 - protein, 20 aa, Mycobacterium
KSAGCPLGTDPAQFVARYHQ

SEQ ID NO: 1348762 - protein, 19 aa, Mycobacterium
KSVIGQPILYGSPTEGPAT

SEQ ID NO: 1348763 - protein, 29 aa, Mycobacterium
KTDDRAGICLRGKPGWGEVLAPLDTVINT

SEQ ID NO: 1348764 - protein, 18 aa, Mycobacterium
KTEELSRTSVEDINIEGH

SEQ ID NO: 1348765 - protein, 18 aa, Mycobacterium
KTVISLDLGSMVAGSKYR

SEQ ID NO: 1348766 - protein, 20 aa, Mycobacterium
KVSTLRWPDGRKTTMQTTGL

SEQ ID NO: 1348767 - protein, 17 aa, Mycobacterium
LAAAMFVAGCSSSSEDA

SEQ ID NO: 1348768 - protein, 21 aa, Mycobacterium
LAANGTALWIYCGGGVASDLD

SEQ ID NO: 1348769 - protein, 17 aa, Mycobacterium
LAARGVENGALIARVGT

SEQ ID NO: 1348770 - protein, 42 aa, Mycobacterium
LAATAARTPAKPLTRQDPAVVIGNVVGLFVGNGTADRPNAGL

SEQ ID NO: 1348771 - protein, 19 aa, Mycobacterium
LAATRASRRRFLGGGAAAA

SEQ ID NO: 1348772 - protein, 24 aa, Mycobacterium
LADAGNSVTLWARRPEVAAEINDT

SEQ ID NO: 1348773 - protein, 25 aa, Mycobacterium
LAEHTRLDGVLAWLEEHAHRDLTLA

SEQ ID NO: 1348774 - protein, 17 aa, Mycobacterium
LAERGADVDATIRTVTT

SEQ ID NO: 1348775 - protein, 33 aa, Mycobacterium
LAESLRGGAIFDRWAKMGGMASALGAPTSPEAA

SEQ ID NO: 1348776 - protein, 21 aa, Mycobacterium
LAESSGRFWFGLDDGRGDISG

SEQ ID NO: 1348777 - protein, 23 aa, Mycobacterium
LAFSPDGKRVYVSSMSQGADGQL

SEQ ID NO: 1348778 - protein, 18 aa, Mycobacterium
LAGIPAGGLFSGAEEEKT

SEQ ID NO: 1348779 - protein, 20 aa, Mycobacterium
LAGRAMRRIGAVEFATTIAP

SEQ ID NO: 1348780 - protein, 22 aa, Mycobacterium
LAIELARSGASVAISDVNLEGL

SEQ ID NO: 1348781 - protein, 36 aa, Mycobacterium
LALANARRWGVLHVIWRQGFYPGIGAPSWTADYGNE

SEQ ID NO: 1348782 - protein, 19 aa, Mycobacterium
LALAVPFAATACGGGGGDE

SEQ ID NO: 1348783 - protein, 17 aa, Mycobacterium
LALDSPLPLAIGAEAAA

SEQ ID NO: 1348784 - protein, 25 aa, Mycobacterium
LAPLLPVRGVISLAEVIQRQVEQEM

SEQ ID NO: 1348785 - protein, 18 aa, Mycobacterium
LAQYPSILVELGNMKNPA

SEQ ID NO: 1348786 - protein, 22 aa, Mycobacterium
LARWRELGVTEVLFGLPDKSEA

SEQ ID NO: 1348787 - protein, 21 aa, Mycobacterium
LASSCSWQMGIPIPEGVPPPP

SEQ ID NO: 1348788 - protein, 23 aa, Mycobacterium
LATAATAFMVWRLTRDHDPDLPE

SEQ ID NO: 1348789 - protein, 23 aa, Mycobacterium
LATQGLKAWPKCGPRGVATRAAV

SEQ ID NO: 1348790 - protein, 26 aa, Mycobacterium
LAVTAGEVPLAFALAAGSFRDGTRVA

SEQ ID NO: 1348791 - protein, 24 aa, Mycobacterium
LCEIGIQFDNDFIEWSVSFAEKPF

SEQ ID NO: 1348792 - protein, 17 aa, Mycobacterium
LCVGGVIGALASAVVAA

SEQ ID NO: 1348793 - protein, 25 aa, Mycobacterium
LDALGWRLNGQFREKDGRQLVIRDV

SEQ ID NO: 1348794 - protein, 20 aa, Mycobacterium
LDPASPWVFDTTLVDPNRWA

SEQ ID NO: 1348795 - protein, 27 aa, Mycobacterium
LDPDEAVAMAVCLRLAAGGSVAGVGES

SEQ ID NO: 1348796 - protein, 23 aa, Mycobacterium
LDRCGYDYVTGCVSVPIAGADGE

SEQ ID NO: 1348797 - protein, 28 aa, Mycobacterium
LDVAAVVDLCSRFVPGMVARGRGAVLNV

SEQ ID NO: 1348798 - protein, 21 aa, Mycobacterium
LDVLHRNGVVPAQLAAVATVG

SEQ ID NO: 1348799 - protein, 24 aa, Mycobacterium
LEKAAELRYGRIPEVEKKLDAAVP

SEQ ID NO: 1348800 - protein, 31 aa, Mycobacterium
LEQAVSAPMCTRVLADFGARVIKIENPKGGD

SEQ ID NO: 1348801 - protein, 19 aa, Mycobacterium
LERGSVCLEITESVVVQDI

SEQ ID NO: 1348802 - protein, 19 aa, Mycobacterium
LERRGRLGGRTHAMRADQV

SEQ ID NO: 1348803 - protein, 19 aa, Mycobacterium
LEYLARAGISKEQVAKGGY

SEQ ID NO: 1348804 - protein, 22 aa, Mycobacterium
LFAGAAATAFFGLAAPAQAAPA

SEQ ID NO: 1348805 - protein, 17 aa, Mycobacterium
LFSEGDLFAALDEHGSA

SEQ ID NO: 1348806 - protein, 19 aa, Mycobacterium
LFTEMTWELGDEVAPMPWL

SEQ ID NO: 1348807 - protein, 20 aa, Mycobacterium
LGAGMARAFAAKGRDLALCA

SEQ ID NO: 1348808 - protein, 17 aa, Mycobacterium
LGDVCIEDLPVPYTAVT

SEQ ID NO: 1348809 - protein, 27 aa, Mycobacterium
LGNARWLPFVIAHGGLDQLVPFPGIVQ

SEQ ID NO: 1348810 - protein, 17 aa, Mycobacterium
LGSLRNLPSLPSPAWAL

SEQ ID NO: 1348811 - protein, 24 aa, Mycobacterium
LGTGGQWAIPWGFENNVVAYNKAY

SEQ ID NO: 1348812 - protein, 21 aa, Mycobacterium
LGVDLVDAFTGALVSLLASIT

SEQ ID NO: 1348813 - protein, 21 aa, Mycobacterium
LIALLCVLPIAVAPAPGVAFV

SEQ ID NO: 1348814 - protein, 24 aa, Mycobacterium
LIEIPRSACRSLDFHRAAEVIELG

SEQ ID NO: 1348815 - protein, 18 aa, Mycobacterium
LINAIAIGIDGGIEAAND

SEQ ID NO: 1348816 - protein, 18 aa, Mycobacterium
LITPVPLPRKLSGDLARL

SEQ ID NO: 1348817 - protein, 25 aa, Mycobacterium
LIYTHGPALVRLHFESAPGDATTDE

SEQ ID NO: 1348818 - protein, 17 aa, Mycobacterium
LKYPRAVTVESVTDPGP

SEQ ID NO: 1348819 - protein, 17 aa, Mycobacterium
LLAEALAVTAGEVPLAF

SEQ ID NO: 1348820 - protein, 20 aa, Mycobacterium
LLCLVPGPVAAAMRTGLDTL

SEQ ID NO: 1348821 - protein, 17 aa, Mycobacterium
LLEALPMQETLEAIDEL

SEQ ID NO: 1348822 - protein, 18 aa, Mycobacterium
LLEPTYLFFDAINLLTGA

SEQ ID NO: 1348823 - protein, 23 aa, Mycobacterium
LLGPAIELIPAITSVIRQPVQNM

SEQ ID NO: 1348824 - protein, 26 aa, Mycobacterium
LNLSEGWWPMLVGLSMGDAGGYKSED

SEQ ID NO: 1348825 - protein, 25 aa, Mycobacterium
LNPSEGWWPMLIGLAMQDSGKYNAE

SEQ ID NO: 1348826 - protein, 27 aa, Mycobacterium
LNTYKKSLWCGIGGLIPFAKSGPQYSG

SEQ ID NO: 1348827 - protein, 24 aa, Mycobacterium
LPAKKWLADRGFDPLYGARPLRRL

SEQ ID NO: 1348828 - protein, 24 aa, Mycobacterium
LPAPRDFPDAAALVAAVKTGQVDA

SEQ ID NO: 1348829 - protein, 25 aa, Mycobacterium
LPASTINRLPVRYTFDNRYFNDTYE

SEQ ID NO: 1348830 - protein, 25 aa, Mycobacterium
LPDQRMKAEFYPRVDKTQLFADGYI

SEQ ID NO: 1348831 - protein, 18 aa, Mycobacterium
LPDQVLWGYVPTVHATPV

SEQ ID NO: 1348832 - protein, 26 aa, Mycobacterium
LPGHPRVMSIADFWRRTAGHELIVAE

SEQ ID NO: 1348833 - protein, 21 aa, Mycobacterium
LPGNAMVAFAMGVDLLNVARE

SEQ ID NO: 1348834 - protein, 18 aa, Mycobacterium
LPIRSVAVTTEFNTLFET

SEQ ID NO: 1348835 - protein, 39 aa, Mycobacterium
LPITLFAIGVLSPIYAGFVKAGGAFVQDVFDAARTGDLE

SEQ ID NO: 1348836 - protein, 20 aa, Mycobacterium
LPLRIARRVAEAVKNAVVAA

SEQ ID NO: 1348837 - protein, 21 aa, Mycobacterium
LPLRLVQPAWAPCCQPDQDDH

SEQ ID NO: 1348838 - protein, 18 aa, Mycobacterium
LPNEGAPGRGPRLAPGSV

SEQ ID NO: 1348839 - protein, 30 aa, Mycobacterium
LPRKLSGDLARLPMRVRRAVRETREILDTV

SEQ ID NO: 1348840 - protein, 29 aa, Mycobacterium
LPTEHLEDYFALRWARPDDGTLVIGSTGF

SEQ ID NO: 1348841 - protein, 21 aa, Mycobacterium
LPTLFVLSAVVLVAACTLTDS

SEQ ID NO: 1348842 - protein, 17 aa, Mycobacterium
LPVDPSVAAGQKPLGDA

SEQ ID NO: 1348843 - protein, 26 aa, Mycobacterium
LPVQNRPGGIGAQFLATMVEQYRGKD

SEQ ID NO: 1348844 - protein, 19 aa, Mycobacterium
LQEGWDFLPNQTRLLDALK

SEQ ID NO: 1348845 - protein, 24 aa, Mycobacterium
LQFNQILAVAGFRCNVQEASGVSC

SEQ ID NO: 1348846 - protein, 19 aa, Mycobacterium
LQKERLVDVPLPVQNRPGG

SEQ ID NO: 1348847 - protein, 17 aa, Mycobacterium
LQYEPGTNWSYAHTNYV

SEQ ID NO: 1348848 - protein, 18 aa, Mycobacterium
LRAKINAAIEKMESSGAW

SEQ ID NO: 1348849 - protein, 25 aa, Mycobacterium
LRDLLMGAAGPEFRPYIREGVEAVY

SEQ ID NO: 1348850 - protein, 23 aa, Mycobacterium
LRDSVIDGVRLVSVHGSDINVVG

SEQ ID NO: 1348851 - protein, 26 aa, Mycobacterium
LREPLYLPVACRLHVTSFEGVQGGDA

SEQ ID NO: 1348852 - protein, 20 aa, Mycobacterium
LRIVLRHELFHHAVREQTAA

SEQ ID NO: 1348853 - protein, 20 aa, Mycobacterium
LRPAVLSALASRATVVIPEA

SEQ ID NO: 1348854 - protein, 19 aa, Mycobacterium
LRPEVFAFSTSLTRLTPVL

SEQ ID NO: 1348855 - protein, 18 aa, Mycobacterium
LRPFPRSVGDLDARTLSG

SEQ ID NO: 1348856 - protein, 19 aa, Mycobacterium
LRQGPFVWWEHLLEGGDEP

SEQ ID NO: 1348857 - protein, 20 aa, Mycobacterium
LRRWPVDGIPAEPAAWVITV

SEQ ID NO: 1348858 - protein, 20 aa, Mycobacterium
LRSARSVQELISLVRNSARS

SEQ ID NO: 1348859 - protein, 21 aa, Mycobacterium
LSAAGEFDAQIAPRVLRDTLG

SEQ ID NO: 1348860 - protein, 24 aa, Mycobacterium
LSAAPRGTDSWYRDAARIGELADQ

SEQ ID NO: 1348861 - protein, 24 aa, Mycobacterium
LSDPEVRVVLCAPQVPCGHAASAV

SEQ ID NO: 1348862 - protein, 25 aa, Mycobacterium
LSGGRVSLGVGFGWNTDELADHNVP

SEQ ID NO: 1348863 - protein, 20 aa, Mycobacterium
LSPSRVVLTEGWQAGGAGME

SEQ ID NO: 1348864 - protein, 19 aa, Mycobacterium
LSPYGLLHTRVTDWRTTTM

SEQ ID NO: 1348865 - protein, 24 aa, Mycobacterium
LSQPSRGPRRWGIRRHIHTAPWSD

SEQ ID NO: 1348866 - protein, 17 aa, Mycobacterium
LTALIADAEGLRQTDGQ

SEQ ID NO: 1348867 - protein, 22 aa, Mycobacterium
LTDPIKGFGPRVGQMLMGALFR

SEQ ID NO: 1348868 - protein, 46 aa, Mycobacterium
LTGAVGDLYSYLAIRNWNAVGFLVGQAVSIWSYVFEQATKIDPRDI

SEQ ID NO: 1348869 - protein, 17 aa, Mycobacterium
LTGIAVQLLTLVQNEAG

SEQ ID NO: 1348870 - protein, 19 aa, Mycobacterium
LTLLSPRAGLVVDPGAKVT

SEQ ID NO: 1348871 - protein, 23 aa, Mycobacterium
LTRNPKWWGEPPLLDSITYSVLD

SEQ ID NO: 1348872 - protein, 26 aa, Mycobacterium
LTSAGKMLLMLDCSQAAADRLKASQP

SEQ ID NO: 1348873 - protein, 17 aa, Mycobacterium
LTVPLPFPLPTLPNPVT

SEQ ID NO: 1348874 - protein, 17 aa, Mycobacterium
LVAPVGVNTDPEVPPPP

SEQ ID NO: 1348875 - protein, 24 aa, Mycobacterium
LVDGPRLLVAINMMSQTCGHADFH

SEQ ID NO: 1348876 - protein, 18 aa, Mycobacterium
LVPFPGIVQQVLELDRLG

SEQ ID NO: 1348877 - protein, 22 aa, Mycobacterium
LVPGYRYHLALDAKAAGAELMA

SEQ ID NO: 1348878 - protein, 18 aa, Mycobacterium
LVPVVAFGVLLSAVTVPF

SEQ ID NO: 1348879 - protein, 18 aa, Mycobacterium
LVSACVEAGLTVSCLPGP

SEQ ID NO: 1348880 - protein, 21 aa, Mycobacterium
LWAYWCGPCADELPAMAEYQR

SEQ ID NO: 1348881 - protein, 19 aa, Mycobacterium
LWHRYRQAALYAYVAALIT

SEQ ID NO: 1348882 - protein, 17 aa, Mycobacterium
LYAAALRHYGTGTRVEP

SEQ ID NO: 1348883 - protein, 17 aa, Mycobacterium
LYPWNDYYYGPALVFGW

SEQ ID NO: 1348884 - protein, 18 aa, Mycobacterium
LYRLPLWEAAYAAQKLAV

SEQ ID NO: 1348885 - protein, 19 aa, Mycobacterium
LYSPNLWRYLTQGLTELEA

SEQ ID NO: 1348886 - protein, 17 aa, Mycobacterium
LYVLLAVAEAVKVGSVE

SEQ ID NO: 1348887 - protein, 18 aa, Mycobacterium
MADFGLERGSVCLEITES

SEQ ID NO: 1348888 - protein, 17 aa, Mycobacterium
MAQASSPVPDWSGLDAR

SEQ ID NO: 1348889 - protein, 19 aa, Mycobacterium
MAVCGGNGLGMSFSDKALP

SEQ ID NO: 1348890 - protein, 23 aa, Mycobacterium
MESSGAWKEAFDKNLGPAGITAP

SEQ ID NO: 1348891 - protein, 17 aa, Mycobacterium
MKVTFSYESKYKVPANA

SEQ ID NO: 1348892 - protein, 19 aa, Mycobacterium
MLPDLCSITERLAQLSQQR

SEQ ID NO: 1348893 - protein, 23 aa, Mycobacterium
MMADRLGGRGNIVILQGPLGQSG

SEQ ID NO: 1348894 - protein, 22 aa, Mycobacterium
MMADRLGGRGNIVVLQGPLGGS

SEQ ID NO: 1348895 - protein, 23 aa, Mycobacterium
MNVPGDIAGAFAAGVRQAFEDGL

SEQ ID NO: 1348896 - protein, 28 aa, Mycobacterium
MPAPAREALWDWLALGIAAEPVSKESAK

SEQ ID NO: 1348897 - protein, 32 aa, Mycobacterium
MPMTDRYTYGIGIVISGDWLLQNPMFSGYGGL

SEQ ID NO: 1348898 - protein, 24 aa, Mycobacterium
MQFICSSIQAGSRLGYQESAELCA

SEQ ID NO: 1348899 - protein, 31 aa, Mycobacterium
MSAAGTCWVAQHGKPAWPMAFAPVDSPDSRL

SEQ ID NO: 1348900 - protein, 24 aa, Mycobacterium
MSAEGPKAATLLIYTHGPALVRLH

SEQ ID NO: 1348901 - protein, 20 aa, Mycobacterium
MSATVPRGWQLAKAYTPNAC

SEQ ID NO: 1348902 - protein, 21 aa, Mycobacterium
MSGREQLVPRELVYPPDKSKD

SEQ ID NO: 1348903 - protein, 18 aa, Mycobacterium
MSNYLYLNPRRGMLTDPK

SEQ ID NO: 1348904 - protein, 20 aa, Mycobacterium
MVSAGLTLGVERYRYPGDLP

SEQ ID NO: 1348905 - protein, 33 aa, Mycobacterium
NAAFLDYLACPYGPRMLSPKGLADNAGDDHAQN

SEQ ID NO: 1348906 - protein, 19 aa, Mycobacterium
NAPDGRAVIIGMFNSTWGQ

SEQ ID NO: 1348907 - protein, 19 aa, Mycobacterium
NARGLFAGRGIDLCSDGDP

SEQ ID NO: 1348908 - protein, 25 aa, Mycobacterium
NDVRVRQAIAYGIDREAIVAATSYG

SEQ ID NO: 1348909 - protein, 18 aa, Mycobacterium
NELLGAPVTGARRRRLNA

SEQ ID NO: 1348910 - protein, 23 aa, Mycobacterium
NELPRGCIAAGDRAFFCDYALEY

SEQ ID NO: 1348911 - protein, 30 aa, Mycobacterium
NFNARARNGETYRALWQVATAQGVNPSTLG

SEQ ID NO: 1348912 - protein, 22 aa, Mycobacterium
NGDMGVAMVLAHEYGHTIVRQA

SEQ ID NO: 1348913 - protein, 27 aa, Mycobacterium
NGIVDEIDYVLSLGWFPIPLPPLPTPP

SEQ ID NO: 1348914 - protein, 21 aa, Mycobacterium
NGRIRYKRTCEVCGEVVEYRD

SEQ ID NO: 1348915 - protein, 41 aa, Mycobacterium
NLAGELGRWVLRNACAEFARWRAAGVGDRIVLRVNVSPVQL

SEQ ID NO: 1348916 - protein, 18 aa, Mycobacterium
NLEQILALYPIEIAGLQG

SEQ ID NO: 1348917 - protein, 21 aa, Mycobacterium
NLEQWKGLIADDATLVSLAKG

SEQ ID NO: 1348918 - protein, 25 aa, Mycobacterium
NLLGWPSINVPAGFTADGLPIGVQL

SEQ ID NO: 1348919 - protein, 27 aa, Mycobacterium
NLPPGKPRALAALRHFADHRRFYRAVL

SEQ ID NO: 1348920 - protein, 24 aa, Mycobacterium
NMILRRLGIEPAEELRSARSVQEL

SEQ ID NO: 1348921 - protein, 20 aa, Mycobacterium
NNKRLCSVSGSTPAQKIKDE

SEQ ID NO: 1348922 - protein, 22 aa, Mycobacterium
NPLRWYPMASAAGGALTVDTGA

SEQ ID NO: 1348923 - protein, 23 aa, Mycobacterium
NQRAIRFTFAYRDGSEHWTPERR

SEQ ID NO: 1348924 - protein, 19 aa, Mycobacterium
NRLLLKDGLEKQGLENYEN

SEQ ID NO: 1348925 - protein, 28 aa, Mycobacterium
NRSPRYARFGWAAARLDDALNYLPARLT

SEQ ID NO: 1348926 - protein, 17 aa, Mycobacterium
NRVALENVLHVAPNAIG

SEQ ID NO: 1348927 - protein, 25 aa, Mycobacterium
NRYGIATRGSKSWATIHPGFMTQYV

SEQ ID NO: 1348928 - protein, 26 aa, Mycobacterium
NSPDGYRTEVEWATQMSYSGIYVHSA

SEQ ID NO: 1348929 - protein, 25 aa, Mycobacterium
NSRNKLPAWLFIQWATGKESMNKAV

SEQ ID NO: 1348930 - protein, 24 aa, Mycobacterium
NSRRLGHEFDYFNPPQTFKIENPV

SEQ ID NO: 1348931 - protein, 21 aa, Mycobacterium
NTDTWGVAMMGNFEVVPPTPI

SEQ ID NO: 1348932 - protein, 18 aa, Mycobacterium
NTIAARKGYSGWSSQPAW

SEQ ID NO: 1348933 - protein, 18 aa, Mycobacterium
NVLSRYPDIKVLAIDTAN

SEQ ID NO: 1348934 - protein, 23 aa, Mycobacterium
NVPPGGADHLIAWVKTVVYGAAE

SEQ ID NO: 1348935 - protein, 19 aa, Mycobacterium
NVSHGCINLSPANAQWFFD

SEQ ID NO: 1348936 - protein, 28 aa, Mycobacterium
NVTILNATIEWKTRPSARSFGDGFSILG

SEQ ID NO: 1348937 - protein, 18 aa, Mycobacterium
PAALQLRLLQTVVEVAAE

SEQ ID NO: 1348938 - protein, 27 aa, Mycobacterium
PAAQHPGGWPRLDWSMDAALLLAALAA

SEQ ID NO: 1348939 - protein, 26 aa, Mycobacterium
PADPEVLGLAALVCFGEARRPARRGV

SEQ ID NO: 1348940 - protein, 23 aa, Mycobacterium
PAEARAALNEAWAGLQATHLDAQ

SEQ ID NO: 1348941 - protein, 18 aa, Mycobacterium
PAEELMGYYRKAEATFGV

SEQ ID NO: 1348942 - protein, 26 aa, Mycobacterium
PAGCQELDGRNALGFVRTRATPRADL

SEQ ID NO: 1348943 - protein, 25 aa, Mycobacterium
PAHAEAITRYGLRITGRRGDLVITD

SEQ ID NO: 1348944 - protein, 20 aa, Mycobacterium
PALFPACNPSAFPADLHTGY

SEQ ID NO: 1348945 - protein, 17 aa, Mycobacterium
PAMQLGRDWCAQGADIE

SEQ ID NO: 1348946 - protein, 24 aa, Mycobacterium
PARKLAIAVAVTFAPEAFDAQGNY

SEQ ID NO: 1348947 - protein, 17 aa, Mycobacterium
PARTWFTAMKPIATNFG

SEQ ID NO: 1348948 - protein, 41 aa, Mycobacterium
PASRVAILLPAHWQTAAVLFGLWWIGAEALVGGPSDVDGAD

SEQ ID NO: 1348949 - protein, 18 aa, Mycobacterium
PATGRLVVDLAELQIMGA

SEQ ID NO: 1348950 - protein, 37 aa, Mycobacterium
PATLRPLPNFAVDRLESRWCGGHLLLQLCGDNLLTLS

SEQ ID NO: 1348951 - protein, 18 aa, Mycobacterium
PAVGLAAHLGRGVQRVAT

SEQ ID NO: 1348952 - protein, 18 aa, Mycobacterium
PAVKAPAWVPPGDENPWV

SEQ ID NO: 1348953 - protein, 26 aa, Mycobacterium
PCRDIPFDVVQRAGLAYTPPAPEDAL

SEQ ID NO: 1348954 - protein, 24 aa, Mycobacterium
PDIKVLAKDTANWKRDEAVNKMKN

SEQ ID NO: 1348955 - protein, 19 aa, Mycobacterium
PDLAAFFAGIAIQMYCPQM

SEQ ID NO: 1348956 - protein, 18 aa, Mycobacterium
PDPTKWGDVSVFTPVEEG

SEQ ID NO: 1348957 - protein, 24 aa, Mycobacterium
PDQRVWTFHLRRGVTFHDGSPFTA

SEQ ID NO: 1348958 - protein, 17 aa, Mycobacterium
PDTYGFNGLDPAGTTGD

SEQ ID NO: 1348959 - protein, 17 aa, Mycobacterium
PDVIAFDLATAVEVFGR

SEQ ID NO: 1348960 - protein, 24 aa, Mycobacterium
PEAPDLQALLAVMVEQGVDTVVME

SEQ ID NO: 1348961 - protein, 24 aa, Mycobacterium
PEAQKLWAEAGFRPVDPAVAAEFA

SEQ ID NO: 1348962 - protein, 20 aa, Mycobacterium
PEARLLVIGPPWPTADPPPA

SEQ ID NO: 1348963 - protein, 23 aa, Mycobacterium
PEAVNRACIAIGVFASLPVALQS

SEQ ID NO: 1348964 - protein, 20 aa, Mycobacterium
PEDKTAAVLDAFSASMPGQK

SEQ ID NO: 1348965 - protein, 24 aa, Mycobacterium
PEFINRLDDVIVFDGLNPEELVSI

SEQ ID NO: 1348966 - protein, 19 aa, Mycobacterium
PEGNPWYTPYDRYSADLEK

SEQ ID NO: 1348967 - protein, 17 aa, Mycobacterium
PEPPSIRYPGGPAPGPM

SEQ ID NO: 1348968 - protein, 21 aa, Mycobacterium
PERRRGYEIALDRGALTAFLS

SEQ ID NO: 1348969 - protein, 26 aa, Mycobacterium
PESPVSAVLPELVAPVGVNTDPEVPP

SEQ ID NO: 1348970 - protein, 22 aa, Mycobacterium
PEVLVHALARVRRRAYRVVWLN

SEQ ID NO: 1348971 - protein, 21 aa, Mycobacterium
PEVPVEQMVAAGCNPGGTEEP

SEQ ID NO: 1348972 - protein, 21 aa, Mycobacterium
PFCDEFMPAHSISGLRDLFEV

SEQ ID NO: 1348973 - protein, 20 aa, Mycobacterium
PFGGPRPLLVYGPGTQGQGD

SEQ ID NO: 1348974 - protein, 18 aa, Mycobacterium
PGATWPPVVRPPVGWIAQ

SEQ ID NO: 1348975 - protein, 19 aa, Mycobacterium
PGDELRTAYTAFAAELVER

SEQ ID NO: 1348976 - protein, 22 aa, Mycobacterium
PGIEKESNWLPAPKGPFQMILR

SEQ ID NO: 1348977 - protein, 21 aa, Mycobacterium
PGKESHPVLAMASNRTYGLNL

SEQ ID NO: 1348978 - protein, 18 aa, Mycobacterium
PGLGEWNNGGSVATNITV

SEQ ID NO: 1348979 - protein, 17 aa, Mycobacterium
PHFRCELAVDGVVVASH

SEQ ID NO: 1348980 - protein, 20 aa, Mycobacterium
PILAHAPAPLPPHIGARTVS

SEQ ID NO: 1348981 - protein, 20 aa, Mycobacterium
PKDLPVPVLLLGVQNDPIVG

SEQ ID NO: 1348982 - protein, 20 aa, Mycobacterium
PKWAAHPIDPISIRDALHYL

SEQ ID NO: 1348983 - protein, 27 aa, Mycobacterium
PLAMALSPDGSRLFVNTMTFADASGST

SEQ ID NO: 1348984 - protein, 18 aa, Mycobacterium
PLGKEGGLIDQVDQTVDG

SEQ ID NO: 1348985 - protein, 22 aa, Mycobacterium
PLIPRDRMASVLDAADVLIWTT

SEQ ID NO: 1348986 - protein, 20 aa, Mycobacterium
PLLKEFTELTGINVNVDLVP

SEQ ID NO: 1348987 - protein, 17 aa, Mycobacterium
PLLTSILTYHVVPGQAG

SEQ ID NO: 1348988 - protein, 23 aa, Mycobacterium
PLMERLRVMMNLSDNVMAEAIGR

SEQ ID NO: 1348989 - protein, 20 aa, Mycobacterium
PLQCKWIPNQWPPVYTGFWT

SEQ ID NO: 1348990 - protein, 21 aa, Mycobacterium
PLTVAAILRYAATVHGDRTVT

SEQ ID NO: 1348991 - protein, 21 aa, Mycobacterium
PMGRVAAELADLVVVTDDNPR

SEQ ID NO: 1348992 - protein, 24 aa, Mycobacterium
PNAPDILTGTAWPDAPSPYTWGHI

SEQ ID NO: 1348993 - protein, 17 aa, Mycobacterium
PNVMPATVVLRADGSVA

SEQ ID NO: 1348994 - protein, 21 aa, Mycobacterium
PPEQARRLSVRTQQETGVVLA

SEQ ID NO: 1348995 - protein, 17 aa, Mycobacterium
PPGVGAGPESLRGITLE

SEQ ID NO: 1348996 - protein, 18 aa, Mycobacterium
PPPPVAPTLNELVVAAYR

SEQ ID NO: 1348997 - protein, 19 aa, Mycobacterium
PPRLRLAADPARIVDDLVA

SEQ ID NO: 1348998 - protein, 25 aa, Mycobacterium
PQKLWTIADLGGWQKVDSELFNKDS

SEQ ID NO: 1348999 - protein, 17 aa, Mycobacterium
PQRPRPVNRLVDVHHLA

SEQ ID NO: 1349000 - protein, 17 aa, Mycobacterium
PQTGIEVHRYGAHLFHT

SEQ ID NO: 1349001 - protein, 22 aa, Mycobacterium
PRAVDMSVRLGLRSYALPGTAR

SEQ ID NO: 1349002 - protein, 19 aa, Mycobacterium
PRNEWLFDENWGVDVAVST

SEQ ID NO: 1349003 - protein, 19 aa, Mycobacterium
PRSTYLYHVVDNEWSMAEY

SEQ ID NO: 1349004 - protein, 20 aa, Mycobacterium
PRVGGEMTLAELCQAILQVS

SEQ ID NO: 1349005 - protein, 17 aa, Mycobacterium
PSQALPGDLIFYGPNGT

SEQ ID NO: 1349006 - protein, 18 aa, Mycobacterium
PSVALPVEEFTAAHERTL

SEQ ID NO: 1349007 - protein, 17 aa, Mycobacterium
PSVSRYVPVPADLSDGW

SEQ ID NO: 1349008 - protein, 19 aa, Mycobacterium
PSVTMKRSFFEAHPEIAEV

SEQ ID NO: 1349009 - protein, 24 aa, Mycobacterium
PTADTVIGVGGWRNPTSDRIPNKF

SEQ ID NO: 1349010 - protein, 18 aa, Mycobacterium
PTLIACGDRDLLTPMEYS

SEQ ID NO: 1349011 - protein, 31 aa, Mycobacterium
PTPYGRIGTVKGRADSPVALGDMKVDPDAEL

SEQ ID NO: 1349012 - protein, 19 aa, Mycobacterium
PVEGYTKWLENMAADDRIE

SEQ ID NO: 1349013 - protein, 23 aa, Mycobacterium
PVEIADAVAFLLSDQASFITGSE

SEQ ID NO: 1349014 - protein, 17 aa, Mycobacterium
PVKDILSAIPGVELDRA

SEQ ID NO: 1349015 - protein, 18 aa, Mycobacterium
PVKHCGLMGPGQQPADPA

SEQ ID NO: 1349016 - protein, 19 aa, Mycobacterium
PVRLLRLGGTAALPSYFEI

SEQ ID NO: 1349017 - protein, 23 aa, Mycobacterium
PVSGYDRPIFLGVGLLDRDVPPS

SEQ ID NO: 1349018 - protein, 22 aa, Mycobacterium
PVTVCLRGAYERVGRATMIAMW

SEQ ID NO: 1349019 - protein, 26 aa, Mycobacterium
PVVEGTRWGRGISVVGGRDVSIRDIA

SEQ ID NO: 1349020 - protein, 24 aa, Mycobacterium
PVVKAFGSVVFDILGAVTKFITGP

SEQ ID NO: 1349021 - protein, 17 aa, Mycobacterium
PVVPLPSDIRVSASDFT

SEQ ID NO: 1349022 - protein, 19 aa, Mycobacterium
PYMTGMVGLAYNKAATGRE

SEQ ID NO: 1349023 - protein, 18 aa, Mycobacterium
QAAKLCNNMVLAVQQIAI

SEQ ID NO: 1349024 - protein, 22 aa, Mycobacterium
QAASGVALFLAILIATSLSMVF

SEQ ID NO: 1349025 - protein, 18 aa, Mycobacterium
QADRRFREAAPFLSYGPF

SEQ ID NO: 1349026 - protein, 18 aa, Mycobacterium
QAGNLGWYPGPAGPDGNY

SEQ ID NO: 1349027 - protein, 22 aa, Mycobacterium
QASSPVPDWSGLDARIYTEDIP

SEQ ID NO: 1349028 - protein, 29 aa, Mycobacterium
QAVMTFAKPYAEWRGMLSGNTMLLPKSMT

SEQ ID NO: 1349029 - protein, 26 aa, Mycobacterium
QAYQFPMGLGLVSQFFGRYFTPDEAR

SEQ ID NO: 1349030 - protein, 17 aa, Mycobacterium
QAYTTLVALDLRTGHAD

SEQ ID NO: 1349031 - protein, 23 aa, Mycobacterium
QDALPGDLFAALPGSSAHGARFV

SEQ ID NO: 1349032 - protein, 24 aa, Mycobacterium
QDGFPGMAAAYGFDPARAQTPILQ

SEQ ID NO: 1349033 - protein, 26 aa, Mycobacterium
QFRSFAAAMDRWWALDSDGELTSDID

SEQ ID NO: 1349034 - protein, 17 aa, Mycobacterium
QGMYFWKDYQPGMEPFF

SEQ ID NO: 1349035 - protein, 19 aa, Mycobacterium
QIAGLALANARRWGVLHVI

SEQ ID NO: 1349036 - protein, 19 aa, Mycobacterium
QKRDPGLVVLKGGGDPTLS

SEQ ID NO: 1349037 - protein, 31 aa, Mycobacterium
QLLAYSVSTPGRFRFLRVYPNAQAYAPVTGF

SEQ ID NO: 1349038 - protein, 18 aa, Mycobacterium
QLLEAITLDSNRQFQSEY

SEQ ID NO: 1349039 - protein, 17 aa, Mycobacterium
QLRTTGRLLGWRLGLDR

SEQ ID NO: 1349040 - protein, 21 aa, Mycobacterium
QLSRRNMLAAMGIAGAAAASL

SEQ ID NO: 1349041 - protein, 20 aa, Mycobacterium
QLVRRAHRTLSFQLSGAQVG

SEQ ID NO: 1349042 - protein, 23 aa, Mycobacterium
QMTIEAFVWRTYEETLPPDAVQL

SEQ ID NO: 1349043 - protein, 17 aa, Mycobacterium
QNFPVRQLIANTGFGTG

SEQ ID NO: 1349044 - protein, 25 aa, Mycobacterium
QNGLKIVSCYQFGKADTADWLGGQN

SEQ ID NO: 1349045 - protein, 25 aa, Mycobacterium
QNMARDRIYWFFSLDYTARRQYSEN

SEQ ID NO: 1349046 - protein, 18 aa, Mycobacterium
QPAAAARTVLVDNVEEMV

SEQ ID NO: 1349047 - protein, 18 aa, Mycobacterium
QPGPFDWVYTPSADHTSM

SEQ ID NO: 1349048 - protein, 31 aa, Mycobacterium
QPLTNLSGRCKLPVTIPQVLGLMQAAQQSGA

SEQ ID NO: 1349049 - protein, 26 aa, Mycobacterium
QQADCFAGAYMRWVAEGSSPRFTLST

SEQ ID NO: 1349050 - protein, 17 aa, Mycobacterium
QQLGALLARAGELADGL

SEQ ID NO: 1349051 - protein, 18 aa, Mycobacterium
QRGAMYWSPESGAAPVMG

SEQ ID NO: 1349052 - protein, 20 aa, Mycobacterium
QRIPALAAYPDRPAAGRGTT

SEQ ID NO: 1349053 - protein, 19 aa, Mycobacterium
QRPDGKWGATINGQPVEAV

SEQ ID NO: 1349054 - protein, 19 aa, Mycobacterium
QRPDLLLASFNPDAAHPDT

SEQ ID NO: 1349055 - protein, 37 aa, Mycobacterium
QSGDAWRLGWSPALLHPDLKPGMKFQYSEDSELQTPV

SEQ ID NO: 1349056 - protein, 18 aa, Mycobacterium
QSVRERFDVVGFDPRGVA

SEQ ID NO: 1349057 - protein, 21 aa, Mycobacterium
QTCGHADFHLPSGIDLTPMVG

SEQ ID NO: 1349058 - protein, 33 aa, Mycobacterium
QTGYAGRFIGPFKGRLGLFGSEVTQIPTSGIQI

SEQ ID NO: 1349059 - protein, 21 aa, Mycobacterium
QTPEFDRYGGTRGGAPRLTVN

SEQ ID NO: 1349060 - protein, 18 aa, Mycobacterium
QTPGAFKIVGDTFSEERY

SEQ ID NO: 1349061 - protein, 17 aa, Mycobacterium
QTRPGDCGRDYRLKSTV

SEQ ID NO: 1349062 - protein, 18 aa, Mycobacterium
QVAPLVWAAVAGVPGLLV

SEQ ID NO: 1349063 - protein, 24 aa, Mycobacterium
QVATRWGNWAKLFFNNKGVVAHAT

SEQ ID NO: 1349064 - protein, 26 aa, Mycobacterium
QVRWRPQDFWPAGTVVNIDASGTKSS

SEQ ID NO: 1349065 - protein, 24 aa, Mycobacterium
QVTLVPAVAFVLMKQVATGLLTGE

SEQ ID NO: 1349066 - protein, 18 aa, Mycobacterium
QVVITPLLGPAIELIPAI

SEQ ID NO: 1349067 - protein, 18 aa, Mycobacterium
QWLDPWVAHLRSKGVTFH

SEQ ID NO: 1349068 - protein, 25 aa, Mycobacterium
QYPGLYAPMIHPWSGTGDLKDENDE

SEQ ID NO: 1349069 - protein, 25 aa, Mycobacterium
RAADLSGRRVCVVKGTTSLRRVQQI

SEQ ID NO: 1349070 - protein, 19 aa, Mycobacterium
RAAGIAAGLVADALLGDPR

SEQ ID NO: 1349071 - protein, 21 aa, Mycobacterium
RAEEGRANLRLVNTASSGEHR

SEQ ID NO: 1349072 - protein, 22 aa, Mycobacterium
RAKGYEPMNFFAPLSRLKELDA

SEQ ID NO: 1349073 - protein, 17 aa, Mycobacterium
RAKRRIRDTGVPFTLPE

SEQ ID NO: 1349074 - protein, 21 aa, Mycobacterium
RAKWPYIGAKGGNLPGDLTFS

SEQ ID NO: 1349075 - protein, 17 aa, Mycobacterium
RANPSFWGGPPRISGVT

SEQ ID NO: 1349076 - protein, 19 aa, Mycobacterium
RAPGPLRIGLSTKFPFTGF

SEQ ID NO: 1349077 - protein, 25 aa, Mycobacterium
RAVGDFPGVGTFGRITGLTPREEPP

SEQ ID NO: 1349078 - protein, 25 aa, Mycobacterium
RCGDMDRVTLFRAWYSRGNFGQLAG

SEQ ID NO: 1349079 - protein, 18 aa, Mycobacterium
RDAVFEFSGAVLRSQEMF

SEQ ID NO: 1349080 - protein, 23 aa, Mycobacterium
RDFKFELPAGVAPEGGLQVKTIW

SEQ ID NO: 1349081 - protein, 27 aa, Mycobacterium
RDGGGIPSFLGYHGFPASICSSVNDRV

SEQ ID NO: 1349082 - protein, 21 aa, Mycobacterium
RDGLTLAQALTLWMSGREQLV

SEQ ID NO: 1349083 - protein, 23 aa, Mycobacterium
RDIPARFVTAAAIVRHLLTDPVL

SEQ ID NO: 1349084 - protein, 20 aa, Mycobacterium
RDKRSLVFPVKRLADLGFKV

SEQ ID NO: 1349085 - protein, 18 aa, Mycobacterium
RDLAGFWVAEAVWVTHSA

SEQ ID NO: 1349086 - protein, 25 aa, Mycobacterium
RDPAAFAGFHRWDVYYNSTAGDVAL

SEQ ID NO: 1349087 - protein, 18 aa, Mycobacterium
RDPRGGNVVTTINPRVQQ

SEQ ID NO: 1349088 - protein, 17 aa, Mycobacterium
RDSLRWDDDDAAFYGRA

SEQ ID NO: 1349089 - protein, 24 aa, Mycobacterium
RDYRLKSTVLVEVTFCAFTEAVPD

SEQ ID NO: 1349090 - protein, 17 aa, Mycobacterium
REAWAQIKAHLNDTDTV

SEQ ID NO: 1349091 - protein, 24 aa, Mycobacterium
REDLGIGPHRVWWVSELRAADDVK

SEQ ID NO: 1349092 - protein, 25 aa, Mycobacterium
REHPDYAVTVLDAFTYAGSRESLAP

SEQ ID NO: 1349093 - protein, 20 aa, Mycobacterium
RELAGATLTVGVKVATSVGG

SEQ ID NO: 1349094 - protein, 25 aa, Mycobacterium
REPALPVPAGWPFGEDFPRTCGTGR

SEQ ID NO: 1349095 - protein, 20 aa, Mycobacterium
REPTVRVALTRMVGAGDLVR

SEQ ID NO: 1349096 - protein, 19 aa, Mycobacterium
RETGCSSPLGAYVDNTRGL

SEQ ID NO: 1349097 - protein, 19 aa, Mycobacterium
RFAGGALFWTDFLYDDHGA

SEQ ID NO: 1349098 - protein, 18 aa, Mycobacterium
RFGIGGTDLGIMWDNGIK

SEQ ID NO: 1349099 - protein, 22 aa, Mycobacterium
RGANSWPDKFLAAAAGVAHGVA

SEQ ID NO: 1349100 - protein, 28 aa, Mycobacterium
RGATVARFAAGLAKHGSGTVLVGRDGSA

SEQ ID NO: 1349101 - protein, 17 aa, Mycobacterium
RGIGMSGALECRDLYDR

SEQ ID NO: 1349102 - protein, 20 aa, Mycobacterium
RGMTPRAALTKHLLDGDDSF

SEQ ID NO: 1349103 - protein, 24 aa, Mycobacterium
RGSLRDAWPPSAHGAPRTHELDVP

SEQ ID NO: 1349104 - protein, 25 aa, Mycobacterium
RGVVYRFGQVQSRVREPGLTLLVPV

SEQ ID NO: 1349105 - protein, 18 aa, Mycobacterium
RHHELLLSRGPYRYDDEL

SEQ ID NO: 1349106 - protein, 18 aa, Mycobacterium
RIDAFRVGVLGDEQRCLT

SEQ ID NO: 1349107 - protein, 17 aa, Mycobacterium
RIIATSAPRCVGNTLLL

SEQ ID NO: 1349108 - protein, 17 aa, Mycobacterium
RIPFPGNSHGTWQNLTR

SEQ ID NO: 1349109 - protein, 17 aa, Mycobacterium
RITGRRGDLVITDNLTA

SEQ ID NO: 1349110 - protein, 17 aa, Mycobacterium
RLAQRRLTLEVSLPAKK

SEQ ID NO: 1349111 - protein, 17 aa, Mycobacterium
RLGPERTAAICAVSPAL

SEQ ID NO: 1349112 - protein, 19 aa, Mycobacterium
RLNPRLLVDTHQGYQARCE

SEQ ID NO: 1349113 - protein, 28 aa, Mycobacterium
RLRAARATLRLGWQALRQPADLADLTTE

SEQ ID NO: 1349114 - protein, 24 aa, Mycobacterium
RLVKSGKVSEDWNKNATKGIPFGS

SEQ ID NO: 1349115 - protein, 25 aa, Mycobacterium
RLYDIEFALRLGASVEQVAEASGVD

SEQ ID NO: 1349116 - protein, 25 aa, Mycobacterium
RNDGTWYALYRKWLTVLGPAPAPPV

SEQ ID NO: 1349117 - protein, 25 aa, Mycobacterium
RNGGLRYAPRADLATREEQIAIAEV

SEQ ID NO: 1349118 - protein, 34 aa, Mycobacterium
RNPGRANGGLFARLYPLAGLFGIDTVTPDTEVSN

SEQ ID NO: 1349119 - protein, 20 aa, Mycobacterium
RPIANRALAEQAIHISSNPP

SEQ ID NO: 1349120 - protein, 28 aa, Mycobacterium
RPTPDRVRELVVAWGKQYPQFGVVGALD

SEQ ID NO: 1349121 - protein, 17 aa, Mycobacterium
RPTPELLAYQYLQTLPE

SEQ ID NO: 1349122 - protein, 19 aa, Mycobacterium
RPVPRGHRVLARGMSSGKV

SEQ ID NO: 1349123 - protein, 18 aa, Mycobacterium
RPYYLSWQEIERMADSGR

SEQ ID NO: 1349124 - protein, 18 aa, Mycobacterium
RQDFGPEFEDLREPITEL

SEQ ID NO: 1349125 - protein, 17 aa, Mycobacterium
RQGWGAWPTCSGRLGAS

SEQ ID NO: 1349126 - protein, 25 aa, Mycobacterium
RQYINYMAVKSWDSPGRWTTNYSAI

SEQ ID NO: 1349127 - protein, 18 aa, Mycobacterium
RQYMPWISLEDQVRAMLF

SEQ ID NO: 1349128 - protein, 18 aa, Mycobacterium
RRGYGLALVARRADQLRA

SEQ ID NO: 1349129 - protein, 22 aa, Mycobacterium
RRRVTAAVALALAVPFAATACG

SEQ ID NO: 1349130 - protein, 18 aa, Mycobacterium
RSGWRRALTGTLASGALA

SEQ ID NO: 1349131 - protein, 19 aa, Mycobacterium
RSLVRWSVAAAAGTALLSF

SEQ ID NO: 1349132 - protein, 18 aa, Mycobacterium
RSSPYLIGALKLMLTAPF

SEQ ID NO: 1349133 - protein, 17 aa, Mycobacterium
RSTWDVPTLALLGIGNG

SEQ ID NO: 1349134 - protein, 24 aa, Mycobacterium
RSVPGRGAGWIVVDVRDLAALHVA

SEQ ID NO: 1349135 - protein, 20 aa, Mycobacterium
RTAAAPAFFAGATAAISTAL

SEQ ID NO: 1349136 - protein, 18 aa, Mycobacterium
RTFLHRTAIGFVTAAGAI

SEQ ID NO: 1349137 - protein, 20 aa, Mycobacterium
RTGDLEGLANAFITGPAAVI

SEQ ID NO: 1349138 - protein, 17 aa, Mycobacterium
RTGEGLWQASETFTPHQ

SEQ ID NO: 1349139 - protein, 25 aa, Mycobacterium
RTKANLRMGRLLSEHVLRKARAKEA

SEQ ID NO: 1349140 - protein, 21 aa, Mycobacterium
RTLIEVAVRFVAVRGNAWRVG

SEQ ID NO: 1349141 - protein, 23 aa, Mycobacterium
RTMLREYLEAMRALWTQEEASYE

SEQ ID NO: 1349142 - protein, 17 aa, Mycobacterium
RTRLAAIAIPVATVPST

SEQ ID NO: 1349143 - protein, 28 aa, Mycobacterium
RTTGRLLGWRLGLDRVNPMGTTVLTSAG

SEQ ID NO: 1349144 - protein, 24 aa, Mycobacterium
RTVSGQLTLLIPFIDKIRARVDLR

SEQ ID NO: 1349145 - protein, 18 aa, Mycobacterium
RVAIGLSTTDTWWRIDWN

SEQ ID NO: 1349146 - protein, 25 aa, Mycobacterium
RVFTFKLREGVTFHDGTPFTAEAVK

SEQ ID NO: 1349147 - protein, 19 aa, Mycobacterium
RVLADPAPILAQILQNQWN

SEQ ID NO: 1349148 - protein, 22 aa, Mycobacterium
RVSSRPPILFGVNISAQAVAVA

SEQ ID NO: 1349149 - protein, 18 aa, Mycobacterium
RWAALLVSVTLALTACGS

SEQ ID NO: 1349150 - protein, 34 aa, Mycobacterium
RWEPCPDGTAADGLQVFRFVPTVPDGSMTDPAST

SEQ ID NO: 1349151 - protein, 24 aa, Mycobacterium
RYGQPPVWGTCQQWGDASRIPTAQ

SEQ ID NO: 1349152 - protein, 20 aa, Mycobacterium
RYKGGVVGFRNRKHFFTDWS

SEQ ID NO: 1349153 - protein, 26 aa, Mycobacterium
SAAAPPWAMPDVRGMNLQQATDTIKG

SEQ ID NO: 1349154 - protein, 23 aa, Mycobacterium
SAARRAGDRAGRRARLGPSQELA

SEQ ID NO: 1349155 - protein, 17 aa, Mycobacterium
SAIELQHKGFPIIDSLS

SEQ ID NO: 1349156 - protein, 20 aa, Mycobacterium
SALNRAGVRYDNPVDTVALG

SEQ ID NO: 1349157 - protein, 27 aa, Mycobacterium
SAPVINRLLAAFGLGSLRNLPSLPSPA

SEQ ID NO: 1349158 - protein, 24 aa, Mycobacterium
SAQACPDVEIVFARGTGEAVGVGG

SEQ ID NO: 1349159 - protein, 19 aa, Mycobacterium
SAQSCPQAELIFARGRTES

SEQ ID NO: 1349160 - protein, 24 aa, Mycobacterium
SDGICAGTGGLWSASAAPGATPAT

SEQ ID NO: 1349161 - protein, 25 aa, Mycobacterium
SDLPSSVQLPVWLARSQALVDKHPI

SEQ ID NO: 1349162 - protein, 20 aa, Mycobacterium
SDMWYPYPCEFDYLCDDGGS

SEQ ID NO: 1349163 - protein, 22 aa, Mycobacterium
SDVPAWPNPFSLLNTLTAVVAP

SEQ ID NO: 1349164 - protein, 17 aa, Mycobacterium
SDVRRSRKGAPLPPAGG

SEQ ID NO: 1349165 - protein, 25 aa, Mycobacterium
SEAAKAAADTGCWLNIADVDDFVVA

SEQ ID NO: 1349166 - protein, 19 aa, Mycobacterium
SELCEIRGAAPPLVTGQYR

SEQ ID NO: 1349167 - protein, 23 aa, Mycobacterium
SELRTAGVGLNIWPNGVRVLDGL

SEQ ID NO: 1349168 - protein, 21 aa, Mycobacterium
SFTHFRGSPIGRERKTEELSR

SEQ ID NO: 1349169 - protein, 19 aa, Mycobacterium
SGAAEEFYRGAPYGVGYFA

SEQ ID NO: 1349170 - protein, 22 aa, Mycobacterium
SGALECRDLYDRQEMIEQAQFA

SEQ ID NO: 1349171 - protein, 17 aa, Mycobacterium
SGASVAISDVNLEGLAV

SEQ ID NO: 1349172 - protein, 24 aa, Mycobacterium
SGDGMTCYWKRVGADGKLLDNALT

SEQ ID NO: 1349173 - protein, 19 aa, Mycobacterium
SGGDEIRRSDAPRLVDLVR

SEQ ID NO: 1349174 - protein, 25 aa, Mycobacterium
SGGVWCPPNPIAQVLDRKGEEVSVT

SEQ ID NO: 1349175 - protein, 24 aa, Mycobacterium
SGSAKWNLLAPYAVKSDGGKNPQA

SEQ ID NO: 1349176 - protein, 20 aa, Mycobacterium
SGSDAIFLLTQRPLDPAATP

SEQ ID NO: 1349177 - protein, 25 aa, Mycobacterium
SGVNYAAALLGAFAVFALAPATAAA

SEQ ID NO: 1349178 - protein, 24 aa, Mycobacterium
SIDGNEFDARFDASVQQIYDSGDV

SEQ ID NO: 1349179 - protein, 17 aa, Mycobacterium
SIGPLGLAGRQASHRVS

SEQ ID NO: 1349180 - protein, 17 aa, Mycobacterium
SINLAGELGRWVLRNAC

SEQ ID NO: 1349181 - protein, 20 aa, Mycobacterium
SKPSVKRNTLLRNVFGGPKG

SEQ ID NO: 1349182 - protein, 19 aa, Mycobacterium
SKYRGEFEERLKAVLDDIK

SEQ ID NO: 1349183 - protein, 23 aa, Mycobacterium
SLANALAGLVYVHGDQGPDNVDL

SEQ ID NO: 1349184 - protein, 25 aa, Mycobacterium
SLRPTRRGDLRSALVTARSIGPLGL

SEQ ID NO: 1349185 - protein, 25 aa, Mycobacterium
SLTMYEMPASLLVANPMQRYLINSP

SEQ ID NO: 1349186 - protein, 23 aa, Mycobacterium
SMPGQKLPFAIAPTAQGARGSDV

SEQ ID NO: 1349187 - protein, 18 aa, Mycobacterium
SNAGGYRGSMNVTDALAT

SEQ ID NO: 1349188 - protein, 21 aa, Mycobacterium
SNDYWYLALNEARAPWNDVRV

SEQ ID NO: 1349189 - protein, 22 aa, Mycobacterium
SPEVKKAVNFYVDTVKNFGELG

SEQ ID NO: 1349190 - protein, 18 aa, Mycobacterium
SPGASWMTGEVLDLNGGA

SEQ ID NO: 1349191 - protein, 31 aa, Mycobacterium
SPTPGELCSFPLRQCGSGNLFGGNEPARTWF

SEQ ID NO: 1349192 - protein, 18 aa, Mycobacterium
SPVIEKWSDIDAVLAASG

SEQ ID NO: 1349193 - protein, 18 aa, Mycobacterium
SRAFASSCNTTFAELASR

SEQ ID NO: 1349194 - protein, 26 aa, Mycobacterium
SRGLSYLRDLWHAVQTQEVSGSDAIF

SEQ ID NO: 1349195 - protein, 25 aa, Mycobacterium
SRLVLEPSGALGMIMANGTRIMYRS

SEQ ID NO: 1349196 - protein, 19 aa, Mycobacterium
SRRELERSVATRSVSTSTP

SEQ ID NO: 1349197 - protein, 21 aa, Mycobacterium
SRSQVLSALFDRTPPTPSTAA

SEQ ID NO: 1349198 - protein, 22 aa, Mycobacterium
SRYPDIKVLAIDTANWKRDEAV

SEQ ID NO: 1349199 - protein, 18 aa, Mycobacterium
SSEYAVQMLRGMLDGLPA

SEQ ID NO: 1349200 - protein, 22 aa, Mycobacterium
SSMRAGLPPGWTTADKTGSGDY

SEQ ID NO: 1349201 - protein, 24 aa, Mycobacterium
SSNPPVPGRFYWTSDTQVRWRPQD

SEQ ID NO: 1349202 - protein, 28 aa, Mycobacterium
SSPRVANAVRFAFWGSEEIGLEGSRAYL

SEQ ID NO: 1349203 - protein, 22 aa, Mycobacterium
STAAHFGWIGALFALDVPASSD

SEQ ID NO: 1349204 - protein, 21 aa, Mycobacterium
STDTIPYAVRGTLWEATATDE

SEQ ID NO: 1349205 - protein, 20 aa, Mycobacterium
STGFGDLDWQPLPPECVTAV

SEQ ID NO: 1349206 - protein, 18 aa, Mycobacterium
STHVGRFIGIPDLLVEAP

SEQ ID NO: 1349207 - protein, 27 aa, Mycobacterium
STPLKRWQLCLNVNLTGVFLVTKAVIP

SEQ ID NO: 1349208 - protein, 25 aa, Mycobacterium
STTDTWWRIDWNTLLDKTIPVGLFT

SEQ ID NO: 1349209 - protein, 25 aa, Mycobacterium
STTVFGAKFVRFFPPEDPSPEKLRK

SEQ ID NO: 1349210 - protein, 24 aa, Mycobacterium
STWGQFPAAVSWQAATQRAGQGVV

SEQ ID NO: 1349211 - protein, 22 aa, Mycobacterium
SVARLVGAPPGYIGYDQGGQLT

SEQ ID NO: 1349212 - protein, 23 aa, Mycobacterium
SVFRPDTRLAVTIPTVDPQRGRL

SEQ ID NO: 1349213 - protein, 29 aa, Mycobacterium
SVGNIVGATLRWESFFTNPVQAFYVDNPV

SEQ ID NO: 1349214 - protein, 30 aa, Mycobacterium
SVQAVRPGWRTDFLTQMGFTVADPGDPLIP

SEQ ID NO: 1349215 - protein, 20 aa, Mycobacterium
SVSLPFQLGFARVYRVFAER

SEQ ID NO: 1349216 - protein, 17 aa, Mycobacterium
SVSNLRFEADHVLVDVD

SEQ ID NO: 1349217 - protein, 19 aa, Mycobacterium
SVYSPCALTPLVGYVDTGA

SEQ ID NO: 1349218 - protein, 21 aa, Mycobacterium
SWDSPGRWTTNYSAIAYSDDN

SEQ ID NO: 1349219 - protein, 28 aa, Mycobacterium
SWTGAGGVKGFFEKTFAPLGLKKIQAQV

SEQ ID NO: 1349220 - protein, 25 aa, Mycobacterium
SWVGDAFPLSGLTQIYASNGESNFG

SEQ ID NO: 1349221 - protein, 19 aa, Mycobacterium
SYAAYILAAFREARPDLDV

SEQ ID NO: 1349222 - protein, 22 aa, Mycobacterium
SYGTDRPCAGITITTPVVEGTR

SEQ ID NO: 1349223 - protein, 19 aa, Mycobacterium
SYPTDDFYLYYSGNEKAYP

SEQ ID NO: 1349224 - protein, 18 aa, Mycobacterium
TAAFEWYLDSGLSVIMPV

SEQ ID NO: 1349225 - protein, 29 aa, Mycobacterium
TAEDLKGNYLYRMAGAVFGIYGNTAAEAL

SEQ ID NO: 1349226 - protein, 22 aa, Mycobacterium
TAFGSFPDINWMNVPGDIAGAF

SEQ ID NO: 1349227 - protein, 25 aa, Mycobacterium
TAGAFSRPGLPVEYLDVFSQSMNRN

SEQ ID NO: 1349228 - protein, 18 aa, Mycobacterium
TAGEAMPSMLPFTDDDFA

SEQ ID NO: 1349229 - protein, 25 aa, Mycobacterium
TASELIRLTADFDIREPTVRVALTR

SEQ ID NO: 1349230 - protein, 27 aa, Mycobacterium
TCPDARPSPPVSYCPATGRLVVDLAEL

SEQ ID NO: 1349231 - protein, 21 aa, Mycobacterium
TDEAIVRWRGVFETAQAGVPA

SEQ ID NO: 1349232 - protein, 20 aa, Mycobacterium
TDIIGYRASNSIDVKIRDLS

SEQ ID NO: 1349233 - protein, 24 aa, Mycobacterium
TDWNNRWWTTCAVAFDTSYGVIQQ

SEQ ID NO: 1349234 - protein, 18 aa, Mycobacterium
TEIRRVVQVLSRRTKNNP

SEQ ID NO: 1349235 - protein, 21 aa, Mycobacterium
TEKNFKWIAKSADGWITTPRD

SEQ ID NO: 1349236 - protein, 23 aa, Mycobacterium
TESNRSSAFLGFTNQLAAANYIY

SEQ ID NO: 1349237 - protein, 24 aa, Mycobacterium
TESSRIAVCKSPDGKYQYRGVRVR

SEQ ID NO: 1349238 - protein, 26 aa, Mycobacterium
TETDFATAFVRFAGFRRARVRALVRE

SEQ ID NO: 1349239 - protein, 17 aa, Mycobacterium
TETIGGTTLSFWTPPGV

SEQ ID NO: 1349240 - protein, 26 aa, Mycobacterium
TFGAGMGISTWWYRGSDMDVERELEQ

SEQ ID NO: 1349241 - protein, 24 aa, Mycobacterium
TFLTQELPGWLAANRGQDPRGNAV

SEQ ID NO: 1349242 - protein, 26 aa, Mycobacterium
TFNFPANGTHGWGYWGSQLNAMKGDI

SEQ ID NO: 1349243 - protein, 17 aa, Mycobacterium
TGDTFLGFERWAPEMPW

SEQ ID NO: 1349244 - protein, 17 aa, Mycobacterium
TGNQWGAEPGGPGNPGL

SEQ ID NO: 1349245 - protein, 17 aa, Mycobacterium
TGPFSFAGATSGDSITL

SEQ ID NO: 1349246 - protein, 20 aa, Mycobacterium
TGPRGAATVAEIPLRSGDVT

SEQ ID NO: 1349247 - protein, 18 aa, Mycobacterium
THQREFMSALLHRAASPA

SEQ ID NO: 1349248 - protein, 25 aa, Mycobacterium
TICPGFFDCHVHFSLPGAGATPIDR

SEQ ID NO: 1349249 - protein, 21 aa, Mycobacterium
TIPAILSAPLFVGIEEGIFEK

SEQ ID NO: 1349250 - protein, 25 aa, Mycobacterium
TKSIRDLKKSLADASRSRAADDSSD

SEQ ID NO: 1349251 - protein, 25 aa, Mycobacterium
TLAVSLAGWCERYPDVTVHRESVFD

SEQ ID NO: 1349252 - protein, 20 aa, Mycobacterium
TLSNWRGLYGPPDMPQFAVA

SEQ ID NO: 1349253 - protein, 25 aa, Mycobacterium
TMIKACPVTWPWNLLGWPSINVPAG

SEQ ID NO: 1349254 - protein, 26 aa, Mycobacterium
TMRPILRRRVITGLTVAQFFPQSPII

SEQ ID NO: 1349255 - protein, 20 aa, Mycobacterium
TMVPGRVFEVNTVLPESDVA

SEQ ID NO: 1349256 - protein, 27 aa, Mycobacterium
TPGMSASVTFHFDRAGDIEMPVPVEAC

SEQ ID NO: 1349257 - protein, 23 aa, Mycobacterium
TPLARGPACWYFDEGELDVWEVF

SEQ ID NO: 1349258 - protein, 17 aa, Mycobacterium
TPPDVVTDIGIKQAIAL

SEQ ID NO: 1349259 - protein, 17 aa, Mycobacterium
TPPYPAAPGASASGSGV

SEQ ID NO: 1349260 - protein, 18 aa, Mycobacterium
TPSALPRSDRDNEYLTHW

SEQ ID NO: 1349261 - protein, 18 aa, Mycobacterium
TPVLRMRSGQTVTIDALS

SEQ ID NO: 1349262 - protein, 18 aa, Mycobacterium
TPYEAGVALARQMGASLI

SEQ ID NO: 1349263 - protein, 22 aa, Mycobacterium
TQGEINRALLFASVSVVGTHAA

SEQ ID NO: 1349264 - protein, 25 aa, Mycobacterium
TQIFQRLQLIYLFTIGHKKAASIED

SEQ ID NO: 1349265 - protein, 19 aa, Mycobacterium
TRGSVVFRLAADGSQVALT

SEQ ID NO: 1349266 - protein, 17 aa, Mycobacterium
TRIEDLWDPAFKGRVSL

SEQ ID NO: 1349267 - protein, 27 aa, Mycobacterium
TRIVLEGRPSRTFGWARGGEITVTLPP

SEQ ID NO: 1349268 - protein, 21 aa, Mycobacterium
TRLAARAVLGRIGKPVEIADA

SEQ ID NO: 1349269 - protein, 18 aa, Mycobacterium
TRLLTFVAAGVTVAGVAG

SEQ ID NO: 1349270 - protein, 21 aa, Mycobacterium
TRLVPERGYALELITPVPLPR

SEQ ID NO: 1349271 - protein, 17 aa, Mycobacterium
TRRPDLRLEPGGSHVVD

SEQ ID NO: 1349272 - protein, 20 aa, Mycobacterium
TRTAGWSVYLVDGDGAAAQR

SEQ ID NO: 1349273 - protein, 25 aa, Mycobacterium
TRVECNCAGVAPGHVYTARQLLEAL

SEQ ID NO: 1349274 - protein, 21 aa, Mycobacterium
TRVSAYFGARGAFAPAPVDPT

SEQ ID NO: 1349275 - protein, 19 aa, Mycobacterium
TSATNEWPANAGVRSTGID

SEQ ID NO: 1349276 - protein, 20 aa, Mycobacterium
TSAYFSFEVLENVFDTLVEP

SEQ ID NO: 1349277 - protein, 20 aa, Mycobacterium
TSGLLDWAERLGYGVDFDKR

SEQ ID NO: 1349278 - protein, 24 aa, Mycobacterium
TSLTRLTPVLSHRSPELALARANE

SEQ ID NO: 1349279 - protein, 17 aa, Mycobacterium
TSNGEWAKKNEVFRDEA

SEQ ID NO: 1349280 - protein, 18 aa, Mycobacterium
TSQFAEWIDRGRPAPNHH

SEQ ID NO: 1349281 - protein, 27 aa, Mycobacterium
TSSKMPGLYAPMIHPWSSTDNVSAADQ

SEQ ID NO: 1349282 - protein, 18 aa, Mycobacterium
TSVGCQWLAGGSIVGPHF

SEQ ID NO: 1349283 - protein, 23 aa, Mycobacterium
TTDPPVTGSWYWVDDQTAHWRPE

SEQ ID NO: 1349284 - protein, 36 aa, Mycobacterium
TTMLQSGRFQLTWKPEFPYIALAVIAKQSWADAHRD

SEQ ID NO: 1349285 - protein, 25 aa, Mycobacterium
TVAQLLTMRSGLYGYTGDEALSAAM

SEQ ID NO: 1349286 - protein, 19 aa, Mycobacterium
TVDAITFAGIQLRDNAVRP

SEQ ID NO: 1349287 - protein, 17 aa, Mycobacterium
TVDEWRATMNVNVIGAV

SEQ ID NO: 1349288 - protein, 22 aa, Mycobacterium
TVLPRLAARHHVLIAAVTDPRV

SEQ ID NO: 1349289 - protein, 20 aa, Mycobacterium
TVQNARFSVPLAEKAGTSGI

SEQ ID NO: 1349290 - protein, 26 aa, Mycobacterium
TVSGGVWWDCYRDLVSNVVLVDKITG

SEQ ID NO: 1349291 - protein, 17 aa, Mycobacterium
TVTDLKASTDTIPYAVR

SEQ ID NO: 1349292 - protein, 18 aa, Mycobacterium
TVVGGYQLSPAVALAEPD

SEQ ID NO: 1349293 - protein, 17 aa, Mycobacterium
TYFGRGKKAEQLYPPNM

SEQ ID NO: 1349294 - protein, 24 aa, Mycobacterium
TYTFTLRDGVKFSDGTPFDSAAAK

SEQ ID NO: 1349295 - protein, 29 aa, Mycobacterium
TYTLDRFYPGDVVDVTWIDGFGQERTAKA

SEQ ID NO: 1349296 - protein, 24 aa, Mycobacterium
VAAEPRPTMLVAISPSDGGILAAA

SEQ ID NO: 1349297 - protein, 24 aa, Mycobacterium
VADRFLVLPMPKWAAHPIDPISIR

SEQ ID NO: 1349298 - protein, 24 aa, Mycobacterium
VADVALRVLAPMGLVFDENSPWLD

SEQ ID NO: 1349299 - protein, 22 aa, Mycobacterium
VAERYKRGLVASGAPNTDDVAF

SEQ ID NO: 1349300 - protein, 18 aa, Mycobacterium
VAMMGNFEVVPPTPIQLR

SEQ ID NO: 1349301 - protein, 20 aa, Mycobacterium
VAPEVLGVVVPFLALQPLVE

SEQ ID NO: 1349302 - protein, 24 aa, Mycobacterium
VAPYLKGWEAVLGRQRVGIYANSK

SEQ ID NO: 1349303 - protein, 24 aa, Mycobacterium
VASVSRLLGTVAGFAGSAIFETGL

SEQ ID NO: 1349304 - protein, 22 aa, Mycobacterium
VATQNPWLARGLDPEQKAHRLA

SEQ ID NO: 1349305 - protein, 21 aa, Mycobacterium
VCTHKGCKVSEVVGGEIVCPC

SEQ ID NO: 1349306 - protein, 19 aa, Mycobacterium
VDAAALVGPVWRRDAVFEF

SEQ ID NO: 1349307 - protein, 23 aa, Mycobacterium
VDGADGFRLTRVTVRDTLADGIH

SEQ ID NO: 1349308 - protein, 17 aa, Mycobacterium
VDGIGFVETERGRASYT

SEQ ID NO: 1349309 - protein, 17 aa, Mycobacterium
VDITRFWFEEGSLDNEQ

SEQ ID NO: 1349310 - protein, 28 aa, Mycobacterium
VDPDVRNTVRFGFWGAEEQGLLGSMDYV

SEQ ID NO: 1349311 - protein, 17 aa, Mycobacterium
VDPSILLDVRYITPHNF

SEQ ID NO: 1349312 - protein, 18 aa, Mycobacterium
VDSFVYDFLDPVVNDALN

SEQ ID NO: 1349313 - protein, 17 aa, Mycobacterium
VDTCAAEFEAKTPYHYS

SEQ ID NO: 1349314 - protein, 17 aa, Mycobacterium
VDVAIEHVVTGRQQFLD

SEQ ID NO: 1349315 - protein, 24 aa, Mycobacterium
VDVAYEFTGNAWINYLGHEKPIPN

SEQ ID NO: 1349316 - protein, 23 aa, Mycobacterium
VECSQAGWTWLISDFGEETPGFS

SEQ ID NO: 1349317 - protein, 19 aa, Mycobacterium
VEDHIAFLLKDDFDDPIAH

SEQ ID NO: 1349318 - protein, 24 aa, Mycobacterium
VELPLCALITAWARGEYAPRAAAE

SEQ ID NO: 1349319 - protein, 19 aa, Mycobacterium
VELRGGMRAWQADGRPLTG

SEQ ID NO: 1349320 - protein, 23 aa, Mycobacterium
VELTRRASLIPSLVHTVQTFAAH

SEQ ID NO: 1349321 - protein, 18 aa, Mycobacterium
VFAERGATVFGISRDADR

SEQ ID NO: 1349322 - protein, 25 aa, Mycobacterium
VFAQLRFEREQRYTAVFANVSGLTS

SEQ ID NO: 1349323 - protein, 17 aa, Mycobacterium
VGANGDGGAGARGGDAG

SEQ ID NO: 1349324 - protein, 19 aa, Mycobacterium
VGARFARRVLSAVADPGLG

SEQ ID NO: 1349325 - protein, 26 aa, Mycobacterium
VGAVEPTLRLLVDMGYTDRDYQNADK

SEQ ID NO: 1349326 - protein, 21 aa, Mycobacterium
VGGTPRPAPVGTDGTIVVGMS

SEQ ID NO: 1349327 - protein, 18 aa, Mycobacterium
VGIKSAVGDLEFWEQLTD

SEQ ID NO: 1349328 - protein, 23 aa, Mycobacterium
VGIKSAVGGLQFWHELADQMADG

SEQ ID NO: 1349329 - protein, 18 aa, Mycobacterium
VGLPDVVPDIGFSAPVHL

SEQ ID NO: 1349330 - protein, 17 aa, Mycobacterium
VGPVWRRDAVFEFSGAV

SEQ ID NO: 1349331 - protein, 25 aa, Mycobacterium
VGSRYALAAYPGYWGEKPYFEQVEI

SEQ ID NO: 1349332 - protein, 17 aa, Mycobacterium
VGSVEWDDELTITERAK

SEQ ID NO: 1349333 - protein, 25 aa, Mycobacterium
VGVVGLPAWFLGVGVASAEPVAGQE

SEQ ID NO: 1349334 - protein, 32 aa, Mycobacterium
VIAVPRPGTPIQWAPCQAGAPSDESRIPAGAE

SEQ ID NO: 1349335 - protein, 23 aa, Mycobacterium
VIDGQGADALWFLPLLGQDARDL

SEQ ID NO: 1349336 - protein, 18 aa, Mycobacterium
VIGNWRGGVGTTWEARIK

SEQ ID NO: 1349337 - protein, 18 aa, Mycobacterium
VIQLSAYVVAGFPKPQNP

SEQ ID NO: 1349338 - protein, 21 aa, Mycobacterium
VKADDHLVVFYGSRNDERVEP

SEQ ID NO: 1349339 - protein, 25 aa, Mycobacterium
VKEAVLPFHRFRKADGAQIDSLLGP

SEQ ID NO: 1349340 - protein, 22 aa, Mycobacterium
VKEQLARLASELGPSGGVSDTS

SEQ ID NO: 1349341 - protein, 18 aa, Mycobacterium
VKFQGGGTKAVYLLDGLR

SEQ ID NO: 1349342 - protein, 27 aa, Mycobacterium
VKGEVLRLRWRRGCMPAPRRVVRARVH

SEQ ID NO: 1349343 - protein, 24 aa, Mycobacterium
VKIVELFQAPWWVPFKQADRARYR

SEQ ID NO: 1349344 - protein, 17 aa, Mycobacterium
VLAAPIAAFGFDRPLPP

SEQ ID NO: 1349345 - protein, 22 aa, Mycobacterium
VLAGCAPGLAANPRFATDNGAR

SEQ ID NO: 1349346 - protein, 24 aa, Mycobacterium
VLAGLVYIGWRLMRVSATRPQRRV

SEQ ID NO: 1349347 - protein, 22 aa, Mycobacterium
VLGCAAMARFAEPLSQRLGVPV

SEQ ID NO: 1349348 - protein, 25 aa, Mycobacterium
VLGPEAFDAVPFLELLTAYGSPWGV

SEQ ID NO: 1349349 - protein, 23 aa, Mycobacterium
VLIIGGGFGGLFCARRLSRADVD

SEQ ID NO: 1349350 - protein, 24 aa, Mycobacterium
VLSVELRAPLRGVAAGQTMVIYRP

SEQ ID NO: 1349351 - protein, 19 aa, Mycobacterium
VMFHLGKFIPTGVPDTYGF

SEQ ID NO: 1349352 - protein, 18 aa, Mycobacterium
VMFPEIKTIGGYRQDPLK

SEQ ID NO: 1349353 - protein, 20 aa, Mycobacterium
VMTVLTWRLDMDALAATAER

SEQ ID NO: 1349354 - protein, 20 aa, Mycobacterium
VNFGPSWAWPKPVQAHIPVL

SEQ ID NO: 1349355 - protein, 17 aa, Mycobacterium
VNIPTPPYPAAPGASAS

SEQ ID NO: 1349356 - protein, 23 aa, Mycobacterium
VNKMKNWISSFGPQINGVVAQND

SEQ ID NO: 1349357 - protein, 25 aa, Mycobacterium
VNLNGPFFLCRAALPHLLETGGSIV

SEQ ID NO: 1349358 - protein, 17 aa, Mycobacterium
VNPPDFLTGAMANLSGQ

SEQ ID NO: 1349359 - protein, 17 aa, Mycobacterium
VNVSSVFGLFAVPGQGA

SEQ ID NO: 1349360 - protein, 24 aa, Mycobacterium
VPDGLRCGNVYYGPVIPTRDVYTW

SEQ ID NO: 1349361 - protein, 17 aa, Mycobacterium
VPLEPGRQTVGFSVTVI

SEQ ID NO: 1349362 - protein, 44 aa, Mycobacterium
VPQPLRYTWDGARWTQSYDWQWDCFMGDGVPKVWAPARSFVYYV

SEQ ID NO: 1349363 - protein, 18 aa, Mycobacterium
VPSGFSRIDAFRVGVLGD

SEQ ID NO: 1349364 - protein, 19 aa, Mycobacterium
VQARLWGGRAGAAFDPNYH

SEQ ID NO: 1349365 - protein, 21 aa, Mycobacterium
VQYPAELPVDPSVAAGQKPLG

SEQ ID NO: 1349366 - protein, 26 aa, Mycobacterium
VRAEADPTVLANWLAAVEEIRTKGTV

SEQ ID NO: 1349367 - protein, 24 aa, Mycobacterium
VRDEGRWEVRWATTGLHPRLGENQ

SEQ ID NO: 1349368 - protein, 23 aa, Mycobacterium
VRLSADGQVEWVLGNLGDIPAVT

SEQ ID NO: 1349369 - protein, 17 aa, Mycobacterium
VRNPRTVTSFSPIDRIG

SEQ ID NO: 1349370 - protein, 22 aa, Mycobacterium
VRPENSHPFLADGIAMAHNGSI

SEQ ID NO: 1349371 - protein, 22 aa, Mycobacterium
VRPRVPAPLLEIYDRNVSARRQ

SEQ ID NO: 1349372 - protein, 17 aa, Mycobacterium
VRRLEIEEMALAKEEDD

SEQ ID NO: 1349373 - protein, 25 aa, Mycobacterium
VRSDQGWEAPIYKKGGIWYVKHTVP

SEQ ID NO: 1349374 - protein, 21 aa, Mycobacterium
VRSRHGITLAPRVAHDVAEYA

SEQ ID NO: 1349375 - protein, 24 aa, Mycobacterium
VRTGVWRMNTLFRSTDTVLSNGMY

SEQ ID NO: 1349376 - protein, 17 aa, Mycobacterium
VSEPTAWAVEGLLPYVA

SEQ ID NO: 1349377 - protein, 17 aa, Mycobacterium
VSGCGLGSGSTVPLMVG

SEQ ID NO: 1349378 - protein, 20 aa, Mycobacterium
VSPDGRRLYTANADSTVTVI

SEQ ID NO: 1349379 - protein, 21 aa, Mycobacterium
VTAWRFLSPPSAFLEGLTVGA

SEQ ID NO: 1349380 - protein, 19 aa, Mycobacterium
VTDDLGWTYRFEQISFDGL

SEQ ID NO: 1349381 - protein, 19 aa, Mycobacterium
VTLGAGIPLGVLPARTAEF

SEQ ID NO: 1349382 - protein, 24 aa, Mycobacterium
VTPPRAVNPITLIIRTVTNAVRAS

SEQ ID NO: 1349383 - protein, 17 aa, Mycobacterium
VTRRRARRVYQLTDAGK

SEQ ID NO: 1349384 - protein, 18 aa, Mycobacterium
VTSCRSVLALAASYDVEM

SEQ ID NO: 1349385 - protein, 19 aa, Mycobacterium
VTVIRLREADFTPIADQLR

SEQ ID NO: 1349386 - protein, 19 aa, Mycobacterium
VTVKTSWTGAGGVKGFFEK

SEQ ID NO: 1349387 - protein, 20 aa, Mycobacterium
VTYHPTCHSLRMLRVGEKPL

SEQ ID NO: 1349388 - protein, 17 aa, Mycobacterium
VTYRDGVAIEWDKTAFV

SEQ ID NO: 1349389 - protein, 21 aa, Mycobacterium
VVAAYRPANQRGTGAAPASAQ

SEQ ID NO: 1349390 - protein, 22 aa, Mycobacterium
VVDAVGGVTMCPAEPINDPLAG

SEQ ID NO: 1349391 - protein, 17 aa, Mycobacterium
VVGGIGLMSNRASDVVA

SEQ ID NO: 1349392 - protein, 18 aa, Mycobacterium
VVLLRTGLVLSPSGGLLS

SEQ ID NO: 1349393 - protein, 18 aa, Mycobacterium
VVLTEGWQAGGAGMEIPP

SEQ ID NO: 1349394 - protein, 17 aa, Mycobacterium
VVRMPKATFSQVVGTDA

SEQ ID NO: 1349395 - protein, 17 aa, Mycobacterium
VVTGPIFVEGAEPGDVL

SEQ ID NO: 1349396 - protein, 25 aa, Mycobacterium
VVVPAYKIVPAFIEAAQGNKAGAQV

SEQ ID NO: 1349397 - protein, 25 aa, Mycobacterium
VVYNDGGQDLLLWVQPPPSSTSSST

SEQ ID NO: 1349398 - protein, 17 aa, Mycobacterium
VWANVWPTDEIIRIDPG

SEQ ID NO: 1349399 - protein, 20 aa, Mycobacterium
VWHDRITRTAGWSVYLVDGD

SEQ ID NO: 1349400 - protein, 20 aa, Mycobacterium
VWRILRDGVVGRTYLIGAEG

SEQ ID NO: 1349401 - protein, 18 aa, Mycobacterium
WATQMSYSGIYVHSAPWS

SEQ ID NO: 1349402 - protein, 17 aa, Mycobacterium
WCDLGYNALVDKFGQVF

SEQ ID NO: 1349403 - protein, 21 aa, Mycobacterium
WDADGGLNYLGCSAPPVTSAL

SEQ ID NO: 1349404 - protein, 17 aa, Mycobacterium
WDGSKWVRNRPAVAAPI

SEQ ID NO: 1349405 - protein, 17 aa, Mycobacterium
WDKPFNMGRYVTDQEHV

SEQ ID NO: 1349406 - protein, 22 aa, Mycobacterium
WDLDQFRVWAPMAGRFDSRYDE

SEQ ID NO: 1349407 - protein, 17 aa, Mycobacterium
WDLPAWAAQGRRLLDDM

SEQ ID NO: 1349408 - protein, 19 aa, Mycobacterium
WDTPGRWTTNYSAISIYDQ

SEQ ID NO: 1349409 - protein, 17 aa, Mycobacterium
WDYVRQFTEFTGYQHRV

SEQ ID NO: 1349410 - protein, 25 aa, Mycobacterium
WGGPPRISGVTFRFISEPSTALSAL

SEQ ID NO: 1349411 - protein, 24 aa, Mycobacterium
WHTWRMTWQPQGMYFWKDYQPGME

SEQ ID NO: 1349412 - protein, 20 aa, Mycobacterium
WIAKSADGWITTPRDFDIDA

SEQ ID NO: 1349413 - protein, 18 aa, Mycobacterium
WIPNQWPPVYTGFWTATY

SEQ ID NO: 1349414 - protein, 19 aa, Mycobacterium
WKLQATKSRVRDVKATVDV

SEQ ID NO: 1349415 - protein, 21 aa, Mycobacterium
WKQADHRGRVALLKQTDSRPY

SEQ ID NO: 1349416 - protein, 20 aa, Mycobacterium
WLGMRRELIAAVVEEAAAYG

SEQ ID NO: 1349417 - protein, 19 aa, Mycobacterium
WMAADAFRAAFPAVHLDPD

SEQ ID NO: 1349418 - protein, 20 aa, Mycobacterium
WNLIMRIAAPRGMMDVADVA

SEQ ID NO: 1349419 - protein, 25 aa, Mycobacterium
WPAIPDKRLELMLVCAHPSVAVNVR

SEQ ID NO: 1349420 - protein, 23 aa, Mycobacterium
WPDRPGVAGCAALDGTVLVNLVN

SEQ ID NO: 1349421 - protein, 20 aa, Mycobacterium
WPDRRLSRRGLEIVSRRSPR

SEQ ID NO: 1349422 - protein, 19 aa, Mycobacterium
WPNGVRVLDGLGLGAQFRS

SEQ ID NO: 1349423 - protein, 17 aa, Mycobacterium
WQAKVVQMDGRRIDLLE

SEQ ID NO: 1349424 - protein, 19 aa, Mycobacterium
WRATMNVNVIGAVALTLAL

SEQ ID NO: 1349425 - protein, 19 aa, Mycobacterium
WSDVTGRAISTWTRDSQGW

SEQ ID NO: 1349426 - protein, 18 aa, Mycobacterium
WTAAGGWTDGQHRLGTSP

SEQ ID NO: 1349427 - protein, 21 aa, Mycobacterium
WTDGMLYPLLHRLERLGYVSA

SEQ ID NO: 1349428 - protein, 18 aa, Mycobacterium
WTEQCLLSPYGLLHTRVT

SEQ ID NO: 1349429 - protein, 30 aa, Mycobacterium
WVLAPSTIRSAGWFRSSTRYVAGSQNFQQA

SEQ ID NO: 1349430 - protein, 18 aa, Mycobacterium
YAALMAGADLVLPDRFMD

SEQ ID NO: 1349431 - protein, 18 aa, Mycobacterium
YAAVAGRQDSFTDLVPRL

SEQ ID NO: 1349432 - protein, 17 aa, Mycobacterium
YDFLDPVVNDALNPAVW

SEQ ID NO: 1349433 - protein, 18 aa, Mycobacterium
YEGLPVEGYTKWLENMAA

SEQ ID NO: 1349434 - protein, 37 aa, Mycobacterium
YERVGRATMIAMWRVGRGSVLAALALVVAGAVAPPAS

SEQ ID NO: 1349435 - protein, 25 aa, Mycobacterium
YFFTTPSGRWECAVVPRVQAGCQAA

SEQ ID NO: 1349436 - protein, 21 aa, Mycobacterium
YGGALWDLLFEAGRDHGVIAA

SEQ ID NO: 1349437 - protein, 28 aa, Mycobacterium
YGLFARAGLHDRVTWIGSGKLGLPGNAM

SEQ ID NO: 1349438 - protein, 17 aa, Mycobacterium
YGTRIGAAYAEQFPEKV

SEQ ID NO: 1349439 - protein, 17 aa, Mycobacterium
YINAGMVNQAADFIAGR

SEQ ID NO: 1349440 - protein, 21 aa, Mycobacterium
YIPFLELHAPTNLFNSTSNIT

SEQ ID NO: 1349441 - protein, 19 aa, Mycobacterium
YITARFLPDKAIDLVDEAA

SEQ ID NO: 1349442 - protein, 26 aa, Mycobacterium
YKPACGKAGCSTYKWETFLTQELPAY

SEQ ID NO: 1349443 - protein, 22 aa, Mycobacterium
YKTNLWTWTWAMNANSRNKLPA

SEQ ID NO: 1349444 - protein, 20 aa, Mycobacterium
YLLAGPGWQGAKPDGIDEVI

SEQ ID NO: 1349445 - protein, 17 aa, Mycobacterium
YLPARLTGLLAALCAPV

SEQ ID NO: 1349446 - protein, 25 aa, Mycobacterium
YLTLERARFGTSLDVRLQVAPEVLG

SEQ ID NO: 1349447 - protein, 24 aa, Mycobacterium
YNHAEFGQPFAMDYVWGRQLGELT

SEQ ID NO: 1349448 - protein, 22 aa, Mycobacterium
YNIKGNATGVDMANPLQPVTKP

SEQ ID NO: 1349449 - protein, 21 aa, Mycobacterium
YNPMLTCLFVGAKTTLDTGYA

SEQ ID NO: 1349450 - protein, 17 aa, Mycobacterium
YPLVADRLPPLLAQILA

SEQ ID NO: 1349451 - protein, 20 aa, Mycobacterium
YPTSEIYGWIGNDAPNAPDI

SEQ ID NO: 1349452 - protein, 33 aa, Mycobacterium
YQSAPGFWLRCSGFPCAIEVWNNVIAKGDAIRD

SEQ ID NO: 1349453 - protein, 21 aa, Mycobacterium
YRDGVAIEWDKTAFVPIREIP

SEQ ID NO: 1349454 - protein, 27 aa, Mycobacterium
YREHLPRWVDGRVALIGDAAHPMYPGM

SEQ ID NO: 1349455 - protein, 17 aa, Mycobacterium
YRVEGIPTVSGSVPPTV

SEQ ID NO: 1349456 - protein, 23 aa, Mycobacterium
YSGWSSQPAWMWDTDFSTLAYRD

SEQ ID NO: 1349457 - protein, 27 aa, Mycobacterium
YVEAAKEYRDSLCWINLADLHNTIAAR

SEQ ID NO: 1349458 - protein, 19 aa, Mycobacterium
YWNGTSWTPGNPAAAKPIL

SEQ ID NO: 1349459 - protein, 47 aa, Mycobacterium
YYPGGRVAGRPVPAGWYSEPWWKPALVAGAWGLGSVLLFDALFSGMH

SEQ ID NO: 1349460 - protein, 18 aa, Mycobacterium
AAAAEYTVEFSFPAGYPD

SEQ ID NO: 1349461 - protein, 23 aa, Mycobacterium
AAALDRFGKALADNGYHPMTFDA

SEQ ID NO: 1349462 - protein, 17 aa, Mycobacterium
AAALLVAGCGSDDKAAD

SEQ ID NO: 1349463 - protein, 18 aa, Mycobacterium
AAAPWLSRLCGSRTVVCA

SEQ ID NO: 1349464 - protein, 18 aa, Mycobacterium
AAAVIMIALTVAGLSGCG

SEQ ID NO: 1349465 - protein, 30 aa, Mycobacterium; identical to SEQ ID NO: 1256768

SEQ ID NO: 1349466 - protein, 17 aa, Mycobacterium
AACGLAFALTACGSGQI

SEQ ID NO: 1349467 - protein, 24 aa, Mycobacterium
AADGYLRLRTWLTRLYQAEFNGFI

SEQ ID NO: 1349468 - protein, 23 aa, Mycobacterium
AAEAALASGQRLYFPEGSYRFAQ

SEQ ID NO: 1349469 - protein, 23 aa, Mycobacterium
AAEQKLPLNVTWVNLTTGKSGSA

SEQ ID NO: 1349470 - protein, 30 aa, Mycobacterium; identical to SEQ ID NO: 1256852

SEQ ID NO: 1349471 - protein, 28 aa, Mycobacterium
AAFDRGDIDAGYSWLPTLDQLRRNGKDL

SEQ ID NO: 1349472 - protein, 17 aa, Mycobacterium
AAGLLDWQAVRRGHPSR

SEQ ID NO: 1349473 - protein, 22 aa, Mycobacterium
AAGREAAGWLRAKTGSLTGTNS

SEQ ID NO: 1349474 - protein, 20 aa, Mycobacterium
AAHELDRVHVVAYFDNSNGV

SEQ ID NO: 1349475 - protein, 25 aa, Mycobacterium
AAHTFSLPELTDWSNADFTVENVNV

SEQ ID NO: 1349476 - protein, 18 aa, Mycobacterium
AAISLVFDGANTGTLGAS

SEQ ID NO: 1349477 - protein, 23 aa, Mycobacterium
AAKAGDWATVFAMLDDDDTPVDV

SEQ ID NO: 1349478 - protein, 23 aa, Mycobacterium
AALEVNWPYVLPSLLENAVKGGV

SEQ ID NO: 1349479 - protein, 18 aa, Mycobacterium
AALGRRYLAECLAVARAD

SEQ ID NO: 1349480 - protein, 26 aa, Mycobacterium
AALGVAAWGLSTVRVLSDSHALPSAM

SEQ ID NO: 1349481 - protein, 19 aa, Mycobacterium
AALKLPALLTASAAASALP

SEQ ID NO: 1349482 - protein, 18 aa, Mycobacterium
AAPALFFVAAPSGGSTIT

SEQ ID NO: 1349483 - protein, 25 aa, Mycobacterium
AAPDAAWAFTSWITSPAVDAQRVAE

SEQ ID NO: 1349484 - protein, 31 aa, Mycobacterium
AAPLGVCYLPAFLCLGIVPVVVGLAGDVLQS

SEQ ID NO: 1349485 - protein, 22 aa, Mycobacterium
AAPRRMRPLLAVLLVALATAAA

SEQ ID NO: 1349486 - protein, 23 aa, Mycobacterium
AARYLCSGGLNLRDPSQVMSAIL

SEQ ID NO: 1349487 - protein, 20 aa, Mycobacterium
AASGYMLWHHRQAVAEREQR

SEQ ID NO: 1349488 - protein, 27 aa, Mycobacterium
AASRRWSAARAHAWYQQQGWLVGANFI

SEQ ID NO: 1349489 - protein, 23 aa, Mycobacterium
AAVVPRIAAVTVFGNRSARVGQP

SEQ ID NO: 1349490 - protein, 25 aa, Mycobacterium
ADAKAIIVAPNLIAARYVQLTPAYE

SEQ ID NO: 1349491 - protein, 23 aa, Mycobacterium
ADDPERMALYFAVAGAEFEALEP

SEQ ID NO: 1349492 - protein, 18 aa, Mycobacterium
ADGWGCQHALSAVSNLTV

SEQ ID NO: 1349493 - protein, 18 aa, Mycobacterium
ADNPGVWMMHCHNTYHQE

SEQ ID NO: 1349494 - protein, 18 aa, Mycobacterium
ADPARLTVTVGYGSELFD

SEQ ID NO: 1349495 - protein, 21 aa, Mycobacterium
ADPPAMAAFWSAALGRPEQER

SEQ ID NO: 1349496 - protein, 19 aa, Mycobacterium
ADTLRRAGPYLVRGSADLQ

SEQ ID NO: 1349497 - protein, 24 aa, Mycobacterium
ADYEKRPDRAVGHIHVDGRYEPLY

SEQ ID NO: 1349498 - protein, 21 aa, Mycobacterium
AEALTGLGARFGESLEHGAAI

SEQ ID NO: 1349499 - protein, 23 aa, Mycobacterium
AEFGDALAPYHQVIGSIKATAAG

SEQ ID NO: 1349500 - protein, 20 aa, Mycobacterium
AESQRALTFVDEEPAAEPEP

SEQ ID NO: 1349501 - protein, 20 aa, Mycobacterium
AEVASPEWLGSEGAPGNIAV

SEQ ID NO: 1349502 - protein, 18 aa, Mycobacterium
AFAVARDVPEEWLQVSVD

SEQ ID NO: 1349503 - protein, 17 aa, Mycobacterium
AFCAIAARREFFEQIVV

SEQ ID NO: 1349504 - protein, 28 aa, Mycobacterium
AFYGRAALEYGLRLAAMEAEWAAGLTAA

SEQ ID NO: 1349505 - protein, 28 aa, Mycobacterium
AGAPRTGELYNYTARFGTYMVIVTANPL

SEQ ID NO: 1349506 - protein, 23 aa, Mycobacterium
AGDGGRGGLLFGNGGNGGIASAE

SEQ ID NO: 1349507 - protein, 25 aa, Mycobacterium
AGELAGLVQRAAWPQTYLDEVPAAR

SEQ ID NO: 1349508 - protein, 28 aa, Mycobacterium
AGGIMAFGYVRVPAMLGIGQYTVTVELP

SEQ ID NO: 1349509 - protein, 19 aa, Mycobacterium
AGGLRARYLAAADGLHSPI

SEQ ID NO: 1349510 - protein, 25 aa, Mycobacterium
AGLDARAWRLPWVAGTTLFEIDHPG

SEQ ID NO: 1349511 - protein, 17 aa, Mycobacterium
AGLKIVPDQGVYAATKN

SEQ ID NO: 1349512 - protein, 17 aa, Mycobacterium
AGLRAAGRVAGLIGTVG

SEQ ID NO: 1349513 - protein, 28 aa, Mycobacterium
AGLSGCGFRGLNSFRLPGTQGQGQGSYT

SEQ ID NO: 1349514 - protein, 22 aa, Mycobacterium
AGLWPTLIGFAMKDAGGFNPQN

SEQ ID NO: 1349515 - protein, 21 aa, Mycobacterium
AGSLLAALGIDADLDLPDIDG

SEQ ID NO: 1349516 - protein, 18 aa, Mycobacterium
AGVAACFAQMLVAAPTAG

SEQ ID NO: 1349517 - protein, 20 aa, Mycobacterium
AGVDRAAWDQALKSCASLAP

SEQ ID NO: 1349518 - protein, 24 aa, Mycobacterium
AGVVSVLCAVVFVALAAVGGLLFW

SEQ ID NO: 1349519 - protein, 24 aa, Mycobacterium
AGVYFPRGGMRAVPDAMAAAAADA

SEQ ID NO: 1349520 - protein, 17 aa, Mycobacterium
AHCPGCLLETGEPATQE

SEQ ID NO: 1349521 - protein, 23 aa, Mycobacterium
AHRRKFYAAAAMLAPFALTMLLV

SEQ ID NO: 1349522 - protein, 28 aa, Mycobacterium
AILERLRALPLAPFRDSYAYTNFGLTAA

SEQ ID NO: 1349523 - protein, 24 aa, Mycobacterium
AIMSDCGFTKMGVWSENSLDRTVV

SEQ ID NO: 1349524 - protein, 17 aa, Mycobacterium
AIVLTQNVIQLGVIPAE

SEQ ID NO: 1349525 - protein, 23 aa, Mycobacterium
AKADFQAIVAALLQLEGEPATAQ

SEQ ID NO: 1349526 - protein, 18 aa, Mycobacterium
AKNPAGPHYHYVLDSNGE

SEQ ID NO: 1349527 - protein, 30 aa, Mycobacterium; identical to SEQ ID NO: 1258473

SEQ ID NO: 1349528 - protein, 28 aa, Mycobacterium
AKPTLPAWRIVEPRPAEELMGYYRKAEA

SEQ ID NO: 1349529 - protein, 18 aa, Mycobacterium
AKSAPGWPAQYGDAANSS

SEQ ID NO: 1349530 - protein, 20 aa, Mycobacterium
ALADELVRLVGTEAPTATAP

SEQ ID NO: 1349531 - protein, 26 aa, Mycobacterium
ALAGAAVGLGALWLAGPAAAQPDAPP

SEQ ID NO: 1349532 - protein, 27 aa, Mycobacterium
ALEANGFDISRQFGIGSRETYIPAVQD

SEQ ID NO: 1349533 - protein, 18 aa, Mycobacterium
ALEWDIRNGVIARKGAAY

SEQ ID NO: 1349534 - protein, 22 aa, Mycobacterium
ALFGSGCARFDGAQSQPFTTEP

SEQ ID NO: 1349535 - protein, 17 aa, Mycobacterium
ALGNRPLTVRIGYQSPN

SEQ ID NO: 1349536 - protein, 25 aa, Mycobacterium
ALHPLVERDRILGGFHTPTDGLAKA

SEQ ID NO: 1349537 - protein, 17 aa, Mycobacterium
ALMFPVVGGIGLMSNRA

SEQ ID NO: 1349538 - protein, 26 aa, Mycobacterium
ALQWDRVLCSAGKRGLEIAVAPDDLV

SEQ ID NO: 1349539 - protein, 17 aa, Mycobacterium
ALTKNGWTDAFVTGAAF

SEQ ID NO: 1349540 - protein, 20 aa, Mycobacterium
AMCSTFKAYLAAHVLQLVGR

SEQ ID NO: 1349541 - protein, 20 aa, Mycobacterium
ANPHIWYSPAAVTAVADAVT

SEQ ID NO: 1349542 - protein, 25 aa, Mycobacterium
APAAPPALWALLASARREFERAFTR

SEQ ID NO: 1349543 - protein, 24 aa, Mycobacterium
APAKERPGQRFAERINDVVKKVTG

SEQ ID NO: 1349544 - protein, 29 aa, Mycobacterium
APGGLTCVIQRGGAYGCSGPIPAAPGGAN

SEQ ID NO: 1349545 - protein, 18 aa, Mycobacterium
APGVGWAGQEFVDALQSQ

SEQ ID NO: 1349546 - protein, 23 aa, Mycobacterium
APLGRPILCTEYLARGMGSTVEG

SEQ ID NO: 1349547 - protein, 25 aa, Mycobacterium
APLNIPYKVAFVLDVAGDNEALVAR

SEQ ID NO: 1349548 - protein, 17 aa, Mycobacterium
APLRLIRGLAPGMIERG

SEQ ID NO: 1349549 - protein, 22 aa, Mycobacterium
APPQRRLLEDWMRANETSSMRA

SEQ ID NO: 1349550 - protein, 31 aa, Mycobacterium; identical to SEQ ID NO: 924623

SEQ ID NO: 1349551 - protein, 26 aa, Mycobacterium
APSRLPWERIEPLAGLVEEIDGKVDA

SEQ ID NO: 1349552 - protein, 19 aa, Mycobacterium
APWILPKWDSRYGVLHDRV

SEQ ID NO: 1349553 - protein, 24 aa, Mycobacterium
APYGLAGSSGLAWVSQTATNTVIG

SEQ ID NO: 1349554 - protein, 21 aa, Mycobacterium
AQAPIGPRVRILSPMEIGILR

SEQ ID NO: 1349555 - protein, 25 aa, Mycobacterium
AQDAPLAWRTALWFWTTQKAAAAAT

SEQ ID NO: 1349556 - protein, 18 aa, Mycobacterium
AQEALQFQHHSWPDMVAE

SEQ ID NO: 1349557 - protein, 17 aa, Mycobacterium
AQFWKRNLSSYGDGTVK

SEQ ID NO: 1349558 - protein, 18 aa, Mycobacterium
ARALLEWLQATHPEPKVT

SEQ ID NO: 1349559 - protein, 19 aa, Mycobacterium
ARALSQRGVAFAYGGGNTA

SEQ ID NO: 1349560 - protein, 29 aa, Mycobacterium
ARAMGPMQFLPGTWARYASDGDGDGRADV

SEQ ID NO: 1349561 - protein, 21 aa, Mycobacterium
ARARLLGMPAAMLVEAAPAQP

SEQ ID NO: 1349562 - protein, 17 aa, Mycobacterium
ARAVARWAYAAHSVDSA

SEQ ID NO: 1349563 - protein, 20 aa, Mycobacterium
ARDVPEEWLQVSVDDVPFLY

SEQ ID NO: 1349564 - protein, 18 aa, Mycobacterium
ARHAADLTAAAEAKTQMA

SEQ ID NO: 1349565 - protein, 18 aa, Mycobacterium
ARLDEWLPNYQPCAYIQR

SEQ ID NO: 1349566 - protein, 23 aa, Mycobacterium
ARRRRLNAMLADALDPVEIQFNT

SEQ ID NO: 1349567 - protein, 24 aa, Mycobacterium
ARSACAQAALVARAMDTTVTDCAA

SEQ ID NO: 1349568 - protein, 24 aa, Mycobacterium
ARSFGDGFSILGWASNTAPPPGWT

SEQ ID NO: 1349569 - protein, 18 aa, Mycobacterium
ARWGAVASAAAVVLTACG

SEQ ID NO: 1349570 - protein, 20 aa, Mycobacterium
ASAFDRLTGRYVLVLEDLPA

SEQ ID NO: 1349571 - protein, 21 aa, Mycobacterium
ASALRPEDFRTVADTLLGFID

SEQ ID NO: 1349572 - protein, 22 aa, Mycobacterium
ASARREFERAFTRPVTTAPAQS

SEQ ID NO: 1349573 - protein, 27 aa, Mycobacterium
ASDGQIAYNFGHKWGLGDTVASDEYAF

SEQ ID NO: 1349574 - protein, 23 aa, Mycobacterium
ASSPSGLDGPGWESITTPHDLAV

SEQ ID NO: 1349575 - protein, 24 aa, Mycobacterium
ASSRTKWFDEYFIAAGAHGLEQMV

SEQ ID NO: 1349576 - protein, 31 aa, Mycobacterium
ASTVCSGGHGGLLIGNGGNGFRGGNGGNAGF

SEQ ID NO: 1349577 - protein, 19 aa, Mycobacterium
ATDLCEFMEFPSGILQVCG

SEQ ID NO: 1349578 - protein, 21 aa, Mycobacterium
ATELRANPFLQRVTTDLTRLP

SEQ ID NO: 1349579 - protein, 18 aa, Mycobacterium
ATLAGWLGPDRVIGASTI

SEQ ID NO: 1349580 - protein, 23 aa, Mycobacterium
ATPRPHHGVAVLLADGTLVHSIG

SEQ ID NO: 1349581 - protein, 21 aa, Mycobacterium
AVDGIRVNAVFPGPVETPMLD

SEQ ID NO: 1349582 - protein, 25 aa, Mycobacterium
AVIPEDRTAVPLEWDDLRTQLEKLT

SEQ ID NO: 1349583 - protein, 23 aa, Mycobacterium
AVLPSHYEPFGIVALEAAATGTP

SEQ ID NO: 1349584 - protein, 18 aa, Mycobacterium
AVRGKLPFYIDGAQAEVV

SEQ ID NO: 1349585 - protein, 19 aa, Mycobacterium
AVVGRAPLVLDYQINDKAV

SEQ ID NO: 1349586 - protein, 22 aa, Mycobacterium
AWANAALGFIYVHNGYYNDVEI

SEQ ID NO: 1349587 - protein, 17 aa, Mycobacterium
AYALDWPGESPLRRSYE

SEQ ID NO: 1349588 - protein, 24 aa, Mycobacterium
AYGASAVPVRWRAMLHGWPGMTGR

SEQ ID NO: 1349589 - protein, 17 aa, Mycobacterium
CAFTEAVPDIVMTNILA

SEQ ID NO: 1349590 - protein, 18 aa, Mycobacterium
CAPFCLPGRALDTNTGLC

SEQ ID NO: 1349591 - protein, 19 aa, Mycobacterium
CEQVEWVWYVETLRETPGF

SEQ ID NO: 1349592 - protein, 24 aa, Mycobacterium
CNGELPATMIKTPFSLAYKTELPI

SEQ ID NO: 1349593 - protein, 17 aa, Mycobacterium
CPAVEAIAVPGTTQTNP

SEQ ID NO: 1349594 - protein, 19 aa, Mycobacterium
CSAGRWEVYAGPYPSSDRW

SEQ ID NO: 1349595 - protein, 24 aa, Mycobacterium
CVSERSRRGFTFSAEGFAPQYTDV

SEQ ID NO: 1349596 - protein, 21 aa, Mycobacterium
DAEQYFRTALYGDPVEVTGTR

SEQ ID NO: 1349597 - protein, 25 aa, Mycobacterium
DAGHPRWVAADVMAGRLNQVGVAKA

SEQ ID NO: 1349598 - protein, 18 aa, Mycobacterium
DAPGCKRVLFSNDYYPAI

SEQ ID NO: 1349599 - protein, 26 aa, Mycobacterium
DAPHPAAARLWQEFLYSDEGQNLYLG

SEQ ID NO: 1349600 - protein, 22 aa, Mycobacterium
DARANLDPILALIDKAKPVMDS

SEQ ID NO: 1349601 - protein, 24 aa, Mycobacterium
DARAWLRDPTPLWRTNVEGLQRVL

SEQ ID NO: 1349602 - protein, 18 aa, Mycobacterium
DAVDAGFFSPGLGAISGL

SEQ ID NO: 1349603 - protein, 18 aa, Mycobacterium
DDAPAPLSVYGRTKLAGE

SEQ ID NO: 1349604 - protein, 20 aa, Mycobacterium
DDAPPLKNGDVIPVDRASVP

SEQ ID NO: 1349605 - protein, 19 aa, Mycobacterium
DDMLHSWFLDPAIIAPGAP

SEQ ID NO: 1349606 - protein, 24 aa, Mycobacterium
DDPAFTGWHRLEYLLFSQNTTEGG

SEQ ID NO: 1349607 - protein, 23 aa, Mycobacterium
DEESRLLTRELFYTAVTRAKAKV

SEQ ID NO: 1349608 - protein, 18 aa, Mycobacterium
DEHGRFDLDRLVDVVGSG

SEQ ID NO: 1349609 - protein, 17 aa, Mycobacterium
DEMAALIARVDEKFTNA

SEQ ID NO: 1349610 - protein, 22 aa, Mycobacterium
DGADSLTLEWSRSVKGDLGAAV

SEQ ID NO: 1349611 - protein, 27 aa, Mycobacterium
DGDGTRRFGATISRIDRDDADERPRGH

SEQ ID NO: 1349612 - protein, 19 aa, Mycobacterium
DGDRLIYIVTRGPKTGSVK

SEQ ID NO: 1349613 - protein, 26 aa, Mycobacterium
DGEFTWLSDSVMQWTPTGFWPAHSPI

SEQ ID NO: 1349614 - protein, 18 aa, Mycobacterium
DGFYRTGDRVRIFADGPL

SEQ ID NO: 1349615 - protein, 19 aa, Mycobacterium
DGGDASWGGAGGAGGAAHG

SEQ ID NO: 1349616 - protein, 20 aa, Mycobacterium
DGGHGGAYINNGRASGGGKA

SEQ ID NO: 1349617 - protein, 17 aa, Mycobacterium
DGNVWGATVNKTAGDAE

SEQ ID NO: 1349618 - protein, 17 aa, Mycobacterium
DGTGWSGSGGRGGDGGA

SEQ ID NO: 1349619 - protein, 17 aa, Mycobacterium
DGVDTFRVVAVDVGPHV

SEQ ID NO: 1349620 - protein, 24 aa, Mycobacterium
DGVTWSSAEPLGYNKQYTLQAHAQ

SEQ ID NO: 1349621 - protein, 17 aa, Mycobacterium
DGYVIDGEFTLKGVTKP

SEQ ID NO: 1349622 - protein, 24 aa, Mycobacterium
DISPEAWRTMLRVHLGGLVNVARS

SEQ ID NO: 1349623 - protein, 17 aa, Mycobacterium
DIVTRVAQRYGLSGTRP

SEQ ID NO: 1349624 - protein, 20 aa, Mycobacterium
DLKHRHPRVIPVEIDGYGAG

SEQ ID NO: 1349625 - protein, 20 aa, Mycobacterium
DLSHNAFRYFRAMRTYLGAL

SEQ ID NO: 1349626 - protein, 31 aa, Mycobacterium; identical to SEQ ID NO: 1261704

SEQ ID NO: 1349627 - protein, 26 aa, Mycobacterium
DPEAVAWLKSRIAERFPGEAVSGLDI

SEQ ID NO: 1349628 - protein, 21 aa, Mycobacterium
DPEGYKLTVYDAVRITWGGVY

SEQ ID NO: 1349629 - protein, 40 aa, Mycobacterium
DPGAVSPGVPCVNIMQQLLTVPGRLPQTLPGANSALTNTA

SEQ ID NO: 1349630 - protein, 26 aa, Mycobacterium
DPNVPEAFAVIADRVGGDGLYSSNAQ

SEQ ID NO: 1349631 - protein, 18 aa, Mycobacterium
DPPEALLRLRAHAYSTGR

SEQ ID NO: 1349632 - protein, 20 aa, Mycobacterium
DPTPSAPRSPGVPAPGGLAA

SEQ ID NO: 1349633 - protein, 29 aa, Mycobacterium
DPVHSTIGFSVRHLMVSKVRGTFDDYSGT

SEQ ID NO: 1349634 - protein, 24 aa, Mycobacterium
DQLDALCALGLQSRIVAAALPDGR

SEQ ID NO: 1349635 - protein, 19 aa, Mycobacterium
DREAMAAAVDRVVDQFGKL

SEQ ID NO: 1349636 - protein, 23 aa, Mycobacterium
DREAWNTLVLPWFRGINSVVGVQ

SEQ ID NO: 1349637 - protein, 19 aa, Mycobacterium
DRLDWPLRPRPAVVRTFDA

SEQ ID NO: 1349638 - protein, 21 aa, Mycobacterium
DRLRKVLVPHALRLREAAILG

SEQ ID NO: 1349639 - protein, 23 aa, Mycobacterium
DRVPRPAPRPAYSALSGAGSAAC

SEQ ID NO: 1349640 - protein, 19 aa, Mycobacterium
DSCPVRVNVELVRERRGDD

SEQ ID NO: 1349641 - protein, 24 aa, Mycobacterium
DSFRFRWTAEPGIDLLTGAAVPIR

SEQ ID NO: 1349642 - protein, 17 aa, Mycobacterium
DSGRPDLTIPRRFLPGL

SEQ ID NO: 1349643 - protein, 17 aa, Mycobacterium
DSPECQALMGALPEVLG

SEQ ID NO: 1349644 - protein, 20 aa, Mycobacterium
DSSLDFTIGRRQVVRAEASS

SEQ ID NO: 1349645 - protein, 19 aa, Mycobacterium
DTRTGAVALDGEREIARSA

SEQ ID NO: 1349646 - protein, 26 aa, Mycobacterium
DVAMMKVSVQWPYSANLHCEILIDDQ

SEQ ID NO: 1349647 - protein, 21 aa, Mycobacterium
DVEGNEFCAFPGRPDDDAAAR

SEQ ID NO: 1349648 - protein, 19 aa, Mycobacterium
DVGGGFSFESCNDQGEPPY

SEQ ID NO: 1349649 - protein, 18 aa, Mycobacterium
DVQFPKWRHLLPSDTSRM

SEQ ID NO: 1349650 - protein, 24 aa, Mycobacterium
DVTMIACLMTEYYVVVTGAGSPYK

SEQ ID NO: 1349651 - protein, 23 aa, Mycobacterium
DYLGEKICAAVVFRGKQLTLAEL

SEQ ID NO: 1349652 - protein, 27 aa, Mycobacterium
DYLRRKYRGWAEPIPTLLATTAARDVL

SEQ ID NO: 1349653 - protein, 27 aa, Mycobacterium
EAAAMRRMLLVLGFPDHRIIVEDKANS

SEQ ID NO: 1349654 - protein, 31 aa, Mycobacterium; identical to SEQ ID NO: 1262446

SEQ ID NO: 1349655 - protein, 25 aa, Mycobacterium
EAEKMLPKFLWERPDTVAKAGLDGL

SEQ ID NO: 1349656 - protein, 17 aa, Mycobacterium
EAQGHRVVVNRLSDAPL

SEQ ID NO: 1349657 - protein, 26 aa, Mycobacterium
EASRWSADRANAWYAAQGWLVGANYV

SEQ ID NO: 1349658 - protein, 25 aa, Mycobacterium
EDPTASKIAGRWGAVSLPVGGANTT

SEQ ID NO: 1349659 - protein, 24 aa, Mycobacterium
EEYVPLNDGMNWKGDPNATLSGQD

SEQ ID NO: 1349660 - protein, 33 aa, Mycobacterium; identical to SEQ ID NO: 926488

SEQ ID NO: 1349661 - protein, 18 aa, Mycobacterium
EILTRYLNLVSFGNGAFG

SEQ ID NO: 1349662 - protein, 22 aa, Mycobacterium
EIPTNWPGPTLVYRLLTRKPHS

SEQ ID NO: 1349663 - protein, 22 aa, Mycobacterium
EITELFGPGLPEIRVIRNGIEA

SEQ ID NO: 1349664 - protein, 19 aa, Mycobacterium
EKFGVQIRQLWGMTETSPV

SEQ ID NO: 1349665 - protein, 19 aa, Mycobacterium
EKLGLPAQSLFDVITGATG

SEQ ID NO: 1349666 - protein, 25 aa, Mycobacterium
EKPNSGWLYTWALGIPKGAKNPDGA

SEQ ID NO: 1349667 - protein, 17 aa, Mycobacterium
ELARRIVLATGMQYRLQ

SEQ ID NO: 1349668 - protein, 19 aa, Mycobacterium
ELDHIYALAAAWDAGAWRW

SEQ ID NO: 1349669 - protein, 23 aa, Mycobacterium
ELLARLHARFWGRLSAPGQPGPF

SEQ ID NO: 1349670 - protein, 20 aa, Mycobacterium
ELLRQHPLPNTGRVVVTGSP

SEQ ID NO: 1349671 - protein, 18 aa, Mycobacterium
EPALWMPPNTAFHCQYAM

SEQ ID NO: 1349672 - protein, 19 aa, Mycobacterium
EPATAQWLAGMKANAVIYN

SEQ ID NO: 1349673 - protein, 18 aa, Mycobacterium
EPELRPGPTSSEPPPPPL

SEQ ID NO: 1349674 - protein, 31 aa, Mycobacterium
EPPARPADVYGEWKGGWVDFPGGTLDVGSAH

SEQ ID NO: 1349675 - protein, 29 aa, Mycobacterium
EQFRTAFDASRPVFGFAPYPGVQPGDPAR

SEQ ID NO: 1349676 - protein, 35 aa, Mycobacterium
EQGYSLKVYDCYRPQRAVNDFVAWAKNLPDQRMKA

SEQ ID NO: 1349677 - protein, 24 aa, Mycobacterium
EQVEKLRSVFTLRAVEKDAGVEPV

SEQ ID NO: 1349678 - protein, 23 aa, Mycobacterium
ERAALPARIAALGAEVDILVNNA

SEQ ID NO: 1349679 - protein, 19 aa, Mycobacterium
ERAPRVDIVTTYPGGDAAA

SEQ ID NO: 1349680 - protein, 17 aa, Mycobacterium
ERRRTGTARSWSADPPG

SEQ ID NO: 1349681 - protein, 18 aa, Mycobacterium
ERTNSVVVAPTLTSNPFR

SEQ ID NO: 1349682 - protein, 20 aa, Mycobacterium
ESGAPAGPAVHEIGQQADLV

SEQ ID NO: 1349683 - protein, 23 aa, Mycobacterium
ETTARLALEQGKAALEVNWPYVL

SEQ ID NO: 1349684 - protein, 17 aa, Mycobacterium
ETVVLDRGGPGAGEQSS

SEQ ID NO: 1349685 - protein, 18 aa, Mycobacterium
EVAGFDASVVLNRKDFGI

SEQ ID NO: 1349686 - protein, 19 aa, Mycobacterium
EVECSCVGLTPGQPYTTRQ

SEQ ID NO: 1349687 - protein, 19 aa, Mycobacterium
EVKEQLTALSAQLGPQQGS

SEQ ID NO: 1349688 - protein, 17 aa, Mycobacterium
FAAATLAGALALAACSS

SEQ ID NO: 1349689 - protein, 17 aa, Mycobacterium
FAAYQIGGAYTRDGAKR

SEQ ID NO: 1349690 - protein, 36 aa, Mycobacterium; identical to SEQ ID NO: 1264130

SEQ ID NO: 1349691 - protein, 19 aa, Mycobacterium
FALIAVFAQLRFEREQRYT

SEQ ID NO: 1349692 - protein, 17 aa, Mycobacterium
FANTSAFVGTTIGAAVL

SEQ ID NO: 1349693 - protein, 18 aa, Mycobacterium
FAQRRPRSGPAQLLYLGR

SEQ ID NO: 1349694 - protein, 19 aa, Mycobacterium
FCTENDPYPSARCPEVTVD

SEQ ID NO: 1349695 - protein, 25 aa, Mycobacterium
FDGVFRFNSDLVDLLARLGASLRVD

SEQ ID NO: 1349696 - protein, 17 aa, Mycobacterium
FDIPEALPMGVASEAGL

SEQ ID NO: 1349697 - protein, 19 aa, Mycobacterium
FEAIRCLRNVENQRYTSVE

SEQ ID NO: 1349698 - protein, 25 aa, Mycobacterium
FETPQWAKDGWLVNLSEYAKNTPGY

SEQ ID NO: 1349699 - protein, 29 aa, Mycobacterium
FFATAADDWARCDGETVVLDRGGPGAGEQ

SEQ ID NO: 1349700 - protein, 17 aa, Mycobacterium
FGLAGLLGYAVYLAGNT

SEQ ID NO: 1349701 - protein, 29 aa, Mycobacterium
FGMPKVLAHQGEWLRLAVDALIRGGCGDV

SEQ ID NO: 1349702 - protein, 17 aa, Mycobacterium
FGSAGMDGGNGGAGGLG

SEQ ID NO: 1349703 - protein, 27 aa, Mycobacterium
FGVTSWGRLVFCGSPRRYEPRWFRSPE

SEQ ID NO: 1349704 - protein, 18 aa, Mycobacterium
FIDYWGYQVSPIWDPGFR

SEQ ID NO: 1349705 - protein, 26 aa, Mycobacterium
FIERPGENVERTWMVFDQFVVTADGS

SEQ ID NO: 1349706 - protein, 17 aa, Mycobacterium
FILAPLVLAGAVGATSP

SEQ ID NO: 1349707 - protein, 25 aa, Mycobacterium
FINYPREFGIMTGLGSHTYDDSKSI

SEQ ID NO: 1349708 - protein, 17 aa, Mycobacterium
FKGCREVADLSQIQIPN

SEQ ID NO: 1349709 - protein, 21 aa, Mycobacterium
FLCGAVQAASRLNNEQSAKLC

SEQ ID NO: 1349710 - protein, 27 aa, Mycobacterium
FLDFECEGCRALYPVVEQLRAEYGDRV

SEQ ID NO: 1349711 - protein, 23 aa, Mycobacterium
FLTQELPAWLEANRGVSPSGNAV

SEQ ID NO: 1349712 - protein, 19 aa, Mycobacterium
FNVGIRYAGNPGISTGRTV

SEQ ID NO: 1349713 - protein, 19 aa, Mycobacterium
FQPPECAKFAEGRLPEADL

SEQ ID NO: 1349714 - protein, 21 aa, Mycobacterium
FRDSDAWFLIRAVTPPGADVL

SEQ ID NO: 1349715 - protein, 21 aa, Mycobacterium
FRIKIDGCVGQSFIRSYAILT

SEQ ID NO: 1349716 - protein, 18 aa, Mycobacterium
FRPADVVIYGTGFRATDF

SEQ ID NO: 1349717 - protein, 23 aa, Mycobacterium
FRPDLLGPCAKFVSPFGGPGFMP

SEQ ID NO: 1349718 - protein, 24 aa, Mycobacterium
FRQALRELSQTAGRLGDSRTDLFG

SEQ ID NO: 1349719 - protein, 23 aa, Mycobacterium
FRRWLDARCAAAVRLAPGYEHPG

SEQ ID NO: 1349720 - protein, 17 aa, Mycobacterium
FRYGSAVSVLERSADGR

SEQ ID NO: 1349721 - protein, 19 aa, Mycobacterium
FSGPGLRGAVEVVEAPHID

SEQ ID NO: 1349722 - protein, 20 aa, Mycobacterium
FSTGEAMTVRGLDVQFPKWR

SEQ ID NO: 1349723 - protein, 26 aa, Mycobacterium
FTVEPRSGQEFQFRTEVPGNVEIELH

SEQ ID NO: 1349724 - protein, 17 aa, Mycobacterium
FVTPLGGYNAWFSAPDT

SEQ ID NO: 1349725 - protein, 17 aa, Mycobacterium
FYNAELLDRYKVAPPTT

SEQ ID NO: 1349726 - protein, 18 aa, Mycobacterium
GAAFLPHTEVLGVVEKAG

SEQ ID NO: 1349727 - protein, 21 aa, Mycobacterium
GAAQRDGRRLVVVLMHGLVKE

SEQ ID NO: 1349728 - protein, 26 aa, Mycobacterium
GACHGAWCFDALVGALRNRGHRADAH

SEQ ID NO: 1349729 - protein, 30 aa, Mycobacterium; identical to SEQ ID NO: 1265238

SEQ ID NO: 1349730 - protein, 26 aa, Mycobacterium
GAGGRGGRGGLFVGNGGAGGAGAAGV

SEQ ID NO: 1349731 - protein, 28 aa, Mycobacterium
GAGGVGGRSGMLFGYAGDGGIGGAAGSG

SEQ ID NO: 1349732 - protein, 27 aa, Mycobacterium
GAGNCPIEPFIAVADLHGWKHNCDLFG

SEQ ID NO: 1349733 - protein, 18 aa, Mycobacterium
GAGTRFGMPKVLAHQGEW

SEQ ID NO: 1349734 - protein, 19 aa, Mycobacterium
GAILAFPRTQWIRWRKPVI

SEQ ID NO: 1349735 - protein, 17 aa, Mycobacterium
GALKLMLTAPFSIENVP

SEQ ID NO: 1349736 - protein, 23 aa, Mycobacterium
GALRVPPNFHCEIAVDSVVVVQS

SEQ ID NO: 1349737 - protein, 24 aa, Mycobacterium
GASEVSGGFDWRKAAGSTINILQT

SEQ ID NO: 1349738 - protein, 21 aa, Mycobacterium
GATARMGIGAADLKHRHPRVI

SEQ ID NO: 1349739 - protein, 20 aa, Mycobacterium
GAVPVMCLPGHRTAELGHFA

SEQ ID NO: 1349740 - protein, 21 aa, Mycobacterium
GAWPVCGAYALSPRSSAPPGT

SEQ ID NO: 1349741 - protein, 21 aa, Mycobacterium
GDEWKFSRPGWLDVEASSDTA

SEQ ID NO: 1349742 - protein, 19 aa, Mycobacterium
GDGISVLIDLGRVNHVNAE

SEQ ID NO: 1349743 - protein, 21 aa, Mycobacterium
GDGPLGFLRDAWHQAQNPYGM

SEQ ID NO: 1349744 - protein, 19 aa, Mycobacterium
GDYMNQFIIFDFTIPRLKR

SEQ ID NO: 1349745 - protein, 34 aa, Mycobacterium
GEAAYDLKNEFADFVFRSIFENLNLAAFAQAAGV

SEQ ID NO: 1349746 - protein, 20 aa, Mycobacterium
GEFTALGVLSEEPLPNLDVP

SEQ ID NO: 1349747 - protein, 21 aa, Mycobacterium
GEGWGVCFDGGRIVRSDGTDR

SEQ ID NO: 1349748 - protein, 19 aa, Mycobacterium
GEREPRAVLYQSVVVTASE

SEQ ID NO: 1349749 - protein, 26 aa, Mycobacterium
GEVTGRTALPGFGRHLQLARPGGPVL

SEQ ID NO: 1349750 - protein, 21 aa, Mycobacterium
GEWNNGGSVATNITVTGGAAS

SEQ ID NO: 1349751 - protein, 25 aa, Mycobacterium
GFAGVRSGGFGSLTQRNGLLSLCSP

SEQ ID NO: 1349752 - protein, 17 aa, Mycobacterium
GFDRHLTEFPALADRVR

SEQ ID NO: 1349753 - protein, 26 aa, Mycobacterium
GFGKFDYIFVWRVEVRNHRELPERGP

SEQ ID NO: 1349754 - protein, 32 aa, Mycobacterium; identical to SEQ ID NO: 1265876

SEQ ID NO: 1349755 - protein, 19 aa, Mycobacterium
GFVDFGQLFSATALMPSHV

SEQ ID NO: 1349756 - protein, 17 aa, Mycobacterium
GGAMCIDPSDGALYVTD

SEQ ID NO: 1349757 - protein, 22 aa, Mycobacterium
GGDAVLTNGVWAYDTTIADGIT

SEQ ID NO: 1349758 - protein, 19 aa, Mycobacterium
GGGAGTFGSAGMDGGNGGA

SEQ ID NO: 1349759 - protein, 20 aa, Mycobacterium
GGLDLPRPSTAAVNSVPDDA

SEQ ID NO: 1349760 - protein, 19 aa, Mycobacterium
GGNAGWFGNGGIGGFTGFD

SEQ ID NO: 1349761 - protein, 24 aa, Mycobacterium
GGPPAVTAFARWIGDPRSRLDRYE

SEQ ID NO: 1349762 - protein, 22 aa, Mycobacterium
GGTGGFGGLFGTSPGYGGDGHN

SEQ ID NO: 1349763 - protein, 24 aa, Mycobacterium
GGVADARTALRLHAAAGGPGSAPI

SEQ ID NO: 1349764 - protein, 23 aa, Mycobacterium
GGVADARTGWQLHSAAGGGQSAP

SEQ ID NO: 1349765 - protein, 20 aa, Mycobacterium
GGWERPAWFEANAGLIADLD

SEQ ID NO: 1349766 - protein, 20 aa, Mycobacterium
GHDYRRAAFGDAWTDDNSAP

SEQ ID NO: 1349767 - protein, 26 aa, Mycobacterium
GHGMAMPGMVDDATMKRLESLRGAEF

SEQ ID NO: 1349768 - protein, 18 aa, Mycobacterium
GIPGMAVAVVHGGKTVYA

SEQ ID NO: 1349769 - protein, 20 aa, Mycobacterium
GKCLSYSNGTPVGVATPGVA

SEQ ID NO: 1349770 - protein, 20 aa, Mycobacterium
GKQEGFAFASPNGSDRVASV

SEQ ID NO: 1349771 - protein, 17 aa, Mycobacterium
GLAPRGTQSLVLEVYQN

SEQ ID NO: 1349772 - protein, 19 aa, Mycobacterium
GLHRLRMMVPNSPGGGYDL

SEQ ID NO: 1349773 - protein, 31 aa, Mycobacterium
GLVPLFTPNPWRPGSSMSHLDDATFTGVNVK

SEQ ID NO: 1349774 - protein, 19 aa, Mycobacterium
GMHHGGHGMAMPGMVDDAT

SEQ ID NO: 1349775 - protein, 18 aa, Mycobacterium
GMMGPGMMGPGWNGPNGP

SEQ ID NO: 1349776 - protein, 31 aa, Mycobacterium
GNGGRGGDAYAISTAVAGWGGHAHGIGNGGA

SEQ ID NO: 1349777 - protein, 28 aa, Mycobacterium
GNTIAWLYSQRRFEVPSEQIANTMKLAI

SEQ ID NO: 1349778 - protein, 23 aa, Mycobacterium
GPALAFWLTRNGYRVVVVETAAD

SEQ ID NO: 1349779 - protein, 30 aa, Mycobacterium
GPEGLDAVTLRPGRPAGCSAGDYGAVDVRR

SEQ ID NO: 1349780 - protein, 17 aa, Mycobacterium
GPFQMILRLYWPKPDAL

SEQ ID NO: 1349781 - protein, 18 aa, Mycobacterium
GPGQLSWNYNYRAAGDAL

SEQ ID NO: 1349782 - protein, 29 aa, Mycobacterium
GPIERYRIDGASMPTEWATGQLATRAAFI

SEQ ID NO: 1349783 - protein, 23 aa, Mycobacterium
GPLLELQSQFAFLTADQLLREGY

SEQ ID NO: 1349784 - protein, 27 aa, Mycobacterium
GPLRVSGYAGWVAWGLLHIAFLTGVSN

SEQ ID NO: 1349785 - protein, 19 aa, Mycobacterium
GPPEALVVEMVIKGGTVTP

SEQ ID NO: 1349786 - protein, 18 aa, Mycobacterium
GPTTLTAIVDTGSGSIMS

SEQ ID NO: 1349787 - protein, 18 aa, Mycobacterium
GPVGGQTWYKPFTPAPVT

SEQ ID NO: 1349788 - protein, 20 aa, Mycobacterium
GQGPAIRDAIIRLSQSVSAL

SEQ ID NO: 1349789 - protein, 18 aa, Mycobacterium
GQPLRFEVLPVMFSIQLT

SEQ ID NO: 1349790 - protein, 17 aa, Mycobacterium
GQVPWTLVTNSNETITC

SEQ ID NO: 1349791 - protein, 19 aa, Mycobacterium
GQYPGWRVTGPDGKVDEAG

SEQ ID NO: 1349792 - protein, 18 aa, Mycobacterium
GRFAANFADRGVRSGFSA

SEQ ID NO: 1349793 - protein, 34 aa, Mycobacterium
GRGGDGGSSEGWMSGSGGWGGDGGDASWGGAGGA

SEQ ID NO: 1349794 - protein, 23 aa, Mycobacterium
GRPDLTIPRRFLPGLSDDQLLRH

SEQ ID NO: 1349795 - protein, 18 aa, Mycobacterium
GRPSFTRLQRRWPQQRRP

SEQ ID NO: 1349796 - protein, 24 aa, Mycobacterium
GRPWRPEVVHAHDWLVAHPAITLA

SEQ ID NO: 1349797 - protein, 25 aa, Mycobacterium
GSAVAWKATLDDVLFDLVATGGIAL

SEQ ID NO: 1349798 - protein, 24 aa, Mycobacterium
GSGGVPTGTLWKIDTVAGTVQAVA

SEQ ID NO: 1349799 - protein, 18 aa, Mycobacterium
GSGPAYFFLMVEALVDAA

SEQ ID NO: 1349800 - protein, 21 aa, Mycobacterium
GSKPLMMWCDMAAMMQSMSMS

SEQ ID NO: 1349801 - protein, 19 aa, Mycobacterium
GSTLGGFFGAAAFDEVALV

SEQ ID NO: 1349802 - protein, 18 aa, Mycobacterium
GTQLDWLIEQARRHKVRK

SEQ ID NO: 1349803 - protein, 26 aa, Mycobacterium
GTVRELEHAYKLGVTSVRVATHCTEA

SEQ ID NO: 1349804 - protein, 17 aa, Mycobacterium
GVDFAVRTDRGDFVGRA

SEQ ID NO: 1349805 - protein, 18 aa, Mycobacterium
GVTLKLLVNQPHVTSFRD

SEQ ID NO: 1349806 - protein, 24 aa, Mycobacterium
GVYPQRFGIPEGLYAVPVAVKQGW

SEQ ID NO: 1349807 - protein, 18 aa, Mycobacterium
GWTDAFVTGAAFEQFLVE

SEQ ID NO: 1349808 - protein, 24 aa, Mycobacterium
GYPGMPAKPGPPVADISTGLYAAL

SEQ ID NO: 1349809 - protein, 37 aa, Mycobacterium
HAVLNRLELAPAILVGWSFGGSLALGVARRYPEDVAR

SEQ ID NO: 1349810 - protein, 21 aa, Mycobacterium
HDIRPLFVLFDSCWDPLPRLG

SEQ ID NO: 1349811 - protein, 27 aa, Mycobacterium
HDLFRRAGATNVRWMWSPDAIGGGEVP

SEQ ID NO: 1349812 - protein, 22 aa, Mycobacterium
HEEVLLMPRWVKCRRATFKYGL

SEQ ID NO: 1349813 - protein, 17 aa, Mycobacterium
HETEMSEAVLAWYGTTK

SEQ ID NO: 1349814 - protein, 23 aa, Mycobacterium
HGLPRPTLFAFPFSDGYDDDRAS

SEQ ID NO: 1349815 - protein, 25 aa, Mycobacterium
HGRGRNCLRPPLSPLSRSAIALLDE

SEQ ID NO: 1349816 - protein, 18 aa, Mycobacterium
HHARCPVAVIGPDADQPS

SEQ ID NO: 1349817 - protein, 17 aa, Mycobacterium
HLDFHPTMEDYFDAKAG

SEQ ID NO: 1349818 - protein, 19 aa, Mycobacterium
HLFEFPKIDADAVDEVLIM

SEQ ID NO: 1349819 - protein, 17 aa, Mycobacterium
HLGTFVLNAGFYRPALL

SEQ ID NO: 1349820 - protein, 21 aa, Mycobacterium
HLTELELQWGRTIGQLPSPYT

SEQ ID NO: 1349821 - protein, 23 aa, Mycobacterium
HPVAYPASPDWPRAADGVIDTSN

SEQ ID NO: 1349822 - protein, 19 aa, Mycobacterium
HRPAEAGVDFAVRTDRGDF

SEQ ID NO: 1349823 - protein, 17 aa, Mycobacterium
HTAESQRALTFVDEEPA

SEQ ID NO: 1349824 - protein, 28 aa, Mycobacterium
HVSFPFRLGFAEVYGLFARAGLHDRVTW

SEQ ID NO: 1349825 - protein, 24 aa, Mycobacterium
HVTSFRDVLAPAWQQATGGALDVT

SEQ ID NO: 1349826 - protein, 25 aa, Mycobacterium
IADGRRVSADWYFPDTDEPPTRIIY

SEQ ID NO: 1349827 - protein, 23 aa, Mycobacterium
IAERPRLTTALDKLRIFSDSATG

SEQ ID NO: 1349828 - protein, 24 aa, Mycobacterium
IDAELRLAQQVGFNTVRVFLHDLL

SEQ ID NO: 1349829 - protein, 24 aa, Mycobacterium
IDAMGNLWWDRPITVTGVHMGAGT

SEQ ID NO: 1349830 - protein, 18 aa, Mycobacterium
IDKAAWDALPPVSGEPVI

SEQ ID NO: 1349831 - protein, 24 aa, Mycobacterium
IDLARFPGLNTWSAEDLNILASLI

SEQ ID NO: 1349832 - protein, 24 aa, Mycobacterium
IDLTFANWRGVLAPPGISDDAKQA

SEQ ID NO: 1349833 - protein, 21 aa, Mycobacterium
IDRGRPAPNHHRWAAYLRWVA

SEQ ID NO: 1349834 - protein, 23 aa, Mycobacterium
IDRMEPYPALVLPGFPAHCPGCL

SEQ ID NO: 1349835 - protein, 24 aa, Mycobacterium
IEADLPGFEAFNVCSGRPISIIEV

SEQ ID NO: 1349836 - protein, 17 aa, Mycobacterium
IEHIVPLAYAWDQGARA

SEQ ID NO: 1349837 - protein, 19 aa, Mycobacterium
IGGFGGVDGLRRWLTETPV

SEQ ID NO: 1349838 - protein, 17 aa, Mycobacterium
IGTSWWAVELGGGNPAQ

SEQ ID NO: 1349839 - protein, 17 aa, Mycobacterium
IIDKALETIPDALAVIN

SEQ ID NO: 1349840 - protein, 27 aa, Mycobacterium
IIGDSKRSTGLFGFVVDWANDPNVFGG

SEQ ID NO: 1349841 - protein, 18 aa, Mycobacterium
IKPLFVLFDSCWDPMPKP

SEQ ID NO: 1349842 - protein, 18 aa, Mycobacterium
ILHPGIREMTGFDWQARH

SEQ ID NO: 1349843 - protein, 17 aa, Mycobacterium
ILTVLIAAASVGLAVVL

SEQ ID NO: 1349844 - protein, 34 aa, Mycobacterium
IPDVLKVRAPVVIGEGVGAFAAGMAYQDILAQLP

SEQ ID NO: 1349845 - protein, 18 aa, Mycobacterium
IPEALPMGVASEAGLQPN

SEQ ID NO: 1349846 - protein, 21 aa, Mycobacterium
IPIRDLIRMAAHSRHYLAVFD

SEQ ID NO: 1349847 - protein, 23 aa, Mycobacterium
IPTVDSPSGWVYIVADNFDRSGP

SEQ ID NO: 1349848 - protein, 25 aa, Mycobacterium
IQEFVKKLPAWVSWERREHYERDLV

SEQ ID NO: 1349849 - protein, 23 aa, Mycobacterium
IQFICGSIEAASRVNAVYSSKLC

SEQ ID NO: 1349850 - protein, 20 aa, Mycobacterium
IRDLEGFTGAYWEGTVGDGK

SEQ ID NO: 1349851 - protein, 18 aa, Mycobacterium
IRGGCGDVVVVLGAAVVA

SEQ ID NO: 1349852 - protein, 26 aa, Mycobacterium
IRNGVIARKGAAYGIATPISDIVVPL

SEQ ID NO: 1349853 - protein, 18 aa, Mycobacterium
IRNYFVANPQEWADLQRI

SEQ ID NO: 1349854 - protein, 23 aa, Mycobacterium
ISALLPPPVIEGFEQPMGAVPGL

SEQ ID NO: 1349855 - protein, 23 aa, Mycobacterium
ITGGTCCIGVWGPLARDMVQLLC

SEQ ID NO: 1349856 - protein, 21 aa, Mycobacterium
ITLPGLIGFAGGSATAGAFSR

SEQ ID NO: 1349857 - protein, 25 aa, Mycobacterium
ITVPMFPNLFLLYGPNTNVGSGSIL

SEQ ID NO: 1349858 - protein, 22 aa, Mycobacterium
IVSTVTWADCLVALQQRQVDAV

SEQ ID NO: 1349859 - protein, 30 aa, Mycobacterium
KAANRLASDMGEFFMPFPGTRVNQSTTPLD

SEQ ID NO: 1349860 - protein, 18 aa, Mycobacterium
KAATEYKAYAIAQADELV

SEQ ID NO: 1349861 - protein, 20 aa, Mycobacterium
KDIGFPYRSSLVPRRNAELD

SEQ ID NO: 1349862 - protein, 17 aa, Mycobacterium
KDISLYLNFDMLGSPNP

SEQ ID NO: 1349863 - protein, 25 aa, Mycobacterium
KDRTEPALDLDLLLGGLKPVIRGLN

SEQ ID NO: 1349864 - protein, 27 aa, Mycobacterium
KELARLIGEGAPILWADMPTLPLYRQQ

SEQ ID NO: 1349865 - protein, 17 aa, Mycobacterium
KESLSLDLKSPAGMDIL

SEQ ID NO: 1349866 - protein, 20 aa, Mycobacterium
KFSDEILLPAARERAVRSEA

SEQ ID NO: 1349867 - protein, 23 aa, Mycobacterium
KHMRADVTVGAFLSGGIDSTAIA

SEQ ID NO: 1349868 - protein, 17 aa, Mycobacterium
KHNCDLFGLQDAADDIV

SEQ ID NO: 1349869 - protein, 18 aa, Mycobacterium
KLPPGRQSAVIVAAEAAA

SEQ ID NO: 1349870 - protein, 25 aa, Mycobacterium
KNPDGAWEFISWMTSKDYMKLVGEK

SEQ ID NO: 1349871 - protein, 29 aa, Mycobacterium
KNSTLVLPFPVELLRFLERSTPRAQCESA

SEQ ID NO: 1349872 - protein, 22 aa, Mycobacterium
KNVDAAAAFIAWATAAPQNLKV

SEQ ID NO: 1349873 - protein, 21 aa, Mycobacterium
KPAAGVFILAPLVLAGAVGAT

SEQ ID NO: 1349874 - protein, 17 aa, Mycobacterium
KPGFATALMNKDLGLAM

SEQ ID NO: 1349875 - protein, 20 aa, Mycobacterium
KPVGHFWFDIPHFIMEQKMM

SEQ ID NO: 1349876 - protein, 18 aa, Mycobacterium
KPVTCDDLVLAWASQSGR

SEQ ID NO: 1349877 - protein, 26 aa, Mycobacterium
KRSLRLAGMRPVPRWPARPTVDLRGK

SEQ ID NO: 1349878 - protein, 34 aa, Mycobacterium; identical to SEQ ID NO: 1319873

SEQ ID NO: 1349879 - protein, 35 aa, Mycobacterium
KYARVSVGLGPAWKVLRDLPLRPGDRHTVTMEVSP

SEQ ID NO: 1349880 - protein, 18 aa, Mycobacterium
LAAVEEIRTKGTVPAQLP

SEQ ID NO: 1349881 - protein, 19 aa, Mycobacterium
LAGAIAFASPLSYPLVADR

SEQ ID NO: 1349882 - protein, 21 aa, Mycobacterium
LAGALALAACSSGGDDASTPS

SEQ ID NO: 1349883 - protein, 21 aa, Mycobacterium
LAGNKARWGGFEGVPNTGADP

SEQ ID NO: 1349884 - protein, 18 aa, Mycobacterium
LAPDAADYFTERQAEFGD

SEQ ID NO: 1349885 - protein, 20 aa, Mycobacterium
LARRGAAVVLGARRADHLDR

SEQ ID NO: 1349886 - protein, 21 aa, Mycobacterium
LARSCDELQFTLGEGPCLDTV

SEQ ID NO: 1349887 - protein, 18 aa, Mycobacterium
LASCGWAFVTPAAATANP

SEQ ID NO: 1349888 - protein, 29 aa, Mycobacterium
LDDVRRLADRAVDEFGRLDVMVNNAGIGR

SEQ ID NO: 1349889 - protein, 17 aa, Mycobacterium
LDGCPPAGPPPGFQECH

SEQ ID NO: 1349890 - protein, 23 aa, Mycobacterium
LDLKSPAGMDILHRLLDGADVLV

SEQ ID NO: 1349891 - protein, 26 aa, Mycobacterium
LDPEAGRPGVQLSLLTGTPNLGYGNK

SEQ ID NO: 1349892 - protein, 17 aa, Mycobacterium
LDPGGQVLTNFHVVQGA

SEQ ID NO: 1349893 - protein, 17 aa, Mycobacterium
LDPIIHVSSFTALFRPG

SEQ ID NO: 1349894 - protein, 26 aa, Mycobacterium
LDRREYFHGGVLRVTVPGVRIEGNGA

SEQ ID NO: 1349895 - protein, 20 aa, Mycobacterium
LDRYKVAPPTTWDEYDEVAA

SEQ ID NO: 1349896 - protein, 19 aa, Mycobacterium
LDVPGYLKSIYDPYTLLDG

SEQ ID NO: 1349897 - protein, 18 aa, Mycobacterium
LEDRSFAALSLREVTREA

SEQ ID NO: 1349898 - protein, 17 aa, Mycobacterium
LEGGEAFAVEEQPTELD

SEQ ID NO: 1349899 - protein, 19 aa, Mycobacterium
LELDAKGAAGFFTDYINTG

SEQ ID NO: 1349900 - protein, 23 aa, Mycobacterium
LERHGMHAVSFLITGNVGAKRPY

SEQ ID NO: 1349901 - protein, 18 aa, Mycobacterium
LERSTPRAQCESAAEDDV

SEQ ID NO: 1349902 - protein, 20 aa, Mycobacterium
LEVPSAAMGRNIRVQFQGGG

SEQ ID NO: 1349903 - protein, 18 aa, Mycobacterium
LFGNEYFHLLQLDPIDGG

SEQ ID NO: 1349904 - protein, 22 aa, Mycobacterium
LFRNDPRVLGWDVWNEPDNPAR

SEQ ID NO: 1349905 - protein, 18 aa, Mycobacterium
LFTTIPFVKDNLTKWWRG

SEQ ID NO: 1349906 - protein, 19 aa, Mycobacterium
LGAYGSWLNQYLCGLSVRV

SEQ ID NO: 1349907 - protein, 23 aa, Mycobacterium
LGDEILAFAMANAARLGLQDVIW

SEQ ID NO: 1349908 - protein, 21 aa, Mycobacterium
LGGALDRAGENLANSFSADNP

SEQ ID NO: 1349909 - protein, 17 aa, Mycobacterium
LGGPGHWRDSGMADTPA

SEQ ID NO: 1349910 - protein, 18 aa, Mycobacterium
LGLGAGYVRKEFEAAELP

SEQ ID NO: 1349911 - protein, 19 aa, Mycobacterium
LGLLVRFGGLTPMQAIVAA

SEQ ID NO: 1349912 - protein, 21 aa, Mycobacterium
LHAAGGPSWIAVQGKQYEGLM

SEQ ID NO: 1349913 - protein, 18 aa, Mycobacterium
LIAARYVQLTPAYESSGP

SEQ ID NO: 1349914 - protein, 17 aa, Mycobacterium
LLDGRRYGLPYDGDIHI

SEQ ID NO: 1349915 - protein, 18 aa, Mycobacterium
LLFTKGPAVARLEFQSAP

SEQ ID NO: 1349916 - protein, 23 aa, Mycobacterium
LLKPEYRGKVALNGDPTQAGAAF

SEQ ID NO: 1349917 - protein, 25 aa, Mycobacterium
LLRARDGWCALTLSRPDDLAAVPAL

SEQ ID NO: 1349918 - protein, 18 aa, Mycobacterium
LLSLAALVTALLLAGCSS

SEQ ID NO: 1349919 - protein, 18 aa, Mycobacterium
LLTSILTYHVVPGQAAPD

SEQ ID NO: 1349920 - protein, 19 aa, Mycobacterium
LMTEARPPLAGSIDQLNRV

SEQ ID NO: 1349921 - protein, 25 aa, Mycobacterium
LNGENARWFYDFSVPGDVVEVRNTG

SEQ ID NO: 1349922 - protein, 23 aa, Mycobacterium
LNLPPPCTTGFLPVDQQLAPNVE

SEQ ID NO: 1349923 - protein, 23 aa, Mycobacterium
LNVSPQLLLAAEWHAKDLMGNRS

SEQ ID NO: 1349924 - protein, 26 aa, Mycobacterium
LPDTYRVMLRQGLYGNYFTFYLCDLL

SEQ ID NO: 1349925 - protein, 22 aa, Mycobacterium
LPDYNIKWTKFDSGADVNTAFI

SEQ ID NO: 1349926 - protein, 17 aa, Mycobacterium
LPFLEAVRLEFGSGQLV

SEQ ID NO: 1349927 - protein, 21 aa, Mycobacterium
LPGGLYVGGATLIPVKIDVTL

SEQ ID NO: 1349928 - protein, 23 aa, Mycobacterium
LPGISPMAAVSIFIDGTKDILPT

SEQ ID NO: 1349929 - protein, 19 aa, Mycobacterium
LPIVPMFHANAWGLPYAAL

SEQ ID NO: 1349930 - protein, 23 aa, Mycobacterium
LPLLRTGGSIVLLGSVTALQGHP

SEQ ID NO: 1349931 - protein, 17 aa, Mycobacterium
LPLYLAAAAALAELPRA

SEQ ID NO: 1349932 - protein, 27 aa, Mycobacterium
LPMALRLERFAVWLIFELLAVTLVDAK

SEQ ID NO: 1349933 - protein, 21 aa, Mycobacterium
LPRINARGGPGGRPGCWQKVT

SEQ ID NO: 1349934 - protein, 20 aa, Mycobacterium
LPTSNCARLYRSVTSTQSGG

SEQ ID NO: 1349935 - protein, 21 aa, Mycobacterium
LPTTYRLLGRTPRRLLPLRPA

SEQ ID NO: 1349936 - protein, 21 aa, Mycobacterium
LPWRDPEAWLTAVRASPLTGT

SEQ ID NO: 1349937 - protein, 19 aa, Mycobacterium
LQAPGLPAMESLGPVIQQA

SEQ ID NO: 1349938 - protein, 18 aa, Mycobacterium
LQTQIAVVKSQYEALTPR

SEQ ID NO: 1349939 - protein, 17 aa, Mycobacterium
LRAAGRVAGLIGTVGIR

SEQ ID NO: 1349940 - protein, 23 aa, Mycobacterium
LRCGLDRPVDFVVGVPIQVVDAV

SEQ ID NO: 1349941 - protein, 19 aa, Mycobacterium
LRDALGAWVGAARDVAGTI

SEQ ID NO: 1349942 - protein, 18 aa, Mycobacterium
LRELERGGLRSAVANAVE

SEQ ID NO: 1349943 - protein, 17 aa, Mycobacterium
LRESLSYEGNMYAVPFY

SEQ ID NO: 1349944 - protein, 26 aa, Mycobacterium
LREVPCRVMAFDVLRLDGRDTTALPY

SEQ ID NO: 1349945 - protein, 20 aa, Mycobacterium
LRFEVLPVMFSIQLTGDCLW

SEQ ID NO: 1349946 - protein, 27 aa, Mycobacterium
LRKDGYDASGVTFVLLGNGARNDGGLW

SEQ ID NO: 1349947 - protein, 18 aa, Mycobacterium
LRPAQARVLLMAALAADV

SEQ ID NO: 1349948 - protein, 20 aa, Mycobacterium
LRPLGRPIVCTEYLAREFGN

SEQ ID NO: 1349949 - protein, 26 aa, Mycobacterium
LRRRLRRSVWALCASWYRTSSGEIPT

SEQ ID NO: 1349950 - protein, 19 aa, Mycobacterium
LRSAVPAAALPRPGTSEGR

SEQ ID NO: 1349951 - protein, 20 aa, Mycobacterium
LRYHRERALPAVAMCVSNTY

SEQ ID NO: 1349952 - protein, 23 aa, Mycobacterium
LSEALRLPVITGPYAQVVAAAGA

SEQ ID NO: 1349953 - protein, 17 aa, Mycobacterium
LSGTRPPGDGRWWNTIS

SEQ ID NO: 1349954 - protein, 22 aa, Mycobacterium
LSRIDAGLFTGTRFEGHLTELE

SEQ ID NO: 1349955 - protein, 17 aa, Mycobacterium
LSVLSVVLAALLALVGP

SEQ ID NO: 1349956 - protein, 17 aa, Mycobacterium
LTAMLAVTTAVSAGCSG

SEQ ID NO: 1349957 - protein, 17 aa, Mycobacterium
LTGERPVFTSGAAFGGP

SEQ ID NO: 1349958 - protein, 17 aa, Mycobacterium
LTIGWPAAGDGWVPVRL

SEQ ID NO: 1349959 - protein, 23 aa, Mycobacterium
LTKNVRTMAAIRWIQRGYRTPAG

SEQ ID NO: 1349960 - protein, 17 aa, Mycobacterium
LTMPYVLPNEGEVVGVG

SEQ ID NO: 1349961 - protein, 26 aa, Mycobacterium
LTNVKVPLQPGVPWVFQTTLDDPTQW

SEQ ID NO: 1349962 - protein, 17 aa, Mycobacterium
LTSGDFVRIAGVEVGKV

SEQ ID NO: 1349963 - protein, 21 aa, Mycobacterium
LTWATTEPLGYNKSYTLTAKS

SEQ ID NO: 1349964 - protein, 18 aa, Mycobacterium
LVADRPTLRHVLVDGDPG

SEQ ID NO: 1349965 - protein, 22 aa, Mycobacterium
LVANDKWWGAKPVTNRITVWPR

SEQ ID NO: 1349966 - protein, 24 aa, Mycobacterium
LVGGMCWSAPSAQAFYIHNHAAVT

SEQ ID NO: 1349967 - protein, 19 aa, Mycobacterium
LVGKIGYLPAPIVEKPNSG

SEQ ID NO: 1349968 - protein, 25 aa, Mycobacterium
LVGYDRGRDIAVIQLLGAGGLPVAP

SEQ ID NO: 1349969 - protein, 18 aa, Mycobacterium
LVTSRSWAAIPAAIATIA

SEQ ID NO: 1349970 - protein, 18 aa, Mycobacterium
LWLILAIAIASVILGVTT

SEQ ID NO: 1349971 - protein, 23 aa, Mycobacterium
LYHFRTRPWIYTWGARDEELTAP

SEQ ID NO: 1349972 - protein, 18 aa, Mycobacterium
LYRPLGMNSTSSRFADYE

SEQ ID NO: 1349973 - protein, 20 aa, Mycobacterium
MAAGTPFALAHTFGQTGPFR

SEQ ID NO: 1349974 - protein, 17 aa, Mycobacterium
MAALPVLPRCGAEIIRR

SEQ ID NO: 1349975 - protein, 26 aa, Mycobacterium
MANAARLGLQDVIWRGTYYTPAGPQA

SEQ ID NO: 1349976 - protein, 17 aa, Mycobacterium
MCLPGHRTAELGHFADV

SEQ ID NO: 1349977 - protein, 19 aa, Mycobacterium
MDLGRKFLSSMGIGGSSAS

SEQ ID NO: 1349978 - protein, 21 aa, Mycobacterium
MDPDVLLREFLKATADPANRH

SEQ ID NO: 1349979 - protein, 26 aa, Mycobacterium
MEGSLRGTFRLTVCKPGSGDAPSVAY

SEQ ID NO: 1349980 - protein, 23 aa, Mycobacterium
MELTRRDVLVLFDYHRYQASAVD

SEQ ID NO: 1349981 - protein, 26 aa, Mycobacterium
MFPEWEVLRPSWFMQNFTGAHPVAES

SEQ ID NO: 1349982 - protein, 19 aa, Mycobacterium
MGPGNVDGLLAFTISGECR

SEQ ID NO: 1349983 - protein, 17 aa, Mycobacterium
MLAGACLLSAGCTATVD

SEQ ID NO: 1349984 - protein, 19 aa, Mycobacterium
MLARIAALLRQAEGTDNVH

SEQ ID NO: 1349985 - protein, 24 aa, Mycobacterium
MLARRIGLNTVRVFLHDQLWAQDR

SEQ ID NO: 1349986 - protein, 17 aa, Mycobacterium
MLGQLGGMLGRAKGPMP

SEQ ID NO: 1349987 - protein, 20 aa, Mycobacterium
MPLSGIAYLDGHRRVDATFR

SEQ ID NO: 1349988 - protein, 25 aa, Mycobacterium
MPTLSRASVIIGTLVVVLALVAAFA

SEQ ID NO: 1349989 - protein, 18 aa, Mycobacterium
MQFMPATFAAYGAGGDIT

SEQ ID NO: 1349990 - protein, 18 aa, Mycobacterium
MRAVPDWEALPAGELAGL

SEQ ID NO: 1349991 - protein, 22 aa, Mycobacterium
MSELVPRLLFVHAHPDDETLTT

SEQ ID NO: 1349992 - protein, 27 aa, Mycobacterium
MTKDSKISTVWTWPDRPGVAGCAALDG

SEQ ID NO: 1349993 - protein, 23 aa, Mycobacterium
MTMGDCPCCGDSGPCCGEGCPCC

SEQ ID NO: 1349994 - protein, 17 aa, Mycobacterium
MVGRILAAQARRQGRDV

SEQ ID NO: 1349995 - protein, 26 aa, Mycobacterium
NAAGGFSYVVPGGWKVSDATNLSYGQ

SEQ ID NO: 1349996 - protein, 19 aa, Mycobacterium
NAASMLMAAAAVFAGDAAA

SEQ ID NO: 1349997 - protein, 25 aa, Mycobacterium
NALNITLPMPRGWAYIPDPNVPEAF

SEQ ID NO: 1349998 - protein, 27 aa, Mycobacterium
NATAMKWMQRWPLRPIASRLWFRTADA

SEQ ID NO: 1349999 - protein, 19 aa, Mycobacterium
NAWGLPYAALMAGADLVLP

SEQ ID NO: 1350000 - protein, 21 aa, Mycobacterium
NDPICSLGRDFDAHVRYPQSG

SEQ ID NO: 1350001 - protein, 27 aa, Mycobacterium
NEQSAKLCVQYLAPIIKNRQYNFPPIG

SEQ ID NO: 1350002 - protein, 21 aa, Mycobacterium
NESLHPYVDWATVRAPAEETL

SEQ ID NO: 1350003 - protein, 19 aa, Mycobacterium
NLIQRGVAFAKALTQQLFW

SEQ ID NO: 1350004 - protein, 18 aa, Mycobacterium
NLSSYGDGTVKDCLSAII

SEQ ID NO: 1350005 - protein, 19 aa, Mycobacterium
NLTNWIVCSQSPRAGGSIG

SEQ ID NO: 1350006 - protein, 19 aa, Mycobacterium
NPGDICARAQQAWSTLSPV

SEQ ID NO: 1350007 - protein, 26 aa, Mycobacterium
NPGLPARGVVALCDFGATGASITLAD

SEQ ID NO: 1350008 - protein, 24 aa, Mycobacterium
NPLQFRSFDVVDGWRRPDGPVAPL

SEQ ID NO: 1350009 - protein, 18 aa, Mycobacterium
NQYLCGLSVRVTDLQGRT

SEQ ID NO: 1350010 - protein, 22 aa, Mycobacterium
NRANIVDAFAALRSFAIVGSRI

SEQ ID NO: 1350011 - protein, 19 aa, Mycobacterium
NRLAAQRAISVKTDPPVEG

SEQ ID NO: 1350012 - protein, 19 aa, Mycobacterium
NRLTREWFHSGRAKYIVAG

SEQ ID NO: 1350013 - protein, 17 aa, Mycobacterium
NSGWRSIGFQERLFEDG

SEQ ID NO: 1350014 - protein, 25 aa, Mycobacterium
NSPNGYRTEVDWATQMSYSGIYVHS

SEQ ID NO: 1350015 - protein, 19 aa, Mycobacterium
NTAFHCQYAMQFIAVLRGY

SEQ ID NO: 1350016 - protein, 19 aa, Mycobacterium
NTQLLWYRADLIPQPPTTW

SEQ ID NO: 1350017 - protein, 26 aa, Mycobacterium
NVVRGNRNYPCLNRPGKRAPTAKMCE

SEQ ID NO: 1350018 - protein, 18 aa, Mycobacterium
PAATLFYHQHLREVMSAA

SEQ ID NO: 1350019 - protein, 18 aa, Mycobacterium
PADAALRPLMSHYTALRR

SEQ ID NO: 1350020 - protein, 21 aa, Mycobacterium
PADDVFRGFAQQLGLDMSTFD

SEQ ID NO: 1350021 - protein, 18 aa, Mycobacterium
PAGMRFQPPECAKFAEGR

SEQ ID NO: 1350022 - protein, 24 aa, Mycobacterium
PALGEPVPAWAPRKPAENWAGQPV

SEQ ID NO: 1350023 - protein, 18 aa, Mycobacterium
PALGWGIHIDRVEIKDVV

SEQ ID NO: 1350024 - protein, 20 aa, Mycobacterium
PANRRLRHAAGPGRAADRYP

SEQ ID NO: 1350025 - protein, 18 aa, Mycobacterium
PAPILAQILQNQWNSAQT

SEQ ID NO: 1350026 - protein, 28 aa, Mycobacterium
PAPVESPATWAVLAWARRQPFSTTTAAN

SEQ ID NO: 1350027 - protein, 20 aa, Mycobacterium
PAREGRVWVRITGHGTVGDR

SEQ ID NO: 1350028 - protein, 26 aa, Mycobacterium
PARKLREIRMALTLDKTFTKPEILTR

SEQ ID NO: 1350029 - protein, 25 aa, Mycobacterium
PASEPAMRTGFYGFGFNVGTSSAAR

SEQ ID NO: 1350030 - protein, 23 aa, Mycobacterium
PASTIKVLLAMVVLDHLSPDNFA

SEQ ID NO: 1350031 - protein, 17 aa, Mycobacterium
PAVAPYGAFPTRDGQTV

SEQ ID NO: 1350032 - protein, 18 aa, Mycobacterium
PAVHEIGQQADLVNGSVV

SEQ ID NO: 1350033 - protein, 25 aa, Mycobacterium
PDAGDACVLWCCAIRHAVLTAQLDV

SEQ ID NO: 1350034 - protein, 23 aa, Mycobacterium
PDDASPRIALRTVGGEDTPAEEA

SEQ ID NO: 1350035 - protein, 18 aa, Mycobacterium
PDDGQWDPTLPKLLSAGA

SEQ ID NO: 1350036 - protein, 20 aa, Mycobacterium
PDESVALAVAFAVRALRNGS

SEQ ID NO: 1350037 - protein, 18 aa, Mycobacterium
PDGAEVRWADLTDSDQVD

SEQ ID NO: 1350038 - protein, 23 aa, Mycobacterium
PDHRMWRPAEELGYGRTYTLTVR

SEQ ID NO: 1350039 - protein, 17 aa, Mycobacterium
PDLPWRDPEAWLTAVRA

SEQ ID NO: 1350040 - protein, 17 aa, Mycobacterium
PDRGFVDFGQLFSATAL

SEQ ID NO: 1350041 - protein, 22 aa, Mycobacterium
PDVTARIALPEVDGLDPEAGRP

SEQ ID NO: 1350042 - protein, 23 aa, Mycobacterium
PEGKVLPGYGWIFPLGNGEVNIG

SEQ ID NO: 1350043 - protein, 25 aa, Mycobacterium
PELWITMASAMCTFADPATLVSDAV

SEQ ID NO: 1350044 - protein, 22 aa, Mycobacterium
PEQRVAAEIALSQSLTVLTGGP

SEQ ID NO: 1350045 - protein, 24 aa, Mycobacterium
PERDDAWFITDWMDATRAQEALQF

SEQ ID NO: 1350046 - protein, 20 aa, Mycobacterium
PETDDCNRRASLRPFPTRAE

SEQ ID NO: 1350047 - protein, 27 aa, Mycobacterium
PFRADDFWLGGDPMYRAVAELFTGDRE

SEQ ID NO: 1350048 - protein, 39 aa, Mycobacterium
PGAAANGPWDFIPTIQVPQIPGLPVPLPTEIGPPSDGIC

SEQ ID NO: 1350049 - protein, 20 aa, Mycobacterium
PGHDGWRPGDPPGHNPFGPP

SEQ ID NO: 1350050 - protein, 19 aa, Mycobacterium
PGIREMTGFDWQARHDREF

SEQ ID NO: 1350051 - protein, 23 aa, Mycobacterium
PGNLAAVCARVGAGLIHVSTDYV

SEQ ID NO: 1350052 - protein, 24 aa, Mycobacterium
PGNYRKLVRLGAYGSWLNQYLCGL

SEQ ID NO: 1350053 - protein, 17 aa, Mycobacterium
PGPFLSWAALIDSGGVA

SEQ ID NO: 1350054 - protein, 28 aa, Mycobacterium
PGPTAIRIGEDFFGLLMPVRPPGDEWKF

SEQ ID NO: 1350055 - protein, 20 aa, Mycobacterium
PGQGMSVVMLHGLPGTSEDF

SEQ ID NO: 1350056 - protein, 25 aa, Mycobacterium
PGQKRARVSFAPDRGFVDFGQLFSA

SEQ ID NO: 1350057 - protein, 24 aa, Mycobacterium
PGSRSTICGLQLEHSDVITFHSYG

SEQ ID NO: 1350058 - protein, 17 aa, Mycobacterium
PHLSVACDPDFASAAWR

SEQ ID NO: 1350059 - protein, 20 aa, Mycobacterium
PIGVNPFVGATVRPNEVTYS

SEQ ID NO: 1350060 - protein, 26 aa, Mycobacterium
PIPGGKSALGLWSWAIPANSAAPDAA

SEQ ID NO: 1350061 - protein, 19 aa, Mycobacterium
PKLPGLHLVSIDRPGFGWS

SEQ ID NO: 1350062 - protein, 18 aa, Mycobacterium
PKVTAALRDPSYRLVTTT

SEQ ID NO: 1350063 - protein, 19 aa, Mycobacterium
PKWDSRYGVLHDRVSELLP

SEQ ID NO: 1350064 - protein, 23 aa, Mycobacterium
PLAAPPARRALAFCTPRDVIARN

SEQ ID NO: 1350065 - protein, 22 aa, Mycobacterium
PLIMRQRYPVPGAPYGLAGSSG

SEQ ID NO: 1350066 - protein, 18 aa, Mycobacterium
PLIPKLPGLHLVSIDRPG

SEQ ID NO: 1350067 - protein, 19 aa, Mycobacterium
PLRHRYAGYTAWRGIAAHR

SEQ ID NO: 1350068 - protein, 18 aa, Mycobacterium
PMILGCSYINRLTGYGGN

SEQ ID NO: 1350069 - protein, 17 aa, Mycobacterium
PNCTPGIQPGVVLGSYC

SEQ ID NO: 1350070 - protein, 23 aa, Mycobacterium
PNPESPEGIALGDEILAFAMANA

SEQ ID NO: 1350071 - protein, 20 aa, Mycobacterium
PNRDCGSFAAGGFGSAGAYR

SEQ ID NO: 1350072 - protein, 21 aa, Mycobacterium
PPEVMAEAKNPAGPHYHYVLD

SEQ ID NO: 1350073 - protein, 18 aa, Mycobacterium
PPLAGSIDQLNRVAPLLE

SEQ ID NO: 1350074 - protein, 20 aa, Mycobacterium
PPLRRPDLLRVFLLGELTPV

SEQ ID NO: 1350075 - protein, 25 aa, Mycobacterium
PPLYGEQQVVPFFLGPQGIADAIRA

SEQ ID NO: 1350076 - protein, 22 aa, Mycobacterium
PPPRPEVGVAVPVAPENVPPEM

SEQ ID NO: 1350077 - protein, 19 aa, Mycobacterium
PPRNQVWRANVVVQPVKVP

SEQ ID NO: 1350078 - protein, 25 aa, Mycobacterium
PPSADELRSALALVGQLAQAPIVAD

SEQ ID NO: 1350079 - protein, 25 aa, Mycobacterium
PPTVLRFAHSLGFEGFADLQVSLRA

SEQ ID NO: 1350080 - protein, 19 aa, Mycobacterium
PPVNAFWSLTMYEMPASLL

SEQ ID NO: 1350081 - protein, 17 aa, Mycobacterium
PPYRGLVEMSAQLPPGT

SEQ ID NO: 1350082 - protein, 17 aa, Mycobacterium
PQAFARVLTGFNYHGPE

SEQ ID NO: 1350083 - protein, 21 aa, Mycobacterium
PQPERVKITFWVDDKYQVPAD

SEQ ID NO: 1350084 - protein, 24 aa, Mycobacterium
PQPTQVRITFWFDAKYPVPADAKA

SEQ ID NO: 1350085 - protein, 20 aa, Mycobacterium
PRFLPLTGPVAMRSTALMRI

SEQ ID NO: 1350086 - protein, 23 aa, Mycobacterium
PRQREALAALPPAPAVPAPAAAP

SEQ ID NO: 1350087 - protein, 19 aa, Mycobacterium
PRRYEPRWFRSPEMHGVKN

SEQ ID NO: 1350088 - protein, 17 aa, Mycobacterium
PRVAGSFGQAPNQASAA

SEQ ID NO: 1350089 - protein, 25 aa, Mycobacterium
PRWVKCRRATFKYGLGAEFIDVLKT

SEQ ID NO: 1350090 - protein, 19 aa, Mycobacterium
PSADPAPGYPLAGRLWEAT

SEQ ID NO: 1350091 - protein, 18 aa, Mycobacterium
PSGRAGSAYVSRVAEGSV

SEQ ID NO: 1350092 - protein, 17 aa, Mycobacterium
PTIQPAVLTVGGSTITG

SEQ ID NO: 1350093 - protein, 26 aa, Mycobacterium
PTITARLNFQLAFGARIGVRLTEARE

SEQ ID NO: 1350094 - protein, 23 aa, Mycobacterium
PTLPAEAPVPMPDPSNRQTDPAA

SEQ ID NO: 1350095 - protein, 17 aa, Mycobacterium
PTLRPAQARVLLMAALA

SEQ ID NO: 1350096 - protein, 17 aa, Mycobacterium
PTLRVAYQIIKTVDRFL

SEQ ID NO: 1350097 - protein, 24 aa, Mycobacterium
PTNSRLGYRETISYATRISIDGIY

SEQ ID NO: 1350098 - protein, 25 aa, Mycobacterium
PTPPLPRLASESAPAVTVTVSSEFD

SEQ ID NO: 1350099 - protein, 19 aa, Mycobacterium
PTVGRTIAYAWLPAGADTG

SEQ ID NO: 1350100 - protein, 17 aa, Mycobacterium
PTWPGARLETVILTEAD

SEQ ID NO: 1350101 - protein, 28 aa, Mycobacterium
PVAIHEILHSFGFMSFIERPGENVERTW

SEQ ID NO: 1350102 - protein, 22 aa, Mycobacterium
PVPYAMAITFQFRGVTPTGDAY

SEQ ID NO: 1350103 - protein, 17 aa, Mycobacterium
PVTSGVWQGHWRDPGSR

SEQ ID NO: 1350104 - protein, 26 aa, Mycobacterium
PVYDPALARPGIHFDPEPVEDSPDGS

SEQ ID NO: 1350105 - protein, 17 aa, Mycobacterium
PWITPVGSAVFAIPPGA

SEQ ID NO: 1350106 - protein, 18 aa, Mycobacterium
PYGQALNFGDYRCRTDPS

SEQ ID NO: 1350107 - protein, 25 aa, Mycobacterium
QAARLAHALRRFGIEGDDRVGTFMW

SEQ ID NO: 1350108 - protein, 19 aa, Mycobacterium
QADPHCWWVPNTPGPGCLP

SEQ ID NO: 1350109 - protein, 18 aa, Mycobacterium
QAEADIRGYFTANPQEYY

SEQ ID NO: 1350110 - protein, 19 aa, Mycobacterium
QAERWGGEADRPFDPNYHK

SEQ ID NO: 1350111 - protein, 24 aa, Mycobacterium
QAVASGLYPSAPVLSPDGTRLYVP

SEQ ID NO: 1350112 - protein, 17 aa, Mycobacterium
QEDFSGWDINTAAFEWY

SEQ ID NO: 1350113 - protein, 26 aa, Mycobacterium
QELVAAFLPHVFQWTRAMNPVQPVTS

SEQ ID NO: 1350114 - protein, 25 aa, Mycobacterium
QEPRAWRLAVELSREGDQIKMSKVE

SEQ ID NO: 1350115 - protein, 20 aa, Mycobacterium
QERRRLTLVEGRDDDRALIP

SEQ ID NO: 1350116 - protein, 23 aa, Mycobacterium
QEYYELRGILAPIGDTQRQCNVT

SEQ ID NO: 1350117 - protein, 22 aa, Mycobacterium
QFLRDNREAAGIATDRLAAITT

SEQ ID NO: 1350118 - protein, 22 aa, Mycobacterium
QGKGRIAVVFGAGGNRDAGKRE

SEQ ID NO: 1350119 - protein, 23 aa, Mycobacterium
QHTDEILGGLGLSADEIAALREQ

SEQ ID NO: 1350120 - protein, 20 aa, Mycobacterium
QIGGAYTRDGAKRMIAQKTV

SEQ ID NO: 1350121 - protein, 20 aa, Mycobacterium
QIPLLRDLLTQGLNVAGLNT

SEQ ID NO: 1350122 - protein, 25 aa, Mycobacterium
QLPLTRPLLDLGVPPEIVRALDPLL

SEQ ID NO: 1350123 - protein, 18 aa, Mycobacterium
QLRPELDGAPAAYASAFD

SEQ ID NO: 1350124 - protein, 29 aa, Mycobacterium
QPQRGYKIFEEWANWLFAAGGSIYDADGK

SEQ ID NO: 1350125 - protein, 27 aa, Mycobacterium
QPSVLWRPVPDAFVLDAMGAPLCTAYI

SEQ ID NO: 1350126 - protein, 29 aa, Mycobacterium
QQFPQIVQISGWRPDPIGGHGDGRALDIL

SEQ ID NO: 1350127 - protein, 18 aa, Mycobacterium
QRAPRVAGSFGQAPNQAS

SEQ ID NO: 1350128 - protein, 25 aa, Mycobacterium
QRDAHLRAADFFDVENHPVATFTST

SEQ ID NO: 1350129 - protein, 24 aa, Mycobacterium
QRLYFPEGSYRFAQQNPAGNAAVL

SEQ ID NO: 1350130 - protein, 23 aa, Mycobacterium
QRPPRPGVHNSGWVQSPGAQYLG

SEQ ID NO: 1350131 - protein, 26 aa, Mycobacterium
QRTGIYGGIRACQWAVADGVIGRSRS

SEQ ID NO: 1350132 - protein, 19 aa, Mycobacterium
QSRGRPGPIRGPDLMDPNR

SEQ ID NO: 1350133 - protein, 24 aa, Mycobacterium
QTGYRWPGMGMMRIVVTPASVPAG

SEQ ID NO: 1350134 - protein, 26 aa, Mycobacterium
QVLRNIVYRTRIDGVSRGATITYSAE

SEQ ID NO: 1350135 - protein, 18 aa, Mycobacterium
QVQLRTGVVTDVRRGEQF

SEQ ID NO: 1350136 - protein, 25 aa, Mycobacterium
QVTQAGPACLAWFGNKDDGKCLSYS

SEQ ID NO: 1350137 - protein, 23 aa, Mycobacterium
RAALFEPATRSLVVLGSGPGGRS

SEQ ID NO: 1350138 - protein, 21 aa, Mycobacterium
RADLDAGVFEHRCPVGGEELQ

SEQ ID NO: 1350139 - protein, 26 aa, Mycobacterium
RADVALSARLSGSMASYDWTINGRPF

SEQ ID NO: 1350140 - protein, 18 aa, Mycobacterium
RAEYGDRVNFVLRYFPLR

SEQ ID NO: 1350141 - protein, 18 aa, Mycobacterium
RAGLVVDPGAKVTFNGVE

SEQ ID NO: 1350142 - protein, 18 aa, Mycobacterium
RAMAIRAGRAVTVSASGR

SEQ ID NO: 1350143 - protein, 21 aa, Mycobacterium
RAPAPAPARVPAPAPAPAPAP

SEQ ID NO: 1350144 - protein, 18 aa, Mycobacterium
RAPAVILAAGGFVHNREW

SEQ ID NO: 1350145 - protein, 21 aa, Mycobacterium
RAQESFAMCSTFKAYLAAHVL

SEQ ID NO: 1350146 - protein, 23 aa, Mycobacterium
RAVHAGLLLRGWSDDIVVLAGDV

SEQ ID NO: 1350147 - protein, 19 aa, Mycobacterium
RDAWHQAQNPYGMGMPDQM

SEQ ID NO: 1350148 - protein, 30 aa, Mycobacterium; identical to SEQ ID NO: 1277353

SEQ ID NO: 1350149 - protein, 17 aa, Mycobacterium
RDKAGMIIANLAASTPD

SEQ ID NO: 1350150 - protein, 26 aa, Mycobacterium
RDRGCTHPGCTVPFYWTEAHHTDDYS

SEQ ID NO: 1350151 - protein, 19 aa, Mycobacterium
REAHLRSAVPAAALPRPGT

SEQ ID NO: 1350152 - protein, 20 aa, Mycobacterium
RELTVPGALVLAHTPQGRFT

SEQ ID NO: 1350153 - protein, 20 aa, Mycobacterium
REVNAAAAAKGFAQLDAPVS

SEQ ID NO: 1350154 - protein, 18 aa, Mycobacterium
RFAGKMVDEAHRLADMIG

SEQ ID NO: 1350155 - protein, 19 aa, Mycobacterium
RFEETCATPPMAIDDPRTW

SEQ ID NO: 1350156 - protein, 24 aa, Mycobacterium
RGASQMGTPYSWGGGKPNGPSRGV

SEQ ID NO: 1350157 - protein, 17 aa, Mycobacterium
RGGKGISALFVNQDDTR

SEQ ID NO: 1350158 - protein, 25 aa, Mycobacterium
RGSRGVSLAEVWKTQAYAYLGITVP

SEQ ID NO: 1350159 - protein, 23 aa, Mycobacterium
RGVIPANRLLGVALVADPSQAPV

SEQ ID NO: 1350160 - protein, 18 aa, Mycobacterium
RHAAGPGRAADRYPRSSD

SEQ ID NO: 1350161 - protein, 17 aa, Mycobacterium
RILAAQARRQGRDVSAL

SEQ ID NO: 1350162 - protein, 34 aa, Mycobacterium; identical to SEQ ID NO: 1278106

SEQ ID NO: 1350163 - protein, 23 aa, Mycobacterium
RKAEATFGVGWNYLAAINLVETA

SEQ ID NO: 1350164 - protein, 23 aa, Mycobacterium
RKHAARLSWFQALATEQRTCVFF

SEQ ID NO: 1350165 - protein, 19 aa, Mycobacterium
RKKKVGFSTVYLNADQRIL

SEQ ID NO: 1350166 - protein, 28 aa, Mycobacterium
RLATLAACLSVSMAELLSAAPSAVAAAG

SEQ ID NO: 1350167 - protein, 31 aa, Mycobacterium
RLESLRGAEFDRLWLESMISHHQGAVEMAKA

SEQ ID NO: 1350168 - protein, 17 aa, Mycobacterium
RLGATTATVAALAGCSD

SEQ ID NO: 1350169 - protein, 21 aa, Mycobacterium
RLLDERAWEAAQHTLSTGEDV

SEQ ID NO: 1350170 - protein, 23 aa, Mycobacterium
RLREYRDRYGVSYVIVQAPHEDA

SEQ ID NO: 1350171 - protein, 18 aa, Mycobacterium
RLYVPAVAVVDGQPQLAI

SEQ ID NO: 1350172 - protein, 25 aa, Mycobacterium
RMNRARYELPPGYEVAELQGRVTPL

SEQ ID NO: 1350173 - protein, 18 aa, Mycobacterium
RPAAAGRTILPFVNGDQN

SEQ ID NO: 1350174 - protein, 25 aa, Mycobacterium
RPDVVAVAVPAHWSTAAVAALRAVV

SEQ ID NO: 1350175 - protein, 19 aa, Mycobacterium
RPGFGWSRGGWLPYQDQIE

SEQ ID NO: 1350176 - protein, 18 aa, Mycobacterium
RPGTSEGRQLRRWLTQLL

SEQ ID NO: 1350177 - protein, 26 aa, Mycobacterium
RPHARRRTMAAAGLSALAILGVAACS

SEQ ID NO: 1350178 - protein, 26 aa, Mycobacterium
RPRRQRAWWAGMLVVPAMVLGLTSCS

SEQ ID NO: 1350179 - protein, 28 aa, Mycobacterium
RPRRVLLALLLAEFVSAVLMLDRSQPPA

SEQ ID NO: 1350180 - protein, 21 aa, Mycobacterium
RPTGLPWKGPDPVEVWDAYPD

SEQ ID NO: 1350181 - protein, 19 aa, Mycobacterium
RPWSRWTPPVELFEPAVTE

SEQ ID NO: 1350182 - protein, 30 aa, Mycobacterium
RQSDEPPCCPTGIGTVRFRIGGDGKLEAVD

SEQ ID NO: 1350183 - protein, 21 aa, Mycobacterium
RRAEGALTCLVDLREPPARPA

SEQ ID NO: 1350184 - protein, 18 aa, Mycobacterium
RRALQLLGLAGGAALLGP

SEQ ID NO: 1350185 - protein, 22 aa, Mycobacterium
RRAPGNSWYHFTFNGAPGSILA

SEQ ID NO: 1350186 - protein, 22 aa, Mycobacterium
RRATWLLALLMATASLSASAGA

SEQ ID NO: 1350187 - protein, 25 aa, Mycobacterium
RREAIAHAVRWARPGDVVLVAGKGH

SEQ ID NO: 1350188 - protein, 19 aa, Mycobacterium
RRLAQFVAIAARHDIRPLF

SEQ ID NO: 1350189 - protein, 19 aa, Mycobacterium
RRLLLWSAPLTLAVILVAV

SEQ ID NO: 1350190 - protein, 20 aa, Mycobacterium
RRVRQRRKEIGRGQRFELSA

SEQ ID NO: 1350191 - protein, 17 aa, Mycobacterium
RRWPQQRRPSAELLREV

SEQ ID NO: 1350192 - protein, 20 aa, Mycobacterium
RSDEPWITSHLELRSPEGKV

SEQ ID NO: 1350193 - protein, 19 aa, Mycobacterium
RSGPAQLLYLGRLEYEKGV

SEQ ID NO: 1350194 - protein, 21 aa, Mycobacterium
RSREIEVLEFVPASDLDPLMY

SEQ ID NO: 1350195 - protein, 22 aa, Mycobacterium
RSRSPGKVWAWQTRSWSNGQIY

SEQ ID NO: 1350196 - protein, 19 aa, Mycobacterium
RTFIAGCALAMTMSSVGVV

SEQ ID NO: 1350197 - protein, 17 aa, Mycobacterium
RTLAWAWSDPLSQEPGY

SEQ ID NO: 1350198 - protein, 19 aa, Mycobacterium
RTQWIRWRKPVIGAPTTPR

SEQ ID NO: 1350199 - protein, 26 aa, Mycobacterium
RTRPIRIAPRKALALRALDVVAPRAL

SEQ ID NO: 1350200 - protein, 19 aa, Mycobacterium
RVAAVAACVTVIASGCTFD

SEQ ID NO: 1350201 - protein, 26 aa, Mycobacterium
RVIIPARWNFLNVVRPLGVQLDNLLL

SEQ ID NO: 1350202 - protein, 22 aa, Mycobacterium
RVRDGTGAGGCWSFVLRPERGG

SEQ ID NO: 1350203 - protein, 19 aa, Mycobacterium
RVSLGDALPHTVVVSPDGR

SEQ ID NO: 1350204 - protein, 18 aa, Mycobacterium
RWFRSPEMHGVKNQFDLC

SEQ ID NO: 1350205 - protein, 17 aa, Mycobacterium
RWHDVERVMQLNYYAPL

SEQ ID NO: 1350206 - protein, 17 aa, Mycobacterium
RYGLPYDGDIHILFYNA

SEQ ID NO: 1350207 - protein, 21 aa, Mycobacterium
SADELRRATTVYGSRRQLDLL

SEQ ID NO: 1350208 - protein, 24 aa, Mycobacterium
SAEALEFVGLMGIPPLGADAESAF

SEQ ID NO: 1350209 - protein, 18 aa, Mycobacterium
SAGLLSRIAGELPAAAEL

SEQ ID NO: 1350210 - protein, 18 aa, Mycobacterium
SAILRYNNSVAYARNVLS

SEQ ID NO: 1350211 - protein, 18 aa, Mycobacterium
SAQPQCTAAGLSSALSSV

SEQ ID NO: 1350212 - protein, 27 aa, Mycobacterium
SARKFRWRGVLEVSRLPQGEVAVGHRF

SEQ ID NO: 1350213 - protein, 21 aa, Mycobacterium
SASAGAGCRECARPQADSPVA

SEQ ID NO: 1350214 - protein, 18 aa, Mycobacterium
SAVSGGLNPAVNVASVLD

SEQ ID NO: 1350215 - protein, 24 aa, Mycobacterium
SAYTGPEMAFGWDPLDIPGGDIAP

SEQ ID NO: 1350216 - protein, 19 aa, Mycobacterium
SCVVFCLEDAPAPAAAPAP

SEQ ID NO: 1350217 - protein, 21 aa, Mycobacterium
SDPGVHGRQTLALTTLTTLTS

SEQ ID NO: 1350218 - protein, 24 aa, Mycobacterium
SDRRPGGAWMLGKPILLSEARDLY

SEQ ID NO: 1350219 - protein, 21 aa, Mycobacterium
SEDRLRPDFVPPAAPTEPAVA

SEQ ID NO: 1350220 - protein, 24 aa, Mycobacterium
SELPDRAAPVVLAYHDIRPMTATE

SEQ ID NO: 1350221 - protein, 23 aa, Mycobacterium
SEPLGYGVTYSWSGSAVGEDGKA

SEQ ID NO: 1350222 - protein, 25 aa, Mycobacterium
SFAGQGVGFGGWYSPVALHVETDSI

SEQ ID NO: 1350223 - protein, 24 aa, Mycobacterium
SFLMYRKDLFEQAGITVDQNPDYQ

SEQ ID NO: 1350224 - protein, 22 aa, Mycobacterium
SGDRGEVVWTREDVVPLTTSSR

SEQ ID NO: 1350225 - protein, 18 aa, Mycobacterium
SGHYARFVTASGESNHLA

SEQ ID NO: 1350226 - protein, 20 aa, Mycobacterium
SGLLDILGLDLSNLADLTGL

SEQ ID NO: 1350227 - protein, 35 aa, Mycobacterium
SGVTPPGVFPPLEGAAAVFDRLLPGAPTPGAPGAA

SEQ ID NO: 1350228 - protein, 21 aa, Mycobacterium
SISNGCLKDGGNVLATAISVA

SEQ ID NO: 1350229 - protein, 24 aa, Mycobacterium
SIYDPPMRTMIALGARYPTTVIPS

SEQ ID NO: 1350230 - protein, 22 aa, Mycobacterium
SKPWHPSGLAIDIMIPNPESPE

SEQ ID NO: 1350231 - protein, 18 aa, Mycobacterium
SKTDLWDFEANLQGSEAA

SEQ ID NO: 1350232 - protein, 18 aa, Mycobacterium
SLMRTAPVALAYLDDEDA

SEQ ID NO: 1350233 - protein, 23 aa, Mycobacterium
SLQNRPPLRIALAAPTGKAAARL

SEQ ID NO: 1350234 - protein, 17 aa, Mycobacterium
SLVAYLYGYGAQQTAEV

SEQ ID NO: 1350235 - protein, 27 aa, Mycobacterium
SMGEALLSGLLRAGRQVKDLVVAEKHP

SEQ ID NO: 1350236 - protein, 18 aa, Mycobacterium
SNTDWEWIEAAADVVHRA

SEQ ID NO: 1350237 - protein, 23 aa, Mycobacterium
SPDGRYVYTETFASGSGGVPTGT

SEQ ID NO: 1350238 - protein, 26 aa, Mycobacterium
SPLPGVNVPTGLASLMPAGSPLTSLL

SEQ ID NO: 1350239 - protein, 18 aa, Mycobacterium
SPSAFRIAASTVSSPPPA

SEQ ID NO: 1350240 - protein, 21 aa, Mycobacterium
SPVREVSELAGKTVAVTAPGS

SEQ ID NO: 1350241 - protein, 19 aa, Mycobacterium
SQALPAWRSTDASLAPYNG

SEQ ID NO: 1350242 - protein, 24 aa, Mycobacterium
SRPAALARRGLGPDVVPAREGRVW

SEQ ID NO: 1350243 - protein, 21 aa, Mycobacterium
SRQLLAAQIIWTLNRAGINGP

SEQ ID NO: 1350244 - protein, 17 aa, Mycobacterium
SRRALLGAGAAAAGIAG

SEQ ID NO: 1350245 - protein, 24 aa, Mycobacterium
SRTEFGDKLDVAFNVEGEKSVVGM

SEQ ID NO: 1350246 - protein, 23 aa, Mycobacterium
SSGPDRYLVSLAVTTTVDQAVPA

SEQ ID NO: 1350247 - protein, 24 aa, Mycobacterium
SSKLCAQYLAPIVKNRQMNFPPLG

SEQ ID NO: 1350248 - protein, 25 aa, Mycobacterium
SSSVNDLTKWLAMVLADGKAGGQQL

SEQ ID NO: 1350249 - protein, 19 aa, Mycobacterium
STVPNRRGGKGISALFVNQ

SEQ ID NO: 1350250 - protein, 26 aa, Mycobacterium
SVAPESLRFGLYGALVHPIEANGLGS

SEQ ID NO: 1350251 - protein, 17 aa, Mycobacterium
SVASRSWAAGSVDGPAL

SEQ ID NO: 1350252 - protein, 25 aa, Mycobacterium
SVRFPLNPFMGMMGVAFARDESLNA

SEQ ID NO: 1350253 - protein, 24 aa, Mycobacterium
TAAYCQGSAAAVAFGRTADALVAI

SEQ ID NO: 1350254 - protein, 23 aa, Mycobacterium
TADPRRIVVLSGDQLDALCALGL

SEQ ID NO: 1350255 - protein, 20 aa, Mycobacterium
TADSINAWASHLANLTDQVR

SEQ ID NO: 1350256 - protein, 21 aa, Mycobacterium
TAMWGPGGGPAWKRNDPTVNV

SEQ ID NO: 1350257 - protein, 26 aa, Mycobacterium
TATGRGCGRWVGQPPAHLCQHLGPQN

SEQ ID NO: 1350258 - protein, 17 aa, Mycobacterium
TAVARARLLGMPAAMLV

SEQ ID NO: 1350259 - protein, 24 aa, Mycobacterium
TCVDAHNGAGFVISPTASFVLQPS

SEQ ID NO: 1350260 - protein, 21 aa, Mycobacterium
TDARFNLSRAALLVVALTERP

SEQ ID NO: 1350261 - protein, 18 aa, Mycobacterium
TDCRLYWVQIGPTAAAPD

SEQ ID NO: 1350262 - protein, 20 aa, Mycobacterium
TDVTAAWAMAVPAAPLPAEY

SEQ ID NO: 1350263 - protein, 17 aa, Mycobacterium
TDWTDYQAGVFIGAATG

SEQ ID NO: 1350264 - protein, 21 aa, Mycobacterium
TEADFPPGVQYDRIVDEPGPG

SEQ ID NO: 1350265 - protein, 31 aa, Mycobacterium; identical to SEQ ID NO: 1281559

SEQ ID NO: 1350266 - protein, 26 aa, Mycobacterium
TEMSLPLASIFKLYVLLAVAEAVKVG

SEQ ID NO: 1350267 - protein, 24 aa, Mycobacterium
TEPFSEPEVFDFPDGIGPVECVNV

SEQ ID NO: 1350268 - protein, 28 aa, Mycobacterium
TEPVRVEVSGGWFQRVALMNAQGKPVAG

SEQ ID NO: 1350269 - protein, 18 aa, Mycobacterium
TEPVSVVVSVDQWGGIVS

SEQ ID NO: 1350270 - protein, 24 aa, Mycobacterium
TESIQYTRFAQWKLDPAVAPATAP

SEQ ID NO: 1350271 - protein, 29 aa, Mycobacterium
TFLGFERWAPEMPWEISIGRTVRPVELTV

SEQ ID NO: 1350272 - protein, 24 aa, Mycobacterium
TGAALQIVTLFGLAYATDSHLPGI

SEQ ID NO: 1350273 - protein, 20 aa, Mycobacterium
TGFWPAHSPISVGAGDFMTE

SEQ ID NO: 1350274 - protein, 23 aa, Mycobacterium
TGHPQVDAFLWVKRPGESDGSCG

SEQ ID NO: 1350275 - protein, 18 aa, Mycobacterium
TGPGDWTSLASRDISISD

SEQ ID NO: 1350276 - protein, 19 aa, Mycobacterium
TGVADWLSTQGWQVTMIGA

SEQ ID NO: 1350277 - protein, 17 aa, Mycobacterium
TIDGSAAAGVFVDGADG

SEQ ID NO: 1350278 - protein, 23 aa, Mycobacterium
TIPRARTAVPVEFDEFRQQLERL

SEQ ID NO: 1350279 - protein, 17 aa, Mycobacterium
TKYEYWNGTSWTPGNPA

SEQ ID NO: 1350280 - protein, 24 aa, Mycobacterium
TLTARPGQRIRMRIINAASDTAFR

SEQ ID NO: 1350281 - protein, 19 aa, Mycobacterium
TLTVAALLCAGLLTGCTQT

SEQ ID NO: 1350282 - protein, 31 aa, Mycobacterium
TNARLKAVADRCPRTVFILTGYSQGADVAGD

SEQ ID NO: 1350283 - protein, 26 aa, Mycobacterium
TNGLTYPFTFAFERSGEVTVQVPISA

SEQ ID NO: 1350284 - protein, 18 aa, Mycobacterium
TPAFEWYHQSGLSVVMPV

SEQ ID NO: 1350285 - protein, 22 aa, Mycobacterium
TPEGPWSAPVTVATSKQYPGLY

SEQ ID NO: 1350286 - protein, 20 aa, Mycobacterium
TPIVSKLPWFALSDPAVTQM

SEQ ID NO: 1350287 - protein, 31 aa, Mycobacterium
TPPGRTGGDFTFPMEFARTPDGGWQLTRDSA

SEQ ID NO: 1350288 - protein, 18 aa, Mycobacterium
TPPMAIDDPRTWAVAARA

SEQ ID NO: 1350289 - protein, 23 aa, Mycobacterium
TPPSGPLPPTARVDTASGATPPA

SEQ ID NO: 1350290 - protein, 26 aa, Mycobacterium
TPQLARLAAMGGFRRWDRVVRNYIAD

SEQ ID NO: 1350291 - protein, 28 aa, Mycobacterium
TPRGQRTPERWFVVWLGSATNPVDREAA

SEQ ID NO: 1350292 - protein, 17 aa, Mycobacterium
TQQLFWLAGPQVAAVAT

SEQ ID NO: 1350293 - protein, 23 aa, Mycobacterium
TRAAFIVCSHIQVVYGGVNLTTP

SEQ ID NO: 1350294 - protein, 18 aa, Mycobacterium
TRADRRFAVVYVDDHSEY

SEQ ID NO: 1350295 - protein, 18 aa, Mycobacterium
TRDARGAAYGAIVSGQQV

SEQ ID NO: 1350296 - protein, 18 aa, Mycobacterium
TRGDAVRVFTPRPEPREV

SEQ ID NO: 1350297 - protein, 18 aa, Mycobacterium
TRKFGLAGLLGYAVYLAG

SEQ ID NO: 1350298 - protein, 22 aa, Mycobacterium
TRLTPLTIRLMHIMSPMDHSKA

SEQ ID NO: 1350299 - protein, 21 aa, Mycobacterium
TRVAQRYGLSGTRPPGDGRWW

SEQ ID NO: 1350300 - protein, 25 aa, Mycobacterium
TSLDVMALDVVWTAEFAEAGWALPL

SEQ ID NO: 1350301 - protein, 18 aa, Mycobacterium
TSNPFRADDFWLGGDPMY

SEQ ID NO: 1350302 - protein, 24 aa, Mycobacterium
TTLTSRGPILGLFGDGVDAARDCT

SEQ ID NO: 1350303 - protein, 34 aa, Mycobacterium; identical to SEQ ID NO: 936634

SEQ ID NO: 1350304 - protein, 19 aa, Mycobacterium
TTPRTALDAGFGLGISTAS

SEQ ID NO: 1350305 - protein, 19 aa, Mycobacterium
TTTVARLLALLAEQASLQN

SEQ ID NO: 1350306 - protein, 24 aa, Mycobacterium
TTVGARLGIFARVDALVAQGNTTV

SEQ ID NO: 1350307 - protein, 17 aa, Mycobacterium
TVALAADNPGVWMMHCH

SEQ ID NO: 1350308 - protein, 19 aa, Mycobacterium
TVAVLKRQPDELVLLDADT

SEQ ID NO: 1350309 - protein, 22 aa, Mycobacterium
TVEAWACAFGPGGEAATIATEM

SEQ ID NO: 1350310 - protein, 25 aa, Mycobacterium
TVGTYAVKYPASWDFSQVGLGATDA

SEQ ID NO: 1350311 - protein, 19 aa, Mycobacterium
TVRVDARFYGVKFGEDAYG

SEQ ID NO: 1350312 - protein, 27 aa, Mycobacterium
TVTKIERRGWHALLTLALNGDVDLPAN

SEQ ID NO: 1350313 - protein, 25 aa, Mycobacterium
TVTVLRGDEIVKVFTDSVQPAGLAP

SEQ ID NO: 1350314 - protein, 17 aa, Mycobacterium
TVVPFLLADAYHARVDI

SEQ ID NO: 1350315 - protein, 17 aa, Mycobacterium
TWQDCASAALTVDDGVV

SEQ ID NO: 1350316 - protein, 18 aa, Mycobacterium
TYSEDWMRPDYVPPQPTL

SEQ ID NO: 1350317 - protein, 20 aa, Mycobacterium
VAACGSAPPPPEVDELTAQL

SEQ ID NO: 1350318 - protein, 17 aa, Mycobacterium
VAAGLPVGVDIPELLTG

SEQ ID NO: 1350319 - protein, 33 aa, Mycobacterium
VAASGKANIVFLGQRLDGVEFVVADGNLYGAIS

SEQ ID NO: 1350320 - protein, 28 aa, Mycobacterium
VAAVVLTSCGSWKGIANVPLPGGPGTGG

SEQ ID NO: 1350321 - protein, 29 aa, Mycobacterium
VACDPDFASAAWRKLLVNAVVGLMVLTGR

SEQ ID NO: 1350322 - protein, 20 aa, Mycobacterium
VADLHGWKHNCDLFGLQDAA

SEQ ID NO: 1350323 - protein, 23 aa, Mycobacterium
VADTRGDELLVFGTDPLIMRQRY

SEQ ID NO: 1350324 - protein, 17 aa, Mycobacterium
VAHRAQESFAMCSTFKA

SEQ ID NO: 1350325 - protein, 27 aa, Mycobacterium
VALDLGPWLLNWVPLGYLISDQIYIWY

SEQ ID NO: 1350326 - protein, 19 aa, Mycobacterium
VAPPTTWDEYDEVAAKITR

SEQ ID NO: 1350327 - protein, 17 aa, Mycobacterium
VARWVAPFLTVAAVAGT

SEQ ID NO: 1350328 - protein, 25 aa, Mycobacterium
VAVKQGWMCCVGSDWMHLSTGVIGA

SEQ ID NO: 1350329 - protein, 17 aa, Mycobacterium
VCVPATYARGRRLPLTL

SEQ ID NO: 1350330 - protein, 19 aa, Mycobacterium
VDAYLRISALLGVPPGEDL

SEQ ID NO: 1350331 - protein, 18 aa, Mycobacterium
VDGLRRWLTETPVHAVVD

SEQ ID NO: 1350332 - protein, 21 aa, Mycobacterium
VDGRYEPLYVRNADAEGPAGG

SEQ ID NO: 1350333 - protein, 19 aa, Mycobacterium
VDSDSWCNPPGRALGTPPT

SEQ ID NO: 1350334 - protein, 22 aa, Mycobacterium
VEDGVRIAIHYDAGVYDGSCAL

SEQ ID NO: 1350335 - protein, 17 aa, Mycobacterium
VEKFIPRQITNILTGRR

SEQ ID NO: 1350336 - protein, 24 aa, Mycobacterium
VESADALIRVALPGGESQSQIVTG

SEQ ID NO: 1350337 - protein, 22 aa, Mycobacterium
VFIPAGLAHRVANTAPHDAHVV

SEQ ID NO: 1350338 - protein, 26 aa, Mycobacterium
VFNFPPKGTHSWGYWGSQLQAMKPDL

SEQ ID NO: 1350339 - protein, 23 aa, Mycobacterium
VGIVCGGISLAALTIDEGEIDGL

SEQ ID NO: 1350340 - protein, 19 aa, Mycobacterium
VGLTPAFAAHAATPPTPGH

SEQ ID NO: 1350341 - protein, 30 aa, Mycobacterium; identical to SEQ ID NO: 1283487

SEQ ID NO: 1350342 - protein, 18 aa, Mycobacterium
VGPTPLVLQVLYINPAGA

SEQ ID NO: 1350343 - protein, 21 aa, Mycobacterium
VGTFTGWRPAMPVTQWVVVKP

SEQ ID NO: 1350344 - protein, 25 aa, Mycobacterium
VGVAMPLTVRFAAPVDNRFAAQRSL

SEQ ID NO: 1350345 - protein, 25 aa, Mycobacterium
VIALPPDWANYGTIIDTFSKKYGIK

SEQ ID NO: 1350346 - protein, 18 aa, Mycobacterium
VKASLSFRSEPIVYDRRD

SEQ ID NO: 1350347 - protein, 17 aa, Mycobacterium
VLGAKLPTSNCARLYRS

SEQ ID NO: 1350348 - protein, 36 aa, Mycobacterium; identical to SEQ ID NO: 1283826

SEQ ID NO: 1350349 - protein, 20 aa, Mycobacterium
VLTEFPPLIEHFAETRDLFA

SEQ ID NO: 1350350 - protein, 18 aa, Mycobacterium
VLTGLGVTAVMLAAGCAD

SEQ ID NO: 1350351 - protein, 24 aa, Mycobacterium
VLWTAGVEAVRFARHVAEVLGAET

SEQ ID NO: 1350352 - protein, 20 aa, Mycobacterium
VLYLSTRGGYLRVDVAAGAV

SEQ ID NO: 1350353 - protein, 18 aa, Mycobacterium
VMSAAGPSASTPDAMPDD

SEQ ID NO: 1350354 - protein, 32 aa, Mycobacterium; identical to SEQ ID NO: 1283949

SEQ ID NO: 1350355 - protein, 23 aa, Mycobacterium
VNLPPSVSYSFRSLARGPQAEAL

SEQ ID NO: 1350356 - protein, 21 aa, Mycobacterium
VNVHVRPGYNFPNAEAAIGYG

SEQ ID NO: 1350357 - protein, 22 aa, Mycobacterium
VNVHVRPGYNFPNAEAAIGYGR

SEQ ID NO: 1350358 - protein, 26 aa, Mycobacterium
VPADAKAVIVSPQLVTARAVQLTPAY

SEQ ID NO: 1350359 - protein, 22 aa, Mycobacterium
VPDSDVYFVEFLDFECEGCRAL

SEQ ID NO: 1350360 - protein, 17 aa, Mycobacterium
VPDSLALAHDGLGADHD

SEQ ID NO: 1350361 - protein, 17 aa, Mycobacterium
VPESLRIPNEGLGHDHQ

SEQ ID NO: 1350362 - protein, 21 aa, Mycobacterium
VPGGRVRPAYGPGRDLADAGA

SEQ ID NO: 1350363 - protein, 24 aa, Mycobacterium
VPIQVVDAVQWFRVGEEAAPGSRP

SEQ ID NO: 1350364 - protein, 19 aa, Mycobacterium
VPLAYAWDQGARAWTDEMR

SEQ ID NO: 1350365 - protein, 17 aa, Mycobacterium
VPLPTEIGPPSDGICAG

SEQ ID NO: 1350366 - protein, 27 aa, Mycobacterium
VPPEIVRALDPLLRAIIETGYDRPTDG

SEQ ID NO: 1350367 - protein, 19 aa, Mycobacterium
VPPGHWDDPGYFGIPTTWL

SEQ ID NO: 1350368 - protein, 23 aa, Mycobacterium
VPVITWEPWLWRTDVTVAGAETI

SEQ ID NO: 1350369 - protein, 21 aa, Mycobacterium
VPVVALAVVLAGCSSNGEGGD

SEQ ID NO: 1350370 - protein, 19 aa, Mycobacterium
VQIRQLWGMTETSPVATIA

SEQ ID NO: 1350371 - protein, 17 aa, Mycobacterium
VRFAVAFFGLLRAGAVP

SEQ ID NO: 1350372 - protein, 21 aa, Mycobacterium
VRIVFAATFVWIALLQYGLFA

SEQ ID NO: 1350373 - protein, 20 aa, Mycobacterium
VRRPTRRGADLTAGLDVTVV

SEQ ID NO: 1350374 - protein, 18 aa, Mycobacterium
VRSAVTLVVAAFGLSLGL

SEQ ID NO: 1350375 - protein, 27 aa, Mycobacterium
VRSQAYDRAWRFATYVADRYGPERLRA

SEQ ID NO: 1350376 - protein, 19 aa, Mycobacterium
VRYLYAFGTPSGRAGSAYV

SEQ ID NO: 1350377 - protein, 23 aa, Mycobacterium
VSDPGCLGAIYGAEAPVYADSGW

SEQ ID NO: 1350378 - protein, 19 aa, Mycobacterium
VSDVWPWLAQIGEDRGGFY

SEQ ID NO: 1350379 - protein, 25 aa, Mycobacterium
VSGQFAKIPFILTGAVGDLYSYLAI

SEQ ID NO: 1350380 - protein, 18 aa, Mycobacterium
VSTLGSLVNTAADNLRGQ

SEQ ID NO: 1350381 - protein, 26 aa, Mycobacterium
VTREDPSRPAVCIVRARSKDGSETGR

SEQ ID NO: 1350382 - protein, 17 aa, Mycobacterium
VTVELPQAGGLYQTGNV

SEQ ID NO: 1350383 - protein, 23 aa, Mycobacterium
VTVLRYAIRTEIRLITSELAIDL

SEQ ID NO: 1350384 - protein, 17 aa, Mycobacterium
VTWTINPKAVWSDGAPI

SEQ ID NO: 1350385 - protein, 20 aa, Mycobacterium
VVATCPDTKMVLGGYSQGAA

SEQ ID NO: 1350386 - protein, 18 aa, Mycobacterium
VVDAGAQVTFRFSTGEAM

SEQ ID NO: 1350387 - protein, 24 aa, Mycobacterium
VVDALRRFPGRPVRTATRKSNAPT

SEQ ID NO: 1350388 - protein, 18 aa, Mycobacterium
VVDYSRLLIEPTDINSAY

SEQ ID NO: 1350389 - protein, 21 aa, Mycobacterium
VVIPGDGGLYVLQINADGRED

SEQ ID NO: 1350390 - protein, 17 aa, Mycobacterium
VVLNLWAYWCGPCADEL

SEQ ID NO: 1350391 - protein, 19 aa, Mycobacterium
VVTDIGIKQAIALRVGLPS

SEQ ID NO: 1350392 - protein, 23 aa, Mycobacterium
VWTAEFAEAGWALPLSDDPAGLA

SEQ ID NO: 1350393 - protein, 22 aa, Mycobacterium
VYGARGHFGWIPIDATHAYWYG

SEQ ID NO: 1350394 - protein, 30 aa, Mycobacterium; identical to SEQ ID NO: 1284866

SEQ ID NO: 1350395 - protein, 22 aa, Mycobacterium
VYSVARYWANYVALDLGPWLLN

SEQ ID NO: 1350396 - protein, 26 aa, Mycobacterium
VYVSELRPGADFDFKPVTRGYADALR

SEQ ID NO: 1350397 - protein, 21 aa, Mycobacterium
WANDPNVFGGYLGGLFGAKTG

SEQ ID NO: 1350398 - protein, 18 aa, Mycobacterium
WANRGKESLSLDLKSPAG

SEQ ID NO: 1350399 - protein, 18 aa, Mycobacterium
WDPTLPKLLSAGAPGDPL

SEQ ID NO: 1350400 - protein, 19 aa, Mycobacterium
WGAEPGGPGNPGLAGQPGS

SEQ ID NO: 1350401 - protein, 27 aa, Mycobacterium
WGDAVFHCPFCHGWEVRDAPVAVLADG

SEQ ID NO: 1350402 - protein, 17 aa, Mycobacterium
WKGPDPVEVWDAYPDAR

SEQ ID NO: 1350403 - protein, 17 aa, Mycobacterium
WLLVFAVAASGCAGVPN

SEQ ID NO: 1350404 - protein, 18 aa, Mycobacterium
WLSRLCGSRTVVCALQNG

SEQ ID NO: 1350405 - protein, 17 aa, Mycobacterium
WLTQLLVAERVVAAEAA

SEQ ID NO: 1350406 - protein, 18 aa, Mycobacterium
WPATLDSFRFRWTAEPGI

SEQ ID NO: 1350407 - protein, 20 aa, Mycobacterium
WPQQRRPSAELLREVPCRVM

SEQ ID NO: 1350408 - protein, 19 aa, Mycobacterium
WPSPLMPALQAIRDDPAGD

SEQ ID NO: 1350409 - protein, 20 aa, Mycobacterium
WPVFTDLSVAPGRDVPNVKA

SEQ ID NO: 1350410 - protein, 26 aa, Mycobacterium
WRAMLHGWPGMTGRGLVELASAIQRG

SEQ ID NO: 1350411 - protein, 25 aa, Mycobacterium
WRIDRLPNGVFLDWQQFQSTYKRNT

SEQ ID NO: 1350412 - protein, 18 aa, Mycobacterium
WRPAEYWEPGTHVEVSVE

SEQ ID NO: 1350413 - protein, 17 aa, Mycobacterium
WRPAEYWEPGTKVQVEV

SEQ ID NO: 1350414 - protein, 17 aa, Mycobacterium
WRWTLEQRQTFANDPVE

SEQ ID NO: 1350415 - protein, 17 aa, Mycobacterium
WSDQVEVHWGPDSEAYV

SEQ ID NO: 1350416 - protein, 24 aa, Mycobacterium
WTINPKAVWSDGAPITWEDIAAQV

SEQ ID NO: 1350417 - protein, 21 aa, Mycobacterium
WVATLKLGIQPGVELPSNALA

SEQ ID NO: 1350418 - protein, 24 aa, Mycobacterium
WVVPSDFAGALGGFTKLLGTPGED

SEQ ID NO: 1350419 - protein, 18 aa, Mycobacterium
WYVETLRETPGFGAQVKT

SEQ ID NO: 1350420 - protein, 19 aa, Mycobacterium
YAALSILALLYARKGDGAE

SEQ ID NO: 1350421 - protein, 17 aa, Mycobacterium
YAGNPGISTGRTVADTD

SEQ ID NO: 1350422 - protein, 26 aa, Mycobacterium
YALAAAWDAGAWRWTLEQRQTFANDP

SEQ ID NO: 1350423 - protein, 18 aa, Mycobacterium
YARNVLSWAGGYATGVVP

SEQ ID NO: 1350424 - protein, 17 aa, Mycobacterium
YCVVDARAWLRDPTPLW

SEQ ID NO: 1350425 - protein, 42 aa, Mycobacterium
YDELGWKPAHLDFEEGLRATVQWYRDNEAWWRPLKDAAEAAY

SEQ ID NO: 1350426 - protein, 21 aa, Mycobacterium
YDVIHPYQFRSALRGLRTSPF

SEQ ID NO: 1350427 - protein, 21 aa, Mycobacterium
YDVYRWPELSTLSVTAVTPRF

SEQ ID NO: 1350428 - protein, 26 aa, Mycobacterium
YERSCRKGDGCVFGPAWNDPLAHSAC

SEQ ID NO: 1350429 - protein, 18 aa, Mycobacterium
YGAHCVYVTDSGGRLTMG

SEQ ID NO: 1350430 - protein, 18 aa, Mycobacterium
YGCSGPIPAAPGGANLVS

SEQ ID NO: 1350431 - protein, 30 aa, Mycobacterium
YGDRVNFVLRYFPLRSHFNAERAARAVEAA

SEQ ID NO: 1350432 - protein, 25 aa, Mycobacterium
YGNYFTFYLCDLLLKVNGKGGQPVY

SEQ ID NO: 1350433 - protein, 23 aa, Mycobacterium
YGPERLRALYLRACGPGHPDVAT

SEQ ID NO: 1350434 - protein, 24 aa, Mycobacterium
YGPPDMPQFAVAYWQTALGEMVRS

SEQ ID NO: 1350435 - protein, 23 aa, Mycobacterium
YGPVDWYINATWRHEGEASPLWR

SEQ ID NO: 1350436 - protein, 22 aa, Mycobacterium
YGSELFDAVGLTAHRPATLRPL

SEQ ID NO: 1350437 - protein, 21 aa, Mycobacterium
YGTGCGAVPPPPPPAPGVYVP

SEQ ID NO: 1350438 - protein, 24 aa, Mycobacterium
YHLEGALWATRRTFLNQAPDVAPI

SEQ ID NO: 1350439 - protein, 20 aa, Mycobacterium
YHQHLREVMSAAGPSASTPD

SEQ ID NO: 1350440 - protein, 26 aa, Mycobacterium
YIADERLRRIFTFQALYAGVPPHKAL

SEQ ID NO: 1350441 - protein, 20 aa, Mycobacterium
YIDFQRPIANRALAEQAIHI

SEQ ID NO: 1350442 - protein, 21 aa, Mycobacterium
YIRERGRLIVGLDIGSNLFSF

SEQ ID NO: 1350443 - protein, 18 aa, Mycobacterium
YLHVRGLQVSEQFYTPAS

SEQ ID NO: 1350444 - protein, 19 aa, Mycobacterium
YNNSVAYARNVLSWAGGYA

SEQ ID NO: 1350445 - protein, 18 aa, Mycobacterium
YPSARCPEVTVDPATIDK

SEQ ID NO: 1350446 - protein, 18 aa, Mycobacterium
YQRTAPWILPKWDSRYGV

SEQ ID NO: 1350447 - protein, 24 aa, Mycobacterium
YRIAELTAALAALGVDAPHFLGGP

SEQ ID NO: 1350448 - protein, 17 aa, Mycobacterium
YSVCVPATYARGRRLPL

SEQ ID NO: 1350449 - protein, 18 aa, Mycobacterium
YSVLMSRYLQAVQHEQGL

SEQ ID NO: 1350450 - protein, 25 aa, Mycobacterium
YTAVGRLGPELSRIVQGSTRLAGDA

SEQ ID NO: 1350451 - protein, 25 aa, Mycobacterium
YVPGRWLRHASFKGCREVADLSQIQ

SEQ ID NO: 1350452 - protein, 27 aa, Mycobacterium
AAAAAAICGAVPADVSALVAQVDSEGA

SEQ ID NO: 1350453 - protein, 39 aa, Mycobacterium
AAAALRPGSTLRFPRGTYRFAQRWPPGGAAVVISGLADV

SEQ ID NO: 1350454 - protein, 39 aa, Mycobacterium
AAAALRPGSTLRFSRGTYRFAQRWPPGGAAVVISGLADV

SEQ ID NO: 1350455 - protein, 25 aa, Mycobacterium
AAAARPMNLLAIPWIDPVDVANASL

SEQ ID NO: 1350456 - protein, 25 aa, Mycobacterium
AAADDVRLGWPLKPSPTVVRQFDAP

SEQ ID NO: 1350457 - protein, 22 aa, Mycobacterium
AAAEGIGPLSLRDNEIDVLIAG

SEQ ID NO: 1350458 - protein, 18 aa, Mycobacterium
AAAERWRPYGIRTNAEVS

SEQ ID NO: 1350459 - protein, 24 aa, Mycobacterium
AAAKRIGFLDIRDAAKPVGLGTLS

SEQ ID NO: 1350460 - protein, 24 aa, Mycobacterium
AAALRAGLIVAVKGVGGYHLACRA

SEQ ID NO: 1350461 - protein, 18 aa, Mycobacterium
AAAMGRAGLIVYNGLGLE

SEQ ID NO: 1350462 - protein, 19 aa, Mycobacterium
AAANARVALFDGGQYLLAR

SEQ ID NO: 1350463 - protein, 22 aa, Mycobacterium
AAANRLYLELMIAHHAGAIKMA

SEQ ID NO: 1350464 - protein, 23 aa, Mycobacterium
AAANRLYLELMIAHHAGAIKMAR

SEQ ID NO: 1350465 - protein, 17 aa, Mycobacterium
AAAPPVAVPPLPPVPAV

SEQ ID NO: 1350466 - protein, 23 aa, Mycobacterium
AAAPSCPLRVSMWEMSITDTYSD

SEQ ID NO: 1350467 - protein, 24 aa, Mycobacterium
AAAQLPRRWIAVGVAAADGVHGPE

SEQ ID NO: 1350468 - protein, 17 aa, Mycobacterium
AAARLQAKIDGLRGAPP

SEQ ID NO: 1350469 - protein, 22 aa, Mycobacterium
AAAVCADLGLPHLLLARPAWSA

SEQ ID NO: 1350470 - protein, 20 aa, Mycobacterium
AAAVCAVLAATACSTTLQGN

SEQ ID NO: 1350471 - protein, 20 aa, Mycobacterium
AAAVSLPFRGLVTISPRFLE

SEQ ID NO: 1350472 - protein, 28 aa, Mycobacterium
AAAVVLTSCGSWKGISNVPLPGGPGSGS

SEQ ID NO: 1350473 - protein, 18 aa, Mycobacterium
AACGLAFALTACGSGQIS

SEQ ID NO: 1350474 - protein, 18 aa, Mycobacterium
AACILPILAACAPPAVAP

SEQ ID NO: 1350475 - protein, 18 aa, Mycobacterium
AADCAESVGCPLGTDPAQ

SEQ ID NO: 1350476 - protein, 20 aa, Mycobacterium
AADIPWKLLQRSAISAVSVD

SEQ ID NO: 1350477 - protein, 19 aa, Mycobacterium
AADRWNWVLDGMVEIGALS

SEQ ID NO: 1350478 - protein, 22 aa, Mycobacterium
AADVAAWLGRYAEVASVMEQID

SEQ ID NO: 1350479 - protein, 22 aa, Mycobacterium
AAEAALASGQRLHFPEGSYRFA

SEQ ID NO: 1350480 - protein, 26 aa, Mycobacterium
AAEGLNRFAGILARSKDSLGRTLDTL

SEQ ID NO: 1350481 - protein, 27 aa, Mycobacterium
AAEGPDGSVLWSLRAIDWNCDNLFVAA

SEQ ID NO: 1350482 - protein, 23 aa, Mycobacterium
AAELIRLTSDFGIRESTVRVALT

SEQ ID NO: 1350483 - protein, 26 aa, Mycobacterium
AAEPRRAAVCSYGYGGTIAHVLLEEA

SEQ ID NO: 1350484 - protein, 28 aa, Mycobacterium
AAERKFRWRGVLDVNRLSPAKVSVGHQF

SEQ ID NO: 1350485 - protein, 29 aa, Mycobacterium
AAERRSAELARWLLGQGVGKGTRVGLFFP

SEQ ID NO: 1350486 - protein, 24 aa, Mycobacterium
AAESCPDVQVVFARGTAEPAGLGR

SEQ ID NO: 1350487 - protein, 28 aa, Mycobacterium
AAGALSGYRAGLLASIAAACTAAYSVTL

SEQ ID NO: 1350488 - protein, 18 aa, Mycobacterium
AAGEAWLTKAGVKLWTDG

SEQ ID NO: 1350489 - protein, 22 aa, Mycobacterium
AAGERAVLVALPAQAANDVAGA

SEQ ID NO: 1350490 - protein, 26 aa, Mycobacterium
AAGLDARAWRLPWVAGTTLFEIDHPG

SEQ ID NO: 1350491 - protein, 17 aa, Mycobacterium
AAGREAAGWLRAKTGSL

SEQ ID NO: 1350492 - protein, 18 aa, Mycobacterium
AAGVPFMVTSGWRSKGFQ

SEQ ID NO: 1350493 - protein, 26 aa, Mycobacterium
AAHPKAAEEFLEFLVTKDAATLLSAS

SEQ ID NO: 1350494 - protein, 18 aa, Mycobacterium
AAIGRIVNLRPAFLSGVA

SEQ ID NO: 1350495 - protein, 17 aa, Mycobacterium
AAIGRVILQPVRTVFGA

SEQ ID NO: 1350496 - protein, 22 aa, Mycobacterium
AAIKTKTLLGAKILEVSPRGDG

SEQ ID NO: 1350497 - protein, 18 aa, Mycobacterium
AAILARAADMLALGADAA

SEQ ID NO: 1350498 - protein, 26 aa, Mycobacterium
AAILRRFDIIVLPLVNPDGRWVSVTA

SEQ ID NO: 1350499 - protein, 19 aa, Mycobacterium
AALAARAGDHVDFLAHDRE

SEQ ID NO: 1350500 - protein, 27 aa, Mycobacterium
AALDAPLRWFIELAYDRSDYSEPTRAK

SEQ ID NO: 1350501 - protein, 17 aa, Mycobacterium
AALEPCPTGGDAGPGPE

SEQ ID NO: 1350502 - protein, 17 aa, Mycobacterium
AALKGAVGLAAVPLLGF

SEQ ID NO: 1350503 - protein, 19 aa, Mycobacterium
AALLVRQVFFGPKTITAYF

SEQ ID NO: 1350504 - protein, 19 aa, Mycobacterium
AALPTRIAALGAEVDILVN

SEQ ID NO: 1350505 - protein, 20 aa, Mycobacterium
AALREARPDLGVDRVLTPAG

SEQ ID NO: 1350506 - protein, 25 aa, Mycobacterium
AALRRAAKYASGWWSFLTPPEKLAE

SEQ ID NO: 1350507 - protein, 21 aa, Mycobacterium
AALSGCGWSPPAPPPTSTAAE

SEQ ID NO: 1350508 - protein, 26 aa, Mycobacterium
AALSRLRGMFAFALWDTVTGELFCAR

SEQ ID NO: 1350509 - protein, 29 aa, Mycobacterium
AALTSLVYYHVFLGLLGPDDVKGQRPTQQ

SEQ ID NO: 1350510 - protein, 24 aa, Mycobacterium
AALVGLGALAWVFWPSSGGEGHAG

SEQ ID NO: 1350511 - protein, 23 aa, Mycobacterium
AAMVCAGAIAVNPVAPTNSMPDI

SEQ ID NO: 1350512 - protein, 23 aa, Mycobacterium
AAPRRADLLSAVMVSEGTTYGVA

SEQ ID NO: 1350513 - protein, 20 aa, Mycobacterium
AAPVGRLREGSLIPLSNTRS

SEQ ID NO: 1350514 - protein, 18 aa, Mycobacterium
AAQQKLRDFAAMPVEQRQ

SEQ ID NO: 1350515 - protein, 20 aa, Mycobacterium
AAQRDGRRLVVVLMHGLVKE

SEQ ID NO: 1350516 - protein, 21 aa, Mycobacterium
AAQRHGRKFGIVAGYGGHGIG

SEQ ID NO: 1350517 - protein, 24 aa, Mycobacterium
AARAADHVERIWVTAYFENSNGLF

SEQ ID NO: 1350518 - protein, 19 aa, Mycobacterium
AARDGHRLFLEVSAHPVVS

SEQ ID NO: 1350519 - protein, 18 aa, Mycobacterium
AARGDIVVVTLNYRLGAP

SEQ ID NO: 1350520 - protein, 17 aa, Mycobacterium
AARNARAGQNYLHPNYD

SEQ ID NO: 1350521 - protein, 19 aa, Mycobacterium
AASRWLGGRTGELRAIASA

SEQ ID NO: 1350522 - protein, 20 aa, Mycobacterium
AATAAFALAGCQAKEEAPAA

SEQ ID NO: 1350523 - protein, 19 aa, Mycobacterium
AAVFGGWTSSSRKAMLPVF

SEQ ID NO: 1350524 - protein, 19 aa, Mycobacterium
AAVQRLRAPLKVAGEYSPV

SEQ ID NO: 1350525 - protein, 27 aa, Mycobacterium
AAVVLTSCGSWKGIANVPLPGGPGTGG

SEQ ID NO: 1350526 - protein, 19 aa, Mycobacterium
AAVVPRIAAVTVFGNPSAR

SEQ ID NO: 1350527 - protein, 28 aa, Mycobacterium
AAWERGDIDAAYTWLPTLDELRKTGRDL

SEQ ID NO: 1350528 - protein, 25 aa, Mycobacterium
AAWMSRNGPRFGLCQVYANELWHYE

SEQ ID NO: 1350529 - protein, 18 aa, Mycobacterium
AAWTAVLLALVLVAGAVF

SEQ ID NO: 1350530 - protein, 22 aa, Mycobacterium
AAWVGGSTMHRAVAELFVGDRA

SEQ ID NO: 1350531 - protein, 28 aa, Mycobacterium
AAYTGPPAPFAVWGFRGSPVTDPAPCAA

SEQ ID NO: 1350532 - protein, 24 aa, Mycobacterium
ACAGAECTGIYGAPGSRVEIPTGK

SEQ ID NO: 1350533 - protein, 25 aa, Mycobacterium
ACAGAECTGIYGAPGSRVEIPTGKG

SEQ ID NO: 1350534 - protein, 29 aa, Mycobacterium
ACLGFKNDYLSVGFSELIPTVASGQADWI

SEQ ID NO: 1350535 - protein, 23 aa, Mycobacterium
ACVGGIPGYIGLELAAQGVVGPG

SEQ ID NO: 1350536 - protein, 18 aa, Mycobacterium
ACVRVSWVKVDPSHVESG

SEQ ID NO: 1350537 - protein, 20 aa, Mycobacterium
ADAEARVVLARRFHNDAVRD

SEQ ID NO: 1350538 - protein, 20 aa, Mycobacterium
ADAKAAILSPQLVTGRAIQL

SEQ ID NO: 1350539 - protein, 18 aa, Mycobacterium
ADAKALMIAPNLVAARFI

SEQ ID NO: 1350540 - protein, 19 aa, Mycobacterium
ADAKALMIAPNLVAARFIQ

SEQ ID NO: 1350541 - protein, 23 aa, Mycobacterium
ADAKAVILSPSLVSVRAIQLTPA

SEQ ID NO: 1350542 - protein, 18 aa, Mycobacterium
ADALRLEWTRSVKGNLAA

SEQ ID NO: 1350543 - protein, 21 aa, Mycobacterium
ADAQGPIALTGLYPPGSTFKT

SEQ ID NO: 1350544 - protein, 17 aa, Mycobacterium
ADARLAAQTAAEERHRA

SEQ ID NO: 1350545 - protein, 33 aa, Mycobacterium
ADDAFTDPAPWPWYRRPGVVFAGAATLAATALT

SEQ ID NO: 1350546 - protein, 23 aa, Mycobacterium
ADDPERMALYFAVAGAEFEVLEP

SEQ ID NO: 1350547 - protein, 25 aa, Mycobacterium
ADDPERMVPWLAMPGCDFEVLEPPE

SEQ ID NO: 1350548 - protein, 25 aa, Mycobacterium
ADDVPGRFVVAAAMVRHLLTDPVLP

SEQ ID NO: 1350549 - protein, 19 aa, Mycobacterium
ADEMAALIARVDEKFTNAA

SEQ ID NO: 1350550 - protein, 24 aa, Mycobacterium
ADFDGWRVPGWTWRDVLPHFRAIE

SEQ ID NO: 1350551 - protein, 27 aa, Mycobacterium
ADFHALKYRHGRIYGHDSQSGTVMVSF

SEQ ID NO: 1350552 - protein, 19 aa, Mycobacterium
ADFLRPGGIADLVDDRDAT

SEQ ID NO: 1350553 - protein, 17 aa, Mycobacterium
ADFPDRPLNLLATANAV

SEQ ID NO: 1350554 - protein, 21 aa, Mycobacterium
ADFPKNPFNLLALANAIAAFD

SEQ ID NO: 1350555 - protein, 25 aa, Mycobacterium
ADGNFVYRPMNAMAAVGGTDTFTVA

SEQ ID NO: 1350556 - protein, 19 aa, Mycobacterium
ADGSGWRGVYDELTARGYR

SEQ ID NO: 1350557 - protein, 24 aa, Mycobacterium
ADHILRPIIDAGYRRHDQPGDSRP

SEQ ID NO: 1350558 - protein, 23 aa, Mycobacterium
ADIDLGGPVARTLAYNNIVPGPL

SEQ ID NO: 1350559 - protein, 22 aa, Mycobacterium
ADIDLGGPVARTLAYNNSVPGP

SEQ ID NO: 1350560 - protein, 25 aa, Mycobacterium
ADISPEAWRTMLRVHLGGLVNVARS

SEQ ID NO: 1350561 - protein, 17 aa, Mycobacterium
ADLAAVLNRRIVEGHQR

SEQ ID NO: 1350562 - protein, 18 aa, Mycobacterium
ADLDAPGNYVWTEGNTTY

SEQ ID NO: 1350563 - protein, 28 aa, Mycobacterium
ADLGSTWRPGCPLGPERLRRVELDHLGF

SEQ ID NO: 1350564 - protein, 17 aa, Mycobacterium
ADLVDWPALGPVVRLMK

SEQ ID NO: 1350565 - protein, 17 aa, Mycobacterium
ADLWIFLTTAARYADAV

SEQ ID NO: 1350566 - protein, 19 aa, Mycobacterium
ADMGRKFLTKLGILSPASA

SEQ ID NO: 1350567 - protein, 24 aa, Mycobacterium
ADMIGRAGALLVDISIDTVPRGYR

SEQ ID NO: 1350568 - protein, 25 aa, Mycobacterium
ADPDRYAAEIAHIIGCEPEDVLRVS

SEQ ID NO: 1350569 - protein, 31 aa, Mycobacterium
ADPGFTNGRIPRVYGQQAMELVIRRAMSQLG

SEQ ID NO: 1350570 - protein, 24 aa, Mycobacterium
ADPNWRPGRETVLADQLRASVGDV

SEQ ID NO: 1350571 - protein, 29 aa, Mycobacterium
ADPVESPLLWTLLAFARRQFGQPRTEIGD

SEQ ID NO: 1350572 - protein, 20 aa, Mycobacterium
ADQGRLGLDDPIAGYVDGVP

SEQ ID NO: 1350573 - protein, 20 aa, Mycobacterium
ADQIREFLGRLDTFTEELNR

SEQ ID NO: 1350574 - protein, 23 aa, Mycobacterium
ADRHPHCRWTVIIDESYPEVDFI

SEQ ID NO: 1350575 - protein, 22 aa, Mycobacterium
ADRIVLCAGAIATAQLLMISGV

SEQ ID NO: 1350576 - protein, 19 aa, Mycobacterium
ADRLIVPTVPSFEYPRSDL

SEQ ID NO: 1350577 - protein, 22 aa, Mycobacterium
ADRLPMDPVHPAYHAKFADGSA

SEQ ID NO: 1350578 - protein, 26 aa, Mycobacterium
ADRLVWQCASLLLSYPDGAQLAAAEE

SEQ ID NO: 1350579 - protein, 21 aa, Mycobacterium
ADSLGIGWLAEPFIDLAEPVL

SEQ ID NO: 1350580 - protein, 20 aa, Mycobacterium
ADSSMFFPIPGLTLGGLLVD

SEQ ID NO: 1350581 - protein, 21 aa, Mycobacterium
ADSSMFFPIPGLTLGGLLVDE

SEQ ID NO: 1350582 - protein, 24 aa, Mycobacterium
ADSYKRYVNSQVEALVPAVEAFVA

SEQ ID NO: 1350583 - protein, 17 aa, Mycobacterium
ADTLEWTDALTITEGAK

SEQ ID NO: 1350584 - protein, 18 aa, Mycobacterium
ADVEVAWPGPSFPSISSA

SEQ ID NO: 1350585 - protein, 24 aa, Mycobacterium
ADVPPDVYGAIYLSAAKGTPNPPA

SEQ ID NO: 1350586 - protein, 17 aa, Mycobacterium
ADVSALVAQVDSEGAEQ

SEQ ID NO: 1350587 - protein, 25 aa, Mycobacterium
ADVTAILAAQGFRVIVPHLRGFGTT

SEQ ID NO: 1350588 - protein, 21 aa, Mycobacterium
ADVVSAWTGIPAGRMLEGETA

SEQ ID NO: 1350589 - protein, 19 aa, Mycobacterium
ADYSLGWIRVLDFDDQYTS

SEQ ID NO: 1350590 - protein, 27 aa, Mycobacterium
AEAAASLALRGGDPAGIGFYIDSGRIH

SEQ ID NO: 1350591 - protein, 19 aa, Mycobacterium
AEAAPWTGKDDLTLGASID

SEQ ID NO: 1350592 - protein, 19 aa, Mycobacterium
AEAGLPILRHQDADLYFRE

SEQ ID NO: 1350593 - protein, 19 aa, Mycobacterium
AEAIAACTQFARALDLASL

SEQ ID NO: 1350594 - protein, 17 aa, Mycobacterium
AEALEAYTRHARLLDAE

SEQ ID NO: 1350595 - protein, 29 aa, Mycobacterium
AEALRKCLQHGAAGLARRYFRATAKPISV

SEQ ID NO: 1350596 - protein, 23 aa, Mycobacterium
AEALRYGADHGFAVKRMSVGHGV

SEQ ID NO: 1350597 - protein, 28 aa, Mycobacterium
AEDPEERFDWVTVEAYSADGVPINIRVG

SEQ ID NO: 1350598 - protein, 27 aa, Mycobacterium
AEDRDFYSNPGFSFTGFARAFKNNLFG

SEQ ID NO: 1350599 - protein, 26 aa, Mycobacterium
AEEESLESVSLFAAVVSNVVAPLADP

SEQ ID NO: 1350600 - protein, 25 aa, Mycobacterium
AEESAKLCVQYMAPIIKNRQYNFLP

SEQ ID NO: 1350601 - protein, 25 aa, Mycobacterium
AEFEFRAGPVFTNLLLADEINRTPP

SEQ ID NO: 1350602 - protein, 25 aa, Mycobacterium
AEGISVNVTLIFSVERHRLVMDAYL

SEQ ID NO: 1350603 - protein, 24 aa, Mycobacterium
AEGLPPRRVVVELDLDDADGITFR

SEQ ID NO: 1350604 - protein, 27 aa, Mycobacterium
AEHMLRSAVIATRIAERLGLDRPQRDC

SEQ ID NO: 1350605 - protein, 26 aa, Mycobacterium
AEHRSCAKTQALVAERGFEITAGVAG

SEQ ID NO: 1350606 - protein, 19 aa, Mycobacterium
AEHTFTWDTTLRVRQALTA

SEQ ID NO: 1350607 - protein, 21 aa, Mycobacterium
AEIFENSWICAVRAADLAQPG

SEQ ID NO: 1350608 - protein, 20 aa, Mycobacterium
AEIPENMPLPGGGVPKRSGP

SEQ ID NO: 1350609 - protein, 20 aa, Mycobacterium
AEIRGGTGPAELLLEIDPEQ

SEQ ID NO: 1350610 - protein, 25 aa, Mycobacterium
AEIVSRVGNHYVVRNASWNPKVAAN

SEQ ID NO: 1350611 - protein, 18 aa, Mycobacterium
AEIYWRQVDPPDWGAYSH

SEQ ID NO: 1350612 - protein, 17 aa, Mycobacterium
AELDDVIAHPLDLFVAA

SEQ ID NO: 1350613 - protein, 19 aa, Mycobacterium
AELDRTVVVSGLTEPTDFK

SEQ ID NO: 1350614 - protein, 46 aa, Mycobacterium
AELINGPVVQAWTISGLKPSSDVIPWHVRGALWEATATNTAVAGTV

SEQ ID NO: 1350615 - protein, 21 aa, Mycobacterium
AELLPQVFQWARSVDPVQPLT

SEQ ID NO: 1350616 - protein, 18 aa, Mycobacterium
AELLRRFPSIAGSDTSGR

SEQ ID NO: 1350617 - protein, 17 aa, Mycobacterium
AELRAQFATNVFGVAAT

SEQ ID NO: 1350618 - protein, 19 aa, Mycobacterium
AEMAGVVAFLLSDAASMVN

SEQ ID NO: 1350619 - protein, 17 aa, Mycobacterium
AEMGRVAVELGNAAQEV

SEQ ID NO: 1350620 - protein, 19 aa, Mycobacterium
AENELSAALGRVNPSSLPL

SEQ ID NO: 1350621 - protein, 19 aa, Mycobacterium
AENLVPLYRRNELTESQVL

SEQ ID NO: 1350622 - protein, 33 aa, Mycobacterium
AENVLRTQGLKAWPKCGAKGMAAQVWGNTAPTA

SEQ ID NO: 1350623 - protein, 23 aa, Mycobacterium
AEPALLEECGRWTMTAGPTTGAV

SEQ ID NO: 1350624 - protein, 20 aa, Mycobacterium
AEPAPGLPIDTLQAPGLPAM

SEQ ID NO: 1350625 - protein, 38 aa, Mycobacterium
AEPNPYSLMAYIALVGVYERFQWVALNHLPEVTGQTQN

SEQ ID NO: 1350626 - protein, 17 aa, Mycobacterium
AEPVTKMVIPVDGSGDG

SEQ ID NO: 1350627 - protein, 18 aa, Mycobacterium
AEQGWWWFWGPGPGEDGP

SEQ ID NO: 1350628 - protein, 20 aa, Mycobacterium
AERIRKALNLSKDVKGALRV

SEQ ID NO: 1350629 - protein, 19 aa, Mycobacterium
AERTNAIVVAPSLTSNFFA

SEQ ID NO: 1350630 - protein, 27 aa, Mycobacterium
AESAQKWPLCRGYNAGGSPVTVGDVSS

SEQ ID NO: 1350631 - protein, 18 aa, Mycobacterium
AESFRPVNGTAFAVTPAL

SEQ ID NO: 1350632 - protein, 22 aa, Mycobacterium
AETDALAGWLGRQAGIELPDGP

SEQ ID NO: 1350633 - protein, 22 aa, Mycobacterium
AETKKLPSWTVLVPPENPVAGY

SEQ ID NO: 1350634 - protein, 20 aa, Mycobacterium
AETPDGLVSLSIGDVTLLES

SEQ ID NO: 1350635 - protein, 20 aa, Mycobacterium
AEVADALGLTVVLLGTPAEE

SEQ ID NO: 1350636 - protein, 31 aa, Mycobacterium; identical to SEQ ID NO: 1250682

SEQ ID NO: 1350637 - protein, 19 aa, Mycobacterium
AFLNVCRHRGAQLCTESEG

SEQ ID NO: 1350638 - protein, 18 aa, Mycobacterium
AFNAGMDSWKAMGVKEYF

SEQ ID NO: 1350639 - protein, 25 aa, Mycobacterium
AFNCRGIPGSQAWSYHAYGRAIDLN

SEQ ID NO: 1350640 - protein, 20 aa, Mycobacterium
AFNVGIRYAGNPGISTGRTV

SEQ ID NO: 1350641 - protein, 23 aa, Mycobacterium
AFPEGTTWCGLGYGRFRPAMFQA

SEQ ID NO: 1350642 - protein, 24 aa, Mycobacterium
AFTAGCARAAAAIDAERWEEALTE

SEQ ID NO: 1350643 - protein, 26 aa, Mycobacterium
AFVDSLRSQLGWRTLGVYAVNYPASG

SEQ ID NO: 1350644 - protein, 27 aa, Mycobacterium
AFYGRAALEYGLRLAAMEAEWAAGLTA

SEQ ID NO: 1350645 - protein, 18 aa, Mycobacterium
AGAAHGGLVRDLAGDLPV

SEQ ID NO: 1350646 - protein, 19 aa, Mycobacterium
AGAAPGWSVLVALLAPVAT

SEQ ID NO: 1350647 - protein, 19 aa, Mycobacterium
AGAAVCFAQMLGAAPTAGA

SEQ ID NO: 1350648 - protein, 24 aa, Mycobacterium
AGAFSRPGLPVEYLMVPSPSMGRD

SEQ ID NO: 1350649 - protein, 18 aa, Mycobacterium
AGAIVHFSSPGPAPAAPD

SEQ ID NO: 1350650 - protein, 17 aa, Mycobacterium
AGAKPSFPSIVSGDVDD

SEQ ID NO: 1350651 - protein, 20 aa, Mycobacterium
AGARCMVHESLAPGLAVAAD

SEQ ID NO: 1350652 - protein, 17 aa, Mycobacterium
AGAYSRPGLPVETLMVP

SEQ ID NO: 1350653 - protein, 25 aa, Mycobacterium
AGCPGEGPGTHWLPITVTPISPPSG

SEQ ID NO: 1350654 - protein, 26 aa, Mycobacterium
AGDIERARAAAAFAVDAAAAHGFDSR

SEQ ID NO: 1350655 - protein, 18 aa, Mycobacterium
AGFPEEYRNRVFIADYSL

SEQ ID NO: 1350656 - protein, 18 aa, Mycobacterium
AGGLRARYLAAADGLHSP

SEQ ID NO: 1350657 - protein, 18 aa, Mycobacterium
AGGNIAFATIPIVEEAGW

SEQ ID NO: 1350658 - protein, 22 aa, Mycobacterium
AGGVLLRPYARLIASSGDSVTT

SEQ ID NO: 1350659 - protein, 22 aa, Mycobacterium
AGHSRYATYFAQGIISSQQREI

SEQ ID NO: 1350660 - protein, 22 aa, Mycobacterium
AGIEAWTGIGTSLCGVANRVSH

SEQ ID NO: 1350661 - protein, 18 aa, Mycobacterium
AGIPARRHVFTGKELAGA

SEQ ID NO: 1350662 - protein, 19 aa, Mycobacterium
AGKQACRLLYTGQPAQAVI

SEQ ID NO: 1350663 - protein, 20 aa, Mycobacterium
AGLAALVLVGAAATGCGGRQ

SEQ ID NO: 1350664 - protein, 19 aa, Mycobacterium
AGLAEAMPVTGGQFRVESI

SEQ ID NO: 1350665 - protein, 25 aa, Mycobacterium
AGLARFGGVDTRNMWGLPQLGRWKW

SEQ ID NO: 1350666 - protein, 19 aa, Mycobacterium
AGLRAAGRVAGLIGTVGIR

SEQ ID NO: 1350667 - protein, 21 aa, Mycobacterium
AGLRGLVGVAHYTAAKHGVVG

SEQ ID NO: 1350668 - protein, 23 aa, Mycobacterium
AGLWPTLIGFAMKDAGGFNPQNM

SEQ ID NO: 1350669 - protein, 35 aa, Mycobacterium
AGNCPIEPFVAVADLFGWKHGCDLFALQDAADDIV

SEQ ID NO: 1350670 - protein, 24 aa, Mycobacterium
AGNLPGDLTFSWYAVDASGQPWVV

SEQ ID NO: 1350671 - protein, 17 aa, Mycobacterium
AGNMVSTLHDLRIWAPA

SEQ ID NO: 1350672 - protein, 18 aa, Mycobacterium
AGPCGLAQLHAFEQARLD

SEQ ID NO: 1350673 - protein, 20 aa, Mycobacterium
AGPGSLQWAIDQPGAKYILF

SEQ ID NO: 1350674 - protein, 27 aa, Mycobacterium
AGPTRRGEVLTDVRLLGPRIAEAAAGP

SEQ ID NO: 1350675 - protein, 26 aa, Mycobacterium
AGPVPFPLAGEFRTYWVDKTPGRIVT

SEQ ID NO: 1350676 - protein, 18 aa, Mycobacterium
AGQWARALTGDGWFRTGD

SEQ ID NO: 1350677 - protein, 17 aa, Mycobacterium
AGRPWRAVDFEVTAGVL

SEQ ID NO: 1350678 - protein, 24 aa, Mycobacterium
AGRREADGYLRLREWLTKLYRTEF

SEQ ID NO: 1350679 - protein, 24 aa, Mycobacterium
AGTEDMSWTFWSWNPNSTDTGGIL

SEQ ID NO: 1350680 - protein, 23 aa, Mycobacterium
AGTELALAIADARSGDTNRLNNL

SEQ ID NO: 1350681 - protein, 18 aa, Mycobacterium
AGTMPVLALYGIPNRDCG

SEQ ID NO: 1350682 - protein, 19 aa, Mycobacterium
AGTSGFSGWTVEFDSPAQI

SEQ ID NO: 1350683 - protein, 18 aa, Mycobacterium
AGVAVQIDLPVGVDTVDH

SEQ ID NO: 1350684 - protein, 24 aa, Mycobacterium
AGVDPKVTGLVYVSGLAPDAGETT

SEQ ID NO: 1350685 - protein, 19 aa, Mycobacterium
AGVGVLLPRWSGDQYNAGR

SEQ ID NO: 1350686 - protein, 19 aa, Mycobacterium
AGVSWPLERPAVAAINTVR

SEQ ID NO: 1350687 - protein, 18 aa, Mycobacterium
AGVVGWWVNPQTPGMDAC

SEQ ID NO: 1350688 - protein, 25 aa, Mycobacterium
AGVVSVLCAVAFVALAAVGGSLFWE

SEQ ID NO: 1350689 - protein, 21 aa, Mycobacterium
AHAFSRPGLPVEYLDIPSPSM

SEQ ID NO: 1350690 - protein, 24 aa, Mycobacterium
AHRPDLVVSAGFMKILGPQFLSTF

SEQ ID NO: 1350691 - protein, 22 aa, Mycobacterium
AHTDADIAFARDMVPHHEQAIV

SEQ ID NO: 1350692 - protein, 17 aa, Mycobacterium
AIAARLIQDGFCVAACD

SEQ ID NO: 1350693 - protein, 20 aa, Mycobacterium
AIAARSWRTLTTGPTRDRGR

SEQ ID NO: 1350694 - protein, 20 aa, Mycobacterium
AIARCPRAVAAGTLRDPYTN

SEQ ID NO: 1350695 - protein, 23 aa, Mycobacterium
AIARRGDGRLVLGSADGTVYTLT

SEQ ID NO: 1350696 - protein, 18 aa, Mycobacterium
AIGLALAGRRTRKFGLAG

SEQ ID NO: 1350697 - protein, 22 aa, Mycobacterium
AIKYVCLMLLALGSVSCSGPTV

SEQ ID NO: 1350698 - protein, 20 aa, Mycobacterium
AIQLVPAYDGGPVMPTQAVI

SEQ ID NO: 1350699 - protein, 23 aa, Mycobacterium
AISEAYPPGSTFKVITTAAALQA

SEQ ID NO: 1350700 - protein, 24 aa, Mycobacterium
AISNCDFEWPMTRLTLALSPATLP

SEQ ID NO: 1350701 - protein, 24 aa, Mycobacterium
AIWDPKFQNAAFFHRSTAEDPEER

SEQ ID NO: 1350702 - protein, 21 aa, Mycobacterium
AKARTPVPYLQWQNAPGVTPP

SEQ ID NO: 1350703 - protein, 26 aa, Mycobacterium
AKELVISTKMSGEWSKDQVLQSYLNI

SEQ ID NO: 1350704 - protein, 23 aa, Mycobacterium
AKFLEGFTLRTNKTFQEEYLAAG

SEQ ID NO: 1350705 - protein, 21 aa, Mycobacterium
AKGAPLAFAYPPGGTTFSQKY

SEQ ID NO: 1350706 - protein, 21 aa, Mycobacterium
AKGRPADQLHEWAAERAPALG

SEQ ID NO: 1350707 - protein, 17 aa, Mycobacterium
AKGVAFLGIDVRDNNRE

SEQ ID NO: 1350708 - protein, 18 aa, Mycobacterium
AKIDGLRGAPPVAPPPPP

SEQ ID NO: 1350709 - protein, 24 aa, Mycobacterium
AKIGESLAILGWNMSVSNLRFDAE

SEQ ID NO: 1350710 - protein, 17 aa, Mycobacterium
AKLPTDFPIYNLAGKSY

SEQ ID NO: 1350711 - protein, 27 aa, Mycobacterium
AKPTLPAWRIIEPRPAEELMGYYRKAE

SEQ ID NO: 1350712 - protein, 19 aa, Mycobacterium
AKRGDLLFWGPGGSQHEAL

SEQ ID NO: 1350713 - protein, 25 aa, Mycobacterium
AKTFPALGVPVSASWITWDNSGEAE

SEQ ID NO: 1350714 - protein, 20 aa, Mycobacterium
AKVNLRPGTVTVVPVGEKSF

SEQ ID NO: 1350715 - protein, 27 aa, Mycobacterium
AKVTMLVFTKWGGFYRRTLTINRSDHA

SEQ ID NO: 1350716 - protein, 22 aa, Mycobacterium
ALAAALPFAATACGGGDGGGGG

SEQ ID NO: 1350717 - protein, 19 aa, Mycobacterium
ALAATKLLLLMGLRADVDR

SEQ ID NO: 1350718 - protein, 23 aa, Mycobacterium
ALAENRVDAVVGWHQAGGDLATA

SEQ ID NO: 1350719 - protein, 18 aa, Mycobacterium
ALAHAWRSSGGHVLGLAP

SEQ ID NO: 1350720 - protein, 24 aa, Mycobacterium
ALAILKSQGVKAYFGGSTGSVLPQ

SEQ ID NO: 1350721 - protein, 35 aa, Mycobacterium
ALANAKRWGVLHVIWRQGYYPGIGAPSWTADYGSE

SEQ ID NO: 1350722 - protein, 18 aa, Mycobacterium
ALANPFVVYGEVVENTLT

SEQ ID NO: 1350723 - protein, 23 aa, Mycobacterium
ALAVALTAPWLWVPTAHAETFAQ

SEQ ID NO: 1350724 - protein, 22 aa, Mycobacterium
ALAVGLMAPWLSVSPAHAETYA

SEQ ID NO: 1350725 - protein, 19 aa, Mycobacterium
ALCGVSWGAPPATADNADW

SEQ ID NO: 1350726 - protein, 18 aa, Mycobacterium
ALDDTRFGTAVKEPARGS

SEQ ID NO: 1350727 - protein, 17 aa, Mycobacterium
ALEANGFTISRQFGIGS

SEQ ID NO: 1350728 - protein, 18 aa, Mycobacterium
ALESRMAGCFAAGAVATG

SEQ ID NO: 1350729 - protein, 25 aa, Mycobacterium
ALGGVNVCLNAPVYEPLSGADFPAG

SEQ ID NO: 1350730 - protein, 26 aa, Mycobacterium
ALGQMWAAGVDLDWSRLSKDKPGLIT

SEQ ID NO: 1350731 - protein, 20 aa, Mycobacterium
ALGQSKDARGFGGVGGAGGR

SEQ ID NO: 1350732 - protein, 17 aa, Mycobacterium
ALGQYGGVWAHNETRKS

SEQ ID NO: 1350733 - protein, 18 aa, Mycobacterium
ALGTCWAVTVQGSSNVVV

SEQ ID NO: 1350734 - protein, 25 aa, Mycobacterium
ALGVAAWGLSTVRVLSDSHALPSAM

SEQ ID NO: 1350735 - protein, 19 aa, Mycobacterium
ALGVPEWAVQPVTAMGDDH

SEQ ID NO: 1350736 - protein, 23 aa, Mycobacterium
ALGVTCPSPYTLAANVLTVTGYT

SEQ ID NO: 1350737 - protein, 17 aa, Mycobacterium
ALIGGLGLSSCADDTAD

SEQ ID NO: 1350738 - protein, 29 aa, Mycobacterium
ALKLSIGAFGRRASYEIADLGKALTTVQP

SEQ ID NO: 1350739 - protein, 25 aa, Mycobacterium
ALKNQQRVSVNWPAEAAPWTGKDDL

SEQ ID NO: 1350740 - protein, 24 aa, Mycobacterium
ALLCRRSTFERVLHRIAALQDGIT

SEQ ID NO: 1350741 - protein, 22 aa, Mycobacterium
ALLERYREGDGFVSYDKVTEPE

SEQ ID NO: 1350742 - protein, 20 aa, Mycobacterium
ALLFTKGPAVARLEFQSAPG

SEQ ID NO: 1350743 - protein, 19 aa, Mycobacterium
ALLGDFPVLMIPKVTADSL

SEQ ID NO: 1350744 - protein, 17 aa, Mycobacterium
ALLRRAAPSLLVVAAVA

SEQ ID NO: 1350745 - protein, 35 aa, Mycobacterium
ALMAMGVMGVHFMKLPAKLFGVGRYTVTVQLPQAG

SEQ ID NO: 1350746 - protein, 18 aa, Mycobacterium
ALMFPVVGGIGLMSNRAS

SEQ ID NO: 1350747 - protein, 17 aa, Mycobacterium
ALMRPRSRGRLTLASAD

SEQ ID NO: 1350748 - protein, 33 aa, Mycobacterium
ALNEDVKMLWFCGGHGSCLPGQGNGEADSAWVM

SEQ ID NO: 1350749 - protein, 18 aa, Mycobacterium
ALPVVRPDGSLLVTTYKA

SEQ ID NO: 1350750 - protein, 18 aa, Mycobacterium
ALQLPLWGGVGEEDRLRA

SEQ ID NO: 1350751 - protein, 26 aa, Mycobacterium
ALQWDRVLCSAGKRGLEIAVAPNDLV

SEQ ID NO: 1350752 - protein, 23 aa, Mycobacterium
ALRAGEGATMMAADGAGRVLVTD

SEQ ID NO: 1350753 - protein, 24 aa, Mycobacterium
ALRGKFVAALLCSRDAAVESRRAL

SEQ ID NO: 1350754 - protein, 27 aa, Mycobacterium
ALRNKTRLAALRVKDFSKRDVMMIHTL

SEQ ID NO: 1350755 - protein, 23 aa, Mycobacterium
ALRQRGIEDFVIFEQSEGIGGTW

SEQ ID NO: 1350756 - protein, 17 aa, Mycobacterium
ALSAIVERGDLLAAQAG

SEQ ID NO: 1350757 - protein, 26 aa, Mycobacterium
ALSFKNGDCDAGFAFDSMVDETMAQK

SEQ ID NO: 1350758 - protein, 21 aa, Mycobacterium
ALSRAVIRLFLTPMPLQAAEL

SEQ ID NO: 1350759 - protein, 24 aa, Mycobacterium
ALTDLLWRMGIRTIGQFAELSRSD

SEQ ID NO: 1350760 - protein, 22 aa, Mycobacterium
ALTEAQRQFGLQQAEVDRLVAA

SEQ ID NO: 1350761 - protein, 20 aa, Mycobacterium
ALTEGLRLISAVSDGSGAAD

SEQ ID NO: 1350762 - protein, 18 aa, Mycobacterium
ALTGDGWFRTGDRGQLRA

SEQ ID NO: 1350763 - protein, 26 aa, Mycobacterium
ALTVPKMIYRLGIFRAPRGSSAVTGP

SEQ ID NO: 1350764 - protein, 24 aa, Mycobacterium
ALVELNTWALVAMENLAFPLTSLL

SEQ ID NO: 1350765 - protein, 28 aa, Mycobacterium
ALVGIYKRFQEMAALTTFTTWTTYDSWH

SEQ ID NO: 1350766 - protein, 25 aa, Mycobacterium
ALVLAVLVLIGFVVGYNRIRSADVR

SEQ ID NO: 1350767 - protein, 17 aa, Mycobacterium
ALVTINTVGGGFTYTPP

SEQ ID NO: 1350768 - protein, 43 aa, Mycobacterium
ALWSGDSALKELLREVIQADFSRKYGWIPVVGTVAHAFSLMGN

SEQ ID NO: 1350769 - protein, 17 aa, Mycobacterium
ALYAGRFTLPQALDAVG

SEQ ID NO: 1350770 - protein, 26 aa, Mycobacterium
AMANAARFGLQDVIWRGTYYTPAGPQ

SEQ ID NO: 1350771 - protein, 17 aa, Mycobacterium
AMFAIGCIQAQKCHTDR

SEQ ID NO: 1350772 - protein, 21 aa, Mycobacterium
AMGLIYVHGPAMWDVDLSDVP

SEQ ID NO: 1350773 - protein, 27 aa, Mycobacterium
AMGPMQFIPETWRLYGVDANNDGDVSA

SEQ ID NO: 1350774 - protein, 26 aa, Mycobacterium
AMLQAGGRRAVLCGNIGDPVLSQLDR

SEQ ID NO: 1350775 - protein, 23 aa, Mycobacterium
AMLRELPPVRGVVHAAGVEAGAL

SEQ ID NO: 1350776 - protein, 21 aa, Mycobacterium
AMQYIEVLRGYGLPVDAPSVP

SEQ ID NO: 1350777 - protein, 18 aa, Mycobacterium
AMRALLMIVTAAAVPGLL

SEQ ID NO: 1350778 - protein, 21 aa, Mycobacterium
ANAISAFGTVHMNYADADLDA

SEQ ID NO: 1350779 - protein, 24 aa, Mycobacterium
ANATDPNWDRLTFVASTVDTAKGR

SEQ ID NO: 1350780 - protein, 20 aa, Mycobacterium
ANAWGLPYAALMAGADLVLP

SEQ ID NO: 1350781 - protein, 18 aa, Mycobacterium
ANDLLAIGVLQALALIGD

SEQ ID NO: 1350782 - protein, 17 aa, Mycobacterium
ANETFTLTLSNPSGATV

SEQ ID NO: 1350783 - protein, 27 aa, Mycobacterium
ANGAVPLPAFEFVTAVFGAIRREMDRL

SEQ ID NO: 1350784 - protein, 23 aa, Mycobacterium
ANIRSNALLPAFVDTPMQQTAMT

SEQ ID NO: 1350785 - protein, 17 aa, Mycobacterium
ANLPPGQFIQPFVEAAF

SEQ ID NO: 1350786 - protein, 18 aa, Mycobacterium
ANNDFKPGFATALMNKDL

SEQ ID NO: 1350787 - protein, 21 aa, Mycobacterium
ANRLNSYGGMVNWQVQNPVPN

SEQ ID NO: 1350788 - protein, 18 aa, Mycobacterium
ANSVWGLAALNGIPLRID

SEQ ID NO: 1350789 - protein, 17 aa, Mycobacterium
ANTAGWSRSLGRGVCAV

SEQ ID NO: 1350790 - protein, 17 aa, Mycobacterium
ANTEPTAVLSWQSSPGW

SEQ ID NO: 1350791 - protein, 18 aa, Mycobacterium
APAGHRGADEAVTPDAAP

SEQ ID NO: 1350792 - protein, 23 aa, Mycobacterium
APAKERPGQRFAERINDVVKKVT

SEQ ID NO: 1350793 - protein, 19 aa, Mycobacterium
APAPAPWFGVPLKKWTRLA

SEQ ID NO: 1350794 - protein, 24 aa, Mycobacterium
APAPPPALWALLASARREFERAFT

SEQ ID NO: 1350795 - protein, 18 aa, Mycobacterium
APARAMIFDSVYDIYRGV

SEQ ID NO: 1350796 - protein, 20 aa, Mycobacterium
APDQWHFPYFDDAMGEAVNA

SEQ ID NO: 1350797 - protein, 23 aa, Mycobacterium
APDVSLADGLVWAGADLEDPLMQ

SEQ ID NO: 1350798 - protein, 24 aa, Mycobacterium
APDVTARIALPEVDGLDPEAGRPG

SEQ ID NO: 1350799 - protein, 25 aa, Mycobacterium
APEASSWTMPNLIGRDLQAAQDAIQ

SEQ ID NO: 1350800 - protein, 27 aa, Mycobacterium
APFLSYGPFTGFAPRDLCAMWPVPPTP

SEQ ID NO: 1350801 - protein, 27 aa, Mycobacterium
APFNVRGARNLPCISVPGKRAPTWQDC

SEQ ID NO: 1350802 - protein, 17 aa, Mycobacterium
APGIPGIPDIQIPNLPL

SEQ ID NO: 1350803 - protein, 18 aa, Mycobacterium
APGKTSWNLEPWRPEVPV

SEQ ID NO: 1350804 - protein, 18 aa, Mycobacterium
APGRARVPLYTTALEDPR

SEQ ID NO: 1350805 - protein, 25 aa, Mycobacterium
APIIGGIRPGLFVSSNFLPGSPAYT

SEQ ID NO: 1350806 - protein, 29 aa, Mycobacterium
APILVKPNSGWLYTWALGIPKAAKNPDGA

SEQ ID NO: 1350807 - protein, 17 aa, Mycobacterium
APLRVVIEDAYDRDVGP

SEQ ID NO: 1350808 - protein, 30 aa, Mycobacterium
APLTVVFAHGFSLRMGSFYFQRARLTEQWG

SEQ ID NO: 1350809 - protein, 19 aa, Mycobacterium
APLVFADHVSFPFRMGFAR

SEQ ID NO: 1350810 - protein, 18 aa, Mycobacterium
APLYRASVSASIEESAAS

SEQ ID NO: 1350811 - protein, 23 aa, Mycobacterium
APNETRNLPGFEGADKGEPSNLG

SEQ ID NO: 1350812 - protein, 24 aa, Mycobacterium
APPPCFNPDGTPCAVNGTAGPGGA

SEQ ID NO: 1350813 - protein, 18 aa, Mycobacterium
APPPLGTPGRAYALGGAH

SEQ ID NO: 1350814 - protein, 23 aa, Mycobacterium
APPPRPADCPDFTGFGQGIYLES

SEQ ID NO: 1350815 - protein, 18 aa, Mycobacterium
APPPTQWDSATPPSGPDA

SEQ ID NO: 1350816 - protein, 25 aa, Mycobacterium
APPSITLPTVPGFPVQLPSELSMPR

SEQ ID NO: 1350817 - protein, 21 aa, Mycobacterium
APPSLTGFVDRVGDPVPLVAA

SEQ ID NO: 1350818 - protein, 26 aa, Mycobacterium
APRHAAHIGRIGALAVSLGIGIAIAN

SEQ ID NO: 1350819 - protein, 17 aa, Mycobacterium
APRRLPVDGPRPDLVHY

SEQ ID NO: 1350820 - protein, 22 aa, Mycobacterium
APSEPYRMRVIIHEDDNGHMTA

SEQ ID NO: 1350821 - protein, 17 aa, Mycobacterium
APSFAKAEYQWRSEGSV

SEQ ID NO: 1350822 - protein, 18 aa, Mycobacterium
APSLLNLVGSVVLNVLVG

SEQ ID NO: 1350823 - protein, 29 aa, Mycobacterium
APSPVADSLLAWVRRLITHTFFNKTPVVR

SEQ ID NO: 1350824 - protein, 19 aa, Mycobacterium
APSRRPDLWTRLSDDTEAP

SEQ ID NO: 1350825 - protein, 20 aa, Mycobacterium
APSRRPDLWTRLSDDTKAPL

SEQ ID NO: 1350826 - protein, 28 aa, Mycobacterium
APTATARSSLSWFSPKVYGTVTAKDADK

SEQ ID NO: 1350827 - protein, 23 aa, Mycobacterium
APTDSPLVLALWAAARRPSESAA

SEQ ID NO: 1350828 - protein, 26 aa, Mycobacterium
APTINLPFPQGWEAAGPRAPQGAYDA

SEQ ID NO: 1350829 - protein, 25 aa, Mycobacterium
APTRPGKGLSHACDVYGSSVLVLPD

SEQ ID NO: 1350830 - protein, 20 aa, Mycobacterium
APYMSGLVGLAYNRAATGRD

SEQ ID NO: 1350831 - protein, 25 aa, Mycobacterium
AQADFAASLIKRAAKTGHRVIDVRR

SEQ ID NO: 1350832 - protein, 19 aa, Mycobacterium
AQADTWCPGDYLFTGMPNW

SEQ ID NO: 1350833 - protein, 25 aa, Mycobacterium
AQAEGAWKPGWVEFTGTGLSVGSLR

SEQ ID NO: 1350834 - protein, 22 aa, Mycobacterium
AQAVADFSPWFANSVGPATQVL

SEQ ID NO: 1350835 - protein, 24 aa, Mycobacterium
AQDPVCPEGTYWDVATATCVAVNV

SEQ ID NO: 1350836 - protein, 21 aa, Mycobacterium
AQGCPDIEVVFARGTDEPPGL

SEQ ID NO: 1350837 - protein, 24 aa, Mycobacterium
AQIRARRVLLATGMSYCPPQLPGL

SEQ ID NO: 1350838 - protein, 17 aa, Mycobacterium
AQISNIWNAEIVSQVGN

SEQ ID NO: 1350839 - protein, 20 aa, Mycobacterium
AQKIAIAVATTFAPEAFDDS

SEQ ID NO: 1350840 - protein, 19 aa, Mycobacterium
AQLKGRRIGTPFASTAHYS

SEQ ID NO: 1350841 - protein, 17 aa, Mycobacterium
AQLLRRLESPVVVQFDE

SEQ ID NO: 1350842 - protein, 18 aa, Mycobacterium
AQNRCFFNTSANLLTPNG

SEQ ID NO: 1350843 - protein, 24 aa, Mycobacterium
AQPTRWTMPDLRGMNLAAAQEAYT

SEQ ID NO: 1350844 - protein, 17 aa, Mycobacterium
AQQAWSTLSPVILRGSQ

SEQ ID NO: 1350845 - protein, 20 aa, Mycobacterium
AQQDYVFWQEGVVFGPDGTP

SEQ ID NO: 1350846 - protein, 20 aa, Mycobacterium
AQSPGAFKIVGEPFSEERYG

SEQ ID NO: 1350847 - protein, 20 aa, Mycobacterium
ARAIGPLGLAGRQGSHRVPW

SEQ ID NO: 1350848 - protein, 17 aa, Mycobacterium
ARALLEWLQATHPEPKV

SEQ ID NO: 1350849 - protein, 20 aa, Mycobacterium
ARALSQRGVPYSWGGGAATG

SEQ ID NO: 1350850 - protein, 19 aa, Mycobacterium
ARAPAVILAAGGFVHNREW

SEQ ID NO: 1350851 - protein, 20 aa, Mycobacterium
ARARLLGMPAAMLAEAAPAQ

SEQ ID NO: 1350852 - protein, 17 aa, Mycobacterium
ARAVEFSGGAGLQADSV

SEQ ID NO: 1350853 - protein, 18 aa, Mycobacterium
ARAWTPDTAPSWAQPLVT

SEQ ID NO: 1350854 - protein, 26 aa, Mycobacterium
ARDGIPYRNTYAWFLTLNDGQIVKAA

SEQ ID NO: 1350855 - protein, 19 aa, Mycobacterium
ARDIVYPRFESGGVPYENP

SEQ ID NO: 1350856 - protein, 26 aa, Mycobacterium
ARFVDGIDVPHVMVSDGIVPLDISAD

SEQ ID NO: 1350857 - protein, 18 aa, Mycobacterium
ARGFSLNTANFFTTEESM

SEQ ID NO: 1350858 - protein, 22 aa, Mycobacterium
ARGLEFVGLMAIPPLNADAGEA

SEQ ID NO: 1350859 - protein, 23 aa, Mycobacterium
ARIALDLLDRAGIEASDDLPPVA

SEQ ID NO: 1350860 - protein, 25 aa, Mycobacterium
ARIGEIRPDGLIYTVWESPGPIEPD

SEQ ID NO: 1350861 - protein, 27 aa, Mycobacterium
ARIPVDAGPVALEFPGPIAELQLSRDG

SEQ ID NO: 1350862 - protein, 20 aa, Mycobacterium
ARKAAADALRVERQAEADGI

SEQ ID NO: 1350863 - protein, 18 aa, Mycobacterium
ARLGWAVQDTEVISLVTA

SEQ ID NO: 1350864 - protein, 19 aa, Mycobacterium
ARPASGWAAQYADAANTSS

SEQ ID NO: 1350865 - protein, 18 aa, Mycobacterium
ARPGMSAAEIVDRLSWLG

SEQ ID NO: 1350866 - protein, 19 aa, Mycobacterium
ARPLPDPFIVAATQNPIEY

SEQ ID NO: 1350867 - protein, 17 aa, Mycobacterium
ARQRWCSRLVQGGGGAS

SEQ ID NO: 1350868 - protein, 20 aa, Mycobacterium
ARRAIARGAAFLPHTEVRGV

SEQ ID NO: 1350869 - protein, 22 aa, Mycobacterium
ARRRRLNAMLADALDPAEIQFN

SEQ ID NO: 1350870 - protein, 24 aa, Mycobacterium
ARSFGDGFSILGWASNTPPPPGWT

SEQ ID NO: 1350871 - protein, 19 aa, Mycobacterium
ARSGKVGVILPDTKSSVRW

SEQ ID NO: 1350872 - protein, 21 aa, Mycobacterium
ARSVAVLAVLGLLLTGCVSRD

SEQ ID NO: 1350873 - protein, 21 aa, Mycobacterium
ARTAASRPFAPSWDKNDRFRV

SEQ ID NO: 1350874 - protein, 25 aa, Mycobacterium
ARTPRPRLAAWTPDGDLLVSVPSAG

SEQ ID NO: 1350875 - protein, 18 aa, Mycobacterium
ARTSRIRLATSVLVLGYH

SEQ ID NO: 1350876 - protein, 20 aa, Mycobacterium
ARVLPALAVGHCYHPDRRVA

SEQ ID NO: 1350877 - protein, 18 aa, Mycobacterium
ARVLRVFEEPPAPAAEPP

SEQ ID NO: 1350878 - protein, 17 aa, Mycobacterium
ARWAQDNPQQWARSYSE

SEQ ID NO: 1350879 - protein, 17 aa, Mycobacterium
ARWFLRQRDDVVAVECG

SEQ ID NO: 1350880 - protein, 18 aa, Mycobacterium
ARWGAVASAAAVGLTACG

SEQ ID NO: 1350881 - protein, 19 aa, Mycobacterium
ARWLPLSGTDYVRNGYTFD

SEQ ID NO: 1350882 - protein, 17 aa, Mycobacterium
ARWRMPRPAVMLAPLRP

SEQ ID NO: 1350883 - protein, 17 aa, Mycobacterium
ASAEGKNALARAILSTG

SEQ ID NO: 1350884 - protein, 20 aa, Mycobacterium
ASAPHHWFAAPGYPSRGGGH

SEQ ID NO: 1350885 - protein, 21 aa, Mycobacterium
ASARREFERAFTRPVTTAPAQ

SEQ ID NO: 1350886 - protein, 18 aa, Mycobacterium
ASDLDAMVQIVDRDATIM

SEQ ID NO: 1350887 - protein, 27 aa, Mycobacterium
ASEIEMMRGWLALWGVGPAAAQQHHPN

SEQ ID NO: 1350888 - protein, 17 aa, Mycobacterium
ASGELFADIPFALRGGG

SEQ ID NO: 1350889 - protein, 17 aa, Mycobacterium
ASGGVLQLDSPQYEGQD

SEQ ID NO: 1350890 - protein, 18 aa, Mycobacterium
ASGLVLVLTAVVGLSGCG

SEQ ID NO: 1350891 - protein, 18 aa, Mycobacterium
ASGPFMFTTVDAPRTLTM

SEQ ID NO: 1350892 - protein, 22 aa, Mycobacterium
ASGPRVGVLIVNPGGPGASAVN

SEQ ID NO: 1350893 - protein, 36 aa, Mycobacterium
ASGRLLINREWFLWLNEVERAFVLAHELLHLALHSH

SEQ ID NO: 1350894 - protein, 24 aa, Mycobacterium
ASGSLPPGVPLDFYQRVADMCREA

SEQ ID NO: 1350895 - protein, 30 aa, Mycobacterium; identical to SEQ ID NO: 301388

SEQ ID NO: 1350896 - protein, 20 aa, Mycobacterium
ASIACYRARGFLSVAGDGAM

SEQ ID NO: 1350897 - protein, 23 aa, Mycobacterium
ASIAQQAGWVWFGPADREGAPER

SEQ ID NO: 1350898 - protein, 20 aa, Mycobacterium
ASIDDVISWIGAGTPTDPAG

SEQ ID NO: 1350899 - protein, 25 aa, Mycobacterium
ASIDRAGFIGAVFAMDLPASSALTR

SEQ ID NO: 1350900 - protein, 20 aa, Mycobacterium
ASIFPLWPPAPPTFPESPEE

SEQ ID NO: 1350901 - protein, 19 aa, Mycobacterium
ASLAEAFASGPYFKVMLVN

SEQ ID NO: 1350902 - protein, 32 aa, Mycobacterium; identical to SEQ ID NO: 1251067

SEQ ID NO: 1350903 - protein, 17 aa, Mycobacterium
ASPKLLWESNFSSMEEA

SEQ ID NO: 1350904 - protein, 20 aa, Mycobacterium
ASQLLPALCVALGEHSPTGA

SEQ ID NO: 1350905 - protein, 23 aa, Mycobacterium
ASQSGRYPWFDAASRAGYADIAT

SEQ ID NO: 1350906 - protein, 24 aa, Mycobacterium
ASRRRAAVIPAHYPGRGGATVVAR

SEQ ID NO: 1350907 - protein, 24 aa, Mycobacterium
ASSPFKRSDRFTVTVNDGHGGTDT

SEQ ID NO: 1350908 - protein, 23 aa, Mycobacterium
ASSPSGLDGPGWESVTTPHDLAV

SEQ ID NO: 1350909 - protein, 25 aa, Mycobacterium
ASSRTKWFDEYFIAAGAHGLEQMVI

SEQ ID NO: 1350910 - protein, 25 aa, Mycobacterium
ASSSERSVAIAIGRNSYAQASGAGS

SEQ ID NO: 1350911 - protein, 27 aa, Mycobacterium
ASSVAPLRPTVIVASLPPTYTIGRAGS

SEQ ID NO: 1350912 - protein, 19 aa, Mycobacterium
ASSWVEAKSAPGWPAQYGD

SEQ ID NO: 1350913 - protein, 32 aa, Mycobacterium
ASTVCSGGHGGLLIGNGGNGFRGGNGGNAGFI

SEQ ID NO: 1350914 - protein, 21 aa, Mycobacterium
ASWQAFVTGLRVLRGDDGAER

SEQ ID NO: 1350915 - protein, 19 aa, Mycobacterium
ATAAAMCGVMAAAAGTPTA

SEQ ID NO: 1350916 - protein, 32 aa, Mycobacterium
ATASRVGDLVTWWTGDALMVFSANNLQYKYTV

SEQ ID NO: 1350917 - protein, 17 aa, Mycobacterium
ATCELLIAGYWCAGGPG

SEQ ID NO: 1350918 - protein, 22 aa, Mycobacterium
ATDPERDAVTFAGSGVTGNGSV

SEQ ID NO: 1350919 - protein, 25 aa, Mycobacterium
ATDVLELVFPPAPSVQVEAPMSAES

SEQ ID NO: 1350920 - protein, 20 aa, Mycobacterium
ATEAWKEALVKNGWSDAFMT

SEQ ID NO: 1350921 - protein, 17 aa, Mycobacterium
ATEKFSSISTALVESTD

SEQ ID NO: 1350922 - protein, 20 aa, Mycobacterium
ATENYLRWVSDTDRTPPKPD

SEQ ID NO: 1350923 - protein, 26 aa, Mycobacterium
ATFHPDRFRYAGSMSGFMTPSATTLN

SEQ ID NO: 1350924 - protein, 26 aa, Mycobacterium
ATFHPDRYRFAGSLSGFLTPSATALN

SEQ ID NO: 1350925 - protein, 17 aa, Mycobacterium
ATGCARVNLGTAALENP

SEQ ID NO: 1350926 - protein, 23 aa, Mycobacterium
ATGCVAPGLVVRCRNDIPHSRGL

SEQ ID NO: 1350927 - protein, 26 aa, Mycobacterium
ATGIVTDLLNWLGLGTGGAIPLPGGA

SEQ ID NO: 1350928 - protein, 23 aa, Mycobacterium
ATGRRRIAFVSGPTELRQVRDRL

SEQ ID NO: 1350929 - protein, 17 aa, Mycobacterium
ATHAAGALSGYRAGLLA

SEQ ID NO: 1350930 - protein, 25 aa, Mycobacterium
ATHARLGGPGRWLLALPAHHIAGLQ

SEQ ID NO: 1350931 - protein, 27 aa, Mycobacterium
ATIPGGKQVLGSWSWAIPANSATPDAA

SEQ ID NO: 1350932 - protein, 17 aa, Mycobacterium
ATLKVIAGDVYWTTVGN

SEQ ID NO: 1350933 - protein, 23 aa, Mycobacterium
ATLWRARLIAPMRPDRYLRMGLA

SEQ ID NO: 1350934 - protein, 25 aa, Mycobacterium
ATMHSVGLPDSWLIRPGSTLTVGKL

SEQ ID NO: 1350935 - protein, 20 aa, Mycobacterium
ATNALCCNEFSCAVTNSSEW

SEQ ID NO: 1350936 - protein, 19 aa, Mycobacterium
ATPALPIPFPRTGQGGEPR

SEQ ID NO: 1350937 - protein, 17 aa, Mycobacterium
ATPDNFVGIPLYPAGAR

SEQ ID NO: 1350938 - protein, 25 aa, Mycobacterium
ATPKRPWRELVAGFIDDWTADTEAW

SEQ ID NO: 1350939 - protein, 24 aa, Mycobacterium
ATPPSGPDAGLWDTTLPMVPSANV

SEQ ID NO: 1350940 - protein, 26 aa, Mycobacterium
ATPRNLRFAATMPRAVVLCADADDVA

SEQ ID NO: 1350941 - protein, 21 aa, Mycobacterium
ATRALAVVGLISAGHVVAPPA

SEQ ID NO: 1350942 - protein, 24 aa, Mycobacterium
ATRLEMWRSDMVRMLSYGALDAPI

SEQ ID NO: 1350943 - protein, 22 aa, Mycobacterium
ATRQDILVDIDFLRTPAETPVA

SEQ ID NO: 1350944 - protein, 18 aa, Mycobacterium
ATSLRVGGVAALAVTLGI

SEQ ID NO: 1350945 - protein, 17 aa, Mycobacterium
ATSSLAIAEYIVGTVVP

SEQ ID NO: 1350946 - protein, 17 aa, Mycobacterium
ATTGIGVVVSTGDDPAV

SEQ ID NO: 1350947 - protein, 25 aa, Mycobacterium
ATVARFAAGLAPHGAGTVLVGRDGS

SEQ ID NO: 1350948 - protein, 17 aa, Mycobacterium
ATVGPVYSVLAIGDPPT

SEQ ID NO: 1350949 - protein, 34 aa, Mycobacterium
AVAASGKANIVFLGQRLDGVEFVVADGNLYGAIS

SEQ ID NO: 1350950 - protein, 25 aa, Mycobacterium
AVANKGVMMRPYLVESLKGPDLANI

SEQ ID NO: 1350951 - protein, 18 aa, Mycobacterium
AVAPYGAFPTRDGQTVVL

SEQ ID NO: 1350952 - protein, 25 aa, Mycobacterium
AVARRHWPALLASLSGDDGARWFLR

SEQ ID NO: 1350953 - protein, 20 aa, Mycobacterium
AVDGIRVNAVFPGPVETPML

SEQ ID NO: 1350954 - protein, 20 aa, Mycobacterium
AVDIPDDFDIVLAVGPLDPR

SEQ ID NO: 1350955 - protein, 25 aa, Mycobacterium
AVEPRLWNMWTVLPILQDTTIVAAG

SEQ ID NO: 1350956 - protein, 24 aa, Mycobacterium
AVEVWKVGSALIRRTNDRISSLVA

SEQ ID NO: 1350957 - protein, 27 aa, Mycobacterium
AVFDFGGRYLFVYEPLRGYQTAANPAT

SEQ ID NO: 1350958 - protein, 22 aa, Mycobacterium
AVGADMSNPMAGMITKPFTVTV

SEQ ID NO: 1350959 - protein, 25 aa, Mycobacterium
AVGEPRGVPQAGALAGASRAVPGGL

SEQ ID NO: 1350960 - protein, 25 aa, Mycobacterium
AVIPEQRTAVPVEWDDFRQQLEKLS

SEQ ID NO: 1350961 - protein, 19 aa, Mycobacterium
AVKAMPRRLTMGAMAVVTA

SEQ ID NO: 1350962 - protein, 26 aa, Mycobacterium
AVLAVAIGFVSVRSWSSSSQTQLVAY

SEQ ID NO: 1350963 - protein, 31 aa, Mycobacterium; identical to SEQ ID NO: 1251138

SEQ ID NO: 1350964 - protein, 18 aa, Mycobacterium
AVMLRAALNYPLIAQIMR

SEQ ID NO: 1350965 - protein, 18 aa, Mycobacterium
AVNGRDGLRVGVLDVTPD

SEQ ID NO: 1350966 - protein, 23 aa, Mycobacterium
AVNRTGIVKALFRDLGQPAAQLI

SEQ ID NO: 1350967 - protein, 18 aa, Mycobacterium
AVPDRIPGTRARPFHPGW

SEQ ID NO: 1350968 - protein, 19 aa, Mycobacterium
AVPGYPNFFMLYGPNTNVG

SEQ ID NO: 1350969 - protein, 43 aa, Mycobacterium
AVQAALSRIGSPYSWGGSGPNAFDCSGLVMWAFQHEGISLPHS

SEQ ID NO: 1350970 - protein, 43 aa, Mycobacterium; identical to SEQ ID NO: 1260106

SEQ ID NO: 1350971 - protein, 26 aa, Mycobacterium
AVQRSVVLSDGWNIMDFVEQLQKLAG

SEQ ID NO: 1350972 - protein, 17 aa, Mycobacterium
AVREARTVMSRAAFVRE

SEQ ID NO: 1350973 - protein, 17 aa, Mycobacterium
AVRRCALYRNCFPSMDV

SEQ ID NO: 1350974 - protein, 24 aa, Mycobacterium
AVRRRPYTVILFDEIEKAHPDVFD

SEQ ID NO: 1350975 - protein, 28 aa, Mycobacterium
AVRSQAYDRAWRFATYVADRYGPERLRA

SEQ ID NO: 1350976 - protein, 17 aa, Mycobacterium
AVSGGLNPAVNVASVLD

SEQ ID NO: 1350977 - protein, 18 aa, Mycobacterium
AVTAFLLWGLASALCDVL

SEQ ID NO: 1350978 - protein, 25 aa, Mycobacterium
AVTLDRVVAIPAMLPQNTRKRQKVT

SEQ ID NO: 1350979 - protein, 20 aa, Mycobacterium
AVTTLRIREGVQLPKGSTAE

SEQ ID NO: 1350980 - protein, 26 aa, Mycobacterium
AVVAEWRRIDGRWKLASKSLCNGIKT

SEQ ID NO: 1350981 - protein, 22 aa, Mycobacterium
AVVDARCRVYGVSNLWVVDGSI

SEQ ID NO: 1350982 - protein, 25 aa, Mycobacterium
AVVGRSGTFADLIPRLAELTASLDR

SEQ ID NO: 1350983 - protein, 24 aa, Mycobacterium
AVVRPRVPRPLLDVYDRNIDARRQ

SEQ ID NO: 1350984 - protein, 26 aa, Mycobacterium
AVVVPKMIYRVGFFRSPKGSSMVTGP

SEQ ID NO: 1350985 - protein, 24 aa, Mycobacterium
AVYRAEFDPAAALDMARRTVDECL

SEQ ID NO: 1350986 - protein, 20 aa, Mycobacterium
AWEKAGLRGGERAVKVQAPG

SEQ ID NO: 1350987 - protein, 23 aa, Mycobacterium
AWMSRNGPRFGLCQVYANELWHY

SEQ ID NO: 1350988 - protein, 24 aa, Mycobacterium
AWMSRNGPRFGLCQVYANELWHYE

SEQ ID NO: 1350989 - protein, 19 aa, Mycobacterium
AWNDHLNKFVMLYTNTVSD

SEQ ID NO: 1350990 - protein, 23 aa, Mycobacterium
AWNPEFLREGFAVKDTLHPDRIV

SEQ ID NO: 1350991 - protein, 19 aa, Mycobacterium
AWPVCGAYALSPRSSAPPG

SEQ ID NO: 1350992 - protein, 18 aa, Mycobacterium
AWQRTAAGAVPPERNTGK

SEQ ID NO: 1350993 - protein, 19 aa, Mycobacterium
AWRGLGMGSTSGFVAAQLE

SEQ ID NO: 1350994 - protein, 38 aa, Mycobacterium
AWRLGIFLAVCALGTFVLLSVFAQFRFGDGKTYQAEFS

SEQ ID NO: 1350995 - protein, 24 aa, Mycobacterium
AWRLLVFLSVCALATFALLTVFAQ

SEQ ID NO: 1350996 - protein, 34 aa, Mycobacterium
AWSMTGTGGRMFVGRAGAGFAYAATDVITFYPPT

SEQ ID NO: 1350997 - protein, 18 aa, Mycobacterium
AYDWDLPRRIRFNEKVVD

SEQ ID NO: 1350998 - protein, 18 aa, Mycobacterium
AYFNKPVEELNVAEGALL

SEQ ID NO: 1350999 - protein, 17 aa, Mycobacterium
AYGASAVPVRWRALLHG

SEQ ID NO: 1351000 - protein, 22 aa, Mycobacterium
AYMAAQCPNTRIVLGGYSQGAA

SEQ ID NO: 1351001 - protein, 18 aa, Mycobacterium
AYPPDLLIEVPRTVCRSL

SEQ ID NO: 1351002 - protein, 35 aa, Mycobacterium
AYQALARQGIYGDFFSFYLCDIVLKLNGKGGQPVY

SEQ ID NO: 1351003 - protein, 19 aa, Mycobacterium
CAAAVCLVAGAPVAPATAP

SEQ ID NO: 1351004 - protein, 23 aa, Mycobacterium
CAADACLHWGAMWGPASRADYVD

SEQ ID NO: 1351005 - protein, 17 aa, Mycobacterium
CAALDIASGAAIPTFTV

SEQ ID NO: 1351006 - protein, 18 aa, Mycobacterium
CAFTEAVPDIVMTNILAK

SEQ ID NO: 1351007 - protein, 19 aa, Mycobacterium
CAPVEPAAAVAPVVDATVQ

SEQ ID NO: 1351008 - protein, 20 aa, Mycobacterium
CARLGWPVQDTEVISLVTAA

SEQ ID NO: 1351009 - protein, 24 aa, Mycobacterium
CATRPGKRAPTVAICESDEIYVPL

SEQ ID NO: 1351010 - protein, 20 aa, Mycobacterium
CAVGPRGRKEYRITDAGRAE

SEQ ID NO: 1351011 - protein, 23 aa, Mycobacterium
CDPAGPCFYTYTIDPKYVGLHPF

SEQ ID NO: 1351012 - protein, 20 aa, Mycobacterium
CDVVCYCVVDARAWLRDPAP

SEQ ID NO: 1351013 - protein, 30 aa, Mycobacterium
CEEPRVCREVYYQWILPLGTVEIGVDSNVE

SEQ ID NO: 1351014 - protein, 22 aa, Mycobacterium
CEIGEARLKYRGWGVPYDHARL

SEQ ID NO: 1351015 - protein, 23 aa, Mycobacterium
CEIGEARLKYRGWGVPYEHARLV

SEQ ID NO: 1351016 - protein, 21 aa, Mycobacterium
CGAEWPMSRLTLALSPATLPK

SEQ ID NO: 1351017 - protein, 19 aa, Mycobacterium
CGAVQAASRMNGEQSAKLC

SEQ ID NO: 1351018 - protein, 24 aa, Mycobacterium
CITSGGALTCLLDLTAPPPRPAQA

SEQ ID NO: 1351019 - protein, 20 aa, Mycobacterium
CITVLPLQHPVVLAKALATA

SEQ ID NO: 1351020 - protein, 21 aa, Mycobacterium
CKVFFAPDRPDFIGIAQRERN

SEQ ID NO: 1351021 - protein, 26 aa, Mycobacterium
CLGASLARLEVMAVLNAVLDRYRTIA

SEQ ID NO: 1351022 - protein, 29 aa, Mycobacterium
CMSSTLPTLFRNAGGYRRQLTLTPTGVIA

SEQ ID NO: 1351023 - protein, 23 aa, Mycobacterium
CNGELPATMIKTPFSLAYKTELP

SEQ ID NO: 1351024 - protein, 18 aa, Mycobacterium
CQDTRNAASIGITGAPDE

SEQ ID NO: 1351025 - protein, 27 aa, Mycobacterium
CQGDACNGGDGGILWGNGGNGAHGGTG

SEQ ID NO: 1351026 - protein, 17 aa, Mycobacterium
CQYAMQFIAVLRGYGLP

SEQ ID NO: 1351027 - protein, 19 aa, Mycobacterium
CRRRGRARTEHVVRQDMAG

SEQ ID NO: 1351028 - protein, 17 aa, Mycobacterium
CSAALSLSGCAFQGVNS

SEQ ID NO: 1351029 - protein, 19 aa, Mycobacterium
CSGLTRFAFAGVGVLLPRW

SEQ ID NO: 1351030 - protein, 17 aa, Mycobacterium
CTMHRFRQSHGRVLTRL

SEQ ID NO: 1351031 - protein, 17 aa, Mycobacterium
CVAAGAAVLIAAATVGA

SEQ ID NO: 1351032 - protein, 26 aa, Mycobacterium
CVAGCEWRGLNSLPLPGTAGGGSGAY

SEQ ID NO: 1351033 - protein, 17 aa, Mycobacterium
CVCRGCYLLFTDTAAQL

SEQ ID NO: 1351034 - protein, 19 aa, Mycobacterium
CVPVVGDLREPLYLPVGCR

SEQ ID NO: 1351035 - protein, 19 aa, Mycobacterium
CWQSPRAGSTFTAKSWTGV

SEQ ID NO: 1351036 - protein, 19 aa, Mycobacterium
CWSAPSAQAFYIHNHAAVT

SEQ ID NO: 1351037 - protein, 18 aa, Mycobacterium
CYVSGRYAGPFSEEELEV

SEQ ID NO: 1351038 - protein, 23 aa, Mycobacterium
DAAAPGWGCGRALARRNNVIVDV

SEQ ID NO: 1351039 - protein, 19 aa, Mycobacterium
DAAATRLLAPTGWTAPTDG

SEQ ID NO: 1351040 - protein, 18 aa, Mycobacterium
DAAIPATEAVSLSGGSAV

SEQ ID NO: 1351041 - protein, 25 aa, Mycobacterium
DAAKAGDWPTVFAMLDGPRQRVDIN

SEQ ID NO: 1351042 - protein, 30 aa, Mycobacterium
DAALSAAGYLCWRGKDLSKPRGWMEALRAY

SEQ ID NO: 1351043 - protein, 19 aa, Mycobacterium
DAARAAGFVDVRSVVPDAI

SEQ ID NO: 1351044 - protein, 24 aa, Mycobacterium
DAARRYSPRAGRHLRLEHFDNASR

SEQ ID NO: 1351045 - protein, 18 aa, Mycobacterium
DADLDEWVAREVAAAVAA

SEQ ID NO: 1351046 - protein, 22 aa, Mycobacterium
DADRPTPPLLYGFYDVSVDFSK

SEQ ID NO: 1351047 - protein, 23 aa, Mycobacterium
DAESRTGAVALQGDREIARNEDC

SEQ ID NO: 1351048 - protein, 23 aa, Mycobacterium
DAFRDSDAWFLIRAVTPPDAEVL

SEQ ID NO: 1351049 - protein, 25 aa, Mycobacterium
DAGHPRWVAADVMAGRLNQVGIDRA

SEQ ID NO: 1351050 - protein, 17 aa, Mycobacterium
DAGQPAIEIIAFDSQDA

SEQ ID NO: 1351051 - protein, 25 aa, Mycobacterium
DAGVRPGMTVAWQLPSHVGAAVLML

SEQ ID NO: 1351052 - protein, 21 aa, Mycobacterium
DAGYPEYFQALTVRTPDVQAQ

SEQ ID NO: 1351053 - protein, 19 aa, Mycobacterium
DAIEQWSRNLNVIASQTAE

SEQ ID NO: 1351054 - protein, 21 aa, Mycobacterium
DAIGPATEWTTYVGDGKRVSV

SEQ ID NO: 1351055 - protein, 20 aa, Mycobacterium
DALDATWRRSYPVGDGSQSC

SEQ ID NO: 1351056 - protein, 17 aa, Mycobacterium
DALDRLGQFSALAADSV

SEQ ID NO: 1351057 - protein, 24 aa, Mycobacterium
DALFWSGGLPTPGITDLLTTSRDD

SEQ ID NO: 1351058 - protein, 23 aa, Mycobacterium
DALGEGDFYSAVNLLVGAAIAPV

SEQ ID NO: 1351059 - protein, 20 aa, Mycobacterium
DALIPRDRIAEVLGAADVLI

SEQ ID NO: 1351060 - protein, 28 aa, Mycobacterium
DALKKMEESGAWKEAFDKNLGPAGITAP

SEQ ID NO: 1351061 - protein, 17 aa, Mycobacterium
DALPDGYEVAAYTGPPA

SEQ ID NO: 1351062 - protein, 26 aa, Mycobacterium
DAPAPVKVGFRLGDPGPGEFGVRDGV

SEQ ID NO: 1351063 - protein, 26 aa, Mycobacterium
DAPHPAAARLWQEFLYSDEGQNLFAQ

SEQ ID NO: 1351064 - protein, 22 aa, Mycobacterium
DAPTPRPAAMSHRDRADVFAGI

SEQ ID NO: 1351065 - protein, 17 aa, Mycobacterium
DAQAVILSPSLVSARAI

SEQ ID NO: 1351066 - protein, 19 aa, Mycobacterium
DATLARWLGPDRVIGASTI

SEQ ID NO: 1351067 - protein, 19 aa, Mycobacterium
DAVDAGFFSPGLGTISGLL

SEQ ID NO: 1351068 - protein, 21 aa, Mycobacterium
DAVIPRERTAVPVEWDEVRQQ

SEQ ID NO: 1351069 - protein, 20 aa, Mycobacterium
DAVLTNGVWAYDTTIADGIT

SEQ ID NO: 1351070 - protein, 23 aa, Mycobacterium
DAYQIGGAYTRDGAKRMIAQKTV

SEQ ID NO: 1351071 - protein, 23 aa, Mycobacterium
DCLGGRPANVVFLNGSPTDNNAT

SEQ ID NO: 1351072 - protein, 23 aa, Mycobacterium
DDDWPTWVLNDFGRKDPPVAEDY

SEQ ID NO: 1351073 - protein, 25 aa, Mycobacterium
DDFDRIIGINLRGAWLCTKHAAPRM

SEQ ID NO: 1351074 - protein, 29 aa, Mycobacterium
DDFIKSLEFLPTFPFHYTYLRNAVRGDYL

SEQ ID NO: 1351075 - protein, 30 aa, Mycobacterium
DDFIKSLEFLPTFPFHYTYLRNAVRGDYLN

SEQ ID NO: 1351076 - protein, 33 aa, Mycobacterium
DDFVKSLEFLPTFPFHYKYLRNAVRGDYLNVFT

SEQ ID NO: 1351077 - protein, 25 aa, Mycobacterium
DDHRRLEGLIAPGSWNIDPSATPQD

SEQ ID NO: 1351078 - protein, 20 aa, Mycobacterium
DDLYWCNPSGRALGARPTTN

SEQ ID NO: 1351079 - protein, 19 aa, Mycobacterium
DDMLHSWFLDPAIIAPGTP

SEQ ID NO: 1351080 - protein, 22 aa, Mycobacterium
DDRELSGFVARATRARTTAVAG

SEQ ID NO: 1351081 - protein, 18 aa, Mycobacterium
DDRNLFWTGLPEGSPYQH

SEQ ID NO: 1351082 - protein, 22 aa, Mycobacterium
DDSKRPSYIVNHVAVVQDLVAH

SEQ ID NO: 1351083 - protein, 25 aa, Mycobacterium
DDVRVLGVPVGRVLEIEPQPDRAKV

SEQ ID NO: 1351084 - protein, 21 aa, Mycobacterium
DDYLAILDIRPFTRGHTLVLP

SEQ ID NO: 1351085 - protein, 18 aa, Mycobacterium
DEAGGSRVHWRTREYYPA

SEQ ID NO: 1351086 - protein, 30 aa, Mycobacterium
DEAGLRGAVYWDPLATLGFLAARTSRIRLA

SEQ ID NO: 1351087 - protein, 24 aa, Mycobacterium
DEAPDFLPVVLEFAATVDAGVGRR

SEQ ID NO: 1351088 - protein, 25 aa, Mycobacterium
DEDLRKPIDGAFAWVIDTDQGVVSY

SEQ ID NO: 1351089 - protein, 17 aa, Mycobacterium
DEHGRFDLDRLVDVVGS

SEQ ID NO: 1351090 - protein, 25 aa, Mycobacterium
DEISPGIAQRGSWVFDVAPALVEAG

SEQ ID NO: 1351091 - protein, 24 aa, Mycobacterium
DEIYVPLNDGFNWKGDPNATSSGQ

SEQ ID NO: 1351092 - protein, 21 aa, Mycobacterium
DEKFRPVAELISWDANGFDGE

SEQ ID NO: 1351093 - protein, 17 aa, Mycobacterium
DELILQPSITRLPRDLG

SEQ ID NO: 1351094 - protein, 28 aa, Mycobacterium
DELRDVTRDVIGTVPIVGAPIAADLYFK

SEQ ID NO: 1351095 - protein, 17 aa, Mycobacterium
DEPWITSHLELRSPAGE

SEQ ID NO: 1351096 - protein, 19 aa, Mycobacterium
DEPYVPLGTNPWYGDPNQI

SEQ ID NO: 1351097 - protein, 30 aa, Mycobacterium
DEWSLPIQYKFTLNGARWSGAVDGHTYGFD

SEQ ID NO: 1351098 - protein, 22 aa, Mycobacterium
DFAADFKDLFPVIKALNDNADF

SEQ ID NO: 1351099 - protein, 21 aa, Mycobacterium
DFDGVDTFRVLAVDVGMHVNV

SEQ ID NO: 1351100 - protein, 25 aa, Mycobacterium
DFESGLRDTIDWYRDNESWWGPLKD

SEQ ID NO: 1351101 - protein, 33 aa, Mycobacterium
DFFIKDLEFLPTFPFHYKYLRNAVRGDYLNVYT

SEQ ID NO: 1351102 - protein, 31 aa, Mycobacterium
DFGAVLGGGALPFGIFAGGLLTGPELIDPAA

SEQ ID NO: 1351103 - protein, 35 aa, Mycobacterium
DFIIDRGVTFPSIYDPPMRTMIAFGGRYPTTVIPS

SEQ ID NO: 1351104 - protein, 23 aa, Mycobacterium
DFMGFTVAGPDEFLASGHPDPAD

SEQ ID NO: 1351105 - protein, 21 aa, Mycobacterium
DFMGFTVAGPDHFLGSGHPGE

SEQ ID NO: 1351106 - protein, 19 aa, Mycobacterium
DFRGVGGFTGSFWADNIGD

SEQ ID NO: 1351107 - protein, 25 aa, Mycobacterium
DFTRYSFRAAGQFTTLAEELRNIDR

SEQ ID NO: 1351108 - protein, 19 aa, Mycobacterium
DGAAAMAAIGRVILQPVRT

SEQ ID NO: 1351109 - protein, 27 aa, Mycobacterium
DGALIPLFTSDPWLGTSVGAHLDDMVF

SEQ ID NO: 1351110 - protein, 25 aa, Mycobacterium
DGALYAGTHFGVYRIANERDPELVG

SEQ ID NO: 1351111 - protein, 21 aa, Mycobacterium
DGARSAVRRALGIELDGDRSE

SEQ ID NO: 1351112 - protein, 27 aa, Mycobacterium
DGDGKRRFGATISRIDRDDADERPRGH

SEQ ID NO: 1351113 - protein, 24 aa, Mycobacterium
DGELPAPFQRGALVGVHGSWNRQP

SEQ ID NO: 1351114 - protein, 24 aa, Mycobacterium
DGEPRAPLSALLPMGGAVSGVAGP

SEQ ID NO: 1351115 - protein, 25 aa, Mycobacterium
DGEPRAPLSALLPMGGAVSGVAGPN

SEQ ID NO: 1351116 - protein, 21 aa, Mycobacterium
DGGHGGAYINNGRASGGGKAG

SEQ ID NO: 1351117 - protein, 19 aa, Mycobacterium
DGGLARAVYHGSPGHPVAV

SEQ ID NO: 1351118 - protein, 20 aa, Mycobacterium
DGGLARAVYHGSPGHPVAVA

SEQ ID NO: 1351119 - protein, 24 aa, Mycobacterium
DGGTIEFRADGTLGKTYTTEGNAL

SEQ ID NO: 1351120 - protein, 22 aa, Mycobacterium
DGGVARAVYHGRPGHPVVVARR

SEQ ID NO: 1351121 - protein, 23 aa, Mycobacterium
DGGYEIPVTPGVHTIAVQAEGIE

SEQ ID NO: 1351122 - protein, 19 aa, Mycobacterium
DGIELLKVDTLEHAVDGLR

SEQ ID NO: 1351123 - protein, 19 aa, Mycobacterium
DGKRLGADVLRGETVTVGA

SEQ ID NO: 1351124 - protein, 28 aa, Mycobacterium
DGLHVHGLFGWLQFVPILGNLLNPGGGH

SEQ ID NO: 1351125 - protein, 22 aa, Mycobacterium
DGLRLPIGVASSVVRRYPTALT

SEQ ID NO: 1351126 - protein, 18 aa, Mycobacterium
DGLTRLVTQAGGTVTGSI

SEQ ID NO: 1351127 - protein, 18 aa, Mycobacterium
DGMARLVTDVADINQQLQ

SEQ ID NO: 1351128 - protein, 25 aa, Mycobacterium
DGMGGYPLLYARPADQQPYADESEY

SEQ ID NO: 1351129 - protein, 28 aa, Mycobacterium
DGPAHIHGLTGLLHLVSLGLVGHSGHSA

SEQ ID NO: 1351130 - protein, 18 aa, Mycobacterium
DGPLTAFDLATGRQLWTS

SEQ ID NO: 1351131 - protein, 19 aa, Mycobacterium
DGPPPLACVDSFVTEMRPA

SEQ ID NO: 1351132 - protein, 19 aa, Mycobacterium
DGPQSPLLEEFIGIVRGRK

SEQ ID NO: 1351133 - protein, 21 aa, Mycobacterium
DGRLLRFLSMVTTFGTALDLT

SEQ ID NO: 1351134 - protein, 18 aa, Mycobacterium
DGSCALTVTAAWANLDTG

SEQ ID NO: 1351135 - protein, 24 aa, Mycobacterium
DGSEFLDGLVAVFLESGPVGALGY

SEQ ID NO: 1351136 - protein, 24 aa, Mycobacterium
DGTSWSSAEPLGYNKQYTLQAEAL

SEQ ID NO: 1351137 - protein, 19 aa, Mycobacterium
DGTTAPGLQVFRFKAMNAE

SEQ ID NO: 1351138 - protein, 24 aa, Mycobacterium
DGVARYPARFQLVMAANPCPCAPA

SEQ ID NO: 1351139 - protein, 39 aa, Mycobacterium
DGVIRPIIDSGYWRFWFKDRSSGWPLPPPEPAGTAPMDI

SEQ ID NO: 1351140 - protein, 30 aa, Mycobacterium
DGVRMVITVLTWRLDLERLAATAQRCAEYE

SEQ ID NO: 1351141 - protein, 22 aa, Mycobacterium
DGVRRLCADGVLVAVSTRVPGG

SEQ ID NO: 1351142 - protein, 24 aa, Mycobacterium
DGVSWSSAEPLGYNKQYTLHAQAL

SEQ ID NO: 1351143 - protein, 23 aa, Mycobacterium
DGVWPLLVSIAMRDAGGFSSTAM

SEQ ID NO: 1351144 - protein, 22 aa, Mycobacterium
DGWADFPTYLWNPIAVANAVVG

SEQ ID NO: 1351145 - protein, 25 aa, Mycobacterium
DGYPAGGTTGIFGVTRYVFDVITGT

SEQ ID NO: 1351146 - protein, 24 aa, Mycobacterium
DHGLPRPTLFAFPFSDGYDEDRAS

SEQ ID NO: 1351147 - protein, 23 aa, Mycobacterium
DHLDALCALGLQSRIVGAALPEG

SEQ ID NO: 1351148 - protein, 18 aa, Mycobacterium
DHLDFHPTMEDYFDAKAG

SEQ ID NO: 1351149 - protein, 18 aa, Mycobacterium
DHRWSRSAGLAAVGVAVA

SEQ ID NO: 1351150 - protein, 26 aa, Mycobacterium
DHSRRLWTVLIFMLWHAIFVEGSVTP

SEQ ID NO: 1351151 - protein, 28 aa, Mycobacterium
DHSRRLWTVLIFMLWYAIFVDKTVTPQI

SEQ ID NO: 1351152 - protein, 23 aa, Mycobacterium
DIDLYAPVARYWPEFGRAGKEDI

SEQ ID NO: 1351153 - protein, 28 aa, Mycobacterium
DIDRETWNRLALPWFRGINSVIGVQRTG

SEQ ID NO: 1351154 - protein, 25 aa, Mycobacterium
DIELDGAAVLVRFTVDKNITMGELT

SEQ ID NO: 1351155 - protein, 21 aa, Mycobacterium
DIELLPVTKFFPASDVVALHR

SEQ ID NO: 1351156 - protein, 23 aa, Mycobacterium
DIEVPGAKMLGGPRGRRHAFRPA

SEQ ID NO: 1351157 - protein, 25 aa, Mycobacterium
DIGPDLNEAVLWASAFPYGPTFADR

SEQ ID NO: 1351158 - protein, 23 aa, Mycobacterium
DILGESVTVLPGLREIDAGIYEG

SEQ ID NO: 1351159 - protein, 27 aa, Mycobacterium
DIPVPVRPVQSWWWQMVLRWLEIENPA

SEQ ID NO: 1351160 - protein, 22 aa, Mycobacterium
DIQALRPPPVISDFEQPMGAIP

SEQ ID NO: 1351161 - protein, 22 aa, Mycobacterium
DKATAAECLRALPGNKLRTPVW

SEQ ID NO: 1351162 - protein, 24 aa, Mycobacterium
DKGVLPAFWSVGLEPGHEYDWPRQ

SEQ ID NO: 1351163 - protein, 19 aa, Mycobacterium
DKIAYGFSGGARVVSKWLQ

SEQ ID NO: 1351164 - protein, 19 aa, Mycobacterium
DKLSFAKGILLRRDPDREE

SEQ ID NO: 1351165 - protein, 35 aa, Mycobacterium
DKTILQAIELWKIVDRPNLLIKIPATMAGLPAITA

SEQ ID NO: 1351166 - protein, 21 aa, Mycobacterium
DKTLVVNFSGLRSYDPDDDDT

SEQ ID NO: 1351167 - protein, 18 aa, Mycobacterium
DKVTLTYLDPAGKSQSLD

SEQ ID NO: 1351168 - protein, 18 aa, Mycobacterium
DLAAMLAPLLRDLAAAEL

SEQ ID NO: 1351169 - protein, 18 aa, Mycobacterium
DLAAMLAPLLRDLAAAEV

SEQ ID NO: 1351170 - protein, 26 aa, Mycobacterium
DLAVMLRAALKYPLIAQIMRSPTAPF

SEQ ID NO: 1351171 - protein, 29 aa, Mycobacterium
DLCAFDDPFCSPGFNLPAHFAYVDNGMVE

SEQ ID NO: 1351172 - protein, 23 aa, Mycobacterium
DLDETACLVAEVGVRVVTEVVDV

SEQ ID NO: 1351173 - protein, 18 aa, Mycobacterium
DLDMVRQHFVTWEHDKDD

SEQ ID NO: 1351174 - protein, 17 aa, Mycobacterium
DLDRVARQQAVMASMAH

SEQ ID NO: 1351175 - protein, 19 aa, Mycobacterium
DLGLLLSHQLPNTGVVVLE

SEQ ID NO: 1351176 - protein, 19 aa, Mycobacterium
DLGNALGACLGFKNDYLSV

SEQ ID NO: 1351177 - protein, 24 aa, Mycobacterium
DLGRASDAIGLIVATGGNATRINS

SEQ ID NO: 1351178 - protein, 27 aa, Mycobacterium
DLGTTWRPECPVPPDALRRVDLDYWGF

SEQ ID NO: 1351179 - protein, 25 aa, Mycobacterium
DLKTVWKSEMIAGSVFAANDALGAE

SEQ ID NO: 1351180 - protein, 20 aa, Mycobacterium
DLLAPEFYKQPDVLFSDDMF

SEQ ID NO: 1351181 - protein, 24 aa, Mycobacterium
DLLKPEYKGRVSISNPVTSGTGQA

SEQ ID NO: 1351182 - protein, 22 aa, Mycobacterium
DLLMPSLRMLIGGGAPCPPEVH

SEQ ID NO: 1351183 - protein, 19 aa, Mycobacterium
DLLTSILTYHVVPGQAAPD

SEQ ID NO: 1351184 - protein, 30 aa, Mycobacterium
DLNARARNGDTYRTLFLVATPQGINPAALA

SEQ ID NO: 1351185 - protein, 19 aa, Mycobacterium
DLNYYECNEWWDFDADIDI

SEQ ID NO: 1351186 - protein, 27 aa, Mycobacterium
DLPAGCQRLDGRTALGYVRSRATARAD

SEQ ID NO: 1351187 - protein, 19 aa, Mycobacterium
DLPMPDGWEPITEAADVPP

SEQ ID NO: 1351188 - protein, 23 aa, Mycobacterium
DLQMRPGSSSGWHTHPGPEHSVI

SEQ ID NO: 1351189 - protein, 21 aa, Mycobacterium
DLRIPPELLGGRIYVSLEQPL

SEQ ID NO: 1351190 - protein, 25 aa, Mycobacterium
DLSHALEVTGSWWVYTPTNVLGYDP

SEQ ID NO: 1351191 - protein, 21 aa, Mycobacterium
DLTELEMQWGRTLGQMPSPYT

SEQ ID NO: 1351192 - protein, 24 aa, Mycobacterium
DLVEEFRPGTTLAVTIPTVDAQRG

SEQ ID NO: 1351193 - protein, 24 aa, Mycobacterium
DMDAAIDYWAEFFRLGQRNEAEYS

SEQ ID NO: 1351194 - protein, 31 aa, Mycobacterium
DMPGGPMMPGMPGMEGMPGMEGMMSPADMQA

SEQ ID NO: 1351195 - protein, 25 aa, Mycobacterium
DNGRIRYKRVCEVCGEVVEYRDIAK

SEQ ID NO: 1351196 - protein, 18 aa, Mycobacterium
DNLAPLGISVKIRTVDFA

SEQ ID NO: 1351197 - protein, 19 aa, Mycobacterium
DNPFNLLALANAFAGFQYV

SEQ ID NO: 1351198 - protein, 34 aa, Mycobacterium; identical to SEQ ID NO: 1119658

SEQ ID NO: 1351199 - protein, 19 aa, Mycobacterium
DPAPILAQILQNQWNSAQT

SEQ ID NO: 1351200 - protein, 22 aa, Mycobacterium
DPAPRKWWFTIGGAAQVGESLA

SEQ ID NO: 1351201 - protein, 17 aa, Mycobacterium
DPARLTVTVGYGPELFD

SEQ ID NO: 1351202 - protein, 24 aa, Mycobacterium
DPARPSGGVANWVPEGVRVPGIGL

SEQ ID NO: 1351203 - protein, 36 aa, Mycobacterium
DPATGATLWRYARDLELCGVTWVYSYAVAVYPDVRG

SEQ ID NO: 1351204 - protein, 20 aa, Mycobacterium
DPAVLVFTDRGWRWGGDWRT

SEQ ID NO: 1351205 - protein, 20 aa, Mycobacterium
DPDPRRSALNSEYAKFYHEV

SEQ ID NO: 1351206 - protein, 19 aa, Mycobacterium
DPDVLLREFLKATADPANR

SEQ ID NO: 1351207 - protein, 24 aa, Mycobacterium
DPEEAVAMAVCLRVAAGGSVAGVG

SEQ ID NO: 1351208 - protein, 20 aa, Mycobacterium
DPFAEPGWFRTDDVGALDDG

SEQ ID NO: 1351209 - protein, 39 aa, Mycobacterium
DPGAVSPGVPCVNIMQQLLTVPGRLPQTLPGANSALTNT

SEQ ID NO: 1351210 - protein, 21 aa, Mycobacterium
DPKIGVNLCEVGIQFNDDFIE

SEQ ID NO: 1351211 - protein, 21 aa, Mycobacterium
DPLPLTRLTIEKQIVALGEAF

SEQ ID NO: 1351212 - protein, 19 aa, Mycobacterium
DPNAPFQAQMKVDWVKAYA

SEQ ID NO: 1351213 - protein, 19 aa, Mycobacterium
DPNHDRVWVASSGTNEVVG

SEQ ID NO: 1351214 - protein, 22 aa, Mycobacterium
DPPEPFPSVSAYLGAGDIPPPP

SEQ ID NO: 1351215 - protein, 18 aa, Mycobacterium
DPRCRVRGVDALWVVDGS

SEQ ID NO: 1351216 - protein, 35 aa, Mycobacterium
DPRFGDVACKLGRSTGYSCGVTWGPGQEPGTILNQ

SEQ ID NO: 1351217 - protein, 17 aa, Mycobacterium
DPRIDLREADLEPGQKW

SEQ ID NO: 1351218 - protein, 23 aa, Mycobacterium
DPRLRRLREDAVFEAVVGAIPQL

SEQ ID NO: 1351219 - protein, 28 aa, Mycobacterium
DPSSNFTYRFSAPHPGTYWAHPHTGLDA

SEQ ID NO: 1351220 - protein, 29 aa, Mycobacterium
DPSTDKLDFGWFKAHEFDVTEVAGSTRIA

SEQ ID NO: 1351221 - protein, 18 aa, Mycobacterium
DQAVWAFVAPLVRNDVSG

SEQ ID NO: 1351222 - protein, 18 aa, Mycobacterium
DQFGFPFSFTVSQDATGF

SEQ ID NO: 1351223 - protein, 26 aa, Mycobacterium
DQNGVRRWLALDGQPLHRVIVAASEM

SEQ ID NO: 1351224 - protein, 17 aa, Mycobacterium
DQYGDRWTSEVSPTEAG

SEQ ID NO: 1351225 - protein, 17 aa, Mycobacterium
DRDGLAYTASATAKGGT

SEQ ID NO: 1351226 - protein, 18 aa, Mycobacterium
DRDTVAITVSDGYGGSIT

SEQ ID NO: 1351227 - protein, 23 aa, Mycobacterium
DREHRVAAVFLRELLAEDLQPVV

SEQ ID NO: 1351228 - protein, 24 aa, Mycobacterium
DREYTGREKWMFAHIPLAKKIYRT

SEQ ID NO: 1351229 - protein, 20 aa, Mycobacterium
DRGACPFGGKQAVAAERGAV

SEQ ID NO: 1351230 - protein, 21 aa, Mycobacterium
DRGEEVCAVLVPVGNEVDVDS

SEQ ID NO: 1351231 - protein, 21 aa, Mycobacterium
DRGPLTVPVWYQYSPGGQPWV

SEQ ID NO: 1351232 - protein, 29 aa, Mycobacterium
DRITYRLSAPPHRGALVVTGDGRFTYTPT

SEQ ID NO: 1351233 - protein, 21 aa, Mycobacterium
DRKAAVLHRVFGAVPASVHLV

SEQ ID NO: 1351234 - protein, 17 aa, Mycobacterium
DRLTFVLTGNPLRSDNG

SEQ ID NO: 1351235 - protein, 21 aa, Mycobacterium
DRLVRVSATGGLRVYQLGVAA

SEQ ID NO: 1351236 - protein, 18 aa, Mycobacterium
DRMDDHFGGMFAEDPYTM

SEQ ID NO: 1351237 - protein, 22 aa, Mycobacterium
DRMGALALHVAKIARRRHPQHV

SEQ ID NO: 1351238 - protein, 24 aa, Mycobacterium
DRNFDVFNLDGLSDFDVRNDVRNK

SEQ ID NO: 1351239 - protein, 23 aa, Mycobacterium
DRNWQVCSSSPPAGSTLTAGTPV

SEQ ID NO: 1351240 - protein, 31 aa, Mycobacterium
DRPLVEGMPSYPAWDRHLFVFQEGTCISQEL

SEQ ID NO: 1351241 - protein, 18 aa, Mycobacterium
DRQHRVAAVYLMALLAED

SEQ ID NO: 1351242 - protein, 24 aa, Mycobacterium
DRRPLVWHDPRIESTKCSDTGPAF

SEQ ID NO: 1351243 - protein, 22 aa, Mycobacterium
DRSCKLQMLTLYRAGRAAEALE

SEQ ID NO: 1351244 - protein, 18 aa, Mycobacterium
DRSGMAWCISNFGREEML

SEQ ID NO: 1351245 - protein, 19 aa, Mycobacterium
DRTRPGSRATYLFQETLDL

SEQ ID NO: 1351246 - protein, 19 aa, Mycobacterium
DRTTPALDLDVLLGGLKPV

SEQ ID NO: 1351247 - protein, 24 aa, Mycobacterium
DRTVSVAWTAWRGLGMGSTSGFVA

SEQ ID NO: 1351248 - protein, 21 aa, Mycobacterium
DRVAFDAATDVVDFRYFGTRE

SEQ ID NO: 1351249 - protein, 20 aa, Mycobacterium
DRVSLGDALPHTVVVSPDGR

SEQ ID NO: 1351250 - protein, 19 aa, Mycobacterium
DRWEVELNSALPGDPRDTS

SEQ ID NO: 1351251 - protein, 18 aa, Mycobacterium
DSAEPGTDVGWHYVASRA

SEQ ID NO: 1351252 - protein, 19 aa, Mycobacterium
DSATFTLAATWKFGPEKRN

SEQ ID NO: 1351253 - protein, 28 aa, Mycobacterium
DSAWHTWRMTWLPTGMYFWKDYQPGMEP

SEQ ID NO: 1351254 - protein, 20 aa, Mycobacterium
DSCPVRVNVELVRERRGDDA

SEQ ID NO: 1351255 - protein, 24 aa, Mycobacterium
DSGAIRYVMRNEGLATGGITPTAV

SEQ ID NO: 1351256 - protein, 20 aa, Mycobacterium
DSGFPATITLAAVPAENSAD

SEQ ID NO: 1351257 - protein, 18 aa, Mycobacterium
DSGTRLGPGGAFLQPALE

SEQ ID NO: 1351258 - protein, 22 aa, Mycobacterium
DSLRYYPGFAGGALDTLRRSES

SEQ ID NO: 1351259 - protein, 18 aa, Mycobacterium
DSLWLRPAPGHTPGSTMV

SEQ ID NO: 1351260 - protein, 25 aa, Mycobacterium
DSPGPVWGRGDVVAYVDAAPSRPLI

SEQ ID NO: 1351261 - protein, 17 aa, Mycobacterium
DSRTDLFGTVRNLQVLV

SEQ ID NO: 1351262 - protein, 26 aa, Mycobacterium
DSSSPRIVPFFGDYFLLHEAKSDMVN

SEQ ID NO: 1351263 - protein, 25 aa, Mycobacterium
DSTHMGRYMGIPDLLIEAPTRETED

SEQ ID NO: 1351264 - protein, 17 aa, Mycobacterium
DSTNRLLAIVGQRNQTL

SEQ ID NO: 1351265 - protein, 22 aa, Mycobacterium
DTAEGVGFRNPWSGETAVVKGV

SEQ ID NO: 1351266 - protein, 23 aa, Mycobacterium
DTALERFDRFAVATYVHGPGISL

SEQ ID NO: 1351267 - protein, 18 aa, Mycobacterium
DTAPVSRRDIAVTHNDAD

SEQ ID NO: 1351268 - protein, 17 aa, Mycobacterium
DTARFLVYERIQALLEA

SEQ ID NO: 1351269 - protein, 30 aa, Mycobacterium
DTDRRFPGAVWSFSIGWGCDKLITAADLAP

SEQ ID NO: 1351270 - protein, 26 aa, Mycobacterium
DTFVVGLLRTLRWINEETGIKILSGI

SEQ ID NO: 1351271 - protein, 25 aa, Mycobacterium
DTGACAGAKCTGIYGPPGSRVEIPT

SEQ ID NO: 1351272 - protein, 18 aa, Mycobacterium
DTGLYFPVIVDDPNEPGD

SEQ ID NO: 1351273 - protein, 17 aa, Mycobacterium
DTILGRKNIEIEPRGSE

SEQ ID NO: 1351274 - protein, 17 aa, Mycobacterium
DTIVLRRSRPLEISTDG

SEQ ID NO: 1351275 - protein, 20 aa, Mycobacterium
DTLGRLFASLGTDVGFEVTA

SEQ ID NO: 1351276 - protein, 19 aa, Mycobacterium
DTLHPDRIVLGVDSSRSSA

SEQ ID NO: 1351277 - protein, 21 aa, Mycobacterium
DTPIVSRLPWFALSDPAVTQM

SEQ ID NO: 1351278 - protein, 22 aa, Mycobacterium
DTPLSRASVVSVHPGSGDASAL

SEQ ID NO: 1351279 - protein, 20 aa, Mycobacterium
DTPRPGPCAVGSVKSNIGHL

SEQ ID NO: 1351280 - protein, 28 aa, Mycobacterium
DTQLRWRPQDFWPAGTVVTIDAAGTKST

SEQ ID NO: 1351281 - protein, 25 aa, Mycobacterium
DTRLKAGSAVTGWPGEPMTAMPDAE

SEQ ID NO: 1351282 - protein, 20 aa, Mycobacterium
DTRTGAVALDGEREIARSAD

SEQ ID NO: 1351283 - protein, 21 aa, Mycobacterium
DTRTVLGFCLSVIHNGEVRGQ

SEQ ID NO: 1351284 - protein, 17 aa, Mycobacterium
DTSVLLGRLDLKLFAGA

SEQ ID NO: 1351285 - protein, 17 aa, Mycobacterium
DTTRPTPTVAQFLNASA

SEQ ID NO: 1351286 - protein, 20 aa, Mycobacterium
DTVLCTLGYVDPQTRIGYTA

SEQ ID NO: 1351287 - protein, 23 aa, Mycobacterium
DTVPEAYQALIIRDEDGNPIRIL

SEQ ID NO: 1351288 - protein, 18 aa, Mycobacterium
DVAAGLGGQGLEGVAVDG

SEQ ID NO: 1351289 - protein, 25 aa, Mycobacterium
DVAMMKVSVQWPYSANLHCEILIDD

SEQ ID NO: 1351290 - protein, 25 aa, Mycobacterium
DVDAECPGATWAMATRRAAVFGCAS

SEQ ID NO: 1351291 - protein, 19 aa, Mycobacterium
DVDPRWSALLSDTAAIEDP

SEQ ID NO: 1351292 - protein, 17 aa, Mycobacterium
DVDVAGRTVIEKDANSS

SEQ ID NO: 1351293 - protein, 23 aa, Mycobacterium
DVEGTPNFIARKTVVIPAPEHTY

SEQ ID NO: 1351294 - protein, 18 aa, Mycobacterium
DVELPVELGGGMMNYDWT

SEQ ID NO: 1351295 - protein, 19 aa, Mycobacterium
DVERDLGAGLPPVVDPESD

SEQ ID NO: 1351296 - protein, 25 aa, Mycobacterium
DVIAHPLDLFVAALIDTLQRNGVPQ

SEQ ID NO: 1351297 - protein, 17 aa, Mycobacterium
DVIEEVRTAGAGWPDKF

SEQ ID NO: 1351298 - protein, 24 aa, Mycobacterium
DVLAACLRSGMPVASAAAAVAESA

SEQ ID NO: 1351299 - protein, 18 aa, Mycobacterium
DVLDLTWVDSTGVTRDGK

SEQ ID NO: 1351300 - protein, 18 aa, Mycobacterium
DVLFNIAGVFPAGDGDVA

SEQ ID NO: 1351301 - protein, 25 aa, Mycobacterium
DVPDGLRCGNVYYGPIIPTLDVYSW

SEQ ID NO: 1351302 - protein, 18 aa, Mycobacterium
DVPYPAWDTYGYGPAFVG

SEQ ID NO: 1351303 - protein, 22 aa, Mycobacterium
DVRLRTPVPPGRVRDIQVVLQD

SEQ ID NO: 1351304 - protein, 19 aa, Mycobacterium
DVRTARIVTPRVMQVTLRG

SEQ ID NO: 1351305 - protein, 23 aa, Mycobacterium
DVRTRVLAMNAIDARSRFDNPPR

SEQ ID NO: 1351306 - protein, 18 aa, Mycobacterium
DVTPRLEFQGARRVVTFM

SEQ ID NO: 1351307 - protein, 24 aa, Mycobacterium
DVTPTVLSLFGFEPAEDSDGVPLT

SEQ ID NO: 1351308 - protein, 21 aa, Mycobacterium
DVVTDIGIKQAIALRVGLPSV

SEQ ID NO: 1351309 - protein, 23 aa, Mycobacterium
DVYSVARYWANYVALDLGPWLLN

SEQ ID NO: 1351310 - protein, 20 aa, Mycobacterium
DWLSRPWGNGALKGKPVAVI

SEQ ID NO: 1351311 - protein, 32 aa, Mycobacterium
DWNDVSAYYPAGGRWNDWARFFHAHSLNGFAY

SEQ ID NO: 1351312 - protein, 19 aa, Mycobacterium
DWPDRPDNWISVANAIVGL

SEQ ID NO: 1351313 - protein, 17 aa, Mycobacterium
DYARPEVHFDRADDAFT

SEQ ID NO: 1351314 - protein, 23 aa, Mycobacterium
DYIRRHISAPLGMAETSFPTDAT

SEQ ID NO: 1351315 - protein, 23 aa, Mycobacterium
DYLATRVSHQFNLRGPSVTVQTA

SEQ ID NO: 1351316 - protein, 17 aa, Mycobacterium
DYREMAAQLVADRPTLR

SEQ ID NO: 1351317 - protein, 24 aa, Mycobacterium
DYVQPGTEVELIFVAANTSPDVAD

SEQ ID NO: 1351318 - protein, 27 aa, Mycobacterium
EAAAMRRMLLVLGFPDHRIIVEDRANS

SEQ ID NO: 1351319 - protein, 20 aa, Mycobacterium
EAAARAGAALVITPEYNGTI

SEQ ID NO: 1351320 - protein, 32 aa, Mycobacterium
EAAYDLKNEFADFVFRSIFENLNLAAFAQAAG

SEQ ID NO: 1351321 - protein, 21 aa, Mycobacterium
EAAYGCWARHQAGALLLTDEL

SEQ ID NO: 1351322 - protein, 18 aa, Mycobacterium
EADARRAAQTAAEERHRA

SEQ ID NO: 1351323 - protein, 24 aa, Mycobacterium
EADLEPGQKWTGFHRLEKDLWVTG

SEQ ID NO: 1351324 - protein, 18 aa, Mycobacterium
EADLGVDLSQGFHDYGMD

SEQ ID NO: 1351325 - protein, 17 aa, Mycobacterium
EADRPVVLTTFTVLADI

SEQ ID NO: 1351326 - protein, 31 aa, Mycobacterium
EADSAWVMRETLAWMYRYVKDDGSQDDVVFE

SEQ ID NO: 1351327 - protein, 26 aa, Mycobacterium
EAEKMLPKFLWERPDTVAKVGLDGLA

SEQ ID NO: 1351328 - protein, 30 aa, Mycobacterium; identical to SEQ ID NO: 1119699

SEQ ID NO: 1351329 - protein, 26 aa, Mycobacterium
EAGGLRAGAAVQVFGTRVGQVSSIEL

SEQ ID NO: 1351330 - protein, 18 aa, Mycobacterium
EAGIPGAIVGIWGPGGDY

SEQ ID NO: 1351331 - protein, 18 aa, Mycobacterium
EAGQGGWRTVPGSERDAG

SEQ ID NO: 1351332 - protein, 19 aa, Mycobacterium
EAGQGRWRTVPGSERDAGH

SEQ ID NO: 1351333 - protein, 17 aa, Mycobacterium
EALIAPLIEQFTADTGI

SEQ ID NO: 1351334 - protein, 33 aa, Mycobacterium
EALNLEWAQHGIRVIDMWPLYVNTAMTQGVKTG

SEQ ID NO: 1351335 - protein, 26 aa, Mycobacterium
EALPDGRAAIRLAMDPSQLAIIPSNV

SEQ ID NO: 1351336 - protein, 25 aa, Mycobacterium
EALSSYKVPTRWVIASSEQIPTLPS

SEQ ID NO: 1351337 - protein, 18 aa, Mycobacterium
EALVKNGWSDAFMTGEPF

SEQ ID NO: 1351338 - protein, 24 aa, Mycobacterium
EAPDAGTLASLIVRIAEADQSLHD

SEQ ID NO: 1351339 - protein, 20 aa, Mycobacterium
EAPDPKRRLVEIADEVAARL

SEQ ID NO: 1351340 - protein, 22 aa, Mycobacterium
EAPKVLPKTLARNILPDLQANR

SEQ ID NO: 1351341 - protein, 18 aa, Mycobacterium
EAPVEPRVPPLAEQPPGV

SEQ ID NO: 1351342 - protein, 26 aa, Mycobacterium
EAQFWKRKLSSYGDGTVKDCLSAIIS

SEQ ID NO: 1351343 - protein, 17 aa, Mycobacterium
EAQGHRVVVNRLSGTPL

SEQ ID NO: 1351344 - protein, 20 aa, Mycobacterium
EAQLDRFLLKLTVPLPPRDQ

SEQ ID NO: 1351345 - protein, 18 aa, Mycobacterium
EATVLHWSDYAQMARETG

SEQ ID NO: 1351346 - protein, 33 aa, Mycobacterium
EAVAAGPFFKAYVANLLPGQFIQPFVDAAFSDL

SEQ ID NO: 1351347 - protein, 19 aa, Mycobacterium
ECNEWWDFDADIDIDPGPP

SEQ ID NO: 1351348 - protein, 21 aa, Mycobacterium
ECVARFGRLDVLANIAGFHKM

SEQ ID NO: 1351349 - protein, 18 aa, Mycobacterium
ECYHCSSIHPELVDVLPE

SEQ ID NO: 1351350 - protein, 17 aa, Mycobacterium
EDAEAFEALSPGRAHAR

SEQ ID NO: 1351351 - protein, 22 aa, Mycobacterium
EDARIPAVAAILARQIAIAPAA

SEQ ID NO: 1351352 - protein, 18 aa, Mycobacterium
EDEFGYRSIYVAYTAGDT

SEQ ID NO: 1351353 - protein, 29 aa, Mycobacterium
EDFARAKDLGMLSMWSVNRDKPGNLGQAT

SEQ ID NO: 1351354 - protein, 19 aa, Mycobacterium
EDFLTNVIRPFNARMSQRL

SEQ ID NO: 1351355 - protein, 18 aa, Mycobacterium
EDGPVIGIDPIGTVYASQ

SEQ ID NO: 1351356 - protein, 17 aa, Mycobacterium
EDLNALFLPPAPAAPAA

SEQ ID NO: 1351357 - protein, 19 aa, Mycobacterium
EDRLRPGHIPPVPDTPPPA

SEQ ID NO: 1351358 - protein, 17 aa, Mycobacterium
EEFPDPMRLHGGTLCSD

SEQ ID NO: 1351359 - protein, 24 aa, Mycobacterium
EEGRVREVLRAHFAGWTPGVQTLI

SEQ ID NO: 1351360 - protein, 20 aa, Mycobacterium
EEKFGVQIRQLWGMTETSPV

SEQ ID NO: 1351361 - protein, 18 aa, Mycobacterium
EEKKACVGIAGTAEAQAY

SEQ ID NO: 1351362 - protein, 21 aa, Mycobacterium
EEVLLMPRWVKCRRATFKYGL

SEQ ID NO: 1351363 - protein, 19 aa, Mycobacterium
EEYLILGACNPPLAHRAVN

SEQ ID NO: 1351364 - protein, 20 aa, Mycobacterium
EFDSPAQISNIWNAEIVSQV

SEQ ID NO: 1351365 - protein, 24 aa, Mycobacterium
EFDTPAQISNIWNAEIVSRVGNHY

SEQ ID NO: 1351366 - protein, 24 aa, Mycobacterium
EFEKYAAYVAWKYGDQVDNWATLN

SEQ ID NO: 1351367 - protein, 28 aa, Mycobacterium
EFKAFSAVCTHAGCTVSEVIGASITCPC

SEQ ID NO: 1351368 - protein, 26 aa, Mycobacterium
EFPAEQFDRLVAINIGGMYWTTRTAI

SEQ ID NO: 1351369 - protein, 20 aa, Mycobacterium
EFTPLALIPNWIKPLYSWFT

SEQ ID NO: 1351370 - protein, 19 aa, Mycobacterium
EGAARAHGSLDFLFNNAGV

SEQ ID NO: 1351371 - protein, 17 aa, Mycobacterium
EGACVRVSWVKVDPSHV

SEQ ID NO: 1351372 - protein, 18 aa, Mycobacterium
EGADELFGGYTIYREPLS

SEQ ID NO: 1351373 - protein, 23 aa, Mycobacterium
EGHCSTSLLVNRATGAAVISTAY

SEQ ID NO: 1351374 - protein, 19 aa, Mycobacterium
EGKVRSVFEPVVKTTVIAP

SEQ ID NO: 1351375 - protein, 20 aa, Mycobacterium
EGPAQAWLLADLDSGRVLAS

SEQ ID NO: 1351376 - protein, 19 aa, Mycobacterium
EGQHLYWVVGDNTQGVVNS

SEQ ID NO: 1351377 - protein, 19 aa, Mycobacterium
EGQNLFAQGGVRPVRADNM

SEQ ID NO: 1351378 - protein, 22 aa, Mycobacterium
EGRGRPAAVCARADGAPFSTSP

SEQ ID NO: 1351379 - protein, 32 aa, Mycobacterium
EGTLELGYQVGFPWSLGVSINFSYTTPNIAFD

SEQ ID NO: 1351380 - protein, 24 aa, Mycobacterium
EGVAAKPDGGFVLAVEGEEGPGNE

SEQ ID NO: 1351381 - protein, 22 aa, Mycobacterium
EGVLPIPSRELVVISSEADDAE

SEQ ID NO: 1351382 - protein, 17 aa, Mycobacterium
EIGALSAVYGRGRADNP

SEQ ID NO: 1351383 - protein, 25 aa, Mycobacterium
EIGRMYRPTLPRAFFIKPDGEMTVN

SEQ ID NO: 1351384 - protein, 19 aa, Mycobacterium
EILTRYLNLVSFGNGAFGI

SEQ ID NO: 1351385 - protein, 21 aa, Mycobacterium
EIPFTLSFKEPLPIPVDQYPL

SEQ ID NO: 1351386 - protein, 19 aa, Mycobacterium
EIRQDWYALYAKAFEDMDK

SEQ ID NO: 1351387 - protein, 23 aa, Mycobacterium
EITYSEPWMRPDYVPPAVPPAPE

SEQ ID NO: 1351388 - protein, 26 aa, Mycobacterium
EIVGMSVELMMRWSSRGIAIKARTAE

SEQ ID NO: 1351389 - protein, 17 aa, Mycobacterium
EKATGIVGWPAFTQRMR

SEQ ID NO: 1351390 - protein, 17 aa, Mycobacterium
EKEFDRYQPATVPGAEW

SEQ ID NO: 1351391 - protein, 17 aa, Mycobacterium
EKMKELVEEQGVDPAVA

SEQ ID NO: 1351392 - protein, 24 aa, Mycobacterium
EKPAEGDWLYFVTIDLQGTTLFTR

SEQ ID NO: 1351393 - protein, 19 aa, Mycobacterium
EKPRELWRSYAESPDSVEG

SEQ ID NO: 1351394 - protein, 20 aa, Mycobacterium
ELAARLWDLPGWAATGRELL

SEQ ID NO: 1351395 - protein, 20 aa, Mycobacterium
ELAGAIAFASPLSYPLVADR

SEQ ID NO: 1351396 - protein, 25 aa, Mycobacterium
ELAPDPWLSEVFRAEMTRVGRTPVA

SEQ ID NO: 1351397 - protein, 28 aa, Mycobacterium
ELGMNTFRMGIEWSRIFPESTAAVDISD

SEQ ID NO: 1351398 - protein, 19 aa, Mycobacterium
ELGTIAFPIAHIGGMVYLA

SEQ ID NO: 1351399 - protein, 19 aa, Mycobacterium
ELHFGRAAERLHMTQPPLS

SEQ ID NO: 1351400 - protein, 20 aa, Mycobacterium
ELHPLLNPAAYVWADVDPGF

SEQ ID NO: 1351401 - protein, 26 aa, Mycobacterium
ELIDPAAGPEFGFSLAGPIGALLLWR

SEQ ID NO: 1351402 - protein, 24 aa, Mycobacterium
ELKEAAKAKGAKVFDSGAAAVADA

SEQ ID NO: 1351403 - protein, 20 aa, Mycobacterium
ELLEVPGRVVNAVLQVFGFT

SEQ ID NO: 1351404 - protein, 20 aa, Mycobacterium
ELLREHPLPNTGRVVVTGSP

SEQ ID NO: 1351405 - protein, 20 aa, Mycobacterium
ELNAAVNPIQTWIEVFGQAA

SEQ ID NO: 1351406 - protein, 25 aa, Mycobacterium
ELPPPEGVTAEWIVRNHGEAGIHQS

SEQ ID NO: 1351407 - protein, 19 aa, Mycobacterium
ELPRADLVAGPNTYAASDR

SEQ ID NO: 1351408 - protein, 26 aa, Mycobacterium
ELQLPVLRAQLRWMEAVLAMWIGDFA

SEQ ID NO: 1351409 - protein, 19 aa, Mycobacterium
ELREGVWMRPANVDLELGP

SEQ ID NO: 1351410 - protein, 17 aa, Mycobacterium
ELRFVYIGDPARPSGGV

SEQ ID NO: 1351411 - protein, 19 aa, Mycobacterium
ELSGLNLGKVISISESGGP

SEQ ID NO: 1351412 - protein, 22 aa, Mycobacterium
ELSIEWPYGSNLHCEILVDDQV

SEQ ID NO: 1351413 - protein, 24 aa, Mycobacterium
ELYEIDYADGLRIARTLRTQVSPG

SEQ ID NO: 1351414 - protein, 21 aa, Mycobacterium
EMKTPMGVFTLDFAFGTEPNP

SEQ ID NO: 1351415 - protein, 18 aa, Mycobacterium
EMSVAWNDHLNKFVMLYT

SEQ ID NO: 1351416 - protein, 18 aa, Mycobacterium
ENAADRFIDPSGVDCTSL

SEQ ID NO: 1351417 - protein, 24 aa, Mycobacterium
ENGDTYRVLFGVATEQGVNPSTLA

SEQ ID NO: 1351418 - protein, 21 aa, Mycobacterium
ENGYIPIPEAFKTRLTEAVDA

SEQ ID NO: 1351419 - protein, 18 aa, Mycobacterium
ENLREHRRGLLVDVVTDV

SEQ ID NO: 1351420 - protein, 18 aa, Mycobacterium
ENLVLRYHRERALPAVAM

SEQ ID NO: 1351421 - protein, 19 aa, Mycobacterium
ENMREHRRGLLVDVVTDVK

SEQ ID NO: 1351422 - protein, 25 aa, Mycobacterium
ENSFPSGAIESFFDGYPAGGTTGIF

SEQ ID NO: 1351423 - protein, 25 aa, Mycobacterium
ENVKAAEKISAAWLNDMFTGTQASG

SEQ ID NO: 1351424 - protein, 23 aa, Mycobacterium
ENYDYAAALAQWMEDEAAKIAAQ

SEQ ID NO: 1351425 - protein, 21 aa, Mycobacterium
EPAATFAGLAQREMQATTQAA

SEQ ID NO: 1351426 - protein, 19 aa, Mycobacterium
EPALWMPPNTAFHCQYAMQ

SEQ ID NO: 1351427 - protein, 18 aa, Mycobacterium
EPARGSVVHLRWATNGLA

SEQ ID NO: 1351428 - protein, 18 aa, Mycobacterium
EPATAQWLAGMKANAVIY

SEQ ID NO: 1351429 - protein, 19 aa, Mycobacterium
EPDMPALVMTSANQGGSPI

SEQ ID NO: 1351430 - protein, 19 aa, Mycobacterium
EPELAFAEHRSCAKTQALV

SEQ ID NO: 1351431 - protein, 19 aa, Mycobacterium
EPFARAMGPMQFIPETWRL

SEQ ID NO: 1351432 - protein, 20 aa, Mycobacterium
EPFSEERYGIGLKKDDTELR

SEQ ID NO: 1351433 - protein, 23 aa, Mycobacterium
EPFSEPEVFDFPDGIGPVECVNV

SEQ ID NO: 1351434 - protein, 24 aa, Mycobacterium
EPLAPQSEYGWWYQYYFATPRGEL

SEQ ID NO: 1351435 - protein, 18 aa, Mycobacterium
EPLASVLPGGRLYNSYRP

SEQ ID NO: 1351436 - protein, 19 aa, Mycobacterium
EPLFWDRGADEWKIAIQTW

SEQ ID NO: 1351437 - protein, 25 aa, Mycobacterium
EPLNIPYKVAFVLDVAGDNEALVVR

SEQ ID NO: 1351438 - protein, 20 aa, Mycobacterium
EPPAHLVLGSDALRLIAAAR

SEQ ID NO: 1351439 - protein, 31 aa, Mycobacterium
EPPPRPADVYGEWKGGWVDFPGGTLDVGSAH

SEQ ID NO: 1351440 - protein, 25 aa, Mycobacterium
EPQPDRAKVTFGYDRAIQIPADAKA

SEQ ID NO: 1351441 - protein, 27 aa, Mycobacterium
EPQPDRVKVIFWYDARYKVPADANAAV

SEQ ID NO: 1351442 - protein, 24 aa, Mycobacterium
EPSPGVPCLEILQQLAAAPPSVPE

SEQ ID NO: 1351443 - protein, 27 aa, Mycobacterium
EPTAVLSWQSSPGWLTGRVTGRIRAAD

SEQ ID NO: 1351444 - protein, 23 aa, Mycobacterium
EPTRAKFFAPLKPLGAVDVPADE

SEQ ID NO: 1351445 - protein, 18 aa, Mycobacterium
EPTRVAVVREILSQEGNP

SEQ ID NO: 1351446 - protein, 19 aa, Mycobacterium
EPVTAWALFRYDQVFEAAR

SEQ ID NO: 1351447 - protein, 26 aa, Mycobacterium
EPYTAAAVWSSCTPWIADVSRIPTAQ

SEQ ID NO: 1351448 - protein, 19 aa, Mycobacterium
EQATSAWLSAMKANAEIYS

SEQ ID NO: 1351449 - protein, 24 aa, Mycobacterium
EQDRRVREAAPFMAYGEFTGLAPM

SEQ ID NO: 1351450 - protein, 17 aa, Mycobacterium
EQMAAALGGRFKDYTRV

SEQ ID NO: 1351451 - protein, 21 aa, Mycobacterium
EQNIAPIYLGEFGTRMTDPKD

SEQ ID NO: 1351452 - protein, 25 aa, Mycobacterium
EQRLFADAGYAWAPDGQHIAWTGGR

SEQ ID NO: 1351453 - protein, 24 aa, Mycobacterium
EQSAKLCAQYMAPIFKNRQYNFPP

SEQ ID NO: 1351454 - protein, 23 aa, Mycobacterium
EQSPRPGKGDTFECTADVGGQTV

SEQ ID NO: 1351455 - protein, 21 aa, Mycobacterium
EQTVCSGLPGGDLVVAQNVAA

SEQ ID NO: 1351456 - protein, 26 aa, Mycobacterium
EQVATRWGNWAKLFFNNKGVVAHATD

SEQ ID NO: 1351457 - protein, 24 aa, Mycobacterium
EQVEKLRSVFTLRAVEKDADVEPV

SEQ ID NO: 1351458 - protein, 25 aa, Mycobacterium
EQVGELLAGHGWRLVEQAGPSYFRD

SEQ ID NO: 1351459 - protein, 19 aa, Mycobacterium
EQVLLKRCHEEGVQFRWKT

SEQ ID NO: 1351460 - protein, 19 aa, Mycobacterium
EQVVCLRHCLPPSGCTGDC

SEQ ID NO: 1351461 - protein, 24 aa, Mycobacterium
ERARRAQGVTIRRAPAPNWYHLTL

SEQ ID NO: 1351462 - protein, 21 aa, Mycobacterium
ERASTCMSEFVVGDQYLIDVA

SEQ ID NO: 1351463 - protein, 26 aa, Mycobacterium
ERATPPWWPMRRLVRALGADADEVLE

SEQ ID NO: 1351464 - protein, 26 aa, Mycobacterium
ERECREVYYQYILPLGTFEPGLAENV

SEQ ID NO: 1351465 - protein, 26 aa, Mycobacterium
ERGLPGRGVVVLCDFGATGTTITLVD

SEQ ID NO: 1351466 - protein, 20 aa, Mycobacterium
ERPFVPLIPTLGIPGDIADA

SEQ ID NO: 1351467 - protein, 17 aa, Mycobacterium
ERPPAADQLLGFYRKAE

SEQ ID NO: 1351468 - protein, 19 aa, Mycobacterium
ERPPGRRPDAVFCANDLLA

SEQ ID NO: 1351469 - protein, 27 aa, Mycobacterium
ERRLNKLRPVYAWRRWALYFDYDRRQL

SEQ ID NO: 1351470 - protein, 19 aa, Mycobacterium
ERYFWSRGGDMADKLQLAR

SEQ ID NO: 1351471 - protein, 26 aa, Mycobacterium
ESCADARPSPPASFCPATNTIVVDLP

SEQ ID NO: 1351472 - protein, 20 aa, Mycobacterium
ESFFGFAALDYGLRLNAMQA

SEQ ID NO: 1351473 - protein, 25 aa, Mycobacterium
ESGAPAGPAVHEIGQQADLVNGSVV

SEQ ID NO: 1351474 - protein, 17 aa, Mycobacterium
ESGQWDPTLPKLISAGA

SEQ ID NO: 1351475 - protein, 17 aa, Mycobacterium
ESGRITSVLALSALING

SEQ ID NO: 1351476 - protein, 24 aa, Mycobacterium
ESKGYKVILNKVGSAPLEQCTVSG

SEQ ID NO: 1351477 - protein, 19 aa, Mycobacterium
ESLHPYVDWATVRAPAEET

SEQ ID NO: 1351478 - protein, 25 aa, Mycobacterium
ESLLRAAGVLDDLPYKIAFSTFTSG

SEQ ID NO: 1351479 - protein, 26 aa, Mycobacterium
ESRRALPAMREYLAATGRYTFLSSTE

SEQ ID NO: 1351480 - protein, 17 aa, Mycobacterium
ESTGYTAVLTRLASEPG

SEQ ID NO: 1351481 - protein, 23 aa, Mycobacterium
ESTWVFDAPFFLLLNLAVGGNWP

SEQ ID NO: 1351482 - protein, 17 aa, Mycobacterium
ETQRGTVLAALRDTGFV

SEQ ID NO: 1351483 - protein, 24 aa, Mycobacterium
ETWAKVFYHSLGLGTSARFVDGRA

SEQ ID NO: 1351484 - protein, 25 aa, Mycobacterium
EVAELQGRVTPLAQWGYGENWSAQP

SEQ ID NO: 1351485 - protein, 26 aa, Mycobacterium
EVANAVRFGFWGAEEEGLLGSRDYVT

SEQ ID NO: 1351486 - protein, 17 aa, Mycobacterium
EVAPFLSYGPFTGFAPR

SEQ ID NO: 1351487 - protein, 18 aa, Mycobacterium
EVARRWGGALNILVNTVG

SEQ ID NO: 1351488 - protein, 21 aa, Mycobacterium
EVCSGGRTCSSVPYPYLLRAE

SEQ ID NO: 1351489 - protein, 22 aa, Mycobacterium
EVDQVFRRELGFSARGALASGE

SEQ ID NO: 1351490 - protein, 20 aa, Mycobacterium
EVHAGLFGLLKHGSWSAWHQ

SEQ ID NO: 1351491 - protein, 17 aa, Mycobacterium
EVHPDFWHEDEFGYRSI

SEQ ID NO: 1351492 - protein, 25 aa, Mycobacterium
EVITRGGAHYPYWHLVLAPGSCAVP

SEQ ID NO: 1351493 - protein, 28 aa, Mycobacterium
EVLELNLSSAWYLSRAAAKPMIAQGKGA

SEQ ID NO: 1351494 - protein, 17 aa, Mycobacterium
EVNGYFAEMGRVAVELG

SEQ ID NO: 1351495 - protein, 24 aa, Mycobacterium
EVPAELKTNWLPEGQYANVIQYPD

SEQ ID NO: 1351496 - protein, 28 aa, Mycobacterium
EVPLPVASLIRDRFLTLLAGGGRDLDWS

SEQ ID NO: 1351497 - protein, 19 aa, Mycobacterium
EVPSAAMGRNIRVQFQGGG

SEQ ID NO: 1351498 - protein, 22 aa, Mycobacterium
EVSGSLLRRKFGLATKAMEPLR

SEQ ID NO: 1351499 - protein, 25 aa, Mycobacterium
EVSGSLLRRRFWPSTQVMKPLRRAV

SEQ ID NO: 1351500 - protein, 25 aa, Mycobacterium
EVTEAGGTLGLRVGPRGEVWPLKHW

SEQ ID NO: 1351501 - protein, 25 aa, Mycobacterium
EVTLDARTGAFIYTPTSVARHQASA

SEQ ID NO: 1351502 - protein, 21 aa, Mycobacterium
EVWGVGSLRQLQSWLAGKGDL

SEQ ID NO: 1351503 - protein, 23 aa, Mycobacterium
EWAEGRRYLGLDILARCRLTTIT

SEQ ID NO: 1351504 - protein, 20 aa, Mycobacterium
EWALPDTLLLHDKWSAAGGA

SEQ ID NO: 1351505 - protein, 20 aa, Mycobacterium
EWNNGGSVATNITVTGGAAS

SEQ ID NO: 1351506 - protein, 22 aa, Mycobacterium
EWTFTLRDGVTFSDGAPFTSAD

SEQ ID NO: 1351507 - protein, 25 aa, Mycobacterium
EWVLGPYFEGEFVKGANRVIATQSD

SEQ ID NO: 1351508 - protein, 19 aa, Mycobacterium
EWVPPDALLSFAEKLVEAK

SEQ ID NO: 1351509 - protein, 20 aa, Mycobacterium
EYGHAISRLAGLTKKDTPTL

SEQ ID NO: 1351510 - protein, 20 aa, Mycobacterium
EYGSALDAAMTWQRDGAEWI

SEQ ID NO: 1351511 - protein, 20 aa, Mycobacterium
EYLERVAYDWDLPRRIRFNE

SEQ ID NO: 1351512 - protein, 18 aa, Mycobacterium
EYLILGACNPPLAHRAVN

SEQ ID NO: 1351513 - protein, 18 aa, Mycobacterium
EYPDRAAWDAALADATAA

SEQ ID NO: 1351514 - protein, 20 aa, Mycobacterium
EYQIPAGVHAAIISPQLVTA

SEQ ID NO: 1351515 - protein, 21 aa, Mycobacterium
EYTARCDVAGCAVSMDNSDDL

SEQ ID NO: 1351516 - protein, 18 aa, Mycobacterium
EYYRVVGEILADAAPLSQ

SEQ ID NO: 1351517 - protein, 17 aa, Mycobacterium
FAALFAVVALVAGCSGS

SEQ ID NO: 1351518 - protein, 27 aa, Mycobacterium
FAAPLLGVLCSIGWQRGKPSVTVQAEP

SEQ ID NO: 1351519 - protein, 18 aa, Mycobacterium
FAATACGGGDGGGGGAGG

SEQ ID NO: 1351520 - protein, 18 aa, Mycobacterium
FADAEAMFEALRAGQLDV

SEQ ID NO: 1351521 - protein, 30 aa, Mycobacterium
FADHVSFPFRMGFARVYGLFAERGLTDRVT

SEQ ID NO: 1351522 - protein, 17 aa, Mycobacterium
FAERGATVFGVARDGSR

SEQ ID NO: 1351523 - protein, 18 aa, Mycobacterium
FAFAGVGVLLPRWSGDQY

SEQ ID NO: 1351524 - protein, 19 aa, Mycobacterium
FAFRVTRTAALPFVLALAA

SEQ ID NO: 1351525 - protein, 18 aa, Mycobacterium
FAGPYLITGQSLLVRSDN

SEQ ID NO: 1351526 - protein, 27 aa, Mycobacterium
FAMFAIFAQLRFQSERTYRAVFTNVSG

SEQ ID NO: 1351527 - protein, 22 aa, Mycobacterium
FANRRLLAGIAHGLRVRGLEVL

SEQ ID NO: 1351528 - protein, 18 aa, Mycobacterium
FAPCARLLMDNLDAAGHG

SEQ ID NO: 1351529 - protein, 17 aa, Mycobacterium
FAPSFSIWTTIEECLNP

SEQ ID NO: 1351530 - protein, 30 aa, Mycobacterium; identical to SEQ ID NO: 1119773

SEQ ID NO: 1351531 - protein, 21 aa, Mycobacterium
FAQRVASFVSNNYGKTVANAQ

SEQ ID NO: 1351532 - protein, 23 aa, Mycobacterium
FARPEQAVRCGLAIQHSLDKRPN

SEQ ID NO: 1351533 - protein, 25 aa, Mycobacterium
FASSCSTAAAALRVSLADADRGPAC

SEQ ID NO: 1351534 - protein, 19 aa, Mycobacterium
FATACTVSAVAPQHAAVSA

SEQ ID NO: 1351535 - protein, 26 aa, Mycobacterium
FAVDLPRIIGNALKPATPALAKVAST

SEQ ID NO: 1351536 - protein, 23 aa, Mycobacterium
FDANRVLGALPHVAMRDGYTLDY

SEQ ID NO: 1351537 - protein, 17 aa, Mycobacterium
FDGEFCGEDTYGLINAG

SEQ ID NO: 1351538 - protein, 18 aa, Mycobacterium
FDGPDLILPGGYRQLIDH

SEQ ID NO: 1351539 - protein, 17 aa, Mycobacterium
FDGVFRFNSDLVDLLAR

SEQ ID NO: 1351540 - protein, 27 aa, Mycobacterium
FDITVSDGWGGIVAVPVTVRIRPANSA

SEQ ID NO: 1351541 - protein, 22 aa, Mycobacterium
FDLPTAVKVVAQRARLMHASPS

SEQ ID NO: 1351542 - protein, 25 aa, Mycobacterium
FDLTLSRLDSGFFTGTRWEGDLTEL

SEQ ID NO: 1351543 - protein, 17 aa, Mycobacterium
FDLVDAYGADTVRFNIE

SEQ ID NO: 1351544 - protein, 24 aa, Mycobacterium
FDMRRRATMYLTYWTAGDTRNRGQ

SEQ ID NO: 1351545 - protein, 18 aa, Mycobacterium
FDNLPGLVTPLTVEGYLF

SEQ ID NO: 1351546 - protein, 17 aa, Mycobacterium
FDQNSGWHRDVGERQSG

SEQ ID NO: 1351547 - protein, 24 aa, Mycobacterium
FDRAARLGVHVSLAPFQYYYWGDL

SEQ ID NO: 1351548 - protein, 21 aa, Mycobacterium
FDSAPYGWPVEKGSPLAQSLL

SEQ ID NO: 1351549 - protein, 18 aa, Mycobacterium
FDYREMAAQLVADRPTLR

SEQ ID NO: 1351550 - protein, 26 aa, Mycobacterium
FEGSWRVNCLGPFLGIQASLPHLREA

SEQ ID NO: 1351551 - protein, 25 aa, Mycobacterium
FETPQWAKDGWLVNLSDYAENTPGY

SEQ ID NO: 1351552 - protein, 17 aa, Mycobacterium
FEVLTARDGMDDWPVQP

SEQ ID NO: 1351553 - protein, 32 aa, Mycobacterium
FFATAADDWARCDGETVVLDRGGPGAGEQSSI

SEQ ID NO: 1351554 - protein, 20 aa, Mycobacterium
FFDRSSVTWQDCANATITTG

SEQ ID NO: 1351555 - protein, 18 aa, Mycobacterium
FFGFPPQMARMMDPQHRL

SEQ ID NO: 1351556 - protein, 17 aa, Mycobacterium
FFHAHSLNGFAYGFPYD

SEQ ID NO: 1351557 - protein, 17 aa, Mycobacterium
FFRAPLVSLPGAAQALE

SEQ ID NO: 1351558 - protein, 24 aa, Mycobacterium
FFRPDLLGPCAKFVSPFGGPGFMP

SEQ ID NO: 1351559 - protein, 30 aa, Mycobacterium
FFTGSRWECDLTWLELQWGRTIGQFPNPCN

SEQ ID NO: 1351560 - protein, 17 aa, Mycobacterium
FFVPRPILKAIDAPLRV

SEQ ID NO: 1351561 - protein, 27 aa, Mycobacterium
FGAALPDKFEQMWGYIYEQNIAPIYLG

SEQ ID NO: 1351562 - protein, 27 aa, Mycobacterium
FGADSFPSEVIGEFFDGGPVAVVAIAS

SEQ ID NO: 1351563 - protein, 23 aa, Mycobacterium
FGAFRELERHLGLWQTPAPQPVV

SEQ ID NO: 1351564 - protein, 23 aa, Mycobacterium
FGAFRRRRVRPLVRESAAIGRIV

SEQ ID NO: 1351565 - protein, 18 aa, Mycobacterium
FGASFALTAPPAMAAPPT

SEQ ID NO: 1351566 - protein, 17 aa, Mycobacterium
FGASTSFVASVPIYATN

SEQ ID NO: 1351567 - protein, 28 aa, Mycobacterium
FGDLLNRLVPPYTIEPGPDYVMTKAQVA

SEQ ID NO: 1351568 - protein, 21 aa, Mycobacterium
FGEGITVVGDRIWQLTYRDEV

SEQ ID NO: 1351569 - protein, 25 aa, Mycobacterium
FGFGTASLFAGGWVLRALQGTPAAL

SEQ ID NO: 1351570 - protein, 18 aa, Mycobacterium
FGGSLALGVARRYPEDVA

SEQ ID NO: 1351571 - protein, 17 aa, Mycobacterium
FGIGRVVARINEASNEW

SEQ ID NO: 1351572 - protein, 22 aa, Mycobacterium
FGLERLESGLARNTVSASDVDD

SEQ ID NO: 1351573 - protein, 17 aa, Mycobacterium
FGLLDKVVLVFDEPFWT

SEQ ID NO: 1351574 - protein, 19 aa, Mycobacterium
FGMESDIFTPHGLWTRNYK

SEQ ID NO: 1351575 - protein, 23 aa, Mycobacterium
FGNPSARFGRPLTVLSPDFGART

SEQ ID NO: 1351576 - protein, 18 aa, Mycobacterium
FGSFHMVDGFLLNNQLTD

SEQ ID NO: 1351577 - protein, 17 aa, Mycobacterium
FGTALKVTLQVAPEVLN

SEQ ID NO: 1351578 - protein, 20 aa, Mycobacterium
FIALTPPATVSKLLIRVAET

SEQ ID NO: 1351579 - protein, 20 aa, Mycobacterium
FICGAIQAASRHGAEQSAKL

SEQ ID NO: 1351580 - protein, 17 aa, Mycobacterium
FISEPSTALSALQAGEI

SEQ ID NO: 1351581 - protein, 17 aa, Mycobacterium
FKGRVSLFSDAQDGLGM

SEQ ID NO: 1351582 - protein, 20 aa, Mycobacterium
FKPLYGTSLVTGWASIHGFP

SEQ ID NO: 1351583 - protein, 22 aa, Mycobacterium
FLADELPNWLAANKGLAPNGHA

SEQ ID NO: 1351584 - protein, 21 aa, Mycobacterium
FLADPFRAWTTHDLLSYATSK

SEQ ID NO: 1351585 - protein, 17 aa, Mycobacterium
FLFWPGLIGAGLVVGVA

SEQ ID NO: 1351586 - protein, 17 aa, Mycobacterium
FLGSALLPRILQRTGGE

SEQ ID NO: 1351587 - protein, 25 aa, Mycobacterium
FLHGGRFSVLLAHHLGAHLEQLRPG

SEQ ID NO: 1351588 - protein, 24 aa, Mycobacterium
FLHGGRFSVLLAQHLGAHLEQLRP

SEQ ID NO: 1351589 - protein, 23 aa, Mycobacterium
FLKDERLLRVFTFQSLYAGVPPQ

SEQ ID NO: 1351590 - protein, 17 aa, Mycobacterium
FLPDKAIDLVDEAASRL

SEQ ID NO: 1351591 - protein, 23 aa, Mycobacterium
FLSQELPAWLEANRGVSRTGNAV

SEQ ID NO: 1351592 - protein, 31 aa, Mycobacterium
FLSVLQRAVSRLVGWPGTPRNFVDVTNYQTD

SEQ ID NO: 1351593 - protein, 23 aa, Mycobacterium
FLTQELPAWLEANRGVSPNGNAV

SEQ ID NO: 1351594 - protein, 17 aa, Mycobacterium
FLTQLGILPQASAPADP

SEQ ID NO: 1351595 - protein, 20 aa, Mycobacterium
FLTTFPWAKELIPKWFRGDF

SEQ ID NO: 1351596 - protein, 17 aa, Mycobacterium
FMAWGVAAGGTAYLAGA

SEQ ID NO: 1351597 - protein, 24 aa, Mycobacterium
FMYEYEIADWGKPVVGELVADAGY

SEQ ID NO: 1351598 - protein, 17 aa, Mycobacterium
FMYRDMGTIGVDVVSWP

SEQ ID NO: 1351599 - protein, 24 aa, Mycobacterium
FNFPNNGTHNWAYWGRELQAMKPD

SEQ ID NO: 1351600 - protein, 17 aa, Mycobacterium
FNFPTSGTHSWGYWGQQ

SEQ ID NO: 1351601 - protein, 18 aa, Mycobacterium
FNTAWICTRAQNQDGQTI

SEQ ID NO: 1351602 - protein, 18 aa, Mycobacterium
FNVADEYQIPAGVHAAII

SEQ ID NO: 1351603 - protein, 19 aa, Mycobacterium
FPAGLLVFGDAICSFNPIY

SEQ ID NO: 1351604 - protein, 17 aa, Mycobacterium
FPDDLDPRIDLREADLE

SEQ ID NO: 1351605 - protein, 17 aa, Mycobacterium
FPDPMRLHGGTLCSDVR

SEQ ID NO: 1351606 - protein, 21 aa, Mycobacterium
FPEGSYRFAQQNPNGGAAVLL

SEQ ID NO: 1351607 - protein, 17 aa, Mycobacterium
FPKETLTNWMRGDYANL

SEQ ID NO: 1351608 - protein, 17 aa, Mycobacterium
FPLTSLLTIPKAMFDAV

SEQ ID NO: 1351609 - protein, 18 aa, Mycobacterium
FPSATARMSTLAAAEPAL

SEQ ID NO: 1351610 - protein, 22 aa, Mycobacterium
FPSDGTHSWNYWGQQLRQMKPD

SEQ ID NO: 1351611 - protein, 22 aa, Mycobacterium
FPTSGTHSWGYWGQQLQQMKPD

SEQ ID NO: 1351612 - protein, 19 aa, Mycobacterium
FPVNGQAKVNLRPGTVTVV

SEQ ID NO: 1351613 - protein, 17 aa, Mycobacterium
FPVVGGIGLMSNRASDV

SEQ ID NO: 1351614 - protein, 23 aa, Mycobacterium
FQGDGYMLLGLEISGLAARYRDD

SEQ ID NO: 1351615 - protein, 23 aa, Mycobacterium
FQNGDILVWGGGTYTTSYGHIGI

SEQ ID NO: 1351616 - protein, 19 aa, Mycobacterium
FQPANAGPWVDRARTEPGM

SEQ ID NO: 1351617 - protein, 17 aa, Mycobacterium
FQRDYFKSGDANCATAA

SEQ ID NO: 1351618 - protein, 18 aa, Mycobacterium
FRAAARRAVDAGMDGVEI

SEQ ID NO: 1351619 - protein, 18 aa, Mycobacterium
FRADGPFVGTGLQGAFLA

SEQ ID NO: 1351620 - protein, 21 aa, Mycobacterium
FRFNSDLVDLLARLGASLRVD

SEQ ID NO: 1351621 - protein, 19 aa, Mycobacterium
FRGAEPGTLLARAVTTELT

SEQ ID NO: 1351622 - protein, 19 aa, Mycobacterium
FRPKDDPLYGVLQCGAPLN

SEQ ID NO: 1351623 - protein, 17 aa, Mycobacterium
FRPLFRALDPEQVNELS

SEQ ID NO: 1351624 - protein, 20 aa, Mycobacterium
FRRHGIDLLLGVTVEHIDVD

SEQ ID NO: 1351625 - protein, 23 aa, Mycobacterium
FRRWLDARCAAAVHLAPGYEHPG

SEQ ID NO: 1351626 - protein, 17 aa, Mycobacterium
FSALGDHSDDLFTTVKN

SEQ ID NO: 1351627 - protein, 25 aa, Mycobacterium
FSEDLPTCVVKFIPLHTPAVTMSFN

SEQ ID NO: 1351628 - protein, 24 aa, Mycobacterium
FSGAWDHYLILNVAVGNPWTGDPD

SEQ ID NO: 1351629 - protein, 22 aa, Mycobacterium
FSGGARVASKWLQDHGSDHEES

SEQ ID NO: 1351630 - protein, 23 aa, Mycobacterium
FSGGARVASVWLDEHADDVDAPD

SEQ ID NO: 1351631 - protein, 19 aa, Mycobacterium
FSGGARVVSKWLQDNAATT

SEQ ID NO: 1351632 - protein, 20 aa, Mycobacterium
FSGPGLRGAVEVVEAPHIDG

SEQ ID NO: 1351633 - protein, 17 aa, Mycobacterium
FSVPHARVEDGELGEPV

SEQ ID NO: 1351634 - protein, 28 aa, Mycobacterium
FSVSNFSNPVWFVCGLIGGVANTTAPET

SEQ ID NO: 1351635 - protein, 19 aa, Mycobacterium
FSVTARLATAQAMAPQSLT

SEQ ID NO: 1351636 - protein, 18 aa, Mycobacterium
FTATMPWAADLPGTQWQH

SEQ ID NO: 1351637 - protein, 22 aa, Mycobacterium
FTCRIGAFTLSYRGWGAGYDTA

SEQ ID NO: 1351638 - protein, 18 aa, Mycobacterium
FTDDRILPQLPRSAGPDG

SEQ ID NO: 1351639 - protein, 20 aa, Mycobacterium
FTGQLLQRFAPDASARADVQ

SEQ ID NO: 1351640 - protein, 17 aa, Mycobacterium
FTGVKIVLDDQVLVGGG

SEQ ID NO: 1351641 - protein, 22 aa, Mycobacterium
FTIPRFPILHLPIGRKPAPKTT

SEQ ID NO: 1351642 - protein, 23 aa, Mycobacterium
FTMVGVPAGGLFSGAEDKMSAEQ

SEQ ID NO: 1351643 - protein, 24 aa, Mycobacterium
FTSPSGRWECAIVPRVRAGCQDTR

SEQ ID NO: 1351644 - protein, 18 aa, Mycobacterium
FTTWTTYDSWHYTNGLGM

SEQ ID NO: 1351645 - protein, 20 aa, Mycobacterium
FTYTPPAIWDPKFQNAAFFH

SEQ ID NO: 1351646 - protein, 18 aa, Mycobacterium
FVADRWTPDKVYSGGYKA

SEQ ID NO: 1351647 - protein, 24 aa, Mycobacterium
FVAGRTQTYLPWDSWKKPYTEPPD

SEQ ID NO: 1351648 - protein, 18 aa, Mycobacterium
FVDTAAQSVVNMFSYTQN

SEQ ID NO: 1351649 - protein, 22 aa, Mycobacterium
FVEPVIRLLQPVTKLLIDLGYD

SEQ ID NO: 1351650 - protein, 24 aa, Mycobacterium
FVERSAREWDDCAGRQVSISDGEE

SEQ ID NO: 1351651 - protein, 20 aa, Mycobacterium
FVGGAARNGRHLVVALMYGL

SEQ ID NO: 1351652 - protein, 24 aa, Mycobacterium
FVGIRGDLALAVFVSDAGSSGPAV

SEQ ID NO: 1351653 - protein, 19 aa, Mycobacterium
FVPEGARLQYGPGQLGTAL

SEQ ID NO: 1351654 - protein, 30 aa, Mycobacterium; identical to SEQ ID NO: 1123461

SEQ ID NO: 1351655 - protein, 17 aa, Mycobacterium
FVYIGDPARPSGGVANW

SEQ ID NO: 1351656 - protein, 17 aa, Mycobacterium
FVYIPKVSTDLIPAFDT

SEQ ID NO: 1351657 - protein, 20 aa, Mycobacterium
FWARQIRATVRFADELSTVL

SEQ ID NO: 1351658 - protein, 19 aa, Mycobacterium
FYFQRARLTEQWGDQVRMV

SEQ ID NO: 1351659 - protein, 21 aa, Mycobacterium
FYHEVAHMAISLYRLPITGPE

SEQ ID NO: 1351660 - protein, 28 aa, Mycobacterium
FYSDGGSEVLLWLEAPPAPATGSAGSGA

SEQ ID NO: 1351661 - protein, 24 aa, Mycobacterium
GAAAPGLFSLLIGNGDEPGENGGW

SEQ ID NO: 1351662 - protein, 17 aa, Mycobacterium
GAAGCLGFGIAAADEAP

SEQ ID NO: 1351663 - protein, 19 aa, Mycobacterium
GAAGLLDWQAIRRGHPSRE

SEQ ID NO: 1351664 - protein, 24 aa, Mycobacterium
GAAVLPFAVGCSSGSAAAEQPSGN

SEQ ID NO: 1351665 - protein, 26 aa, Mycobacterium
GACHGAWCFDDLVGALRNRGHRADAH

SEQ ID NO: 1351666 - protein, 20 aa, Mycobacterium
GACRGFPSAGTFMSQNAIDL

SEQ ID NO: 1351667 - protein, 28 aa, Mycobacterium
GADALTRLRGMFAFALWDSVAQELFCAR

SEQ ID NO: 1351668 - protein, 21 aa, Mycobacterium
GADDYWYLWRQMVSQPGVVDP

SEQ ID NO: 1351669 - protein, 26 aa, Mycobacterium
GADEPFAMCSTFKAYAAAAVLQRTQT

SEQ ID NO: 1351670 - protein, 18 aa, Mycobacterium
GADIIALDICGPVDDTVV

SEQ ID NO: 1351671 - protein, 24 aa, Mycobacterium
GADIRGYTYWSFVDNLEWSEGYEL

SEQ ID NO: 1351672 - protein, 24 aa, Mycobacterium
GADRSCPVRVNLALVREREGDIDA

SEQ ID NO: 1351673 - protein, 20 aa, Mycobacterium
GADTLRRAGPYLVRGSADLQ

SEQ ID NO: 1351674 - protein, 23 aa, Mycobacterium
GAFDPKEAISHGFIDSQKLPAWR

SEQ ID NO: 1351675 - protein, 18 aa, Mycobacterium
GAFGEPTRAWNVTLPAWT

SEQ ID NO: 1351676 - protein, 19 aa, Mycobacterium
GAFTDVMRLLVPTTDLTNQ

SEQ ID NO: 1351677 - protein, 23 aa, Mycobacterium
GAGDIPPPPGWGAPPGPRGIYQP

SEQ ID NO: 1351678 - protein, 17 aa, Mycobacterium
GAGDIPPPPGWNQPPGP

SEQ ID NO: 1351679 - protein, 23 aa, Mycobacterium
GAGDKKIVYAFSGGARVASVWLD

SEQ ID NO: 1351680 - protein, 32 aa, Mycobacterium
GAGDPRYAAAPIRLHPDIAIFAAVPQVRSSTA

SEQ ID NO: 1351681 - protein, 25 aa, Mycobacterium
GAGGRGGRGGLLVGNGGAGGAGAAG

SEQ ID NO: 1351682 - protein, 28 aa, Mycobacterium
GAGGVGGRSGMLFGYAGDGGIGGAAGTG

SEQ ID NO: 1351683 - protein, 29 aa, Mycobacterium
GAGSGSIGIEWCRSGAGCRAIAFERDGTR

SEQ ID NO: 1351684 - protein, 30 aa, Mycobacterium; identical to SEQ ID NO: 1265262

SEQ ID NO: 1351685 - protein, 23 aa, Mycobacterium
GAGWPDKFLAGAALVAHGVAAAN

SEQ ID NO: 1351686 - protein, 31 aa, Mycobacterium
GAIPLPGGAVESLWLAIRQSRGPQAEQPVVV

SEQ ID NO: 1351687 - protein, 23 aa, Mycobacterium
GAIRREMDRLFANHGPTAALAWS

SEQ ID NO: 1351688 - protein, 23 aa, Mycobacterium
GALDCRDLFDRQEMFEQAQFQSG

SEQ ID NO: 1351689 - protein, 28 aa, Mycobacterium
GALGLRIAQRLADLGARRLVLLSRSGLP

SEQ ID NO: 1351690 - protein, 17 aa, Mycobacterium
GALKLMLTAPFSIENIP

SEQ ID NO: 1351691 - protein, 18 aa, Mycobacterium
GALLAALIQRPSALDPAV

SEQ ID NO: 1351692 - protein, 22 aa, Mycobacterium
GALRDHPVLVIATVRDGEHAPE

SEQ ID NO: 1351693 - protein, 29 aa, Mycobacterium
GANRYVFRFPSGGLPPVNAFWSLTMYELP

SEQ ID NO: 1351694 - protein, 20 aa, Mycobacterium
GAPLPPALGPLLPAEAVPTA

SEQ ID NO: 1351695 - protein, 27 aa, Mycobacterium
GAPRTGELYNYTARFGTYMVIVTANPL

SEQ ID NO: 1351696 - protein, 33 aa, Mycobacterium; identical to SEQ ID NO: 1252288

SEQ ID NO: 1351697 - protein, 18 aa, Mycobacterium
GAQLSARVLRVFEEPPAP

SEQ ID NO: 1351698 - protein, 26 aa, Mycobacterium
GAQQGGSIGLGFAIPVDQAKRIADEI

SEQ ID NO: 1351699 - protein, 17 aa, Mycobacterium
GARGYAHIGVLNELTER

SEQ ID NO: 1351700 - protein, 21 aa, Mycobacterium
GATARMGIGAADLKHRHPQVI

SEQ ID NO: 1351701 - protein, 24 aa, Mycobacterium
GATSYRFSDYESRRDRAVGHIRID

SEQ ID NO: 1351702 - protein, 23 aa, Mycobacterium
GAVSKAGLFAPISPDTLAAVPAQ

SEQ ID NO: 1351703 - protein, 17 aa, Mycobacterium
GAVTGAFSLVNFANPVH

SEQ ID NO: 1351704 - protein, 18 aa, Mycobacterium
GAWARCVQIVGALDAAAA

SEQ ID NO: 1351705 - protein, 22 aa, Mycobacterium
GAYVPGMCDYVVMVRNRSKVFL

SEQ ID NO: 1351706 - protein, 18 aa, Mycobacterium
GCADKATAAECLRALPGN

SEQ ID NO: 1351707 - protein, 24 aa, Mycobacterium
GCAGDACLHWGAMWGPASRADYVD

SEQ ID NO: 1351708 - protein, 20 aa, Mycobacterium
GCINLSPANAQWFYDNFGSG

SEQ ID NO: 1351709 - protein, 21 aa, Mycobacterium
GCLNVSPANARWFYDNTRRGD

SEQ ID NO: 1351710 - protein, 18 aa, Mycobacterium
GCNYRYTINPQYISSKPL

SEQ ID NO: 1351711 - protein, 18 aa, Mycobacterium
GCTLMPTDTIFHADIRGL

SEQ ID NO: 1351712 - protein, 17 aa, Mycobacterium
GDATTGIGVVVSTGDDP

SEQ ID NO: 1351713 - protein, 17 aa, Mycobacterium
GDCGRDYRVKSVLLVEI

SEQ ID NO: 1351714 - protein, 24 aa, Mycobacterium
GDDCTPSALPRSGRDDEYLSHWLD

SEQ ID NO: 1351715 - protein, 25 aa, Mycobacterium
GDDDGWAYLSTRGGYYRLDIATADV

SEQ ID NO: 1351716 - protein, 18 aa, Mycobacterium
GDDVRILGVPVGRVDSIR

SEQ ID NO: 1351717 - protein, 26 aa, Mycobacterium
GDEPRFRAIWDWTRTHLRRPDGLLSW

SEQ ID NO: 1351718 - protein, 18 aa, Mycobacterium
GDEVRILGVAVGKIDKIE

SEQ ID NO: 1351719 - protein, 17 aa, Mycobacterium
GDFCAGCSEVELDVMVS

SEQ ID NO: 1351720 - protein, 26 aa, Mycobacterium
GDFGAGMGISTWWYRGSDMDTERALE

SEQ ID NO: 1351721 - protein, 17 aa, Mycobacterium
GDGGLYVLQINADGRED

SEQ ID NO: 1351722 - protein, 20 aa, Mycobacterium
GDHAHFMFVVTLDRASTEAV

SEQ ID NO: 1351723 - protein, 24 aa, Mycobacterium
GDHSHFMFVATLNKASTETVTVSY

SEQ ID NO: 1351724 - protein, 24 aa, Mycobacterium
GDHVRFKRWANAFMLSSSLTPDER

SEQ ID NO: 1351725 - protein, 20 aa, Mycobacterium
GDIPPPPGWNQPPGPPGLYT

SEQ ID NO: 1351726 - protein, 25 aa, Mycobacterium
GDIRKAAQADLILDNGLNLEAWFAR

SEQ ID NO: 1351727 - protein, 20 aa, Mycobacterium
GDLARIGMEVDVLKIAGISD

SEQ ID NO: 1351728 - protein, 22 aa, Mycobacterium
GDLGLDHPYSPLGHSITVEVTV

SEQ ID NO: 1351729 - protein, 18 aa, Mycobacterium
GDLTELELQWGRTIGQFP

SEQ ID NO: 1351730 - protein, 22 aa, Mycobacterium
GDNRCRGDATGLLCVNYAHRSA

SEQ ID NO: 1351731 - protein, 20 aa, Mycobacterium
GDPALPKSLFILDNNVSRPD

SEQ ID NO: 1351732 - protein, 18 aa, Mycobacterium
GDPCSYTPPADGLPTPGN

SEQ ID NO: 1351733 - protein, 20 aa, Mycobacterium
GDQRDEWSRPGVTEAGDTVA

SEQ ID NO: 1351734 - protein, 21 aa, Mycobacterium
GDSNVAFFREYRNVGLTPQDM

SEQ ID NO: 1351735 - protein, 24 aa, Mycobacterium
GDSRPYLYDGRIRRDVPPVVPLQQ

SEQ ID NO: 1351736 - protein, 19 aa, Mycobacterium
GDSRTDLFGTVRNLQVLVN

SEQ ID NO: 1351737 - protein, 18 aa, Mycobacterium
GDSWTRYTGFPSSICRGQ

SEQ ID NO: 1351738 - protein, 24 aa, Mycobacterium
GDTDRVTMFRAWYSRNNFGQLAGT

SEQ ID NO: 1351739 - protein, 23 aa, Mycobacterium
GDTLVELDEQFTLTLSSPLNATI

SEQ ID NO: 1351740 - protein, 22 aa, Mycobacterium
GDYMNQFIIFDFTIPRLKRGLF

SEQ ID NO: 1351741 - protein, 19 aa, Mycobacterium
GEDTVRFTVAASDGLASAT

SEQ ID NO: 1351742 - protein, 23 aa, Mycobacterium
GEEARPRVIATRAVVVLVSEKRQ

SEQ ID NO: 1351743 - protein, 25 aa, Mycobacterium
GEFLRRLESRVGRIRDRMVSAVSGR

SEQ ID NO: 1351744 - protein, 22 aa, Mycobacterium
GEGWGVCFDGGRIVRSDGSDRL

SEQ ID NO: 1351745 - protein, 17 aa, Mycobacterium
GEHIAVFGYSQGGAVVS

SEQ ID NO: 1351746 - protein, 23 aa, Mycobacterium
GEIRVVPGFTGQLLQRFAPDASA

SEQ ID NO: 1351747 - protein, 19 aa, Mycobacterium
GELDLGMARPPLKRPGLVS

SEQ ID NO: 1351748 - protein, 23 aa, Mycobacterium
GELGAAILRGDRADVADELRDVT

SEQ ID NO: 1351749 - protein, 22 aa, Mycobacterium
GELQGQGLVDCLGGRPANVVFL

SEQ ID NO: 1351750 - protein, 17 aa, Mycobacterium
GELQPLLSTGWEQTSPN

SEQ ID NO: 1351751 - protein, 21 aa, Mycobacterium
GELVCAVVRRSSRHRDVTLDE

SEQ ID NO: 1351752 - protein, 22 aa, Mycobacterium
GEMKTPMGVFTLDFAFGTEPNP

SEQ ID NO: 1351753 - protein, 23 aa, Mycobacterium
GEPQTYPPVVWQVAGDQIAQITP

SEQ ID NO: 1351754 - protein, 25 aa, Mycobacterium
GEPRGELSMDLQVAHAIAPDARKVV

SEQ ID NO: 1351755 - protein, 22 aa, Mycobacterium
GEPTRAWNVTLPAWTEAQVNPY

SEQ ID NO: 1351756 - protein, 19 aa, Mycobacterium
GESAGLVPPIHQWSGSTFS

SEQ ID NO: 1351757 - protein, 23 aa, Mycobacterium
GEVAALMPGWGVRDVLRTPTARF

SEQ ID NO: 1351758 - protein, 30 aa, Mycobacterium
GEYDGLADFPDRWWNALAVANAIAGSIYVH

SEQ ID NO: 1351759 - protein, 18 aa, Mycobacterium
GFDCSGLILYAFAGVGIA

SEQ ID NO: 1351760 - protein, 24 aa, Mycobacterium
GFDCSGLILYAFAGVGIKLEHYSG

SEQ ID NO: 1351761 - protein, 23 aa, Mycobacterium
GFDCSGLMLYAFAGVGIKLDHYS

SEQ ID NO: 1351762 - protein, 20 aa, Mycobacterium
GFFEKTFAPLGLRKIQAEVL

SEQ ID NO: 1351763 - protein, 29 aa, Mycobacterium
GFGCVVNGPPAVLCIRQSRDLAAPSRAWV

SEQ ID NO: 1351764 - protein, 25 aa, Mycobacterium
GFGTRYPLFALIGVNPFPSPTDTAA

SEQ ID NO: 1351765 - protein, 21 aa, Mycobacterium
GFGYDAVTLLNLYAGCATNPR

SEQ ID NO: 1351766 - protein, 18 aa, Mycobacterium
GFRRWEPAVRRFLKDERL

SEQ ID NO: 1351767 - protein, 41 aa, Mycobacterium
GFSLAGPIGALLLWRAGLADSIRTIFGFGRAAAESQVSDLP

SEQ ID NO: 1351768 - protein, 30 aa, Mycobacterium
GGAHPQTWFKAFNWDVAKKAPITFDTLFRP

SEQ ID NO: 1351769 - protein, 24 aa, Mycobacterium
GGASGTSLAQWYVTRGLSAQALAT

SEQ ID NO: 1351770 - protein, 18 aa, Mycobacterium
GGASWEFEDRKSLPLTVV

SEQ ID NO: 1351771 - protein, 17 aa, Mycobacterium
GGAVTNWVIARPPDQTA

SEQ ID NO: 1351772 - protein, 17 aa, Mycobacterium
GGCNTGYVASWGGTLHI

SEQ ID NO: 1351773 - protein, 17 aa, Mycobacterium
GGDEIRRSDAPRLVDLV

SEQ ID NO: 1351774 - protein, 22 aa, Mycobacterium
GGDIKTTFALTGRYGRAHLSSH

SEQ ID NO: 1351775 - protein, 24 aa, Mycobacterium
GGDTPEWAYGAIIYNGPGAGEYSP

SEQ ID NO: 1351776 - protein, 20 aa, Mycobacterium
GGEMRLFRRVEWGALATFHM

SEQ ID NO: 1351777 - protein, 18 aa, Mycobacterium
GGERAVKVQAPGPVTLAA

SEQ ID NO: 1351778 - protein, 17 aa, Mycobacterium
GGFDIPEALPMGVASEA

SEQ ID NO: 1351779 - protein, 26 aa, Mycobacterium
GGFDVSPRLAAAISDSRAELSGDTAA

SEQ ID NO: 1351780 - protein, 18 aa, Mycobacterium
GGGATDWAAAAERAGNAV

SEQ ID NO: 1351781 - protein, 25 aa, Mycobacterium
GGGCLPKDIRAFIAMAGELGAGQAF

SEQ ID NO: 1351782 - protein, 31 aa, Mycobacterium
GGGRGATLAARWGGSEWMGSTAGIPVNVVGA

SEQ ID NO: 1351783 - protein, 24 aa, Mycobacterium
GGGVRRPGARHLSAEALMLEAEFA

SEQ ID NO: 1351784 - protein, 18 aa, Mycobacterium
GGIDCVIVNAGIGKGYPL

SEQ ID NO: 1351785 - protein, 21 aa, Mycobacterium
GGIGGGVAMLVHPDHGVPGIS

SEQ ID NO: 1351786 - protein, 19 aa, Mycobacterium
GGIICELERECREVYYQYI

SEQ ID NO: 1351787 - protein, 18 aa, Mycobacterium
GGITRLWRRTTGVPAPVI

SEQ ID NO: 1351788 - protein, 21 aa, Mycobacterium
GGKGGYMFGNGGAGGKGGDAV

SEQ ID NO: 1351789 - protein, 19 aa, Mycobacterium
GGLDLPRPSTAAVNSVPDD

SEQ ID NO: 1351790 - protein, 23 aa, Mycobacterium
GGLDRKKMLLGMERKNSPTIPTL

SEQ ID NO: 1351791 - protein, 25 aa, Mycobacterium
GGLQVKTIWAARAISTMFPEITTIG

SEQ ID NO: 1351792 - protein, 18 aa, Mycobacterium
GGNVTEWVNEGGDDGLEL

SEQ ID NO: 1351793 - protein, 18 aa, Mycobacterium
GGPTRFGLDAARLPIRFA

SEQ ID NO: 1351794 - protein, 18 aa, Mycobacterium
GGQFDPRVVDAFTADAVT

SEQ ID NO: 1351795 - protein, 23 aa, Mycobacterium
GGSAIIDRVVKRYGLSSTSRPGN

SEQ ID NO: 1351796 - protein, 19 aa, Mycobacterium
GGSDRRSAAQSAVVQQSSA

SEQ ID NO: 1351797 - protein, 18 aa, Mycobacterium
GGSGGRGGLAHSNAGGTG

SEQ ID NO: 1351798 - protein, 21 aa, Mycobacterium
GGSPLGGLLPTGPTAPVTAAP

SEQ ID NO: 1351799 - protein, 17 aa, Mycobacterium
GGSRTTVAPGRRVYGRQ

SEQ ID NO: 1351800 - protein, 20 aa, Mycobacterium
GGSRVHWRTREYYPAGTTVH

SEQ ID NO: 1351801 - protein, 22 aa, Mycobacterium
GGTGGFGGLFGTSPGYGGQGHN

SEQ ID NO: 1351802 - protein, 19 aa, Mycobacterium
GGVADARTGWALHTAAGGG

SEQ ID NO: 1351803 - protein, 17 aa, Mycobacterium
GGVGTTWEARIKLNCLT

SEQ ID NO: 1351804 - protein, 22 aa, Mycobacterium
GGVPTGTLWKIDTVAGTVQAVA

SEQ ID NO: 1351805 - protein, 19 aa, Mycobacterium
GGVSLRVPHHVGYFHEPGS

SEQ ID NO: 1351806 - protein, 19 aa, Mycobacterium
GGVTMCPEAPISDPLAGID

SEQ ID NO: 1351807 - protein, 19 aa, Mycobacterium
GGWERPAWFEANAGLTADL

SEQ ID NO: 1351808 - protein, 22 aa, Mycobacterium
GGYRRCVGAAFATSELAVALGT

SEQ ID NO: 1351809 - protein, 23 aa, Mycobacterium
GHDARIGRRFLNAGIGFGGGCLP

SEQ ID NO: 1351810 - protein, 20 aa, Mycobacterium
GHDYRRAAFGDAWTDDNSAL

SEQ ID NO: 1351811 - protein, 26 aa, Mycobacterium
GHEYDWPRQGEIDIVEIPGLGTPAAR

SEQ ID NO: 1351812 - protein, 19 aa, Mycobacterium
GHLKSADFFDAEKHPVATF

SEQ ID NO: 1351813 - protein, 23 aa, Mycobacterium
GHNPIGIVVPCHRVIGANGSLTG

SEQ ID NO: 1351814 - protein, 17 aa, Mycobacterium
GHSRYATDFAQGIISSQ

SEQ ID NO: 1351815 - protein, 21 aa, Mycobacterium
GIDLKASVFGPTTPELERTDL

SEQ ID NO: 1351816 - protein, 24 aa, Mycobacterium
GIDTSLCGLTVALNKGYVEVPLVE

SEQ ID NO: 1351817 - protein, 21 aa, Mycobacterium
GIGPWAKLLRFRDDLDRLLAE

SEQ ID NO: 1351818 - protein, 17 aa, Mycobacterium
GIVGWPAFTQRMREHPS

SEQ ID NO: 1351819 - protein, 19 aa, Mycobacterium
GKCLSYSNGTPVGVATPGV

SEQ ID NO: 1351820 - protein, 18 aa, Mycobacterium
GKFKEAADSYKRYVNSQV

SEQ ID NO: 1351821 - protein, 30 aa, Mycobacterium
GKFTTLGEFPAFQLGGTWVQDGVTKIAAQK

SEQ ID NO: 1351822 - protein, 19 aa, Mycobacterium
GKGGQPVFIKVAGQDTGRC

SEQ ID NO: 1351823 - protein, 19 aa, Mycobacterium
GKIVSCRGGTITITTAPKT

SEQ ID NO: 1351824 - protein, 20 aa, Mycobacterium
GKLIRKGEWVALFFGSANRD

SEQ ID NO: 1351825 - protein, 19 aa, Mycobacterium
GKNALARAILSTGAGAAPD

SEQ ID NO: 1351826 - protein, 20 aa, Mycobacterium
GKPHFAQWAPGMKTLDDALS

SEQ ID NO: 1351827 - protein, 19 aa, Mycobacterium
GKRHAKWLAAAAAVPIMTF

SEQ ID NO: 1351828 - protein, 31 aa, Mycobacterium
GKRSVWRFGVPVICVAAGLLLGATHGVSGGD

SEQ ID NO: 1351829 - protein, 19 aa, Mycobacterium
GKSGPYLLGALKIFLTAPY

SEQ ID NO: 1351830 - protein, 23 aa, Mycobacterium
GKTQTFLPWDSWDRPVTGPPGLW

SEQ ID NO: 1351831 - protein, 23 aa, Mycobacterium
GKVTFAGPGLRGLVEVVEAPQID

SEQ ID NO: 1351832 - protein, 28 aa, Mycobacterium
GKVVGMLEIDAWIGLPTPTTTPWQIIDV

SEQ ID NO: 1351833 - protein, 24 aa, Mycobacterium
GKYKEIAANWGLEEGMIDKPVING

SEQ ID NO: 1351834 - protein, 20 aa, Mycobacterium
GLACGAAFASAVLAASTATS

SEQ ID NO: 1351835 - protein, 18 aa, Mycobacterium
GLAFALVLVALAGGVVAL

SEQ ID NO: 1351836 - protein, 25 aa, Mycobacterium
GLASLPVYVTNAFFNGFVPPFPTRS

SEQ ID NO: 1351837 - protein, 19 aa, Mycobacterium
GLAVWRIRNIFGSHQLPTY

SEQ ID NO: 1351838 - protein, 18 aa, Mycobacterium
GLCTAVLTDGERRWDAER

SEQ ID NO: 1351839 - protein, 26 aa, Mycobacterium
GLDSRAYRLPWPDGTVVYEIDQPAVI

SEQ ID NO: 1351840 - protein, 21 aa, Mycobacterium
GLERLESGLARNTVSASDVDD

SEQ ID NO: 1351841 - protein, 19 aa, Mycobacterium
GLGDWNIPWDRWKAGNAND

SEQ ID NO: 1351842 - protein, 17 aa, Mycobacterium
GLGFLGAAAVCLGTAGP

SEQ ID NO: 1351843 - protein, 17 aa, Mycobacterium
GLHTALMLRGWTDDVVL

SEQ ID NO: 1351844 - protein, 18 aa, Mycobacterium
GLLAFGSAAIVAPVANSQ

SEQ ID NO: 1351845 - protein, 26 aa, Mycobacterium
GLLAPEWKGKIGFAPSNASWQAFVTG

SEQ ID NO: 1351846 - protein, 19 aa, Mycobacterium
GLLDILGLDLSNLADLTGL

SEQ ID NO: 1351847 - protein, 19 aa, Mycobacterium
GLLHLRLAFNPGVHSVSAT

SEQ ID NO: 1351848 - protein, 17 aa, Mycobacterium
GLLRAGAVPVMCLPGHR

SEQ ID NO: 1351849 - protein, 28 aa, Mycobacterium
GLLSGCAGWRGLNSLPLPGVQGTGPGAF

SEQ ID NO: 1351850 - protein, 17 aa, Mycobacterium
GLLVRFGGLTPMQAIVA

SEQ ID NO: 1351851 - protein, 18 aa, Mycobacterium
GLMKQKWPERLVIVDEFP

SEQ ID NO: 1351852 - protein, 18 aa, Mycobacterium
GLMSPPITAFFAAMNVAD

SEQ ID NO: 1351853 - protein, 23 aa, Mycobacterium
GLNLEAWFARFVDGIDVPHVMVS

SEQ ID NO: 1351854 - protein, 40 aa, Mycobacterium
GLPRRGRHRRGRPRRLQPYAWLGAGAVGFGLGAAALTGAG

SEQ ID NO: 1351855 - protein, 18 aa, Mycobacterium
GLRLNAMQAEWARSVIDR

SEQ ID NO: 1351856 - protein, 18 aa, Mycobacterium
GLRTYCPDKLPILDQARQ

SEQ ID NO: 1351857 - protein, 18 aa, Mycobacterium
GLVEAIFADGPLGAVAYA

SEQ ID NO: 1351858 - protein, 30 aa, Mycobacterium
GLVPLFTPNPWRPGSSMSHVDDATFTGVNV

SEQ ID NO: 1351859 - protein, 17 aa, Mycobacterium
GLVSLSIGDVTLLESAT

SEQ ID NO: 1351860 - protein, 18 aa, Mycobacterium
GLVSRPLLHEQLLAALPE

SEQ ID NO: 1351861 - protein, 19 aa, Mycobacterium
GLVTPLTVEGYLFPGPIAL

SEQ ID NO: 1351862 - protein, 25 aa, Mycobacterium
GMAGLCALVALPAAWLTGCSDGDML

SEQ ID NO: 1351863 - protein, 22 aa, Mycobacterium
GMASGTPFALAHTFAQTGPFRP

SEQ ID NO: 1351864 - protein, 21 aa, Mycobacterium
GMCATLAMIVVGCTNFTDGDA

SEQ ID NO: 1351865 - protein, 25 aa, Mycobacterium
GMDSWKAMGVKEYFGQDGRIAGQGV

SEQ ID NO: 1351866 - protein, 27 aa, Mycobacterium
GMPGYQEYKLYPGPDMDKARALIAEAN

SEQ ID NO: 1351867 - protein, 41 aa, Mycobacterium
GMSYCPPQLPGLAELWGRSVFQCPFCHGWEMRDGKLAALAS

SEQ ID NO: 1351868 - protein, 19 aa, Mycobacterium
GMTVPGFFTAPVTSIPGAI

SEQ ID NO: 1351869 - protein, 17 aa, Mycobacterium
GNGEADSAWVMRETLAW

SEQ ID NO: 1351870 - protein, 19 aa, Mycobacterium
GNIQSPGPWRRNATPEQTA

SEQ ID NO: 1351871 - protein, 24 aa, Mycobacterium
GNPFHVHGLLGLLGITRPTEVTVV

SEQ ID NO: 1351872 - protein, 22 aa, Mycobacterium
GNPHVWYNPTAVTEFAEAVTAQ

SEQ ID NO: 1351873 - protein, 22 aa, Mycobacterium
GNPMVDAFLWVKRPGESDGACR

SEQ ID NO: 1351874 - protein, 26 aa, Mycobacterium
GNQIRYCAIICPLLVDTAVTAAVTTV

SEQ ID NO: 1351875 - protein, 23 aa, Mycobacterium
GNSFLNYNFVEYYLYPDGGGGYQ

SEQ ID NO: 1351876 - protein, 19 aa, Mycobacterium
GNVVSRIFGTPILGRPVDA

SEQ ID NO: 1351877 - protein, 25 aa, Mycobacterium
GNYQIFRRGDVMSAVFRETYHADGP

SEQ ID NO: 1351878 - protein, 22 aa, Mycobacterium
GPADLAKVYAFLASDDSRGING

SEQ ID NO: 1351879 - protein, 25 aa, Mycobacterium
GPAEALRALGIRVWSDVPVGASTSD

SEQ ID NO: 1351880 - protein, 24 aa, Mycobacterium
GPAEYRYSDTASFTRGVDMLPVGE

SEQ ID NO: 1351881 - protein, 19 aa, Mycobacterium
GPALRLGRATTPSVGSTGP

SEQ ID NO: 1351882 - protein, 27 aa, Mycobacterium
GPATVLHHGPTPWAMDENLGGALCEQP

SEQ ID NO: 1351883 - protein, 17 aa, Mycobacterium
GPDACILTAGADDPERM

SEQ ID NO: 1351884 - protein, 18 aa, Mycobacterium
GPDGRPRYVTGIDAETGT

SEQ ID NO: 1351885 - protein, 17 aa, Mycobacterium
GPECVATGLKAPTVSLF

SEQ ID NO: 1351886 - protein, 30 aa, Mycobacterium
GPEGLDAVTLRPGRPAGCSAGDYGGVDVRR

SEQ ID NO: 1351887 - protein, 21 aa, Mycobacterium
GPEPEGLAITEIGGRPTALVA

SEQ ID NO: 1351888 - protein, 24 aa, Mycobacterium
GPERYAEMLKKFGLGQRTGVGLPG

SEQ ID NO: 1351889 - protein, 17 aa, Mycobacterium
GPGSVQGMAASPVATAA

SEQ ID NO: 1351890 - protein, 18 aa, Mycobacterium
GPGVRVLSAIELGILKDL

SEQ ID NO: 1351891 - protein, 25 aa, Mycobacterium
GPHFSFSWFRGSPIGRERKTMELSR

SEQ ID NO: 1351892 - protein, 26 aa, Mycobacterium
GPKVRPDIYRRLGLDDVASGPRTITT

SEQ ID NO: 1351893 - protein, 23 aa, Mycobacterium
GPLDQRQALIAAMNVIDEGTTIT

SEQ ID NO: 1351894 - protein, 20 aa, Mycobacterium
GPLLAFRASDQLGIVDGTTV

SEQ ID NO: 1351895 - protein, 18 aa, Mycobacterium
GPLPEGMRGKSLLHRGSL

SEQ ID NO: 1351896 - protein, 25 aa, Mycobacterium
GPLPSRYVGYTAWRGVAAYRLDPAL

SEQ ID NO: 1351897 - protein, 19 aa, Mycobacterium
GPMMPGMGGMPGMGGMAGM

SEQ ID NO: 1351898 - protein, 25 aa, Mycobacterium
GPMQFIPETWRLYGVDANNDGIVSP

SEQ ID NO: 1351899 - protein, 25 aa, Mycobacterium
GPMQFIPETWRLYGVDANNDGVVSP

SEQ ID NO: 1351900 - protein, 17 aa, Mycobacterium
GPNAPWAGLTADRLRKV

SEQ ID NO: 1351901 - protein, 18 aa, Mycobacterium
GPPLRVVFNPNWTAWGVW

SEQ ID NO: 1351902 - protein, 20 aa, Mycobacterium
GPRRRGRGPQHRRPPPHPRP

SEQ ID NO: 1351903 - protein, 24 aa, Mycobacterium
GPSWRHEFLTQMGLTVLETDDALI

SEQ ID NO: 1351904 - protein, 19 aa, Mycobacterium
GPTPPVPMQAPRAMEAAVP

SEQ ID NO: 1351905 - protein, 18 aa, Mycobacterium
GPTTSLRNAFAHSCNTAF

SEQ ID NO: 1351906 - protein, 17 aa, Mycobacterium
GPVDWYINATWLHEGEA

SEQ ID NO: 1351907 - protein, 19 aa, Mycobacterium
GPVDYFAVDLPRIIGNALK

SEQ ID NO: 1351908 - protein, 26 aa, Mycobacterium
GPVKVAGFLGWIAWGLLHIAFLTGVR

SEQ ID NO: 1351909 - protein, 18 aa, Mycobacterium
GPWARRLGIAALAAVLLP

SEQ ID NO: 1351910 - protein, 24 aa, Mycobacterium
GPYQHVEKFIPRQITNVLTGRRPE

SEQ ID NO: 1351911 - protein, 27 aa, Mycobacterium
GPYTSFPLKRNVVVLGIVHEGVPVATA

SEQ ID NO: 1351912 - protein, 18 aa, Mycobacterium
GQAMLAFAQAYRDAGAPA

SEQ ID NO: 1351913 - protein, 18 aa, Mycobacterium
GQAQEQWLLNGFQQSRAR

SEQ ID NO: 1351914 - protein, 26 aa, Mycobacterium
GQDGGRGGLLFGNGGRGGDALTSGGP

SEQ ID NO: 1351915 - protein, 24 aa, Mycobacterium
GQGGEPRLTLPDAITGNPGDPRYP

SEQ ID NO: 1351916 - protein, 18 aa, Mycobacterium
GQIGDLGLDHPYSPLGHS

SEQ ID NO: 1351917 - protein, 31 aa, Mycobacterium
GQIGRVGLWNNRRCMNEPWLMNMAVGQIRGG

SEQ ID NO: 1351918 - protein, 18 aa, Mycobacterium
GQIPEDRTTPALDLDVLL

SEQ ID NO: 1351919 - protein, 20 aa, Mycobacterium
GQKDYNAWIGKIACKRITTG

SEQ ID NO: 1351920 - protein, 18 aa, Mycobacterium
GQLNPAVNITGVLDNGPY

SEQ ID NO: 1351921 - protein, 26 aa, Mycobacterium
GQLPDAVKYSVRFAKPVVLPARAGLY

SEQ ID NO: 1351922 - protein, 30 aa, Mycobacterium
GQPKVVRGGARFRVPGIERVDIMSLEPFNV

SEQ ID NO: 1351923 - protein, 26 aa, Mycobacterium
GQPVVWTSAWGGRWGVWINGGFIALS

SEQ ID NO: 1351924 - protein, 26 aa, Mycobacterium
GQPVVWTSAWGGRWGVWINGGFIPLS

SEQ ID NO: 1351925 - protein, 28 aa, Mycobacterium
GQRVLFWVSAHALRGFWGAGRITGELLV

SEQ ID NO: 1351926 - protein, 17 aa, Mycobacterium
GQVLTNFHVVQGADRIT

SEQ ID NO: 1351927 - protein, 17 aa, Mycobacterium
GQVLTNFHVVQGADRVN

SEQ ID NO: 1351928 - protein, 17 aa, Mycobacterium
GQWCGPCRTEITQLQQV

SEQ ID NO: 1351929 - protein, 27 aa, Mycobacterium
GQYRVTLELPETGGLYPRGNVTYRGVE

SEQ ID NO: 1351930 - protein, 20 aa, Mycobacterium
GRAFAAGALDAGHRVVGTVR

SEQ ID NO: 1351931 - protein, 29 aa, Mycobacterium
GRAVVPGWPWWPLVEVMKVLPPRFAKYFA

SEQ ID NO: 1351932 - protein, 18 aa, Mycobacterium
GRDGLRVGVLDVTPDSMR

SEQ ID NO: 1351933 - protein, 20 aa, Mycobacterium
GREAAGWLRAKTGSLTGTNS

SEQ ID NO: 1351934 - protein, 19 aa, Mycobacterium
GRFGPPRQWLVVTGTNGKT

SEQ ID NO: 1351935 - protein, 21 aa, Mycobacterium
GRGAGELLLRVRAEADGSTPR

SEQ ID NO: 1351936 - protein, 32 aa, Mycobacterium
GRGGDGGSSEGWMSGLGGWGGDGGDASGGGAG

SEQ ID NO: 1351937 - protein, 22 aa, Mycobacterium
GRGGGQVSKLIEQVMNLRARGI

SEQ ID NO: 1351938 - protein, 17 aa, Mycobacterium
GRGKRPVREIVGMSVEL

SEQ ID NO: 1351939 - protein, 18 aa, Mycobacterium
GRGRWLAVAVSLAVSAGM

SEQ ID NO: 1351940 - protein, 17 aa, Mycobacterium
GRGYSEKGPASGGAGGA

SEQ ID NO: 1351941 - protein, 26 aa, Mycobacterium
GRIRRLRPWLDVRAAFLEKCAPSLHD

SEQ ID NO: 1351942 - protein, 27 aa, Mycobacterium
GRIRRLRPWLDVRAAFLEKCAPSLHDV

SEQ ID NO: 1351943 - protein, 22 aa, Mycobacterium
GRITSVLALSALINGGRPDRFG

SEQ ID NO: 1351944 - protein, 18 aa, Mycobacterium
GRIVAALVLVASLAACSK

SEQ ID NO: 1351945 - protein, 22 aa, Mycobacterium
GRLARRCIVTALLLALGLAVLA

SEQ ID NO: 1351946 - protein, 17 aa, Mycobacterium
GRLPEPSPTVLLDDPVE

SEQ ID NO: 1351947 - protein, 19 aa, Mycobacterium
GRLRRWRGGAHRAGVVALV

SEQ ID NO: 1351948 - protein, 25 aa, Mycobacterium
GRNEGAEPLVMWVLYANPPATPLAI

SEQ ID NO: 1351949 - protein, 24 aa, Mycobacterium
GRRLKMVARILGSLAAAAMVIVGC

SEQ ID NO: 1351950 - protein, 24 aa, Mycobacterium
GRSGRLSWWAGPWPVDERWWDAAP

SEQ ID NO: 1351951 - protein, 23 aa, Mycobacterium
GRSRTPGKVWAWQTRSWSNGQIY

SEQ ID NO: 1351952 - protein, 25 aa, Mycobacterium
GRSYSPRFLFAWPNSKSAVMGPAQL

SEQ ID NO: 1351953 - protein, 25 aa, Mycobacterium
GRTANAVAALWPQRCTGLVAVSGYI

SEQ ID NO: 1351954 - protein, 18 aa, Mycobacterium
GRVVNAVLQVFGFTTSAN

SEQ ID NO: 1351955 - protein, 18 aa, Mycobacterium
GSAACGVAALGMAITVGG

SEQ ID NO: 1351956 - protein, 30 aa, Mycobacterium
GSAGRDCGPLRWLPAIPDRLAGDPQWGDYL

SEQ ID NO: 1351957 - protein, 26 aa, Mycobacterium
GSAVAWKATLDDVLFDLVATGGIALT

SEQ ID NO: 1351958 - protein, 25 aa, Mycobacterium
GSDHRWRLEHCGAGTRAQFDRAARL

SEQ ID NO: 1351959 - protein, 19 aa, Mycobacterium
GSDVLKSHPIVSVDRRGIG

SEQ ID NO: 1351960 - protein, 19 aa, Mycobacterium
GSFSYPYNVIAVGPPPATD

SEQ ID NO: 1351961 - protein, 22 aa, Mycobacterium
GSGACLYDFKAVFDDGEELVRS

SEQ ID NO: 1351962 - protein, 19 aa, Mycobacterium
GSGALALALAVAFPAAQVT

SEQ ID NO: 1351963 - protein, 19 aa, Mycobacterium
GSGALLLAGCQFGGLNSLN

SEQ ID NO: 1351964 - protein, 17 aa, Mycobacterium
GSGCAAYAEQVPSGPGS

SEQ ID NO: 1351965 - protein, 23 aa, Mycobacterium
GSGFPAPMLNAAGNWYELSNGGR

SEQ ID NO: 1351966 - protein, 19 aa, Mycobacterium
GSGPLVVGVCAEYDALPEM

SEQ ID NO: 1351967 - protein, 20 aa, Mycobacterium
GSGVRDGMLVGFSASGPTNE

SEQ ID NO: 1351968 - protein, 24 aa, Mycobacterium
GSLIGARVAVLGAAFKPDSDDVRD

SEQ ID NO: 1351969 - protein, 26 aa, Mycobacterium
GSMVAGAKYRGEFEERLKAVLDDIKN

SEQ ID NO: 1351970 - protein, 26 aa, Mycobacterium
GSSAAPLFHNIASWLLQRQNVPLSPP

SEQ ID NO: 1351971 - protein, 22 aa, Mycobacterium
GSSNRRVMWQGIGHGATIYSSC

SEQ ID NO: 1351972 - protein, 25 aa, Mycobacterium
GSSYTSAEPGFWPTLVQNKLISGGD

SEQ ID NO: 1351973 - protein, 25 aa, Mycobacterium
GSTAELRSATPLGDVFIAIKPPPSV

SEQ ID NO: 1351974 - protein, 22 aa, Mycobacterium
GSTGFGDLDWSPLPPESVASVA

SEQ ID NO: 1351975 - protein, 17 aa, Mycobacterium
GSTMVWLDAGVPAVFVG

SEQ ID NO: 1351976 - protein, 25 aa, Mycobacterium
GSVAASVCLVTACSGGAAPPAAPSA

SEQ ID NO: 1351977 - protein, 25 aa, Mycobacterium
GSVLACPRARAVFAGVTAHVDVGDA

SEQ ID NO: 1351978 - protein, 20 aa, Mycobacterium
GSVPSGLVEAIFADGPLGAV

SEQ ID NO: 1351979 - protein, 24 aa, Mycobacterium
GSVRRLPMMVFRDVAQVTETVAAA

SEQ ID NO: 1351980 - protein, 19 aa, Mycobacterium
GSYQVAFSLADTAADAVEG

SEQ ID NO: 1351981 - protein, 17 aa, Mycobacterium
GTANPAAADTWEMPDVE

SEQ ID NO: 1351982 - protein, 19 aa, Mycobacterium
GTAPPTCKDANSILSKMFL

SEQ ID NO: 1351983 - protein, 28 aa, Mycobacterium
GTAQAVPWARACAAVLLAVNGRDGLRVG

SEQ ID NO: 1351984 - protein, 21 aa, Mycobacterium
GTARFLALSVHEMVVDSTSRE

SEQ ID NO: 1351985 - protein, 19 aa, Mycobacterium
GTERGRVAFVQPDDAFAAR

SEQ ID NO: 1351986 - protein, 17 aa, Mycobacterium
GTFDIISPYKIMGAAVV

SEQ ID NO: 1351987 - protein, 18 aa, Mycobacterium
GTGIAWGKIRSFESGINH

SEQ ID NO: 1351988 - protein, 18 aa, Mycobacterium
GTGPFRFLGQKSGDSISL

SEQ ID NO: 1351989 - protein, 24 aa, Mycobacterium
GTIPESRTAVPVEWDEVKTQLMRL

SEQ ID NO: 1351990 - protein, 19 aa, Mycobacterium
GTKTTRVYTFTGTSNTVRE

SEQ ID NO: 1351991 - protein, 18 aa, Mycobacterium
GTLAEFFAAKGVAMEPQS

SEQ ID NO: 1351992 - protein, 17 aa, Mycobacterium
GTQSLVLEVYQNVGGAH

SEQ ID NO: 1351993 - protein, 22 aa, Mycobacterium
GTRAAIRYDNLFGGRYLALEEG

SEQ ID NO: 1351994 - protein, 25 aa, Mycobacterium
GTRLPAKRLSAPRLRNKIREAMGLT

SEQ ID NO: 1351995 - protein, 30 aa, Mycobacterium
GTRMTDPKDLVWYEAITSYLSGDFDNNGTI

SEQ ID NO: 1351996 - protein, 26 aa, Mycobacterium
GTTGWHYHPGDVFAVVRAGTLTHYAA

SEQ ID NO: 1351997 - protein, 17 aa, Mycobacterium
GTTPLAFHDALDFAEQV

SEQ ID NO: 1351998 - protein, 19 aa, Mycobacterium
GTTRTRFMLGVAPGEDHAG

SEQ ID NO: 1351999 - protein, 26 aa, Mycobacterium
GTTTTISWQYGRHATLDFDPSTDKLD

SEQ ID NO: 1352000 - protein, 18 aa, Mycobacterium
GTVAAFLTLRQMIADALK

SEQ ID NO: 1352001 - protein, 19 aa, Mycobacterium
GTVAEWKLQATKSRSRNVK

SEQ ID NO: 1352002 - protein, 32 aa, Mycobacterium
GTVGFDCSGLMLYMFAGVGIKLDHYSGSQYNA

SEQ ID NO: 1352003 - protein, 17 aa, Mycobacterium
GTVGPYTSFPLKRNVVV

SEQ ID NO: 1352004 - protein, 27 aa, Mycobacterium
GTVLLRPDGTFTYTVPTTMYAGGTDTF

SEQ ID NO: 1352005 - protein, 17 aa, Mycobacterium
GTWGGGGATDWAAAAER

SEQ ID NO: 1352006 - protein, 19 aa, Mycobacterium
GTYTTSYGHIGIWHNGKTF

SEQ ID NO: 1352007 - protein, 18 aa, Mycobacterium
GVAALGMAITVGGVAATQ

SEQ ID NO: 1352008 - protein, 20 aa, Mycobacterium
GVASDAAGVVGWWVNPQTPG

SEQ ID NO: 1352009 - protein, 17 aa, Mycobacterium
GVASFYADWYRPAKNRN

SEQ ID NO: 1352010 - protein, 26 aa, Mycobacterium
GVASRASALIPEWAVASHLASIAAGS

SEQ ID NO: 1352011 - protein, 18 aa, Mycobacterium
GVAVALVLVLVGGVVAAI

SEQ ID NO: 1352012 - protein, 19 aa, Mycobacterium
GVCPDTVVIQTDWEPEAEH

SEQ ID NO: 1352013 - protein, 25 aa, Mycobacterium
GVDASRLFLTQMIRHHEGAITMAQN

SEQ ID NO: 1352014 - protein, 17 aa, Mycobacterium
GVDIRGAITGALLSSLA

SEQ ID NO: 1352015 - protein, 18 aa, Mycobacterium
GVDIRGAITGALLSSLAA

SEQ ID NO: 1352016 - protein, 24 aa, Mycobacterium
GVEAARLFLTGMIAHHEGAVTMAQ

SEQ ID NO: 1352017 - protein, 22 aa, Mycobacterium
GVEASKLFLSQMIRHHEGAITM

SEQ ID NO: 1352018 - protein, 20 aa, Mycobacterium
GVEHVGWYVPARPTGCQALA

SEQ ID NO: 1352019 - protein, 22 aa, Mycobacterium
GVELPGAGILDILGNAVYRSIW

SEQ ID NO: 1352020 - protein, 21 aa, Mycobacterium
GVFGLFAVFGQMRFGEKTHSY

SEQ ID NO: 1352021 - protein, 25 aa, Mycobacterium
GVFVPRPETESVLEWAVAQPLPARP

SEQ ID NO: 1352022 - protein, 19 aa, Mycobacterium
GVGAGDRNSVRVLGDDNTA

SEQ ID NO: 1352023 - protein, 18 aa, Mycobacterium
GVGCTRLAIHAVTATGQE

SEQ ID NO: 1352024 - protein, 23 aa, Mycobacterium
GVIGPRSRLHWSQATDWDAVCAH

SEQ ID NO: 1352025 - protein, 20 aa, Mycobacterium
GVLCSVGWQPRPPGVSVSTS

SEQ ID NO: 1352026 - protein, 26 aa, Mycobacterium
GVMLEAPRPGQFVQVSPVRTSGMTPY

SEQ ID NO: 1352027 - protein, 22 aa, Mycobacterium
GVPASPLCRFVSAGASASSVSV

SEQ ID NO: 1352028 - protein, 23 aa, Mycobacterium
GVPGRSAAWIVIDVRDLADLHVA

SEQ ID NO: 1352029 - protein, 24 aa, Mycobacterium
GVPINIRVGIEIIDGTNAAPTYSG

SEQ ID NO: 1352030 - protein, 17 aa, Mycobacterium
GVPKRSGPFPIKGTDRE

SEQ ID NO: 1352031 - protein, 19 aa, Mycobacterium
GVRDWRFIALTPPATVSKL

SEQ ID NO: 1352032 - protein, 25 aa, Mycobacterium
GVRPGEPRLLVARGGTAVVARVEAP

SEQ ID NO: 1352033 - protein, 25 aa, Mycobacterium
GVRVNCIACGAIRTPGLEADAKRQG

SEQ ID NO: 1352034 - protein, 23 aa, Mycobacterium
GVTRYVFDVITGTVVPGGEQDAE

SEQ ID NO: 1352035 - protein, 23 aa, Mycobacterium
GVTTRLGEDIAFTAPSGAPHSST

SEQ ID NO: 1352036 - protein, 19 aa, Mycobacterium
GVTVGDAWKHGTMPYTTTG

SEQ ID NO: 1352037 - protein, 24 aa, Mycobacterium
GVVDTSYFARAWVQWNNTTRTFGN

SEQ ID NO: 1352038 - protein, 24 aa, Mycobacterium
GVVGLSRRYVMVIGSMQPAGDDAA

SEQ ID NO: 1352039 - protein, 18 aa, Mycobacterium
GVWQGHWRDPGSRSTICG

SEQ ID NO: 1352040 - protein, 24 aa, Mycobacterium
GVYPQRFGIPEGLYAEPVAVKQGW

SEQ ID NO: 1352041 - protein, 18 aa, Mycobacterium
GWCVLAPVAGAQPAPEPP

SEQ ID NO: 1352042 - protein, 21 aa, Mycobacterium
GWKHYLKQSVVLFPYQEKAGE

SEQ ID NO: 1352043 - protein, 25 aa, Mycobacterium
GWPAAGDGWVPVRLSEPGPCADDIG

SEQ ID NO: 1352044 - protein, 26 aa, Mycobacterium
GWPAAGDGWVPVRLSEPGPCEDDIGE

SEQ ID NO: 1352045 - protein, 18 aa, Mycobacterium
GYETILYGPGLAQAGATD

SEQ ID NO: 1352046 - protein, 30 aa, Mycobacterium
GYGLTPALWTLGLRSAWIPDSTDTNGNVFS

SEQ ID NO: 1352047 - protein, 24 aa, Mycobacterium
GYGPELFDAVGLTAHRPATLRPLP

SEQ ID NO: 1352048 - protein, 18 aa, Mycobacterium
GYKAWALTPDELVIYMPD

SEQ ID NO: 1352049 - protein, 19 aa, Mycobacterium
GYLAGFPGQGAYACANAFL

SEQ ID NO: 1352050 - protein, 23 aa, Mycobacterium
GYNAADIAFAYDMVPHHAQAIDL

SEQ ID NO: 1352051 - protein, 24 aa, Mycobacterium
GYNLHPDTAWRVAHQACVGGIPGY

SEQ ID NO: 1352052 - protein, 25 aa, Mycobacterium
GYPGMPAKPGPPVADISTGLYAALS

SEQ ID NO: 1352053 - protein, 28 aa, Mycobacterium
GYRIGCGIVGGPVELFATVGANPNIGPN

SEQ ID NO: 1352054 - protein, 24 aa, Mycobacterium
GYSQGARVAADWIAQHAGTEDAPS

SEQ ID NO: 1352055 - protein, 20 aa, Mycobacterium
HAAAPWLVVWDDHELDNNWA

SEQ ID NO: 1352056 - protein, 20 aa, Mycobacterium
HADPGVLVSPGMEIRQDTNL

SEQ ID NO: 1352057 - protein, 18 aa, Mycobacterium
HAFGESFLTQNFPVGSVV

SEQ ID NO: 1352058 - protein, 17 aa, Mycobacterium
HAGAWRAALSVPNGIGG

SEQ ID NO: 1352059 - protein, 21 aa, Mycobacterium
HALDYRHGLVYGLNSRTQTVM

SEQ ID NO: 1352060 - protein, 21 aa, Mycobacterium
HAPEVARLLSTVARGEDNRHI

SEQ ID NO: 1352061 - protein, 28 aa, Mycobacterium
HAVAPRAGDAMMAFGYSQSAVIASLAKL

SEQ ID NO: 1352062 - protein, 32 aa, Mycobacterium
HAVLNRLELAPAILVGWSFGGSLALGVARRYP

SEQ ID NO: 1352063 - protein, 17 aa, Mycobacterium
HAVRCRQNGWSWYIDTT

SEQ ID NO: 1352064 - protein, 18 aa, Mycobacterium
HAWDGSWTMLVITSVGTD

SEQ ID NO: 1352065 - protein, 24 aa, Mycobacterium
HDALDFAEQVRAEAALQGYSDEDI

SEQ ID NO: 1352066 - protein, 18 aa, Mycobacterium
HDASEAPNGTVFVANELG

SEQ ID NO: 1352067 - protein, 25 aa, Mycobacterium
HDIYWVDQDGAWKLSNPSACVIATD

SEQ ID NO: 1352068 - protein, 20 aa, Mycobacterium
HDTFLLALGQMWAAGVDLDW

SEQ ID NO: 1352069 - protein, 28 aa, Mycobacterium
HEDDLPMFRYWWGVPSDFESVVRAEVES

SEQ ID NO: 1352070 - protein, 20 aa, Mycobacterium
HELDVSGLPPILVISTTNDP

SEQ ID NO: 1352071 - protein, 22 aa, Mycobacterium
HEVPGDSFWDLVRKGAEAAAKK

SEQ ID NO: 1352072 - protein, 35 aa, Mycobacterium
HFTLPVWVHDPIVARPLIQLGLPAPAAGWLSSNTA

SEQ ID NO: 1352073 - protein, 18 aa, Mycobacterium
HGAVKRLLLGSVTTGLLH

SEQ ID NO: 1352074 - protein, 27 aa, Mycobacterium
HGGGFILEPLVTHWLDYAAMARDTGAT

SEQ ID NO: 1352075 - protein, 26 aa, Mycobacterium
HGGTGGDGGFWFGHGGNGGDGDAVLD

SEQ ID NO: 1352076 - protein, 17 aa, Mycobacterium
HGLHFCLGASLARLEVM

SEQ ID NO: 1352077 - protein, 25 aa, Mycobacterium
HGMAMPGMVDDATMKRLESLRGAEF

SEQ ID NO: 1352078 - protein, 22 aa, Mycobacterium
HGPKRYNWHQLVGSLQYTLYRL

SEQ ID NO: 1352079 - protein, 17 aa, Mycobacterium
HGPTPWDMTNNLSGEPC

SEQ ID NO: 1352080 - protein, 25 aa, Mycobacterium
HGRGRHCLRPPLSPLSRNTIDVFDE

SEQ ID NO: 1352081 - protein, 19 aa, Mycobacterium
HGSAVMRRGLAARFSALLV

SEQ ID NO: 1352082 - protein, 20 aa, Mycobacterium
HGSFAYCLSQHGVPAAPGPV

SEQ ID NO: 1352083 - protein, 25 aa, Mycobacterium
HGWTTVIVVSWRYHLPRARRIFDQC

SEQ ID NO: 1352084 - protein, 18 aa, Mycobacterium
HHDGRLSTVPAFVGDDSL

SEQ ID NO: 1352085 - protein, 20 aa, Mycobacterium
HHGIGYGLLRFLYGPTARTL

SEQ ID NO: 1352086 - protein, 28 aa, Mycobacterium
HLPLTRPFRDLGVPDCLVDAADHILRPI

SEQ ID NO: 1352087 - protein, 26 aa, Mycobacterium
HLRAVLRRFSPDWTHTDVTAALYRES

SEQ ID NO: 1352088 - protein, 24 aa, Mycobacterium
HLRQDLSGALAWESGVTPQPDTVY

SEQ ID NO: 1352089 - protein, 18 aa, Mycobacterium
HLVSLGLVGHSGHSATAT

SEQ ID NO: 1352090 - protein, 22 aa, Mycobacterium
HMTGRSVSFPWGMETNQSTERA

SEQ ID NO: 1352091 - protein, 17 aa, Mycobacterium
HPLPERVNTDIEMVSAP

SEQ ID NO: 1352092 - protein, 36 aa, Mycobacterium
HPSNLKTLCRFHHLLKTFWLGATGWRDRQYPDGTIE

SEQ ID NO: 1352093 - protein, 18 aa, Mycobacterium
HPSSLHWHGIALRNDMDG

SEQ ID NO: 1352094 - protein, 17 aa, Mycobacterium
HPVATFSSTAVRQDGDG

SEQ ID NO: 1352095 - protein, 25 aa, Mycobacterium
HPVVWYSGWGGRWGVWINGSFISLT

SEQ ID NO: 1352096 - protein, 17 aa, Mycobacterium
HRDGTVVGTLWIGDRHW

SEQ ID NO: 1352097 - protein, 17 aa, Mycobacterium
HRGAVEFDPPLPADYGE

SEQ ID NO: 1352098 - protein, 26 aa, Mycobacterium
HRHLFTVLMDREWKHGVTAAVDVTLL

SEQ ID NO: 1352099 - protein, 26 aa, Mycobacterium
HRPAEAGLDFAVRMDKGDFVGRAALE

SEQ ID NO: 1352100 - protein, 21 aa, Mycobacterium
HSADCRLNWVVVSSGHFDAPQ

SEQ ID NO: 1352101 - protein, 28 aa, Mycobacterium
HSGWAAGDARLFVGAPWVLSVDDHVDPG

SEQ ID NO: 1352102 - protein, 17 aa, Mycobacterium
HSHCASAGMLADRLGVS

SEQ ID NO: 1352103 - protein, 19 aa, Mycobacterium
HSLELRYLFDVGGAPPPDP

SEQ ID NO: 1352104 - protein, 18 aa, Mycobacterium
HSRAEAAASLALRGGDPA

SEQ ID NO: 1352105 - protein, 18 aa, Mycobacterium
HTAACGRAEHVAHAMGAR

SEQ ID NO: 1352106 - protein, 22 aa, Mycobacterium
HTAESQRALTFVDEEPAAEPEP

SEQ ID NO: 1352107 - protein, 25 aa, Mycobacterium
HTAPWSDRVEVHWGPHSEAYVTPVA

SEQ ID NO: 1352108 - protein, 25 aa, Mycobacterium
HTNLPRLLWSALRPLLSALGFTAPV

SEQ ID NO: 1352109 - protein, 24 aa, Mycobacterium
HTTFPLPAPSAWPAERDRRELTGQ

SEQ ID NO: 1352110 - protein, 17 aa, Mycobacterium
HVAAYDAIHTWDTTAAA

SEQ ID NO: 1352111 - protein, 21 aa, Mycobacterium
HVCVFPLAAPQSVSVPRTDLL

SEQ ID NO: 1352112 - protein, 23 aa, Mycobacterium
HVEAGVGSGAWRLGPAHAAARGG

SEQ ID NO: 1352113 - protein, 24 aa, Mycobacterium
HVISRGVAVLGLTAAAALPVVPIA

SEQ ID NO: 1352114 - protein, 27 aa, Mycobacterium
HVSFPFRLGFAEVYGLFARAGLHDRVT

SEQ ID NO: 1352115 - protein, 19 aa, Mycobacterium
HYADWRGMFAGNGMLYPKE

SEQ ID NO: 1352116 - protein, 20 aa, Mycobacterium
IAAAEPWWAPGTAQGYHMVT

SEQ ID NO: 1352117 - protein, 21 aa, Mycobacterium
IAAAPALFFVAAPSGGSTITY

SEQ ID NO: 1352118 - protein, 18 aa, Mycobacterium
IAAFLAMLAVVFAASLWV

SEQ ID NO: 1352119 - protein, 18 aa, Mycobacterium
IAAIGVLLATGFVALSAV

SEQ ID NO: 1352120 - protein, 18 aa, Mycobacterium
IAATCPDSRIVLGGYSQG

SEQ ID NO: 1352121 - protein, 20 aa, Mycobacterium
IADGQRWLFGLDVTSGEQLF

SEQ ID NO: 1352122 - protein, 23 aa, Mycobacterium
IADGRRASADWYFPDTDEPPTRI

SEQ ID NO: 1352123 - protein, 22 aa, Mycobacterium
IAELRGKRIAVGKGSSAHGHIL

SEQ ID NO: 1352124 - protein, 25 aa, Mycobacterium
IAETLPPGAERDAWLTFAVTGGGPT

SEQ ID NO: 1352125 - protein, 20 aa, Mycobacterium
IAFGSVVSFAVRPGNPKNIR

SEQ ID NO: 1352126 - protein, 18 aa, Mycobacterium
IAGDGSFAAIAMENQRDE

SEQ ID NO: 1352127 - protein, 18 aa, Mycobacterium
IAGVPVLGSEVILVTNAA

SEQ ID NO: 1352128 - protein, 24 aa, Mycobacterium
IAIVDGRTGAVQKIFSAGTASVSG

SEQ ID NO: 1352129 - protein, 17 aa, Mycobacterium
IALTGLYPPGSTFKTVT

SEQ ID NO: 1352130 - protein, 28 aa, Mycobacterium
IAQMQGWLDEWGMPGNMPPGHGDMPGGP

SEQ ID NO: 1352131 - protein, 20 aa, Mycobacterium
IARALSQRGVPFAYGGGGAS

SEQ ID NO: 1352132 - protein, 21 aa, Mycobacterium
IARNLSILPFNPFTFNPIQFS

SEQ ID NO: 1352133 - protein, 19 aa, Mycobacterium
IARSDGGVVRARHIDDAAL

SEQ ID NO: 1352134 - protein, 24 aa, Mycobacterium
IASIPAPVVTCLCGVINTVTNFFD

SEQ ID NO: 1352135 - protein, 17 aa, Mycobacterium
IASTFAAALAFGAIALI

SEQ ID NO: 1352136 - protein, 24 aa, Mycobacterium
IATCADCLRELFDPADRRHRHPFI

SEQ ID NO: 1352137 - protein, 19 aa, Mycobacterium
IATKTELTSIVANPYLVDG

SEQ ID NO: 1352138 - protein, 18 aa, Mycobacterium
IAVATTFAPEAFDDSGDY

SEQ ID NO: 1352139 - protein, 21 aa, Mycobacterium
IAVLAAPWIMRSRGPRGELAQ

SEQ ID NO: 1352140 - protein, 35 aa, Mycobacterium
IAVTDWFGAEPFGVWPWAQPRLGGAQPVVLSLADG

SEQ ID NO: 1352141 - protein, 20 aa, Mycobacterium
IAVVAALVLLAACGGQSDGA

SEQ ID NO: 1352142 - protein, 25 aa, Mycobacterium
IAVVMGMSGCADWQGLNSLPMPGTE

SEQ ID NO: 1352143 - protein, 18 aa, Mycobacterium
ICAALTLAALLSGCGGPD

SEQ ID NO: 1352144 - protein, 18 aa, Mycobacterium
IDAAREAARLAARGDDAS

SEQ ID NO: 1352145 - protein, 23 aa, Mycobacterium
IDADPWPAIGDWLADRSADTAVA

SEQ ID NO: 1352146 - protein, 23 aa, Mycobacterium
IDAMGNLWWDRPITVTGVDIRAG

SEQ ID NO: 1352147 - protein, 17 aa, Mycobacterium
IDEDCPLGTDPAKAVDV

SEQ ID NO: 1352148 - protein, 18 aa, Mycobacterium
IDGCIGQSFLRSYAILTS

SEQ ID NO: 1352149 - protein, 32 aa, Mycobacterium
IDGGADFTYRFSVPDPGTYWAHPHTGLDADTG

SEQ ID NO: 1352150 - protein, 18 aa, Mycobacterium
IDGLPYTGSYTERAVVGV

SEQ ID NO: 1352151 - protein, 23 aa, Mycobacterium
IDGVRRLCADGVLVAVSTRVPGG

SEQ ID NO: 1352152 - protein, 19 aa, Mycobacterium
IDHLVPLALAWDLGARNWT

SEQ ID NO: 1352153 - protein, 27 aa, Mycobacterium
IDLSLPDDFRWGVAHSGFQAEGGPGSP

SEQ ID NO: 1352154 - protein, 24 aa, Mycobacterium
IDLTFTNWRGVIAPPGISDQDRAA

SEQ ID NO: 1352155 - protein, 18 aa, Mycobacterium
IDNAKNPGDICARAQQAW

SEQ ID NO: 1352156 - protein, 19 aa, Mycobacterium
IDPSILLDIRYSAPHNFTG

SEQ ID NO: 1352157 - protein, 19 aa, Mycobacterium
IDPSSTFTYRFSAPHPGTY

SEQ ID NO: 1352158 - protein, 22 aa, Mycobacterium
IDRGRPAPNHHRWAAYLRWVAD

SEQ ID NO: 1352159 - protein, 18 aa, Mycobacterium
IDRYRYGLVPVALTEWLG

SEQ ID NO: 1352160 - protein, 25 aa, Mycobacterium
IDSLRPRWDELLVLIASDHDQEPID

SEQ ID NO: 1352161 - protein, 22 aa, Mycobacterium
IDSQKLPAWRSTDASLADFGGM

SEQ ID NO: 1352162 - protein, 17 aa, Mycobacterium
IDSRVIDMARQIKAAQD

SEQ ID NO: 1352163 - protein, 17 aa, Mycobacterium
IDVTGAWTEPDDWQDPR

SEQ ID NO: 1352164 - protein, 24 aa, Mycobacterium
IEAGLPGFEAFNVCSGRPISIIEV

SEQ ID NO: 1352165 - protein, 22 aa, Mycobacterium
IEAPPFPSYVDRLVAFMRAHPD

SEQ ID NO: 1352166 - protein, 18 aa, Mycobacterium
IEARRHLDPLITLIDQSQ

SEQ ID NO: 1352167 - protein, 17 aa, Mycobacterium
IEIEPRGSEALQSNGVL

SEQ ID NO: 1352168 - protein, 19 aa, Mycobacterium
IELSQAMSAFGDHSDDVFG

SEQ ID NO: 1352169 - protein, 17 aa, Mycobacterium
IELVKTPDGWRIDRLPN

SEQ ID NO: 1352170 - protein, 22 aa, Mycobacterium
IEPEEARVLLFDGGDRVLKSFA

SEQ ID NO: 1352171 - protein, 26 aa, Mycobacterium
IEPVLRIPRPEGWKRVTALDSGAIRY

SEQ ID NO: 1352172 - protein, 25 aa, Mycobacterium
IERPGENVERTWMVFDQFVVTADGS

SEQ ID NO: 1352173 - protein, 20 aa, Mycobacterium
IERQGWNALVTMAIDKDVDL

SEQ ID NO: 1352174 - protein, 32 aa, Mycobacterium
IERWDYGQKLVLARNATYWGQAPSFAKAEYQW

SEQ ID NO: 1352175 - protein, 20 aa, Mycobacterium
IETEELRTLITYDVGRHGIR

SEQ ID NO: 1352176 - protein, 17 aa, Mycobacterium
IETPALTVLEGRAAGER

SEQ ID NO: 1352177 - protein, 25 aa, Mycobacterium
IETRTVLWFRTYQLIDAPRNITTYR

SEQ ID NO: 1352178 - protein, 19 aa, Mycobacterium
IEVEARYAGSGELAAQLIT

SEQ ID NO: 1352179 - protein, 20 aa, Mycobacterium
IEWSAARYRQLQALTDERRR

SEQ ID NO: 1352180 - protein, 17 aa, Mycobacterium
IFHADIRGLPTLSESNS

SEQ ID NO: 1352181 - protein, 23 aa, Mycobacterium
IGDGQLHGWALGGIVVNSQAPIW

SEQ ID NO: 1352182 - protein, 19 aa, Mycobacterium
IGGFGGVDGLRRWLTDTPV

SEQ ID NO: 1352183 - protein, 18 aa, Mycobacterium
IGGLHIWHHAVTGGALLP

SEQ ID NO: 1352184 - protein, 22 aa, Mycobacterium
IGGLRPGQSVDVYDLAVGITLD

SEQ ID NO: 1352185 - protein, 19 aa, Mycobacterium
IGLAFALVLVALAGGVVAL

SEQ ID NO: 1352186 - protein, 20 aa, Mycobacterium
IGLASVLVLLLIAGLVTVSP

SEQ ID NO: 1352187 - protein, 27 aa, Mycobacterium
IGNGGRKYGGINGWWYGDALLTPTDTQ

SEQ ID NO: 1352188 - protein, 26 aa, Mycobacterium
IGNGGRKYGGLNGWWYGDALLTPTDT

SEQ ID NO: 1352189 - protein, 21 aa, Mycobacterium
IGPERVGLRISPGNNAGDMTE

SEQ ID NO: 1352190 - protein, 26 aa, Mycobacterium
IGPLRWRDPEPAPRWDGVRDATAFGS

SEQ ID NO: 1352191 - protein, 17 aa, Mycobacterium
IGPVAAFLASRRNSYMT

SEQ ID NO: 1352192 - protein, 17 aa, Mycobacterium
IGQVTPGQWSWVDRDGV

SEQ ID NO: 1352193 - protein, 17 aa, Mycobacterium
IGRAGSVLMPVVTVEDL

SEQ ID NO: 1352194 - protein, 23 aa, Mycobacterium
IGRVGALALALGVGGAVATTPGV

SEQ ID NO: 1352195 - protein, 23 aa, Mycobacterium
IHGLSGLIYNLTFGLLGRAGHSA

SEQ ID NO: 1352196 - protein, 19 aa, Mycobacterium
IHVVLRCDRVSDTIRRAAA

SEQ ID NO: 1352197 - protein, 27 aa, Mycobacterium
IIGDSKRSTGLFGFVVDWANDPKVFGG

SEQ ID NO: 1352198 - protein, 19 aa, Mycobacterium
IIGNWRGGVGTTWEARIKL

SEQ ID NO: 1352199 - protein, 18 aa, Mycobacterium
IISPYKIMGAAVVGTATV

SEQ ID NO: 1352200 - protein, 23 aa, Mycobacterium
IIVGVVTWADCLVALQQRQVDAV

SEQ ID NO: 1352201 - protein, 23 aa, Mycobacterium
IIVSTVTWADCLVALQQRQVDAV

SEQ ID NO: 1352202 - protein, 17 aa, Mycobacterium
IKAGRPTPEMLAYQYLQ

SEQ ID NO: 1352203 - protein, 20 aa, Mycobacterium
IKDPRAFDATGRMVFGDELW

SEQ ID NO: 1352204 - protein, 22 aa, Mycobacterium
IKKGRGDTMLALSDLYMGRDAQ

SEQ ID NO: 1352205 - protein, 20 aa, Mycobacterium
IKLSQAFSALGDHSDDLFTT

SEQ ID NO: 1352206 - protein, 26 aa, Mycobacterium
IKQMQGWLDQWGMPGPNAPGGDMGPH

SEQ ID NO: 1352207 - protein, 26 aa, Mycobacterium
IKRGMSQMGVPYSWGGGNASGPSRGI

SEQ ID NO: 1352208 - protein, 20 aa, Mycobacterium
ILDRHARGFDPRDLSAVRAV

SEQ ID NO: 1352209 - protein, 17 aa, Mycobacterium
ILDRMRPPAGLLQHPTW

SEQ ID NO: 1352210 - protein, 21 aa, Mycobacterium
ILGAVCGLLAFLKDPSAQSSP

SEQ ID NO: 1352211 - protein, 24 aa, Mycobacterium
ILHTRVLAGMAVGHMFPQSPIIVT

SEQ ID NO: 1352212 - protein, 30 aa, Mycobacterium
ILKNPALEAVRFSARYAPKLVHRSRGAARS

SEQ ID NO: 1352213 - protein, 19 aa, Mycobacterium
ILLDIRYSAPHNFTGDPVD

SEQ ID NO: 1352214 - protein, 19 aa, Mycobacterium
ILLTDIITAFGQRLAGQEV

SEQ ID NO: 1352215 - protein, 17 aa, Mycobacterium
ILPIALAAVLALVAPLT

SEQ ID NO: 1352216 - protein, 25 aa, Mycobacterium
ILQPVRTVFGAFEYVDILMNQPNAP

SEQ ID NO: 1352217 - protein, 31 aa, Mycobacterium
ILSKMFLAPIWDLISGYQFPELNNPVNEEEG

SEQ ID NO: 1352218 - protein, 19 aa, Mycobacterium
ILVEVGRRGLIGGQEDMIV

SEQ ID NO: 1352219 - protein, 18 aa, Mycobacterium
IMAYAMANAARFGLQDVI

SEQ ID NO: 1352220 - protein, 17 aa, Mycobacterium
IMGSIRMKVSSELDEMT

SEQ ID NO: 1352221 - protein, 23 aa, Mycobacterium
IMQDCSNTAIGVWSENSLDRTVV

SEQ ID NO: 1352222 - protein, 21 aa, Mycobacterium
IMRAALKYPLIAQIMRSPSAP

SEQ ID NO: 1352223 - protein, 17 aa, Mycobacterium
INAAFSVGGPRLLARTV

SEQ ID NO: 1352224 - protein, 34 aa, Mycobacterium
INAGYCYPDRTIGWDRGELLPGLQRAHGDMGVVM

SEQ ID NO: 1352225 - protein, 22 aa, Mycobacterium
INAYLRPAVNPERIIYTDPKLA

SEQ ID NO: 1352226 - protein, 19 aa, Mycobacterium
INAYLRPAVSPERTIYTDP

SEQ ID NO: 1352227 - protein, 22 aa, Mycobacterium
INLPPPCTTGFLPAQQQRSPVF

SEQ ID NO: 1352228 - protein, 33 aa, Mycobacterium
INNPLGLWSRLSFLRYIPLLNVSFGPQLPTDIG

SEQ ID NO: 1352229 - protein, 23 aa, Mycobacterium
IPANLREAFELIVGGNPAEGIPA

SEQ ID NO: 1352230 - protein, 23 aa, Mycobacterium
IPAQDGLFVLKLIADGTEEVAYP

SEQ ID NO: 1352231 - protein, 33 aa, Mycobacterium
IPDVLKVRAPVVIGEGVGAFAAGMAYQDILAQL

SEQ ID NO: 1352232 - protein, 22 aa, Mycobacterium
IPGTRARPFHPGWKPGPGMGSW

SEQ ID NO: 1352233 - protein, 20 aa, Mycobacterium
IPGVITPYVLDGRLLADGGI

SEQ ID NO: 1352234 - protein, 20 aa, Mycobacterium
IPITASPVWGSRSIDLCNGL

SEQ ID NO: 1352235 - protein, 18 aa, Mycobacterium
IPLLRDLLTQGLNVAGLN

SEQ ID NO: 1352236 - protein, 24 aa, Mycobacterium
IPQDLVCEGTAWSAGRTAPEGDAA

SEQ ID NO: 1352237 - protein, 20 aa, Mycobacterium
IPSAQMRRGDLIFYGPNASQ

SEQ ID NO: 1352238 - protein, 25 aa, Mycobacterium
IPSPLELYPQVLVRAVQNSAALVEA

SEQ ID NO: 1352239 - protein, 20 aa, Mycobacterium
IPSSQMRRGDLIFYGPNASQ

SEQ ID NO: 1352240 - protein, 17 aa, Mycobacterium
IPTPLLPLLKPLADAGA

SEQ ID NO: 1352241 - protein, 28 aa, Mycobacterium
IPYDEYIMRTGADWFPGLDRQIVDYPAG

SEQ ID NO: 1352242 - protein, 27 aa, Mycobacterium
IQDAGRWRVPLLFAIRPEVGVDDVRAV

SEQ ID NO: 1352243 - protein, 23 aa, Mycobacterium
IQDASGAPARIPVDAGPVALEFP

SEQ ID NO: 1352244 - protein, 23 aa, Mycobacterium
IQDASGAPARIPVDAGPVALKFP

SEQ ID NO: 1352245 - protein, 18 aa, Mycobacterium
IQDGFCVAACDLLVDDLG

SEQ ID NO: 1352246 - protein, 25 aa, Mycobacterium
IQEFVKKLPAWVSWERRDRYERDLV

SEQ ID NO: 1352247 - protein, 25 aa, Mycobacterium
IQFLCGAIEAASRLGAEQAAKLCVQ

SEQ ID NO: 1352248 - protein, 20 aa, Mycobacterium
IQFNDDFIEWSISYAQPPFP

SEQ ID NO: 1352249 - protein, 17 aa, Mycobacterium
IQLDLSDVITFHSYADR

SEQ ID NO: 1352250 - protein, 21 aa, Mycobacterium
IQQLRRVAGTFANQREVIDRA

SEQ ID NO: 1352251 - protein, 20 aa, Mycobacterium
IQSFDWRTLPLVRQQAPSVP

SEQ ID NO: 1352252 - protein, 26 aa, Mycobacterium
IQSTFVGAICRWQAANPAGLVDITRF

SEQ ID NO: 1352253 - protein, 17 aa, Mycobacterium
IRAGVQLAGVRTAADGV

SEQ ID NO: 1352254 - protein, 17 aa, Mycobacterium
IRATVRFADELSTVLAT

SEQ ID NO: 1352255 - protein, 28 aa, Mycobacterium
IRDGGGIPSFLGYHGFPASICASVNDRV

SEQ ID NO: 1352256 - protein, 21 aa, Mycobacterium
IRDLEGFTGAYWEGTVGDGKA

SEQ ID NO: 1352257 - protein, 17 aa, Mycobacterium
IREAMGLTSGARAVADG

SEQ ID NO: 1352258 - protein, 25 aa, Mycobacterium
IRIGRRIMARLNWRKNGPGPTTPPH

SEQ ID NO: 1352259 - protein, 19 aa, Mycobacterium
IRILAPRSHQPGSLATWFD

SEQ ID NO: 1352260 - protein, 21 aa, Mycobacterium
IRNPHEWDKPFNMGRYVTDQE

SEQ ID NO: 1352261 - protein, 21 aa, Mycobacterium
IRPANSAPRAKAIVGKGNPSN

SEQ ID NO: 1352262 - protein, 19 aa, Mycobacterium
IRPEAQWTDNAPIGADDYW

SEQ ID NO: 1352263 - protein, 34 aa, Mycobacterium
IRPEPTRARITFWVDRRYPVPADAKAVILSPQLV

SEQ ID NO: 1352264 - protein, 18 aa, Mycobacterium
IRPIHVVLRCDRVSDTIR

SEQ ID NO: 1352265 - protein, 24 aa, Mycobacterium
IRQCIPGPAIGPVPYPGAPPYGAA

SEQ ID NO: 1352266 - protein, 19 aa, Mycobacterium
IRRAPIVDGIDEFDNDFFG

SEQ ID NO: 1352267 - protein, 20 aa, Mycobacterium
IRRDGTWNTLYRKWLTVLGP

SEQ ID NO: 1352268 - protein, 19 aa, Mycobacterium
IRRSDAPRLVDLVRESQQS

SEQ ID NO: 1352269 - protein, 17 aa, Mycobacterium
IRSRRMGTDWLDVPVSK

SEQ ID NO: 1352270 - protein, 24 aa, Mycobacterium
ISALLPPPVIEGFEQPMGAVPGLG

SEQ ID NO: 1352271 - protein, 21 aa, Mycobacterium
ISALNRPVAAGGDARNQNTVL

SEQ ID NO: 1352272 - protein, 27 aa, Mycobacterium
ISEPMPVAATFSWEFEDGSSLGQLARL

SEQ ID NO: 1352273 - protein, 21 aa, Mycobacterium
ISHFSAASLFAGKITGVTPGS

SEQ ID NO: 1352274 - protein, 19 aa, Mycobacterium
ISIFCPRAVSAMTDGVPFS

SEQ ID NO: 1352275 - protein, 20 aa, Mycobacterium
ISLAAVFLALAIGIALGSGM

SEQ ID NO: 1352276 - protein, 25 aa, Mycobacterium
ISLDGPRVLVEFDVDKGVRLGDRTE

SEQ ID NO: 1352277 - protein, 19 aa, Mycobacterium
ISPGLQRKLIVQLTQPGTY

SEQ ID NO: 1352278 - protein, 18 aa, Mycobacterium
ISSTEWLGTEGNPGNLAV

SEQ ID NO: 1352279 - protein, 18 aa, Mycobacterium
ISTDGGGTEQVWTTASTV

SEQ ID NO: 1352280 - protein, 24 aa, Mycobacterium
ISVPRPGTPIEWGPCEAGPSDQVR

SEQ ID NO: 1352281 - protein, 19 aa, Mycobacterium
ITACIALVLGLSACSDTAP

SEQ ID NO: 1352282 - protein, 24 aa, Mycobacterium
ITENRPQFKPALDKLNGVLTIVER

SEQ ID NO: 1352283 - protein, 23 aa, Mycobacterium
ITEQPWWGAYAWYVTPPSPAYPF

SEQ ID NO: 1352284 - protein, 23 aa, Mycobacterium
ITGGTCCIGVWGPLARDMVQPLC

SEQ ID NO: 1352285 - protein, 22 aa, Mycobacterium
ITRATTKFALRRALEPVVPAHV

SEQ ID NO: 1352286 - protein, 17 aa, Mycobacterium
ITRLPRDLGAVIDSLVA

SEQ ID NO: 1352287 - protein, 23 aa, Mycobacterium
ITYSEDWLRPDYVPPPQAPLNDP

SEQ ID NO: 1352288 - protein, 20 aa, Mycobacterium
IVALGEAFDALGEGDGAAAM

SEQ ID NO: 1352289 - protein, 18 aa, Mycobacterium
IVDLCTGSGALALALAVA

SEQ ID NO: 1352290 - protein, 22 aa, Mycobacterium
IVDRLSWLGAQGVTVSAVPIPK

SEQ ID NO: 1352291 - protein, 27 aa, Mycobacterium
IVEIPGLGTPAARRLWTGNIHGPAETD

SEQ ID NO: 1352292 - protein, 20 aa, Mycobacterium
IVGAPIAADLYFKEAGASVE

SEQ ID NO: 1352293 - protein, 18 aa, Mycobacterium
IVGARLGFESTFTDPFQA

SEQ ID NO: 1352294 - protein, 20 aa, Mycobacterium
IVGLAARLVASIPVAVDNLT

SEQ ID NO: 1352295 - protein, 20 aa, Mycobacterium
IVGSSILAPVIMTLQQIPVI

SEQ ID NO: 1352296 - protein, 33 aa, Mycobacterium
IVMGHSFGAQVCSRWMRVYARDPVRRAMADRLT

SEQ ID NO: 1352297 - protein, 17 aa, Mycobacterium
IVTPRVMQVTLRGQLPK

SEQ ID NO: 1352298 - protein, 20 aa, Mycobacterium
IWGSWCAPCRTETPELEKVF

SEQ ID NO: 1352299 - protein, 17 aa, Mycobacterium
IYCPCHGSMFSLDGEVV

SEQ ID NO: 1352300 - protein, 23 aa, Mycobacterium
IYGCAPFCVAGKYLDTQTGLCMP

SEQ ID NO: 1352301 - protein, 17 aa, Mycobacterium
IYLGEFGTRMTDPKDLV

SEQ ID NO: 1352302 - protein, 17 aa, Mycobacterium
IYRTRLWLRSESNISVI

SEQ ID NO: 1352303 - protein, 24 aa, Mycobacterium
IYSSCALPPVLEYLKSGELPSTDT

SEQ ID NO: 1352304 - protein, 19 aa, Mycobacterium
IYVHVPVMFADLSKVPAEN

SEQ ID NO: 1352305 - protein, 31 aa, Mycobacterium
KAAQRLASDMGEFFMPFPGTRVNQQVVPLDN

SEQ ID NO: 1352306 - protein, 19 aa, Mycobacterium
KADASGYGGELWVLDLSPD

SEQ ID NO: 1352307 - protein, 21 aa, Mycobacterium
KADFQAIVAALLQLEGEPATA

SEQ ID NO: 1352308 - protein, 18 aa, Mycobacterium
KAEYQWRSEGSVRAAMIT

SEQ ID NO: 1352309 - protein, 24 aa, Mycobacterium
KAGDVLDALFTRGGINGITKAVLA

SEQ ID NO: 1352310 - protein, 17 aa, Mycobacterium
KALLLAGTLFRDSVQVS

SEQ ID NO: 1352311 - protein, 18 aa, Mycobacterium
KANLPMDAGCTGTAPPTC

SEQ ID NO: 1352312 - protein, 22 aa, Mycobacterium
KAPDPDRIVLVVTFGNPENKFG

SEQ ID NO: 1352313 - protein, 17 aa, Mycobacterium
KAPNMTVLVGGPSGVLG

SEQ ID NO: 1352314 - protein, 20 aa, Mycobacterium
KARVKAVPLVSGHSGGTVSA

SEQ ID NO: 1352315 - protein, 21 aa, Mycobacterium
KASDFTYAIQRLFKTDSGGSV

SEQ ID NO: 1352316 - protein, 28 aa, Mycobacterium
KATEQRWLVKRARIYRNVVIPQPDNPAS

SEQ ID NO: 1352317 - protein, 17 aa, Mycobacterium
KAVDVYRSLVWPLVDAP

SEQ ID NO: 1352318 - protein, 22 aa, Mycobacterium
KDARGFGGVGGAGGRSGVTGTG

SEQ ID NO: 1352319 - protein, 20 aa, Mycobacterium
KDHPEVLLIVTADHETGGMT

SEQ ID NO: 1352320 - protein, 18 aa, Mycobacterium
KDIGFPYRSALLPRRNAE

SEQ ID NO: 1352321 - protein, 19 aa, Mycobacterium
KDYMKLVGERLGWARVPPG

SEQ ID NO: 1352322 - protein, 21 aa, Mycobacterium
KEGTRIPLLNYTVSRVAQSPY

SEQ ID NO: 1352323 - protein, 27 aa, Mycobacterium
KELARLLGEAGPILWGDMPTLPLYRQQ

SEQ ID NO: 1352324 - protein, 17 aa, Mycobacterium
KELQAGVSAPDFSVDST

SEQ ID NO: 1352325 - protein, 18 aa, Mycobacterium
KENLTKWFRGDYGNLTMV

SEQ ID NO: 1352326 - protein, 25 aa, Mycobacterium
KEPSELEIPTLLLGVANNPIVGNEG

SEQ ID NO: 1352327 - protein, 21 aa, Mycobacterium
KEQLTRLATALGPEAGVSDTS

SEQ ID NO: 1352328 - protein, 17 aa, Mycobacterium
KESLSLDLNSPAGMDIL

SEQ ID NO: 1352329 - protein, 18 aa, Mycobacterium
KETLTNWMRGDYANLTLI

SEQ ID NO: 1352330 - protein, 22 aa, Mycobacterium
KFDGPYFVMQWLLRQPRKAVLP

SEQ ID NO: 1352331 - protein, 22 aa, Mycobacterium
KGESPGRWMGRGLAALADTGAR

SEQ ID NO: 1352332 - protein, 18 aa, Mycobacterium
KGIPVVAFNAGMDSWKAM

SEQ ID NO: 1352333 - protein, 19 aa, Mycobacterium
KGLNSYALGLGEAVSSGPF

SEQ ID NO: 1352334 - protein, 17 aa, Mycobacterium
KGLRLARAQAAAVRAQG

SEQ ID NO: 1352335 - protein, 29 aa, Mycobacterium
KGNTIAWLYSQRRFEVPSEQIANTMKLAI

SEQ ID NO: 1352336 - protein, 18 aa, Mycobacterium
KGPFQMILRLYWPKPDAL

SEQ ID NO: 1352337 - protein, 20 aa, Mycobacterium
KGRDLSTCETVWSLSGDNGS

SEQ ID NO: 1352338 - protein, 17 aa, Mycobacterium
KGRDLYFTLSRWSDYST

SEQ ID NO: 1352339 - protein, 21 aa, Mycobacterium
KGTANIIFLGQRLNDVAFVVS

SEQ ID NO: 1352340 - protein, 25 aa, Mycobacterium
KGTPNPPAILVRMARLEGGTFDVAK

SEQ ID NO: 1352341 - protein, 22 aa, Mycobacterium
KGTRFVAVAGIGLLAPGETGQL

SEQ ID NO: 1352342 - protein, 20 aa, Mycobacterium
KHALPHLRVEGGSIVNTAST

SEQ ID NO: 1352343 - protein, 20 aa, Mycobacterium
KHRAVAAVVCAGLVAACSAG

SEQ ID NO: 1352344 - protein, 19 aa, Mycobacterium
KIERQGWHALVTIELNGDV

SEQ ID NO: 1352345 - protein, 19 aa, Mycobacterium
KILTRRTFLAATLAASTAA

SEQ ID NO: 1352346 - protein, 17 aa, Mycobacterium
KINPQLQLAAQWHTNDV

SEQ ID NO: 1352347 - protein, 18 aa, Mycobacterium
KISFERVDAELSVVGLNN

SEQ ID NO: 1352348 - protein, 27 aa, Mycobacterium
KIVVSRQDLRFSWRNSEQLTGDLVEAV

SEQ ID NO: 1352349 - protein, 18 aa, Mycobacterium
KKKVGFSTVYLNADQRIL

SEQ ID NO: 1352350 - protein, 19 aa, Mycobacterium
KLAGVVLLDGVGFGDVTPE

SEQ ID NO: 1352351 - protein, 18 aa, Mycobacterium
KLDVWERTAAGWQPVAGG

SEQ ID NO: 1352352 - protein, 30 aa, Mycobacterium
KLESLSGPEFDKLWLQSMIGQHQGAVELAN

SEQ ID NO: 1352353 - protein, 18 aa, Mycobacterium
KLGIPITASPVWGSRSID

SEQ ID NO: 1352354 - protein, 20 aa, Mycobacterium
KLGVDMEDYLILGACNPSLA

SEQ ID NO: 1352355 - protein, 20 aa, Mycobacterium
KLKEEVIRHNKLRPGLAKYV

SEQ ID NO: 1352356 - protein, 18 aa, Mycobacterium
KLPFGIAPTTEGARGSDL

SEQ ID NO: 1352357 - protein, 18 aa, Mycobacterium
KLPGLHLVSIDRPGFGWS

SEQ ID NO: 1352358 - protein, 17 aa, Mycobacterium
KLSNPSACVIATDVAGV

SEQ ID NO: 1352359 - protein, 17 aa, Mycobacterium
KLSVYDIATKTELTSIV

SEQ ID NO: 1352360 - protein, 24 aa, Mycobacterium
KLTAIGVDLPDVFTVLEDEGVEKF

SEQ ID NO: 1352361 - protein, 19 aa, Mycobacterium
KMLAQRYANDPTVIGADLH

SEQ ID NO: 1352362 - protein, 19 aa, Mycobacterium
KMQRFPAGLLVFGDAICSF

SEQ ID NO: 1352363 - protein, 30 aa, Mycobacterium
KMTRILRSKGFCWIASRPTIAAIWSQAGPN

SEQ ID NO: 1352364 - protein, 18 aa, Mycobacterium
KNALARALLSTGAGAAPD

SEQ ID NO: 1352365 - protein, 18 aa, Mycobacterium
KNLIRWRGSVRSYRSTVP

SEQ ID NO: 1352366 - protein, 25 aa, Mycobacterium
KNPDGAWEFISWMTSKDYMKLVGER

SEQ ID NO: 1352367 - protein, 28 aa, Mycobacterium
KNSTLVLPFPVELLRFLERSTPQAQSDG

SEQ ID NO: 1352368 - protein, 29 aa, Mycobacterium
KNSTLVLPFPVELLRFLERSTPRAQGESA

SEQ ID NO: 1352369 - protein, 25 aa, Mycobacterium
KPACGKSGCLTYNWETFLTQELPGW

SEQ ID NO: 1352370 - protein, 23 aa, Mycobacterium
KPDLEIWYTLPVLPTGLTADGLN

SEQ ID NO: 1352371 - protein, 23 aa, Mycobacterium
KPGKYADPWAAIRSRLGDPGLDR

SEQ ID NO: 1352372 - protein, 24 aa, Mycobacterium
KPLSNALGEHVSWWAKANLPMDAG

SEQ ID NO: 1352373 - protein, 19 aa, Mycobacterium
KPLTLRDVFYDGASTRAIA

SEQ ID NO: 1352374 - protein, 19 aa, Mycobacterium
KPSDGLGVGEVGYLITGVK

SEQ ID NO: 1352375 - protein, 24 aa, Mycobacterium
KPSVRELRECVGRPLPTEAEQLAA

SEQ ID NO: 1352376 - protein, 20 aa, Mycobacterium
KQMRAAMTLVNRILTAQTPG

SEQ ID NO: 1352377 - protein, 26 aa, Mycobacterium
KRFPAIGVPEAVAWVTWTNASRDVPG

SEQ ID NO: 1352378 - protein, 18 aa, Mycobacterium
KRGDPGAPIIDLPIPEGW

SEQ ID NO: 1352379 - protein, 21 aa, Mycobacterium
KRPRSTMAPTLVFDASTGPPG

SEQ ID NO: 1352380 - protein, 28 aa, Mycobacterium
KRREICRQRMGPVFKRITMNFPPLLAHP

SEQ ID NO: 1352381 - protein, 26 aa, Mycobacterium
KRRKGLPTSFRRSALTGATAALTAVF

SEQ ID NO: 1352382 - protein, 19 aa, Mycobacterium
KRRLVEIADEVAARLNNKP

SEQ ID NO: 1352383 - protein, 19 aa, Mycobacterium
KRVGTPFASTAHYSLLAAL

SEQ ID NO: 1352384 - protein, 19 aa, Mycobacterium
KRVSLPADVAAGLGGQGLE

SEQ ID NO: 1352385 - protein, 24 aa, Mycobacterium
KSAGARVQRPLWASTGVKNPDYSD

SEQ ID NO: 1352386 - protein, 35 aa, Mycobacterium; identical to SEQ ID NO: 1253293

SEQ ID NO: 1352387 - protein, 21 aa, Mycobacterium
KSGIPGMAVAVVHGGKAVYAK

SEQ ID NO: 1352388 - protein, 17 aa, Mycobacterium
KTPDGWRIDRLPNGVFL

SEQ ID NO: 1352389 - protein, 40 aa, Mycobacterium
KTTPPVEGAFYWLNNREVRWRPAKYWKPGTTVEVAVNTYG

SEQ ID NO: 1352390 - protein, 19 aa, Mycobacterium
KTTWRELFEPAVQLADGGF

SEQ ID NO: 1352391 - protein, 18 aa, Mycobacterium
KTVVSLDLGSMVAGAKYR

SEQ ID NO: 1352392 - protein, 27 aa, Mycobacterium
KTYPVPLLMPVAWLPDPIIAALDAPLR

SEQ ID NO: 1352393 - protein, 24 aa, Mycobacterium
KVERQGWHALLTMRLNADVNLPEN

SEQ ID NO: 1352394 - protein, 26 aa, Mycobacterium
KVTLYVRPAAWGMWTFYELSEEDKRQ

SEQ ID NO: 1352395 - protein, 20 aa, Mycobacterium
KWGIPESRIVELDWNEAHRI

SEQ ID NO: 1352396 - protein, 27 aa, Mycobacterium
KYGYPDIGTTLALGARTIFASVPYYVD

SEQ ID NO: 1352397 - protein, 22 aa, Mycobacterium
LAACGLAASVVLSGCSAGQVSQ

SEQ ID NO: 1352398 - protein, 24 aa, Mycobacterium
LAADGSFTYTISKLLTSSYYHEAA

SEQ ID NO: 1352399 - protein, 19 aa, Mycobacterium
LAAILARAADMLALGADAA

SEQ ID NO: 1352400 - protein, 21 aa, Mycobacterium
LAALAPRPGELLWDVGAGSGS

SEQ ID NO: 1352401 - protein, 21 aa, Mycobacterium
LAALAPRPGGLLWDVGAGSGS

SEQ ID NO: 1352402 - protein, 18 aa, Mycobacterium
LAALARAAGCVSGDLANG

SEQ ID NO: 1352403 - protein, 23 aa, Mycobacterium
LAALGMVWPFLFYGAPAAAEPSP

SEQ ID NO: 1352404 - protein, 30 aa, Mycobacterium
LAALSGKCKLPLTLPQVFGLMQAAQQVPAL

SEQ ID NO: 1352405 - protein, 26 aa, Mycobacterium
LAATAGEVPLAFALAAGSFRDGTRVA

SEQ ID NO: 1352406 - protein, 19 aa, Mycobacterium
LAAVEEIRTKGTVPAQLPE

SEQ ID NO: 1352407 - protein, 21 aa, Mycobacterium
LAAVPARRALALCTPRDVIAR

SEQ ID NO: 1352408 - protein, 19 aa, Mycobacterium
LADELVRLVGTEAPTATAP

SEQ ID NO: 1352409 - protein, 18 aa, Mycobacterium
LAEEIVRMTGRAAPTTSV

SEQ ID NO: 1352410 - protein, 18 aa, Mycobacterium
LAELCQAALQQSDNAAAN

SEQ ID NO: 1352411 - protein, 17 aa, Mycobacterium
LAFPLTSLLTIPKAMFD

SEQ ID NO: 1352412 - protein, 18 aa, Mycobacterium
LAGAGCARFDSAQSQPFT

SEQ ID NO: 1352413 - protein, 18 aa, Mycobacterium
LAGAIAYASTLSYPVVAD

SEQ ID NO: 1352414 - protein, 25 aa, Mycobacterium
LAGALRPDLLITRVVERGGELHFAT

SEQ ID NO: 1352415 - protein, 19 aa, Mycobacterium
LAGDLPVRRVRLQMMQTAP

SEQ ID NO: 1352416 - protein, 18 aa, Mycobacterium
LAGGRGGDSGYLLGNGGN

SEQ ID NO: 1352417 - protein, 17 aa, Mycobacterium
LAGLLSGCAGWRGLNSL

SEQ ID NO: 1352418 - protein, 24 aa, Mycobacterium
LAGLRAGDILIELDGTPLDSTNTL

SEQ ID NO: 1352419 - protein, 20 aa, Mycobacterium
LAGLRARAALEPCPTGGDAG

SEQ ID NO: 1352420 - protein, 21 aa, Mycobacterium
LAGRKSRWLRNAGVASAAANA

SEQ ID NO: 1352421 - protein, 21 aa, Mycobacterium
LAHALRRLGIEGDDRVGTFMW

SEQ ID NO: 1352422 - protein, 22 aa, Mycobacterium
LAICGLLATAQPAYGWAQPAAE

SEQ ID NO: 1352423 - protein, 22 aa, Mycobacterium
LAICGLLATAQPSYGWAQPAAE

SEQ ID NO: 1352424 - protein, 29 aa, Mycobacterium
LAISGVEIMNQWYYRPDYMAIMSNCANTQ

SEQ ID NO: 1352425 - protein, 24 aa, Mycobacterium
LAKAAELRYGRIPEVEKKLDAAVP

SEQ ID NO: 1352426 - protein, 26 aa, Mycobacterium
LAKTIKETDRSAAIVVADHEYFDNFL

SEQ ID NO: 1352427 - protein, 17 aa, Mycobacterium
LALAEATVQLRIWQRGA

SEQ ID NO: 1352428 - protein, 24 aa, Mycobacterium
LALANAFAGFQYVHIYGYDDVDLE

SEQ ID NO: 1352429 - protein, 18 aa, Mycobacterium
LALSEMTIHYTGRESHAA

SEQ ID NO: 1352430 - protein, 21 aa, Mycobacterium
LANALAAFYYVHLDYSDVDLD

SEQ ID NO: 1352431 - protein, 18 aa, Mycobacterium
LANMVGELIELSRLQGAE

SEQ ID NO: 1352432 - protein, 26 aa, Mycobacterium
LANPDVYRPAALLPTPRETATFLRNL

SEQ ID NO: 1352433 - protein, 24 aa, Mycobacterium
LAPMTTCGFWPVPPTSVPHELDVS

SEQ ID NO: 1352434 - protein, 23 aa, Mycobacterium
LAPNGRVAIMFSDIEESTALNER

SEQ ID NO: 1352435 - protein, 25 aa, Mycobacterium
LAPQLAAPMRSWALAATKLLLLMGL

SEQ ID NO: 1352436 - protein, 18 aa, Mycobacterium
LAQARPPLAKTIKETDRS

SEQ ID NO: 1352437 - protein, 20 aa, Mycobacterium
LAQLIGIDFRRQRVELETEL

SEQ ID NO: 1352438 - protein, 20 aa, Mycobacterium
LASACQRMHDGAAVDVPAQL

SEQ ID NO: 1352439 - protein, 24 aa, Mycobacterium
LASEANPLVGLPFYVNPQSKGMRA

SEQ ID NO: 1352440 - protein, 25 aa, Mycobacterium
LASIVSKFLGVLGIGPSAANGAVPL

SEQ ID NO: 1352441 - protein, 23 aa, Mycobacterium
LASRYGCPALEATPVQTAPAAPP

SEQ ID NO: 1352442 - protein, 19 aa, Mycobacterium
LASVAVCFARVVAHPPVDG

SEQ ID NO: 1352443 - protein, 18 aa, Mycobacterium
LATAQAMAPQSLTPEEEH

SEQ ID NO: 1352444 - protein, 27 aa, Mycobacterium
LATFALLTVFAQFRFGDGRTYFAEFDN

SEQ ID NO: 1352445 - protein, 24 aa, Mycobacterium
LATPKGWMKALWAYNQSDPYSRSV

SEQ ID NO: 1352446 - protein, 22 aa, Mycobacterium
LATQAACRVLRNGGTAADAMVT

SEQ ID NO: 1352447 - protein, 18 aa, Mycobacterium
LAVAACSRVSDGVPVADP

SEQ ID NO: 1352448 - protein, 33 aa, Mycobacterium
LAVDVGMHVNVLDWFRPWGTRATPLINQGAVTF

SEQ ID NO: 1352449 - protein, 17 aa, Mycobacterium
LAVLMVLVAACGRGDAG

SEQ ID NO: 1352450 - protein, 19 aa, Mycobacterium
LAVLPEVFDLVDAYGADTV

SEQ ID NO: 1352451 - protein, 24 aa, Mycobacterium
LAVQEMLRRCRIDVHCVVSEAQPS

SEQ ID NO: 1352452 - protein, 17 aa, Mycobacterium
LAVRTGMHIEGRSESKG

SEQ ID NO: 1352453 - protein, 24 aa, Mycobacterium
LAVSLPFVLSACGGDDTSAMDTSA

SEQ ID NO: 1352454 - protein, 20 aa, Mycobacterium
LAVVCIAAIVALAVGLFNGS

SEQ ID NO: 1352455 - protein, 24 aa, Mycobacterium
LAYSQGALIAADWIEQNAGTSGSP

SEQ ID NO: 1352456 - protein, 17 aa, Mycobacterium
LAYSVSTQGRFRFLRVY

SEQ ID NO: 1352457 - protein, 19 aa, Mycobacterium
LCACVSTVEGAAVRHPGAA

SEQ ID NO: 1352458 - protein, 21 aa, Mycobacterium
LCALMVFAVGCAGVPSSSSPQ

SEQ ID NO: 1352459 - protein, 17 aa, Mycobacterium
LCALVAAVVVVWQTTPG

SEQ ID NO: 1352460 - protein, 21 aa, Mycobacterium
LCGAVQAASRLGAEESAKLCV

SEQ ID NO: 1352461 - protein, 20 aa, Mycobacterium
LCGLPAVRGHYMSPLLGTAA

SEQ ID NO: 1352462 - protein, 19 aa, Mycobacterium
LCLLLGVAIATQVRQTDSG

SEQ ID NO: 1352463 - protein, 18 aa, Mycobacterium
LDAAMTWQRDGAEWIHLV

SEQ ID NO: 1352464 - protein, 18 aa, Mycobacterium
LDADYGLYAPVIIDDAAE

SEQ ID NO: 1352465 - protein, 17 aa, Mycobacterium
LDADYGLYAPVIIDDPA

SEQ ID NO: 1352466 - protein, 24 aa, Mycobacterium
LDAEALKDIALYLNFDMLGSPNPG

SEQ ID NO: 1352467 - protein, 18 aa, Mycobacterium
LDAPWAPFTIDFNLANIG

SEQ ID NO: 1352468 - protein, 18 aa, Mycobacterium
LDAQLAVTIPIFGTKTHD

SEQ ID NO: 1352469 - protein, 19 aa, Mycobacterium
LDATFRPLVERDYRRPAFT

SEQ ID NO: 1352470 - protein, 22 aa, Mycobacterium
LDDIRVRQAINYAVNRTGIVKA

SEQ ID NO: 1352471 - protein, 33 aa, Mycobacterium
LDDPEKRFFILLALRLRGVVGLGPNDSRQAPSS

SEQ ID NO: 1352472 - protein, 17 aa, Mycobacterium
LDDRAWVAAERALATGE

SEQ ID NO: 1352473 - protein, 17 aa, Mycobacterium
LDDVIAHPLDLFVAALI

SEQ ID NO: 1352474 - protein, 17 aa, Mycobacterium
LDDVIMFDALNPEQLVS

SEQ ID NO: 1352475 - protein, 23 aa, Mycobacterium
LDGFPAKNGVYGFFTYPNDETAG

SEQ ID NO: 1352476 - protein, 20 aa, Mycobacterium
LDGRIAHRGLRMSGFGADVE

SEQ ID NO: 1352477 - protein, 17 aa, Mycobacterium
LDHALRLLIDARNQLAQ

SEQ ID NO: 1352478 - protein, 27 aa, Mycobacterium
LDKMIWEIGHSLPLFQAPGNVAVRSNL

SEQ ID NO: 1352479 - protein, 17 aa, Mycobacterium
LDLGDVSVHNFIVVDTA

SEQ ID NO: 1352480 - protein, 17 aa, Mycobacterium
LDPATAVDRIADFDLVV

SEQ ID NO: 1352481 - protein, 26 aa, Mycobacterium
LDPEAGRPGVQLSLLTGTPNLGYGNE

SEQ ID NO: 1352482 - protein, 17 aa, Mycobacterium
LDPLYRQAVDHATRNYC

SEQ ID NO: 1352483 - protein, 25 aa, Mycobacterium
LDPTTGAFRFLPFASEKNPDGSQNA

SEQ ID NO: 1352484 - protein, 17 aa, Mycobacterium
LDQRIEALGQRHNAQIG

SEQ ID NO: 1352485 - protein, 24 aa, Mycobacterium
LDREHRVAAVFLRELLAEDLQPVV

SEQ ID NO: 1352486 - protein, 25 aa, Mycobacterium
LDRREYFHGGVLRVTVPGVRIEGNG

SEQ ID NO: 1352487 - protein, 19 aa, Mycobacterium
LDRSHRVAAVFLRALLAED

SEQ ID NO: 1352488 - protein, 20 aa, Mycobacterium
LDRSHRVAAVFLRALLAEDL

SEQ ID NO: 1352489 - protein, 21 aa, Mycobacterium
LDSIVKFRWNGSGVELIGNTA

SEQ ID NO: 1352490 - protein, 23 aa, Mycobacterium
LDVACGGVPLGVLASLHGHGVVV

SEQ ID NO: 1352491 - protein, 23 aa, Mycobacterium
LDVDVVLCATGYAAADYLGQIEV

SEQ ID NO: 1352492 - protein, 21 aa, Mycobacterium
LDVINELRAAGAEAMEIRGEQ

SEQ ID NO: 1352493 - protein, 20 aa, Mycobacterium
LDVLACGAGVVARREQIDVD

SEQ ID NO: 1352494 - protein, 25 aa, Mycobacterium
LDVQAADAWNHFYNKWFPNAVIDGW

SEQ ID NO: 1352495 - protein, 23 aa, Mycobacterium
LDVTPDPGIVLWLGTARGPVHTG

SEQ ID NO: 1352496 - protein, 23 aa, Mycobacterium
LEAAPRLLAVVVDDVQWSDTASA

SEQ ID NO: 1352497 - protein, 24 aa, Mycobacterium
LEANGFDITRQFGIGSRETYILAV

SEQ ID NO: 1352498 - protein, 18 aa, Mycobacterium
LEAQGHRVVVNRLSDAPL

SEQ ID NO: 1352499 - protein, 18 aa, Mycobacterium
LEASLPLGSTDMGNVTQV

SEQ ID NO: 1352500 - protein, 17 aa, Mycobacterium
LEFVPAGDLDPLMYDRS

SEQ ID NO: 1352501 - protein, 20 aa, Mycobacterium
LEGFTLRTNIAFRDNYIAAG

SEQ ID NO: 1352502 - protein, 20 aa, Mycobacterium
LEGLTIRTNRTFQDNYIAAG

SEQ ID NO: 1352503 - protein, 36 aa, Mycobacterium
LEKPEWKGRWGAPPVKPDFQAIVAAMLELTGEQATS

SEQ ID NO: 1352504 - protein, 17 aa, Mycobacterium
LELDAKGAAGFFTDYIN

SEQ ID NO: 1352505 - protein, 20 aa, Mycobacterium
LELQSQFAFLTADQLLREGY

SEQ ID NO: 1352506 - protein, 19 aa, Mycobacterium
LEMLGQLGGMLGRAKGPMP

SEQ ID NO: 1352507 - protein, 33 aa, Mycobacterium
LEQGYSLKVYDCYRPQRAVNDFVEWAKNLTDQR

SEQ ID NO: 1352508 - protein, 17 aa, Mycobacterium
LERAAGWAHTGGGNRLP

SEQ ID NO: 1352509 - protein, 24 aa, Mycobacterium
LERHGMHAVSFLITGNVGAKRPYY

SEQ ID NO: 1352510 - protein, 29 aa, Mycobacterium
LERLRQLPLDQFRTSYAYTNFGLTAGAEA

SEQ ID NO: 1352511 - protein, 22 aa, Mycobacterium
LETARPADLLVLLDSLQQREAA

SEQ ID NO: 1352512 - protein, 19 aa, Mycobacterium
LETEFALALIDLRKRGHTV

SEQ ID NO: 1352513 - protein, 28 aa, Mycobacterium
LEVAEIPPRCLMNGPRTVLCVRADEDLR

SEQ ID NO: 1352514 - protein, 17 aa, Mycobacterium
LEYLVRQKVRGIPNIAM

SEQ ID NO: 1352515 - protein, 29 aa, Mycobacterium
LFADIPFALRGGGVYSVATPGGVPIDPPA

SEQ ID NO: 1352516 - protein, 19 aa, Mycobacterium
LFAKHGVPMVAHDNDPLGE

SEQ ID NO: 1352517 - protein, 17 aa, Mycobacterium
LFIGGVHAREWVPPDAL

SEQ ID NO: 1352518 - protein, 21 aa, Mycobacterium
LFRRVEWGALATFHMLDTRQY

SEQ ID NO: 1352519 - protein, 18 aa, Mycobacterium
LFVAAGLAPVYGERSLQA

SEQ ID NO: 1352520 - protein, 19 aa, Mycobacterium
LFVKLPQTIAAALKKPVVP

SEQ ID NO: 1352521 - protein, 17 aa, Mycobacterium
LGADVLRGETVTVGAAP

SEQ ID NO: 1352522 - protein, 20 aa, Mycobacterium
LGARTIFASVPYYVDMLTTG

SEQ ID NO: 1352523 - protein, 21 aa, Mycobacterium
LGARTPITFDTLFRPGTRPLD

SEQ ID NO: 1352524 - protein, 24 aa, Mycobacterium
LGARVYPGGFAIELTSEPNANLYS

SEQ ID NO: 1352525 - protein, 18 aa, Mycobacterium
LGDVSVHNFIVVDTAEGV

SEQ ID NO: 1352526 - protein, 21 aa, Mycobacterium
LGGALDRAGESLANSFSADNP

SEQ ID NO: 1352527 - protein, 18 aa, Mycobacterium
LGGGPAWQRNDPTVNVGR

SEQ ID NO: 1352528 - protein, 21 aa, Mycobacterium
LGGITRKAKELVISTKMSGEW

SEQ ID NO: 1352529 - protein, 17 aa, Mycobacterium
LGGMDYLSPERVELRYT

SEQ ID NO: 1352530 - protein, 23 aa, Mycobacterium
LGGSLLFTAGLGMAQAQPAETPD

SEQ ID NO: 1352531 - protein, 18 aa, Mycobacterium
LGHRIVYDVAANWKLIVE

SEQ ID NO: 1352532 - protein, 19 aa, Mycobacterium
LGIVLGLVGLLLGLNLPAR

SEQ ID NO: 1352533 - protein, 23 aa, Mycobacterium
LGLPANAIVAFALGVDLINVARE

SEQ ID NO: 1352534 - protein, 26 aa, Mycobacterium
LGLYYLRLPSLAGIGEYKLYAELERS

SEQ ID NO: 1352535 - protein, 33 aa, Mycobacterium; identical to SEQ ID NO: 1253545

SEQ ID NO: 1352536 - protein, 18 aa, Mycobacterium
LGPNQAWVHETWLADPNQ

SEQ ID NO: 1352537 - protein, 17 aa, Mycobacterium
LGQAGDIIREFNATLNG

SEQ ID NO: 1352538 - protein, 25 aa, Mycobacterium
LGRTGEVTFSIVLRTENSNPSSSSS

SEQ ID NO: 1352539 - protein, 20 aa, Mycobacterium
LGSGALLLAGCQFGGLNSLN

SEQ ID NO: 1352540 - protein, 30 aa, Mycobacterium; identical to SEQ ID NO: 1253556

SEQ ID NO: 1352541 - protein, 20 aa, Mycobacterium
LGTSIGWIPVVGTAVYGVSF

SEQ ID NO: 1352542 - protein, 21 aa, Mycobacterium
LGVDLSQGFHDYGMDWYSDRI

SEQ ID NO: 1352543 - protein, 24 aa, Mycobacterium
LHELFPPEQLDWMVLFSSCGYLAG

SEQ ID NO: 1352544 - protein, 23 aa, Mycobacterium
LHGIGGSAVRMFGPDRVTVLPHV

SEQ ID NO: 1352545 - protein, 25 aa, Mycobacterium
LHPLVDRDRILGGFHTPTDGLAKAV

SEQ ID NO: 1352546 - protein, 24 aa, Mycobacterium
LIAERPRLTTALDKLRIFSDSATG

SEQ ID NO: 1352547 - protein, 18 aa, Mycobacterium
LIALFMAVGVVAGLTLGA

SEQ ID NO: 1352548 - protein, 22 aa, Mycobacterium
LIALLCALPVVLSPYPAATFAV

SEQ ID NO: 1352549 - protein, 18 aa, Mycobacterium
LIGGFRPLFRALDPDQVN

SEQ ID NO: 1352550 - protein, 20 aa, Mycobacterium
LIGGFRPLFRALDPDQVNAL

SEQ ID NO: 1352551 - protein, 23 aa, Mycobacterium
LIGGFRPLFRALDPEQVNALSGQ

SEQ ID NO: 1352552 - protein, 19 aa, Mycobacterium
LIGGFRPLFRALDPEQVNE

SEQ ID NO: 1352553 - protein, 24 aa, Mycobacterium
LIHTTCSYDQLYAAIRTEAPRAAT

SEQ ID NO: 1352554 - protein, 19 aa, Mycobacterium
LILDNGLNLEAWFARFVDG

SEQ ID NO: 1352555 - protein, 20 aa, Mycobacterium
LINGGRPDRFGIGPGATSVT

SEQ ID NO: 1352556 - protein, 22 aa, Mycobacterium
LIPNWIKPLYSWFTQNIDFSTC

SEQ ID NO: 1352557 - protein, 24 aa, Mycobacterium
LITADPNATFGFGRPLPPAVADHV

SEQ ID NO: 1352558 - protein, 20 aa, Mycobacterium
LIVLALRWLLIHTPKARVKA

SEQ ID NO: 1352559 - protein, 18 aa, Mycobacterium
LKALPGDLSILYPSPAED

SEQ ID NO: 1352560 - protein, 22 aa, Mycobacterium
LKARLCRRGVHLLREYLAQKDI

SEQ ID NO: 1352561 - protein, 24 aa, Mycobacterium
LKAVLDRTPWRAGEPIVIAAPMFH

SEQ ID NO: 1352562 - protein, 19 aa, Mycobacterium
LKCPFTLGHSRAVAELAAG

SEQ ID NO: 1352563 - protein, 26 aa, Mycobacterium
LKEKGIKSLYLVGSDYVFPQTANRII

SEQ ID NO: 1352564 - protein, 18 aa, Mycobacterium
LKELIPRQQFEVPVQAAV

SEQ ID NO: 1352565 - protein, 21 aa, Mycobacterium
LKGTFVVLRAALAQMITQDRV

SEQ ID NO: 1352566 - protein, 17 aa, Mycobacterium
LKPEYQGKVALNGDPTQ

SEQ ID NO: 1352567 - protein, 25 aa, Mycobacterium
LKTVWKSEMIAGSVFAANDSLGPEA

SEQ ID NO: 1352568 - protein, 17 aa, Mycobacterium
LLAEAGYQMAPVGDGAP

SEQ ID NO: 1352569 - protein, 19 aa, Mycobacterium
LLAELVSAVLMLDRSQPPA

SEQ ID NO: 1352570 - protein, 18 aa, Mycobacterium
LLAKLGGITRLWRRTTGV

SEQ ID NO: 1352571 - protein, 18 aa, Mycobacterium
LLALGVSVFALLRTLDHG

SEQ ID NO: 1352572 - protein, 17 aa, Mycobacterium
LLALLSATVLVLAGCGQ

SEQ ID NO: 1352573 - protein, 19 aa, Mycobacterium
LLALSRLGSMRAVADAHHL

SEQ ID NO: 1352574 - protein, 24 aa, Mycobacterium
LLATARSWAWLSGRNYVTPDDVKA

SEQ ID NO: 1352575 - protein, 19 aa, Mycobacterium
LLCAVAILATGCTQQVGGT

SEQ ID NO: 1352576 - protein, 19 aa, Mycobacterium
LLCVQRLDGGLTIGDTHEY

SEQ ID NO: 1352577 - protein, 17 aa, Mycobacterium
LLDSFVLGTERYRYPQN

SEQ ID NO: 1352578 - protein, 25 aa, Mycobacterium
LLDVSRIQWRFERVCRKVSVDQPWR

SEQ ID NO: 1352579 - protein, 19 aa, Mycobacterium
LLEECGRWTMTAGPTTGAV

SEQ ID NO: 1352580 - protein, 18 aa, Mycobacterium
LLERRKRAESALITVVAD

SEQ ID NO: 1352581 - protein, 18 aa, Mycobacterium
LLFHPINSITAYKGQILY

SEQ ID NO: 1352582 - protein, 31 aa, Mycobacterium; identical to SEQ ID NO: 1253644

SEQ ID NO: 1352583 - protein, 19 aa, Mycobacterium
LLLLMGLRADVDRFNAAAA

SEQ ID NO: 1352584 - protein, 17 aa, Mycobacterium
LLMVATFGLERLESGLA

SEQ ID NO: 1352585 - protein, 18 aa, Mycobacterium
LLQPFAFFVPRPILKAID

SEQ ID NO: 1352586 - protein, 23 aa, Mycobacterium
LLRYPLQLIAPLARVFVARQGAY

SEQ ID NO: 1352587 - protein, 23 aa, Mycobacterium
LLRYPLQLIAPLARVFVASQGAY

SEQ ID NO: 1352588 - protein, 19 aa, Mycobacterium
LLVGHSYGGTVITEAGVDP

SEQ ID NO: 1352589 - protein, 20 aa, Mycobacterium
LLVHPIAVRKGARLFDEGTP

SEQ ID NO: 1352590 - protein, 26 aa, Mycobacterium
LLYRIAEGAPRPAYRDVTLGGNAVDN

SEQ ID NO: 1352591 - protein, 28 aa, Mycobacterium
LLYSYRKSLWCGIGGLVPFAKSPPQFSG

SEQ ID NO: 1352592 - protein, 30 aa, Mycobacterium
LMACSAALLASACQFSIGGGLDYDKLEKAI

SEQ ID NO: 1352593 - protein, 23 aa, Mycobacterium
LMASSCSWQIGIPVPDGVPPPPG

SEQ ID NO: 1352594 - protein, 21 aa, Mycobacterium
LMVPSAAMGRAIPVAFQGGGP

SEQ ID NO: 1352595 - protein, 17 aa, Mycobacterium
LNALFLPPAPAAPAAPP

SEQ ID NO: 1352596 - protein, 21 aa, Mycobacterium
LNALMAFEYVHGYYLDPNSNG

SEQ ID NO: 1352597 - protein, 27 aa, Mycobacterium
LNAMGDFLNRVIPPFTIADGAGTFDII

SEQ ID NO: 1352598 - protein, 27 aa, Mycobacterium
LNAVMLGTMSPIWYLFTGVDYRAVADT

SEQ ID NO: 1352599 - protein, 24 aa, Mycobacterium
LNGIPLRIDCGFDDPFYSATEQFI

SEQ ID NO: 1352600 - protein, 20 aa, Mycobacterium
LNGPAGSGWHTHPGPEHTVI

SEQ ID NO: 1352601 - protein, 24 aa, Mycobacterium
LNLSEGWWPMLVNISMGDAGGYDA

SEQ ID NO: 1352602 - protein, 24 aa, Mycobacterium
LNPPTRRQLLDWMLANQTSSMRAG

SEQ ID NO: 1352603 - protein, 25 aa, Mycobacterium
LNPSEGWWPMLIGLAMNDAGGFNAE

SEQ ID NO: 1352604 - protein, 21 aa, Mycobacterium
LNQHIKYSWYLASAEALLIAE

SEQ ID NO: 1352605 - protein, 17 aa, Mycobacterium
LNQQLGIGAVSDSQILP

SEQ ID NO: 1352606 - protein, 17 aa, Mycobacterium
LNRMLATVLAPRRAQKT

SEQ ID NO: 1352607 - protein, 23 aa, Mycobacterium
LNRTRTPVEFARVLDVLDKLSTS

SEQ ID NO: 1352608 - protein, 19 aa, Mycobacterium
LNSNETFVYLARAVDPVIS

SEQ ID NO: 1352609 - protein, 18 aa, Mycobacterium
LNVVVPFLALQPLVENAV

SEQ ID NO: 1352610 - protein, 26 aa, Mycobacterium
LPAKGSDFIVCSQIQVVYGGVNLTTP

SEQ ID NO: 1352611 - protein, 24 aa, Mycobacterium
LPAKKWLAERGFDPLYGARPLRRL

SEQ ID NO: 1352612 - protein, 23 aa, Mycobacterium
LPAQALPGDLIFYGPEGTQSVAL

SEQ ID NO: 1352613 - protein, 18 aa, Mycobacterium
LPARAGAVSVHVAPNLTD

SEQ ID NO: 1352614 - protein, 18 aa, Mycobacterium
LPDAATLLQRSSETTKAQ

SEQ ID NO: 1352615 - protein, 19 aa, Mycobacterium
LPDAERFHRAATYPVYLNR

SEQ ID NO: 1352616 - protein, 38 aa, Mycobacterium
LPDAYKKLGRQGLYGDWFAFYVCEVVFKVNGKGGQPVY

SEQ ID NO: 1352617 - protein, 38 aa, Mycobacterium
LPDKYRALGRQGMYGDFFSFYLCELVLKLNGKGGQPVY

SEQ ID NO: 1352618 - protein, 17 aa, Mycobacterium
LPDSLYPDRSFKTAYSS

SEQ ID NO: 1352619 - protein, 19 aa, Mycobacterium
LPDSMGIVRGSAPGNDIDG

SEQ ID NO: 1352620 - protein, 21 aa, Mycobacterium
LPDTYRLIGRTPVRPLRLRPA

SEQ ID NO: 1352621 - protein, 22 aa, Mycobacterium
LPDYNIKWTKFDSGADVNTAFV

SEQ ID NO: 1352622 - protein, 22 aa, Mycobacterium
LPEMGHACGHNIIAASAVGTAL

SEQ ID NO: 1352623 - protein, 17 aa, Mycobacterium
LPFVTVALIRIAALLAH

SEQ ID NO: 1352624 - protein, 17 aa, Mycobacterium
LPGDLSILYPSPAEDKD

SEQ ID NO: 1352625 - protein, 20 aa, Mycobacterium
LPGGLYVGGATLIPVKIDVT

SEQ ID NO: 1352626 - protein, 18 aa, Mycobacterium
LPGLIGFAGGSATAGAFS

SEQ ID NO: 1352627 - protein, 19 aa, Mycobacterium
LPGLIGFAGGSATAGAFSR

SEQ ID NO: 1352628 - protein, 17 aa, Mycobacterium
LPGLPVVPRSVAYIPSA

SEQ ID NO: 1352629 - protein, 24 aa, Mycobacterium
LPGRLRLLVRLTRVAALRRAAATV

SEQ ID NO: 1352630 - protein, 21 aa, Mycobacterium
LPGYRWRKLKEEVIRHNKLRP

SEQ ID NO: 1352631 - protein, 22 aa, Mycobacterium
LPIAGLLWTFSRGAVPQGGSAG

SEQ ID NO: 1352632 - protein, 19 aa, Mycobacterium
LPIGQGLSMTLLQMAGMYQ

SEQ ID NO: 1352633 - protein, 26 aa, Mycobacterium
LPIGSGRSVQADWYFPETVDESTRLV

SEQ ID NO: 1352634 - protein, 25 aa, Mycobacterium
LPIVNASGGPNCRGLPDVPSKQYGG

SEQ ID NO: 1352635 - protein, 20 aa, Mycobacterium
LPIVPMFHANAWGLPYAALM

SEQ ID NO: 1352636 - protein, 22 aa, Mycobacterium
LPLAACSPGLAANPRFATDSGA

SEQ ID NO: 1352637 - protein, 17 aa, Mycobacterium
LPLLDRLEEALGRGGPD

SEQ ID NO: 1352638 - protein, 25 aa, Mycobacterium
LPLRAMVMVLLFLGVVFLLVALQSM

SEQ ID NO: 1352639 - protein, 17 aa, Mycobacterium
LPLVALAATLALVAGCD

SEQ ID NO: 1352640 - protein, 25 aa, Mycobacterium
LPPARTAARRALYRALTLLSQKVLL

SEQ ID NO: 1352641 - protein, 17 aa, Mycobacterium
LPPGMPGYQEYKLYPGP

SEQ ID NO: 1352642 - protein, 21 aa, Mycobacterium
LPPSVSYSFRSLARGPQAEAL

SEQ ID NO: 1352643 - protein, 26 aa, Mycobacterium
LPPTTLYVGELEWALPDTLLLHDKWS

SEQ ID NO: 1352644 - protein, 26 aa, Mycobacterium
LPQAKRAAVERLGFGLLDKVVLVFDE

SEQ ID NO: 1352645 - protein, 18 aa, Mycobacterium
LPQSACLVGQQKVTSGGR

SEQ ID NO: 1352646 - protein, 17 aa, Mycobacterium
LPQTIAAALKKPVVPAV

SEQ ID NO: 1352647 - protein, 22 aa, Mycobacterium
LPRINARGGPGGRPGCWQKVTR

SEQ ID NO: 1352648 - protein, 22 aa, Mycobacterium
LPRPVRRSLRRASAPLPEGMRG

SEQ ID NO: 1352649 - protein, 17 aa, Mycobacterium
LPSPFGFVQQLPPVVKA

SEQ ID NO: 1352650 - protein, 17 aa, Mycobacterium
LPTDFPIYNLAGKSYYW

SEQ ID NO: 1352651 - protein, 29 aa, Mycobacterium
LPTLSVRASRWGRYPLLATVRVGGRGGLL

SEQ ID NO: 1352652 - protein, 17 aa, Mycobacterium
LPTTIIFDAHGRPRYRT

SEQ ID NO: 1352653 - protein, 21 aa, Mycobacterium
LPVELGGGMMNYDWTINGLPF

SEQ ID NO: 1352654 - protein, 17 aa, Mycobacterium
LPVRGMPVCHFGVVTGE

SEQ ID NO: 1352655 - protein, 18 aa, Mycobacterium
LQDIPGLLGKTGTAEYID

SEQ ID NO: 1352656 - protein, 24 aa, Mycobacterium
LQDQEWRKNTLFRSATTDLSNGMT

SEQ ID NO: 1352657 - protein, 18 aa, Mycobacterium
LQPLLSTGWEQTSPNEWT

SEQ ID NO: 1352658 - protein, 21 aa, Mycobacterium
LQRMHGFVGFSLLADRESGRC

SEQ ID NO: 1352659 - protein, 17 aa, Mycobacterium
LQRRGAWARCVQIVGAL

SEQ ID NO: 1352660 - protein, 20 aa, Mycobacterium
LRAALNYPLIAQIMRSPTAP

SEQ ID NO: 1352661 - protein, 21 aa, Mycobacterium
LRAKLTPTHPLGCKRLVFATD

SEQ ID NO: 1352662 - protein, 23 aa, Mycobacterium
LRALAGLARSFADPARCAGLDVA

SEQ ID NO: 1352663 - protein, 25 aa, Mycobacterium
LRAPDPVGVFVTRWAADPYARGSYS

SEQ ID NO: 1352664 - protein, 20 aa, Mycobacterium
LRDALADKSVVIFRTPDAAD

SEQ ID NO: 1352665 - protein, 19 aa, Mycobacterium
LRDALNSWVDAARAVATAI

SEQ ID NO: 1352666 - protein, 17 aa, Mycobacterium
LRDAVQGVARFAQTLNE

SEQ ID NO: 1352667 - protein, 28 aa, Mycobacterium
LRDFAAQCLDRMGAEFLASVGTATAARD

SEQ ID NO: 1352668 - protein, 19 aa, Mycobacterium
LRFSAGRVVGVDCLGPGGP

SEQ ID NO: 1352669 - protein, 19 aa, Mycobacterium
LRFTTSYKEAADFADVHFI

SEQ ID NO: 1352670 - protein, 28 aa, Mycobacterium
LRGAHDRPIYLISSERYFWSRGGDMADK

SEQ ID NO: 1352671 - protein, 22 aa, Mycobacterium
LRGALLDIIGKYGYPDIGTTLA

SEQ ID NO: 1352672 - protein, 18 aa, Mycobacterium
LRGAWLCTKHAAPRMAER

SEQ ID NO: 1352673 - protein, 18 aa, Mycobacterium
LRGEVCSGGRTCSSVPYP

SEQ ID NO: 1352674 - protein, 21 aa, Mycobacterium
LRGFGTTRFRSANTVRNGQQA

SEQ ID NO: 1352675 - protein, 17 aa, Mycobacterium
LRGGERAVKVQAPGPVT

SEQ ID NO: 1352676 - protein, 19 aa, Mycobacterium
LRGLNIRWADGARRSLGDG

SEQ ID NO: 1352677 - protein, 21 aa, Mycobacterium
LRGRIAIPAYLSAGVAAFTLL

SEQ ID NO: 1352678 - protein, 17 aa, Mycobacterium
LRIPSMALAAYRNAETT

SEQ ID NO: 1352679 - protein, 19 aa, Mycobacterium
LRIRYTRNAVLDHVSIGNA

SEQ ID NO: 1352680 - protein, 32 aa, Mycobacterium
LRLQQRLAALLARWFRRPGEWLDRAPMGPSRP

SEQ ID NO: 1352681 - protein, 21 aa, Mycobacterium
LRMVRAEGVAHVAGLVERLTD

SEQ ID NO: 1352682 - protein, 24 aa, Mycobacterium
LRNARRLEAAFARQDGIAEIAALI

SEQ ID NO: 1352683 - protein, 17 aa, Mycobacterium
LRPLGMGATSYRFSDYE

SEQ ID NO: 1352684 - protein, 33 aa, Mycobacterium
LRQAPELAGWPRSPEWTGAAALPQPQPEPATVP

SEQ ID NO: 1352685 - protein, 19 aa, Mycobacterium
LRQDIPLDGFLRVNPAGDD

SEQ ID NO: 1352686 - protein, 20 aa, Mycobacterium
LRQGSAITIRVWKKSLKQLM

SEQ ID NO: 1352687 - protein, 18 aa, Mycobacterium
LRQLGCSSGTLQDFGPDF

SEQ ID NO: 1352688 - protein, 21 aa, Mycobacterium
LRTAKLIGLNTVRVFLHDLLW

SEQ ID NO: 1352689 - protein, 25 aa, Mycobacterium
LRTGHRRLALIVAGAAVCFAQMLGA

SEQ ID NO: 1352690 - protein, 25 aa, Mycobacterium
LRTGHRRLALIVAGVAACFAQMLVA

SEQ ID NO: 1352691 - protein, 26 aa, Mycobacterium
LRTGHRRLALIVAGVAACFAQMLVAA

SEQ ID NO: 1352692 - protein, 18 aa, Mycobacterium
LRTLITYDVGRHGIRVNP

SEQ ID NO: 1352693 - protein, 17 aa, Mycobacterium
LRTLPFPVGASHSLELR

SEQ ID NO: 1352694 - protein, 25 aa, Mycobacterium
LRVLRGDDGAERWLRAFKDQDPQAF

SEQ ID NO: 1352695 - protein, 20 aa, Mycobacterium
LRYIPADAPVRIGGTTIFGA

SEQ ID NO: 1352696 - protein, 22 aa, Mycobacterium
LSASAGAGCRECARPQADSPVA

SEQ ID NO: 1352697 - protein, 29 aa, Mycobacterium
LSDEGQLVFARVGARPVRYVLGELEVPAE

SEQ ID NO: 1352698 - protein, 24 aa, Mycobacterium
LSEALRLPVITGPYAQVVAAAGAE

SEQ ID NO: 1352699 - protein, 17 aa, Mycobacterium
LSEIERLSIIGGASDAQ

SEQ ID NO: 1352700 - protein, 21 aa, Mycobacterium
LSELSVALGEVQRFVAGTRDL

SEQ ID NO: 1352701 - protein, 20 aa, Mycobacterium
LSELTTRWQNEKGAIDVVRE

SEQ ID NO: 1352702 - protein, 23 aa, Mycobacterium
LSERMDFDKSYHHLLFKQDFTSF

SEQ ID NO: 1352703 - protein, 21 aa, Mycobacterium
LSFGTAGTAWAEPVGPGCAAY

SEQ ID NO: 1352704 - protein, 27 aa, Mycobacterium
LSGCADWRGANSLPLPGTEGGGDGAYT

SEQ ID NO: 1352705 - protein, 21 aa, Mycobacterium
LSGLGPGGGLCIDPADESLYV

SEQ ID NO: 1352706 - protein, 25 aa, Mycobacterium
LSGVKYAATILGAFAVLAVAPATAF

SEQ ID NO: 1352707 - protein, 20 aa, Mycobacterium
LSGVMARCLGSAGPVDVGAA

SEQ ID NO: 1352708 - protein, 19 aa, Mycobacterium
LSIPAALPLDPHGDDAVDS

SEQ ID NO: 1352709 - protein, 17 aa, Mycobacterium
LSLAALVTALLLAGCSS

SEQ ID NO: 1352710 - protein, 18 aa, Mycobacterium
LSLALTALRLRVARAAEA

SEQ ID NO: 1352711 - protein, 23 aa, Mycobacterium
LSNIVPAFAVVTVLPGLPLDAPP

SEQ ID NO: 1352712 - protein, 32 aa, Mycobacterium; identical to SEQ ID NO: 82438

SEQ ID NO: 1352713 - protein, 22 aa, Mycobacterium
LSRASVIIGTLVVVLALVAAFA

SEQ ID NO: 1352714 - protein, 38 aa, Mycobacterium
LSRLDAGLFTGTRFEGALTRLEMQWGRTIGQMPSPYTA

SEQ ID NO: 1352715 - protein, 27 aa, Mycobacterium
LSTCAAWPVLRRRLAVRALSGADPGEL

SEQ ID NO: 1352716 - protein, 17 aa, Mycobacterium
LSTVPAFVGDDSLLASV

SEQ ID NO: 1352717 - protein, 26 aa, Mycobacterium
LSVSGCGYRLAAYPTDDTAARPVEPR

SEQ ID NO: 1352718 - protein, 27 aa, Mycobacterium
LTAAEIAEIIGLFRAAARRAVDAGMDG

SEQ ID NO: 1352719 - protein, 17 aa, Mycobacterium
LTAALPFMMLPLTVAGP

SEQ ID NO: 1352720 - protein, 23 aa, Mycobacterium
LTADMGRKFLTQLGILPQASAPA

SEQ ID NO: 1352721 - protein, 22 aa, Mycobacterium
LTALPADFTGTVVVTAGDVPLL

SEQ ID NO: 1352722 - protein, 18 aa, Mycobacterium
LTAVLAVTIAVSAGCSGS

SEQ ID NO: 1352723 - protein, 25 aa, Mycobacterium
LTDRSRPTALIDWARDRSLSVRWRP

SEQ ID NO: 1352724 - protein, 22 aa, Mycobacterium
LTEADFPPGVQYDRIVDEPGPG

SEQ ID NO: 1352725 - protein, 22 aa, Mycobacterium
LTEQDRRFAVVYVDDQSEHARM

SEQ ID NO: 1352726 - protein, 25 aa, Mycobacterium
LTFIAGPSPTGWQLSKQSAMALMSA

SEQ ID NO: 1352727 - protein, 17 aa, Mycobacterium
LTGDFCAGCSEVELDVM

SEQ ID NO: 1352728 - protein, 23 aa, Mycobacterium
LTGFDFPFAAMGSVHLENHITQY

SEQ ID NO: 1352729 - protein, 18 aa, Mycobacterium
LTGVPAQPILPVVPPPPA

SEQ ID NO: 1352730 - protein, 19 aa, Mycobacterium
LTIEKQIVALGEAFDALGE

SEQ ID NO: 1352731 - protein, 24 aa, Mycobacterium
LTKNVRTMAAIRWIQRGYRAPTGP

SEQ ID NO: 1352732 - protein, 26 aa, Mycobacterium
LTLAAWYPRQYKFAASLSGYLAPSRG

SEQ ID NO: 1352733 - protein, 19 aa, Mycobacterium
LTNWEVCSQSPSAGEEVSE

SEQ ID NO: 1352734 - protein, 18 aa, Mycobacterium
LTNWIVCSQSPRAGGSIG

SEQ ID NO: 1352735 - protein, 23 aa, Mycobacterium
LTPEEIVRFCVTLVVAGSETTTF

SEQ ID NO: 1352736 - protein, 18 aa, Mycobacterium
LTRLDNFVGVLAEQRENI

SEQ ID NO: 1352737 - protein, 17 aa, Mycobacterium
LTTFPFVKENIGNFFRG

SEQ ID NO: 1352738 - protein, 20 aa, Mycobacterium
LTVVCCAHLTALDAISVPKD

SEQ ID NO: 1352739 - protein, 19 aa, Mycobacterium
LTVYVALVGIYKRFQEMAA

SEQ ID NO: 1352740 - protein, 26 aa, Mycobacterium
LTWTFHLRPGVTFHDGTPLTADDVVF

SEQ ID NO: 1352741 - protein, 26 aa, Mycobacterium
LTYSEDWLRPDYIPPQPGSAAPPPPA

SEQ ID NO: 1352742 - protein, 24 aa, Mycobacterium
LTYSEDWLRPDYVPPQSPPPPADV

SEQ ID NO: 1352743 - protein, 19 aa, Mycobacterium
LVDITRFWFETGSLDNERS

SEQ ID NO: 1352744 - protein, 17 aa, Mycobacterium
LVDRGACPFGGKQAVAA

SEQ ID NO: 1352745 - protein, 18 aa, Mycobacterium
LVEFGRLSALTTETLEKS

SEQ ID NO: 1352746 - protein, 24 aa, Mycobacterium
LVEGKTGDGRWLIGEDSDHGVIRN

SEQ ID NO: 1352747 - protein, 22 aa, Mycobacterium
LVFCAASLAVGHIVVNSVDQIE

SEQ ID NO: 1352748 - protein, 25 aa, Mycobacterium
LVFWDCYRPHAVQVRMFEMVPDPAW

SEQ ID NO: 1352749 - protein, 18 aa, Mycobacterium
LVGERLGWARVPPGSRTS

SEQ ID NO: 1352750 - protein, 18 aa, Mycobacterium
LVGEYDGLRALRSAITSS

SEQ ID NO: 1352751 - protein, 26 aa, Mycobacterium
LVGYDRGRDIAVIQLLGAGGLPVAPI

SEQ ID NO: 1352752 - protein, 18 aa, Mycobacterium
LVIRRAMSQLGVPYSWGG

SEQ ID NO: 1352753 - protein, 18 aa, Mycobacterium
LVIYMPDYPVGRDSPTNF

SEQ ID NO: 1352754 - protein, 19 aa, Mycobacterium
LVLDSPLPLGISAEAATEQ

SEQ ID NO: 1352755 - protein, 23 aa, Mycobacterium
LVLTWAPSFCRVEPSNPACTSGE

SEQ ID NO: 1352756 - protein, 24 aa, Mycobacterium
LVNLPPSVSYSFRSLARGPQAEAL

SEQ ID NO: 1352757 - protein, 18 aa, Mycobacterium
LVQLPPSVSYSFRSLARG

SEQ ID NO: 1352758 - protein, 21 aa, Mycobacterium
LVQSLWLAVRQTQYTWNNQRP

SEQ ID NO: 1352759 - protein, 19 aa, Mycobacterium
LVSARAIQLVPAYDGGPVM

SEQ ID NO: 1352760 - protein, 17 aa, Mycobacterium
LVSDGHGGATTETVSVP

SEQ ID NO: 1352761 - protein, 17 aa, Mycobacterium
LVSSTRPHARRRTMAAA

SEQ ID NO: 1352762 - protein, 18 aa, Mycobacterium
LVTIMRWLRPGAMIAITE

SEQ ID NO: 1352763 - protein, 25 aa, Mycobacterium
LVTPFIKPFVKLLCPSCDPEHPEDP

SEQ ID NO: 1352764 - protein, 26 aa, Mycobacterium
LVVTLAVGIYLVWPSRTGNKITAYFT

SEQ ID NO: 1352765 - protein, 26 aa, Mycobacterium
LVVTLAVGVYLVWPSRTGNKITAYFT

SEQ ID NO: 1352766 - protein, 22 aa, Mycobacterium
LVYEALPARGARTVDEIGRDSG

SEQ ID NO: 1352767 - protein, 20 aa, Mycobacterium
LWAYWCGPCADELPAMAEYQ

SEQ ID NO: 1352768 - protein, 25 aa, Mycobacterium
LWQQRTDAAAGWAIIAETAAGAQRV

SEQ ID NO: 1352769 - protein, 20 aa, Mycobacterium
LYAAALRFYGNPAHVQVTDA

SEQ ID NO: 1352770 - protein, 19 aa, Mycobacterium
LYAAISILALLYGRARHPG

SEQ ID NO: 1352771 - protein, 20 aa, Mycobacterium
LYAALSILALLYARKGDGAE

SEQ ID NO: 1352772 - protein, 18 aa, Mycobacterium
LYDREQIRVWSRGLVTLV

SEQ ID NO: 1352773 - protein, 19 aa, Mycobacterium
LYFTLSRWSDYSTLLMHTS

SEQ ID NO: 1352774 - protein, 20 aa, Mycobacterium
LYLGNGVMLEAPRPGQFVQV

SEQ ID NO: 1352775 - protein, 19 aa, Mycobacterium
LYLTDVIAIARSDGGVVRA

SEQ ID NO: 1352776 - protein, 26 aa, Mycobacterium
LYNQLRRLSPVAGYRDWPPGTIPGAD

SEQ ID NO: 1352777 - protein, 31 aa, Mycobacterium
LYPDRSFKTAYSSLLLLGLVTTGARINPQIY

SEQ ID NO: 1352778 - protein, 17 aa, Mycobacterium
LYPGAPIPAPPNVLSNI

SEQ ID NO: 1352779 - protein, 21 aa, Mycobacterium
LYQDRDILFGYGRTTEYMVAQ

SEQ ID NO: 1352780 - protein, 25 aa, Mycobacterium
LYSYSFDLNAHWSRMWSGQEEILQY

SEQ ID NO: 1352781 - protein, 18 aa, Mycobacterium
LYTQHGQSFGWNQLGVTP

SEQ ID NO: 1352782 - protein, 25 aa, Mycobacterium
MAAAASRAGVEFVYNATVSDLEFIG

SEQ ID NO: 1352783 - protein, 28 aa, Mycobacterium
MAAPLGVCYLPAFLCVGIVPVVAGLAGE

SEQ ID NO: 1352784 - protein, 26 aa, Mycobacterium
MAAPPTWTMPDIRGMNLAAAEKAFTA

SEQ ID NO: 1352785 - protein, 17 aa, Mycobacterium
MAARMAGFRDATTRAAA

SEQ ID NO: 1352786 - protein, 25 aa, Mycobacterium
MAAVESMLTAARNWFERTFFAATPV

SEQ ID NO: 1352787 - protein, 25 aa, Mycobacterium
MADEWDKLHAPTCRAELDQAKATVA

SEQ ID NO: 1352788 - protein, 20 aa, Mycobacterium
MAGNCPDTRLVLGGYSLGAA

SEQ ID NO: 1352789 - protein, 19 aa, Mycobacterium
MALLTAFLFLVFSDTRTGA

SEQ ID NO: 1352790 - protein, 25 aa, Mycobacterium
MANAERFGIQDAIWRGAYYTPGGAK

SEQ ID NO: 1352791 - protein, 25 aa, Mycobacterium
MAQPTRWTMPDLRGMNLAAAQEAYT

SEQ ID NO: 1352792 - protein, 29 aa, Mycobacterium
MDKIVAYAGEIGMRVILDHHRSSAGAGPN

SEQ ID NO: 1352793 - protein, 17 aa, Mycobacterium
MDLPLSPKWAVVGQSQG

SEQ ID NO: 1352794 - protein, 26 aa, Mycobacterium
MDPQHRLFLQTAWHAMEDAGCDPAGF

SEQ ID NO: 1352795 - protein, 25 aa, Mycobacterium
MDPQQRLALEVSWEALEHAGISPRA

SEQ ID NO: 1352796 - protein, 17 aa, Mycobacterium
MEDAIALQWAFKDHPDD

SEQ ID NO: 1352797 - protein, 18 aa, Mycobacterium
MEDYLILGACNPSLAHRA

SEQ ID NO: 1352798 - protein, 26 aa, Mycobacterium
MEGSLRGTFRLTVCKPGSGDAPSVTY

SEQ ID NO: 1352799 - protein, 21 aa, Mycobacterium
MEIADAVAFLVSEHATFITGS

SEQ ID NO: 1352800 - protein, 17 aa, Mycobacterium
MEYLTSLGWTMAGLPRT

SEQ ID NO: 1352801 - protein, 19 aa, Mycobacterium
MFDPEHGARWAAFGDAVAS

SEQ ID NO: 1352802 - protein, 17 aa, Mycobacterium
MFHANAWGLPYAALMAG

SEQ ID NO: 1352803 - protein, 18 aa, Mycobacterium
MFTGLAISIFCPRAVSAM

SEQ ID NO: 1352804 - protein, 21 aa, Mycobacterium
MGAYLRYKGYVYAYGTGAGRG

SEQ ID NO: 1352805 - protein, 18 aa, Mycobacterium
MGGMPGMGGMAGMDGMMS

SEQ ID NO: 1352806 - protein, 19 aa, Mycobacterium
MGGSAMLASLAAVRDELER

SEQ ID NO: 1352807 - protein, 17 aa, Mycobacterium
MGTDWLDVPVSKATEQR

SEQ ID NO: 1352808 - protein, 20 aa, Mycobacterium
MGYSGQWHRITTAGAIPVYK

SEQ ID NO: 1352809 - protein, 18 aa, Mycobacterium
MIFDSVYDIYRGVVTYVR

SEQ ID NO: 1352810 - protein, 28 aa, Mycobacterium
MIPEEHLPLVLPFKYLGVPTETLIELDA

SEQ ID NO: 1352811 - protein, 21 aa, Mycobacterium
MKIAIASVVKLFIADDLLLQV

SEQ ID NO: 1352812 - protein, 17 aa, Mycobacterium
MKPTDWNNRWWITCMVA

SEQ ID NO: 1352813 - protein, 23 aa, Mycobacterium
MKSYGRAPTFLAMTGHEQVRSVA

SEQ ID NO: 1352814 - protein, 22 aa, Mycobacterium
MLFAKPRYFAQFGDTGGINPGD

SEQ ID NO: 1352815 - protein, 23 aa, Mycobacterium
MLKTVPPQCEWVYAETQVFGSDV

SEQ ID NO: 1352816 - protein, 19 aa, Mycobacterium
MLMVPSAAMGRSIPVAFQG

SEQ ID NO: 1352817 - protein, 24 aa, Mycobacterium
MMANCPRTRLVLGGYSQGAAVIDV

SEQ ID NO: 1352818 - protein, 18 aa, Mycobacterium
MNSGLYPAIGYANASQLP

SEQ ID NO: 1352819 - protein, 17 aa, Mycobacterium
MPDAWEVGKGLNPLSAN

SEQ ID NO: 1352820 - protein, 24 aa, Mycobacterium
MPDVEGKVLQSAWDAVVAATDGAL

SEQ ID NO: 1352821 - protein, 17 aa, Mycobacterium
MQAPRAMEAAVPLEPGQ

SEQ ID NO: 1352822 - protein, 30 aa, Mycobacterium
MQEAKAPGWGCGRALALRNNIIIDVNTCSP

SEQ ID NO: 1352823 - protein, 18 aa, Mycobacterium
MQFMPATFAAYGGGGDIT

SEQ ID NO: 1352824 - protein, 17 aa, Mycobacterium
MQFMPSTFAAYGAGTDI

SEQ ID NO: 1352825 - protein, 19 aa, Mycobacterium
MQGPLSAFVNQAADTFDGN

SEQ ID NO: 1352826 - protein, 20 aa, Mycobacterium
MQGPLSAFVNQAADTFDGNG

SEQ ID NO: 1352827 - protein, 19 aa, Mycobacterium
MQGTVWLTRCSNYFRAPNG

SEQ ID NO: 1352828 - protein, 28 aa, Mycobacterium
MQKALKYEGVDVITIFKGLQLDIGAPPQ

SEQ ID NO: 1352829 - protein, 19 aa, Mycobacterium
MQQWLAKWGTGAPSGHEGH

SEQ ID NO: 1352830 - protein, 21 aa, Mycobacterium
MRFYEGASWHAGGRLLKYQTT

SEQ ID NO: 1352831 - protein, 23 aa, Mycobacterium
MRPDRYLRMGLAMRRAGLTATVG

SEQ ID NO: 1352832 - protein, 18 aa, Mycobacterium
MRPPAGLLQHPTWPRPEA

SEQ ID NO: 1352833 - protein, 19 aa, Mycobacterium
MSAFGDHSDDVFGTVEDLS

SEQ ID NO: 1352834 - protein, 18 aa, Mycobacterium
MSDGKFTTLGEFPAFQLG

SEQ ID NO: 1352835 - protein, 17 aa, Mycobacterium
MSFFSVLPWQKETIPNW

SEQ ID NO: 1352836 - protein, 17 aa, Mycobacterium
MSGKHRSPEPMTQHRTT

SEQ ID NO: 1352837 - protein, 17 aa, Mycobacterium
MSNCANTQIGVWSENSL

SEQ ID NO: 1352838 - protein, 24 aa, Mycobacterium
MSPIRPNVIWAMDFQFDTTADGRI

SEQ ID NO: 1352839 - protein, 20 aa, Mycobacterium
MSQRLIPQIRDIYADGDTVV

SEQ ID NO: 1352840 - protein, 17 aa, Mycobacterium
MSTLVPMGRLGRPEEIA

SEQ ID NO: 1352841 - protein, 20 aa, Mycobacterium
MSVICPNTRLVLGGFSQGAM

SEQ ID NO: 1352842 - protein, 18 aa, Mycobacterium
MTGVPANTAMHFRNGAVA

SEQ ID NO: 1352843 - protein, 19 aa, Mycobacterium
MTPFPTMHELFSVGWGTPD

SEQ ID NO: 1352844 - protein, 18 aa, Mycobacterium
MTPWNTYVRPGLPATPIC

SEQ ID NO: 1352845 - protein, 17 aa, Mycobacterium
MTVVAPFLDRAVEAGVR

SEQ ID NO: 1352846 - protein, 23 aa, Mycobacterium
MVAPRALNAFQVGVVGLLNVLPA

SEQ ID NO: 1352847 - protein, 17 aa, Mycobacterium
MVDNYRVQYSYFVDKQD

SEQ ID NO: 1352848 - protein, 20 aa, Mycobacterium
MVFGDELWQWVDPENISRTG

SEQ ID NO: 1352849 - protein, 30 aa, Mycobacterium
MVGFGVAPLPGFPFLRGFPIRCSGEEPTCS

SEQ ID NO: 1352850 - protein, 18 aa, Mycobacterium
MVPQGWTLSVWARTPRPR

SEQ ID NO: 1352851 - protein, 19 aa, Mycobacterium
MVSEIKRFAGRREADGYLR

SEQ ID NO: 1352852 - protein, 23 aa, Mycobacterium
MYGDPVARHAFGESFLTQNFPVG

SEQ ID NO: 1352853 - protein, 18 aa, Mycobacterium
MYNLQCWIYGSNPEANAD

SEQ ID NO: 1352854 - protein, 28 aa, Mycobacterium
NAAGGFSYVVPAGWEVSDSTQLSYGQAL

SEQ ID NO: 1352855 - protein, 19 aa, Mycobacterium
NAAIAALVLPSSFRPIPDP

SEQ ID NO: 1352856 - protein, 17 aa, Mycobacterium
NAASIGITGAPDEVPGA

SEQ ID NO: 1352857 - protein, 28 aa, Mycobacterium
NAEQSAKLCVQYLAPIVKNRQFNFPPIG

SEQ ID NO: 1352858 - protein, 24 aa, Mycobacterium
NAGIPKLGAFEVMNRVIDIAQAAL

SEQ ID NO: 1352859 - protein, 19 aa, Mycobacterium
NAIVLTQNVIQLGVIPAEN

SEQ ID NO: 1352860 - protein, 21 aa, Mycobacterium
NAKTMGAYAIQAAESTHAQLS

SEQ ID NO: 1352861 - protein, 19 aa, Mycobacterium
NALNEKLSAAGDFDAQVAP

SEQ ID NO: 1352862 - protein, 19 aa, Mycobacterium
NAPAPRPAVGVPVPVDPNT

SEQ ID NO: 1352863 - protein, 24 aa, Mycobacterium
NAQARLAALSILIGTVAATGPGVT

SEQ ID NO: 1352864 - protein, 17 aa, Mycobacterium
NAQDFFDRSSVTWQDCA

SEQ ID NO: 1352865 - protein, 17 aa, Mycobacterium
NASAFPTTERVLASISS

SEQ ID NO: 1352866 - protein, 24 aa, Mycobacterium
NAVRGARNYPCVDVPGKRAASPKE

SEQ ID NO: 1352867 - protein, 22 aa, Mycobacterium
NAVTKLPGWDGPTTGTPSELGG

SEQ ID NO: 1352868 - protein, 24 aa, Mycobacterium
NAVYRSIWGSSWIAQGGVHYDMNS

SEQ ID NO: 1352869 - protein, 22 aa, Mycobacterium
NCGLAGMLPLAMAPPPPVPGVL

SEQ ID NO: 1352870 - protein, 20 aa, Mycobacterium
NDDKLAFTIEARALTFQPVK

SEQ ID NO: 1352871 - protein, 22 aa, Mycobacterium
NDLLAGLWVGMRRLHYTFFNSS

SEQ ID NO: 1352872 - protein, 27 aa, Mycobacterium
NDPERYGALGLYGWVGGAVNDVAPDAT

SEQ ID NO: 1352873 - protein, 20 aa, Mycobacterium
NDPKVFGGYLGGLFGAKTGG

SEQ ID NO: 1352874 - protein, 25 aa, Mycobacterium
NDPYRFPDNLPRIAAKGGPGGAPGC

SEQ ID NO: 1352875 - protein, 19 aa, Mycobacterium
NDRDRLVVIIAGYSNDIDR

SEQ ID NO: 1352876 - protein, 18 aa, Mycobacterium
NDSVSAWSDMTTTSPTRA

SEQ ID NO: 1352877 - protein, 21 aa, Mycobacterium
NDVRVRQAINYAIDPEALNRI

SEQ ID NO: 1352878 - protein, 21 aa, Mycobacterium
NDVRVRQAVAYAVDRDAIVQA

SEQ ID NO: 1352879 - protein, 17 aa, Mycobacterium
NDYRRAAFGESWTDDTT

SEQ ID NO: 1352880 - protein, 17 aa, Mycobacterium
NEAGLVCGGVQTANATV

SEQ ID NO: 1352881 - protein, 22 aa, Mycobacterium
NEEAAVRLLEWLQASHPSPEVA

SEQ ID NO: 1352882 - protein, 18 aa, Mycobacterium
NEIRRVVQVLSRRTKNNP

SEQ ID NO: 1352883 - protein, 26 aa, Mycobacterium
NETRKSFGIAGPRVVEDLELSIPTTT

SEQ ID NO: 1352884 - protein, 18 aa, Mycobacterium
NFDRSGPVVLYRVAPQMF

SEQ ID NO: 1352885 - protein, 18 aa, Mycobacterium
NFDRSGPVVLYRVAPQVF

SEQ ID NO: 1352886 - protein, 18 aa, Mycobacterium
NFEQGWFTAYRRLAEEEP

SEQ ID NO: 1352887 - protein, 30 aa, Mycobacterium
NFLSCDGCWVGGSPMHRAVAGLFVDGNTAL

SEQ ID NO: 1352888 - protein, 19 aa, Mycobacterium
NFVGIPLYPAGARCMVHES

SEQ ID NO: 1352889 - protein, 18 aa, Mycobacterium
NGADSMFVNIGTYGSSAP

SEQ ID NO: 1352890 - protein, 20 aa, Mycobacterium
NGAFSKLAGVVLLDGVGFGD

SEQ ID NO: 1352891 - protein, 25 aa, Mycobacterium
NGASEVSGGFDWRKAAGSTINILQT

SEQ ID NO: 1352892 - protein, 23 aa, Mycobacterium
NGDPIIWDRGRELGMTNRINRVP

SEQ ID NO: 1352893 - protein, 25 aa, Mycobacterium
NGGRKYGGINGWWGGYGDSLMTPTE

SEQ ID NO: 1352894 - protein, 24 aa, Mycobacterium
NGLAAAVSHVLSGKGFTKGNVGNN

SEQ ID NO: 1352895 - protein, 22 aa, Mycobacterium
NGLRFTDVPLLVGLRGGANARA

SEQ ID NO: 1352896 - protein, 18 aa, Mycobacterium
NGNTPAYVLNPFAMANSL

SEQ ID NO: 1352897 - protein, 17 aa, Mycobacterium
NGPDARVKAIYRVAIPD

SEQ ID NO: 1352898 - protein, 22 aa, Mycobacterium
NGPGGLAAHFVWSNRGKESVTL

SEQ ID NO: 1352899 - protein, 25 aa, Mycobacterium
NGPRGAEDSRWVYFTSGTTGRPKGV

SEQ ID NO: 1352900 - protein, 19 aa, Mycobacterium
NGQIWAGVVGEPVAPGTPR

SEQ ID NO: 1352901 - protein, 17 aa, Mycobacterium
NGQIWAGVVGNPVAPGT

SEQ ID NO: 1352902 - protein, 20 aa, Mycobacterium
NGQTGAGCSLMVWETDNRAR

SEQ ID NO: 1352903 - protein, 18 aa, Mycobacterium
NGRHLVVALMYGLVKEGG

SEQ ID NO: 1352904 - protein, 19 aa, Mycobacterium
NGVKCLNYLGLQEETAELG

SEQ ID NO: 1352905 - protein, 20 aa, Mycobacterium
NILAGTQCMTVYKSATEEAN

SEQ ID NO: 1352906 - protein, 26 aa, Mycobacterium
NINRRLKLPYDIWLRGSQCDEANAIW

SEQ ID NO: 1352907 - protein, 25 aa, Mycobacterium
NITTYRTSYSFFGLGSPSLPGTVVK

SEQ ID NO: 1352908 - protein, 18 aa, Mycobacterium
NKLRPGLAKYVVREVTEP

SEQ ID NO: 1352909 - protein, 21 aa, Mycobacterium
NKMAYLQAIQFDFDEGSPGVL

SEQ ID NO: 1352910 - protein, 20 aa, Mycobacterium
NLAQFPSILVELGNMKSPVD

SEQ ID NO: 1352911 - protein, 17 aa, Mycobacterium
NLEQILALYPIEIAGLQ

SEQ ID NO: 1352912 - protein, 19 aa, Mycobacterium
NLIAARYVQLTPAYESSGP

SEQ ID NO: 1352913 - protein, 23 aa, Mycobacterium
NLPGAAWQRCRTHYAANLMSICP

SEQ ID NO: 1352914 - protein, 20 aa, Mycobacterium
NLTNWTVCWQSPKAGSTFTA

SEQ ID NO: 1352915 - protein, 21 aa, Mycobacterium
NLTNWTVCWQSPRAGSTFTAK

SEQ ID NO: 1352916 - protein, 25 aa, Mycobacterium
NNAAAKGYFPLSFTVADIDQNGPVV

SEQ ID NO: 1352917 - protein, 18 aa, Mycobacterium
NNLGGIICELERECREVY

SEQ ID NO: 1352918 - protein, 18 aa, Mycobacterium
NPDCLGTVYAAEEPAYAG

SEQ ID NO: 1352919 - protein, 24 aa, Mycobacterium
NPDLGTRVDQRFEEVEALLERYRE

SEQ ID NO: 1352920 - protein, 17 aa, Mycobacterium
NPEKWAFGSPPAPPAPT

SEQ ID NO: 1352921 - protein, 29 aa, Mycobacterium
NPFVSTFRLGGYNVVTWDPRGEFASGGVL

SEQ ID NO: 1352922 - protein, 28 aa, Mycobacterium
NPGDALWGEAYFAPYVDMGAWPVPDLLA

SEQ ID NO: 1352923 - protein, 25 aa, Mycobacterium
NPGLPARGVVALCDFGATGTSITLA

SEQ ID NO: 1352924 - protein, 17 aa, Mycobacterium
NPIRILAPRSHQPGSLA

SEQ ID NO: 1352925 - protein, 26 aa, Mycobacterium
NPIYSPENFPGLFSAGGTLDALFVKL

SEQ ID NO: 1352926 - protein, 20 aa, Mycobacterium
NPLAMLNALMAFEYVHGYYL

SEQ ID NO: 1352927 - protein, 17 aa, Mycobacterium
NPQTFVTKTWLRDNYPQ

SEQ ID NO: 1352928 - protein, 19 aa, Mycobacterium
NPTWPGARLETVILTEADF

SEQ ID NO: 1352929 - protein, 26 aa, Mycobacterium
NPVLRGKFLAALHCDRDGAVESRQAL

SEQ ID NO: 1352930 - protein, 18 aa, Mycobacterium
NPWITPVGSAVFAIPPGA

SEQ ID NO: 1352931 - protein, 19 aa, Mycobacterium
NQHTFSWTGNSNGLGTQQT

SEQ ID NO: 1352932 - protein, 20 aa, Mycobacterium
NQMAALDFNTIRLAYSSESL

SEQ ID NO: 1352933 - protein, 25 aa, Mycobacterium
NQPPPCMTGFLPASEWRSPADTSTA

SEQ ID NO: 1352934 - protein, 17 aa, Mycobacterium
NQPRPAAEANLRGYFTA

SEQ ID NO: 1352935 - protein, 25 aa, Mycobacterium
NQVGHLKTIWGMTAAEAGTRRGTGL

SEQ ID NO: 1352936 - protein, 21 aa, Mycobacterium
NRANIVDAFAALRSFAIVGSR

SEQ ID NO: 1352937 - protein, 17 aa, Mycobacterium
NRLAAQRAITVKTTPPV

SEQ ID NO: 1352938 - protein, 20 aa, Mycobacterium
NRLDAGLLTGTRWEGDLTAL

SEQ ID NO: 1352939 - protein, 20 aa, Mycobacterium
NRLLLKEGLERHGLQNYELE

SEQ ID NO: 1352940 - protein, 21 aa, Mycobacterium
NRLPIRDLIRMAAHSRHYLAV

SEQ ID NO: 1352941 - protein, 20 aa, Mycobacterium
NRLYGAQAIEYVIRRAGTQI

SEQ ID NO: 1352942 - protein, 22 aa, Mycobacterium
NRQLTTIPWMFVAPLTGVAEKE

SEQ ID NO: 1352943 - protein, 23 aa, Mycobacterium
NRTIAWYSAMAYRALGNEEAAVR

SEQ ID NO: 1352944 - protein, 24 aa, Mycobacterium
NRVDAIAPGWAWNTLPDSLYPDRS

SEQ ID NO: 1352945 - protein, 26 aa, Mycobacterium
NSATPDAAWAFVSWITAKPNDVVRTE

SEQ ID NO: 1352946 - protein, 24 aa, Mycobacterium
NSLAFALGAVTGFAEPSAITATSV

SEQ ID NO: 1352947 - protein, 19 aa, Mycobacterium
NSPAGMDILHRLLDGADVL

SEQ ID NO: 1352948 - protein, 25 aa, Mycobacterium
NSPDGYRTEVEWATQMSYSGIYVHS

SEQ ID NO: 1352949 - protein, 25 aa, Mycobacterium
NSPNGYRTEVDWATQISYSGIYVHA

SEQ ID NO: 1352950 - protein, 23 aa, Mycobacterium
NSVTCVKQGGKINVASGAIGGQQ

SEQ ID NO: 1352951 - protein, 24 aa, Mycobacterium
NSYPLPEATGWPVGVSLGHDGRVV

SEQ ID NO: 1352952 - protein, 24 aa, Mycobacterium
NSYPLPEATGWPVGVSLGHDGSVV

SEQ ID NO: 1352953 - protein, 31 aa, Mycobacterium
NTAALIPGFIKRWFSWLGQLNFQACIFGISA

SEQ ID NO: 1352954 - protein, 20 aa, Mycobacterium
NTAFHCQYAMQFIAVLRGYG

SEQ ID NO: 1352955 - protein, 17 aa, Mycobacterium
NTALADLLVRFEKAARW

SEQ ID NO: 1352956 - protein, 17 aa, Mycobacterium
NTAMHFRNGAVAISYVA

SEQ ID NO: 1352957 - protein, 28 aa, Mycobacterium
NTEMSLPLASIFKLYVLLAVAEAVKVGS

SEQ ID NO: 1352958 - protein, 24 aa, Mycobacterium
NTFPDPPSTGWRVNAATIFEGAAF

SEQ ID NO: 1352959 - protein, 18 aa, Mycobacterium
NTLTVRRGAEPVSVELIL

SEQ ID NO: 1352960 - protein, 27 aa, Mycobacterium
NTSLEEWRPGKFNGVRLADGSHSDTML

SEQ ID NO: 1352961 - protein, 17 aa, Mycobacterium
NTSMMWHPMHLHGHTFE

SEQ ID NO: 1352962 - protein, 19 aa, Mycobacterium
NTSYYRLMLELNNGPQDVA

SEQ ID NO: 1352963 - protein, 17 aa, Mycobacterium
NTTMGRLAVNLPPDGLT

SEQ ID NO: 1352964 - protein, 20 aa, Mycobacterium
NVDLAFFGPFAYVVAGLNGA

SEQ ID NO: 1352965 - protein, 21 aa, Mycobacterium
NVDLAFFGPFGYVVAGLNGAK

SEQ ID NO: 1352966 - protein, 20 aa, Mycobacterium
NVHVRPGYNFPNADAAIGYG

SEQ ID NO: 1352967 - protein, 17 aa, Mycobacterium
NVLMVPFAGGWRIDLEC

SEQ ID NO: 1352968 - protein, 19 aa, Mycobacterium
NVSHGCINLSPANAQWFYD

SEQ ID NO: 1352969 - protein, 19 aa, Mycobacterium
NWFERTFFAATPVYPPQTV

SEQ ID NO: 1352970 - protein, 30 aa, Mycobacterium
NWLPAPKGPFALVLRLYWPKPDALNGSWRS

SEQ ID NO: 1352971 - protein, 23 aa, Mycobacterium
NWPEFRSQTAAAWLMSIARQTFD

SEQ ID NO: 1352972 - protein, 24 aa, Mycobacterium
NYAVLECGPSIYDCQQRSVKKVKF

SEQ ID NO: 1352973 - protein, 25 aa, Mycobacterium
NYDLGARAPITFDTLFRPGTRPLDV

SEQ ID NO: 1352974 - protein, 19 aa, Mycobacterium
NYETVFDWYEMSYDNGSVP

SEQ ID NO: 1352975 - protein, 38 aa, Mycobacterium
NYKRAEICRQRMGPVFKRIAMNFPPLLFHPINSITAYK

SEQ ID NO: 1352976 - protein, 24 aa, Mycobacterium
NYQMAVEAFVWRTYEETLPPDAVE

SEQ ID NO: 1352977 - protein, 20 aa, Mycobacterium
NYSGPCVPIASDVDCAAGSG

SEQ ID NO: 1352978 - protein, 23 aa, Mycobacterium
NYVWKEGNTTYVFIPTENLPLLE

SEQ ID NO: 1352979 - protein, 17 aa, Mycobacterium
PAAAGRTILPFVNGDQN

SEQ ID NO: 1352980 - protein, 26 aa, Mycobacterium
PAAEPVPSLKPAAAVPDSLEQRWTTG

SEQ ID NO: 1352981 - protein, 25 aa, Mycobacterium
PAAICLSWAPAAPAATVLGVEGTGQ

SEQ ID NO: 1352982 - protein, 21 aa, Mycobacterium
PAAQDWAGLVLAALKLATVAP

SEQ ID NO: 1352983 - protein, 25 aa, Mycobacterium
PACGCYYSDVYWITFAGMATVDDPR

SEQ ID NO: 1352984 - protein, 26 aa, Mycobacterium
PADAKAIIVAPNLIAARYVQLTPAYE

SEQ ID NO: 1352985 - protein, 24 aa, Mycobacterium
PADAKAVILSPQLVTGRAIQLTPA

SEQ ID NO: 1352986 - protein, 24 aa, Mycobacterium
PADAKAVILSPTLVTARTIQLTPA

SEQ ID NO: 1352987 - protein, 23 aa, Mycobacterium
PADAKAVILSPTLVTSRAIQLTP

SEQ ID NO: 1352988 - protein, 24 aa, Mycobacterium
PADAKAVILSPTLVTSRAIQLTPG

SEQ ID NO: 1352989 - protein, 21 aa, Mycobacterium
PADAKAVIVAQNLVAARYVQL

SEQ ID NO: 1352990 - protein, 21 aa, Mycobacterium
PADAKAVIVAQNLVAERFVAL

SEQ ID NO: 1352991 - protein, 25 aa, Mycobacterium
PADMCGFSGQRLMGMLSDGGDSIEY

SEQ ID NO: 1352992 - protein, 20 aa, Mycobacterium
PADMRVYMDMFARHNEIRRT

SEQ ID NO: 1352993 - protein, 19 aa, Mycobacterium
PAEAVEFGIANGFTIAEMA

SEQ ID NO: 1352994 - protein, 34 aa, Mycobacterium; identical to SEQ ID NO: 1254188

SEQ ID NO: 1352995 - protein, 17 aa, Mycobacterium
PAFEWYHQSGLSVVMPV

SEQ ID NO: 1352996 - protein, 19 aa, Mycobacterium
PAGAGCLYGGPYISKCDGP

SEQ ID NO: 1352997 - protein, 17 aa, Mycobacterium
PAGTVLTPDGWELTVAA

SEQ ID NO: 1352998 - protein, 17 aa, Mycobacterium
PAGYHVAFRDGVTTRLG

SEQ ID NO: 1352999 - protein, 17 aa, Mycobacterium
PAIDLEPPLIVTPVGVP

SEQ ID NO: 1353000 - protein, 18 aa, Mycobacterium
PALEEFFTGVVASLDPTN

SEQ ID NO: 1353001 - protein, 17 aa, Mycobacterium
PALFYSKAGSLYISDPA

SEQ ID NO: 1353002 - protein, 19 aa, Mycobacterium
PALPTRPVSTIAPATSGTL

SEQ ID NO: 1353003 - protein, 19 aa, Mycobacterium
PALTRSMSFFSVLPWQKET

SEQ ID NO: 1353004 - protein, 17 aa, Mycobacterium
PAMLSRPEGCADALTRD

SEQ ID NO: 1353005 - protein, 21 aa, Mycobacterium
PANPFVFPNPLAPPAPPAPAP

SEQ ID NO: 1353006 - protein, 25 aa, Mycobacterium
PAPAPEIPGLPFLQQLAANPAAATQ

SEQ ID NO: 1353007 - protein, 19 aa, Mycobacterium
PAPDRWDRQTPAGATAPAD

SEQ ID NO: 1353008 - protein, 20 aa, Mycobacterium
PAPEFDKWVDRRYNDVLRPL

SEQ ID NO: 1353009 - protein, 24 aa, Mycobacterium
PAPEGGWPVVAWAHGTVGLGDDCT

SEQ ID NO: 1353010 - protein, 28 aa, Mycobacterium
PAPELPFNRILAVAGFRCNVQESVGISC

SEQ ID NO: 1353011 - protein, 18 aa, Mycobacterium
PAPGLPIDTLQAPGLPAM

SEQ ID NO: 1353012 - protein, 17 aa, Mycobacterium
PAPKPGRQMVLDDDEPE

SEQ ID NO: 1353013 - protein, 28 aa, Mycobacterium
PAPVESPATWAVLAWARRQPFSTTTAAH

SEQ ID NO: 1353014 - protein, 22 aa, Mycobacterium
PAQAQPGVLVFPGMEIHQDTVL

SEQ ID NO: 1353015 - protein, 20 aa, Mycobacterium
PARDGRVWVRITGHGTVAER

SEQ ID NO: 1353016 - protein, 23 aa, Mycobacterium
PARGRPADQLRVWAAQRAPALNM

SEQ ID NO: 1353017 - protein, 17 aa, Mycobacterium
PASAARVLPALAVGHCY

SEQ ID NO: 1353018 - protein, 26 aa, Mycobacterium
PASAEFLRVLRGCGVAAVLSGAGPAV

SEQ ID NO: 1353019 - protein, 24 aa, Mycobacterium
PASTIKVLLAMTVLDHLRPDNFAR

SEQ ID NO: 1353020 - protein, 23 aa, Mycobacterium
PASTIKVLLAMVVLDELPLDATI

SEQ ID NO: 1353021 - protein, 21 aa, Mycobacterium
PATTSWQAWSQRCAELTTHPA

SEQ ID NO: 1353022 - protein, 20 aa, Mycobacterium
PATVSKLLIRVAETSDAPQP

SEQ ID NO: 1353023 - protein, 20 aa, Mycobacterium
PAVAPYGAFPTRDGQTVVLG

SEQ ID NO: 1353024 - protein, 34 aa, Mycobacterium
PAVQRAETPVLWTVFAWTRRTFFNATPVVRYDDT

SEQ ID NO: 1353025 - protein, 19 aa, Mycobacterium
PAVRSMGSVAASVCLVTAC

SEQ ID NO: 1353026 - protein, 25 aa, Mycobacterium
PDAGDACVLWCCAIRHAVLTGQLDV

SEQ ID NO: 1353027 - protein, 27 aa, Mycobacterium
PDAPSESPLWLVVAAALRRQLDSPTTS

SEQ ID NO: 1353028 - protein, 18 aa, Mycobacterium
PDATKNFPVRQLVTNTGW

SEQ ID NO: 1353029 - protein, 18 aa, Mycobacterium
PDAVFCANDLLAIGVLQA

SEQ ID NO: 1353030 - protein, 20 aa, Mycobacterium
PDCTVSAPGNSLCESAGNAQ

SEQ ID NO: 1353031 - protein, 22 aa, Mycobacterium
PDDASPRIALRTVGGEDTPAEE

SEQ ID NO: 1353032 - protein, 22 aa, Mycobacterium
PDDFFRPLLHGDSILPTNGNNL

SEQ ID NO: 1353033 - protein, 26 aa, Mycobacterium
PDGGMWQRLAWLRYLLGEPVPILDLS

SEQ ID NO: 1353034 - protein, 21 aa, Mycobacterium
PDGKLAWAGLSALTPDSDFDQ

SEQ ID NO: 1353035 - protein, 18 aa, Mycobacterium
PDHIPLNVPDRGLGPDAL

SEQ ID NO: 1353036 - protein, 22 aa, Mycobacterium
PDHRMWRPAEELGYGRTYTLTV

SEQ ID NO: 1353037 - protein, 20 aa, Mycobacterium
PDIARTILVYRRGEATLARD

SEQ ID NO: 1353038 - protein, 21 aa, Mycobacterium
PDLPAAFDRFGAFRRRRVRPL

SEQ ID NO: 1353039 - protein, 17 aa, Mycobacterium
PDLPALRVADVSSTKTE

SEQ ID NO: 1353040 - protein, 38 aa, Mycobacterium
PDLVGIPYPASFWPLSFLPGWCVPGRCEKWDVSVGEGT

SEQ ID NO: 1353041 - protein, 21 aa, Mycobacterium
PDMQSTLWIGPLGGRAAQALE

SEQ ID NO: 1353042 - protein, 18 aa, Mycobacterium
PDPAAAAINTEWATFYHE

SEQ ID NO: 1353043 - protein, 19 aa, Mycobacterium
PDPSFLTKTFVNVRELITT

SEQ ID NO: 1353044 - protein, 17 aa, Mycobacterium
PDRPDFIGIAQRERNQQ

SEQ ID NO: 1353045 - protein, 18 aa, Mycobacterium
PDRVRAMVLDGAVDPSLD

SEQ ID NO: 1353046 - protein, 17 aa, Mycobacterium
PDSPVFAVVAGFIRTYL

SEQ ID NO: 1353047 - protein, 18 aa, Mycobacterium
PEALPMGVASEVGLQPNA

SEQ ID NO: 1353048 - protein, 26 aa, Mycobacterium
PEAQKLWAEANFRPVDPAVLAEFADK

SEQ ID NO: 1353049 - protein, 20 aa, Mycobacterium
PEARRFADAEAMFEALRAGQ

SEQ ID NO: 1353050 - protein, 23 aa, Mycobacterium
PEDGWTLVSWDGVAVDPDPSFLT

SEQ ID NO: 1353051 - protein, 21 aa, Mycobacterium
PEDIRFGLYGALAHPLEANAL

SEQ ID NO: 1353052 - protein, 21 aa, Mycobacterium
PEDRTAVPVEWDDFRAQLDSL

SEQ ID NO: 1353053 - protein, 22 aa, Mycobacterium
PEELALRWFGHEGEFDGPDLIL

SEQ ID NO: 1353054 - protein, 24 aa, Mycobacterium
PEEPAEWPAPVATLTDTVGAGGTP

SEQ ID NO: 1353055 - protein, 18 aa, Mycobacterium
PEFARGMAAQSFVGHGAE

SEQ ID NO: 1353056 - protein, 23 aa, Mycobacterium
PEGAPYRLVEPASLPSIYADTEV

SEQ ID NO: 1353057 - protein, 20 aa, Mycobacterium
PEGIPPPAGAPVPYIDYPAR

SEQ ID NO: 1353058 - protein, 21 aa, Mycobacterium
PEGPAQAWLLADLDSGRVLAS

SEQ ID NO: 1353059 - protein, 22 aa, Mycobacterium
PEGRLRDGSLIPLSSGGRYPST

SEQ ID NO: 1353060 - protein, 22 aa, Mycobacterium
PEINILNVFLVQWNENPENRSG

SEQ ID NO: 1353061 - protein, 25 aa, Mycobacterium
PEKLWTIEDLGGWSKVDSELFDKEN

SEQ ID NO: 1353062 - protein, 17 aa, Mycobacterium
PELRELQTAVLRQAPEL

SEQ ID NO: 1353063 - protein, 21 aa, Mycobacterium
PELRGRVGTVEAFNAAPGAAL

SEQ ID NO: 1353064 - protein, 23 aa, Mycobacterium
PELRIAVQGVSRFADTINQRDEQ

SEQ ID NO: 1353065 - protein, 26 aa, Mycobacterium
PEPPDGPGVPGSFPVSFANNSGYADD

SEQ ID NO: 1353066 - protein, 17 aa, Mycobacterium
PEPPHNFVTPANYTLDQ

SEQ ID NO: 1353067 - protein, 21 aa, Mycobacterium
PEQFFPIGQLTFARSVAEGLV

SEQ ID NO: 1353068 - protein, 17 aa, Mycobacterium
PEQKKAAVIAFADANPQ

SEQ ID NO: 1353069 - protein, 19 aa, Mycobacterium
PEQRTFFIWEGVTQYLSPE

SEQ ID NO: 1353070 - protein, 18 aa, Mycobacterium
PESGLVFREPLTGKFVYT

SEQ ID NO: 1353071 - protein, 24 aa, Mycobacterium
PESIPGDSGAPVWQPASDGTATIV

SEQ ID NO: 1353072 - protein, 22 aa, Mycobacterium
PESVKVSFWYDSKYKVPADAKA

SEQ ID NO: 1353073 - protein, 19 aa, Mycobacterium
PETDDCNRRASLRPFPTRA

SEQ ID NO: 1353074 - protein, 17 aa, Mycobacterium
PETRTVTTLTVISTTTG

SEQ ID NO: 1353075 - protein, 17 aa, Mycobacterium
PEVELIFARGRIESPGA

SEQ ID NO: 1353076 - protein, 18 aa, Mycobacterium
PEVHFDRADDAFTDPAPW

SEQ ID NO: 1353077 - protein, 24 aa, Mycobacterium
PEVNAGPQCLAWFGNKEDGNCLSY

SEQ ID NO: 1353078 - protein, 17 aa, Mycobacterium
PEVNWFFTSLRGLPPDE

SEQ ID NO: 1353079 - protein, 33 aa, Mycobacterium
PEVPSWRPWPTAFDLRSAVTYVVDLATSFVDAL

SEQ ID NO: 1353080 - protein, 17 aa, Mycobacterium
PEYQGKVALNGDPTQAG

SEQ ID NO: 1353081 - protein, 22 aa, Mycobacterium
PFALAGLLCWAANRAGALRVHL

SEQ ID NO: 1353082 - protein, 20 aa, Mycobacterium
PFALTAVLIWTARRAGVLRW

SEQ ID NO: 1353083 - protein, 26 aa, Mycobacterium
PFPGLPDDLRYSLDVGTENLHAAVYA

SEQ ID NO: 1353084 - protein, 28 aa, Mycobacterium
PFPKDCPAPGVMQGCLESTSGLIMLPDS

SEQ ID NO: 1353085 - protein, 27 aa, Mycobacterium
PFPPVLTEFLAIPWVVPNWPPGVLRPD

SEQ ID NO: 1353086 - protein, 38 aa, Mycobacterium
PFSQTWRRCDFSKFAYTGPRAYGRLVGQFRVEAGELVA

SEQ ID NO: 1353087 - protein, 31 aa, Mycobacterium
PGAAANGPWDFIPTIQVPQIPGLPVPLPTEI

SEQ ID NO: 1353088 - protein, 27 aa, Mycobacterium
PGADKPVLVGLRYRPGQTPLLAREWTS

SEQ ID NO: 1353089 - protein, 33 aa, Mycobacterium; identical to SEQ ID NO: 1274951

SEQ ID NO: 1353090 - protein, 27 aa, Mycobacterium
PGALPAFPGAEGFGSLATGGRGGSVVY

SEQ ID NO: 1353091 - protein, 26 aa, Mycobacterium
PGAMVLDEFLPLLATQGLDTSRVAFL

SEQ ID NO: 1353092 - protein, 19 aa, Mycobacterium
PGAPGIFTPPVTAPQPTNN

SEQ ID NO: 1353093 - protein, 26 aa, Mycobacterium
PGAPIIDLPIPEGWEDAGGDTPEWAY

SEQ ID NO: 1353094 - protein, 34 aa, Mycobacterium
PGAVLSFPPTQWIRWRRPVIGMPMTARILTPGNL

SEQ ID NO: 1353095 - protein, 26 aa, Mycobacterium
PGDPRYPYRPPLPQPPPGGPPPGPPA

SEQ ID NO: 1353096 - protein, 25 aa, Mycobacterium
PGEGPRWNGDWDMDDPRVNPIAGAD

SEQ ID NO: 1353097 - protein, 24 aa, Mycobacterium
PGEGWGLCYDGERLIRSDGTNRLM

SEQ ID NO: 1353098 - protein, 19 aa, Mycobacterium
PGGECPTEPVSVVVSVDQW

SEQ ID NO: 1353099 - protein, 25 aa, Mycobacterium
PGGFREVLELAGSYGKPLWVTENGI

SEQ ID NO: 1353100 - protein, 17 aa, Mycobacterium
PGGLTPREIEVLCLVAR

SEQ ID NO: 1353101 - protein, 17 aa, Mycobacterium
PGGQVLTNFHVVQGADR

SEQ ID NO: 1353102 - protein, 19 aa, Mycobacterium
PGHDGWRPGDPPGHNPFGP

SEQ ID NO: 1353103 - protein, 25 aa, Mycobacterium
PGHPEIFVIGDLVGRDDLPGVAENA

SEQ ID NO: 1353104 - protein, 22 aa, Mycobacterium
PGIDKEANWLPAPKGPFALVLR

SEQ ID NO: 1353105 - protein, 19 aa, Mycobacterium
PGIGKLKINGVYGSVHLEK

SEQ ID NO: 1353106 - protein, 19 aa, Mycobacterium
PGLITGAFLNGYKPYFGHD

SEQ ID NO: 1353107 - protein, 17 aa, Mycobacterium
PGLRTATVPGRLEAVDR

SEQ ID NO: 1353108 - protein, 18 aa, Mycobacterium
PGNYVWTEGNTTYVFIPT

SEQ ID NO: 1353109 - protein, 18 aa, Mycobacterium
PGPDEAVEVWKVGSALIR

SEQ ID NO: 1353110 - protein, 18 aa, Mycobacterium
PGPSYGQVIPEYVNDNPP

SEQ ID NO: 1353111 - protein, 19 aa, Mycobacterium
PGQGMSVVMLHGLPGTSED

SEQ ID NO: 1353112 - protein, 22 aa, Mycobacterium
PGRPRAVMVWIHGGSFVAGSGG

SEQ ID NO: 1353113 - protein, 27 aa, Mycobacterium
PGSSPALWAVAAWVRRQTTQAIDGFLA

SEQ ID NO: 1353114 - protein, 20 aa, Mycobacterium
PGTDVGWHYVASRAVRLDDV

SEQ ID NO: 1353115 - protein, 19 aa, Mycobacterium
PGTEGGGPGSFVIQAQLPD

SEQ ID NO: 1353116 - protein, 17 aa, Mycobacterium
PGTSEGRQLRRWLTQLL

SEQ ID NO: 1353117 - protein, 17 aa, Mycobacterium
PGTYWAHPHTGLDADYG

SEQ ID NO: 1353118 - protein, 25 aa, Mycobacterium
PHGGGRLDGPIPMSRTVSPYQLPDA

SEQ ID NO: 1353119 - protein, 22 aa, Mycobacterium
PHPRPERRLDDPLAGMAQGQRP

SEQ ID NO: 1353120 - protein, 26 aa, Mycobacterium
PIEFICGGVQAASRLGAEQAAKLCVQ

SEQ ID NO: 1353121 - protein, 24 aa, Mycobacterium
PIEFLCGAVQAASRLNGEQSAKLC

SEQ ID NO: 1353122 - protein, 18 aa, Mycobacterium
PIGANPFVGQSARPNELT

SEQ ID NO: 1353123 - protein, 18 aa, Mycobacterium
PIIAALDAPLRWFIELAY

SEQ ID NO: 1353124 - protein, 25 aa, Mycobacterium
PISFICGAIQAASRLNAEQSAKLCV

SEQ ID NO: 1353125 - protein, 17 aa, Mycobacterium
PKDPITLLLPSRPMLEY

SEQ ID NO: 1353126 - protein, 22 aa, Mycobacterium
PKIVRYEIFGDPGATADINYID

SEQ ID NO: 1353127 - protein, 21 aa, Mycobacterium
PKLADPSVRRAILGLLDVDLL

SEQ ID NO: 1353128 - protein, 26 aa, Mycobacterium
PKLCREVYYQWIVPLGLVEVGVAENV

SEQ ID NO: 1353129 - protein, 27 aa, Mycobacterium
PKNDLSWRDCTSRVFASAAVQPLGGVK

SEQ ID NO: 1353130 - protein, 19 aa, Mycobacterium
PKSGGVFRSPVLGRGSVLA

SEQ ID NO: 1353131 - protein, 23 aa, Mycobacterium
PKVAANQTVSFGFQASPGGASAT

SEQ ID NO: 1353132 - protein, 19 aa, Mycobacterium
PLADDGLGGMPARVVDVEW

SEQ ID NO: 1353133 - protein, 18 aa, Mycobacterium
PLAERFTGVHPNTYVYDV

SEQ ID NO: 1353134 - protein, 25 aa, Mycobacterium
PLASIFKLYVLFAVAEAVKADTLEW

SEQ ID NO: 1353135 - protein, 17 aa, Mycobacterium
PLDDAIRASIAIPGVIT

SEQ ID NO: 1353136 - protein, 18 aa, Mycobacterium
PLDGCPPAGPPPGFQECH

SEQ ID NO: 1353137 - protein, 27 aa, Mycobacterium
PLILRQRYPVPDAPYAVAGSRDDDGLA

SEQ ID NO: 1353138 - protein, 17 aa, Mycobacterium
PLIPALESHGYRPEQRT

SEQ ID NO: 1353139 - protein, 17 aa, Mycobacterium
PLIPKLPGLHLVSIDRP

SEQ ID NO: 1353140 - protein, 17 aa, Mycobacterium
PLLELQSQFAFLTADQL

SEQ ID NO: 1353141 - protein, 18 aa, Mycobacterium
PLLHEQLLAALPEGHPLA

SEQ ID NO: 1353142 - protein, 23 aa, Mycobacterium
PLLRACALTLISDVGLVAVARPP

SEQ ID NO: 1353143 - protein, 19 aa, Mycobacterium
PLLYQCATGTLSIGHISRP

SEQ ID NO: 1353144 - protein, 33 aa, Mycobacterium
PLPDEMPAAALWWRLADALSRTAAIPDRTVVDH

SEQ ID NO: 1353145 - protein, 26 aa, Mycobacterium
PLPGTAYKWTVVFHHNEHTHPFADNL

SEQ ID NO: 1353146 - protein, 22 aa, Mycobacterium
PLQFRSFDVVDGWRRPDGPVAP

SEQ ID NO: 1353147 - protein, 22 aa, Mycobacterium
PLRDIRGGGPLPQMSGTYGSKS

SEQ ID NO: 1353148 - protein, 20 aa, Mycobacterium
PLRHRYAGYTAWRGIAAHRL

SEQ ID NO: 1353149 - protein, 20 aa, Mycobacterium
PLRPRPAVVRTFDAPAPNWQ

SEQ ID NO: 1353150 - protein, 20 aa, Mycobacterium
PLRPRPAVVRTFDAPTPNWQ

SEQ ID NO: 1353151 - protein, 19 aa, Mycobacterium
PLRRPDLLRVFLLGELPPA

SEQ ID NO: 1353152 - protein, 26 aa, Mycobacterium
PLRVSGYAGWVAWGLLHIAFLTGVSN

SEQ ID NO: 1353153 - protein, 17 aa, Mycobacterium
PLRYYLVESSVNGLSGN

SEQ ID NO: 1353154 - protein, 18 aa, Mycobacterium
PLSWTLSGVVVALTSNTT

SEQ ID NO: 1353155 - protein, 24 aa, Mycobacterium
PLTGKFVYTPSLPVIGDPVTVQFD

SEQ ID NO: 1353156 - protein, 17 aa, Mycobacterium
PLTKRFPAIGVPEAVAW

SEQ ID NO: 1353157 - protein, 22 aa, Mycobacterium
PLVTGLRRLGHRVDLADQSSGL

SEQ ID NO: 1353158 - protein, 18 aa, Mycobacterium
PLWLFTLRAQSWAGDYGS

SEQ ID NO: 1353159 - protein, 21 aa, Mycobacterium
PMDAGCTGTAPPTCKDANSIL

SEQ ID NO: 1353160 - protein, 25 aa, Mycobacterium
PMPALPLMLRHVRESAADCALTDVT

SEQ ID NO: 1353161 - protein, 25 aa, Mycobacterium
PNADKPVLVGLRYRPGQTPQLTREW

SEQ ID NO: 1353162 - protein, 24 aa, Mycobacterium
PNKSAATADSFKVLVSDGHGGATT

SEQ ID NO: 1353163 - protein, 19 aa, Mycobacterium
PNPCVRCNERIKFSALSAR

SEQ ID NO: 1353164 - protein, 18 aa, Mycobacterium
PNRDRVWVASSCTNEVVG

SEQ ID NO: 1353165 - protein, 25 aa, Mycobacterium
PNVPDAFAVLADRVGGNGLYSSNAQ

SEQ ID NO: 1353166 - protein, 20 aa, Mycobacterium
PNVPEYPGFESFPGRILHSH

SEQ ID NO: 1353167 - protein, 27 aa, Mycobacterium
PPADPSGWALLAWVRREFFNGTPAPVE

SEQ ID NO: 1353168 - protein, 24 aa, Mycobacterium
PPAGPFCVPAVLPSLRTVARVTDP

SEQ ID NO: 1353169 - protein, 18 aa, Mycobacterium
PPAMAAFWSAALGRPEQE

SEQ ID NO: 1353170 - protein, 25 aa, Mycobacterium
PPDGQPVILLHGWPYDIHSYADVTA

SEQ ID NO: 1353171 - protein, 28 aa, Mycobacterium
PPEAWRVDAVFLDPRWISGFDPMADYAV

SEQ ID NO: 1353172 - protein, 22 aa, Mycobacterium
PPELQRRVGTVGVFTAAPEAVL

SEQ ID NO: 1353173 - protein, 23 aa, Mycobacterium
PPELQRRVGTVGVFTAAPEAVLD

SEQ ID NO: 1353174 - protein, 23 aa, Mycobacterium
PPGAECGMLSVPVDWVRADAPDG

SEQ ID NO: 1353175 - protein, 23 aa, Mycobacterium
PPGAQPATIVAFVTKLTGNVDSA

SEQ ID NO: 1353176 - protein, 30 aa, Mycobacterium
PPGAWTAHGRWLRAPVDGIFWAGTETADRW

SEQ ID NO: 1353177 - protein, 17 aa, Mycobacterium
PPGTRGPLYAVLGSPGG

SEQ ID NO: 1353178 - protein, 20 aa, Mycobacterium
PPIRRRWAGVYSQCVDPERL

SEQ ID NO: 1353179 - protein, 25 aa, Mycobacterium
PPLYGEQQVVPFFLGPQGIADAISA

SEQ ID NO: 1353180 - protein, 19 aa, Mycobacterium
PPPCTTGFLPAQQRRVPTF

SEQ ID NO: 1353181 - protein, 20 aa, Mycobacterium
PPPPAAPWLPQAQPMAGDQI

SEQ ID NO: 1353182 - protein, 20 aa, Mycobacterium
PPPVPGVLLLDSFVLGTERY

SEQ ID NO: 1353183 - protein, 35 aa, Mycobacterium
PPQPELPEWAVGLPIVWNPDLGVWGVWNEDTGIFV

SEQ ID NO: 1353184 - protein, 20 aa, Mycobacterium
PPQRRLLEDWMRANETSSMR

SEQ ID NO: 1353185 - protein, 20 aa, Mycobacterium
PPRNQVWRANVVVQPIKVPV

SEQ ID NO: 1353186 - protein, 25 aa, Mycobacterium
PPSADELRSALALVGQLAQAPIGAD

SEQ ID NO: 1353187 - protein, 31 aa, Mycobacterium
PPSELRLPATPLPRISIFLSLLDAHVQRAPL

SEQ ID NO: 1353188 - protein, 22 aa, Mycobacterium
PPSGPLPPTARVDTASGATPPA

SEQ ID NO: 1353189 - protein, 18 aa, Mycobacterium
PPSLTLRFSEKLSANGED

SEQ ID NO: 1353190 - protein, 25 aa, Mycobacterium
PPSVLAVGGTPYFLGEDPVALLSVA

SEQ ID NO: 1353191 - protein, 25 aa, Mycobacterium
PPVGRWRRRGVMQFDHAHTFRMPVV

SEQ ID NO: 1353192 - protein, 20 aa, Mycobacterium
PPVNAFWSLTMYEMPASLLV

SEQ ID NO: 1353193 - protein, 23 aa, Mycobacterium
PPVRSAGLLRVFLLGLVPPEQAR

SEQ ID NO: 1353194 - protein, 30 aa, Mycobacterium
PPVTAAPPGVVWPMAGAALAAVFDAATASL

SEQ ID NO: 1353195 - protein, 25 aa, Mycobacterium
PQAEGNCTGCASINPIYVYEHSAPP

SEQ ID NO: 1353196 - protein, 19 aa, Mycobacterium
PQAILAAWERGDIDAAYTW

SEQ ID NO: 1353197 - protein, 20 aa, Mycobacterium
PQAVAEVWACRGDQEPGAAA

SEQ ID NO: 1353198 - protein, 19 aa, Mycobacterium
PQGNPWFTPYDRYRDDGEQ

SEQ ID NO: 1353199 - protein, 34 aa, Mycobacterium
PQGPDCGAFKEALPNWKGLANLPVSTALSSIPDI

SEQ ID NO: 1353200 - protein, 19 aa, Mycobacterium
PQGRLKEGSLIPLSSSRAY

SEQ ID NO: 1353201 - protein, 17 aa, Mycobacterium
PQLLPLSYLVGTDGSVR

SEQ ID NO: 1353202 - protein, 32 aa, Mycobacterium; identical to SEQ ID NO: 1254444

SEQ ID NO: 1353203 - protein, 26 aa, Mycobacterium
PQQQPECAVFCIKDLPPAAPAPAPAP

SEQ ID NO: 1353204 - protein, 19 aa, Mycobacterium
PQQRTAIQYYLYGLDERQP

SEQ ID NO: 1353205 - protein, 19 aa, Mycobacterium
PQRCTGLVAVSGYIVVNLA

SEQ ID NO: 1353206 - protein, 25 aa, Mycobacterium
PQRDCCYYTALIMWIGCHADSHEYA

SEQ ID NO: 1353207 - protein, 23 aa, Mycobacterium
PQTRIGYTAGHCRASGTVSDKFG

SEQ ID NO: 1353208 - protein, 19 aa, Mycobacterium
PRAGLSALLPMGGAVSGVA

SEQ ID NO: 1353209 - protein, 18 aa, Mycobacterium
PRATGWPVGVSVGHDGRV

SEQ ID NO: 1353210 - protein, 18 aa, Mycobacterium
PRAVAAGTLRDPYTNATV

SEQ ID NO: 1353211 - protein, 20 aa, Mycobacterium
PRAVLDPRCRVRGVDALWVV

SEQ ID NO: 1353212 - protein, 20 aa, Mycobacterium
PRDLAVIFRAAMADPVFAQI

SEQ ID NO: 1353213 - protein, 20 aa, Mycobacterium
PRISPDQILMMISQEYQTGR

SEQ ID NO: 1353214 - protein, 24 aa, Mycobacterium
PRKHAARLAWFQALATEQRTCVFF

SEQ ID NO: 1353215 - protein, 18 aa, Mycobacterium
PRKVEFDVEAARAAGLDT

SEQ ID NO: 1353216 - protein, 25 aa, Mycobacterium
PRLPVGEVRIGGFGGVDGLRAALSG

SEQ ID NO: 1353217 - protein, 21 aa, Mycobacterium
PRQTLLSAIGTVIFNIYTFAV

SEQ ID NO: 1353218 - protein, 28 aa, Mycobacterium
PRRALWFSVPDMYGAFHISLQDDGVYVG

SEQ ID NO: 1353219 - protein, 20 aa, Mycobacterium
PRRLVAGLALATVTVATGGC

SEQ ID NO: 1353220 - protein, 26 aa, Mycobacterium
PRSDLPEGVRFVGLVRPRSADRFVTP

SEQ ID NO: 1353221 - protein, 21 aa, Mycobacterium
PRSHQPGSLATWFDEPVDDFW

SEQ ID NO: 1353222 - protein, 20 aa, Mycobacterium
PRSVRWQASEYVVARALSQR

SEQ ID NO: 1353223 - protein, 17 aa, Mycobacterium
PRTDLFAKHGVPMVAHD

SEQ ID NO: 1353224 - protein, 23 aa, Mycobacterium
PRTGELYNYVAHFGTFIVIVTAN

SEQ ID NO: 1353225 - protein, 18 aa, Mycobacterium
PRVGALFLGGSDRHICTG

SEQ ID NO: 1353226 - protein, 21 aa, Mycobacterium
PRVGTSMSLAELCQAALQQSD

SEQ ID NO: 1353227 - protein, 17 aa, Mycobacterium
PRVPIWVGGRTARSLRR

SEQ ID NO: 1353228 - protein, 28 aa, Mycobacterium
PRWLHGCAGWPGLIWKFVRVDDARITPN

SEQ ID NO: 1353229 - protein, 18 aa, Mycobacterium
PSAAMGRSIPVAFQGGGP

SEQ ID NO: 1353230 - protein, 20 aa, Mycobacterium
PSDDPLWFWSDQYGRNIQFV

SEQ ID NO: 1353231 - protein, 25 aa, Mycobacterium
PSDPGFRLVADRAFTDRAHARGLRV

SEQ ID NO: 1353232 - protein, 22 aa, Mycobacterium
PSEGYFRFGGHLLPRDGRPKDP

SEQ ID NO: 1353233 - protein, 20 aa, Mycobacterium
PSGDTRAFLGARIGVRRGSV

SEQ ID NO: 1353234 - protein, 17 aa, Mycobacterium
PSGIDFSKNPDLVGLSS

SEQ ID NO: 1353235 - protein, 17 aa, Mycobacterium
PSGRAGSAYVSRVAEGS

SEQ ID NO: 1353236 - protein, 20 aa, Mycobacterium
PSGRLQPGTTLGLDRSSTYP

SEQ ID NO: 1353237 - protein, 24 aa, Mycobacterium
PSIYDPPMRTMIAFGGKYPTTVIP

SEQ ID NO: 1353238 - protein, 25 aa, Mycobacterium
PSLARLVALGGFRRWEPAVRRFLKD

SEQ ID NO: 1353239 - protein, 31 aa, Mycobacterium; identical to SEQ ID NO: 1275907

SEQ ID NO: 1353240 - protein, 31 aa, Mycobacterium
PSPADLDAFLRLLSDRGVDVLIYNVQTEGSV

SEQ ID NO: 1353241 - protein, 19 aa, Mycobacterium
PSPALYPGAPIPAPPNVLS

SEQ ID NO: 1353242 - protein, 24 aa, Mycobacterium
PSPDDIRFVLIASPEEGVAQYFKE

SEQ ID NO: 1353243 - protein, 24 aa, Mycobacterium
PSPLPRPRPAEVHSVTAADLGTTW

SEQ ID NO: 1353244 - protein, 21 aa, Mycobacterium
PSQPYRLRVIVHEDDNGHMTG

SEQ ID NO: 1353245 - protein, 18 aa, Mycobacterium
PSRRPDLWTRLSDDTEAP

SEQ ID NO: 1353246 - protein, 23 aa, Mycobacterium
PSRYRPARLMPSLGELIDTASKV

SEQ ID NO: 1353247 - protein, 17 aa, Mycobacterium
PSSLHWHGIALRNDMDG

SEQ ID NO: 1353248 - protein, 21 aa, Mycobacterium
PSTADVFRADGPFVGTGLQGA

SEQ ID NO: 1353249 - protein, 20 aa, Mycobacterium
PSTFCGCTLMPTDTIFHADI

SEQ ID NO: 1353250 - protein, 24 aa, Mycobacterium
PSVPPRESDALEEADESAVDADLD

SEQ ID NO: 1353251 - protein, 24 aa, Mycobacterium
PTAKLPLVQLFPSLAAKEAELKAK

SEQ ID NO: 1353252 - protein, 26 aa, Mycobacterium
PTALPLCALITAWLRGLARPQAVAEV

SEQ ID NO: 1353253 - protein, 27 aa, Mycobacterium
PTATVRTSSSWFSAKVYGTVTAKDLDR

SEQ ID NO: 1353254 - protein, 19 aa, Mycobacterium
PTAWCAEGLLIYLPPEAQD

SEQ ID NO: 1353255 - protein, 18 aa, Mycobacterium
PTDKEFLIGVVVTAQNCD

SEQ ID NO: 1353256 - protein, 33 aa, Mycobacterium
PTENLPLLQGFRNFGLGWLVDSWEEPLREIIDQ

SEQ ID NO: 1353257 - protein, 31 aa, Mycobacterium
PTERRTFQDWLFTVAGKILFGIDFATCAVDP

SEQ ID NO: 1353258 - protein, 17 aa, Mycobacterium
PTGREWIDRYLAPLSAA

SEQ ID NO: 1353259 - protein, 18 aa, Mycobacterium
PTGSRWELDPTLLESAEV

SEQ ID NO: 1353260 - protein, 17 aa, Mycobacterium
PTHGARLALAGAAVGLG

SEQ ID NO: 1353261 - protein, 26 aa, Mycobacterium
PTITARLNFQLAFGARVGVRLTEARE

SEQ ID NO: 1353262 - protein, 25 aa, Mycobacterium
PTLPEEVRQRFDLVGFDPRGVAEST

SEQ ID NO: 1353263 - protein, 22 aa, Mycobacterium
PTLSESNSWIELLGGGRGATLA

SEQ ID NO: 1353264 - protein, 20 aa, Mycobacterium
PTLYGRQATEYVIKRGMSQM

SEQ ID NO: 1353265 - protein, 18 aa, Mycobacterium
PTMHELFSVGWGTPDLRE

SEQ ID NO: 1353266 - protein, 24 aa, Mycobacterium
PTNEAFAALPPEQLEVLRTDPAAL

SEQ ID NO: 1353267 - protein, 25 aa, Mycobacterium
PTNSRLGYRETISYATPHQHRRHLP

SEQ ID NO: 1353268 - protein, 20 aa, Mycobacterium
PTPAAPMGGSAMLASLAAVR

SEQ ID NO: 1353269 - protein, 25 aa, Mycobacterium
PTPPLPRLASESAPAVTVAASSEFD

SEQ ID NO: 1353270 - protein, 24 aa, Mycobacterium
PTPYAMAITFSFRGVTPTGDAYES

SEQ ID NO: 1353271 - protein, 29 aa, Mycobacterium
PTQQSRLGYLRDLWHAMQTQEVSGSNALL

SEQ ID NO: 1353272 - protein, 17 aa, Mycobacterium
PTRLIYLQHGFLASGAF

SEQ ID NO: 1353273 - protein, 26 aa, Mycobacterium
PTSFSRLLARFVPFVRSDRFAVTVSD

SEQ ID NO: 1353274 - protein, 18 aa, Mycobacterium
PTSVSLDIYVHGSSDGVS

SEQ ID NO: 1353275 - protein, 24 aa, Mycobacterium
PTVAAAAVPLAWSAAAEDPALVEF

SEQ ID NO: 1353276 - protein, 18 aa, Mycobacterium
PTVGRTIAYAWLPAGADT

SEQ ID NO: 1353277 - protein, 19 aa, Mycobacterium
PTVLQDGWGVRAPTRAAME

SEQ ID NO: 1353278 - protein, 24 aa, Mycobacterium
PTVRPRGVLQVAVVEATNIVAAVV

SEQ ID NO: 1353279 - protein, 19 aa, Mycobacterium
PTYFGAAWVALGRIMLDTS

SEQ ID NO: 1353280 - protein, 24 aa, Mycobacterium
PVADPALVPLYFIAREARKHVKVV

SEQ ID NO: 1353281 - protein, 17 aa, Mycobacterium
PVDASAVVTRFPGAIAE

SEQ ID NO: 1353282 - protein, 22 aa, Mycobacterium
PVEHLEDYFSLRVARPDDATVV

SEQ ID NO: 1353283 - protein, 19 aa, Mycobacterium
PVGAMPRAVAQPAPEPGSP

SEQ ID NO: 1353284 - protein, 34 aa, Mycobacterium
PVGSQARWLPDMVSIVSLFFIPSVSGATFTDKLN

SEQ ID NO: 1353285 - protein, 20 aa, Mycobacterium
PVHFVCGLIGGVANTTAPET

SEQ ID NO: 1353286 - protein, 18 aa, Mycobacterium
PVLDHALQTIPDALAVLD

SEQ ID NO: 1353287 - protein, 26 aa, Mycobacterium
PVLMPLDHVVAWAEAPGTLVDHRPET

SEQ ID NO: 1353288 - protein, 18 aa, Mycobacterium
PVPCEMVSNGTPTPKTPA

SEQ ID NO: 1353289 - protein, 23 aa, Mycobacterium
PVPDPRYPFLGVHLTKHVDGRVS

SEQ ID NO: 1353290 - protein, 27 aa, Mycobacterium
PVPDRDLKVDIARGYLDRGVDVLFGGG

SEQ ID NO: 1353291 - protein, 26 aa, Mycobacterium
PVPLLRRFGLDAGERIAKLLSDSGVR

SEQ ID NO: 1353292 - protein, 22 aa, Mycobacterium
PVRRAMADRLTFVLTGNPLRSD

SEQ ID NO: 1353293 - protein, 17 aa, Mycobacterium
PVSRKAPNMTVLVGGPS

SEQ ID NO: 1353294 - protein, 19 aa, Mycobacterium
PVTAAGPLAERFTGVHPNT

SEQ ID NO: 1353295 - protein, 19 aa, Mycobacterium
PVTEPRVGTSMSLAELCQA

SEQ ID NO: 1353296 - protein, 17 aa, Mycobacterium
PVVGAPVAGTLYADDAF

SEQ ID NO: 1353297 - protein, 19 aa, Mycobacterium
PVVLNLWAYWCGPCADELP

SEQ ID NO: 1353298 - protein, 24 aa, Mycobacterium
PVWGDVELAWHLDRSGRFGPPRQW

SEQ ID NO: 1353299 - protein, 26 aa, Mycobacterium
PVYDPALARPGIHFDPEPIEDSPDGS

SEQ ID NO: 1353300 - protein, 18 aa, Mycobacterium
PWAPFTIDFNLANIGGPS

SEQ ID NO: 1353301 - protein, 17 aa, Mycobacterium
PYDEVIAAIKAGATGRT

SEQ ID NO: 1353302 - protein, 23 aa, Mycobacterium
PYGTGCGAVPPPPPPAPGVYVPP

SEQ ID NO: 1353303 - protein, 18 aa, Mycobacterium
PYLTSGLLGLQRGTDPGD

SEQ ID NO: 1353304 - protein, 18 aa, Mycobacterium
PYPIALRTAAVLDGFPAK

SEQ ID NO: 1353305 - protein, 18 aa, Mycobacterium
PYSPLGHSITVEVTVDYT

SEQ ID NO: 1353306 - protein, 23 aa, Mycobacterium
QAAEDRIHWFYSLDAVGRRQYSE

SEQ ID NO: 1353307 - protein, 31 aa, Mycobacterium
QAAGGEHLVSWVKAVVYGAAQRWTDVIEEVR

SEQ ID NO: 1353308 - protein, 19 aa, Mycobacterium
QAALRWVRDNIAAFGGDPG

SEQ ID NO: 1353309 - protein, 19 aa, Mycobacterium
QAATSISIAKDWLGESRVM

SEQ ID NO: 1353310 - protein, 25 aa, Mycobacterium
QADCFGGAYMRWVAEDSSARFTLST

SEQ ID NO: 1353311 - protein, 18 aa, Mycobacterium
QAERWGGEADRPFDPNYH

SEQ ID NO: 1353312 - protein, 33 aa, Mycobacterium
QALGRQGMYGDFFSFYLCEIVLKLNGKGGQPVY

SEQ ID NO: 1353313 - protein, 27 aa, Mycobacterium
QAPDVALPPTWRLLTSRGPYELPGELH

SEQ ID NO: 1353314 - protein, 20 aa, Mycobacterium
QAPIGPRVRILSPMEIGILR

SEQ ID NO: 1353315 - protein, 24 aa, Mycobacterium
QAQGDCLKKLIPIMQQAQVDYIND

SEQ ID NO: 1353316 - protein, 22 aa, Mycobacterium
QASEIYSPIEAWMALGQPTIAI

SEQ ID NO: 1353317 - protein, 18 aa, Mycobacterium
QASSWGVFYNTDLVDPAF

SEQ ID NO: 1353318 - protein, 19 aa, Mycobacterium
QATEFSVVRINDFGVARGI

SEQ ID NO: 1353319 - protein, 24 aa, Mycobacterium
QAVASGLYPSAPVLSPDGTRLYGP

SEQ ID NO: 1353320 - protein, 19 aa, Mycobacterium
QAWARAAVELAQRAADGLA

SEQ ID NO: 1353321 - protein, 22 aa, Mycobacterium
QDAFNAIRCVDAVYPTDSAPWV

SEQ ID NO: 1353322 - protein, 24 aa, Mycobacterium
QDLQMRPGSSSGWHTHPGPEHSVI

SEQ ID NO: 1353323 - protein, 19 aa, Mycobacterium
QDNPQQWARSYSEAVGLDL

SEQ ID NO: 1353324 - protein, 21 aa, Mycobacterium
QDPDMRTAVVSIDPKNGGVKA

SEQ ID NO: 1353325 - protein, 17 aa, Mycobacterium
QDYWPAHLAPAYIGAGM

SEQ ID NO: 1353326 - protein, 20 aa, Mycobacterium
QEALKAITFSATQLGLPRTI

SEQ ID NO: 1353327 - protein, 18 aa, Mycobacterium
QEDFSGWDINTAAFEWYL

SEQ ID NO: 1353328 - protein, 19 aa, Mycobacterium
QEKVEGFAVAGNGKLYVVT

SEQ ID NO: 1353329 - protein, 26 aa, Mycobacterium
QELERLWSRTALLGMNPAVPRVLVSI

SEQ ID NO: 1353330 - protein, 17 aa, Mycobacterium
QELPAYLAANKGVDPNR

SEQ ID NO: 1353331 - protein, 24 aa, Mycobacterium
QEVKSRYSDRFRMEDSINTYYMFM

SEQ ID NO: 1353332 - protein, 19 aa, Mycobacterium
QFAAQRPVLDHALQTIPDA

SEQ ID NO: 1353333 - protein, 22 aa, Mycobacterium
QFAEFLSGVKLNAPRIPLLSNV

SEQ ID NO: 1353334 - protein, 17 aa, Mycobacterium
QFNFPPIGANPFVGQSA

SEQ ID NO: 1353335 - protein, 21 aa, Mycobacterium
QFRTAGMPDDWINFGEFYQSV

SEQ ID NO: 1353336 - protein, 17 aa, Mycobacterium
QFVPCCVEVVAAPASGP

SEQ ID NO: 1353337 - protein, 25 aa, Mycobacterium
QGAPTVLVTAEWRYIDGRWKLANKS

SEQ ID NO: 1353338 - protein, 17 aa, Mycobacterium
QGASIDDVISWIGAGTP

SEQ ID NO: 1353339 - protein, 22 aa, Mycobacterium
QGGEPRMTIPDAITGKPGDPRY

SEQ ID NO: 1353340 - protein, 21 aa, Mycobacterium
QGHTLERLFPGIGRLDDSFPG

SEQ ID NO: 1353341 - protein, 25 aa, Mycobacterium
QGITFSTDGSRVFVADLAGSVKVID

SEQ ID NO: 1353342 - protein, 27 aa, Mycobacterium
QGLGAWPVCGRKGVEHVGWYVPARPTG

SEQ ID NO: 1353343 - protein, 17 aa, Mycobacterium
QGNNYWWGGNLMGVKDR

SEQ ID NO: 1353344 - protein, 29 aa, Mycobacterium
QGTGGGVSALFDMPAWQRTAAGAVPPERN

SEQ ID NO: 1353345 - protein, 24 aa, Mycobacterium
QHLCGTARMGAVVDARCRVYGVSN

SEQ ID NO: 1353346 - protein, 17 aa, Mycobacterium
QHVLPEEVNGYFAEMGR

SEQ ID NO: 1353347 - protein, 18 aa, Mycobacterium
QIALEIMEPAGWTAEQSG

SEQ ID NO: 1353348 - protein, 17 aa, Mycobacterium
QIDRVAFDAATDVVDFR

SEQ ID NO: 1353349 - protein, 19 aa, Mycobacterium
QIEHIVPLAYAWDQGARAW

SEQ ID NO: 1353350 - protein, 19 aa, Mycobacterium
QIIDWEVIHLAPHVAVNNV

SEQ ID NO: 1353351 - protein, 18 aa, Mycobacterium
QIPLGLVNHYYLYELINS

SEQ ID NO: 1353352 - protein, 18 aa, Mycobacterium
QIRQLWGMTETSPVATIA

SEQ ID NO: 1353353 - protein, 17 aa, Mycobacterium
QIVDAFTALRSFATVAS

SEQ ID NO: 1353354 - protein, 22 aa, Mycobacterium
QKDIRYSECGKIVVAHTAGDAA

SEQ ID NO: 1353355 - protein, 18 aa, Mycobacterium
QKKAAVIAFADANPQVAA

SEQ ID NO: 1353356 - protein, 26 aa, Mycobacterium
QKTPEITAEWVASRAVALVATVAETR

SEQ ID NO: 1353357 - protein, 18 aa, Mycobacterium
QKVIDFDLPAGVVAGSAD

SEQ ID NO: 1353358 - protein, 17 aa, Mycobacterium
QLAAGDMIFGFSHGAVV

SEQ ID NO: 1353359 - protein, 19 aa, Mycobacterium
QLALLAQLIGIDFRRQRVE

SEQ ID NO: 1353360 - protein, 26 aa, Mycobacterium
QLARPDRFTGVGLKGGLHIDYMEGGN

SEQ ID NO: 1353361 - protein, 18 aa, Mycobacterium
QLGLPRTITVNVTEVDGD

SEQ ID NO: 1353362 - protein, 18 aa, Mycobacterium
QLGRWKWHDPDVHAQLLV

SEQ ID NO: 1353363 - protein, 22 aa, Mycobacterium
QLLCVQRLHGGLTIGDTHEYTE

SEQ ID NO: 1353364 - protein, 19 aa, Mycobacterium
QLMAGWINDMFADRIDADT

SEQ ID NO: 1353365 - protein, 21 aa, Mycobacterium
QLMAGWINDMFADRIDADTGA

SEQ ID NO: 1353366 - protein, 18 aa, Mycobacterium
QLPGAVEYSVRFAKPVVL

SEQ ID NO: 1353367 - protein, 23 aa, Mycobacterium
QLPSPRPDALVYRQTMRLRGEEN

SEQ ID NO: 1353368 - protein, 23 aa, Mycobacterium
QLRAVLPRFRPEWVHTDVTAPVY

SEQ ID NO: 1353369 - protein, 19 aa, Mycobacterium
QLRPELDGAPAAYASAFDR

SEQ ID NO: 1353370 - protein, 21 aa, Mycobacterium
QLVLRHVVTGLDLDPSGTSAV

SEQ ID NO: 1353371 - protein, 17 aa, Mycobacterium
QMAQRIGAQITDVEGSH

SEQ ID NO: 1353372 - protein, 17 aa, Mycobacterium
QMRKAVIELSQAMSAFG

SEQ ID NO: 1353373 - protein, 28 aa, Mycobacterium
QNFPDPELADWPRAYYGANLDRLTRVKA

SEQ ID NO: 1353374 - protein, 24 aa, Mycobacterium
QNQKAAEAWINYVYDRANYAKLVS

SEQ ID NO: 1353375 - protein, 19 aa, Mycobacterium
QNVRLPWVVNGEEFVLHLI

SEQ ID NO: 1353376 - protein, 20 aa, Mycobacterium
QPAALQLRLLQTVVEVAAEK

SEQ ID NO: 1353377 - protein, 25 aa, Mycobacterium
QPADALSAFTQREADAWAIWDPYTA

SEQ ID NO: 1353378 - protein, 18 aa, Mycobacterium
QPDSAPPPTQWDSATPPS

SEQ ID NO: 1353379 - protein, 25 aa, Mycobacterium
QPEQVKITFWVDDRYKIPADAQAVI

SEQ ID NO: 1353380 - protein, 25 aa, Mycobacterium
QPGCGLSWNLLAGIGRIESMHAYGG

SEQ ID NO: 1353381 - protein, 20 aa, Mycobacterium
QPGGECPTEPVSVVVSVDQW

SEQ ID NO: 1353382 - protein, 18 aa, Mycobacterium
QPHHGVAVILSDGTLVHS

SEQ ID NO: 1353383 - protein, 19 aa, Mycobacterium
QPLRTVARAKGLRLARAQA

SEQ ID NO: 1353384 - protein, 29 aa, Mycobacterium
QPLVIDPAWTLRGWSWFPDSTRAVVNEQQ

SEQ ID NO: 1353385 - protein, 18 aa, Mycobacterium
QPPECAKFAEGRLPEADL

SEQ ID NO: 1353386 - protein, 20 aa, Mycobacterium
QPQIPWPVFTFAPPTPEPSQ

SEQ ID NO: 1353387 - protein, 29 aa, Mycobacterium
QPQRGYKIFEEWGNWLFAAGGSIYDADGK

SEQ ID NO: 1353388 - protein, 28 aa, Mycobacterium
QPSPGVPCLEMVQQFAASPPDFEESFAT

SEQ ID NO: 1353389 - protein, 18 aa, Mycobacterium
QPSVWMPPNDAFHCQYAM

SEQ ID NO: 1353390 - protein, 23 aa, Mycobacterium
QQAAFDRIHWFFSLDPVGRRQYS

SEQ ID NO: 1353391 - protein, 23 aa, Mycobacterium
QQLIDRLSLQRVVAATTADQMKE

SEQ ID NO: 1353392 - protein, 22 aa, Mycobacterium
QQLMAGWINDMFADRIDADTGA

SEQ ID NO: 1353393 - protein, 17 aa, Mycobacterium
QQQNPWVVIEQWESAGY

SEQ ID NO: 1353394 - protein, 30 aa, Mycobacterium
QQSSANPALRPMIGDGGWLIGNGLDAADDC

SEQ ID NO: 1353395 - protein, 20 aa, Mycobacterium
QQVELDRLTAERARAQAKLQ

SEQ ID NO: 1353396 - protein, 18 aa, Mycobacterium
QRAGRTLTELTLDGNKGF

SEQ ID NO: 1353397 - protein, 19 aa, Mycobacterium
QRAGVTIIDPASTWIDVDV

SEQ ID NO: 1353398 - protein, 17 aa, Mycobacterium
QRAPRVSGQFGQMPGQT

SEQ ID NO: 1353399 - protein, 26 aa, Mycobacterium
QRDGLTLGQALVFWASGRDQLVPREL

SEQ ID NO: 1353400 - protein, 19 aa, Mycobacterium
QREADAWAIWDPYTAQTAS

SEQ ID NO: 1353401 - protein, 25 aa, Mycobacterium
QRELSTIPVQWFEAVDVVGLAADPA

SEQ ID NO: 1353402 - protein, 19 aa, Mycobacterium
QRGTLPIFMPLVDIGNATG

SEQ ID NO: 1353403 - protein, 17 aa, Mycobacterium
QRGVDFIAIDGGEGGTG

SEQ ID NO: 1353404 - protein, 28 aa, Mycobacterium
QRITLERNPKWWGTPPVLDRITYTVLDD

SEQ ID NO: 1353405 - protein, 43 aa, Mycobacterium; identical to SEQ ID NO: 324796

SEQ ID NO: 1353406 - protein, 21 aa, Mycobacterium
QRLQQIWCECLGVASIDPAEN

SEQ ID NO: 1353407 - protein, 17 aa, Mycobacterium
QRSFMYRDMATVGVDVV

SEQ ID NO: 1353408 - protein, 27 aa, Mycobacterium
QRTGIYAGIRPCQWATADGVIGRSRTP

SEQ ID NO: 1353409 - protein, 18 aa, Mycobacterium
QRYPTYFGAAWVALGRIM

SEQ ID NO: 1353410 - protein, 25 aa, Mycobacterium
QSAKLCAQYLAPIIKNRQYNFPPLG

SEQ ID NO: 1353411 - protein, 25 aa, Mycobacterium
QSAKLCAQYLAPIVKNRQYNFPPIG

SEQ ID NO: 1353412 - protein, 24 aa, Mycobacterium
QSAPDCVPVAYPAGQSVFIPAGVP

SEQ ID NO: 1353413 - protein, 25 aa, Mycobacterium
QSASRLGKAVARLRASGAVVVVGTC

SEQ ID NO: 1353414 - protein, 21 aa, Mycobacterium
QSEIASRWSVCCPSCGSGDVV

SEQ ID NO: 1353415 - protein, 26 aa, Mycobacterium
QSILHSIARLFGLAKVDNYTQTVEFD

SEQ ID NO: 1353416 - protein, 19 aa, Mycobacterium
QSLHAYFIKGGRVGVDVEY

SEQ ID NO: 1353417 - protein, 17 aa, Mycobacterium
QSLVDAIDFARVPAIFV

SEQ ID NO: 1353418 - protein, 18 aa, Mycobacterium
QSPAGCSLMVWEADNDAR

SEQ ID NO: 1353419 - protein, 19 aa, Mycobacterium
QSPAGCSLMVWEAENDARQ

SEQ ID NO: 1353420 - protein, 30 aa, Mycobacterium
QSPPGRWFRCSDFPCAPTSPGNILGTGAAL

SEQ ID NO: 1353421 - protein, 17 aa, Mycobacterium
QTAFQGSFCERNTCRSI

SEQ ID NO: 1353422 - protein, 21 aa, Mycobacterium
QTGLHRLRMMVPNSPGGGYDL

SEQ ID NO: 1353423 - protein, 24 aa, Mycobacterium
QTIACPECGPTLSWHGPGPHGGAV

SEQ ID NO: 1353424 - protein, 17 aa, Mycobacterium
QVAPRILRDALADKSVV

SEQ ID NO: 1353425 - protein, 24 aa, Mycobacterium
QVATRWGNWAKVFFNNKGVVAKAT

SEQ ID NO: 1353426 - protein, 24 aa, Mycobacterium
QVEGGIIYHYYWFRDQSQTKEISG

SEQ ID NO: 1353427 - protein, 22 aa, Mycobacterium
QVKATDPDGGWLTYSGSTSTEK

SEQ ID NO: 1353428 - protein, 17 aa, Mycobacterium
QVLKWKYQFLEAGAERM

SEQ ID NO: 1353429 - protein, 20 aa, Mycobacterium
QVREDRLNQQLGIGAVSDSQ

SEQ ID NO: 1353430 - protein, 25 aa, Mycobacterium
QVSAFLSGPAFREAFGAPDDEDSAD

SEQ ID NO: 1353431 - protein, 18 aa, Mycobacterium
QVTPGQWSWVDRDGVAHH

SEQ ID NO: 1353432 - protein, 17 aa, Mycobacterium
QVVFTGTTPLAFHDALD

SEQ ID NO: 1353433 - protein, 17 aa, Mycobacterium
QVYQIALERGRKMRGLG

SEQ ID NO: 1353434 - protein, 20 aa, Mycobacterium
QWCTPIPSVDIFTVDEERSI

SEQ ID NO: 1353435 - protein, 35 aa, Mycobacterium
QWIPDAMALINLFFKSALPGYSFSDGLNTFGDLLN

SEQ ID NO: 1353436 - protein, 22 aa, Mycobacterium
QWQVPKFYWTVMSKSGMGDAFA

SEQ ID NO: 1353437 - protein, 22 aa, Mycobacterium
QWQVPKFYWTVMSRSGMGDAFA

SEQ ID NO: 1353438 - protein, 23 aa, Mycobacterium
QYADYPTPPSFVIETGPDGFGFI

SEQ ID NO: 1353439 - protein, 39 aa, Mycobacterium
QYDMAADMPDRFNLLALANVLAGFMFIHADYEEVDLYDP

SEQ ID NO: 1353440 - protein, 21 aa, Mycobacterium
QYNFPPLGFNFFVGAQARPNE

SEQ ID NO: 1353441 - protein, 18 aa, Mycobacterium
QYRHAVVMGVNKARVPGN

SEQ ID NO: 1353442 - protein, 17 aa, Mycobacterium
RAAALGVVRFVASTDRH

SEQ ID NO: 1353443 - protein, 20 aa, Mycobacterium
RAADLVLRARKRCDVTHAKD

SEQ ID NO: 1353444 - protein, 18 aa, Mycobacterium
RAAETFSSSMLRGQPLAA

SEQ ID NO: 1353445 - protein, 27 aa, Mycobacterium
RAAPVGKAAKARRAAAVAEATAPAPDG

SEQ ID NO: 1353446 - protein, 20 aa, Mycobacterium
RAAVAVAIALLAAVLSACGS

SEQ ID NO: 1353447 - protein, 21 aa, Mycobacterium
RADAYWPTLAAHLTNAARGND

SEQ ID NO: 1353448 - protein, 21 aa, Mycobacterium
RADHLRLALDAAVRAGDDTDT

SEQ ID NO: 1353449 - protein, 20 aa, Mycobacterium
RADLDAGVFEHRCPVGGEEL

SEQ ID NO: 1353450 - protein, 21 aa, Mycobacterium
RADVFAGIAAGQVWVLDSRQQ

SEQ ID NO: 1353451 - protein, 19 aa, Mycobacterium
RAEAVARLRKWARTSTGRG

SEQ ID NO: 1353452 - protein, 26 aa, Mycobacterium
RAEVSEMGRILSFIPHRMSRPDHIPL

SEQ ID NO: 1353453 - protein, 26 aa, Mycobacterium
RAFAPTEMLEFAFSQPPMFAPGDGYH

SEQ ID NO: 1353454 - protein, 21 aa, Mycobacterium
RAFDGDFNTAWICTRAQNQDG

SEQ ID NO: 1353455 - protein, 18 aa, Mycobacterium
RAGLIVYNGLGLEETVIR

SEQ ID NO: 1353456 - protein, 19 aa, Mycobacterium
RAGLVVDPGAKVTFNGVEI

SEQ ID NO: 1353457 - protein, 23 aa, Mycobacterium
RAGSQIGVPYSWGGGSLTGPSRG

SEQ ID NO: 1353458 - protein, 18 aa, Mycobacterium
RAGSVLMPVVTVEDLDSR

SEQ ID NO: 1353459 - protein, 23 aa, Mycobacterium
RAGTQIGVPYSWGGGSLTGPSRG

SEQ ID NO: 1353460 - protein, 18 aa, Mycobacterium
RALAGRLVAAGTVIAESV

SEQ ID NO: 1353461 - protein, 26 aa, Mycobacterium
RALFDRLQPTLPIVLANLVSIGEVAV

SEQ ID NO: 1353462 - protein, 17 aa, Mycobacterium
RALRELFDGVVNASAVV

SEQ ID NO: 1353463 - protein, 24 aa, Mycobacterium
RALSFLPTFPFPKETLTNWMRGDY

SEQ ID NO: 1353464 - protein, 19 aa, Mycobacterium
RAMAIRAGRAVTVSASGRP

SEQ ID NO: 1353465 - protein, 20 aa, Mycobacterium
RAMSQLGVPYSWGGGNANGP

SEQ ID NO: 1353466 - protein, 31 aa, Mycobacterium
RAPADFAENWILQHIRIRPGLNGPSDDGLRI

SEQ ID NO: 1353467 - protein, 17 aa, Mycobacterium
RAPALGIPVTALEAYAY

SEQ ID NO: 1353468 - protein, 18 aa, Mycobacterium
RAPAPNWYHLTLNGAEGA

SEQ ID NO: 1353469 - protein, 30 aa, Mycobacterium
RAPKVLDSDAWRRLSANRDGRVFAVNNEVW

SEQ ID NO: 1353470 - protein, 26 aa, Mycobacterium
RAPMKTDFYSRIGSLTKTFTVTAVLL

SEQ ID NO: 1353471 - protein, 19 aa, Mycobacterium
RAPSTDWLNRMWRSSSSLL

SEQ ID NO: 1353472 - protein, 26 aa, Mycobacterium
RAPTRAAMEAMWEWVTASSDTLETVT

SEQ ID NO: 1353473 - protein, 18 aa, Mycobacterium
RAPVAGTLDAPRQYPPLS

SEQ ID NO: 1353474 - protein, 26 aa, Mycobacterium
RAQESFAMCSTFKAYLAAHVLQLVGR

SEQ ID NO: 1353475 - protein, 24 aa, Mycobacterium
RAQGFAVRRWLQVGAASAGVGAGL

SEQ ID NO: 1353476 - protein, 25 aa, Mycobacterium
RAQKLSARHPFPAITYTPTEMLRAV

SEQ ID NO: 1353477 - protein, 18 aa, Mycobacterium
RAQMSTLVPMGRLGRPEE

SEQ ID NO: 1353478 - protein, 20 aa, Mycobacterium
RARQRWCTRLVQGGGLSSPL

SEQ ID NO: 1353479 - protein, 19 aa, Mycobacterium
RARWDLLGQQVFFSQLDLT

SEQ ID NO: 1353480 - protein, 19 aa, Mycobacterium
RATALLFAQRGYRVGGYDI

SEQ ID NO: 1353481 - protein, 31 aa, Mycobacterium
RAVLRDRAGAWPRDPMDIRLLESVAGDTISP

SEQ ID NO: 1353482 - protein, 25 aa, Mycobacterium
RCAGVKETFPATEILNVNGKDMPSV

SEQ ID NO: 1353483 - protein, 17 aa, Mycobacterium
RCALGDRTVSVAWTAWR

SEQ ID NO: 1353484 - protein, 22 aa, Mycobacterium
RCALYRNCFPSMDVAYPALVVR

SEQ ID NO: 1353485 - protein, 29 aa, Mycobacterium
RCGGSEAWNLPAVFGPIAITYNLEGVDGL

SEQ ID NO: 1353486 - protein, 26 aa, Mycobacterium
RCNERIKFSALSARALALGFDALATG

SEQ ID NO: 1353487 - protein, 25 aa, Mycobacterium
RCPTGVATQNAWLARGLDPEQKSHR

SEQ ID NO: 1353488 - protein, 24 aa, Mycobacterium
RDAIIKFSRAISALSDHSTDIFGT

SEQ ID NO: 1353489 - protein, 19 aa, Mycobacterium
RDEILLARNDRYWSAPAKP

SEQ ID NO: 1353490 - protein, 30 aa, Mycobacterium
RDFRALNIVLPKPRGWEHIPDPNVPDAFAV

SEQ ID NO: 1353491 - protein, 34 aa, Mycobacterium
RDGHLELALGPRGVFKLQPWDGNVFTFPVSSENA

SEQ ID NO: 1353492 - protein, 19 aa, Mycobacterium
RDGLLRAFLNVCRHRGAQL

SEQ ID NO: 1353493 - protein, 24 aa, Mycobacterium
RDGLRHEHKLRRFGRPEEVAAVAA

SEQ ID NO: 1353494 - protein, 17 aa, Mycobacterium
RDKVRRLLEDALLTDAE

SEQ ID NO: 1353495 - protein, 17 aa, Mycobacterium
RDLCAMWPVPPTPVVGV

SEQ ID NO: 1353496 - protein, 19 aa, Mycobacterium
RDLLHAYLRAERDGFEGTD

SEQ ID NO: 1353497 - protein, 18 aa, Mycobacterium
RDPRGGTVATTINPQVQR

SEQ ID NO: 1353498 - protein, 26 aa, Mycobacterium
RDRGCTHPGCTVPFYWTEAHHAHDYS

SEQ ID NO: 1353499 - protein, 19 aa, Mycobacterium
RDTPPVLPPFHKVTASKGA

SEQ ID NO: 1353500 - protein, 29 aa, Mycobacterium
RDVAAAVGFPGFWRFAVRNTAAAVREART

SEQ ID NO: 1353501 - protein, 19 aa, Mycobacterium
RDVAVLQLIGANGLAAAPI

SEQ ID NO: 1353502 - protein, 26 aa, Mycobacterium
RDVGPGVATRASWRPIKDIVGLAARL

SEQ ID NO: 1353503 - protein, 23 aa, Mycobacterium
RDYRGRMGQLFYASPHQPAVPEH

SEQ ID NO: 1353504 - protein, 20 aa, Mycobacterium
REHLGIPIVHAYGMTEAAMV

SEQ ID NO: 1353505 - protein, 17 aa, Mycobacterium
RELAATGDPARAVGAAA

SEQ ID NO: 1353506 - protein, 20 aa, Mycobacterium
RELTVPGALVLVHTPQGRFT

SEQ ID NO: 1353507 - protein, 26 aa, Mycobacterium
REMTATDWNLSWSWAAGNMVSTLHDL

SEQ ID NO: 1353508 - protein, 19 aa, Mycobacterium
REPLYLPVGCRLHVNPSRG

SEQ ID NO: 1353509 - protein, 17 aa, Mycobacterium
RERPVELDAVWRGDSTN

SEQ ID NO: 1353510 - protein, 23 aa, Mycobacterium
RERQVVLRLLGPRRRGRGPQHRR

SEQ ID NO: 1353511 - protein, 17 aa, Mycobacterium
RESCQWINAQYGELMGQ

SEQ ID NO: 1353512 - protein, 19 aa, Mycobacterium
RETTRWGTFLDDLAGFDAE

SEQ ID NO: 1353513 - protein, 17 aa, Mycobacterium
RETYSWDANTLFGTIDS

SEQ ID NO: 1353514 - protein, 17 aa, Mycobacterium
REVDPLGDRSCKLQMLT

SEQ ID NO: 1353515 - protein, 19 aa, Mycobacterium
REVNAAAAAKGFAQLDAPV

SEQ ID NO: 1353516 - protein, 19 aa, Mycobacterium
REYRLRTGAAAGPVNSPIG

SEQ ID NO: 1353517 - protein, 23 aa, Mycobacterium
RFDRAQMAVAIKGFITEYNDLVS

SEQ ID NO: 1353518 - protein, 22 aa, Mycobacterium
RFGGALPTLPIRDLARQGAKGL

SEQ ID NO: 1353519 - protein, 21 aa, Mycobacterium
RFTPLTIRLMHIMSPMDHSKA

SEQ ID NO: 1353520 - protein, 17 aa, Mycobacterium
RFVLPGPVLSPGEEARC

SEQ ID NO: 1353521 - protein, 19 aa, Mycobacterium
RFVPTRLSAVGALLAGALR

SEQ ID NO: 1353522 - protein, 19 aa, Mycobacterium
RGAAFLPHTEVRGVVEKAG

SEQ ID NO: 1353523 - protein, 18 aa, Mycobacterium
RGAHNIPCATRPGKRAPT

SEQ ID NO: 1353524 - protein, 17 aa, Mycobacterium
RGARVLVLDRGYGGGAT

SEQ ID NO: 1353525 - protein, 24 aa, Mycobacterium
RGETPIRVAYDFVNIQAGQLVGEK

SEQ ID NO: 1353526 - protein, 22 aa, Mycobacterium
RGFEMSIRFRIIAAVIGAAALV

SEQ ID NO: 1353527 - protein, 19 aa, Mycobacterium
RGGELLVYGVNPLILRQRY

SEQ ID NO: 1353528 - protein, 23 aa, Mycobacterium
RGGTQIGTPYSWGGGKPNGPSRG

SEQ ID NO: 1353529 - protein, 17 aa, Mycobacterium
RGGYYRLDIATADVTKV

SEQ ID NO: 1353530 - protein, 24 aa, Mycobacterium
RGIALSRREVFSAFEDTVPEAYQA

SEQ ID NO: 1353531 - protein, 19 aa, Mycobacterium
RGLGEGFGITPDAAVDEDS

SEQ ID NO: 1353532 - protein, 18 aa, Mycobacterium
RGLPTLSESNSWIELLGG

SEQ ID NO: 1353533 - protein, 20 aa, Mycobacterium
RGLRVVPWTINDPGAMRAQI

SEQ ID NO: 1353534 - protein, 19 aa, Mycobacterium
RGLTGIEVHPDFWHEDEFG

SEQ ID NO: 1353535 - protein, 25 aa, Mycobacterium
RGNVVVKADGSFVYTPTAAARDAAS

SEQ ID NO: 1353536 - protein, 17 aa, Mycobacterium
RGPAAIEYAIRRGGTQI

SEQ ID NO: 1353537 - protein, 22 aa, Mycobacterium
RGPGGEALQCRWIPNQWPPIYT

SEQ ID NO: 1353538 - protein, 20 aa, Mycobacterium
RGRDILYRNTLHQFHPPGHE

SEQ ID NO: 1353539 - protein, 19 aa, Mycobacterium
RGSDGVVIPGSYRNRHDAV

SEQ ID NO: 1353540 - protein, 25 aa, Mycobacterium
RGSEPAMRSGFYGYGFNVGTTSAAR

SEQ ID NO: 1353541 - protein, 30 aa, Mycobacterium; identical to SEQ ID NO: 143350

SEQ ID NO: 1353542 - protein, 17 aa, Mycobacterium
RGVRSVRVATHCTEADI

SEQ ID NO: 1353543 - protein, 25 aa, Mycobacterium
RGVVYRFGKVQSRVREPGLTLLVPI

SEQ ID NO: 1353544 - protein, 21 aa, Mycobacterium
RGYRIARGRSGAMRRAVSLLE

SEQ ID NO: 1353545 - protein, 35 aa, Mycobacterium
RGYVDHMLGMTIAKDLGAGYVWPARAGDGSGADGV

SEQ ID NO: 1353546 - protein, 20 aa, Mycobacterium
RHDLPRGDLDRVARQQAVMA

SEQ ID NO: 1353547 - protein, 20 aa, Mycobacterium
RHYTGDVLDLTWVDSTGVTR

SEQ ID NO: 1353548 - protein, 18 aa, Mycobacterium
RIAGQMIVAVAALTAAVL

SEQ ID NO: 1353549 - protein, 20 aa, Mycobacterium
RIALPAGVGLHAAFWLLGSD

SEQ ID NO: 1353550 - protein, 17 aa, Mycobacterium
RIARSCGVPVIMTPLTG

SEQ ID NO: 1353551 - protein, 27 aa, Mycobacterium
RIDCGDGYEVPADWYVPEGATPTRLIY

SEQ ID NO: 1353552 - protein, 17 aa, Mycobacterium
RIDEAVTRVIAMKGPSP

SEQ ID NO: 1353553 - protein, 19 aa, Mycobacterium
RIEVVGFDASGLMVYAYAG

SEQ ID NO: 1353554 - protein, 26 aa, Mycobacterium
RIGALAFALGVGVGLGATPAVAFADE

SEQ ID NO: 1353555 - protein, 23 aa, Mycobacterium
RIHLQGLNIRWADGARRSLGDGI

SEQ ID NO: 1353556 - protein, 17 aa, Mycobacterium
RIHLRGLNIRWADGARR

SEQ ID NO: 1353557 - protein, 21 aa, Mycobacterium
RIIGSFFFAGAAATAIATAPL

SEQ ID NO: 1353558 - protein, 17 aa, Mycobacterium
RILAAVARRDGRMATAS

SEQ ID NO: 1353559 - protein, 19 aa, Mycobacterium
RILARRVRTSHAFHSRLMD

SEQ ID NO: 1353560 - protein, 19 aa, Mycobacterium
RIPGKGGAFFVHSTDGGAT

SEQ ID NO: 1353561 - protein, 17 aa, Mycobacterium
RIPLPEFTLPRPAPPSS

SEQ ID NO: 1353562 - protein, 17 aa, Mycobacterium
RIPPRVLKATIAPDGTR

SEQ ID NO: 1353563 - protein, 28 aa, Mycobacterium
RIPVDAGPVALKFPGPITELQLSRDGTR

SEQ ID NO: 1353564 - protein, 28 aa, Mycobacterium
RITKDSRVSTVWTWPDRPGVAGCAALDG

SEQ ID NO: 1353565 - protein, 26 aa, Mycobacterium
RITMNFPPLLAHPINSITAYKGQILY

SEQ ID NO: 1353566 - protein, 19 aa, Mycobacterium
RITPNRWWPTLAESVDDLV

SEQ ID NO: 1353567 - protein, 24 aa, Mycobacterium
RIVNLRPAFLSGVASRASALIPEW

SEQ ID NO: 1353568 - protein, 19 aa, Mycobacterium
RIVTGNLYLGHAAGDVEAA

SEQ ID NO: 1353569 - protein, 18 aa, Mycobacterium
RKLKEAGNFLPVDPTPAT

SEQ ID NO: 1353570 - protein, 20 aa, Mycobacterium
RKRGHPVVAIDVLDGSPLEG

SEQ ID NO: 1353571 - protein, 23 aa, Mycobacterium
RKRGVCTECDVLAELLVDEICAT

SEQ ID NO: 1353572 - protein, 24 aa, Mycobacterium
RLAADGVVAYGCLAEVTPPPESAA

SEQ ID NO: 1353573 - protein, 20 aa, Mycobacterium
RLALLLTFPRFLPAAGPLAM

SEQ ID NO: 1353574 - protein, 19 aa, Mycobacterium
RLARPHRRPDVAAVAAPAH

SEQ ID NO: 1353575 - protein, 22 aa, Mycobacterium
RLDADRSLPGYRWRKLKEEVIR

SEQ ID NO: 1353576 - protein, 20 aa, Mycobacterium
RLDGEGCSRFVVTDVTKDGT

SEQ ID NO: 1353577 - protein, 23 aa, Mycobacterium
RLEATFWAVRRTFFNQAPTVDPV

SEQ ID NO: 1353578 - protein, 20 aa, Mycobacterium
RLEFQGARRVVTFMAAHPDG

SEQ ID NO: 1353579 - protein, 30 aa, Mycobacterium
RLESLRGAEFDRLWLESMISHHQGAVEMAK

SEQ ID NO: 1353580 - protein, 30 aa, Mycobacterium
RLGAEQAAKLCVQYLAPILKNRQYNFPPIG

SEQ ID NO: 1353581 - protein, 29 aa, Mycobacterium
RLGAEQAAKLCVQYLAPIVKNRQYNFPPL

SEQ ID NO: 1353582 - protein, 19 aa, Mycobacterium
RLGRLALTADDPWDLVTGD

SEQ ID NO: 1353583 - protein, 18 aa, Mycobacterium
RLGYPIAKMRTVDAYPGA

SEQ ID NO: 1353584 - protein, 17 aa, Mycobacterium
RLIEAAGHFSLMVERIE

SEQ ID NO: 1353585 - protein, 22 aa, Mycobacterium
RLIYLQHGFLASGAFYSYTAAR

SEQ ID NO: 1353586 - protein, 25 aa, Mycobacterium
RLKEKAIAPIRAWLGGLTADAEQRA

SEQ ID NO: 1353587 - protein, 26 aa, Mycobacterium
RLLRARDGWCALTLSRPDDLAAVPAL

SEQ ID NO: 1353588 - protein, 23 aa, Mycobacterium
RLNARRTSRRRFIGGGAAAAAGL

SEQ ID NO: 1353589 - protein, 20 aa, Mycobacterium
RLRRRLLLASAPPALVTVVV

SEQ ID NO: 1353590 - protein, 20 aa, Mycobacterium
RLSVLSLPTTIIFDAHGRPR

SEQ ID NO: 1353591 - protein, 18 aa, Mycobacterium
RLTAERARAQAKLQEART

SEQ ID NO: 1353592 - protein, 22 aa, Mycobacterium
RLTGDFRDAFTALTDDVVIPGA

SEQ ID NO: 1353593 - protein, 20 aa, Mycobacterium
RLVKAEAGQGGWRTVPGSER

SEQ ID NO: 1353594 - protein, 18 aa, Mycobacterium
RLVKAEAGQGRWRTVPGS

SEQ ID NO: 1353595 - protein, 20 aa, Mycobacterium
RLVKAGKVDENWNAGPNKGI

SEQ ID NO: 1353596 - protein, 21 aa, Mycobacterium
RLVYFQHGFLASGPMYSYTAA

SEQ ID NO: 1353597 - protein, 24 aa, Mycobacterium
RLWRKNRRSAVAGSCLGVDINRNY

SEQ ID NO: 1353598 - protein, 17 aa, Mycobacterium
RLYESYRAGGLEGSLLG

SEQ ID NO: 1353599 - protein, 19 aa, Mycobacterium
RMAGCFAAGAVATGCEHVV

SEQ ID NO: 1353600 - protein, 19 aa, Mycobacterium
RMYNLECWIYGSDPAANGD

SEQ ID NO: 1353601 - protein, 18 aa, Mycobacterium
RNAFAHSCNTAFVQLGID

SEQ ID NO: 1353602 - protein, 20 aa, Mycobacterium
RNEDCPGLHGETVVADEEVV

SEQ ID NO: 1353603 - protein, 18 aa, Mycobacterium
RNGAVGVIDGRLTDQLVV

SEQ ID NO: 1353604 - protein, 18 aa, Mycobacterium
RNGDKVIPVEGDVTDGAV

SEQ ID NO: 1353605 - protein, 24 aa, Mycobacterium
RNGGLRYAQRADLATREEQIAIAE

SEQ ID NO: 1353606 - protein, 19 aa, Mycobacterium
RNIDAAADITVGWVNDLFA

SEQ ID NO: 1353607 - protein, 22 aa, Mycobacterium
RNYDIAWDFQRYYDTAAASRVK

SEQ ID NO: 1353608 - protein, 25 aa, Mycobacterium
RNYQCVSCGATGNATKALALQDNKR

SEQ ID NO: 1353609 - protein, 20 aa, Mycobacterium
RPAAEANLRGYFTANPAEYY

SEQ ID NO: 1353610 - protein, 18 aa, Mycobacterium
RPAITGGLAVLGATALVG

SEQ ID NO: 1353611 - protein, 18 aa, Mycobacterium
RPAKPFAVMAADIEAARR

SEQ ID NO: 1353612 - protein, 17 aa, Mycobacterium
RPARAAGVPTVHDATEA

SEQ ID NO: 1353613 - protein, 18 aa, Mycobacterium
RPAVPPGPTRSELGDLCE

SEQ ID NO: 1353614 - protein, 17 aa, Mycobacterium
RPDARLAERAGIRTQGG

SEQ ID NO: 1353615 - protein, 18 aa, Mycobacterium
RPDGGFGTRYPLFALIGV

SEQ ID NO: 1353616 - protein, 25 aa, Mycobacterium
RPDQAITLDQAWRAQTIDAARTLHR

SEQ ID NO: 1353617 - protein, 17 aa, Mycobacterium
RPDRFGIGPGATSVTVP

SEQ ID NO: 1353618 - protein, 18 aa, Mycobacterium
RPDVAAVAAPAHWPESAV

SEQ ID NO: 1353619 - protein, 24 aa, Mycobacterium
RPEKGRVSAFGFRLTGVIVAVVAT

SEQ ID NO: 1353620 - protein, 24 aa, Mycobacterium
RPFAPSWDKNDRFRVTVDDGHGGT

SEQ ID NO: 1353621 - protein, 24 aa, Mycobacterium
RPGAPDMASSLWVGPLGGNASQVL

SEQ ID NO: 1353622 - protein, 25 aa, Mycobacterium
RPGAPDMQSTLWIGPLGGRAAQALE

SEQ ID NO: 1353623 - protein, 18 aa, Mycobacterium
RPGFGWSRGGWLPYQDQI

SEQ ID NO: 1353624 - protein, 17 aa, Mycobacterium
RPIKDIVGLAARLVASI

SEQ ID NO: 1353625 - protein, 19 aa, Mycobacterium
RPLLSALGFTAPVDSSSTT

SEQ ID NO: 1353626 - protein, 25 aa, Mycobacterium
RPNGIRVRIGIHVGKSVLRGDDLFG

SEQ ID NO: 1353627 - protein, 20 aa, Mycobacterium
RPPGDLYCRVPQDSPLNVRG

SEQ ID NO: 1353628 - protein, 19 aa, Mycobacterium
RPPLKRPGLVSRPLLHEQL

SEQ ID NO: 1353629 - protein, 21 aa, Mycobacterium
RPRRVLLALLLAELVSAVLML

SEQ ID NO: 1353630 - protein, 18 aa, Mycobacterium
RPRYVTGIDAETGTVHVG

SEQ ID NO: 1353631 - protein, 19 aa, Mycobacterium
RPTIQPAVLTVGGSTITGF

SEQ ID NO: 1353632 - protein, 27 aa, Mycobacterium
RPTPDRVRELVVAWGKMYPQFGTVGAL

SEQ ID NO: 1353633 - protein, 18 aa, Mycobacterium
RPTPTVAQFLNASAAGYV

SEQ ID NO: 1353634 - protein, 25 aa, Mycobacterium
RPVAFSHGATIMFWTMMNVDNPDLG

SEQ ID NO: 1353635 - protein, 20 aa, Mycobacterium
RPVNGTAFAVTPALREAYAE

SEQ ID NO: 1353636 - protein, 18 aa, Mycobacterium
RPVPASMVLLSLAPDSSL

SEQ ID NO: 1353637 - protein, 26 aa, Mycobacterium
RPYPIARAELQLMLMKAYGIDDINFG

SEQ ID NO: 1353638 - protein, 20 aa, Mycobacterium
RPYSGAVCQYILARRSGGAP

SEQ ID NO: 1353639 - protein, 19 aa, Mycobacterium
RQDAFAALFAEEPQEIVQM

SEQ ID NO: 1353640 - protein, 22 aa, Mycobacterium
RQGFPALHCAGVVDGFSGAPWI

SEQ ID NO: 1353641 - protein, 17 aa, Mycobacterium
RQGWGAWPTCSGRIGAS

SEQ ID NO: 1353642 - protein, 19 aa, Mycobacterium
RQLLAAQLIWTLSRSGING

SEQ ID NO: 1353643 - protein, 17 aa, Mycobacterium
RQLNPRGADPLDRLRQI

SEQ ID NO: 1353644 - protein, 24 aa, Mycobacterium
RQMRNMLRLYGIPDERIIVEDRAN

SEQ ID NO: 1353645 - protein, 18 aa, Mycobacterium
RQNGWSWYIDTTEKDNGF

SEQ ID NO: 1353646 - protein, 17 aa, Mycobacterium
RQPEGRGVLVTVLTQEA

SEQ ID NO: 1353647 - protein, 18 aa, Mycobacterium
RQPEGRGVLVTVLTQEAT

SEQ ID NO: 1353648 - protein, 29 aa, Mycobacterium
RQRHDGRWIWRWDPAFIHSNFDFLRDEST

SEQ ID NO: 1353649 - protein, 17 aa, Mycobacterium
RQRVDINWWRPGGTAWF

SEQ ID NO: 1353650 - protein, 20 aa, Mycobacterium
RQRVMKRLLALLSATVLVLA

SEQ ID NO: 1353651 - protein, 24 aa, Mycobacterium
RQVQRELLELFNISEQQLNTEGLQ

SEQ ID NO: 1353652 - protein, 24 aa, Mycobacterium
RQVTLRMAVAPTVSNAGPTVVLTT

SEQ ID NO: 1353653 - protein, 24 aa, Mycobacterium
RQVVPDSLLFCWTIVREHEHLGDA

SEQ ID NO: 1353654 - protein, 21 aa, Mycobacterium
RRAEGALTCLVDLREPPPRPA

SEQ ID NO: 1353655 - protein, 17 aa, Mycobacterium
RRALALCTPRDVIARSA

SEQ ID NO: 1353656 - protein, 25 aa, Mycobacterium
RRALEKRTGLALPPTLLWEHPTAAA

SEQ ID NO: 1353657 - protein, 23 aa, Mycobacterium
RRAMSQLGVPYSWGGGNANGPSR

SEQ ID NO: 1353658 - protein, 21 aa, Mycobacterium
RRAPGNSWYHFTFNGAPGSIL

SEQ ID NO: 1353659 - protein, 19 aa, Mycobacterium
RRASLIPSLVHTVQTFATH

SEQ ID NO: 1353660 - protein, 23 aa, Mycobacterium
RRATWLLALLMATASLSASAGAG

SEQ ID NO: 1353661 - protein, 28 aa, Mycobacterium
RRAWEVLQIPVGLAFFFRNSSLGRTVAF

SEQ ID NO: 1353662 - protein, 18 aa, Mycobacterium
RRDVPPVVPLQQGGDDGG

SEQ ID NO: 1353663 - protein, 24 aa, Mycobacterium
RREAIAHAVRWARSGDVVLVAGKG

SEQ ID NO: 1353664 - protein, 29 aa, Mycobacterium
RRENIPLLEPLRLMGLHELADQLNGPLKE

SEQ ID NO: 1353665 - protein, 24 aa, Mycobacterium
RRFVRFCLWSLALAAIATVVVNLT

SEQ ID NO: 1353666 - protein, 19 aa, Mycobacterium
RRGGKGISALFVNQDDTRA

SEQ ID NO: 1353667 - protein, 19 aa, Mycobacterium
RRGLFGMFAGGLLAFGSAA

SEQ ID NO: 1353668 - protein, 18 aa, Mycobacterium
RRLLTILAATLAAAVLFA

SEQ ID NO: 1353669 - protein, 26 aa, Mycobacterium
RRPDVVAVAVPAHWSTAAVAALRAVV

SEQ ID NO: 1353670 - protein, 19 aa, Mycobacterium
RRPPSVRIANRYVDRLQRA

SEQ ID NO: 1353671 - protein, 24 aa, Mycobacterium
RRTLRCPYHAWTYALDGKLVAAPN

SEQ ID NO: 1353672 - protein, 21 aa, Mycobacterium
RRVADVLGIPFYVWDFADRFK

SEQ ID NO: 1353673 - protein, 22 aa, Mycobacterium
RRWRTAAALTLSAAVLAACGGG

SEQ ID NO: 1353674 - protein, 17 aa, Mycobacterium
RRYPFSVAQWQYTYLYQ

SEQ ID NO: 1353675 - protein, 20 aa, Mycobacterium
RSAGLLSRIAGELPAAAELV

SEQ ID NO: 1353676 - protein, 22 aa, Mycobacterium
RSAKELYRGAPYGVGYFVGVWT

SEQ ID NO: 1353677 - protein, 26 aa, Mycobacterium
RSDGVACYQCRIQLVLAANLCPCAPP

SEQ ID NO: 1353678 - protein, 27 aa, Mycobacterium
RSDWDRRLRPMLARQFELAAGRRKIKD

SEQ ID NO: 1353679 - protein, 25 aa, Mycobacterium
RSDWYRWVHDPVNRLLGLVKGVPED

SEQ ID NO: 1353680 - protein, 23 aa, Mycobacterium
RSDYELFYCCNDFASVSNPDDSS

SEQ ID NO: 1353681 - protein, 22 aa, Mycobacterium
RSGDARPLRDGDVITPADTSVP

SEQ ID NO: 1353682 - protein, 20 aa, Mycobacterium
RSGLLLSLAVLLVAGCSQVV

SEQ ID NO: 1353683 - protein, 18 aa, Mycobacterium
RSGMGDAFAVARDVPEEW

SEQ ID NO: 1353684 - protein, 21 aa, Mycobacterium
RSGPVVLYRVAPQMFTDRDEW

SEQ ID NO: 1353685 - protein, 20 aa, Mycobacterium
RSGPVVLYRVAPQVFTDRDE

SEQ ID NO: 1353686 - protein, 20 aa, Mycobacterium
RSIAPWDCPTWADVQTVFTD

SEQ ID NO: 1353687 - protein, 21 aa, Mycobacterium
RSIVSDALSWIGLGMATDQHI

SEQ ID NO: 1353688 - protein, 17 aa, Mycobacterium
RSLADSLGIGWLAEPFI

SEQ ID NO: 1353689 - protein, 17 aa, Mycobacterium
RSLSFLTTFPFVKENIG

SEQ ID NO: 1353690 - protein, 26 aa, Mycobacterium
RSLSVRWRPGDDWVVVEGSPDAVTQA

SEQ ID NO: 1353691 - protein, 25 aa, Mycobacterium
RSPSRAELLAALSIAIDLGLGQPAE

SEQ ID NO: 1353692 - protein, 21 aa, Mycobacterium
RSREIEVLEFVPAGDLDPLMY

SEQ ID NO: 1353693 - protein, 20 aa, Mycobacterium
RSREIEVLEFVPASDLDPLM

SEQ ID NO: 1353694 - protein, 27 aa, Mycobacterium
RSSANLDWDPSVAILGFPFITQAQRRH

SEQ ID NO: 1353695 - protein, 21 aa, Mycobacterium
RSTQNLSYRALRRLNVSIPDM

SEQ ID NO: 1353696 - protein, 17 aa, Mycobacterium
RSVAGIQSFVMRPNDPN

SEQ ID NO: 1353697 - protein, 17 aa, Mycobacterium
RSVAIGAFAAAAVAAPL

SEQ ID NO: 1353698 - protein, 19 aa, Mycobacterium
RSVASRSWAAGSVDGPALS

SEQ ID NO: 1353699 - protein, 21 aa, Mycobacterium
RSWAEPIPTLLATSAAQDVLR

SEQ ID NO: 1353700 - protein, 23 aa, Mycobacterium
RTADGGWDLTLRNSKGEPHLTGT

SEQ ID NO: 1353701 - protein, 18 aa, Mycobacterium
RTAPRDEPGVLIQEVMVG

SEQ ID NO: 1353702 - protein, 17 aa, Mycobacterium
RTNSVVVAPTLTSNPFR

SEQ ID NO: 1353703 - protein, 19 aa, Mycobacterium
RTREYYPAGTTVHVDAKLY

SEQ ID NO: 1353704 - protein, 18 aa, Mycobacterium
RTRLDRWEVELNSALPGD

SEQ ID NO: 1353705 - protein, 21 aa, Mycobacterium
RTRLWLRSESNISVIENGSDK

SEQ ID NO: 1353706 - protein, 18 aa, Mycobacterium
RTRRSNHIGTVIKNTINR

SEQ ID NO: 1353707 - protein, 18 aa, Mycobacterium
RTTEFVYHGTGYTVTGRV

SEQ ID NO: 1353708 - protein, 26 aa, Mycobacterium
RTTQWPVVVGGSLSFAVASAGVLAGA

SEQ ID NO: 1353709 - protein, 24 aa, Mycobacterium
RTVELCAAGDSICDGAPNGGPNLA

SEQ ID NO: 1353710 - protein, 17 aa, Mycobacterium
RTVLCVRADEDLRKPID

SEQ ID NO: 1353711 - protein, 18 aa, Mycobacterium
RVAAKMSYAELVNQVKAD

SEQ ID NO: 1353712 - protein, 19 aa, Mycobacterium
RVAALALTAALLAGCGTEG

SEQ ID NO: 1353713 - protein, 19 aa, Mycobacterium
RVAARAGAPGSGDWAATRG

SEQ ID NO: 1353714 - protein, 23 aa, Mycobacterium
RVAEPPCAALAALVAEAGAVDAA

SEQ ID NO: 1353715 - protein, 20 aa, Mycobacterium
RVALFDGGQYLLARLDPATP

SEQ ID NO: 1353716 - protein, 25 aa, Mycobacterium
RVFRSSGELHLDWWYDTRRVPQETV

SEQ ID NO: 1353717 - protein, 19 aa, Mycobacterium
RVGALAVALGVGAATVALP

SEQ ID NO: 1353718 - protein, 25 aa, Mycobacterium
RVGALAVTLGVGWAVASAPGVAHAE

SEQ ID NO: 1353719 - protein, 21 aa, Mycobacterium
RVGGLAVALGVGVAILTGQGV

SEQ ID NO: 1353720 - protein, 19 aa, Mycobacterium
RVGGLRFSAGRVVGVDCLG

SEQ ID NO: 1353721 - protein, 18 aa, Mycobacterium
RVGTPFASTAHYSLLAAL

SEQ ID NO: 1353722 - protein, 18 aa, Mycobacterium
RVGVLSCAAALTACSSGG

SEQ ID NO: 1353723 - protein, 20 aa, Mycobacterium
RVKPTLPIVLANLVSVGQVA

SEQ ID NO: 1353724 - protein, 19 aa, Mycobacterium
RVMRARILLVATAVIVAGL

SEQ ID NO: 1353725 - protein, 22 aa, Mycobacterium
RVRAIELKNWIATLTLDLEPSV

SEQ ID NO: 1353726 - protein, 17 aa, Mycobacterium
RVRANTLTVRRGAEPVS

SEQ ID NO: 1353727 - protein, 20 aa, Mycobacterium
RVRASVTVYGFGAEFAGAKP

SEQ ID NO: 1353728 - protein, 18 aa, Mycobacterium
RVRQRRKEIGRGQRFELS

SEQ ID NO: 1353729 - protein, 22 aa, Mycobacterium
RVRRLKGFPVQMVKGLGVALTA

SEQ ID NO: 1353730 - protein, 17 aa, Mycobacterium
RVRVADVYVGRVRAIEL

SEQ ID NO: 1353731 - protein, 23 aa, Mycobacterium
RVSELKSSFPAPYTVNSVGPAGI

SEQ ID NO: 1353732 - protein, 20 aa, Mycobacterium
RVSLADADRGPACQASGSVV

SEQ ID NO: 1353733 - protein, 25 aa, Mycobacterium
RVSQWWKAGLAAVLAIAALFGGLDR

SEQ ID NO: 1353734 - protein, 17 aa, Mycobacterium
RVSVMPVSDDRFYFFFD

SEQ ID NO: 1353735 - protein, 29 aa, Mycobacterium
RVTIRDERGLICSATFDFSQDPLVLGPED

SEQ ID NO: 1353736 - protein, 21 aa, Mycobacterium
RVVGALALAAALPFAATACGG

SEQ ID NO: 1353737 - protein, 19 aa, Mycobacterium
RVVLARRFHNDAVRDTLAL

SEQ ID NO: 1353738 - protein, 20 aa, Mycobacterium
RVYGRQAIEYVIRRAGSQIG

SEQ ID NO: 1353739 - protein, 25 aa, Mycobacterium
RWGPPEAPLRYVLVFNGEIYNYLEL

SEQ ID NO: 1353740 - protein, 24 aa, Mycobacterium
RWVKCRRATFKYGLGAEFIDVLKT

SEQ ID NO: 1353741 - protein, 18 aa, Mycobacterium
RYDAEWIVVLDDWTDGIG

SEQ ID NO: 1353742 - protein, 18 aa, Mycobacterium
RYLCSGGMNLRNQPDVIA

SEQ ID NO: 1353743 - protein, 23 aa, Mycobacterium
RYLTLERARFGTALKVTLQVAPE

SEQ ID NO: 1353744 - protein, 28 aa, Mycobacterium
RYPQNLPKVAARGGPQCVGLPDVGYETR

SEQ ID NO: 1353745 - protein, 20 aa, Mycobacterium
RYVDAFLRMARRSASSGTAL

SEQ ID NO: 1353746 - protein, 17 aa, Mycobacterium
SAAALLAVMLLLAGCSD

SEQ ID NO: 1353747 - protein, 24 aa, Mycobacterium
SADAANFMFSYFVGVDENGHLYGG

SEQ ID NO: 1353748 - protein, 26 aa, Mycobacterium
SADAYAGLPNPHAWMSPLNVQIYADN

SEQ ID NO: 1353749 - protein, 22 aa, Mycobacterium
SADLRVGQDVVAIGSPLGLEGT

SEQ ID NO: 1353750 - protein, 22 aa, Mycobacterium
SADSSMFFPIPGLTLGGLLVDE

SEQ ID NO: 1353751 - protein, 23 aa, Mycobacterium
SAEALEFVGLMGIPPLGADAGSA

SEQ ID NO: 1353752 - protein, 21 aa, Mycobacterium
SAEFGDKGLRVNVLSPGPIDT

SEQ ID NO: 1353753 - protein, 17 aa, Mycobacterium
SAEGACVRVSWVKVDPS

SEQ ID NO: 1353754 - protein, 20 aa, Mycobacterium
SAEQAEIWGGRADEPFDPNY

SEQ ID NO: 1353755 - protein, 25 aa, Mycobacterium
SAEYLAMLRRCGVPAVLSGAGPAVL

SEQ ID NO: 1353756 - protein, 18 aa, Mycobacterium
SAFDEFKPLYGTSLVTGW

SEQ ID NO: 1353757 - protein, 24 aa, Mycobacterium
SAGPIDGGACYWKRTAGEETVDNR

SEQ ID NO: 1353758 - protein, 19 aa, Mycobacterium
SAKGKAVVDRGVRTIDLTV

SEQ ID NO: 1353759 - protein, 19 aa, Mycobacterium
SAKHKGVEFIPLAQVHSLI

SEQ ID NO: 1353760 - protein, 24 aa, Mycobacterium
SALDRACIAIALFGGLDVPLQQPL

SEQ ID NO: 1353761 - protein, 19 aa, Mycobacterium
SALILLPAVDVVEGRAVRL

SEQ ID NO: 1353762 - protein, 20 aa, Mycobacterium
SALSIGSYVCQARAARQTDQ

SEQ ID NO: 1353763 - protein, 20 aa, Mycobacterium
SANQFYLDWHANYNDWQVVC

SEQ ID NO: 1353764 - protein, 19 aa, Mycobacterium
SAPDVFDLGQSVALANTAM

SEQ ID NO: 1353765 - protein, 24 aa, Mycobacterium
SAPEPRYTPSPALAAYIRCRDLTC

SEQ ID NO: 1353766 - protein, 19 aa, Mycobacterium
SAPGQPGPFDWVYTPSADH

SEQ ID NO: 1353767 - protein, 18 aa, Mycobacterium
SAPMTVAPNGAVFFKTRQ

SEQ ID NO: 1353768 - protein, 19 aa, Mycobacterium
SAQPQCTAAGLSSALSSVS

SEQ ID NO: 1353769 - protein, 24 aa, Mycobacterium
SATPRPHHGVAVLLADGTLVHSIG

SEQ ID NO: 1353770 - protein, 18 aa, Mycobacterium
SAVAGCATYGRSVTPAPA

SEQ ID NO: 1353771 - protein, 33 aa, Mycobacterium
SAVFLVDYLMNFFQYHLPGVQAYHLDVTPDPGI

SEQ ID NO: 1353772 - protein, 20 aa, Mycobacterium
SAVPVRWRALLHGWPGMTAH

SEQ ID NO: 1353773 - protein, 24 aa, Mycobacterium
SAVVTRFPGAIAELQLSRDGTRAA

SEQ ID NO: 1353774 - protein, 26 aa, Mycobacterium
SAYELLLCRIASLNIAYLHVVSEPSA

SEQ ID NO: 1353775 - protein, 23 aa, Mycobacterium
SAYTGPEMAFGWDPLDIPGGDIA

SEQ ID NO: 1353776 - protein, 25 aa, Mycobacterium
SCVSERSRRGFTFSAEGFAPQYTDV

SEQ ID NO: 1353777 - protein, 27 aa, Mycobacterium
SDADPVILCAMPFFWIGGVLAATGALH

SEQ ID NO: 1353778 - protein, 18 aa, Mycobacterium
SDAGQSWEPLSLHGSADF

SEQ ID NO: 1353779 - protein, 20 aa, Mycobacterium
SDDRFYFFFDVVEPQGSPYE

SEQ ID NO: 1353780 - protein, 20 aa, Mycobacterium
SDFDGWGIAGWSWDEVLPHY

SEQ ID NO: 1353781 - protein, 26 aa, Mycobacterium
SDGQIAYNFGHKWGLGDTVASDEYAF

SEQ ID NO: 1353782 - protein, 28 aa, Mycobacterium
SDLPSSVQLPVWLSRAGSDVLKSHPIVS

SEQ ID NO: 1353783 - protein, 25 aa, Mycobacterium
SDPATGWPRLDWSMDAALLLAALAA

SEQ ID NO: 1353784 - protein, 20 aa, Mycobacterium
SDRHICTGAALASAGEDLIL

SEQ ID NO: 1353785 - protein, 24 aa, Mycobacterium
SDRRPGGAWMLGKPILLPEARDLY

SEQ ID NO: 1353786 - protein, 18 aa, Mycobacterium
SDVLYDWADGKPILRGIE

SEQ ID NO: 1353787 - protein, 17 aa, Mycobacterium
SDWCRFNSAGSLFIDPG

SEQ ID NO: 1353788 - protein, 23 aa, Mycobacterium
SDWGGLWNYTWRTGLDSHGDPVH

SEQ ID NO: 1353789 - protein, 21 aa, Mycobacterium
SEAQPSRMVLVSPALHLTLRG

SEQ ID NO: 1353790 - protein, 22 aa, Mycobacterium
SEGVVGVLFVFARRSREFTEDE

SEQ ID NO: 1353791 - protein, 20 aa, Mycobacterium
SEGWWPGLINISMGDAGGYK

SEQ ID NO: 1353792 - protein, 21 aa, Mycobacterium
SEGWWPTLVGIAMNDAGRFDA

SEQ ID NO: 1353793 - protein, 18 aa, Mycobacterium
SEHVALYLGNGVMLEAPR

SEQ ID NO: 1353794 - protein, 26 aa, Mycobacterium
SEIEMMRGWLALWGVGPAAAQQHHPN

SEQ ID NO: 1353795 - protein, 25 aa, Mycobacterium
SELPDRAAPVVLAYHDIRPMTATED

SEQ ID NO: 1353796 - protein, 17 aa, Mycobacterium
SEPDAADTELIWAAEHS

SEQ ID NO: 1353797 - protein, 20 aa, Mycobacterium
SEVTVRNAIDLAVEQINASG

SEQ ID NO: 1353798 - protein, 22 aa, Mycobacterium
SEYEPVEAFKLLTADDLDLALT

SEQ ID NO: 1353799 - protein, 25 aa, Mycobacterium
SFLMYRKDLFEQAGIKVDQNPDYQP

SEQ ID NO: 1353800 - protein, 22 aa, Mycobacterium
SFPKPEEIGGYAGVPQAPPPRP

SEQ ID NO: 1353801 - protein, 18 aa, Mycobacterium
SFQLHWAPSLRPEAGAVL

SEQ ID NO: 1353802 - protein, 26 aa, Mycobacterium
SFVEAARRAGFRWVEDLSGLDADVPV

SEQ ID NO: 1353803 - protein, 25 aa, Mycobacterium
SGAAKWNLLAPYAYASNGGKDPQAG

SEQ ID NO: 1353804 - protein, 17 aa, Mycobacterium
SGACAVTGYPGMPAKPG

SEQ ID NO: 1353805 - protein, 27 aa, Mycobacterium
SGADGVPMGMVFRLREDVDLSGYAEST

SEQ ID NO: 1353806 - protein, 18 aa, Mycobacterium
SGAPDMQSTLWIGPLGGR

SEQ ID NO: 1353807 - protein, 18 aa, Mycobacterium
SGAVKWTADAGFHPVCAT

SEQ ID NO: 1353808 - protein, 19 aa, Mycobacterium
SGAVVCVLALLSGCSSGTD

SEQ ID NO: 1353809 - protein, 22 aa, Mycobacterium
SGGRMMVTFGVGWLQGEFEALG

SEQ ID NO: 1353810 - protein, 18 aa, Mycobacterium
SGGVYLPGLPVVPRSVAY

SEQ ID NO: 1353811 - protein, 19 aa, Mycobacterium
SGHYARFVTASGESNHLAG

SEQ ID NO: 1353812 - protein, 25 aa, Mycobacterium
SGNPYPIYWNLNAVNNYFRTGPQFP

SEQ ID NO: 1353813 - protein, 23 aa, Mycobacterium
SGPGLWASIACRKRYIDERLSDP

SEQ ID NO: 1353814 - protein, 17 aa, Mycobacterium
SGPPLTSLAGRWSVRNG

SEQ ID NO: 1353815 - protein, 25 aa, Mycobacterium
SGQFAKIPLILTGAVGDLYSYLAIR

SEQ ID NO: 1353816 - protein, 26 aa, Mycobacterium
SGRRVSVDTLGAWVIKCNPARTAIEP

SEQ ID NO: 1353817 - protein, 18 aa, Mycobacterium
SGSLIPLSAAGGYPTTEE

SEQ ID NO: 1353818 - protein, 19 aa, Mycobacterium
SGSQISALVADLAQANQRL

SEQ ID NO: 1353819 - protein, 19 aa, Mycobacterium
SGVRPGRDVTEFRQNRRDQ

SEQ ID NO: 1353820 - protein, 23 aa, Mycobacterium
SGVSWNYLAAINFVETAFGRITG

SEQ ID NO: 1353821 - protein, 34 aa, Mycobacterium
SGVTPPGVFPPLEGAAAVFDRLLPGAPTPGAPGA

SEQ ID NO: 1353822 - protein, 18 aa, Mycobacterium
SHRGELSPREFFADQRRQ

SEQ ID NO: 1353823 - protein, 26 aa, Mycobacterium
SIDELIQGLWLAGRQDQQARATQRKA

SEQ ID NO: 1353824 - protein, 18 aa, Mycobacterium
SIGVPGIVRLLQTAHEAH

SEQ ID NO: 1353825 - protein, 25 aa, Mycobacterium
SIMAAGRFLAAHGFARDRDQAIYRY

SEQ ID NO: 1353826 - protein, 20 aa, Mycobacterium
SITCPCHGSSFHLDGTVATG

SEQ ID NO: 1353827 - protein, 18 aa, Mycobacterium
SIVTALFAPKSWGDTAPA

SEQ ID NO: 1353828 - protein, 17 aa, Mycobacterium
SIYRLWYQFTQISDKIK

SEQ ID NO: 1353829 - protein, 20 aa, Mycobacterium
SKIHSVASFFVSRVDTEIDN

SEQ ID NO: 1353830 - protein, 33 aa, Mycobacterium; identical to SEQ ID NO: 1280476

SEQ ID NO: 1353831 - protein, 18 aa, Mycobacterium
SKPRGWMEALRAYNHSDQ

SEQ ID NO: 1353832 - protein, 22 aa, Mycobacterium
SKPWHPSGLAIDIMIPNSDSPE

SEQ ID NO: 1353833 - protein, 18 aa, Mycobacterium
SLAACSKGSPAAEQSLQS

SEQ ID NO: 1353834 - protein, 28 aa, Mycobacterium
SLAANIVGGIDWDGHGLLGLEDSLDAVL

SEQ ID NO: 1353835 - protein, 24 aa, Mycobacterium
SLAAQQIPLVFGFDYQTVERTFAE

SEQ ID NO: 1353836 - protein, 17 aa, Mycobacterium
SLADFVKRQNIGSFTLG

SEQ ID NO: 1353837 - protein, 19 aa, Mycobacterium
SLCTQGEINAALLYATVSL

SEQ ID NO: 1353838 - protein, 17 aa, Mycobacterium
SLEQRWTTGSAKTTLPV

SEQ ID NO: 1353839 - protein, 18 aa, Mycobacterium
SLHGSADFHALKYRHGRI

SEQ ID NO: 1353840 - protein, 17 aa, Mycobacterium
SLLSVLLATILVGGLVV

SEQ ID NO: 1353841 - protein, 19 aa, Mycobacterium
SLNGFAYGFPYDDVNSQSS

SEQ ID NO: 1353842 - protein, 17 aa, Mycobacterium
SLNRLVSRFGERQETLD

SEQ ID NO: 1353843 - protein, 21 aa, Mycobacterium
SLPDRLLAAAVAYQSALEPRP

SEQ ID NO: 1353844 - protein, 23 aa, Mycobacterium
SLQAGADVALWLSTAEVPAVLDR

SEQ ID NO: 1353845 - protein, 18 aa, Mycobacterium
SLRISSRLADGGDGNGWL

SEQ ID NO: 1353846 - protein, 29 aa, Mycobacterium
SLRRAVGLADGWMPFGLTPARIAEMLAAV

SEQ ID NO: 1353847 - protein, 21 aa, Mycobacterium
SLTMYELPASLLVENPINRYL

SEQ ID NO: 1353848 - protein, 21 aa, Mycobacterium
SLTNLPVRLQAAGEFLAAGQF

SEQ ID NO: 1353849 - protein, 17 aa, Mycobacterium
SLVAYLYGYGAQQTAIV

SEQ ID NO: 1353850 - protein, 25 aa, Mycobacterium
SMASAVKFDDGWARAAESGMTAVFG

SEQ ID NO: 1353851 - protein, 18 aa, Mycobacterium
SMVTRCGRTPELRPVEYR

SEQ ID NO: 1353852 - protein, 17 aa, Mycobacterium
SMYRYLWSNGPKECLEF

SEQ ID NO: 1353853 - protein, 21 aa, Mycobacterium
SNDYWYLALNEAREPWNDVRV

SEQ ID NO: 1353854 - protein, 18 aa, Mycobacterium
SNGGTWDALARCEAGGNW

SEQ ID NO: 1353855 - protein, 27 aa, Mycobacterium
SNGLTCMLQRSGGYGCNGVLPGAPQNA

SEQ ID NO: 1353856 - protein, 26 aa, Mycobacterium
SNNLYWDPRFFIALGPNTNIVTDSSG

SEQ ID NO: 1353857 - protein, 22 aa, Mycobacterium
SNPELFGQGVINLKYSIVDVTP

SEQ ID NO: 1353858 - protein, 18 aa, Mycobacterium
SNQGWNPEPLAGNYNECA

SEQ ID NO: 1353859 - protein, 18 aa, Mycobacterium
SNRVALVTGATAVEPGGL

SEQ ID NO: 1353860 - protein, 29 aa, Mycobacterium
SPADLDAFLQLLADRGVDVLIYNTQTEGS

SEQ ID NO: 1353861 - protein, 24 aa, Mycobacterium
SPAGEVLPGYGWIFPLGNGEVNIG

SEQ ID NO: 1353862 - protein, 17 aa, Mycobacterium
SPAIPLGPFLPTGQELA

SEQ ID NO: 1353863 - protein, 19 aa, Mycobacterium
SPALGWGIHIDRVEIKDVI

SEQ ID NO: 1353864 - protein, 19 aa, Mycobacterium
SPALGWGIHIDRVEIKDVV

SEQ ID NO: 1353865 - protein, 19 aa, Mycobacterium
SPDFPRTVVDGIRDATNRV

SEQ ID NO: 1353866 - protein, 17 aa, Mycobacterium
SPDGASLAYALYRSTDS

SEQ ID NO: 1353867 - protein, 25 aa, Mycobacterium
SPDGVVIWTRLAPRPLADDGLGGMP

SEQ ID NO: 1353868 - protein, 23 aa, Mycobacterium
SPDLRGAYAHALKSVAVGPDGAV

SEQ ID NO: 1353869 - protein, 24 aa, Mycobacterium
SPDTPWRTSIIEFPTRTPSAPLAP

SEQ ID NO: 1353870 - protein, 18 aa, Mycobacterium
SPGLWRHLTQALTEIKKG

SEQ ID NO: 1353871 - protein, 25 aa, Mycobacterium
SPLAQLAIVPVKFVGDLAYVATNFV

SEQ ID NO: 1353872 - protein, 27 aa, Mycobacterium
SPLATPIRMFERAVFDFGGSPQGRALS

SEQ ID NO: 1353873 - protein, 17 aa, Mycobacterium
SPLPLGISAEAATEQRV

SEQ ID NO: 1353874 - protein, 17 aa, Mycobacterium
SPLRLRGPVTRADGGKT

SEQ ID NO: 1353875 - protein, 27 aa, Mycobacterium
SPMERRPEPGWRLSVTDLGLPNANSAD

SEQ ID NO: 1353876 - protein, 20 aa, Mycobacterium
SPNPPWFVKYGLDVRRTEYE

SEQ ID NO: 1353877 - protein, 20 aa, Mycobacterium
SPQMRAAIEGGMADGNAELD

SEQ ID NO: 1353878 - protein, 29 aa, Mycobacterium
SPQVLRNIVYRARIDGVSRGATITYSAEG

SEQ ID NO: 1353879 - protein, 26 aa, Mycobacterium
SPRRVKRLEGWLGELVPRLLEDLGSG

SEQ ID NO: 1353880 - protein, 26 aa, Mycobacterium
SPSLPGTVVKRGFFGWDAAAVSAHAN

SEQ ID NO: 1353881 - protein, 24 aa, Mycobacterium
SPSPENLSFVFLGNSLRKYGGVRP

SEQ ID NO: 1353882 - protein, 24 aa, Mycobacterium
SPTENPDLFWGLRGGAGGNFGVVT

SEQ ID NO: 1353883 - protein, 23 aa, Mycobacterium
SPTKTRVPVAITVDSGGVVTKTT

SEQ ID NO: 1353884 - protein, 19 aa, Mycobacterium
SPVITDFMAAPALGAGTAA

SEQ ID NO: 1353885 - protein, 22 aa, Mycobacterium
SPVREVSELAGKTVAVTAPGSL

SEQ ID NO: 1353886 - protein, 27 aa, Mycobacterium
SPVYGSGLPSDIWKATMDGALEDTDNE

SEQ ID NO: 1353887 - protein, 19 aa, Mycobacterium
SQCDPNYSGPCVPIASDVD

SEQ ID NO: 1353888 - protein, 17 aa, Mycobacterium
SQDDVVFEWTDQYGDRW

SEQ ID NO: 1353889 - protein, 18 aa, Mycobacterium
SQGDGFMVAFARPEQAVR

SEQ ID NO: 1353890 - protein, 18 aa, Mycobacterium
SQRCAELTTHPAVLAGRE

SEQ ID NO: 1353891 - protein, 17 aa, Mycobacterium
SQSPRAGGTIRAKSQPA

SEQ ID NO: 1353892 - protein, 20 aa, Mycobacterium
SQSRSLRLPTELDDEVVASE

SEQ ID NO: 1353893 - protein, 24 aa, Mycobacterium
SQTRTSEAIQAWAAQVATVTTQLQ

SEQ ID NO: 1353894 - protein, 18 aa, Mycobacterium
SRAAIRTDTILGRKNIEI

SEQ ID NO: 1353895 - protein, 20 aa, Mycobacterium
SRAVIRYDDLIGGRYLALQE

SEQ ID NO: 1353896 - protein, 17 aa, Mycobacterium
SRELVVISSEADDAEAR

SEQ ID NO: 1353897 - protein, 24 aa, Mycobacterium
SRGKVALPAWRVERPPAADQLLGF

SEQ ID NO: 1353898 - protein, 18 aa, Mycobacterium
SRIDSGFFTGSRWECDLT

SEQ ID NO: 1353899 - protein, 17 aa, Mycobacterium
SRIIARENIRAIRKDVL

SEQ ID NO: 1353900 - protein, 18 aa, Mycobacterium
SRITALGAAVALAVGLTA

SEQ ID NO: 1353901 - protein, 19 aa, Mycobacterium
SRLDSALLTGTRFEGSLTE

SEQ ID NO: 1353902 - protein, 17 aa, Mycobacterium
SRMRPDVVTAFMDQFGD

SEQ ID NO: 1353903 - protein, 24 aa, Mycobacterium
SRPAALARRGLGPDVVPARDGRVW

SEQ ID NO: 1353904 - protein, 18 aa, Mycobacterium
SRRRVLVGAAALAALGVT

SEQ ID NO: 1353905 - protein, 24 aa, Mycobacterium
SRTEFGDKLDVAFNVDGEKSVVGM

SEQ ID NO: 1353906 - protein, 18 aa, Mycobacterium
SRVSGWLTPEARAHWDLI

SEQ ID NO: 1353907 - protein, 30 aa, Mycobacterium
SRVSGWLTPEARAHWDLIAAKYAAPGTNLP

SEQ ID NO: 1353908 - protein, 20 aa, Mycobacterium
SRVSGWLTPEARAHWDVIAA

SEQ ID NO: 1353909 - protein, 19 aa, Mycobacterium
SRYATDFAQGIISSQQREI

SEQ ID NO: 1353910 - protein, 24 aa, Mycobacterium
SSAMTRALVRIGELGRMAGDTLTY

SEQ ID NO: 1353911 - protein, 19 aa, Mycobacterium
SSAPLLLRIWAGSDILDSR

SEQ ID NO: 1353912 - protein, 21 aa, Mycobacterium
SSASTPGRAAGPVLVSSNGTI

SEQ ID NO: 1353913 - protein, 17 aa, Mycobacterium
SSCGYLAGFPGQGAYAC

SEQ ID NO: 1353914 - protein, 20 aa, Mycobacterium
SSDCVAAVFGGWTSSSRKAM

SEQ ID NO: 1353915 - protein, 21 aa, Mycobacterium
SSDIAAGWWQAALDAYDRLPA

SEQ ID NO: 1353916 - protein, 27 aa, Mycobacterium
SSGPFFKAYVANLLPGQFVQPFVDAAF

SEQ ID NO: 1353917 - protein, 19 aa, Mycobacterium
SSGPFFKGLIANLPPGQFI

SEQ ID NO: 1353918 - protein, 33 aa, Mycobacterium
SSGPFYKAYVANLLPGQFLQPAIDAAFSDLGLD

SEQ ID NO: 1353919 - protein, 22 aa, Mycobacterium
SSIPLLLAGCQFGGLNSLNMPG

SEQ ID NO: 1353920 - protein, 17 aa, Mycobacterium
SSLRWWPDRTLTRRGLE

SEQ ID NO: 1353921 - protein, 28 aa, Mycobacterium
SSMEEALRYWGLQTGRWGQSAGENQYYT

SEQ ID NO: 1353922 - protein, 39 aa, Mycobacterium
SSNAYPEPQFESVSCRGPIAAQGPGLWEVTTLFGQAATV

SEQ ID NO: 1353923 - protein, 24 aa, Mycobacterium
SSNPPVPGRFYWVNDTQLRWRPQD

SEQ ID NO: 1353924 - protein, 19 aa, Mycobacterium
SSPGIAWADPDTSSSPSTD

SEQ ID NO: 1353925 - protein, 17 aa, Mycobacterium
SSRVAICQDADGDYEYR

SEQ ID NO: 1353926 - protein, 17 aa, Mycobacterium
SSSALVIGGIATSSMHD

SEQ ID NO: 1353927 - protein, 26 aa, Mycobacterium
SSTNVFSGMVGKAWVTPEGQVIIAYQ

SEQ ID NO: 1353928 - protein, 24 aa, Mycobacterium
SSVNDMTRWMAMVLADGRHDGNQL

SEQ ID NO: 1353929 - protein, 18 aa, Mycobacterium
SSWVEAKSAPGWPAQYGD

SEQ ID NO: 1353930 - protein, 24 aa, Mycobacterium
SSYPRFGISGADLGILWDNGNSGA

SEQ ID NO: 1353931 - protein, 21 aa, Mycobacterium
STAMWGLGGGPAWQRNDPTVN

SEQ ID NO: 1353932 - protein, 24 aa, Mycobacterium
STAPLPSGMYCKIPKDYQGNAVRG

SEQ ID NO: 1353933 - protein, 21 aa, Mycobacterium
STFAAALAFGAIALIVPGTGT

SEQ ID NO: 1353934 - protein, 17 aa, Mycobacterium
STFTYRFSAPHPGTYWA

SEQ ID NO: 1353935 - protein, 23 aa, Mycobacterium
STISRLEADGNRVIVNNLSSTPL

SEQ ID NO: 1353936 - protein, 19 aa, Mycobacterium
STLDFSVGRFQVVKAEASS

SEQ ID NO: 1353937 - protein, 20 aa, Mycobacterium
STLHDLRIWAPALVTGTLLS

SEQ ID NO: 1353938 - protein, 19 aa, Mycobacterium
STVFQRWAAVEQRKVDQVL

SEQ ID NO: 1353939 - protein, 20 aa, Mycobacterium
STVPNRRGGKGISALFVNQD

SEQ ID NO: 1353940 - protein, 25 aa, Mycobacterium
STWGTLPAAISWQVASQMAEADTIS

SEQ ID NO: 1353941 - protein, 36 aa, Mycobacterium
STYPGDGSNRWPAVHRLDAAALFRIAAEDAPAGTLL

SEQ ID NO: 1353942 - protein, 18 aa, Mycobacterium
SVAGGILAMVEEIDTSDE

SEQ ID NO: 1353943 - protein, 22 aa, Mycobacterium
SVARLVGAPPGYVGYDQGGQLT

SEQ ID NO: 1353944 - protein, 20 aa, Mycobacterium
SVCCPSCGSGDVVVVRGDEF

SEQ ID NO: 1353945 - protein, 17 aa, Mycobacterium
SVDQWGGIVSQLGGQCA

SEQ ID NO: 1353946 - protein, 18 aa, Mycobacterium
SVDQWGGIVSQLGGQCAT

SEQ ID NO: 1353947 - protein, 19 aa, Mycobacterium
SVERRWAGVYSQCVDPHEL

SEQ ID NO: 1353948 - protein, 25 aa, Mycobacterium
SVGFSVRHLMVSKVRGVFDTFSGAI

SEQ ID NO: 1353949 - protein, 19 aa, Mycobacterium
SVGGPRLLARTVELATGLR

SEQ ID NO: 1353950 - protein, 17 aa, Mycobacterium
SVLMSRYLQAVQREQGL

SEQ ID NO: 1353951 - protein, 18 aa, Mycobacterium
SVPPGAASFQAWQVDQLS

SEQ ID NO: 1353952 - protein, 25 aa, Mycobacterium
SVPVKDYNPMMGRQLLIKVLKGKSS

SEQ ID NO: 1353953 - protein, 27 aa, Mycobacterium
SVSAFPRVVWVAGGLLKGASVDEMVEA

SEQ ID NO: 1353954 - protein, 25 aa, Mycobacterium
SVSGCGYRLAAYPTDDAAAQPVEPR

SEQ ID NO: 1353955 - protein, 19 aa, Mycobacterium
SVSPLRAAYILDADGTARF

SEQ ID NO: 1353956 - protein, 24 aa, Mycobacterium
SVVGRSPLILDYEIKAEAVYSDGK

SEQ ID NO: 1353957 - protein, 18 aa, Mycobacterium
SVVHLRWATNGLAVQPEN

SEQ ID NO: 1353958 - protein, 24 aa, Mycobacterium
SVVPGAADGAVWVFSGHGSHWPGM

SEQ ID NO: 1353959 - protein, 19 aa, Mycobacterium
SVVVDVRLSLPPVVALRGG

SEQ ID NO: 1353960 - protein, 32 aa, Mycobacterium
SYCDADSGNTCTPVKYLSGVPLVGEYDGLRAL

SEQ ID NO: 1353961 - protein, 24 aa, Mycobacterium
SYTEAAWIADWKMLAQRYANDPTV

SEQ ID NO: 1353962 - protein, 18 aa, Mycobacterium
TAAFEWYDQSGISVIMPV

SEQ ID NO: 1353963 - protein, 29 aa, Mycobacterium
TAATLPFAALPLMFLGPVPLAAATQVIPE

SEQ ID NO: 1353964 - protein, 23 aa, Mycobacterium
TAAYCQGSAAAVAFGRTADALVA

SEQ ID NO: 1353965 - protein, 24 aa, Mycobacterium
TADEVPGVLIARGLAEQSGKRIRL

SEQ ID NO: 1353966 - protein, 22 aa, Mycobacterium
TAEALTGLGARFGESLEHGAAI

SEQ ID NO: 1353967 - protein, 20 aa, Mycobacterium
TAELGRLAPDAADYFTERQA

SEQ ID NO: 1353968 - protein, 21 aa, Mycobacterium
TAELGRLAPDAADYFTERQAE

SEQ ID NO: 1353969 - protein, 20 aa, Mycobacterium
TAFQRRVWEALLTIPYGETR

SEQ ID NO: 1353970 - protein, 17 aa, Mycobacterium
TAFTITEPLGYGTTYTW

SEQ ID NO: 1353971 - protein, 27 aa, Mycobacterium
TAGAFSRPGLPVEYLDVFSPSMGRDIR

SEQ ID NO: 1353972 - protein, 18 aa, Mycobacterium
TAGDGYLYLVRQVAAADS

SEQ ID NO: 1353973 - protein, 17 aa, Mycobacterium
TAHAWHAVRRGHHVIHL

SEQ ID NO: 1353974 - protein, 29 aa, Mycobacterium
TAKLCAQYLGPALRLLNFNNIPLPINAYL

SEQ ID NO: 1353975 - protein, 25 aa, Mycobacterium
TAKLCAQYLGPALRSIPIHNLPFPI

SEQ ID NO: 1353976 - protein, 24 aa, Mycobacterium
TALRERFARIGIGPDGDFDADSLS

SEQ ID NO: 1353977 - protein, 17 aa, Mycobacterium
TALRPEDFRKVADTLLG

SEQ ID NO: 1353978 - protein, 30 aa, Mycobacterium
TALVIMVFAYMRLPAFLGIGQYRVTLELPE

SEQ ID NO: 1353979 - protein, 22 aa, Mycobacterium
TAMWGPGGGPAWKRNDPTVNVG

SEQ ID NO: 1353980 - protein, 26 aa, Mycobacterium
TANEGDWKGGTRGWTIFDATTGEVVW

SEQ ID NO: 1353981 - protein, 21 aa, Mycobacterium
TASRRPVPLAVMIAAADDETP

SEQ ID NO: 1353982 - protein, 25 aa, Mycobacterium
TATVCSAPVWAGGPGGMVETGVVSR

SEQ ID NO: 1353983 - protein, 19 aa, Mycobacterium
TAVAIGRNSLAYAGTGDDN

SEQ ID NO: 1353984 - protein, 25 aa, Mycobacterium
TAVARLYRRRFSWLSQGSTPTASRR

SEQ ID NO: 1353985 - protein, 21 aa, Mycobacterium
TAVDVLSRIVARGGGQVSATT

SEQ ID NO: 1353986 - protein, 17 aa, Mycobacterium
TAYSVLMSRYLQAVQRE

SEQ ID NO: 1353987 - protein, 35 aa, Mycobacterium
TCAVLAGGVDALPCDDARCAIPSGERVLAYVTTRG

SEQ ID NO: 1353988 - protein, 23 aa, Mycobacterium
TCSSVPYPYLLRAEGVELLDQAI

SEQ ID NO: 1353989 - protein, 29 aa, Mycobacterium
TDANRDAWMVGFTPSLSTAVWVGTVDGTK

SEQ ID NO: 1353990 - protein, 25 aa, Mycobacterium
TDAPTCPVALAFPDGPQSPLLEEFI

SEQ ID NO: 1353991 - protein, 17 aa, Mycobacterium
TDAVALRSIATADAAAA

SEQ ID NO: 1353992 - protein, 22 aa, Mycobacterium
TDDGTRWGRPVAAVVGPDGAVY

SEQ ID NO: 1353993 - protein, 22 aa, Mycobacterium
TDFGAAIYAEYRLARSVRSSAN

SEQ ID NO: 1353994 - protein, 24 aa, Mycobacterium
TDGGIDLKSRFRDTLAAEFNGKDV

SEQ ID NO: 1353995 - protein, 26 aa, Mycobacterium
TDGPRLGGLDHHKLVLAGDDVSLTDV

SEQ ID NO: 1353996 - protein, 27 aa, Mycobacterium
TDGPRLGGLDHHKLVLAGDDVSLTDVT

SEQ ID NO: 1353997 - protein, 26 aa, Mycobacterium
TDGPRLGGLDHHKLVLAGDDVSLTEV

SEQ ID NO: 1353998 - protein, 19 aa, Mycobacterium
TDLLDRLGTHLTRHIGPGV

SEQ ID NO: 1353999 - protein, 19 aa, Mycobacterium
TDLLDRLGTHLTRHVGPGV

SEQ ID NO: 1354000 - protein, 23 aa, Mycobacterium
TDLPGLQPFMPPYVPGGGAKPHY

SEQ ID NO: 1354001 - protein, 18 aa, Mycobacterium
TDPAVLPVRGMPVCHFGV

SEQ ID NO: 1354002 - protein, 24 aa, Mycobacterium
TDQRMKAEFYPRVDKTRLFADGYI

SEQ ID NO: 1354003 - protein, 32 aa, Mycobacterium
TDQWAKHRIVTKLEVWFPKDLRRDPVTIDTGG

SEQ ID NO: 1354004 - protein, 25 aa, Mycobacterium
TDSHEVVDSIILATGAPFDLAVSPD

SEQ ID NO: 1354005 - protein, 18 aa, Mycobacterium
TDTAARAVVDIAYQYNYN

SEQ ID NO: 1354006 - protein, 20 aa, Mycobacterium
TDVTAAWAMAVPAAPLPAQY

SEQ ID NO: 1354007 - protein, 26 aa, Mycobacterium
TDWNNRWWITCMVAFKTSYGVIQQSL

SEQ ID NO: 1354008 - protein, 19 aa, Mycobacterium
TEAAAMPLSEIERLSIIGG

SEQ ID NO: 1354009 - protein, 29 aa, Mycobacterium
TEDLPLLQGLRDLGLDWLADEWEEPLREI

SEQ ID NO: 1354010 - protein, 22 aa, Mycobacterium
TEEFKGIALRTLEATVADDELR

SEQ ID NO: 1354011 - protein, 29 aa, Mycobacterium
TEGVPGTGVAAGWFKTAGNQIVDSAGNPV

SEQ ID NO: 1354012 - protein, 21 aa, Mycobacterium
TEIGGRPTALVASERSNFVAV

SEQ ID NO: 1354013 - protein, 27 aa, Mycobacterium
TEKGTVTVTPWGTFRYTPSATARHAAA

SEQ ID NO: 1354014 - protein, 18 aa, Mycobacterium
TELAKALAEFLFDDERAM

SEQ ID NO: 1354015 - protein, 19 aa, Mycobacterium
TELDPRIWDGMQMKPDVRE

SEQ ID NO: 1354016 - protein, 20 aa, Mycobacterium
TELELQWGRTIGQFPSPYTR

SEQ ID NO: 1354017 - protein, 29 aa, Mycobacterium
TENLPLLEPLRWLGLTGIADALNGPLKAI

SEQ ID NO: 1354018 - protein, 18 aa, Mycobacterium
TETARIPLLDNVSTHGPT

SEQ ID NO: 1354019 - protein, 20 aa, Mycobacterium
TFCAFPASVPDIVMTNILSN

SEQ ID NO: 1354020 - protein, 24 aa, Mycobacterium
TFDFRYETGAGHWSAERKAALLGA

SEQ ID NO: 1354021 - protein, 29 aa, Mycobacterium
TFLGFERWAPEMPWEISIGRTVRPGELTV

SEQ ID NO: 1354022 - protein, 31 aa, Mycobacterium
TFNYDSWVIGNGYYWLSYVSYSGTRRYVAEA

SEQ ID NO: 1354023 - protein, 27 aa, Mycobacterium
TFPDAHAANGWCDARAIPVDECYAKVI

SEQ ID NO: 1354024 - protein, 30 aa, Mycobacterium; identical to SEQ ID NO: 1255741

SEQ ID NO: 1354025 - protein, 26 aa, Mycobacterium
TFTGGVWWDCYRDLVSNVVLLDKITG

SEQ ID NO: 1354026 - protein, 26 aa, Mycobacterium
TFTLEWPRGSGIFKEFPEIDRVAWFG

SEQ ID NO: 1354027 - protein, 22 aa, Mycobacterium
TGAFLNGYKPYFGHDEEGNPIY

SEQ ID NO: 1354028 - protein, 20 aa, Mycobacterium
TGAGRGGMPFLSRVNENAVA

SEQ ID NO: 1354029 - protein, 27 aa, Mycobacterium
TGAPALLFISWPDRGPLLGADLEGRLY

SEQ ID NO: 1354030 - protein, 18 aa, Mycobacterium
TGDPLWDRHADVPMQPAS

SEQ ID NO: 1354031 - protein, 17 aa, Mycobacterium
TGDTVRIAGIRVGTVKD

SEQ ID NO: 1354032 - protein, 25 aa, Mycobacterium
TGELFCARDPFGIKPLYIATGPGGT

SEQ ID NO: 1354033 - protein, 23 aa, Mycobacterium
TGELKRGQVLAGDHVTVEINTVF

SEQ ID NO: 1354034 - protein, 21 aa, Mycobacterium
TGFDFPFAAMGSVHIENHITQ

SEQ ID NO: 1354035 - protein, 24 aa, Mycobacterium
TGGDAALVGGVWGFSVPKTEGMQC

SEQ ID NO: 1354036 - protein, 28 aa, Mycobacterium
TGHPNCAAPACLHWGAMWGPASRADYVD

SEQ ID NO: 1354037 - protein, 21 aa, Mycobacterium
TGIKVTYRQGGDTELGNQLIA

SEQ ID NO: 1354038 - protein, 26 aa, Mycobacterium
TGIYGHSRACAWAIADGMIGRSTTPD

SEQ ID NO: 1354039 - protein, 25 aa, Mycobacterium
TGIYGHSRACAWAIADGVIGRSTTP

SEQ ID NO: 1354040 - protein, 18 aa, Mycobacterium
TGKILALVSAPSYDPNLL

SEQ ID NO: 1354041 - protein, 30 aa, Mycobacterium
TGKVVLINVWGSWCAPCRTETPELETVYGE

SEQ ID NO: 1354042 - protein, 31 aa, Mycobacterium
TGLDIRPNPGIGHPCWANYFPVTRAVPEQPS

SEQ ID NO: 1354043 - protein, 24 aa, Mycobacterium
TGLVGLKEKYGLDIAPANFVAISD

SEQ ID NO: 1354044 - protein, 19 aa, Mycobacterium
TGMDMRAYMNMFMRHQELR

SEQ ID NO: 1354045 - protein, 19 aa, Mycobacterium
TGPGDWTSLASRDIAVSDV

SEQ ID NO: 1354046 - protein, 24 aa, Mycobacterium
TGQSPFEYHFLRFDQDGATIATAD

SEQ ID NO: 1354047 - protein, 19 aa, Mycobacterium
TGRRPELYGTGANVRDWIH

SEQ ID NO: 1354048 - protein, 17 aa, Mycobacterium
TGRRWYLMCFDRDRVDW

SEQ ID NO: 1354049 - protein, 24 aa, Mycobacterium
TGSMAAAWTRKGVRVNCIACGAIR

SEQ ID NO: 1354050 - protein, 18 aa, Mycobacterium
TGTLPSALDRACIAIALF

SEQ ID NO: 1354051 - protein, 17 aa, Mycobacterium
TGTMLGGFAMGNFANPV

SEQ ID NO: 1354052 - protein, 19 aa, Mycobacterium
TGVADWLSTQGWQVTVIGA

SEQ ID NO: 1354053 - protein, 29 aa, Mycobacterium
TGVINNIFTPWTYEKWPTVFTQLETLDGD

SEQ ID NO: 1354054 - protein, 17 aa, Mycobacterium
TGVQFSGFVQGDRNFDV

SEQ ID NO: 1354055 - protein, 19 aa, Mycobacterium
TGVTGASIFPLWPPAPPTF

SEQ ID NO: 1354056 - protein, 19 aa, Mycobacterium
TGWTPRKVEFDVEAARAAG

SEQ ID NO: 1354057 - protein, 17 aa, Mycobacterium
TIAAIWSQAGPNLVIEP

SEQ ID NO: 1354058 - protein, 18 aa, Mycobacterium
TIADGAGTFDIISPYKIM

SEQ ID NO: 1354059 - protein, 23 aa, Mycobacterium
TIAKACAPAGITVEDAAAEGIGP

SEQ ID NO: 1354060 - protein, 25 aa, Mycobacterium
TIAYRNAPMGFGWPDGIAEVPALQH

SEQ ID NO: 1354061 - protein, 24 aa, Mycobacterium
TIPGVLKNAIDWLSRPWGNGALKG

SEQ ID NO: 1354062 - protein, 18 aa, Mycobacterium
TIPKAMFDAVGRVYDSLI

SEQ ID NO: 1354063 - protein, 18 aa, Mycobacterium
TIRGDWRSFKGFNDTYNA

SEQ ID NO: 1354064 - protein, 19 aa, Mycobacterium
TIVLDDGWTVVTADGSRAA

SEQ ID NO: 1354065 - protein, 21 aa, Mycobacterium
TKAAADMLVRAWVRSYRVAAT

SEQ ID NO: 1354066 - protein, 27 aa, Mycobacterium
TKATRLPERWADHFEVLTARDGMDDWP

SEQ ID NO: 1354067 - protein, 21 aa, Mycobacterium
TKDRLVGVVLIGRDRAIVGNA

SEQ ID NO: 1354068 - protein, 22 aa, Mycobacterium
TKIERQGWHAVLTMKLNGDVAL

SEQ ID NO: 1354069 - protein, 21 aa, Mycobacterium
TKNFPVRQLVTNTGWGTGLDI

SEQ ID NO: 1354070 - protein, 28 aa, Mycobacterium
TKPDPILPLRISFVEMVPRTTSTTEKVR

SEQ ID NO: 1354071 - protein, 31 aa, Mycobacterium
TKSSVRWETKDRPALAAAFQNAGVDYTIQNA

SEQ ID NO: 1354072 - protein, 18 aa, Mycobacterium
TKYEYWNGTSWTPGNPAA

SEQ ID NO: 1354073 - protein, 20 aa, Mycobacterium
TLAATWKFGPEKRNEWSYTT

SEQ ID NO: 1354074 - protein, 25 aa, Mycobacterium
TLAGRSMLSHALHAVAGLEARHLVV

SEQ ID NO: 1354075 - protein, 25 aa, Mycobacterium
TLDESACDAWVGRIRCGDTDRVTMF

SEQ ID NO: 1354076 - protein, 23 aa, Mycobacterium
TLGAPCANTSHFVFGTTDWGRLV

SEQ ID NO: 1354077 - protein, 26 aa, Mycobacterium
TLGGHSFYGGVLMNYSNPAHGFGLDN

SEQ ID NO: 1354078 - protein, 22 aa, Mycobacterium
TLLNLWASWCAPCREEMPVLDA

SEQ ID NO: 1354079 - protein, 38 aa, Mycobacterium
TLPDTYRILGREGLYGDFFGFYLCDAILKVNGKGGQPV

SEQ ID NO: 1354080 - protein, 26 aa, Mycobacterium
TLSDTRIPAVFSGPVGLTAISNPTYE

SEQ ID NO: 1354081 - protein, 25 aa, Mycobacterium
TLTDRAGGFSVVYRAGGRVVGTLDV

SEQ ID NO: 1354082 - protein, 17 aa, Mycobacterium
TLTLSFRQAEDNLHRTQ

SEQ ID NO: 1354083 - protein, 26 aa, Mycobacterium
TLTQAAWRTKPSWAVVATQDEAIDPR

SEQ ID NO: 1354084 - protein, 24 aa, Mycobacterium
TLTRRWGTGPALMFVSLNPSVADE

SEQ ID NO: 1354085 - protein, 17 aa, Mycobacterium
TLTYRWDFGDGNSSTEA

SEQ ID NO: 1354086 - protein, 24 aa, Mycobacterium
TMIPRPLVERELPGLLLEPEEASA

SEQ ID NO: 1354087 - protein, 25 aa, Mycobacterium
TMIPRPLVERELSELLLSPERAAAE

SEQ ID NO: 1354088 - protein, 28 aa, Mycobacterium
TMKKFPKFLAASLLPLGAALAVAAPAQA

SEQ ID NO: 1354089 - protein, 26 aa, Mycobacterium
TMPIGVATLEQWRRIVDLNLWGVIYG

SEQ ID NO: 1354090 - protein, 18 aa, Mycobacterium
TNAPMCSDIGIAFGQVAE

SEQ ID NO: 1354091 - protein, 22 aa, Mycobacterium
TNDPICSLGRDFDAHVRYPQSG

SEQ ID NO: 1354092 - protein, 17 aa, Mycobacterium
TNGKLVQAGEVFDSAPY

SEQ ID NO: 1354093 - protein, 26 aa, Mycobacterium
TNGLTYPFTFTFERSGEVTVQVPISA

SEQ ID NO: 1354094 - protein, 17 aa, Mycobacterium
TNLPGWTPMSDGKFTTL

SEQ ID NO: 1354095 - protein, 24 aa, Mycobacterium
TNPPTEGSWAWLPDEAAGSRLHWR

SEQ ID NO: 1354096 - protein, 23 aa, Mycobacterium
TNPPTEGSWAWLPDESAGSRLHW

SEQ ID NO: 1354097 - protein, 25 aa, Mycobacterium
TNSPACGFGTCTVTATTTDPDGDDL

SEQ ID NO: 1354098 - protein, 18 aa, Mycobacterium
TPAFEWFYQSGLSTIMPV

SEQ ID NO: 1354099 - protein, 19 aa, Mycobacterium
TPARHFSGRLFARDSTLWS

SEQ ID NO: 1354100 - protein, 27 aa, Mycobacterium
TPARKLREIRMALTLDKTFTKPEILTR

SEQ ID NO: 1354101 - protein, 20 aa, Mycobacterium
TPDAFARELAATGDPARAVG

SEQ ID NO: 1354102 - protein, 20 aa, Mycobacterium
TPDDLRAVLRLLNDDVERRQ

SEQ ID NO: 1354103 - protein, 22 aa, Mycobacterium
TPDHWWAWQTKAWSAGEREPRA

SEQ ID NO: 1354104 - protein, 19 aa, Mycobacterium
TPEEYPRLLADTFGADARA

SEQ ID NO: 1354105 - protein, 21 aa, Mycobacterium
TPEGPWSAPVTVATSKQYPGL

SEQ ID NO: 1354106 - protein, 20 aa, Mycobacterium
TPEPRRFITVIPQGRSDAVV

SEQ ID NO: 1354107 - protein, 17 aa, Mycobacterium
TPGRAYALGGAHVLGIP

SEQ ID NO: 1354108 - protein, 24 aa, Mycobacterium
TPPELKVAVQGVARLSQTIDARDA

SEQ ID NO: 1354109 - protein, 18 aa, Mycobacterium
TPPTRPGVVVAPADGLIC

SEQ ID NO: 1354110 - protein, 19 aa, Mycobacterium
TPPWWEVLDADRPVVHVTQ

SEQ ID NO: 1354111 - protein, 18 aa, Mycobacterium
TPQGWMKALRAYNQSDPY

SEQ ID NO: 1354112 - protein, 24 aa, Mycobacterium
TPRGDGRLAGTIPLDRTTPAYQLP

SEQ ID NO: 1354113 - protein, 28 aa, Mycobacterium
TPRGQRTPERWFVVWLGTATNPIPQAEA

SEQ ID NO: 1354114 - protein, 27 aa, Mycobacterium
TPTSGVFWGLGANDWTSVFATDPNGDS

SEQ ID NO: 1354115 - protein, 19 aa, Mycobacterium
TQELPGWLQANRDVKPTGS

SEQ ID NO: 1354116 - protein, 20 aa, Mycobacterium
TQELPQWLASHRNISPTGHA

SEQ ID NO: 1354117 - protein, 25 aa, Mycobacterium
TQFTTFLIGLPIVGSSILAPVIMTL

SEQ ID NO: 1354118 - protein, 19 aa, Mycobacterium
TQNGQFLLSITGQVNATDP

SEQ ID NO: 1354119 - protein, 20 aa, Mycobacterium
TQNMGRKFLQSIGLLPTPTG

SEQ ID NO: 1354120 - protein, 22 aa, Mycobacterium
TQRKAVAALVELVSENSLAQLG

SEQ ID NO: 1354121 - protein, 18 aa, Mycobacterium
TRAAIRYDNVIGGRYLAL

SEQ ID NO: 1354122 - protein, 26 aa, Mycobacterium
TRASENFEALLSYFLEQYDNDATPIQ

SEQ ID NO: 1354123 - protein, 20 aa, Mycobacterium
TRAVIRYDDLIGGRYLGLEE

SEQ ID NO: 1354124 - protein, 21 aa, Mycobacterium
TRDLMAIVARVTWGAEPDAVS

SEQ ID NO: 1354125 - protein, 26 aa, Mycobacterium
TRFGLDAARLPIRFAESCDPADRAVA

SEQ ID NO: 1354126 - protein, 21 aa, Mycobacterium
TRGGRSYPYWNLVLAPGAAPV

SEQ ID NO: 1354127 - protein, 17 aa, Mycobacterium
TRIGVAAAVCAVLAATA

SEQ ID NO: 1354128 - protein, 21 aa, Mycobacterium
TRLGPGGAFLQPALERDNLDL

SEQ ID NO: 1354129 - protein, 17 aa, Mycobacterium
TRLRTVMADLGMPLPPA

SEQ ID NO: 1354130 - protein, 23 aa, Mycobacterium
TRNMWGLPQLGRWKWHDPDVHAQ

SEQ ID NO: 1354131 - protein, 22 aa, Mycobacterium
TRNMWGLPQLGRWKWHDPDVHI

SEQ ID NO: 1354132 - protein, 21 aa, Mycobacterium
TRRRNVGAYTWGFFAGKTQTF

SEQ ID NO: 1354133 - protein, 21 aa, Mycobacterium
TRRVGKAFRAHNIEAGLAGNA

SEQ ID NO: 1354134 - protein, 17 aa, Mycobacterium
TRSELGDLCEVTPAIGA

SEQ ID NO: 1354135 - protein, 18 aa, Mycobacterium
TRSLSFLTTFPWAKELIP

SEQ ID NO: 1354136 - protein, 19 aa, Mycobacterium
TRTAALPFVLALAAMLGGA

SEQ ID NO: 1354137 - protein, 20 aa, Mycobacterium
TRVECSCVGLQPGQAYTTAQ

SEQ ID NO: 1354138 - protein, 17 aa, Mycobacterium
TRYDVMVVKAEYDGIAD

SEQ ID NO: 1354139 - protein, 21 aa, Mycobacterium
TRYFTPRFDAVPFRAASAPGS

SEQ ID NO: 1354140 - protein, 20 aa, Mycobacterium
TRYLPPAAVEPYLEMARREH

SEQ ID NO: 1354141 - protein, 24 aa, Mycobacterium
TSAPRCVGNTLLLNGRTYSPPYVI

SEQ ID NO: 1354142 - protein, 23 aa, Mycobacterium
TSATAEMGRAFLAQAGVGPDAVS

SEQ ID NO: 1354143 - protein, 25 aa, Mycobacterium
TSGCGWRGANSISLPGTEGGGSGSY

SEQ ID NO: 1354144 - protein, 25 aa, Mycobacterium
TSGRLPVEPQFRCELAVDGVVVATA

SEQ ID NO: 1354145 - protein, 20 aa, Mycobacterium
TSGRRVALALAPAGAGKTTA

SEQ ID NO: 1354146 - protein, 17 aa, Mycobacterium
TSGVWQGHWRDPGSRST

SEQ ID NO: 1354147 - protein, 20 aa, Mycobacterium
TSGVWQGHWRDPGSRSTICG

SEQ ID NO: 1354148 - protein, 17 aa, Mycobacterium
TSHLELRSPAGEVLPGY

SEQ ID NO: 1354149 - protein, 19 aa, Mycobacterium
TSLVTGWASIHGFPVGILA

SEQ ID NO: 1354150 - protein, 24 aa, Mycobacterium
TSMAGLMAVPGMSAYCASKFAVEG

SEQ ID NO: 1354151 - protein, 27 aa, Mycobacterium
TSMGVPRLPVPLLDAGRLADRLIVPTV

SEQ ID NO: 1354152 - protein, 30 aa, Mycobacterium
TSNPFRADDFWLGGDPMYRAVAELFTGDRE

SEQ ID NO: 1354153 - protein, 18 aa, Mycobacterium
TSRHIYAQVVDRSTGLVV

SEQ ID NO: 1354154 - protein, 17 aa, Mycobacterium
TSRVFAVAASALLFGSA

SEQ ID NO: 1354155 - protein, 31 aa, Mycobacterium
TSTKVTWGSMIVDWLYSIGIRSRRMGTDWLD

SEQ ID NO: 1354156 - protein, 24 aa, Mycobacterium
TSTRVSSPGWFTAKVTGQVRATDP

SEQ ID NO: 1354157 - protein, 19 aa, Mycobacterium
TSYFSFEVLENVFDTLVEP

SEQ ID NO: 1354158 - protein, 17 aa, Mycobacterium
TTACIQMQGASGPGQCA

SEQ ID NO: 1354159 - protein, 18 aa, Mycobacterium
TTAMAALAHAWRSSGGHV

SEQ ID NO: 1354160 - protein, 23 aa, Mycobacterium
TTDELPLTRLIRAVLGDTVADAS

SEQ ID NO: 1354161 - protein, 40 aa, Mycobacterium
TTDPPVEGAFYWLNNREVRWRPAQYWKPGTTVEVEVKAYG

SEQ ID NO: 1354162 - protein, 18 aa, Mycobacterium
TTDVIPGYPVEQALPVVR

SEQ ID NO: 1354163 - protein, 25 aa, Mycobacterium
TTDWGRLVFCGSPRRYAPRYFRSPP

SEQ ID NO: 1354164 - protein, 17 aa, Mycobacterium
TTEETLAALSLVLNGGG

SEQ ID NO: 1354165 - protein, 18 aa, Mycobacterium
TTGEVVWDAGNTVEQLAV

SEQ ID NO: 1354166 - protein, 18 aa, Mycobacterium
TTIWPKENLTKWFRGDYG

SEQ ID NO: 1354167 - protein, 40 aa, Mycobacterium
TTNPPVEGAFYWLNNREVRWRPAEYWKPGTKVEVAVNAYG

SEQ ID NO: 1354168 - protein, 23 aa, Mycobacterium
TTPDHWWAWQTKAWSAGEREPRA

SEQ ID NO: 1354169 - protein, 22 aa, Mycobacterium
TTPREFWSFLLTGGSKVTEVPS

SEQ ID NO: 1354170 - protein, 25 aa, Mycobacterium
TTSDLAWRVVVVVPDTGEMSPSGAT

SEQ ID NO: 1354171 - protein, 22 aa, Mycobacterium
TTSWGRLVFCGSPRRYEPRYFR

SEQ ID NO: 1354172 - protein, 29 aa, Mycobacterium
TTTARPDALKEFGDGVAKAVNDTRITLKK

SEQ ID NO: 1354173 - protein, 25 aa, Mycobacterium
TTTPPVEGGWAWLPDEAGGSRVHWR

SEQ ID NO: 1354174 - protein, 29 aa, Mycobacterium
TTTPWQIIDVARRWDGWADWPDDSSNATA

SEQ ID NO: 1354175 - protein, 22 aa, Mycobacterium
TTWVPGSPWLAGVDPAVVGDPI

SEQ ID NO: 1354176 - protein, 17 aa, Mycobacterium
TVAPGRRVYGRQAIEYV

SEQ ID NO: 1354177 - protein, 17 aa, Mycobacterium
TVDDFDRIIGINLRGAW

SEQ ID NO: 1354178 - protein, 23 aa, Mycobacterium
TVDDPRYVIGIMMDAPHRAADGS

SEQ ID NO: 1354179 - protein, 24 aa, Mycobacterium
TVDGARYGVPFYNYALGYLYNADD

SEQ ID NO: 1354180 - protein, 19 aa, Mycobacterium
TVDGYDFAPSFSIWTTIEE

SEQ ID NO: 1354181 - protein, 23 aa, Mycobacterium
TVDSEWGWTAPIYQKSGVWYVKH

SEQ ID NO: 1354182 - protein, 23 aa, Mycobacterium
TVEKLLPGVIAFRDKVLSQDPQA

SEQ ID NO: 1354183 - protein, 23 aa, Mycobacterium
TVFTGPAGSAWRDNLRTVGAATG

SEQ ID NO: 1354184 - protein, 20 aa, Mycobacterium
TVGFDCSGLTRFAFAGVGVL

SEQ ID NO: 1354185 - protein, 20 aa, Mycobacterium
TVGKRICEMLTTGLTGNPNP

SEQ ID NO: 1354186 - protein, 26 aa, Mycobacterium
TVGTYAVKYPASWDFSQVGLGATDAS

SEQ ID NO: 1354187 - protein, 25 aa, Mycobacterium
TVLSPRAGLVMDVDAKVKYRGIQVG

SEQ ID NO: 1354188 - protein, 18 aa, Mycobacterium
TVMLDYTIGIGVPQGDHQ

SEQ ID NO: 1354189 - protein, 19 aa, Mycobacterium
TVNASMEFVGPDATAAMNQ

SEQ ID NO: 1354190 - protein, 23 aa, Mycobacterium
TVNSRGSFTYTPSAAARHAAAAT

SEQ ID NO: 1354191 - protein, 27 aa, Mycobacterium
TVPRASAELTRWSPDRAHRWHRAQGWL

SEQ ID NO: 1354192 - protein, 19 aa, Mycobacterium
TVQAHIPLAALAPILRPEF

SEQ ID NO: 1354193 - protein, 18 aa, Mycobacterium
TVQPDPFAEPGWFRTDDV

SEQ ID NO: 1354194 - protein, 23 aa, Mycobacterium
TVTFSDGRRGVVSVPITVTIAPA

SEQ ID NO: 1354195 - protein, 17 aa, Mycobacterium
TVTGTWLGGRRIDLDEF

SEQ ID NO: 1354196 - protein, 27 aa, Mycobacterium
TVTGYTAGGALEWDMSEVFQGSYCDAD

SEQ ID NO: 1354197 - protein, 24 aa, Mycobacterium
TVTLPAVSVAPPLISVTPTTTATG

SEQ ID NO: 1354198 - protein, 18 aa, Mycobacterium
TVVGTLWIGDRHWDFTAV

SEQ ID NO: 1354199 - protein, 18 aa, Mycobacterium
TVVLNLWAYWCGPCADEL

SEQ ID NO: 1354200 - protein, 20 aa, Mycobacterium
TVVPDPRYVAVSEPDQLATE

SEQ ID NO: 1354201 - protein, 24 aa, Mycobacterium
TVYFSSARGLDRMDVFTALERPSL

SEQ ID NO: 1354202 - protein, 18 aa, Mycobacterium
TWAAFASTVFQRWAAVEQ

SEQ ID NO: 1354203 - protein, 20 aa, Mycobacterium
TWDALARCEAGGNWAINTGN

SEQ ID NO: 1354204 - protein, 23 aa, Mycobacterium
TWNDTRVVLGFNRLSIIDIAHSH

SEQ ID NO: 1354205 - protein, 22 aa, Mycobacterium
TWNTLYRKWLTVLGPAPAPPAA

SEQ ID NO: 1354206 - protein, 22 aa, Mycobacterium
TYAVRYPASWDFLQVAAGANDA

SEQ ID NO: 1354207 - protein, 22 aa, Mycobacterium
TYKAWFPLTHRWLGFEDAHITF

SEQ ID NO: 1354208 - protein, 18 aa, Mycobacterium
TYLMGSDVLYDWADGKPI

SEQ ID NO: 1354209 - protein, 27 aa, Mycobacterium
TYPRLKKTLLAGTRWGDQNAKLIPAPG

SEQ ID NO: 1354210 - protein, 17 aa, Mycobacterium
VAAALRRQLDSPTTSGE

SEQ ID NO: 1354211 - protein, 24 aa, Mycobacterium
VAAGETKPHWCVADNYRSRLITPG

SEQ ID NO: 1354212 - protein, 18 aa, Mycobacterium
VAAGIAIAALSVGVAAPA

SEQ ID NO: 1354213 - protein, 24 aa, Mycobacterium
VAAGSALAGWWVERAAHPGTSAVT

SEQ ID NO: 1354214 - protein, 23 aa, Mycobacterium
VAAIRISNVGNRTHVTAYFTNST

SEQ ID NO: 1354215 - protein, 27 aa, Mycobacterium
VAAPAHWPESAVAALRARVPHLTVVPD

SEQ ID NO: 1354216 - protein, 17 aa, Mycobacterium
VAAVVFPAFNHVLSAVF

SEQ ID NO: 1354217 - protein, 19 aa, Mycobacterium
VADESLWDPTLPKVLSAGA

SEQ ID NO: 1354218 - protein, 20 aa, Mycobacterium
VADMCREAGALLILDTSGGG

SEQ ID NO: 1354219 - protein, 23 aa, Mycobacterium
VADPALVPLYFIAREARKHVKVV

SEQ ID NO: 1354220 - protein, 25 aa, Mycobacterium
VADRPTRWGFFSSINTTFARHMAYF

SEQ ID NO: 1354221 - protein, 23 aa, Mycobacterium
VADRVVLCAGAIASAQLLMVSGV

SEQ ID NO: 1354222 - protein, 20 aa, Mycobacterium
VAEDHLDWHGSMAAYAGDKA

SEQ ID NO: 1354223 - protein, 22 aa, Mycobacterium
VAEDYPPLVLWVLGQENLADVA

SEQ ID NO: 1354224 - protein, 18 aa, Mycobacterium
VAGELDFGALGSSPVARG

SEQ ID NO: 1354225 - protein, 24 aa, Mycobacterium
VAGITVGLAEGWTLDRAVRYGIAA

SEQ ID NO: 1354226 - protein, 23 aa, Mycobacterium
VAGLEARHLVVVVGKDRERVAPA

SEQ ID NO: 1354227 - protein, 26 aa, Mycobacterium
VAGLRPGGEYFYRFRAEGYLSPAGRT

SEQ ID NO: 1354228 - protein, 23 aa, Mycobacterium
VAGRTQTYLPWDSWKKPYTEPPD

SEQ ID NO: 1354229 - protein, 22 aa, Mycobacterium
VAGSLLAALGIDADLDLPDIDG

SEQ ID NO: 1354230 - protein, 18 aa, Mycobacterium
VAGSRDDDGLAWVAQTAT

SEQ ID NO: 1354231 - protein, 18 aa, Mycobacterium
VAGTALLLAILLIAGAAL

SEQ ID NO: 1354232 - protein, 25 aa, Mycobacterium
VAHYRAVFAALRRRGLDPFVTVNHF

SEQ ID NO: 1354233 - protein, 26 aa, Mycobacterium
VAIDLREDWPAALRAAGFDSAAPTAW

SEQ ID NO: 1354234 - protein, 19 aa, Mycobacterium
VAIEYSRLAQWKFDPATAP

SEQ ID NO: 1354235 - protein, 27 aa, Mycobacterium
VAIHEILHSFGFMSFIERPGENVERTW

SEQ ID NO: 1354236 - protein, 17 aa, Mycobacterium
VALPGLIGFAGGSATAG

SEQ ID NO: 1354237 - protein, 20 aa, Mycobacterium
VAMAALLPLFAPAAAAQPQT

SEQ ID NO: 1354238 - protein, 32 aa, Mycobacterium
VAMEQAVAAPMCTRVLADFGARIIKVENPNGG

SEQ ID NO: 1354239 - protein, 17 aa, Mycobacterium
VANARLAYAAYEEVFLG

SEQ ID NO: 1354240 - protein, 24 aa, Mycobacterium
VANDKWWGTAPVTGRITVWPSSAD

SEQ ID NO: 1354241 - protein, 24 aa, Mycobacterium
VANIKARGRLIVGLDIGSNLFSFR

SEQ ID NO: 1354242 - protein, 33 aa, Mycobacterium
VANPMRPNGGILMRLHGWPTIPILEIPFPGASP

SEQ ID NO: 1354243 - protein, 23 aa, Mycobacterium
VAPEAMVGPLWRRDAVINFNGSV

SEQ ID NO: 1354244 - protein, 25 aa, Mycobacterium
VAPESLRFGLYGALVHPIEANGLGS

SEQ ID NO: 1354245 - protein, 18 aa, Mycobacterium
VAPGQVIPAPSVNNGQNP

SEQ ID NO: 1354246 - protein, 29 aa, Mycobacterium
VAPNGAVFFKTRQFASGSGDRLVRVSATG

SEQ ID NO: 1354247 - protein, 18 aa, Mycobacterium
VAPPPPAWVPPWMQQPQQ

SEQ ID NO: 1354248 - protein, 27 aa, Mycobacterium
VAQELFCARDPFGIKPLYLATGTGGTA

SEQ ID NO: 1354249 - protein, 17 aa, Mycobacterium
VARFPTVQNPYTVAVDP

SEQ ID NO: 1354250 - protein, 23 aa, Mycobacterium
VARRHWPALLASLSGDDGARWFL

SEQ ID NO: 1354251 - protein, 24 aa, Mycobacterium
VARRIVAKWKPAVRSMGSVAASVC

SEQ ID NO: 1354252 - protein, 18 aa, Mycobacterium
VASAEGKNALARALLSTG

SEQ ID NO: 1354253 - protein, 40 aa, Mycobacterium
VASALLRASGGWPWLAPGHDPGELLALLGRAATLSEGQPA

SEQ ID NO: 1354254 - protein, 25 aa, Mycobacterium
VATMPIEVWDDVMAVNVRSAMLTTK

SEQ ID NO: 1354255 - protein, 17 aa, Mycobacterium
VAVDVMLPAAHGGAAPL

SEQ ID NO: 1354256 - protein, 26 aa, Mycobacterium
VAVKQGWMCCVGADWMHLSTGVVGLS

SEQ ID NO: 1354257 - protein, 17 aa, Mycobacterium
VAVLGMPVGEVTKIVTK

SEQ ID NO: 1354258 - protein, 17 aa, Mycobacterium
VCALATFALLTVFAQFR

SEQ ID NO: 1354259 - protein, 17 aa, Mycobacterium
VCDMAWVIGLSQGLVSH

SEQ ID NO: 1354260 - protein, 20 aa, Mycobacterium
VCSDGRVSSAVFACGAAAVA

SEQ ID NO: 1354261 - protein, 20 aa, Mycobacterium
VCVCSCGQPSPPSPATPTTE

SEQ ID NO: 1354262 - protein, 20 aa, Mycobacterium
VCVCSCGQPSPQSPATLTTE

SEQ ID NO: 1354263 - protein, 17 aa, Mycobacterium
VDAAAALDLVGLVNAVV

SEQ ID NO: 1354264 - protein, 24 aa, Mycobacterium
VDAIDFARVPAIFVDSSQPDKLAR

SEQ ID NO: 1354265 - protein, 18 aa, Mycobacterium
VDALLIGMGERYDALITT

SEQ ID NO: 1354266 - protein, 18 aa, Mycobacterium
VDALLIGMGERYDVLITT

SEQ ID NO: 1354267 - protein, 25 aa, Mycobacterium
VDARAWLRDPAPLWRTNVEGLQRVL

SEQ ID NO: 1354268 - protein, 17 aa, Mycobacterium
VDAVGGVTMCPEAPISD

SEQ ID NO: 1354269 - protein, 17 aa, Mycobacterium
VDFRYFGTREQVYMSDT

SEQ ID NO: 1354270 - protein, 17 aa, Mycobacterium
VDFTEKWIRMQHEAGPT

SEQ ID NO: 1354271 - protein, 19 aa, Mycobacterium
VDGDAVWVALQREVKTDPK

SEQ ID NO: 1354272 - protein, 17 aa, Mycobacterium
VDGLRRWLTDTPVDAVV

SEQ ID NO: 1354273 - protein, 29 aa, Mycobacterium
VDGYQAPMCLLTRPAAYALRDAQQEFLEQ

SEQ ID NO: 1354274 - protein, 24 aa, Mycobacterium
VDHYAEIGLLGFALITDALGGVNV

SEQ ID NO: 1354275 - protein, 24 aa, Mycobacterium
VDKRLRPVIDSGYKRNDPKSESGG

SEQ ID NO: 1354276 - protein, 22 aa, Mycobacterium
VDLATCEVLWSMPRPGPDEAVE

SEQ ID NO: 1354277 - protein, 25 aa, Mycobacterium
VDMGAWPVPDLLAIARNYGTSLITL

SEQ ID NO: 1354278 - protein, 23 aa, Mycobacterium
VDNRLTKKPSFVQIMPTDTTFTT

SEQ ID NO: 1354279 - protein, 23 aa, Mycobacterium
VDNSLMVPIHWATFRLAPHPWAE

SEQ ID NO: 1354280 - protein, 33 aa, Mycobacterium
VDPAFRPTDFTSFLNPYWRGKFSVPISTNDSSI

SEQ ID NO: 1354281 - protein, 22 aa, Mycobacterium
VDPRAIPAFAAMFRRENIRSTA

SEQ ID NO: 1354282 - protein, 20 aa, Mycobacterium
VDPRVLESFLSTTTFTRELV

SEQ ID NO: 1354283 - protein, 24 aa, Mycobacterium
VDQAKRIADEIIQTGSASRASLGV

SEQ ID NO: 1354284 - protein, 23 aa, Mycobacterium
VDQHGRPAVSTAVVFTPKTPAPE

SEQ ID NO: 1354285 - protein, 24 aa, Mycobacterium
VDRSLRVAWTLADLAGRQVPGVDE

SEQ ID NO: 1354286 - protein, 22 aa, Mycobacterium
VDVSEGTPLFAPISLEVAEIPP

SEQ ID NO: 1354287 - protein, 17 aa, Mycobacterium
VDVTFSWFDTGSLQRER

SEQ ID NO: 1354288 - protein, 23 aa, Mycobacterium
VDWTGLPYLRFLMANTGRGQPLL

SEQ ID NO: 1354289 - protein, 21 aa, Mycobacterium
VDWYINATWLHEGEASPLWRA

SEQ ID NO: 1354290 - protein, 20 aa, Mycobacterium
VEALPAIVWYLDEPVADPAL

SEQ ID NO: 1354291 - protein, 23 aa, Mycobacterium
VEALRRFPGRPVRTATRNPAAPT

SEQ ID NO: 1354292 - protein, 31 aa, Mycobacterium
VEALRVAYRPPWELALHRWLDAVTPHRRTYG

SEQ ID NO: 1354293 - protein, 23 aa, Mycobacterium
VEATWPRRLVKQVHFPVGGQAKA

SEQ ID NO: 1354294 - protein, 17 aa, Mycobacterium
VEGHQRAGVTIIDPAST

SEQ ID NO: 1354295 - protein, 19 aa, Mycobacterium
VEGNEFCAFPGRPDDDAAA

SEQ ID NO: 1354296 - protein, 22 aa, Mycobacterium
VEGYLFPGPIALGILIDQDAAD

SEQ ID NO: 1354297 - protein, 17 aa, Mycobacterium
VEIMRWLRPGALIAVSK

SEQ ID NO: 1354298 - protein, 27 aa, Mycobacterium
VELDGPRVLIKFGVDKGVRLGDRTEAA

SEQ ID NO: 1354299 - protein, 19 aa, Mycobacterium
VELTRRASLIPSLVHTVQT

SEQ ID NO: 1354300 - protein, 18 aa, Mycobacterium
VENLKLLFRDTNATSEAV

SEQ ID NO: 1354301 - protein, 36 aa, Mycobacterium
VEQGYSLKVYDCYRPQRAVNDFVAWAKNLPDQRMKA

SEQ ID NO: 1354302 - protein, 36 aa, Mycobacterium
VESDEFDFMMALMHEMLHSFGILFAVRPGETTRRYW

SEQ ID NO: 1354303 - protein, 24 aa, Mycobacterium
VEVEGREGVDFTAIARRGDGRLVL

SEQ ID NO: 1354304 - protein, 35 aa, Mycobacterium; identical to SEQ ID NO: 1256080

SEQ ID NO: 1354305 - protein, 19 aa, Mycobacterium
VEYSVRFAKPVVLPAKAGL

SEQ ID NO: 1354306 - protein, 21 aa, Mycobacterium
VFAEQPFFVDIYYRDVDPENW

SEQ ID NO: 1354307 - protein, 17 aa, Mycobacterium
VFAMVLALTACGESVDT

SEQ ID NO: 1354308 - protein, 20 aa, Mycobacterium
VFAVVAGFIRTYLTATNGLD

SEQ ID NO: 1354309 - protein, 23 aa, Mycobacterium
VFGQLRFEPRRGFTAEFTNVGGL

SEQ ID NO: 1354310 - protein, 26 aa, Mycobacterium
VFNFPPDGTHGWGYWGAQLGAMKPDI

SEQ ID NO: 1354311 - protein, 27 aa, Mycobacterium
VFNFPPKGTHSWGYWGSQLQAMKPDLL

SEQ ID NO: 1354312 - protein, 26 aa, Mycobacterium
VFNFPPNGTHSWGYWGAQLQAMKADI

SEQ ID NO: 1354313 - protein, 21 aa, Mycobacterium
VFTDRGWRWGGDWRTPKDYQH

SEQ ID NO: 1354314 - protein, 27 aa, Mycobacterium
VFYKNGAPIVWDRGRELGMTNRIDRVP

SEQ ID NO: 1354315 - protein, 19 aa, Mycobacterium
VGAAARALAGRLVAAGTVI

SEQ ID NO: 1354316 - protein, 23 aa, Mycobacterium
VGAFASDFVVAWRTATANQRDSL

SEQ ID NO: 1354317 - protein, 26 aa, Mycobacterium
VGALDMVKCLNWPSGSAPKEPSELEI

SEQ ID NO: 1354318 - protein, 26 aa, Mycobacterium
VGAQPQLVLLSWPEDGPVIGIDPIGT

SEQ ID NO: 1354319 - protein, 24 aa, Mycobacterium
VGARLEGPDGMWAEVTITATSLDP

SEQ ID NO: 1354320 - protein, 20 aa, Mycobacterium
VGCACGVLFGAAPSHADPAE

SEQ ID NO: 1354321 - protein, 17 aa, Mycobacterium
VGCVPTTSMGRLFDAVS

SEQ ID NO: 1354322 - protein, 25 aa, Mycobacterium
VGGAHPQTWFKAFNYDLGARAPITF

SEQ ID NO: 1354323 - protein, 25 aa, Mycobacterium
VGGAHPQTWFKAFNYDLGARTPITF

SEQ ID NO: 1354324 - protein, 25 aa, Mycobacterium
VGGTWRINTYPGLACDVKSHLYSYS

SEQ ID NO: 1354325 - protein, 18 aa, Mycobacterium
VGGVAALAVTLGITLAGC

SEQ ID NO: 1354326 - protein, 18 aa, Mycobacterium
VGGVVQDFMGFTVAGPDH

SEQ ID NO: 1354327 - protein, 21 aa, Mycobacterium
VGHIRIDGGYQPRFVRDAQAQ

SEQ ID NO: 1354328 - protein, 17 aa, Mycobacterium
VGIDPIVHVSSFTALFR

SEQ ID NO: 1354329 - protein, 19 aa, Mycobacterium
VGISCLSEASGKGFTFSAD

SEQ ID NO: 1354330 - protein, 23 aa, Mycobacterium
VGIVCGGISLAALTIDEGEIDGV

SEQ ID NO: 1354331 - protein, 33 aa, Mycobacterium
VGKGTRVGLFFPNGAEWVTWWLAVSRVGAVAVP

SEQ ID NO: 1354332 - protein, 20 aa, Mycobacterium
VGLEPGHEYDWPRQGEIDIV

SEQ ID NO: 1354333 - protein, 27 aa, Mycobacterium
VGLRVLRGFSSLIGIDIYGLIGQALES

SEQ ID NO: 1354334 - protein, 22 aa, Mycobacterium
VGNHYVVRNVSWNPKVVAGQTV

SEQ ID NO: 1354335 - protein, 19 aa, Mycobacterium
VGPGGAFLQPALQRANLTL

SEQ ID NO: 1354336 - protein, 18 aa, Mycobacterium
VGQKVLPAQALPGDLIFY

SEQ ID NO: 1354337 - protein, 18 aa, Mycobacterium
VGSGTWRFGPAHAAARGG

SEQ ID NO: 1354338 - protein, 23 aa, Mycobacterium
VGVCGDARPVLKPELDPRRTVGA

SEQ ID NO: 1354339 - protein, 17 aa, Mycobacterium
VGVKLPRSSGEMYKVGQ

SEQ ID NO: 1354340 - protein, 27 aa, Mycobacterium
VGYQIGCGISLNVVKLNGSVGITPSVT

SEQ ID NO: 1354341 - protein, 24 aa, Mycobacterium
VHVCGDPPAVALLHVRRRQGTATD

SEQ ID NO: 1354342 - protein, 26 aa, Mycobacterium
VIALPPDWANYGAIIKAFSDKYGIKV

SEQ ID NO: 1354343 - protein, 25 aa, Mycobacterium
VIAMVKELLKAIGITQTGGDGSSPL

SEQ ID NO: 1354344 - protein, 23 aa, Mycobacterium
VIDVVLAPVRFVGAVATDVLELV

SEQ ID NO: 1354345 - protein, 18 aa, Mycobacterium
VIEGGSWFYTSTTSPSGR

SEQ ID NO: 1354346 - protein, 26 aa, Mycobacterium
VIHNYRWRLSLAPGESRYDADEQRLA

SEQ ID NO: 1354347 - protein, 17 aa, Mycobacterium
VIPKSWDVPPRADGVYS

SEQ ID NO: 1354348 - protein, 21 aa, Mycobacterium
VIRNYFVANPQEWADLQRIAQ

SEQ ID NO: 1354349 - protein, 21 aa, Mycobacterium
VISRRGLLMSAATLAVVGVSV

SEQ ID NO: 1354350 - protein, 18 aa, Mycobacterium
VITADGVYQYTYDESTGK

SEQ ID NO: 1354351 - protein, 27 aa, Mycobacterium
VITRGGRSCPYWNLVLAPGAAPVPLDV

SEQ ID NO: 1354352 - protein, 24 aa, Mycobacterium
VKAMARPTLRHRIALRPEAELEGA

SEQ ID NO: 1354353 - protein, 21 aa, Mycobacterium
VKCAAVAAASLLVLAGCGSSD

SEQ ID NO: 1354354 - protein, 22 aa, Mycobacterium
VKDFARVFGVSGEQRGEVGEAD

SEQ ID NO: 1354355 - protein, 21 aa, Mycobacterium
VKIERQGWHALATIKLDGDIE

SEQ ID NO: 1354356 - protein, 20 aa, Mycobacterium
VKLVGEYDTGWVYSTEGAEY

SEQ ID NO: 1354357 - protein, 20 aa, Mycobacterium
VKRMSVGHGVSWTSGVAVRT

SEQ ID NO: 1354358 - protein, 19 aa, Mycobacterium
VKSRLNVVTIGGIENPDGG

SEQ ID NO: 1354359 - protein, 36 aa, Mycobacterium
VKTDPKGVARIGRYTPADDRWEWFGYQLDSTDTEGD

SEQ ID NO: 1354360 - protein, 17 aa, Mycobacterium
VKTKSLLGTKIFEVTPR

SEQ ID NO: 1354361 - protein, 24 aa, Mycobacterium
VKTSWQGAGGIGGFFEKTFAPLGL

SEQ ID NO: 1354362 - protein, 19 aa, Mycobacterium
VKVLELDLGQGELVEPVKF

SEQ ID NO: 1354363 - protein, 17 aa, Mycobacterium
VKVVLSGEGADELFGGY

SEQ ID NO: 1354364 - protein, 23 aa, Mycobacterium
VLAALVYVGWRVARMNANRPRTR

SEQ ID NO: 1354365 - protein, 21 aa, Mycobacterium
VLAGAIVHFSSPGPAPAAPEA

SEQ ID NO: 1354366 - protein, 17 aa, Mycobacterium
VLAHELLHLALHSHERS

SEQ ID NO: 1354367 - protein, 26 aa, Mycobacterium
VLARAAAGATRWLVLSGPPGIGKTRL

SEQ ID NO: 1354368 - protein, 17 aa, Mycobacterium
VLATCVFLAALTGCSPG

SEQ ID NO: 1354369 - protein, 20 aa, Mycobacterium
VLDPAGQVLTNFHVVQGADR

SEQ ID NO: 1354370 - protein, 18 aa, Mycobacterium
VLDPGGQVLTNFHVVQGA

SEQ ID NO: 1354371 - protein, 24 aa, Mycobacterium
VLDRKHRVAAIFLRALLAEDLRPV

SEQ ID NO: 1354372 - protein, 19 aa, Mycobacterium
VLENPLLVWQNVFTNSFTQ

SEQ ID NO: 1354373 - protein, 26 aa, Mycobacterium
VLEPDLPPGPFLTGIELNMAFAGDRR

SEQ ID NO: 1354374 - protein, 24 aa, Mycobacterium
VLEPMAGKIIHCGASGAGQAAKLC

SEQ ID NO: 1354375 - protein, 19 aa, Mycobacterium
VLGDALARVRLPILTLLSI

SEQ ID NO: 1354376 - protein, 17 aa, Mycobacterium
VLHHGPTPWDMTNNLSG

SEQ ID NO: 1354377 - protein, 17 aa, Mycobacterium
VLLDRARMQAVTGAGEH

SEQ ID NO: 1354378 - protein, 18 aa, Mycobacterium
VLLIGGWAYQTANRLDRL

SEQ ID NO: 1354379 - protein, 20 aa, Mycobacterium
VLMGRLITFSGVATVSHETL

SEQ ID NO: 1354380 - protein, 31 aa, Mycobacterium; identical to SEQ ID NO: 1283842

SEQ ID NO: 1354381 - protein, 37 aa, Mycobacterium
VLNRPKLGFPVPIRHWLRSGELLDWAYGMVGTSGAGD

SEQ ID NO: 1354382 - protein, 21 aa, Mycobacterium
VLPMQQLRVSFVTDNPGVWML

SEQ ID NO: 1354383 - protein, 17 aa, Mycobacterium
VLRGYGLPVDAPSVPVL

SEQ ID NO: 1354384 - protein, 20 aa, Mycobacterium
VLRLRPVEVVSAEALQLPLW

SEQ ID NO: 1354385 - protein, 21 aa, Mycobacterium
VLRYHRERALPAVAMCVSNTY

SEQ ID NO: 1354386 - protein, 17 aa, Mycobacterium
VLSGKGFTKGNVGNNDG

SEQ ID NO: 1354387 - protein, 26 aa, Mycobacterium
VLSPGEEARCLEALRQAAYSAQFVVA

SEQ ID NO: 1354388 - protein, 24 aa, Mycobacterium
VLTEADFPPGVRYERVLNEPRDDN

SEQ ID NO: 1354389 - protein, 19 aa, Mycobacterium
VLTEFPPLIEHFAETRDLF

SEQ ID NO: 1354390 - protein, 19 aa, Mycobacterium
VLTEFPPLIQHFADTRDLF

SEQ ID NO: 1354391 - protein, 25 aa, Mycobacterium
VLTPGRRLAIIGAGFIGLEIAATAA

SEQ ID NO: 1354392 - protein, 24 aa, Mycobacterium
VLWTAGVEAVRFARHVAEVLGADT

SEQ ID NO: 1354393 - protein, 21 aa, Mycobacterium
VMILTEWKQFVALDPAALGEV

SEQ ID NO: 1354394 - protein, 18 aa, Mycobacterium
VMVIGQVTPGQWSWVDRD

SEQ ID NO: 1354395 - protein, 17 aa, Mycobacterium
VNAFWSLTMYELPASLL

SEQ ID NO: 1354396 - protein, 24 aa, Mycobacterium
VNAGSRVTKLWWPQTGAPKLSLTT

SEQ ID NO: 1354397 - protein, 19 aa, Mycobacterium
VNAPVVISYRVDGFDDPTS

SEQ ID NO: 1354398 - protein, 25 aa, Mycobacterium
VNATSGKEGFAFASPNGSDRVASVT

SEQ ID NO: 1354399 - protein, 23 aa, Mycobacterium
VNDYGGYMSIGFDSSKVPPVTSV

SEQ ID NO: 1354400 - protein, 36 aa, Mycobacterium
VNGSVIQHWTVTGLKPSSDVIPYRPVGTLWEATATD

SEQ ID NO: 1354401 - protein, 17 aa, Mycobacterium
VNLKGTFVVLRAALAQM

SEQ ID NO: 1354402 - protein, 25 aa, Mycobacterium
VNLNGPFYLCRAALPHLLESGGNIV

SEQ ID NO: 1354403 - protein, 18 aa, Mycobacterium
VNNLLPSGRPLVVDPSVV

SEQ ID NO: 1354404 - protein, 29 aa, Mycobacterium
VNNYFRTGPQFPYGMFDDQILRVVGNTLY

SEQ ID NO: 1354405 - protein, 19 aa, Mycobacterium
VNPDGRWVSVTAPKENAEN

SEQ ID NO: 1354406 - protein, 18 aa, Mycobacterium
VNSLVAYLYGYREQSEID

SEQ ID NO: 1354407 - protein, 18 aa, Mycobacterium
VNTDVAFHSPAMDGLTGE

SEQ ID NO: 1354408 - protein, 19 aa, Mycobacterium
VNVEAVGLVRIGSADEAVQ

SEQ ID NO: 1354409 - protein, 18 aa, Mycobacterium
VPDGFKTLRVDLTGEETD

SEQ ID NO: 1354410 - protein, 21 aa, Mycobacterium
VPEDRVPAVLAAFSTTLPGQK

SEQ ID NO: 1354411 - protein, 17 aa, Mycobacterium
VPEGLSLERAMVYPRGV

SEQ ID NO: 1354412 - protein, 25 aa, Mycobacterium
VPFMVTSGWRSKGFQQRLFDDAVTT

SEQ ID NO: 1354413 - protein, 17 aa, Mycobacterium
VPFSDLLAPEFYKQPDV

SEQ ID NO: 1354414 - protein, 20 aa, Mycobacterium
VPGFPNFFIMYGPNTNSVPL

SEQ ID NO: 1354415 - protein, 23 aa, Mycobacterium
VPGGGAKPHYGPIIMIGDPTAMT

SEQ ID NO: 1354416 - protein, 25 aa, Mycobacterium
VPGGLELSTGLATSRVHPLPERVNT

SEQ ID NO: 1354417 - protein, 17 aa, Mycobacterium
VPIDACYEFVGRLRMLW

SEQ ID NO: 1354418 - protein, 25 aa, Mycobacterium
VPILKGDKGEPCWPDGIVGSLTHCE

SEQ ID NO: 1354419 - protein, 25 aa, Mycobacterium
VPKLRKGTYFPEWLLERRKRAESAL

SEQ ID NO: 1354420 - protein, 18 aa, Mycobacterium
VPLALAWDLGARNWTEEM

SEQ ID NO: 1354421 - protein, 18 aa, Mycobacterium
VPLAYAWDQGARAWTDEM

SEQ ID NO: 1354422 - protein, 17 aa, Mycobacterium
VPLHTAFARSCNTTMGR

SEQ ID NO: 1354423 - protein, 25 aa, Mycobacterium
VPLMRRFGLDAGERIAKLLSDSGVR

SEQ ID NO: 1354424 - protein, 26 aa, Mycobacterium
VPLQRRFGVDVGKRVAEMLADAGVTV

SEQ ID NO: 1354425 - protein, 18 aa, Mycobacterium
VPLWSIGWGLGVPSGTAA

SEQ ID NO: 1354426 - protein, 18 aa, Mycobacterium
VPNVMPATVVLRADGSVA

SEQ ID NO: 1354427 - protein, 18 aa, Mycobacterium
VPPGHWDDPAYFGIPTTW

SEQ ID NO: 1354428 - protein, 19 aa, Mycobacterium
VPQETVEVFAARFPAALND

SEQ ID NO: 1354429 - protein, 23 aa, Mycobacterium
VPQIPGLPVPLPTEIGPPSDGIC

SEQ ID NO: 1354430 - protein, 24 aa, Mycobacterium
VPRLREHRQRRSAEQAGITVSQML

SEQ ID NO: 1354431 - protein, 23 aa, Mycobacterium
VPTLLRCRLLVCQLAEPSADRAA

SEQ ID NO: 1354432 - protein, 18 aa, Mycobacterium
VPTMKSRVIDVVEENGFE

SEQ ID NO: 1354433 - protein, 29 aa, Mycobacterium
VPVALTEWLGYVWVCLADVPPSFEETVVG

SEQ ID NO: 1354434 - protein, 18 aa, Mycobacterium
VPVPLARVVGPAMGEAVC

SEQ ID NO: 1354435 - protein, 23 aa, Mycobacterium
VPVPYAMAITFQFRGVTPTGDAY

SEQ ID NO: 1354436 - protein, 23 aa, Mycobacterium
VPWQIRILPPFLSRKHLPSRLAR

SEQ ID NO: 1354437 - protein, 23 aa, Mycobacterium
VPYIAGRTAYDFATGRELWTASG

SEQ ID NO: 1354438 - protein, 19 aa, Mycobacterium
VQAAGSWVVIDTTLEAIRS

SEQ ID NO: 1354439 - protein, 18 aa, Mycobacterium
VQAGEVFDSAPYGWPVEK

SEQ ID NO: 1354440 - protein, 19 aa, Mycobacterium
VQFICGGTFDAAVTTDNYK

SEQ ID NO: 1354441 - protein, 17 aa, Mycobacterium
VQFICGGTFDAGATPDN

SEQ ID NO: 1354442 - protein, 17 aa, Mycobacterium
VQGVARFAQTLNERDAQ

SEQ ID NO: 1354443 - protein, 25 aa, Mycobacterium
VQIIYEDGWARPVAFSHGATIMFWT

SEQ ID NO: 1354444 - protein, 22 aa, Mycobacterium
VQIPRLVANNSRIWVYCGNGQP

SEQ ID NO: 1354445 - protein, 25 aa, Mycobacterium
VQLLPRSADGPVLKDGDVIPINRTT

SEQ ID NO: 1354446 - protein, 27 aa, Mycobacterium
VQLVSNEEDILWLSLNGGSDRRSAAQS

SEQ ID NO: 1354447 - protein, 25 aa, Mycobacterium
VQNMVTDVLTWVGLRPQADDGPTPP

SEQ ID NO: 1354448 - protein, 17 aa, Mycobacterium
VRAAFKPEFINRLDDVI

SEQ ID NO: 1354449 - protein, 22 aa, Mycobacterium
VRADCARWTAVSGHTTGVVTGV

SEQ ID NO: 1354450 - protein, 20 aa, Mycobacterium
VRAVGIEFFTKVADGEFDMT

SEQ ID NO: 1354451 - protein, 29 aa, Mycobacterium
VRDMFPEWEILRPSWFMQNFTGAHPVAES

SEQ ID NO: 1354452 - protein, 25 aa, Mycobacterium
VRDTFTVTVSDTFGASTSFVASVPI

SEQ ID NO: 1354453 - protein, 18 aa, Mycobacterium
VRDYLSTLVNNWKTVGVK

SEQ ID NO: 1354454 - protein, 27 aa, Mycobacterium
VRFPLNPFMGVMGVAFARDESLNAPNA

SEQ ID NO: 1354455 - protein, 17 aa, Mycobacterium
VRGKLPFYIDGAQAEVV

SEQ ID NO: 1354456 - protein, 17 aa, Mycobacterium
VRGLEVLTHRVVPCNDG

SEQ ID NO: 1354457 - protein, 18 aa, Mycobacterium
VRHTDARFNLSRAALLVV

SEQ ID NO: 1354458 - protein, 24 aa, Mycobacterium
VRIRPANSAPAWLRSTVAAPDPAT

SEQ ID NO: 1354459 - protein, 22 aa, Mycobacterium
VRLGEQMVDHWAAFVRAGDPGW

SEQ ID NO: 1354460 - protein, 17 aa, Mycobacterium
VRLLGPRIAEAAAGPDA

SEQ ID NO: 1354461 - protein, 23 aa, Mycobacterium
VRNHGEAGIHQSLESLRQANGDA

SEQ ID NO: 1354462 - protein, 19 aa, Mycobacterium
VRPDARLAERAGIHTQGGR

SEQ ID NO: 1354463 - protein, 17 aa, Mycobacterium
VRQAAAFQQAFDDYATD

SEQ ID NO: 1354464 - protein, 20 aa, Mycobacterium
VRQALTALGVRTAMSRGDDT

SEQ ID NO: 1354465 - protein, 17 aa, Mycobacterium
VRRAILGLLDVDLLASV

SEQ ID NO: 1354466 - protein, 18 aa, Mycobacterium
VRRSAFVIYNDWLQAQLA

SEQ ID NO: 1354467 - protein, 19 aa, Mycobacterium
VRSDRFAVTVSDGRGGVTS

SEQ ID NO: 1354468 - protein, 25 aa, Mycobacterium
VRSRGVVVALRLTGDFCAGCSEVEL

SEQ ID NO: 1354469 - protein, 18 aa, Mycobacterium
VRTSHAFHSRLMDAVVPQ

SEQ ID NO: 1354470 - protein, 18 aa, Mycobacterium
VRVDRETLTLGFAGVYSS

SEQ ID NO: 1354471 - protein, 25 aa, Mycobacterium
VRVLGGPPMLPWGSSVTVRSSSLRI

SEQ ID NO: 1354472 - protein, 17 aa, Mycobacterium
VRVLSAIELGILKDLGY

SEQ ID NO: 1354473 - protein, 18 aa, Mycobacterium
VRYLYAFGTPSGRAGSAY

SEQ ID NO: 1354474 - protein, 25 aa, Mycobacterium
VSACATEGLASLPLPAPSGGSGGYT

SEQ ID NO: 1354475 - protein, 20 aa, Mycobacterium
VSAIAGRTLTVFDRIRTVAD

SEQ ID NO: 1354476 - protein, 20 aa, Mycobacterium
VSARRGALHVTERLTDRAAD

SEQ ID NO: 1354477 - protein, 24 aa, Mycobacterium
VSASRWRVVSRTLPAGVAPENGLQ

SEQ ID NO: 1354478 - protein, 19 aa, Mycobacterium
VSDCDQPQTQWCTPIPSVD

SEQ ID NO: 1354479 - protein, 18 aa, Mycobacterium
VSDLGPVFAALAAAGPSL

SEQ ID NO: 1354480 - protein, 22 aa, Mycobacterium
VSEPSAPAFAAIRTQWEGTLVL

SEQ ID NO: 1354481 - protein, 22 aa, Mycobacterium
VSGQLTLLLPFIDRIRARVDLR

SEQ ID NO: 1354482 - protein, 21 aa, Mycobacterium
VSGSNALLLLTQRPLSSSPSA

SEQ ID NO: 1354483 - protein, 21 aa, Mycobacterium
VSHGPFFPECGGISDETIAQL

SEQ ID NO: 1354484 - protein, 27 aa, Mycobacterium
VSISDGEEWFDWELDAVVRDGGMVSQQ

SEQ ID NO: 1354485 - protein, 24 aa, Mycobacterium
VSLFSDAQDGLGMIMLSQGNSPEN

SEQ ID NO: 1354486 - protein, 18 aa, Mycobacterium
VSPAAALWSGDSALKELL

SEQ ID NO: 1354487 - protein, 17 aa, Mycobacterium
VSQLISWAAGLDGVELD

SEQ ID NO: 1354488 - protein, 25 aa, Mycobacterium
VSRAHRGVLFLDEFAEINSAALEAL

SEQ ID NO: 1354489 - protein, 17 aa, Mycobacterium
VSRRGRDRLVSAGRQGQ

SEQ ID NO: 1354490 - protein, 20 aa, Mycobacterium
VSTDLIPAFDTDSFQVQVSD

SEQ ID NO: 1354491 - protein, 19 aa, Mycobacterium
VSVAVGCACGVLFGAAPSH

SEQ ID NO: 1354492 - protein, 24 aa, Mycobacterium
VSVAVGCACGVLFGAAPSHADPAE

SEQ ID NO: 1354493 - protein, 17 aa, Mycobacterium
VSVRAIQLTPAYTSGPA

SEQ ID NO: 1354494 - protein, 17 aa, Mycobacterium
VTADAMMAHLTRLQEIA

SEQ ID NO: 1354495 - protein, 17 aa, Mycobacterium
VTARAIGPLGLAGRQGS

SEQ ID NO: 1354496 - protein, 24 aa, Mycobacterium
VTATRPAGGLNRTQVIAYFANSNG

SEQ ID NO: 1354497 - protein, 24 aa, Mycobacterium
VTCMSSSLPTLFRRAADYQRQITL

SEQ ID NO: 1354498 - protein, 24 aa, Mycobacterium
VTDSAAGATAWAIGQKVPNGTTGL

SEQ ID NO: 1354499 - protein, 24 aa, Mycobacterium
VTEAGGTLGLRVGPRGEVWPLKHW

SEQ ID NO: 1354500 - protein, 25 aa, Mycobacterium
VTEAQMKALFGLGWHPNADKIYGHL

SEQ ID NO: 1354501 - protein, 18 aa, Mycobacterium
VTEDGFGIVAGFDDAPVK

SEQ ID NO: 1354502 - protein, 26 aa, Mycobacterium
VTELKVFPGQGFTVRRCHGGDPDTVD

SEQ ID NO: 1354503 - protein, 23 aa, Mycobacterium
VTGDGRFTYTPTPVARHAAATGR

SEQ ID NO: 1354504 - protein, 18 aa, Mycobacterium
VTGGLPYLLGGDPVGLLS

SEQ ID NO: 1354505 - protein, 19 aa, Mycobacterium
VTGHSLGGWEAQYVAQQTG

SEQ ID NO: 1354506 - protein, 26 aa, Mycobacterium
VTIDGRGRFTYTPSDAARHVAAAEAA

SEQ ID NO: 1354507 - protein, 17 aa, Mycobacterium
VTKGGYVEVEFTVDGDV

SEQ ID NO: 1354508 - protein, 18 aa, Mycobacterium
VTLACARLGWPVQDTEVI

SEQ ID NO: 1354509 - protein, 19 aa, Mycobacterium
VTLDRIWWDRPFTVTNVDV

SEQ ID NO: 1354510 - protein, 27 aa, Mycobacterium
VTLTAARWGRYPVRANVRVAGRGGLLE

SEQ ID NO: 1354511 - protein, 25 aa, Mycobacterium
VTLYKRYAVRFGLGYTEESREVELV

SEQ ID NO: 1354512 - protein, 24 aa, Mycobacterium
VTQAGPACLAWFGNKDDGKCLSYS

SEQ ID NO: 1354513 - protein, 25 aa, Mycobacterium
VTQWPRSARTFWGLTRRFNPGDYGF

SEQ ID NO: 1354514 - protein, 24 aa, Mycobacterium
VTRYFRPRFDAVAFRAGAEQARYD

SEQ ID NO: 1354515 - protein, 25 aa, Mycobacterium
VTSGGRMLLMLDCTQEAADQIKAMG

SEQ ID NO: 1354516 - protein, 17 aa, Mycobacterium
VTTGARINPQIYGGIIT

SEQ ID NO: 1354517 - protein, 26 aa, Mycobacterium
VTVALIRIAALLAHASEVDRDFTQQL

SEQ ID NO: 1354518 - protein, 26 aa, Mycobacterium
VTVDCGEGLKAVEVGATFDCTAADEY

SEQ ID NO: 1354519 - protein, 37 aa, Mycobacterium
VTVGLNGSWLYTRTSNWTHSGPDTFTMTIDDTLGQIG

SEQ ID NO: 1354520 - protein, 22 aa, Mycobacterium
VTVRPGYNFANADHALAYGRGV

SEQ ID NO: 1354521 - protein, 17 aa, Mycobacterium
VTWTINPKAVWSDGTPI

SEQ ID NO: 1354522 - protein, 17 aa, Mycobacterium
VTYRAAPATSKGVVSID

SEQ ID NO: 1354523 - protein, 24 aa, Mycobacterium
VTYSEDWLRPDFVPPAAPPADQPQ

SEQ ID NO: 1354524 - protein, 19 aa, Mycobacterium
VVAAVGWSYLGDRMDTISV

SEQ ID NO: 1354525 - protein, 26 aa, Mycobacterium
VVALLALAVGVVFGARVVPRLREHRQ

SEQ ID NO: 1354526 - protein, 21 aa, Mycobacterium
VVALVAAVVWWTSDARATESR

SEQ ID NO: 1354527 - protein, 17 aa, Mycobacterium
VVARIGLAYTPPAHEDS

SEQ ID NO: 1354528 - protein, 27 aa, Mycobacterium
VVCALGAFALIAVFAQLRFEREQRYTA

SEQ ID NO: 1354529 - protein, 19 aa, Mycobacterium
VVDEVPRRGIGKVDRRALS

SEQ ID NO: 1354530 - protein, 19 aa, Mycobacterium
VVDYSRLLIEPTDINSAYD

SEQ ID NO: 1354531 - protein, 17 aa, Mycobacterium
VVECDWLYAPDVVAAGH

SEQ ID NO: 1354532 - protein, 42 aa, Mycobacterium
VVESVVRFGKAMWLDFNPFVPGSFLWKGYPYTLVTPFIKPFV

SEQ ID NO: 1354533 - protein, 20 aa, Mycobacterium
VVFEWTDQYGDRWTSEVSPT

SEQ ID NO: 1354534 - protein, 18 aa, Mycobacterium
VVGLERRGLLAAMPSATY

SEQ ID NO: 1354535 - protein, 27 aa, Mycobacterium
VVGLSGCGWRGLNSLPLPGTAGGGPGS

SEQ ID NO: 1354536 - protein, 25 aa, Mycobacterium
VVGPAMGEAVCRLHRDNGVDIRAGV

SEQ ID NO: 1354537 - protein, 17 aa, Mycobacterium
VVGPFTYLRPGTELGAA

SEQ ID NO: 1354538 - protein, 20 aa, Mycobacterium
VVGVGQSFASVPMLFAKPRY

SEQ ID NO: 1354539 - protein, 19 aa, Mycobacterium
VVINIWGSWCAPCRTETPE

SEQ ID NO: 1354540 - protein, 23 aa, Mycobacterium
VVIPAPEHTYLLALDAQGPLDQR

SEQ ID NO: 1354541 - protein, 19 aa, Mycobacterium
VVIPGDGGLYVLQINADGR

SEQ ID NO: 1354542 - protein, 19 aa, Mycobacterium
VVISGNWLLQNPMFAGYAG

SEQ ID NO: 1354543 - protein, 17 aa, Mycobacterium
VVLGRSVERQPLSTTDA

SEQ ID NO: 1354544 - protein, 22 aa, Mycobacterium
VVLPARAGLYVDRSADAWELTL

SEQ ID NO: 1354545 - protein, 33 aa, Mycobacterium
VVLPLGVPARPVWPPLLDTILTAVFDFGGRYLF

SEQ ID NO: 1354546 - protein, 25 aa, Mycobacterium
VVVLTGFRPDLSFLTEMRVELDPVL

SEQ ID NO: 1354547 - protein, 18 aa, Mycobacterium
VVVPADLIERLRNSAAAP

SEQ ID NO: 1354548 - protein, 17 aa, Mycobacterium
VVYAPLYWGNPFAIVNM

SEQ ID NO: 1354549 - protein, 31 aa, Mycobacterium
VVYARAMGPMQFLPGTWSRYASDGDGDGKAD

SEQ ID NO: 1354550 - protein, 25 aa, Mycobacterium
VVYNDGARDLAVWLTPPPAPPAPAA

SEQ ID NO: 1354551 - protein, 19 aa, Mycobacterium
VWLTRCSNYFRAPNGRVVT

SEQ ID NO: 1354552 - protein, 20 aa, Mycobacterium
VWSIAGTAYLGPDVDPRVLE

SEQ ID NO: 1354553 - protein, 21 aa, Mycobacterium
VYGARGHFGWIPIDATHAYWY

SEQ ID NO: 1354554 - protein, 18 aa, Mycobacterium
VYGDLALDDPRRFTESTP

SEQ ID NO: 1354555 - protein, 18 aa, Mycobacterium
VYHKPHFVQKVVNSQGDV

SEQ ID NO: 1354556 - protein, 22 aa, Mycobacterium
VYLPERQTALVILTNTDIAFRG

SEQ ID NO: 1354557 - protein, 17 aa, Mycobacterium
WAAERAPALGIPVTALE

SEQ ID NO: 1354558 - protein, 20 aa, Mycobacterium
WADPPDRPWNLVAVANAAMG

SEQ ID NO: 1354559 - protein, 17 aa, Mycobacterium
WAEEFPDPMRLHGGTLC

SEQ ID NO: 1354560 - protein, 18 aa, Mycobacterium
WAEPVGPGCAAYVQQVPE

SEQ ID NO: 1354561 - protein, 19 aa, Mycobacterium
WAGLSALTPDSDFDQAKAI

SEQ ID NO: 1354562 - protein, 21 aa, Mycobacterium
WAKELIPKWFRGDFANLTLVL

SEQ ID NO: 1354563 - protein, 27 aa, Mycobacterium
WAMATRRAAVFGCASGALRLTDGGATP

SEQ ID NO: 1354564 - protein, 17 aa, Mycobacterium
WANDPKVFGGYLGGLFG

SEQ ID NO: 1354565 - protein, 18 aa, Mycobacterium
WANRGKESLSLDLNSPAG

SEQ ID NO: 1354566 - protein, 17 aa, Mycobacterium
WAQDNPQQWARSYSEAV

SEQ ID NO: 1354567 - protein, 21 aa, Mycobacterium
WASAFPYGPTFADRITRGDYI

SEQ ID NO: 1354568 - protein, 17 aa, Mycobacterium
WASSPAPIFGGPVNALP

SEQ ID NO: 1354569 - protein, 17 aa, Mycobacterium
WATQMSYSGIYVHSAPW

SEQ ID NO: 1354570 - protein, 19 aa, Mycobacterium
WDLIMRIASPRGFMATDDV

SEQ ID NO: 1354571 - protein, 17 aa, Mycobacterium
WDLPGWAATGRELLTRI

SEQ ID NO: 1354572 - protein, 19 aa, Mycobacterium
WDMSEVFQGSYCDADSGNT

SEQ ID NO: 1354573 - protein, 20 aa, Mycobacterium
WDMTLPQIPSAFVSGDPVQI

SEQ ID NO: 1354574 - protein, 18 aa, Mycobacterium
WDPTLPKLISAGAPGDPL

SEQ ID NO: 1354575 - protein, 18 aa, Mycobacterium
WEAAGPRAPQGAYDAIIY

SEQ ID NO: 1354576 - protein, 25 aa, Mycobacterium
WETFLATELPDWLAANKGLAPGGHG

SEQ ID NO: 1354577 - protein, 26 aa, Mycobacterium
WETFLTRELPAWLAANRGQDPFGNAV

SEQ ID NO: 1354578 - protein, 20 aa, Mycobacterium
WGAEPGGPGNPGLAGQPGSG

SEQ ID NO: 1354579 - protein, 20 aa, Mycobacterium
WGDYLRRRGQLVSDLADQIR

SEQ ID NO: 1354580 - protein, 17 aa, Mycobacterium
WGEKTGVINNIFTPWTY

SEQ ID NO: 1354581 - protein, 24 aa, Mycobacterium
WGGDAFPLGGLTQIYASNGESNYG

SEQ ID NO: 1354582 - protein, 19 aa, Mycobacterium
WGKIRSFESGINHINPVAL

SEQ ID NO: 1354583 - protein, 17 aa, Mycobacterium
WGKPGSPAWLRADPTVN

SEQ ID NO: 1354584 - protein, 22 aa, Mycobacterium
WGPPEAPGRYTLVFNGEIYNYL

SEQ ID NO: 1354585 - protein, 18 aa, Mycobacterium
WHAVRRGHHVIHLEREVE

SEQ ID NO: 1354586 - protein, 23 aa, Mycobacterium
WHVQRAYCRLMLRSFGVRIAVSG

SEQ ID NO: 1354587 - protein, 20 aa, Mycobacterium
WKFGPEKRNEWSYTTDGTAT

SEQ ID NO: 1354588 - protein, 17 aa, Mycobacterium
WKQFVALDPAALGEVAR

SEQ ID NO: 1354589 - protein, 36 aa, Mycobacterium
WLAEPFIDLAEPVLREFVDLGFDWSGDPGISRALSI

SEQ ID NO: 1354590 - protein, 22 aa, Mycobacterium
WLEYELDVAKLLDCPLMTDLRD

SEQ ID NO: 1354591 - protein, 17 aa, Mycobacterium
WLFGLDVTSGEQLFGPV

SEQ ID NO: 1354592 - protein, 24 aa, Mycobacterium
WLLHIVSITVLFAVGGCHTEGEPQ

SEQ ID NO: 1354593 - protein, 17 aa, Mycobacterium
WLLMVATFGLERLESGL

SEQ ID NO: 1354594 - protein, 19 aa, Mycobacterium
WLNRMWRSSSSLLDTKAAR

SEQ ID NO: 1354595 - protein, 18 aa, Mycobacterium
WLPLLIVVVVAIAGLTVA

SEQ ID NO: 1354596 - protein, 22 aa, Mycobacterium
WLTGCSDGDMLGGMGSEVEPAH

SEQ ID NO: 1354597 - protein, 25 aa, Mycobacterium
WLTPEARAHWDLIAAKYAAPGTNRP

SEQ ID NO: 1354598 - protein, 17 aa, Mycobacterium
WLWTSAVAQPHPASAPQ

SEQ ID NO: 1354599 - protein, 21 aa, Mycobacterium
WMTRRRALAALAVGVVAPGTL

SEQ ID NO: 1354600 - protein, 22 aa, Mycobacterium
WNPKVVAGQTVEFGFQASPGGA

SEQ ID NO: 1354601 - protein, 17 aa, Mycobacterium
WPTVAWAHGTVGLGDDC

SEQ ID NO: 1354602 - protein, 19 aa, Mycobacterium
WPVFTDLSVTPGRDVPNVK

SEQ ID NO: 1354603 - protein, 23 aa, Mycobacterium
WPVVVGGSLSFAVASAGVLAGAI

SEQ ID NO: 1354604 - protein, 18 aa, Mycobacterium
WQALDGALARRAVVARAV

SEQ ID NO: 1354605 - protein, 17 aa, Mycobacterium
WQEGVVFGPDGTPYATL

SEQ ID NO: 1354606 - protein, 24 aa, Mycobacterium
WQGEPEAFLGMMVPGFPNFFIMYG

SEQ ID NO: 1354607 - protein, 18 aa, Mycobacterium
WQNEKGAIDVVRELKEQL

SEQ ID NO: 1354608 - protein, 30 aa, Mycobacterium
WRAGEPIVIAAPMFHAWGFSQLLFAALLAC

SEQ ID NO: 1354609 - protein, 28 aa, Mycobacterium
WRALLHGWPGMTAHGLVGLGSAIQRRGE

SEQ ID NO: 1354610 - protein, 18 aa, Mycobacterium
WRGVAAYRLDPALAGETM

SEQ ID NO: 1354611 - protein, 25 aa, Mycobacterium
WRIDRLPNGVFLDWQQFQATYKRHT

SEQ ID NO: 1354612 - protein, 29 aa, Mycobacterium
WRLAIFVCVCLLGLSLLVAVFGQLRFEPR

SEQ ID NO: 1354613 - protein, 21 aa, Mycobacterium
WRRIVDLNLWGVIYGVHAAVP

SEQ ID NO: 1354614 - protein, 17 aa, Mycobacterium
WRVWEFHPPNPTGNTVI

SEQ ID NO: 1354615 - protein, 21 aa, Mycobacterium
WRYHLPRARRIFDQCFTSPTR

SEQ ID NO: 1354616 - protein, 21 aa, Mycobacterium
WRYIDGRWKLANKSLCSGIAT

SEQ ID NO: 1354617 - protein, 25 aa, Mycobacterium
WSDEWRTFDLRGWWVTIAGVTFPDA

SEQ ID NO: 1354618 - protein, 43 aa, Mycobacterium
WSGDPGISRALSILPFKIFQNWLKVGVDLAVAAVKGVEAFIKN

SEQ ID NO: 1354619 - protein, 17 aa, Mycobacterium
WSGGEVDLTRPLPSDLI

SEQ ID NO: 1354620 - protein, 34 aa, Mycobacterium
WSTPTKLALSRGGGRLYISNALAGTVSVISTATN

SEQ ID NO: 1354621 - protein, 18 aa, Mycobacterium
WTDEEWHEVLELNLSSAW

SEQ ID NO: 1354622 - protein, 19 aa, Mycobacterium
WTGKDDLTLGASIDIGITN

SEQ ID NO: 1354623 - protein, 19 aa, Mycobacterium
WTIFDATTGEVVWDAGNTV

SEQ ID NO: 1354624 - protein, 19 aa, Mycobacterium
WTINPKAVWSDGTPITWED

SEQ ID NO: 1354625 - protein, 18 aa, Mycobacterium
WTPDKVYSGGYKAWALTP

SEQ ID NO: 1354626 - protein, 17 aa, Mycobacterium
WTPDTAPSWAQPLVTAN

SEQ ID NO: 1354627 - protein, 28 aa, Mycobacterium
WTRTHLRRPDGLLSWRWADGRVTDPSSA

SEQ ID NO: 1354628 - protein, 24 aa, Mycobacterium
WTSSSRKAMLPVFESANSLLYYPV

SEQ ID NO: 1354629 - protein, 27 aa, Mycobacterium
WTTYDSWHYTNGLGMYAAGTFHAVDPD

SEQ ID NO: 1354630 - protein, 23 aa, Mycobacterium
WTVPRTSIRPSWFNTVPGVQFVW

SEQ ID NO: 1354631 - protein, 17 aa, Mycobacterium
WVACAPAQGTAWADTPA

SEQ ID NO: 1354632 - protein, 20 aa, Mycobacterium
WVATLKLGIQPGVELPSNAL

SEQ ID NO: 1354633 - protein, 18 aa, Mycobacterium
WVGNIAISFPYLDTEATR

SEQ ID NO: 1354634 - protein, 17 aa, Mycobacterium
WVGVSGRARVIVYNPTL

SEQ ID NO: 1354635 - protein, 17 aa, Mycobacterium
WVLDGMVEIGALSEADR

SEQ ID NO: 1354636 - protein, 17 aa, Mycobacterium
WVRREFFNGTPAPVENP

SEQ ID NO: 1354637 - protein, 17 aa, Mycobacterium
WVSTYRFHRSVALSYTD

SEQ ID NO: 1354638 - protein, 20 aa, Mycobacterium
WVTRKRPGSAAAEAAAAAGA

SEQ ID NO: 1354639 - protein, 18 aa, Mycobacterium
WVVIEQWESAGYQVNIDR

SEQ ID NO: 1354640 - protein, 31 aa, Mycobacterium
WVVPNWPPGVLRPDLASTFVVNQAIGHVAAY

SEQ ID NO: 1354641 - protein, 24 aa, Mycobacterium
WVVPSDFAGALGGFTKLLGAPGED

SEQ ID NO: 1354642 - protein, 23 aa, Mycobacterium
WWETPGRLSVAGGILAMVEEIDT

SEQ ID NO: 1354643 - protein, 18 aa, Mycobacterium
WWPDRTLTRRGLEVVSRR

SEQ ID NO: 1354644 - protein, 18 aa, Mycobacterium
WYLMCFDRDRVDWRSLRL

SEQ ID NO: 1354645 - protein, 20 aa, Mycobacterium
WYRDNEAWWRPLKDAAESAY

SEQ ID NO: 1354646 - protein, 22 aa, Mycobacterium
WYRDNESWWGPLKDAVEATYQR

SEQ ID NO: 1354647 - protein, 19 aa, Mycobacterium
YAAIRAVLAGARLSLIGLH

SEQ ID NO: 1354648 - protein, 17 aa, Mycobacterium
YAAPAGVSIDAEQVNEF

SEQ ID NO: 1354649 - protein, 19 aa, Mycobacterium
YADAVPWNMLHTARDRGTA

SEQ ID NO: 1354650 - protein, 34 aa, Mycobacterium; identical to SEQ ID NO: 1285584

SEQ ID NO: 1354651 - protein, 26 aa, Mycobacterium
YAGECVSLVSQFLRQVHNITTAAWGN

SEQ ID NO: 1354652 - protein, 17 aa, Mycobacterium
YAGNPGISTGRTVADTE

SEQ ID NO: 1354653 - protein, 18 aa, Mycobacterium
YAIPDRPLVEGMPSYPAW

SEQ ID NO: 1354654 - protein, 38 aa, Mycobacterium; identical to SEQ ID NO: 1285616

SEQ ID NO: 1354655 - protein, 39 aa, Mycobacterium
YALTYPRRLGFGLGETVVSLGWRTGDDIVVSRKDPQHPV

SEQ ID NO: 1354656 - protein, 39 aa, Mycobacterium
YALTYPRRLGYGLGETAVSLSWRTGDDIVVTRTVAQSPV

SEQ ID NO: 1354657 - protein, 27 aa, Mycobacterium
YANAFWDPSRQLFAFGDAGYFQASVDV

SEQ ID NO: 1354658 - protein, 35 aa, Mycobacterium
YANVTGLRFGNTVPLTYPFALTFPTVMALLTGFDF

SEQ ID NO: 1354659 - protein, 26 aa, Mycobacterium
YAPACGKAGCSTYKWETFLTQELPAY

SEQ ID NO: 1354660 - protein, 17 aa, Mycobacterium
YAPKLVHRSRGAARSVI

SEQ ID NO: 1354661 - protein, 17 aa, Mycobacterium
YAQVVDRSTGLVVGNIV

SEQ ID NO: 1354662 - protein, 32 aa, Mycobacterium
YARVSIGLGPAWKVLRDLPLPPGDRHTVTMEV

SEQ ID NO: 1354663 - protein, 21 aa, Mycobacterium
YASAFDRLTGRYVLVLEDLPA

SEQ ID NO: 1354664 - protein, 23 aa, Mycobacterium
YATLTGADQGVWALTSTGPVKVL

SEQ ID NO: 1354665 - protein, 18 aa, Mycobacterium
YAYALNWPGQSPMRRSYE

SEQ ID NO: 1354666 - protein, 30 aa, Mycobacterium
YCAELGLPEMPAEFVPPLIVGDVGSNPAQY

SEQ ID NO: 1354667 - protein, 20 aa, Mycobacterium
YDAGLGRRGLPEQLDGDLWR

SEQ ID NO: 1354668 - protein, 37 aa, Mycobacterium
YDELGWKPAHLDFEEGLRATVQWYRDNEAWWRPLKDA

SEQ ID NO: 1354669 - protein, 21 aa, Mycobacterium
YDIYRGVVTYVRVVDGKITPR

SEQ ID NO: 1354670 - protein, 19 aa, Mycobacterium
YDLTARTAVKIMEDDDITG

SEQ ID NO: 1354671 - protein, 19 aa, Mycobacterium
YDLTARTAVKIMEDDEITG

SEQ ID NO: 1354672 - protein, 18 aa, Mycobacterium
YDLTARTAVKIMEDNDIT

SEQ ID NO: 1354673 - protein, 34 aa, Mycobacterium
YDPPGVIPTTVWDTGKVLPIIPLIGGSGPNPEVP

SEQ ID NO: 1354674 - protein, 17 aa, Mycobacterium
YDRPVFLGVGMQDRDVP

SEQ ID NO: 1354675 - protein, 20 aa, Mycobacterium
YDVIHPYQFRSAPRGLRTSP

SEQ ID NO: 1354676 - protein, 18 aa, Mycobacterium
YEAALLADPLWRARGVHT

SEQ ID NO: 1354677 - protein, 28 aa, Mycobacterium
YEDGDIWDWAVPWDEWVAMSALSEQESP

SEQ ID NO: 1354678 - protein, 20 aa, Mycobacterium
YELGCNGFAAQGVNRTDTDM

SEQ ID NO: 1354679 - protein, 32 aa, Mycobacterium; identical to SEQ ID NO: 208759

SEQ ID NO: 1354680 - protein, 36 aa, Mycobacterium
YEPLSGADFPAGWQKLNGTQALSFVRQRHDLPRGDL

SEQ ID NO: 1354681 - protein, 26 aa, Mycobacterium
YEVAELQGRVTPLAQWGYGENWSAQP

SEQ ID NO: 1354682 - protein, 20 aa, Mycobacterium
YFGGLQFKPSTWAEHGGRGN

SEQ ID NO: 1354683 - protein, 24 aa, Mycobacterium
YFKRFPPCRPGKFGAAISQRESEQ

SEQ ID NO: 1354684 - protein, 19 aa, Mycobacterium
YFPRGGMRALPDAMAAAAS

SEQ ID NO: 1354685 - protein, 17 aa, Mycobacterium
YFQALTVRTPDVQAQGD

SEQ ID NO: 1354686 - protein, 17 aa, Mycobacterium
YGGELWVLDLSPDREPE

SEQ ID NO: 1354687 - protein, 19 aa, Mycobacterium
YGMDWYSDRIVWHVDGVEV

SEQ ID NO: 1354688 - protein, 24 aa, Mycobacterium
YGPERLRALYLRACGPGHPDVATA

SEQ ID NO: 1354689 - protein, 24 aa, Mycobacterium
YGPPDMPQFAVAYWQTALGEMVQS

SEQ ID NO: 1354690 - protein, 18 aa, Mycobacterium
YGPYRARVSDMYSGEGDD

SEQ ID NO: 1354691 - protein, 17 aa, Mycobacterium
YGRALAILKSQGVKAYF

SEQ ID NO: 1354692 - protein, 17 aa, Mycobacterium
YGTRIGAGYAEEYPQNV

SEQ ID NO: 1354693 - protein, 17 aa, Mycobacterium
YGTTYTWAGTVVGNDGK

SEQ ID NO: 1354694 - protein, 18 aa, Mycobacterium
YGYQEWWGTPGPEIVDEI

SEQ ID NO: 1354695 - protein, 17 aa, Mycobacterium
YHGRPGHPVVVARRHWP

SEQ ID NO: 1354696 - protein, 23 aa, Mycobacterium
YHLEGALWATRRTFLNQAPDVAP

SEQ ID NO: 1354697 - protein, 17 aa, Mycobacterium
YHRLREWAEKPAKAPDP

SEQ ID NO: 1354698 - protein, 36 aa, Mycobacterium
YIDPQLSYTVEGWEVLWNVYTPLLTYRHARGKEGTE

SEQ ID NO: 1354699 - protein, 19 aa, Mycobacterium
YINFQRPIANRALAEQAIH

SEQ ID NO: 1354700 - protein, 20 aa, Mycobacterium
YIRERGRLIVGLDIGSNLFS

SEQ ID NO: 1354701 - protein, 20 aa, Mycobacterium
YITARFLPDKAIDLVDEAAS

SEQ ID NO: 1354702 - protein, 17 aa, Mycobacterium
YIVEGETGFTLPVSSSS

SEQ ID NO: 1354703 - protein, 24 aa, Mycobacterium
YKGLPAVCTHNGCLVNEIADETIY

SEQ ID NO: 1354704 - protein, 22 aa, Mycobacterium
YKLKLRPNMKYSDGTPIKASDF

SEQ ID NO: 1354705 - protein, 19 aa, Mycobacterium
YKLYAELERSGGLYPTGNV

SEQ ID NO: 1354706 - protein, 25 aa, Mycobacterium
YKPSEPGAYPIVLAAYEIVCSQYPD

SEQ ID NO: 1354707 - protein, 17 aa, Mycobacterium
YLHVRGLQVSEQFYTPA

SEQ ID NO: 1354708 - protein, 25 aa, Mycobacterium
YLPLAGRSMLAWSLDTLTRLPDIAR

SEQ ID NO: 1354709 - protein, 19 aa, Mycobacterium
YLTAQKLPPGLTFDPADCG

SEQ ID NO: 1354710 - protein, 17 aa, Mycobacterium
YLTVRILSQVGGLDAVA

SEQ ID NO: 1354711 - protein, 31 aa, Mycobacterium
YMLIKADVLPMLGWLDWFVDDEGMAKLDATF

SEQ ID NO: 1354712 - protein, 17 aa, Mycobacterium
YNGWTVWELASPDPSGE

SEQ ID NO: 1354713 - protein, 20 aa, Mycobacterium
YNPMLTCLFVGAKTTLDTGY

SEQ ID NO: 1354714 - protein, 21 aa, Mycobacterium
YPAAVGDLICTMHRFRQSHGR

SEQ ID NO: 1354715 - protein, 19 aa, Mycobacterium
YPAGHSALLHRVSGSGLLV

SEQ ID NO: 1354716 - protein, 24 aa, Mycobacterium
YPAPVDAPVTWRSIVSDALSWIGL

SEQ ID NO: 1354717 - protein, 25 aa, Mycobacterium
YPARGRPADQLRIWAAQRAPALNMP

SEQ ID NO: 1354718 - protein, 19 aa, Mycobacterium
YPARVVAVGTDRVCAALDI

SEQ ID NO: 1354719 - protein, 30 aa, Mycobacterium
YPASFWPIPLPGWCPGLTCDTWNTSVGEGV

SEQ ID NO: 1354720 - protein, 23 aa, Mycobacterium
YPGMPAKPGPAVADFSTGLYAAI

SEQ ID NO: 1354721 - protein, 17 aa, Mycobacterium
YPLPRATGWPVGVSVGH

SEQ ID NO: 1354722 - protein, 22 aa, Mycobacterium
YPTDEFNAAISRLNDSKTTALD

SEQ ID NO: 1354723 - protein, 20 aa, Mycobacterium
YPTVSALAGALGARFSTGGL

SEQ ID NO: 1354724 - protein, 17 aa, Mycobacterium
YPWCELDMFCYDDDLDI

SEQ ID NO: 1354725 - protein, 17 aa, Mycobacterium
YPYREPLPAPAPGGPPP

SEQ ID NO: 1354726 - protein, 17 aa, Mycobacterium
YPYREPLPAPPPGGPPP

SEQ ID NO: 1354727 - protein, 22 aa, Mycobacterium
YQAMRPKILSAHYSGYRVLEGG

SEQ ID NO: 1354728 - protein, 25 aa, Mycobacterium
YQTACKPGMVGDGIRSDFTVTGDAV

SEQ ID NO: 1354729 - protein, 20 aa, Mycobacterium
YRAAPATSKGVVSIDADGTF

SEQ ID NO: 1354730 - protein, 17 aa, Mycobacterium
YRALRRLNVSIPDMVDE

SEQ ID NO: 1354731 - protein, 17 aa, Mycobacterium
YRAVAELFTGDREALNA

SEQ ID NO: 1354732 - protein, 21 aa, Mycobacterium
YRDEVAVEWDRAALTPVREVP

SEQ ID NO: 1354733 - protein, 25 aa, Mycobacterium
YREPRPMVYSGLYPVDGSDYPVLRE

SEQ ID NO: 1354734 - protein, 21 aa, Mycobacterium
YRFRAEGYLSPAGRTRTAPAT

SEQ ID NO: 1354735 - protein, 24 aa, Mycobacterium
YRFSAPHPGTYWAHPHTGLDADYG

SEQ ID NO: 1354736 - protein, 24 aa, Mycobacterium
YRKAEATFGVGWNYLAAINLVETA

SEQ ID NO: 1354737 - protein, 20 aa, Mycobacterium
YRLARRELDGLVVLPDGARV

SEQ ID NO: 1354738 - protein, 17 aa, Mycobacterium
YRPDGTAALQLEMDPSQ

SEQ ID NO: 1354739 - protein, 21 aa, Mycobacterium
YRPGQTPLLAREWTSDAVEKG

SEQ ID NO: 1354740 - protein, 20 aa, Mycobacterium
YRPGQTPQLTREWTSDAVGG

SEQ ID NO: 1354741 - protein, 20 aa, Mycobacterium
YRPNEIARRIAASVYSTPAS

SEQ ID NO: 1354742 - protein, 17 aa, Mycobacterium
YRRNELTESQVLALNEI

SEQ ID NO: 1354743 - protein, 17 aa, Mycobacterium
YSAPHNFTGDPVDGYQA

SEQ ID NO: 1354744 - protein, 20 aa, Mycobacterium
YSARRAAALQAYYENMPLRS

SEQ ID NO: 1354745 - protein, 18 aa, Mycobacterium
YSPNIVALVSKLVGDVDP

SEQ ID NO: 1354746 - protein, 26 aa, Mycobacterium
YSQFFSQGYLGYWRKSGTSGGGGGGG

SEQ ID NO: 1354747 - protein, 19 aa, Mycobacterium
YSQRYWPYLTSGLLGLQRG

SEQ ID NO: 1354748 - protein, 19 aa, Mycobacterium
YSVCVPATYARGRRLPLTL

SEQ ID NO: 1354749 - protein, 32 aa, Mycobacterium
YSVSTQGRFRFLRVYPDPMIYAPVTGFYSLSY

SEQ ID NO: 1354750 - protein, 28 aa, Mycobacterium
YTANGGIVSLNWDGTFTYIPNKSAATAD

SEQ ID NO: 1354751 - protein, 19 aa, Mycobacterium
YTAVLTRLASEPGDDNEHW

SEQ ID NO: 1354752 - protein, 18 aa, Mycobacterium
YTFAVRVLGGPPMLPWGS

SEQ ID NO: 1354753 - protein, 20 aa, Mycobacterium
YTLTVDVPDGLRCGNVYYGP

SEQ ID NO: 1354754 - protein, 17 aa, Mycobacterium
YTSAAVFAAEQAEIFEN

SEQ ID NO: 1354755 - protein, 17 aa, Mycobacterium
YTTPDDYGWVFFTTPDG

SEQ ID NO: 1354756 - protein, 17 aa, Mycobacterium
YTVPTTMYAGGTDTFTV

SEQ ID NO: 1354757 - protein, 22 aa, Mycobacterium
YTYTTTLEWVLGPYFEGEFVKG

SEQ ID NO: 1354758 - protein, 28 aa, Mycobacterium
YVALDLGPWLLNWVPLGYLISDQIYIWY

SEQ ID NO: 1354759 - protein, 18 aa, Mycobacterium
YVCQARAARQTDQAVWAF

SEQ ID NO: 1354760 - protein, 17 aa, Mycobacterium
YVGLHPFPESPFTVEYE

SEQ ID NO: 1354761 - protein, 24 aa, Mycobacterium
YVHRTARILVEMSSGWSPAPSGAP

SEQ ID NO: 1354762 - protein, 18 aa, Mycobacterium
YVKDDGSQDDVVFEWTDQ

SEQ ID NO: 1354763 - protein, 18 aa, Mycobacterium
YYERIEPVAESFPDDLDP

SEQ ID NO: 1354764 - protein, 17 aa, Mycobacterium
YYGANLDRLTRVKATWD

SEQ ID NO: 1354765 - protein, 43 aa, Mycobacterium
YYPGGRVAGRPVPAGWYSEPWWKPALVAGAWGLGSALLFSSLF

SEQ ID NO: 1354766 - protein, 27 aa, Mycobacterium
LGYQIGFPWSLGVGINFSYTTPNIAFD

SEQ ID NO: 1354767 - protein, 17 aa, Mycobacterium
LEPMRAWFLTVAVRTGI

SEQ ID NO: 1354768 - protein, 18 aa, Mycobacterium
SLELGYQIGFPWSLGVGI

SEQ ID NO: 1354769 - protein, 18 aa, Mycobacterium
AIELWKIVDRPNLLIKIP

SEQ ID NO: 1354770 - protein, 23 aa, Mycobacterium
FAYLRLPSLLFGVGRYQVTMKLQ

SEQ ID NO: 1354771 - protein, 26 aa, Mycobacterium
GTGLDWRPNPGIGFPGYANYFPVTRA

SEQ ID NO: 1354772 - protein, 20 aa, Mycobacterium
RNKTRLAALRVKDFSKRDVM

SEQ ID NO: 1354773 - protein, 18 aa, Mycobacterium
AAADTGCWLNIADVDDFV

SEQ ID NO: 1354774 - protein, 22 aa, Mycobacterium
AACAALGMGIGLGIFVAAPTAG

SEQ ID NO: 1354775 - protein, 19 aa, Mycobacterium
AAELRYGRIPEVEKKLDAA

SEQ ID NO: 1354776 - protein, 17 aa, Mycobacterium
AAKAAADTGCWLNIADV

SEQ ID NO: 1354777 - protein, 21 aa, Mycobacterium
AAPPWAMPDVRGMNLQQATDT

SEQ ID NO: 1354778 - protein, 20 aa, Mycobacterium
ACPVTWPWNLLGWPSINVPA

SEQ ID NO: 1354779 - protein, 18 aa, Mycobacterium
ADRLGGRGNIVILQGPLG

SEQ ID NO: 1354780 - protein, 24 aa, Mycobacterium
AEGLNRFAGILARSRDSLGRTLDT

SEQ ID NO: 1354781 - protein, 22 aa, Mycobacterium
AEHGFRFFPGFYRNVTDTMRRI

SEQ ID NO: 1354782 - protein, 28 aa, Mycobacterium
AESLRGGAIFDRWAKMGGMASALGAPTS

SEQ ID NO: 1354783 - protein, 19 aa, Mycobacterium
AGVKRIVYLGGFVPTDETL

SEQ ID NO: 1354784 - protein, 29 aa, Mycobacterium
AGWYSEPWWKPALVAGAWGLGSVLLFDAL

SEQ ID NO: 1354785 - protein, 23 aa, Mycobacterium
AHCTRLGVRWAPPVDDLAAVDDV

SEQ ID NO: 1354786 - protein, 20 aa, Mycobacterium
AIGVLSPIYAGFVKAGGAFV

SEQ ID NO: 1354787 - protein, 23 aa, Mycobacterium
AIHEILHSFGFMSFIERPGENVE

SEQ ID NO: 1354788 - protein, 23 aa, Mycobacterium
AIYDAWGSLGFERGALGLPTSGE

SEQ ID NO: 1354789 - protein, 17 aa, Mycobacterium
ALTLAVLASAVACSSTD

SEQ ID NO: 1354790 - protein, 20 aa, Mycobacterium
ANGTHGWGYWGSQLNAMKGD

SEQ ID NO: 1354791 - protein, 21 aa, Mycobacterium
APGFWLRCSGFPCAIEVWNNV

SEQ ID NO: 1354792 - protein, 24 aa, Mycobacterium
AQHPGGWPRLDWSMDAALLLAALA

SEQ ID NO: 1354793 - protein, 19 aa, Mycobacterium
AQRGFGRVGANGDGGAGAR

SEQ ID NO: 1354794 - protein, 25 aa, Mycobacterium
ARARNGETYRALWQVATAQGVNPST

SEQ ID NO: 1354795 - protein, 21 aa, Mycobacterium
ARATLRLGWQALRQPADLADL

SEQ ID NO: 1354796 - protein, 19 aa, Mycobacterium
ARDRIYWFFSLDYTARRQY

SEQ ID NO: 1354797 - protein, 20 aa, Mycobacterium
ARKLAIAVAVTFAPEAFDAQ

SEQ ID NO: 1354798 - protein, 19 aa, Mycobacterium
ARLAGRWRAPLPVRGIDTS

SEQ ID NO: 1354799 - protein, 18 aa, Mycobacterium
ARPRLKFYAYYEGTAQLV

SEQ ID NO: 1354800 - protein, 19 aa, Mycobacterium
ARWLPFVIAHGGLDQLVPF

SEQ ID NO: 1354801 - protein, 18 aa, Mycobacterium
ASFDRRLAVDQGPAYMVA

SEQ ID NO: 1354802 - protein, 20 aa, Mycobacterium
ASGKANIVFLGQRLDGVEFV

SEQ ID NO: 1354803 - protein, 18 aa, Mycobacterium
ATPPRPPVPSAPVTSSSQ

SEQ ID NO: 1354804 - protein, 24 aa, Mycobacterium
ATVARFAAGLAKHGSGTVLVGRDG

SEQ ID NO: 1354805 - protein, 22 aa, Mycobacterium
AVEPTLRLLVDMGYTDRDYQNA

SEQ ID NO: 1354806 - protein, 26 aa, Mycobacterium
AVGDLYSYLAIRNWNAVGFLVGQAVS

SEQ ID NO: 1354807 - protein, 17 aa, Mycobacterium
AVHRLDAAALFRRAVED

SEQ ID NO: 1354808 - protein, 24 aa, Mycobacterium
AVTAGEVPLAFALAAGSFRDGTRV

SEQ ID NO: 1354809 - protein, 18 aa, Mycobacterium
AYDRAWRFATYVADRYGP

SEQ ID NO: 1354810 - protein, 22 aa, Mycobacterium
AYSEDRLRPPPGYKDTTVPGIF

SEQ ID NO: 1354811 - protein, 18 aa, Mycobacterium
CDALRPLMDALRHTELTV

SEQ ID NO: 1354812 - protein, 21 aa, Mycobacterium
CQELDGRNALGFVRTRATPRA

SEQ ID NO: 1354813 - protein, 18 aa, Mycobacterium
DCFAGAYMRWVAEGSSPR

SEQ ID NO: 1354814 - protein, 25 aa, Mycobacterium
DDRAGICLRGKPGWGEVLAPLDTVI

SEQ ID NO: 1354815 - protein, 20 aa, Mycobacterium
DEGRLGWRTLDFELEVLETG

SEQ ID NO: 1354816 - protein, 25 aa, Mycobacterium
DFTIPRLKRGLFLGTRWGEEGTPMV

SEQ ID NO: 1354817 - protein, 20 aa, Mycobacterium
DGMTCYWKRVGADGKLLDNA

SEQ ID NO: 1354818 - protein, 24 aa, Mycobacterium
DGQIAYNFGHKWGLGDTVASDEYA

SEQ ID NO: 1354819 - protein, 19 aa, Mycobacterium
DGTAADGLQVFRFVPTVPD

SEQ ID NO: 1354820 - protein, 18 aa, Mycobacterium
DKRLELMLVCAHPSVAVN

SEQ ID NO: 1354821 - protein, 20 aa, Mycobacterium
DKVVRWWLPERWTFVDEIPR

SEQ ID NO: 1354822 - protein, 22 aa, Mycobacterium
DLGPWLLNWVPLGYLISDQIYI

SEQ ID NO: 1354823 - protein, 24 aa, Mycobacterium
DPEAGRPGVQLSLLTGTPNLGYGN

SEQ ID NO: 1354824 - protein, 22 aa, Mycobacterium
DPEVLGLAALVCFGEARRPARR

SEQ ID NO: 1354825 - protein, 17 aa, Mycobacterium
DSPGRWTTNYSAIAYSD

SEQ ID NO: 1354826 - protein, 17 aa, Mycobacterium
EALAGACTVVFAVPAQS

SEQ ID NO: 1354827 - protein, 19 aa, Mycobacterium
EAVSGWVARQPKVWWDTPQ

SEQ ID NO: 1354828 - protein, 18 aa, Mycobacterium
EAVYRGSQIVPWVNVVVP

SEQ ID NO: 1354829 - protein, 23 aa, Mycobacterium
EGISVNVTLIFSVERHRAVMDAY

SEQ ID NO: 1354830 - protein, 18 aa, Mycobacterium
EGLPGLKEKYGLDIAPSN

SEQ ID NO: 1354831 - protein, 21 aa, Mycobacterium
EHLEDYFALRWARPDDGTLVI

SEQ ID NO: 1354832 - protein, 17 aa, Mycobacterium
ELGRWVLRNACAEFARW

SEQ ID NO: 1354833 - protein, 23 aa, Mycobacterium
EPVKAIRVAEQWTEPDDWQQPRP

SEQ ID NO: 1354834 - protein, 19 aa, Mycobacterium
ETWSALATMILPVGGAPYV

SEQ ID NO: 1354835 - protein, 20 aa, Mycobacterium
EVDGLASIVRFRWNGNGVEL

SEQ ID NO: 1354836 - protein, 19 aa, Mycobacterium
EVLRLRWRRGCMPAPRRVV

SEQ ID NO: 1354837 - protein, 23 aa, Mycobacterium
FEGLRTSTRWDFTLGNPLGTGGQ

SEQ ID NO: 1354838 - protein, 18 aa, Mycobacterium
FGQPFAMDYVWGRQLGEL

SEQ ID NO: 1354839 - protein, 24 aa, Mycobacterium
FGTAIYAEYRWSRTLRDVANLDSD

SEQ ID NO: 1354840 - protein, 24 aa, Mycobacterium
FNFPPKGTHSWGYWGSQLQAMKPD

SEQ ID NO: 1354841 - protein, 20 aa, Mycobacterium
FRLGFAEVYGLFARAGLHDR

SEQ ID NO: 1354842 - protein, 23 aa, Mycobacterium
FRSFAAAMDRWWALDSDGELTSD

SEQ ID NO: 1354843 - protein, 27 aa, Mycobacterium
FTALATAGACWIVQLFNPATAIADPGA

SEQ ID NO: 1354844 - protein, 17 aa, Mycobacterium
FTGTGLKGWFQRWFYTV

SEQ ID NO: 1354845 - protein, 18 aa, Mycobacterium
GAAATAFFGLAAPAQAAP

SEQ ID NO: 1354846 - protein, 18 aa, Mycobacterium
GACTVVFAVPAQSLRSNL

SEQ ID NO: 1354847 - protein, 18 aa, Mycobacterium
GAIGAAIWLWVKRRQLAV

SEQ ID NO: 1354848 - protein, 25 aa, Mycobacterium
GDAWRLGWSPALLHPDLKPGMKFQY

SEQ ID NO: 1354849 - protein, 18 aa, Mycobacterium
GDMDRVTLFRAWYSRGNF

SEQ ID NO: 1354850 - protein, 19 aa, Mycobacterium
GEAIAWKFTLDDLLVDVGV

SEQ ID NO: 1354851 - protein, 19 aa, Mycobacterium
GFFDCHVHFSLPGAGATPI

SEQ ID NO: 1354852 - protein, 19 aa, Mycobacterium
GFPGMAAAYGFDPARAQTP

SEQ ID NO: 1354853 - protein, 21 aa, Mycobacterium
GGGIPSFLGYHGFPASICSSV

SEQ ID NO: 1354854 - protein, 17 aa, Mycobacterium
GGLRYAPRADLATREEQ

SEQ ID NO: 1354855 - protein, 18 aa, Mycobacterium
GHPRVMSIADFWRRTAGH

SEQ ID NO: 1354856 - protein, 24 aa, Mycobacterium
GIVDEIDYVLSLGWFPIPLPPLPT

SEQ ID NO: 1354857 - protein, 18 aa, Mycobacterium
GLKGWFQRWFYTVAGQVP

SEQ ID NO: 1354858 - protein, 22 aa, Mycobacterium
GLLSRLKPLFGLGLGARLGNGR

SEQ ID NO: 1354859 - protein, 18 aa, Mycobacterium
GLPAPRFGLATTFDQARR

SEQ ID NO: 1354860 - protein, 17 aa, Mycobacterium
GLWPTLVGFAMRDSGGF

SEQ ID NO: 1354861 - protein, 20 aa, Mycobacterium
GNEFDARFDASVQQIYDSGD

SEQ ID NO: 1354862 - protein, 20 aa, Mycobacterium
GPPRISGVTFRFISEPSTAL

SEQ ID NO: 1354863 - protein, 34 aa, Mycobacterium
GQHRRKAEGPRVLPVSGWLSAGAVTVAMGAAMIA

SEQ ID NO: 1354864 - protein, 23 aa, Mycobacterium
GRAAVPWWPWAPLVQLMRVLPPR

SEQ ID NO: 1354865 - protein, 26 aa, Mycobacterium
GRFIGPFKGRLGLFGSEVTQIPTSGI

SEQ ID NO: 1354866 - protein, 17 aa, Mycobacterium
GRIRLTLHTDRAGERVE

SEQ ID NO: 1354867 - protein, 19 aa, Mycobacterium
GRLLGWRLGLDRVNPMGTT

SEQ ID NO: 1354868 - protein, 18 aa, Mycobacterium
GRRTELYWAARLTLVNRA

SEQ ID NO: 1354869 - protein, 23 aa, Mycobacterium
GRTTGYSCGVTWGPGEDPGTIVN

SEQ ID NO: 1354870 - protein, 17 aa, Mycobacterium
GSQIVPWVNVVVPAYKI

SEQ ID NO: 1354871 - protein, 18 aa, Mycobacterium
GSWARRPEAVTGIDNLFL

SEQ ID NO: 1354872 - protein, 19 aa, Mycobacterium
GVVLLMWAGILAYLDRCGY

SEQ ID NO: 1354873 - protein, 19 aa, Mycobacterium
GVWCPPNPIAQVLDRKGEE

SEQ ID NO: 1354874 - protein, 22 aa, Mycobacterium
GWDRGELLPALRAANGDMGVAM

SEQ ID NO: 1354875 - protein, 18 aa, Mycobacterium
GWWPMLIGLAMQDSGKYN

SEQ ID NO: 1354876 - protein, 20 aa, Mycobacterium
GYRAPLCLLTRPAAEALRRA

SEQ ID NO: 1354877 - protein, 18 aa, Mycobacterium
IEKESNWLPAPKGPFQMI

SEQ ID NO: 1354878 - protein, 17 aa, Mycobacterium
IEQVEWEKLAQIALAAA

SEQ ID NO: 1354879 - protein, 21 aa, Mycobacterium
ILNATIEWKTRPSARSFGDGF

SEQ ID NO: 1354880 - protein, 19 aa, Mycobacterium
IPAAWCHLVGIKPQRGRIS

SEQ ID NO: 1354881 - protein, 18 aa, Mycobacterium
IQIPESWSREVAKNVANL

SEQ ID NO: 1354882 - protein, 19 aa, Mycobacterium
IRILYGLGCREFAESREQE

SEQ ID NO: 1354883 - protein, 18 aa, Mycobacterium
ISLAAVFLALAIGVALGS

SEQ ID NO: 1354884 - protein, 18 aa, Mycobacterium
IVISGDWLLQNPMFSGYG

SEQ ID NO: 1354885 - protein, 21 aa, Mycobacterium
KANLRMGRLLSEHVLRKARAK

SEQ ID NO: 1354886 - protein, 20 aa, Mycobacterium
KGNYLYRMAGAVFGIYGNTA

SEQ ID NO: 1354887 - protein, 19 aa, Mycobacterium
KLREIRMALTLDKTFTKPE

SEQ ID NO: 1354888 - protein, 23 aa, Mycobacterium
KMPGLYAPMIHPWSSTDNVSAAD

SEQ ID NO: 1354889 - protein, 20 aa, Mycobacterium
KRWRVAAALAATASLLAGCG

SEQ ID NO: 1354890 - protein, 25 aa, Mycobacterium
LAEHTRLDGVLAWLEEHAHRDLTLA

SEQ ID NO: 1354891 - protein, 20 aa, Mycobacterium
LAKACARIMLGASIAQLREE

SEQ ID NO: 1354892 - protein, 22 aa, Mycobacterium
LALPRLGSFAVMNRTIDIAQAA

SEQ ID NO: 1354893 - protein, 25 aa, Mycobacterium
LANARRWGVLHVIWRQGFYPGIGAP

SEQ ID NO: 1354894 - protein, 24 aa, Mycobacterium
LAPSTIRSAGWFRSSTRYVAGSQN

SEQ ID NO: 1354895 - protein, 21 aa, Mycobacterium
LARLPMRVRRAVRETREILDT

SEQ ID NO: 1354896 - protein, 23 aa, Mycobacterium
LDSDPWVGIIGFPFVTQAMDHEF

SEQ ID NO: 1354897 - protein, 17 aa, Mycobacterium
LESAGVPNAERWAEEVV

SEQ ID NO: 1354898 - protein, 18 aa, Mycobacterium
LGHEFDYFNPPQTFKIEN

SEQ ID NO: 1354899 - protein, 19 aa, Mycobacterium
LKIVSCYQFGKADTADWLG

SEQ ID NO: 1354900 - protein, 22 aa, Mycobacterium
LKNEFADFVFRSIFENLNLAAF

SEQ ID NO: 1354901 - protein, 23 aa, Mycobacterium
LLHPDLKPGMKFQYSEDSELQTP

SEQ ID NO: 1354902 - protein, 23 aa, Mycobacterium
LLRTEWMNGLMFYLRERVDVTKG

SEQ ID NO: 1354903 - protein, 21 aa, Mycobacterium
LNGPFFLCRAALPHLLETGGS

SEQ ID NO: 1354904 - protein, 19 aa, Mycobacterium
LPVRGVISLAEVIQRQVEQ

SEQ ID NO: 1354905 - protein, 17 aa, Mycobacterium
LQALLAVMVEQGVDTVV

SEQ ID NO: 1354906 - protein, 18 aa, Mycobacterium
LQFRSFDVVDGWRRPDGP

SEQ ID NO: 1354907 - protein, 17 aa, Mycobacterium
LRYAPRADLATREEQIA

SEQ ID NO: 1354908 - protein, 17 aa, Mycobacterium
LSTNTVVAYFSDTLALY

SEQ ID NO: 1354909 - protein, 17 aa, Mycobacterium
LTVPGRLPQTLPGANSA

SEQ ID NO: 1354910 - protein, 17 aa, Mycobacterium
LVKSGKVSEDWNKNATK

SEQ ID NO: 1354911 - protein, 18 aa, Mycobacterium
LVRPLRLLPGGDIVADAI

SEQ ID NO: 1354912 - protein, 19 aa, Mycobacterium
MDRNARFVAVAGLGLLAPG

SEQ ID NO: 1354913 - protein, 20 aa, Mycobacterium
MKVSVQWPYSANLHCEILID

SEQ ID NO: 1354914 - protein, 21 aa, Mycobacterium
MQFIPETWRLYGVDANGDGKS

SEQ ID NO: 1354915 - protein, 17 aa, Mycobacterium
MSIADFWRRTAGHELIV

SEQ ID NO: 1354916 - protein, 17 aa, Mycobacterium
MSVKSWDTPGRWTTNYS

SEQ ID NO: 1354917 - protein, 17 aa, Mycobacterium
MTGDWRSNVLLISTDND

SEQ ID NO: 1354918 - protein, 25 aa, Mycobacterium
MWDGGIRLGERFVHVAFGDTFANAN

SEQ ID NO: 1354919 - protein, 18 aa, Mycobacterium
NGPCKGSVVALEPSTGKI

SEQ ID NO: 1354920 - protein, 25 aa, Mycobacterium
NGTADRPNAGLLLGNGYSYTATTCP

SEQ ID NO: 1354921 - protein, 18 aa, Mycobacterium
NHEPGWVVAPGMQGVDVQ

SEQ ID NO: 1354922 - protein, 22 aa, Mycobacterium
NRFGELREGVWLRPDNLDTALP

SEQ ID NO: 1354923 - protein, 23 aa, Mycobacterium
NSWRVNCLGPFLGIQAVLEHLKA

SEQ ID NO: 1354924 - protein, 17 aa, Mycobacterium
PAIPDKRLELMLVCAHP

SEQ ID NO: 1354925 - protein, 20 aa, Mycobacterium
PALEAVRFAARYAPGTVHRT

SEQ ID NO: 1354926 - protein, 22 aa, Mycobacterium
PDARPSPPVSYCPATGRLVVDL

SEQ ID NO: 1354927 - protein, 21 aa, Mycobacterium
PDYTVGMSWNFLSRSTSGLLD

SEQ ID NO: 1354928 - protein, 21 aa, Mycobacterium
PELRPLVDLLPIAGGSGTLSN

SEQ ID NO: 1354929 - protein, 25 aa, Mycobacterium
PGAVSPGVPCVNIMQQLLTVPGRLP

SEQ ID NO: 1354930 - protein, 25 aa, Mycobacterium
PGELCSFPLRQCGSGNLFGGNEPAR

SEQ ID NO: 1354931 - protein, 20 aa, Mycobacterium
PGLYAPMIHPWSGTGDLKDE

SEQ ID NO: 1354932 - protein, 22 aa, Mycobacterium
PLKRWQLCLNVNLTGVFLVTKA

SEQ ID NO: 1354933 - protein, 17 aa, Mycobacterium
PLMDALRHTELTVVELD

SEQ ID NO: 1354934 - protein, 25 aa, Mycobacterium
PLTNLSGRCKLPVTIPQVLGLMQAA

SEQ ID NO: 1354935 - protein, 18 aa, Mycobacterium
PMGLGLVSQFFGRYFTPD

SEQ ID NO: 1354936 - protein, 23 aa, Mycobacterium
PPGKPRALAALRHFADHRRFYRA

SEQ ID NO: 1354937 - protein, 22 aa, Mycobacterium
PPLEGAAAVFDRLLPGAPTPGA

SEQ ID NO: 1354938 - protein, 18 aa, Mycobacterium
PQDFWPAGTVVNIDASGT

SEQ ID NO: 1354939 - protein, 18 aa, Mycobacterium
PSSVQLPVWLARSQALVD

SEQ ID NO: 1354940 - protein, 17 aa, Mycobacterium
PVINRLLAAFGLGSLRN

SEQ ID NO: 1354941 - protein, 24 aa, Mycobacterium
PVQNRPGGIGAQFLATMVEQYRGK

SEQ ID NO: 1354942 - protein, 19 aa, Mycobacterium
PVRAGGTWDALAQCEAGGN

SEQ ID NO: 1354943 - protein, 18 aa, Mycobacterium
PYGPRMLSPKGLADNAGD

SEQ ID NO: 1354944 - protein, 24 aa, Mycobacterium
QAVRPGWRTDFLTQMGFTVADPGD

SEQ ID NO: 1354945 - protein, 25 aa, Mycobacterium
QDPAVVIGNVVGLFVGNGTADRPNA

SEQ ID NO: 1354946 - protein, 18 aa, Mycobacterium
QIFQRLQLIYLFTIGHKK

SEQ ID NO: 1354947 - protein, 24 aa, Mycobacterium
QQPEWKGRWGAPPAKADFQAIVAA

SEQ ID NO: 1354948 - protein, 17 aa, Mycobacterium
QQVVPFFLGPQGIADAI

SEQ ID NO: 1354949 - protein, 17 aa, Mycobacterium
QQYLYWNLSTWDDYQVK

SEQ ID NO: 1354950 - protein, 25 aa, Mycobacterium
QTLAYRWTLAPGREFGYEATGTAEQ

SEQ ID NO: 1354951 - protein, 17 aa, Mycobacterium
RAARATLRLGWQALRQP

SEQ ID NO: 1354952 - protein, 17 aa, Mycobacterium
RALRPGRRTELYWAARL

SEQ ID NO: 1354953 - protein, 17 aa, Mycobacterium
RATTHWMAADAFRAAFP

SEQ ID NO: 1354954 - protein, 19 aa, Mycobacterium
REALWDWLALGIAAEPVSK

SEQ ID NO: 1354955 - protein, 24 aa, Mycobacterium
RGLSYLRDLWHAVQTQEVSGSDAI

SEQ ID NO: 1354956 - protein, 19 aa, Mycobacterium
RGSVLAALALVVAGAVAPP

SEQ ID NO: 1354957 - protein, 19 aa, Mycobacterium
RLGGLDHHKLVLAGDDVSL

SEQ ID NO: 1354958 - protein, 19 aa, Mycobacterium
RLLAAFGLGSLRNLPSLPS

SEQ ID NO: 1354959 - protein, 20 aa, Mycobacterium
RLLKEQFYSTAWDTLDPLAL

SEQ ID NO: 1354960 - protein, 17 aa, Mycobacterium
RNFLADKVVRWWLPERW

SEQ ID NO: 1354961 - protein, 19 aa, Mycobacterium
RPDVVAVAVPAHWSTAAVA

SEQ ID NO: 1354962 - protein, 20 aa, Mycobacterium
RPGTPIQWAPCQAGAPSDES

SEQ ID NO: 1354963 - protein, 19 aa, Mycobacterium
RRATWLLALLMATASLSAS

SEQ ID NO: 1354964 - protein, 18 aa, Mycobacterium
RSLVRWSVAAAAGTALLS

SEQ ID NO: 1354965 - protein, 18 aa, Mycobacterium
RTAAAPAFFAGATAAIST

SEQ ID NO: 1354966 - protein, 17 aa, Mycobacterium
RTFLHRTAIGFVTAAGA

SEQ ID NO: 1354967 - protein, 19 aa, Mycobacterium
RVANAVRFAFWGSEEIGLE

SEQ ID NO: 1354968 - protein, 19 aa, Mycobacterium
RVSNWPLYMADGFVAAFQT

SEQ ID NO: 1354969 - protein, 17 aa, Mycobacterium
RYARFGWAAARLDDALN

SEQ ID NO: 1354970 - protein, 18 aa, Mycobacterium
SCVPTVGDLREPLYLPVA

SEQ ID NO: 1354971 - protein, 21 aa, Mycobacterium
SEGWWPMLVGLSMGDAGGYKS

SEQ ID NO: 1354972 - protein, 23 aa, Mycobacterium
SGGRVSLGVGFGWNTDELADHNV

SEQ ID NO: 1354973 - protein, 20 aa, Mycobacterium
SNGTHAWGYWGQQLQQMKPD

SEQ ID NO: 1354974 - protein, 21 aa, Mycobacterium
SRNKLPAWLFIQWATGKESMN

SEQ ID NO: 1354975 - protein, 24 aa, Mycobacterium
SSDSTRQAFAWKPTHVGLIDDLEQ

SEQ ID NO: 1354976 - protein, 18 aa, Mycobacterium
STINRLPVRYTFDNRYFN

SEQ ID NO: 1354977 - protein, 21 aa, Mycobacterium
TALEMFKRTGAGHLVLISSVL

SEQ ID NO: 1354978 - protein, 24 aa, Mycobacterium
TDWFGGEPFGVWPWARGQLGPAQP

SEQ ID NO: 1354979 - protein, 18 aa, Mycobacterium
TEASMWWDFSGLTISDVT

SEQ ID NO: 1354980 - protein, 23 aa, Mycobacterium
TFAKPYAEWRGMLSGNTMLLPKS

SEQ ID NO: 1354981 - protein, 17 aa, Mycobacterium
TFLPGRCAIQLDAGAEM

SEQ ID NO: 1354982 - protein, 20 aa, Mycobacterium
TGSITYRYTWHLPKERTWTY

SEQ ID NO: 1354983 - protein, 19 aa, Mycobacterium
TIFPSCVPTVGDLREPLYL

SEQ ID NO: 1354984 - protein, 23 aa, Mycobacterium
TLNRLTTTIPWMFVAGPAGVSER

SEQ ID NO: 1354985 - protein, 34 aa, Mycobacterium
TMLQSGRFQLTWKPEFPYIALAVIAKQSWADAHR

SEQ ID NO: 1354986 - protein, 17 aa, Mycobacterium
TPVLSHRSPELALARAN

SEQ ID NO: 1354987 - protein, 18 aa, Mycobacterium
TQELPGWLAANRGQDPRG

SEQ ID NO: 1354988 - protein, 18 aa, Mycobacterium
TSLSMVFGELVPKNLAVA

SEQ ID NO: 1354989 - protein, 23 aa, Mycobacterium
TTVFGAKFVRFFPPEDPSPEKLR

SEQ ID NO: 1354990 - protein, 17 aa, Mycobacterium
TWWRIDWNTLLDKTIPV

SEQ ID NO: 1354991 - protein, 23 aa, Mycobacterium
TYAKAKNIELVWNSANNDVSTQA

SEQ ID NO: 1354992 - protein, 23 aa, Mycobacterium
VAAEPRPTMLVAISPSDGGILAA

SEQ ID NO: 1354993 - protein, 22 aa, Mycobacterium
VAESIGGIGLRCDVTDPEQVDS

SEQ ID NO: 1354994 - protein, 24 aa, Mycobacterium
VAILLPAHWQTAAVLFGLWWIGAE

SEQ ID NO: 1354995 - protein, 21 aa, Mycobacterium
VAQHGKPAWPMAFAPVDSPDS

SEQ ID NO: 1354996 - protein, 17 aa, Mycobacterium
VASDAGGVVGWWVNPQA

SEQ ID NO: 1354997 - protein, 18 aa, Mycobacterium
VAVPAHWSTAAVAALRAV

SEQ ID NO: 1354998 - protein, 20 aa, Mycobacterium
VDAPTLWPGLPIRPVKGEVL

SEQ ID NO: 1354999 - protein, 19 aa, Mycobacterium
VDGGVIYHYYWFRDQSKTK

SEQ ID NO: 1355000 - protein, 18 aa, Mycobacterium
VDLCSRFVPGMVARGRGA

SEQ ID NO: 1355001 - protein, 23 aa, Mycobacterium
VDPRPHAIESWGRLPDDRQISVR

SEQ ID NO: 1355002 - protein, 23 aa, Mycobacterium
VDRLESRWCGGHLLLQLCGDNLL

SEQ ID NO: 1355003 - protein, 25 aa, Mycobacterium
VEAAKEYRDSLCWINLADLHNTIAA

SEQ ID NO: 1355004 - protein, 17 aa, Mycobacterium
VECNCAGVAPGHVYTAR

SEQ ID NO: 1355005 - protein, 18 aa, Mycobacterium
VEGLPDRWIAIGVGAVDE

SEQ ID NO: 1355006 - protein, 19 aa, Mycobacterium
VEIPAESTVSFGQPTTAAV

SEQ ID NO: 1355007 - protein, 20 aa, Mycobacterium
VESPATWAVLAWARRQPFST

SEQ ID NO: 1355008 - protein, 19 aa, Mycobacterium
VGATLRWESFFTNPVQAFY

SEQ ID NO: 1355009 - protein, 24 aa, Mycobacterium
VGFLVGQAVSIWSYVFEQATKIDP

SEQ ID NO: 1355010 - protein, 26 aa, Mycobacterium
VLDEATNRWGLRVARVELRAIDPPPS

SEQ ID NO: 1355011 - protein, 23 aa, Mycobacterium
VLEGRPSRTFGWARGGEITVTLP

SEQ ID NO: 1355012 - protein, 21 aa, Mycobacterium
VLTSCGSWKGIANVPLPGGPG

SEQ ID NO: 1355013 - protein, 19 aa, Mycobacterium
VNYAAALLGAFAVFALAPA

SEQ ID NO: 1355014 - protein, 19 aa, Mycobacterium
VPNAERWAEEVVEYRPYPP

SEQ ID NO: 1355015 - protein, 18 aa, Mycobacterium
VRFAARYAPGTVHRTRGV

SEQ ID NO: 1355016 - protein, 17 aa, Mycobacterium
VRFAFWGSEEIGLEGSR

SEQ ID NO: 1355017 - protein, 18 aa, Mycobacterium
VSGGFDWRKAAGSTINIL

SEQ ID NO: 1355018 - protein, 24 aa, Mycobacterium
VVEGTRWGRGISVVGGRDVSIRDI

SEQ ID NO: 1355019 - protein, 20 aa, Mycobacterium
VVGLPAWFLGVGVASAEPVA

SEQ ID NO: 1355020 - protein, 17 aa, Mycobacterium
WASFKIDFNLANIGGPS

SEQ ID NO: 1355021 - protein, 18 aa, Mycobacterium
WGNWAKLFFNNKGVVAHA

SEQ ID NO: 1355022 - protein, 20 aa, Mycobacterium
WQLYKRLSTNTVVAYFSDTL

SEQ ID NO: 1355023 - protein, 19 aa, Mycobacterium
WRAAGVGDRIVLRVNVSPV

SEQ ID NO: 1355024 - protein, 20 aa, Mycobacterium
WVLRNACAEFARWRAAGVGD

SEQ ID NO: 1355025 - protein, 17 aa, Mycobacterium
YKIVPAFIEAAQGNKAG

SEQ ID NO: 1355026 - protein, 23 aa, Mycobacterium
YLPGRGNGAGWGVRLLQVHDLDV

SEQ ID NO: 1355027 - protein, 19 aa, Mycobacterium
YMAVKSWDSPGRWTTNYSA

SEQ ID NO: 1355028 - protein, 19 aa, Mycobacterium
YRTEVEWATQMSYSGIYVH

SEQ ID NO: 1355029 - protein, 17 aa, Mycobacterium
YRYTWHLPKERTWTYDG

SEQ ID NO: 1355030 - protein, 24 aa, Mycobacterium
YSVSTPGRFRFLRVYPNAQAYAPV

SEQ ID NO: 1355031 - protein, 19 aa, Mycobacterium
YTYGIGIVISGDWLLQNPM

SEQ ID NO: 1355032 - protein, 18 aa, Mycobacterium
YVRPGSDVELLFVATNDS

SEQ ID NO: 1355033 - protein, 18 aa, Mycobacterium
YYHVFLGLLGPADVKGQR

SEQ ID NO: 1355034 - protein, 25 aa, Mycobacterium
AAAMRRMLLVLGFPDHRIIVEDKAN

SEQ ID NO: 1355035 - protein, 23 aa, Mycobacterium
AAANGPWDFIPTIQVPQIPGLPV

SEQ ID NO: 1355036 - protein, 20 aa, Mycobacterium
AAFLPHVFQWTRAMNPVQPV

SEQ ID NO: 1355037 - protein, 19 aa, Mycobacterium
AASCTAAWRVALAPPAKDT

SEQ ID NO: 1355038 - protein, 18 aa, Mycobacterium
ACHGAWCFDALVGALRNR

SEQ ID NO: 1355039 - protein, 18 aa, Mycobacterium
ACVLWCCAIRHAVLTAQL

SEQ ID NO: 1355040 - protein, 21 aa, Mycobacterium
ADERLRRIFTFQALYAGVPPH

SEQ ID NO: 1355041 - protein, 17 aa, Mycobacterium
ADGFRLTRVTVRDTLAD

SEQ ID NO: 1355042 - protein, 20 aa, Mycobacterium
ADVYGEWKGGWVDFPGGTLD

SEQ ID NO: 1355043 - protein, 18 aa, Mycobacterium
AEAPVPMPDPSNRQTDPA

SEQ ID NO: 1355044 - protein, 19 aa, Mycobacterium
AGGFSYVVPGGWKVSDATN

SEQ ID NO: 1355045 - protein, 24 aa, Mycobacterium
AGGRGGRGGLFVGNGGAGGAGAAG

SEQ ID NO: 1355046 - protein, 26 aa, Mycobacterium
AGGVGGRSGMLFGYAGDGGIGGAAGS

SEQ ID NO: 1355047 - protein, 23 aa, Mycobacterium
AGHPRWVAADVMAGRLNQVGVAK

SEQ ID NO: 1355048 - protein, 18 aa, Mycobacterium
AGVVSVLCAVVFVALAAV

SEQ ID NO: 1355049 - protein, 19 aa, Mycobacterium
AHALRRFGIEGDDRVGTFM

SEQ ID NO: 1355050 - protein, 17 aa, Mycobacterium
AHSLGFEGFADLQVSLR

SEQ ID NO: 1355051 - protein, 17 aa, Mycobacterium
ALFEPATRSLVVLGSGP

SEQ ID NO: 1355052 - protein, 18 aa, Mycobacterium
ALFGSGCARFDGAQSQPF

SEQ ID NO: 1355053 - protein, 18 aa, Mycobacterium
ALLSGLLRAGRQVKDLVV

SEQ ID NO: 1355054 - protein, 18 aa, Mycobacterium
ALPPDWANYGTIIDTFSK

SEQ ID NO: 1355055 - protein, 21 aa, Mycobacterium
AMLDMRIRGVFAMPVLIAGEY

SEQ ID NO: 1355056 - protein, 23 aa, Mycobacterium
ANAARLGLQDVIWRGTYYTPAGP

SEQ ID NO: 1355057 - protein, 18 aa, Mycobacterium
ANGFDISRQFGIGSRETY

SEQ ID NO: 1355058 - protein, 20 aa, Mycobacterium
APESLRFGLYGALVHPIEAN

SEQ ID NO: 1355059 - protein, 21 aa, Mycobacterium
ARAGLHDRVTWIGSGKLGLPG

SEQ ID NO: 1355060 - protein, 22 aa, Mycobacterium
ARLIGEGAPILWADMPTLPLYR

SEQ ID NO: 1355061 - protein, 19 aa, Mycobacterium
ARNDGGLWARLPAGVYVPL

SEQ ID NO: 1355062 - protein, 19 aa, Mycobacterium
ATLAACLSVSMAELLSAAP

SEQ ID NO: 1355063 - protein, 19 aa, Mycobacterium
CGFRGLNSFRLPGTQGQGQ

SEQ ID NO: 1355064 - protein, 17 aa, Mycobacterium
CVIQRGGAYGCSGPIPA

SEQ ID NO: 1355065 - protein, 17 aa, Mycobacterium
DALRRFPGRPVRTATRK

SEQ ID NO: 1355066 - protein, 20 aa, Mycobacterium
DAVFHCPFCHGWEVRDAPVA

SEQ ID NO: 1355067 - protein, 17 aa, Mycobacterium
DDAWFITDWMDATRAQE

SEQ ID NO: 1355068 - protein, 26 aa, Mycobacterium
DFIKSLEFLPTFPFHYTYLRNAVRGD

SEQ ID NO: 1355069 - protein, 25 aa, Mycobacterium
DGDIWDWAVPWEEWKSMSALSDQAS

SEQ ID NO: 1355070 - protein, 17 aa, Mycobacterium
DGRRVSADWYFPDTDEP

SEQ ID NO: 1355071 - protein, 17 aa, Mycobacterium
DPGFRSWGFWLFGVFIP

SEQ ID NO: 1355072 - protein, 22 aa, Mycobacterium
DVRNTVRFGFWGAEEQGLLGSM

SEQ ID NO: 1355073 - protein, 17 aa, Mycobacterium
EFAEAGWALPLSDDPAG

SEQ ID NO: 1355074 - protein, 22 aa, Mycobacterium
EIEMMRGWLALWGVGPAAAQQH

SEQ ID NO: 1355075 - protein, 20 aa, Mycobacterium
EKMLPKFLWERPDTVAKAGL

SEQ ID NO: 1355076 - protein, 17 aa, Mycobacterium
ELPVEMVGGGVWEPGEW

SEQ ID NO: 1355077 - protein, 23 aa, Mycobacterium
EPRAWRLAVELSREGDQIKMSKV

SEQ ID NO: 1355078 - protein, 18 aa, Mycobacterium
ETIGGLVLQELGHIPEVG

SEQ ID NO: 1355079 - protein, 19 aa, Mycobacterium
EVPCRVMAFDVLRLDGRDT

SEQ ID NO: 1355080 - protein, 24 aa, Mycobacterium
FDRGDIDAGYSWLPTLDQLRRNGK

SEQ ID NO: 1355081 - protein, 18 aa, Mycobacterium
FECEGCRALYPVVEQLRA

SEQ ID NO: 1355082 - protein, 23 aa, Mycobacterium
FEEGLRATVQWYRDNEAWWRPLK

SEQ ID NO: 1355083 - protein, 18 aa, Mycobacterium
FPMEFARTPDGGWQLTRD

SEQ ID NO: 1355084 - protein, 21 aa, Mycobacterium
FRWRGVLEVSRLPQGEVAVGH

SEQ ID NO: 1355085 - protein, 19 aa, Mycobacterium
FTFYLCDLLLKVNGKGGQP

SEQ ID NO: 1355086 - protein, 19 aa, Mycobacterium
FTGAAPWVMVSNFRIKIDG

SEQ ID NO: 1355087 - protein, 25 aa, Mycobacterium
FTPNPWRPGSSMSHLDDATFTGVNV

SEQ ID NO: 1355088 - protein, 25 aa, Mycobacterium
GDGTRRFGATISRIDRDDADERPRG

SEQ ID NO: 1355089 - protein, 17 aa, Mycobacterium
GDWATVFAMLDDDDTPV

SEQ ID NO: 1355090 - protein, 17 aa, Mycobacterium
GDWRSNVLLISTDNDLT

SEQ ID NO: 1355091 - protein, 19 aa, Mycobacterium
GEASPLWRAGLWGDAIPSL

SEQ ID NO: 1355092 - protein, 17 aa, Mycobacterium
GELAGLVQRAAWPQTYL

SEQ ID NO: 1355093 - protein, 22 aa, Mycobacterium
GENARWFYDFSVPGDVVEVRNT

SEQ ID NO: 1355094 - protein, 19 aa, Mycobacterium
GGSSEGWMSGSGGWGGDGG

SEQ ID NO: 1355095 - protein, 17 aa, Mycobacterium
GISPMAAVSIFIDGTKD

SEQ ID NO: 1355096 - protein, 18 aa, Mycobacterium
GPMQFLPGTWARYASDGD

SEQ ID NO: 1355097 - protein, 18 aa, Mycobacterium
GQDLLLWVQPPPSSTSSS

SEQ ID NO: 1355098 - protein, 22 aa, Mycobacterium
GQRTPERWFVVWLGSATNPVDR

SEQ ID NO: 1355099 - protein, 19 aa, Mycobacterium
GRGRNCLRPPLSPLSRSAI

SEQ ID NO: 1355100 - protein, 20 aa, Mycobacterium
GRWLRHASFKGCREVADLSQ

SEQ ID NO: 1355101 - protein, 19 aa, Mycobacterium
GSLELGYQIGFPWSLGVGI

SEQ ID NO: 1355102 - protein, 23 aa, Mycobacterium
GSLRGTFRLTVCKPGSGDAPSVA

SEQ ID NO: 1355103 - protein, 20 aa, Mycobacterium
GVSLAEVWKTQAYAYLGITV

SEQ ID NO: 1355104 - protein, 20 aa, Mycobacterium
GVWWDCYRDLVSNVVLVDKI

SEQ ID NO: 1355105 - protein, 19 aa, Mycobacterium
HPDYAVTVLDAFTYAGSRE

SEQ ID NO: 1355106 - protein, 17 aa, Mycobacterium
HPLVERDRILGGFHTPT

SEQ ID NO: 1355107 - protein, 19 aa, Mycobacterium
HTFSLPELTDWSNADFTVE

SEQ ID NO: 1355108 - protein, 19 aa, Mycobacterium
IEPFIAVADLHGWKHNCDL

SEQ ID NO: 1355109 - protein, 18 aa, Mycobacterium
IFATLGPLRRGDGFVLFC

SEQ ID NO: 1355110 - protein, 25 aa, Mycobacterium
IGDSKRSTGLFGFVVDWANDPNVFG

SEQ ID NO: 1355111 - protein, 17 aa, Mycobacterium
IGFSVRHLMVSKVRGTF

SEQ ID NO: 1355112 - protein, 17 aa, Mycobacterium
IGLNTVRVFLHDQLWAQ

SEQ ID NO: 1355113 - protein, 23 aa, Mycobacterium
INYPREFGIMTGLGSHTYDDSKS

SEQ ID NO: 1355114 - protein, 19 aa, Mycobacterium
KACPAPGVMQGCLESTSGL

SEQ ID NO: 1355115 - protein, 25 aa, Mycobacterium
KAVADRCPRTVFILTGYSQGADVAG

SEQ ID NO: 1355116 - protein, 20 aa, Mycobacterium
KDGYDASGVTFVLLGNGARN

SEQ ID NO: 1355117 - protein, 22 aa, Mycobacterium
KDSKISTVWTWPDRPGVAGCAA

SEQ ID NO: 1355118 - protein, 17 aa, Mycobacterium
KGAAYGIATPISDIVVP

SEQ ID NO: 1355119 - protein, 17 aa, Mycobacterium
KGDGCVFGPAWNDPLAH

SEQ ID NO: 1355120 - protein, 18 aa, Mycobacterium
KHAARLSWFQALATEQRT

SEQ ID NO: 1355121 - protein, 17 aa, Mycobacterium
KIAGRWGAVSLPVGGAN

SEQ ID NO: 1355122 - protein, 20 aa, Mycobacterium
KIERRGWHALLTLALNGDVD

SEQ ID NO: 1355123 - protein, 21 aa, Mycobacterium
KKLPSWKVVVPPGQAVAGYYY

SEQ ID NO: 1355124 - protein, 23 aa, Mycobacterium
LAMGHAMIRAGLAIKDHGRPWRP

SEQ ID NO: 1355125 - protein, 22 aa, Mycobacterium
LDAVTLRPGRPAGCSAGDYGAV

SEQ ID NO: 1355126 - protein, 20 aa, Mycobacterium
LEHAYKLGVTSVRVATHCTE

SEQ ID NO: 1355127 - protein, 17 aa, Mycobacterium
LEMLGQLGGMLGRAKGP

SEQ ID NO: 1355128 - protein, 24 aa, Mycobacterium
LERLRALPLAPFRDSYAYTNFGLT

SEQ ID NO: 1355129 - protein, 23 aa, Mycobacterium
LFRRAGATNVRWMWSPDAIGGGE

SEQ ID NO: 1355130 - protein, 25 aa, Mycobacterium
LGFERWAPEMPWEISIGRTVRPVEL

SEQ ID NO: 1355131 - protein, 17 aa, Mycobacterium
LGPELSRIVQGSTRLAG

SEQ ID NO: 1355132 - protein, 17 aa, Mycobacterium
LGSIAASCTAAWRVALA

SEQ ID NO: 1355133 - protein, 26 aa, Mycobacterium
LGYQVGFPWSLGVGINFSYTTPNIAF

SEQ ID NO: 1355134 - protein, 20 aa, Mycobacterium
LKVYDCYRPQRAVNDFVAWA

SEQ ID NO: 1355135 - protein, 19 aa, Mycobacterium
LMYRKDLFEQAGITVDQNP

SEQ ID NO: 1355136 - protein, 22 aa, Mycobacterium
LNITLPMPRGWAYIPDPNVPEA

SEQ ID NO: 1355137 - protein, 17 aa, Mycobacterium
LPELTDWSNADFTVENV

SEQ ID NO: 1355138 - protein, 22 aa, Mycobacterium
LRARDGWCALTLSRPDDLAAVP

SEQ ID NO: 1355139 - protein, 25 aa, Mycobacterium
LRGAEFDRLWLESMISHHQGAVEMA

SEQ ID NO: 1355140 - protein, 23 aa, Mycobacterium
LRVSGYAGWVAWGLLHIAFLTGV

SEQ ID NO: 1355141 - protein, 17 aa, Mycobacterium
LWARLPAGVYVPLIGLS

SEQ ID NO: 1355142 - protein, 22 aa, Mycobacterium
MALRLERFAVWLIFELLAVTLV

SEQ ID NO: 1355143 - protein, 17 aa, Mycobacterium
MAMPGMVDDATMKRLES

SEQ ID NO: 1355144 - protein, 21 aa, Mycobacterium
NCGVSWNLLAGIGRIESGHAS

SEQ ID NO: 1355145 - protein, 18 aa, Mycobacterium
NGVIARKGAAYGIATPIS

SEQ ID NO: 1355146 - protein, 22 aa, Mycobacterium
NPDGAWEFISWMTSKDYMKLVG

SEQ ID NO: 1355147 - protein, 24 aa, Mycobacterium
NPPVEGAFYWLSNREVRWRPAEYW

SEQ ID NO: 1355148 - protein, 22 aa, Mycobacterium
NRLELAPAILVGWSFGGSLALG

SEQ ID NO: 1355149 - protein, 23 aa, Mycobacterium
NVPEAFAVIADRVGGDGLYSSNA

SEQ ID NO: 1355150 - protein, 21 aa, Mycobacterium
PADAKAVIVSPQLVTARAVQL

SEQ ID NO: 1355151 - protein, 18 aa, Mycobacterium
PAFTGWHRLEYLLFSQNT

SEQ ID NO: 1355152 - protein, 19 aa, Mycobacterium
PAGKLRAGSLIPLTSAGAY

SEQ ID NO: 1355153 - protein, 18 aa, Mycobacterium
PAMRTGFYGFGFNVGTSS

SEQ ID NO: 1355154 - protein, 20 aa, Mycobacterium
PAVTAFARWIGDPRSRLDRY

SEQ ID NO: 1355155 - protein, 19 aa, Mycobacterium
PDLTIPRRFLPGLSDDQLL

SEQ ID NO: 1355156 - protein, 21 aa, Mycobacterium
PEDRTAVPLEWDDLRTQLEKL

SEQ ID NO: 1355157 - protein, 22 aa, Mycobacterium
PEWEVLRPSWFMQNFTGAHPVA

SEQ ID NO: 1355158 - protein, 23 aa, Mycobacterium
PGGKSALGLWSWAIPANSAAPDA

SEQ ID NO: 1355159 - protein, 31 aa, Mycobacterium
PGRANGGLFARLYPLAGLFGIDTVTPDTEVS

SEQ ID NO: 1355160 - protein, 17 aa, Mycobacterium
PLLDLGVPPEIVRALDP

SEQ ID NO: 1355161 - protein, 18 aa, Mycobacterium
PLNIPYKVAFVLDVAGDN

SEQ ID NO: 1355162 - protein, 17 aa, Mycobacterium
PPLPRLASESAPAVTVT

SEQ ID NO: 1355163 - protein, 26 aa, Mycobacterium
PQRGYKIFEEWANWLFAAGGSIYDAD

SEQ ID NO: 1355164 - protein, 23 aa, Mycobacterium
PSADELRSALALVGQLAQAPIVA

SEQ ID NO: 1355165 - protein, 18 aa, Mycobacterium
PTLPAWRIVEPRPAEELM

SEQ ID NO: 1355166 - protein, 19 aa, Mycobacterium
QDAPLAWRTALWFWTTQKA

SEQ ID NO: 1355167 - protein, 19 aa, Mycobacterium
QGYSLKVYDCYRPQRAVND

SEQ ID NO: 1355168 - protein, 22 aa, Mycobacterium
QLARLAAMGGFRRWDRVVRNYI

SEQ ID NO: 1355169 - protein, 20 aa, Mycobacterium
QPSRGPRRWGIRRHIHTAPW

SEQ ID NO: 1355170 - protein, 22 aa, Mycobacterium
QVEKLRSVFTLRAVEKDAGVEP

SEQ ID NO: 1355171 - protein, 19 aa, Mycobacterium
RAALEYGLRLAAMEAEWAA

SEQ ID NO: 1355172 - protein, 23 aa, Mycobacterium
RDAHLRAADFFDVENHPVATFTS

SEQ ID NO: 1355173 - protein, 22 aa, Mycobacterium
REDPSRPAVCIVRARSKDGSET

SEQ ID NO: 1355174 - protein, 20 aa, Mycobacterium
RFYPGDVVDVTWIDGFGQER

SEQ ID NO: 1355175 - protein, 22 aa, Mycobacterium
RGCTHPGCTVPFYWTEAHHTDD

SEQ ID NO: 1355176 - protein, 21 aa, Mycobacterium
RGNRNYPCLNRPGKRAPTAKM

SEQ ID NO: 1355177 - protein, 19 aa, Mycobacterium
RIAPRKALALRALDVVAPR

SEQ ID NO: 1355178 - protein, 24 aa, Mycobacterium
RLASDMGEFFMPFPGTRVNQSTTP

SEQ ID NO: 1355179 - protein, 20 aa, Mycobacterium
RNIVYRTRIDGVSRGATITY

SEQ ID NO: 1355180 - protein, 17 aa, Mycobacterium
RRIGLNTVRVFLHDQLW

SEQ ID NO: 1355181 - protein, 19 aa, Mycobacterium
RRLADRAVDEFGRLDVMVN

SEQ ID NO: 1355182 - protein, 20 aa, Mycobacterium
RRPGGAWMLGKPILLSEARD

SEQ ID NO: 1355183 - protein, 18 aa, Mycobacterium
RRQRAWWAGMLVVPAMVL

SEQ ID NO: 1355184 - protein, 18 aa, Mycobacterium
RSLRLAGMRPVPRWPARP

SEQ ID NO: 1355185 - protein, 20 aa, Mycobacterium
RTGIYGGIRACQWAVADGVI

SEQ ID NO: 1355186 - protein, 18 aa, Mycobacterium
RWNFLNVVRPLGVQLDNL

SEQ ID NO: 1355187 - protein, 21 aa, Mycobacterium
RYRIDGASMPTEWATGQLATR

SEQ ID NO: 1355188 - protein, 20 aa, Mycobacterium
SAKLCVQYLAPIIKNRQYNF

SEQ ID NO: 1355189 - protein, 17 aa, Mycobacterium
SDRPGCPAATWCVSNAG

SEQ ID NO: 1355190 - protein, 22 aa, Mycobacterium
SRLPWERIEPLAGLVEEIDGKV

SEQ ID NO: 1355191 - protein, 22 aa, Mycobacterium
SRRWSAARAHAWYQQQGWLVGA

SEQ ID NO: 1355192 - protein, 22 aa, Mycobacterium
SSVNDLTKWLAMVLADGKAGGQ

SEQ ID NO: 1355193 - protein, 19 aa, Mycobacterium
SVTFHFDRAGDIEMPVPVE

SEQ ID NO: 1355194 - protein, 23 aa, Mycobacterium
TACNGGRGGLLWGNGGDGANGGV

SEQ ID NO: 1355195 - protein, 19 aa, Mycobacterium
TAFDASRPVFGFAPYPGVQ

SEQ ID NO: 1355196 - protein, 18 aa, Mycobacterium
TAVGRLGPELSRIVQGST

SEQ ID NO: 1355197 - protein, 24 aa, Mycobacterium
TDPPVEGAFYWLSNQEVRWRPAEY

SEQ ID NO: 1355198 - protein, 18 aa, Mycobacterium
TFVGAVCRWQAANPAGLV

SEQ ID NO: 1355199 - protein, 20 aa, Mycobacterium
TGGDFTFPMEFARTPDGGWQ

SEQ ID NO: 1355200 - protein, 24 aa, Mycobacterium
TITARLNFQLAFGARIGVRLTEAR

SEQ ID NO: 1355201 - protein, 19 aa, Mycobacterium
TKLRPGDAIPLDRTAPALD

SEQ ID NO: 1355202 - protein, 18 aa, Mycobacterium
TLELGYQVGFPWSLGVGI

SEQ ID NO: 1355203 - protein, 24 aa, Mycobacterium
TNVKVPLQPGVPWVFQTTLDDPTQ

SEQ ID NO: 1355204 - protein, 21 aa, Mycobacterium
TQAGPACLAWFGNKDDGKCLS

SEQ ID NO: 1355205 - protein, 17 aa, Mycobacterium
TSFRDVLAPAWQQATGG

SEQ ID NO: 1355206 - protein, 18 aa, Mycobacterium
TSWGRLVFCGSPRRYEPR

SEQ ID NO: 1355207 - protein, 17 aa, Mycobacterium
TTLSFWTPPGVYTVLDK

SEQ ID NO: 1355208 - protein, 24 aa, Mycobacterium
TVEPRSGQEFQFRTEVPGNVEIEL

SEQ ID NO: 1355209 - protein, 17 aa, Mycobacterium
TVLRFAHSLGFEGFADL

SEQ ID NO: 1355210 - protein, 19 aa, Mycobacterium
VCYLPAFLCLGIVPVVVGL

SEQ ID NO: 1355211 - protein, 21 aa, Mycobacterium
VGGMCWSAPSAQAFYIHNHAA

SEQ ID NO: 1355212 - protein, 17 aa, Mycobacterium
VIPEDRTAVPLEWDDLR

SEQ ID NO: 1355213 - protein, 21 aa, Mycobacterium
VKQGWMCCVGSDWMHLSTGVI

SEQ ID NO: 1355214 - protein, 18 aa, Mycobacterium
VLCAVVFVALAAVGGLLF

SEQ ID NO: 1355215 - protein, 24 aa, Mycobacterium
VNFVLRYFPLRSHFNAERAARAVE

SEQ ID NO: 1355216 - protein, 20 aa, Mycobacterium
VPMFPNLFLLYGPNTNVGSG

SEQ ID NO: 1355217 - protein, 20 aa, Mycobacterium
VTGRTALPGFGRHLQLARPG

SEQ ID NO: 1355218 - protein, 25 aa, Mycobacterium
VVGALDLVKCLNWPSGSAPPEPKDL

SEQ ID NO: 1355219 - protein, 19 aa, Mycobacterium
VYFPRGGMRAVPDAMAAAA

SEQ ID NO: 1355220 - protein, 19 aa, Mycobacterium
VYNDGGQDLLLWVQPPPSS

SEQ ID NO: 1355221 - protein, 17 aa, Mycobacterium
WAIPWGFENNVVAYNKA

SEQ ID NO: 1355222 - protein, 17 aa, Mycobacterium
WFVVWLGSATNPVDREA

SEQ ID NO: 1355223 - protein, 17 aa, Mycobacterium
WRPEVVHAHDWLVAHPA

SEQ ID NO: 1355224 - protein, 20 aa, Mycobacterium
YDPALARPGIHFDPEPVEDS

SEQ ID NO: 1355225 - protein, 20 aa, Mycobacterium
YKKSLWCGIGGLIPFAKSGP

SEQ ID NO: 1355226 - protein, 19 aa, Mycobacterium
YPFTFAFERSGEVTVQVPI

SEQ ID NO: 1355227 - protein, 19 aa, Mycobacterium
YRGEPVGTFTGWRPAMPVT

SEQ ID NO: 1355228 - protein, 19 aa, Mycobacterium
YRTEVDWATQMSYSGIYVH

SEQ ID NO: 1355229 - protein, 23 aa, Mycobacterium
YVSELRPGADFDFKPVTRGYADA

SEQ ID NO: 1355230 - protein, 25 aa, Mycobacterium
AAAMRRMLLVLGFPDHRIIVEDRAN

SEQ ID NO: 1355231 - protein, 22 aa, Mycobacterium
AAANGPWDFIPTIQVPQIPGLP

SEQ ID NO: 1355232 - protein, 17 aa, Mycobacterium
AADDVRLGWPLKPSPTV

SEQ ID NO: 1355233 - protein, 17 aa, Mycobacterium
AADGAVWVFSGHGSHWP

SEQ ID NO: 1355234 - protein, 20 aa, Mycobacterium
AADMPDRFNLLALANVLAGF

SEQ ID NO: 1355235 - protein, 17 aa, Mycobacterium
AAEIAEIIGLFRAAARR

SEQ ID NO: 1355236 - protein, 18 aa, Mycobacterium
AAELRYGRIPEVEKKLDA

SEQ ID NO: 1355237 - protein, 18 aa, Mycobacterium
AAGATAWAIGQKVPNGTT

SEQ ID NO: 1355238 - protein, 19 aa, Mycobacterium
AAGATRWLVLSGPPGIGKT

SEQ ID NO: 1355239 - protein, 19 aa, Mycobacterium
AAGDARLFVGAPWVLSVDD

SEQ ID NO: 1355240 - protein, 19 aa, Mycobacterium
AAGYLCWRGKDLSKPRGWM

SEQ ID NO: 1355241 - protein, 20 aa, Mycobacterium
AAKLCVQYLAPILKNRQYNF

SEQ ID NO: 1355242 - protein, 28 aa, Mycobacterium
AALIPGFIKRWFSWLGQLNFQACIFGIS

SEQ ID NO: 1355243 - protein, 17 aa, Mycobacterium
AAPLFHNIASWLLQRQN

SEQ ID NO: 1355244 - protein, 25 aa, Mycobacterium
AAPLLGVLCSIGWQRGKPSVTVQAE

SEQ ID NO: 1355245 - protein, 19 aa, Mycobacterium
AAPPTWTMPDIRGMNLAAA

SEQ ID NO: 1355246 - protein, 18 aa, Mycobacterium
AAQLPRRWIAVGVAAADG

SEQ ID NO: 1355247 - protein, 25 aa, Mycobacterium
AATLPFAALPLMFLGPVPLAAATQV

SEQ ID NO: 1355248 - protein, 20 aa, Mycobacterium
ACGKAGCSTYKWETFLTQEL

SEQ ID NO: 1355249 - protein, 20 aa, Mycobacterium
ACHGAWCFDDLVGALRNRGH

SEQ ID NO: 1355250 - protein, 17 aa, Mycobacterium
ACPECGPTLSWHGPGPH

SEQ ID NO: 1355251 - protein, 18 aa, Mycobacterium
ACVLWCCAIRHAVLTGQL

SEQ ID NO: 1355252 - protein, 17 aa, Mycobacterium
ADDFWLGGDPMYRAVAE

SEQ ID NO: 1355253 - protein, 17 aa, Mycobacterium
ADGSFTYTISKLLTSSY

SEQ ID NO: 1355254 - protein, 24 aa, Mycobacterium
ADGVPMGMVFRLREDVDLSGYAES

SEQ ID NO: 1355255 - protein, 26 aa, Mycobacterium
ADLDAFLRLLGDRGVDVLIYNVQTEG

SEQ ID NO: 1355256 - protein, 18 aa, Mycobacterium
ADSFPSEVIGEFFDGGPV

SEQ ID NO: 1355257 - protein, 17 aa, Mycobacterium
ADYIYAYGFRNPFRLTF

SEQ ID NO: 1355258 - protein, 21 aa, Mycobacterium
AEALRALGIRVWSDVPVGAST

SEQ ID NO: 1355259 - protein, 18 aa, Mycobacterium
AEGAWKPGWVEFTGTGLS

SEQ ID NO: 1355260 - protein, 17 aa, Mycobacterium
AEGDWLYFVTIDLQGTT

SEQ ID NO: 1355261 - protein, 24 aa, Mycobacterium
AEGLNRFAGILARSKDSLGRTLDT

SEQ ID NO: 1355262 - protein, 18 aa, Mycobacterium
AEIIGLFRAAARRAVDAG

SEQ ID NO: 1355263 - protein, 17 aa, Mycobacterium
AEIPPRCLMNGPRTVLC

SEQ ID NO: 1355264 - protein, 17 aa, Mycobacterium
AELKTNWLPEGQYANVI

SEQ ID NO: 1355265 - protein, 17 aa, Mycobacterium
AENRVDAVVGWHQAGGD

SEQ ID NO: 1355266 - protein, 24 aa, Mycobacterium
AEPRRAAVCSYGYGGTIAHVLLEE

SEQ ID NO: 1355267 - protein, 20 aa, Mycobacterium
AEPVLREFVDLGFDWSGDPG

SEQ ID NO: 1355268 - protein, 19 aa, Mycobacterium
AETPVLWTVFAWTRRTFFN

SEQ ID NO: 1355269 - protein, 18 aa, Mycobacterium
AGAGFAYAATDVITFYPP

SEQ ID NO: 1355270 - protein, 19 aa, Mycobacterium
AGCEWRGLNSLPLPGTAGG

SEQ ID NO: 1355271 - protein, 20 aa, Mycobacterium
AGCQRLDGRTALGYVRSRAT

SEQ ID NO: 1355272 - protein, 18 aa, Mycobacterium
AGGFSVVYRAGGRVVGTL

SEQ ID NO: 1355273 - protein, 20 aa, Mycobacterium
AGGFSYVVPAGWEVSDSTQL

SEQ ID NO: 1355274 - protein, 19 aa, Mycobacterium
AGGTTGIFGVTRYVFDVIT

SEQ ID NO: 1355275 - protein, 26 aa, Mycobacterium
AGGVGGRSGMLFGYAGDGGIGGAAGT

SEQ ID NO: 1355276 - protein, 18 aa, Mycobacterium
AGLCALVALPAAWLTGCS

SEQ ID NO: 1355277 - protein, 23 aa, Mycobacterium
AGLRGAVYWDPLATLGFLAARTS

SEQ ID NO: 1355278 - protein, 36 aa, Mycobacterium; identical to SEQ ID NO: 1290390

SEQ ID NO: 1355279 - protein, 25 aa, Mycobacterium
AGRDCGPLRWLPAIPDRLAGDPQWG

SEQ ID NO: 1355280 - protein, 24 aa, Mycobacterium
AGVVSVLCAVAFVALAAVGGSLFW

SEQ ID NO: 1355281 - protein, 17 aa, Mycobacterium
AGWCERYPDVTVHRESV

SEQ ID NO: 1355282 - protein, 28 aa, Mycobacterium
AGWYSEPWWKPALVAGAWGLGSALLFSS

SEQ ID NO: 1355283 - protein, 17 aa, Mycobacterium
AKACAPAGITVEDAAAE

SEQ ID NO: 1355284 - protein, 22 aa, Mycobacterium
AKDLGMLSMWSVNRDKPGNLGQ

SEQ ID NO: 1355285 - protein, 17 aa, Mycobacterium
AKLCVQYLAPIVKNRQF

SEQ ID NO: 1355286 - protein, 17 aa, Mycobacterium
AKLCVQYLAPIVKNRQY

SEQ ID NO: 1355287 - protein, 17 aa, Mycobacterium
AKWNLLAPYAYASNGGK

SEQ ID NO: 1355288 - protein, 19 aa, Mycobacterium
ALAVGVVFGARVVPRLREH

SEQ ID NO: 1355289 - protein, 20 aa, Mycobacterium
ALDRACIAIALFGGLDVPLQ

SEQ ID NO: 1355290 - protein, 18 aa, Mycobacterium
ALEAVRFSARYAPKLVHR

SEQ ID NO: 1355291 - protein, 18 aa, Mycobacterium
ALPPTWRLLTSRGPYELP

SEQ ID NO: 1355292 - protein, 18 aa, Mycobacterium
ALSGCGWSPPAPPPTSTA

SEQ ID NO: 1355293 - protein, 23 aa, Mycobacterium
ALTEWLGYVWVCLADVPPSFEET

SEQ ID NO: 1355294 - protein, 24 aa, Mycobacterium
ALTYPRRLGFGLGETVVSLAWRTG

SEQ ID NO: 1355295 - protein, 28 aa, Mycobacterium
ALTYPRRLGFGLGETVVSLGWRTGDDIV

SEQ ID NO: 1355296 - protein, 18 aa, Mycobacterium
ALVGGVWGFSVPKTEGMQ

SEQ ID NO: 1355297 - protein, 19 aa, Mycobacterium
AMRSGFYGYGFNVGTTSAA

SEQ ID NO: 1355298 - protein, 17 aa, Mycobacterium
ANFMFSYFVGVDENGHL

SEQ ID NO: 1355299 - protein, 28 aa, Mycobacterium
ANGGLFARLYPLAGLFGIDTVTPDTEVS

SEQ ID NO: 1355300 - protein, 17 aa, Mycobacterium
ANLDWDPSVAILGFPFI

SEQ ID NO: 1355301 - protein, 23 aa, Mycobacterium
APAPEIPGLPFLQQLAANPAAAT

SEQ ID NO: 1355302 - protein, 19 aa, Mycobacterium
APDAGTLASLIVRIAEADQ

SEQ ID NO: 1355303 - protein, 19 aa, Mycobacterium
APDFLPVVLEFAATVDAGV

SEQ ID NO: 1355304 - protein, 19 aa, Mycobacterium
APESLRFGLYGALVHPIEA

SEQ ID NO: 1355305 - protein, 23 aa, Mycobacterium
APTRAAMEAMWEWVTASSDTLET

SEQ ID NO: 1355306 - protein, 18 aa, Mycobacterium
AQALLLCYRRRRWYLEGV

SEQ ID NO: 1355307 - protein, 17 aa, Mycobacterium
AQAVPWARACAAVLLAV

SEQ ID NO: 1355308 - protein, 17 aa, Mycobacterium
AQMKALFGLGWHPNADK

SEQ ID NO: 1355309 - protein, 18 aa, Mycobacterium
ARDLELCGVTWVYSYAVA

SEQ ID NO: 1355310 - protein, 19 aa, Mycobacterium
ARGRPADQLRIWAAQRAPA

SEQ ID NO: 1355311 - protein, 21 aa, Mycobacterium
ARLLGEAGPILWGDMPTLPLY

SEQ ID NO: 1355312 - protein, 19 aa, Mycobacterium
ARPSPPASFCPATNTIVVD

SEQ ID NO: 1355313 - protein, 19 aa, Mycobacterium
ARRHWPALLASLSGDDGAR

SEQ ID NO: 1355314 - protein, 18 aa, Mycobacterium
ASCTAAWRVALAPPAKDT

SEQ ID NO: 1355315 - protein, 18 aa, Mycobacterium
ASIFKLYVLFAVAEAVKA

SEQ ID NO: 1355316 - protein, 17 aa, Mycobacterium
ASSLEWVVLRLGGVLSV

SEQ ID NO: 1355317 - protein, 17 aa, Mycobacterium
ASTPGRAAGPVLVSSNG

SEQ ID NO: 1355318 - protein, 23 aa, Mycobacterium
ATAGEVPLAFALAAGSFRDGTRV

SEQ ID NO: 1355319 - protein, 22 aa, Mycobacterium
ATARSSLSWFSPKVYGTVTAKD

SEQ ID NO: 1355320 - protein, 18 aa, Mycobacterium
ATDPNWDRLTFVASTVDT

SEQ ID NO: 1355321 - protein, 25 aa, Mycobacterium
ATEQRWLVKRARIYRNVVIPQPDNP

SEQ ID NO: 1355322 - protein, 18 aa, Mycobacterium
ATFSWEFEDGSSLGQLAR

SEQ ID NO: 1355323 - protein, 18 aa, Mycobacterium
ATLEQWRRIVDLNLWGVI

SEQ ID NO: 1355324 - protein, 21 aa, Mycobacterium
ATPDAAWAFVSWITAKPNDVV

SEQ ID NO: 1355325 - protein, 23 aa, Mycobacterium
ATPPWWPMRRLVRALGADADEVL

SEQ ID NO: 1355326 - protein, 19 aa, Mycobacterium
AVAALWPQRCTGLVAVSGY

SEQ ID NO: 1355327 - protein, 19 aa, Mycobacterium
AVAIGFVSVRSWSSSSQTQ

SEQ ID NO: 1355328 - protein, 21 aa, Mycobacterium
AVDLPRIIGNALKPATPALAK

SEQ ID NO: 1355329 - protein, 20 aa, Mycobacterium
AVGLADGWMPFGLTPARIAE

SEQ ID NO: 1355330 - protein, 17 aa, Mycobacterium
AVIIQFVVKTVVGMLDW

SEQ ID NO: 1355331 - protein, 25 aa, Mycobacterium
AWEVLQIPVGLAFFFRNSSLGRTVA

SEQ ID NO: 1355332 - protein, 20 aa, Mycobacterium
AWNLPAVFGPIAITYNLEGV

SEQ ID NO: 1355333 - protein, 21 aa, Mycobacterium
AYAGEIGMRVILDHHRSSAGA

SEQ ID NO: 1355334 - protein, 17 aa, Mycobacterium
AYAGLPNPHAWMSPLNV

SEQ ID NO: 1355335 - protein, 21 aa, Mycobacterium
AYRNAPMGFGWPDGIAEVPAL

SEQ ID NO: 1355336 - protein, 18 aa, Mycobacterium
CADARPSPPASFCPATNT

SEQ ID NO: 1355337 - protein, 25 aa, Mycobacterium
CAFDDPFCSPGFNLPAHFAYVDNGM

SEQ ID NO: 1355338 - protein, 17 aa, Mycobacterium
CAPFCVAGKYLDTQTGL

SEQ ID NO: 1355339 - protein, 17 aa, Mycobacterium
CAQAALVARAMDTTVTD

SEQ ID NO: 1355340 - protein, 23 aa, Mycobacterium
CGAFKEALPNWKGLANLPVSTAL

SEQ ID NO: 1355341 - protein, 18 aa, Mycobacterium
CIACGAIRTPGLEADAKR

SEQ ID NO: 1355342 - protein, 17 aa, Mycobacterium
CMTGFLPASEWRSPADT

SEQ ID NO: 1355343 - protein, 21 aa, Mycobacterium
CPGEGPGTHWLPITVTPISPP

SEQ ID NO: 1355344 - protein, 19 aa, Mycobacterium
CRGPIAAQGPGLWEVTTLF

SEQ ID NO: 1355345 - protein, 18 aa, Mycobacterium
CRPYRGKEICGMPPPSSG

SEQ ID NO: 1355346 - protein, 18 aa, Mycobacterium
CWSAPSAQAFYIHNHAAV

SEQ ID NO: 1355347 - protein, 25 aa, Mycobacterium
DADPVILCAMPFFWIGGVLAATGAL

SEQ ID NO: 1355348 - protein, 20 aa, Mycobacterium
DAHAANGWCDARAIPVDECY

SEQ ID NO: 1355349 - protein, 25 aa, Mycobacterium
DALTRLRGMFAFALWDSVAQELFCA

SEQ ID NO: 1355350 - protein, 17 aa, Mycobacterium
DAPTCPVALAFPDGPQS

SEQ ID NO: 1355351 - protein, 23 aa, Mycobacterium
DCGDGYEVPADWYVPEGATPTRL

SEQ ID NO: 1355352 - protein, 17 aa, Mycobacterium
DDGAERWLRAFKDQDPQ

SEQ ID NO: 1355353 - protein, 17 aa, Mycobacterium
DDRWEWFGYQLDSTDTE

SEQ ID NO: 1355354 - protein, 18 aa, Mycobacterium
DEYIMRTGADWFPGLDRQ

SEQ ID NO: 1355355 - protein, 22 aa, Mycobacterium
DFFSFYLCDIVLKLNGKGGQPV

SEQ ID NO: 1355356 - protein, 17 aa, Mycobacterium
DFQAIVAAMLELTGEQA

SEQ ID NO: 1355357 - protein, 26 aa, Mycobacterium
DFVKSLEFLPTFPFHYKYLRNAVRGD

SEQ ID NO: 1355358 - protein, 22 aa, Mycobacterium
DGGGIPSFLGYHGFPASICASV

SEQ ID NO: 1355359 - protein, 22 aa, Mycobacterium
DGGRGGLLFGNGGRGGDALTSG

SEQ ID NO: 1355360 - protein, 17 aa, Mycobacterium
DGIPYRNTYAWFLTLND

SEQ ID NO: 1355361 - protein, 26 aa, Mycobacterium
DGLADFPDRWWNALAVANAIAGSIYV

SEQ ID NO: 1355362 - protein, 19 aa, Mycobacterium
DGLTLGQALVFWASGRDQL

SEQ ID NO: 1355363 - protein, 18 aa, Mycobacterium
DGNFVYRPMNAMAAVGGT

SEQ ID NO: 1355364 - protein, 21 aa, Mycobacterium
DGRWIWRWDPAFIHSNFDFLR

SEQ ID NO: 1355365 - protein, 21 aa, Mycobacterium
DGYRTEVEWATQMSYSGIYVH

SEQ ID NO: 1355366 - protein, 19 aa, Mycobacterium
DIERARAAAAFAVDAAAAH

SEQ ID NO: 1355367 - protein, 25 aa, Mycobacterium
DKMIWEIGHSLPLFQAPGNVAVRSN

SEQ ID NO: 1355368 - protein, 25 aa, Mycobacterium
DLDAFLRLLSDRGVDVLIYNVQTEG

SEQ ID NO: 1355369 - protein, 24 aa, Mycobacterium
DLGSTWRPGCPLGPERLRRVELDH

SEQ ID NO: 1355370 - protein, 23 aa, Mycobacterium
DPEKRFFILLALRLRGVVGLGPN

SEQ ID NO: 1355371 - protein, 24 aa, Mycobacterium
DPIVARPLIQLGLPAPAAGWLSSN

SEQ ID NO: 1355372 - protein, 20 aa, Mycobacterium
DPNWRPGRETVLADQLRASV

SEQ ID NO: 1355373 - protein, 18 aa, Mycobacterium
DPPMRTMIAFGGRYPTTV

SEQ ID NO: 1355374 - protein, 23 aa, Mycobacterium
DPQHRLFLQTAWHAMEDAGCDPA

SEQ ID NO: 1355375 - protein, 23 aa, Mycobacterium
DPQQRLALEVSWEALEHAGISPR

SEQ ID NO: 1355376 - protein, 17 aa, Mycobacterium
DQRMKAEFYPRVDKTQL

SEQ ID NO: 1355377 - protein, 24 aa, Mycobacterium
DRETWNRLALPWFRGINSVIGVQR

SEQ ID NO: 1355378 - protein, 21 aa, Mycobacterium
DRFYPGDVVDVTWIDGFGQER

SEQ ID NO: 1355379 - protein, 24 aa, Mycobacterium
DRLVWQCASLLLSYPDGAQLAAAE

SEQ ID NO: 1355380 - protein, 18 aa, Mycobacterium
DRPTRWGFFSSINTTFAR

SEQ ID NO: 1355381 - protein, 18 aa, Mycobacterium
DSAWVMRETLAWMYRYVK

SEQ ID NO: 1355382 - protein, 22 aa, Mycobacterium
DSRAYRLPWPDGTVVYEIDQPA

SEQ ID NO: 1355383 - protein, 24 aa, Mycobacterium
DVGPGVATRASWRPIKDIVGLAAR

SEQ ID NO: 1355384 - protein, 17 aa, Mycobacterium
DVVFPLFPQGGGFPRTN

SEQ ID NO: 1355385 - protein, 23 aa, Mycobacterium
DWDRRLRPMLARQFELAAGRRKI

SEQ ID NO: 1355386 - protein, 18 aa, Mycobacterium
EADGYLRLREWLTKLYRT

SEQ ID NO: 1355387 - protein, 17 aa, Mycobacterium
EAWACAFGPGGEAATIA

SEQ ID NO: 1355388 - protein, 25 aa, Mycobacterium
EDDLPMFRYWWGVPSDFESVVRAEV

SEQ ID NO: 1355389 - protein, 28 aa, Mycobacterium
EDVKMLWFCGGHGSCLPGQGNGEADSAW

SEQ ID NO: 1355390 - protein, 24 aa, Mycobacterium
EEESLESVSLFAAVVSNVVAPLAD

SEQ ID NO: 1355391 - protein, 18 aa, Mycobacterium
EEGLRATVQWYRDNEAWW

SEQ ID NO: 1355392 - protein, 17 aa, Mycobacterium
EGISVNVTLIFSVERHR

SEQ ID NO: 1355393 - protein, 23 aa, Mycobacterium
EGPDGSVLWSLRAIDWNCDNLFV

SEQ ID NO: 1355394 - protein, 25 aa, Mycobacterium
EGVPGTGVAAGWFKTAGNQIVDSAG

SEQ ID NO: 1355395 - protein, 20 aa, Mycobacterium
EISPGIAQRGSWVFDVAPAL

SEQ ID NO: 1355396 - protein, 23 aa, Mycobacterium
EKGIKSLYLVGSDYVFPQTANRI

SEQ ID NO: 1355397 - protein, 20 aa, Mycobacterium
EKMLPKFLWERPDTVAKVGL

SEQ ID NO: 1355398 - protein, 24 aa, Mycobacterium
ELDGPRVLIKFGVDKGVRLGDRTE

SEQ ID NO: 1355399 - protein, 21 aa, Mycobacterium
ELIQGLWLAGRQDQQARATQR

SEQ ID NO: 1355400 - protein, 17 aa, Mycobacterium
ELIRLTADFDIREPTVR

SEQ ID NO: 1355401 - protein, 18 aa, Mycobacterium
ELKRGQVLAGDHVTVEIN

SEQ ID NO: 1355402 - protein, 17 aa, Mycobacterium
ELQRRVGTVGVFTAAPE

SEQ ID NO: 1355403 - protein, 17 aa, Mycobacterium
ENLSFVFLGNSLRKYGG

SEQ ID NO: 1355404 - protein, 17 aa, Mycobacterium
EPAEWPAPVATLTDTVG

SEQ ID NO: 1355405 - protein, 20 aa, Mycobacterium
EPDLPPGPFLTGIELNMAFA

SEQ ID NO: 1355406 - protein, 27 aa, Mycobacterium
EPRVCREVYYQWILPLGTVEIGVDSNV

SEQ ID NO: 1355407 - protein, 25 aa, Mycobacterium
ESAQKWPLCRGYNAGGSPVTVGDVS

SEQ ID NO: 1355408 - protein, 22 aa, Mycobacterium
ESIPGDSGAPVWQPASDGTATI

SEQ ID NO: 1355409 - protein, 18 aa, Mycobacterium
ETDRSAAIVVADHEYFDN

SEQ ID NO: 1355410 - protein, 21 aa, Mycobacterium
EVNIWFLVQFLERPFVPLIPT

SEQ ID NO: 1355411 - protein, 22 aa, Mycobacterium
EVSEMGRILSFIPHRMSRPDHI

SEQ ID NO: 1355412 - protein, 21 aa, Mycobacterium
EWEILRPSWFMQNFTGAHPVA

SEQ ID NO: 1355413 - protein, 17 aa, Mycobacterium
FAALPPEQLEVLRTDPA

SEQ ID NO: 1355414 - protein, 24 aa, Mycobacterium
FAENWILQHIRIRPGLNGPSDDGL

SEQ ID NO: 1355415 - protein, 17 aa, Mycobacterium
FAPTEMLEFAFSQPPMF

SEQ ID NO: 1355416 - protein, 22 aa, Mycobacterium
FARAGLHDRVTWIGSGKLGLPG

SEQ ID NO: 1355417 - protein, 17 aa, Mycobacterium
FAVLADRVGGNGLYSSN

SEQ ID NO: 1355418 - protein, 18 aa, Mycobacterium
FDFMMALMHEMLHSFGIL

SEQ ID NO: 1355419 - protein, 18 aa, Mycobacterium
FEMSIRFRIIAAVIGAAA

SEQ ID NO: 1355420 - protein, 26 aa, Mycobacterium
FFIKDLEFLPTFPFHYKYLRNAVRGD

SEQ ID NO: 1355421 - protein, 19 aa, Mycobacterium
FFQYHLPGVQAYHLDVTPD

SEQ ID NO: 1355422 - protein, 17 aa, Mycobacterium
FFSFYLCELVLKLNGKG

SEQ ID NO: 1355423 - protein, 17 aa, Mycobacterium
FGLDAGERIAKLLSDSG

SEQ ID NO: 1355424 - protein, 19 aa, Mycobacterium
FGLGETVVSLAWRTGDDIV

SEQ ID NO: 1355425 - protein, 18 aa, Mycobacterium
FGLQDVIWRGTYYTPAGP

SEQ ID NO: 1355426 - protein, 21 aa, Mycobacterium
FKNGDCDAGFAFDSMVDETMA

SEQ ID NO: 1355427 - protein, 17 aa, Mycobacterium
FLAAGLRTYCPDKLPIL

SEQ ID NO: 1355428 - protein, 20 aa, Mycobacterium
FLTRELPAWLAANRGQDPFG

SEQ ID NO: 1355429 - protein, 19 aa, Mycobacterium
FLWLNEVERAFVLAHELLH

SEQ ID NO: 1355430 - protein, 23 aa, Mycobacterium
FNVRGARNLPCISVPGKRAPTWQ

SEQ ID NO: 1355431 - protein, 17 aa, Mycobacterium
FNWDVAKKAPITFDTLF

SEQ ID NO: 1355432 - protein, 17 aa, Mycobacterium
FPALGVPVSASWITWDN

SEQ ID NO: 1355433 - protein, 17 aa, Mycobacterium
FPDNLPRIAAKGGPGGA

SEQ ID NO: 1355434 - protein, 19 aa, Mycobacterium
FPGAEGFGSLATGGRGGSV

SEQ ID NO: 1355435 - protein, 22 aa, Mycobacterium
FPPDGTHGWGYWGAQLGAMKPD

SEQ ID NO: 1355436 - protein, 17 aa, Mycobacterium
FPTRSTFPGVFSDGGPV

SEQ ID NO: 1355437 - protein, 17 aa, Mycobacterium
FQLGGTWVQDGVTKIAA

SEQ ID NO: 1355438 - protein, 18 aa, Mycobacterium
FRAGPVFTNLLLADEINR

SEQ ID NO: 1355439 - protein, 17 aa, Mycobacterium
FRCSDFPCAPTSPGNIL

SEQ ID NO: 1355440 - protein, 17 aa, Mycobacterium
FRNPFRLTFTPDGKLLV

SEQ ID NO: 1355441 - protein, 17 aa, Mycobacterium
FSDGRRGVVSVPITVTI

SEQ ID NO: 1355442 - protein, 24 aa, Mycobacterium
FTDPAPWPWYRRPGVVFAGAATLA

SEQ ID NO: 1355443 - protein, 18 aa, Mycobacterium
FTPWTYEKWPTVFTQLET

SEQ ID NO: 1355444 - protein, 18 aa, Mycobacterium
FTRYSFRAAGQFTTLAEE

SEQ ID NO: 1355445 - protein, 18 aa, Mycobacterium
FVCVCLLGLSLLVAVFGQ

SEQ ID NO: 1355446 - protein, 23 aa, Mycobacterium
FVEAARRAGFRWVEDLSGLDADV

SEQ ID NO: 1355447 - protein, 23 aa, Mycobacterium
FVSTFRLGGYNVVTWDPRGEFAS

SEQ ID NO: 1355448 - protein, 19 aa, Mycobacterium
FWVSAHALRGFWGAGRITG

SEQ ID NO: 1355449 - protein, 25 aa, Mycobacterium
GAALPDKFEQMWGYIYEQNIAPIYL

SEQ ID NO: 1355450 - protein, 19 aa, Mycobacterium
GADGFRLTRVTVRDTLADG

SEQ ID NO: 1355451 - protein, 19 aa, Mycobacterium
GAEPLVMWVLYANPPATPL

SEQ ID NO: 1355452 - protein, 17 aa, Mycobacterium
GAGELLLRVRAEADGST

SEQ ID NO: 1355453 - protein, 18 aa, Mycobacterium
GAHYPYWHLVLAPGSCAV

SEQ ID NO: 1355454 - protein, 19 aa, Mycobacterium
GALRPDLLITRVVERGGEL

SEQ ID NO: 1355455 - protein, 19 aa, Mycobacterium
GALSGYRAGLLASIAAACT

SEQ ID NO: 1355456 - protein, 17 aa, Mycobacterium
GAPTVLVTAEWRYIDGR

SEQ ID NO: 1355457 - protein, 19 aa, Mycobacterium
GARVYPGGFAIELTSEPNA

SEQ ID NO: 1355458 - protein, 23 aa, Mycobacterium
GAVPLPAFEFVTAVFGAIRREMD

SEQ ID NO: 1355459 - protein, 21 aa, Mycobacterium
GCLPKDIRAFIAMAGELGAGQ

SEQ ID NO: 1355460 - protein, 20 aa, Mycobacterium
GDFFGFYLCDAILKVNGKGG

SEQ ID NO: 1355461 - protein, 20 aa, Mycobacterium
GDFFSFYLCEIVLKLNGKGG

SEQ ID NO: 1355462 - protein, 25 aa, Mycobacterium
GDGKRRFGATISRIDRDDADERPRG

SEQ ID NO: 1355463 - protein, 21 aa, Mycobacterium
GDGSNRWPAVHRLDAAALFRI

SEQ ID NO: 1355464 - protein, 24 aa, Mycobacterium
GDIWDWAVPWDEWVAMSALSEQES

SEQ ID NO: 1355465 - protein, 17 aa, Mycobacterium
GDTPEWAYGAIIYNGPG

SEQ ID NO: 1355466 - protein, 20 aa, Mycobacterium
GDWFAFYVCEVVFKVNGKGG

SEQ ID NO: 1355467 - protein, 18 aa, Mycobacterium
GEASPLWRAGLWGDAIPP

SEQ ID NO: 1355468 - protein, 23 aa, Mycobacterium
GEGPRWNGDWDMDDPRVNPIAGA

SEQ ID NO: 1355469 - protein, 17 aa, Mycobacterium
GEPRLTLPDAITGNPGD

SEQ ID NO: 1355470 - protein, 23 aa, Mycobacterium
GFDVSPRLAAAISDSRAELSGDT

SEQ ID NO: 1355471 - protein, 18 aa, Mycobacterium
GFPGFWRFAVRNTAAAVR

SEQ ID NO: 1355472 - protein, 20 aa, Mycobacterium
GGAVESLWLAIRQSRGPQAE

SEQ ID NO: 1355473 - protein, 23 aa, Mycobacterium
GGLRAGAAVQVFGTRVGQVSSIE

SEQ ID NO: 1355474 - protein, 17 aa, Mycobacterium
GGLRYAQRADLATREEQ

SEQ ID NO: 1355475 - protein, 19 aa, Mycobacterium
GGRGGRGGLLVGNGGAGGA

SEQ ID NO: 1355476 - protein, 25 aa, Mycobacterium
GGSSEGWMSGLGGWGGDGGDASGGG

SEQ ID NO: 1355477 - protein, 21 aa, Mycobacterium
GGVWWDCYRDLVSNVVLVDKI

SEQ ID NO: 1355478 - protein, 22 aa, Mycobacterium
GHLELALGPRGVFKLQPWDGNV

SEQ ID NO: 1355479 - protein, 28 aa, Mycobacterium
GHSFGAQVCSRWMRVYARDPVRRAMADR

SEQ ID NO: 1355480 - protein, 17 aa, Mycobacterium
GIRGDLALAVFVSDAGS

SEQ ID NO: 1355481 - protein, 23 aa, Mycobacterium
GITFSTDGSRVFVADLAGSVKVI

SEQ ID NO: 1355482 - protein, 19 aa, Mycobacterium
GIVSLNWDGTFTYIPNKSA

SEQ ID NO: 1355483 - protein, 22 aa, Mycobacterium
GIVTDLLNWLGLGTGGAIPLPG

SEQ ID NO: 1355484 - protein, 17 aa, Mycobacterium
GKVLPIIPLIGGSGPNP

SEQ ID NO: 1355485 - protein, 19 aa, Mycobacterium
GKYADPWAAIRSRLGDPGL

SEQ ID NO: 1355486 - protein, 17 aa, Mycobacterium
GLAFALVLVALAGGVVA

SEQ ID NO: 1355487 - protein, 22 aa, Mycobacterium
GLDAARLPIRFAESCDPADRAV

SEQ ID NO: 1355488 - protein, 20 aa, Mycobacterium
GLPDDLRYSLDVGTENLHAA

SEQ ID NO: 1355489 - protein, 18 aa, Mycobacterium
GLTCMLQRSGGYGCNGVL

SEQ ID NO: 1355490 - protein, 17 aa, Mycobacterium
GLWNYTWRTGLDSHGDP

SEQ ID NO: 1355491 - protein, 22 aa, Mycobacterium
GLWSRLSFLRYIPLLNVSFGPQ

SEQ ID NO: 1355492 - protein, 21 aa, Mycobacterium
GMPSYPAWDRHLFVFQEGTCI

SEQ ID NO: 1355493 - protein, 24 aa, Mycobacterium
GPDGLRLAPHPGIGPGLALLDAPD

SEQ ID NO: 1355494 - protein, 22 aa, Mycobacterium
GPPAPFAVWGFRGSPVTDPAPC

SEQ ID NO: 1355495 - protein, 18 aa, Mycobacterium
GPVALEFPGPIAELQLSR

SEQ ID NO: 1355496 - protein, 19 aa, Mycobacterium
GPVALKFPGPITELQLSRD

SEQ ID NO: 1355497 - protein, 17 aa, Mycobacterium
GPVWGRGDVVAYVDAAP

SEQ ID NO: 1355498 - protein, 17 aa, Mycobacterium
GQLHGWALGGIVVNSQA

SEQ ID NO: 1355499 - protein, 18 aa, Mycobacterium
GQLVFARVGARPVRYVLG

SEQ ID NO: 1355500 - protein, 22 aa, Mycobacterium
GQRTPERWFVVWLGTATNPIPQ

SEQ ID NO: 1355501 - protein, 17 aa, Mycobacterium
GREKWMFAHIPLAKKIY

SEQ ID NO: 1355502 - protein, 20 aa, Mycobacterium
GRIRYKRVCEVCGEVVEYRD

SEQ ID NO: 1355503 - protein, 17 aa, Mycobacterium
GRLRLLVRLTRVAALRR

SEQ ID NO: 1355504 - protein, 21 aa, Mycobacterium
GRSVFQCPFCHGWEMRDGKLA

SEQ ID NO: 1355505 - protein, 23 aa, Mycobacterium
GRTGEVTFSIVLRTENSNPSSSS

SEQ ID NO: 1355506 - protein, 17 aa, Mycobacterium
GRWRRRGVMQFDHAHTF

SEQ ID NO: 1355507 - protein, 17 aa, Mycobacterium
GRYLFVYEPLRGYQTAA

SEQ ID NO: 1355508 - protein, 19 aa, Mycobacterium
GSIGIEWCRSGPGCRAIAF

SEQ ID NO: 1355509 - protein, 23 aa, Mycobacterium
GSLRGTFRLTVCKPGSGDAPSVT

SEQ ID NO: 1355510 - protein, 20 aa, Mycobacterium
GSMIVDWLYSIGIRSRRMGT

SEQ ID NO: 1355511 - protein, 18 aa, Mycobacterium
GSPEFFDWMNGGKHCITV

SEQ ID NO: 1355512 - protein, 28 aa, Mycobacterium
GSQARWLPDMVSIVSLFFIPSVSGATFT

SEQ ID NO: 1355513 - protein, 23 aa, Mycobacterium
GSSPALWAVAAWVRRQTTQAIDG

SEQ ID NO: 1355514 - protein, 22 aa, Mycobacterium
GSWRVNCLGPFLGIQASLPHLR

SEQ ID NO: 1355515 - protein, 18 aa, Mycobacterium
GTAYKWTVVFHHNEHTHP

SEQ ID NO: 1355516 - protein, 21 aa, Mycobacterium
GTGGDGGFWFGHGGNGGDGDA

SEQ ID NO: 1355517 - protein, 18 aa, Mycobacterium
GTTLSFWTPPGVYTVLDK

SEQ ID NO: 1355518 - protein, 22 aa, Mycobacterium
GTVTVTPWGTFRYTPSATARHA

SEQ ID NO: 1355519 - protein, 20 aa, Mycobacterium
GVLCSVGWQPRPPGVSVSTS

SEQ ID NO: 1355520 - protein, 19 aa, Mycobacterium
GVMMRPYLVESLKGPDLAN

SEQ ID NO: 1355521 - protein, 18 aa, Mycobacterium
GVVYRFGKVQSRVREPGL

SEQ ID NO: 1355522 - protein, 17 aa, Mycobacterium
GWWPMLIGLAMNDAGGF

SEQ ID NO: 1355523 - protein, 17 aa, Mycobacterium
GYFPLSFTVADIDQNGP

SEQ ID NO: 1355524 - protein, 18 aa, Mycobacterium
GYTYWSFVDNLEWSEGYE

SEQ ID NO: 1355525 - protein, 22 aa, Mycobacterium
HALKYRHGRIYGHDSQSGTVMV

SEQ ID NO: 1355526 - protein, 17 aa, Mycobacterium
HILRPIIDAGYRRHDQP

SEQ ID NO: 1355527 - protein, 17 aa, Mycobacterium
HMLRSAVIATRIAERLG

SEQ ID NO: 1355528 - protein, 18 aa, Mycobacterium
HPDYAVTVLDAFTYAGSR

SEQ ID NO: 1355529 - protein, 22 aa, Mycobacterium
HPKAAEEFLEFLVTKDAATLLS

SEQ ID NO: 1355530 - protein, 23 aa, Mycobacterium
HPQTWFKAFNWDVAKKAPITFDT

SEQ ID NO: 1355531 - protein, 17 aa, Mycobacterium
HRQRRSAEQAGITVSQM

SEQ ID NO: 1355532 - protein, 21 aa, Mycobacterium
HRRLEGLIAPGSWNIDPSATP

SEQ ID NO: 1355533 - protein, 23 aa, Mycobacterium
HVISRGVAVLGLTAAAALPVVPI

SEQ ID NO: 1355534 - protein, 23 aa, Mycobacterium
IALPPDWANYGAIIKAFSDKYGI

SEQ ID NO: 1355535 - protein, 23 aa, Mycobacterium
IAMVKELLKAIGITQTGGDGSSP

SEQ ID NO: 1355536 - protein, 19 aa, Mycobacterium
IDAAYTWLPTLDELRKTGR

SEQ ID NO: 1355537 - protein, 19 aa, Mycobacterium
IDGRGRFTYTPSDAARHVA

SEQ ID NO: 1355538 - protein, 18 aa, Mycobacterium
IDKEANWLPAPKGPFALV

SEQ ID NO: 1355539 - protein, 19 aa, Mycobacterium
IDLKSRFRDTLAAEFNGKD

SEQ ID NO: 1355540 - protein, 17 aa, Mycobacterium
IDRLPNGVFLDWQQFQS

SEQ ID NO: 1355541 - protein, 18 aa, Mycobacterium
IDVARRWDGWADWPDDSS

SEQ ID NO: 1355542 - protein, 21 aa, Mycobacterium
IELDGAAVLVRFTVDKNITMG

SEQ ID NO: 1355543 - protein, 18 aa, Mycobacterium
IEPFVAVADLFGWKHGCD

SEQ ID NO: 1355544 - protein, 19 aa, Mycobacterium
IGAFGRRASYEIADLGKAL

SEQ ID NO: 1355545 - protein, 25 aa, Mycobacterium
IGDSKRSTGLFGFVVDWANDPKVFG

SEQ ID NO: 1355546 - protein, 18 aa, Mycobacterium
IGLAFALVLVALAGGVVA

SEQ ID NO: 1355547 - protein, 18 aa, Mycobacterium
IGLASVLVLLLIAGLVTV

SEQ ID NO: 1355548 - protein, 20 aa, Mycobacterium
IGRVGALALALGVGGAVATT

SEQ ID NO: 1355549 - protein, 18 aa, Mycobacterium
IGTTLALGARTIFASVPY

SEQ ID NO: 1355550 - protein, 20 aa, Mycobacterium
IHNYRWRLSLAPGESRYDAD

SEQ ID NO: 1355551 - protein, 17 aa, Mycobacterium
IIGNALKPATPALAKVA

SEQ ID NO: 1355552 - protein, 17 aa, Mycobacterium
IKARGRLIVGLDIGSNL

SEQ ID NO: 1355553 - protein, 23 aa, Mycobacterium
ILHSIARLFGLAKVDNYTQTVEF

SEQ ID NO: 1355554 - protein, 23 aa, Mycobacterium
ILKGDKGEPCWPDGIVGSLTHCE

SEQ ID NO: 1355555 - protein, 19 aa, Mycobacterium
ILMRLHGWPTIPILEIPFP

SEQ ID NO: 1355556 - protein, 17 aa, Mycobacterium
ILRRFDIIVLPLVNPDG

SEQ ID NO: 1355557 - protein, 20 aa, Mycobacterium
ILRSKGFCWIASRPTIAAIW

SEQ ID NO: 1355558 - protein, 17 aa, Mycobacterium
INIRVGIEIIDGTNAAP

SEQ ID NO: 1355559 - protein, 26 aa, Mycobacterium
IPDAMALINLFFKSALPGYSFSDGLN

SEQ ID NO: 1355560 - protein, 25 aa, Mycobacterium
IPGGKQVLGSWSWAIPANSATPDAA

SEQ ID NO: 1355561 - protein, 19 aa, Mycobacterium
IPWHVRGALWEATATNTAV

SEQ ID NO: 1355562 - protein, 18 aa, Mycobacterium
IRILPPFLSRKHLPSRLA

SEQ ID NO: 1355563 - protein, 18 aa, Mycobacterium
IRPDGLIYTVWESPGPIE

SEQ ID NO: 1355564 - protein, 20 aa, Mycobacterium
IRPNPGIGHPCWANYFPVTR

SEQ ID NO: 1355565 - protein, 19 aa, Mycobacterium
ISLAAVFLALAIGIALGSG

SEQ ID NO: 1355566 - protein, 21 aa, Mycobacterium
ISVNVTLIFSVERHRLVMDAY

SEQ ID NO: 1355567 - protein, 17 aa, Mycobacterium
ITACIALVLGLSACSDT

SEQ ID NO: 1355568 - protein, 25 aa, Mycobacterium
ITKDSRVSTVWTWPDRPGVAGCAAL

SEQ ID NO: 1355569 - protein, 19 aa, Mycobacterium
ITVLTWRLDLERLAATAQR

SEQ ID NO: 1355570 - protein, 19 aa, Mycobacterium
ITVSDGWGGIVAVPVTVRI

SEQ ID NO: 1355571 - protein, 23 aa, Mycobacterium
IVIAAPMFHAWGFSQLLFAALLA

SEQ ID NO: 1355572 - protein, 19 aa, Mycobacterium
KAAEAWINYVYDRANYAKL

SEQ ID NO: 1355573 - protein, 25 aa, Mycobacterium
KADVLPMLGWLDWFVDDEGMAKLDA

SEQ ID NO: 1355574 - protein, 21 aa, Mycobacterium
KAGDWPTVFAMLDGPRQRVDI

SEQ ID NO: 1355575 - protein, 20 aa, Mycobacterium
KDCPAPGVMQGCLESTSGLI

SEQ ID NO: 1355576 - protein, 20 aa, Mycobacterium
KDLGAGYVWPARAGDGSGAD

SEQ ID NO: 1355577 - protein, 19 aa, Mycobacterium
KHAARLAWFQALATEQRTC

SEQ ID NO: 1355578 - protein, 19 aa, Mycobacterium
KLGFPVPIRHWLRAGELLE

SEQ ID NO: 1355579 - protein, 19 aa, Mycobacterium
KLGFPVPIRHWLRSGELLD

SEQ ID NO: 1355580 - protein, 20 aa, Mycobacterium
KLRKGTYFPEWLLERRKRAE

SEQ ID NO: 1355581 - protein, 20 aa, Mycobacterium
KMIYRLGIFRAPRGSSAVTG

SEQ ID NO: 1355582 - protein, 26 aa, Mycobacterium
KPEWKGRWGAPPVKPDFQAIVAAMLE

SEQ ID NO: 1355583 - protein, 18 aa, Mycobacterium
KPLYGTSLVTGWASIHGF

SEQ ID NO: 1355584 - protein, 19 aa, Mycobacterium
KPTLPAWRIIEPRPAEELM

SEQ ID NO: 1355585 - protein, 26 aa, Mycobacterium
KRAEICRQRMGPVFKRIAMNFPPLLF

SEQ ID NO: 1355586 - protein, 17 aa, Mycobacterium
KRIGFLDIRDAAKPVGL

SEQ ID NO: 1355587 - protein, 19 aa, Mycobacterium
KRLEGWLGELVPRLLEDLG

SEQ ID NO: 1355588 - protein, 18 aa, Mycobacterium
KRLRPVIDSGYKRNDPKS

SEQ ID NO: 1355589 - protein, 17 aa, Mycobacterium
KRSVWRFGVPVICVAAG

SEQ ID NO: 1355590 - protein, 19 aa, Mycobacterium
KTDPKGVARIGRYTPADDR

SEQ ID NO: 1355591 - protein, 18 aa, Mycobacterium
KYADPWAAIRSRLGDPGL

SEQ ID NO: 1355592 - protein, 18 aa, Mycobacterium
LAACSPGLAANPRFATDS

SEQ ID NO: 1355593 - protein, 20 aa, Mycobacterium
LAALGMVWPFLFYGAPAAAE

SEQ ID NO: 1355594 - protein, 19 aa, Mycobacterium
LAIVPVKFVGDLAYVATNF

SEQ ID NO: 1355595 - protein, 25 aa, Mycobacterium
LANAKRWGVLHVIWRQGYYPGIGAP

SEQ ID NO: 1355596 - protein, 21 aa, Mycobacterium
LANVLAGFMFIHADYEEVDLY

SEQ ID NO: 1355597 - protein, 23 aa, Mycobacterium
LAPIWDLISGYQFPELNNPVNEE

SEQ ID NO: 1355598 - protein, 17 aa, Mycobacterium
LAQLAIVPVKFVGDLAY

SEQ ID NO: 1355599 - protein, 17 aa, Mycobacterium
LARGELRLVGATTLDEY

SEQ ID NO: 1355600 - protein, 18 aa, Mycobacterium
LASLPVYVTNAFFNGFVP

SEQ ID NO: 1355601 - protein, 19 aa, Mycobacterium
LATPIRMFERAVFDFGGSP

SEQ ID NO: 1355602 - protein, 19 aa, Mycobacterium
LCALMVFAVGCAGVPSSSS

SEQ ID NO: 1355603 - protein, 18 aa, Mycobacterium
LCGVTWVYSYAVAVYPDV

SEQ ID NO: 1355604 - protein, 21 aa, Mycobacterium
LCREVYYQWIVPLGLVEVGVA

SEQ ID NO: 1355605 - protein, 17 aa, Mycobacterium
LDAFLQLLADRGVDVLI

SEQ ID NO: 1355606 - protein, 24 aa, Mycobacterium
LDAPLRWFIELAYDRSDYSEPTRA

SEQ ID NO: 1355607 - protein, 22 aa, Mycobacterium
LDAVTLRPGRPAGCSAGDYGGV

SEQ ID NO: 1355608 - protein, 26 aa, Mycobacterium
LDFNPFVPGSFLWKGYPYTLVTPFIK

SEQ ID NO: 1355609 - protein, 18 aa, Mycobacterium
LDHVVAWAEAPGTLVDHR

SEQ ID NO: 1355610 - protein, 17 aa, Mycobacterium
LDIPGVVVGGVLNGFGF

SEQ ID NO: 1355611 - protein, 21 aa, Mycobacterium
LDMVKCLNWPSGSAPKEPSEL

SEQ ID NO: 1355612 - protein, 18 aa, Mycobacterium
LDRTPWRAGEPIVIAAPM

SEQ ID NO: 1355613 - protein, 17 aa, Mycobacterium
LDRVVAIPAMLPQNTRK

SEQ ID NO: 1355614 - protein, 19 aa, Mycobacterium
LFTSDPWLGTSVGAHLDDM

SEQ ID NO: 1355615 - protein, 25 aa, Mycobacterium
LGFERWAPEMPWEISIGRTVRPGEL

SEQ ID NO: 1355616 - protein, 21 aa, Mycobacterium
LGGGALPFGIFAGGLLTGPEL

SEQ ID NO: 1355617 - protein, 19 aa, Mycobacterium
LGIFLAVCALGTFVLLSVF

SEQ ID NO: 1355618 - protein, 19 aa, Mycobacterium
LGLDHPYSPLGHSITVEVT

SEQ ID NO: 1355619 - protein, 27 aa, Mycobacterium
LGMNTFRMGIEWSRIFPESTAAVDISD

SEQ ID NO: 1355620 - protein, 24 aa, Mycobacterium
LGQMWAAGVDLDWSRLSKDKPGLI

SEQ ID NO: 1355621 - protein, 24 aa, Mycobacterium
LGRSTGYSCGVTWGPGQEPGTILN

SEQ ID NO: 1355622 - protein, 17 aa, Mycobacterium
LGTDLGWVPTLPNSVAD

SEQ ID NO: 1355623 - protein, 18 aa, Mycobacterium
LGTPAARRLWTGNIHGPA

SEQ ID NO: 1355624 - protein, 26 aa, Mycobacterium
LGYQIGFPWSLGVGINFSYTTPNIAF

SEQ ID NO: 1355625 - protein, 26 aa, Mycobacterium
LGYQVGFPWSLGVSINFSYTTPNIAF

SEQ ID NO: 1355626 - protein, 22 aa, Mycobacterium
LHGGRFSVLLAHHLGAHLEQLR

SEQ ID NO: 1355627 - protein, 24 aa, Mycobacterium
LHPLSAPMTLRWLRDRFTDRPVYE

SEQ ID NO: 1355628 - protein, 21 aa, Mycobacterium
LKEKAIAPIRAWLGGLTADAE

SEQ ID NO: 1355629 - protein, 19 aa, Mycobacterium
LKLPYDIWLRGSQCDEANA

SEQ ID NO: 1355630 - protein, 17 aa, Mycobacterium
LKNAIDWLSRPWGNGAL

SEQ ID NO: 1355631 - protein, 17 aa, Mycobacterium
LKPEYKGRVSISNPVTS

SEQ ID NO: 1355632 - protein, 20 aa, Mycobacterium
LKYEGVDVITIFKGLQLDIG

SEQ ID NO: 1355633 - protein, 17 aa, Mycobacterium
LLALSRLGSMRAVADAH

SEQ ID NO: 1355634 - protein, 23 aa, Mycobacterium
LLAPEWKGKIGFAPSNASWQAFV

SEQ ID NO: 1355635 - protein, 19 aa, Mycobacterium
LLINREWFLWLNEVERAFV

SEQ ID NO: 1355636 - protein, 22 aa, Mycobacterium
LMHEMLHSFGILFAVRPGETTR

SEQ ID NO: 1355637 - protein, 19 aa, Mycobacterium
LMYRKDLFEQAGIKVDQNP

SEQ ID NO: 1355638 - protein, 17 aa, Mycobacterium
LNEAVLWASAFPYGPTF

SEQ ID NO: 1355639 - protein, 19 aa, Mycobacterium
LNGSWLYTRTSNWTHSGPD

SEQ ID NO: 1355640 - protein, 17 aa, Mycobacterium
LNLPTPEQFIASIPAPV

SEQ ID NO: 1355641 - protein, 18 aa, Mycobacterium
LPAAISWQVASQMAEADT

SEQ ID NO: 1355642 - protein, 22 aa, Mycobacterium
LPDGRAAIRLAMDPSQLAIIPS

SEQ ID NO: 1355643 - protein, 19 aa, Mycobacterium
LPFPQGWEAAGPRAPQGAY

SEQ ID NO: 1355644 - protein, 25 aa, Mycobacterium
LPIQYKFTLNGARWSGAVDGHTYGF

SEQ ID NO: 1355645 - protein, 23 aa, Mycobacterium
LPLAGRSMLAWSLDTLTRLPDIA

SEQ ID NO: 1355646 - protein, 18 aa, Mycobacterium
LPLCALITAWLRGLARPQ

SEQ ID NO: 1355647 - protein, 25 aa, Mycobacterium
LPLLEPLRWLGLTGIADALNGPLKA

SEQ ID NO: 1355648 - protein, 20 aa, Mycobacterium
LPLRAMVMVLLFLGVVFLLV

SEQ ID NO: 1355649 - protein, 18 aa, Mycobacterium
LPLTRPLLDLGVPPEIVR

SEQ ID NO: 1355650 - protein, 19 aa, Mycobacterium
LPLTRPLLDLGVPPEIVRA

SEQ ID NO: 1355651 - protein, 19 aa, Mycobacterium
LPLVLPFKYLGVPTETLIE

SEQ ID NO: 1355652 - protein, 22 aa, Mycobacterium
LPPPEGVTAEWIVRNHGEAGIH

SEQ ID NO: 1355653 - protein, 18 aa, Mycobacterium
LPPRRVVVELDLDDADGI

SEQ ID NO: 1355654 - protein, 17 aa, Mycobacterium
LPSRYVGYTAWRGVAAY

SEQ ID NO: 1355655 - protein, 18 aa, Mycobacterium
LPVEPQFRCELAVDGVVV

SEQ ID NO: 1355656 - protein, 18 aa, Mycobacterium
LQPTLPIVLANLVSIGEV

SEQ ID NO: 1355657 - protein, 17 aa, Mycobacterium
LQRRFGVDVGKRVAEML

SEQ ID NO: 1355658 - protein, 19 aa, Mycobacterium
LRAALKYPLIAQIMRSPTA

SEQ ID NO: 1355659 - protein, 17 aa, Mycobacterium
LRACALTLISDVGLVAV

SEQ ID NO: 1355660 - protein, 23 aa, Mycobacterium
LRARDGWCALTLSRPDDLAAVPA

SEQ ID NO: 1355661 - protein, 19 aa, Mycobacterium
LRATVQWYRDNEAWWRPLK

SEQ ID NO: 1355662 - protein, 18 aa, Mycobacterium
LRGKFLAALHCDRDGAVE

SEQ ID NO: 1355663 - protein, 18 aa, Mycobacterium
LRIDCGFDDPFYSATEQF

SEQ ID NO: 1355664 - protein, 22 aa, Mycobacterium
LRISNWPLYMADGFVAAFQTAS

SEQ ID NO: 1355665 - protein, 17 aa, Mycobacterium
LRPGDAIPLDRTAPALD

SEQ ID NO: 1355666 - protein, 21 aa, Mycobacterium
LRPGGEYFYRFRAEGYLSPAG

SEQ ID NO: 1355667 - protein, 19 aa, Mycobacterium
LRSATPLGDVFIAIKPPPS

SEQ ID NO: 1355668 - protein, 19 aa, Mycobacterium
LRSQLGWRTLGVYAVNYPA

SEQ ID NO: 1355669 - protein, 21 aa, Mycobacterium
LRVHPDIHLFPAIPQQRSSTA

SEQ ID NO: 1355670 - protein, 22 aa, Mycobacterium
LRVSGYAGWVAWGLLHIAFLTG

SEQ ID NO: 1355671 - protein, 19 aa, Mycobacterium
LSCDGCWVGGSPMHRAVAG

SEQ ID NO: 1355672 - protein, 19 aa, Mycobacterium
LSGADFPAGWQKLNGTQAL

SEQ ID NO: 1355673 - protein, 22 aa, Mycobacterium
LSGCADWRGANSLPLPGTEGGG

SEQ ID NO: 1355674 - protein, 22 aa, Mycobacterium
LSHALEVTGSWWVYTPTNVLGY

SEQ ID NO: 1355675 - protein, 23 aa, Mycobacterium
LSLPDDFRWGVAHSGFQAEGGPG

SEQ ID NO: 1355676 - protein, 17 aa, Mycobacterium
LSPRAGLVMDVDAKVKY

SEQ ID NO: 1355677 - protein, 23 aa, Mycobacterium
LSRLRGMFAFALWDTVTGELFCA

SEQ ID NO: 1355678 - protein, 23 aa, Mycobacterium
LSVRWRPGDDWVVVEGSPDAVTQ

SEQ ID NO: 1355679 - protein, 20 aa, Mycobacterium
LTAARWGRYPVRANVRVAGR

SEQ ID NO: 1355680 - protein, 24 aa, Mycobacterium
LTQAAWRTKPSWAVVATQDEAIDP

SEQ ID NO: 1355681 - protein, 21 aa, Mycobacterium
LTYPFTFTFERSGEVTVQVPI

SEQ ID NO: 1355682 - protein, 17 aa, Mycobacterium
LTYPRRLGYGLGETAVS

SEQ ID NO: 1355683 - protein, 24 aa, Mycobacterium
LVIDPAWTLRGWSWFPDSTRAVVN

SEQ ID NO: 1355684 - protein, 19 aa, Mycobacterium
LVLAVLVLIGFVVGYNRIR

SEQ ID NO: 1355685 - protein, 17 aa, Mycobacterium
LVLIGFVVGYNRIRSAD

SEQ ID NO: 1355686 - protein, 22 aa, Mycobacterium
LVSNEEDILWLSLNGGSDRRSA

SEQ ID NO: 1355687 - protein, 17 aa, Mycobacterium
LVTAEWRYIDGRWKLAN

SEQ ID NO: 1355688 - protein, 19 aa, Mycobacterium
LVYYHVFLGLLGPDDVKGQ

SEQ ID NO: 1355689 - protein, 18 aa, Mycobacterium
MAAGRFLAAHGFARDRDQ

SEQ ID NO: 1355690 - protein, 21 aa, Mycobacterium
MANAARFGLQDVIWRGTYYTP

SEQ ID NO: 1355691 - protein, 22 aa, Mycobacterium
MEEALRYWGLQTGRWGQSAGEN

SEQ ID NO: 1355692 - protein, 22 aa, Mycobacterium
MERRPEPGWRLSVTDLGLPNAN

SEQ ID NO: 1355693 - protein, 18 aa, Mycobacterium
MGAWPVPDLLAIARNYGT

SEQ ID NO: 1355694 - protein, 20 aa, Mycobacterium
MGDFLNRVIPPFTIADGAGT

SEQ ID NO: 1355695 - protein, 18 aa, Mycobacterium
MGPMQFLPGTWSRYASDG

SEQ ID NO: 1355696 - protein, 24 aa, Mycobacterium
MGVHFMKLPAKLFGVGRYTVTVQL

SEQ ID NO: 1355697 - protein, 19 aa, Mycobacterium
MLEAPRPGQFVQVSPVRTS

SEQ ID NO: 1355698 - protein, 21 aa, Mycobacterium
MQFIPETWRLYGVDANNDGDV

SEQ ID NO: 1355699 - protein, 21 aa, Mycobacterium
MQFIPETWRLYGVDANNDGIV

SEQ ID NO: 1355700 - protein, 23 aa, Mycobacterium
MVRCVRAALPLLRSASWARIVNF

SEQ ID NO: 1355701 - protein, 21 aa, Mycobacterium
MVTDVLTWVGLRPQADDGPTP

SEQ ID NO: 1355702 - protein, 17 aa, Mycobacterium
MVTSGWRSKGFQQRLFD

SEQ ID NO: 1355703 - protein, 19 aa, Mycobacterium
MWQRLAWLRYLLGEPVPIL

SEQ ID NO: 1355704 - protein, 19 aa, Mycobacterium
NDYLSVGFSELIPTVASGQ

SEQ ID NO: 1355705 - protein, 20 aa, Mycobacterium
NGVRRWLALDGQPLHRVIVA

SEQ ID NO: 1355706 - protein, 18 aa, Mycobacterium
NIVLPKPRGWEHIPDPNV

SEQ ID NO: 1355707 - protein, 19 aa, Mycobacterium
NLKTLCRFHHLLKTFWLGA

SEQ ID NO: 1355708 - protein, 18 aa, Mycobacterium
NLREAFELIVGGNPAEGI

SEQ ID NO: 1355709 - protein, 22 aa, Mycobacterium
NLYWDPRFFIALGPNTNIVTDS

SEQ ID NO: 1355710 - protein, 26 aa, Mycobacterium
NNREVRWRPAKYWKPGTTVEVAVNTY

SEQ ID NO: 1355711 - protein, 26 aa, Mycobacterium
NNREVRWRPAQYWKPGTTVEVEVKAY

SEQ ID NO: 1355712 - protein, 21 aa, Mycobacterium
NPDVYRPAALLPTPRETATFL

SEQ ID NO: 1355713 - protein, 18 aa, Mycobacterium
NPFRLTFTPDGKLLVADV

SEQ ID NO: 1355714 - protein, 24 aa, Mycobacterium
NQIRYCAIICPLLVDTAVTAAVTT

SEQ ID NO: 1355715 - protein, 17 aa, Mycobacterium
NRARYELPPGYEVAELQ

SEQ ID NO: 1355716 - protein, 20 aa, Mycobacterium
NREVRWRPAEYWKPGTKVEV

SEQ ID NO: 1355717 - protein, 22 aa, Mycobacterium
NSPACGFGTCTVTATTTDPDGD

SEQ ID NO: 1355718 - protein, 20 aa, Mycobacterium
NVPDAFAVLADRVGGNGLYS

SEQ ID NO: 1355719 - protein, 23 aa, Mycobacterium
NVTGLRFGNTVPLTYPFALTFPT

SEQ ID NO: 1355720 - protein, 27 aa, Mycobacterium
NYDSWVIGNGYYWLSYVSYSGTRRYVA

SEQ ID NO: 1355721 - protein, 24 aa, Mycobacterium
NYFRTGPQFPYGMFDDQILRVVGN

SEQ ID NO: 1355722 - protein, 19 aa, Mycobacterium
NYQCVSCGATGNATKALAL

SEQ ID NO: 1355723 - protein, 19 aa, Mycobacterium
PAAICLSWAPAAPAATVLG

SEQ ID NO: 1355724 - protein, 17 aa, Mycobacterium
PACLAWFGNKDDGKCLS

SEQ ID NO: 1355725 - protein, 24 aa, Mycobacterium
PADPSGWALLAWVRREFFNGTPAP

SEQ ID NO: 1355726 - protein, 21 aa, Mycobacterium
PADVYGEWKGGWVDFPGGTLD

SEQ ID NO: 1355727 - protein, 17 aa, Mycobacterium
PAGGLNRTQVIAYFANS

SEQ ID NO: 1355728 - protein, 18 aa, Mycobacterium
PAPVKVGFRLGDPGPGEF

SEQ ID NO: 1355729 - protein, 21 aa, Mycobacterium
PATGWPRLDWSMDAALLLAAL

SEQ ID NO: 1355730 - protein, 18 aa, Mycobacterium
PAVARLEFQSAPGDPTPP

SEQ ID NO: 1355731 - protein, 17 aa, Mycobacterium
PAWRELFNNILPAHIVK

SEQ ID NO: 1355732 - protein, 19 aa, Mycobacterium
PDALKEFGDGVAKAVNDTR

SEQ ID NO: 1355733 - protein, 18 aa, Mycobacterium
PDDIRFVLIASPEEGVAQ

SEQ ID NO: 1355734 - protein, 29 aa, Mycobacterium
PDEMPAAALWWRLADALSRTAAIPDRTVV

SEQ ID NO: 1355735 - protein, 21 aa, Mycobacterium
PDGAWEFISWMTSKDYMKLVG

SEQ ID NO: 1355736 - protein, 23 aa, Mycobacterium
PDPILPLRISFVEMVPRTTSTTE

SEQ ID NO: 1355737 - protein, 20 aa, Mycobacterium
PDTYRILGREGLYGDFFGFY

SEQ ID NO: 1355738 - protein, 23 aa, Mycobacterium
PDVRNTVRFGFWGAEEQGLLGSM

SEQ ID NO: 1355739 - protein, 19 aa, Mycobacterium
PDVYGAIYLSAAKGTPNPP

SEQ ID NO: 1355740 - protein, 21 aa, Mycobacterium
PECAVFCIKDLPPAAPAPAPA

SEQ ID NO: 1355741 - protein, 24 aa, Mycobacterium
PEERFDWVTVEAYSADGVPINIRV

SEQ ID NO: 1355742 - protein, 20 aa, Mycobacterium
PEIYRKLARVGSYGAWFPYY

SEQ ID NO: 1355743 - protein, 25 aa, Mycobacterium
PELPFNRILAVAGFRCNVQESVGIS

SEQ ID NO: 1355744 - protein, 18 aa, Mycobacterium
PELPVEMVGGGVWEPGEW

SEQ ID NO: 1355745 - protein, 23 aa, Mycobacterium
PERYGALGLYGWVGGAVNDVAPD

SEQ ID NO: 1355746 - protein, 17 aa, Mycobacterium
PETESVLEWAVAQPLPA

SEQ ID NO: 1355747 - protein, 22 aa, Mycobacterium
PETSVALGFGFRCGFLGLLHME

SEQ ID NO: 1355748 - protein, 19 aa, Mycobacterium
PFALRGGGVYSVATPGGVP

SEQ ID NO: 1355749 - protein, 19 aa, Mycobacterium
PGEEARCLEALRQAAYSAQ

SEQ ID NO: 1355750 - protein, 31 aa, Mycobacterium
PGISRALSILPFKIFQNWLKVGVDLAVAAVK

SEQ ID NO: 1355751 - protein, 18 aa, Mycobacterium
PGKGLSHACDVYGSSVLV

SEQ ID NO: 1355752 - protein, 18 aa, Mycobacterium
PGLFSLLIGNGDEPGENG

SEQ ID NO: 1355753 - protein, 18 aa, Mycobacterium
PGMTVAWQLPSHVGAAVL

SEQ ID NO: 1355754 - protein, 18 aa, Mycobacterium
PGQRIRMRIINAASDTAF

SEQ ID NO: 1355755 - protein, 17 aa, Mycobacterium
PGVLIARGLAEQSGKRI

SEQ ID NO: 1355756 - protein, 20 aa, Mycobacterium
PGVLRPDLASTFVVNQAIGH

SEQ ID NO: 1355757 - protein, 17 aa, Mycobacterium
PGVPCLEILQQLAAAPP

SEQ ID NO: 1355758 - protein, 20 aa, Mycobacterium
PGVVVGGVLNGFGFDGGLLT

SEQ ID NO: 1355759 - protein, 19 aa, Mycobacterium
PGWGCGRALALRNNIIIDV

SEQ ID NO: 1355760 - protein, 19 aa, Mycobacterium
PGYQEYKLYPGPDMDKARA

SEQ ID NO: 1355761 - protein, 18 aa, Mycobacterium
PIGSGRSVQADWYFPETV

SEQ ID NO: 1355762 - protein, 18 aa, Mycobacterium
PILFPSLALLMPVQGIIT

SEQ ID NO: 1355763 - protein, 17 aa, Mycobacterium
PKFLAASLLPLGAALAV

SEQ ID NO: 1355764 - protein, 21 aa, Mycobacterium
PKGPFALVLRLYWPKPDALNG

SEQ ID NO: 1355765 - protein, 24 aa, Mycobacterium
PKVRPDIYRRLGLDDVASGPRTIT

SEQ ID NO: 1355766 - protein, 18 aa, Mycobacterium
PLELYPQVLVRAVQNSAA

SEQ ID NO: 1355767 - protein, 21 aa, Mycobacterium
PLLEPLRLMGLHELADQLNGP

SEQ ID NO: 1355768 - protein, 17 aa, Mycobacterium
PLLQGLRDLGLDWLADE

SEQ ID NO: 1355769 - protein, 20 aa, Mycobacterium
PLMRRFGLDAGERIAKLLSD

SEQ ID NO: 1355770 - protein, 20 aa, Mycobacterium
PLNIPYKVAFVLDVAGDNEA

SEQ ID NO: 1355771 - protein, 19 aa, Mycobacterium
PLTRPFRDLGVPDCLVDAA

SEQ ID NO: 1355772 - protein, 18 aa, Mycobacterium
PMNLLAIPWIDPVDVANA

SEQ ID NO: 1355773 - protein, 20 aa, Mycobacterium
PNGTHSWGYWGAQLQAMKAD

SEQ ID NO: 1355774 - protein, 17 aa, Mycobacterium
PPLPRLASESAPAVTVA

SEQ ID NO: 1355775 - protein, 21 aa, Mycobacterium
PPTQWIRWRRPVIGMPMTARI

SEQ ID NO: 1355776 - protein, 21 aa, Mycobacterium
PPVEGAFYWLNNREVRWRPAQ

SEQ ID NO: 1355777 - protein, 20 aa, Mycobacterium
PQFESVSCRGPIAAQGPGLW

SEQ ID NO: 1355778 - protein, 23 aa, Mycobacterium
PQPDRAKVTFGYDRAIQIPADAK

SEQ ID NO: 1355779 - protein, 24 aa, Mycobacterium
PQPDRVKVIFWYDARYKVPADANA

SEQ ID NO: 1355780 - protein, 27 aa, Mycobacterium
PQRGYKIFEEWGNWLFAAGGSIYDADG

SEQ ID NO: 1355781 - protein, 17 aa, Mycobacterium
PRAGLVMDVDAKVKYRG

SEQ ID NO: 1355782 - protein, 24 aa, Mycobacterium
PRGTYRFAQRWPPGGAAVVISGLA

SEQ ID NO: 1355783 - protein, 22 aa, Mycobacterium
PRGVFKLQPWDGNVFTFPVSSE

SEQ ID NO: 1355784 - protein, 17 aa, Mycobacterium
PRLPVPLLDAGRLADRL

SEQ ID NO: 1355785 - protein, 20 aa, Mycobacterium
PRLWNMWTVLPILQDTTIVA

SEQ ID NO: 1355786 - protein, 17 aa, Mycobacterium
PRPADCPDFTGFGQGIY

SEQ ID NO: 1355787 - protein, 18 aa, Mycobacterium
PRRLVAGLALATVTVATG

SEQ ID NO: 1355788 - protein, 20 aa, Mycobacterium
PRWVAADVMAGRLNQVGIDR

SEQ ID NO: 1355789 - protein, 24 aa, Mycobacterium
PRYAAAPIRLHPDIAIFAAVPQVR

SEQ ID NO: 1355790 - protein, 23 aa, Mycobacterium
PSADELRSALALVGQLAQAPIGA

SEQ ID NO: 1355791 - protein, 17 aa, Mycobacterium
PSARFGRPLTVLSPDFG

SEQ ID NO: 1355792 - protein, 17 aa, Mycobacterium
PSDIWKATMDGALEDTD

SEQ ID NO: 1355793 - protein, 25 aa, Mycobacterium
PSPVADSLLAWVRRLITHTFFNKTP

SEQ ID NO: 1355794 - protein, 18 aa, Mycobacterium
PSRAELLAALSIAIDLGL

SEQ ID NO: 1355795 - protein, 25 aa, Mycobacterium
PTAVLSWQSSPGWLTGRVTGRIRAA

SEQ ID NO: 1355796 - protein, 19 aa, Mycobacterium
PTDFTSFLNPYWRGKFSVP

SEQ ID NO: 1355797 - protein, 19 aa, Mycobacterium
PTINLPFPQGWEAAGPRAP

SEQ ID NO: 1355798 - protein, 20 aa, Mycobacterium
PVEGAFYWLNNREVRWRPAE

SEQ ID NO: 1355799 - protein, 21 aa, Mycobacterium
PVEGAFYWLNNREVRWRPAKY

SEQ ID NO: 1355800 - protein, 17 aa, Mycobacterium
PVLTEFLAIPWVVPNWP

SEQ ID NO: 1355801 - protein, 19 aa, Mycobacterium
QAAFDRIHWFFSLDPVGRR

SEQ ID NO: 1355802 - protein, 35 aa, Mycobacterium
QAALSRIGSPYSWGGSGPNAFDCSGLVMWAFQHEG

SEQ ID NO: 1355803 - protein, 35 aa, Mycobacterium; identical to SEQ ID NO: 1293675

SEQ ID NO: 1355804 - protein, 25 aa, Mycobacterium
QDAGRWRVPLLFAIRPEVGVDDVRA

SEQ ID NO: 1355805 - protein, 20 aa, Mycobacterium
QFIPETWRLYGVDANNDGVV

SEQ ID NO: 1355806 - protein, 19 aa, Mycobacterium
QGDCLKKLIPIMQQAQVDY

SEQ ID NO: 1355807 - protein, 17 aa, Mycobacterium
QGFYPGIGAPSWTADYG

SEQ ID NO: 1355808 - protein, 21 aa, Mycobacterium
QGGSIGLGFAIPVDQAKRIAD

SEQ ID NO: 1355809 - protein, 24 aa, Mycobacterium
QGYSLKVYDCYRPQRAVNDFVAWA

SEQ ID NO: 1355810 - protein, 24 aa, Mycobacterium
QGYSLKVYDCYRPQRAVNDFVEWA

SEQ ID NO: 1355811 - protein, 17 aa, Mycobacterium
QGYYPGIGAPSWTADYG

SEQ ID NO: 1355812 - protein, 18 aa, Mycobacterium
QLLADRGVDVLIYNTQTE

SEQ ID NO: 1355813 - protein, 27 aa, Mycobacterium
QPELPEWAVGLPIVWNPDLGVWGVWNE

SEQ ID NO: 1355814 - protein, 17 aa, Mycobacterium
QPSRGPRRWGIRRHIHT

SEQ ID NO: 1355815 - protein, 17 aa, Mycobacterium
QQAGWVWFGPADREGAP

SEQ ID NO: 1355816 - protein, 17 aa, Mycobacterium
QRTAVPVEWDDFRQQLE

SEQ ID NO: 1355817 - protein, 17 aa, Mycobacterium
QRTDAAAGWAIIAETAA

SEQ ID NO: 1355818 - protein, 17 aa, Mycobacterium
QSEYGWWYQYYFATPRG

SEQ ID NO: 1355819 - protein, 25 aa, Mycobacterium
QSRLGYLRDLWHAMQTQEVSGSNAL

SEQ ID NO: 1355820 - protein, 22 aa, Mycobacterium
QTACKPGMVGDGIRSDFTVTGD

SEQ ID NO: 1355821 - protein, 22 aa, Mycobacterium
QVEKLRSVFTLRAVEKDADVEP

SEQ ID NO: 1355822 - protein, 22 aa, Mycobacterium
QVGELLAGHGWRLVEQAGPSYF

SEQ ID NO: 1355823 - protein, 22 aa, Mycobacterium
QVGHLKTIWGMTAAEAGTRRGT

SEQ ID NO: 1355824 - protein, 18 aa, Mycobacterium
QVQRELLELFNISEQQLN

SEQ ID NO: 1355825 - protein, 18 aa, Mycobacterium
QWAIPWGFENNVVAYNKA

SEQ ID NO: 1355826 - protein, 18 aa, Mycobacterium
RAALEYGLRLAAMEAEWA

SEQ ID NO: 1355827 - protein, 17 aa, Mycobacterium
RAARLGVHVSLAPFQYY

SEQ ID NO: 1355828 - protein, 19 aa, Mycobacterium
RAAVFGCASGALRLTDGGA

SEQ ID NO: 1355829 - protein, 18 aa, Mycobacterium
RAGAWPRDPMDIRLLESV

SEQ ID NO: 1355830 - protein, 20 aa, Mycobacterium
RAGDAMMAFGYSQSAVIASL

SEQ ID NO: 1355831 - protein, 21 aa, Mycobacterium
RAQGFAVRRWLQVGAASAGVG

SEQ ID NO: 1355832 - protein, 21 aa, Mycobacterium
RAVLRRFSPDWTHTDVTAALY

SEQ ID NO: 1355833 - protein, 17 aa, Mycobacterium
RDTFTVTVSDTFGASTS

SEQ ID NO: 1355834 - protein, 20 aa, Mycobacterium
RECREVYYQYILPLGTFEPG

SEQ ID NO: 1355835 - protein, 19 aa, Mycobacterium
REHRVAAVFLRELLAEDLQ

SEQ ID NO: 1355836 - protein, 24 aa, Mycobacterium
REICRQRMGPVFKRITMNFPPLLA

SEQ ID NO: 1355837 - protein, 19 aa, Mycobacterium
RELFNNILPAHIVKDVPGG

SEQ ID NO: 1355838 - protein, 22 aa, Mycobacterium
REPRPMVYSGLYPVDGSDYPVL

SEQ ID NO: 1355839 - protein, 18 aa, Mycobacterium
RFARIGIGPDGDFDADSL

SEQ ID NO: 1355840 - protein, 24 aa, Mycobacterium
RFEGALTRLEMQWGRTIGQMPSPY

SEQ ID NO: 1355841 - protein, 19 aa, Mycobacterium
RFPAIGVPEAVAWVTWTNA

SEQ ID NO: 1355842 - protein, 20 aa, Mycobacterium
RFVRFCLWSLALAAIATVVV

SEQ ID NO: 1355843 - protein, 17 aa, Mycobacterium
RGADWSRRRHLITELFS

SEQ ID NO: 1355844 - protein, 23 aa, Mycobacterium
RGAEFDRLWLESMISHHQGAVEM

SEQ ID NO: 1355845 - protein, 21 aa, Mycobacterium
RGATLAARWGGSEWMGSTAGI

SEQ ID NO: 1355846 - protein, 22 aa, Mycobacterium
RGCTHPGCTVPFYWTEAHHAHD

SEQ ID NO: 1355847 - protein, 23 aa, Mycobacterium
RGGRSCPYWNLVLAPGAAPVPLD

SEQ ID NO: 1355848 - protein, 17 aa, Mycobacterium
RGLICSATFDFSQDPLV

SEQ ID NO: 1355849 - protein, 23 aa, Mycobacterium
RGMSQMGVPYSWGGGNASGPSRG

SEQ ID NO: 1355850 - protein, 18 aa, Mycobacterium
RGRHCLRPPLSPLSRNTI

SEQ ID NO: 1355851 - protein, 20 aa, Mycobacterium
RHLFTVLMDREWKHGVTAAV

SEQ ID NO: 1355852 - protein, 20 aa, Mycobacterium
RIAEGAPRPAYRDVTLGGNA

SEQ ID NO: 1355853 - protein, 21 aa, Mycobacterium
RIGALAFALGVGVGLGATPAV

SEQ ID NO: 1355854 - protein, 23 aa, Mycobacterium
RIGCGIVGGPVELFATVGANPNI

SEQ ID NO: 1355855 - protein, 19 aa, Mycobacterium
RIIGSFFFAGAAATAIATA

SEQ ID NO: 1355856 - protein, 25 aa, Mycobacterium
RITYRLSAPPHRGALVVTGDGRFTY

SEQ ID NO: 1355857 - protein, 19 aa, Mycobacterium
RIVAKWKPAVRSMGSVAAS

SEQ ID NO: 1355858 - protein, 21 aa, Mycobacterium
RKFRWRGVLDVNRLSPAKVSV

SEQ ID NO: 1355859 - protein, 21 aa, Mycobacterium
RKGLPTSFRRSALTGATAALT

SEQ ID NO: 1355860 - protein, 25 aa, Mycobacterium
RLASDMGEFFMPFPGTRVNQQVVPL

SEQ ID NO: 1355861 - protein, 20 aa, Mycobacterium
RLELAPAILVGWSFGGSLAL

SEQ ID NO: 1355862 - protein, 18 aa, Mycobacterium
RLKKTLLAGTRWGDQNAK

SEQ ID NO: 1355863 - protein, 25 aa, Mycobacterium
RLQQRLAALLARWFRRPGEWLDRAP

SEQ ID NO: 1355864 - protein, 19 aa, Mycobacterium
RMFVGRAGAGFAYAATDVI

SEQ ID NO: 1355865 - protein, 17 aa, Mycobacterium
RNGDTYRTLFLVATPQG

SEQ ID NO: 1355866 - protein, 20 aa, Mycobacterium
RNIVYRARIDGVSRGATITY

SEQ ID NO: 1355867 - protein, 23 aa, Mycobacterium
RPAEAGLDFAVRMDKGDFVGRAA

SEQ ID NO: 1355868 - protein, 18 aa, Mycobacterium
RPAEYWKPGTKVEVAVNA

SEQ ID NO: 1355869 - protein, 19 aa, Mycobacterium
RPGGAWMLGKPILLPEARD

SEQ ID NO: 1355870 - protein, 26 aa, Mycobacterium
RPIIDSGYWRFWFKDRSSGWPLPPPE

SEQ ID NO: 1355871 - protein, 20 aa, Mycobacterium
RPNGGILMRLHGWPTIPILE

SEQ ID NO: 1355872 - protein, 20 aa, Mycobacterium
RPQDFWPAGTVVTIDAAGTK

SEQ ID NO: 1355873 - protein, 19 aa, Mycobacterium
RPRWDELLVLIASDHDQEP

SEQ ID NO: 1355874 - protein, 17 aa, Mycobacterium
RRDVLVLFDYHRYQASA

SEQ ID NO: 1355875 - protein, 17 aa, Mycobacterium
RRLKLPYDIWLRGSQCD

SEQ ID NO: 1355876 - protein, 25 aa, Mycobacterium
RRLNKLRPVYAWRRWALYFDYDRRQ

SEQ ID NO: 1355877 - protein, 19 aa, Mycobacterium
RRLPMMVFRDVAQVTETVA

SEQ ID NO: 1355878 - protein, 23 aa, Mycobacterium
RRLWTVLIFMLWYAIFVDKTVTP

SEQ ID NO: 1355879 - protein, 19 aa, Mycobacterium
RRPYTVILFDEIEKAHPDV

SEQ ID NO: 1355880 - protein, 19 aa, Mycobacterium
RRYSPRAGRHLRLEHFDNA

SEQ ID NO: 1355881 - protein, 22 aa, Mycobacterium
RSDLPEGVRFVGLVRPRSADRF

SEQ ID NO: 1355882 - protein, 18 aa, Mycobacterium
RSGELLDWAYGMVGTSGA

SEQ ID NO: 1355883 - protein, 20 aa, Mycobacterium
RSLRVAWTLADLAGRQVPGV

SEQ ID NO: 1355884 - protein, 22 aa, Mycobacterium
RSYSPRFLFAWPNSKSAVMGPA

SEQ ID NO: 1355885 - protein, 18 aa, Mycobacterium
RTVLWFRTYQLIDAPRNI

SEQ ID NO: 1355886 - protein, 17 aa, Mycobacterium
RVAALALTAALLAGCGT

SEQ ID NO: 1355887 - protein, 20 aa, Mycobacterium
RWECDLTWLELQWGRTIGQF

SEQ ID NO: 1355888 - protein, 19 aa, Mycobacterium
RWGNWAKLFFNNKGVVAHA

SEQ ID NO: 1355889 - protein, 19 aa, Mycobacterium
RYTMPLGEIIFDFFDSLKS

SEQ ID NO: 1355890 - protein, 20 aa, Mycobacterium
SAELARWLLGQGVGKGTRVG

SEQ ID NO: 1355891 - protein, 18 aa, Mycobacterium
SAEPGFWPTLVQNKLISG

SEQ ID NO: 1355892 - protein, 17 aa, Mycobacterium
SAFPRVVWVAGGLLKGA

SEQ ID NO: 1355893 - protein, 25 aa, Mycobacterium
SALLRASGGWPWLAPGHDPGELLAL

SEQ ID NO: 1355894 - protein, 24 aa, Mycobacterium
SDGGSEVLLWLEAPPAPATGSAGS

SEQ ID NO: 1355895 - protein, 21 aa, Mycobacterium
SDLAWRVVVVVPDTGEMSPSG

SEQ ID NO: 1355896 - protein, 19 aa, Mycobacterium
SDPGFRLVADRAFTDRAHA

SEQ ID NO: 1355897 - protein, 18 aa, Mycobacterium
SDRPGCPAATWCVSNAGG

SEQ ID NO: 1355898 - protein, 21 aa, Mycobacterium
SDTRIPAVFSGPVGLTAISNP

SEQ ID NO: 1355899 - protein, 19 aa, Mycobacterium
SELEIPTLLLGVANNPIVG

SEQ ID NO: 1355900 - protein, 18 aa, Mycobacterium
SENFEALLSYFLEQYDND

SEQ ID NO: 1355901 - protein, 20 aa, Mycobacterium
SESPLWLVVAAALRRQLDSP

SEQ ID NO: 1355902 - protein, 20 aa, Mycobacterium
SFPFRMGFARVYGLFAERGL

SEQ ID NO: 1355903 - protein, 22 aa, Mycobacterium
SFSRLLARFVPFVRSDRFAVTV

SEQ ID NO: 1355904 - protein, 19 aa, Mycobacterium
SGCAGWRGLNSLPLPGVQG

SEQ ID NO: 1355905 - protein, 17 aa, Mycobacterium
SGGALTCLLDLTAPPPR

SEQ ID NO: 1355906 - protein, 22 aa, Mycobacterium
SGKCKLPLTLPQVFGLMQAAQQ

SEQ ID NO: 1355907 - protein, 18 aa, Mycobacterium
SGLLLSLAVLLVAGCSQV

SEQ ID NO: 1355908 - protein, 23 aa, Mycobacterium
SGPEFDKLWLQSMIGQHQGAVEL

SEQ ID NO: 1355909 - protein, 19 aa, Mycobacterium
SGVKYAATILGAFAVLAVA

SEQ ID NO: 1355910 - protein, 22 aa, Mycobacterium
SIDRAGFIGAVFAMDLPASSAL

SEQ ID NO: 1355911 - protein, 17 aa, Mycobacterium
SIGIEWCRSGAGCRAIA

SEQ ID NO: 1355912 - protein, 18 aa, Mycobacterium
SIVSKFLGVLGIGPSAAN

SEQ ID NO: 1355913 - protein, 23 aa, Mycobacterium
SLDGPRVLVEFDVDKGVRLGDRT

SEQ ID NO: 1355914 - protein, 24 aa, Mycobacterium
SLEEWRPGKFNGVRLADGSHSDTM

SEQ ID NO: 1355915 - protein, 22 aa, Mycobacterium
SLPGTVVKRGFFGWDAAAVSAH

SEQ ID NO: 1355916 - protein, 20 aa, Mycobacterium
SNFSNPVWFVCGLIGGVANT

SEQ ID NO: 1355917 - protein, 17 aa, Mycobacterium
SNGCLKDGGNVLATAIS

SEQ ID NO: 1355918 - protein, 17 aa, Mycobacterium
SPADYIYAYGFRNPFRL

SEQ ID NO: 1355919 - protein, 17 aa, Mycobacterium
SQAGWTWLISDFGEETP

SEQ ID NO: 1355920 - protein, 24 aa, Mycobacterium
SQFFSQGYLGYWRKSGTSGGGGGG

SEQ ID NO: 1355921 - protein, 24 aa, Mycobacterium
SRGGGRLYISNALAGTVSVISTAT

SEQ ID NO: 1355922 - protein, 18 aa, Mycobacterium
SRGPRRWGIRRHIHTAPW

SEQ ID NO: 1355923 - protein, 22 aa, Mycobacterium
SRRLWTVLIFMLWHAIFVEGSV

SEQ ID NO: 1355924 - protein, 21 aa, Mycobacterium
SSERSVAIAIGRNSYAQASGA

SEQ ID NO: 1355925 - protein, 19 aa, Mycobacterium
SSGELHLDWWYDTRRVPQE

SEQ ID NO: 1355926 - protein, 24 aa, Mycobacterium
SSSPRIVPFFGDYFLLHEAKSDMV

SEQ ID NO: 1355927 - protein, 19 aa, Mycobacterium
SSVQLPVWLSRAGSDVLKS

SEQ ID NO: 1355928 - protein, 22 aa, Mycobacterium
STFVGAICRWQAANPAGLVDIT

SEQ ID NO: 1355929 - protein, 17 aa, Mycobacterium
STIKVLLAMTVLDHLRP

SEQ ID NO: 1355930 - protein, 18 aa, Mycobacterium
STIPVQWFEAVDVVGLAA

SEQ ID NO: 1355931 - protein, 27 aa, Mycobacterium
SVLQRAVSRLVGWPGTPRNFVDVTNYQ

SEQ ID NO: 1355932 - protein, 18 aa, Mycobacterium
SVTFHFDRAGDIEMPVPV

SEQ ID NO: 1355933 - protein, 27 aa, Mycobacterium
SYGAWFPYYICGISFRASDLEGRTVVF

SEQ ID NO: 1355934 - protein, 18 aa, Mycobacterium
TAEGVGFRNPWSGETAVV

SEQ ID NO: 1355935 - protein, 17 aa, Mycobacterium
TAFDLRSAVTYVVDLAT

SEQ ID NO: 1355936 - protein, 17 aa, Mycobacterium
TATDWNLSWSWAAGNMV

SEQ ID NO: 1355937 - protein, 20 aa, Mycobacterium
TAVSLSWRTGDDIVVTRTVA

SEQ ID NO: 1355938 - protein, 21 aa, Mycobacterium
TCAAWPVLRRRLAVRALSGAD

SEQ ID NO: 1355939 - protein, 24 aa, Mycobacterium
TDKLDFGWFKAHEFDVTEVAGSTR

SEQ ID NO: 1355940 - protein, 21 aa, Mycobacterium
TDPKDLVWYEAITSYLSGDFD

SEQ ID NO: 1355941 - protein, 24 aa, Mycobacterium
TDRRFPGAVWSFSIGWGCDKLITA

SEQ ID NO: 1355942 - protein, 26 aa, Mycobacterium
TDWFGAEPFGVWPWAQPRLGGAQPVV

SEQ ID NO: 1355943 - protein, 17 aa, Mycobacterium
TEDMSWTFWSWNPNSTD

SEQ ID NO: 1355944 - protein, 24 aa, Mycobacterium
TFHPDRFRYAGSMSGFMTPSATTL

SEQ ID NO: 1355945 - protein, 23 aa, Mycobacterium
TFHPDRYRFAGSLSGFLTPSATA

SEQ ID NO: 1355946 - protein, 22 aa, Mycobacterium
TFIAGPSPTGWQLSKQSAMALM

SEQ ID NO: 1355947 - protein, 22 aa, Mycobacterium
TGGVWWDCYRDLVSNVVLLDKI

SEQ ID NO: 1355948 - protein, 18 aa, Mycobacterium
TGIYAGIRPCQWATADGV

SEQ ID NO: 1355949 - protein, 19 aa, Mycobacterium
TGSSFKVFALVAALQQGIG

SEQ ID NO: 1355950 - protein, 24 aa, Mycobacterium
THLRRPDGLLSWRWADGRVTDPSS

SEQ ID NO: 1355951 - protein, 18 aa, Mycobacterium
TIPESRTAVPVEWDEVKT

SEQ ID NO: 1355952 - protein, 25 aa, Mycobacterium
TISGLKPSSDVIPWHVRGALWEATA

SEQ ID NO: 1355953 - protein, 24 aa, Mycobacterium
TITARLNFQLAFGARVGVRLTEAR

SEQ ID NO: 1355954 - protein, 18 aa, Mycobacterium
TKKLPSWTVLVPPENPVA

SEQ ID NO: 1355955 - protein, 17 aa, Mycobacterium
TKLPGWDGPTTGTPSEL

SEQ ID NO: 1355956 - protein, 17 aa, Mycobacterium
TKLRPGDAIPLDRTAPA

SEQ ID NO: 1355957 - protein, 18 aa, Mycobacterium
TKMSGEWSKDQVLQSYLN

SEQ ID NO: 1355958 - protein, 17 aa, Mycobacterium
TLDQAWRAQTIDAARTL

SEQ ID NO: 1355959 - protein, 18 aa, Mycobacterium
TLELGYQVGFPWSLGVSI

SEQ ID NO: 1355960 - protein, 18 aa, Mycobacterium
TLERARFGTALKVTLQVA

SEQ ID NO: 1355961 - protein, 22 aa, Mycobacterium
TLPEEVRQRFDLVGFDPRGVAE

SEQ ID NO: 1355962 - protein, 18 aa, Mycobacterium
TLWRARLIAPMRPDRYLR

SEQ ID NO: 1355963 - protein, 20 aa, Mycobacterium
TLYKRYAVRFGLGYTEESRE

SEQ ID NO: 1355964 - protein, 21 aa, Mycobacterium
TMPIEVWDDVMAVNVRSAMLT

SEQ ID NO: 1355965 - protein, 18 aa, Mycobacterium
TNVFSGMVGKAWVTPEGQ

SEQ ID NO: 1355966 - protein, 23 aa, Mycobacterium
TPALWTLGLRSAWIPDSTDTNGN

SEQ ID NO: 1355967 - protein, 17 aa, Mycobacterium
TPEQFIASIPAPVVTCL

SEQ ID NO: 1355968 - protein, 17 aa, Mycobacterium
TPGRLSVAGGILAMVEE

SEQ ID NO: 1355969 - protein, 21 aa, Mycobacterium
TPNPPAILVRMARLEGGTFDV

SEQ ID NO: 1355970 - protein, 23 aa, Mycobacterium
TPNPWRPGSSMSHVDDATFTGVN

SEQ ID NO: 1355971 - protein, 24 aa, Mycobacterium
TPRNLRFAATMPRAVVLCADADDV

SEQ ID NO: 1355972 - protein, 24 aa, Mycobacterium
TQGLKAWPKCGAKGMAAQVWGNTA

SEQ ID NO: 1355973 - protein, 22 aa, Mycobacterium
TRARITFWVDRRYPVPADAKAV

SEQ ID NO: 1355974 - protein, 18 aa, Mycobacterium
TRKSFGIAGPRVVEDLEL

SEQ ID NO: 1355975 - protein, 23 aa, Mycobacterium
TRLKAGSAVTGWPGEPMTAMPDA

SEQ ID NO: 1355976 - protein, 17 aa, Mycobacterium
TRSTFPGVFSDGGPVDY

SEQ ID NO: 1355977 - protein, 22 aa, Mycobacterium
TRYFRPRFDAVAFRAGAEQARY

SEQ ID NO: 1355978 - protein, 20 aa, Mycobacterium
TRYPVFAVIGVNPLPTPTSP

SEQ ID NO: 1355979 - protein, 21 aa, Mycobacterium
TSGKEGFAFASPNGSDRVASV

SEQ ID NO: 1355980 - protein, 24 aa, Mycobacterium
TSGVFWGLGANDWTSVFATDPNGD

SEQ ID NO: 1355981 - protein, 19 aa, Mycobacterium
TTGAFRFLPFASEKNPDGS

SEQ ID NO: 1355982 - protein, 23 aa, Mycobacterium
TTPPVEGGWAWLPDEAGGSRVHW

SEQ ID NO: 1355983 - protein, 19 aa, Mycobacterium
TTTISWQYGRHATLDFDPS

SEQ ID NO: 1355984 - protein, 17 aa, Mycobacterium
TTTLEWVLGPYFEGEFV

SEQ ID NO: 1355985 - protein, 17 aa, Mycobacterium
TTVWDTGKVLPIIPLIG

SEQ ID NO: 1355986 - protein, 20 aa, Mycobacterium
TTYRTSYSFFGLGSPSLPGT

SEQ ID NO: 1355987 - protein, 19 aa, Mycobacterium
TVCSAPVWAGGPGGMVETG

SEQ ID NO: 1355988 - protein, 24 aa, Mycobacterium
TVLLRPDGTFTYTVPTTMYAGGTD

SEQ ID NO: 1355989 - protein, 22 aa, Mycobacterium
TVLRGDEIVKVFTDSVQPAGLA

SEQ ID NO: 1355990 - protein, 21 aa, Mycobacterium
TVRPRGVLQVAVVEATNIVAA

SEQ ID NO: 1355991 - protein, 20 aa, Mycobacterium
TVVSLAWRTGDDIVVSRKDP

SEQ ID NO: 1355992 - protein, 20 aa, Mycobacterium
TVVSLGWRTGDDIVVSRKDP

SEQ ID NO: 1355993 - protein, 21 aa, Mycobacterium
TYRFAQRWPPGGAAVVISGLA

SEQ ID NO: 1355994 - protein, 17 aa, Mycobacterium
VAIPAMLPQNTRKRQKV

SEQ ID NO: 1355995 - protein, 18 aa, Mycobacterium
VALIRIAALLAHASEVDR

SEQ ID NO: 1355996 - protein, 17 aa, Mycobacterium
VALPAWRVERPPAADQL

SEQ ID NO: 1355997 - protein, 20 aa, Mycobacterium
VANAVRFGFWGAEEEGLLGS

SEQ ID NO: 1355998 - protein, 17 aa, Mycobacterium
VARYPARFQLVMAANPC

SEQ ID NO: 1355999 - protein, 24 aa, Mycobacterium
VASRASALIPEWAVASHLASIAAG

SEQ ID NO: 1356000 - protein, 18 aa, Mycobacterium
VATQNAWLARGLDPEQKS

SEQ ID NO: 1356001 - protein, 21 aa, Mycobacterium
VCALGAFALIAVFAQLRFERE

SEQ ID NO: 1356002 - protein, 17 aa, Mycobacterium
VCGRKGVEHVGWYVPAR

SEQ ID NO: 1356003 - protein, 18 aa, Mycobacterium
VCYLPAFLCVGIVPVVAG

SEQ ID NO: 1356004 - protein, 19 aa, Mycobacterium
VDASRLFLTQMIRHHEGAI

SEQ ID NO: 1356005 - protein, 17 aa, Mycobacterium
VDGRTGAVQKIFSAGTA

SEQ ID NO: 1356006 - protein, 17 aa, Mycobacterium
VDLGFDWSGDPGISRAL

SEQ ID NO: 1356007 - protein, 17 aa, Mycobacterium
VEAFVWRTYEETLPPDA

SEQ ID NO: 1356008 - protein, 19 aa, Mycobacterium
VEGGIIYHYYWFRDQSQTK

SEQ ID NO: 1356009 - protein, 20 aa, Mycobacterium
VESPLLWTLLAFARRQFGQP

SEQ ID NO: 1356010 - protein, 25 aa, Mycobacterium
VESVVRFGKAMWLDFNPFVPGSFLW

SEQ ID NO: 1356011 - protein, 22 aa, Mycobacterium
VFAYMRLPAFLGIGQYRVTLEL

SEQ ID NO: 1356012 - protein, 18 aa, Mycobacterium
VFPGQGFTVRRCHGGDPD

SEQ ID NO: 1356013 - protein, 20 aa, Mycobacterium
VGALAVTLGVGWAVASAPGV

SEQ ID NO: 1356014 - protein, 24 aa, Mycobacterium
VGALDLVKCLNWPSGSAPPEPKDL

SEQ ID NO: 1356015 - protein, 25 aa, Mycobacterium
VGFDCSGLMLYMFAGVGIKLDHYSG

SEQ ID NO: 1356016 - protein, 34 aa, Mycobacterium
VGIPYPASFWPLSFLPGWCVPGRCEKWDVSVGEG

SEQ ID NO: 1356017 - protein, 25 aa, Mycobacterium
VGIYKRFQEMAALTTFTTWTTYDSW

SEQ ID NO: 1356018 - protein, 22 aa, Mycobacterium
VGMSVELMMRWSSRGIAIKART

SEQ ID NO: 1356019 - protein, 17 aa, Mycobacterium
VGNHYVVRNASWNPKVA

SEQ ID NO: 1356020 - protein, 20 aa, Mycobacterium
VHGLFGWLQFVPILGNLLNP

SEQ ID NO: 1356021 - protein, 17 aa, Mycobacterium
VIATRIAERLGLDRPQR

SEQ ID NO: 1356022 - protein, 25 aa, Mycobacterium
VIQADFSRKYGWIPVVGTVAHAFSL

SEQ ID NO: 1356023 - protein, 22 aa, Mycobacterium
VKAAEKISAAWLNDMFTGTQAS

SEQ ID NO: 1356024 - protein, 22 aa, Mycobacterium
VKQGWMCCVGADWMHLSTGVVG

SEQ ID NO: 1356025 - protein, 23 aa, Mycobacterium
VKVAGFLGWIAWGLLHIAFLTGV

SEQ ID NO: 1356026 - protein, 30 aa, Mycobacterium
VLAGGVDALPCDDARCAIPSGERVLAYVTT

SEQ ID NO: 1356027 - protein, 25 aa, Mycobacterium
VLDEATGRWGLRVARVELRSIDPPP

SEQ ID NO: 1356028 - protein, 18 aa, Mycobacterium
VLELAGSYGKPLWVTENG

SEQ ID NO: 1356029 - protein, 19 aa, Mycobacterium
VLMDREWKHGVTAAVDVTL

SEQ ID NO: 1356030 - protein, 18 aa, Mycobacterium
VLPGYGWIFPLGNGEVNI

SEQ ID NO: 1356031 - protein, 18 aa, Mycobacterium
VLPIPSRELVVISSEADD

SEQ ID NO: 1356032 - protein, 26 aa, Mycobacterium
VLPLGVPARPVWPPLLDTILTAVFDF

SEQ ID NO: 1356033 - protein, 21 aa, Mycobacterium
VLTSCGSWKGISNVPLPGGPG

SEQ ID NO: 1356034 - protein, 21 aa, Mycobacterium
VMRETLAWMYRYVKDDGSQDD

SEQ ID NO: 1356035 - protein, 18 aa, Mycobacterium
VNDMTRWMAMVLADGRHD

SEQ ID NO: 1356036 - protein, 25 aa, Mycobacterium
VPDRDLKVDIARGYLDRGVDVLFGG

SEQ ID NO: 1356037 - protein, 17 aa, Mycobacterium
VPGRFVVAAAMVRHLLT

SEQ ID NO: 1356038 - protein, 24 aa, Mycobacterium
VPLLRRFGLDAGERIAKLLSDSGV

SEQ ID NO: 1356039 - protein, 17 aa, Mycobacterium
VQYLAPIIKNRQYNFPP

SEQ ID NO: 1356040 - protein, 20 aa, Mycobacterium
VRGGARFRVPGIERVDIMSL

SEQ ID NO: 1356041 - protein, 18 aa, Mycobacterium
VRLGWPLKPSPTVVRQFD

SEQ ID NO: 1356042 - protein, 19 aa, Mycobacterium
VRPAAWGMWTFYELSEEDK

SEQ ID NO: 1356043 - protein, 20 aa, Mycobacterium
VRTSSSWFSAKVYGTVTAKD

SEQ ID NO: 1356044 - protein, 22 aa, Mycobacterium
VSGCGYRLAAYPTDDAAAQPVE

SEQ ID NO: 1356045 - protein, 22 aa, Mycobacterium
VSGCGYRLAAYPTDDTAARPVE

SEQ ID NO: 1356046 - protein, 17 aa, Mycobacterium
VSIGLGPAWKVLRDLPL

SEQ ID NO: 1356047 - protein, 25 aa, Mycobacterium
VSTQGRFRFLRVYPDPMIYAPVTGF

SEQ ID NO: 1356048 - protein, 17 aa, Mycobacterium
VTCPSPYTLAANVLTVT

SEQ ID NO: 1356049 - protein, 24 aa, Mycobacterium
VTGYTAGGALEWDMSEVFQGSYCD

SEQ ID NO: 1356050 - protein, 23 aa, Mycobacterium
VTVLRGDEIVKVFTDSVQPAGLA

SEQ ID NO: 1356051 - protein, 20 aa, Mycobacterium
VVGMLEIDAWIGLPTPTTTP

SEQ ID NO: 1356052 - protein, 19 aa, Mycobacterium
VVLSDGWNIMDFVEQLQKL

SEQ ID NO: 1356053 - protein, 18 aa, Mycobacterium
VVPKMIYRVGFFRSPKGS

SEQ ID NO: 1356054 - protein, 24 aa, Mycobacterium
VVTLAVGIYLVWPSRTGNKITAYF

SEQ ID NO: 1356055 - protein, 24 aa, Mycobacterium
VVTLAVGVYLVWPSRTGNKITAYF

SEQ ID NO: 1356056 - protein, 23 aa, Mycobacterium
VYNDGARDLAVWLTPPPAPPAPA

SEQ ID NO: 1356057 - protein, 23 aa, Mycobacterium
VYNDGGQDLLLWVQPPPSSTSSS

SEQ ID NO: 1356058 - protein, 18 aa, Mycobacterium
VYRAEFDPAAALDMARRT

SEQ ID NO: 1356059 - protein, 18 aa, Mycobacterium
VYVTNAFFNGFVPPFPTR

SEQ ID NO: 1356060 - protein, 18 aa, Mycobacterium
WAKDGWLVNLSDYAENTP

SEQ ID NO: 1356061 - protein, 26 aa, Mycobacterium
WAQHGIRVIDMWPLYVNTAMTQGVKT

SEQ ID NO: 1356062 - protein, 18 aa, Mycobacterium
WDPSVAILGFPFITQAQR

SEQ ID NO: 1356063 - protein, 18 aa, Mycobacterium
WERGDIDAAYTWLPTLDE

SEQ ID NO: 1356064 - protein, 21 aa, Mycobacterium
WETKDRPALAAAFQNAGVDYT

SEQ ID NO: 1356065 - protein, 19 aa, Mycobacterium
WFSVPDMYGAFHISLQDDG

SEQ ID NO: 1356066 - protein, 18 aa, Mycobacterium
WHTWRMTWLPTGMYFWKD

SEQ ID NO: 1356067 - protein, 25 aa, Mycobacterium
WLHGCAGWPGLIWKFVRVDDARITP

SEQ ID NO: 1356068 - protein, 17 aa, Mycobacterium
WLSEVFRAEMTRVGRTP

SEQ ID NO: 1356069 - protein, 17 aa, Mycobacterium
WNLSWSWAAGNMVSTLH

SEQ ID NO: 1356070 - protein, 21 aa, Mycobacterium
WPAVHRLDAAALFRIAAEDAP

SEQ ID NO: 1356071 - protein, 19 aa, Mycobacterium
WPRSPEWTGAAALPQPQPE

SEQ ID NO: 1356072 - protein, 20 aa, Mycobacterium
WPVVVGGSLSFAVASAGVLA

SEQ ID NO: 1356073 - protein, 21 aa, Mycobacterium
WPVVVGGSLSFAVASAGVLAG

SEQ ID NO: 1356074 - protein, 19 aa, Mycobacterium
WPWAQPRLGGAQPVVLSLA

SEQ ID NO: 1356075 - protein, 17 aa, Mycobacterium
WRHEFLTQMGLTVLETD

SEQ ID NO: 1356076 - protein, 17 aa, Mycobacterium
WRLGIFLAVCALGTFVL

SEQ ID NO: 1356077 - protein, 19 aa, Mycobacterium
WRPECPVPPDALRRVDLDY

SEQ ID NO: 1356078 - protein, 22 aa, Mycobacterium
WTFHLRPGVTFHDGTPLTADDV

SEQ ID NO: 1356079 - protein, 18 aa, Mycobacterium
WTGLPYLRFLMANTGRGQ

SEQ ID NO: 1356080 - protein, 18 aa, Mycobacterium
YAAEIAHIIGCEPEDVLR

SEQ ID NO: 1356081 - protein, 17 aa, Mycobacterium
YAATILGAFAVLAVAPA

SEQ ID NO: 1356082 - protein, 17 aa, Mycobacterium
YAVRFGLGYTEESREVE

SEQ ID NO: 1356083 - protein, 20 aa, Mycobacterium
YDPALARPGIHFDPEPIEDS

SEQ ID NO: 1356084 - protein, 17 aa, Mycobacterium
YELPPGYEVAELQGRVT

SEQ ID NO: 1356085 - protein, 18 aa, Mycobacterium
YETGAGHWSAERKAALLG

SEQ ID NO: 1356086 - protein, 19 aa, Mycobacterium
YETIGGLVLQELGHIPEVG

SEQ ID NO: 1356087 - protein, 29 aa, Mycobacterium
YEYYTPFGWLRGFPFLAVQVVWAPGSEMS

SEQ ID NO: 1356088 - protein, 23 aa, Mycobacterium
YFKVMLVNLAPYWILQPYVDAAF

SEQ ID NO: 1356089 - protein, 21 aa, Mycobacterium
YGHSRACAWAIADGMIGRSTT

SEQ ID NO: 1356090 - protein, 21 aa, Mycobacterium
YGHSRACAWAIADGVIGRSTT

SEQ ID NO: 1356091 - protein, 21 aa, Mycobacterium
YIYAYGFRNPFRLTFTPDGKL

SEQ ID NO: 1356092 - protein, 21 aa, Mycobacterium
YKKSLWCGIGGLIPFAKSGPQ

SEQ ID NO: 1356093 - protein, 18 aa, Mycobacterium
YKVPTRWVIASSEQIPTL

SEQ ID NO: 1356094 - protein, 18 aa, Mycobacterium
YLGPALRLLNFNNIPLPI

SEQ ID NO: 1356095 - protein, 23 aa, Mycobacterium
YNQLRRLSPVAGYRDWPPGTIPG

SEQ ID NO: 1356096 - protein, 17 aa, Mycobacterium
YPLFALIGVNPFPSPTD

SEQ ID NO: 1356097 - protein, 19 aa, Mycobacterium
YQALARQGIYGDFFSFYLC

SEQ ID NO: 1356098 - protein, 18 aa, Mycobacterium
YRALGRQGMYGDFFSFYL

SEQ ID NO: 1356099 - protein, 20 aa, Mycobacterium
YRKSLWCGIGGLVPFAKSPP

SEQ ID NO: 1356100 - protein, 18 aa, Mycobacterium
YRNTYAWFLTLNDGQIVK

SEQ ID NO: 1356101 - protein, 21 aa, Mycobacterium
YRPPWELALHRWLDAVTPHRR

SEQ ID NO: 1356102 - protein, 17 aa, Mycobacterium
YRPTLPRAFFIKPDGEM

SEQ ID NO: 1356103 - protein, 19 aa, Mycobacterium
YRTEVDWATQISYSGIYVH

SEQ ID NO: 1356104 - protein, 21 aa, Mycobacterium
YRVTLELPETGGLYPRGNVTY

SEQ ID NO: 1356105 - protein, 32 aa, Mycobacterium
YSLMAYIALVGVYERFQWVALNHLPEVTGQTQ

SEQ ID NO: 1356106 - protein, 17 aa, Mycobacterium
YSQGALIAADWIEQNAG

SEQ ID NO: 1356107 - protein, 23 aa, Mycobacterium
YTSFPLKRNVVVLGIVHEGVPVA

SEQ ID NO: 1356108 - protein, 22 aa, Mycobacterium
YVQPGTEVELIFVAANTSPDVA

SEQ ID NO: 1356109 - protein, 23 aa, Mycobacterium
YYPAGGRWNDWARFFHAHSLNGF

SEQ ID NO: 1356110 - protein, 25 aa, Mycobacterium
AAREDILAFTAFPKDVWTQIWSNNP

SEQ ID NO: 1356111 - protein, 22 aa, Mycobacterium
AEGRRYLGLDILARCRLTTITN

SEQ ID NO: 1356112 - protein, 22 aa, Mycobacterium
ANLPGAAWQRCRTHYAANLMSI

SEQ ID NO: 1356113 - protein, 23 aa, Mycobacterium
EQFRHRPLDSAGPFTFVAADALT

SEQ ID NO: 1356114 - protein, 17 aa, Mycobacterium
GLDILARCRLTTITNDN

SEQ ID NO: 1356115 - protein, 26 aa, Mycobacterium
NLMSICPKSMWPAVKAMLHSVYDQPD

SEQ ID NO: 1356116 - protein, 26 aa, Mycobacterium
LRKGTYFPDWLLERRKRAESALITVV

SEQ ID NO: 1356117 - protein, 26 aa, Mycobacterium
SLELGYQIGFPWSLGVGINFSYTTPN

SEQ ID NO: 1356118 - protein, 24 aa, Mycobacterium
GQRLEPMRAWFLTVAVRTGIDVTI

SEQ ID NO: 1356119 - protein, 17 aa, Mycobacterium
LQVPPATVRGWLRRAGQ

SEQ ID NO: 1356120 - protein, 20 aa, Mycobacterium
RIAAWLQVPPATVRGWLRRA

SEQ ID NO: 1356121 - protein, 34 aa, Mycobacterium; identical to SEQ ID NO: 942462

SEQ ID NO: 1356122 - protein, 26 aa, Mycobacterium
ANNDFKPGFATALMNKDLGLAMAAVS

SEQ ID NO: 1356123 - protein, 24 aa, Mycobacterium
ELCPAQIWQLRQSAAGYPYSASST

SEQ ID NO: 1356124 - protein, 18 aa, Mycobacterium
GFPGYANYFPVTRAVPEP

SEQ ID NO: 1356125 - protein, 19 aa, Mycobacterium
LQLAIFAMVTVVAGGSMAF

SEQ ID NO: 1356126 - protein, 27 aa, Mycobacterium
PTTNLLMKYNPMLTCLFVGAKTTLDTG

SEQ ID NO: 1356127 - protein, 24 aa, Mycobacterium
QDYKGLFLSFNLNLNVPPPCRTGY

SEQ ID NO: 1356128 - protein, 25 aa, Mycobacterium
QLFERVQPTLPILLANLVSLGQVAL

SEQ ID NO: 1356129 - protein, 27 aa, Mycobacterium
QPNLEQILALYPIEIAGLQGAALANRN

SEQ ID NO: 1356130 - protein, 22 aa, Mycobacterium
QQWDTFLNGVFPLDRNRLTREW

SEQ ID NO: 1356131 - protein, 23 aa, Mycobacterium
QQWDTFLNGVFPLDRNRLTREWF

SEQ ID NO: 1356132 - protein, 18 aa, Mycobacterium
RGEFEERLKAVLDDIKNS

SEQ ID NO: 1356133 - protein, 23 aa, Mycobacterium
RYITARFLPDKAIDLVDEAASRL

SEQ ID NO: 1356134 - protein, 17 aa, Mycobacterium
VERFSPPAPPAPAVPAA

SEQ ID NO: 1356135 - protein, 25 aa, Mycobacterium
AAALLGAFAVFALAPATAAALPPGN

SEQ ID NO: 1356136 - protein, 38 aa, Mycobacterium
AAANGPWDFIPTIQVPQIPGLPVPLPTEIGPPSDGICA

SEQ ID NO: 1356137 - protein, 20 aa, Mycobacterium
AAFFAGIAIQMYCPQMVSSV

SEQ ID NO: 1356138 - protein, 26 aa, Mycobacterium
AAGLDARAWRLPWVAGTTLFEIDHPG

SEQ ID NO: 1356139 - protein, 28 aa, Mycobacterium
AAGSVDGPALSGFFGVVQLGSTEEAAAF

SEQ ID NO: 1356140 - protein, 26 aa, Mycobacterium
AAGTILGGGLLFTAGLGLANAQPVEA

SEQ ID NO: 1356141 - protein, 22 aa, Mycobacterium
AAKGFSRIFLTTGRTGVDAFRD

SEQ ID NO: 1356142 - protein, 17 aa, Mycobacterium
AALVATLTLAACSSGDE

SEQ ID NO: 1356143 - protein, 23 aa, Mycobacterium
AAPFLSYGPFTGYAPRDVCGLWP

SEQ ID NO: 1356144 - protein, 19 aa, Mycobacterium
AAPFYGARLKNWTEQCLLS

SEQ ID NO: 1356145 - protein, 25 aa, Mycobacterium
AARPTPELLAYQYLQTLPEMARGEA

SEQ ID NO: 1356146 - protein, 22 aa, Mycobacterium
AASIVVGLLLGAAAVFGVTLMV

SEQ ID NO: 1356147 - protein, 19 aa, Mycobacterium
AASLLAAAVIAAPPAAAGG

SEQ ID NO: 1356148 - protein, 25 aa, Mycobacterium
AAVAALGVAAWGLSTVRVLSDSHAL

SEQ ID NO: 1356149 - protein, 24 aa, Mycobacterium
AAVAAMFAVPALALSACSPNEPVS

SEQ ID NO: 1356150 - protein, 30 aa, Mycobacterium
AAVTLFGLPSPQWLGTYGSPPVVIGPLYAP

SEQ ID NO: 1356151 - protein, 18 aa, Mycobacterium
ADAFRAAFPAVHLDPDVL

SEQ ID NO: 1356152 - protein, 35 aa, Mycobacterium
ADAPLTVVFAHGFCLRMGAFHFQRARLSEQWGDQV

SEQ ID NO: 1356153 - protein, 25 aa, Mycobacterium
ADELHVHSVPEHTFRVEPKAGQMFQ

SEQ ID NO: 1356154 - protein, 35 aa, Mycobacterium
ADELRNFLADKVVRWWLPERWTFVDEIPRTSVGKY

SEQ ID NO: 1356155 - protein, 24 aa, Mycobacterium
ADNPFGVPALLRAAGDHLAAGDLE

SEQ ID NO: 1356156 - protein, 27 aa, Mycobacterium
ADQFPAPQKLWTIADLGGWQKVDSELF

SEQ ID NO: 1356157 - protein, 35 aa, Mycobacterium
ADWDHDLAVNLNGPFFLCRAALPHLLETGGSIVNV

SEQ ID NO: 1356158 - protein, 21 aa, Mycobacterium
AEELMGYYRKAEATFGVGWNY

SEQ ID NO: 1356159 - protein, 21 aa, Mycobacterium
AEGVTSCRSVLALAASYDVEM

SEQ ID NO: 1356160 - protein, 20 aa, Mycobacterium
AERNLHEQVTFIGGGKLGLP

SEQ ID NO: 1356161 - protein, 31 aa, Mycobacterium
AESGGTFLPFSSILRRCDFSTRPYYDSAGSA

SEQ ID NO: 1356162 - protein, 17 aa, Mycobacterium
AEWPPRTSPGGPDPLKV

SEQ ID NO: 1356163 - protein, 20 aa, Mycobacterium
AFAGFHRWDVYYNSTAGDVA

SEQ ID NO: 1356164 - protein, 29 aa, Mycobacterium
AFDERNPLPPPWYPQPGPPPAPAPGVIPG

SEQ ID NO: 1356165 - protein, 23 aa, Mycobacterium
AFERVSAFQFGFTDGPSSCAAID

SEQ ID NO: 1356166 - protein, 18 aa, Mycobacterium
AFGLLAAGALLLSGCGSD

SEQ ID NO: 1356167 - protein, 24 aa, Mycobacterium
AGAVIALVLGFKRSKKPKTEPQRT

SEQ ID NO: 1356168 - protein, 22 aa, Mycobacterium
AGDRAFFCDYALEYLARAGISK

SEQ ID NO: 1356169 - protein, 18 aa, Mycobacterium
AGGLATGFLAFAAPAQAA

SEQ ID NO: 1356170 - protein, 24 aa, Mycobacterium
AGIGGAAGTRRLGGGTAGASGDAG

SEQ ID NO: 1356171 - protein, 29 aa, Mycobacterium
AGLDPIIHVSSFTALFRPGLDVLHADLPV

SEQ ID NO: 1356172 - protein, 40 aa, Mycobacterium
AGPASRVAILLPAHWQTAAVLFGLWWIGAEALVGGPSDVD

SEQ ID NO: 1356173 - protein, 25 aa, Mycobacterium
AGSAAMTLAIYYPQQFQYAASLSGF

SEQ ID NO: 1356174 - protein, 26 aa, Mycobacterium
AGSVLGVGYVFRNIFDSPAPESRLTG

SEQ ID NO: 1356175 - protein, 18 aa, Mycobacterium
AGVLQFNQILAVAGFRCN

SEQ ID NO: 1356176 - protein, 23 aa, Mycobacterium
AGVPPLMRGYLRLGAQVCGEPAH

SEQ ID NO: 1356177 - protein, 25 aa, Mycobacterium
AGVVAFTPTYLFSGAPTATAECTES

SEQ ID NO: 1356178 - protein, 18 aa, Mycobacterium
AHGVGVVGLLNVQYALKD

SEQ ID NO: 1356179 - protein, 29 aa, Mycobacterium
AHKDPELCPPLLTPPFYSIDISADSSMFF

SEQ ID NO: 1356180 - protein, 25 aa, Mycobacterium
AHRLANYVLTLRRDLLKVSEAAGVR

SEQ ID NO: 1356181 - protein, 17 aa, Mycobacterium
AIALFAGAVIALVLGFK

SEQ ID NO: 1356182 - protein, 19 aa, Mycobacterium
AIASAAALGLGLTACGAGD

SEQ ID NO: 1356183 - protein, 26 aa, Mycobacterium
AIATALAPTHTLFLAGRPSAQLDEVA

SEQ ID NO: 1356184 - protein, 34 aa, Mycobacterium; identical to SEQ ID NO: 791728

SEQ ID NO: 1356185 - protein, 18 aa, Mycobacterium
AIGFVTAAGAIAIAPSAG

SEQ ID NO: 1356186 - protein, 31 aa, Mycobacterium
AIITRGLAEIMRLGIALGAKPATLAGLAGVG

SEQ ID NO: 1356187 - protein, 20 aa, Mycobacterium
AIQHVVTERGKFLEGLVELT

SEQ ID NO: 1356188 - protein, 38 aa, Mycobacterium
AIRGDYMNQFIIFDFTIPRLKRGLFLGTRWGEEGTPMV

SEQ ID NO: 1356189 - protein, 32 aa, Mycobacterium
AIVGTIQTLYSPNLWRYLTQGLTELEAGRGDT

SEQ ID NO: 1356190 - protein, 17 aa, Mycobacterium
AKYPDIKVLAKDTANWK

SEQ ID NO: 1356191 - protein, 21 aa, Mycobacterium
ALELLANGTWSGAGVLGPEAF

SEQ ID NO: 1356192 - protein, 18 aa, Mycobacterium
ALIRQHRRTAPTLAEAVR

SEQ ID NO: 1356193 - protein, 19 aa, Mycobacterium
ALLGPLLDSDPAGPSITYY

SEQ ID NO: 1356194 - protein, 18 aa, Mycobacterium
ALLRRAAPSLLVVAAVAA

SEQ ID NO: 1356195 - protein, 19 aa, Mycobacterium
ALMFPVVGGIGLMSNRASD

SEQ ID NO: 1356196 - protein, 20 aa, Mycobacterium
ALRIDPAAVTVLRGPYRGGR

SEQ ID NO: 1356197 - protein, 23 aa, Mycobacterium
ALTYSIYYPQKFVYAASLSGFLN

SEQ ID NO: 1356198 - protein, 22 aa, Mycobacterium
AMTLPKMIAYSEDRLRPPPGYK

SEQ ID NO: 1356199 - protein, 26 aa, Mycobacterium
ANEVDKLLWDEVFSLPLTQSPGNVAV

SEQ ID NO: 1356200 - protein, 19 aa, Mycobacterium
ANYFPVTRAVPEPPSIRYP

SEQ ID NO: 1356201 - protein, 23 aa, Mycobacterium
APAPGVAFVALFGALVLAIVADI

SEQ ID NO: 1356202 - protein, 19 aa, Mycobacterium
APFMSYGEFTGHAPLSTCA

SEQ ID NO: 1356203 - protein, 24 aa, Mycobacterium
APGNSWYHFTFNGAPGSILADKAL

SEQ ID NO: 1356204 - protein, 19 aa, Mycobacterium
APGPMPYPGAPPYGAPQYG

SEQ ID NO: 1356205 - protein, 28 aa, Mycobacterium
APKGPFQMILRLYWPKPDALNGTWKAPQ

SEQ ID NO: 1356206 - protein, 24 aa, Mycobacterium
APLSVFLNAPPPPGAPPIDFVPPL

SEQ ID NO: 1356207 - protein, 28 aa, Mycobacterium
APNAAFLDYLACPYGPRMLSPKGLADNA

SEQ ID NO: 1356208 - protein, 19 aa, Mycobacterium
APRVLRDTLGGKSVVLFRT

SEQ ID NO: 1356209 - protein, 25 aa, Mycobacterium
APTLNELVVAAYRPANQRGTGAAPA

SEQ ID NO: 1356210 - protein, 18 aa, Mycobacterium
APTLPGKGLSYACAAYGA

SEQ ID NO: 1356211 - protein, 26 aa, Mycobacterium
APVELPLCALITAWARGEYAPRAAAE

SEQ ID NO: 1356212 - protein, 18 aa, Mycobacterium
APVTGFYSLTYSSTGLER

SEQ ID NO: 1356213 - protein, 19 aa, Mycobacterium
APYNHAEFGQPFAMDYVWG

SEQ ID NO: 1356214 - protein, 23 aa, Mycobacterium
AQALIAVLLAAAMFVAGCSSSSE

SEQ ID NO: 1356215 - protein, 25 aa, Mycobacterium
AQDWPILAHAPAPLPPHIGARTVSV

SEQ ID NO: 1356216 - protein, 25 aa, Mycobacterium
AQGAIAFNGLYPPGSTFKTITTAAA

SEQ ID NO: 1356217 - protein, 17 aa, Mycobacterium
AQGWATAFIPPGRYRVD

SEQ ID NO: 1356218 - protein, 17 aa, Mycobacterium
AQHGKPAWPMAFAPVDS

SEQ ID NO: 1356219 - protein, 18 aa, Mycobacterium
AQLPNPPAGGFSPGGHDG

SEQ ID NO: 1356220 - protein, 28 aa, Mycobacterium
ARNSAPVINRLLAAFGLGSLRNLPSLPS

SEQ ID NO: 1356221 - protein, 29 aa, Mycobacterium
ARRVADVLDIPFYVWDFADRFKEDVIDDF

SEQ ID NO: 1356222 - protein, 24 aa, Mycobacterium
ARVVLLRTGLVLSPSGGLLSRLKP

SEQ ID NO: 1356223 - protein, 17 aa, Mycobacterium
ASLSGFLNLSEGWWPML

SEQ ID NO: 1356224 - protein, 20 aa, Mycobacterium
ASRVPLGGMSLPVVTPKTVQ

SEQ ID NO: 1356225 - protein, 32 aa, Mycobacterium
ASTSTYLFTHPDVNAFFTGLKGLPKEEVRARV

SEQ ID NO: 1356226 - protein, 36 aa, Mycobacterium
ATAARTPAKPLTRQDPAVVIGNVVGLFVGNGTADRP

SEQ ID NO: 1356227 - protein, 17 aa, Mycobacterium
ATAFIPPGRYRVDQAPS

SEQ ID NO: 1356228 - protein, 17 aa, Mycobacterium
ATDLLIERLGPGAVERA

SEQ ID NO: 1356229 - protein, 17 aa, Mycobacterium
ATEAIAHGVGVVGLLNV

SEQ ID NO: 1356230 - protein, 18 aa, Mycobacterium
ATILVLASSCSWQMGIPI

SEQ ID NO: 1356231 - protein, 20 aa, Mycobacterium
ATLLLFTVGCSREVTGTARQ

SEQ ID NO: 1356232 - protein, 25 aa, Mycobacterium
ATSKQYPGLYAPMIHPWSGTGDLKD

SEQ ID NO: 1356233 - protein, 25 aa, Mycobacterium
ATTDEFVFTVGKMQLIALRTGLTDE

SEQ ID NO: 1356234 - protein, 18 aa, Mycobacterium
ATTHWMAADAFRAAFPAV

SEQ ID NO: 1356235 - protein, 24 aa, Mycobacterium
AVAGSLFSVGFTPGVASAAPTTTE

SEQ ID NO: 1356236 - protein, 22 aa, Mycobacterium
AVASMVHLRWATNGLAVRPENS

SEQ ID NO: 1356237 - protein, 24 aa, Mycobacterium
AVDPRFVMPIFNGALAGGADYLDM

SEQ ID NO: 1356238 - protein, 27 aa, Mycobacterium
AVIRDGGGIPSFLGYHGFPASICSSVN

SEQ ID NO: 1356239 - protein, 18 aa, Mycobacterium
AVLHTLNIRLFPEQIEFV

SEQ ID NO: 1356240 - protein, 25 aa, Mycobacterium
AVLTLRDLLMGAAGPEFRPYIREGV

SEQ ID NO: 1356241 - protein, 19 aa, Mycobacterium
AVMFHLGKFIPTGVPDTYG

SEQ ID NO: 1356242 - protein, 31 aa, Mycobacterium
AVNDYLGHIAGDWFIRVLAERLQQGDEKKFI

SEQ ID NO: 1356243 - protein, 23 aa, Mycobacterium
AVNKMKNWISGFGPQINGVVAEN

SEQ ID NO: 1356244 - protein, 27 aa, Mycobacterium
AVNRACIAIGVFASLPVALQSPVGNRA

SEQ ID NO: 1356245 - protein, 23 aa, Mycobacterium
AVRRRPYTVVLFDEIEKAHPDVF

SEQ ID NO: 1356246 - protein, 20 aa, Mycobacterium
AVRRSTPLPGGYFGEGMTAV

SEQ ID NO: 1356247 - protein, 23 aa, Mycobacterium
AVTIMVLIVLLLGNATVTQVFTA

SEQ ID NO: 1356248 - protein, 18 aa, Mycobacterium
AWIDYVYDRANYAKLIAF

SEQ ID NO: 1356249 - protein, 23 aa, Mycobacterium
AWVQADRRFREAAPFLSYGPFTG

SEQ ID NO: 1356250 - protein, 26 aa, Mycobacterium
AYIHPEDRFMLTDPIKGFGPRVGQML

SEQ ID NO: 1356251 - protein, 18 aa, Mycobacterium
AYLVATSQFAEWIDRGRP

SEQ ID NO: 1356252 - protein, 18 aa, Mycobacterium
CAAYGASVLVLPEASREA

SEQ ID NO: 1356253 - protein, 27 aa, Mycobacterium
CAYVRARPRLKFYAYYEGTAQLVNGRY

SEQ ID NO: 1356254 - protein, 21 aa, Mycobacterium
CDGVIHLAYRHDFDDYANAAE

SEQ ID NO: 1356255 - protein, 17 aa, Mycobacterium
CDIPVLRIDSDPATIEP

SEQ ID NO: 1356256 - protein, 18 aa, Mycobacterium
CENLPGGALAIKNGVPAE

SEQ ID NO: 1356257 - protein, 27 aa, Mycobacterium
CGAIGAAIWLWVKRRQLAVAAAKAVPE

SEQ ID NO: 1356258 - protein, 22 aa, Mycobacterium
CGEGLMPHTVAHLDRLGVAPHG

SEQ ID NO: 1356259 - protein, 29 aa, Mycobacterium
CGGSDAWNLPAVFGPIAITYNLEGVDGVV

SEQ ID NO: 1356260 - protein, 19 aa, Mycobacterium
CLNPPVIWEDGRGWFVTEP

SEQ ID NO: 1356261 - protein, 26 aa, Mycobacterium
CLTDGAWPAFWLINDNPVRGGEVDLV

SEQ ID NO: 1356262 - protein, 25 aa, Mycobacterium
CNNMVLAVQQIAIGEAFVLAEKLGL

SEQ ID NO: 1356263 - protein, 20 aa, Mycobacterium
CVDGQVWANVWPTDEIIRID

SEQ ID NO: 1356264 - protein, 23 aa, Mycobacterium
CVEGLPDRWIAIGVGAVDEVLTP

SEQ ID NO: 1356265 - protein, 19 aa, Mycobacterium
CYRMLPPPGAIAAGGLYTA

SEQ ID NO: 1356266 - protein, 24 aa, Mycobacterium
DAAGMLRATMPRAFRIAADGSATL

SEQ ID NO: 1356267 - protein, 18 aa, Mycobacterium
DAALFVGAPWVISVDDHV

SEQ ID NO: 1356268 - protein, 17 aa, Mycobacterium
DAALLLAALAARAGDHV

SEQ ID NO: 1356269 - protein, 23 aa, Mycobacterium
DAKGNTIAWLYSQRRFEVPSEQI

SEQ ID NO: 1356270 - protein, 27 aa, Mycobacterium
DAQFRAEVRNRRLLRQAGQLEQRPDGK

SEQ ID NO: 1356271 - protein, 27 aa, Mycobacterium
DATSRTLAWAWSDPLSQEPGYWRTVVQ

SEQ ID NO: 1356272 - protein, 17 aa, Mycobacterium
DAVIRVVGPHYQRLFTS

SEQ ID NO: 1356273 - protein, 18 aa, Mycobacterium
DDKQFFAHYNPSVTMKRS

SEQ ID NO: 1356274 - protein, 35 aa, Mycobacterium
DEIDYVLSLGWFPIPLPPLPTPPLPRLASESAPAV

SEQ ID NO: 1356275 - protein, 25 aa, Mycobacterium
DFGTGYSVLSLLKSLPVDTLKIDKS

SEQ ID NO: 1356276 - protein, 20 aa, Mycobacterium
DFIEWSVSFAEKPFPDPCEV

SEQ ID NO: 1356277 - protein, 36 aa, Mycobacterium
DFVAPALSVPALPTPLPSPFGFVQQLPPVVKAFGSV

SEQ ID NO: 1356278 - protein, 22 aa, Mycobacterium
DGRRLVVVLMHGLVKEGGPTYW

SEQ ID NO: 1356279 - protein, 17 aa, Mycobacterium
DGSKWVRNRPAVAAPII

SEQ ID NO: 1356280 - protein, 18 aa, Mycobacterium
DGTMLTRIPIDTGSPTAV

SEQ ID NO: 1356281 - protein, 28 aa, Mycobacterium
DGVPKVWAPARSFVYYVPQRDGSLEGSW

SEQ ID NO: 1356282 - protein, 25 aa, Mycobacterium
DIHNQSTFLYPWGDSYYGPATVVDW

SEQ ID NO: 1356283 - protein, 25 aa, Mycobacterium
DISADSSMFFPIPGLTLGGLLVDES

SEQ ID NO: 1356284 - protein, 23 aa, Mycobacterium
DITAIHLVTLLEALPMQETLEAI

SEQ ID NO: 1356285 - protein, 33 aa, Mycobacterium
DKALPIVPMFHANAWGLPYAALMAGADLVLPDR

SEQ ID NO: 1356286 - protein, 21 aa, Mycobacterium
DKLTYLGYSYGTRIGAAYAEQ

SEQ ID NO: 1356287 - protein, 20 aa, Mycobacterium
DLAGFWVAEAVWVTHSAGVA

SEQ ID NO: 1356288 - protein, 26 aa, Mycobacterium
DLERNDMVWLDPAPMDDTYALAASKA

SEQ ID NO: 1356289 - protein, 17 aa, Mycobacterium
DLKKSLADASRSRAADD

SEQ ID NO: 1356290 - protein, 18 aa, Mycobacterium
DLLVRAWVRSYGVRATIS

SEQ ID NO: 1356291 - protein, 18 aa, Mycobacterium
DLQQPEWKGRWGAPPAKA

SEQ ID NO: 1356292 - protein, 17 aa, Mycobacterium
DLTFSWYAVDHTGQPWV

SEQ ID NO: 1356293 - protein, 17 aa, Mycobacterium
DMHMAIASALNMYDNTL

SEQ ID NO: 1356294 - protein, 24 aa, Mycobacterium
DNDVTLVIWTNLTLSPDGRTTAQA

SEQ ID NO: 1356295 - protein, 24 aa, Mycobacterium
DNMQDLFRGLGAEHALLLDGGGSS

SEQ ID NO: 1356296 - protein, 32 aa, Mycobacterium
DPDVFYQPEGLLIMTSAYQGLLRYAPESTEVE

SEQ ID NO: 1356297 - protein, 19 aa, Mycobacterium
DPRNEWLFDENWGVDVAVS

SEQ ID NO: 1356298 - protein, 28 aa, Mycobacterium
DPRNTPPHAWYIAFAPAQAPKVAVAVLV

SEQ ID NO: 1356299 - protein, 40 aa, Mycobacterium
DPTLTTMLQSGRFQLTWKPEFPYIALAVIAKQSWADAHRD

SEQ ID NO: 1356300 - protein, 25 aa, Mycobacterium
DPVAEPAFRLLQRRALRPPVAIDRL

SEQ ID NO: 1356301 - protein, 25 aa, Mycobacterium
DQPWFAGGTVLVLRRIRAEMDTWDQ

SEQ ID NO: 1356302 - protein, 24 aa, Mycobacterium
DRAPEWSYSAMIFADPAMAEDPPT

SEQ ID NO: 1356303 - protein, 25 aa, Mycobacterium
DRARELILEFADFTRYSFRAAGQYT

SEQ ID NO: 1356304 - protein, 20 aa, Mycobacterium
DRLHVRYDLSWQALDGALAR

SEQ ID NO: 1356305 - protein, 33 aa, Mycobacterium
DRTMIKACPVTWPWNLLGWPSINVPAGFTADGL

SEQ ID NO: 1356306 - protein, 22 aa, Mycobacterium
DRYMRTLDPWVSLGTACAVTSR

SEQ ID NO: 1356307 - protein, 25 aa, Mycobacterium
DSLLDWVELLAAETGLPVGIKSAVG

SEQ ID NO: 1356308 - protein, 19 aa, Mycobacterium
DTFRLLGNARWLPFVIAHG

SEQ ID NO: 1356309 - protein, 20 aa, Mycobacterium
DTKSIRDLKKSLADASRSRA

SEQ ID NO: 1356310 - protein, 18 aa, Mycobacterium
DTSLQRIPALAAYPDRPA

SEQ ID NO: 1356311 - protein, 25 aa, Mycobacterium
DTSYGVIQQVLFYSPIYSQPDVDCM

SEQ ID NO: 1356312 - protein, 22 aa, Mycobacterium
DVAFMFIAAPFVPNGGVYSRFP

SEQ ID NO: 1356313 - protein, 24 aa, Mycobacterium
DVLVPGYRYHLALDAKAAGAELMA

SEQ ID NO: 1356314 - protein, 17 aa, Mycobacterium
DVPLPVQNRPGGIGAQF

SEQ ID NO: 1356315 - protein, 19 aa, Mycobacterium
DVRNTVRFGFWGAEEQGLL

SEQ ID NO: 1356316 - protein, 23 aa, Mycobacterium
DYQPGMEPFFTVLANSLPEWPFN

SEQ ID NO: 1356317 - protein, 24 aa, Mycobacterium
DYTYKWETFLTQELPAWLEANRGV

SEQ ID NO: 1356318 - protein, 27 aa, Mycobacterium
EAAAQRRIGWVFNICDVVLAPTTAQPP

SEQ ID NO: 1356319 - protein, 22 aa, Mycobacterium
EAITRYGLRITGRRGDLVITDN

SEQ ID NO: 1356320 - protein, 19 aa, Mycobacterium
EAIVRWRGVFETAQAGVPA

SEQ ID NO: 1356321 - protein, 22 aa, Mycobacterium
EALDYAVIQFDPQKVAPTNNVN

SEQ ID NO: 1356322 - protein, 25 aa, Mycobacterium
EASFYRLSSLRWWPDRRLSRRGLEI

SEQ ID NO: 1356323 - protein, 20 aa, Mycobacterium
EAVLPFHRFRKADGAQIDSL

SEQ ID NO: 1356324 - protein, 22 aa, Mycobacterium
EDFLTIIRDEGIVWEAADTPAV

SEQ ID NO: 1356325 - protein, 25 aa, Mycobacterium
EDLRLLGQWLEDAAPHWPRRRTLRR

SEQ ID NO: 1356326 - protein, 22 aa, Mycobacterium
EDNGYIPVPEAFKTRLTEAVDA

SEQ ID NO: 1356327 - protein, 17 aa, Mycobacterium
EDRGAFGEVLRTAGLPA

SEQ ID NO: 1356328 - protein, 21 aa, Mycobacterium
EESTYWNPSWTITHGAIQTAT

SEQ ID NO: 1356329 - protein, 20 aa, Mycobacterium
EFGQPFAMDYVWGRQLGELT

SEQ ID NO: 1356330 - protein, 29 aa, Mycobacterium
EGEFVNFGPSWAWPKPVQAHIPVLVGAAG

SEQ ID NO: 1356331 - protein, 32 aa, Mycobacterium
EGPKAATLLIYTHGPALVRLHFESAPGDATTD

SEQ ID NO: 1356332 - protein, 24 aa, Mycobacterium
EGPLATMGLYPPGSTFKIVTAAAA

SEQ ID NO: 1356333 - protein, 22 aa, Mycobacterium
EGWDFLPNQTRLLDALKSTVAY

SEQ ID NO: 1356334 - protein, 21 aa, Mycobacterium
EHLEDYFALRWARPDDGTLVI

SEQ ID NO: 1356335 - protein, 20 aa, Mycobacterium
EIAILQILNGPPPGGGAMGS

SEQ ID NO: 1356336 - protein, 24 aa, Mycobacterium
EILTRYLNLVSFGNGAFGIQDAAQ

SEQ ID NO: 1356337 - protein, 28 aa, Mycobacterium
EKRREQVDFIDYMQIPLSVLTTVDNAPK

SEQ ID NO: 1356338 - protein, 18 aa, Mycobacterium
ELAALLLAGRDTGVRLSL

SEQ ID NO: 1356339 - protein, 18 aa, Mycobacterium
ELAKLFDKKLANTTPERA

SEQ ID NO: 1356340 - protein, 20 aa, Mycobacterium
ELDVEGLPPILVVSTTNDPA

SEQ ID NO: 1356341 - protein, 25 aa, Mycobacterium
ELQHKGFPIIDSLSRHGLGSTGTNI

SEQ ID NO: 1356342 - protein, 26 aa, Mycobacterium
ELQSQFAFLTADQLLREGYWACRAAR

SEQ ID NO: 1356343 - protein, 19 aa, Mycobacterium
EMFFVHRTARFEPSLDAHT

SEQ ID NO: 1356344 - protein, 23 aa, Mycobacterium
EMIADAVLLALGAPMSAAGTCWV

SEQ ID NO: 1356345 - protein, 26 aa, Mycobacterium
EMLILVIAGLVILGPERLPGAIRWTS

SEQ ID NO: 1356346 - protein, 22 aa, Mycobacterium
EPALPVPAGWPFGEDFPRTCGT

SEQ ID NO: 1356347 - protein, 25 aa, Mycobacterium
EPGATWPPVVRPPVGWIAQDDGRVT

SEQ ID NO: 1356348 - protein, 19 aa, Mycobacterium
EPVVVLPGLREVEAGQFEG

SEQ ID NO: 1356349 - protein, 27 aa, Mycobacterium
EQLDDIALYLNFDMLGSTNAGYFTYDG

SEQ ID NO: 1356350 - protein, 33 aa, Mycobacterium
EQSGDAWRLGWSPALLHPDLKPGMKFQYSEDSE

SEQ ID NO: 1356351 - protein, 18 aa, Mycobacterium
ERGATVFGISRDADRMAS

SEQ ID NO: 1356352 - protein, 18 aa, Mycobacterium
ERPAALQLRLLQTVVEVA

SEQ ID NO: 1356353 - protein, 19 aa, Mycobacterium
ESAAPFLRELTGTDGIALF

SEQ ID NO: 1356354 - protein, 20 aa, Mycobacterium
ESDMWYPYPCEFDYLCDDGG

SEQ ID NO: 1356355 - protein, 25 aa, Mycobacterium
ESKLIGRVVNLRPAVLSALASRATV

SEQ ID NO: 1356356 - protein, 21 aa, Mycobacterium
ETAQRWNLKTIGDLAAHSPEV

SEQ ID NO: 1356357 - protein, 26 aa, Mycobacterium
ETWSALATMILPVGGAPYVVMPKGKQ

SEQ ID NO: 1356358 - protein, 23 aa, Mycobacterium
EVENPDCHLTWTTLAGIGMVESH

SEQ ID NO: 1356359 - protein, 18 aa, Mycobacterium
EVPPVRAGGTWDALAQCE

SEQ ID NO: 1356360 - protein, 20 aa, Mycobacterium
EVRVVLCAPQVPCGHAASAV

SEQ ID NO: 1356361 - protein, 27 aa, Mycobacterium
EVSGSDAIFLLTQRPLDPAATPPPGVP

SEQ ID NO: 1356362 - protein, 41 aa, Mycobacterium
EVSLPAKKWLADRGFDPLYGARPLRRLIQQSIGDQLAKMLL

SEQ ID NO: 1356363 - protein, 18 aa, Mycobacterium
EVVPPTPIQLRTTGRLLG

SEQ ID NO: 1356364 - protein, 18 aa, Mycobacterium
EVYGLFARAGLHDRVTWI

SEQ ID NO: 1356365 - protein, 19 aa, Mycobacterium
EWMQAHAPQFMKVSPLGTV

SEQ ID NO: 1356366 - protein, 22 aa, Mycobacterium
EYAALSYLKYPRAVTVESVTDP

SEQ ID NO: 1356367 - protein, 17 aa, Mycobacterium
FCDEFMPAHSISGLRDL

SEQ ID NO: 1356368 - protein, 18 aa, Mycobacterium
FEMLRYVADRFLVLPMPK

SEQ ID NO: 1356369 - protein, 17 aa, Mycobacterium
FERVGMPAPAREALWDW

SEQ ID NO: 1356370 - protein, 17 aa, Mycobacterium
FERYMALADPTLQAMDR

SEQ ID NO: 1356371 - protein, 18 aa, Mycobacterium
FFAHYNPSVTMKRSFFEA

SEQ ID NO: 1356372 - protein, 18 aa, Mycobacterium
FFGRYFTPDEARALIAEQ

SEQ ID NO: 1356373 - protein, 23 aa, Mycobacterium
FGELREGVWLRPDNLDTALPEDV

SEQ ID NO: 1356374 - protein, 23 aa, Mycobacterium
FGNKYVALRSPDHPAREPISPDL

SEQ ID NO: 1356375 - protein, 22 aa, Mycobacterium
FGTAIYAEYRWSRTLRDVANLD

SEQ ID NO: 1356376 - protein, 25 aa, Mycobacterium
FHRCGGELIFQIGTAYFGCRDDQGR

SEQ ID NO: 1356377 - protein, 17 aa, Mycobacterium
FIDVLKTLHKLGLDRTD

SEQ ID NO: 1356378 - protein, 25 aa, Mycobacterium
FPIAKIAAKLAIGYTLDEILNDITK

SEQ ID NO: 1356379 - protein, 18 aa, Mycobacterium
FSARVQEALLADDRIRHL

SEQ ID NO: 1356380 - protein, 31 aa, Mycobacterium
FSEKMMHDTPIPTLVEFLHALEVHDETGGLT

SEQ ID NO: 1356381 - protein, 21 aa, Mycobacterium
FTGNAWINYLGHEKPIPNARE

SEQ ID NO: 1356382 - protein, 23 aa, Mycobacterium
GAAATAFFGLAAPAQAAPAGPGN

SEQ ID NO: 1356383 - protein, 33 aa, Mycobacterium
GAAPLIFTDSVSLPFQLGFARVYRVFAERNLHE

SEQ ID NO: 1356384 - protein, 23 aa, Mycobacterium
GADPVVPVLVHPDPRAVLGAVAS

SEQ ID NO: 1356385 - protein, 26 aa, Mycobacterium
GADTDQTLAYRWTLAPGREFGYEATG

SEQ ID NO: 1356386 - protein, 21 aa, Mycobacterium
GAIPIAGLPAAAPALVLPEPP

SEQ ID NO: 1356387 - protein, 24 aa, Mycobacterium
GAIRPFPHHAAYGSAKWALRGLTQ

SEQ ID NO: 1356388 - protein, 17 aa, Mycobacterium
GALARRAVVARAVAVDA

SEQ ID NO: 1356389 - protein, 17 aa, Mycobacterium
GALLLGARLGPERTAAI

SEQ ID NO: 1356390 - protein, 25 aa, Mycobacterium
GCSTYKWETFLTQELPAYLASNKGV

SEQ ID NO: 1356391 - protein, 28 aa, Mycobacterium
GDDHPELRPLVDLLPIAGGSGTLSNRYL

SEQ ID NO: 1356392 - protein, 22 aa, Mycobacterium
GDENTIVIGTKFDQPGLGLRNP

SEQ ID NO: 1356393 - protein, 23 aa, Mycobacterium
GDGGHGGAYINNGRASGGGKAGD

SEQ ID NO: 1356394 - protein, 17 aa, Mycobacterium
GDLVRLMEFRKGQANLV

SEQ ID NO: 1356395 - protein, 18 aa, Mycobacterium
GDRVLKTFAPALSLKAND

SEQ ID NO: 1356396 - protein, 31 aa, Mycobacterium
GEFTGHAPLSTCAFWPVPPTSEPHELDVEGL

SEQ ID NO: 1356397 - protein, 21 aa, Mycobacterium
GEKPLELLRHVRGLTLVELPD

SEQ ID NO: 1356398 - protein, 26 aa, Mycobacterium
GELEVRGPWITGSYYRNTDDSKFQSG

SEQ ID NO: 1356399 - protein, 28 aa, Mycobacterium
GEVAVVPGLTGRLLDRFQPEATARADEQ

SEQ ID NO: 1356400 - protein, 27 aa, Mycobacterium
GEVDGGVIYHYYWFRDQSKTKEISGNT

SEQ ID NO: 1356401 - protein, 18 aa, Mycobacterium
GFLLAPWTAERVSAELQT

SEQ ID NO: 1356402 - protein, 22 aa, Mycobacterium
GGAAIVIAGLAGCSSDSGSSES

SEQ ID NO: 1356403 - protein, 35 aa, Mycobacterium
GGARIPIVTQRLSEALRLPVITGPYAQVVAAAGAE

SEQ ID NO: 1356404 - protein, 21 aa, Mycobacterium
GGGPHAVYLLDGLRAQDDYNG

SEQ ID NO: 1356405 - protein, 31 aa, Mycobacterium
GGQNGDQPLPDGPIGGVAPDAGHGGTGASGG

SEQ ID NO: 1356406 - protein, 29 aa, Mycobacterium
GGSHSWFAGYRGDLAFAALIVGGGSSEYA

SEQ ID NO: 1356407 - protein, 34 aa, Mycobacterium
GGTDTYILVRAEHLPLLQPIRDLAAATGTTVVVE

SEQ ID NO: 1356408 - protein, 24 aa, Mycobacterium
GGVTPKLFLPGLAGLNQGPGFPNL

SEQ ID NO: 1356409 - protein, 20 aa, Mycobacterium
GHLFQPLLYQCATGKLSIGQ

SEQ ID NO: 1356410 - protein, 18 aa, Mycobacterium
GIAAHRLDPQLAGQTLGA

SEQ ID NO: 1356411 - protein, 27 aa, Mycobacterium
GIAAQNARIYLIDTVLDPAAAPDAVSP

SEQ ID NO: 1356412 - protein, 22 aa, Mycobacterium
GIDGVAAGEWGTSGVGGGAGGA

SEQ ID NO: 1356413 - protein, 25 aa, Mycobacterium
GIGGTDLGIMWDGGIRLGERFVHVA

SEQ ID NO: 1356414 - protein, 19 aa, Mycobacterium
GKAVKRLELPRDSALVTIL

SEQ ID NO: 1356415 - protein, 27 aa, Mycobacterium
GKMDNVTAWRFLSPPSAFLEGLTVGAD

SEQ ID NO: 1356416 - protein, 27 aa, Mycobacterium
GKSTFVAFTLAPLLPGSPFVNADEIAR

SEQ ID NO: 1356417 - protein, 20 aa, Mycobacterium
GLATFAGALAVAPMALGAGT

SEQ ID NO: 1356418 - protein, 24 aa, Mycobacterium
GLDSLRLWHGGFLEGLPDEVVTAR

SEQ ID NO: 1356419 - protein, 25 aa, Mycobacterium
GLEAYLPARKLAIAVAVTFAPEAFD

SEQ ID NO: 1356420 - protein, 32 aa, Mycobacterium
GLNRADLTVPLPFPLPTLPNPVTPKAFIESVT

SEQ ID NO: 1356421 - protein, 22 aa, Mycobacterium
GLPAPRFGLATTFDQARRIAAD

SEQ ID NO: 1356422 - protein, 35 aa, Mycobacterium
GLSTTDTWWRIDWNTLLDKTIPVGLFTFDTDRGTS

SEQ ID NO: 1356423 - protein, 24 aa, Mycobacterium
GNGFYGGLQFLPATWREHGGVGSP

SEQ ID NO: 1356424 - protein, 21 aa, Mycobacterium
GNPGLAGQPGSGGSAGIGGTG

SEQ ID NO: 1356425 - protein, 26 aa, Mycobacterium
GNTICPGFFDCHVHFSLPGAGATPID

SEQ ID NO: 1356426 - protein, 35 aa, Mycobacterium
GPLRVSGYAGWVAWGLLHIAFLTGVSNRISTVATW

SEQ ID NO: 1356427 - protein, 32 aa, Mycobacterium
GPMVKIVELFQAPWWVPFKQADRARYRAKLPN

SEQ ID NO: 1356428 - protein, 24 aa, Mycobacterium
GPTYWDQAAGLLDWGFGLDRGASV

SEQ ID NO: 1356429 - protein, 18 aa, Mycobacterium
GPVALPPTDPRYVDGGPG

SEQ ID NO: 1356430 - protein, 26 aa, Mycobacterium
GQACAQTIAWYLAMTYRSQGNEEGAR

SEQ ID NO: 1356431 - protein, 20 aa, Mycobacterium
GQAKCDALRPLMDALRHTEL

SEQ ID NO: 1356432 - protein, 26 aa, Mycobacterium
GQGADALWFLPLLGQDARDLLELGLG

SEQ ID NO: 1356433 - protein, 46 aa, Mycobacterium
GQHRRKAEGPRVLPVSGWLSAGAVTVAMGAAMIAGAGLAQADSTSG

SEQ ID NO: 1356434 - protein, 17 aa, Mycobacterium
GQKLPFAIAPTAQGARG

SEQ ID NO: 1356435 - protein, 29 aa, Mycobacterium
GQLPPVNAFWSLTMYEMPASLLVANPMQR

SEQ ID NO: 1356436 - protein, 29 aa, Mycobacterium
GRAAVPWWPWAPLVQLMRVLPPRLTRLFA

SEQ ID NO: 1356437 - protein, 25 aa, Mycobacterium
GREITRIEDLWDPAFKGRVSLLSDT

SEQ ID NO: 1356438 - protein, 23 aa, Mycobacterium
GRQYMPWISLEDQVRAMLFAVAH

SEQ ID NO: 1356439 - protein, 19 aa, Mycobacterium
GRRTDRAWLYCLTTSGAYE

SEQ ID NO: 1356440 - protein, 23 aa, Mycobacterium
GRSVWLQRGPVDAAIRASIAIPG

SEQ ID NO: 1356441 - protein, 25 aa, Mycobacterium
GSPPGLFTPGYYRELTVPVGIINSD

SEQ ID NO: 1356442 - protein, 25 aa, Mycobacterium
GSRYALAAYPGYWGEKPYFEQVEIP

SEQ ID NO: 1356443 - protein, 29 aa, Mycobacterium
GTADRPNAGLLLGNGYSYTATTCPASTVC

SEQ ID NO: 1356444 - protein, 26 aa, Mycobacterium
GTFGAGMGISTWWYRGSDMDVERELE

SEQ ID NO: 1356445 - protein, 29 aa, Mycobacterium
GTLRVSNWPLYMADGFVAAFQTASGITVD

SEQ ID NO: 1356446 - protein, 21 aa, Mycobacterium
GTRLYLGQLLGEAGQDPASLT

SEQ ID NO: 1356447 - protein, 22 aa, Mycobacterium
GVARAVIGPILRAASYGDEKIS

SEQ ID NO: 1356448 - protein, 21 aa, Mycobacterium
GVDRAILATASLAGLMPWHPD

SEQ ID NO: 1356449 - protein, 19 aa, Mycobacterium
GVDWQGTLTGLAGYLRGDT

SEQ ID NO: 1356450 - protein, 24 aa, Mycobacterium
GVERLLAGYLNEAGVRPADMPLSD

SEQ ID NO: 1356451 - protein, 18 aa, Mycobacterium
GVKRIVYLGGFVPTDETL

SEQ ID NO: 1356452 - protein, 17 aa, Mycobacterium
GVLLRPYARLIASTGDS

SEQ ID NO: 1356453 - protein, 17 aa, Mycobacterium
GVMSERPAALQLRLLQT

SEQ ID NO: 1356454 - protein, 27 aa, Mycobacterium
GVNAGDLAIVRAIIALAAAFGLELVAE

SEQ ID NO: 1356455 - protein, 25 aa, Mycobacterium
GVRALRQRLGIHPVFKTVDTCAAEF

SEQ ID NO: 1356456 - protein, 17 aa, Mycobacterium
GVVITPQPDMLPTDEEF

SEQ ID NO: 1356457 - protein, 18 aa, Mycobacterium
GVVNGTKAFLPHLIASGD

SEQ ID NO: 1356458 - protein, 22 aa, Mycobacterium
GVYSRFPGLRLPGFTSTGAAAP

SEQ ID NO: 1356459 - protein, 17 aa, Mycobacterium
GWATAFIPPGRYRVDQA

SEQ ID NO: 1356460 - protein, 24 aa, Mycobacterium
GYAGRFIGPFKGRLGLFGSEVTQI

SEQ ID NO: 1356461 - protein, 28 aa, Mycobacterium
GYDRPIFLGVGLLDRDVPPSSTLSLYDQ

SEQ ID NO: 1356462 - protein, 22 aa, Mycobacterium
HADCPLFNDPYAQVFIDAALSR

SEQ ID NO: 1356463 - protein, 20 aa, Mycobacterium
HARQYPQRYPTRVVGAAIIS

SEQ ID NO: 1356464 - protein, 19 aa, Mycobacterium
HGYMYGGSFYALADEPYPA

SEQ ID NO: 1356465 - protein, 20 aa, Mycobacterium
HLLMALLTQNDGIAAPLLEA

SEQ ID NO: 1356466 - protein, 17 aa, Mycobacterium
HMDIGHRTVPNYGGFDL

SEQ ID NO: 1356467 - protein, 27 aa, Mycobacterium
HTGQPWVVSFQLNWPRYRSRTAASWLL

SEQ ID NO: 1356468 - protein, 17 aa, Mycobacterium
HVLVIGSGPILIGQAAE

SEQ ID NO: 1356469 - protein, 20 aa, Mycobacterium
HVPLGPDHTYWFATERTAEG

SEQ ID NO: 1356470 - protein, 33 aa, Mycobacterium
IADEVSYIYLYNPSVIQAWTPALSGYEARRDGA

SEQ ID NO: 1356471 - protein, 21 aa, Mycobacterium
IAQFSWVGDAFPLSGLTQIYA

SEQ ID NO: 1356472 - protein, 29 aa, Mycobacterium
IDALPLLEPTYLFFDAINLLTGANLNNPI

SEQ ID NO: 1356473 - protein, 18 aa, Mycobacterium
IDLIPEYTGNLLQYFDEE

SEQ ID NO: 1356474 - protein, 29 aa, Mycobacterium
IDQTQLPITLFAIGVLSPIYAGFVKAGGA

SEQ ID NO: 1356475 - protein, 28 aa, Mycobacterium
IDRALNPPSYHYFQLIDRLRVTLHNGVT

SEQ ID NO: 1356476 - protein, 24 aa, Mycobacterium
IDSGALVLHYLPEVDIRTGEILAT

SEQ ID NO: 1356477 - protein, 18 aa, Mycobacterium
IEDDSQLIRDARARAFED

SEQ ID NO: 1356478 - protein, 21 aa, Mycobacterium
IGSRFARVELLAAAPPAAPPA

SEQ ID NO: 1356479 - protein, 23 aa, Mycobacterium
IGTLVVVLALVAAFAGWQLYKRL

SEQ ID NO: 1356480 - protein, 29 aa, Mycobacterium
IIGREIGHYREHLPRWVDGRVALIGDAAH

SEQ ID NO: 1356481 - protein, 17 aa, Mycobacterium
IIVVVAALALAVYSSSK

SEQ ID NO: 1356482 - protein, 17 aa, Mycobacterium
ILLDVRYITPHNFTGDP

SEQ ID NO: 1356483 - protein, 27 aa, Mycobacterium
INSLWQVVITPLLGPAIELIPAITSVI

SEQ ID NO: 1356484 - protein, 19 aa, Mycobacterium
IPAAHWRLGDACEISVLES

SEQ ID NO: 1356485 - protein, 30 aa, Mycobacterium
IPGPSTAAHFGWIGALFALDVPASSDSTRQ

SEQ ID NO: 1356486 - protein, 25 aa, Mycobacterium
IPSGDTRAFLGARIGVRRGAVVDAG

SEQ ID NO: 1356487 - protein, 17 aa, Mycobacterium
IPTPPGWQPYPGTQFEP

SEQ ID NO: 1356488 - protein, 31 aa, Mycobacterium
IRTQTQIFQRLQLIYLFTIGHKKAASIEDLA

SEQ ID NO: 1356489 - protein, 26 aa, Mycobacterium
ISLAAVFLALAIGVALGSGLLSNTVL

SEQ ID NO: 1356490 - protein, 25 aa, Mycobacterium
ITITTPVVEGTRWGRGISVVGGRDV

SEQ ID NO: 1356491 - protein, 21 aa, Mycobacterium
ITLAAPSAAAPPWAMPDVRGM

SEQ ID NO: 1356492 - protein, 20 aa, Mycobacterium
ITSVLALADLIGGARPGQYG

SEQ ID NO: 1356493 - protein, 30 aa, Mycobacterium
ITTQAPPRPWTDLLVIELASMWAGPLLGRM

SEQ ID NO: 1356494 - protein, 22 aa, Mycobacterium
ITYNEWSFAKAQNLSIAKIITA

SEQ ID NO: 1356495 - protein, 22 aa, Mycobacterium
IVISGDWLLQNPMFSGYGGLEA

SEQ ID NO: 1356496 - protein, 19 aa, Mycobacterium
IVTPPLFPGVSISADLGNG

SEQ ID NO: 1356497 - protein, 33 aa, Mycobacterium
KAFAESALKPLIRALIRNLPKPLGKEGGLIDQV

SEQ ID NO: 1356498 - protein, 32 aa, Mycobacterium
KEHALRRNFPVLARFRYLLESIGPELRQYIIT

SEQ ID NO: 1356499 - protein, 29 aa, Mycobacterium
KEYTEQVILGYILEFTLMAAGAEVRDLTG

SEQ ID NO: 1356500 - protein, 27 aa, Mycobacterium
KGDTYPIAMLLVFELTGQFDPAEAIKH

SEQ ID NO: 1356501 - protein, 28 aa, Mycobacterium
KGEVLRLRWRRGCMPAPRRVVRARVHGR

SEQ ID NO: 1356502 - protein, 20 aa, Mycobacterium
KGNYLYRMAGAVFGIYGNTA

SEQ ID NO: 1356503 - protein, 22 aa, Mycobacterium
KQINLTNWIVCSQSPRAGGSIG

SEQ ID NO: 1356504 - protein, 22 aa, Mycobacterium
KRWRVAAALAATASLLAGCGGG

SEQ ID NO: 1356505 - protein, 20 aa, Mycobacterium
KVLHLSFLQDPGQPPDPDVF

SEQ ID NO: 1356506 - protein, 19 aa, Mycobacterium
KVPTLIACGDRDLLTPMEY

SEQ ID NO: 1356507 - protein, 18 aa, Mycobacterium
KVPVPYAMAITFQFRGVT

SEQ ID NO: 1356508 - protein, 28 aa, Mycobacterium
LAAGRPGPVAVLFFDLDRLKAVNDYLGH

SEQ ID NO: 1356509 - protein, 28 aa, Mycobacterium
LAAIDQGLPLRLVQPAWAPCCQPDQDDH

SEQ ID NO: 1356510 - protein, 17 aa, Mycobacterium
LAALLLAGCGGADEQQA

SEQ ID NO: 1356511 - protein, 25 aa, Mycobacterium
LADAFERALRRWPVDGIPAEPAAWV

SEQ ID NO: 1356512 - protein, 18 aa, Mycobacterium
LALIVALLLAVTGCSTGE

SEQ ID NO: 1356513 - protein, 24 aa, Mycobacterium
LALRAQISPHFIYNALNTIASFVR

SEQ ID NO: 1356514 - protein, 19 aa, Mycobacterium
LAPLLPVRGVISLAEVIQR

SEQ ID NO: 1356515 - protein, 18 aa, Mycobacterium
LASIVRFRWNGNGVELIG

SEQ ID NO: 1356516 - protein, 20 aa, Mycobacterium
LATGFLAFAAPAQAAPSGTG

SEQ ID NO: 1356517 - protein, 23 aa, Mycobacterium
LATQGLKAWPKCGPRGVATRAAV

SEQ ID NO: 1356518 - protein, 28 aa, Mycobacterium
LAVLLVIVLLVGAWAYQTAHRLDRLHVR

SEQ ID NO: 1356519 - protein, 19 aa, Mycobacterium
LAYSVSTPGRFRFLRVYPN

SEQ ID NO: 1356520 - protein, 33 aa, Mycobacterium
LCAQYLAPILDALKFNFPPFGLNQISTAMTLPK

SEQ ID NO: 1356521 - protein, 24 aa, Mycobacterium
LCNAQRAWVPQPPLVGVRTQGAPC

SEQ ID NO: 1356522 - protein, 26 aa, Mycobacterium
LDRAMGPMQFIPETWRLYGVDANGDG

SEQ ID NO: 1356523 - protein, 27 aa, Mycobacterium
LDVTLSNWRGLYGPPDMPQFAVAYWQT

SEQ ID NO: 1356524 - protein, 19 aa, Mycobacterium
LEDATGLRVYFVSGTPACY

SEQ ID NO: 1356525 - protein, 17 aa, Mycobacterium
LEDPKNNFLAANVVPLV

SEQ ID NO: 1356526 - protein, 27 aa, Mycobacterium
LENYENEWWHFTFKPETYPDTYFDFPV

SEQ ID NO: 1356527 - protein, 23 aa, Mycobacterium
LEQATAFVNFQYTPEAQKLWAEA

SEQ ID NO: 1356528 - protein, 27 aa, Mycobacterium
LERLRSTWDVPTLALLGIGNGAQVALA

SEQ ID NO: 1356529 - protein, 18 aa, Mycobacterium
LEYDLIGDFPAYANPLSL

SEQ ID NO: 1356530 - protein, 20 aa, Mycobacterium
LGAAYAERYPDRVRAMVLDG

SEQ ID NO: 1356531 - protein, 19 aa, Mycobacterium
LGGRGNIVILQGPLGQSGE

SEQ ID NO: 1356532 - protein, 24 aa, Mycobacterium
LGGTGNQWGAEPGGPGNPGLAGQP

SEQ ID NO: 1356533 - protein, 17 aa, Mycobacterium
LGLLGERVLADPAPILA

SEQ ID NO: 1356534 - protein, 20 aa, Mycobacterium
LGLPVVVRPSFTMGGLGSGM

SEQ ID NO: 1356535 - protein, 32 aa, Mycobacterium
LGSLRNLPSLPSPAWALSALLALGSRRELERS

SEQ ID NO: 1356536 - protein, 26 aa, Mycobacterium
LGSVTVLPMLLLRNPGRANGGLFARL

SEQ ID NO: 1356537 - protein, 18 aa, Mycobacterium
LHRKSGWAQAWGIEGRLL

SEQ ID NO: 1356538 - protein, 18 aa, Mycobacterium
LIAGVSLASAGLIVGGSN

SEQ ID NO: 1356539 - protein, 22 aa, Mycobacterium
LIALLCVLPIAVAPAPGVAFVA

SEQ ID NO: 1356540 - protein, 26 aa, Mycobacterium
LINANRFDPLVPWAPAMQLGRDWCAQ

SEQ ID NO: 1356541 - protein, 29 aa, Mycobacterium
LKNWTEQCLLSPYGLLHTRVTDWRTTTMR

SEQ ID NO: 1356542 - protein, 19 aa, Mycobacterium
LLDFAVHKPLQYEPGTNWS

SEQ ID NO: 1356543 - protein, 25 aa, Mycobacterium
LLGNARWLPFVIAHGGLDQLVPFPG

SEQ ID NO: 1356544 - protein, 21 aa, Mycobacterium
LLGVSAIFALGTLSACSGGES

SEQ ID NO: 1356545 - protein, 25 aa, Mycobacterium
LLKTTGPVSLLYYGYDQIADLANME

SEQ ID NO: 1356546 - protein, 18 aa, Mycobacterium
LLLLLDNASAQPCLDKPR

SEQ ID NO: 1356547 - protein, 20 aa, Mycobacterium
LLVALTFAGGYAVAAHKTVT

SEQ ID NO: 1356548 - protein, 17 aa, Mycobacterium
LLVVVLGGCGAQRDPST

SEQ ID NO: 1356549 - protein, 24 aa, Mycobacterium
LMDRNARFVAVAGLGLLAPGETGQ

SEQ ID NO: 1356550 - protein, 18 aa, Mycobacterium
LNGGEFTVFAPTDEAFAK

SEQ ID NO: 1356551 - protein, 24 aa, Mycobacterium
LNGPLRHRYAGYTAWRGIAAHRLD

SEQ ID NO: 1356552 - protein, 18 aa, Mycobacterium
LNIWPNGVRVLDGLGLGA

SEQ ID NO: 1356553 - protein, 23 aa, Mycobacterium
LNLAQYPSILVELGNMKNPADSA

SEQ ID NO: 1356554 - protein, 26 aa, Mycobacterium
LPAEHGFRFFPGFYRNVTDTMRRIPF

SEQ ID NO: 1356555 - protein, 18 aa, Mycobacterium
LPGHPRVMSIADFWRRTA

SEQ ID NO: 1356556 - protein, 21 aa, Mycobacterium
LPTLFVLSAVVLVAACTLTDS

SEQ ID NO: 1356557 - protein, 18 aa, Mycobacterium
LPVVPRQVSYLPSAEIDD

SEQ ID NO: 1356558 - protein, 17 aa, Mycobacterium
LQFNQILAVAGFRCNVQ

SEQ ID NO: 1356559 - protein, 25 aa, Mycobacterium
LRDLFQRRHALLRNYPVVGHARYLL

SEQ ID NO: 1356560 - protein, 19 aa, Mycobacterium
LRDTLGGKSVVLFRTPDAA

SEQ ID NO: 1356561 - protein, 28 aa, Mycobacterium
LRHKMVEAGIFLVPTLLETMADVTSSPA

SEQ ID NO: 1356562 - protein, 28 aa, Mycobacterium
LSASPLVTLYKQYVVRFGLGYTEEPRAE

SEQ ID NO: 1356563 - protein, 26 aa, Mycobacterium
LSDALDIAPTGLMGQLVEGGADTLLR

SEQ ID NO: 1356564 - protein, 19 aa, Mycobacterium
LTGDVLAPPQRRLLEDWMR

SEQ ID NO: 1356565 - protein, 18 aa, Mycobacterium
LTNLSGRCKLPVTIPQVL

SEQ ID NO: 1356566 - protein, 20 aa, Mycobacterium
LTTAIFAAGLFGGLVLSAAP

SEQ ID NO: 1356567 - protein, 18 aa, Mycobacterium
LVAYAVPEPGWSKVIPAF

SEQ ID NO: 1356568 - protein, 19 aa, Mycobacterium
LVGQAVSIWSYVFEQATKI

SEQ ID NO: 1356569 - protein, 17 aa, Mycobacterium
LVHAIGQPDFRDTDNRA

SEQ ID NO: 1356570 - protein, 17 aa, Mycobacterium
LVLPDRFMDATSLVDLI

SEQ ID NO: 1356571 - protein, 17 aa, Mycobacterium
LVRFGGLTPMQAIVAAT

SEQ ID NO: 1356572 - protein, 18 aa, Mycobacterium
LVSIDRPGFGWSRGGWLP

SEQ ID NO: 1356573 - protein, 20 aa, Mycobacterium
MAAALAEPVVVLPGLREVEA

SEQ ID NO: 1356574 - protein, 26 aa, Mycobacterium
MAEDPPTIIALMSKLTGPADPAKILE

SEQ ID NO: 1356575 - protein, 18 aa, Mycobacterium
MAGWINDMFADRIDADTG

SEQ ID NO: 1356576 - protein, 17 aa, Mycobacterium
MAVAPLHRGGGQAQFIL

SEQ ID NO: 1356577 - protein, 19 aa, Mycobacterium
MDPFLPNEGAPGRGPRLAP

SEQ ID NO: 1356578 - protein, 25 aa, Mycobacterium
MDQHIAAIALFGNGVAWVGPITNFS

SEQ ID NO: 1356579 - protein, 18 aa, Mycobacterium
MGGNLNIAIGQATTGIGA

SEQ ID NO: 1356580 - protein, 24 aa, Mycobacterium
MGPIEALHRLIVEPLSALLVGDPE

SEQ ID NO: 1356581 - protein, 30 aa, Mycobacterium; identical to SEQ ID NO: 947854

SEQ ID NO: 1356582 - protein, 28 aa, Mycobacterium
MPAPAREALWDWLALGIAAEPVSKESAK

SEQ ID NO: 1356583 - protein, 20 aa, Mycobacterium
MPSMLPFTDDDFAPAWSAAT

SEQ ID NO: 1356584 - protein, 17 aa, Mycobacterium
MVPVMLDGGRTQPVSEE

SEQ ID NO: 1356585 - protein, 17 aa, Mycobacterium
MVYAFAGAGLKIPRTSG

SEQ ID NO: 1356586 - protein, 26 aa, Mycobacterium
NAGVLWLGPIESTPLKRWQLCLNVNL

SEQ ID NO: 1356587 - protein, 29 aa, Mycobacterium
NDEPDLNNLYWNMSLWGDYNVVLMQTDLS

SEQ ID NO: 1356588 - protein, 29 aa, Mycobacterium
NDPAVHSLALLQPLAARYLDIITGRVRAE

SEQ ID NO: 1356589 - protein, 31 aa, Mycobacterium
NEEQLKDISLYLNFDMLGSPNPGYFTYDGDQ

SEQ ID NO: 1356590 - protein, 24 aa, Mycobacterium
NEFTGIVTPPLFPGVSISADLGNG

SEQ ID NO: 1356591 - protein, 25 aa, Mycobacterium
NFREQFRRLTGVAPLSYRNTFRERV

SEQ ID NO: 1356592 - protein, 21 aa, Mycobacterium
NGGILLASLRDSVIDGVRLVS

SEQ ID NO: 1356593 - protein, 27 aa, Mycobacterium
NGGVVLLMWAGILAYLDRCGYDYVTGC

SEQ ID NO: 1356594 - protein, 30 aa, Mycobacterium
NGQAYQFPMGLGLVSQFFGRYFTPDEARAL

SEQ ID NO: 1356595 - protein, 32 aa, Mycobacterium
NGSNAIVLTQNVIQLGVIPAENGTAGGNGGVG

SEQ ID NO: 1356596 - protein, 28 aa, Mycobacterium
NGVHGADSSFLAPNPRAGGDGTNGGDGG

SEQ ID NO: 1356597 - protein, 25 aa, Mycobacterium
NHHRWAAYLRWVADAIGMNVVHGEV

SEQ ID NO: 1356598 - protein, 17 aa, Mycobacterium
NIAIGQATTGIGAVVTE

SEQ ID NO: 1356599 - protein, 22 aa, Mycobacterium
NKVARLALDSPLPLAIGAEAAA

SEQ ID NO: 1356600 - protein, 23 aa, Mycobacterium
NLATWYPTQFIFASSLSGYLNPS

SEQ ID NO: 1356601 - protein, 26 aa, Mycobacterium
NLDSDPWVGIIGFPFVTQAMDHEFGE

SEQ ID NO: 1356602 - protein, 31 aa, Mycobacterium
NLPLALLTDPIFVDLLGGITLPLAAALGALP

SEQ ID NO: 1356603 - protein, 27 aa, Mycobacterium
NMARDRIYWFFSLDYTARRQYSENTAT

SEQ ID NO: 1356604 - protein, 23 aa, Mycobacterium
NPDGAWEFISWMTSKDYMKLVGE

SEQ ID NO: 1356605 - protein, 26 aa, Mycobacterium
NPFRADDFWLGGDPMYRAVAELFTGD

SEQ ID NO: 1356606 - protein, 21 aa, Mycobacterium
NPQIAPAHLLMALLTQNDGIA

SEQ ID NO: 1356607 - protein, 24 aa, Mycobacterium
NPSEGWWPMLIGLAMQDSGKYNAE

SEQ ID NO: 1356608 - protein, 24 aa, Mycobacterium
NQAKYHLEGALWATRRTFLNQAPD

SEQ ID NO: 1356609 - protein, 31 aa, Mycobacterium
NRAGGGFWTTYSPFAPLLLTSADPTPTDLGV

SEQ ID NO: 1356610 - protein, 26 aa, Mycobacterium
NRDKRSLVFPVKRLADLGFKVLATEG

SEQ ID NO: 1356611 - protein, 25 aa, Mycobacterium
NSEGLKNWLFGPLDGPPRNTAQIGM

SEQ ID NO: 1356612 - protein, 24 aa, Mycobacterium
NSRRLGHEFDYFNPPQTFKIENPV

SEQ ID NO: 1356613 - protein, 25 aa, Mycobacterium
NSTHVGRFIGIPDLLVEAPTGETND

SEQ ID NO: 1356614 - protein, 19 aa, Mycobacterium
NTSLVIITAVALATSGCGE

SEQ ID NO: 1356615 - protein, 18 aa, Mycobacterium
NWLPAPKGPFQMILRLYW

SEQ ID NO: 1356616 - protein, 23 aa, Mycobacterium
PADLKALFPFIDGSMLVGAVGYA

SEQ ID NO: 1356617 - protein, 23 aa, Mycobacterium
PAGMDILHRLLDGADVLVSNLAP

SEQ ID NO: 1356618 - protein, 23 aa, Mycobacterium
PALTDAPRWWFTVGGGVEPGEAI

SEQ ID NO: 1356619 - protein, 34 aa, Mycobacterium
PAPAPSMGLPRIPLPEFTLPRPAPPSSTPAPAPA

SEQ ID NO: 1356620 - protein, 26 aa, Mycobacterium
PCRTPQYLASLPLRRLTTPQEVARCV

SEQ ID NO: 1356621 - protein, 25 aa, Mycobacterium
PDDFAERMLRVQYFLIPEGRRDADE

SEQ ID NO: 1356622 - protein, 25 aa, Mycobacterium
PDGNYKTNLWTWTWAMNANSRNKLP

SEQ ID NO: 1356623 - protein, 22 aa, Mycobacterium
PDGPVAFWGYSQGGGAAASAAE

SEQ ID NO: 1356624 - protein, 35 aa, Mycobacterium
PDPQTFVVTLTKPVAPFLDYLASPYGPLMTSPAAI

SEQ ID NO: 1356625 - protein, 28 aa, Mycobacterium
PDPVLVDGYPLAMALSPDGSRLFVNTMT

SEQ ID NO: 1356626 - protein, 21 aa, Mycobacterium
PDQRVWTFHLRRGVTFHDGSP

SEQ ID NO: 1356627 - protein, 25 aa, Mycobacterium
PEARLLVIGPPWPTADPPPAILRIR

SEQ ID NO: 1356628 - protein, 24 aa, Mycobacterium
PEMAFGWDPLDIPGGDIAPMVPVM

SEQ ID NO: 1356629 - protein, 30 aa, Mycobacterium
PEQAASGVALFLAILIATSLSMVFGELVPK

SEQ ID NO: 1356630 - protein, 17 aa, Mycobacterium
PERLPGAIRWTSNALRQ

SEQ ID NO: 1356631 - protein, 25 aa, Mycobacterium
PEVLGVVVPFLALQPLVENAVRHGL

SEQ ID NO: 1356632 - protein, 24 aa, Mycobacterium
PGELCSFPLRQCGSGNLFGGNEPA

SEQ ID NO: 1356633 - protein, 25 aa, Mycobacterium
PGGADHLIAWVKTVVYGAAERWTDV

SEQ ID NO: 1356634 - protein, 23 aa, Mycobacterium
PGGPDVVWLGAAIIIGAGSTSFE

SEQ ID NO: 1356635 - protein, 17 aa, Mycobacterium
PGGPGNPGLAGQPGSGG

SEQ ID NO: 1356636 - protein, 23 aa, Mycobacterium
PGTTPSVWTGSPSPSAAPGQGEE

SEQ ID NO: 1356637 - protein, 34 aa, Mycobacterium
PGVPCVNIMQQLLTVPGRLPQTLPGANSALTNTA

SEQ ID NO: 1356638 - protein, 17 aa, Mycobacterium
PHRVTYHPTCHSLRMLR

SEQ ID NO: 1356639 - protein, 17 aa, Mycobacterium
PIAVLKESQNATGARQF

SEQ ID NO: 1356640 - protein, 17 aa, Mycobacterium
PLDPDVFYQPEGLLIMT

SEQ ID NO: 1356641 - protein, 18 aa, Mycobacterium
PLMERLRVMMNLSDNVMA

SEQ ID NO: 1356642 - protein, 22 aa, Mycobacterium
PLSQEPGYWRTVVQNKIISGVD

SEQ ID NO: 1356643 - protein, 21 aa, Mycobacterium
PLTRLSPVFGSRTADLCNTND

SEQ ID NO: 1356644 - protein, 18 aa, Mycobacterium
PLTVAAILRYAATVHGDR

SEQ ID NO: 1356645 - protein, 32 aa, Mycobacterium; identical to SEQ ID NO: 948694

SEQ ID NO: 1356646 - protein, 23 aa, Mycobacterium
PNAAMYYHGGELPGFNSFMGYDP

SEQ ID NO: 1356647 - protein, 19 aa, Mycobacterium
PNPASWFIVPARETIRNPV

SEQ ID NO: 1356648 - protein, 27 aa, Mycobacterium
PPEPKDLPVPVLLLGVQNDPIVGNEGV

SEQ ID NO: 1356649 - protein, 17 aa, Mycobacterium
PPPPYIDHVTWAKWGDL

SEQ ID NO: 1356650 - protein, 25 aa, Mycobacterium
PPTGRGFHVLYSSPPLNEAQAGPAV

SEQ ID NO: 1356651 - protein, 19 aa, Mycobacterium
PQCPDVHWIGAAGSGERGA

SEQ ID NO: 1356652 - protein, 26 aa, Mycobacterium
PRDVCGLWPVPATSAPRPATSPGPGK

SEQ ID NO: 1356653 - protein, 19 aa, Mycobacterium
PRVANAVRFAFWGSEEIGL

SEQ ID NO: 1356654 - protein, 20 aa, Mycobacterium
PRVMSIADFWRRTAGHELIV

SEQ ID NO: 1356655 - protein, 20 aa, Mycobacterium
PRVPAPLLEIYDRNVSARRQ

SEQ ID NO: 1356656 - protein, 24 aa, Mycobacterium
PSGLDGPGMPFWSTAHDLAVIFRA

SEQ ID NO: 1356657 - protein, 23 aa, Mycobacterium
PSIRPRIVPAAQALPAVFAGVVN

SEQ ID NO: 1356658 - protein, 23 aa, Mycobacterium
PSNDYWYLALNEARAPWNDVRVR

SEQ ID NO: 1356659 - protein, 21 aa, Mycobacterium
PSPPVSYCPATGRLVVDLAEL

SEQ ID NO: 1356660 - protein, 18 aa, Mycobacterium
PTDKVLHLSFLQDPGQPP

SEQ ID NO: 1356661 - protein, 25 aa, Mycobacterium
PTLDYVVVKAPRFAFEKFPGADATL

SEQ ID NO: 1356662 - protein, 17 aa, Mycobacterium
PTRFSLITPPDRIIETA

SEQ ID NO: 1356663 - protein, 22 aa, Mycobacterium
PVDPLNPFALGNSLVAYLYGYG

SEQ ID NO: 1356664 - protein, 29 aa, Mycobacterium
PVDRRALRKLYLALLRVAPSLGAAVALAA

SEQ ID NO: 1356665 - protein, 25 aa, Mycobacterium
PVPYTGIQFVGIPEFQDLGTRVSQQ

SEQ ID NO: 1356666 - protein, 18 aa, Mycobacterium
PVRLRLDGQPVLVKSRNV

SEQ ID NO: 1356667 - protein, 17 aa, Mycobacterium
PVRPEVVEALRPMMRLV

SEQ ID NO: 1356668 - protein, 19 aa, Mycobacterium
PVRPRSLYAASKAAQEHYA

SEQ ID NO: 1356669 - protein, 19 aa, Mycobacterium
PVVARLLQPGLDAIGLPEQ

SEQ ID NO: 1356670 - protein, 20 aa, Mycobacterium
PYIDHVTWAKWGDLSSLRVY

SEQ ID NO: 1356671 - protein, 24 aa, Mycobacterium
QADWNLIMRIAAPRGMMDVADVAK

SEQ ID NO: 1356672 - protein, 23 aa, Mycobacterium
QAERPKVLILGSGPNRIGQGIEF

SEQ ID NO: 1356673 - protein, 26 aa, Mycobacterium
QAGDLLGIALLLNKDPAAPVVSDAER

SEQ ID NO: 1356674 - protein, 26 aa, Mycobacterium
QAGLTATVRDFPLAQFFALGENPGQR

SEQ ID NO: 1356675 - protein, 22 aa, Mycobacterium
QANLVEITLPDDTPWGGKAVKR

SEQ ID NO: 1356676 - protein, 25 aa, Mycobacterium
QDGIGTYFWQHNWGSPGRVAHPAAH

SEQ ID NO: 1356677 - protein, 19 aa, Mycobacterium
QDIQAVLNALWSAGAEGVQ

SEQ ID NO: 1356678 - protein, 26 aa, Mycobacterium
QFGGKKALLLRGPLYRDSVQAVRPGW

SEQ ID NO: 1356679 - protein, 17 aa, Mycobacterium
QGGNLRLALTAFPANFN

SEQ ID NO: 1356680 - protein, 20 aa, Mycobacterium
QGQRLLLAVMTRSATDDPDA

SEQ ID NO: 1356681 - protein, 27 aa, Mycobacterium
QHPGGWPRLDWSMDAALLLAALAARAG

SEQ ID NO: 1356682 - protein, 27 aa, Mycobacterium
QIQGRYDFHTWLWAVSRCPGECLRVQA

SEQ ID NO: 1356683 - protein, 23 aa, Mycobacterium
QLAACGTACPPPPPPPGPLEMLG

SEQ ID NO: 1356684 - protein, 18 aa, Mycobacterium
QLAVTYRPVTFLDQNGDH

SEQ ID NO: 1356685 - protein, 22 aa, Mycobacterium
QLLRVVSLSTVALVLAGCAPGL

SEQ ID NO: 1356686 - protein, 27 aa, Mycobacterium
QLRTTGRLLGWRLGLDRVNPMGTTVLT

SEQ ID NO: 1356687 - protein, 17 aa, Mycobacterium
QPLMTWQTVALVNLDRA

SEQ ID NO: 1356688 - protein, 22 aa, Mycobacterium
QQFGTRTVLWTAGVEAVRFARH

SEQ ID NO: 1356689 - protein, 18 aa, Mycobacterium
QQLAKRLAQRRLTLEVSL

SEQ ID NO: 1356690 - protein, 20 aa, Mycobacterium
QRAVLRLLDPSLTAPGVLRA

SEQ ID NO: 1356691 - protein, 21 aa, Mycobacterium
QRDLLDVYRRALAAAGGPDLD

SEQ ID NO: 1356692 - protein, 18 aa, Mycobacterium
QRDPSTLTVFAAASLRTS

SEQ ID NO: 1356693 - protein, 20 aa, Mycobacterium
QRPTDRLTIDISIEGGNVTP

SEQ ID NO: 1356694 - protein, 17 aa, Mycobacterium
QRRLTLEVSLPAKKWLA

SEQ ID NO: 1356695 - protein, 25 aa, Mycobacterium
QRTSPQFFEILNFALRYAPVLPSER

SEQ ID NO: 1356696 - protein, 23 aa, Mycobacterium
QVAPLVWAAVAGVPGLLVYRGAN

SEQ ID NO: 1356697 - protein, 21 aa, Mycobacterium
QVATRWGNWAKLFFNNKGVVA

SEQ ID NO: 1356698 - protein, 27 aa, Mycobacterium
QWTDGMLYPLLHRLERLGYVSASWGVS

SEQ ID NO: 1356699 - protein, 28 aa, Mycobacterium
RAAAPPQLLFSTIFTPLIRLTNGTANMI

SEQ ID NO: 1356700 - protein, 28 aa, Mycobacterium
RAKGYEPMNFFAPLSRLKELDALPTADA

SEQ ID NO: 1356701 - protein, 17 aa, Mycobacterium
RAPLPVRGIDTSVVAQL

SEQ ID NO: 1356702 - protein, 23 aa, Mycobacterium
RATMIAMWRVGRGSVLAALALVV

SEQ ID NO: 1356703 - protein, 20 aa, Mycobacterium
RAVNPITLIIRTVTNAVRAS

SEQ ID NO: 1356704 - protein, 24 aa, Mycobacterium
RDEGRWEVRWATTGLHPRLGENQS

SEQ ID NO: 1356705 - protein, 19 aa, Mycobacterium
RDTGFLTFGTDPVGAANTA

SEQ ID NO: 1356706 - protein, 38 aa, Mycobacterium
REFMSALLHRAASPAVLLNPLRWYPMASAAGGALTVDT

SEQ ID NO: 1356707 - protein, 25 aa, Mycobacterium
REHLAFPKVSTLRWPDGRKTTMQTT

SEQ ID NO: 1356708 - protein, 17 aa, Mycobacterium
RFSLITPPDRIIETAAA

SEQ ID NO: 1356709 - protein, 35 aa, Mycobacterium
RGGEPLQCKWIPNQWPPVYTGFWTATYALYGVQDI

SEQ ID NO: 1356710 - protein, 21 aa, Mycobacterium
RGLLLVALLTFAVSAAHTLGD

SEQ ID NO: 1356711 - protein, 18 aa, Mycobacterium
RGPACWYFDEGELDVWEV

SEQ ID NO: 1356712 - protein, 27 aa, Mycobacterium
RGPRLAPGSVLAIEPMLTLGTTKTKVL

SEQ ID NO: 1356713 - protein, 17 aa, Mycobacterium
RGQDFLALVDYAHKPGA

SEQ ID NO: 1356714 - protein, 21 aa, Mycobacterium
RGSQIVPWVNVVVPAYKIVPA

SEQ ID NO: 1356715 - protein, 23 aa, Mycobacterium
RHIVASPRRAAEQLGFRAVVDPR

SEQ ID NO: 1356716 - protein, 31 aa, Mycobacterium
RIAADIGYPVLVRPSYVLGGRGMEIVYDEQT

SEQ ID NO: 1356717 - protein, 20 aa, Mycobacterium
RILSPMEIGILRDLGYRASA

SEQ ID NO: 1356718 - protein, 23 aa, Mycobacterium
RIPPALDVLIAERPRLTTALDKL

SEQ ID NO: 1356719 - protein, 32 aa, Mycobacterium
RIRCGDMDRVTLFRAWYSRGNFGQLAGAAEIS

SEQ ID NO: 1356720 - protein, 25 aa, Mycobacterium
RKEKVDFAGPYLITGQSLLVRNDNT

SEQ ID NO: 1356721 - protein, 18 aa, Mycobacterium
RKLREVAPFMSYGEFTGH

SEQ ID NO: 1356722 - protein, 21 aa, Mycobacterium
RLAGRWRAPLPVRGIDTSVVA

SEQ ID NO: 1356723 - protein, 25 aa, Mycobacterium
RLDDALNYLPARLTGLLAALCAPVV

SEQ ID NO: 1356724 - protein, 18 aa, Mycobacterium
RLGWALRGDLTTTTVPIG

SEQ ID NO: 1356725 - protein, 18 aa, Mycobacterium
RLYDIEFALRLGASVEQV

SEQ ID NO: 1356726 - protein, 17 aa, Mycobacterium
RLYFEPLTFEDVLEIYY

SEQ ID NO: 1356727 - protein, 20 aa, Mycobacterium
RNRKHFFTDWSTATPAIATD

SEQ ID NO: 1356728 - protein, 21 aa, Mycobacterium
RPEVFAFSTSLTRLTPVLSHR

SEQ ID NO: 1356729 - protein, 21 aa, Mycobacterium
RPEVVEALRPMMRLVVTNGTA

SEQ ID NO: 1356730 - protein, 17 aa, Mycobacterium
RPMMRLVVTNGTAKDLA

SEQ ID NO: 1356731 - protein, 18 aa, Mycobacterium
RPRRPYRYRDLGSAAYIS

SEQ ID NO: 1356732 - protein, 18 aa, Mycobacterium
RPTGSFMFLGPTGVGKTE

SEQ ID NO: 1356733 - protein, 21 aa, Mycobacterium
RPTPLTVPGFALRTVLGEFAD

SEQ ID NO: 1356734 - protein, 22 aa, Mycobacterium
RQGGDLVFQIGTGYFGCRDEHG

SEQ ID NO: 1356735 - protein, 25 aa, Mycobacterium
RQGIAQLFDVPPLPYKEVKIATADG

SEQ ID NO: 1356736 - protein, 26 aa, Mycobacterium
RRATWLLALLMATASLSASAGAGCRE

SEQ ID NO: 1356737 - protein, 19 aa, Mycobacterium
RRIRGSLRDAWPPSAHGAP

SEQ ID NO: 1356738 - protein, 28 aa, Mycobacterium
RRLLAGALAALLLPGLIAVAGGTATAGA

SEQ ID NO: 1356739 - protein, 27 aa, Mycobacterium
RRRVTAAVALALAVPFAATACGGGGGD

SEQ ID NO: 1356740 - protein, 27 aa, Mycobacterium
RSDYDGFTLAGIPAGGLFSGAEEEKTP

SEQ ID NO: 1356741 - protein, 20 aa, Mycobacterium
RSGWRRALTGTLASGALAAA

SEQ ID NO: 1356742 - protein, 21 aa, Mycobacterium
RSLVRWSVAAAAGTALLSFGA

SEQ ID NO: 1356743 - protein, 26 aa, Mycobacterium
RSRDPKVVLLALDSISSDAWLVGAKG

SEQ ID NO: 1356744 - protein, 18 aa, Mycobacterium
RTAAAPAFFAGATAAIST

SEQ ID NO: 1356745 - protein, 34 aa, Mycobacterium
RTAQRITLTRNPKWWGEPPLLDSITYSVLDDAAR

SEQ ID NO: 1356746 - protein, 24 aa, Mycobacterium
RTDTIMLVHLPGLTSSAPATMVSI

SEQ ID NO: 1356747 - protein, 19 aa, Mycobacterium
RTELLDAPVLDGTLLRRAK

SEQ ID NO: 1356748 - protein, 22 aa, Mycobacterium
RTFLHRTAIGFVTAAGAIAIAP

SEQ ID NO: 1356749 - protein, 24 aa, Mycobacterium
RTPGLNKGWKQIIAPGVQSFPDQI

SEQ ID NO: 1356750 - protein, 26 aa, Mycobacterium
RTSTPAPPPRTLTPAPPSASAPPSAA

SEQ ID NO: 1356751 - protein, 19 aa, Mycobacterium
RTWMVFDQFVVTADGSRPI

SEQ ID NO: 1356752 - protein, 23 aa, Mycobacterium
RVLASIATILRGGGIPNLEVIQT

SEQ ID NO: 1356753 - protein, 21 aa, Mycobacterium
RVQEALLADDRIRHLRGRVAH

SEQ ID NO: 1356754 - protein, 19 aa, Mycobacterium
RVRRRAYRVVWLNPRAAHV

SEQ ID NO: 1356755 - protein, 20 aa, Mycobacterium
RWAALLVSVTLALTACGSSN

SEQ ID NO: 1356756 - protein, 27 aa, Mycobacterium
RYVADRFLVLPMPKWAAHPIDPISIRD

SEQ ID NO: 1356757 - protein, 18 aa, Mycobacterium
SAAALAALLAPIEPTITP

SEQ ID NO: 1356758 - protein, 27 aa, Mycobacterium
SAADQQYLYWNLSTWDDYQVKLMRTDL

SEQ ID NO: 1356759 - protein, 26 aa, Mycobacterium
SADAPAANRVLAATAARTPAKPLTRQ

SEQ ID NO: 1356760 - protein, 26 aa, Mycobacterium
SAIAEAPWRLLRVYEDPVDTTASVFR

SEQ ID NO: 1356761 - protein, 24 aa, Mycobacterium
SAKAKGIPLVPVNAALNSPDVAAS

SEQ ID NO: 1356762 - protein, 25 aa, Mycobacterium
SAKEKGIPLLAVNAALETPDLAGNV

SEQ ID NO: 1356763 - protein, 25 aa, Mycobacterium
SALEEGLITVLPRLAARHHVLIAAV

SEQ ID NO: 1356764 - protein, 25 aa, Mycobacterium
SALVVLAVPVPALGLMLGHIRDAAP

SEQ ID NO: 1356765 - protein, 25 aa, Mycobacterium
SAVWRILRDGVVGRTYLIGAEGERD

SEQ ID NO: 1356766 - protein, 28 aa, Mycobacterium
SDLPSSVQLPVWLARSQALVDKHPIVAV

SEQ ID NO: 1356767 - protein, 24 aa, Mycobacterium
SDQGWEAPIYKKGGIWYVKHTVPR

SEQ ID NO: 1356768 - protein, 34 aa, Mycobacterium
SDWHTWRMTWQPQGMYFWKDYQPGMEPFFTVLAN

SEQ ID NO: 1356769 - protein, 22 aa, Mycobacterium
SGFLNLSEGWWPMLVGLSMGDA

SEQ ID NO: 1356770 - protein, 17 aa, Mycobacterium
SGKTTTTYLVEAGLRAA

SEQ ID NO: 1356771 - protein, 18 aa, Mycobacterium
SGNTMLLPKSMTATPEAF

SEQ ID NO: 1356772 - protein, 27 aa, Mycobacterium
SGRCKLPVTIPQVLGLMQAAQQSGAAQ

SEQ ID NO: 1356773 - protein, 39 aa, Mycobacterium
SGVTPPGVFPPLEGAAAVFDRLLPGAPTPGAPGAAANGP

SEQ ID NO: 1356774 - protein, 18 aa, Mycobacterium
SGWSSQPAWMWDTDFSTL

SEQ ID NO: 1356775 - protein, 19 aa, Mycobacterium
SIMRLWSEDAARLTQGLPA

SEQ ID NO: 1356776 - protein, 19 aa, Mycobacterium
SIVLGCAAMARFAEPLSQR

SEQ ID NO: 1356777 - protein, 29 aa, Mycobacterium
SLFFTAIAATLVLLPWAVNGLPGDDDESA

SEQ ID NO: 1356778 - protein, 17 aa, Mycobacterium
SLITPPDRIIETAAAMK

SEQ ID NO: 1356779 - protein, 18 aa, Mycobacterium
SLLAIVVLTAGTAVFVAA

SEQ ID NO: 1356780 - protein, 18 aa, Mycobacterium
SMGGYGALLLGARLGPER

SEQ ID NO: 1356781 - protein, 35 aa, Mycobacterium
SMNTLAARIPIGGLFGEITYPITSPLAITMGFAVN

SEQ ID NO: 1356782 - protein, 21 aa, Mycobacterium
SNPTAQAYFGPISNVAATCNN

SEQ ID NO: 1356783 - protein, 23 aa, Mycobacterium
SPCALTPLVGYVDTGAPPATDTY

SEQ ID NO: 1356784 - protein, 27 aa, Mycobacterium
SPDGSAWYRRPGALFAGAACLAALAAT

SEQ ID NO: 1356785 - protein, 27 aa, Mycobacterium
SPSGGLLSRLKPLFGLGLGARLGNGRQ

SEQ ID NO: 1356786 - protein, 26 aa, Mycobacterium
SRDGDIVLGLPDRGPYLVRAQSGDST

SEQ ID NO: 1356787 - protein, 28 aa, Mycobacterium
SRTVSGQLTLLIPFIDKIRARVDLRERV

SEQ ID NO: 1356788 - protein, 22 aa, Mycobacterium
SRVGFLGWSMGGYGALLLGARL

SEQ ID NO: 1356789 - protein, 23 aa, Mycobacterium
SSCSWQMGIPIPEGVPPPPGDPV

SEQ ID NO: 1356790 - protein, 22 aa, Mycobacterium
SSRPPILFGVNISAQAVAVAEP

SEQ ID NO: 1356791 - protein, 23 aa, Mycobacterium
SSVFGLFAVPGQGAYNAAKFAVR

SEQ ID NO: 1356792 - protein, 17 aa, Mycobacterium
STALTYSIYYPQKFVYA

SEQ ID NO: 1356793 - protein, 20 aa, Mycobacterium
STQFYPSGMLPDGAVPDTHD

SEQ ID NO: 1356794 - protein, 26 aa, Mycobacterium
SVENAFIVPTFLPGRCAIQLDAGAEM

SEQ ID NO: 1356795 - protein, 17 aa, Mycobacterium
SVPSAIAEAPWRLLRVY

SEQ ID NO: 1356796 - protein, 28 aa, Mycobacterium
SVTTVFQTLYRLPLWEAAYAAQKLAVYV

SEQ ID NO: 1356797 - protein, 21 aa, Mycobacterium
TAGEVPLAFALAAGSFRDGTR

SEQ ID NO: 1356798 - protein, 22 aa, Mycobacterium
TAMHLDNFTTQVWTFTGGPAGV

SEQ ID NO: 1356799 - protein, 25 aa, Mycobacterium
TASLAGLMPWHPDPVYSLGKHGVVG

SEQ ID NO: 1356800 - protein, 23 aa, Mycobacterium
TATKSVIGQPILYGSPTEGPATN

SEQ ID NO: 1356801 - protein, 20 aa, Mycobacterium
TCRLPAPRDFPDAAALVAAV

SEQ ID NO: 1356802 - protein, 25 aa, Mycobacterium
TDEPPTRIIYLQHGFLANGTMYSHT

SEQ ID NO: 1356803 - protein, 38 aa, Mycobacterium
TDKTILQAIELWKIVDRPNLLIKIPATEAGLPAITAVI

SEQ ID NO: 1356804 - protein, 20 aa, Mycobacterium
TDYDTADRLYFEPLTFEDVL

SEQ ID NO: 1356805 - protein, 23 aa, Mycobacterium
TEALVRWQHPTRGLLSPDRFIGV

SEQ ID NO: 1356806 - protein, 24 aa, Mycobacterium
TFVDPIAERWFVDAPGLIGADGVH

SEQ ID NO: 1356807 - protein, 30 aa, Mycobacterium
TGDDGLAFVTYYDPTLPWTYGPGDGPFNQP

SEQ ID NO: 1356808 - protein, 28 aa, Mycobacterium
TGGGYTWTSPLYQLLGPAAAAAPADTVT

SEQ ID NO: 1356809 - protein, 32 aa, Mycobacterium
TGKHDAFMLGAYFIWQYGPPGWIEDLNPWLQN

SEQ ID NO: 1356810 - protein, 25 aa, Mycobacterium
TGKSTIAAALALALAAGGRKVLLVE

SEQ ID NO: 1356811 - protein, 26 aa, Mycobacterium
TGLYAALSILALLYARKGDGAEPAPA

SEQ ID NO: 1356812 - protein, 31 aa, Mycobacterium
TGNALYTPRLWAYLTSGLLGLQRGTDPGDLL

SEQ ID NO: 1356813 - protein, 17 aa, Mycobacterium
TGTAWPDAPSPYTWGHI

SEQ ID NO: 1356814 - protein, 32 aa, Mycobacterium
TIERLKTDAPLLTSILTYHVVPGQAGPDAVVG

SEQ ID NO: 1356815 - protein, 19 aa, Mycobacterium
TIGAYLPGRGNGAGWGVRL

SEQ ID NO: 1356816 - protein, 25 aa, Mycobacterium
TIGGTTLSFWTPPGVYTVLDKDNPV

SEQ ID NO: 1356817 - protein, 25 aa, Mycobacterium
TIGWDRGELLPALRAANGDMGVAMV

SEQ ID NO: 1356818 - protein, 18 aa, Mycobacterium
TINRLPVRYTFDNRYFND

SEQ ID NO: 1356819 - protein, 20 aa, Mycobacterium
TIPAILSAPLFVGIEEGIFE

SEQ ID NO: 1356820 - protein, 18 aa, Mycobacterium
TIPYAVRGTLWEATATDE

SEQ ID NO: 1356821 - protein, 17 aa, Mycobacterium
TKFPFTGFHATLHPDIR

SEQ ID NO: 1356822 - protein, 21 aa, Mycobacterium
TLAQALTLWMSGREQLVPREL

SEQ ID NO: 1356823 - protein, 20 aa, Mycobacterium
TLGGLAVAIPLSAGVASAQP

SEQ ID NO: 1356824 - protein, 26 aa, Mycobacterium
TLIFSVERHRAVMDAYLAGLEKAKEA

SEQ ID NO: 1356825 - protein, 26 aa, Mycobacterium
TLNRLTTTIPWMFVAGPAGVSEREYY

SEQ ID NO: 1356826 - protein, 26 aa, Mycobacterium
TLRGQDALPGDLFAALPGSSAHGARF

SEQ ID NO: 1356827 - protein, 18 aa, Mycobacterium
TMRDLGIAILREVGVATG

SEQ ID NO: 1356828 - protein, 19 aa, Mycobacterium
TMTAALIVLLAQDGKVRFD

SEQ ID NO: 1356829 - protein, 23 aa, Mycobacterium
TNLKELGLLVRFGGLTPMQAIVA

SEQ ID NO: 1356830 - protein, 31 aa, Mycobacterium
TNTEMSLPLASIFKLYVLLAVAEAVKVGSVE

SEQ ID NO: 1356831 - protein, 25 aa, Mycobacterium
TPAEVLAIAFRHPPQFAPDSAYEYS

SEQ ID NO: 1356832 - protein, 23 aa, Mycobacterium
TPDFEVRLPFAEKPQLTVGGRAV

SEQ ID NO: 1356833 - protein, 23 aa, Mycobacterium
TPGRFRFLRVYPNAQAYAPVTGF

SEQ ID NO: 1356834 - protein, 33 aa, Mycobacterium
TPLKRWQLCLNVNLTGVFLVTKAVIPHVRARGG

SEQ ID NO: 1356835 - protein, 30 aa, Mycobacterium
TRGIWLTVIGAAFALVPTFFSSATASADSV

SEQ ID NO: 1356836 - protein, 19 aa, Mycobacterium
TRLLTFVAAGVTVAGVAGC

SEQ ID NO: 1356837 - protein, 23 aa, Mycobacterium
TSAYLFTHPPVNDFFTSLEGQSR

SEQ ID NO: 1356838 - protein, 18 aa, Mycobacterium
TSSKMPGLYAPMIHPWSS

SEQ ID NO: 1356839 - protein, 18 aa, Mycobacterium
TTALTAAATFVAAGGTSL

SEQ ID NO: 1356840 - protein, 35 aa, Mycobacterium
TTCPASTVCSGGHGGLLIGNGGNGFRGGNGGNAGF

SEQ ID NO: 1356841 - protein, 18 aa, Mycobacterium
TTTYLVEAGLRAAGRVAG

SEQ ID NO: 1356842 - protein, 26 aa, Mycobacterium
TTVFGAKFVRFFPPEDPSPEKLRKGQ

SEQ ID NO: 1356843 - protein, 25 aa, Mycobacterium
TTVLLAEMFAAGVRKLVLASSMVVY

SEQ ID NO: 1356844 - protein, 26 aa, Mycobacterium
TVDTGAHVWDLARLGWALRGDLTTTT

SEQ ID NO: 1356845 - protein, 18 aa, Mycobacterium
TVGAFNVGIRYAGNPGIS

SEQ ID NO: 1356846 - protein, 18 aa, Mycobacterium
TVPRGWQLAKAYTPNACQ

SEQ ID NO: 1356847 - protein, 23 aa, Mycobacterium
TVTVQTVASGQLEPGFHGMHVHQ

SEQ ID NO: 1356848 - protein, 18 aa, Mycobacterium
TYQYLDMHMAIASALNMY

SEQ ID NO: 1356849 - protein, 32 aa, Mycobacterium
TYVTFESDGLPLVRPLRLLPGGDIVADAIEPT

SEQ ID NO: 1356850 - protein, 24 aa, Mycobacterium
VADADLYRFVFTSSIATIGIADSG

SEQ ID NO: 1356851 - protein, 29 aa, Mycobacterium
VAETLTKFMFRHLQPYFNQDIFAVVEQEP

SEQ ID NO: 1356852 - protein, 46 aa, Mycobacterium
VAGRPVPAGWYSEPWWKPALVAGAWGLGSVLLFDALFSGMHGSGYE

SEQ ID NO: 1356853 - protein, 23 aa, Mycobacterium
VALQRALATGYLRPYTNADVVGA

SEQ ID NO: 1356854 - protein, 21 aa, Mycobacterium
VALRDAALASLRLLAADDGAS

SEQ ID NO: 1356855 - protein, 24 aa, Mycobacterium
VAMMKVSVQWPYSANLHCEILIDD

SEQ ID NO: 1356856 - protein, 23 aa, Mycobacterium
VAPGHVYTARQLLEALLLVSGND

SEQ ID NO: 1356857 - protein, 28 aa, Mycobacterium
VARAPGPLRIGLSTKFPFTGFHATLHPD

SEQ ID NO: 1356858 - protein, 19 aa, Mycobacterium
VATIAWPPPDTPAEKHWQI

SEQ ID NO: 1356859 - protein, 25 aa, Mycobacterium
VAVAVPAHWSTAAVAALRAVVPHVT

SEQ ID NO: 1356860 - protein, 36 aa, Mycobacterium
VCAAGFWGAELARQVDLVLPLVPMAHQYARTGQIAP

SEQ ID NO: 1356861 - protein, 22 aa, Mycobacterium
VDAIWVSEPHRTPGLNKGWKQI

SEQ ID NO: 1356862 - protein, 27 aa, Mycobacterium
VDAPTLWPGLPIRPVKGEVLRLRWRRG

SEQ ID NO: 1356863 - protein, 20 aa, Mycobacterium
VDGFTQYFFTTPSGRWECAV

SEQ ID NO: 1356864 - protein, 31 aa, Mycobacterium
VDIEPLMEQMPTPCQWLFAESQTFGDEVEEF

SEQ ID NO: 1356865 - protein, 19 aa, Mycobacterium
VDIQLQQLAKRLAQRRLTL

SEQ ID NO: 1356866 - protein, 25 aa, Mycobacterium
VDKEITVVGLNNTITYRDGDPKIDD

SEQ ID NO: 1356867 - protein, 21 aa, Mycobacterium
VDPWFVDQIAGLVALRTELLD

SEQ ID NO: 1356868 - protein, 17 aa, Mycobacterium
VDQAPSMPPYQSAPGFW

SEQ ID NO: 1356869 - protein, 21 aa, Mycobacterium
VDVIYYLVHAIGQPDFRDTDN

SEQ ID NO: 1356870 - protein, 27 aa, Mycobacterium
VEAPVVITPWRSLLICDLDEGVADVAL

SEQ ID NO: 1356871 - protein, 19 aa, Mycobacterium
VEEAVAVGDLVRLMEFRKG

SEQ ID NO: 1356872 - protein, 28 aa, Mycobacterium
VFADHVSFPFRLGFAEVYGLFARAGLHD

SEQ ID NO: 1356873 - protein, 17 aa, Mycobacterium
VFDFPDGIGPVECVNVE

SEQ ID NO: 1356874 - protein, 21 aa, Mycobacterium
VFMGPLLTLLGRPKVQGLEYL

SEQ ID NO: 1356875 - protein, 22 aa, Mycobacterium
VGALDLVKCLNWPSGSAPPEPK

SEQ ID NO: 1356876 - protein, 26 aa, Mycobacterium
VGDLYSYLAIRNWNAVGFLVGQAVSI

SEQ ID NO: 1356877 - protein, 17 aa, Mycobacterium
VGGTPRPAPVGTDGTIV

SEQ ID NO: 1356878 - protein, 19 aa, Mycobacterium
VGLLNVQYALKDDVLYVLE

SEQ ID NO: 1356879 - protein, 28 aa, Mycobacterium
VGNIVGATLRWESFFTNPVQAFYVDNPV

SEQ ID NO: 1356880 - protein, 23 aa, Mycobacterium
VGRKVLPSQALPGDLIFYGPNGT

SEQ ID NO: 1356881 - protein, 17 aa, Mycobacterium
VGTREHLAFPKVSTLRW

SEQ ID NO: 1356882 - protein, 25 aa, Mycobacterium
VLATAATAFMVWRLTRDHDPDLPEI

SEQ ID NO: 1356883 - protein, 17 aa, Mycobacterium
VLDGTLLRRAKNSGLSD

SEQ ID NO: 1356884 - protein, 23 aa, Mycobacterium
VLEGRPSRTFGWARGGEITVTLP

SEQ ID NO: 1356885 - protein, 18 aa, Mycobacterium
VLGGIGVLRRLPADVDAV

SEQ ID NO: 1356886 - protein, 17 aa, Mycobacterium
VLGLMQAAQQSGAAQPA

SEQ ID NO: 1356887 - protein, 24 aa, Mycobacterium
VLIADLSLAPVLAPVLRSLETVHT

SEQ ID NO: 1356888 - protein, 21 aa, Mycobacterium
VLLLVLVVFAVVVVAKSVALI

SEQ ID NO: 1356889 - protein, 20 aa, Mycobacterium
VLLLVVIALTYRLWKLRQVG

SEQ ID NO: 1356890 - protein, 21 aa, Mycobacterium
VLRGLRPFPRSVGDLDARTLS

SEQ ID NO: 1356891 - protein, 19 aa, Mycobacterium
VLTALRDTGFLTFGTDPVG

SEQ ID NO: 1356892 - protein, 19 aa, Mycobacterium
VLVLAVLALAGFVMGYNKL

SEQ ID NO: 1356893 - protein, 22 aa, Mycobacterium
VNKMKNWISSFGPQINGVVAQN

SEQ ID NO: 1356894 - protein, 19 aa, Mycobacterium
VNTYPIAVLKESQNATGAR

SEQ ID NO: 1356895 - protein, 30 aa, Mycobacterium
VNVIGAVALTLALLPALRAAPDGQVVFINS

SEQ ID NO: 1356896 - protein, 20 aa, Mycobacterium
VPANPALPPLDTLQAPTVDP

SEQ ID NO: 1356897 - protein, 26 aa, Mycobacterium
VPAPGDPWYLNYTLDPLNAPVAPPTA

SEQ ID NO: 1356898 - protein, 29 aa, Mycobacterium
VPATYARGRRLPLTLMLHSLALGQNQYAA

SEQ ID NO: 1356899 - protein, 27 aa, Mycobacterium
VPERGYALELITPVPLPRKLSGDLARL

SEQ ID NO: 1356900 - protein, 19 aa, Mycobacterium
VPTGTLWKIDTVAGTVQAV

SEQ ID NO: 1356901 - protein, 25 aa, Mycobacterium
VREGAMYFVALAKDLLGVYRAKGYE

SEQ ID NO: 1356902 - protein, 29 aa, Mycobacterium
VRGDYLNVFTTFDLTLRRIGESVFTTSLG

SEQ ID NO: 1356903 - protein, 25 aa, Mycobacterium
VRIPAAWCHLVGIKPQRGRISTSPL

SEQ ID NO: 1356904 - protein, 19 aa, Mycobacterium
VRTAPLRVYLQLSLDGDVE

SEQ ID NO: 1356905 - protein, 28 aa, Mycobacterium
VRTVTPPIARPALGLLCLVPGPVAAAMR

SEQ ID NO: 1356906 - protein, 28 aa, Mycobacterium
VSAPTPTPLLAALTLPFDAAQLQAAAAA

SEQ ID NO: 1356907 - protein, 28 aa, Mycobacterium
VSGQIRVLPPFLSRKHLPSRLARLRELD

SEQ ID NO: 1356908 - protein, 24 aa, Mycobacterium
VSQSQTIVLRRSRPLDISLDGQHT

SEQ ID NO: 1356909 - protein, 24 aa, Mycobacterium
VTAAAIVRHLLTDPVLPADLLPAD

SEQ ID NO: 1356910 - protein, 29 aa, Mycobacterium
VTDDLGWTYRFEQISFDGLLPALQSGRID

SEQ ID NO: 1356911 - protein, 21 aa, Mycobacterium
VTLPWRRQFTVTADSRFLSLS

SEQ ID NO: 1356912 - protein, 26 aa, Mycobacterium
VTTDPPVTGSWYWVDDQTAHWRPERY

SEQ ID NO: 1356913 - protein, 24 aa, Mycobacterium
VTTSPIAGLGFAAPMPAAVVPRIA

SEQ ID NO: 1356914 - protein, 24 aa, Mycobacterium
VVLEDLVVTQPTPGAFTGLSNVCT

SEQ ID NO: 1356915 - protein, 24 aa, Mycobacterium
VVLRGGALCAGRTLRRGVGTGGIS

SEQ ID NO: 1356916 - protein, 23 aa, Mycobacterium
VVSDAGMPLINDPGYRLVSACVE

SEQ ID NO: 1356917 - protein, 27 aa, Mycobacterium
VYGARGHFGWIPIDATHAYWYGSVGGL

SEQ ID NO: 1356918 - protein, 22 aa, Mycobacterium
VYGVFQLARRTAPEARLLVIGP

SEQ ID NO: 1356919 - protein, 17 aa, Mycobacterium
VYRGSQIVPWVNVVVPA

SEQ ID NO: 1356920 - protein, 21 aa, Mycobacterium
WAEEVVEYRPYPPDDPNLQKL

SEQ ID NO: 1356921 - protein, 18 aa, Mycobacterium
WATRRTFLNQAPDVAPIQ

SEQ ID NO: 1356922 - protein, 28 aa, Mycobacterium
WDQTVMYKNGDPIIWDRGRELGMTNRIN

SEQ ID NO: 1356923 - protein, 21 aa, Mycobacterium
WEKLAQIALAAAWSVTALGAI

SEQ ID NO: 1356924 - protein, 19 aa, Mycobacterium
WGKQYPQFGVVGALDLVKC

SEQ ID NO: 1356925 - protein, 17 aa, Mycobacterium
WMNGLRAYNYSEQYART

SEQ ID NO: 1356926 - protein, 27 aa, Mycobacterium
WPDAPSPYTWGHISWDADGGLNYLGCS

SEQ ID NO: 1356927 - protein, 19 aa, Mycobacterium
WSNGQIYPGAVLYQRIIDT

SEQ ID NO: 1356928 - protein, 24 aa, Mycobacterium
WSYAHTNYVLLGLALEKATGRSMT

SEQ ID NO: 1356929 - protein, 26 aa, Mycobacterium
WVSKAAAERLYLGLAADLRADNIAVN

SEQ ID NO: 1356930 - protein, 30 aa, Mycobacterium
YAHFSLPTMMSNYLYLNPRRGMLTDPKNRA

SEQ ID NO: 1356931 - protein, 18 aa, Mycobacterium
YATFVQQCPTSKVVLAGY

SEQ ID NO: 1356932 - protein, 26 aa, Mycobacterium
YDRANYAKLIAFTQFVPVLSEMTDEL

SEQ ID NO: 1356933 - protein, 27 aa, Mycobacterium
YFEPHNPWPFGGPRPLLVYGPGTQGQG

SEQ ID NO: 1356934 - protein, 24 aa, Mycobacterium
YGSPPVVIGPLYAPKTLQLCAEGD

SEQ ID NO: 1356935 - protein, 23 aa, Mycobacterium
YGVPPLPFFDDRASSHPLASLLQ

SEQ ID NO: 1356936 - protein, 25 aa, Mycobacterium
YNSYEKKYIMLYGDKNNNIVMRKAD

SEQ ID NO: 1356937 - protein, 24 aa, Mycobacterium
YPTDDFYLYYSGNEKAYPYAGRAR

SEQ ID NO: 1356938 - protein, 17 aa, Mycobacterium
YRALWQVATAQGVNPST

SEQ ID NO: 1356939 - protein, 22 aa, Mycobacterium
YRAPLCLLTRPAAEALRRAQQE

SEQ ID NO: 1356940 - protein, 30 aa, Mycobacterium
YSEDTGSITYRYTWHLPKERTWTYDGQLNM

SEQ ID NO: 1356941 - protein, 18 aa, Mycobacterium
YTAWRGIAAHRLDPQLAG

SEQ ID NO: 1356942 - protein, 17 aa, Mycobacterium
YVFDYAERAVYVLDPAT

SEQ ID NO: 1356943 - protein, 23 aa, Mycobacterium
AAALLTALLTHPATAAAAANSAM

SEQ ID NO: 1356944 - protein, 20 aa, Mycobacterium
AAAPDLILGSQALTPELFDA

SEQ ID NO: 1356945 - protein, 23 aa, Mycobacterium
AAAPLGVLLDYAAGVLKATDIRA

SEQ ID NO: 1356946 - protein, 26 aa, Mycobacterium
AADGYLRLRTWLTRLYQAEFNGFIAS

SEQ ID NO: 1356947 - protein, 25 aa, Mycobacterium
AAELAGIPLLDLLDTDLRAAVDEPG

SEQ ID NO: 1356948 - protein, 30 aa, Mycobacterium
AAFENSWRVNCLGPFLGIQAVLEHLKAADG

SEQ ID NO: 1356949 - protein, 26 aa, Mycobacterium
AAGAIVVLSLWEPGADKPVLVGLRYR

SEQ ID NO: 1356950 - protein, 21 aa, Mycobacterium
AAGGVLLRPFARLISSTGDSV

SEQ ID NO: 1356951 - protein, 19 aa, Mycobacterium
AAHTFSLPELTDWSNADFT

SEQ ID NO: 1356952 - protein, 19 aa, Mycobacterium
AAIRWIQRGYRTPAGSSPA

SEQ ID NO: 1356953 - protein, 18 aa, Mycobacterium
AAIVARLHADGYRVTACD

SEQ ID NO: 1356954 - protein, 18 aa, Mycobacterium
AAPAAPPALWALLASARR

SEQ ID NO: 1356955 - protein, 30 aa, Mycobacterium
AAPLGVCYLPAFLCLGIVPVVVGLAGDVLQ

SEQ ID NO: 1356956 - protein, 26 aa, Mycobacterium
AAPPAPPVPAPLPPPSALTDVLYRLA

SEQ ID NO: 1356957 - protein, 30 aa, Mycobacterium
AAPRRMRPLLAVLLVALATAAALIVGTSSL

SEQ ID NO: 1356958 - protein, 24 aa, Mycobacterium
AARQGVVTLMSLDFNKAQEDVKRI

SEQ ID NO: 1356959 - protein, 19 aa, Mycobacterium
AAVQSPPLMERLRVMMNLS

SEQ ID NO: 1356960 - protein, 25 aa, Mycobacterium
AAYGGLVPLFTPNPWRPGSSMSHLD

SEQ ID NO: 1356961 - protein, 20 aa, Mycobacterium
ACTSALLLSGLVACAPPEKE

SEQ ID NO: 1356962 - protein, 24 aa, Mycobacterium
ADALNPWITPVGSAVFAIPPGAPE

SEQ ID NO: 1356963 - protein, 25 aa, Mycobacterium
ADLAARLWDLPAWAAQGRRLLDDMD

SEQ ID NO: 1356964 - protein, 24 aa, Mycobacterium
ADMHAANPHIWYSPAAVTAVADAV

SEQ ID NO: 1356965 - protein, 24 aa, Mycobacterium
AEKMLPKFLWERPDTVAKAGLDGL

SEQ ID NO: 1356966 - protein, 30 aa, Mycobacterium
AEKNSTLVLPFPVELLRFLERSTPRAQCES

SEQ ID NO: 1356967 - protein, 21 aa, Mycobacterium
AESRHRVLKWPAPHVLPESRS

SEQ ID NO: 1356968 - protein, 27 aa, Mycobacterium
AEYGDRVNFVLRYFPLRSHFNAERAAR

SEQ ID NO: 1356969 - protein, 34 aa, Mycobacterium
AEYLGPALRLLNFNYLPMPINAYLKKSPSPENLV

SEQ ID NO: 1356970 - protein, 28 aa, Mycobacterium
AEYTAMNGTWYAFGAPGGLTCVIQRGGA

SEQ ID NO: 1356971 - protein, 26 aa, Mycobacterium
AFRDSDAWFLIRAVTPPGADVLPRHH

SEQ ID NO: 1356972 - protein, 25 aa, Mycobacterium
AGGIMAFGYVRVPAMLGIGQYTVTV

SEQ ID NO: 1356973 - protein, 24 aa, Mycobacterium
AGGMRSYTRDLVQARYLQFSQQPV

SEQ ID NO: 1356974 - protein, 26 aa, Mycobacterium
AGIAGPALAFWLTRNGYRVVVVETAA

SEQ ID NO: 1356975 - protein, 20 aa, Mycobacterium
AGKLRAGSLIPLTSAGAYPS

SEQ ID NO: 1356976 - protein, 18 aa, Mycobacterium
AGLLGFSLLGPQVGTAAA

SEQ ID NO: 1356977 - protein, 25 aa, Mycobacterium
AGPGTFGTPWSKLPPGRQSAVIVAA

SEQ ID NO: 1356978 - protein, 24 aa, Mycobacterium
AGQTPSEFLRAPLVSLPGAAQALE

SEQ ID NO: 1356979 - protein, 24 aa, Mycobacterium
AGRDLAPIPIPDVALRTVGRIFDV

SEQ ID NO: 1356980 - protein, 18 aa, Mycobacterium
AGRWEVYAGPYPSSDRWF

SEQ ID NO: 1356981 - protein, 38 aa, Mycobacterium
AGVVSVLCAVVFVALAAVGGLLFWERVETRGAQEARAE

SEQ ID NO: 1356982 - protein, 22 aa, Mycobacterium
AHAQPVPPCTFTLSAPSVVQNA

SEQ ID NO: 1356983 - protein, 40 aa, Mycobacterium
AHRRKFYAAAAMLAPFALTMLLVAFVLLAGGGSPATNEAA

SEQ ID NO: 1356984 - protein, 26 aa, Mycobacterium
AIASVVKLFIADDLLLSGKPLSPEDV

SEQ ID NO: 1356985 - protein, 18 aa, Mycobacterium
AIIVAPNLIAARYVQLTP

SEQ ID NO: 1356986 - protein, 18 aa, Mycobacterium
AITLAEFFDVPLVSTMHA

SEQ ID NO: 1356987 - protein, 30 aa, Mycobacterium
AKIPVECSQAGWTWLISDFGEETPGFSASV

SEQ ID NO: 1356988 - protein, 24 aa, Mycobacterium
AKPVTNRITVWPRGADIQERVNEG

SEQ ID NO: 1356989 - protein, 22 aa, Mycobacterium
ALATLLNLIGLDNGLPGGIGGA

SEQ ID NO: 1356990 - protein, 25 aa, Mycobacterium
ALDPKLWNWIAVSGIFLVLNSFTPC

SEQ ID NO: 1356991 - protein, 19 aa, Mycobacterium
ALEQAPPPRRTLRSIVFDD

SEQ ID NO: 1356992 - protein, 22 aa, Mycobacterium
ALIAVFAQLRFEREQRYTAVFA

SEQ ID NO: 1356993 - protein, 19 aa, Mycobacterium
ALLSGLLRAGRQVKDLVVA

SEQ ID NO: 1356994 - protein, 23 aa, Mycobacterium
ALLSSLAALVPVGSPGAPFAEAV

SEQ ID NO: 1356995 - protein, 21 aa, Mycobacterium
AMGNLWWDRPITVTGVHMGAG

SEQ ID NO: 1356996 - protein, 23 aa, Mycobacterium
AMRTGFYGFGFNVGTSSAARVEL

SEQ ID NO: 1356997 - protein, 28 aa, Mycobacterium
ANARRWGVLHVIWRQGFYPGIGAPSWTA

SEQ ID NO: 1356998 - protein, 21 aa, Mycobacterium
ANLDPILALIDKAKPVMDSQA

SEQ ID NO: 1356999 - protein, 18 aa, Mycobacterium
APAAPLPGPAPTGPAPGP

SEQ ID NO: 1357000 - protein, 20 aa, Mycobacterium
APAPTPGPPGFGPDAPPTQD

SEQ ID NO: 1357001 - protein, 23 aa, Mycobacterium
APDAAWAFTSWITSPAVDAQRVA

SEQ ID NO: 1357002 - protein, 27 aa, Mycobacterium
APGAPTVDLPLPPGWQDAGDRAPEWSY

SEQ ID NO: 1357003 - protein, 28 aa, Mycobacterium
APGDPPYVAVPYLSRMDLAYAAADLAIC

SEQ ID NO: 1357004 - protein, 31 aa, Mycobacterium; identical to SEQ ID NO: 1137621

SEQ ID NO: 1357005 - protein, 21 aa, Mycobacterium
APIIKNRQYNFPPIGVNPFVG

SEQ ID NO: 1357006 - protein, 25 aa, Mycobacterium
APPGRDLLYVLAPAPNKAVGHVDWS

SEQ ID NO: 1357007 - protein, 18 aa, Mycobacterium
AQGPMQFMPATFAAYGAG

SEQ ID NO: 1357008 - protein, 27 aa, Mycobacterium
AQPPTPVPGPVLPPLAPGQVVRLGPTA

SEQ ID NO: 1357009 - protein, 21 aa, Mycobacterium
ARARLLGMPAAMLVEAAPAQP

SEQ ID NO: 1357010 - protein, 36 aa, Mycobacterium
ARGFSVARRLALLLTLPRFLPLTGPVAMRSTALMRI

SEQ ID NO: 1357011 - protein, 18 aa, Mycobacterium
ARGPQAEALILGTDGMLH

SEQ ID NO: 1357012 - protein, 21 aa, Mycobacterium
ARRGYGLALVARRADQLRALV

SEQ ID NO: 1357013 - protein, 19 aa, Mycobacterium
ARWGAVASAAAVVLTACGS

SEQ ID NO: 1357014 - protein, 17 aa, Mycobacterium
ASLPDSTPFLRTALAGG

SEQ ID NO: 1357015 - protein, 18 aa, Mycobacterium
ASLSGFLNPSEGWWPMLI

SEQ ID NO: 1357016 - protein, 25 aa, Mycobacterium
ATDCDMGIHLLARPGTSGDPRFTDF

SEQ ID NO: 1357017 - protein, 17 aa, Mycobacterium
ATGTFAGIGGDGGAGGS

SEQ ID NO: 1357018 - protein, 18 aa, Mycobacterium
ATLKLGIQPGVELPSNAL

SEQ ID NO: 1357019 - protein, 31 aa, Mycobacterium
ATMIKTPFSLAYKTELPIPVDKYPLICEPGG

SEQ ID NO: 1357020 - protein, 30 aa, Mycobacterium; identical to SEQ ID NO: 1312365

SEQ ID NO: 1357021 - protein, 19 aa, Mycobacterium
AVAGYYYQAINKDAPHPAA

SEQ ID NO: 1357022 - protein, 22 aa, Mycobacterium
AVAQQFPQIVQISGWRPDPIGG

SEQ ID NO: 1357023 - protein, 26 aa, Mycobacterium
AVDLTADFRLFPPPQAIPDLTGGAGE

SEQ ID NO: 1357024 - protein, 22 aa, Mycobacterium
AVHAGLLLRGWSDDIVVLAGDV

SEQ ID NO: 1357025 - protein, 17 aa, Mycobacterium
AVLIWTARRAGVLRWDL

SEQ ID NO: 1357026 - protein, 23 aa, Mycobacterium
AVLLKGLSDVTVEFAPHARLLMD

SEQ ID NO: 1357027 - protein, 23 aa, Mycobacterium
AVLPSHYEPFGIVALEAAATGTP

SEQ ID NO: 1357028 - protein, 30 aa, Mycobacterium
AVRDMFPEWEVLRPSWFMQNFTGAHPVAES

SEQ ID NO: 1357029 - protein, 26 aa, Mycobacterium
AVSDALLFAAPAAAKLPFLEAVRLEF

SEQ ID NO: 1357030 - protein, 28 aa, Mycobacterium
AVSGSGPAYFFLMVEALVDAAVASGLSR

SEQ ID NO: 1357031 - protein, 23 aa, Mycobacterium
AVSNLTVEAWACAFGPGGEAATI

SEQ ID NO: 1357032 - protein, 18 aa, Mycobacterium
AVTLVVAAFGLSLGLSGC

SEQ ID NO: 1357033 - protein, 31 aa, Mycobacterium
CKDDLSHNAFRYFRAMRTYLGALPVTMMRVS

SEQ ID NO: 1357034 - protein, 18 aa, Mycobacterium
CPPSQAWGRQPEGRGVLV

SEQ ID NO: 1357035 - protein, 26 aa, Mycobacterium
DAALRPLMSHYTALRREEWGFDGEPR

SEQ ID NO: 1357036 - protein, 18 aa, Mycobacterium
DAAPHWPRRRTLRRRPHP

SEQ ID NO: 1357037 - protein, 19 aa, Mycobacterium
DACVLWCCAIRHAVLTAQL

SEQ ID NO: 1357038 - protein, 34 aa, Mycobacterium; identical to SEQ ID NO: 1312872

SEQ ID NO: 1357039 - protein, 17 aa, Mycobacterium
DALRRFPGRPVRTATRK

SEQ ID NO: 1357040 - protein, 17 aa, Mycobacterium
DARGRVLTFALMSNNAG

SEQ ID NO: 1357041 - protein, 37 aa, Mycobacterium
DARLDEWLPNYQPCAYIQRYLTVAVKYQLPITAAERN

SEQ ID NO: 1357042 - protein, 34 aa, Mycobacterium
DDFIKSLEFLPTFPFHYTYLRNAVRGDYLNVFTT

SEQ ID NO: 1357043 - protein, 24 aa, Mycobacterium
DDGQWDPTLPKLLSAGAPGDPLAI

SEQ ID NO: 1357044 - protein, 21 aa, Mycobacterium
DDPLALVPLLSRNDASRMPGT

SEQ ID NO: 1357045 - protein, 33 aa, Mycobacterium
DDTPVDVNWWRPGGTAWFTVLHQAAWHDASTDV

SEQ ID NO: 1357046 - protein, 22 aa, Mycobacterium
DEILAFAMANAARLGLQDVIWR

SEQ ID NO: 1357047 - protein, 18 aa, Mycobacterium
DEPADLAARLWDLPAWAA

SEQ ID NO: 1357048 - protein, 31 aa, Mycobacterium
DEYDRRWRTLTRRYRLLTAGLVRAGATPSIR

SEQ ID NO: 1357049 - protein, 21 aa, Mycobacterium
DFVAAMRRKALGADTVDVVAD

SEQ ID NO: 1357050 - protein, 25 aa, Mycobacterium
DGDGTRRFGATISRIDRDDADERPR

SEQ ID NO: 1357051 - protein, 23 aa, Mycobacterium
DGLALVTYFEAEPTFDPAAHTFS

SEQ ID NO: 1357052 - protein, 22 aa, Mycobacterium
DGPPPPGYFDPPPPPAPGPPPA

SEQ ID NO: 1357053 - protein, 24 aa, Mycobacterium
DGTEASMWWDFSGLTISDVTIHNS

SEQ ID NO: 1357054 - protein, 19 aa, Mycobacterium
DHAIWRQHIYYPSGTAEPM

SEQ ID NO: 1357055 - protein, 25 aa, Mycobacterium
DHIDVDPWRAIGDWLAACSADTAVA

SEQ ID NO: 1357056 - protein, 24 aa, Mycobacterium
DHVAAVVLFGKPSTRFLDAISAPP

SEQ ID NO: 1357057 - protein, 18 aa, Mycobacterium
DIKLLGAGSTFYLPVFAP

SEQ ID NO: 1357058 - protein, 22 aa, Mycobacterium
DITGGTCCIGVWGPLARDMVQL

SEQ ID NO: 1357059 - protein, 20 aa, Mycobacterium
DLDLLIETIRRESGHLDVVV

SEQ ID NO: 1357060 - protein, 29 aa, Mycobacterium
DLDREELWHRYRQAALYAYVAALITAGMG

SEQ ID NO: 1357061 - protein, 20 aa, Mycobacterium
DLDVWRLTGERPVFTSGAAF

SEQ ID NO: 1357062 - protein, 18 aa, Mycobacterium
DLHTGYFNALYSAQFPLD

SEQ ID NO: 1357063 - protein, 20 aa, Mycobacterium
DLTFANWRGVLAPPGISDDA

SEQ ID NO: 1357064 - protein, 41 aa, Mycobacterium; identical to SEQ ID NO: 1313750

SEQ ID NO: 1357065 - protein, 20 aa, Mycobacterium
DLVRYYDMLLSGAGGLPRDK

SEQ ID NO: 1357066 - protein, 26 aa, Mycobacterium
DPLALDFYVTVPIDALPLLEPTYLFF

SEQ ID NO: 1357067 - protein, 17 aa, Mycobacterium
DPNLIPNLIQRGVAFAK

SEQ ID NO: 1357068 - protein, 20 aa, Mycobacterium
DPTVLANWLAAVEEIRTKGT

SEQ ID NO: 1357069 - protein, 18 aa, Mycobacterium
DQGVWEFILPLVRSDVRA

SEQ ID NO: 1357070 - protein, 26 aa, Mycobacterium
DREAWNTLVLPWFRGINSVVGVQRTG

SEQ ID NO: 1357071 - protein, 19 aa, Mycobacterium
DRREYFHGGVLRVTVPGVR

SEQ ID NO: 1357072 - protein, 27 aa, Mycobacterium
DRTEPALDLDLLLGGLKPVIRGLNPED

SEQ ID NO: 1357073 - protein, 24 aa, Mycobacterium
DSHLPGISPMAAVSIFIDGTKDIL

SEQ ID NO: 1357074 - protein, 22 aa, Mycobacterium
DSKISTVWTWPDRPGVAGCAAL

SEQ ID NO: 1357075 - protein, 17 aa, Mycobacterium
DTRAILLAVGERGLVGG

SEQ ID NO: 1357076 - protein, 18 aa, Mycobacterium
DTSVLLGRLDLKLFAGAE

SEQ ID NO: 1357077 - protein, 18 aa, Mycobacterium
DTVHIGPPALLGVGVRTA

SEQ ID NO: 1357078 - protein, 17 aa, Mycobacterium
DTVKPTLPVLLANLVSV

SEQ ID NO: 1357079 - protein, 21 aa, Mycobacterium
DVLPRHHELLLSRGPYRYDDE

SEQ ID NO: 1357080 - protein, 26 aa, Mycobacterium
DVPKYVMNPLAWANAALGFIYVHNGY

SEQ ID NO: 1357081 - protein, 24 aa, Mycobacterium
DVQFPKWRHLLPSDTSRMGGIVGM

SEQ ID NO: 1357082 - protein, 19 aa, Mycobacterium
DVTALLFTKGPAVARLEFQ

SEQ ID NO: 1357083 - protein, 25 aa, Mycobacterium
DWGATSLKKLLTSSLRISDKAAGDR

SEQ ID NO: 1357084 - protein, 24 aa, Mycobacterium
DYMKLVGEKLGWARVPPGSRTSTY

SEQ ID NO: 1357085 - protein, 26 aa, Mycobacterium
EAAAMRRMLLVLGFPDHRIIVEDKAN

SEQ ID NO: 1357086 - protein, 24 aa, Mycobacterium
EAGRPGVQLSLLTGTPNLGYGNKG

SEQ ID NO: 1357087 - protein, 17 aa, Mycobacterium
EDRLRPDFVPPAAPTEP

SEQ ID NO: 1357088 - protein, 22 aa, Mycobacterium
EESRLLTRELFYTAVTRAKAKV

SEQ ID NO: 1357089 - protein, 33 aa, Mycobacterium
EFTWLSDSVMQWTPTGFWPAHSPISVGAGDFMT

SEQ ID NO: 1357090 - protein, 24 aa, Mycobacterium
EGAVTLVANDKWWGAKPVTNRITV

SEQ ID NO: 1357091 - protein, 19 aa, Mycobacterium
EGGQYALTYPRRLGFGLGE

SEQ ID NO: 1357092 - protein, 29 aa, Mycobacterium
EGLRATVQWYRDNEAWWRPLKDAAEAAYE

SEQ ID NO: 1357093 - protein, 24 aa, Mycobacterium
EGNMYAVPFYGESSFLMYRKDLFE

SEQ ID NO: 1357094 - protein, 17 aa, Mycobacterium
EHIVPLAYAWDQGARAW

SEQ ID NO: 1357095 - protein, 27 aa, Mycobacterium
EIGDRREAIAHAVRWARPGDVVLVAGK

SEQ ID NO: 1357096 - protein, 22 aa, Mycobacterium
ELAIDLARFPGLNTWSAEDLNI

SEQ ID NO: 1357097 - protein, 21 aa, Mycobacterium
ELLTGRAALLDLPAPGRVSAG

SEQ ID NO: 1357098 - protein, 17 aa, Mycobacterium
ELTRYPQVQLRTGVVTD

SEQ ID NO: 1357099 - protein, 24 aa, Mycobacterium
EPDDWQQPRPTVFAREDAVYVTDP

SEQ ID NO: 1357100 - protein, 30 aa, Mycobacterium; identical to SEQ ID NO: 944499

SEQ ID NO: 1357101 - protein, 28 aa, Mycobacterium
EQNELVALNPELWITMASAMCTFADPAT

SEQ ID NO: 1357102 - protein, 22 aa, Mycobacterium
ERMYLVAPIGHPAPITVVAPFL

SEQ ID NO: 1357103 - protein, 21 aa, Mycobacterium
ESSFLMYRKDLFEQAGITVDQ

SEQ ID NO: 1357104 - protein, 23 aa, Mycobacterium
ETDFATAFVRFAGFRRARVRALV

SEQ ID NO: 1357105 - protein, 24 aa, Mycobacterium
ETGNATVVPFLLADAYHARVDIPA

SEQ ID NO: 1357106 - protein, 17 aa, Mycobacterium
EVGLDRPAAQRFTDEPF

SEQ ID NO: 1357107 - protein, 19 aa, Mycobacterium
EVTGFVRDGMPAMMGPMMG

SEQ ID NO: 1357108 - protein, 25 aa, Mycobacterium
EVVHAHDWLVAHPAITLAEFFDVPL

SEQ ID NO: 1357109 - protein, 20 aa, Mycobacterium
EVYDVIHPYQFRSALRGLRT

SEQ ID NO: 1357110 - protein, 19 aa, Mycobacterium
FAAATLAGALALAACSSGG

SEQ ID NO: 1357111 - protein, 19 aa, Mycobacterium
FAPSRLPWERIEPLAGLVE

SEQ ID NO: 1357112 - protein, 19 aa, Mycobacterium
FASAAWRKLLVNAVVGLMV

SEQ ID NO: 1357113 - protein, 30 aa, Mycobacterium
FCFEGFPPRKHAARLSWFQALATEQRTCVF

SEQ ID NO: 1357114 - protein, 26 aa, Mycobacterium
FDASRPVFGFAPYPGVQPGDPARVTL

SEQ ID NO: 1357115 - protein, 21 aa, Mycobacterium
FDSPLSLVTPQLARLAAMGGF

SEQ ID NO: 1357116 - protein, 17 aa, Mycobacterium
FLNGVFPLDRNRLTREW

SEQ ID NO: 1357117 - protein, 25 aa, Mycobacterium
FNTVRVFLHDLLWATDRAGFSQRLT

SEQ ID NO: 1357118 - protein, 18 aa, Mycobacterium
FSGNGYMLLGLQIDGLAS

SEQ ID NO: 1357119 - protein, 17 aa, Mycobacterium
FTDWSTATPAIATDVTA

SEQ ID NO: 1357120 - protein, 21 aa, Mycobacterium
FTVTGPKVRPYLGDVSAERAP

SEQ ID NO: 1357121 - protein, 26 aa, Mycobacterium
FVAGRTQTYLPWDSWKKPYTEPPDPW

SEQ ID NO: 1357122 - protein, 26 aa, Mycobacterium
FVKDNLTKWWRGDYANITTIVDLTLS

SEQ ID NO: 1357123 - protein, 18 aa, Mycobacterium
FVLQPSNPLLMPREGRNP

SEQ ID NO: 1357124 - protein, 26 aa, Mycobacterium
GAGGHAGLLSIYGTGGAGGAGGIGAN

SEQ ID NO: 1357125 - protein, 27 aa, Mycobacterium
GAGKESYPVLWQIASPAGIPAATLAQG

SEQ ID NO: 1357126 - protein, 23 aa, Mycobacterium
GAKPITLPYARSLAAAGLAIVSN

SEQ ID NO: 1357127 - protein, 25 aa, Mycobacterium
GAKQEPRAWRLAVELSREGDQIKMS

SEQ ID NO: 1357128 - protein, 19 aa, Mycobacterium
GAKRPYYLSWQEIERMADS

SEQ ID NO: 1357129 - protein, 20 aa, Mycobacterium
GALRWHDGTWLRRPSADRMV

SEQ ID NO: 1357130 - protein, 29 aa, Mycobacterium
GAPILWADMPTLPLYRQQRTLLTSSKMYA

SEQ ID NO: 1357131 - protein, 20 aa, Mycobacterium
GAYMRWVAEGSSPRFTLSTA

SEQ ID NO: 1357132 - protein, 18 aa, Mycobacterium
GDAIPLDRTAPALDLDAV

SEQ ID NO: 1357133 - protein, 17 aa, Mycobacterium
GDGRWWNTISTAADLVR

SEQ ID NO: 1357134 - protein, 22 aa, Mycobacterium
GDNIWLARRYGPAARQIVAAVA

SEQ ID NO: 1357135 - protein, 38 aa, Mycobacterium
GDQEPALWMPPNTAFHCQYAMQFIAVLRGYGLPVDAPS

SEQ ID NO: 1357136 - protein, 22 aa, Mycobacterium
GEAFVLAEKLGLSAQSLFDVIT

SEQ ID NO: 1357137 - protein, 31 aa, Mycobacterium
GELDYLRRKYRGWAEPIPTLLATTAARDVLR

SEQ ID NO: 1357138 - protein, 23 aa, Mycobacterium
GEPATAQWLAGMKANAVIYNDNI

SEQ ID NO: 1357139 - protein, 23 aa, Mycobacterium
GEVPLRAWFPGDDYVDVVGIDGY

SEQ ID NO: 1357140 - protein, 19 aa, Mycobacterium
GEYVGALDLFRTEPGGLRA

SEQ ID NO: 1357141 - protein, 17 aa, Mycobacterium
GFAGMLLGSVSTAVVQA

SEQ ID NO: 1357142 - protein, 27 aa, Mycobacterium
GFAQAMGPMQFIPETWRLYGVDANNDG

SEQ ID NO: 1357143 - protein, 21 aa, Mycobacterium
GFGAELPYGQALNFGDYRCRT

SEQ ID NO: 1357144 - protein, 30 aa, Mycobacterium
GFTALATAGACWIVQLFNPATAIADPGAVS

SEQ ID NO: 1357145 - protein, 17 aa, Mycobacterium
GFTLNYTSSGSGAGVSE

SEQ ID NO: 1357146 - protein, 20 aa, Mycobacterium
GFYSYWLLERAVGAGIHNAD

SEQ ID NO: 1357147 - protein, 24 aa, Mycobacterium
GGGDLLTALLGKKITAGTSSPGEL

SEQ ID NO: 1357148 - protein, 20 aa, Mycobacterium
GGILDPLPMAPVAAVNADVT

SEQ ID NO: 1357149 - protein, 27 aa, Mycobacterium
GGVKGFFEKTFAPLGLKKIQAQVLENL

SEQ ID NO: 1357150 - protein, 24 aa, Mycobacterium
GHTTDCRLYWVQIGPTAAAPDSPQ

SEQ ID NO: 1357151 - protein, 22 aa, Mycobacterium
GIEAQRWPFAQRRPRSGPAQLL

SEQ ID NO: 1357152 - protein, 26 aa, Mycobacterium
GIFQQQPWWGTIPDLMNPRISAMKFF

SEQ ID NO: 1357153 - protein, 23 aa, Mycobacterium
GLPTCVVKYIPLHTPAVTMSFNT

SEQ ID NO: 1357154 - protein, 19 aa, Mycobacterium
GLVDITRFWFEEGSLDNEQ

SEQ ID NO: 1357155 - protein, 24 aa, Mycobacterium
GMGEAIAWKFTLDDLLVDVGVAGG

SEQ ID NO: 1357156 - protein, 27 aa, Mycobacterium
GNAASMIGYNWNLPALNDPAGASGARA

SEQ ID NO: 1357157 - protein, 27 aa, Mycobacterium
GNEPARTWFTAMKPIATNFGPVALPPT

SEQ ID NO: 1357158 - protein, 18 aa, Mycobacterium
GNRPLTVRIGYQSPNARL

SEQ ID NO: 1357159 - protein, 17 aa, Mycobacterium
GNVTDILIKNPVGQLPL

SEQ ID NO: 1357160 - protein, 20 aa, Mycobacterium
GPPEALVVEMVIKGGTVTPA

SEQ ID NO: 1357161 - protein, 36 aa, Mycobacterium
GQPGAILAFPRTQWIRWRKPVIGAPTTPRIMAPGQL

SEQ ID NO: 1357162 - protein, 24 aa, Mycobacterium
GQPLRFEVLPVMFSIQLTGDCLWQ

SEQ ID NO: 1357163 - protein, 26 aa, Mycobacterium
GQRTPERWFVVWLGSATNPVDREAAV

SEQ ID NO: 1357164 - protein, 25 aa, Mycobacterium
GRDAARILYAPHIPGAGYTATGRGC

SEQ ID NO: 1357165 - protein, 31 aa, Mycobacterium
GRDVAEIALLPVTKFFPASDIRILYGLGCRE

SEQ ID NO: 1357166 - protein, 18 aa, Mycobacterium
GRGGFAGMLLGSVSTAVV

SEQ ID NO: 1357167 - protein, 20 aa, Mycobacterium
GRLYRDPQSVLRYPSVGILH

SEQ ID NO: 1357168 - protein, 26 aa, Mycobacterium
GRSTTPDHWWAWQTKAWSAGEREPRA

SEQ ID NO: 1357169 - protein, 17 aa, Mycobacterium
GSMAAALPFCDEFMPAH

SEQ ID NO: 1357170 - protein, 24 aa, Mycobacterium
GSNFVLSVLGYQNSVDYRDVHGGT

SEQ ID NO: 1357171 - protein, 19 aa, Mycobacterium
GSVLAEVGLDRPAAQRFTD

SEQ ID NO: 1357172 - protein, 20 aa, Mycobacterium
GTACNGGRGGLLWGNGGDGA

SEQ ID NO: 1357173 - protein, 17 aa, Mycobacterium
GTALLSFGAHPAAAAPT

SEQ ID NO: 1357174 - protein, 19 aa, Mycobacterium
GVAGPNWMLIGDAAACVNP

SEQ ID NO: 1357175 - protein, 31 aa, Mycobacterium; identical to SEQ ID NO: 1317962

SEQ ID NO: 1357176 - protein, 24 aa, Mycobacterium
GVDRLLRLGARVLADHLPDWVTLA

SEQ ID NO: 1357177 - protein, 24 aa, Mycobacterium
GVGFGKFDYIFVWRVEVRNHRELP

SEQ ID NO: 1357178 - protein, 27 aa, Mycobacterium
GVGGRSGMLFGYAGDGGIGGAAGSGGR

SEQ ID NO: 1357179 - protein, 19 aa, Mycobacterium
GVIPANRLLGVALVADPSQ

SEQ ID NO: 1357180 - protein, 17 aa, Mycobacterium
GVYVPPPPGVAGAIPGG

SEQ ID NO: 1357181 - protein, 17 aa, Mycobacterium
GWGGDGGDASWGGAGGA

SEQ ID NO: 1357182 - protein, 19 aa, Mycobacterium
GWMSGSGGWGGDGGDASWG

SEQ ID NO: 1357183 - protein, 24 aa, Mycobacterium
HDWLSDVPAWPNPFSLLNTLTAVV

SEQ ID NO: 1357184 - protein, 22 aa, Mycobacterium
HEILHSFGFMSFIERPGENVER

SEQ ID NO: 1357185 - protein, 28 aa, Mycobacterium
HGLPANPTPALLPGAPIPAGPSAPATLD

SEQ ID NO: 1357186 - protein, 37 aa, Mycobacterium
HGRQTLALTTLTTLTSRGPILGLFGDGVDAARDCTGT

SEQ ID NO: 1357187 - protein, 17 aa, Mycobacterium
HLALDPPVGKLPSGRLQ

SEQ ID NO: 1357188 - protein, 22 aa, Mycobacterium
HPEPKVTAALRDPSYRLVTTTA

SEQ ID NO: 1357189 - protein, 19 aa, Mycobacterium
HPHLTARDRWRPVETPNGE

SEQ ID NO: 1357190 - protein, 21 aa, Mycobacterium
HPYQFRSALRGLRTSPFHARH

SEQ ID NO: 1357191 - protein, 18 aa, Mycobacterium
HQIKPLFVLFDSCWDPMP

SEQ ID NO: 1357192 - protein, 19 aa, Mycobacterium
HRPATLRPLPNFAVDRLES

SEQ ID NO: 1357193 - protein, 24 aa, Mycobacterium
HVENPDCQLAWTTLAGIGMVESRN

SEQ ID NO: 1357194 - protein, 30 aa, Mycobacterium
HVRIIQEFVKKLPAWVSWERREHYERDLVG

SEQ ID NO: 1357195 - protein, 26 aa, Mycobacterium
IADERLRRIFTFQALYAGVPPHKALA

SEQ ID NO: 1357196 - protein, 19 aa, Mycobacterium
IALAIGLFAGTFTRTVPVT

SEQ ID NO: 1357197 - protein, 25 aa, Mycobacterium
IAPTSIPLYDVYRWPELSTLSVTAV

SEQ ID NO: 1357198 - protein, 25 aa, Mycobacterium
IASKFFRPDLLGPCAKFVSPFGGPG

SEQ ID NO: 1357199 - protein, 35 aa, Mycobacterium
IAVLTAALGVGLTPAFAAHAATPPTPGHLAISING

SEQ ID NO: 1357200 - protein, 17 aa, Mycobacterium
IAVVGRAPLVLDYQIND

SEQ ID NO: 1357201 - protein, 21 aa, Mycobacterium
IAYREYVPGRWLRHASFKGCR

SEQ ID NO: 1357202 - protein, 20 aa, Mycobacterium
IDQLTIGWPAAGDGWVPVRL

SEQ ID NO: 1357203 - protein, 25 aa, Mycobacterium
IEAGFSEIFATLGPLRRGDGFVLFC

SEQ ID NO: 1357204 - protein, 20 aa, Mycobacterium
IELKNWVATLKLGIQPGVEL

SEQ ID NO: 1357205 - protein, 21 aa, Mycobacterium
IGATMAALLHEAGRPVLLCGR

SEQ ID NO: 1357206 - protein, 25 aa, Mycobacterium
IGEAFVLAEKLGLPAQSLFDVITGA

SEQ ID NO: 1357207 - protein, 20 aa, Mycobacterium
IGEVIRWIEAAPPAAPEDFH

SEQ ID NO: 1357208 - protein, 20 aa, Mycobacterium
IGHPAPITVVAPFLHRAVEA

SEQ ID NO: 1357209 - protein, 19 aa, Mycobacterium
ILALYGIPNRDCGSFAAGG

SEQ ID NO: 1357210 - protein, 27 aa, Mycobacterium
ILANTRVLLTIFVIAVATVATAVFLSV

SEQ ID NO: 1357211 - protein, 19 aa, Mycobacterium
ILTVLIAAASVGLAVVLYV

SEQ ID NO: 1357212 - protein, 17 aa, Mycobacterium
INDITVYGWDQTVMYKN

SEQ ID NO: 1357213 - protein, 17 aa, Mycobacterium
IPFLDQLGNAPQLLQTF

SEQ ID NO: 1357214 - protein, 24 aa, Mycobacterium
ISDVLTPELRDALGAWVGAARDVA

SEQ ID NO: 1357215 - protein, 25 aa, Mycobacterium
ISGIELINLWYHNPAYHAIMSDCGF

SEQ ID NO: 1357216 - protein, 20 aa, Mycobacterium
ITVVAPFLHRAVEAGVRRVV

SEQ ID NO: 1357217 - protein, 22 aa, Mycobacterium
IVGVVGLPAWFLGVGVASAEPV

SEQ ID NO: 1357218 - protein, 26 aa, Mycobacterium
IVKNNRWLEDALPDYNIKWTKFDSGA

SEQ ID NO: 1357219 - protein, 26 aa, Mycobacterium
IVRALDPLLRAIIETGYDRPTDGKYA

SEQ ID NO: 1357220 - protein, 34 aa, Mycobacterium
KAFSGLLAAVGLAPLIANLPAAPAAPPALWALLA

SEQ ID NO: 1357221 - protein, 17 aa, Mycobacterium
KAFVLSYTHALREELRG

SEQ ID NO: 1357222 - protein, 17 aa, Mycobacterium
KELFVGRRLGSGAPLTG

SEQ ID NO: 1357223 - protein, 18 aa, Mycobacterium
KFFTAMRAVPDWEALPAG

SEQ ID NO: 1357224 - protein, 24 aa, Mycobacterium
KGVHDLIAALPRIRRTHPGTTLTI

SEQ ID NO: 1357225 - protein, 21 aa, Mycobacterium
KPIATNFGPVALPPTDPRYVD

SEQ ID NO: 1357226 - protein, 20 aa, Mycobacterium
KPLFVLFDSCWDPMPKPGRQ

SEQ ID NO: 1357227 - protein, 20 aa, Mycobacterium
KPTLPAWRIVEPRPAEELMG

SEQ ID NO: 1357228 - protein, 25 aa, Mycobacterium
KRDVMMIHTLLWPDEIRDPDFPVLD

SEQ ID NO: 1357229 - protein, 20 aa, Mycobacterium
KRGDLLFWGPGGSQHVAMYL

SEQ ID NO: 1357230 - protein, 33 aa, Mycobacterium
KTDPPVEGAFYWLSNQEVRWRPAEYWEPGTKVQ

SEQ ID NO: 1357231 - protein, 17 aa, Mycobacterium
KVLLAMVVLDHLSPDNF

SEQ ID NO: 1357232 - protein, 28 aa, Mycobacterium
LAGRTVVLNLWAYWCGPCADELPAMAEY

SEQ ID NO: 1357233 - protein, 17 aa, Mycobacterium
LALVARRADQLRALVDD

SEQ ID NO: 1357234 - protein, 26 aa, Mycobacterium
LAQMWGDAVFHCPFCHGWEVRDAPVA

SEQ ID NO: 1357235 - protein, 24 aa, Mycobacterium
LASMWAGPLLGRMLVRAGATVVKV

SEQ ID NO: 1357236 - protein, 18 aa, Mycobacterium
LCQVYANELWHYELTADA

SEQ ID NO: 1357237 - protein, 22 aa, Mycobacterium
LDGGEFTVFAPTDDAFAKLDPA

SEQ ID NO: 1357238 - protein, 28 aa, Mycobacterium
LDHIYALAAAWDAGAWRWTLEQRQTFAN

SEQ ID NO: 1357239 - protein, 21 aa, Mycobacterium
LDLDAVIGGFRPLLNALDPTQ

SEQ ID NO: 1357240 - protein, 20 aa, Mycobacterium
LDLFRTEPGGLRAGQLAGAI

SEQ ID NO: 1357241 - protein, 17 aa, Mycobacterium
LDRSHRVAAVFLRALLA

SEQ ID NO: 1357242 - protein, 22 aa, Mycobacterium
LEDHLLTHPAIYAAAAVALPDD

SEQ ID NO: 1357243 - protein, 18 aa, Mycobacterium
LEFVGLMGIPPLGADAES

SEQ ID NO: 1357244 - protein, 17 aa, Mycobacterium
LELAMWTRRPDLRLEPG

SEQ ID NO: 1357245 - protein, 25 aa, Mycobacterium
LELGYQVGFPWSLGVGINFSYTTPN

SEQ ID NO: 1357246 - protein, 23 aa, Mycobacterium
LGAQFRSFAAAMDRWWALDSDGE

SEQ ID NO: 1357247 - protein, 20 aa, Mycobacterium
LGDTEVRFYRQLRPELDGAP

SEQ ID NO: 1357248 - protein, 25 aa, Mycobacterium
LGITVPMFPNLFLLYGPNTNVGSGS

SEQ ID NO: 1357249 - protein, 23 aa, Mycobacterium
LGNGILQFLLKNAKTLGVDHAIW

SEQ ID NO: 1357250 - protein, 17 aa, Mycobacterium
LGPRPGVVITPQPDMLP

SEQ ID NO: 1357251 - protein, 20 aa, Mycobacterium
LGYAGVYSSFLRHAEAAAKQ

SEQ ID NO: 1357252 - protein, 30 aa, Mycobacterium
LIALVPVVAFGVLLSAVTVPFVSLGPGPTF

SEQ ID NO: 1357253 - protein, 17 aa, Mycobacterium
LIMLPDSQSALVAERTT

SEQ ID NO: 1357254 - protein, 20 aa, Mycobacterium
LLENAVKGGVPFLPLNQDPS

SEQ ID NO: 1357255 - protein, 30 aa, Mycobacterium
LLGAGSTFYLPVFAPGALFYVGDPHMAMGD

SEQ ID NO: 1357256 - protein, 17 aa, Mycobacterium
LLGSMHLALDPPVGKLP

SEQ ID NO: 1357257 - protein, 17 aa, Mycobacterium
LLQPIRLAGGAAGVRRR

SEQ ID NO: 1357258 - protein, 27 aa, Mycobacterium
LLQVAWRVLPDRLLLIPLARNRIEYEK

SEQ ID NO: 1357259 - protein, 22 aa, Mycobacterium
LLSLAALVTALLLAGCSSPEPQ

SEQ ID NO: 1357260 - protein, 20 aa, Mycobacterium
LLYLDRYWREEQQVCDDVLA

SEQ ID NO: 1357261 - protein, 17 aa, Mycobacterium
LMLARRIGLNTVRVFLH

SEQ ID NO: 1357262 - protein, 18 aa, Mycobacterium
LMPVRPPGDEWKFSRPGW

SEQ ID NO: 1357263 - protein, 42 aa, Mycobacterium; identical to SEQ ID NO: 947430

SEQ ID NO: 1357264 - protein, 22 aa, Mycobacterium
LNVNPANARWFYDNTRRGDIVE

SEQ ID NO: 1357265 - protein, 17 aa, Mycobacterium
LPLYLAAAAALAELPRA

SEQ ID NO: 1357266 - protein, 26 aa, Mycobacterium
LQNLQRPLKQLARSSPYLIGALKLML

SEQ ID NO: 1357267 - protein, 24 aa, Mycobacterium
LQNRPPLRIALAAPTGKAAARLLE

SEQ ID NO: 1357268 - protein, 26 aa, Mycobacterium
LRFAHEFNGDWYPWTPAHGATPDAYV

SEQ ID NO: 1357269 - protein, 25 aa, Mycobacterium
LRKPAAGVFILAPLVLAGAVGATSP

SEQ ID NO: 1357270 - protein, 21 aa, Mycobacterium
LRKVLVPHALRLREAAILGDG

SEQ ID NO: 1357271 - protein, 20 aa, Mycobacterium
LRLAGMRPVPRWPARPTVDL

SEQ ID NO: 1357272 - protein, 18 aa, Mycobacterium
LRTSTRWDFTLGNPLGTG

SEQ ID NO: 1357273 - protein, 17 aa, Mycobacterium
LSALLMVSGNDAANMLA

SEQ ID NO: 1357274 - protein, 17 aa, Mycobacterium
LSVLRTLLRIMDRDPDD

SEQ ID NO: 1357275 - protein, 27 aa, Mycobacterium
LSVLSVVLAALLALVGPFSPATSSAAP

SEQ ID NO: 1357276 - protein, 17 aa, Mycobacterium
LSYLRDLWHAVQTQEVS

SEQ ID NO: 1357277 - protein, 23 aa, Mycobacterium
LTGTPPVLRLYSGSSGDLLYLDR

SEQ ID NO: 1357278 - protein, 25 aa, Mycobacterium
LTRSLNLFTTIPFVKDNLTKWWRGD

SEQ ID NO: 1357279 - protein, 24 aa, Mycobacterium
LTVQKALPLLRTGGSIVLLGSVTA

SEQ ID NO: 1357280 - protein, 24 aa, Mycobacterium
LVAAFLPHVFQWTRAMNPVQPVTS

SEQ ID NO: 1357281 - protein, 28 aa, Mycobacterium
LVFGTDPLIMRQRYPVPGAPYGLAGSSG

SEQ ID NO: 1357282 - protein, 20 aa, Mycobacterium
LWLILAIAIASVILGVTTTA

SEQ ID NO: 1357283 - protein, 23 aa, Mycobacterium
LYHFRTRPWIYTWGARDEELTAP

SEQ ID NO: 1357284 - protein, 24 aa, Mycobacterium
MAAGFLLTELLLPLVMEAIGEPAR

SEQ ID NO: 1357285 - protein, 18 aa, Mycobacterium
MDDFAAAGFLEPLNDRIS

SEQ ID NO: 1357286 - protein, 22 aa, Mycobacterium
MDVSGFLMMSHLAEPSHLAAQA

SEQ ID NO: 1357287 - protein, 17 aa, Mycobacterium
MGPMQFLPGTWARYASD

SEQ ID NO: 1357288 - protein, 18 aa, Mycobacterium
MLARIAALLRQAEGTDNV

SEQ ID NO: 1357289 - protein, 18 aa, Mycobacterium
MPVLIAGEYVGALDLFRT

SEQ ID NO: 1357290 - protein, 32 aa, Mycobacterium; identical to SEQ ID NO: 1321960

SEQ ID NO: 1357291 - protein, 24 aa, Mycobacterium
MRLIDFTHRLVPPDQIKSAGFDGA

SEQ ID NO: 1357292 - protein, 25 aa, Mycobacterium
MSPEEARFILDRLTPGLSQIFGMAE

SEQ ID NO: 1357293 - protein, 26 aa, Mycobacterium
NAARLGLQDVIWRGTYYTPAGPQASG

SEQ ID NO: 1357294 - protein, 18 aa, Mycobacterium
NFLAMTATLAGSTVLAGC

SEQ ID NO: 1357295 - protein, 24 aa, Mycobacterium
NGENARWFYDFSVPGDVVEVRNTG

SEQ ID NO: 1357296 - protein, 18 aa, Mycobacterium
NGGIGGFTGFDYGTGGKG

SEQ ID NO: 1357297 - protein, 26 aa, Mycobacterium
NGGTGGFGGLFGTSPGYGGDGHNGGN

SEQ ID NO: 1357298 - protein, 18 aa, Mycobacterium
NGYMLLGLQIDGLASRYR

SEQ ID NO: 1357299 - protein, 20 aa, Mycobacterium
NIEYSFFQSGSDVASALFAG

SEQ ID NO: 1357300 - protein, 19 aa, Mycobacterium
NTGSYNVGFFNTGEFNFGV

SEQ ID NO: 1357301 - protein, 25 aa, Mycobacterium
NTPVATVPIGIFSGPGSPGGGPLDI

SEQ ID NO: 1357302 - protein, 26 aa, Mycobacterium
NTYKKSLWCGIGGLIPFAKSGPQYSG

SEQ ID NO: 1357303 - protein, 22 aa, Mycobacterium
NVANCVLAAALLDAVDVSPEQA

SEQ ID NO: 1357304 - protein, 20 aa, Mycobacterium
NVFINYPREFGIMTGLGSHT

SEQ ID NO: 1357305 - protein, 19 aa, Mycobacterium
NVGFFNTGEFNFGVGNTGV

SEQ ID NO: 1357306 - protein, 26 aa, Mycobacterium
NVGPTPLVLQVLYINPAGAPLADDAP

SEQ ID NO: 1357307 - protein, 24 aa, Mycobacterium
NVLSRYPDIKVLAIDTANWKRDEA

SEQ ID NO: 1357308 - protein, 19 aa, Mycobacterium
NVVPLYRRNTLGESQVLAL

SEQ ID NO: 1357309 - protein, 18 aa, Mycobacterium
PAAFYRHFDSMEALGLVL

SEQ ID NO: 1357310 - protein, 30 aa, Mycobacterium
PAALTDLDYYHVFLGLLGPADVKGQRATQQ

SEQ ID NO: 1357311 - protein, 17 aa, Mycobacterium
PADDPLALVPLLSRNDA

SEQ ID NO: 1357312 - protein, 20 aa, Mycobacterium
PALGILPNPLYGVPPGHWDD

SEQ ID NO: 1357313 - protein, 18 aa, Mycobacterium
PAPAAPLAPGLAPLPQPL

SEQ ID NO: 1357314 - protein, 30 aa, Mycobacterium
PAPPPPTYSVPSLPGLPGGPPPPIGQTVVE

SEQ ID NO: 1357315 - protein, 25 aa, Mycobacterium
PATLDSFRFRWTAEPGIDLLTGAAV

SEQ ID NO: 1357316 - protein, 22 aa, Mycobacterium
PAYDLIVVDNPWMDDFAAAGFL

SEQ ID NO: 1357317 - protein, 21 aa, Mycobacterium
PDMMAWTLAMGHAMIRAGLAI

SEQ ID NO: 1357318 - protein, 25 aa, Mycobacterium
PDMPQFAVAYWQTALGEMVRSPTWQ

SEQ ID NO: 1357319 - protein, 21 aa, Mycobacterium
PDMQSTLWIGPLGGRAAQALE

SEQ ID NO: 1357320 - protein, 17 aa, Mycobacterium
PEARAHWDLIAAKYAAP

SEQ ID NO: 1357321 - protein, 17 aa, Mycobacterium
PFARRAALKLPALLTAS

SEQ ID NO: 1357322 - protein, 27 aa, Mycobacterium
PGGKSALGLWSWAIPANSAAPDAAWAF

SEQ ID NO: 1357323 - protein, 19 aa, Mycobacterium
PGKGLSYACAAYGASVLVL

SEQ ID NO: 1357324 - protein, 17 aa, Mycobacterium
PGLVEGLVARAEEMRTG

SEQ ID NO: 1357325 - protein, 23 aa, Mycobacterium
PGMMGPWRYPAAPPPSCSAPALP

SEQ ID NO: 1357326 - protein, 19 aa, Mycobacterium
PGPFLSWAALIDSGGVAPE

SEQ ID NO: 1357327 - protein, 26 aa, Mycobacterium
PGYLKSIYDPYTLLDGRRYGLPYDGD

SEQ ID NO: 1357328 - protein, 24 aa, Mycobacterium
PHGMPLSGIAYLDGHRRVDATFRG

SEQ ID NO: 1357329 - protein, 29 aa, Mycobacterium
PHSRQLLAAQIIWTLNRAGINGPYVINAD

SEQ ID NO: 1357330 - protein, 26 aa, Mycobacterium
PHVLDGRLLADGGILDPLPMAPVAAV

SEQ ID NO: 1357331 - protein, 24 aa, Mycobacterium
PIPGVEHYVLVSGAPGPRDARGWE

SEQ ID NO: 1357332 - protein, 20 aa, Mycobacterium
PKNNFLAANVVPLVASQKKS

SEQ ID NO: 1357333 - protein, 19 aa, Mycobacterium
PLASLLQPIRLAGGAAGVR

SEQ ID NO: 1357334 - protein, 28 aa, Mycobacterium
PLRKNAPVKLVTYYTPYPATIVGGTEGG

SEQ ID NO: 1357335 - protein, 19 aa, Mycobacterium
PLVGRPFYVNPASKAMRAV

SEQ ID NO: 1357336 - protein, 27 aa, Mycobacterium
PMNRRRALTALAVGLVAPGALAACSRS

SEQ ID NO: 1357337 - protein, 17 aa, Mycobacterium
PPNCDRIPRSAWIAPTS

SEQ ID NO: 1357338 - protein, 18 aa, Mycobacterium
PPPPPAPVDPFAPPPPPA

SEQ ID NO: 1357339 - protein, 19 aa, Mycobacterium
PPRRTLRSIVFDDPAAVVL

SEQ ID NO: 1357340 - protein, 18 aa, Mycobacterium
PPSALTDVLYRLADPNVP

SEQ ID NO: 1357341 - protein, 28 aa, Mycobacterium
PPVAPPPPPPPPPPPPPPPAAPSIGADG

SEQ ID NO: 1357342 - protein, 23 aa, Mycobacterium
PQGDLVMRFIGHLGSHLDASDPA

SEQ ID NO: 1357343 - protein, 25 aa, Mycobacterium
PQPERVKITFWVDDKYQVPADAKAV

SEQ ID NO: 1357344 - protein, 19 aa, Mycobacterium
PRRRTLRRRPHPRGDRIDL

SEQ ID NO: 1357345 - protein, 18 aa, Mycobacterium
PRRVLGAVAGACAVLALS

SEQ ID NO: 1357346 - protein, 21 aa, Mycobacterium
PRRYMLGGRRVPVGELATLIG

SEQ ID NO: 1357347 - protein, 23 aa, Mycobacterium
PSTRFLDAISAPPITIGSLYADK

SEQ ID NO: 1357348 - protein, 20 aa, Mycobacterium
PSVAYRYPFAETEQAWIPIG

SEQ ID NO: 1357349 - protein, 27 aa, Mycobacterium
PTAPAPWVPPWMAPPPAPQPSCVVFCL

SEQ ID NO: 1357350 - protein, 24 aa, Mycobacterium
PTDNGAYIIGDRYSFLVMDSSTYG

SEQ ID NO: 1357351 - protein, 23 aa, Mycobacterium
PTGFKVLGDQTLLVAALANLVSN

SEQ ID NO: 1357352 - protein, 19 aa, Mycobacterium
PVAPVNTELARRLLVDAVA

SEQ ID NO: 1357353 - protein, 27 aa, Mycobacterium
PVGGQTWYKPFTPAPVTQAPPTATVPP

SEQ ID NO: 1357354 - protein, 19 aa, Mycobacterium
PVHLELMPDPHQWVEDFHA

SEQ ID NO: 1357355 - protein, 23 aa, Mycobacterium
PVHSTIGFSVRHLMVSKVRGTFD

SEQ ID NO: 1357356 - protein, 23 aa, Mycobacterium
PVLNQIPLLRDLLTQGLNVAGLN

SEQ ID NO: 1357357 - protein, 20 aa, Mycobacterium
PVLVGLRYRPGQTPLLAREW

SEQ ID NO: 1357358 - protein, 22 aa, Mycobacterium
PVRVEVSGGWFQRVALMNAQGK

SEQ ID NO: 1357359 - protein, 29 aa, Mycobacterium
PYDGDIHILFYNAELLDRYKVAPPTTWDE

SEQ ID NO: 1357360 - protein, 29 aa, Mycobacterium
QAALVVELLARLHARFWGRLSAPGQPGPF

SEQ ID NO: 1357361 - protein, 17 aa, Mycobacterium
QAPSMPPYQSAPGFWLR

SEQ ID NO: 1357362 - protein, 27 aa, Mycobacterium
QDAPLAWRTALWFWTTQKAAAAATPHD

SEQ ID NO: 1357363 - protein, 18 aa, Mycobacterium
QFMPATFAAYGAGGDITS

SEQ ID NO: 1357364 - protein, 22 aa, Mycobacterium
QFRDRLFGPVGLTQTSLPAADD

SEQ ID NO: 1357365 - protein, 31 aa, Mycobacterium; identical to SEQ ID NO: 1324134

SEQ ID NO: 1357366 - protein, 18 aa, Mycobacterium
QGKGRIAVVFGAGGNRDA

SEQ ID NO: 1357367 - protein, 19 aa, Mycobacterium
QIYIWYPDLVLPTVDSFVY

SEQ ID NO: 1357368 - protein, 24 aa, Mycobacterium
QKVTRELWPHPYLVMDTGYSLAPY

SEQ ID NO: 1357369 - protein, 21 aa, Mycobacterium
QLAPSPDPAPAAPPPIAVAEY

SEQ ID NO: 1357370 - protein, 25 aa, Mycobacterium
QLDVRIGLRHIDWSRRKLWQERLDA

SEQ ID NO: 1357371 - protein, 18 aa, Mycobacterium
QLDWLIEQARRHKVRKAV

SEQ ID NO: 1357372 - protein, 28 aa, Mycobacterium
QLFGNEYFHLLQLDPIDGGYRAYVCDGR

SEQ ID NO: 1357373 - protein, 19 aa, Mycobacterium
QLGSSPRVANAVRFAFWGS

SEQ ID NO: 1357374 - protein, 26 aa, Mycobacterium
QLRRWLTQLLVAERVVAAEAAALNVC

SEQ ID NO: 1357375 - protein, 17 aa, Mycobacterium
QPAPQRAAAPQGAAPAP

SEQ ID NO: 1357376 - protein, 19 aa, Mycobacterium
QQLERLTALLQPTEPGEVS

SEQ ID NO: 1357377 - protein, 19 aa, Mycobacterium
QQWDTFLNGVFPLDRNRLT

SEQ ID NO: 1357378 - protein, 18 aa, Mycobacterium
QRLGPLPGPAPEAPASTA

SEQ ID NO: 1357379 - protein, 17 aa, Mycobacterium
QVMHWRGETWQGGQLAT

SEQ ID NO: 1357380 - protein, 21 aa, Mycobacterium
QVPMILGCSYINRLTGYGGNL

SEQ ID NO: 1357381 - protein, 37 aa, Mycobacterium
QYEALTPRQREALAALPPAPAVPAPAAAPPANDPGVL

SEQ ID NO: 1357382 - protein, 33 aa, Mycobacterium
RAAFALVAAALLAAPFGLAWYLHVRGLQVSEQF

SEQ ID NO: 1357383 - protein, 17 aa, Mycobacterium
RAALRRLHATPTDASAR

SEQ ID NO: 1357384 - protein, 19 aa, Mycobacterium
RAARATLRLGWQALRQPAD

SEQ ID NO: 1357385 - protein, 24 aa, Mycobacterium
RALAVIVLAVVLLTACGVTRGNES

SEQ ID NO: 1357386 - protein, 25 aa, Mycobacterium
RANGGLFARLYPLAGLFGIDTVTPD

SEQ ID NO: 1357387 - protein, 22 aa, Mycobacterium
RASSLEWVVLRLGGVLSVDPKA

SEQ ID NO: 1357388 - protein, 31 aa, Mycobacterium
RDFNALNITLPMPRGWAYIPDPNVPEAFAVI

SEQ ID NO: 1357389 - protein, 22 aa, Mycobacterium
RDIAVIQLLGAGGLPVAPIGDS

SEQ ID NO: 1357390 - protein, 19 aa, Mycobacterium
RDSLGRTLDTLPAALDVLN

SEQ ID NO: 1357391 - protein, 28 aa, Mycobacterium
RDVGGPPAVTAFARWIGDPRSRLDRYEI

SEQ ID NO: 1357392 - protein, 20 aa, Mycobacterium
REAHLRSAVPAAALPRPGTS

SEQ ID NO: 1357393 - protein, 20 aa, Mycobacterium
RERFAVRISNNGEFIHANPA

SEQ ID NO: 1357394 - protein, 22 aa, Mycobacterium
RFATYVADRYGPERLRALYLRA

SEQ ID NO: 1357395 - protein, 20 aa, Mycobacterium
RFGMPKVLAHQGEWLRLAVD

SEQ ID NO: 1357396 - protein, 32 aa, Mycobacterium; identical to SEQ ID NO: 1325181

SEQ ID NO: 1357397 - protein, 22 aa, Mycobacterium
RGDAVRVFTPRPEPREVGLAAQ

SEQ ID NO: 1357398 - protein, 25 aa, Mycobacterium
RGEVWPLKHWDGNVFTFSFVSENSP

SEQ ID NO: 1357399 - protein, 24 aa, Mycobacterium
RGGRGGLFVGNGGAGGAGAAGVAG

SEQ ID NO: 1357400 - protein, 19 aa, Mycobacterium
RGHGAVKRLLLGSVTTGLL

SEQ ID NO: 1357401 - protein, 24 aa, Mycobacterium
RGLSAPLNIPYKVAFVLDVAGDNE

SEQ ID NO: 1357402 - protein, 18 aa, Mycobacterium
RGPQAIEYVIRRGASQMG

SEQ ID NO: 1357403 - protein, 30 aa, Mycobacterium
RGVLHGIAAALPIFRRQGHGHFVTTVSTAG

SEQ ID NO: 1357404 - protein, 29 aa, Mycobacterium
RGYFTANPQEYYELRGILAPIGDTQRQCN

SEQ ID NO: 1357405 - protein, 26 aa, Mycobacterium
RHDIRPLFVLFDSCWDPLPRLGRQRP

SEQ ID NO: 1357406 - protein, 24 aa, Mycobacterium
RHVDLVLWYEDFAAPPPVSGVTKV

SEQ ID NO: 1357407 - protein, 24 aa, Mycobacterium
RKDTVIVLPMQELTVALAADNPGV

SEQ ID NO: 1357408 - protein, 29 aa, Mycobacterium
RLESLRGAEFDRLWLESMISHHQGAVEMA

SEQ ID NO: 1357409 - protein, 21 aa, Mycobacterium
RLLKEQFYSTAWDTLDPLALL

SEQ ID NO: 1357410 - protein, 20 aa, Mycobacterium
RLPELTASTLHRLLQRRRDN

SEQ ID NO: 1357411 - protein, 31 aa, Mycobacterium
RLVNLPPSVSYSFRSLARGPQAEALILGTDG

SEQ ID NO: 1357412 - protein, 21 aa, Mycobacterium
RMGIGAADLKHRHPRVIPVEI

SEQ ID NO: 1357413 - protein, 25 aa, Mycobacterium
RNCLRPPLSPLSRSAIALLDERLAE

SEQ ID NO: 1357414 - protein, 34 aa, Mycobacterium; identical to SEQ ID NO: 1325747

SEQ ID NO: 1357415 - protein, 21 aa, Mycobacterium
RPDLTIPRRFLPGLSDDQLLR

SEQ ID NO: 1357416 - protein, 20 aa, Mycobacterium
RPGRRTELYWAARLTLVNRA

SEQ ID NO: 1357417 - protein, 22 aa, Mycobacterium
RPGWRTDFLTQMGFTVADPGDP

SEQ ID NO: 1357418 - protein, 31 aa, Mycobacterium
RPRRQRAWWAGMLVVPAMVLGLTSCSSDSEE

SEQ ID NO: 1357419 - protein, 34 aa, Mycobacterium
RPRRVLLALLLAEFVSAVLMLDRSQPPAAPPMAA

SEQ ID NO: 1357420 - protein, 31 aa, Mycobacterium
RPTPTITARLNFQLAFGARIGVRLTEAREEA

SEQ ID NO: 1357421 - protein, 21 aa, Mycobacterium
RQVFKTLVIAVPKGLAVAVLP

SEQ ID NO: 1357422 - protein, 17 aa, Mycobacterium
RRAALKLPALLTASAAA

SEQ ID NO: 1357423 - protein, 24 aa, Mycobacterium
RRALQLLGLAGGAALLGPALAACG

SEQ ID NO: 1357424 - protein, 20 aa, Mycobacterium
RRDTRLTPLTIRLMHIMSPM

SEQ ID NO: 1357425 - protein, 27 aa, Mycobacterium
RRKTEVDFMLAPYLAAAQELGMDVPTL

SEQ ID NO: 1357426 - protein, 34 aa, Mycobacterium
RRLEPYQLVTTGRRWYLLGYDRDKQDWRSLRLDR

SEQ ID NO: 1357427 - protein, 24 aa, Mycobacterium
RRLLLWSAPLTLAVILVAVKLLSV

SEQ ID NO: 1357428 - protein, 23 aa, Mycobacterium
RRLRRVPLAVLAVAGLVGGMCWS

SEQ ID NO: 1357429 - protein, 26 aa, Mycobacterium
RSFGDGFSILGWASNTAPPPGWTGST

SEQ ID NO: 1357430 - protein, 24 aa, Mycobacterium
RSSPYLIGALKLMLTAPFSIENVP

SEQ ID NO: 1357431 - protein, 22 aa, Mycobacterium
RTLTVAALLCAGLLTGCTQTVT

SEQ ID NO: 1357432 - protein, 20 aa, Mycobacterium
RVREPGLTLLVPVADRLQKV

SEQ ID NO: 1357433 - protein, 23 aa, Mycobacterium
SAGSKPLMMWCDMAAMMQSMSMS

SEQ ID NO: 1357434 - protein, 23 aa, Mycobacterium
SAKLCVQYLAPIIKNRQYNFPPI

SEQ ID NO: 1357435 - protein, 26 aa, Mycobacterium
SALAIAAAPALFFVAAPSGGSTITYT

SEQ ID NO: 1357436 - protein, 25 aa, Mycobacterium
SAQKLATIFMAGLVAPATAAINQIL

SEQ ID NO: 1357437 - protein, 25 aa, Mycobacterium
SATTRRRLFDQLQPIRRTTSPVANR

SEQ ID NO: 1357438 - protein, 22 aa, Mycobacterium
SAVTAGLAACGLAFALTACGSG

SEQ ID NO: 1357439 - protein, 20 aa, Mycobacterium
SDDGLIQTYRITPDTHAVTT

SEQ ID NO: 1357440 - protein, 24 aa, Mycobacterium
SDRDNEYLTHWLDQGYAVVATDYA

SEQ ID NO: 1357441 - protein, 27 aa, Mycobacterium
SDRRPGGAWMLGKPILLSEARDLYQNG

SEQ ID NO: 1357442 - protein, 22 aa, Mycobacterium
SDSGLLFLAYQRDPASQFVPAQ

SEQ ID NO: 1357443 - protein, 24 aa, Mycobacterium
SEDWMRPDYVPPQPTLPAATGADP

SEQ ID NO: 1357444 - protein, 35 aa, Mycobacterium
SELLPMALRLERFAVWLIFELLAVTLVDAKPLSRV

SEQ ID NO: 1357445 - protein, 22 aa, Mycobacterium
SFDVVDGWRRPDGPVAPLDQVA

SEQ ID NO: 1357446 - protein, 28 aa, Mycobacterium
SFNLNLNLPPPCTTGFLPVDQQLAPNVE

SEQ ID NO: 1357447 - protein, 22 aa, Mycobacterium
SGLTAAFLGLAAPAQAAPAGPG

SEQ ID NO: 1357448 - protein, 23 aa, Mycobacterium
SGPAQLLYLGRLEYEKGVHDLIA

SEQ ID NO: 1357449 - protein, 25 aa, Mycobacterium
SGQFAKIPFILTGAVGDLYSYLAIR

SEQ ID NO: 1357450 - protein, 18 aa, Mycobacterium
SGVEQLIFAPRGPLAAPP

SEQ ID NO: 1357451 - protein, 26 aa, Mycobacterium
SKRDVMMIHTLLWPDEIRDPDFPVLD

SEQ ID NO: 1357452 - protein, 17 aa, Mycobacterium
SLHPYVDWATVRAPAEE

SEQ ID NO: 1357453 - protein, 22 aa, Mycobacterium
SMEALGLVLIDESFRVLRDLLR

SEQ ID NO: 1357454 - protein, 23 aa, Mycobacterium
SMVSLTLMARLLEAVRPDSRLLL

SEQ ID NO: 1357455 - protein, 20 aa, Mycobacterium
SPGLYVSFNLNLNLPPPCTT

SEQ ID NO: 1357456 - protein, 25 aa, Mycobacterium
SPPSVWFHELLRPDGQPYRDSEVRT

SEQ ID NO: 1357457 - protein, 34 aa, Mycobacterium
SREIEVLEFVPASDLDPLMYDRSYFLEPDGKSSK

SEQ ID NO: 1357458 - protein, 26 aa, Mycobacterium
SRLHWRSKEYFAPGTTVRVDARFYGV

SEQ ID NO: 1357459 - protein, 30 aa, Mycobacterium
SRYLTNVKVPLQPGVPWVFQTTLDDPTQWA

SEQ ID NO: 1357460 - protein, 33 aa, Mycobacterium
SSDDPPLRRPDLLRVFLLGELTPVAARRYAAAF

SEQ ID NO: 1357461 - protein, 29 aa, Mycobacterium
SSEPPPPPLPAKPFPKACPAPGVMQGCLE

SEQ ID NO: 1357462 - protein, 19 aa, Mycobacterium
SSMRAGLPPGWTTADKTGS

SEQ ID NO: 1357463 - protein, 17 aa, Mycobacterium
SSSLPTLFRNADGYRRR

SEQ ID NO: 1357464 - protein, 27 aa, Mycobacterium
STLHLGTFVLNAGFYRPALLARDAAAL

SEQ ID NO: 1357465 - protein, 17 aa, Mycobacterium
STSGLIMLPDSQSALVA

SEQ ID NO: 1357466 - protein, 27 aa, Mycobacterium
SVAPESLRFGLYGALVHPIEANGLGSC

SEQ ID NO: 1357467 - protein, 34 aa, Mycobacterium
SVLRYPSVGILHELPQRALWFSVPDMSGAFHISL

SEQ ID NO: 1357468 - protein, 17 aa, Mycobacterium
SYLGSVIHDVAPAGTRS

SEQ ID NO: 1357469 - protein, 24 aa, Mycobacterium
TAQPAVAPPPPAPAAPLAPGLAPL

SEQ ID NO: 1357470 - protein, 18 aa, Mycobacterium
TARFGTYMVIVTANPLVI

SEQ ID NO: 1357471 - protein, 19 aa, Mycobacterium
TAVTPIYGPALDGTLAGNE

SEQ ID NO: 1357472 - protein, 34 aa, Mycobacterium
TDILIKNPVGQLPLTRPLLDLGVPPEIVRALDPL

SEQ ID NO: 1357473 - protein, 17 aa, Mycobacterium
TDRLRFVAPADFTEIGS

SEQ ID NO: 1357474 - protein, 26 aa, Mycobacterium
TDSDLLTSILTYHVVPGQAAPDQVPG

SEQ ID NO: 1357475 - protein, 25 aa, Mycobacterium
TDVTMIACLMTEYYVVVTGAGSPYK

SEQ ID NO: 1357476 - protein, 33 aa, Mycobacterium
TDVTTPDAVILGLLRALPGDLSILYPSPAEDKD

SEQ ID NO: 1357477 - protein, 20 aa, Mycobacterium
TELYWAARLTLVNRADDLET

SEQ ID NO: 1357478 - protein, 30 aa, Mycobacterium; identical to SEQ ID NO: 1327999

SEQ ID NO: 1357479 - protein, 31 aa, Mycobacterium; identical to SEQ ID NO: 1328002

SEQ ID NO: 1357480 - protein, 26 aa, Mycobacterium
TGEFDVFDYFYFGLGDLVDAGALTDL

SEQ ID NO: 1357481 - protein, 19 aa, Mycobacterium
TGEFLTYYGKFSDEILLPA

SEQ ID NO: 1357482 - protein, 33 aa, Mycobacterium; identical to SEQ ID NO: 1328072

SEQ ID NO: 1357483 - protein, 27 aa, Mycobacterium
TGHPQVDAFLWVKRPGESDGSCGGGAP

SEQ ID NO: 1357484 - protein, 18 aa, Mycobacterium
TGHRRLALIVAGVAACFA

SEQ ID NO: 1357485 - protein, 23 aa, Mycobacterium
TGRTALPGFGRHLQLARPGGPVL

SEQ ID NO: 1357486 - protein, 21 aa, Mycobacterium
TGRTGLGPYATRPADVGTAVY

SEQ ID NO: 1357487 - protein, 17 aa, Mycobacterium
TGTPNLGYGNKGLFNAG

SEQ ID NO: 1357488 - protein, 31 aa, Mycobacterium
TISLQFRGAFAERVTLTLLSPRAGLVVDPGA

SEQ ID NO: 1357489 - protein, 23 aa, Mycobacterium
TKIERRGWHALLTLALNGDVDLP

SEQ ID NO: 1357490 - protein, 24 aa, Mycobacterium
TKKLPSWKVVVPPGQAVAGYYYQA

SEQ ID NO: 1357491 - protein, 20 aa, Mycobacterium
TLFTIMVYGVFQLARRTAPE

SEQ ID NO: 1357492 - protein, 19 aa, Mycobacterium
TLPVLLANLVSVGEVAVVY

SEQ ID NO: 1357493 - protein, 26 aa, Mycobacterium
TMEETALWLELTYDGTTPVVLTGAQR

SEQ ID NO: 1357494 - protein, 24 aa, Mycobacterium
TMVDQMVAQWPLLQSPDCGQRVRE

SEQ ID NO: 1357495 - protein, 18 aa, Mycobacterium
TNWPGPTLVYRLLTRKPH

SEQ ID NO: 1357496 - protein, 20 aa, Mycobacterium
TPNLGYGNKGLFNAGVNNDG

SEQ ID NO: 1357497 - protein, 23 aa, Mycobacterium
TRGHAWALALSADGNVWGATVNK

SEQ ID NO: 1357498 - protein, 26 aa, Mycobacterium
TRGLRTYVQLFVVIAAANDVKCDVAS

SEQ ID NO: 1357499 - protein, 23 aa, Mycobacterium
TRKFGLAGLLGYAVYLAGNTVRK

SEQ ID NO: 1357500 - protein, 22 aa, Mycobacterium
TTDGWRIDRLPNGVFLDWQQFQ

SEQ ID NO: 1357501 - protein, 24 aa, Mycobacterium
TTGAALQIVTLFGLAYATDSHLPG

SEQ ID NO: 1357502 - protein, 19 aa, Mycobacterium
TTLLLPGVGTVRELEHAYK

SEQ ID NO: 1357503 - protein, 28 aa, Mycobacterium
TTNTQLLWYRADLIPQPPTTWDGMVAEA

SEQ ID NO: 1357504 - protein, 19 aa, Mycobacterium
TVELARRIVLATGMQYRLQ

SEQ ID NO: 1357505 - protein, 23 aa, Mycobacterium
TVGRTIAYAWLPAGADTGDRVTV

SEQ ID NO: 1357506 - protein, 25 aa, Mycobacterium
TVQAVASGLYPSAPVLSPDGTRLYV

SEQ ID NO: 1357507 - protein, 18 aa, Mycobacterium
TVRIGYQSPNARLAATVG

SEQ ID NO: 1357508 - protein, 21 aa, Mycobacterium
TVRNLLGAPLTLRGPVTRADG

SEQ ID NO: 1357509 - protein, 23 aa, Mycobacterium
TVRVDARFYGVKFGEDAYGAADS

SEQ ID NO: 1357510 - protein, 18 aa, Mycobacterium
TVTPTPIVPIQGAPGAGT

SEQ ID NO: 1357511 - protein, 18 aa, Mycobacterium
TVYYPLVSTPMIAPTQAY

SEQ ID NO: 1357512 - protein, 17 aa, Mycobacterium
TWGGVYVHGAPWSTGSQ

SEQ ID NO: 1357513 - protein, 22 aa, Mycobacterium
TYHLRGDRQVFCRNGTVACSPA

SEQ ID NO: 1357514 - protein, 25 aa, Mycobacterium
VAACFAQMLVAAPTAGAAGPVVLGG

SEQ ID NO: 1357515 - protein, 17 aa, Mycobacterium
VAAFGLSLGLSGCGSDN

SEQ ID NO: 1357516 - protein, 17 aa, Mycobacterium
VAAGWTDGPPPGKKPFG

SEQ ID NO: 1357517 - protein, 27 aa, Mycobacterium
VAAVAAPLAALLAPLAPAGADPGVLVS

SEQ ID NO: 1357518 - protein, 25 aa, Mycobacterium
VADQVGLPDLPWRDPEAWLTAVRAS

SEQ ID NO: 1357519 - protein, 28 aa, Mycobacterium
VAFAKALTQQLFWLAGPQVAAVATELVN

SEQ ID NO: 1357520 - protein, 22 aa, Mycobacterium
VAHHNILFGGAWEQTFRDIIDE

SEQ ID NO: 1357521 - protein, 21 aa, Mycobacterium
VAMPLTVRFAAPVDNRFAAQR

SEQ ID NO: 1357522 - protein, 26 aa, Mycobacterium
VAQADDFVAPRFLPQDPDYAALTCEA

SEQ ID NO: 1357523 - protein, 22 aa, Mycobacterium
VARWVAPFLTVAAVAGTAAVAE

SEQ ID NO: 1357524 - protein, 27 aa, Mycobacterium
VCVDLGLPHLLLARPAWSAGDAILVSS

SEQ ID NO: 1357525 - protein, 20 aa, Mycobacterium
VDALTITFEPARPPQLDFDA

SEQ ID NO: 1357526 - protein, 18 aa, Mycobacterium
VDFGQLFSATALMPSHVL

SEQ ID NO: 1357527 - protein, 28 aa, Mycobacterium
VDGTTYGVPFYNYALGYIYNKPDLQAAN

SEQ ID NO: 1357528 - protein, 17 aa, Mycobacterium
VDMSVRLGLRSYALPGT

SEQ ID NO: 1357529 - protein, 26 aa, Mycobacterium
VDSPLMSELVPRLLFVHAHPDDETLT

SEQ ID NO: 1357530 - protein, 31 aa, Mycobacterium
VDVKLTKPITNGLTYPFTFAFERSGEVTVQV

SEQ ID NO: 1357531 - protein, 29 aa, Mycobacterium
VEKPNSGWLYTWALGIPKGAKNPDGAWEF

SEQ ID NO: 1357532 - protein, 18 aa, Mycobacterium
VERPAPPSLPKPTPGMDP

SEQ ID NO: 1357533 - protein, 26 aa, Mycobacterium
VESPATWAVLAWARRQPFSTTTAANT

SEQ ID NO: 1357534 - protein, 19 aa, Mycobacterium
VFPQPPVPGPVAVSVAPAA

SEQ ID NO: 1357535 - protein, 29 aa, Mycobacterium
VGAGGSVRFPLNPFMGMMGVAFARDESLN

SEQ ID NO: 1357536 - protein, 17 aa, Mycobacterium
VGAPPAPPAPPAAAVQP

SEQ ID NO: 1357537 - protein, 19 aa, Mycobacterium
VGMIHGAYTEGLPTCVVKY

SEQ ID NO: 1357538 - protein, 17 aa, Mycobacterium
VGTGRTGLGPYATRPAD

SEQ ID NO: 1357539 - protein, 20 aa, Mycobacterium
VHRAKLTTLLLPGVGTVREL

SEQ ID NO: 1357540 - protein, 20 aa, Mycobacterium
VILASPDGRYVYTETFASGS

SEQ ID NO: 1357541 - protein, 20 aa, Mycobacterium
VIPDKPVAPVNTELARRLLV

SEQ ID NO: 1357542 - protein, 26 aa, Mycobacterium
VLDALPHGYVVRTAWVYEGADGTDFV

SEQ ID NO: 1357543 - protein, 17 aa, Mycobacterium
VLGVSRVAYTGEAFTMM

SEQ ID NO: 1357544 - protein, 18 aa, Mycobacterium
VLIDLGRVNHVNAEGSNF

SEQ ID NO: 1357545 - protein, 19 aa, Mycobacterium
VLIIGGGFGGLFCARRLSR

SEQ ID NO: 1357546 - protein, 29 aa, Mycobacterium
VLNRLELAPAILVGWSFGGSLALGVARRY

SEQ ID NO: 1357547 - protein, 19 aa, Mycobacterium
VLRAIALSTFAGAAAVGAI

SEQ ID NO: 1357548 - protein, 25 aa, Mycobacterium
VLSAVIAFRDPLFSEGDLFAALDEH

SEQ ID NO: 1357549 - protein, 25 aa, Mycobacterium
VLTDDMLHSWFLDPAIIAPGAPEVR

SEQ ID NO: 1357550 - protein, 37 aa, Mycobacterium; identical to SEQ ID NO: 1329809

SEQ ID NO: 1357551 - protein, 21 aa, Mycobacterium
VLTVALVALLAAGAAVIVRQE

SEQ ID NO: 1357552 - protein, 26 aa, Mycobacterium
VLVSFAGTVRRPLGLRKVATEDLDGF

SEQ ID NO: 1357553 - protein, 24 aa, Mycobacterium
VMQLNYYAPLRLIRGLAPGMIERG

SEQ ID NO: 1357554 - protein, 26 aa, Mycobacterium
VMRRVPLVLVNVLATDVTAAWAMAVP

SEQ ID NO: 1357555 - protein, 18 aa, Mycobacterium
VMVSNFRIKIDGCVGQSF

SEQ ID NO: 1357556 - protein, 17 aa, Mycobacterium
VNEIAILQILNGPPPGG

SEQ ID NO: 1357557 - protein, 18 aa, Mycobacterium
VNLLDPFRRIGTSADNLV

SEQ ID NO: 1357558 - protein, 18 aa, Mycobacterium
VPARIRGHDYRRAAFGDA

SEQ ID NO: 1357559 - protein, 19 aa, Mycobacterium
VPCRVMAFDVLRLDGRDTT

SEQ ID NO: 1357560 - protein, 24 aa, Mycobacterium
VPLDAIVTPPLFPGVSISADLGNG

SEQ ID NO: 1357561 - protein, 17 aa, Mycobacterium
VPVAVKQGWMCCVGSDW

SEQ ID NO: 1357562 - protein, 21 aa, Mycobacterium
VPVITWEPWLWRTDVTVAGAE

SEQ ID NO: 1357563 - protein, 21 aa, Mycobacterium
VPVRWRAMLHGWPGMTGRGLV

SEQ ID NO: 1357564 - protein, 30 aa, Mycobacterium
VQDIVDHGLPRPTLFAFPFSDGYDDDRASS

SEQ ID NO: 1357565 - protein, 17 aa, Mycobacterium
VQQLPPVVKAFGSVVFD

SEQ ID NO: 1357566 - protein, 24 aa, Mycobacterium
VRFAVAFFGLLRAGAVPVMCLPGH

SEQ ID NO: 1357567 - protein, 29 aa, Mycobacterium
VRIVFAATFVWIALLQYGLFAIDRMEPYP

SEQ ID NO: 1357568 - protein, 25 aa, Mycobacterium
VRRRDYAYALDWPGESPLRRSYERV

SEQ ID NO: 1357569 - protein, 17 aa, Mycobacterium
VRTMAAIRWIQRGYRTP

SEQ ID NO: 1357570 - protein, 22 aa, Mycobacterium
VSPPTVLRFAHSLGFEGFADLQ

SEQ ID NO: 1357571 - protein, 19 aa, Mycobacterium
VSSTRPHARRRTMAAAGLS

SEQ ID NO: 1357572 - protein, 24 aa, Mycobacterium
VSTAYYENKLPAGAPVIRAMPNAP

SEQ ID NO: 1357573 - protein, 19 aa, Mycobacterium
VSVAVGCACGVLFGAAPSH

SEQ ID NO: 1357574 - protein, 27 aa, Mycobacterium
VSVGLGPAWKVLRDLPLRPGDRHTVTM

SEQ ID NO: 1357575 - protein, 25 aa, Mycobacterium
VTADPRRIVVLSGDQLDALCALGLQ

SEQ ID NO: 1357576 - protein, 26 aa, Mycobacterium
VTADQIPPGYIPPAGITGPMAPEIAD

SEQ ID NO: 1357577 - protein, 18 aa, Mycobacterium
VTCDDLVLAWASQSGRFP

SEQ ID NO: 1357578 - protein, 20 aa, Mycobacterium
VTISILPDEAAAKAALDASL

SEQ ID NO: 1357579 - protein, 26 aa, Mycobacterium
VTLANSIRPWAPPPPPPPPAPGDPNV

SEQ ID NO: 1357580 - protein, 36 aa, Mycobacterium; identical to SEQ ID NO: 952193

SEQ ID NO: 1357581 - protein, 20 aa, Mycobacterium
VVMTVLTWRLDMDALAATAE

SEQ ID NO: 1357582 - protein, 21 aa, Mycobacterium
VVMVLFTAALVAIFGQYRAGS

SEQ ID NO: 1357583 - protein, 30 aa, Mycobacterium
VVYNDGGQDLLLWVQPPPSSTSSSTPRSSS

SEQ ID NO: 1357584 - protein, 18 aa, Mycobacterium
VYLPGLPVVPRQVSYLPS

SEQ ID NO: 1357585 - protein, 23 aa, Mycobacterium
VYQPAIEQVLVLEPQLVASLQGA

SEQ ID NO: 1357586 - protein, 19 aa, Mycobacterium
WALLLLGALTGCATTVTGN

SEQ ID NO: 1357587 - protein, 34 aa, Mycobacterium
WANYVALDLGPWLLNWVPLGYLISDQIYIWYPDL

SEQ ID NO: 1357588 - protein, 17 aa, Mycobacterium
WDSWKKPYTEPPDPWFS

SEQ ID NO: 1357589 - protein, 25 aa, Mycobacterium
WFGGEPFGVWPWARGQLGPAQPTVL

SEQ ID NO: 1357590 - protein, 18 aa, Mycobacterium
WGPPPPLHWRGHPPQFID

SEQ ID NO: 1357591 - protein, 17 aa, Mycobacterium
WGRLVFCGSPRRYEPRW

SEQ ID NO: 1357592 - protein, 17 aa, Mycobacterium
WLLVFAVAASGCAGVPN

SEQ ID NO: 1357593 - protein, 21 aa, Mycobacterium
WSRTFIAGCALAMTMSSVGVV

SEQ ID NO: 1357594 - protein, 22 aa, Mycobacterium
WTDYQAGVFIGAATGAFCPQFE

SEQ ID NO: 1357595 - protein, 28 aa, Mycobacterium
YADGDIWDWAVPWEEWKSMSALSDQASP

SEQ ID NO: 1357596 - protein, 24 aa, Mycobacterium
YAQPVYDPALARPGIHFDPEPVED

SEQ ID NO: 1357597 - protein, 29 aa, Mycobacterium
YCVVDARAWLRDPTPLWRTNVEGLQRVLD

SEQ ID NO: 1357598 - protein, 21 aa, Mycobacterium
YEGLMVWFNTLLESAGGQVLS

SEQ ID NO: 1357599 - protein, 27 aa, Mycobacterium
YFGIPTTWLPPNYWGPPLRVVFNPNVT

SEQ ID NO: 1357600 - protein, 23 aa, Mycobacterium
YGEQQVVPFFLGPQGIADAIRAA

SEQ ID NO: 1357601 - protein, 29 aa, Mycobacterium
YGLEPNGTMRPILRRRVITGLTVAQFFPQ

SEQ ID NO: 1357602 - protein, 29 aa, Mycobacterium
YGPAMLDMRIRGVFAMPVLIAGEYVGALD

SEQ ID NO: 1357603 - protein, 21 aa, Mycobacterium
YNKALQILRAQGVKATFGGSF

SEQ ID NO: 1357604 - protein, 18 aa, Mycobacterium
YQAGDPIYVVGFSQGANA

SEQ ID NO: 1357605 - protein, 23 aa, Mycobacterium
YSHGAAIMLWVTMNVDNSHPELL

SEQ ID NO: 1357606 - protein, 24 aa, Mycobacterium
YTEPPDPWFSDLLHPDGRPYDEDE

SEQ ID NO: 1357607 - protein, 24 aa, Mycobacterium
YTYQWETFLTSELPAYLAANKGIS

SEQ ID NO: 1357608 - protein, 17 aa, Mycobacterium
YVKHTVPRWEPCPDGTA

SEQ ID NO: 1357609 - protein, 24 aa, Mycobacterium
AAADDVRLGWPLKPSPTVVRQFDA

SEQ ID NO: 1357610 - protein, 22 aa, Mycobacterium
AAADMLVRAWVRSYRVAATISN

SEQ ID NO: 1357611 - protein, 23 aa, Mycobacterium
AAAGLVTYLPPAPAATATWAGRH

SEQ ID NO: 1357612 - protein, 20 aa, Mycobacterium
AAAPLGVLLDYAAGVLKATD

SEQ ID NO: 1357613 - protein, 25 aa, Mycobacterium
AAAPLRVHPDIHLFPAIPQQRSSTA

SEQ ID NO: 1357614 - protein, 21 aa, Mycobacterium
AAAQLPRRWIAVGVAAADGVH

SEQ ID NO: 1357615 - protein, 22 aa, Mycobacterium
AADFVSYPAAVGDLICTMHRFR

SEQ ID NO: 1357616 - protein, 22 aa, Mycobacterium
AADLAALAAAARIASGARSACA

SEQ ID NO: 1357617 - protein, 32 aa, Mycobacterium
AADLPGTQWQHRRFWRTPTPPPNTRALHDPSS

SEQ ID NO: 1357618 - protein, 24 aa, Mycobacterium
AADPNWWVPAPPPPGHIGQIVNVP

SEQ ID NO: 1357619 - protein, 23 aa, Mycobacterium
AAEDRIHWFYSLDAVGRRQYSEN

SEQ ID NO: 1357620 - protein, 24 aa, Mycobacterium
AAEIAEIIGLFRAAARRAVDAGMD

SEQ ID NO: 1357621 - protein, 30 aa, Mycobacterium
AAEKPAEGDWLYFVTIDLQGTTLFTRDYNE

SEQ ID NO: 1357622 - protein, 17 aa, Mycobacterium
AAEMRGIRQPLVDFRNR

SEQ ID NO: 1357623 - protein, 24 aa, Mycobacterium
AAEQGWWWFWGPGPGEDGPTTFFE

SEQ ID NO: 1357624 - protein, 29 aa, Mycobacterium
AAFENSWRVNCLGPFLGIQAVLEHLKAAD

SEQ ID NO: 1357625 - protein, 25 aa, Mycobacterium
AAGALSGYRAGLLASIAAACTAAYS

SEQ ID NO: 1357626 - protein, 25 aa, Mycobacterium
AAGSGVLSWWVQYRGQAAGDPCVDA

SEQ ID NO: 1357627 - protein, 19 aa, Mycobacterium
AAHAAAPWLVVWDDHELDN

SEQ ID NO: 1357628 - protein, 21 aa, Mycobacterium
AAIAALVLPSSFRPIPDPNTP

SEQ ID NO: 1357629 - protein, 22 aa, Mycobacterium
AAICVLAPVGAMPRAVAQPAPE

SEQ ID NO: 1357630 - protein, 24 aa, Mycobacterium
AAIDRYRYGLVPVALTEWLGYVWV

SEQ ID NO: 1357631 - protein, 24 aa, Mycobacterium
AAKHGVVGLMRSLAHDLAPHGIRV

SEQ ID NO: 1357632 - protein, 19 aa, Mycobacterium
AAKLFGFPTVIAHGMFSAA

SEQ ID NO: 1357633 - protein, 19 aa, Mycobacterium
AAKRIGFLDIRDAAKPVGL

SEQ ID NO: 1357634 - protein, 19 aa, Mycobacterium
AALATPLPQQPSQCDPNYS

SEQ ID NO: 1357635 - protein, 19 aa, Mycobacterium
AALQAYYENMPLRSSAMPR

SEQ ID NO: 1357636 - protein, 21 aa, Mycobacterium
AALSLPDRLLAAAVAYQSALE

SEQ ID NO: 1357637 - protein, 28 aa, Mycobacterium
AALVMELLARLHATFWGRLSAPGQPGPF

SEQ ID NO: 1357638 - protein, 19 aa, Mycobacterium
AAMRPKVAGTLILHELFPP

SEQ ID NO: 1357639 - protein, 25 aa, Mycobacterium
AAPLLGVLCSIGWQRGKPSVTVQAE

SEQ ID NO: 1357640 - protein, 17 aa, Mycobacterium
AAPWLPQAQPMAGDQIF

SEQ ID NO: 1357641 - protein, 20 aa, Mycobacterium
AAPWLVVWDDHELDNNWADE

SEQ ID NO: 1357642 - protein, 19 aa, Mycobacterium
AAPWPVFTDLSVAPGRDVP

SEQ ID NO: 1357643 - protein, 20 aa, Mycobacterium
AAPWPVFTDLSVAPGRDVPN

SEQ ID NO: 1357644 - protein, 20 aa, Mycobacterium
AAPWPVFTDLSVTPGRDVPN

SEQ ID NO: 1357645 - protein, 23 aa, Mycobacterium
AARSLLLAARRFAAPELAEDGKR

SEQ ID NO: 1357646 - protein, 21 aa, Mycobacterium
AASIVVGLLLGAAAVFGVTLM

SEQ ID NO: 1357647 - protein, 17 aa, Mycobacterium
AASMYMNGPSRALPLAR

SEQ ID NO: 1357648 - protein, 26 aa, Mycobacterium
AATFGTPQWFTDIGPDTLIIVDEAGM

SEQ ID NO: 1357649 - protein, 21 aa, Mycobacterium
AATLDIGMQLAAEAALAPLTT

SEQ ID NO: 1357650 - protein, 28 aa, Mycobacterium
AATLLAAADLWIFLTTAARYADAVPWNM

SEQ ID NO: 1357651 - protein, 30 aa, Mycobacterium; identical to SEQ ID NO: 1135725

SEQ ID NO: 1357652 - protein, 17 aa, Mycobacterium
AAVFLRELLAEDLQPVV

SEQ ID NO: 1357653 - protein, 17 aa, Mycobacterium
AAVSLPFRGLVTISPRF

SEQ ID NO: 1357654 - protein, 17 aa, Mycobacterium
AAWMSRNGPRFGLCQVY

SEQ ID NO: 1357655 - protein, 36 aa, Mycobacterium
AAWTAVLLALVLVAGAVFLVRKLYFGPNTITAYFPT

SEQ ID NO: 1357656 - protein, 25 aa, Mycobacterium
AAYGGLVPLFTPNPWRPGSSMSHVD

SEQ ID NO: 1357657 - protein, 23 aa, Mycobacterium
ACQFSIGGGLDYDKLEKAITDEL

SEQ ID NO: 1357658 - protein, 25 aa, Mycobacterium
ADAALRPLMNYYAGLRRDEWGFSGD

SEQ ID NO: 1357659 - protein, 23 aa, Mycobacterium
ADALNPWITPVGSAVFAIPPGAP

SEQ ID NO: 1357660 - protein, 17 aa, Mycobacterium
ADALTRLRGMFAFALWD

SEQ ID NO: 1357661 - protein, 19 aa, Mycobacterium
ADAPAPVKVGFRLGDPGPG

SEQ ID NO: 1357662 - protein, 25 aa, Mycobacterium
ADASAPLLKLIVDSAYYDGNPISSD

SEQ ID NO: 1357663 - protein, 30 aa, Mycobacterium
ADDAFTDPAPWPWYRRPGVVFAGAATLAAT

SEQ ID NO: 1357664 - protein, 25 aa, Mycobacterium
ADGYLRLREWLTKLYRTEFDGFIAN

SEQ ID NO: 1357665 - protein, 28 aa, Mycobacterium
ADIEPVLRIPRPEGWKRVTALDSGAIRY

SEQ ID NO: 1357666 - protein, 24 aa, Mycobacterium
ADLDAVPLWSIGWGLGVPSGTAAD

SEQ ID NO: 1357667 - protein, 26 aa, Mycobacterium
ADLLNLVAHVNSLVAYLYGYREQSEI

SEQ ID NO: 1357668 - protein, 31 aa, Mycobacterium
ADLVRPHGERLVFWDCYRPHAVQVRMFEMVP

SEQ ID NO: 1357669 - protein, 27 aa, Mycobacterium
ADMGRKFLTKLGILSPASAAADPGITN

SEQ ID NO: 1357670 - protein, 20 aa, Mycobacterium
ADMRASYDPLITLLEKETGS

SEQ ID NO: 1357671 - protein, 33 aa, Mycobacterium
ADNYRSRLITPGQRVLFWVSAHALRGFWGAGRI

SEQ ID NO: 1357672 - protein, 23 aa, Mycobacterium
ADPAPRKWWFTIGGAAQVGESLA

SEQ ID NO: 1357673 - protein, 26 aa, Mycobacterium
ADPESQLIAHLYAAALRFYGNPAHVQ

SEQ ID NO: 1357674 - protein, 17 aa, Mycobacterium
ADSHDICFIPSGDTRAF

SEQ ID NO: 1357675 - protein, 20 aa, Mycobacterium
ADSIRTIFGFGRAAAESQVS

SEQ ID NO: 1357676 - protein, 17 aa, Mycobacterium
ADSLGIGWLAEPFIDLA

SEQ ID NO: 1357677 - protein, 24 aa, Mycobacterium
ADTAFSAWLADRNAGRDSLLLGPT

SEQ ID NO: 1357678 - protein, 23 aa, Mycobacterium
ADTKTRAPMKTDFYSRIGSLTKT

SEQ ID NO: 1357679 - protein, 18 aa, Mycobacterium
ADTLLRPLGMGATSYRFS

SEQ ID NO: 1357680 - protein, 24 aa, Mycobacterium
ADTVAYLVNVTVRPGYNFANADHA

SEQ ID NO: 1357681 - protein, 31 aa, Mycobacterium; identical to SEQ ID NO: 1305590

SEQ ID NO: 1357682 - protein, 23 aa, Mycobacterium
ADVPPDVYGAIYLSAAKGTPNPP

SEQ ID NO: 1357683 - protein, 28 aa, Mycobacterium
AEADLNALFLPPAPAAPAAPAAPAAPAA

SEQ ID NO: 1357684 - protein, 18 aa, Mycobacterium
AEEEGLLGSRDYVTSLDA

SEQ ID NO: 1357685 - protein, 32 aa, Mycobacterium; identical to SEQ ID NO: 1310681

SEQ ID NO: 1357686 - protein, 36 aa, Mycobacterium; identical to SEQ ID NO: 1305612

SEQ ID NO: 1357687 - protein, 24 aa, Mycobacterium
AEKMLPKFLWERPDTVAKVGLDGL

SEQ ID NO: 1357688 - protein, 29 aa, Mycobacterium
AEKNSTLVLPFPVELLRFLERSTPQAQSD

SEQ ID NO: 1357689 - protein, 32 aa, Mycobacterium
AEKNSTLVLPFPVELLRFLERSTPRAQGESAA

SEQ ID NO: 1357690 - protein, 20 aa, Mycobacterium
AELLERYPDIKIAVAALDVN

SEQ ID NO: 1357691 - protein, 23 aa, Mycobacterium
AELWGRSVFQCPFCHGWEMRDGK

SEQ ID NO: 1357692 - protein, 23 aa, Mycobacterium
AEMLKKFGLGQRTGVGLPGESAG

SEQ ID NO: 1357693 - protein, 24 aa, Mycobacterium
AEPAPGLPIDTLQAPGLPAMESLG

SEQ ID NO: 1357694 - protein, 32 aa, Mycobacterium
AEQAAKLCVQYLAPILKNRQYNFPPIGTTISP

SEQ ID NO: 1357695 - protein, 21 aa, Mycobacterium
AETAQRWNLKSIADLAAHSAE

SEQ ID NO: 1357696 - protein, 23 aa, Mycobacterium
AETRLLDMVPPGYAADACEAVVP

SEQ ID NO: 1357697 - protein, 17 aa, Mycobacterium
AEYPLLASVPPSAEMPA

SEQ ID NO: 1357698 - protein, 22 aa, Mycobacterium
AFERLSAFQFGFTDGPSACAAI

SEQ ID NO: 1357699 - protein, 17 aa, Mycobacterium
AFGAAAFIGLGAGAAGA

SEQ ID NO: 1357700 - protein, 25 aa, Mycobacterium
AFLDQRGLMKQKWPERLVIVDEFPL

SEQ ID NO: 1357701 - protein, 19 aa, Mycobacterium
AFLIVVVQMLAVTQLDRDI

SEQ ID NO: 1357702 - protein, 17 aa, Mycobacterium
AFRFLPFASEKNPDGSQ

SEQ ID NO: 1357703 - protein, 17 aa, Mycobacterium
AFSPRRVKRLEGWLGEL

SEQ ID NO: 1357704 - protein, 20 aa, Mycobacterium
AFVAVLLAAVAGLSTGSAHA

SEQ ID NO: 1357705 - protein, 17 aa, Mycobacterium
AFVLAHELLHLALHSHE

SEQ ID NO: 1357706 - protein, 24 aa, Mycobacterium
AGAALLVRQVFFGPKTITAYFPTA

SEQ ID NO: 1357707 - protein, 25 aa, Mycobacterium
AGAIGTALWNNPFPILNQIGENQVG

SEQ ID NO: 1357708 - protein, 24 aa, Mycobacterium
AGAVLGGSLLFTAGLGMAQAQPAE

SEQ ID NO: 1357709 - protein, 22 aa, Mycobacterium
AGAYMRWVAEGSSPRFTLSTAD

SEQ ID NO: 1357710 - protein, 22 aa, Mycobacterium
AGDARLFVGAPWVLSVDDHVDP

SEQ ID NO: 1357711 - protein, 26 aa, Mycobacterium
AGECVSLVSQFLRQVHNITTAAWGNA

SEQ ID NO: 1357712 - protein, 34 aa, Mycobacterium
AGEPIVIAAPMFHAWGFSQLLFAALLACPIVTRR

SEQ ID NO: 1357713 - protein, 19 aa, Mycobacterium
AGEVPLAFALAAGSFRDGT

SEQ ID NO: 1357714 - protein, 23 aa, Mycobacterium
AGGFTAYDGEWWHFDGPGAAVER

SEQ ID NO: 1357715 - protein, 23 aa, Mycobacterium
AGGPYKHLVWGGGTPWAPQPPST

SEQ ID NO: 1357716 - protein, 25 aa, Mycobacterium
AGGSLFPDYITPGNFDIAQFAWGGD

SEQ ID NO: 1357717 - protein, 20 aa, Mycobacterium
AGGVLLRPYARLIASSGDSV

SEQ ID NO: 1357718 - protein, 18 aa, Mycobacterium
AGISIWPNALAALDAFGL

SEQ ID NO: 1357719 - protein, 18 aa, Mycobacterium
AGLAALVLVGAAATGCGG

SEQ ID NO: 1357720 - protein, 27 aa, Mycobacterium
AGLGLVVALLVILAVSIGLFAGKFTET

SEQ ID NO: 1357721 - protein, 26 aa, Mycobacterium
AGLNLAQFPSILVELGNMKSPVDSAL

SEQ ID NO: 1357722 - protein, 17 aa, Mycobacterium
AGLPSGVIVTKVDDRLI

SEQ ID NO: 1357723 - protein, 23 aa, Mycobacterium
AGLRGAVYWDPLATLGFLAARTS

SEQ ID NO: 1357724 - protein, 17 aa, Mycobacterium
AGLTAGVTGAALAGVGT

SEQ ID NO: 1357725 - protein, 19 aa, Mycobacterium
AGLVVMLAVFSQTAGLTGA

SEQ ID NO: 1357726 - protein, 33 aa, Mycobacterium
AGMAGLCALVALPAAWLTGCSDGDMLGGMGSEV

SEQ ID NO: 1357727 - protein, 38 aa, Mycobacterium
AGPALTRSMSFFSVLPWQKETIPNWIRGDYANLSAVID

SEQ ID NO: 1357728 - protein, 29 aa, Mycobacterium
AGPILWGDMPTLPLYRQQRTLLTSTKMYA

SEQ ID NO: 1357729 - protein, 18 aa, Mycobacterium
AGQQVLLSLMTRSAIDDP

SEQ ID NO: 1357730 - protein, 25 aa, Mycobacterium
AGQTPSEFFRAPLVSLPGAAQALEA

SEQ ID NO: 1357731 - protein, 18 aa, Mycobacterium
AGRDLAPIPIPDVALRTV

SEQ ID NO: 1357732 - protein, 27 aa, Mycobacterium
AGRSLAVYPVPDVALRSAGRLLDVVGP

SEQ ID NO: 1357733 - protein, 26 aa, Mycobacterium
AGSLSGYLNLSEGWWPMLVNISMGDA

SEQ ID NO: 1357734 - protein, 28 aa, Mycobacterium
AGTEDMSWTFWSWNPNSTDTGGILADDW

SEQ ID NO: 1357735 - protein, 17 aa, Mycobacterium
AGVGIALPHYTGHQYQA

SEQ ID NO: 1357736 - protein, 33 aa, Mycobacterium
AGVNWFGMESDIFTPHGLWTRNYKDMMNQMAAL

SEQ ID NO: 1357737 - protein, 19 aa, Mycobacterium
AGVVSVLCAVAFVALAAVG

SEQ ID NO: 1357738 - protein, 19 aa, Mycobacterium
AGWQKLNGTQALSFVRQRH

SEQ ID NO: 1357739 - protein, 31 aa, Mycobacterium
AGYATKLLNQHIKYSWYLASAEALLIAEAMG

SEQ ID NO: 1357740 - protein, 34 aa, Mycobacterium; identical to SEQ ID NO: 1305720

SEQ ID NO: 1357741 - protein, 19 aa, Mycobacterium
AHEDGSWISLVSPAADLPL

SEQ ID NO: 1357742 - protein, 26 aa, Mycobacterium
AHNGSIKPMAALDALLEPRVVSTLRG

SEQ ID NO: 1357743 - protein, 20 aa, Mycobacterium
AHPHLTARDRWRPVETPNGE

SEQ ID NO: 1357744 - protein, 24 aa, Mycobacterium
AHPQTWFKAFNWDVAKKAPITFDT

SEQ ID NO: 1357745 - protein, 25 aa, Mycobacterium
AHSHQPLRWGPPEAPLRYVLVFNGE

SEQ ID NO: 1357746 - protein, 22 aa, Mycobacterium
AIASVVKLFIADDLLLQVANGQ

SEQ ID NO: 1357747 - protein, 24 aa, Mycobacterium
AIEMSDMIIAKQGIDPRVVDLAEQ

SEQ ID NO: 1357748 - protein, 27 aa, Mycobacterium
AILDRDDLHLFEFPKIDADAVDEVLIM

SEQ ID NO: 1357749 - protein, 18 aa, Mycobacterium
AILLGVALLAGCTAERQA

SEQ ID NO: 1357750 - protein, 23 aa, Mycobacterium
AIPQGNPWFTPYDRYRDDGEQGL

SEQ ID NO: 1357751 - protein, 28 aa, Mycobacterium
AISGLEVLNQWWHNPVSRSIMQDCSNTA

SEQ ID NO: 1357752 - protein, 25 aa, Mycobacterium
AISSGPFFKGLIANLPPGQFIQPFV

SEQ ID NO: 1357753 - protein, 19 aa, Mycobacterium
AIVHFSSPGPAPAAPDAPQ

SEQ ID NO: 1357754 - protein, 24 aa, Mycobacterium
AIVMSDIILAKRDIDPRVTELANQ

SEQ ID NO: 1357755 - protein, 20 aa, Mycobacterium
AIVTPPLFPGVSISADLGNG

SEQ ID NO: 1357756 - protein, 21 aa, Mycobacterium
AIVVAAVLAGLLSGCAGWRGL

SEQ ID NO: 1357757 - protein, 24 aa, Mycobacterium
AKARTAGRHWPPEGVLPASAGVDE

SEQ ID NO: 1357758 - protein, 17 aa, Mycobacterium
AKLVSYVQYVPVLSDMT

SEQ ID NO: 1357759 - protein, 25 aa, Mycobacterium
AKVIRLADVALLIGPTRILDIDVVS

SEQ ID NO: 1357760 - protein, 19 aa, Mycobacterium
ALAAALPFAATACGGGDGG

SEQ ID NO: 1357761 - protein, 22 aa, Mycobacterium
ALAGTALLGPAPVAGADIVGFT

SEQ ID NO: 1357762 - protein, 17 aa, Mycobacterium
ALALLLTGRDGGVRMGR

SEQ ID NO: 1357763 - protein, 18 aa, Mycobacterium
ALAPGFIEPHGHPLISGV

SEQ ID NO: 1357764 - protein, 18 aa, Mycobacterium
ALATLLNLIGLDNGLPGG

SEQ ID NO: 1357765 - protein, 28 aa, Mycobacterium
ALAVALTAPWLWVPTAHAETFAQLPPVP

SEQ ID NO: 1357766 - protein, 24 aa, Mycobacterium
ALDLDAVIGGFRPLLNALDPTQVN

SEQ ID NO: 1357767 - protein, 21 aa, Mycobacterium
ALEFVGLMGIPPLGADAGSAF

SEQ ID NO: 1357768 - protein, 28 aa, Mycobacterium
ALEKRTGLALPPTLLWEHPTAAAVTDRI

SEQ ID NO: 1357769 - protein, 19 aa, Mycobacterium
ALGGFRRWEPAVRRFLKDE

SEQ ID NO: 1357770 - protein, 26 aa, Mycobacterium
ALGPRGVFKLQPWDGNVFTFPVSSEN

SEQ ID NO: 1357771 - protein, 17 aa, Mycobacterium
ALGQILQSSPELATELL

SEQ ID NO: 1357772 - protein, 20 aa, Mycobacterium
ALILLPAVDVVEGRAVRLVQ

SEQ ID NO: 1357773 - protein, 21 aa, Mycobacterium
ALLACTVLAAPVLAGCSSQPP

SEQ ID NO: 1357774 - protein, 18 aa, Mycobacterium
ALLDLPAPGRLSAGGASR

SEQ ID NO: 1357775 - protein, 23 aa, Mycobacterium
ALLRASGGWPWLAPGHDPGELLA

SEQ ID NO: 1357776 - protein, 20 aa, Mycobacterium
ALLSGLNYYVGQLNPKLPAL

SEQ ID NO: 1357777 - protein, 41 aa, Mycobacterium; identical to SEQ ID NO: 1135809

SEQ ID NO: 1357778 - protein, 18 aa, Mycobacterium
ALQYLKYPMAVTVESIDE

SEQ ID NO: 1357779 - protein, 21 aa, Mycobacterium
ALRAQISPHFIYNALNTIASF

SEQ ID NO: 1357780 - protein, 19 aa, Mycobacterium
ALRERPLVRTLRLGGTAAL

SEQ ID NO: 1357781 - protein, 23 aa, Mycobacterium
ALRTRFFDDYFLASTAGGIRQVV

SEQ ID NO: 1357782 - protein, 21 aa, Mycobacterium
ALSAFGLLLTAVGCAKQVTGV

SEQ ID NO: 1357783 - protein, 24 aa, Mycobacterium
ALSAPQLLPLSYLVGTDGSVRRLP

SEQ ID NO: 1357784 - protein, 27 aa, Mycobacterium
ALSRLRGMFAFALWDTVTGELFCARDP

SEQ ID NO: 1357785 - protein, 25 aa, Mycobacterium
ALSSAATGWLWDAGVRPGMTVAWQL

SEQ ID NO: 1357786 - protein, 23 aa, Mycobacterium
ALSSQLIRAFQGQGATISSFLSQ

SEQ ID NO: 1357787 - protein, 20 aa, Mycobacterium
ALSYRLWKLRQVGGTAAILR

SEQ ID NO: 1357788 - protein, 22 aa, Mycobacterium
ALTALLTLTIVPAHAATPVPLG

SEQ ID NO: 1357789 - protein, 26 aa, Mycobacterium
ALTSIPLTFTILPANSVPTSLRATVG

SEQ ID NO: 1357790 - protein, 20 aa, Mycobacterium
ALTYPRRLGFGLGETVVSLA

SEQ ID NO: 1357791 - protein, 20 aa, Mycobacterium
ALTYPRRLGFGLGETVVSLG

SEQ ID NO: 1357792 - protein, 19 aa, Mycobacterium
ALTYPRRLGYGLGETAVSL

SEQ ID NO: 1357793 - protein, 32 aa, Mycobacterium
ALVEVLAASWRNADPLPLARPRTDPAAVALSL

SEQ ID NO: 1357794 - protein, 24 aa, Mycobacterium
ALVGLGALAWVFWPSSGGEGHAGA

SEQ ID NO: 1357795 - protein, 27 aa, Mycobacterium
ALVLAAAVFTYLSYTAAFTPTDKVTVL

SEQ ID NO: 1357796 - protein, 20 aa, Mycobacterium
ALVLAVLVLIGFVVGYNRIR

SEQ ID NO: 1357797 - protein, 55 aa, Mycobacterium
ALWGEAYFAPYVDMGAWPVPDLLAIARNYGTSLITLGFLQATPDGKLAWAGLSAL

SEQ ID NO: 1357798 - protein, 24 aa, Mycobacterium
ALYAGTHFGVYRIANERDPELVGG

SEQ ID NO: 1357799 - protein, 22 aa, Mycobacterium
ALYLGNGVMLEAPRPGQFVQVS

SEQ ID NO: 1357800 - protein, 20 aa, Mycobacterium
AMAQPTRWTMPDLRGMNLAA

SEQ ID NO: 1357801 - protein, 25 aa, Mycobacterium
AMDRRAWEVLQIPVGLAFFFRNSSL

SEQ ID NO: 1357802 - protein, 19 aa, Mycobacterium
AMEDAIALQWAFKDHPDDV

SEQ ID NO: 1357803 - protein, 30 aa, Mycobacterium
AMKADIVRLLAPPPPPPPPPGLPPPGAPVP

SEQ ID NO: 1357804 - protein, 23 aa, Mycobacterium
AMNPASWEVCGQKPSPGAALTPQ

SEQ ID NO: 1357805 - protein, 17 aa, Mycobacterium
AMPLTTDALFFESALPT

SEQ ID NO: 1357806 - protein, 33 aa, Mycobacterium; identical to SEQ ID NO: 942816

SEQ ID NO: 1357807 - protein, 20 aa, Mycobacterium
AMRALLMIVTAAAVPGLLGA

SEQ ID NO: 1357808 - protein, 25 aa, Mycobacterium
AMRLDDVVFPLFPQGGGFPRTNADN

SEQ ID NO: 1357809 - protein, 18 aa, Mycobacterium
AMRSGFYGYGFNVGTTSA

SEQ ID NO: 1357810 - protein, 26 aa, Mycobacterium
AMSPIRPNVIWAMDFQFDTTADGRIL

SEQ ID NO: 1357811 - protein, 21 aa, Mycobacterium
AMTTAAIAALLLAACSTDTQD

SEQ ID NO: 1357812 - protein, 27 aa, Mycobacterium
AMVRSLSFLTTFPFVKENIGNFFRGDY

SEQ ID NO: 1357813 - protein, 23 aa, Mycobacterium
ANADLLEPLFWDRGADEWKIAIQ

SEQ ID NO: 1357814 - protein, 26 aa, Mycobacterium
ANAERFGIQDAIWRGAYYTPGGAKAG

SEQ ID NO: 1357815 - protein, 29 aa, Mycobacterium
ANARRWGVLHVIWRQGFYPGIGAPSWTAD

SEQ ID NO: 1357816 - protein, 26 aa, Mycobacterium
ANGAVPLPAFEFVTAVFGAIRREMDR

SEQ ID NO: 1357817 - protein, 25 aa, Mycobacterium
ANNFDSPLSLLTPSLARLVALGGFR

SEQ ID NO: 1357818 - protein, 24 aa, Mycobacterium
ANNQPTIIALPGLPDSMGIVRGSA

SEQ ID NO: 1357819 - protein, 17 aa, Mycobacterium
ANPAGLVDITRFWFETG

SEQ ID NO: 1357820 - protein, 17 aa, Mycobacterium
ANPISFICGAIQAASRH

SEQ ID NO: 1357821 - protein, 22 aa, Mycobacterium
ANRLYLELMIAHHAGAIKMART

SEQ ID NO: 1357822 - protein, 25 aa, Mycobacterium
ANTRGSYLVYNFGSGFPAPMLNAAG

SEQ ID NO: 1357823 - protein, 30 aa, Mycobacterium
ANTVGFDCSGLILYAFAGVGIKLEHYSGTQ

SEQ ID NO: 1357824 - protein, 32 aa, Mycobacterium
APADPVESPLLWTLLAFARRQFGQPRTEIGDS

SEQ ID NO: 1357825 - protein, 24 aa, Mycobacterium
APAGRDLLYVLAPAPNTDVGTLDW

SEQ ID NO: 1357826 - protein, 30 aa, Mycobacterium
APAPAQPQIPWPVFTFAPPTPEPSQEPAPS

SEQ ID NO: 1357827 - protein, 27 aa, Mycobacterium
APAPREALTDLLWRMGIRTIGQFAELS

SEQ ID NO: 1357828 - protein, 19 aa, Mycobacterium
APATLDDMLLPAEAPPSPP

SEQ ID NO: 1357829 - protein, 24 aa, Mycobacterium
APATPSPALYPGAPIPGPPNILSN

SEQ ID NO: 1357830 - protein, 25 aa, Mycobacterium
APAYAELAPDPWLSEVFRAEMTRVG

SEQ ID NO: 1357831 - protein, 19 aa, Mycobacterium
APDMASSLWVGPLGGNASQ

SEQ ID NO: 1357832 - protein, 22 aa, Mycobacterium
APDPLRTLPFPVGASHSLELRY

SEQ ID NO: 1357833 - protein, 24 aa, Mycobacterium
APDPRVGALFLGGSDRHICTGAAL

SEQ ID NO: 1357834 - protein, 32 aa, Mycobacterium
APESTWVFDAPFFLLLNLAVGGNWPGPPDATT

SEQ ID NO: 1357835 - protein, 23 aa, Mycobacterium
APGALLETVPLDPALSVAGAAGA

SEQ ID NO: 1357836 - protein, 24 aa, Mycobacterium
APGDKVTLTYLDPAGKSQSLDVTL

SEQ ID NO: 1357837 - protein, 28 aa, Mycobacterium
APGGPPYVAVPYLSRMDLAYAAADLAIC

SEQ ID NO: 1357838 - protein, 30 aa, Mycobacterium
APGRSGRLSWWAGPWPVDERWWDAAPAKTG

SEQ ID NO: 1357839 - protein, 29 aa, Mycobacterium
APGTAQGYHMVTFGFILGEVVRRVTGRTI

SEQ ID NO: 1357840 - protein, 19 aa, Mycobacterium
APGVPLPPQPVAPGVPVPP

SEQ ID NO: 1357841 - protein, 20 aa, Mycobacterium
APGVYVPPPPGVAGAIPGGP

SEQ ID NO: 1357842 - protein, 24 aa, Mycobacterium
APIRLHPDIAIFAAVPQVRSSTAE

SEQ ID NO: 1357843 - protein, 26 aa, Mycobacterium
APIVKNRQFNFPPIGANPFVGQSARP

SEQ ID NO: 1357844 - protein, 21 aa, Mycobacterium
APLRPTVIVASLPPTYTIGRA

SEQ ID NO: 1357845 - protein, 19 aa, Mycobacterium
APLRYVLVFNGEIYNYLEL

SEQ ID NO: 1357846 - protein, 19 aa, Mycobacterium
APMTLRWLRDRFTDRPVYE

SEQ ID NO: 1357847 - protein, 20 aa, Mycobacterium
APMTVAPNGAVFFKTRQFAS

SEQ ID NO: 1357848 - protein, 22 aa, Mycobacterium
APPPPPPAAPVPPALPAPAVPP

SEQ ID NO: 1357849 - protein, 17 aa, Mycobacterium
APPPPPVEAPAAPSAPP

SEQ ID NO: 1357850 - protein, 30 aa, Mycobacterium
APPVAPPPPPPPPPPPPPPPAAPSIGADGE

SEQ ID NO: 1357851 - protein, 25 aa, Mycobacterium
APRDLCAMWPVPPTPVVGVASSPGP

SEQ ID NO: 1357852 - protein, 23 aa, Mycobacterium
APRILRDALADKSVVIFRTPDAA

SEQ ID NO: 1357853 - protein, 17 aa, Mycobacterium
APRIPLLSNVTGTWMTD

SEQ ID NO: 1357854 - protein, 20 aa, Mycobacterium
APRTVGVYAVNYPAANNFTD

SEQ ID NO: 1357855 - protein, 34 aa, Mycobacterium
APTTALLHKYDPIYTCWLQGATWFLENGGWDVWG

SEQ ID NO: 1357856 - protein, 28 aa, Mycobacterium
APVAPLPGTPALPLASAPPPAPAVPTVA

SEQ ID NO: 1357857 - protein, 17 aa, Mycobacterium
APVKVGFRLGDPGPGEF

SEQ ID NO: 1357858 - protein, 21 aa, Mycobacterium
APYMSTDLPGLQPFMPPYVPG

SEQ ID NO: 1357859 - protein, 25 aa, Mycobacterium
AQADDFVAPRFLPQDPDYAALTCEA

SEQ ID NO: 1357860 - protein, 18 aa, Mycobacterium
AQAMLAPMLEQIYAGLSL

SEQ ID NO: 1357861 - protein, 27 aa, Mycobacterium
AQGPEIATMQQWLAKWGTGAPSGHEGH

SEQ ID NO: 1357862 - protein, 24 aa, Mycobacterium
AQGPIALTGLYPPGSTFKTVTVSA

SEQ ID NO: 1357863 - protein, 18 aa, Mycobacterium
AQGPMQFMPATFAAYGGG

SEQ ID NO: 1357864 - protein, 26 aa, Mycobacterium
AQHGIRVIDMWPLYVNTAMTQGVKTG

SEQ ID NO: 1357865 - protein, 24 aa, Mycobacterium
AQLTRLGIAALALTLVAGCSSNPV

SEQ ID NO: 1357866 - protein, 28 aa, Mycobacterium
AQNTQFTTFLIGLPIVGSSILAPVIMTL

SEQ ID NO: 1357867 - protein, 18 aa, Mycobacterium
AQPAPPPSPAPPPAVEAP

SEQ ID NO: 1357868 - protein, 25 aa, Mycobacterium
AQPSNPVILPDTPGYVIGAPDVEPG

SEQ ID NO: 1357869 - protein, 27 aa, Mycobacterium
AQPSPAIPLGPFLPTGQELATLLATGP

SEQ ID NO: 1357870 - protein, 23 aa, Mycobacterium
AQPSRMVLVSPALHLTLRGPQID

SEQ ID NO: 1357871 - protein, 32 aa, Mycobacterium
AQRITLERNPKWWGTPPVLDRITYTVLDDAAM

SEQ ID NO: 1357872 - protein, 20 aa, Mycobacterium
AQTAAPFLRDLTGADGLALF

SEQ ID NO: 1357873 - protein, 25 aa, Mycobacterium
AQWSSDIAAGWWQAALDAYDRLPAS

SEQ ID NO: 1357874 - protein, 18 aa, Mycobacterium
AQYLAPIIKNRQYNFPPL

SEQ ID NO: 1357875 - protein, 25 aa, Mycobacterium
ARAAAGATRWLVLSGPPGIGKTRLA

SEQ ID NO: 1357876 - protein, 30 aa, Mycobacterium
ARAAAVDALIVLAVPMPALPLMLRHVRESA

SEQ ID NO: 1357877 - protein, 20 aa, Mycobacterium
ARAHWDLIAAKYAAPGTNLP

SEQ ID NO: 1357878 - protein, 20 aa, Mycobacterium
ARAHWDLIAAKYAAPGTNRP

SEQ ID NO: 1357879 - protein, 18 aa, Mycobacterium
ARAKDLGMLSMWSVNRDK

SEQ ID NO: 1357880 - protein, 26 aa, Mycobacterium
ARAKLLKGQLPLLDRLEEALGRGGPD

SEQ ID NO: 1357881 - protein, 20 aa, Mycobacterium
ARARLLGMPAAMLAEAAPAQ

SEQ ID NO: 1357882 - protein, 18 aa, Mycobacterium
ARCRVYGVSNLWVVDGSI

SEQ ID NO: 1357883 - protein, 20 aa, Mycobacterium
ARDLVPYRTLTTQGPVGVMV

SEQ ID NO: 1357884 - protein, 17 aa, Mycobacterium
ARELTVPGALVLVHTPQ

SEQ ID NO: 1357885 - protein, 23 aa, Mycobacterium
ARFGLQDVIWRGTYYTPAGPQGS

SEQ ID NO: 1357886 - protein, 17 aa, Mycobacterium
ARGPQAEALILGTDGKL

SEQ ID NO: 1357887 - protein, 36 aa, Mycobacterium
ARGRLLRLQQRLAALLARWFRRPGEWLDRAPMGPSR

SEQ ID NO: 1357888 - protein, 25 aa, Mycobacterium
ARIALPAGVGLHAAFWLLGSDVDRV

SEQ ID NO: 1357889 - protein, 30 aa, Mycobacterium
ARIQMPVDKGVLPAFWSVGLEPGHEYDWPR

SEQ ID NO: 1357890 - protein, 19 aa, Mycobacterium
ARLAALSILIGTVAATGPG

SEQ ID NO: 1357891 - protein, 17 aa, Mycobacterium
ARLRLLLSDGSGPLYRC

SEQ ID NO: 1357892 - protein, 26 aa, Mycobacterium
ARQTDQAVWAFVAPLVRNDVSGTDDS

SEQ ID NO: 1357893 - protein, 24 aa, Mycobacterium
ARRAQGVTIRRAPAPNWYHLTLNG

SEQ ID NO: 1357894 - protein, 20 aa, Mycobacterium
ARRGYGLALVARRADQLRAL

SEQ ID NO: 1357895 - protein, 17 aa, Mycobacterium
ARRLAGGLAAAGLVFTS

SEQ ID NO: 1357896 - protein, 29 aa, Mycobacterium
ARRVADVLGIPFYVWDFADRFKEDVIDDF

SEQ ID NO: 1357897 - protein, 18 aa, Mycobacterium
ARRYFRATAKPISVAWRL

SEQ ID NO: 1357898 - protein, 22 aa, Mycobacterium
ARSVAVLAVLGLLLTGCVSRDE

SEQ ID NO: 1357899 - protein, 34 aa, Mycobacterium
ARTAPALDLDALIGGFRPLFRALDPEQVNALSGQ

SEQ ID NO: 1357900 - protein, 17 aa, Mycobacterium
ARWGAVASAAAVGLTAC

SEQ ID NO: 1357901 - protein, 22 aa, Mycobacterium
ASAAFAAVALIGAPAALADPEG

SEQ ID NO: 1357902 - protein, 22 aa, Mycobacterium
ASAEYLAMLRRCGVPAVLSGAG

SEQ ID NO: 1357903 - protein, 17 aa, Mycobacterium
ASALLFGSAVACAPPEK

SEQ ID NO: 1357904 - protein, 29 aa, Mycobacterium
ASAVPVRWRALLHGWPGMTAHGLVGLGSA

SEQ ID NO: 1357905 - protein, 17 aa, Mycobacterium
ASFAPYTPALTVAGVPP

SEQ ID NO: 1357906 - protein, 18 aa, Mycobacterium
ASGDPMLYGIGGSAVRIF

SEQ ID NO: 1357907 - protein, 17 aa, Mycobacterium
ASGIADPYPLYNQLRRL

SEQ ID NO: 1357908 - protein, 24 aa, Mycobacterium
ASGTSLAQWYVTRGLSAQALATAY

SEQ ID NO: 1357909 - protein, 23 aa, Mycobacterium
ASIVSKFLGVLGIGPSAANGAVP

SEQ ID NO: 1357910 - protein, 24 aa, Mycobacterium
ASLAGLVPFPYQSLYCTTKYGVVG

SEQ ID NO: 1357911 - protein, 24 aa, Mycobacterium
ASLLAMPQAPVYAAAKAGLNNLTG

SEQ ID NO: 1357912 - protein, 19 aa, Mycobacterium
ASLPPTYTIGRAGSVLMPV

SEQ ID NO: 1357913 - protein, 19 aa, Mycobacterium
ASLSGFLNPSEGWWPMLIG

SEQ ID NO: 1357914 - protein, 25 aa, Mycobacterium
ASPDPLPGVVPTTGSPPPAGPFCVP

SEQ ID NO: 1357915 - protein, 23 aa, Mycobacterium
ASPVALAPLPAAPAPELQGALVS

SEQ ID NO: 1357916 - protein, 24 aa, Mycobacterium
ASRRRAAVIPAHYPGRGGATVVAR

SEQ ID NO: 1357917 - protein, 25 aa, Mycobacterium
ASRTDTILVVHLPGLGSATPATMVS

SEQ ID NO: 1357918 - protein, 24 aa, Mycobacterium
ASSALTLAIWHPGQFVYAAVLSGA

SEQ ID NO: 1357919 - protein, 17 aa, Mycobacterium
ASSWWIVAAAESAWAGD

SEQ ID NO: 1357920 - protein, 28 aa, Mycobacterium
ATAIATAPLTFAQPAPPPCFNPDGTPCA

SEQ ID NO: 1357921 - protein, 22 aa, Mycobacterium
ATAPAPDGVVSLGPAYAQSRSA

SEQ ID NO: 1357922 - protein, 17 aa, Mycobacterium
ATAPIAGLGYTAPLPAA

SEQ ID NO: 1357923 - protein, 26 aa, Mycobacterium
ATARSSLSWFSPKVYGTVTAKDADKD

SEQ ID NO: 1357924 - protein, 18 aa, Mycobacterium
ATDPQFWARQIRATVRFA

SEQ ID NO: 1357925 - protein, 30 aa, Mycobacterium
ATFFAESAQKWPLCRGYNAGGSPVTVGDVS

SEQ ID NO: 1357926 - protein, 21 aa, Mycobacterium
ATFYHEVGHMAVTVYDLPITG

SEQ ID NO: 1357927 - protein, 28 aa, Mycobacterium
ATGIVTDLLNWLGLGTGGAIPLPGGAVE

SEQ ID NO: 1357928 - protein, 25 aa, Mycobacterium
ATGWPRLDWSMDAALLLAALAARAG

SEQ ID NO: 1357929 - protein, 20 aa, Mycobacterium
ATIAILVVALAAVNYLSADV

SEQ ID NO: 1357930 - protein, 30 aa, Mycobacterium
ATILAYTSPALGHLLPMGALLSELSRRGHT

SEQ ID NO: 1357931 - protein, 23 aa, Mycobacterium
ATILRFVDHDLVLGRAVCAVTHG

SEQ ID NO: 1357932 - protein, 24 aa, Mycobacterium
ATISQVPPQFRPTTSKWTGVAART

SEQ ID NO: 1357933 - protein, 17 aa, Mycobacterium
ATLGMLERFPMADHRPD

SEQ ID NO: 1357934 - protein, 23 aa, Mycobacterium
ATLLTTTLADPTGYGRILRTQDG

SEQ ID NO: 1357935 - protein, 36 aa, Mycobacterium
ATLWRARLIAPMRPDRYLRMGLAMRRAGLTATVGFA

SEQ ID NO: 1357936 - protein, 29 aa, Mycobacterium
ATMEKSPYAIYWDPQTYPAVKKISDLKST

SEQ ID NO: 1357937 - protein, 32 aa, Mycobacterium
ATMIKTPFSLAYKTELPIPVDKYPLICEPGGL

SEQ ID NO: 1357938 - protein, 19 aa, Mycobacterium
ATPAPVAPAVPFPATETVV

SEQ ID NO: 1357939 - protein, 24 aa, Mycobacterium
ATPKRPWRELVAGFIDDWTADTEA

SEQ ID NO: 1357940 - protein, 21 aa, Mycobacterium
ATPRNLRFAATMPRAVVLCAD

SEQ ID NO: 1357941 - protein, 17 aa, Mycobacterium
ATSGRRVALALAPAGAG

SEQ ID NO: 1357942 - protein, 19 aa, Mycobacterium
ATVVLWIASTFAAALAFGA

SEQ ID NO: 1357943 - protein, 23 aa, Mycobacterium
AVAAPLAALLAPLAPAHADPGVL

SEQ ID NO: 1357944 - protein, 22 aa, Mycobacterium
AVADLFGWKHGCDLFALQDAAD

SEQ ID NO: 1357945 - protein, 19 aa, Mycobacterium
AVAHFLEYGIQDAGRWRVP

SEQ ID NO: 1357946 - protein, 26 aa, Mycobacterium
AVALLGAGYFLLKGRSHDDAGRAVAG

SEQ ID NO: 1357947 - protein, 19 aa, Mycobacterium
AVATDVLELVFPPAPSVQV

SEQ ID NO: 1357948 - protein, 26 aa, Mycobacterium
AVAVYTPEQFFPIGQLTFARSVAEGL

SEQ ID NO: 1357949 - protein, 24 aa, Mycobacterium
AVDGRNVLMVPFAGGWRIDLECRP

SEQ ID NO: 1357950 - protein, 25 aa, Mycobacterium
AVEATWPRRLVKQVHFPVGGQAKAL

SEQ ID NO: 1357951 - protein, 28 aa, Mycobacterium
AVEKGKVRVIIPARWNFLNVVRPLGVQL

SEQ ID NO: 1357952 - protein, 31 aa, Mycobacterium
AVEKGKVRVIIPARWNFLNVVRPLGVQLDNL

SEQ ID NO: 1357953 - protein, 18 aa, Mycobacterium
AVERTRKALADQGFGVLT

SEQ ID NO: 1357954 - protein, 17 aa, Mycobacterium
AVFGIAFPTPNPEIPAK

SEQ ID NO: 1357955 - protein, 25 aa, Mycobacterium
AVFGQLRFEPRRGFTAEFTNVGGLK

SEQ ID NO: 1357956 - protein, 17 aa, Mycobacterium
AVFIPAGLAHRVANTAP

SEQ ID NO: 1357957 - protein, 22 aa, Mycobacterium
AVFLDRLQKVGITSSNPYATVH

SEQ ID NO: 1357958 - protein, 17 aa, Mycobacterium
AVIALMAMGVMGVHFMK

SEQ ID NO: 1357959 - protein, 17 aa, Mycobacterium
AVIDGLVELGIDRKDIA

SEQ ID NO: 1357960 - protein, 32 aa, Mycobacterium
AVIGATALLMASSCSWQIGIPVPDGVPPPPGD

SEQ ID NO: 1357961 - protein, 17 aa, Mycobacterium
AVKDIYRRHTPAPDLNG

SEQ ID NO: 1357962 - protein, 17 aa, Mycobacterium
AVLETLGPLLDADGRDG

SEQ ID NO: 1357963 - protein, 35 aa, Mycobacterium
AVLIPGASPFKPINPFYPIIAATYRYIGINLHDDA

SEQ ID NO: 1357964 - protein, 18 aa, Mycobacterium
AVLRDRAGAWPRDPMDIR

SEQ ID NO: 1357965 - protein, 25 aa, Mycobacterium
AVLRQAPELAGWPRSPEWTGAAALP

SEQ ID NO: 1357966 - protein, 26 aa, Mycobacterium
AVQIDHLVPLALAWDLGARNWTEEMR

SEQ ID NO: 1357967 - protein, 17 aa, Mycobacterium
AVQSPPLMERLRVMMNL

SEQ ID NO: 1357968 - protein, 30 aa, Mycobacterium
AVRDMFPEWEILRPSWFMQNFTGAHPVAES

SEQ ID NO: 1357969 - protein, 26 aa, Mycobacterium
AVRGHYMSPLLGTAAPRRADLLSAVM

SEQ ID NO: 1357970 - protein, 20 aa, Mycobacterium
AVRLADPPPVTGAVGLGMVA

SEQ ID NO: 1357971 - protein, 25 aa, Mycobacterium
AVRPGWRTDFLTQMGFTVADPGDPL

SEQ ID NO: 1357972 - protein, 26 aa, Mycobacterium
AVRRCALYRNCFPSMDVAYPALVVRD

SEQ ID NO: 1357973 - protein, 24 aa, Mycobacterium
AVRRRPYTVILFDEIEKAHPDVFD

SEQ ID NO: 1357974 - protein, 23 aa, Mycobacterium
AVSGRFLGVPYGANTLVGSPTRP

SEQ ID NO: 1357975 - protein, 17 aa, Mycobacterium
AVTAFLLWGLASALCDV

SEQ ID NO: 1357976 - protein, 21 aa, Mycobacterium
AVTALLLSGLIAVAGASAPAG

SEQ ID NO: 1357977 - protein, 22 aa, Mycobacterium
AVVALLTLLVGVGVGVALTPRV

SEQ ID NO: 1357978 - protein, 17 aa, Mycobacterium
AVVDARCRVYGVSNLWV

SEQ ID NO: 1357979 - protein, 19 aa, Mycobacterium
AVVFTPKTPAPEGGWPVVA

SEQ ID NO: 1357980 - protein, 51 aa, Mycobacterium
AVVLPLGVPARPVWPPLLDTILTAVFDFGGRYLFVYEPLRGYQTAANPATS

SEQ ID NO: 1357981 - protein, 17 aa, Mycobacterium
AVVYDYFQDVLGRTSFD

SEQ ID NO: 1357982 - protein, 24 aa, Mycobacterium
AVWRILHDGTVGRTYLIGADGERD

SEQ ID NO: 1357983 - protein, 19 aa, Mycobacterium
AWQRLRDDPGSPLLNRAIS

SEQ ID NO: 1357984 - protein, 23 aa, Mycobacterium
AWRLGIFLAVCALGTFVLLSVFA

SEQ ID NO: 1357985 - protein, 25 aa, Mycobacterium
AWRLLVFLSVCALATFALLTVFAQF

SEQ ID NO: 1357986 - protein, 25 aa, Mycobacterium
AWRVDAVFLDPRWISGFDPMADYAV

SEQ ID NO: 1357987 - protein, 24 aa, Mycobacterium
AWVMRETLAWMYRYVKDDGSQDDV

SEQ ID NO: 1357988 - protein, 24 aa, Mycobacterium
AYAATDVITFYPPTGGPAGSPGRA

SEQ ID NO: 1357989 - protein, 20 aa, Mycobacterium
AYDAIIYTAGPPGAQPATIV

SEQ ID NO: 1357990 - protein, 22 aa, Mycobacterium
AYGPSRILGIDLTKTPALIDTQ

SEQ ID NO: 1357991 - protein, 19 aa, Mycobacterium
AYLFTHPDVNTFLTGLHGM

SEQ ID NO: 1357992 - protein, 17 aa, Mycobacterium
AYRVLARHPEWDAVVRP

SEQ ID NO: 1357993 - protein, 24 aa, Mycobacterium
AYSHGAAIMLWVTMNVDNSHPELL

SEQ ID NO: 1357994 - protein, 33 aa, Mycobacterium
AYVEALRVAYRPPWELALHRWLDAVTPHRRTYG

SEQ ID NO: 1357995 - protein, 34 aa, Mycobacterium
CADPDLVGIPYPASFWPLSFLPGWCVPGRCEKWD

SEQ ID NO: 1357996 - protein, 21 aa, Mycobacterium
CAEELSFSPPFDAAVAALVAR

SEQ ID NO: 1357997 - protein, 36 aa, Mycobacterium
CAEYLGPALRLLNFNYLPMPINAYLKKSPSPENLVY

SEQ ID NO: 1357998 - protein, 23 aa, Mycobacterium
CAHIAAAEPWWAPGTAQGYHMVT

SEQ ID NO: 1357999 - protein, 25 aa, Mycobacterium
CARDPFGIKPLYIATGPGGTAVGSE

SEQ ID NO: 1358000 - protein, 24 aa, Mycobacterium
CARDPFGIKPLYLATGTGGTAVGS

SEQ ID NO: 1358001 - protein, 21 aa, Mycobacterium
CATGRRRIAFVSGPTELRQVR

SEQ ID NO: 1358002 - protein, 18 aa, Mycobacterium
CEFMEFPSGILQVCGDSF

SEQ ID NO: 1358003 - protein, 23 aa, Mycobacterium
CFGGAYMRWVAEDSSARFTLSTG

SEQ ID NO: 1358004 - protein, 27 aa, Mycobacterium
CGAFKEALPNWKGLANLPVSTALSSIP

SEQ ID NO: 1358005 - protein, 26 aa, Mycobacterium
CGCYYSDVYWITFAGMATVDDPRYVI

SEQ ID NO: 1358006 - protein, 24 aa, Mycobacterium
CGEPQTYPPVVWQVAGDQIAQITP

SEQ ID NO: 1358007 - protein, 26 aa, Mycobacterium
CIASKFFRPDLLGPCAKFVSPFGGPG

SEQ ID NO: 1358008 - protein, 31 aa, Mycobacterium
CKDDLSHNAFRYFRALRTYLGALPVTMMRVS

SEQ ID NO: 1358009 - protein, 23 aa, Mycobacterium
CLANKVMALLALGKVPAALTEVS

SEQ ID NO: 1358010 - protein, 25 aa, Mycobacterium
CRSAGIFQSHYYTGARLADGATTSG

SEQ ID NO: 1358011 - protein, 25 aa, Mycobacterium
CSGLTRFAFAGVGVLLPRWSGDQYN

SEQ ID NO: 1358012 - protein, 18 aa, Mycobacterium
CSSQPPEYQPPPGALVAG

SEQ ID NO: 1358013 - protein, 24 aa, Mycobacterium
CSSVPYPYLLRAEGVELLDQAIRQ

SEQ ID NO: 1358014 - protein, 20 aa, Mycobacterium
CTAPDIMVLFGSTASSRVAI

SEQ ID NO: 1358015 - protein, 28 aa, Mycobacterium
DAADLYEAALLADPLWRARGVHTGFVCH

SEQ ID NO: 1358016 - protein, 18 aa, Mycobacterium
DAADQLAAYILLTPGDDG

SEQ ID NO: 1358017 - protein, 20 aa, Mycobacterium
DAAIDYWAEFFRLGQRNEAE

SEQ ID NO: 1358018 - protein, 17 aa, Mycobacterium
DAAPHWPRRRTLRRRPH

SEQ ID NO: 1358019 - protein, 29 aa, Mycobacterium
DAAVRAFTDRGWRWGGHWRTPLDYQHFEF

SEQ ID NO: 1358020 - protein, 23 aa, Mycobacterium
DACNGGDGGILWGNGGNGAHGGT

SEQ ID NO: 1358021 - protein, 19 aa, Mycobacterium
DACVLWCCAIRHAVLTGQL

SEQ ID NO: 1358022 - protein, 26 aa, Mycobacterium
DADDFLNLIAELPPPEGVTAEWIVRN

SEQ ID NO: 1358023 - protein, 17 aa, Mycobacterium
DADVAFLQQMIPHHAQA

SEQ ID NO: 1358024 - protein, 19 aa, Mycobacterium
DAERFHRAATYPVYLNRPA

SEQ ID NO: 1358025 - protein, 25 aa, Mycobacterium
DAFRDSDAWFLIRAVTPPDAEVLPR

SEQ ID NO: 1358026 - protein, 25 aa, Mycobacterium
DAGDIELLPVTKFFPASDVVALHRL

SEQ ID NO: 1358027 - protein, 37 aa, Mycobacterium
DAGPALTRALSFLPTFPFPKETLTNWMRGDYANLTLI

SEQ ID NO: 1358028 - protein, 50 aa, Mycobacterium
DAHDDVLDLLFANPTPTTQWIPDAMALINLFFKSALPGYSFSDGLNTFGD

SEQ ID NO: 1358029 - protein, 31 aa, Mycobacterium
DAITFAGIQLRDNAVRPLLVDAAAGTVQTSD

SEQ ID NO: 1358030 - protein, 27 aa, Mycobacterium
DAITFAGIQLRDNAVRPLLVDAAARTV

SEQ ID NO: 1358031 - protein, 28 aa, Mycobacterium
DAITFAGIQLRDNAVRPLLVDAAARTVQ

SEQ ID NO: 1358032 - protein, 22 aa, Mycobacterium
DALPEMGHACGHNIIAASAVGT

SEQ ID NO: 1358033 - protein, 28 aa, Mycobacterium
DALSRAVIRLFLTPMPLQAAELRRALAD

SEQ ID NO: 1358034 - protein, 24 aa, Mycobacterium
DAPAIPSPALYPGAPIPAPPNVLS

SEQ ID NO: 1358035 - protein, 22 aa, Mycobacterium
DAPIAWGALSALSADPADENRL

SEQ ID NO: 1358036 - protein, 18 aa, Mycobacterium
DAPSLRPLIGELAALALS

SEQ ID NO: 1358037 - protein, 20 aa, Mycobacterium
DAPWAPFTIDFNLANIGGPS

SEQ ID NO: 1358038 - protein, 21 aa, Mycobacterium
DATLVTIMRWLRPGAMIAITE

SEQ ID NO: 1358039 - protein, 31 aa, Mycobacterium; identical to SEQ ID NO: 1306112

SEQ ID NO: 1358040 - protein, 17 aa, Mycobacterium
DAVPGVPFLPATLPIPQ

SEQ ID NO: 1358041 - protein, 33 aa, Mycobacterium
DAYKKLGRQGLYGDWFAFYVCEVVFKVNGKGGQ

SEQ ID NO: 1358042 - protein, 17 aa, Mycobacterium
DCPPNCDRIPRSAWIAP

SEQ ID NO: 1358043 - protein, 25 aa, Mycobacterium
DDDYLAILDIRPFTRGHTLVLPKVH

SEQ ID NO: 1358044 - protein, 34 aa, Mycobacterium
DDFVKSLEFLPTFPFHYKYLRNAVRGDYLNVFTT

SEQ ID NO: 1358045 - protein, 27 aa, Mycobacterium
DDHDTFLLALGQMWAAGVDLDWSRLSK

SEQ ID NO: 1358046 - protein, 25 aa, Mycobacterium
DDINDTLVLPYDIPLLGVQCDEANA

SEQ ID NO: 1358047 - protein, 33 aa, Mycobacterium
DDLAESFLPGRLRLLVRLTRVAALRRAAATVTD

SEQ ID NO: 1358048 - protein, 23 aa, Mycobacterium
DDQVTVNFFTGPFGVYDALTSRT

SEQ ID NO: 1358049 - protein, 25 aa, Mycobacterium
DDSASSLLVLTWAPSFCTVEAQNPA

SEQ ID NO: 1358050 - protein, 24 aa, Mycobacterium
DEEWHEVLELNLSSAWYLSRAAAK

SEQ ID NO: 1358051 - protein, 21 aa, Mycobacterium
DEGMAKLDATFRPLVERDYRR

SEQ ID NO: 1358052 - protein, 23 aa, Mycobacterium
DEGNPHVWYNPTAVTEFAEAVTA

SEQ ID NO: 1358053 - protein, 23 aa, Mycobacterium
DEIGYGVLFFASDASSYCSGQTL

SEQ ID NO: 1358054 - protein, 23 aa, Mycobacterium
DELHLLVHPIAVRKGARLFDEGT

SEQ ID NO: 1358055 - protein, 28 aa, Mycobacterium
DEPADLAARLWDLPAWAAQGRRLLDDMD

SEQ ID NO: 1358056 - protein, 24 aa, Mycobacterium
DEPPAHLVLGSDALRLIAAARSAV

SEQ ID NO: 1358057 - protein, 23 aa, Mycobacterium
DEQRVFGLLVSPIGDDLSRLRAS

SEQ ID NO: 1358058 - protein, 28 aa, Mycobacterium
DERATPPWWPMRRLVRALGADADEVLEI

SEQ ID NO: 1358059 - protein, 23 aa, Mycobacterium
DESDRVVFLFPGQGAQHADMARG

SEQ ID NO: 1358060 - protein, 23 aa, Mycobacterium
DESFFGFAALDYGLRLNAMQAEW

SEQ ID NO: 1358061 - protein, 27 aa, Mycobacterium
DESTRLVYFQHGFLASGPMYSYTAARL

SEQ ID NO: 1358062 - protein, 25 aa, Mycobacterium
DETWAKVFYHSLGLGTSARFVDGRA

SEQ ID NO: 1358063 - protein, 30 aa, Mycobacterium
DEYDRRWRTLTRRYRLLTAGLVRAGATPSI

SEQ ID NO: 1358064 - protein, 21 aa, Mycobacterium
DFEWPMTRLTLALSPATLPKM

SEQ ID NO: 1358065 - protein, 27 aa, Mycobacterium
DFSRKYGWIPVVGTVAHAFSLMGNVGE

SEQ ID NO: 1358066 - protein, 31 aa, Mycobacterium
DFSTGLYAAISILALLYGRARHPGSAPAPSV

SEQ ID NO: 1358067 - protein, 18 aa, Mycobacterium
DFVAAWKADPAKVTIGGG

SEQ ID NO: 1358068 - protein, 20 aa, Mycobacterium
DFVVGVVITEQKCFGSAGCN

SEQ ID NO: 1358069 - protein, 18 aa, Mycobacterium
DGAALPWSLTLETTEPSA

SEQ ID NO: 1358070 - protein, 27 aa, Mycobacterium
DGAASSWLVLTWAPSFCRVEPSNPACT

SEQ ID NO: 1358071 - protein, 18 aa, Mycobacterium
DGAERWLRAFKDQDPQAF

SEQ ID NO: 1358072 - protein, 28 aa, Mycobacterium
DGARYGVPFYNYALGYLYNADDLTAANQ

SEQ ID NO: 1358073 - protein, 17 aa, Mycobacterium
DGDAAVRAFTDRGWRWG

SEQ ID NO: 1358074 - protein, 25 aa, Mycobacterium
DGDIWDWAVPWDEWVAMSALSEQES

SEQ ID NO: 1358075 - protein, 24 aa, Mycobacterium
DGEGWKHYLKQSVVLFPYQEKAGE

SEQ ID NO: 1358076 - protein, 17 aa, Mycobacterium
DGGQYLLARLDPATPDD

SEQ ID NO: 1358077 - protein, 17 aa, Mycobacterium
DGKLAWAGLSALTPDSD

SEQ ID NO: 1358078 - protein, 21 aa, Mycobacterium
DGKLYVFDPVTGAQIKTIDVT

SEQ ID NO: 1358079 - protein, 28 aa, Mycobacterium
DGLNTFGDLLNRLVPPYTIEPGPDYVMT

SEQ ID NO: 1358080 - protein, 25 aa, Mycobacterium
DGLPRDTPPVLPPFHKVTASKGAAE

SEQ ID NO: 1358081 - protein, 25 aa, Mycobacterium
DGLTLGQALVFWASGRDQLVPRELV

SEQ ID NO: 1358082 - protein, 25 aa, Mycobacterium
DGMTVPGFFTAPVTSIPGAIEAIDD

SEQ ID NO: 1358083 - protein, 30 aa, Mycobacterium
DGPINDLLAGLWVGMRRLHYTFFNSSPELD

SEQ ID NO: 1358084 - protein, 30 aa, Mycobacterium
DGPRLALTEAPFLRRIALTGPVAAPWATTI

SEQ ID NO: 1358085 - protein, 25 aa, Mycobacterium
DGPTTFFEFTPLALIPNWIKPLYSW

SEQ ID NO: 1358086 - protein, 24 aa, Mycobacterium
DGQPVILLHGWPYDIHSYADVTAI

SEQ ID NO: 1358087 - protein, 21 aa, Mycobacterium
DGRLVEIMRWLRPGALIAVSK

SEQ ID NO: 1358088 - protein, 23 aa, Mycobacterium
DGTEASMWWDFSGLTISDVTIHN

SEQ ID NO: 1358089 - protein, 26 aa, Mycobacterium
DGTLQVPVHIPLFAEPVTAAGVSSVP

SEQ ID NO: 1358090 - protein, 25 aa, Mycobacterium
DGTWQRCVAVARWVPSGLSSHLIPE

SEQ ID NO: 1358091 - protein, 17 aa, Mycobacterium
DGVLALDELLAEGPPMP

SEQ ID NO: 1358092 - protein, 27 aa, Mycobacterium
DGVRPDSKPWHPSGLAIDIMIPNPESP

SEQ ID NO: 1358093 - protein, 21 aa, Mycobacterium
DHAHFMFVVTLDRASTEAVTV

SEQ ID NO: 1358094 - protein, 18 aa, Mycobacterium
DHRLFAGIPYAAPPIGPL

SEQ ID NO: 1358095 - protein, 25 aa, Mycobacterium
DHYEDDWTRLWWVRADGKAAIHHSG

SEQ ID NO: 1358096 - protein, 17 aa, Mycobacterium
DIAWDFQRYYDTAAASR

SEQ ID NO: 1358097 - protein, 17 aa, Mycobacterium
DICFIPSGDTRAFLGAR

SEQ ID NO: 1358098 - protein, 26 aa, Mycobacterium
DIDLYAPVARYWPEFGRAGKEDITLA

SEQ ID NO: 1358099 - protein, 28 aa, Mycobacterium
DIERLRTTWDVPTLALLGIGNGAQVALA

SEQ ID NO: 1358100 - protein, 17 aa, Mycobacterium
DIGAPPQFMDFRYTVHD

SEQ ID NO: 1358101 - protein, 34 aa, Mycobacterium
DIKLLGAGSTFYLPVFAPGALFYVGDPHMAMGDG

SEQ ID NO: 1358102 - protein, 17 aa, Mycobacterium
DIPAALLDAAKQVRDSW

SEQ ID NO: 1358103 - protein, 24 aa, Mycobacterium
DIPLDVVARIGLAYTPPAHEDSLR

SEQ ID NO: 1358104 - protein, 20 aa, Mycobacterium
DIPLLGVQCDEANAFWAPDA

SEQ ID NO: 1358105 - protein, 17 aa, Mycobacterium
DIPPPPGWNQPPGPPGL

SEQ ID NO: 1358106 - protein, 17 aa, Mycobacterium
DIQAVINALWSAGAEGI

SEQ ID NO: 1358107 - protein, 18 aa, Mycobacterium
DIRGAITGALLSSLAALV

SEQ ID NO: 1358108 - protein, 22 aa, Mycobacterium
DITGGTCCIGVWGPLARDMVQP

SEQ ID NO: 1358109 - protein, 23 aa, Mycobacterium
DITTPREFWSFLLTGGSKVTEVP

SEQ ID NO: 1358110 - protein, 18 aa, Mycobacterium
DKANLAMALLAKTEFGIG

SEQ ID NO: 1358111 - protein, 25 aa, Mycobacterium
DKLSFAKGILLRRDPDREETGRLLR

SEQ ID NO: 1358112 - protein, 17 aa, Mycobacterium
DKLTLVQLPPSVSYSFR

SEQ ID NO: 1358113 - protein, 26 aa, Mycobacterium
DKPGLITLPGYQFARHRHWVEPNRNL

SEQ ID NO: 1358114 - protein, 23 aa, Mycobacterium
DKQPSVWMPPNDAFHCQYAMQYI

SEQ ID NO: 1358115 - protein, 34 aa, Mycobacterium
DKSAYEYYTPFGWLRGFPFLAVQVVWAPGSEMSV

SEQ ID NO: 1358116 - protein, 39 aa, Mycobacterium
DKTILQAIELWKIVDRPNLLIKIPATMAGLPAITAVIAE

SEQ ID NO: 1358117 - protein, 24 aa, Mycobacterium
DKVVLVFDEPFWTEAFDIHSDMLG

SEQ ID NO: 1358118 - protein, 18 aa, Mycobacterium
DLAALAAAARVASGARSA

SEQ ID NO: 1358119 - protein, 25 aa, Mycobacterium
DLAAMLAPLLRDLAAAELPILEEHG

SEQ ID NO: 1358120 - protein, 24 aa, Mycobacterium
DLAAMLAPLLRDLAAAEVPILEEH

SEQ ID NO: 1358121 - protein, 21 aa, Mycobacterium
DLAPIPIPDVALRTVGRIFDV

SEQ ID NO: 1358122 - protein, 29 aa, Mycobacterium
DLDDPEKRFFILLALRLRGVVGLGPNDSR

SEQ ID NO: 1358123 - protein, 25 aa, Mycobacterium
DLDLHSAGWFRRHGIDLLLGVTVEH

SEQ ID NO: 1358124 - protein, 19 aa, Mycobacterium
DLDPFHTWVKGRVAVLGDA

SEQ ID NO: 1358125 - protein, 21 aa, Mycobacterium
DLGAGYVWPARAGDGSGADGV

SEQ ID NO: 1358126 - protein, 19 aa, Mycobacterium
DLHTGYFNALYSAQFPLDG

SEQ ID NO: 1358127 - protein, 25 aa, Mycobacterium
DLILDNGLNLEAWFARFVDGIDVPH

SEQ ID NO: 1358128 - protein, 19 aa, Mycobacterium
DLIPEYTGNLLQYFDPESA

SEQ ID NO: 1358129 - protein, 25 aa, Mycobacterium
DLIVAGFGVGLLPLGRPTSPGVTVL

SEQ ID NO: 1358130 - protein, 18 aa, Mycobacterium
DLKASYEPLIKLLEAETG

SEQ ID NO: 1358131 - protein, 26 aa, Mycobacterium
DLLYSYRKSLWCGIGGLVPFAKSPPQ

SEQ ID NO: 1358132 - protein, 19 aa, Mycobacterium
DLQWFTDDRILPQLPRSAG

SEQ ID NO: 1358133 - protein, 24 aa, Mycobacterium
DLVNGLRFTDVPLLVGLRGGANAR

SEQ ID NO: 1358134 - protein, 20 aa, Mycobacterium
DMGEFFMPFPGTRVNQQVVP

SEQ ID NO: 1358135 - protein, 27 aa, Mycobacterium
DMGRKFLTQLGILPQASAPADPGFTNG

SEQ ID NO: 1358136 - protein, 21 aa, Mycobacterium
DMSNPMAGMITKPFTVTVSCS

SEQ ID NO: 1358137 - protein, 17 aa, Mycobacterium
DNAVPPPPLAAPAPQDP

SEQ ID NO: 1358138 - protein, 17 aa, Mycobacterium
DNEGQHLYWVVGDNTQG

SEQ ID NO: 1358139 - protein, 23 aa, Mycobacterium
DNGFGFYTGPLLPGTTISQGIGG

SEQ ID NO: 1358140 - protein, 23 aa, Mycobacterium
DNLLGLMFAAPIPQSTPLDADAT

SEQ ID NO: 1358141 - protein, 19 aa, Mycobacterium
DNLPFPPHFSERNPGKRGG

SEQ ID NO: 1358142 - protein, 18 aa, Mycobacterium
DNPFNLLALANAFAGFQY

SEQ ID NO: 1358143 - protein, 28 aa, Mycobacterium
DNSLMVPIHWATFRLAPHPWAEPAERLL

SEQ ID NO: 1358144 - protein, 38 aa, Mycobacterium
DPAAGPEFGFSLAGPIGALLLWRAGLADSIRTIFGFGR

SEQ ID NO: 1358145 - protein, 21 aa, Mycobacterium
DPAFAPMLATLGAAPSGAAHA

SEQ ID NO: 1358146 - protein, 19 aa, Mycobacterium
DPAITVCRSGIRTKTVCGQ

SEQ ID NO: 1358147 - protein, 23 aa, Mycobacterium
DPAIVAMPAPLPGANGPSPAAGG

SEQ ID NO: 1358148 - protein, 19 aa, Mycobacterium
DPALGPLVGPYATMASLPA

SEQ ID NO: 1358149 - protein, 28 aa, Mycobacterium
DPEGAADRWNWVLDGMVEIGALSEADRA

SEQ ID NO: 1358150 - protein, 23 aa, Mycobacterium
DPGQPWPGRLPEPSPTVLLDDPV

SEQ ID NO: 1358151 - protein, 18 aa, Mycobacterium
DPGSPLLNRAISEAYPPG

SEQ ID NO: 1358152 - protein, 24 aa, Mycobacterium
DPGSTSGFLYPSAGLIEAGVIQSG

SEQ ID NO: 1358153 - protein, 23 aa, Mycobacterium
DPGSTSGFLYPSAGLIEEGVIKS

SEQ ID NO: 1358154 - protein, 30 aa, Mycobacterium
DPHSRQLLAAQLIWTLSRSGINGPYVLNAD

SEQ ID NO: 1358155 - protein, 40 aa, Mycobacterium
DPILQSPPALAVTGGLPYLLGGDPVGLLSLAKIVDADSPS

SEQ ID NO: 1358156 - protein, 23 aa, Mycobacterium
DPLFDDFALINFGTSRSVSTING

SEQ ID NO: 1358157 - protein, 27 aa, Mycobacterium
DPMEAAYVSVYLWKNTVEKAQSFDVKA

SEQ ID NO: 1358158 - protein, 20 aa, Mycobacterium
DPNWRPGRETVLADQLRASV

SEQ ID NO: 1358159 - protein, 29 aa, Mycobacterium
DPPVAEDYPPLVLWVLGQENLADVAARAA

SEQ ID NO: 1358160 - protein, 31 aa, Mycobacterium
DPPVRSAGLLRVFLLGLVPPEQARAHLHAMA

SEQ ID NO: 1358161 - protein, 29 aa, Mycobacterium
DPQDPMVSPLFFEDAVLAALPPTTLYVGE

SEQ ID NO: 1358162 - protein, 26 aa, Mycobacterium
DPQFVALATPAFGLAPDPAPELPFNR

SEQ ID NO: 1358163 - protein, 26 aa, Mycobacterium
DPSPADLDAFLRLLGDRGVDVLIYNV

SEQ ID NO: 1358164 - protein, 26 aa, Mycobacterium
DPSPADLDAFLRLLSDRGVDVLIYNV

SEQ ID NO: 1358165 - protein, 25 aa, Mycobacterium
DPSTDKLDFGWFKAHEFDVTEVAGS

SEQ ID NO: 1358166 - protein, 25 aa, Mycobacterium
DPTRFNDLLDQIDPRIRADAYWPTL

SEQ ID NO: 1358167 - protein, 24 aa, Mycobacterium
DQAQAFVNFQFTPEAQKLWAEANF

SEQ ID NO: 1358168 - protein, 35 aa, Mycobacterium
DQFIAPRLFRPKDDPLYGVLQCGAPLNLPIDGVSP

SEQ ID NO: 1358169 - protein, 18 aa, Mycobacterium
DQILMMISQEYQTGRGGG

SEQ ID NO: 1358170 - protein, 23 aa, Mycobacterium
DQIMAYAMANAARFGLQDVIWRG

SEQ ID NO: 1358171 - protein, 21 aa, Mycobacterium
DQIYIWYPDLVLPTVDSFVYD

SEQ ID NO: 1358172 - protein, 26 aa, Mycobacterium
DQNGVRRWLALDGQPLHRVIVAASEM

SEQ ID NO: 1358173 - protein, 23 aa, Mycobacterium
DQRDNLVYALDQLGKFGALTADT

SEQ ID NO: 1358174 - protein, 32 aa, Mycobacterium
DQTPRWLHGCAGWPGLIWKFVRVDDARITPNR

SEQ ID NO: 1358175 - protein, 24 aa, Mycobacterium
DQTRPLFLHGGRFSVLLAHHLGAH

SEQ ID NO: 1358176 - protein, 20 aa, Mycobacterium
DQTRPLFLHGGRFSVLLAQH

SEQ ID NO: 1358177 - protein, 27 aa, Mycobacterium
DQVLQSYLNIIYFGRGAYGVAAASRAY

SEQ ID NO: 1358178 - protein, 22 aa, Mycobacterium
DRENAMRFYEGASWHAGGRLLK

SEQ ID NO: 1358179 - protein, 31 aa, Mycobacterium
DRFAPIIGGIRPGLFVSSNFLPGSPAYTYPE

SEQ ID NO: 1358180 - protein, 23 aa, Mycobacterium
DRFDTFAASMYVSGPSSSYLTAT

SEQ ID NO: 1358181 - protein, 20 aa, Mycobacterium
DRGIARIVVVSLGAQGALLA

SEQ ID NO: 1358182 - protein, 21 aa, Mycobacterium
DRLHVRYDLSWQALDGALARR

SEQ ID NO: 1358183 - protein, 23 aa, Mycobacterium
DRLPFVTVALIRIAALLAHASEV

SEQ ID NO: 1358184 - protein, 17 aa, Mycobacterium
DRLRRLYSDPQSVLRYP

SEQ ID NO: 1358185 - protein, 24 aa, Mycobacterium
DRMWALQRSFMYRDMGTIGVDVVS

SEQ ID NO: 1358186 - protein, 20 aa, Mycobacterium
DRPETLHLAAARLMSRCDAA

SEQ ID NO: 1358187 - protein, 25 aa, Mycobacterium
DRPTPPLLYGFYDVSVDFSKQTFNG

SEQ ID NO: 1358188 - protein, 23 aa, Mycobacterium
DRPYAIPDRPLVEGMPSYPAWDR

SEQ ID NO: 1358189 - protein, 27 aa, Mycobacterium
DRRAILERLRALPLAPFRDSYAYTNFG

SEQ ID NO: 1358190 - protein, 27 aa, Mycobacterium
DRRQVLERLRQLPLDQFRTSYAYTNFG

SEQ ID NO: 1358191 - protein, 26 aa, Mycobacterium
DRTIGWDRGELLPGLQRAHGDMGVVM

SEQ ID NO: 1358192 - protein, 18 aa, Mycobacterium
DRYQALGRQGMYGDFFSF

SEQ ID NO: 1358193 - protein, 20 aa, Mycobacterium
DRYVVAGAPLRPIGGYQSAV

SEQ ID NO: 1358194 - protein, 20 aa, Mycobacterium
DSAQVMVYLNRTVIEKNGKP

SEQ ID NO: 1358195 - protein, 34 aa, Mycobacterium
DSAWHTWRMTWLPTGMYFWKDYQPGMEPFFTVAS

SEQ ID NO: 1358196 - protein, 26 aa, Mycobacterium
DSDLLTNILTYHVVPGQAAPEQVVGE

SEQ ID NO: 1358197 - protein, 25 aa, Mycobacterium
DSEWGWTAPIYQKSGVWYVKHTVEN

SEQ ID NO: 1358198 - protein, 27 aa, Mycobacterium
DSPSAGIEQLIFAPQGPLAAVPARRAL

SEQ ID NO: 1358199 - protein, 30 aa, Mycobacterium
DSVPSQLIDAYFADGPLGAVAYASLLVSDG

SEQ ID NO: 1358200 - protein, 17 aa, Mycobacterium
DSYAYTNFGLTAAAEAV

SEQ ID NO: 1358201 - protein, 29 aa, Mycobacterium
DTAAQLEYQLRPFPPDTGPYLLMIMHGNQ

SEQ ID NO: 1358202 - protein, 27 aa, Mycobacterium
DTGGVRDWRFIALTPPATVSKLLIRVA

SEQ ID NO: 1358203 - protein, 20 aa, Mycobacterium
DTSVLLGRLDLKLFAGAEND

SEQ ID NO: 1358204 - protein, 23 aa, Mycobacterium
DTTMRVFGPDSFPGSVLAAVGVD

SEQ ID NO: 1358205 - protein, 26 aa, Mycobacterium
DTVPLTYPFALTFPTVMALVTGFDFP

SEQ ID NO: 1358206 - protein, 23 aa, Mycobacterium
DTVTPMLPGAPLQPNYPSIQFGP

SEQ ID NO: 1358207 - protein, 31 aa, Mycobacterium
DVAAAVGFPGFWRFAVRNTAAAVREARTVMS

SEQ ID NO: 1358208 - protein, 20 aa, Mycobacterium
DVAFLQQMIPHHAQAIEMSD

SEQ ID NO: 1358209 - protein, 24 aa, Mycobacterium
DVDALNVVAVRYLPDDRQLQVLPD

SEQ ID NO: 1358210 - protein, 23 aa, Mycobacterium
DVDGRMVTWTPCEILQQHLRMRG

SEQ ID NO: 1358211 - protein, 18 aa, Mycobacterium
DVFADLHRLRFPIEKMHT

SEQ ID NO: 1358212 - protein, 17 aa, Mycobacterium
DVFATIRDLSLVVTALQ

SEQ ID NO: 1358213 - protein, 19 aa, Mycobacterium
DVFTALERPSLIDSGAFGQ

SEQ ID NO: 1358214 - protein, 29 aa, Mycobacterium
DVKGALRVLELHPLLNPAAYVWADVDPGF

SEQ ID NO: 1358215 - protein, 30 aa, Mycobacterium
DVLAVELSSFQLHWAPSLRPEAGAVLNVAE

SEQ ID NO: 1358216 - protein, 17 aa, Mycobacterium
DVLLLNTSFAGPAMAEV

SEQ ID NO: 1358217 - protein, 21 aa, Mycobacterium
DVLPGANVLPGATALPGGNMT

SEQ ID NO: 1358218 - protein, 19 aa, Mycobacterium
DVPPPLVPAMPLPENAVAD

SEQ ID NO: 1358219 - protein, 22 aa, Mycobacterium
DVPSVLLTPKSITKDNINVVFD

SEQ ID NO: 1358220 - protein, 17 aa, Mycobacterium
DVRNKRKLGPAGPIEFP

SEQ ID NO: 1358221 - protein, 28 aa, Mycobacterium
DVRPWQEEPLLSQWVAAVAGPKYASRIS

SEQ ID NO: 1358222 - protein, 21 aa, Mycobacterium
DVSYPFYLANGRIPAAPTTLT

SEQ ID NO: 1358223 - protein, 22 aa, Mycobacterium
DVSYPFYLANGRIPAAPTTLTA

SEQ ID NO: 1358224 - protein, 30 aa, Mycobacterium
DVTAPQFRQILPTTPGPEGVLPIPSRELVV

SEQ ID NO: 1358225 - protein, 31 aa, Mycobacterium
DVTTPDAVILGLLRALPGDLSILYPSPAEDK

SEQ ID NO: 1358226 - protein, 20 aa, Mycobacterium
DVVDGWRRPDGPVAPLHLVA

SEQ ID NO: 1358227 - protein, 28 aa, Mycobacterium
DVVGFDCSGLILYAFAGVGIALPHYTGH

SEQ ID NO: 1358228 - protein, 18 aa, Mycobacterium
DVVVRTWRPERDRRMLIV

SEQ ID NO: 1358229 - protein, 21 aa, Mycobacterium
DVYRSLVWPLVDAPADTTDPR

SEQ ID NO: 1358230 - protein, 17 aa, Mycobacterium
DVYSWDAATLQGTLTSS

SEQ ID NO: 1358231 - protein, 25 aa, Mycobacterium
DWATQISYSGIYVHAAPWSVGSQGY

SEQ ID NO: 1358232 - protein, 26 aa, Mycobacterium
DWFGGEPFGVWPWARGQLGPAQPTVL

SEQ ID NO: 1358233 - protein, 24 aa, Mycobacterium
DWGATSLKKLLTSSLRISDKTAGE

SEQ ID NO: 1358234 - protein, 23 aa, Mycobacterium
DWLSDVPAWPNPFSLLNTLTAVV

SEQ ID NO: 1358235 - protein, 23 aa, Mycobacterium
DWNDVSAYYPAGGRWNDWARFFH

SEQ ID NO: 1358236 - protein, 21 aa, Mycobacterium
DWQDPRPTVFTREDVVYVTDP

SEQ ID NO: 1358237 - protein, 22 aa, Mycobacterium
DWTPLTVEQLIQLSSAFEGHPD

SEQ ID NO: 1358238 - protein, 24 aa, Mycobacterium
DYMKLVGERLGWARVPPGSRTSTY

SEQ ID NO: 1358239 - protein, 26 aa, Mycobacterium
DYPNSVYNQPWFQTANFGAALPDKFE

SEQ ID NO: 1358240 - protein, 19 aa, Mycobacterium
DYSRLLIEPTDINSAYDTF

SEQ ID NO: 1358241 - protein, 19 aa, Mycobacterium
DYWYLALNEAREPWNDVRV

SEQ ID NO: 1358242 - protein, 26 aa, Mycobacterium
EAAAMRRMLLVLGFPDHRIIVEDRAN

SEQ ID NO: 1358243 - protein, 18 aa, Mycobacterium
EAARRLSVLSLPTTIIFD

SEQ ID NO: 1358244 - protein, 35 aa, Mycobacterium
EADDLRIPPELLGGRIYVSLEQPLYIAISADDSGW

SEQ ID NO: 1358245 - protein, 32 aa, Mycobacterium
EADLSVNLNGPFYLCRAALPHLLESGGNIVNV

SEQ ID NO: 1358246 - protein, 22 aa, Mycobacterium
EADPTVLANWLAAVEEIRTKGT

SEQ ID NO: 1358247 - protein, 25 aa, Mycobacterium
EAGRPGVQLSLLTGTPNLGYGNEGL

SEQ ID NO: 1358248 - protein, 26 aa, Mycobacterium
EAGSSAPLLLRIWAGSDILDSRLVID

SEQ ID NO: 1358249 - protein, 18 aa, Mycobacterium
EALIAPLIEQFTADTGIE

SEQ ID NO: 1358250 - protein, 20 aa, Mycobacterium
EALRRRRADFTPAEQERLAR

SEQ ID NO: 1358251 - protein, 21 aa, Mycobacterium
EALVGVLAASALLVGCTSSTA

SEQ ID NO: 1358252 - protein, 36 aa, Mycobacterium
EANWLPAPKGPFALVLRLYWPKPDALNGSWRSPQPE

SEQ ID NO: 1358253 - protein, 26 aa, Mycobacterium
EAPSDDPLWFWSDQYGRNIQFVGTAS

SEQ ID NO: 1358254 - protein, 22 aa, Mycobacterium
EAQKLWAEANFRPVDPAVLAEF

SEQ ID NO: 1358255 - protein, 25 aa, Mycobacterium
EAQMKALFGLGWHPNADKIYGHLSP

SEQ ID NO: 1358256 - protein, 17 aa, Mycobacterium
EARLKYRGWGVPYDHAR

SEQ ID NO: 1358257 - protein, 17 aa, Mycobacterium
EARLLKEQFYSTAWDTL

SEQ ID NO: 1358258 - protein, 24 aa, Mycobacterium
EARQMRNMLRLYGIPDERIIVEDR

SEQ ID NO: 1358259 - protein, 31 aa, Mycobacterium
EAVAGRPVVLNLWAYWCGPCADELPAMAEYQ

SEQ ID NO: 1358260 - protein, 25 aa, Mycobacterium
ECREVYYQYILPLGTFEPGLAENVK

SEQ ID NO: 1358261 - protein, 18 aa, Mycobacterium
EDALTRHGLLGSDHRWRL

SEQ ID NO: 1358262 - protein, 23 aa, Mycobacterium
EDGNPIRILAPRSHQPGSLATWF

SEQ ID NO: 1358263 - protein, 32 aa, Mycobacterium
EELQLPVLRAQLRWMEAVLAMWIGDFAEAARH

SEQ ID NO: 1358264 - protein, 19 aa, Mycobacterium
EEPNILWHRGIGDDQRIEG

SEQ ID NO: 1358265 - protein, 19 aa, Mycobacterium
EEVEALLERYREGDGFVSY

SEQ ID NO: 1358266 - protein, 25 aa, Mycobacterium
EFVEALPAIVWYLDEPVADPALVPL

SEQ ID NO: 1358267 - protein, 31 aa, Mycobacterium
EGATPTRLIYLQHGFLASGAFYSYTAARLAE

SEQ ID NO: 1358268 - protein, 18 aa, Mycobacterium
EGDHGFVPTLISIARATG

SEQ ID NO: 1358269 - protein, 18 aa, Mycobacterium
EGGGLLLVAYAVNGEIVS

SEQ ID NO: 1358270 - protein, 23 aa, Mycobacterium
EGGNLVHAPLWGMSRIAAAEHPQ

SEQ ID NO: 1358271 - protein, 17 aa, Mycobacterium
EGKVLPGYGWIFPLGNG

SEQ ID NO: 1358272 - protein, 19 aa, Mycobacterium
EGKVLPGYGWIFPLGNGEV

SEQ ID NO: 1358273 - protein, 18 aa, Mycobacterium
EGLKQMLFGPLDGPPRNT

SEQ ID NO: 1358274 - protein, 29 aa, Mycobacterium
EGLRATVQWYRDNEAWWRPLKDAAESAYE

SEQ ID NO: 1358275 - protein, 17 aa, Mycobacterium
EGMPGMEGMMSPADMQA

SEQ ID NO: 1358276 - protein, 26 aa, Mycobacterium
EGPDGSVLWSLRAIDWNCDNLFVAAH

SEQ ID NO: 1358277 - protein, 20 aa, Mycobacterium
EGQLVFARVGARPVRYVLGE

SEQ ID NO: 1358278 - protein, 44 aa, Mycobacterium
EGRDPATGATLWRYARDLELCGVTWVYSYAVAVYPDVRGCGQVS

SEQ ID NO: 1358279 - protein, 23 aa, Mycobacterium
EGTPLFAPISLEVAEIPPRCLMN

SEQ ID NO: 1358280 - protein, 24 aa, Mycobacterium
EGVAMHRAQLLRRLESPVVVQFDE

SEQ ID NO: 1358281 - protein, 20 aa, Mycobacterium
EGYFRFGGHLLPRDGRPKDP

SEQ ID NO: 1358282 - protein, 24 aa, Mycobacterium
EHALRHNFPVIARARYLLESIGPE

SEQ ID NO: 1358283 - protein, 24 aa, Mycobacterium
EHGPFDLTLLPIGAYHPAFADIHM

SEQ ID NO: 1358284 - protein, 19 aa, Mycobacterium
EHHMQLLCVQRLHGGLTIG

SEQ ID NO: 1358285 - protein, 27 aa, Mycobacterium
EHWMALSTMILPVKGAPFVVPPRGDDD

SEQ ID NO: 1358286 - protein, 17 aa, Mycobacterium
EIDGLRRAFGVSDTPRP

SEQ ID NO: 1358287 - protein, 21 aa, Mycobacterium
EILHSFGFMSFIERPGENVER

SEQ ID NO: 1358288 - protein, 17 aa, Mycobacterium
EILLARNDRYWSAPAKP

SEQ ID NO: 1358289 - protein, 18 aa, Mycobacterium
EILPDNPHIRYFSNRRGY

SEQ ID NO: 1358290 - protein, 43 aa, Mycobacterium
EITEQPWWGAYAWYVTPPSPAYPFWDRSLYADQFLSGDALAAA

SEQ ID NO: 1358291 - protein, 28 aa, Mycobacterium
EKGTVTVTPWGTFRYTPSATARHAAAAD

SEQ ID NO: 1358292 - protein, 24 aa, Mycobacterium
EKWSVPLQYLAQTPPSVTPGGLVI

SEQ ID NO: 1358293 - protein, 19 aa, Mycobacterium
ELAIALYGVARHAGAVPLA

SEQ ID NO: 1358294 - protein, 20 aa, Mycobacterium
ELAWHLDRSGRFGPPRQWLV

SEQ ID NO: 1358295 - protein, 20 aa, Mycobacterium
ELCVCDMAWVIGLSQGLVSH

SEQ ID NO: 1358296 - protein, 21 aa, Mycobacterium
ELDAQIRLLVATPAPDWVKAA

SEQ ID NO: 1358297 - protein, 27 aa, Mycobacterium
ELDKMIWEIGHSLPLFQAPGNVAVRSN

SEQ ID NO: 1358298 - protein, 30 aa, Mycobacterium; identical to SEQ ID NO: 1306554

SEQ ID NO: 1358299 - protein, 17 aa, Mycobacterium
ELDPVLQAPVRLASEID

SEQ ID NO: 1358300 - protein, 28 aa, Mycobacterium
ELECVDGQVWANLWPSDNIVRIDPASGA

SEQ ID NO: 1358301 - protein, 17 aa, Mycobacterium
ELECVDGQVWANVWPTD

SEQ ID NO: 1358302 - protein, 19 aa, Mycobacterium
ELEIPTLLLGVANNPIVGN

SEQ ID NO: 1358303 - protein, 19 aa, Mycobacterium
ELINGPVVQAWTISGLKPS

SEQ ID NO: 1358304 - protein, 18 aa, Mycobacterium
ELKNWVATLKLGIQPGVE

SEQ ID NO: 1358305 - protein, 32 aa, Mycobacterium
ELLVYGVNPLILRQRYPVPDAPYAVAGSRDDD

SEQ ID NO: 1358306 - protein, 23 aa, Mycobacterium
ELMLVLVPLIGAAYAAFRGVTAL

SEQ ID NO: 1358307 - protein, 25 aa, Mycobacterium
ELNTWALVAMENLAFPLTSLLTIPK

SEQ ID NO: 1358308 - protein, 21 aa, Mycobacterium
ELQFDAPSTLQFLFNGAYAER

SEQ ID NO: 1358309 - protein, 21 aa, Mycobacterium
ELQGRVTPLAQWGYGENWSAQ

SEQ ID NO: 1358310 - protein, 18 aa, Mycobacterium
ELQWGRTIGQFPSPYTRA

SEQ ID NO: 1358311 - protein, 17 aa, Mycobacterium
ELRDALNSWVDAARAVA

SEQ ID NO: 1358312 - protein, 18 aa, Mycobacterium
ELYWAARLTLVNRADDLE

SEQ ID NO: 1358313 - protein, 22 aa, Mycobacterium
EMAALTTFTTWTTYDSWHYTNG

SEQ ID NO: 1358314 - protein, 25 aa, Mycobacterium
EMDDTNFGLLFDIDRVDTGTPTVFD

SEQ ID NO: 1358315 - protein, 18 aa, Mycobacterium
ENGGWLIGNGADGGPGQD

SEQ ID NO: 1358316 - protein, 26 aa, Mycobacterium
ENPNTRAVLFHQGKFIPTGVPDTYGF

SEQ ID NO: 1358317 - protein, 23 aa, Mycobacterium
EPAPGLPIDTLQAPGLPAMESLG

SEQ ID NO: 1358318 - protein, 28 aa, Mycobacterium
EPDGNLQMQPALARAWEVSPDQLTWTFH

SEQ ID NO: 1358319 - protein, 27 aa, Mycobacterium
EPQPDRVKVIFWYDARYKVPADANAAV

SEQ ID NO: 1358320 - protein, 19 aa, Mycobacterium
EPRPMVYSGLYPVDGSDYP

SEQ ID NO: 1358321 - protein, 25 aa, Mycobacterium
EPTGGPWDPLLPKIPSAGAPGDPVA

SEQ ID NO: 1358322 - protein, 24 aa, Mycobacterium
EPTRAKFFAPLKPLGAVDVPADEA

SEQ ID NO: 1358323 - protein, 24 aa, Mycobacterium
EQDRRYFAITVRPSVFVNLVPDHI

SEQ ID NO: 1358324 - protein, 18 aa, Mycobacterium
EQKLPLNVTWVNLTTGKS

SEQ ID NO: 1358325 - protein, 20 aa, Mycobacterium
EQLRHAVFPIGDTPKPAIRE

SEQ ID NO: 1358326 - protein, 25 aa, Mycobacterium
EQQVDFVTYFSAGTLWAQPAGGQID

SEQ ID NO: 1358327 - protein, 21 aa, Mycobacterium
EQTLAAVSLILNGGGIGQIHD

SEQ ID NO: 1358328 - protein, 26 aa, Mycobacterium
ERAQWQVPKFYWTVMSKSGMGDAFAV

SEQ ID NO: 1358329 - protein, 27 aa, Mycobacterium
ERDNLSVMRTILRLMGRSPEDFDHVTD

SEQ ID NO: 1358330 - protein, 22 aa, Mycobacterium
ERERGITIKAQNVRLPWVVNGE

SEQ ID NO: 1358331 - protein, 24 aa, Mycobacterium
ERIAQVWNTTWNLAPDLDLKKFPS

SEQ ID NO: 1358332 - protein, 22 aa, Mycobacterium
ERKFRWRGVLDVNRLSPAKVSV

SEQ ID NO: 1358333 - protein, 19 aa, Mycobacterium
ERPDLARLAPNGRVAIMFS

SEQ ID NO: 1358334 - protein, 18 aa, Mycobacterium
ERSVVLLLPRDDSPEAAA

SEQ ID NO: 1358335 - protein, 18 aa, Mycobacterium
ERVELRYTMPLGEIIFDF

SEQ ID NO: 1358336 - protein, 17 aa, Mycobacterium
ESHAEVLLFVNQTTVMG

SEQ ID NO: 1358337 - protein, 24 aa, Mycobacterium
ESLESVSLFAAVVSNVVAPLADPE

SEQ ID NO: 1358338 - protein, 17 aa, Mycobacterium
ESLGKMTRILRSKGFCW

SEQ ID NO: 1358339 - protein, 19 aa, Mycobacterium
ESLHPYVDWATVRAPAEET

SEQ ID NO: 1358340 - protein, 20 aa, Mycobacterium
ESPQVLRNIVYRARIDGVSR

SEQ ID NO: 1358341 - protein, 21 aa, Mycobacterium
ESSFLMYRKDLFEQAGIKVDQ

SEQ ID NO: 1358342 - protein, 23 aa, Mycobacterium
ESTSGLIMLPDSKSALVAERTTG

SEQ ID NO: 1358343 - protein, 49 aa, Mycobacterium
ESVVRFGKAMWLDFNPFVPGSFLWKGYPYTLVTPFIKPFVKLLCPSCDP

SEQ ID NO: 1358344 - protein, 17 aa, Mycobacterium
ESVWPPMQLSDEVRNRL

SEQ ID NO: 1358345 - protein, 24 aa, Mycobacterium
ETARPADLLVLLDSLQQREAALNT

SEQ ID NO: 1358346 - protein, 18 aa, Mycobacterium
ETATFLRNLADPDNNRRP

SEQ ID NO: 1358347 - protein, 23 aa, Mycobacterium
ETDDIFISALQNQGIPFSTAENA

SEQ ID NO: 1358348 - protein, 24 aa, Mycobacterium
ETDFATAFVRFAGFRRARVRALVR

SEQ ID NO: 1358349 - protein, 27 aa, Mycobacterium
ETEIVPAAVLLNTFLTAAGSGLTDVRL

SEQ ID NO: 1358350 - protein, 28 aa, Mycobacterium
ETFDEKFRPVAELISWDANGFDGEFCGE

SEQ ID NO: 1358351 - protein, 18 aa, Mycobacterium
ETKDRPALAAAFQNAGVD

SEQ ID NO: 1358352 - protein, 25 aa, Mycobacterium
EVCLQMHLLVLSFNLAVAARAKDDP

SEQ ID NO: 1358353 - protein, 21 aa, Mycobacterium
EVLPRHHELLLSRGPYRYDDE

SEQ ID NO: 1358354 - protein, 17 aa, Mycobacterium
EVPARVYIPHRPNPQFQ

SEQ ID NO: 1358355 - protein, 30 aa, Mycobacterium
EVQLVSNEEDILWLSLNGGSDRRSAAQSAV

SEQ ID NO: 1358356 - protein, 25 aa, Mycobacterium
EVRALFDRLQPTLPIVLANLVSIGE

SEQ ID NO: 1358357 - protein, 24 aa, Mycobacterium
EVSGSLLRRKFGLATKAMEPLRSA

SEQ ID NO: 1358358 - protein, 22 aa, Mycobacterium
EVSGSLLRRRFWPSTQVMKPLR

SEQ ID NO: 1358359 - protein, 20 aa, Mycobacterium
EVTGFVRDGMPAMMGPMMGR

SEQ ID NO: 1358360 - protein, 24 aa, Mycobacterium
EVTGSWWVYTPTNVLGYDPADPPK

SEQ ID NO: 1358361 - protein, 23 aa, Mycobacterium
EVTRYFRPRFDAVAFRAGAEQAR

SEQ ID NO: 1358362 - protein, 26 aa, Mycobacterium
EVVDSIILATGAPFDLAVSPDGTTLF

SEQ ID NO: 1358363 - protein, 20 aa, Mycobacterium
EVVGYYMAEPTPREVARFPT

SEQ ID NO: 1358364 - protein, 20 aa, Mycobacterium
EVYDVIHPYQFRSAPRGLRT

SEQ ID NO: 1358365 - protein, 21 aa, Mycobacterium
EWKIAIQTWVIRVDGLTVLVD

SEQ ID NO: 1358366 - protein, 26 aa, Mycobacterium
EYDPVVYAPLYWGNPFAIVNMIAAFD

SEQ ID NO: 1358367 - protein, 30 aa, Mycobacterium
EYGIQDAGRWRVPLLFAIRPEVGVDDVRAV

SEQ ID NO: 1358368 - protein, 18 aa, Mycobacterium
EYNGTIPGVLKNAIDWLS

SEQ ID NO: 1358369 - protein, 17 aa, Mycobacterium
EYQGFDIDLGNALGACL

SEQ ID NO: 1358370 - protein, 19 aa, Mycobacterium
EYSRLAQWKFDPATAPVDA

SEQ ID NO: 1358371 - protein, 20 aa, Mycobacterium
EYTGNLLQYFDPESAATTPD

SEQ ID NO: 1358372 - protein, 20 aa, Mycobacterium
FAALFAVVALVAGCSGSSSK

SEQ ID NO: 1358373 - protein, 19 aa, Mycobacterium
FADLLVPKLQASVTDGAIG

SEQ ID NO: 1358374 - protein, 25 aa, Mycobacterium
FAENWILQHIRIRPGLNGPSDDGLR

SEQ ID NO: 1358375 - protein, 19 aa, Mycobacterium
FAEVARRWGGALNILVNTV

SEQ ID NO: 1358376 - protein, 24 aa, Mycobacterium
FALIAVFAQLRFEREQRYTAVFAN

SEQ ID NO: 1358377 - protein, 20 aa, Mycobacterium
FALTAVLIWTARRAGVLRWD

SEQ ID NO: 1358378 - protein, 30 aa, Mycobacterium
FALVAAALLAAPFGLAWYLHVRGLQVSEQF

SEQ ID NO: 1358379 - protein, 21 aa, Mycobacterium
FAMFAIFAQLRFQSERTYRAV

SEQ ID NO: 1358380 - protein, 25 aa, Mycobacterium
FANHGPTAALAWSSQPAPGLITGTL

SEQ ID NO: 1358381 - protein, 19 aa, Mycobacterium
FANNGWVVAALQAAWSAIA

SEQ ID NO: 1358382 - protein, 19 aa, Mycobacterium
FANPISFICGAIQAASRLN

SEQ ID NO: 1358383 - protein, 18 aa, Mycobacterium
FAPSWDKNDRFRVTVDDG

SEQ ID NO: 1358384 - protein, 36 aa, Mycobacterium
FASGPYFKVMLVNLAPYWILQPYVDAAFKKRGIDPQ

SEQ ID NO: 1358385 - protein, 27 aa, Mycobacterium
FAVRVLGGPPMLPWGSSVTVRSSSLRI

SEQ ID NO: 1358386 - protein, 17 aa, Mycobacterium
FAVVTVLPGLPLDAPPS

SEQ ID NO: 1358387 - protein, 24 aa, Mycobacterium
FAYTGPRAYGRLVGQFRVEAGELV

SEQ ID NO: 1358388 - protein, 30 aa, Mycobacterium
FCFEGFPPRKHAARLAWFQALATEQRTCVF

SEQ ID NO: 1358389 - protein, 18 aa, Mycobacterium
FDITRQFGIGSRETYILA

SEQ ID NO: 1358390 - protein, 22 aa, Mycobacterium
FDKTLASWAEEFPDPMRLHGGT

SEQ ID NO: 1358391 - protein, 17 aa, Mycobacterium
FDNDFFGFPPQMARMMD

SEQ ID NO: 1358392 - protein, 35 aa, Mycobacterium
FDNLPGLVTPLTVEGYLFPGPIALGILIDQDAADY

SEQ ID NO: 1358393 - protein, 17 aa, Mycobacterium
FDVQINWVAGQPSNIPL

SEQ ID NO: 1358394 - protein, 23 aa, Mycobacterium
FELGAATNVLFLPSADVAIVALT

SEQ ID NO: 1358395 - protein, 24 aa, Mycobacterium
FENRKHFFTDWAASAPAVATDITA

SEQ ID NO: 1358396 - protein, 18 aa, Mycobacterium
FFDNVLKPMLGGGAGAAG

SEQ ID NO: 1358397 - protein, 19 aa, Mycobacterium
FFGFLFAGTAAVLLAPTGT

SEQ ID NO: 1358398 - protein, 19 aa, Mycobacterium
FFGFPPQMARMMDPQHRLF

SEQ ID NO: 1358399 - protein, 17 aa, Mycobacterium
FFSLIQNGTTAASTIVG

SEQ ID NO: 1358400 - protein, 21 aa, Mycobacterium
FGEIRQDWYALYAKAFEDMDK

SEQ ID NO: 1358401 - protein, 18 aa, Mycobacterium
FGGVLDLRKMCTALFTPR

SEQ ID NO: 1358402 - protein, 20 aa, Mycobacterium
FGLGYVLRNMIDIPVSRAQP

SEQ ID NO: 1358403 - protein, 17 aa, Mycobacterium
FGPNTITAYFPTATAIY

SEQ ID NO: 1358404 - protein, 20 aa, Mycobacterium
FGVAFVVGRLVTLRAGLIKA

SEQ ID NO: 1358405 - protein, 17 aa, Mycobacterium
FGVVQMTDPGAAQEFFA

SEQ ID NO: 1358406 - protein, 17 aa, Mycobacterium
FHQLVDPLVTRPAATSD

SEQ ID NO: 1358407 - protein, 24 aa, Mycobacterium
FHRAATYPVYLNRPAGEDPAAETV

SEQ ID NO: 1358408 - protein, 26 aa, Mycobacterium
FIGGVHAREWVPPDALLSFAEKLVEA

SEQ ID NO: 1358409 - protein, 22 aa, Mycobacterium
FILEPLVTHWLDYAAMARDTGA

SEQ ID NO: 1358410 - protein, 19 aa, Mycobacterium
FKGLQLDIGAPPQFMDFRY

SEQ ID NO: 1358411 - protein, 22 aa, Mycobacterium
FLGSALLPRILQRTGGEAVCLV

SEQ ID NO: 1358412 - protein, 19 aa, Mycobacterium
FLGSKLWHNMFGGNSNDFA

SEQ ID NO: 1358413 - protein, 27 aa, Mycobacterium
FLKDERLLRVFTFQSLYAGVPPQSALA

SEQ ID NO: 1358414 - protein, 18 aa, Mycobacterium
FLLVGFQALRSDDSSADE

SEQ ID NO: 1358415 - protein, 24 aa, Mycobacterium
FLTLRQMIADALKPDLPALRVADV

SEQ ID NO: 1358416 - protein, 29 aa, Mycobacterium
FMMALMHEMLHSFGILFAVRPGETTRRYW

SEQ ID NO: 1358417 - protein, 17 aa, Mycobacterium
FNGEIYNYLELRDALRS

SEQ ID NO: 1358418 - protein, 18 aa, Mycobacterium
FNKGFLTGPGPSAGPFMI

SEQ ID NO: 1358419 - protein, 26 aa, Mycobacterium
FPGAVWSFSIGWGCDKLITAADLAPV

SEQ ID NO: 1358420 - protein, 28 aa, Mycobacterium
FPSIYDPPMRTMIALGARYPTTVIPSTI

SEQ ID NO: 1358421 - protein, 32 aa, Mycobacterium
FPVRPLNLVATVNALLGYALLHGSAVDIPLAQ

SEQ ID NO: 1358422 - protein, 27 aa, Mycobacterium
FRGAFAERVTLTLLSPRAGLVVDPGAK

SEQ ID NO: 1358423 - protein, 19 aa, Mycobacterium
FRGDYGNLTMVLDLTLNRL

SEQ ID NO: 1358424 - protein, 25 aa, Mycobacterium
FRTGPQFPYGMFDDQILRVVGNTLY

SEQ ID NO: 1358425 - protein, 32 aa, Mycobacterium
FSAVTGAPALLFISWPDRGPLLGADLEGRLYT

SEQ ID NO: 1358426 - protein, 24 aa, Mycobacterium
FSDGFGVELPYGQALNFGDYRCRT

SEQ ID NO: 1358427 - protein, 22 aa, Mycobacterium
FSGNGYMLLGLQIDGLASRYRE

SEQ ID NO: 1358428 - protein, 28 aa, Mycobacterium
FSHGATIMFWTMMNVDNPDLGLLLSHQL

SEQ ID NO: 1358429 - protein, 19 aa, Mycobacterium
FTAVVGVGLTLTACGSNSD

SEQ ID NO: 1358430 - protein, 28 aa, Mycobacterium
FTFVTDPLTLGIQLLSVVGPVINAAAAA

SEQ ID NO: 1358431 - protein, 26 aa, Mycobacterium
FTGLAPMTTCGFWPVPPTSVPHELDV

SEQ ID NO: 1358432 - protein, 17 aa, Mycobacterium
FTGYGHRGDAFAAAVRA

SEQ ID NO: 1358433 - protein, 19 aa, Mycobacterium
FTIEARALTFQPVKVRKQL

SEQ ID NO: 1358434 - protein, 25 aa, Mycobacterium
FVEPVIRLLQPVTKLLIDLGYDRQT

SEQ ID NO: 1358435 - protein, 19 aa, Mycobacterium
FVGAALAFGLVVGVAPGAS

SEQ ID NO: 1358436 - protein, 18 aa, Mycobacterium
FVLHFPGLGQVVFHGTSP

SEQ ID NO: 1358437 - protein, 20 aa, Mycobacterium
FVLIPQRGTLPIFMPLVDIG

SEQ ID NO: 1358438 - protein, 20 aa, Mycobacterium
FVLLSVFAQFRFGDGKTYQA

SEQ ID NO: 1358439 - protein, 18 aa, Mycobacterium
FVQQLPPVVKAFGSVVFD

SEQ ID NO: 1358440 - protein, 19 aa, Mycobacterium
FVTTRLRENVLLQAKVCQS

SEQ ID NO: 1358441 - protein, 18 aa, Mycobacterium
FYGYGFNVGTTSAARTQL

SEQ ID NO: 1358442 - protein, 23 aa, Mycobacterium
FYIEEMVAVYRAEFDPAAALDMA

SEQ ID NO: 1358443 - protein, 18 aa, Mycobacterium
GAAFVAPAPAPDVTARIA

SEQ ID NO: 1358444 - protein, 26 aa, Mycobacterium
GAAIAPVAPLIFLAQPIQAALTQTLA

SEQ ID NO: 1358445 - protein, 20 aa, Mycobacterium
GAAIVARLHADGYRVAACDV

SEQ ID NO: 1358446 - protein, 24 aa, Mycobacterium
GAAPGWSVLVALLAPVATLAAPRF

SEQ ID NO: 1358447 - protein, 24 aa, Mycobacterium
GAATLDVPPLDEAALDRVLLSVDE

SEQ ID NO: 1358448 - protein, 26 aa, Mycobacterium
GAAVCFAQMLGAAPTAGAAGPVVLGG

SEQ ID NO: 1358449 - protein, 19 aa, Mycobacterium
GACLYDFKAVFDDGEELVR

SEQ ID NO: 1358450 - protein, 20 aa, Mycobacterium
GADFPAGWQKLNGTQALSFV

SEQ ID NO: 1358451 - protein, 34 aa, Mycobacterium
GAFTYTPTSFSRLLARFVPFVRSDRFAVTVSDGR

SEQ ID NO: 1358452 - protein, 20 aa, Mycobacterium
GAGDKKIVYAFSGGARVASV

SEQ ID NO: 1358453 - protein, 39 aa, Mycobacterium; identical to SEQ ID NO: 1316465

SEQ ID NO: 1358454 - protein, 26 aa, Mycobacterium
GAGGHAGLLSIYGTGGAGGAGGMGAN

SEQ ID NO: 1358455 - protein, 24 aa, Mycobacterium
GAHPQTWFKAFNYDLGARAPITFD

SEQ ID NO: 1358456 - protein, 24 aa, Mycobacterium
GAHPQTWFKAFNYDLGARTPITFD

SEQ ID NO: 1358457 - protein, 30 aa, Mycobacterium
GAIGVTREHPLWLFTLRAQSWAGDYGSTVH

SEQ ID NO: 1358458 - protein, 19 aa, Mycobacterium
GAIYGAEAPVYADSGWTVM

SEQ ID NO: 1358459 - protein, 23 aa, Mycobacterium
GAKDVTALLFTKGPAVARLEFQS

SEQ ID NO: 1358460 - protein, 23 aa, Mycobacterium
GAKPITLPYAKSLVAAGLVIVSN

SEQ ID NO: 1358461 - protein, 17 aa, Mycobacterium
GAKRPYYLSWQEIERMA

SEQ ID NO: 1358462 - protein, 17 aa, Mycobacterium
GALARRAVVARAVAVEA

SEQ ID NO: 1358463 - protein, 22 aa, Mycobacterium
GALIPLFTSDPWLGTSVGAHLD

SEQ ID NO: 1358464 - protein, 22 aa, Mycobacterium
GALLAALIQRPSALDPAVDPEG

SEQ ID NO: 1358465 - protein, 18 aa, Mycobacterium
GALPAFPGAEGFGSLATG

SEQ ID NO: 1358466 - protein, 22 aa, Mycobacterium
GALPEMQLALLAQLIGIDFRRQ

SEQ ID NO: 1358467 - protein, 21 aa, Mycobacterium
GALRWHDGTWLRRPSADRMVR

SEQ ID NO: 1358468 - protein, 23 aa, Mycobacterium
GALTVTIGGLRKTGYRPAAGETV

SEQ ID NO: 1358469 - protein, 26 aa, Mycobacterium
GARAPITFDTLFRPGTRPLDVVYPAV

SEQ ID NO: 1358470 - protein, 26 aa, Mycobacterium
GARTPITFDTLFRPGTRPLDVVYPAV

SEQ ID NO: 1358471 - protein, 18 aa, Mycobacterium
GATDLCEFMEFPSGILQV

SEQ ID NO: 1358472 - protein, 27 aa, Mycobacterium
GATTEQAWKFLAAGLRTYCPDKLPILD

SEQ ID NO: 1358473 - protein, 33 aa, Mycobacterium
GCDLLGVDYPASFWPIPLPGWCPGLTCDTWNTS

SEQ ID NO: 1358474 - protein, 24 aa, Mycobacterium
GCNYRYTINPQYISSKPLPERTTV

SEQ ID NO: 1358475 - protein, 25 aa, Mycobacterium
GCSTYKWETFLTQELPAYLAANKGV

SEQ ID NO: 1358476 - protein, 26 aa, Mycobacterium
GCTHPGCTVPFYWTEAHHAHDYSRGG

SEQ ID NO: 1358477 - protein, 25 aa, Mycobacterium
GCTHPGCTVPFYWTEAHHTDDYSQG

SEQ ID NO: 1358478 - protein, 25 aa, Mycobacterium
GCTHPGCTVPFYWTEAHHTDDYSRG

SEQ ID NO: 1358479 - protein, 22 aa, Mycobacterium
GCTLMPTDTIFHADIRGLPTLS

SEQ ID NO: 1358480 - protein, 24 aa, Mycobacterium
GDAGDVSYPYYLINGRIAQAPSSF

SEQ ID NO: 1358481 - protein, 23 aa, Mycobacterium
GDAVYQNGVKKNGALAGGRGGDS

SEQ ID NO: 1358482 - protein, 24 aa, Mycobacterium
GDDDGWAYLSTRGGYYRLDIATAD

SEQ ID NO: 1358483 - protein, 27 aa, Mycobacterium
GDDSVVGPFTYLRPGTELGAAGKLGAF

SEQ ID NO: 1358484 - protein, 23 aa, Mycobacterium
GDEKLTFLGYSYGTRIGAGYAEE

SEQ ID NO: 1358485 - protein, 19 aa, Mycobacterium
GDGGFWFGHGGNGGDGDAV

SEQ ID NO: 1358486 - protein, 26 aa, Mycobacterium
GDGGSSEGWMSGLGGWGGDGGDASGG

SEQ ID NO: 1358487 - protein, 25 aa, Mycobacterium
GDGTVLVLHRDGTLAALDVATGTET

SEQ ID NO: 1358488 - protein, 31 aa, Mycobacterium
GDGYAFAHGLLREQLLASMPALRRQRMHAKV

SEQ ID NO: 1358489 - protein, 24 aa, Mycobacterium
GDHDPLVTGLRRLGHRVDLADQSS

SEQ ID NO: 1358490 - protein, 19 aa, Mycobacterium
GDHLIAIHVQAPSGAPGFA

SEQ ID NO: 1358491 - protein, 21 aa, Mycobacterium
GDHLMLMDLTAPLTPGSDVEI

SEQ ID NO: 1358492 - protein, 23 aa, Mycobacterium
GDHSHFMFVATLNKASTETVTVS

SEQ ID NO: 1358493 - protein, 23 aa, Mycobacterium
GDIPPPPGWGAPPGPRGIYQPDP

SEQ ID NO: 1358494 - protein, 31 aa, Mycobacterium
GDLPQPPTGFLQLISLTGAPTGWTPRKVEFD

SEQ ID NO: 1358495 - protein, 22 aa, Mycobacterium
GDMYAVPFYGESSFLMYRKDLF

SEQ ID NO: 1358496 - protein, 18 aa, Mycobacterium
GDNYLFRMAGAAYGIYGN

SEQ ID NO: 1358497 - protein, 19 aa, Mycobacterium
GDPGAPIIDLPIPEGWEDA

SEQ ID NO: 1358498 - protein, 29 aa, Mycobacterium
GDPGAPTINLPFPQGWEAAGPRAPQGAYD

SEQ ID NO: 1358499 - protein, 28 aa, Mycobacterium
GDPRYPYREPPPAPPPGGPPPGPPIPTE

SEQ ID NO: 1358500 - protein, 39 aa, Mycobacterium
GDQEPALWMPPNTAFHCQYAMQFIAVLRGYGLPVDAPSV

SEQ ID NO: 1358501 - protein, 21 aa, Mycobacterium
GDRVVLGAPVRRIARHPDHSL

SEQ ID NO: 1358502 - protein, 31 aa, Mycobacterium
GDSSSPRIVPFFGDYFLLHEAKSDMVNGLIY

SEQ ID NO: 1358503 - protein, 26 aa, Mycobacterium
GDTDRVTMFRAWYSRNNFGQLAGTAE

SEQ ID NO: 1358504 - protein, 19 aa, Mycobacterium
GDTEVRFYRQLRPELDGAP

SEQ ID NO: 1358505 - protein, 25 aa, Mycobacterium
GDTYRTLFLVATPQGINPAALAQGQ

SEQ ID NO: 1358506 - protein, 30 aa, Mycobacterium
GDVIRTRHNARWLPLSGTDYVRNGYTFDIL

SEQ ID NO: 1358507 - protein, 28 aa, Mycobacterium
GEFDGPDLILPGGYRQLIDHLARDLDIR

SEQ ID NO: 1358508 - protein, 18 aa, Mycobacterium
GEIARAPWVLLRAYEDAD

SEQ ID NO: 1358509 - protein, 25 aa, Mycobacterium
GENGDFVFTYTPTAAARHAAAAVSG

SEQ ID NO: 1358510 - protein, 22 aa, Mycobacterium
GEPATAQWLAGMKANAVIYNDN

SEQ ID NO: 1358511 - protein, 29 aa, Mycobacterium
GEPTALPLCALITAWLRGLARPQAVAEVW

SEQ ID NO: 1358512 - protein, 27 aa, Mycobacterium
GEPTRAWNVTLPAWTEAQVNPYTLTVY

SEQ ID NO: 1358513 - protein, 24 aa, Mycobacterium
GEPVPLMRRFGLDAGERIAKLLSD

SEQ ID NO: 1358514 - protein, 17 aa, Mycobacterium
GEQLKNRLLLKDGLEKQ

SEQ ID NO: 1358515 - protein, 17 aa, Mycobacterium
GERAVLVALPAQAANDV

SEQ ID NO: 1358516 - protein, 25 aa, Mycobacterium
GEWLRLAVDALIRGGCGDVVVVLGA

SEQ ID NO: 1358517 - protein, 28 aa, Mycobacterium
GFADWFQDFPHPDDFFRPLLHGDSILPT

SEQ ID NO: 1358518 - protein, 18 aa, Mycobacterium
GFAGVYSSFLRHAEDASA

SEQ ID NO: 1358519 - protein, 26 aa, Mycobacterium
GFEGSWRVNCLGPFLGIQASLPHLRE

SEQ ID NO: 1358520 - protein, 23 aa, Mycobacterium
GFEMSIRFRIIAAVIGAAALVGA

SEQ ID NO: 1358521 - protein, 27 aa, Mycobacterium
GFFAGKTQTFLPWDSWDRPVTGPPGLW

SEQ ID NO: 1358522 - protein, 23 aa, Mycobacterium
GFGDLDWSPLPPESVASVALDDL

SEQ ID NO: 1358523 - protein, 27 aa, Mycobacterium
GFGVAPLPGFPFLRGFPIRCSGEEPTC

SEQ ID NO: 1358524 - protein, 32 aa, Mycobacterium
GFHIHGLSGLIYNLTFGLLGRAGHSATTTVTV

SEQ ID NO: 1358525 - protein, 19 aa, Mycobacterium
GFLTPSSVLNMTFTTGAEP

SEQ ID NO: 1358526 - protein, 17 aa, Mycobacterium
GFQQSRARWDLLGQQVF

SEQ ID NO: 1358527 - protein, 18 aa, Mycobacterium
GFSGAPWISGSTVTGLVG

SEQ ID NO: 1358528 - protein, 29 aa, Mycobacterium
GFTALATAGACWIVQLFNPATAIADPGAV

SEQ ID NO: 1358529 - protein, 18 aa, Mycobacterium
GFTGQLLQRFAPDASARA

SEQ ID NO: 1358530 - protein, 17 aa, Mycobacterium
GFTIGQRKGLGIAGPGP

SEQ ID NO: 1358531 - protein, 25 aa, Mycobacterium
GGAPTLLNLWASWCAPCREEMPVLD

SEQ ID NO: 1358532 - protein, 22 aa, Mycobacterium
GGDHLMLMDLTAPLTPGSDVEI

SEQ ID NO: 1358533 - protein, 23 aa, Mycobacterium
GGDLLTALLGNKIAAGTSGLGEY

SEQ ID NO: 1358534 - protein, 25 aa, Mycobacterium
GGEMRLFRRVEWGALATFHMLDTRQ

SEQ ID NO: 1358535 - protein, 27 aa, Mycobacterium
GGFGTRYPLFALIGVNPFPSPTDTAAR

SEQ ID NO: 1358536 - protein, 20 aa, Mycobacterium
GGGFLLYYDAASGAVQAYDG

SEQ ID NO: 1358537 - protein, 30 aa, Mycobacterium
GGGFTYTPPAIWDPKFQNAAFFHRSTAEDP

SEQ ID NO: 1358538 - protein, 21 aa, Mycobacterium
GGGPRAVYLLDGLRAQEDYNG

SEQ ID NO: 1358539 - protein, 19 aa, Mycobacterium
GGGRDLDWSALGALADWEA

SEQ ID NO: 1358540 - protein, 26 aa, Mycobacterium
GGIGGFFEKTFAPLGLRKIQAEVLGN

SEQ ID NO: 1358541 - protein, 24 aa, Mycobacterium
GGIVSLNWDGTFTYIPNKSAATAD

SEQ ID NO: 1358542 - protein, 17 aa, Mycobacterium
GGNIDIKLLGAGSTFYL

SEQ ID NO: 1358543 - protein, 28 aa, Mycobacterium
GGNRALTVPKMIYRLGIFRAPRGSSAVT

SEQ ID NO: 1358544 - protein, 26 aa, Mycobacterium
GGNRLPIRDLIRMAAHSRHYLAVFDD

SEQ ID NO: 1358545 - protein, 26 aa, Mycobacterium
GGPVDYFAVDLPRIIGNALKPATPAL

SEQ ID NO: 1358546 - protein, 24 aa, Mycobacterium
GGQGPAPVVLPKVAIADASVTESD

SEQ ID NO: 1358547 - protein, 21 aa, Mycobacterium
GGRGGLLVGNGGAGGAGAAGV

SEQ ID NO: 1358548 - protein, 22 aa, Mycobacterium
GGRPSAQWRFDTGGGGWGNNEW

SEQ ID NO: 1358549 - protein, 28 aa, Mycobacterium
GGRWNDWARFFHAHSLNGFAYGFPYDDV

SEQ ID NO: 1358550 - protein, 27 aa, Mycobacterium
GGSEEYYAVRTVLWTAGVEAVPFAGHL

SEQ ID NO: 1358551 - protein, 27 aa, Mycobacterium
GGSGPNAFDCSGLVMWAFQHEGISLPH

SEQ ID NO: 1358552 - protein, 31 aa, Mycobacterium; identical to SEQ ID NO: 1317041

SEQ ID NO: 1358553 - protein, 26 aa, Mycobacterium
GGSILGPHFSFSWFRGSPIGRERKTM

SEQ ID NO: 1358554 - protein, 35 aa, Mycobacterium
GGTTTSYLVPTAKLPLVQLFPSLAAKEAELKAKID

SEQ ID NO: 1358555 - protein, 28 aa, Mycobacterium
GGVKGFFEKTFAPLGLKKIQAQVLENLK

SEQ ID NO: 1358556 - protein, 24 aa, Mycobacterium
GHGIYFNSALIRSYGWDSEPPADP

SEQ ID NO: 1358557 - protein, 19 aa, Mycobacterium
GHHTILFGDAWTQTFRDII

SEQ ID NO: 1358558 - protein, 19 aa, Mycobacterium
GHIAVLRALAVPSGAAALD

SEQ ID NO: 1358559 - protein, 18 aa, Mycobacterium
GHMAVTVYDLPITGREED

SEQ ID NO: 1358560 - protein, 27 aa, Mycobacterium
GHPVAVARRHWPALLASLSGDDGARWF

SEQ ID NO: 1358561 - protein, 28 aa, Mycobacterium
GHPVAVARRHWPALLASLSGDDGARWFL

SEQ ID NO: 1358562 - protein, 24 aa, Mycobacterium
GHRPLADVYGYQEWWGTPGPEIVD

SEQ ID NO: 1358563 - protein, 19 aa, Mycobacterium
GHRTGIYGHSRACAWAIAD

SEQ ID NO: 1358564 - protein, 29 aa, Mycobacterium
GHTYTTYPGSRLLFPALCAPTATLWTGEP

SEQ ID NO: 1358565 - protein, 23 aa, Mycobacterium
GHVSWLDIFAIGAVLPGSFVARA

SEQ ID NO: 1358566 - protein, 22 aa, Mycobacterium
GIADPYPLYNQLRRLSPVAGYR

SEQ ID NO: 1358567 - protein, 18 aa, Mycobacterium
GIATFMIAAAQPAAAAPT

SEQ ID NO: 1358568 - protein, 21 aa, Mycobacterium
GIDLTFTNWRGVIAPPGISDQ

SEQ ID NO: 1358569 - protein, 24 aa, Mycobacterium
GIDPQKFWRDAGLPAYQFPDPNGV

SEQ ID NO: 1358570 - protein, 19 aa, Mycobacterium
GIERMLMAYLDRAGKPAQD

SEQ ID NO: 1358571 - protein, 19 aa, Mycobacterium
GIGGTWWFNRYPGAEVDLE

SEQ ID NO: 1358572 - protein, 19 aa, Mycobacterium
GIGWLAEPFIDLAEPVLRE

SEQ ID NO: 1358573 - protein, 17 aa, Mycobacterium
GIHVGKSVLRGDDLFGR

SEQ ID NO: 1358574 - protein, 18 aa, Mycobacterium
GILGTAHAWHAVRRGHHV

SEQ ID NO: 1358575 - protein, 18 aa, Mycobacterium
GIMTIRHAEPVIAFQTEN

SEQ ID NO: 1358576 - protein, 26 aa, Mycobacterium
GINPAQVFFQPYRPGANYTSTGRGCA

SEQ ID NO: 1358577 - protein, 23 aa, Mycobacterium
GIQSILHSIARLFGLAKVDNYTQ

SEQ ID NO: 1358578 - protein, 24 aa, Mycobacterium
GITGRAVLAALAPLGARATLTDDS

SEQ ID NO: 1358579 - protein, 35 aa, Mycobacterium; identical to SEQ ID NO: 1307012

SEQ ID NO: 1358580 - protein, 20 aa, Mycobacterium
GKDKRFLFASPNGSERVASV

SEQ ID NO: 1358581 - protein, 24 aa, Mycobacterium
GKFTTLGEFPAFQLGGTWVQDGVT

SEQ ID NO: 1358582 - protein, 20 aa, Mycobacterium
GKMFVQLWHVGRMAHPEISG

SEQ ID NO: 1358583 - protein, 31 aa, Mycobacterium
GKPGDPRYPYRPPLPQPPPGGPPPGPPAEDG

SEQ ID NO: 1358584 - protein, 24 aa, Mycobacterium
GKRSVWRFGVPVICVAAGLLLGAT

SEQ ID NO: 1358585 - protein, 23 aa, Mycobacterium
GLAFALVLVALAGGVVALRSMDH

SEQ ID NO: 1358586 - protein, 19 aa, Mycobacterium
GLASLLPGGSPLGGLLPTG

SEQ ID NO: 1358587 - protein, 19 aa, Mycobacterium
GLATIAGALAVAPMAVVTG

SEQ ID NO: 1358588 - protein, 26 aa, Mycobacterium
GLAVWRIRNIFGSHQLPTYAGSMSED

SEQ ID NO: 1358589 - protein, 20 aa, Mycobacterium
GLCQVYANELWHYELTADAN

SEQ ID NO: 1358590 - protein, 28 aa, Mycobacterium
GLGRLGYGLTPALWTLGLRSAWIPDSTD

SEQ ID NO: 1358591 - protein, 18 aa, Mycobacterium
GLGTPAARRLWTGNIHGP

SEQ ID NO: 1358592 - protein, 37 aa, Mycobacterium
GLHGPKRYNWHQLVGSLQYTLYRLQERIVGKGPGVPQ

SEQ ID NO: 1358593 - protein, 20 aa, Mycobacterium
GLHTALMLRGWTDDVVLLTD

SEQ ID NO: 1358594 - protein, 17 aa, Mycobacterium
GLLGFSLLGPQVGTAAA

SEQ ID NO: 1358595 - protein, 19 aa, Mycobacterium
GLLNVLPAAADGLPGVVRA

SEQ ID NO: 1358596 - protein, 25 aa, Mycobacterium
GLNRMLATVLAPRRAQKTPEITAEW

SEQ ID NO: 1358597 - protein, 23 aa, Mycobacterium
GLPPTTVYIGTVEKLLPGVIAFR

SEQ ID NO: 1358598 - protein, 21 aa, Mycobacterium
GLPTREYLHQLSNTEFRQTRH

SEQ ID NO: 1358599 - protein, 25 aa, Mycobacterium
GLQNYELEWWHYTFKPETHPETYFD

SEQ ID NO: 1358600 - protein, 21 aa, Mycobacterium
GLTAAFLGLAAPAQAAPAGPG

SEQ ID NO: 1358601 - protein, 20 aa, Mycobacterium
GLTEELVFAWQVPAGALRQG

SEQ ID NO: 1358602 - protein, 18 aa, Mycobacterium
GLTRYAFAGVGVLLPRYS

SEQ ID NO: 1358603 - protein, 25 aa, Mycobacterium
GLVNHYYLYELINSKGPDAVVAENK

SEQ ID NO: 1358604 - protein, 27 aa, Mycobacterium
GMAVPGYPNFFMLYGPNTNVGSNSVIF

SEQ ID NO: 1358605 - protein, 25 aa, Mycobacterium
GMGEAIAWKFTLDDLLVDVGVAGGV

SEQ ID NO: 1358606 - protein, 27 aa, Mycobacterium
GMHVNVLDWFRPWGTRATPLINQGAVT

SEQ ID NO: 1358607 - protein, 25 aa, Mycobacterium
GMMNYDWTINGLPFAKTQPLEVREG

SEQ ID NO: 1358608 - protein, 17 aa, Mycobacterium
GMRSYTRDLVQARYLQF

SEQ ID NO: 1358609 - protein, 29 aa, Mycobacterium
GMTVAWQLPSHVGAAVLMLALARTAVTQA

SEQ ID NO: 1358610 - protein, 24 aa, Mycobacterium
GMVVLTLWEPNADKPVLVGLRYRP

SEQ ID NO: 1358611 - protein, 27 aa, Mycobacterium
GMYGDFFSFYLCEIVLKLNGKGGQPVY

SEQ ID NO: 1358612 - protein, 27 aa, Mycobacterium
GMYGDFFSFYLCELVLKLNGKGGQPVY

SEQ ID NO: 1358613 - protein, 33 aa, Mycobacterium
GNEPARTWFTAMKPIATNFGPVALPPTDPRYVD

SEQ ID NO: 1358614 - protein, 20 aa, Mycobacterium
GNFTGSFWEGTIGAASASIV

SEQ ID NO: 1358615 - protein, 22 aa, Mycobacterium
GNFTYTVNPLLASAAGTDSFVI

SEQ ID NO: 1358616 - protein, 18 aa, Mycobacterium
GNGDPWYTLARGSVTINA

SEQ ID NO: 1358617 - protein, 25 aa, Mycobacterium
GNKIPIRDLIRMAAHSRHYLAVFDD

SEQ ID NO: 1358618 - protein, 35 aa, Mycobacterium
GNTVPLTYPFALTFPTVMALLTGFDFPFAAMGSVH

SEQ ID NO: 1358619 - protein, 22 aa, Mycobacterium
GPEEGVWVEYLIGSGQLDEKQI

SEQ ID NO: 1358620 - protein, 17 aa, Mycobacterium
GPFLGIQASLPHLREAE

SEQ ID NO: 1358621 - protein, 17 aa, Mycobacterium
GPFVWWEHLLEGGDEPV

SEQ ID NO: 1358622 - protein, 24 aa, Mycobacterium
GPGGAFLQPALQRANLTLVTDTRV

SEQ ID NO: 1358623 - protein, 19 aa, Mycobacterium
GPGSLQWAIDQPGAKYILF

SEQ ID NO: 1358624 - protein, 22 aa, Mycobacterium
GPGTHWLPITVTPISPPSGHPT

SEQ ID NO: 1358625 - protein, 20 aa, Mycobacterium
GPHAVFLLDAFNAAPDVSNW

SEQ ID NO: 1358626 - protein, 18 aa, Mycobacterium
GPPGLWFHDLLNGDGSPY

SEQ ID NO: 1358627 - protein, 24 aa, Mycobacterium
GPPPVGRWRRRGVMQFDHAHTFRM

SEQ ID NO: 1358628 - protein, 33 aa, Mycobacterium
GPQQRTAIQYYLYGLDERQPMDALPYSGFLDTI

SEQ ID NO: 1358629 - protein, 24 aa, Mycobacterium
GPQSPLLEEFIGIVRGRKPGSSRG

SEQ ID NO: 1358630 - protein, 26 aa, Mycobacterium
GPRQRVDINWWRPGGTAWFTVLHQAA

SEQ ID NO: 1358631 - protein, 35 aa, Mycobacterium
GPTPPTPVSALVQSLWLAVRQTQYTWNNQRPTADA

SEQ ID NO: 1358632 - protein, 30 aa, Mycobacterium
GPTSTPPPPPPLPAKPFPKDCPAPGVMQGC

SEQ ID NO: 1358633 - protein, 22 aa, Mycobacterium
GPTTYWIDAVITLHPQAAAALA

SEQ ID NO: 1358634 - protein, 21 aa, Mycobacterium
GPWARRLGIAALAAVLLPGVV

SEQ ID NO: 1358635 - protein, 22 aa, Mycobacterium
GPYTSFPLKRNVVVLGIVHEGV

SEQ ID NO: 1358636 - protein, 24 aa, Mycobacterium
GQACNRTIAWYSAMAYRALGNEEA

SEQ ID NO: 1358637 - protein, 18 aa, Mycobacterium
GQADWIISNLYATEERAA

SEQ ID NO: 1358638 - protein, 24 aa, Mycobacterium
GQFAKIPLILTGAVGDLYSYLAIR

SEQ ID NO: 1358639 - protein, 29 aa, Mycobacterium
GQLGSARRLLDGLTLPWAENTRPAAGIDN

SEQ ID NO: 1358640 - protein, 23 aa, Mycobacterium
GQLQRLGYPIAKMRTVDAYPGAD

SEQ ID NO: 1358641 - protein, 24 aa, Mycobacterium
GQMTPWNTYVRPGLPATPICSPSQ

SEQ ID NO: 1358642 - protein, 33 aa, Mycobacterium
GQNQVSWDTPIVSRLPWFALSDPAVTQMVTVGD

SEQ ID NO: 1358643 - protein, 24 aa, Mycobacterium
GQPGTPALPVPYPRTGQGGEPHLN

SEQ ID NO: 1358644 - protein, 18 aa, Mycobacterium
GQPGTPPLPVPYPRTGQG

SEQ ID NO: 1358645 - protein, 17 aa, Mycobacterium
GQPRHPLYLRADTPLQC

SEQ ID NO: 1358646 - protein, 26 aa, Mycobacterium
GQRTPERWFVVWLGTATNPIPQAEAV

SEQ ID NO: 1358647 - protein, 23 aa, Mycobacterium
GQSPFEYHFLRFDQDGATIATAD

SEQ ID NO: 1358648 - protein, 36 aa, Mycobacterium
GQTFNYDSWVIGNGYYWLSYVSYSGTRRYVAEATLD

SEQ ID NO: 1358649 - protein, 28 aa, Mycobacterium
GQVEGGIIYHYYWFRDQSQTKEISGNTA

SEQ ID NO: 1358650 - protein, 27 aa, Mycobacterium
GRDCGPLRWLPAIPDRLAGDPQWGDYL

SEQ ID NO: 1358651 - protein, 24 aa, Mycobacterium
GRDDEYLSHWLDQGYVVVGSDYAG

SEQ ID NO: 1358652 - protein, 24 aa, Mycobacterium
GRDIAVIQLLGAGGLPVAPIGDSA

SEQ ID NO: 1358653 - protein, 18 aa, Mycobacterium
GRERVRCNAICPGTTTTP

SEQ ID NO: 1358654 - protein, 19 aa, Mycobacterium
GRHLVVALMYGLVKEGGPT

SEQ ID NO: 1358655 - protein, 17 aa, Mycobacterium
GRIVAALVLVASLAACS

SEQ ID NO: 1358656 - protein, 26 aa, Mycobacterium
GRKYGGINGWWYGDALLTPTDTQYSV

SEQ ID NO: 1358657 - protein, 19 aa, Mycobacterium
GRLDPALLAAVQEASRAAA

SEQ ID NO: 1358658 - protein, 19 aa, Mycobacterium
GRLDPALLAAVQEATRAAA

SEQ ID NO: 1358659 - protein, 19 aa, Mycobacterium
GRLRRWRGGAHRAGVVALV

SEQ ID NO: 1358660 - protein, 23 aa, Mycobacterium
GRPTPEMLAYQYLQTLPQMAKGE

SEQ ID NO: 1358661 - protein, 24 aa, Mycobacterium
GRQDGRLLRYGLAAIAVGAWVACA

SEQ ID NO: 1358662 - protein, 27 aa, Mycobacterium
GRRLKMVARILGSLAAAAMVIVGCTSV

SEQ ID NO: 1358663 - protein, 18 aa, Mycobacterium
GRVGLWNNRRCMNEPWLM

SEQ ID NO: 1358664 - protein, 20 aa, Mycobacterium
GRWGVWINGGFIPLSKNPLT

SEQ ID NO: 1358665 - protein, 17 aa, Mycobacterium
GSAALTLAIYHPQQFQY

SEQ ID NO: 1358666 - protein, 30 aa, Mycobacterium
GSDADPVILCAMPFFWIGGVLAATGALHEP

SEQ ID NO: 1358667 - protein, 18 aa, Mycobacterium
GSDRLRFVAPADFTEIGG

SEQ ID NO: 1358668 - protein, 23 aa, Mycobacterium
GSEPASLSPPAYALLRSGDYGGP

SEQ ID NO: 1358669 - protein, 24 aa, Mycobacterium
GSGAPPYVHFLRISDGAVAHRIAV

SEQ ID NO: 1358670 - protein, 18 aa, Mycobacterium
GSGDLLRAFGAAAASVTG

SEQ ID NO: 1358671 - protein, 30 aa, Mycobacterium
GSHRVPWQIRILPPFLSRKHLPSRLARLRE

SEQ ID NO: 1358672 - protein, 17 aa, Mycobacterium
GSHVVFLTNPRAVADVI

SEQ ID NO: 1358673 - protein, 24 aa, Mycobacterium
GSKQWETFLADELPNWLAANKGLA

SEQ ID NO: 1358674 - protein, 18 aa, Mycobacterium
GSLAGKLLRIEQPTTVNQ

SEQ ID NO: 1358675 - protein, 31 aa, Mycobacterium
GSNRWPAVHRLDAAALFRIAAEDAPAGTLLH

SEQ ID NO: 1358676 - protein, 27 aa, Mycobacterium
GSPPPAGPFCVPAVLPSLRTVARVTDP

SEQ ID NO: 1358677 - protein, 21 aa, Mycobacterium
GSPYEEGRVREVLRAHFAGWT

SEQ ID NO: 1358678 - protein, 32 aa, Mycobacterium; identical to SEQ ID NO: 1307154

SEQ ID NO: 1358679 - protein, 24 aa, Mycobacterium
GSRSTQNLSYRALRRLNVSIPDMV

SEQ ID NO: 1358680 - protein, 23 aa, Mycobacterium
GSSKWALRGLTQVAAVELAPAGI

SEQ ID NO: 1358681 - protein, 17 aa, Mycobacterium
GSTPEVANAVRFGFWGA

SEQ ID NO: 1358682 - protein, 27 aa, Mycobacterium
GSVDLLVANPPYIPAGALLEPEVAQYD

SEQ ID NO: 1358683 - protein, 24 aa, Mycobacterium
GTAGGSTILWWEQPNRLMRLNLAD

SEQ ID NO: 1358684 - protein, 32 aa, Mycobacterium; identical to SEQ ID NO: 1139157

SEQ ID NO: 1358685 - protein, 28 aa, Mycobacterium
GTENEEGLWILPPKWLQDNDVEIITDTT

SEQ ID NO: 1358686 - protein, 34 aa, Mycobacterium
GTIAFPIAHIGGMVYLACALLGDFPVLMIPKVTA

SEQ ID NO: 1358687 - protein, 19 aa, Mycobacterium
GTLPIFMPLVDIGNATGTS

SEQ ID NO: 1358688 - protein, 29 aa, Mycobacterium
GTLRISNWPLYMADGFVAAFQTASGITVD

SEQ ID NO: 1358689 - protein, 19 aa, Mycobacterium
GTPIQRALGVAGDAIVDVE

SEQ ID NO: 1358690 - protein, 23 aa, Mycobacterium
GTQLGAVYAARYPDRVRAMVLDG

SEQ ID NO: 1358691 - protein, 17 aa, Mycobacterium
GTRIWVYCGTGRPGELG

SEQ ID NO: 1358692 - protein, 24 aa, Mycobacterium
GTRYPVFAVIGVNPLPTPTSPGAQ

SEQ ID NO: 1358693 - protein, 30 aa, Mycobacterium
GTTTTVLIPTPLLPLLKPLADAGASQETID

SEQ ID NO: 1358694 - protein, 27 aa, Mycobacterium
GTTVHVDAKLYGVPFGDGAYGATDSTL

SEQ ID NO: 1358695 - protein, 23 aa, Mycobacterium
GTVVGTLWIGDRHWDFTAVPGAT

SEQ ID NO: 1358696 - protein, 19 aa, Mycobacterium
GTVVKRGFFGWDAAAVSAH

SEQ ID NO: 1358697 - protein, 23 aa, Mycobacterium
GVASFYADWYRPAKNRNGTLTYK

SEQ ID NO: 1358698 - protein, 22 aa, Mycobacterium
GVAVALVLVLVGGVVAAIRISN

SEQ ID NO: 1358699 - protein, 25 aa, Mycobacterium
GVDRQTYLELLTSTLFAAPAYQTYG

SEQ ID NO: 1358700 - protein, 25 aa, Mycobacterium
GVDSIMTVALRRALEKRTGLALPPT

SEQ ID NO: 1358701 - protein, 20 aa, Mycobacterium
GVFVTRWAADPYARGSYSFL

SEQ ID NO: 1358702 - protein, 28 aa, Mycobacterium
GVGGRSGMLFGYAGDGGIGGAAGTGGRG

SEQ ID NO: 1358703 - protein, 18 aa, Mycobacterium
GVHYDMNSGLYPAIGYAN

SEQ ID NO: 1358704 - protein, 17 aa, Mycobacterium
GVILAVAVGTVSPVAHA

SEQ ID NO: 1358705 - protein, 29 aa, Mycobacterium
GVINNIFTPWTYEKWPTVFTQLETLDGDI

SEQ ID NO: 1358706 - protein, 32 aa, Mycobacterium
GVIRPIIDSGYWRFWFKDRSSGWPLPPPEPAG

SEQ ID NO: 1358707 - protein, 28 aa, Mycobacterium
GVKDGSIDALFWSGGLPTPGITDLLTTS

SEQ ID NO: 1358708 - protein, 27 aa, Mycobacterium
GVLAAPPGAMPPGDIAPPPGGATRAVA

SEQ ID NO: 1358709 - protein, 17 aa, Mycobacterium
GVLCSVGWQPRPPGVSV

SEQ ID NO: 1358710 - protein, 17 aa, Mycobacterium
GVLKAGVIVFDPPLPQA

SEQ ID NO: 1358711 - protein, 17 aa, Mycobacterium
GVLLDYAAGVLKATDIR

SEQ ID NO: 1358712 - protein, 24 aa, Mycobacterium
GVLLSSLAALVPVGSPGAPFAEAV

SEQ ID NO: 1358713 - protein, 26 aa, Mycobacterium
GVLSAVIAFRDPLFSEGDLFAALDEH

SEQ ID NO: 1358714 - protein, 30 aa, Mycobacterium
GVPAQPILPVVPPPPAAPWLPQAQPMAGDQ

SEQ ID NO: 1358715 - protein, 19 aa, Mycobacterium
GVPEAVAWVTWTNASRDVP

SEQ ID NO: 1358716 - protein, 18 aa, Mycobacterium
GVPGGLASLLPGGSPLGG

SEQ ID NO: 1358717 - protein, 18 aa, Mycobacterium
GVPIRALAAAAVPSAWLA

SEQ ID NO: 1358718 - protein, 24 aa, Mycobacterium
GVPKRSGPFPIKGTDREFKVDWTT

SEQ ID NO: 1358719 - protein, 19 aa, Mycobacterium
GVPWASFAPYTPALTVAGV

SEQ ID NO: 1358720 - protein, 23 aa, Mycobacterium
GVQRLVYEALPARGARTVDEIGR

SEQ ID NO: 1358721 - protein, 26 aa, Mycobacterium
GVRMVITVLTWRLDLERLAATAQRCA

SEQ ID NO: 1358722 - protein, 24 aa, Mycobacterium
GVVTLTLLSLLGASVRVIQQFERG

SEQ ID NO: 1358723 - protein, 19 aa, Mycobacterium
GYCYPDRTIGWDRGELLPG

SEQ ID NO: 1358724 - protein, 36 aa, Mycobacterium
GYLPAPILVKPNSGWLYTWALGIPKAAKNPDGAWEF

SEQ ID NO: 1358725 - protein, 25 aa, Mycobacterium
GYTAWRGVAAYRLDPALAGETMSAG

SEQ ID NO: 1358726 - protein, 17 aa, Mycobacterium
GYTLLRAKYPQYQRVEL

SEQ ID NO: 1358727 - protein, 23 aa, Mycobacterium
GYVIRNVFEPRTPDLRLTNGPGD

SEQ ID NO: 1358728 - protein, 19 aa, Mycobacterium
HALDYRHGLVYGLNSRTQT

SEQ ID NO: 1358729 - protein, 18 aa, Mycobacterium
HALKYRHGRIYGHDSQSG

SEQ ID NO: 1358730 - protein, 18 aa, Mycobacterium
HALYPVNGMVGQGASYAA

SEQ ID NO: 1358731 - protein, 24 aa, Mycobacterium
HARQYPQRYPTRIVGAALISSAAE

SEQ ID NO: 1358732 - protein, 17 aa, Mycobacterium
HARRRTMAAAGLSALAI

SEQ ID NO: 1358733 - protein, 18 aa, Mycobacterium
HARRRTMAAAGLSALAIL

SEQ ID NO: 1358734 - protein, 22 aa, Mycobacterium
HAVQPRVPIWVGGRTARSLRRA

SEQ ID NO: 1358735 - protein, 20 aa, Mycobacterium
HDDLLARLDAVPAAQRALVT

SEQ ID NO: 1358736 - protein, 22 aa, Mycobacterium
HDRPIYLISSERYFWSRGGDMA

SEQ ID NO: 1358737 - protein, 25 aa, Mycobacterium
HDYGMDWYSDRIVWHVDGVEVGRIT

SEQ ID NO: 1358738 - protein, 23 aa, Mycobacterium
HEAMYLGNGMMIEAPYTGSVVKI

SEQ ID NO: 1358739 - protein, 18 aa, Mycobacterium
HEHKLRRFGRPEEVAAVA

SEQ ID NO: 1358740 - protein, 19 aa, Mycobacterium
HGFVPTLISIARATGVSTY

SEQ ID NO: 1358741 - protein, 38 aa, Mycobacterium
HGHYARGFSIARRLALLLTFPRFLPAAGPLAMRSSALM

SEQ ID NO: 1358742 - protein, 21 aa, Mycobacterium
HGRGGFAGMLLGSVSTAVVQA

SEQ ID NO: 1358743 - protein, 21 aa, Mycobacterium
HIDADPWPAIGDWLADRSADT

SEQ ID NO: 1358744 - protein, 19 aa, Mycobacterium
HIHTAPWSDRVEVHWGPHS

SEQ ID NO: 1358745 - protein, 17 aa, Mycobacterium
HLHVNTLRYRVDRIARL

SEQ ID NO: 1358746 - protein, 18 aa, Mycobacterium
HLKTIWGMTAAEAGTRRG

SEQ ID NO: 1358747 - protein, 19 aa, Mycobacterium
HLNPFNNQYLLPQHLVPSA

SEQ ID NO: 1358748 - protein, 24 aa, Mycobacterium
HLRRPDGLLSWRWADGRVTDPSSA

SEQ ID NO: 1358749 - protein, 18 aa, Mycobacterium
HLVMQRELSTIPVQWFEA

SEQ ID NO: 1358750 - protein, 20 aa, Mycobacterium
HLVSWVKAVVYGAAQRWTDV

SEQ ID NO: 1358751 - protein, 22 aa, Mycobacterium
HMGRYMGIPDLLIEAPTRETED

SEQ ID NO: 1358752 - protein, 17 aa, Mycobacterium
HNPIGIVVPCHRVIGAN

SEQ ID NO: 1358753 - protein, 26 aa, Mycobacterium
HPHIPVRILSADPALPYAKPPLSKEF

SEQ ID NO: 1358754 - protein, 22 aa, Mycobacterium
HPLASLLQPIRLAGGADGVRRR

SEQ ID NO: 1358755 - protein, 18 aa, Mycobacterium
HRGDPFDLHLMIFGDSTA

SEQ ID NO: 1358756 - protein, 23 aa, Mycobacterium
HRNRPHMPPLHQLDTPYLKALTD

SEQ ID NO: 1358757 - protein, 27 aa, Mycobacterium
HRTRRTLVATLVLIAGLLAACSGLETS

SEQ ID NO: 1358758 - protein, 25 aa, Mycobacterium
HRVAAVYLMALLAEDLRPLLDRLTT

SEQ ID NO: 1358759 - protein, 17 aa, Mycobacterium
HSHQPLRWGPPEAPGRY

SEQ ID NO: 1358760 - protein, 23 aa, Mycobacterium
HVAMYLGDGQMLEAPYTGSVVKI

SEQ ID NO: 1358761 - protein, 20 aa, Mycobacterium
HVGGIMVGSWTDLSMLSDNS

SEQ ID NO: 1358762 - protein, 24 aa, Mycobacterium
HVPGIYRLLRMPAEAVDYFAHPTY

SEQ ID NO: 1358763 - protein, 20 aa, Mycobacterium
HVRGALWEATATNTAVAGTV

SEQ ID NO: 1358764 - protein, 33 aa, Mycobacterium
HVRHTDARFNLSRAALLVVALTERPDLLMEATE

SEQ ID NO: 1358765 - protein, 26 aa, Mycobacterium
HVRIIQEFVKKLPAWVSWERRDRYER

SEQ ID NO: 1358766 - protein, 28 aa, Mycobacterium
HYLKQAVVLFPYREKAAAFYEASVHQWP

SEQ ID NO: 1358767 - protein, 25 aa, Mycobacterium
HYNVANCLLAAALLDAVDVSPEQAA

SEQ ID NO: 1358768 - protein, 23 aa, Mycobacterium
HYRYTLTRRWGTGPALMFVSLNP

SEQ ID NO: 1358769 - protein, 27 aa, Mycobacterium
HYVVCFDIRPDVLRPIVELGAEAAADA

SEQ ID NO: 1358770 - protein, 18 aa, Mycobacterium
IAADLYFKEAGASVEDIF

SEQ ID NO: 1358771 - protein, 20 aa, Mycobacterium
IAAKLFGFPTVIAHGMFSAA

SEQ ID NO: 1358772 - protein, 24 aa, Mycobacterium
IADETIYCPCHGSMFSLDGEVVAG

SEQ ID NO: 1358773 - protein, 29 aa, Mycobacterium
IADFPDNPFNLLALANALAAFYYVHLDYS

SEQ ID NO: 1358774 - protein, 25 aa, Mycobacterium
IADFPDRPLNLLATANAVMGVAYLH

SEQ ID NO: 1358775 - protein, 38 aa, Mycobacterium
IAGIAALLLFVALPIVYVKNYIKVPPNEVAVFTGRGQP

SEQ ID NO: 1358776 - protein, 21 aa, Mycobacterium
IAGIGPWAKLLRFRDDLDRLL

SEQ ID NO: 1358777 - protein, 18 aa, Mycobacterium
IAGLGYTAPLPAAVIPHV

SEQ ID NO: 1358778 - protein, 17 aa, Mycobacterium
IALVTAAALLAGAVAPA

SEQ ID NO: 1358779 - protein, 19 aa, Mycobacterium
IANAEIYWRQVDPPDWGAY

SEQ ID NO: 1358780 - protein, 21 aa, Mycobacterium
ICAALTLAALLSGCGGPDGAD

SEQ ID NO: 1358781 - protein, 21 aa, Mycobacterium
IDADGKFTYTPTAAARHAAAN

SEQ ID NO: 1358782 - protein, 17 aa, Mycobacterium
IDAFRVGVLGDEQRCLT

SEQ ID NO: 1358783 - protein, 21 aa, Mycobacterium
IDALNREMVTLMADEWDKLHA

SEQ ID NO: 1358784 - protein, 25 aa, Mycobacterium
IDAMGILFSPKNPPALSFDADEAES

SEQ ID NO: 1358785 - protein, 19 aa, Mycobacterium
IDEGLLKVLPQLTAKHRVI

SEQ ID NO: 1358786 - protein, 19 aa, Mycobacterium
IDFNLPDAERFHRAATYPV

SEQ ID NO: 1358787 - protein, 28 aa, Mycobacterium
IDFPDEPMPCEVLWMVYSDEPFRPHYGD

SEQ ID NO: 1358788 - protein, 27 aa, Mycobacterium
IDGVRPDSKPWHPSGLAIDIMIPNPES

SEQ ID NO: 1358789 - protein, 17 aa, Mycobacterium
IDLFKHSVLPALEELEG

SEQ ID NO: 1358790 - protein, 27 aa, Mycobacterium
IDRETWNRLALPWFRGINSVIGVQRTG

SEQ ID NO: 1358791 - protein, 18 aa, Mycobacterium
IDVVLAPVRFVGAVATDV

SEQ ID NO: 1358792 - protein, 19 aa, Mycobacterium
IEHIVPLAYAWDQGARAWT

SEQ ID NO: 1358793 - protein, 22 aa, Mycobacterium
IERGYVDHMLGMTIAKDLGAGY

SEQ ID NO: 1358794 - protein, 19 aa, Mycobacterium
IEYSFFQSGSDVASALFAG

SEQ ID NO: 1358795 - protein, 18 aa, Mycobacterium
IFANGRFTKVASPTPYGR

SEQ ID NO: 1358796 - protein, 17 aa, Mycobacterium
IFGTVKNLSILVAALRA

SEQ ID NO: 1358797 - protein, 18 aa, Mycobacterium
IFYFGQGEIMPGAGGALQ

SEQ ID NO: 1358798 - protein, 27 aa, Mycobacterium
IGDFGAGMGISTWWYRGSDMDTERALE

SEQ ID NO: 1358799 - protein, 25 aa, Mycobacterium
IGDINPLLYRIAEGAPRPAYRDVTL

SEQ ID NO: 1358800 - protein, 24 aa, Mycobacterium
IGDRAFVRLLGRHDKPVRRHVDAH

SEQ ID NO: 1358801 - protein, 21 aa, Mycobacterium
IGEVIRWIEAAPPAAPEDFHT

SEQ ID NO: 1358802 - protein, 21 aa, Mycobacterium
IGGLHIWHHAVTGGALLPGLD

SEQ ID NO: 1358803 - protein, 24 aa, Mycobacterium
IGLAFALVLVALAGGVVALRSMDH

SEQ ID NO: 1358804 - protein, 19 aa, Mycobacterium
IGLALLLATPGLATAQPAR

SEQ ID NO: 1358805 - protein, 29 aa, Mycobacterium
IGLASVLVLLLIAGLVTVSPALKAADRVT

SEQ ID NO: 1358806 - protein, 27 aa, Mycobacterium
IGLNTVRVFLHDLLWVQDRVGFQRRLA

SEQ ID NO: 1358807 - protein, 17 aa, Mycobacterium
IGMPMTARILTPGNLLV

SEQ ID NO: 1358808 - protein, 23 aa, Mycobacterium
IGMRVILDHHRSSAGAGPNGNGL

SEQ ID NO: 1358809 - protein, 17 aa, Mycobacterium
IGNFFRGDYVNLTGVFD

SEQ ID NO: 1358810 - protein, 19 aa, Mycobacterium
IGQSFLRSYAILTSSTDTA

SEQ ID NO: 1358811 - protein, 19 aa, Mycobacterium
IGREMHMDPFLPNEGSPGR

SEQ ID NO: 1358812 - protein, 17 aa, Mycobacterium
IGRVGALALALGVGGAV

SEQ ID NO: 1358813 - protein, 31 aa, Mycobacterium
IGVATLEQWRRIVDLNLWGVIYGVHAAVPIM

SEQ ID NO: 1358814 - protein, 17 aa, Mycobacterium
IGVVALTAGCADTVSGN

SEQ ID NO: 1358815 - protein, 18 aa, Mycobacterium
IGVVALTAGCADTVSGNA

SEQ ID NO: 1358816 - protein, 18 aa, Mycobacterium
IIDLPIPEGWEDAGGDTP

SEQ ID NO: 1358817 - protein, 17 aa, Mycobacterium
IIDRGVTFPSIYDPPMR

SEQ ID NO: 1358818 - protein, 22 aa, Mycobacterium
IIKNRQYNFPPLGENLFIGAQA

SEQ ID NO: 1358819 - protein, 33 aa, Mycobacterium
IILCTGYQHHFPFIDPALRLTTTNNLYPGGLYK

SEQ ID NO: 1358820 - protein, 18 aa, Mycobacterium
IKFSALAGRALALGFDAL

SEQ ID NO: 1358821 - protein, 28 aa, Mycobacterium
ILDILGNAVYRSIWGSSWIAQGGVHYDM

SEQ ID NO: 1358822 - protein, 26 aa, Mycobacterium
ILDRDDLHLFEFPKIDADAVDEVLIM

SEQ ID NO: 1358823 - protein, 20 aa, Mycobacterium
ILLAVLVVFAVIVVAKSVAL

SEQ ID NO: 1358824 - protein, 17 aa, Mycobacterium
ILPASATLTPTAHADIG

SEQ ID NO: 1358825 - protein, 28 aa, Mycobacterium
ILPIALAAVLALVAPLTPAVAAPGDPVA

SEQ ID NO: 1358826 - protein, 18 aa, Mycobacterium
ILRRDGFGAAVRSSIEEL

SEQ ID NO: 1358827 - protein, 23 aa, Mycobacterium
ILRSKGFCWIASRPTIAAIWSQA

SEQ ID NO: 1358828 - protein, 26 aa, Mycobacterium
INQPPPCMTGFLPASEWRSPADTSTA

SEQ ID NO: 1358829 - protein, 20 aa, Mycobacterium
INSADALVAAVRSKAPGDKV

SEQ ID NO: 1358830 - protein, 17 aa, Mycobacterium
INVWGQWCGPCRTEMPE

SEQ ID NO: 1358831 - protein, 24 aa, Mycobacterium
IPELLTGRAALLDLPAPGRLSAGG

SEQ ID NO: 1358832 - protein, 22 aa, Mycobacterium
IPGAIVGIWGPGGDYVRAFGVA

SEQ ID NO: 1358833 - protein, 26 aa, Mycobacterium
IPGATAALVLLLFLNGLTGTFLFAHS

SEQ ID NO: 1358834 - protein, 20 aa, Mycobacterium
IPGYIGLELAAQGVVGPGAQ

SEQ ID NO: 1358835 - protein, 21 aa, Mycobacterium
IPITASPVWGSRSIDLCNGLD

SEQ ID NO: 1358836 - protein, 17 aa, Mycobacterium
IPLSARSEARLAVQAGA

SEQ ID NO: 1358837 - protein, 23 aa, Mycobacterium
IPPAIDVLIRERPNFTTALDRLG

SEQ ID NO: 1358838 - protein, 25 aa, Mycobacterium
IPSGDTRAFLGARIGVRRGSVVDAT

SEQ ID NO: 1358839 - protein, 18 aa, Mycobacterium
IPWHVRGALWEATATNTA

SEQ ID NO: 1358840 - protein, 20 aa, Mycobacterium
IPWLLMVATFGLERLESGLA

SEQ ID NO: 1358841 - protein, 23 aa, Mycobacterium
IPYRNTYAWFLTLNDGQIVKAAA

SEQ ID NO: 1358842 - protein, 26 aa, Mycobacterium
IQQITPPPIIVGVVTWADCLVALQQR

SEQ ID NO: 1358843 - protein, 19 aa, Mycobacterium
IQQSLFYSPIYSEPDPDCM

SEQ ID NO: 1358844 - protein, 26 aa, Mycobacterium
IRCEQVEWVWYVETLRETPGFGAQVK

SEQ ID NO: 1358845 - protein, 18 aa, Mycobacterium
IRDWEDELWETVLPHTTG

SEQ ID NO: 1358846 - protein, 19 aa, Mycobacterium
IRKGEWVALFFGSANRDPD

SEQ ID NO: 1358847 - protein, 25 aa, Mycobacterium
IRVDGGLLAHQPFVPDMDSLGAATA

SEQ ID NO: 1358848 - protein, 31 aa, Mycobacterium
IRVNAICPGFIETPLFESVIGIPGMEGPRDG

SEQ ID NO: 1358849 - protein, 18 aa, Mycobacterium
IRVRIGIHVGKSVLRGDD

SEQ ID NO: 1358850 - protein, 17 aa, Mycobacterium
ISGNWLLQNPMFAGYAG

SEQ ID NO: 1358851 - protein, 29 aa, Mycobacterium
ISGVEIMNQWYYRPDYMAIMSNCANTQIG

SEQ ID NO: 1358852 - protein, 22 aa, Mycobacterium
ISLAAVFLALAIGIALGSGMLS

SEQ ID NO: 1358853 - protein, 26 aa, Mycobacterium
ISRALSILPFKIFQNWLKVGVDLAVA

SEQ ID NO: 1358854 - protein, 25 aa, Mycobacterium
ITAVTNLLIPFKPLSNALGEHVSWW

SEQ ID NO: 1358855 - protein, 19 aa, Mycobacterium
ITCDDMVLAWASQSGRYPW

SEQ ID NO: 1358856 - protein, 25 aa, Mycobacterium
ITDAPTCPVALAFPDGPQSPLLEEF

SEQ ID NO: 1358857 - protein, 17 aa, Mycobacterium
ITPNRWWPTLAESVDDL

SEQ ID NO: 1358858 - protein, 27 aa, Mycobacterium
ITRGGAHYPYWHLVLAPGSCAVPLTVP

SEQ ID NO: 1358859 - protein, 29 aa, Mycobacterium
ITRGGRSYPYWNLVLAPGAAPVPLDVPGA

SEQ ID NO: 1358860 - protein, 23 aa, Mycobacterium
ITRPYSGAVCQYILARRSGGAPT

SEQ ID NO: 1358861 - protein, 22 aa, Mycobacterium
ITTYRTSYSFFGLGSPSLPGTV

SEQ ID NO: 1358862 - protein, 31 aa, Mycobacterium
ITVYGWDQTVFYKNGAPIVWDRGRELGMTNR

SEQ ID NO: 1358863 - protein, 21 aa, Mycobacterium
ITYNEWSFAKAQNLSIAKIVT

SEQ ID NO: 1358864 - protein, 17 aa, Mycobacterium
IVANPYLVDGAPTISAS

SEQ ID NO: 1358865 - protein, 17 aa, Mycobacterium
IVAVVSALAVVTGLAAC

SEQ ID NO: 1358866 - protein, 27 aa, Mycobacterium
IVDAGAWTFDHGDHYHYFATDPAVVGT

SEQ ID NO: 1358867 - protein, 18 aa, Mycobacterium
IVKNRQYNFPPIGENLLV

SEQ ID NO: 1358868 - protein, 18 aa, Mycobacterium
IVLVVAAIGLAVYATSKS

SEQ ID NO: 1358869 - protein, 17 aa, Mycobacterium
IVMGHSFGAQVCSRWMR

SEQ ID NO: 1358870 - protein, 19 aa, Mycobacterium
IVPMYPLATTAAGTAVKVV

SEQ ID NO: 1358871 - protein, 17 aa, Mycobacterium
IVRFRWNGNGVELIGNT

SEQ ID NO: 1358872 - protein, 17 aa, Mycobacterium
IVTPVGVPIHTIGKAPV

SEQ ID NO: 1358873 - protein, 18 aa, Mycobacterium
IWPNALAALDAFGLGDAV

SEQ ID NO: 1358874 - protein, 24 aa, Mycobacterium
IYDPPMRTMIAFGGKYPTTVIPST

SEQ ID NO: 1358875 - protein, 18 aa, Mycobacterium
IYEDGWARPVAFSHGATI

SEQ ID NO: 1358876 - protein, 19 aa, Mycobacterium
IYGHLSPRLGVQPATAAGQ

SEQ ID NO: 1358877 - protein, 26 aa, Mycobacterium
IYSSCALPPVLEYLKSGELPSTDTYC

SEQ ID NO: 1358878 - protein, 44 aa, Mycobacterium
KAFSGLLAAVGLAPLIANLPAAPAPPPALWALLASARREFERAF

SEQ ID NO: 1358879 - protein, 20 aa, Mycobacterium
KAIIVAPNLIAARYVQLTPA

SEQ ID NO: 1358880 - protein, 30 aa, Mycobacterium; identical to SEQ ID NO: 1139663

SEQ ID NO: 1358881 - protein, 40 aa, Mycobacterium
KEGNTTYVFIPTENLPLLEPLRWLGLTGIADALNGPLKAI

SEQ ID NO: 1358882 - protein, 18 aa, Mycobacterium
KEKAIAPIRAWLGGLTAD

SEQ ID NO: 1358883 - protein, 20 aa, Mycobacterium
KFEKSWHELLEATRGQLDSA

SEQ ID NO: 1358884 - protein, 24 aa, Mycobacterium
KFPTPEKLWTIEDLGGWSKVDSEL

SEQ ID NO: 1358885 - protein, 17 aa, Mycobacterium
KFVAALLCSRDAAVESR

SEQ ID NO: 1358886 - protein, 37 aa, Mycobacterium
KGTRVGLFFPNGAEWVTWWLAVSRVGAVAVPLSTMYR

SEQ ID NO: 1358887 - protein, 26 aa, Mycobacterium
KHRVAAIFLRALLAEDLRPVVQRIAA

SEQ ID NO: 1358888 - protein, 24 aa, Mycobacterium
KIGESLAILGWNMSVSNLRFDAEN

SEQ ID NO: 1358889 - protein, 21 aa, Mycobacterium
KILTRRTFLAATLAASTAAMA

SEQ ID NO: 1358890 - protein, 25 aa, Mycobacterium
KKAPITFDTLFRPDTKPLDVIFPIV

SEQ ID NO: 1358891 - protein, 25 aa, Mycobacterium
KKGQTLVLHGLWPQPRDRQYCGMPQ

SEQ ID NO: 1358892 - protein, 24 aa, Mycobacterium
KLAMGELPFYEPGLPEVLRKNIDA

SEQ ID NO: 1358893 - protein, 18 aa, Mycobacterium
KLCAQYMAPIFKNRQYNF

SEQ ID NO: 1358894 - protein, 20 aa, Mycobacterium
KLCVQYLAPIVKNRQYNFPP

SEQ ID NO: 1358895 - protein, 28 aa, Mycobacterium
KLNAMGDFLNRVIPPFTIADGAGTFDII

SEQ ID NO: 1358896 - protein, 19 aa, Mycobacterium
KLNSNETFVYLARAVDPVI

SEQ ID NO: 1358897 - protein, 23 aa, Mycobacterium
KLRPGDAIPLDRTAPALDLDAVI

SEQ ID NO: 1358898 - protein, 24 aa, Mycobacterium
KLVTNHHVLGYLAQRFGFTVIGAV

SEQ ID NO: 1358899 - protein, 19 aa, Mycobacterium
KNNFLAANVVPLVASQKKS

SEQ ID NO: 1358900 - protein, 17 aa, Mycobacterium
KNRLLLKDGLEKQGLEN

SEQ ID NO: 1358901 - protein, 31 aa, Mycobacterium
KPGDPRYPYREPLPAPAPGGPPPGPPALQPV

SEQ ID NO: 1358902 - protein, 30 aa, Mycobacterium; identical to SEQ ID NO: 1307585

SEQ ID NO: 1358903 - protein, 24 aa, Mycobacterium
KPSSDVIPYRPVGTLWEATATDEA

SEQ ID NO: 1358904 - protein, 21 aa, Mycobacterium
KPSTADVFRADGPFVGTGLQG

SEQ ID NO: 1358905 - protein, 20 aa, Mycobacterium
KPTLPAWRIIEPRPAEELMG

SEQ ID NO: 1358906 - protein, 17 aa, Mycobacterium
KQAAPRPAPAPAAAPVA

SEQ ID NO: 1358907 - protein, 17 aa, Mycobacterium
KQMLFGPLDGPPRNTSQ

SEQ ID NO: 1358908 - protein, 25 aa, Mycobacterium
KQMQGWLDQWGMPGPNAPGGDMGPH

SEQ ID NO: 1358909 - protein, 17 aa, Mycobacterium
KRGDLLFWGPGGSQHEA

SEQ ID NO: 1358910 - protein, 27 aa, Mycobacterium
KRIAMNFPPLLFHPINSITAYKGQILY

SEQ ID NO: 1358911 - protein, 17 aa, Mycobacterium
KRITMNFPPLLAHPINS

SEQ ID NO: 1358912 - protein, 18 aa, Mycobacterium
KRLPTVIDSSALQWDRVL

SEQ ID NO: 1358913 - protein, 25 aa, Mycobacterium
KRQKVTLYVRPAAWGMWTFYELSEE

SEQ ID NO: 1358914 - protein, 29 aa, Mycobacterium
KSDMVNGLIYPVPDPRYPFLGVHLTKHVD

SEQ ID NO: 1358915 - protein, 24 aa, Mycobacterium
KTAGGLDLLHRLLDRADAFVSNLA

SEQ ID NO: 1358916 - protein, 27 aa, Mycobacterium
KTDSDLLTSILTYHVVPGQAAPDQVPG

SEQ ID NO: 1358917 - protein, 17 aa, Mycobacterium
KTLEFPVTVDCGEGLKA

SEQ ID NO: 1358918 - protein, 20 aa, Mycobacterium
KTMLAQRLPGLLPPLTHTES

SEQ ID NO: 1358919 - protein, 22 aa, Mycobacterium
KTPVGAMGLLAEALLASADDPE

SEQ ID NO: 1358920 - protein, 23 aa, Mycobacterium
KTPVGAMGLLAEALLASADDPET

SEQ ID NO: 1358921 - protein, 22 aa, Mycobacterium
KTRTVWPTMFNPSTYLGMVKLG

SEQ ID NO: 1358922 - protein, 39 aa, Mycobacterium
KVAGTLILHELFPPEQLDWMVLFSSCGYLAGFPGQGAYA

SEQ ID NO: 1358923 - protein, 18 aa, Mycobacterium
KVETLVACGDRDLLTPVE

SEQ ID NO: 1358924 - protein, 22 aa, Mycobacterium
KVLDSDAWRRLSANRDGRVFAV

SEQ ID NO: 1358925 - protein, 22 aa, Mycobacterium
KVLTVALVALLVAGAAVIVRQE

SEQ ID NO: 1358926 - protein, 17 aa, Mycobacterium
KVPRRLLKAARLGLIDL

SEQ ID NO: 1358927 - protein, 22 aa, Mycobacterium
KVPVDLDLMLKTVPPQCEWVYA

SEQ ID NO: 1358928 - protein, 17 aa, Mycobacterium
KVTAVLRDPSYRLVTTT

SEQ ID NO: 1358929 - protein, 28 aa, Mycobacterium
KVTWGSMIVDWLYSIGIRSRRMGTDWLD

SEQ ID NO: 1358930 - protein, 20 aa, Mycobacterium
KVVAGQTVEFGFQASPGGAT

SEQ ID NO: 1358931 - protein, 21 aa, Mycobacterium
KWLEEALPDYNIKWTKFDSGA

SEQ ID NO: 1358932 - protein, 27 aa, Mycobacterium
LAAAPLVTLYKRYAVRFGLGYTEESRE

SEQ ID NO: 1358933 - protein, 20 aa, Mycobacterium
LAADPGSLAGKLLRIEQPTT

SEQ ID NO: 1358934 - protein, 17 aa, Mycobacterium
LAAGLLVVGCGGAEQQQ

SEQ ID NO: 1358935 - protein, 22 aa, Mycobacterium
LAAGRGLVFVATEKGIHRSTDN

SEQ ID NO: 1358936 - protein, 17 aa, Mycobacterium
LAALAVGVVAPGTLAAC

SEQ ID NO: 1358937 - protein, 28 aa, Mycobacterium
LAALGMVWPFLFYGAPAAAEPSPGVPCL

SEQ ID NO: 1358938 - protein, 21 aa, Mycobacterium
LAALLPQGGGGRLLLPGGNCP

SEQ ID NO: 1358939 - protein, 18 aa, Mycobacterium
LAALSGKCKLPLTLPQVF

SEQ ID NO: 1358940 - protein, 23 aa, Mycobacterium
LAARLWDLPGWAATGRELLTRIA

SEQ ID NO: 1358941 - protein, 19 aa, Mycobacterium
LAAVVALLALAVGVVFGAR

SEQ ID NO: 1358942 - protein, 33 aa, Mycobacterium
LAAYDPYPCVMVDRGWWILQANPGASILLDGVA

SEQ ID NO: 1358943 - protein, 31 aa, Mycobacterium
LADNINRRLKLPYDIWLRGSQCDEANAIWNG

SEQ ID NO: 1358944 - protein, 25 aa, Mycobacterium
LADVALREAALASLRLLDDEPAEGL

SEQ ID NO: 1358945 - protein, 17 aa, Mycobacterium
LAGAIVHFSSPGPAPAA

SEQ ID NO: 1358946 - protein, 21 aa, Mycobacterium
LAGGNIAFATIPIVEEAGWSD

SEQ ID NO: 1358947 - protein, 17 aa, Mycobacterium
LAGLGAAVIMAAPASAA

SEQ ID NO: 1358948 - protein, 25 aa, Mycobacterium
LAGLLSGCAGWRGLNSLPLPGVQGT

SEQ ID NO: 1358949 - protein, 23 aa, Mycobacterium
LAGMELSIEWPYGSNLHCEILVD

SEQ ID NO: 1358950 - protein, 18 aa, Mycobacterium
LAGVPPLGDRIGSIGSAP

SEQ ID NO: 1358951 - protein, 18 aa, Mycobacterium
LAGWADPIPALLASTDPA

SEQ ID NO: 1358952 - protein, 18 aa, Mycobacterium
LAICGLLATAQPAYGWAQ

SEQ ID NO: 1358953 - protein, 18 aa, Mycobacterium
LAICGLLATAQPSYGWAQ

SEQ ID NO: 1358954 - protein, 17 aa, Mycobacterium
LAIGLFAGTFTRTVPVT

SEQ ID NO: 1358955 - protein, 27 aa, Mycobacterium
LAKLPTDFPIYNLAGKSYYWNMSGTTN

SEQ ID NO: 1358956 - protein, 17 aa, Mycobacterium
LALDELLAEGPPMPAQC

SEQ ID NO: 1358957 - protein, 26 aa, Mycobacterium
LALIPNWIKPLYSWFTQNIDFSTCVF

SEQ ID NO: 1358958 - protein, 22 aa, Mycobacterium
LALNEDVKMLWFCGGHGSCLPG

SEQ ID NO: 1358959 - protein, 23 aa, Mycobacterium
LALSAALLTALFLSACTSTEQPQ

SEQ ID NO: 1358960 - protein, 18 aa, Mycobacterium
LALSRGGGRLYISNALAG

SEQ ID NO: 1358961 - protein, 22 aa, Mycobacterium
LANFVNMYPPAVGGFAGAFSLN

SEQ ID NO: 1358962 - protein, 26 aa, Mycobacterium
LANLQRPLRELGKSGPYLLGALKIFL

SEQ ID NO: 1358963 - protein, 22 aa, Mycobacterium
LANPDVYRPAALLPTPRETATF

SEQ ID NO: 1358964 - protein, 20 aa, Mycobacterium
LANPFYIRRAPIVDGIDEFD

SEQ ID NO: 1358965 - protein, 39 aa, Mycobacterium
LAPQLAAPMRSWALAATKLLLLMGLRADVDRFNAAAAQV

SEQ ID NO: 1358966 - protein, 27 aa, Mycobacterium
LAQLGTSIGWIPVVGTAVYGVSFLGNL

SEQ ID NO: 1358967 - protein, 24 aa, Mycobacterium
LAQVLNQLAGWPEPPHNFVTPANY

SEQ ID NO: 1358968 - protein, 18 aa, Mycobacterium
LARDIVYPRFESGGVPYE

SEQ ID NO: 1358969 - protein, 21 aa, Mycobacterium
LARFITLPEQGLALPSTPAAV

SEQ ID NO: 1358970 - protein, 20 aa, Mycobacterium
LARLVALGGFRRWEPAVRRF

SEQ ID NO: 1358971 - protein, 30 aa, Mycobacterium
LARQGIYGDFFSFYLCDIVLKLNGKGGQPV

SEQ ID NO: 1358972 - protein, 28 aa, Mycobacterium
LASEANPLVGLPFYVNPQSKGMRAAQGN

SEQ ID NO: 1358973 - protein, 24 aa, Mycobacterium
LASMWAGPLLGRMLVRSGATVVKV

SEQ ID NO: 1358974 - protein, 17 aa, Mycobacterium
LAVFDDHTEEILYLGRA

SEQ ID NO: 1358975 - protein, 20 aa, Mycobacterium
LAVGGTPYFLGEDPVALLSV

SEQ ID NO: 1358976 - protein, 24 aa, Mycobacterium
LAVPTSFLAVRLHQLGWLNDISDE

SEQ ID NO: 1358977 - protein, 17 aa, Mycobacterium
LAWLVGGQLWDWMSAGL

SEQ ID NO: 1358978 - protein, 19 aa, Mycobacterium
LAYALYRSTDSACGTAAIV

SEQ ID NO: 1358979 - protein, 18 aa, Mycobacterium
LCALMVFAVGCAGVPSSS

SEQ ID NO: 1358980 - protein, 19 aa, Mycobacterium
LCAVAFVALAAVGGSLFWE

SEQ ID NO: 1358981 - protein, 17 aa, Mycobacterium
LCLLLGVAIATQVRQTD

SEQ ID NO: 1358982 - protein, 26 aa, Mycobacterium
LCREVYYQWIVPLGLVEVGVAENVRA

SEQ ID NO: 1358983 - protein, 19 aa, Mycobacterium
LCVQYMAPIIKNRQYNFLP

SEQ ID NO: 1358984 - protein, 32 aa, Mycobacterium
LDAEALKDIALYLNFDMLGSPNPGYFTMDGNQ

SEQ ID NO: 1358985 - protein, 28 aa, Mycobacterium
LDDAARLAPVLTPGRRLAIIGAGFIGLE

SEQ ID NO: 1358986 - protein, 23 aa, Mycobacterium
LDGGEFTVFAPTDDAFAKLDPAT

SEQ ID NO: 1358987 - protein, 35 aa, Mycobacterium; identical to SEQ ID NO: 1307691

SEQ ID NO: 1358988 - protein, 27 aa, Mycobacterium
LDLDSVIGGFRPLFRALDADQVNALSG

SEQ ID NO: 1358989 - protein, 17 aa, Mycobacterium
LDQAEVVSIYRGPALRD

SEQ ID NO: 1358990 - protein, 18 aa, Mycobacterium
LDQRQALIAAMNVIDEGT

SEQ ID NO: 1358991 - protein, 28 aa, Mycobacterium
LDREELWHRYRQAALYAYVAALITAGMG

SEQ ID NO: 1358992 - protein, 22 aa, Mycobacterium
LDSRLVIDIPADDPRIARTEDV

SEQ ID NO: 1358993 - protein, 18 aa, Mycobacterium
LDVIFPIVQKDISRQLGV

SEQ ID NO: 1358994 - protein, 18 aa, Mycobacterium
LDVLANIAGFHKMRHTVS

SEQ ID NO: 1358995 - protein, 20 aa, Mycobacterium
LDVRIGLRHIAGSRRKMWQE

SEQ ID NO: 1358996 - protein, 26 aa, Mycobacterium
LDYLREKYRSWAEPIPTLLATSAAQD

SEQ ID NO: 1358997 - protein, 21 aa, Mycobacterium
LEDLGYDRRAILERLRALPLA

SEQ ID NO: 1358998 - protein, 33 aa, Mycobacterium; identical to SEQ ID NO: 1320388

SEQ ID NO: 1358999 - protein, 17 aa, Mycobacterium
LEDPKNVFLAANVVPLV

SEQ ID NO: 1359000 - protein, 24 aa, Mycobacterium
LEENGYIPIPEAFKTRLTEAVDAI

SEQ ID NO: 1359001 - protein, 18 aa, Mycobacterium
LELALGPRGVFKLQPWDG

SEQ ID NO: 1359002 - protein, 25 aa, Mycobacterium
LELGYQVGFPWSLGVSINFSYTTPN

SEQ ID NO: 1359003 - protein, 19 aa, Mycobacterium
LELRYLFDVGGAPPPDPAQ

SEQ ID NO: 1359004 - protein, 19 aa, Mycobacterium
LEMQWGRTIGQMPSPYTAG

SEQ ID NO: 1359005 - protein, 24 aa, Mycobacterium
LEMQWGRTLGQMPSPYTVANPLTV

SEQ ID NO: 1359006 - protein, 24 aa, Mycobacterium
LEPDLPPGPFLTGIELNMAFAGDR

SEQ ID NO: 1359007 - protein, 28 aa, Mycobacterium
LEPGQKWTGFHRLEKDLWVTGPQADTNA

SEQ ID NO: 1359008 - protein, 21 aa, Mycobacterium
LEQLRPGVRLLADPSGRDLGA

SEQ ID NO: 1359009 - protein, 22 aa, Mycobacterium
LEQLRPGVRLLADPSGRDLGAM

SEQ ID NO: 1359010 - protein, 25 aa, Mycobacterium
LERVRLHPYLTVRILSQVGGLDAVA

SEQ ID NO: 1359011 - protein, 22 aa, Mycobacterium
LESPNPPWFVKYGLDVRRTEYE

SEQ ID NO: 1359012 - protein, 24 aa, Mycobacterium
LETLRAELDRFWTQALVDFKDIVE

SEQ ID NO: 1359013 - protein, 33 aa, Mycobacterium
LEVPLPVASLIRDRFLTLLAGGGRDLDWSALGA

SEQ ID NO: 1359014 - protein, 18 aa, Mycobacterium
LEWLQDKAAFTRTGTNGV

SEQ ID NO: 1359015 - protein, 19 aa, Mycobacterium
LFAAATVPLTLAPGAAADP

SEQ ID NO: 1359016 - protein, 28 aa, Mycobacterium
LFAGIPYAAPPIGPLRWRDPEPAPRWDG

SEQ ID NO: 1359017 - protein, 24 aa, Mycobacterium
LFDEGTPIPLKLLTSNTFDTGVVH

SEQ ID NO: 1359018 - protein, 17 aa, Mycobacterium
LFFVGRTGEMIKTSGAN

SEQ ID NO: 1359019 - protein, 18 aa, Mycobacterium
LFLHGGRFSVLLAQHLGA

SEQ ID NO: 1359020 - protein, 17 aa, Mycobacterium
LFRPPRPAHQEIPISSF

SEQ ID NO: 1359021 - protein, 17 aa, Mycobacterium
LFRYDQVFEAARDSATF

SEQ ID NO: 1359022 - protein, 19 aa, Mycobacterium
LFTEAWGVDVAVSTPLAIV

SEQ ID NO: 1359023 - protein, 19 aa, Mycobacterium
LFTIMVYGVFQLARRTAPE

SEQ ID NO: 1359024 - protein, 19 aa, Mycobacterium
LGAALLGFALAGPSPMAEA

SEQ ID NO: 1359025 - protein, 20 aa, Mycobacterium
LGAIYGAEAPVYADSGWTVM

SEQ ID NO: 1359026 - protein, 24 aa, Mycobacterium
LGAQFRSFAAAMDRWWALDSDGEL

SEQ ID NO: 1359027 - protein, 25 aa, Mycobacterium
LGARTIFASVPYYVDMLTTGITDSL

SEQ ID NO: 1359028 - protein, 31 aa, Mycobacterium; identical to SEQ ID NO: 947164

SEQ ID NO: 1359029 - protein, 25 aa, Mycobacterium
LGIPYDEYIMRTGADWFPGLDRQIV

SEQ ID NO: 1359030 - protein, 22 aa, Mycobacterium
LGIVLGLVGLLLGLNLPARAVA

SEQ ID NO: 1359031 - protein, 25 aa, Mycobacterium
LGLALLLCALGFAGQIPPAPAQPDT

SEQ ID NO: 1359032 - protein, 17 aa, Mycobacterium
LGLMLAATGLAGALMLS

SEQ ID NO: 1359033 - protein, 20 aa, Mycobacterium
LGLVRDRLLDDRAWVAAERA

SEQ ID NO: 1359034 - protein, 26 aa, Mycobacterium
LGMMVPGFPNFFIMYGPNTNSVPLVH

SEQ ID NO: 1359035 - protein, 31 aa, Mycobacterium; identical to SEQ ID NO: 1307767

SEQ ID NO: 1359036 - protein, 21 aa, Mycobacterium
LGNFTGSFWEGTIGAASASIV

SEQ ID NO: 1359037 - protein, 18 aa, Mycobacterium
LGPRPGVVITPQPDMLPT

SEQ ID NO: 1359038 - protein, 33 aa, Mycobacterium
LGTGGAIPLPGGAVESLWLAIRQSRGPQAEQPV

SEQ ID NO: 1359039 - protein, 26 aa, Mycobacterium
LGTTWRPECPVPPDALRRVDLDYWGF

SEQ ID NO: 1359040 - protein, 26 aa, Mycobacterium
LGVCYLPAFLCVGIVPVVAGLAGEVL

SEQ ID NO: 1359041 - protein, 19 aa, Mycobacterium
LGVELQRRGAWARCVQIVG

SEQ ID NO: 1359042 - protein, 27 aa, Mycobacterium
LGVMLAYSPVHHLLFAEPDMPALVMTS

SEQ ID NO: 1359043 - protein, 17 aa, Mycobacterium
LHQIVDLPPVAGVRPGE

SEQ ID NO: 1359044 - protein, 26 aa, Mycobacterium
LHSCAADIPWKLLQRSAISAVSVDMH

SEQ ID NO: 1359045 - protein, 20 aa, Mycobacterium
LHTNTDDRLIWSILDRVRTI

SEQ ID NO: 1359046 - protein, 29 aa, Mycobacterium
LHVHGLFGWLQFVPILGNLLNPGGGHGRT

SEQ ID NO: 1359047 - protein, 34 aa, Mycobacterium
LIADKVSYIYLYNPSVIQAWNPALSGYEARRDGA

SEQ ID NO: 1359048 - protein, 17 aa, Mycobacterium
LIALFMAVGVVAGLTLG

SEQ ID NO: 1359049 - protein, 22 aa, Mycobacterium
LIALLCALPVVLSPYPAATFAV

SEQ ID NO: 1359050 - protein, 18 aa, Mycobacterium
LIASLSVILVGGVVVLLR

SEQ ID NO: 1359051 - protein, 28 aa, Mycobacterium
LIAVLVAVVLLIGGWAYQTANRLDRLHV

SEQ ID NO: 1359052 - protein, 26 aa, Mycobacterium
LIDPPARLLHPKILLRVAFTSWRRRG

SEQ ID NO: 1359053 - protein, 19 aa, Mycobacterium
LIGLIVYPSAPLAEADADQ

SEQ ID NO: 1359054 - protein, 18 aa, Mycobacterium
LIGLTRALAVEFTKERLR

SEQ ID NO: 1359055 - protein, 20 aa, Mycobacterium
LITRPPFVAPHPTSSVAALV

SEQ ID NO: 1359056 - protein, 26 aa, Mycobacterium
LIVLALRWLLIHTPKARVKAVPLVSG

SEQ ID NO: 1359057 - protein, 17 aa, Mycobacterium
LIVPVPAPAPPPGAPAP

SEQ ID NO: 1359058 - protein, 19 aa, Mycobacterium
LIYTVWESPGPIEPDPYLK

SEQ ID NO: 1359059 - protein, 19 aa, Mycobacterium
LKVLPQLTAKHRVIVAAVA

SEQ ID NO: 1359060 - protein, 24 aa, Mycobacterium
LLAALAIVGILLSGIGVATMMIFG

SEQ ID NO: 1359061 - protein, 24 aa, Mycobacterium
LLAGKQACRLLYTGQPAQAVIDST

SEQ ID NO: 1359062 - protein, 26 aa, Mycobacterium
LLAGRWELAAFAAPLLGVLCSIGWQR

SEQ ID NO: 1359063 - protein, 25 aa, Mycobacterium
LLALGVSVFALLRTLDHGPDYTDEQ

SEQ ID NO: 1359064 - protein, 20 aa, Mycobacterium
LLALVGPFAPATSSAAPADP

SEQ ID NO: 1359065 - protein, 17 aa, Mycobacterium
LLARLNARRTSRRRFIG

SEQ ID NO: 1359066 - protein, 17 aa, Mycobacterium
LLCRGHVLLEGVPGVAK

SEQ ID NO: 1359067 - protein, 18 aa, Mycobacterium
LLDDRAWVAAERALATGE

SEQ ID NO: 1359068 - protein, 26 aa, Mycobacterium
LLGGGRGATLAARWGGSEWMGSTAGI

SEQ ID NO: 1359069 - protein, 19 aa, Mycobacterium
LLGTGITLAASAVAGCATY

SEQ ID NO: 1359070 - protein, 20 aa, Mycobacterium
LLIVVVVGAVFLGSKLWHNM

SEQ ID NO: 1359071 - protein, 19 aa, Mycobacterium
LLMALLTQNDGIAAPLLEA

SEQ ID NO: 1359072 - protein, 17 aa, Mycobacterium
LLMPSLRMLIGGGAPCP

SEQ ID NO: 1359073 - protein, 18 aa, Mycobacterium
LLMVATFGLERLESGLAR

SEQ ID NO: 1359074 - protein, 33 aa, Mycobacterium
LLQQQKPDLEIWYTLPVLPTGLTADGLNVVRAA

SEQ ID NO: 1359075 - protein, 20 aa, Mycobacterium
LLRPDGTFTYTVPTTMYAGG

SEQ ID NO: 1359076 - protein, 19 aa, Mycobacterium
LLSDTWRDGAFAYLGMAVP

SEQ ID NO: 1359077 - protein, 17 aa, Mycobacterium
LLVNNNTRLWIYSPATT

SEQ ID NO: 1359078 - protein, 25 aa, Mycobacterium
LMSICPKSMWPAVKAMLHSVYDQPD

SEQ ID NO: 1359079 - protein, 35 aa, Mycobacterium; identical to SEQ ID NO: 947405

SEQ ID NO: 1359080 - protein, 17 aa, Mycobacterium
LNLIGLDNGLPGGIGGA

SEQ ID NO: 1359081 - protein, 26 aa, Mycobacterium
LNRPKLGFPVPIRHWLRAGELLEWAY

SEQ ID NO: 1359082 - protein, 33 aa, Mycobacterium
LNRPKLGFPVPIRHWLRSGELLDWAYGMVGTSG

SEQ ID NO: 1359083 - protein, 26 aa, Mycobacterium
LNSEGLKNWLFGPLDGPPRNTAQIGM

SEQ ID NO: 1359084 - protein, 20 aa, Mycobacterium
LNVLVGFIQLIDGPPVLPAN

SEQ ID NO: 1359085 - protein, 21 aa, Mycobacterium
LNVNPANARWFYDNTRRGDIV

SEQ ID NO: 1359086 - protein, 23 aa, Mycobacterium
LNVSPANARWFYDNTRRGDIVEV

SEQ ID NO: 1359087 - protein, 19 aa, Mycobacterium
LPAVAIDRATAALPAVAMD

SEQ ID NO: 1359088 - protein, 26 aa, Mycobacterium
LPAVEARLIGTRLFLANDPNHTMWQQ

SEQ ID NO: 1359089 - protein, 28 aa, Mycobacterium
LPDKFEQMWGYIYEQNIAPIYLGEFGTR

SEQ ID NO: 1359090 - protein, 25 aa, Mycobacterium
LPDKYRALGRQGMYGDFFSFYLCEL

SEQ ID NO: 1359091 - protein, 36 aa, Mycobacterium
LPDPGPIELVKTPDGWRIDRLPNGVFLDWQQFQATY

SEQ ID NO: 1359092 - protein, 26 aa, Mycobacterium
LPDTYRLIGRTPVRPLRLRPAPSAVV

SEQ ID NO: 1359093 - protein, 19 aa, Mycobacterium
LPEIYRKLARVGSYGAWFP

SEQ ID NO: 1359094 - protein, 25 aa, Mycobacterium
LPEKKGAQLFLPSPDIPIVASRDES

SEQ ID NO: 1359095 - protein, 20 aa, Mycobacterium
LPFNRILAVAGFRCNVQESV

SEQ ID NO: 1359096 - protein, 20 aa, Mycobacterium
LPGKGLSYACAAYGASVLVL

SEQ ID NO: 1359097 - protein, 19 aa, Mycobacterium
LPGLQPFMPPYVPGGGAKP

SEQ ID NO: 1359098 - protein, 17 aa, Mycobacterium
LPGYGWIFPLGNGEVNI

SEQ ID NO: 1359099 - protein, 18 aa, Mycobacterium
LPGYGWIFPLGNGEVNIG

SEQ ID NO: 1359100 - protein, 32 aa, Mycobacterium
LPLRAMVMVLLFLGVVFLLVALQSMGGSDGDD

SEQ ID NO: 1359101 - protein, 19 aa, Mycobacterium
LPLVALAATLALVAGCDSA

SEQ ID NO: 1359102 - protein, 17 aa, Mycobacterium
LPPPCTTGFLPAQQQRS

SEQ ID NO: 1359103 - protein, 24 aa, Mycobacterium
LPPVNAFWSLTMYELPASLLVENP

SEQ ID NO: 1359104 - protein, 21 aa, Mycobacterium
LPSGVIVTKVDDRLINSADAL

SEQ ID NO: 1359105 - protein, 24 aa, Mycobacterium
LPSSVQLPVWLSRAGSDVLKSHPI

SEQ ID NO: 1359106 - protein, 22 aa, Mycobacterium
LPTCVVKYIPLHTPAVTMSFNT

SEQ ID NO: 1359107 - protein, 18 aa, Mycobacterium
LPVTVLSGFLGAGKTTLL

SEQ ID NO: 1359108 - protein, 25 aa, Mycobacterium
LQGQGLVDCLGGRPANVVFLNGSPT

SEQ ID NO: 1359109 - protein, 20 aa, Mycobacterium
LQGRVTPLAQWGYGENWSAQ

SEQ ID NO: 1359110 - protein, 21 aa, Mycobacterium
LQLADLLKPGVALSAIPPLAH

SEQ ID NO: 1359111 - protein, 20 aa, Mycobacterium
LQLGSSPRVANAVRFAFWGS

SEQ ID NO: 1359112 - protein, 21 aa, Mycobacterium
LQLLGLLQSRRVWSGEELAER

SEQ ID NO: 1359113 - protein, 21 aa, Mycobacterium
LQLLGLLQSRRVWSGEELAGR

SEQ ID NO: 1359114 - protein, 25 aa, Mycobacterium
LQNLQRPLKQLARSSPYLIGALKLM

SEQ ID NO: 1359115 - protein, 21 aa, Mycobacterium
LQRFVEELWINQDPGGAVFTA

SEQ ID NO: 1359116 - protein, 23 aa, Mycobacterium
LQRMHGFVGFSLLADRESGRCIA

SEQ ID NO: 1359117 - protein, 25 aa, Mycobacterium
LRAAGVLDDLPYKIAFSTFTSGPPQ

SEQ ID NO: 1359118 - protein, 24 aa, Mycobacterium
LRAQFATNVFGVAATLQAALPAMR

SEQ ID NO: 1359119 - protein, 19 aa, Mycobacterium
LRDVEVSVTYFGGGPIERF

SEQ ID NO: 1359120 - protein, 27 aa, Mycobacterium
LRGIEYTHDFVRLAHGAPFIAVNTAIE

SEQ ID NO: 1359121 - protein, 25 aa, Mycobacterium
LRKGTYFPDWLLERRKRAESALITV

SEQ ID NO: 1359122 - protein, 26 aa, Mycobacterium
LRKGTYFPEWLLERRKRAESALITVV

SEQ ID NO: 1359123 - protein, 36 aa, Mycobacterium
LRLVNLPPSVSYSFRSLARGPQAEALILGTDGMLHV

SEQ ID NO: 1359124 - protein, 23 aa, Mycobacterium
LRPQTRLLATDRALTSPTLAGLS

SEQ ID NO: 1359125 - protein, 18 aa, Mycobacterium
LRQDIPLDGFLRVNPAGD

SEQ ID NO: 1359126 - protein, 24 aa, Mycobacterium
LRRVDLDYWGFDGRTHRGRLVVHR

SEQ ID NO: 1359127 - protein, 28 aa, Mycobacterium
LRYTMPLGEIIFDFFDSLKSRTRGYASL

SEQ ID NO: 1359128 - protein, 22 aa, Mycobacterium
LSAAVLLVSALLGVSCATPSTT

SEQ ID NO: 1359129 - protein, 22 aa, Mycobacterium
LSAGGASRLLRARDGWCALTLS

SEQ ID NO: 1359130 - protein, 26 aa, Mycobacterium
LSAIPPLAHPFIVRALDDAPPPHQPG

SEQ ID NO: 1359131 - protein, 24 aa, Mycobacterium
LSDGWNIMDFVEQLQKLAGGNIAF

SEQ ID NO: 1359132 - protein, 24 aa, Mycobacterium
LSHITSGVYLLKPSVRELRECVGR

SEQ ID NO: 1359133 - protein, 21 aa, Mycobacterium
LSLAALVTALLLAGCSSPEPQ

SEQ ID NO: 1359134 - protein, 22 aa, Mycobacterium
LSLALTALRLRVARAAEAAGRD

SEQ ID NO: 1359135 - protein, 17 aa, Mycobacterium
LSLLAAGTLLLSACGSD

SEQ ID NO: 1359136 - protein, 26 aa, Mycobacterium
LSRRLVPAVLTAIALPLAACGGSGAG

SEQ ID NO: 1359137 - protein, 22 aa, Mycobacterium
LSSGPFFKAYVANLLPGQFVQP

SEQ ID NO: 1359138 - protein, 27 aa, Mycobacterium
LTAAAALPVVPIATSPPPPPGVSRDVH

SEQ ID NO: 1359139 - protein, 26 aa, Mycobacterium
LTAALPFMMLPLTVAGPLPAAGAAAA

SEQ ID NO: 1359140 - protein, 28 aa, Mycobacterium
LTAARNWFERTFFAATPVYPPQTVMVTV

SEQ ID NO: 1359141 - protein, 17 aa, Mycobacterium
LTADRRPLYSRASGSHL

SEQ ID NO: 1359142 - protein, 29 aa, Mycobacterium
LTALAGALIPITSLFAPALSHAGAYTVAA

SEQ ID NO: 1359143 - protein, 17 aa, Mycobacterium
LTAVLAVTIAVSAGCSG

SEQ ID NO: 1359144 - protein, 25 aa, Mycobacterium
LTDGAWPAFWLINDNPVRGGEVDLV

SEQ ID NO: 1359145 - protein, 25 aa, Mycobacterium
LTDPVLPDELLATDWPGAALRSAYN

SEQ ID NO: 1359146 - protein, 24 aa, Mycobacterium
LTGANRYVFRFPSGGLPPVNAFWS

SEQ ID NO: 1359147 - protein, 23 aa, Mycobacterium
LTGEAAHLFPPFGGGRGLNSGVP

SEQ ID NO: 1359148 - protein, 33 aa, Mycobacterium
LTLLIALVPVVAFGVLLSAVTVPFVSLGPGPTF

SEQ ID NO: 1359149 - protein, 17 aa, Mycobacterium
LTLLVPVADRLQKVNMQ

SEQ ID NO: 1359150 - protein, 19 aa, Mycobacterium
LTNWTVCWQSPRAGSTFTA

SEQ ID NO: 1359151 - protein, 34 aa, Mycobacterium
LTPVGSLDQFLRRAPLLFLATGTPFQYAADWGEN

SEQ ID NO: 1359152 - protein, 24 aa, Mycobacterium
LTRLRGMFAFALWDSVAQELFCAR

SEQ ID NO: 1359153 - protein, 18 aa, Mycobacterium
LTSIVANPYLVDGAPTIS

SEQ ID NO: 1359154 - protein, 20 aa, Mycobacterium
LTVDFPRPTVTVSAFTVASG

SEQ ID NO: 1359155 - protein, 18 aa, Mycobacterium
LTVFAVGAIAVLTPVFSG

SEQ ID NO: 1359156 - protein, 20 aa, Mycobacterium
LTVLLLVGAVLAGVGRSASE

SEQ ID NO: 1359157 - protein, 23 aa, Mycobacterium
LTYNWETFLTQELPGWLQANRDV

SEQ ID NO: 1359158 - protein, 17 aa, Mycobacterium
LVAAARRQQKAYRVLAR

SEQ ID NO: 1359159 - protein, 29 aa, Mycobacterium
LVAQIAAQRPVLEKALKTIPRALAVLNDQ

SEQ ID NO: 1359160 - protein, 17 aa, Mycobacterium
LVDITRFWFEEGSLDNE

SEQ ID NO: 1359161 - protein, 18 aa, Mycobacterium
LVDLGMEPVPILKGDKGE

SEQ ID NO: 1359162 - protein, 26 aa, Mycobacterium
LVEAYLADPLPLTRLTIEKQIVALGE

SEQ ID NO: 1359163 - protein, 19 aa, Mycobacterium
LVELDEQFTLTLSSPLNAT

SEQ ID NO: 1359164 - protein, 35 aa, Mycobacterium
LVETDLVPLLQPFAFFVPRPILKAIDAPLRVVIED

SEQ ID NO: 1359165 - protein, 30 aa, Mycobacterium
LVFGVLLTVVTVPYVALGPGPTFDTLGEVD

SEQ ID NO: 1359166 - protein, 19 aa, Mycobacterium
LVIVMLLAAGTVAAGVWID

SEQ ID NO: 1359167 - protein, 17 aa, Mycobacterium
LVLRYHRERALPAVAMC

SEQ ID NO: 1359168 - protein, 23 aa, Mycobacterium
LVNGSVIQHWTVTGLKPSSDVIP

SEQ ID NO: 1359169 - protein, 17 aa, Mycobacterium
LVPAMPLPENAVADAVA

SEQ ID NO: 1359170 - protein, 17 aa, Mycobacterium
LVWQCASLLLSYPDGAQ

SEQ ID NO: 1359171 - protein, 17 aa, Mycobacterium
LWNNRRCMNEPWLMNMA

SEQ ID NO: 1359172 - protein, 21 aa, Mycobacterium
LYFGRAKRCATTAQRLALFAR

SEQ ID NO: 1359173 - protein, 18 aa, Mycobacterium
LYLELMIAHHAGAIKMAR

SEQ ID NO: 1359174 - protein, 25 aa, Mycobacterium
LYQDRDILFGYGRTTEYMVAQQDTP

SEQ ID NO: 1359175 - protein, 17 aa, Mycobacterium
LYRTLDAALRRRSGRRV

SEQ ID NO: 1359176 - protein, 18 aa, Mycobacterium
LYSDPQSVLRYPSVGILH

SEQ ID NO: 1359177 - protein, 19 aa, Mycobacterium
LYSTLRGLTPRRYAGRARR

SEQ ID NO: 1359178 - protein, 20 aa, Mycobacterium
MAAIRWIQRGYRAPTGPSPA

SEQ ID NO: 1359179 - protein, 17 aa, Mycobacterium
MALLVTTSLSVSACATE

SEQ ID NO: 1359180 - protein, 31 aa, Mycobacterium
MAMGVMGVHFMKLPAKLFGVGRYTVTVQLPQ

SEQ ID NO: 1359181 - protein, 26 aa, Mycobacterium
MARMMDPQHRLFLQTAWHAMEDAGCD

SEQ ID NO: 1359182 - protein, 25 aa, Mycobacterium
MARPPLKRPGLVSRPLLHEQLLAAL

SEQ ID NO: 1359183 - protein, 29 aa, Mycobacterium
MCEANATHLLPVLDHALRLLIDARNQLAQ

SEQ ID NO: 1359184 - protein, 28 aa, Mycobacterium
MCGRSYSPRFLFAWPNSKSAVMGPAQLA

SEQ ID NO: 1359185 - protein, 17 aa, Mycobacterium
MCVCRGCYLLFTDTAAQ

SEQ ID NO: 1359186 - protein, 26 aa, Mycobacterium
MDAITEHFGHPAHLPRAGLPSEIGPV

SEQ ID NO: 1359187 - protein, 25 aa, Mycobacterium
MDDHAVLPVLRRDQPQRRAVAAAVG

SEQ ID NO: 1359188 - protein, 25 aa, Mycobacterium
MDDLHRHLFTVLMDREWKHGVTAAV

SEQ ID NO: 1359189 - protein, 17 aa, Mycobacterium
MDSPVGLLTLAGSTGRL

SEQ ID NO: 1359190 - protein, 22 aa, Mycobacterium
MDVSGFLMMSHMAQPADLAAQA

SEQ ID NO: 1359191 - protein, 24 aa, Mycobacterium
MEEALRYWGLQTGRWGQSAGENQY

SEQ ID NO: 1359192 - protein, 19 aa, Mycobacterium
MEEYLILGACNPPLAHRAV

SEQ ID NO: 1359193 - protein, 17 aa, Mycobacterium
MFEMVPDPAWVARPGPY

SEQ ID NO: 1359194 - protein, 19 aa, Mycobacterium
MFTHPEVNWFFTSLRGLPP

SEQ ID NO: 1359195 - protein, 27 aa, Mycobacterium
MFVEAITLARRFGGALPTLPIRDLARQ

SEQ ID NO: 1359196 - protein, 25 aa, Mycobacterium
MGNLWWDRPITVTGVDIRAGTATLH

SEQ ID NO: 1359197 - protein, 26 aa, Mycobacterium
MGRILSFIPHRMSRPDHIPLNVPDRG

SEQ ID NO: 1359198 - protein, 22 aa, Mycobacterium
MGRLAVNLPPDGLTKAAAQLGL

SEQ ID NO: 1359199 - protein, 20 aa, Mycobacterium
MGSDVLYDWADGKPILRGIE

SEQ ID NO: 1359200 - protein, 29 aa, Mycobacterium
MIADNVDLAFFGPFAYVVAGLNGAEITPL

SEQ ID NO: 1359201 - protein, 29 aa, Mycobacterium
MIADNVDLAFFGPFGYVVAGLNGAKMTPL

SEQ ID NO: 1359202 - protein, 22 aa, Mycobacterium
MIARLMTEYYVVVTGAGSPYKN

SEQ ID NO: 1359203 - protein, 25 aa, Mycobacterium
MIGDPTAMTPLYNASQLWGTSPIGS

SEQ ID NO: 1359204 - protein, 17 aa, Mycobacterium
MIVAIKASTGEILAVAQ

SEQ ID NO: 1359205 - protein, 17 aa, Mycobacterium
MLATFGLERVESGLGRD

SEQ ID NO: 1359206 - protein, 17 aa, Mycobacterium
MLAVVFAASLWVGHALG

SEQ ID NO: 1359207 - protein, 20 aa, Mycobacterium
MLEFAFSQPPMFAPGDGYHY

SEQ ID NO: 1359208 - protein, 23 aa, Mycobacterium
MLLLVALLLVVGAGWAAAQAVDP

SEQ ID NO: 1359209 - protein, 17 aa, Mycobacterium
MLTAPFSIENIPKVVRG

SEQ ID NO: 1359210 - protein, 18 aa, Mycobacterium
MLYGIGGSAVRIFGPGRV

SEQ ID NO: 1359211 - protein, 18 aa, Mycobacterium
MMVLTAPTRPGKGLSHAC

SEQ ID NO: 1359212 - protein, 18 aa, Mycobacterium
MNDAFLADPFRAWTTHDL

SEQ ID NO: 1359213 - protein, 26 aa, Mycobacterium
MPASAEFLRVLRGCGVAAVLSGAGPA

SEQ ID NO: 1359214 - protein, 18 aa, Mycobacterium
MPGLVEGLVARAEEMRTG

SEQ ID NO: 1359215 - protein, 17 aa, Mycobacterium
MPNLIGRDLQAAQDAIQ

SEQ ID NO: 1359216 - protein, 27 aa, Mycobacterium
MPVSDDRFYFFFDVVEPQGSPYEEGRV

SEQ ID NO: 1359217 - protein, 24 aa, Mycobacterium
MQRELSTIPVQWFEAVDVVGLAAD

SEQ ID NO: 1359218 - protein, 42 aa, Mycobacterium
MRGQYPEVRLVWSDEWRTFDLRGWWVTIAGVTFPDAHAANGW

SEQ ID NO: 1359219 - protein, 24 aa, Mycobacterium
MRPPAGLLQHPTWPRPEAAVANQS

SEQ ID NO: 1359220 - protein, 25 aa, Mycobacterium
MRRRATMYLTYWTAGDTRNRGQAML

SEQ ID NO: 1359221 - protein, 18 aa, Mycobacterium
MSSSLPTLFRNADGYRRR

SEQ ID NO: 1359222 - protein, 25 aa, Mycobacterium
MSSTLPTLFRNAGGYRRQLTLTPTG

SEQ ID NO: 1359223 - protein, 24 aa, Mycobacterium
MSVELMMRWSSRGIAIKARTAELA

SEQ ID NO: 1359224 - protein, 24 aa, Mycobacterium
MSYCPPQLPGLAELWGRSVFQCPF

SEQ ID NO: 1359225 - protein, 19 aa, Mycobacterium
MTATDWNLSWSWAAGNMVS

SEQ ID NO: 1359226 - protein, 17 aa, Mycobacterium
MTLPQIPSAFVSGDPVQ

SEQ ID NO: 1359227 - protein, 27 aa, Mycobacterium
MTRALSLIPTFPFPNETIEKWQRGDYA

SEQ ID NO: 1359228 - protein, 23 aa, Mycobacterium
MVDRFQVQLVPPKIATWSDIDEQ

SEQ ID NO: 1359229 - protein, 27 aa, Mycobacterium
MVLAWASQSGRYPWFDAASRAGYADIA

SEQ ID NO: 1359230 - protein, 18 aa, Mycobacterium
MWGYSVLVALDRSPMRTQ

SEQ ID NO: 1359231 - protein, 18 aa, Mycobacterium
NAELRGIRQPLADIKHRC

SEQ ID NO: 1359232 - protein, 27 aa, Mycobacterium
NAKRWGVLHVIWRQGYYPGIGAPSWTA

SEQ ID NO: 1359233 - protein, 18 aa, Mycobacterium
NASQLWGTSPIGSAVFLV

SEQ ID NO: 1359234 - protein, 17 aa, Mycobacterium
NAVGFLVGQAVSIWSYV

SEQ ID NO: 1359235 - protein, 29 aa, Mycobacterium
NAVMLGTMSPIWYLFTGVDYRAVADTRYD

SEQ ID NO: 1359236 - protein, 23 aa, Mycobacterium
NDAALRGALLDIIGKYGYPDIGT

SEQ ID NO: 1359237 - protein, 30 aa, Mycobacterium
NDAVVGTILPLYSPGLWRHLTQALTEIKKG

SEQ ID NO: 1359238 - protein, 30 aa, Mycobacterium
NDGARDLAVWLTPPPAPPAPAAGGSAPYRG

SEQ ID NO: 1359239 - protein, 38 aa, Mycobacterium
NDNADFFIKDLEFLPTFPFHYKYLRNAVRGDYLNVYTT

SEQ ID NO: 1359240 - protein, 23 aa, Mycobacterium
NEAVLWASAFPYGPTFADRITRG

SEQ ID NO: 1359241 - protein, 26 aa, Mycobacterium
NEEAAVRLLEWLQASHPSPEVAAALK

SEQ ID NO: 1359242 - protein, 21 aa, Mycobacterium
NEPWLMNMAVGQIRGGYSGQP

SEQ ID NO: 1359243 - protein, 23 aa, Mycobacterium
NETQHAIVRFYASNVSRDSWEED

SEQ ID NO: 1359244 - protein, 23 aa, Mycobacterium
NFDIAQFAWGGDAFPLGGLTQIY

SEQ ID NO: 1359245 - protein, 26 aa, Mycobacterium
NFIARKTVVIPAPEHTYLLALDAQGP

SEQ ID NO: 1359246 - protein, 17 aa, Mycobacterium
NFPPLGENLFIGAQARP

SEQ ID NO: 1359247 - protein, 19 aa, Mycobacterium
NFQNGDILVWGGGTYTTSY

SEQ ID NO: 1359248 - protein, 17 aa, Mycobacterium
NFVEYYLYPDGGGGYQY

SEQ ID NO: 1359249 - protein, 18 aa, Mycobacterium
NGAPLTVRIGYQTPNARL

SEQ ID NO: 1359250 - protein, 25 aa, Mycobacterium
NGDRLDAQLAVTIPIFGTKTHDIYW

SEQ ID NO: 1359251 - protein, 19 aa, Mycobacterium
NGFKVSVPGPAPVAPLPGT

SEQ ID NO: 1359252 - protein, 26 aa, Mycobacterium
NGGTGGFGGLFGTSPGYGGQGHNGGN

SEQ ID NO: 1359253 - protein, 19 aa, Mycobacterium
NGITFGIMTIRHAEPVIAF

SEQ ID NO: 1359254 - protein, 23 aa, Mycobacterium
NGITFGIMTIRHAEPVIAFQTVN

SEQ ID NO: 1359255 - protein, 29 aa, Mycobacterium
NGTVLQTISLWSTPTKLALSRGGGRLYIS

SEQ ID NO: 1359256 - protein, 30 aa, Mycobacterium
NISPGLQRKLIVQLTQPGTYQTACKPGMVG

SEQ ID NO: 1359257 - protein, 18 aa, Mycobacterium
NIVPAFAVVTVLPGLPLD

SEQ ID NO: 1359258 - protein, 28 aa, Mycobacterium
NKAYLPLAGRSMLAWSLDTLTRLPDIAR

SEQ ID NO: 1359259 - protein, 35 aa, Mycobacterium
NKHVSATRLTAVVTPNALYSAAPASDVVVLGAHGS

SEQ ID NO: 1359260 - protein, 24 aa, Mycobacterium
NKIPIRDLIRMAAHSRHYLAVFDD

SEQ ID NO: 1359261 - protein, 29 aa, Mycobacterium
NKLRPVYAWRRWALYFDYDRRQLRSSHAR

SEQ ID NO: 1359262 - protein, 20 aa, Mycobacterium
NLAFPLTSLLTIPKAMFDAV

SEQ ID NO: 1359263 - protein, 20 aa, Mycobacterium
NLAMALLAKTEFGIGRVVAR

SEQ ID NO: 1359264 - protein, 19 aa, Mycobacterium
NLAPDLDLKKFPSSGPYKL

SEQ ID NO: 1359265 - protein, 22 aa, Mycobacterium
NLEGVDGLVLDGPTLGKIFNGT

SEQ ID NO: 1359266 - protein, 20 aa, Mycobacterium
NLPGAAWQRCRTHYAANLMS

SEQ ID NO: 1359267 - protein, 18 aa, Mycobacterium
NLSPYQVLTVASLVQRES

SEQ ID NO: 1359268 - protein, 21 aa, Mycobacterium
NLVAERFVALTPAYRTGDGPK

SEQ ID NO: 1359269 - protein, 21 aa, Mycobacterium
NLYDRVLNQVIYNYTNWVVCG

SEQ ID NO: 1359270 - protein, 24 aa, Mycobacterium
NMGRKFLQSIGLLPTPTGITNGAI

SEQ ID NO: 1359271 - protein, 27 aa, Mycobacterium
NMVSTLHDLRIWAPALVTGTLLSRQMQ

SEQ ID NO: 1359272 - protein, 25 aa, Mycobacterium
NMVTDVLTWVGLRPQADDGPTPPTP

SEQ ID NO: 1359273 - protein, 23 aa, Mycobacterium
NNAAVAHIAPFDEFPAEQFDRLV

SEQ ID NO: 1359274 - protein, 24 aa, Mycobacterium
NNMVLAVQQIAIGEAFVLAEKLGL

SEQ ID NO: 1359275 - protein, 33 aa, Mycobacterium
NNPLGLWSRLSFLRYIPLLNVSFGPQLPTDIGV

SEQ ID NO: 1359276 - protein, 31 aa, Mycobacterium
NPAALTDLDYYHVFLGLLGPADVKGQRATQQ

SEQ ID NO: 1359277 - protein, 19 aa, Mycobacterium
NPAAWFIVPARETIRNPHE

SEQ ID NO: 1359278 - protein, 17 aa, Mycobacterium
NPLLVWQNVFTNSFTQA

SEQ ID NO: 1359279 - protein, 25 aa, Mycobacterium
NPLVSAAHYFALMARGGYTSTSDMT

SEQ ID NO: 1359280 - protein, 25 aa, Mycobacterium
NPSEGWWPMLIGLAMNDAGGFNAES

SEQ ID NO: 1359281 - protein, 27 aa, Mycobacterium
NPSFTIPRFPILHLPIGRKPAPKTTAA

SEQ ID NO: 1359282 - protein, 17 aa, Mycobacterium
NPYTLTVYVALVGIYKR

SEQ ID NO: 1359283 - protein, 25 aa, Mycobacterium
NQIDTPLIFLQNTTGFMVGAEYEQG

SEQ ID NO: 1359284 - protein, 22 aa, Mycobacterium
NQLRRLSPVAGYRDWPPGTIPG

SEQ ID NO: 1359285 - protein, 18 aa, Mycobacterium
NQMAALDFNTIRLAYSSE

SEQ ID NO: 1359286 - protein, 23 aa, Mycobacterium
NQQRVSVNWPAEAAPWTGKDDLT

SEQ ID NO: 1359287 - protein, 18 aa, Mycobacterium
NQVIYNYTNWVVCGQSPR

SEQ ID NO: 1359288 - protein, 19 aa, Mycobacterium
NRLAVLPEVFDLVDAYGAD

SEQ ID NO: 1359289 - protein, 27 aa, Mycobacterium
NRLELAPAILVGWSFGGSLALGVARRY

SEQ ID NO: 1359290 - protein, 24 aa, Mycobacterium
NRQLTTIPWMFVAPLTGVAEKEYY

SEQ ID NO: 1359291 - protein, 24 aa, Mycobacterium
NRQYNFPPIGTTISPALIPVTGAK

SEQ ID NO: 1359292 - protein, 17 aa, Mycobacterium
NRRLLAGIAHGLRVRGL

SEQ ID NO: 1359293 - protein, 20 aa, Mycobacterium
NSEHTIWVYNLPSSGDYSIG

SEQ ID NO: 1359294 - protein, 20 aa, Mycobacterium
NSLVAYLYGYGAQQTAIVPP

SEQ ID NO: 1359295 - protein, 32 aa, Mycobacterium
NTAALIPGFIKRWFSWLGQLNFQACIFGISAV

SEQ ID NO: 1359296 - protein, 26 aa, Mycobacterium
NTAPLMLLPALRRDIAGIGPWAKLLR

SEQ ID NO: 1359297 - protein, 24 aa, Mycobacterium
NTEPTAVLSWQSSPGWLTGRVTGR

SEQ ID NO: 1359298 - protein, 26 aa, Mycobacterium
NTGNPMVDAFLWVKRPGESDGACRGF

SEQ ID NO: 1359299 - protein, 24 aa, Mycobacterium
NTGQPPAWAPPKPVDPLWANGQPQ

SEQ ID NO: 1359300 - protein, 24 aa, Mycobacterium
NTGSYNVGFFNTGEFNFGVGNTGV

SEQ ID NO: 1359301 - protein, 21 aa, Mycobacterium
NTLRYRVDRIARLLKTDLDDP

SEQ ID NO: 1359302 - protein, 25 aa, Mycobacterium
NTNKMAYLQAIQFDFDEGSPGVLAQ

SEQ ID NO: 1359303 - protein, 22 aa, Mycobacterium
NTPAYVLNPFAMANSLATYFDN

SEQ ID NO: 1359304 - protein, 25 aa, Mycobacterium
NTPVATVPIGIFSGPGSPGGAPLDI

SEQ ID NO: 1359305 - protein, 23 aa, Mycobacterium
NTSMMWHPMHLHGHTFEVLTADG

SEQ ID NO: 1359306 - protein, 27 aa, Mycobacterium
NTYKKSLWCGIGGLIPFAKSGPQYSGI

SEQ ID NO: 1359307 - protein, 20 aa, Mycobacterium
NTYPLPRATGWPVGVSVGHD

SEQ ID NO: 1359308 - protein, 26 aa, Mycobacterium
NVDRQIGLLLPCNVVVRADPGASDDT

SEQ ID NO: 1359309 - protein, 24 aa, Mycobacterium
NVDRQIGLLLPCNVVVRADRADDT

SEQ ID NO: 1359310 - protein, 25 aa, Mycobacterium
NVDRQIGLLLPCNVVVRADRADDTS

SEQ ID NO: 1359311 - protein, 18 aa, Mycobacterium
NVFLAANVVPLVASQKMS

SEQ ID NO: 1359312 - protein, 22 aa, Mycobacterium
NVLRTQGLKAWPKCGAKGMAAQ

SEQ ID NO: 1359313 - protein, 23 aa, Mycobacterium
NVLSRYPDIKVLAIDTANWKRDE

SEQ ID NO: 1359314 - protein, 19 aa, Mycobacterium
NVNFKTKDTLYDLPSAATT

SEQ ID NO: 1359315 - protein, 17 aa, Mycobacterium
NVTANKHVSATRLTAVV

SEQ ID NO: 1359316 - protein, 28 aa, Mycobacterium
NVTLIFSVERHRLVMDAYLAGLEKAKEA

SEQ ID NO: 1359317 - protein, 17 aa, Mycobacterium
NVVPLYRRNTLGESQVL

SEQ ID NO: 1359318 - protein, 20 aa, Mycobacterium
NYDKLPFFDDSKGYSAYFAE

SEQ ID NO: 1359319 - protein, 18 aa, Mycobacterium
NYFPVTRAVPEPPSIRYP

SEQ ID NO: 1359320 - protein, 21 aa, Mycobacterium
NYTARFGTYMVIVTANPLVIP

SEQ ID NO: 1359321 - protein, 27 aa, Mycobacterium
PAAFSGYYRWDVYYNSTAGDVILPVGY

SEQ ID NO: 1359322 - protein, 21 aa, Mycobacterium
PAAICLSWAPAAPAATVLGVE

SEQ ID NO: 1359323 - protein, 24 aa, Mycobacterium
PADDRWEWFGYQLDSTDTEGDWIG

SEQ ID NO: 1359324 - protein, 24 aa, Mycobacterium
PADQLPPPQSLAPVSDPLSPPGSG

SEQ ID NO: 1359325 - protein, 28 aa, Mycobacterium
PAGAAAPGLFSLLIGNGDEPGENGGWLI

SEQ ID NO: 1359326 - protein, 19 aa, Mycobacterium
PAGAAFLPDARRILQLAEG

SEQ ID NO: 1359327 - protein, 24 aa, Mycobacterium
PAGDLDPLMYDRSYFLEPDGKSSK

SEQ ID NO: 1359328 - protein, 26 aa, Mycobacterium
PAGGTTGIFGVTRYVFDVITGTVVPG

SEQ ID NO: 1359329 - protein, 26 aa, Mycobacterium
PAGIDPRYLTAQKLPPGLTFDPADCG

SEQ ID NO: 1359330 - protein, 24 aa, Mycobacterium
PAGLVDITRFWFETGSLDNERSVA

SEQ ID NO: 1359331 - protein, 21 aa, Mycobacterium
PAIAQPTRWTMPDLRGMNLAA

SEQ ID NO: 1359332 - protein, 23 aa, Mycobacterium
PAIKYVCLMLLALGSVSCSGPTV

SEQ ID NO: 1359333 - protein, 25 aa, Mycobacterium
PAIVAMPAPLPGVNGPSPAAGGFDI

SEQ ID NO: 1359334 - protein, 19 aa, Mycobacterium
PAIVILGYGLKPDGTMRLI

SEQ ID NO: 1359335 - protein, 17 aa, Mycobacterium
PAKYWKPGTTVEVAVNT

SEQ ID NO: 1359336 - protein, 27 aa, Mycobacterium
PALDLDSLIGGFRPLFRALDPEQVNEL

SEQ ID NO: 1359337 - protein, 30 aa, Mycobacterium
PALDLDTLIGGFRPLFRALDPDQVNALSSQ

SEQ ID NO: 1359338 - protein, 23 aa, Mycobacterium
PALPKSLFILDNNVSRPDGGFGT

SEQ ID NO: 1359339 - protein, 20 aa, Mycobacterium
PALRGKFVAALLCSRDAAVE

SEQ ID NO: 1359340 - protein, 20 aa, Mycobacterium
PALWAVAAWVRRQTTQAIDG

SEQ ID NO: 1359341 - protein, 25 aa, Mycobacterium
PANDPGVLAAPPGAIPPGDIAPPPG

SEQ ID NO: 1359342 - protein, 25 aa, Mycobacterium
PAPEIPGLPFLQQLAANPAAATQLM

SEQ ID NO: 1359343 - protein, 26 aa, Mycobacterium
PAPGDPYYLNYAYNPMMVGITPPPEE

SEQ ID NO: 1359344 - protein, 17 aa, Mycobacterium
PAPPSLPKPTPAMDPDV

SEQ ID NO: 1359345 - protein, 21 aa, Mycobacterium
PAQALPGDLIFYGPEGTQSVA

SEQ ID NO: 1359346 - protein, 24 aa, Mycobacterium
PASDLDPLMYDRSYFLEPDGKSSK

SEQ ID NO: 1359347 - protein, 27 aa, Mycobacterium
PATGRGFHVLYSSPPLNAAQAGPSVQF

SEQ ID NO: 1359348 - protein, 24 aa, Mycobacterium
PATSAGTPALAPGAPAPAPAAPAV

SEQ ID NO: 1359349 - protein, 23 aa, Mycobacterium
PDAFARELAATGDPARAVGAAAR

SEQ ID NO: 1359350 - protein, 31 aa, Mycobacterium
PDAPTDSPLVLALWAAARRPSESAASQKSAA

SEQ ID NO: 1359351 - protein, 24 aa, Mycobacterium
PDDNLYQLTIYPGELSMISPSGGN

SEQ ID NO: 1359352 - protein, 18 aa, Mycobacterium
PDFQAIVAAMLELTGEQA

SEQ ID NO: 1359353 - protein, 31 aa, Mycobacterium
PDGGMWQRLAWLRYLLGEPVPILDLSFDPAM

SEQ ID NO: 1359354 - protein, 23 aa, Mycobacterium
PDGTPLPGTAYKWTVVFHHNEHT

SEQ ID NO: 1359355 - protein, 18 aa, Mycobacterium
PDLWTRLSDDTKAPLRIE

SEQ ID NO: 1359356 - protein, 21 aa, Mycobacterium
PDMPQFAVAYWQTALGEMVQS

SEQ ID NO: 1359357 - protein, 23 aa, Mycobacterium
PDQLSFAMYGDPVARHAFGESFL

SEQ ID NO: 1359358 - protein, 17 aa, Mycobacterium
PDRPWNLVAVANAAMGL

SEQ ID NO: 1359359 - protein, 19 aa, Mycobacterium
PDRYLTFPDFAMDRRAWEV

SEQ ID NO: 1359360 - protein, 17 aa, Mycobacterium
PDSHDICFIPSGDTRAF

SEQ ID NO: 1359361 - protein, 22 aa, Mycobacterium
PDSKPWHPSGLAIDIMIPNSDS

SEQ ID NO: 1359362 - protein, 23 aa, Mycobacterium
PDTARFLVYERIQALLEAAPRLL

SEQ ID NO: 1359363 - protein, 18 aa, Mycobacterium
PDVLFSDDMFHPSAAGYA

SEQ ID NO: 1359364 - protein, 19 aa, Mycobacterium
PEIVWYLDEPVADPALVPL

SEQ ID NO: 1359365 - protein, 18 aa, Mycobacterium
PELAAIAPTVFTGPAGSA

SEQ ID NO: 1359366 - protein, 25 aa, Mycobacterium
PELIDAAATRLLAPTGWTAPTDGYP

SEQ ID NO: 1359367 - protein, 26 aa, Mycobacterium
PENADWDLIMRIASPRGFMATDDVAK

SEQ ID NO: 1359368 - protein, 23 aa, Mycobacterium
PENPVAGYYYQAINRDAPHPAAA

SEQ ID NO: 1359369 - protein, 23 aa, Mycobacterium
PENWQDYWPAHLAPAYIGAGMVN

SEQ ID NO: 1359370 - protein, 18 aa, Mycobacterium
PEPKVTAVLRDPSYRLVT

SEQ ID NO: 1359371 - protein, 19 aa, Mycobacterium
PERMVPWLAMPGCDFEVLE

SEQ ID NO: 1359372 - protein, 25 aa, Mycobacterium
PEVLNVVVPFLALQPLVENAVRHGF

SEQ ID NO: 1359373 - protein, 27 aa, Mycobacterium
PFARAMGPMQFIPETWRLYGVDANNDG

SEQ ID NO: 1359374 - protein, 25 aa, Mycobacterium
PFDEHFGGPIPSFPPREVLYDYIVG

SEQ ID NO: 1359375 - protein, 26 aa, Mycobacterium
PGAPTVDLPLPPGWQDAGDRAPEWSY

SEQ ID NO: 1359376 - protein, 33 aa, Mycobacterium
PGAVLSFPPTQWIRWRRPVIGMPMTARILTPGN

SEQ ID NO: 1359377 - protein, 17 aa, Mycobacterium
PGDLYCRVPQDSPLNVR

SEQ ID NO: 1359378 - protein, 30 aa, Mycobacterium
PGDPRYPYREPLPAPPPGGPPPGPPDPVLP

SEQ ID NO: 1359379 - protein, 17 aa, Mycobacterium
PGDSRPYLYDGRIRRDV

SEQ ID NO: 1359380 - protein, 31 aa, Mycobacterium; identical to SEQ ID NO: 1323048

SEQ ID NO: 1359381 - protein, 20 aa, Mycobacterium
PGETIPLARTAPALDLDALI

SEQ ID NO: 1359382 - protein, 18 aa, Mycobacterium
PGFDSLGLALSLYDEIVV

SEQ ID NO: 1359383 - protein, 18 aa, Mycobacterium
PGFTCRIGAFTLSYRGWG

SEQ ID NO: 1359384 - protein, 18 aa, Mycobacterium
PGFTLNYTSSGSGAGVSE

SEQ ID NO: 1359385 - protein, 23 aa, Mycobacterium
PGGDHLMLMDLTGPLQPGSDVAL

SEQ ID NO: 1359386 - protein, 20 aa, Mycobacterium
PGGEYFYRFRAEGYLSPAGR

SEQ ID NO: 1359387 - protein, 26 aa, Mycobacterium
PGGLALGIFLRKAGFTDFTIFDREDG

SEQ ID NO: 1359388 - protein, 24 aa, Mycobacterium
PGGSPLGGLLPTGPTAPVTAAPAG

SEQ ID NO: 1359389 - protein, 23 aa, Mycobacterium
PGGTAWFTVLHQAAWYDASTEVV

SEQ ID NO: 1359390 - protein, 26 aa, Mycobacterium
PGIARNLSILPFNPFTFNPIQFSVDF

SEQ ID NO: 1359391 - protein, 26 aa, Mycobacterium
PGIGHPCWANYFPVTRAVPEQPSIRQ

SEQ ID NO: 1359392 - protein, 31 aa, Mycobacterium
PGIGQNWDLVLYWWETPGRLSVAGGILAMVE

SEQ ID NO: 1359393 - protein, 27 aa, Mycobacterium
PGIIEIPFTLSFKEPLPIPVDQYPLIC

SEQ ID NO: 1359394 - protein, 18 aa, Mycobacterium
PGLQVFRFKAMNAEGAMA

SEQ ID NO: 1359395 - protein, 25 aa, Mycobacterium
PGNKLRTPVWFYEIGDDRLSGPATG

SEQ ID NO: 1359396 - protein, 20 aa, Mycobacterium
PGPIEPDPYLKSYEWAAGLS

SEQ ID NO: 1359397 - protein, 18 aa, Mycobacterium
PGPMPYPGAPPYGAPQYG

SEQ ID NO: 1359398 - protein, 18 aa, Mycobacterium
PGPPPYVDHVTWAKWGDL

SEQ ID NO: 1359399 - protein, 18 aa, Mycobacterium
PGRETVLADQLRASVGDV

SEQ ID NO: 1359400 - protein, 19 aa, Mycobacterium
PGRVLNTHPALLPAFPGAH

SEQ ID NO: 1359401 - protein, 24 aa, Mycobacterium
PGSFSYPYNVIAVGPPPATDSRGT

SEQ ID NO: 1359402 - protein, 23 aa, Mycobacterium
PGSKLVFTYIRQDFIDGTNLYGA

SEQ ID NO: 1359403 - protein, 30 aa, Mycobacterium
PGSTLRFPRGTYRFAQRWPPGGAAVVISGL

SEQ ID NO: 1359404 - protein, 24 aa, Mycobacterium
PGTFDRPWPELTPGEQAAVIVAVE

SEQ ID NO: 1359405 - protein, 17 aa, Mycobacterium
PGTPVPLPPAPPGARNE

SEQ ID NO: 1359406 - protein, 17 aa, Mycobacterium
PGTTVRVDARFYGVKFG

SEQ ID NO: 1359407 - protein, 24 aa, Mycobacterium
PGVNQTWVMSWGPAEYRYSDTASF

SEQ ID NO: 1359408 - protein, 27 aa, Mycobacterium
PGVRPARYRFLTRNRLVAALSGATVVV

SEQ ID NO: 1359409 - protein, 27 aa, Mycobacterium
PHRFDPDRFLSRRPTPFEYAPFGGGYR

SEQ ID NO: 1359410 - protein, 31 aa, Mycobacterium
PHVLDGRLLADGGILDPLPMAPVAAVNADVT

SEQ ID NO: 1359411 - protein, 25 aa, Mycobacterium
PIGADDYWYLWRQMVSQPGVVDPAG

SEQ ID NO: 1359412 - protein, 30 aa, Mycobacterium
PIGGMYGDITYPVNSPLAITLGFAVSEAAL

SEQ ID NO: 1359413 - protein, 25 aa, Mycobacterium
PIIKNRQYNFLPLAQNVFVGATTRP

SEQ ID NO: 1359414 - protein, 27 aa, Mycobacterium
PIPAVIPLAPPVPVVAPPPAVPVAAPV

SEQ ID NO: 1359415 - protein, 22 aa, Mycobacterium
PIVKNRQYNFPPLGINPVVGAV

SEQ ID NO: 1359416 - protein, 22 aa, Mycobacterium
PKVLPKTLARNILPDLQANRGF

SEQ ID NO: 1359417 - protein, 20 aa, Mycobacterium
PLAASALTAPATWTAQCPPG

SEQ ID NO: 1359418 - protein, 25 aa, Mycobacterium
PLADPEAPAPAPWFGVPLKKWTRLA

SEQ ID NO: 1359419 - protein, 24 aa, Mycobacterium
PLAGEFRTYWVDKTPGRIVTGVDD

SEQ ID NO: 1359420 - protein, 24 aa, Mycobacterium
PLALDFYVTVPIDALPLLEPTYLF

SEQ ID NO: 1359421 - protein, 17 aa, Mycobacterium
PLDAIVTPPLFPGVSIS

SEQ ID NO: 1359422 - protein, 18 aa, Mycobacterium
PLDAIVTPPLFPGVSISA

SEQ ID NO: 1359423 - protein, 19 aa, Mycobacterium
PLGAVAYASLLVSDGVFGA

SEQ ID NO: 1359424 - protein, 25 aa, Mycobacterium
PLGPATMFTGLAISIFCPRAVSAMT

SEQ ID NO: 1359425 - protein, 17 aa, Mycobacterium
PLKSAGARVQRPLWAST

SEQ ID NO: 1359426 - protein, 17 aa, Mycobacterium
PLLGADLEGRLYTSADD

SEQ ID NO: 1359427 - protein, 21 aa, Mycobacterium
PLPPGLGYLPPPGQGGPMPQD

SEQ ID NO: 1359428 - protein, 19 aa, Mycobacterium
PLTFIAGPSPTGWQLSKQS

SEQ ID NO: 1359429 - protein, 26 aa, Mycobacterium
PLTSIDELIQGLWLAGRQDQQARATQ

SEQ ID NO: 1359430 - protein, 23 aa, Mycobacterium
PLTVPVWYQYSPGGQPWVLTGAG

SEQ ID NO: 1359431 - protein, 33 aa, Mycobacterium
PLTVVFAHGFSLRMGSFYFQRARLTEQWGDQVR

SEQ ID NO: 1359432 - protein, 28 aa, Mycobacterium
PLVEGMPSYPAWDRHLFVFQEGTCISQE

SEQ ID NO: 1359433 - protein, 19 aa, Mycobacterium
PNAPGVYLLDGLRAQDDFS

SEQ ID NO: 1359434 - protein, 22 aa, Mycobacterium
PNDVTLVFLQPADALSAFTQRE

SEQ ID NO: 1359435 - protein, 32 aa, Mycobacterium
PNEITYSEPWMRPDYVPPAVPPAPEPVAAEPG

SEQ ID NO: 1359436 - protein, 36 aa, Mycobacterium
PNGNGLWYEGSYTEAAWIADWKMLAQRYANDPTVIG

SEQ ID NO: 1359437 - protein, 24 aa, Mycobacterium
PNKVARLVLDSPLPLGISAEAATE

SEQ ID NO: 1359438 - protein, 18 aa, Mycobacterium
PNTRLVLGGFSQGAVVSG

SEQ ID NO: 1359439 - protein, 21 aa, Mycobacterium
PPAAPTSLFAGQAMFGDVAVL

SEQ ID NO: 1359440 - protein, 30 aa, Mycobacterium
PPADPSGWALLAWVRREFFNGTPAPVENPL

SEQ ID NO: 1359441 - protein, 21 aa, Mycobacterium
PPDWANYGAIIKAFSDKYGIK

SEQ ID NO: 1359442 - protein, 25 aa, Mycobacterium
PPEVPSWRPWPTAFDLRSAVTYVVD

SEQ ID NO: 1359443 - protein, 21 aa, Mycobacterium
PPGAIPPGDIAPPPGGATRAV

SEQ ID NO: 1359444 - protein, 20 aa, Mycobacterium
PPPPAWVPPWMQQPQQQPEC

SEQ ID NO: 1359445 - protein, 19 aa, Mycobacterium
PPPPPPAAPVPPALPAPAV

SEQ ID NO: 1359446 - protein, 29 aa, Mycobacterium
PPPPPPANPFVFPNPLAPPAPPAPAPAGA

SEQ ID NO: 1359447 - protein, 21 aa, Mycobacterium
PPPPPPVEAPPPPPPPVEAPP

SEQ ID NO: 1359448 - protein, 23 aa, Mycobacterium
PPPPPPVPPAANPLFPLAQNGSP

SEQ ID NO: 1359449 - protein, 23 aa, Mycobacterium
PPPPPPVPVDPIAPPPPPANPFA

SEQ ID NO: 1359450 - protein, 19 aa, Mycobacterium
PPPQKPPKLGPPNALLNIT

SEQ ID NO: 1359451 - protein, 17 aa, Mycobacterium
PPRAPEVSFYPWQDGTL

SEQ ID NO: 1359452 - protein, 18 aa, Mycobacterium
PPSLPKPTPAMDPDVLLR

SEQ ID NO: 1359453 - protein, 18 aa, Mycobacterium
PPVEAPPPPPPPVEAPPP

SEQ ID NO: 1359454 - protein, 18 aa, Mycobacterium
PPVSGFFGVVQMTDPGAA

SEQ ID NO: 1359455 - protein, 26 aa, Mycobacterium
PQFAGKKALLLAGTLFRDSVQVSGPS

SEQ ID NO: 1359456 - protein, 20 aa, Mycobacterium
PQIAPAHLLMALLTQNDGIA

SEQ ID NO: 1359457 - protein, 24 aa, Mycobacterium
PQPPAGAPLPPALGPLLPAEAVPT

SEQ ID NO: 1359458 - protein, 17 aa, Mycobacterium
PQRLAESLGKMTRILRS

SEQ ID NO: 1359459 - protein, 27 aa, Mycobacterium
PQSEYGWWYQYYFATPRGELGYRRNTK

SEQ ID NO: 1359460 - protein, 18 aa, Mycobacterium
PRDPMDIRLLESVAGDTI

SEQ ID NO: 1359461 - protein, 41 aa, Mycobacterium
PREAMVPQGWTLSVWARTPRPRLAAWTPDGDLLVSVPSAGR

SEQ ID NO: 1359462 - protein, 20 aa, Mycobacterium
PRISPDQILMMISQEYQTGR

SEQ ID NO: 1359463 - protein, 26 aa, Mycobacterium
PRNTPPHAWYIAFAPAQAPKVAVAVL

SEQ ID NO: 1359464 - protein, 18 aa, Mycobacterium
PRPAQAEGAWKPGWVEFT

SEQ ID NO: 1359465 - protein, 17 aa, Mycobacterium
PRRLLKAARLGLIDLDR

SEQ ID NO: 1359466 - protein, 20 aa, Mycobacterium
PRRLVAGLALATVTVATGGC

SEQ ID NO: 1359467 - protein, 17 aa, Mycobacterium
PRRTEEPNILWHRGIGD

SEQ ID NO: 1359468 - protein, 20 aa, Mycobacterium
PRRVKRLEGWLGELVPRLLE

SEQ ID NO: 1359469 - protein, 28 aa, Mycobacterium
PSDWQPDYTLFPYNLWQIRVTPEQITAQ

SEQ ID NO: 1359470 - protein, 17 aa, Mycobacterium
PSEYQGFDIDLGNALGA

SEQ ID NO: 1359471 - protein, 30 aa, Mycobacterium
PSFGDTFVVGLLRTLRWINEETGIKILSGI

SEQ ID NO: 1359472 - protein, 21 aa, Mycobacterium
PSLEQLLVLLPQGTAVTQAVG

SEQ ID NO: 1359473 - protein, 23 aa, Mycobacterium
PSPADLDAFLQLLADRGVDVLIY

SEQ ID NO: 1359474 - protein, 23 aa, Mycobacterium
PSPDGVVIWTRLAPRPLADDGLG

SEQ ID NO: 1359475 - protein, 32 aa, Mycobacterium
PSPVADSLLAWVRRLITHTFFNKTPVVRSVTT

SEQ ID NO: 1359476 - protein, 18 aa, Mycobacterium
PSRYVGYTAWRGVAAYRL

SEQ ID NO: 1359477 - protein, 24 aa, Mycobacterium
PSTKIGRPLTAVSPLYGANAIDLC

SEQ ID NO: 1359478 - protein, 17 aa, Mycobacterium
PTALLPAITPQVTSSRG

SEQ ID NO: 1359479 - protein, 24 aa, Mycobacterium
PTDNGTYIIGDRYSFLVMDSSTYG

SEQ ID NO: 1359480 - protein, 24 aa, Mycobacterium
PTENLPLLQGFRNFGLGWLVDSWE

SEQ ID NO: 1359481 - protein, 18 aa, Mycobacterium
PTFPNARYLMPELDYRHF

SEQ ID NO: 1359482 - protein, 25 aa, Mycobacterium
PTGSSFKVFALVAALQQGIGLGYQV

SEQ ID NO: 1359483 - protein, 20 aa, Mycobacterium
PTIAAIWSQAGPNLVIEPAQ

SEQ ID NO: 1359484 - protein, 24 aa, Mycobacterium
PTLEVAPGITIPFGPPTTVPVGPP

SEQ ID NO: 1359485 - protein, 18 aa, Mycobacterium
PTLVFDASTGPPGTRGPL

SEQ ID NO: 1359486 - protein, 27 aa, Mycobacterium
PTRSSKKLGVLGLGSFAVATAFAGLGS

SEQ ID NO: 1359487 - protein, 21 aa, Mycobacterium
PTRWGFFSSINTTFARHMAYF

SEQ ID NO: 1359488 - protein, 33 aa, Mycobacterium
PTTLYVGELEWALPDTLLLHDKWSAAGGAVSTV

SEQ ID NO: 1359489 - protein, 25 aa, Mycobacterium
PTTSGPALRLGRATTPSVGSTGPAG

SEQ ID NO: 1359490 - protein, 24 aa, Mycobacterium
PTVAAAAVPLAWSAAAEDPALVEF

SEQ ID NO: 1359491 - protein, 24 aa, Mycobacterium
PTYSVPNIPGLPGGPPPPIGQTVV

SEQ ID NO: 1359492 - protein, 24 aa, Mycobacterium
PVAHGFTATMPWAADLPGTQWQHR

SEQ ID NO: 1359493 - protein, 27 aa, Mycobacterium
PVAPESLRFGLYGALVHPIEANGLGSC

SEQ ID NO: 1359494 - protein, 19 aa, Mycobacterium
PVGNLYCRVPQDAPFNVRG

SEQ ID NO: 1359495 - protein, 24 aa, Mycobacterium
PVGQPVPAPAPAPGVPLPPQPVAP

SEQ ID NO: 1359496 - protein, 35 aa, Mycobacterium
PVGSQARWLPDMVSIVSLFFIPSVSGATFTDKLNA

SEQ ID NO: 1359497 - protein, 25 aa, Mycobacterium
PVHHSDTIVLRRSRPLEISTDGGGT

SEQ ID NO: 1359498 - protein, 24 aa, Mycobacterium
PVINDHLRQDLSGALAWESGVTPQ

SEQ ID NO: 1359499 - protein, 18 aa, Mycobacterium
PVLSALAALLSTAAALVA

SEQ ID NO: 1359500 - protein, 17 aa, Mycobacterium
PVPAGVAPAPHGSSGTP

SEQ ID NO: 1359501 - protein, 25 aa, Mycobacterium
PVPDPPDPPPPPGALPAFPGAEGFG

SEQ ID NO: 1359502 - protein, 19 aa, Mycobacterium
PVPPTSVPHELDVSGLPPI

SEQ ID NO: 1359503 - protein, 24 aa, Mycobacterium
PVQARYFNELLISTFTIAGTTPRY

SEQ ID NO: 1359504 - protein, 21 aa, Mycobacterium
PVSPITFAPINDAIFGAFREL

SEQ ID NO: 1359505 - protein, 19 aa, Mycobacterium
PVVQAWTISGLKPSSDVIP

SEQ ID NO: 1359506 - protein, 17 aa, Mycobacterium
PWEWDGIRRAGVSSFGV

SEQ ID NO: 1359507 - protein, 17 aa, Mycobacterium
PWLAVTAAVVAVTACGP

SEQ ID NO: 1359508 - protein, 21 aa, Mycobacterium
PWRTSIIEFPTRTPSAPLAPV

SEQ ID NO: 1359509 - protein, 18 aa, Mycobacterium
PYAKPPLSKEFLCGGEHH

SEQ ID NO: 1359510 - protein, 17 aa, Mycobacterium
PYRLVEPASLPSIYADT

SEQ ID NO: 1359511 - protein, 17 aa, Mycobacterium
PYYDTWFAPWPYGFRGY

SEQ ID NO: 1359512 - protein, 25 aa, Mycobacterium
QAADAWNHFYNKWFPNAVIDGWVDA

SEQ ID NO: 1359513 - protein, 26 aa, Mycobacterium
QAAFDRIHWFFSLDPVGRRQYSENTA

SEQ ID NO: 1359514 - protein, 25 aa, Mycobacterium
QAAPLSVYLNRPPPPPAPAIDFVPP

SEQ ID NO: 1359515 - protein, 26 aa, Mycobacterium
QAASMINYNWQLPALNEPGSGPAAGK

SEQ ID NO: 1359516 - protein, 21 aa, Mycobacterium
QAEVVSIYRGPALRDTVRDDL

SEQ ID NO: 1359517 - protein, 35 aa, Mycobacterium; identical to SEQ ID NO: 1323984

SEQ ID NO: 1359518 - protein, 17 aa, Mycobacterium
QAPIWRANVYRQLGLSA

SEQ ID NO: 1359519 - protein, 34 aa, Mycobacterium; identical to SEQ ID NO: 1308533

SEQ ID NO: 1359520 - protein, 18 aa, Mycobacterium
QAQEDLFRIACRAAGVTP

SEQ ID NO: 1359521 - protein, 26 aa, Mycobacterium
QASVSAFPRVVWVAGGLLKGASVDEM

SEQ ID NO: 1359522 - protein, 20 aa, Mycobacterium
QAVFIPAGLAHRVANTAPHD

SEQ ID NO: 1359523 - protein, 21 aa, Mycobacterium
QAVPWARACAAVLLAVNGRDG

SEQ ID NO: 1359524 - protein, 19 aa, Mycobacterium
QCDEANAFWAPDAKTVTIC

SEQ ID NO: 1359525 - protein, 20 aa, Mycobacterium
QDFGPDFGLSYVLDGLAAMG

SEQ ID NO: 1359526 - protein, 25 aa, Mycobacterium
QDIVDHGLPRPTLFAFPFSDGYDED

SEQ ID NO: 1359527 - protein, 21 aa, Mycobacterium
QDTILLPETPAWVTTPVVPPE

SEQ ID NO: 1359528 - protein, 19 aa, Mycobacterium
QFLEKFLARTSRTFQEKYL

SEQ ID NO: 1359529 - protein, 19 aa, Mycobacterium
QFLFWPGLIGAGLVVGVAV

SEQ ID NO: 1359530 - protein, 17 aa, Mycobacterium
QFMDFRYTVHDRWHGEF

SEQ ID NO: 1359531 - protein, 17 aa, Mycobacterium
QFMPATFAAYGGGGDIT

SEQ ID NO: 1359532 - protein, 25 aa, Mycobacterium
QFNDDFIEWSISYAQPPFPDACEVA

SEQ ID NO: 1359533 - protein, 25 aa, Mycobacterium
QFQYGGPHAVFLLDGLRAQDDFNGW

SEQ ID NO: 1359534 - protein, 21 aa, Mycobacterium
QFRDRLFGPVGLTQTSLPAAD

SEQ ID NO: 1359535 - protein, 19 aa, Mycobacterium
QFSGIFVSSGLTLGVERYR

SEQ ID NO: 1359536 - protein, 24 aa, Mycobacterium
QFVVKTVVGMLDWGLDPQQAVGMV

SEQ ID NO: 1359537 - protein, 26 aa, Mycobacterium
QGGPYGPVDWYINATWLHEGEASPLW

SEQ ID NO: 1359538 - protein, 25 aa, Mycobacterium
QGGSIGLGFAIPVDQAKRIADEIIQ

SEQ ID NO: 1359539 - protein, 17 aa, Mycobacterium
QGPMQFMPSTFAAYGAG

SEQ ID NO: 1359540 - protein, 17 aa, Mycobacterium
QGRLHSGSLIPLSAAGG

SEQ ID NO: 1359541 - protein, 18 aa, Mycobacterium
QGTGRIAVVFGAGGNRDA

SEQ ID NO: 1359542 - protein, 19 aa, Mycobacterium
QHHMQLLCVQRLDGGLTIG

SEQ ID NO: 1359543 - protein, 24 aa, Mycobacterium
QIDPRIRADAYWPTLAAHLTNAAR

SEQ ID NO: 1359544 - protein, 18 aa, Mycobacterium
QIPLGLVNHYYLYELINS

SEQ ID NO: 1359545 - protein, 26 aa, Mycobacterium
QISAYELLLCRIASLNIAYLHVVSEP

SEQ ID NO: 1359546 - protein, 26 aa, Mycobacterium
QKGQTLLLHGLWPQPPDRQNCGVPRA

SEQ ID NO: 1359547 - protein, 17 aa, Mycobacterium
QKLPLNVTWVNLTTGKS

SEQ ID NO: 1359548 - protein, 22 aa, Mycobacterium
QKWPERLVIVDEFPLTGLGKVA

SEQ ID NO: 1359549 - protein, 17 aa, Mycobacterium
QLAAEAALAPLTTPAAI

SEQ ID NO: 1359550 - protein, 20 aa, Mycobacterium
QLDGDLWRNLTDTGLARLTS

SEQ ID NO: 1359551 - protein, 17 aa, Mycobacterium
QLIDRSGMAWCISNFGR

SEQ ID NO: 1359552 - protein, 36 aa, Mycobacterium
QLITFTILTVVALGVLGLYYLRLPSLAGIGEYKLYA

SEQ ID NO: 1359553 - protein, 26 aa, Mycobacterium
QLPEAQLDRFLLKLTVPLPPRDQEIA

SEQ ID NO: 1359554 - protein, 17 aa, Mycobacterium
QMAGMYQAIANDGVRIP

SEQ ID NO: 1359555 - protein, 18 aa, Mycobacterium
QMGAYLRYKGYVYAYGTG

SEQ ID NO: 1359556 - protein, 26 aa, Mycobacterium
QPEQVKITFWVDDRYKIPADAQAVIL

SEQ ID NO: 1359557 - protein, 26 aa, Mycobacterium
QPESVKVSFWYDSKYKVPADAKAVIL

SEQ ID NO: 1359558 - protein, 25 aa, Mycobacterium
QPGTGSTFTLSIPAALPLDPHGDDA

SEQ ID NO: 1359559 - protein, 24 aa, Mycobacterium
QPNAPQALFQIALSPILGGVAAFG

SEQ ID NO: 1359560 - protein, 23 aa, Mycobacterium
QPNYPSIQFGPDGSGVLITVETG

SEQ ID NO: 1359561 - protein, 25 aa, Mycobacterium
QPPAPAGPLPGPAPVDDPCDIDLAA

SEQ ID NO: 1359562 - protein, 18 aa, Mycobacterium
QPPEYQPPPGALVAGTAQ

SEQ ID NO: 1359563 - protein, 17 aa, Mycobacterium
QPSAPMTVAPNGAVFFK

SEQ ID NO: 1359564 - protein, 25 aa, Mycobacterium
QPSQPYRLRVIVHEDDNGHMTGYDL

SEQ ID NO: 1359565 - protein, 20 aa, Mycobacterium
QPVPQLPPAAGPQAAPPALA

SEQ ID NO: 1359566 - protein, 25 aa, Mycobacterium
QQDPSIDYVVTLGAPFALTAVQSAK

SEQ ID NO: 1359567 - protein, 25 aa, Mycobacterium
QQIAKGAPLAFAYPPGGTTFSQKYN

SEQ ID NO: 1359568 - protein, 24 aa, Mycobacterium
QQNPWVVIEQWESAGYQVNIDRIG

SEQ ID NO: 1359569 - protein, 23 aa, Mycobacterium
QQPEINILNVFLVQWNENPENRS

SEQ ID NO: 1359570 - protein, 17 aa, Mycobacterium
QQRKVPRRLLKAARLGL

SEQ ID NO: 1359571 - protein, 36 aa, Mycobacterium
QQSSANPALRPMIGDGGWLIGNGLDAADDCQGDACN

SEQ ID NO: 1359572 - protein, 22 aa, Mycobacterium
QQSTILDSIDWQCQHTVVSVSN

SEQ ID NO: 1359573 - protein, 34 aa, Mycobacterium
QQTATYTYTTTLEWVLGPYFEGEFVKGANRVIAT

SEQ ID NO: 1359574 - protein, 22 aa, Mycobacterium
QRAVLAVLLLAQGRVVSTDRLA

SEQ ID NO: 1359575 - protein, 21 aa, Mycobacterium
QRDCCYYTALIMWIGCHADSH

SEQ ID NO: 1359576 - protein, 19 aa, Mycobacterium
QRFPAGLLVFGDAICSFNP

SEQ ID NO: 1359577 - protein, 31 aa, Mycobacterium
QRGPLPDEMPAAALWWRLADALSRTAAIPDR

SEQ ID NO: 1359578 - protein, 21 aa, Mycobacterium
QRLQQIWCECLGVASIDPAEN

SEQ ID NO: 1359579 - protein, 24 aa, Mycobacterium
QRQFYRILDVLLAAGDFDATTGSL

SEQ ID NO: 1359580 - protein, 20 aa, Mycobacterium
QRREVALAGFTALFGEAASR

SEQ ID NO: 1359581 - protein, 26 aa, Mycobacterium
QRTSPQFFEILNFVMRFAPALPEETA

SEQ ID NO: 1359582 - protein, 25 aa, Mycobacterium
QRVMKRLLALLSATVLVLAGCGQAA

SEQ ID NO: 1359583 - protein, 24 aa, Mycobacterium
QSAKLCVQYLAPIVKNRQFNFPPI

SEQ ID NO: 1359584 - protein, 20 aa, Mycobacterium
QSYFGKPHFAQWAPGMKTLD

SEQ ID NO: 1359585 - protein, 33 aa, Mycobacterium; identical to SEQ ID NO: 116924

SEQ ID NO: 1359586 - protein, 29 aa, Mycobacterium
QTRSPLLRVLVAATLLALIVAGGTAVAAH

SEQ ID NO: 1359587 - protein, 29 aa, Mycobacterium
QTTSTAVFAPPLTPAPPSTPVPPVASLAA

SEQ ID NO: 1359588 - protein, 30 aa, Mycobacterium; identical to SEQ ID NO: 1136608

SEQ ID NO: 1359589 - protein, 26 aa, Mycobacterium
QTYTYKWETFLTQELPQWLASHRNIS

SEQ ID NO: 1359590 - protein, 23 aa, Mycobacterium
QVEFADVILLNKTDLVSAATLGT

SEQ ID NO: 1359591 - protein, 20 aa, Mycobacterium
QVFKTLVIAVPKGLAVAVLP

SEQ ID NO: 1359592 - protein, 17 aa, Mycobacterium
QVHNITTAAWGNAVDYR

SEQ ID NO: 1359593 - protein, 20 aa, Mycobacterium
QVLGSWSWAIPANSATPDAA

SEQ ID NO: 1359594 - protein, 18 aa, Mycobacterium
QVLKWKYQFLEAGAERMQ

SEQ ID NO: 1359595 - protein, 17 aa, Mycobacterium
QVLLTESMREQPVPGWT

SEQ ID NO: 1359596 - protein, 18 aa, Mycobacterium
QVNEIAILQILNGPPPGG

SEQ ID NO: 1359597 - protein, 19 aa, Mycobacterium
QVSAFLSGPAFREAFGAPD

SEQ ID NO: 1359598 - protein, 22 aa, Mycobacterium
QVTLRMAVAPTVSNAGPTVVLT

SEQ ID NO: 1359599 - protein, 25 aa, Mycobacterium
QWAHVRTFSPWPELIDAAATRLLAP

SEQ ID NO: 1359600 - protein, 17 aa, Mycobacterium
QWAIDQPGAKYILFKVS

SEQ ID NO: 1359601 - protein, 18 aa, Mycobacterium
QWCTPIPSVDIFTVDEER

SEQ ID NO: 1359602 - protein, 18 aa, Mycobacterium
QWLLNGFQQSRARWDLLG

SEQ ID NO: 1359603 - protein, 33 aa, Mycobacterium
QYWIMKPTDWNNRWWITCMVAFKTSYGVIQQSL

SEQ ID NO: 1359604 - protein, 23 aa, Mycobacterium
RAAGGVDFISYSKVFDGILVAKD

SEQ ID NO: 1359605 - protein, 29 aa, Mycobacterium
RAAKYASGWWSFLTPPEKLAERLDFIKSQ

SEQ ID NO: 1359606 - protein, 18 aa, Mycobacterium
RAARATLRLGWQALRQPA

SEQ ID NO: 1359607 - protein, 27 aa, Mycobacterium
RAASPTVLLNPLKWYPMARAAADTVTV

SEQ ID NO: 1359608 - protein, 18 aa, Mycobacterium
RADFLRPGGIADLVDDRD

SEQ ID NO: 1359609 - protein, 19 aa, Mycobacterium
RADGPFVGTGLQGAFLAEL

SEQ ID NO: 1359610 - protein, 28 aa, Mycobacterium
RAEDRLDWPLRPRPAVVRTFDAPAPNWQ

SEQ ID NO: 1359611 - protein, 27 aa, Mycobacterium
RAEDRLDWPLRPRPAVVRTFDAPTPNW

SEQ ID NO: 1359612 - protein, 25 aa, Mycobacterium
RAEEAAFVLLALQAPVAGDLRAVVS

SEQ ID NO: 1359613 - protein, 31 aa, Mycobacterium
RAETPVLWTVFAWTRRTFFNATPVVRYDDTT

SEQ ID NO: 1359614 - protein, 26 aa, Mycobacterium
RAEVLRPGLLALSVRGAARYFGSEQT

SEQ ID NO: 1359615 - protein, 19 aa, Mycobacterium
RAGLIVYNGLGLEETVIRN

SEQ ID NO: 1359616 - protein, 17 aa, Mycobacterium
RAGLLGSIAASCTAAWR

SEQ ID NO: 1359617 - protein, 19 aa, Mycobacterium
RAIWDWTRTHLRRPDGLLS

SEQ ID NO: 1359618 - protein, 17 aa, Mycobacterium
RAKLRADFLRPGGIADL

SEQ ID NO: 1359619 - protein, 25 aa, Mycobacterium
RAKLTPTHPLGCKRLVFATDYLQTL

SEQ ID NO: 1359620 - protein, 18 aa, Mycobacterium
RALDLASLTYSGFADVIA

SEQ ID NO: 1359621 - protein, 18 aa, Mycobacterium
RALFAACAATAVLAGCAT

SEQ ID NO: 1359622 - protein, 27 aa, Mycobacterium
RALPAMREYLAATGRYTFLSSTEAREV

SEQ ID NO: 1359623 - protein, 26 aa, Mycobacterium
RALPSDFDGWGIAGWSWDEVLPHYTA

SEQ ID NO: 1359624 - protein, 19 aa, Mycobacterium
RAMVRLLGLPDGDHVRFKR

SEQ ID NO: 1359625 - protein, 24 aa, Mycobacterium
RANGGLFARLYPLAGLFGIDTVTP

SEQ ID NO: 1359626 - protein, 17 aa, Mycobacterium
RAPFVVPLGIGAHLRKW

SEQ ID NO: 1359627 - protein, 24 aa, Mycobacterium
RAQGFAVRRWLQVGAASAGVGAGL

SEQ ID NO: 1359628 - protein, 22 aa, Mycobacterium
RAREIFAGGWRPAVPPGPTRSE

SEQ ID NO: 1359629 - protein, 23 aa, Mycobacterium
RARELILEFADFTRYSFRAAGQF

SEQ ID NO: 1359630 - protein, 22 aa, Mycobacterium
RARIYRNVVIPQPDNPASPKLL

SEQ ID NO: 1359631 - protein, 20 aa, Mycobacterium
RARRFAVLAAAVAAASAATG

SEQ ID NO: 1359632 - protein, 19 aa, Mycobacterium
RATAKPISVAWRLAAGADL

SEQ ID NO: 1359633 - protein, 26 aa, Mycobacterium
RATGKQYRFVLPGPVLSPGEEARCLE

SEQ ID NO: 1359634 - protein, 20 aa, Mycobacterium
RAVPGGLELSTGLATSRVHP

SEQ ID NO: 1359635 - protein, 19 aa, Mycobacterium
RAVSRLVGWPGTPRNFVDV

SEQ ID NO: 1359636 - protein, 17 aa, Mycobacterium
RAYMEQAVWAPYGNEQF

SEQ ID NO: 1359637 - protein, 30 aa, Mycobacterium
RCGGSEAWNLPAVFGPIAITYNLEGVDGLV

SEQ ID NO: 1359638 - protein, 17 aa, Mycobacterium
RCMNEPWLMNMAVGQIR

SEQ ID NO: 1359639 - protein, 24 aa, Mycobacterium
RCRQNGWSWYIDTTEKDNGFTAVL

SEQ ID NO: 1359640 - protein, 25 aa, Mycobacterium
RDGAEWIHLVDLDAAFGRGSNRELL

SEQ ID NO: 1359641 - protein, 25 aa, Mycobacterium
RDGMDDWPVQPMWFRSRQPVEDDPL

SEQ ID NO: 1359642 - protein, 24 aa, Mycobacterium
RDGMPAMMQGMMGPGGMMGPGGMM

SEQ ID NO: 1359643 - protein, 17 aa, Mycobacterium
RDLVGHATALRPEDFRK

SEQ ID NO: 1359644 - protein, 22 aa, Mycobacterium
RDNEYLTHWLDQGYAVAATDYT

SEQ ID NO: 1359645 - protein, 22 aa, Mycobacterium
RDRGITFPSIYDPPMRTMIAFG

SEQ ID NO: 1359646 - protein, 29 aa, Mycobacterium
RDSGARRLVIVPWFLAHGRITDRVADYAA

SEQ ID NO: 1359647 - protein, 18 aa, Mycobacterium
RDSYAYTNFGLTAAAEAV

SEQ ID NO: 1359648 - protein, 30 aa, Mycobacterium
RDVAEIALLPVTKFFPASDIRILYGLGCRE

SEQ ID NO: 1359649 - protein, 22 aa, Mycobacterium
RDVAGISCWRRGAPPHPCRQAE

SEQ ID NO: 1359650 - protein, 21 aa, Mycobacterium
RDVYAVLLEEQIPFLVTDLAT

SEQ ID NO: 1359651 - protein, 20 aa, Mycobacterium
REFGSTIRALSQILADENFG

SEQ ID NO: 1359652 - protein, 19 aa, Mycobacterium
RERFAVRISNNGEFIHANP

SEQ ID NO: 1359653 - protein, 28 aa, Mycobacterium
RESGARRLVIVPWFLAHGRITDRVADYA

SEQ ID NO: 1359654 - protein, 17 aa, Mycobacterium
RETISYATPHQHRRHLP

SEQ ID NO: 1359655 - protein, 17 aa, Mycobacterium
REYLAQKDIRYSECGKI

SEQ ID NO: 1359656 - protein, 20 aa, Mycobacterium
RFGFWGAEEEGLLGSRDYVT

SEQ ID NO: 1359657 - protein, 18 aa, Mycobacterium
RFQEMAALTTFTTWTTYD

SEQ ID NO: 1359658 - protein, 25 aa, Mycobacterium
RFSRGTYRFAQRWPPGGAAVVISGL

SEQ ID NO: 1359659 - protein, 19 aa, Mycobacterium
RFVTPPWWEVLDADRPVVH

SEQ ID NO: 1359660 - protein, 24 aa, Mycobacterium
RGAEFDRLWLESMISHHQGAVEMA

SEQ ID NO: 1359661 - protein, 22 aa, Mycobacterium
RGDLALAVFVSDAGSSGPAVDA

SEQ ID NO: 1359662 - protein, 26 aa, Mycobacterium
RGDYLNVYTTFDLTLRRVGESVFTTS

SEQ ID NO: 1359663 - protein, 32 aa, Mycobacterium
RGEDARIPAVAAILARQIAIAPAAAVPAKHPG

SEQ ID NO: 1359664 - protein, 21 aa, Mycobacterium
RGERIYLVTPTERLTYAAAER

SEQ ID NO: 1359665 - protein, 25 aa, Mycobacterium
RGGARFRVPGIERVDIMSLEPFNVS

SEQ ID NO: 1359666 - protein, 29 aa, Mycobacterium
RGGDLATPKGWMKALWAYNQSDPYSRSVR

SEQ ID NO: 1359667 - protein, 20 aa, Mycobacterium
RGGGRLYISNALAGTVSVIS

SEQ ID NO: 1359668 - protein, 27 aa, Mycobacterium
RGGRSCPYWNLVLAPGAAPVPLDVPGA

SEQ ID NO: 1359669 - protein, 24 aa, Mycobacterium
RGKRPVREIVGMSVELMMRWSSRG

SEQ ID NO: 1359670 - protein, 21 aa, Mycobacterium
RGLSEPLNIPYKVAFVLDVAG

SEQ ID NO: 1359671 - protein, 17 aa, Mycobacterium
RGPLLGADLEGRLYTSA

SEQ ID NO: 1359672 - protein, 24 aa, Mycobacterium
RGPVIVCHPADLQWFTDDRILPQL

SEQ ID NO: 1359673 - protein, 24 aa, Mycobacterium
RGPYLAPGSVLAIEPMLTLGTAKT

SEQ ID NO: 1359674 - protein, 21 aa, Mycobacterium
RGSVVHLRWATNGLAVQPENS

SEQ ID NO: 1359675 - protein, 22 aa, Mycobacterium
RGTAVRPIYGPALDGTLPGNEV

SEQ ID NO: 1359676 - protein, 28 aa, Mycobacterium
RGYFTANPAEYYDLRGILAPLGDAQRSC

SEQ ID NO: 1359677 - protein, 31 aa, Mycobacterium
RHDSYLVDWTGLPYLRFLMANTGRGQPLLHR

SEQ ID NO: 1359678 - protein, 32 aa, Mycobacterium
RHYDAVIVDYLFLGILPLLLDDTVRTPPVLHY

SEQ ID NO: 1359679 - protein, 21 aa, Mycobacterium
RIGALAFALGVGVGLGATPAV

SEQ ID NO: 1359680 - protein, 26 aa, Mycobacterium
RIGEYYHDLLTQLGFNATLKVIAGDV

SEQ ID NO: 1359681 - protein, 24 aa, Mycobacterium
RIGRRIMARLNWRKNGPGPTTPPH

SEQ ID NO: 1359682 - protein, 21 aa, Mycobacterium
RIIGSFFFAGAAATAIATAPL

SEQ ID NO: 1359683 - protein, 18 aa, Mycobacterium
RIQWRFERVCRKVSVDQP

SEQ ID NO: 1359684 - protein, 27 aa, Mycobacterium
RIRCEQVEWVWYVETLRETPGFGAQVK

SEQ ID NO: 1359685 - protein, 18 aa, Mycobacterium
RIRYTRNAVLDHVSIGNA

SEQ ID NO: 1359686 - protein, 21 aa, Mycobacterium
RITFWVDRRYPVPADAKAVIL

SEQ ID NO: 1359687 - protein, 26 aa, Mycobacterium
RKEKVSFAGPYLITGQSLLVRSDNTD

SEQ ID NO: 1359688 - protein, 21 aa, Mycobacterium
RKFSAPYMSGLVGLAYNRAAT

SEQ ID NO: 1359689 - protein, 32 aa, Mycobacterium; identical to SEQ ID NO: 367610

SEQ ID NO: 1359690 - protein, 25 aa, Mycobacterium
RKLGPAGPIEFPPDSGPRASINGVS

SEQ ID NO: 1359691 - protein, 24 aa, Mycobacterium
RKYGGLNGWWYGDALLTPTDTDYA

SEQ ID NO: 1359692 - protein, 17 aa, Mycobacterium
RLADPPPVTGAVGLGLV

SEQ ID NO: 1359693 - protein, 23 aa, Mycobacterium
RLANYVMTLRRDLLKVSEAAGVR

SEQ ID NO: 1359694 - protein, 18 aa, Mycobacterium
RLDPALLAAVQEASRAAA

SEQ ID NO: 1359695 - protein, 22 aa, Mycobacterium
RLDRREYFHGGVLRVTVPGVRI

SEQ ID NO: 1359696 - protein, 18 aa, Mycobacterium
RLELAMWTRRPDLRLEPG

SEQ ID NO: 1359697 - protein, 32 aa, Mycobacterium
RLGVHVSLAPFQYYYWGDLLDGAMFDPEHGAR

SEQ ID NO: 1359698 - protein, 18 aa, Mycobacterium
RLHDGSLIPLSSGGAFPS

SEQ ID NO: 1359699 - protein, 19 aa, Mycobacterium
RLHSGSLIPLSAAGGYPTT

SEQ ID NO: 1359700 - protein, 18 aa, Mycobacterium
RLKGFPVQMVKGLGVALT

SEQ ID NO: 1359701 - protein, 18 aa, Mycobacterium
RLLVATPAPDWVKAAQLE

SEQ ID NO: 1359702 - protein, 24 aa, Mycobacterium
RLPATPLPRISIFLSLLDAHVQRA

SEQ ID NO: 1359703 - protein, 22 aa, Mycobacterium
RLRDELLNSWRFDSLLEARVII

SEQ ID NO: 1359704 - protein, 22 aa, Mycobacterium
RLRRRLLLASAPPALVTVVVAV

SEQ ID NO: 1359705 - protein, 20 aa, Mycobacterium
RLRTVMADLGMPLPPAYPRP

SEQ ID NO: 1359706 - protein, 24 aa, Mycobacterium
RLVAINIGGMYWTTRTAIKHLGEG

SEQ ID NO: 1359707 - protein, 17 aa, Mycobacterium
RLVLGGFSQGAVVSGFT

SEQ ID NO: 1359708 - protein, 18 aa, Mycobacterium
RMGALALHVAKIARRRHP

SEQ ID NO: 1359709 - protein, 20 aa, Mycobacterium
RMGIGAADLKHRHPQVIPVE

SEQ ID NO: 1359710 - protein, 20 aa, Mycobacterium
RMLKSLRDVEVSVTYFGGGP

SEQ ID NO: 1359711 - protein, 20 aa, Mycobacterium
RMMVTFGVGWLQGEFEALGV

SEQ ID NO: 1359712 - protein, 25 aa, Mycobacterium
RMYQYTLDELLLAALSRTVGDTLGD

SEQ ID NO: 1359713 - protein, 19 aa, Mycobacterium
RNAQDFFDRSSVTWQDCAN

SEQ ID NO: 1359714 - protein, 28 aa, Mycobacterium
RNEGAEPLVMWVLYANPPATPLAIDVPD

SEQ ID NO: 1359715 - protein, 23 aa, Mycobacterium
RNIEGWVTRKRPGSAAAEAAAAA

SEQ ID NO: 1359716 - protein, 17 aa, Mycobacterium
RNVGAYTWGFFAGKTQT

SEQ ID NO: 1359717 - protein, 18 aa, Mycobacterium
RPATLRPLPNFAVDRLES

SEQ ID NO: 1359718 - protein, 21 aa, Mycobacterium
RPDTKPLDVIFPIVQKDISRQ

SEQ ID NO: 1359719 - protein, 20 aa, Mycobacterium
RPEPTRARITFWVDRRYPVP

SEQ ID NO: 1359720 - protein, 19 aa, Mycobacterium
RPGRRTELYWAARLTLVNR

SEQ ID NO: 1359721 - protein, 25 aa, Mycobacterium
RPKDPITLLLPSRPMLEYLVRQKVR

SEQ ID NO: 1359722 - protein, 17 aa, Mycobacterium
RPLFRALDPEQVNELSA

SEQ ID NO: 1359723 - protein, 21 aa, Mycobacterium
RPLTVLSPDFGARTADLCNTG

SEQ ID NO: 1359724 - protein, 36 aa, Mycobacterium
RPNGGILMRLHGWPTIPILEIPFPGASPTDSAVLPD

SEQ ID NO: 1359725 - protein, 34 aa, Mycobacterium
RPRRVLLALLLAELVSAVLMLDRSQPPAAPPMAA

SEQ ID NO: 1359726 - protein, 20 aa, Mycobacterium
RPRVIATRAVVVLVSEKRQG

SEQ ID NO: 1359727 - protein, 28 aa, Mycobacterium
RPTDFTSFLNPYWRGKFSVPISTNDSSI

SEQ ID NO: 1359728 - protein, 31 aa, Mycobacterium
RPTPTITARLNFQLAFGARVGVRLTEAREEA

SEQ ID NO: 1359729 - protein, 19 aa, Mycobacterium
RPVNGTAFAVTPALREAYA

SEQ ID NO: 1359730 - protein, 20 aa, Mycobacterium
RPYLYDGRIRRDVPPVVPLQ

SEQ ID NO: 1359731 - protein, 26 aa, Mycobacterium
RPYPIARAELQLMLMKAYGIDDINFG

SEQ ID NO: 1359732 - protein, 18 aa, Mycobacterium
RPYYDTWFAPWPYGFRGY

SEQ ID NO: 1359733 - protein, 20 aa, Mycobacterium
RQLRRWLTQLLAAERVVAAE

SEQ ID NO: 1359734 - protein, 31 aa, Mycobacterium
RQSGYSQFFSQGYLGYWRKSGTSGGGGGGGA

SEQ ID NO: 1359735 - protein, 17 aa, Mycobacterium
RQVVLRLLGPRRRGRGP

SEQ ID NO: 1359736 - protein, 31 aa, Mycobacterium
RQYDGWADFPTYLWNPIAVANAVVGILLVHG

SEQ ID NO: 1359737 - protein, 17 aa, Mycobacterium
RRAAYGSAAAVLVLAVS

SEQ ID NO: 1359738 - protein, 18 aa, Mycobacterium
RRDQLVERVLYTTVYVDA

SEQ ID NO: 1359739 - protein, 21 aa, Mycobacterium
RRFLNAGIGFGGGCLPKDIRA

SEQ ID NO: 1359740 - protein, 23 aa, Mycobacterium
RRFVRFCLWSLALAAIATVVVNL

SEQ ID NO: 1359741 - protein, 26 aa, Mycobacterium
RRGLAARFSALLVALALAVTPLAVGP

SEQ ID NO: 1359742 - protein, 27 aa, Mycobacterium
RRGLFGMFAGGLLAFGSAAIVAPVANS

SEQ ID NO: 1359743 - protein, 34 aa, Mycobacterium
RRGRHRRGRPRRLQPYAWLGAGAVGFGLGAAALT

SEQ ID NO: 1359744 - protein, 18 aa, Mycobacterium
RRHWPALLESLTGDDGAR

SEQ ID NO: 1359745 - protein, 27 aa, Mycobacterium
RRKTEVDFMLAPYLAAAQELGMDTPTL

SEQ ID NO: 1359746 - protein, 20 aa, Mycobacterium
RRLEGLIAPGSWNIDPSATP

SEQ ID NO: 1359747 - protein, 34 aa, Mycobacterium
RRLEPYHLVTTGRRWYLMCFDRDRVDWRSLRLDR

SEQ ID NO: 1359748 - protein, 33 aa, Mycobacterium
RRLEPYQLVTTGRRWYLLGYDRDKQDWRSLRLD

SEQ ID NO: 1359749 - protein, 17 aa, Mycobacterium
RRLGFGLGETVVSLAWR

SEQ ID NO: 1359750 - protein, 31 aa, Mycobacterium
RRLLTILAATLAAAVLFAASAFAAADIVLTF

SEQ ID NO: 1359751 - protein, 19 aa, Mycobacterium
RRPAPLRVYLQVSLDGDEA

SEQ ID NO: 1359752 - protein, 27 aa, Mycobacterium
RRPGGAWMLGKPILLPEARDLYQNGLK

SEQ ID NO: 1359753 - protein, 21 aa, Mycobacterium
RRPPRRVLGAVAGACAVLALS

SEQ ID NO: 1359754 - protein, 20 aa, Mycobacterium
RRRDTRFTPLTIRLMHIMSP

SEQ ID NO: 1359755 - protein, 26 aa, Mycobacterium
RRRPMPTAPVTAIVVAAVVAAALAVA

SEQ ID NO: 1359756 - protein, 27 aa, Mycobacterium
RRRRMPTAPVTAIVVATVVAAALAVVG

SEQ ID NO: 1359757 - protein, 18 aa, Mycobacterium
RRRTLRRRPHPRGDRIDL

SEQ ID NO: 1359758 - protein, 23 aa, Mycobacterium
RRVWEALLTIPYGETRSYGQIAQ

SEQ ID NO: 1359759 - protein, 20 aa, Mycobacterium
RRYMLGGRRVPVGELATLIG

SEQ ID NO: 1359760 - protein, 25 aa, Mycobacterium
RSDWDRRLRPMLARQFELAAGRRKI

SEQ ID NO: 1359761 - protein, 21 aa, Mycobacterium
RSGLLLSLAVLLVAGCSQVVA

SEQ ID NO: 1359762 - protein, 17 aa, Mycobacterium
RSIADYDELFVPIRNAR

SEQ ID NO: 1359763 - protein, 24 aa, Mycobacterium
RSQLGWRTLGVYAVNYPASGAFTS

SEQ ID NO: 1359764 - protein, 25 aa, Mycobacterium
RSSGELHLDWWYDTRRVPQETVEVF

SEQ ID NO: 1359765 - protein, 27 aa, Mycobacterium
RSSPYLIGALKLMLTAPFSIENIPKVV

SEQ ID NO: 1359766 - protein, 20 aa, Mycobacterium
RSTMAPTLVFDASTGPPGTR

SEQ ID NO: 1359767 - protein, 19 aa, Mycobacterium
RSYTRDLVQARYLQFSQQP

SEQ ID NO: 1359768 - protein, 24 aa, Mycobacterium
RTAGAGWPDKFLAGAALVAHGVAA

SEQ ID NO: 1359769 - protein, 28 aa, Mycobacterium
RTAVARLYRRRFSWLSQGSTPTASRRPV

SEQ ID NO: 1359770 - protein, 32 aa, Mycobacterium
RTDPAALTSLVYYHVFLGLLGPDDVKGQRPTQ

SEQ ID NO: 1359771 - protein, 31 aa, Mycobacterium
RTGELYNYVAHFGTFIVIVTANPLVVDGKPA

SEQ ID NO: 1359772 - protein, 27 aa, Mycobacterium
RTGHRRLALIVAGAAVCFAQMLGAAPT

SEQ ID NO: 1359773 - protein, 26 aa, Mycobacterium
RTGIVKALFRDLGQPAAQLIPSGVVG

SEQ ID NO: 1359774 - protein, 18 aa, Mycobacterium
RTIGQFPSPYTRANPLTV

SEQ ID NO: 1359775 - protein, 19 aa, Mycobacterium
RTIGQLPSPYTAGNPLLAP

SEQ ID NO: 1359776 - protein, 18 aa, Mycobacterium
RTIGQLPSPYTARNPLIV

SEQ ID NO: 1359777 - protein, 20 aa, Mycobacterium
RTKWSNLIYSAGQSVSQPSL

SEQ ID NO: 1359778 - protein, 17 aa, Mycobacterium
RTLDAALRRRSGRRVSV

SEQ ID NO: 1359779 - protein, 19 aa, Mycobacterium
RTLVELPATLPAVEARLIG

SEQ ID NO: 1359780 - protein, 18 aa, Mycobacterium
RTMIPRPLVERELPGLLL

SEQ ID NO: 1359781 - protein, 21 aa, Mycobacterium
RTPALADRLVWQCASLLLSYP

SEQ ID NO: 1359782 - protein, 24 aa, Mycobacterium
RTRKFGLAGLLGYAVYLAGNTVRK

SEQ ID NO: 1359783 - protein, 34 aa, Mycobacterium
RTSTVGYANAFWDPSRQLFAFGDAGYFQASVDVV

SEQ ID NO: 1359784 - protein, 26 aa, Mycobacterium
RVCREVYYQWILPLGTVEIGVDSNVE

SEQ ID NO: 1359785 - protein, 25 aa, Mycobacterium
RVDAELSVVGLNNTVTYRDGDPKVN

SEQ ID NO: 1359786 - protein, 26 aa, Mycobacterium
RVDLTADFRLFPPPQAIPDLTGGAGE

SEQ ID NO: 1359787 - protein, 23 aa, Mycobacterium
RVGDLVTWWTGDALMVFSANNLQ

SEQ ID NO: 1359788 - protein, 27 aa, Mycobacterium
RVGLAALLVVTLAVGIYLVWPSRTGNK

SEQ ID NO: 1359789 - protein, 27 aa, Mycobacterium
RVGLAALLVVTLAVGVYLVWPSRTGNK

SEQ ID NO: 1359790 - protein, 17 aa, Mycobacterium
RVGVLSCAAALTACSSG

SEQ ID NO: 1359791 - protein, 24 aa, Mycobacterium
RVGYRSIALGSGALLLAGCQFGGL

SEQ ID NO: 1359792 - protein, 24 aa, Mycobacterium
RVGYRSIVLGSGALLLAGCQFGGL

SEQ ID NO: 1359793 - protein, 18 aa, Mycobacterium
RVIVPHLRGFGTTRFRSA

SEQ ID NO: 1359794 - protein, 19 aa, Mycobacterium
RVKAIYRVAIPDGGGATGA

SEQ ID NO: 1359795 - protein, 23 aa, Mycobacterium
RVLAATLAVSLPFVLSACGGDDT

SEQ ID NO: 1359796 - protein, 31 aa, Mycobacterium
RVMTIETRTVLWFRTYQLIDAPRNITTYRTS

SEQ ID NO: 1359797 - protein, 23 aa, Mycobacterium
RVPTEAEPWPRAAEPRRAAVCSY

SEQ ID NO: 1359798 - protein, 24 aa, Mycobacterium
RVREPGLTLLVPIADRLQKVNMQI

SEQ ID NO: 1359799 - protein, 21 aa, Mycobacterium
RVREPGLTLLVPVADRLQKVN

SEQ ID NO: 1359800 - protein, 31 aa, Mycobacterium
RVSIGLGPAWKVLRDLPLPPGDRHTVTMEVS

SEQ ID NO: 1359801 - protein, 25 aa, Mycobacterium
RVSQWWKAGLAAVLAIAALFGGLDR

SEQ ID NO: 1359802 - protein, 24 aa, Mycobacterium
RVSRLAGLIGAQPSPRRLAATSSP

SEQ ID NO: 1359803 - protein, 20 aa, Mycobacterium
RVVGALALAAALPFAATACG

SEQ ID NO: 1359804 - protein, 21 aa, Mycobacterium
RVVMTVLTWRLDMDALAATAE

SEQ ID NO: 1359805 - protein, 32 aa, Mycobacterium
RVYGQQAMELVIRRAMSQLGVPYSWGGGNANG

SEQ ID NO: 1359806 - protein, 19 aa, Mycobacterium
RVYGQQASELVIRRAMSQL

SEQ ID NO: 1359807 - protein, 22 aa, Mycobacterium
RWEPYLHRDPRNAALLRETTRW

SEQ ID NO: 1359808 - protein, 17 aa, Mycobacterium
RWNFLNVVRPLGVQLDN

SEQ ID NO: 1359809 - protein, 23 aa, Mycobacterium
RYDAEWIVVLDDWTDGIGSSPQQ

SEQ ID NO: 1359810 - protein, 19 aa, Mycobacterium
RYDFHTWTWAVTYCIPDAP

SEQ ID NO: 1359811 - protein, 19 aa, Mycobacterium
RYGALGLYGWVGGAVNDVA

SEQ ID NO: 1359812 - protein, 19 aa, Mycobacterium
RYRPARLMPSLGELIDTAS

SEQ ID NO: 1359813 - protein, 24 aa, Mycobacterium
SAAALLAVMLLLAGCSDAEDRLES

SEQ ID NO: 1359814 - protein, 17 aa, Mycobacterium
SAAAPPWAMPDVRGMNL

SEQ ID NO: 1359815 - protein, 20 aa, Mycobacterium
SAADLLLLAGTRRELQAQQE

SEQ ID NO: 1359816 - protein, 32 aa, Mycobacterium
SADRRWLDVSRTQRVLVWQLIGTASLPPDWAS

SEQ ID NO: 1359817 - protein, 20 aa, Mycobacterium
SAELGMYRLFAHVGGTDALL

SEQ ID NO: 1359818 - protein, 22 aa, Mycobacterium
SAGFMKILGPQFLSTFPGRVLN

SEQ ID NO: 1359819 - protein, 26 aa, Mycobacterium
SAGHRLAFNAAFAELGLDIEWSAARY

SEQ ID NO: 1359820 - protein, 23 aa, Mycobacterium
SAGLVPPIHQWSGSTFSNLPIGQ

SEQ ID NO: 1359821 - protein, 24 aa, Mycobacterium
SAGMGMMRLLANPAAVPAGPVSLR

SEQ ID NO: 1359822 - protein, 26 aa, Mycobacterium
SAGRLLDVVGPFLPFETPINSAAMQY

SEQ ID NO: 1359823 - protein, 30 aa, Mycobacterium
SAGVPTLLRCRLLVCQLAEPSADRAADAAA

SEQ ID NO: 1359824 - protein, 23 aa, Mycobacterium
SAKAPTPPPPPPPSDPTFAQRVA

SEQ ID NO: 1359825 - protein, 27 aa, Mycobacterium
SALAIAAAPALFFVAAPSGGSTITYTA

SEQ ID NO: 1359826 - protein, 25 aa, Mycobacterium
SALDRACIAIALFGGLDVPLQQPLG

SEQ ID NO: 1359827 - protein, 21 aa, Mycobacterium
SALFDMPAWQRTAAGAVPPER

SEQ ID NO: 1359828 - protein, 18 aa, Mycobacterium
SALTEILLDALPPDTVQT

SEQ ID NO: 1359829 - protein, 25 aa, Mycobacterium
SAPAGLAMLLRRAADLVALGADPNR

SEQ ID NO: 1359830 - protein, 25 aa, Mycobacterium
SAPAKPDLVLFRRGGAPAALADSIR

SEQ ID NO: 1359831 - protein, 18 aa, Mycobacterium
SAPVMVPVLASSAAAETE

SEQ ID NO: 1359832 - protein, 23 aa, Mycobacterium
SARADVQVYRALLSVLPEGVAAG

SEQ ID NO: 1359833 - protein, 22 aa, Mycobacterium
SARGLEFVGLMAIPPLNADAGE

SEQ ID NO: 1359834 - protein, 24 aa, Mycobacterium
SATFTLAATWKFGPEKRNEWSYTT

SEQ ID NO: 1359835 - protein, 30 aa, Mycobacterium
SAVFLVDYLMNFFQYHLPGVQAYHLDVTPD

SEQ ID NO: 1359836 - protein, 23 aa, Mycobacterium
SAVTAGLAACGLAFALTACGSGQ

SEQ ID NO: 1359837 - protein, 23 aa, Mycobacterium
SAWGGRWGVWINGGFIALSKNPV

SEQ ID NO: 1359838 - protein, 20 aa, Mycobacterium
SDERIVAFVDLPAAIRPKTA

SEQ ID NO: 1359839 - protein, 22 aa, Mycobacterium
SDGSWYVLQLNADGLENQIDII

SEQ ID NO: 1359840 - protein, 29 aa, Mycobacterium
SDHSRRLWTVLIFMLWHAIFVEGSVTPRI

SEQ ID NO: 1359841 - protein, 24 aa, Mycobacterium
SDIDPSILLDIRYSAPHNFTGDPV

SEQ ID NO: 1359842 - protein, 18 aa, Mycobacterium
SDPHFWTDPQRMIMAVDA

SEQ ID NO: 1359843 - protein, 20 aa, Mycobacterium
SDQGVWEFILPLVRSDVRAT

SEQ ID NO: 1359844 - protein, 17 aa, Mycobacterium
SDRDNEYLTHWLDQGYA

SEQ ID NO: 1359845 - protein, 21 aa, Mycobacterium
SDSGLLFLAYQSDPASQFVPA

SEQ ID NO: 1359846 - protein, 20 aa, Mycobacterium
SDTIRRAAALGVVRFVASTD

SEQ ID NO: 1359847 - protein, 20 aa, Mycobacterium
SDTVHIGPPALLGVGVRTAP

SEQ ID NO: 1359848 - protein, 30 aa, Mycobacterium
SDVTTAPMLAPPALFYSKAGSLYISDPAGA

SEQ ID NO: 1359849 - protein, 24 aa, Mycobacterium
SDYDGFTMVGVPAGGLFSGAEDKM

SEQ ID NO: 1359850 - protein, 25 aa, Mycobacterium
SEDDFWRVWEFHPPNPTGNTVIAVH

SEQ ID NO: 1359851 - protein, 20 aa, Mycobacterium
SEDWLRPDYIPPQPGSAAPP

SEQ ID NO: 1359852 - protein, 31 aa, Mycobacterium
SEFLDGLVAVFLESGPVGALGYLAVAASDSA

SEQ ID NO: 1359853 - protein, 26 aa, Mycobacterium
SEIEMMRGWLALWGVGPAAAQQHHPN

SEQ ID NO: 1359854 - protein, 25 aa, Mycobacterium
SELVIRRAMSQLGVPYSWGGGNANG

SEQ ID NO: 1359855 - protein, 17 aa, Mycobacterium
SETIAINPALAISGLEV

SEQ ID NO: 1359856 - protein, 29 aa, Mycobacterium
SEYAKFYHEVAHMAISLYRLPITGPEEDA

SEQ ID NO: 1359857 - protein, 24 aa, Mycobacterium
SFGAQVCSRWMRVYARDPVRRAMA

SEQ ID NO: 1359858 - protein, 26 aa, Mycobacterium
SFGDGFSILGWASNTPPPPGWTGSTG

SEQ ID NO: 1359859 - protein, 21 aa, Mycobacterium
SFTALFRPDLDVLHADLPVVG

SEQ ID NO: 1359860 - protein, 31 aa, Mycobacterium
SFVGNQIRYCAIICPLLVDTAVTAAVTTVHA

SEQ ID NO: 1359861 - protein, 25 aa, Mycobacterium
SGAAKWNLLAPYAYASNGGKDPQAG

SEQ ID NO: 1359862 - protein, 22 aa, Mycobacterium
SGAIALAGLGFGSATAAGIELR

SEQ ID NO: 1359863 - protein, 21 aa, Mycobacterium
SGALALALAVAFPAAQVTAVD

SEQ ID NO: 1359864 - protein, 17 aa, Mycobacterium
SGEITAFDPHELGDGLP

SEQ ID NO: 1359865 - protein, 23 aa, Mycobacterium
SGELFADIPFALRGGGVYSVATP

SEQ ID NO: 1359866 - protein, 17 aa, Mycobacterium
SGFYGYGFNVGTTSAAR

SEQ ID NO: 1359867 - protein, 23 aa, Mycobacterium
SGGPNSPALYLLDGLRAQDDFNG

SEQ ID NO: 1359868 - protein, 24 aa, Mycobacterium
SGGSLVVGYRIGCGIVGGPVELFA

SEQ ID NO: 1359869 - protein, 24 aa, Mycobacterium
SGKCKLPLTLPQVFGLMQAAQQVP

SEQ ID NO: 1359870 - protein, 24 aa, Mycobacterium
SGLAAAFFGLAAPAAQAAPAGPGN

SEQ ID NO: 1359871 - protein, 25 aa, Mycobacterium
SGLDSRAYRLPWPDGTVVYEIDQPA

SEQ ID NO: 1359872 - protein, 27 aa, Mycobacterium
SGNPFHVHGLLGLLGITRPTEVTVVIA

SEQ ID NO: 1359873 - protein, 31 aa, Mycobacterium
SGPFYKAYVANLLPGQFLQPAIDAAFSDLGL

SEQ ID NO: 1359874 - protein, 21 aa, Mycobacterium
SGPYLLGALKIFLTAPYNIEN

SEQ ID NO: 1359875 - protein, 33 aa, Mycobacterium
SGQPLVIDPAWTLRGWSWFPDSTRAVVNEQQRP

SEQ ID NO: 1359876 - protein, 29 aa, Mycobacterium
SGQVGLLRYPLQLIAPLARVFVARQGAYR

SEQ ID NO: 1359877 - protein, 28 aa, Mycobacterium
SGQVGLLRYPLQLIAPLARVFVASQGAY

SEQ ID NO: 1359878 - protein, 24 aa, Mycobacterium
SGRITSVLALSALINGGRPDRFGI

SEQ ID NO: 1359879 - protein, 25 aa, Mycobacterium
SGSDRVHVIALLAPNGDPVAGTPVV

SEQ ID NO: 1359880 - protein, 25 aa, Mycobacterium
SGSNALLLLTQRPLSSSPSAGMPAG

SEQ ID NO: 1359881 - protein, 26 aa, Mycobacterium
SGVPANPALVPLAGLQAPAVNPSNLN

SEQ ID NO: 1359882 - protein, 26 aa, Mycobacterium
SGWGAANVSLLLTYLDATGGDDPVAT

SEQ ID NO: 1359883 - protein, 17 aa, Mycobacterium
SHALEVTGSWWVYTPTN

SEQ ID NO: 1359884 - protein, 19 aa, Mycobacterium
SHVLIIAPCSNRTITIRAA

SEQ ID NO: 1359885 - protein, 17 aa, Mycobacterium
SIAPWDCPTWADVQTVF

SEQ ID NO: 1359886 - protein, 26 aa, Mycobacterium
SILSKMFLAPIWDLISGYQFPELNNP

SEQ ID NO: 1359887 - protein, 25 aa, Mycobacterium
SISDGEEWFDWELDAVVRDGGMVSQ

SEQ ID NO: 1359888 - protein, 28 aa, Mycobacterium
SISSSPYPYIARVRYFAPHDVVAQAFSA

SEQ ID NO: 1359889 - protein, 18 aa, Mycobacterium
SITREYVLGGPVSRRYAG

SEQ ID NO: 1359890 - protein, 21 aa, Mycobacterium
SITTYLNVTIRPANSAPRAKA

SEQ ID NO: 1359891 - protein, 20 aa, Mycobacterium
SIVTPPLFPGVSISADLGNG

SEQ ID NO: 1359892 - protein, 26 aa, Mycobacterium
SIYDPPMRTMIAFGGRYPTTVIPSTV

SEQ ID NO: 1359893 - protein, 17 aa, Mycobacterium
SIYLLHNLLTHHDPNTI

SEQ ID NO: 1359894 - protein, 22 aa, Mycobacterium
SIYVHVPVMFADLSKVPAENIT

SEQ ID NO: 1359895 - protein, 29 aa, Mycobacterium
SKTVSGQLTLLLPFIDRIRARVDLRERVV

SEQ ID NO: 1359896 - protein, 30 aa, Mycobacterium
SLAGRTVVLNLWAYWCGPCADELPAMAEYQ

SEQ ID NO: 1359897 - protein, 26 aa, Mycobacterium
SLDHAVWLHRPFDPHQWHLYDAEAVS

SEQ ID NO: 1359898 - protein, 17 aa, Mycobacterium
SLGIGWLAEPFIDLAEP

SEQ ID NO: 1359899 - protein, 22 aa, Mycobacterium
SLLSVLLATILVGGLVVVVGAG

SEQ ID NO: 1359900 - protein, 18 aa, Mycobacterium
SLNTSYYRLMLELNNGPQ

SEQ ID NO: 1359901 - protein, 21 aa, Mycobacterium
SLPFRGLVTISPRFLEETRAL

SEQ ID NO: 1359902 - protein, 18 aa, Mycobacterium
SLPTLSVRASRWGRYPLL

SEQ ID NO: 1359903 - protein, 24 aa, Mycobacterium
SLSGPEFDKLWLQSMIGQHQGAVE

SEQ ID NO: 1359904 - protein, 23 aa, Mycobacterium
SLTQRAVLRLLDPSITSAGVLRA

SEQ ID NO: 1359905 - protein, 34 aa, Mycobacterium
SLTRSASLLTTIWPKENLTKWFRGDYGNLTMVLD

SEQ ID NO: 1359906 - protein, 21 aa, Mycobacterium
SMDLGLLHLRLAFNPGVHSVS

SEQ ID NO: 1359907 - protein, 42 aa, Mycobacterium
SMTRSLSFLTTFPWAKELIPKWFRGDFANLTLVLDLTLSRLD

SEQ ID NO: 1359908 - protein, 22 aa, Mycobacterium
SNALGEHVSWWAKANLPMDAGC

SEQ ID NO: 1359909 - protein, 23 aa, Mycobacterium
SNPECLGALYTAEDPVYESTGYT

SEQ ID NO: 1359910 - protein, 20 aa, Mycobacterium
SNPGFSFTGFARAFKNNLFG

SEQ ID NO: 1359911 - protein, 50 aa, Mycobacterium
SNTHYYVVKTYPVPLLMPVAWLPDPIIAALDAPLRWFIELAYDRSDYSEP

SEQ ID NO: 1359912 - protein, 19 aa, Mycobacterium
SPALWTSPGAAAPGAFDGA

SEQ ID NO: 1359913 - protein, 24 aa, Mycobacterium
SPIEAWMALGQPTIAINANFFDVR

SEQ ID NO: 1359914 - protein, 25 aa, Mycobacterium
SPLFHGDSIYRLWYQFTQISDKIKQ

SEQ ID NO: 1359915 - protein, 21 aa, Mycobacterium
SPPGYLATPDGWELTVAARDE

SEQ ID NO: 1359916 - protein, 27 aa, Mycobacterium
SPSPENLSFVFLGNSLRKYGGVRPAYE

SEQ ID NO: 1359917 - protein, 26 aa, Mycobacterium
SPYEQILYNAGFWPFSRGGFADPTFN

SEQ ID NO: 1359918 - protein, 18 aa, Mycobacterium
SQADLRLTLLRPSDEEDT

SEQ ID NO: 1359919 - protein, 20 aa, Mycobacterium
SQFGSFHMVDGFLLNNQLTD

SEQ ID NO: 1359920 - protein, 23 aa, Mycobacterium
SQLPQVPMMLRPDEIERGYVDHM

SEQ ID NO: 1359921 - protein, 26 aa, Mycobacterium
SRAPGIPGIPDIQIPNLPLPTRNTDV

SEQ ID NO: 1359922 - protein, 20 aa, Mycobacterium
SRDSLGRTLDTLPAALDVLN

SEQ ID NO: 1359923 - protein, 24 aa, Mycobacterium
SREIEVLEFVPAGDLDPLMYDRSY

SEQ ID NO: 1359924 - protein, 24 aa, Mycobacterium
SREIEVLEFVPASDLDPLMYDRSY

SEQ ID NO: 1359925 - protein, 20 aa, Mycobacterium
SRIHLQGLNIRWADGARRSL

SEQ ID NO: 1359926 - protein, 22 aa, Mycobacterium
SRIHLRGLNIRWADGARRSLGD

SEQ ID NO: 1359927 - protein, 18 aa, Mycobacterium
SRITALGAAVALAVGLTA

SEQ ID NO: 1359928 - protein, 31 aa, Mycobacterium; identical to SEQ ID NO: 862923

SEQ ID NO: 1359929 - protein, 18 aa, Mycobacterium
SRRRVLVGAAALAALGVT

SEQ ID NO: 1359930 - protein, 19 aa, Mycobacterium
SRYATYFAQGIISSQQREI

SEQ ID NO: 1359931 - protein, 17 aa, Mycobacterium
SRYHRAFMLGSVSAPEA

SEQ ID NO: 1359932 - protein, 33 aa, Mycobacterium; identical to SEQ ID NO: 1136770

SEQ ID NO: 1359933 - protein, 18 aa, Mycobacterium
SSDCVAAVFGGWTSSSRK

SEQ ID NO: 1359934 - protein, 33 aa, Mycobacterium
SSDDPPLRRPDLLRVFLLGELPPAAARRYAAAF

SEQ ID NO: 1359935 - protein, 18 aa, Mycobacterium
SSGGHVLGLAPTAAAAIV

SEQ ID NO: 1359936 - protein, 27 aa, Mycobacterium
SSGNPYPIYWNLNAVNNYFRTGPQFPY

SEQ ID NO: 1359937 - protein, 20 aa, Mycobacterium
SSIPLLLAGCQFGGLNSLNM

SEQ ID NO: 1359938 - protein, 26 aa, Mycobacterium
SSLLVQDLQMRPGSSSGWHTHPGPEH

SEQ ID NO: 1359939 - protein, 18 aa, Mycobacterium
SSMRAGLPPGWTTADKTG

SEQ ID NO: 1359940 - protein, 29 aa, Mycobacterium
SSRDDGDGKRRFGATISRIDRDDADERPR

SEQ ID NO: 1359941 - protein, 33 aa, Mycobacterium; identical to SEQ ID NO: 950640

SEQ ID NO: 1359942 - protein, 34 aa, Mycobacterium
SSSPTYDLIVVDNPWMVDFANAKFLQPLDARIDS

SEQ ID NO: 1359943 - protein, 21 aa, Mycobacterium
SSVGFSVRHLMVSKVRGVFDT

SEQ ID NO: 1359944 - protein, 18 aa, Mycobacterium
SSVTLACARLGWAVQDTE

SEQ ID NO: 1359945 - protein, 18 aa, Mycobacterium
SSVTLACARLGWPVQDTE

SEQ ID NO: 1359946 - protein, 21 aa, Mycobacterium
SSWGVFYNTDLVDPAFRPTDF

SEQ ID NO: 1359947 - protein, 23 aa, Mycobacterium
STFGKIDVLFNIAGVFPAGDGDV

SEQ ID NO: 1359948 - protein, 20 aa, Mycobacterium
STIKVLLAMTVLDHLRPDNF

SEQ ID NO: 1359949 - protein, 28 aa, Mycobacterium
STTKPDPILPLRISFVEMVPRTTSTTEK

SEQ ID NO: 1359950 - protein, 19 aa, Mycobacterium
SVAIAIGRNSYAQASGAGS

SEQ ID NO: 1359951 - protein, 19 aa, Mycobacterium
SVAWTAWRGLGMGSTSGFV

SEQ ID NO: 1359952 - protein, 19 aa, Mycobacterium
SVDAAHVCVFPLAAPQSVS

SEQ ID NO: 1359953 - protein, 24 aa, Mycobacterium
SVGLPDSWLIRPGSTLTVGKLESR

SEQ ID NO: 1359954 - protein, 18 aa, Mycobacterium
SVGTWAIDPVHSSVGFSV

SEQ ID NO: 1359955 - protein, 25 aa, Mycobacterium
SVLAAHHMDLPLSPKWAVVGQSQGG

SEQ ID NO: 1359956 - protein, 20 aa, Mycobacterium
SVLEWAVAQPLPARPRIVDL

SEQ ID NO: 1359957 - protein, 35 aa, Mycobacterium
SVLRYPSVGILHELPRRALWFSVPDMYGAFHISLQ

SEQ ID NO: 1359958 - protein, 17 aa, Mycobacterium
SVLTTLAACGLAASVVL

SEQ ID NO: 1359959 - protein, 23 aa, Mycobacterium
SVMIMALVVVLLANATLTQVFTA

SEQ ID NO: 1359960 - protein, 24 aa, Mycobacterium
SVMKRLLALLSATVLVLAGCGQAA

SEQ ID NO: 1359961 - protein, 21 aa, Mycobacterium
SVPHELDVSGLPPILVISTTN

SEQ ID NO: 1359962 - protein, 23 aa, Mycobacterium
SVRRAILGLLDVDLLASVGAGDD

SEQ ID NO: 1359963 - protein, 25 aa, Mycobacterium
SVSNFSNPVWFVCGLIGGVANTTAP

SEQ ID NO: 1359964 - protein, 20 aa, Mycobacterium
SWFWFVSLCIPEKNPDCLNV

SEQ ID NO: 1359965 - protein, 28 aa, Mycobacterium
SWTWVLGAVLLTALLPLSPSIAPSATAY

SEQ ID NO: 1359966 - protein, 24 aa, Mycobacterium
TAAPPGVVWPMAGAALAAVFDAAT

SEQ ID NO: 1359967 - protein, 25 aa, Mycobacterium
TAARTRPIRIAPRKALALRALDVVA

SEQ ID NO: 1359968 - protein, 26 aa, Mycobacterium
TAARTRPIRIAPRKALALRALDVVAP

SEQ ID NO: 1359969 - protein, 21 aa, Mycobacterium
TAASRPFAPSWDKNDRFRVTV

SEQ ID NO: 1359970 - protein, 30 aa, Mycobacterium
TAATLPFAALPLMFLGPVPLAAATQVIPEG

SEQ ID NO: 1359971 - protein, 28 aa, Mycobacterium
TAATLYDKLPFITRNHTYTAHLAEAGGL

SEQ ID NO: 1359972 - protein, 24 aa, Mycobacterium
TAAVDVTLLSRFYERFADHAVEVA

SEQ ID NO: 1359973 - protein, 24 aa, Mycobacterium
TADPNATFGFGRPLPPAVADHVAA

SEQ ID NO: 1359974 - protein, 18 aa, Mycobacterium
TAEPLGYNKSYTLTAQSL

SEQ ID NO: 1359975 - protein, 18 aa, Mycobacterium
TAERHEWPSPLMPALQAI

SEQ ID NO: 1359976 - protein, 18 aa, Mycobacterium
TAFDPHELGDGLPPVEKS

SEQ ID NO: 1359977 - protein, 28 aa, Mycobacterium
TAFSGAWDHYLILNVAVGNPWTGDPDPN

SEQ ID NO: 1359978 - protein, 24 aa, Mycobacterium
TAGHLFQPLLYQCATGTLSIGHIS

SEQ ID NO: 1359979 - protein, 32 aa, Mycobacterium
TAKIPVECSQAGWTWLISDFGEETPGFSASVS

SEQ ID NO: 1359980 - protein, 17 aa, Mycobacterium
TALAGIATFMIAAAQPA

SEQ ID NO: 1359981 - protein, 27 aa, Mycobacterium
TAMHLDNFTTQVWTFTAGPTTATDANW

SEQ ID NO: 1359982 - protein, 20 aa, Mycobacterium
TANPKLMYLGMQDQYYTFSM

SEQ ID NO: 1359983 - protein, 18 aa, Mycobacterium
TAPPAMAAPPTWTMPDIR

SEQ ID NO: 1359984 - protein, 21 aa, Mycobacterium
TARFVPTRLSAVGALLAGALR

SEQ ID NO: 1359985 - protein, 24 aa, Mycobacterium
TARNVGDIRFYCSQMIAPITVEMS

SEQ ID NO: 1359986 - protein, 32 aa, Mycobacterium
TASGLYSQRYWPYLTSGLLGLQRGTDPGDLLL

SEQ ID NO: 1359987 - protein, 35 aa, Mycobacterium; identical to SEQ ID NO: 1309323

SEQ ID NO: 1359988 - protein, 22 aa, Mycobacterium
TASSVLMACSAALLASACQFSI

SEQ ID NO: 1359989 - protein, 18 aa, Mycobacterium
TATVCSAPVWAGGPGGMV

SEQ ID NO: 1359990 - protein, 19 aa, Mycobacterium
TAVLALIGGLGLSSCADDT

SEQ ID NO: 1359991 - protein, 17 aa, Mycobacterium
TAWALFRYDQVFEAARD

SEQ ID NO: 1359992 - protein, 27 aa, Mycobacterium
TAWCAEGLLIYLPPEAQDLLFDNVTAL

SEQ ID NO: 1359993 - protein, 25 aa, Mycobacterium
TCMSSSLPTLFRRAADYQRQITLTP

SEQ ID NO: 1359994 - protein, 25 aa, Mycobacterium
TDANRDAWMVGFTPSLSTAVWVGTV

SEQ ID NO: 1359995 - protein, 18 aa, Mycobacterium
TDGLILTNNHVVATAAGA

SEQ ID NO: 1359996 - protein, 25 aa, Mycobacterium
TDGSPWVGNIAISFPYLDTEATRTA

SEQ ID NO: 1359997 - protein, 17 aa, Mycobacterium
TDHYVVCFDIRPDVLRP

SEQ ID NO: 1359998 - protein, 23 aa, Mycobacterium
TDLVRYYDMLLSGAGGLPREQAN

SEQ ID NO: 1359999 - protein, 23 aa, Mycobacterium
TDNGAYIIGDRYSFLVMDSSTYG

SEQ ID NO: 1360000 - protein, 24 aa, Mycobacterium
TDPDTPLWFAGYDALLHGHPAPDA

SEQ ID NO: 1360001 - protein, 23 aa, Mycobacterium
TDPKDLVWYEAITSYLSGDFDNN

SEQ ID NO: 1360002 - protein, 24 aa, Mycobacterium
TDRSRPTALIDWARDRSLSVRWRP

SEQ ID NO: 1360003 - protein, 29 aa, Mycobacterium
TDTSLPLASIFKLYVLFAVAEAVKADTLE

SEQ ID NO: 1360004 - protein, 24 aa, Mycobacterium
TDVPYPAWDTYGYGPAFVGGEHHL

SEQ ID NO: 1360005 - protein, 28 aa, Mycobacterium
TDWFGAEPFGVWPWAQPRLGGAQPVVLS

SEQ ID NO: 1360006 - protein, 25 aa, Mycobacterium
TEDDYFQACLAARTWMEQRGGVARS

SEQ ID NO: 1360007 - protein, 24 aa, Mycobacterium
TEDGRLLRFLSMVTTFGTALDLTA

SEQ ID NO: 1360008 - protein, 36 aa, Mycobacterium
TEGNTTYVFVPTEDLPLLQGLRDLGLDWLADEWEEP

SEQ ID NO: 1360009 - protein, 18 aa, Mycobacterium
TEMRVELDPVLQAPVRLA

SEQ ID NO: 1360010 - protein, 25 aa, Mycobacterium
TEPDDWQQPRPTVFAREDAVYVTDP

SEQ ID NO: 1360011 - protein, 18 aa, Mycobacterium
TEPLGYGTTYTWAGTVVG

SEQ ID NO: 1360012 - protein, 23 aa, Mycobacterium
TEQALAAVALLLNGGGIGDIQDI

SEQ ID NO: 1360013 - protein, 23 aa, Mycobacterium
TEQTLASLSFLLNGGGIGQMQDI

SEQ ID NO: 1360014 - protein, 24 aa, Mycobacterium
TEQTLATLSLILNGGGIGQMQDIT

SEQ ID NO: 1360015 - protein, 26 aa, Mycobacterium
TERRTFQDWLFTVAGKILFGIDFATC

SEQ ID NO: 1360016 - protein, 25 aa, Mycobacterium
TFALLTVFAQFRFGDGRTYFAEFDN

SEQ ID NO: 1360017 - protein, 19 aa, Mycobacterium
TFDVAKIMELAPNAVTKLP

SEQ ID NO: 1360018 - protein, 17 aa, Mycobacterium
TFTYVPTAEARTAASRP

SEQ ID NO: 1360019 - protein, 20 aa, Mycobacterium
TFVGAICRWQAANPAGLVDI

SEQ ID NO: 1360020 - protein, 20 aa, Mycobacterium
TFWAVRRTFFNQAPTVDPVQ

SEQ ID NO: 1360021 - protein, 23 aa, Mycobacterium
TGAAGGVLLRPFARLISSTGDSV

SEQ ID NO: 1360022 - protein, 25 aa, Mycobacterium
TGADQGVWALTSTGPVKVLELDLGQ

SEQ ID NO: 1360023 - protein, 40 aa, Mycobacterium
TGAEPNPYSLMAYIALVGVYERFQWVALNHLPEVTGQTQN

SEQ ID NO: 1360024 - protein, 23 aa, Mycobacterium
TGATVLVPIYPMAPPKSTGTAAT

SEQ ID NO: 1360025 - protein, 22 aa, Mycobacterium
TGDGRFTYTPTPVARHAAATGR

SEQ ID NO: 1360026 - protein, 17 aa, Mycobacterium
TGDLYGHAIRLLDYGFS

SEQ ID NO: 1360027 - protein, 23 aa, Mycobacterium
TGDNMAYSVLVSRYMLAIQQEHG

SEQ ID NO: 1360028 - protein, 31 aa, Mycobacterium
TGDVLNPPTRRQLLDWMLANQTSSMRAGLPA

SEQ ID NO: 1360029 - protein, 19 aa, Mycobacterium
TGEFVYIPKVSTDLIPAFD

SEQ ID NO: 1360030 - protein, 18 aa, Mycobacterium
TGEPVGFDLSPRKRSQPG

SEQ ID NO: 1360031 - protein, 40 aa, Mycobacterium
TGGANPWHTNLPRLLWSALRPLLSALGFTAPVDSSSTTTV

SEQ ID NO: 1360032 - protein, 26 aa, Mycobacterium
TGLLATVLAPLVPPNPDAPTDSPLVL

SEQ ID NO: 1360033 - protein, 22 aa, Mycobacterium
TGPDGFGFINREKFKAGFAADT

SEQ ID NO: 1360034 - protein, 20 aa, Mycobacterium
TGPFRFLGQKSGDSISLAAN

SEQ ID NO: 1360035 - protein, 21 aa, Mycobacterium
TGPYAIERWDYGQKLVLARNA

SEQ ID NO: 1360036 - protein, 27 aa, Mycobacterium
TGQLADYLIPRLRSIDAPLLAVVGGST

SEQ ID NO: 1360037 - protein, 27 aa, Mycobacterium
TGREKWMFAHIPLAKKIYRTRLWLRSE

SEQ ID NO: 1360038 - protein, 25 aa, Mycobacterium
TGRGQPLLHRLSLMATLLADARGQI

SEQ ID NO: 1360039 - protein, 17 aa, Mycobacterium
TGSGALALALAVAFPAA

SEQ ID NO: 1360040 - protein, 26 aa, Mycobacterium
TGSRWECDLTWLELQWGRTIGQFPNP

SEQ ID NO: 1360041 - protein, 28 aa, Mycobacterium
TGVTGASIFPLWPPAPPTFPESPEELST

SEQ ID NO: 1360042 - protein, 19 aa, Mycobacterium
THEVPGDSFWDLVRKGAEA

SEQ ID NO: 1360043 - protein, 35 aa, Mycobacterium
THPSNLKTLCRFHHLLKTFWLGATGWRDRQYPDGT

SEQ ID NO: 1360044 - protein, 27 aa, Mycobacterium
TIADAGIFLISPLAQLAIVPVKFVGDL

SEQ ID NO: 1360045 - protein, 29 aa, Mycobacterium
TIADGAGTFDIISPYKIMGAAVVGTATVL

SEQ ID NO: 1360046 - protein, 21 aa, Mycobacterium
TIDDLWDPAFKGRVSLFSDAQ

SEQ ID NO: 1360047 - protein, 21 aa, Mycobacterium
TIDGLLAPEWKGKIGFAPSNA

SEQ ID NO: 1360048 - protein, 24 aa, Mycobacterium
TIDGRGRFTYTPSDAARHVAAAEA

SEQ ID NO: 1360049 - protein, 25 aa, Mycobacterium
TIDRAMGGVLFIDEAYTLVQERDGR

SEQ ID NO: 1360050 - protein, 22 aa, Mycobacterium
TIDWYRDNESWWGPLKDAVEAT

SEQ ID NO: 1360051 - protein, 19 aa, Mycobacterium
TIDYDRLTLGGSADVYVSF

SEQ ID NO: 1360052 - protein, 17 aa, Mycobacterium
TIGQLPSPYTARNPLIV

SEQ ID NO: 1360053 - protein, 21 aa, Mycobacterium
TIKVLLAMVVLDELPLDATIV

SEQ ID NO: 1360054 - protein, 21 aa, Mycobacterium
TILTRRTFLAATLAASTAAMA

SEQ ID NO: 1360055 - protein, 17 aa, Mycobacterium
TILVGGLVVVVGAGGRT

SEQ ID NO: 1360056 - protein, 30 aa, Mycobacterium
TIPGVLKNAIDWLSRPWGNGALKGKPVAVI

SEQ ID NO: 1360057 - protein, 24 aa, Mycobacterium
TISDGKFFPLPDPQALVDAQPTMA

SEQ ID NO: 1360058 - protein, 17 aa, Mycobacterium
TIVPLNSAPRPRASTVN

SEQ ID NO: 1360059 - protein, 21 aa, Mycobacterium
TIVVPNMLLVREDLDANLACV

SEQ ID NO: 1360060 - protein, 31 aa, Mycobacterium
TIWRLAIFVCVCLLGLSLLVAVFGQLRFEPR

SEQ ID NO: 1360061 - protein, 24 aa, Mycobacterium
TIYREPLSLKPFDYLPRGLRKSVG

SEQ ID NO: 1360062 - protein, 25 aa, Mycobacterium
TKDFNRLIWTNASPLWHFDDAAYDM

SEQ ID NO: 1360063 - protein, 25 aa, Mycobacterium
TKKLPSWTVLVPPENPVAGYYYQAI

SEQ ID NO: 1360064 - protein, 25 aa, Mycobacterium
TKQDYKGQYLSFNLNINLPPPCTTG

SEQ ID NO: 1360065 - protein, 27 aa, Mycobacterium
TLANSIRPWTPPPPPPPADPNAPVPPA

SEQ ID NO: 1360066 - protein, 23 aa, Mycobacterium
TLERLFPGIGRLDDSFPGIGIDG

SEQ ID NO: 1360067 - protein, 25 aa, Mycobacterium
TLICTPARHFSGRLFARDSTLWSSW

SEQ ID NO: 1360068 - protein, 27 aa, Mycobacterium
TLIGLTIAVIAALLLTGCGVTRGEQTG

SEQ ID NO: 1360069 - protein, 19 aa, Mycobacterium
TLKGVTRPISLNLDFNGVN

SEQ ID NO: 1360070 - protein, 39 aa, Mycobacterium
TLPDSLYPDRSFKTAYSSLLLLGLVTTGARINPQIYGGI

SEQ ID NO: 1360071 - protein, 37 aa, Mycobacterium
TLPDTYRILGREGLYGDFFGFYLCDAILKVNGKGGQP

SEQ ID NO: 1360072 - protein, 24 aa, Mycobacterium
TLRCPYHAWTYALDGKLVAAPNIV

SEQ ID NO: 1360073 - protein, 21 aa, Mycobacterium
TLRMHPPVPIVLRRLTEPLTV

SEQ ID NO: 1360074 - protein, 26 aa, Mycobacterium
TLSAGQAVVLFPTADEAATFFAESAQ

SEQ ID NO: 1360075 - protein, 27 aa, Mycobacterium
TLSVRASRWGRYPLLATVRVGGRGGLL

SEQ ID NO: 1360076 - protein, 23 aa, Mycobacterium
TLTPAAKVLALDALTPASTRMDT

SEQ ID NO: 1360077 - protein, 18 aa, Mycobacterium
TLTVFDRIRTVADQPTAG

SEQ ID NO: 1360078 - protein, 24 aa, Mycobacterium
TLTYKWETFLTRELPAWLAANRGQ

SEQ ID NO: 1360079 - protein, 20 aa, Mycobacterium
TLVACGDRDLLTPVEYSREM

SEQ ID NO: 1360080 - protein, 24 aa, Mycobacterium
TLVLMTSVVAVLLVSAPPASAQAN

SEQ ID NO: 1360081 - protein, 31 aa, Mycobacterium
TLVQLPPSVSYSFRSLARGPQAEALILGTDG

SEQ ID NO: 1360082 - protein, 19 aa, Mycobacterium
TMATFHPDRYRFAGSLSGF

SEQ ID NO: 1360083 - protein, 23 aa, Mycobacterium
TMCRFSMHPLIEQVGQRPYPIAR

SEQ ID NO: 1360084 - protein, 27 aa, Mycobacterium
TMKKFPKFLAASLLPLGAALAVAAPAQ

SEQ ID NO: 1360085 - protein, 20 aa, Mycobacterium
TMLDTEFALALIDLRKRGHP

SEQ ID NO: 1360086 - protein, 20 aa, Mycobacterium
TMLETEFALALIDLRKRGHT

SEQ ID NO: 1360087 - protein, 33 aa, Mycobacterium
TMNLELSNNLYWDPRFFIALGPNTNIVTDSSGN

SEQ ID NO: 1360088 - protein, 17 aa, Mycobacterium
TMRLILHTRVLAGMAVG

SEQ ID NO: 1360089 - protein, 17 aa, Mycobacterium
TNEVVGYYMAEPTPREV

SEQ ID NO: 1360090 - protein, 18 aa, Mycobacterium
TNGRIPRVYGQQAMELVI

SEQ ID NO: 1360091 - protein, 23 aa, Mycobacterium
TNTDTIILIRIPNNGQSATAISI

SEQ ID NO: 1360092 - protein, 24 aa, Mycobacterium
TPALTVAGVPPFGLGLKPMSGPVG

SEQ ID NO: 1360093 - protein, 24 aa, Mycobacterium
TPDAAWAFVSWITAKPNDVVRTEK

SEQ ID NO: 1360094 - protein, 25 aa, Mycobacterium
TPDDDDWPTWVLNDFGRKDPPVAED

SEQ ID NO: 1360095 - protein, 20 aa, Mycobacterium
TPDNFVGIPLYPAGARCMVH

SEQ ID NO: 1360096 - protein, 29 aa, Mycobacterium
TPDSVLLGLLKALPGDLSILYPSPAEDKD

SEQ ID NO: 1360097 - protein, 23 aa, Mycobacterium
TPEVANAVRFGFWGAEEEGLLGS

SEQ ID NO: 1360098 - protein, 20 aa, Mycobacterium
TPEWAYGAIIYNGPGAGEYS

SEQ ID NO: 1360099 - protein, 35 aa, Mycobacterium
TPHDLAVIMRAALKYPLIAQIMRSPSAPFPGKTLH

SEQ ID NO: 1360100 - protein, 34 aa, Mycobacterium
TPHDLAVMLRAALNYPLIAQIMRSPTAPFPGKTL

SEQ ID NO: 1360101 - protein, 22 aa, Mycobacterium
TPKGIYTLDFAFGTQPNPGGGL

SEQ ID NO: 1360102 - protein, 22 aa, Mycobacterium
TPLGDVFIAIKPPPSVQPGAAL

SEQ ID NO: 1360103 - protein, 18 aa, Mycobacterium
TPQDLYEYPTVSALAGAL

SEQ ID NO: 1360104 - protein, 24 aa, Mycobacterium
TPTATAIPFPPDAPTPRPAAMSHR

SEQ ID NO: 1360105 - protein, 22 aa, Mycobacterium
TPVKYLSGVPLVGEYDGLRALR

SEQ ID NO: 1360106 - protein, 32 aa, Mycobacterium
TPYVLDGRLLADGGILDPLPMAPIAAVAADMT

SEQ ID NO: 1360107 - protein, 20 aa, Mycobacterium
TQFGWQPTHPGLLADLSQAH

SEQ ID NO: 1360108 - protein, 26 aa, Mycobacterium
TQHRTTQWPVVVGGSLSFAVASAGVL

SEQ ID NO: 1360109 - protein, 28 aa, Mycobacterium
TQKFDGPYFVMQWLLRQPRKAVLPVVGD

SEQ ID NO: 1360110 - protein, 17 aa, Mycobacterium
TQLRWRPQDFWPAGTVV

SEQ ID NO: 1360111 - protein, 24 aa, Mycobacterium
TQREADAWAIWDPYTAQTASQLPV

SEQ ID NO: 1360112 - protein, 20 aa, Mycobacterium
TQRQSVTLPAYTAAKAMLTS

SEQ ID NO: 1360113 - protein, 25 aa, Mycobacterium
TQVHTMLVLVRSGIGIALVPASAAT

SEQ ID NO: 1360114 - protein, 21 aa, Mycobacterium
TRDEWTLFVALQHLRDGRDYT

SEQ ID NO: 1360115 - protein, 34 aa, Mycobacterium
TRGDYINLYAIFDLTYPRLKKTLLAGTRWGDQNA

SEQ ID NO: 1360116 - protein, 20 aa, Mycobacterium
TRGHGAVKRLLLGSVTTGLL

SEQ ID NO: 1360117 - protein, 27 aa, Mycobacterium
TRGLRTYVQLFVVIAAANDAKCDVASN

SEQ ID NO: 1360118 - protein, 17 aa, Mycobacterium
TRGPLYAVLGSPGGAVI

SEQ ID NO: 1360119 - protein, 18 aa, Mycobacterium
TRKALADQGFGVLTEIDM

SEQ ID NO: 1360120 - protein, 21 aa, Mycobacterium
TRLQLSYEDGDIWDWAVPWDE

SEQ ID NO: 1360121 - protein, 31 aa, Mycobacterium
TRRDELILQPSITRLPRDLGAVIDSLVAIAR

SEQ ID NO: 1360122 - protein, 23 aa, Mycobacterium
TRRGEVLTDVRLLGPRIAEAAAG

SEQ ID NO: 1360123 - protein, 24 aa, Mycobacterium
TRTFYQVPVSLWNRQPRALDFPAQ

SEQ ID NO: 1360124 - protein, 27 aa, Mycobacterium
TRYFVPTEHLPLTRPFRDLGVPDCLVD

SEQ ID NO: 1360125 - protein, 17 aa, Mycobacterium
TSAAAASALLAGCSTNG

SEQ ID NO: 1360126 - protein, 24 aa, Mycobacterium
TSAEPGFWPTLVQNKLISGGDANG

SEQ ID NO: 1360127 - protein, 47 aa, Mycobacterium; identical to SEQ ID NO: 1328643

SEQ ID NO: 1360128 - protein, 27 aa, Mycobacterium
TSDHPEWVIPVRWTPTHDLPPLEAVLT

SEQ ID NO: 1360129 - protein, 17 aa, Mycobacterium
TSIAVSAALIVTATAAG

SEQ ID NO: 1360130 - protein, 21 aa, Mycobacterium
TSILGSLHIELSPPAGAAPVG

SEQ ID NO: 1360131 - protein, 21 aa, Mycobacterium
TSLVTGWASIHGFPVGILANA

SEQ ID NO: 1360132 - protein, 32 aa, Mycobacterium
TSPALDLDALIGGFRPLFRALDPDQVNALSSQ

SEQ ID NO: 1360133 - protein, 19 aa, Mycobacterium
TSREILLTDIITAFGQRLA

SEQ ID NO: 1360134 - protein, 21 aa, Mycobacterium
TSRVFAVAASALLFGSAVACA

SEQ ID NO: 1360135 - protein, 20 aa, Mycobacterium
TSRVHPLPERVNTDIEMVSA

SEQ ID NO: 1360136 - protein, 50 aa, Mycobacterium
TSVTLSTILSSLLAPPRTPDAPSESPLWLVVAAALRRQLDSPTTSGEAGL

SEQ ID NO: 1360137 - protein, 26 aa, Mycobacterium
TSYLVPTNDLPLTKPLRQLGVDRRIV

SEQ ID NO: 1360138 - protein, 30 aa, Mycobacterium
TTAKVTMLVFTKWGGFYRRTLTINRSDHAI

SEQ ID NO: 1360139 - protein, 31 aa, Mycobacterium
TTALVIMVFAYMRLPAFLGIGQYRVTLELPE

SEQ ID NO: 1360140 - protein, 21 aa, Mycobacterium
TTDELPLTRLIRAVLGDTVAD

SEQ ID NO: 1360141 - protein, 31 aa, Mycobacterium
TTDHSRRLWTVLIFMLWYAIFVDKTVTPQIS

SEQ ID NO: 1360142 - protein, 25 aa, Mycobacterium
TTGGSHLLFNPLITIAQVLADLQVV

SEQ ID NO: 1360143 - protein, 20 aa, Mycobacterium
TTGRLFVAGLTGGVVQIIDV

SEQ ID NO: 1360144 - protein, 23 aa, Mycobacterium
TTLTLVAFAVPEPGWSKVSPAFA

SEQ ID NO: 1360145 - protein, 17 aa, Mycobacterium
TTLTVRVAIAPLGHVNQ

SEQ ID NO: 1360146 - protein, 30 aa, Mycobacterium
TTNPPTEGSWAWLPDEAAGSRLHWRSKEYF

SEQ ID NO: 1360147 - protein, 29 aa, Mycobacterium
TTNPPTEGSWAWLPDESAGSRLHWRSKEY

SEQ ID NO: 1360148 - protein, 22 aa, Mycobacterium
TTPALDLDVLLGGLKPVIQGLN

SEQ ID NO: 1360149 - protein, 35 aa, Mycobacterium; identical to SEQ ID NO: 1328730

SEQ ID NO: 1360150 - protein, 23 aa, Mycobacterium
TTPPPVPTGPLLAFRASDQLGIV

SEQ ID NO: 1360151 - protein, 17 aa, Mycobacterium
TTSYGHIGIWHNGKTFD

SEQ ID NO: 1360152 - protein, 25 aa, Mycobacterium
TTTPPPWNYGGWNGIGVWPLVGAYG

SEQ ID NO: 1360153 - protein, 24 aa, Mycobacterium
TTTTSMLYAMLQAGGRRAVLCGNI

SEQ ID NO: 1360154 - protein, 32 aa, Mycobacterium
TTTYMIPEEHLPLVLPFKYLGVPTETLIELDA

SEQ ID NO: 1360155 - protein, 27 aa, Mycobacterium
TTVWDTGKVLPIIPLIGGSGPNPEVPL

SEQ ID NO: 1360156 - protein, 25 aa, Mycobacterium
TTWTTYDSWHYTNGLGMYAAGTFHA

SEQ ID NO: 1360157 - protein, 26 aa, Mycobacterium
TVAQVAIGLLRQQLAPGQMVHGIVTD

SEQ ID NO: 1360158 - protein, 27 aa, Mycobacterium
TVDDFDRIIGINLRGAWLCTKHAAPRM

SEQ ID NO: 1360159 - protein, 24 aa, Mycobacterium
TVDVALLRLPADTSALAVIPLYEE

SEQ ID NO: 1360160 - protein, 20 aa, Mycobacterium
TVEFAPCARLLMDNLDAAGH

SEQ ID NO: 1360161 - protein, 27 aa, Mycobacterium
TVEHQRDLAEFLDLAPLTLDNIYNAID

SEQ ID NO: 1360162 - protein, 26 aa, Mycobacterium
TVFAEQPFFVDIYYRDVDPENWAAYS

SEQ ID NO: 1360163 - protein, 18 aa, Mycobacterium
TVFDGAGFPEEYRNRVFI

SEQ ID NO: 1360164 - protein, 24 aa, Mycobacterium
TVGFDCSGLMLYAFAGVGIKLDHY

SEQ ID NO: 1360165 - protein, 27 aa, Mycobacterium
TVGFDCSGLMLYMFAGVGIKLDHYSGS

SEQ ID NO: 1360166 - protein, 25 aa, Mycobacterium
TVGLDGWYLMFQAPGGLNASMRPSH

SEQ ID NO: 1360167 - protein, 25 aa, Mycobacterium
TVGLDGWYLMFQAPGGLNASMRPSL

SEQ ID NO: 1360168 - protein, 23 aa, Mycobacterium
TVGLNGSWLYTRTSNWTHSGPDT

SEQ ID NO: 1360169 - protein, 23 aa, Mycobacterium
TVGRTIAYAWLPAGADTGDPVTV

SEQ ID NO: 1360170 - protein, 18 aa, Mycobacterium
TVLLGAVPTADPGTRPSA

SEQ ID NO: 1360171 - protein, 22 aa, Mycobacterium
TVLVTAEWRYIDGRWKLANKSL

SEQ ID NO: 1360172 - protein, 19 aa, Mycobacterium
TVNLTIVPLNSAPRPRAST

SEQ ID NO: 1360173 - protein, 19 aa, Mycobacterium
TVNLVYPLTLENSGGTWMV

SEQ ID NO: 1360174 - protein, 25 aa, Mycobacterium
TVQAVASGLYPSAPVLSPDGTRLYG

SEQ ID NO: 1360175 - protein, 18 aa, Mycobacterium
TVRIGYQTPNARLAATVG

SEQ ID NO: 1360176 - protein, 24 aa, Mycobacterium
TVRNMLTALAAAAATAAALTACDA

SEQ ID NO: 1360177 - protein, 24 aa, Mycobacterium
TVRTSSSWFSAKVYGTVTAKDLDR

SEQ ID NO: 1360178 - protein, 34 aa, Mycobacterium; identical to SEQ ID NO: 1309554

SEQ ID NO: 1360179 - protein, 27 aa, Mycobacterium
TVTAPFSQTWRRCDFSKFAYTGPRAYG

SEQ ID NO: 1360180 - protein, 18 aa, Mycobacterium
TVTLPALGQILQSSPELA

SEQ ID NO: 1360181 - protein, 19 aa, Mycobacterium
TVTPTPIVPIQGAPGAGTP

SEQ ID NO: 1360182 - protein, 37 aa, Mycobacterium
TVTTDPPVEGAFYWLNNREVRWRPAQYWKPGTTVEVE

SEQ ID NO: 1360183 - protein, 23 aa, Mycobacterium
TVTTGIISALNRPVAAGGDARNQ

SEQ ID NO: 1360184 - protein, 18 aa, Mycobacterium
TVTWALRRGTVGDTFGGG

SEQ ID NO: 1360185 - protein, 21 aa, Mycobacterium
TVWQTANILRRDGFGAAVRSS

SEQ ID NO: 1360186 - protein, 17 aa, Mycobacterium
TWRSIVSDALSWIGLGM

SEQ ID NO: 1360187 - protein, 35 aa, Mycobacterium
TWSVPVKDYNPMMGRQLLIKVLKGKSSGTATLQYL

SEQ ID NO: 1360188 - protein, 34 aa, Mycobacterium
TYMLIKADVLPMLGWLDWFVDDEGMAKLDATFRP

SEQ ID NO: 1360189 - protein, 19 aa, Mycobacterium
TYRFSVPDPGTYWAHPHTG

SEQ ID NO: 1360190 - protein, 22 aa, Mycobacterium
TYSEDWLRPDYVPPPQAPLNDP

SEQ ID NO: 1360191 - protein, 25 aa, Mycobacterium
TYSGRQIYFKRFPPCRPGKFGAAIS

SEQ ID NO: 1360192 - protein, 31 aa, Mycobacterium
TYVLIRRENIPLLEPLRLMGLHELADQLNGP

SEQ ID NO: 1360193 - protein, 24 aa, Mycobacterium
VAAGPFFKAYVANLLPGQFIQPFV

SEQ ID NO: 1360194 - protein, 19 aa, Mycobacterium
VAALLAALTMLLGCTRTVE

SEQ ID NO: 1360195 - protein, 18 aa, Mycobacterium
VAAVFLRELLAEDLQPVV

SEQ ID NO: 1360196 - protein, 18 aa, Mycobacterium
VAAVRSKAPGDKVTLTYL

SEQ ID NO: 1360197 - protein, 22 aa, Mycobacterium
VAAVVFPAFNHVLSAVFETPDA

SEQ ID NO: 1360198 - protein, 24 aa, Mycobacterium
VACYQCRIQLVLAANLCPCAPPDP

SEQ ID NO: 1360199 - protein, 25 aa, Mycobacterium
VADDPVPYWAEIPENMPLPGGGVPK

SEQ ID NO: 1360200 - protein, 18 aa, Mycobacterium
VADQLAAYVLLQPDEDGQ

SEQ ID NO: 1360201 - protein, 20 aa, Mycobacterium
VAELLPQVFQWARSVDPVQP

SEQ ID NO: 1360202 - protein, 24 aa, Mycobacterium
VAERIHTWLEMRDLRPHRGEPDQQ

SEQ ID NO: 1360203 - protein, 17 aa, Mycobacterium
VAEWRRIDGRWKLASKS

SEQ ID NO: 1360204 - protein, 20 aa, Mycobacterium
VAGAAVLPFAVGCSSGSAAA

SEQ ID NO: 1360205 - protein, 27 aa, Mycobacterium
VAGEPVPLLRRFGLDAGERIAKLLSDS

SEQ ID NO: 1360206 - protein, 26 aa, Mycobacterium
VAGLDTAFRAVYGSGPLVVGVCAEYD

SEQ ID NO: 1360207 - protein, 17 aa, Mycobacterium
VAGPNWMLIGDAAACVN

SEQ ID NO: 1360208 - protein, 45 aa, Mycobacterium
VAGRPVPAGWYSEPWWKPALVAGAWGLGSALLFSSLFSGMAGVGY

SEQ ID NO: 1360209 - protein, 27 aa, Mycobacterium
VAGTALLLAILLIAGAALLVRQVFFGP

SEQ ID NO: 1360210 - protein, 18 aa, Mycobacterium
VALAAVGGSLFWERVETR

SEQ ID NO: 1360211 - protein, 22 aa, Mycobacterium
VALGFGFRCGFLGLLHMEITRE

SEQ ID NO: 1360212 - protein, 21 aa, Mycobacterium
VALLGVMLGPAGVAAAQQQNP

SEQ ID NO: 1360213 - protein, 24 aa, Mycobacterium
VAMAALLPLFAPAAAAQPQTTLVD

SEQ ID NO: 1360214 - protein, 18 aa, Mycobacterium
VAMLAGVPPLGDRIGSIG

SEQ ID NO: 1360215 - protein, 25 aa, Mycobacterium
VANLLPGQFIQPFVDAAFSDLGLDP

SEQ ID NO: 1360216 - protein, 26 aa, Mycobacterium
VAPFLSYGPFTGFAPRDLCAMWPVPP

SEQ ID NO: 1360217 - protein, 17 aa, Mycobacterium
VARLVGAPPGYVGYDQG

SEQ ID NO: 1360218 - protein, 22 aa, Mycobacterium
VARRIVAKWKPAVRSMGSVAAS

SEQ ID NO: 1360219 - protein, 18 aa, Mycobacterium
VATRLWRITRATGGAVAV

SEQ ID NO: 1360220 - protein, 20 aa, Mycobacterium
VAVPPLPPVPAVPASAPAPV

SEQ ID NO: 1360221 - protein, 21 aa, Mycobacterium
VAVTSWGSFTYTPSAAARHAA

SEQ ID NO: 1360222 - protein, 27 aa, Mycobacterium
VCADLGLPHLLLARPAWSAGDAILVSS

SEQ ID NO: 1360223 - protein, 17 aa, Mycobacterium
VCPFAAAVSLPFRGLVT

SEQ ID NO: 1360224 - protein, 17 aa, Mycobacterium
VDAGQWARALTGDGWFR

SEQ ID NO: 1360225 - protein, 18 aa, Mycobacterium
VDALNVIAVRYRPDDRQL

SEQ ID NO: 1360226 - protein, 18 aa, Mycobacterium
VDAYPTRPQAWSRVIDER

SEQ ID NO: 1360227 - protein, 17 aa, Mycobacterium
VDGLLPCLGQESHFGPP

SEQ ID NO: 1360228 - protein, 27 aa, Mycobacterium
VDHPEWVLPVTWPPTHGVPPLEAVLTT

SEQ ID NO: 1360229 - protein, 29 aa, Mycobacterium
VDHYAEIGLLGFALITDALGGVNVCLNAP

SEQ ID NO: 1360230 - protein, 24 aa, Mycobacterium
VDIPGTIFPVLPSVSPAVTGDDAN

SEQ ID NO: 1360231 - protein, 19 aa, Mycobacterium
VDIRGAITGALLSSLAALV

SEQ ID NO: 1360232 - protein, 20 aa, Mycobacterium
VDIRGAITGVLLSSLAALVP

SEQ ID NO: 1360233 - protein, 18 aa, Mycobacterium
VDLRYATPDNFVGIPLYP

SEQ ID NO: 1360234 - protein, 18 aa, Mycobacterium
VDMSVRLGLRSYALPGTA

SEQ ID NO: 1360235 - protein, 34 aa, Mycobacterium; identical to SEQ ID NO: 951658

SEQ ID NO: 1360236 - protein, 18 aa, Mycobacterium
VDRPAPPSLPKPTPAMDP

SEQ ID NO: 1360237 - protein, 26 aa, Mycobacterium
VDTRNMWGLPQLGRWKWHDPDVHAQL

SEQ ID NO: 1360238 - protein, 25 aa, Mycobacterium
VDTRNMWGLPQLGRWKWHDPDVHIQ

SEQ ID NO: 1360239 - protein, 25 aa, Mycobacterium
VDVGPHVNLLDPFRPIGTSADNLVN

SEQ ID NO: 1360240 - protein, 31 aa, Mycobacterium
VDVKLTKPITNGLTYPFTFTFERSGEVTVQV

SEQ ID NO: 1360241 - protein, 20 aa, Mycobacterium
VDVLFPLQQSIVNEGLLALN

SEQ ID NO: 1360242 - protein, 18 aa, Mycobacterium
VDVTARHDLAGRPRFVTA

SEQ ID NO: 1360243 - protein, 18 aa, Mycobacterium
VEAARLFLTGMIAHHEGA

SEQ ID NO: 1360244 - protein, 42 aa, Mycobacterium; identical to SEQ ID NO: 1136903

SEQ ID NO: 1360245 - protein, 23 aa, Mycobacterium
VEAGVGSGAWRLGPAHAAARGGP

SEQ ID NO: 1360246 - protein, 18 aa, Mycobacterium
VEAYDGALIPLFTSDPWL

SEQ ID NO: 1360247 - protein, 25 aa, Mycobacterium
VEELLGRSLPPIRRRWAGVYSQCVD

SEQ ID NO: 1360248 - protein, 21 aa, Mycobacterium
VEGLKLGHRIVYDVAANWKLI

SEQ ID NO: 1360249 - protein, 27 aa, Mycobacterium
VEGWEVLWNVYTPLLTYRHARGKEGTE

SEQ ID NO: 1360250 - protein, 24 aa, Mycobacterium
VEHVGWYVPARPTGCQALAANLFG

SEQ ID NO: 1360251 - protein, 18 aa, Mycobacterium
VEIPGLGTPAARRLWTGN

SEQ ID NO: 1360252 - protein, 29 aa, Mycobacterium
VEIQSFDWRTLPLVRQQAPSVPLVALWDD

SEQ ID NO: 1360253 - protein, 17 aa, Mycobacterium
VELAWNPEFLREGFAVK

SEQ ID NO: 1360254 - protein, 26 aa, Mycobacterium
VELSKPITNGLTYDFTFKFENAGETI

SEQ ID NO: 1360255 - protein, 17 aa, Mycobacterium
VENPINRYLINSAMLPS

SEQ ID NO: 1360256 - protein, 27 aa, Mycobacterium
VERAQWQVPKFYWTVMSRSGMGDAFAV

SEQ ID NO: 1360257 - protein, 23 aa, Mycobacterium
VERMYLVAPIGHPAPMTVVAPFL

SEQ ID NO: 1360258 - protein, 26 aa, Mycobacterium
VESPATWAVLAWARRQPFSTTTAAHT

SEQ ID NO: 1360259 - protein, 29 aa, Mycobacterium
VFADHVSFPFRMGFARVYGLFAERGLTDR

SEQ ID NO: 1360260 - protein, 17 aa, Mycobacterium
VFAMVLALTACGESVDT

SEQ ID NO: 1360261 - protein, 30 aa, Mycobacterium
VFASGRLLINREWFLWLNEVERAFVLAHEL

SEQ ID NO: 1360262 - protein, 25 aa, Mycobacterium
VFDSAPYGWPVEKGSPLAQSLLQAL

SEQ ID NO: 1360263 - protein, 21 aa, Mycobacterium
VFREPLTGKFVYTPSLPVIGD

SEQ ID NO: 1360264 - protein, 22 aa, Mycobacterium
VFRVLDAPDVPLIAKGRDLSTC

SEQ ID NO: 1360265 - protein, 17 aa, Mycobacterium
VFVATEKGIHRSTDNGT

SEQ ID NO: 1360266 - protein, 30 aa, Mycobacterium
VFYSDGGSEVLLWLEAPPAPATGSAGSGAS

SEQ ID NO: 1360267 - protein, 23 aa, Mycobacterium
VGAGGSVRFPLNPFMGVMGVAFA

SEQ ID NO: 1360268 - protein, 31 aa, Mycobacterium
VGAQPQLVLLSWPEDGPVIGIDPIGTVYASQ

SEQ ID NO: 1360269 - protein, 23 aa, Mycobacterium
VGARLEGPDGMWAEVTITATSLD

SEQ ID NO: 1360270 - protein, 23 aa, Mycobacterium
VGDRREAIAHAVRWARSGDVVLV

SEQ ID NO: 1360271 - protein, 25 aa, Mycobacterium
VGGGGPIHLLPDAEWDRVLDVNLKG

SEQ ID NO: 1360272 - protein, 19 aa, Mycobacterium
VGGPGAAAWMSRNGPRFGL

SEQ ID NO: 1360273 - protein, 20 aa, Mycobacterium
VGGPGAAAWMSRNGPRFGLC

SEQ ID NO: 1360274 - protein, 21 aa, Mycobacterium
VGGPGAAAWMSRNGPRFGLCQ

SEQ ID NO: 1360275 - protein, 17 aa, Mycobacterium
VGGTWRINTYPGLACDV

SEQ ID NO: 1360276 - protein, 21 aa, Mycobacterium
VGLLLGLNLPARAVADESLWD

SEQ ID NO: 1360277 - protein, 21 aa, Mycobacterium
VGLSRRYVMVIGSMQPAGDDA

SEQ ID NO: 1360278 - protein, 20 aa, Mycobacterium
VGMIHGAYTEGLPTCVVKYI

SEQ ID NO: 1360279 - protein, 33 aa, Mycobacterium
VGPVKVAGFLGWIAWGLLHIAFLTGVRNRVSTV

SEQ ID NO: 1360280 - protein, 26 aa, Mycobacterium
VGQKATPALPIPFPRTGQGGEPRMTI

SEQ ID NO: 1360281 - protein, 25 aa, Mycobacterium
VGQPATPALPVPYPRTGQGGEPRLT

SEQ ID NO: 1360282 - protein, 24 aa, Mycobacterium
VGQSFASVPMLFAKPRYFAQFGDT

SEQ ID NO: 1360283 - protein, 23 aa, Mycobacterium
VGRVRAIELKNWIATLTLDLEPS

SEQ ID NO: 1360284 - protein, 23 aa, Mycobacterium
VGTGRTGLGPYATRPADVGTAVY

SEQ ID NO: 1360285 - protein, 26 aa, Mycobacterium
VGVTLDRIWWDRPFTVTNVDVGAGHA

SEQ ID NO: 1360286 - protein, 21 aa, Mycobacterium
VGVVGLPAWFLGVGVASAEPV

SEQ ID NO: 1360287 - protein, 20 aa, Mycobacterium
VHAGLYYAPGSLKARLCRRG

SEQ ID NO: 1360288 - protein, 18 aa, Mycobacterium
VHLPGLPVVPRQVSYLPS

SEQ ID NO: 1360289 - protein, 22 aa, Mycobacterium
VHPDFWHEDEFGYRSIYVAYTA

SEQ ID NO: 1360290 - protein, 18 aa, Mycobacterium
VHRTGIYGHSRACAWAIA

SEQ ID NO: 1360291 - protein, 29 aa, Mycobacterium
VHTDLSTCAAWPVLRRRLAVRALSGADPG

SEQ ID NO: 1360292 - protein, 18 aa, Mycobacterium
VHVCGDPPAVALLHVRRR

SEQ ID NO: 1360293 - protein, 19 aa, Mycobacterium
VHVSSFTALFRPDLDVLHA

SEQ ID NO: 1360294 - protein, 38 aa, Mycobacterium
VHWDRVLFCAKEATYKAWFPLTHRWLGFEDAHITFDID

SEQ ID NO: 1360295 - protein, 25 aa, Mycobacterium
VIAHPLDLFVAALIDTLQRNGVPQA

SEQ ID NO: 1360296 - protein, 18 aa, Mycobacterium
VIALPPDWANYGAIIKAF

SEQ ID NO: 1360297 - protein, 28 aa, Mycobacterium
VIASAPHHWFAAPGYPSRGGGHGGPRTR

SEQ ID NO: 1360298 - protein, 17 aa, Mycobacterium
VIAVRYRPDDRQLQVLP

SEQ ID NO: 1360299 - protein, 22 aa, Mycobacterium
VIFNIYTFAVRVLGGPPMLPWG

SEQ ID NO: 1360300 - protein, 17 aa, Mycobacterium
VIHNYRWRLSLAPGESR

SEQ ID NO: 1360301 - protein, 25 aa, Mycobacterium
VIMTLQQIPVISTVLAPLIGTATRQ

SEQ ID NO: 1360302 - protein, 18 aa, Mycobacterium
VIPDKPVAPVNTERARRL

SEQ ID NO: 1360303 - protein, 27 aa, Mycobacterium
VIRDGGGIPSFLGYHGFPASICASVND

SEQ ID NO: 1360304 - protein, 17 aa, Mycobacterium
VISFRDPLLAENDPDVG

SEQ ID NO: 1360305 - protein, 19 aa, Mycobacterium
VISRRGLLMSAATLAVVGV

SEQ ID NO: 1360306 - protein, 21 aa, Mycobacterium
VITADRRPLVWHDPRIESTKC

SEQ ID NO: 1360307 - protein, 22 aa, Mycobacterium
VITAIPQPLRTVARAKGLRLAR

SEQ ID NO: 1360308 - protein, 18 aa, Mycobacterium
VITSLVATVVLWIASTFA

SEQ ID NO: 1360309 - protein, 18 aa, Mycobacterium
VIVKRLSDTPLSRASVVS

SEQ ID NO: 1360310 - protein, 17 aa, Mycobacterium
VIVPSAPVMVPVLASSA

SEQ ID NO: 1360311 - protein, 34 aa, Mycobacterium
VKFTAFGLVMALLTAFLFLVFSDTRTGAANEYTA

SEQ ID NO: 1360312 - protein, 19 aa, Mycobacterium
VKNNKWLEEALPDYNIKWT

SEQ ID NO: 1360313 - protein, 23 aa, Mycobacterium
VKPTLPIVLANLVSVGQVAVTYH

SEQ ID NO: 1360314 - protein, 37 aa, Mycobacterium
VKTTPPVEGAFYWLNNREVRWRPAKYWKPGTTVEVAV

SEQ ID NO: 1360315 - protein, 20 aa, Mycobacterium
VLAEFADKFPTPEKLWTIED

SEQ ID NO: 1360316 - protein, 24 aa, Mycobacterium
VLAGAIVHFSSPGPAPAAPEAPQA

SEQ ID NO: 1360317 - protein, 20 aa, Mycobacterium
VLAHQGEWLRLAVDALIRGG

SEQ ID NO: 1360318 - protein, 30 aa, Mycobacterium
VLAHQGEWLRLAVDALIRGGCGDVVVVLGA

SEQ ID NO: 1360319 - protein, 18 aa, Mycobacterium
VLAIEPMLTLGTAKTIVL

SEQ ID NO: 1360320 - protein, 17 aa, Mycobacterium
VLAVLTAEQLRHAVFPI

SEQ ID NO: 1360321 - protein, 17 aa, Mycobacterium
VLAVLTAQQLRHAVFPI

SEQ ID NO: 1360322 - protein, 24 aa, Mycobacterium
VLGAVLLTALLPLSPSIAPSATAY

SEQ ID NO: 1360323 - protein, 27 aa, Mycobacterium
VLGGGALPFGIFAGGLLTGPELIDPAA

SEQ ID NO: 1360324 - protein, 17 aa, Mycobacterium
VLLGRLDLKLFAGAETD

SEQ ID NO: 1360325 - protein, 20 aa, Mycobacterium
VLMPLDHVVAWAEAPGTLVD

SEQ ID NO: 1360326 - protein, 17 aa, Mycobacterium
VLNALWSAGAEGVQMQD

SEQ ID NO: 1360327 - protein, 22 aa, Mycobacterium
VLNQIPLLRDLLTQGLNVAGLN

SEQ ID NO: 1360328 - protein, 30 aa, Mycobacterium; identical to SEQ ID NO: 1329793

SEQ ID NO: 1360329 - protein, 23 aa, Mycobacterium
VLSMAVVLPLAACSPGLAANPRF

SEQ ID NO: 1360330 - protein, 26 aa, Mycobacterium
VLSNYNNMYYPALGGAASALAVNNFA

SEQ ID NO: 1360331 - protein, 18 aa, Mycobacterium
VLSPFALTAVLIWTARRA

SEQ ID NO: 1360332 - protein, 25 aa, Mycobacterium
VLTDDMLHSWFLDPAIIAPGTPEVR

SEQ ID NO: 1360333 - protein, 19 aa, Mycobacterium
VLTDFLALTKIHGDGWGVA

SEQ ID NO: 1360334 - protein, 17 aa, Mycobacterium
VLVFTDRGWRWGGDWRT

SEQ ID NO: 1360335 - protein, 17 aa, Mycobacterium
VLVSAVLALAGCSVDNG

SEQ ID NO: 1360336 - protein, 17 aa, Mycobacterium
VLVWLLIGVFAAYQRDY

SEQ ID NO: 1360337 - protein, 17 aa, Mycobacterium
VMILTEWKQFVALDPAA

SEQ ID NO: 1360338 - protein, 22 aa, Mycobacterium
VNAAVYAFDAGALRSALSRLQA

SEQ ID NO: 1360339 - protein, 28 aa, Mycobacterium
VNAGSRVTKLWWPQTGAPKLSLTTWQCG

SEQ ID NO: 1360340 - protein, 25 aa, Mycobacterium
VNAPGLITGAFLNGYKPYFGHDEEG

SEQ ID NO: 1360341 - protein, 26 aa, Mycobacterium
VNDGDHIWDLARLAWALRGDIVNVTV

SEQ ID NO: 1360342 - protein, 19 aa, Mycobacterium
VNGGYFCRALPSDFDGWGI

SEQ ID NO: 1360343 - protein, 41 aa, Mycobacterium; identical to SEQ ID NO: 1329871

SEQ ID NO: 1360344 - protein, 18 aa, Mycobacterium
VNGNGTFIYTPTAAARHG

SEQ ID NO: 1360345 - protein, 38 aa, Mycobacterium
VNHFTLPVWVHDPIVARPLIQLGLPAPAAGWLSSNTAE

SEQ ID NO: 1360346 - protein, 23 aa, Mycobacterium
VNNVPPPPALPGPPPPPGPGQQL

SEQ ID NO: 1360347 - protein, 19 aa, Mycobacterium
VNWFFTSLRGLPPDERRAK

SEQ ID NO: 1360348 - protein, 17 aa, Mycobacterium
VPALDYLKEKGIKSLYL

SEQ ID NO: 1360349 - protein, 19 aa, Mycobacterium
VPARIRGHDYRRAAFGDAW

SEQ ID NO: 1360350 - protein, 17 aa, Mycobacterium
VPDRGLGPDALLNAYNA

SEQ ID NO: 1360351 - protein, 18 aa, Mycobacterium
VPGPAPVAPLPGTPALPL

SEQ ID NO: 1360352 - protein, 19 aa, Mycobacterium
VPGVPFLPATLPIPQDLVC

SEQ ID NO: 1360353 - protein, 17 aa, Mycobacterium
VPIMTFPAQAPAQAAAA

SEQ ID NO: 1360354 - protein, 26 aa, Mycobacterium
VPINMAIFGDTLTQAAWRTKPSWAVV

SEQ ID NO: 1360355 - protein, 17 aa, Mycobacterium
VPIRALAAAAVPSAWLA

SEQ ID NO: 1360356 - protein, 18 aa, Mycobacterium
VPLGPDHTYWFATERTRE

SEQ ID NO: 1360357 - protein, 17 aa, Mycobacterium
VPLGTNPWYGDPNQIVA

SEQ ID NO: 1360358 - protein, 19 aa, Mycobacterium
VPLIALVSVLLGIGTAANP

SEQ ID NO: 1360359 - protein, 17 aa, Mycobacterium
VPLYRRNTLGESQVLAL

SEQ ID NO: 1360360 - protein, 17 aa, Mycobacterium
VPPAPRAVGAPAGGSGG

SEQ ID NO: 1360361 - protein, 22 aa, Mycobacterium
VPRRYPFSVAQWQYTYLYQYGG

SEQ ID NO: 1360362 - protein, 33 aa, Mycobacterium
VPSGLVEAIFADGPLGAVAYASLLVSDAVFGAD

SEQ ID NO: 1360363 - protein, 18 aa, Mycobacterium
VPTEWTTGLPAKGSDFIV

SEQ ID NO: 1360364 - protein, 24 aa, Mycobacterium
VPVDREIRLIGRTAQFPKITETIE

SEQ ID NO: 1360365 - protein, 25 aa, Mycobacterium
VQTPTFDVRIPWADEPSLTVAGAKT

SEQ ID NO: 1360366 - protein, 20 aa, Mycobacterium
VQYPSIFDPAMRSLITLGRS

SEQ ID NO: 1360367 - protein, 27 aa, Mycobacterium
VRELVVAWGKMYPQFGTVGALDMVKCL

SEQ ID NO: 1360368 - protein, 22 aa, Mycobacterium
VRPVQSWWWQMVLRWLEIENPA

SEQ ID NO: 1360369 - protein, 30 aa, Mycobacterium
VRQDALRWHPNGLALDVMIPNPTSQAGIAL

SEQ ID NO: 1360370 - protein, 23 aa, Mycobacterium
VRRRDYAYALNWPGQSPMRRSYE

SEQ ID NO: 1360371 - protein, 17 aa, Mycobacterium
VRSVLDRRLAALDPAVV

SEQ ID NO: 1360372 - protein, 22 aa, Mycobacterium
VRTLGHLRRWLAGKADLEPRIA

SEQ ID NO: 1360373 - protein, 18 aa, Mycobacterium
VRTMAAIRWIQRGYRAPT

SEQ ID NO: 1360374 - protein, 32 aa, Mycobacterium
VRVGALRQVVPDSLLFCWTIVREHEHLGDAEL

SEQ ID NO: 1360375 - protein, 17 aa, Mycobacterium
VSGLPPILVISTTNDPA

SEQ ID NO: 1360376 - protein, 22 aa, Mycobacterium
VSHLLDLRGPSVALDAACAASL

SEQ ID NO: 1360377 - protein, 45 aa, Mycobacterium
VSLPAKKWLAERGFDPLYGARPLRRLIQQAIGDQLAKLLLAGDVH

SEQ ID NO: 1360378 - protein, 18 aa, Mycobacterium
VSTPLAIVAAIEGAIDVG

SEQ ID NO: 1360379 - protein, 23 aa, Mycobacterium
VSYPSIFDPAMRSLIALGRGYPT

SEQ ID NO: 1360380 - protein, 24 aa, Mycobacterium
VTAERREWPSPLMPALQAIRDDPA

SEQ ID NO: 1360381 - protein, 26 aa, Mycobacterium
VTDWSDYQAGYFIGAATGAFCPQYEW

SEQ ID NO: 1360382 - protein, 20 aa, Mycobacterium
VTFGMAYMIVDVPNPGDIRT

SEQ ID NO: 1360383 - protein, 30 aa, Mycobacterium; identical to SEQ ID NO: 952156

SEQ ID NO: 1360384 - protein, 29 aa, Mycobacterium
VTFSQPYPAWRELFNNILPAHIVKDVPGG

SEQ ID NO: 1360385 - protein, 18 aa, Mycobacterium
VTFSWFDTGSLQRERDLA

SEQ ID NO: 1360386 - protein, 17 aa, Mycobacterium
VTIPIFGTKTHDIYWVD

SEQ ID NO: 1360387 - protein, 21 aa, Mycobacterium
VTISILPDEAAAKAALDASLT

SEQ ID NO: 1360388 - protein, 22 aa, Mycobacterium
VTPDPGIVLWLGTARGPVHTGY

SEQ ID NO: 1360389 - protein, 37 aa, Mycobacterium
VTTNPPVEGAFYWLNNREVRWRPAEYWKPGTKVEVAV

SEQ ID NO: 1360390 - protein, 25 aa, Mycobacterium
VTTTPPVEGGWAWLPDEAGGSRVHW

SEQ ID NO: 1360391 - protein, 18 aa, Mycobacterium
VVAAFQRDYFKSGDANCA

SEQ ID NO: 1360392 - protein, 24 aa, Mycobacterium
VVALVAAVVWWTSDARATESRPAA

SEQ ID NO: 1360393 - protein, 24 aa, Mycobacterium
VVAVPIAAFGFKSPLPDGVDRHIA

SEQ ID NO: 1360394 - protein, 22 aa, Mycobacterium
VVDTSYFARAWVQWNNTTRTFG

SEQ ID NO: 1360395 - protein, 22 aa, Mycobacterium
VVDVRLSLPPVVALRGGDGVLA

SEQ ID NO: 1360396 - protein, 25 aa, Mycobacterium
VVEGMPAMMSGMMGGGMMGPGMGHG

SEQ ID NO: 1360397 - protein, 27 aa, Mycobacterium
VVGEQYGRALAILKSQGVKAYFGGSTG

SEQ ID NO: 1360398 - protein, 29 aa, Mycobacterium
VVGMLEIDAWIGLPTPTTTPWQIIDVARR

SEQ ID NO: 1360399 - protein, 25 aa, Mycobacterium
VVGYNAELQLWPHDLDKARALIEEA

SEQ ID NO: 1360400 - protein, 17 aa, Mycobacterium
VVLAAVLALLVAYQTVS

SEQ ID NO: 1360401 - protein, 20 aa, Mycobacterium
VVLATCVFLAALTGCSPGDR

SEQ ID NO: 1360402 - protein, 31 aa, Mycobacterium
VVQAPDVALPPTWRLLTSRGPYELPGELHLM

SEQ ID NO: 1360403 - protein, 23 aa, Mycobacterium
VVQGSGELYYLKGALPGPDDGDA

SEQ ID NO: 1360404 - protein, 19 aa, Mycobacterium
VVQQLAMPAPKPGRQMVLD

SEQ ID NO: 1360405 - protein, 20 aa, Mycobacterium
VVRAIEAGLRATGCVAPGLV

SEQ ID NO: 1360406 - protein, 17 aa, Mycobacterium
VVTRFPGAIAELQLSRD

SEQ ID NO: 1360407 - protein, 24 aa, Mycobacterium
VVTRYFTPRFDAVPFRAASAPGSA

SEQ ID NO: 1360408 - protein, 23 aa, Mycobacterium
VVVHPHLAARDRWRTVATPKGDI

SEQ ID NO: 1360409 - protein, 23 aa, Mycobacterium
VVVPKMIYRVGFFRSPKGSSMVT

SEQ ID NO: 1360410 - protein, 29 aa, Mycobacterium
VVYNDGGQDLLLWVQPPPSSTSSSTPRSS

SEQ ID NO: 1360411 - protein, 18 aa, Mycobacterium
VWGDVELAWHLDRSGRFG

SEQ ID NO: 1360412 - protein, 18 aa, Mycobacterium
VWPPMQLSDEVRNRLQSA

SEQ ID NO: 1360413 - protein, 18 aa, Mycobacterium
VWVALQREVKTDPKGVAR

SEQ ID NO: 1360414 - protein, 32 aa, Mycobacterium
VYARDPVRRAMADRLTFVLTGNPLRSDNGKVV

SEQ ID NO: 1360415 - protein, 22 aa, Mycobacterium
VYHQDGMGGYPLLYARPADQQP

SEQ ID NO: 1360416 - protein, 23 aa, Mycobacterium
VYLPGLPVVPRSVAYIPSAAVDA

SEQ ID NO: 1360417 - protein, 17 aa, Mycobacterium
VYPDNLPRINARGGPGG

SEQ ID NO: 1360418 - protein, 17 aa, Mycobacterium
WALFRYDQVFEAARDSA

SEQ ID NO: 1360419 - protein, 35 aa, Mycobacterium
WANYVALDLGPWLLNWVPLGYLISDQIYIWYPDLV

SEQ ID NO: 1360420 - protein, 18 aa, Mycobacterium
WCMDWPAVAAAAAADLPP

SEQ ID NO: 1360421 - protein, 25 aa, Mycobacterium
WDINTPAFEWFYQSGLSTIMPVGGQ

SEQ ID NO: 1360422 - protein, 27 aa, Mycobacterium
WDLLGQQVFFSQLDLTPGPGRGFNPDA

SEQ ID NO: 1360423 - protein, 17 aa, Mycobacterium
WDMTVCHEYYWAHKYDL

SEQ ID NO: 1360424 - protein, 24 aa, Mycobacterium
WDPSVAILGFPFITQAQRRHYDEV

SEQ ID NO: 1360425 - protein, 17 aa, Mycobacterium
WEQPNRLMRLNLADPQA

SEQ ID NO: 1360426 - protein, 17 aa, Mycobacterium
WFLTLNDGQIVKAAAFF

SEQ ID NO: 1360427 - protein, 22 aa, Mycobacterium
WGRLVFCGSPRRYAPRYFRSPP

SEQ ID NO: 1360428 - protein, 19 aa, Mycobacterium
WGRTIGQMPSPYTAGNPLV

SEQ ID NO: 1360429 - protein, 18 aa, Mycobacterium
WGTSPIGSAVFLVDYLMN

SEQ ID NO: 1360430 - protein, 17 aa, Mycobacterium
WGYSVLVALDRSPMRTQ

SEQ ID NO: 1360431 - protein, 21 aa, Mycobacterium
WHTTFPLPAPSAWPAERDRRE

SEQ ID NO: 1360432 - protein, 18 aa, Mycobacterium
WIELLGGGRGATLAARWG

SEQ ID NO: 1360433 - protein, 26 aa, Mycobacterium
WIPNQWPPIYTGFWQTSYPLVGVRDI

SEQ ID NO: 1360434 - protein, 18 aa, Mycobacterium
WIVVLDDWTDGIGSSPQQ

SEQ ID NO: 1360435 - protein, 21 aa, Mycobacterium
WLLHIVSITVLFAVGGCHTEG

SEQ ID NO: 1360436 - protein, 22 aa, Mycobacterium
WLPLLIVVVVAIAGLTVARIRT

SEQ ID NO: 1360437 - protein, 17 aa, Mycobacterium
WLVGGQLWDWMSAGLSA

SEQ ID NO: 1360438 - protein, 21 aa, Mycobacterium
WMRGDYANLTLILDLTLSRID

SEQ ID NO: 1360439 - protein, 18 aa, Mycobacterium
WMTRRRALAALAVGVVAP

SEQ ID NO: 1360440 - protein, 24 aa, Mycobacterium
WNVMSSHRLSPPRAALAAAAAFVS

SEQ ID NO: 1360441 - protein, 23 aa, Mycobacterium
WNYAHTNYVLLGLALEKATGETM

SEQ ID NO: 1360442 - protein, 17 aa, Mycobacterium
WPAIGDWLADRSADTAV

SEQ ID NO: 1360443 - protein, 19 aa, Mycobacterium
WPVVVGGSLSFAVASAGVL

SEQ ID NO: 1360444 - protein, 20 aa, Mycobacterium
WQIIDVARRWDGWADWPDDS

SEQ ID NO: 1360445 - protein, 25 aa, Mycobacterium
WQKVTRELWPHPYLVMDTGYSLAPY

SEQ ID NO: 1360446 - protein, 23 aa, Mycobacterium
WRFATYVADRYGPERLRALYLRA

SEQ ID NO: 1360447 - protein, 21 aa, Mycobacterium
WSRRSFLAATVAAGATLAACT

SEQ ID NO: 1360448 - protein, 20 aa, Mycobacterium
WSVSGPLDTGALTEGLRLIS

SEQ ID NO: 1360449 - protein, 20 aa, Mycobacterium
WTAHGRWLRAPVDGIFWAGT

SEQ ID NO: 1360450 - protein, 23 aa, Mycobacterium
WTDYQAGVFIGAATGAFCPQFEY

SEQ ID NO: 1360451 - protein, 35 aa, Mycobacterium
WTEGNTTYVFIPTSQLPLLQGLRTLGLDALADQWE

SEQ ID NO: 1360452 - protein, 18 aa, Mycobacterium
WTISGLKPSSDVIPWHVR

SEQ ID NO: 1360453 - protein, 17 aa, Mycobacterium
WTTGLPAKGSDFIVCSQ

SEQ ID NO: 1360454 - protein, 26 aa, Mycobacterium
WTVPRTSIRPSWFNTVPGVQFVWGDQ

SEQ ID NO: 1360455 - protein, 20 aa, Mycobacterium
WTWAAFASTVFQRWAAVEQR

SEQ ID NO: 1360456 - protein, 17 aa, Mycobacterium
WVDRRYNDVLRPLLIST

SEQ ID NO: 1360457 - protein, 20 aa, Mycobacterium
WVEQTAVIYPAARNAQDFFD

SEQ ID NO: 1360458 - protein, 26 aa, Mycobacterium
WVLDSRQQKWVLIPAPDAVATNTAGD

SEQ ID NO: 1360459 - protein, 18 aa, Mycobacterium
WYRWVHDPVNRLLGLVKG

SEQ ID NO: 1360460 - protein, 21 aa, Mycobacterium
YADLLVPKLQASVTDGAIGVP

SEQ ID NO: 1360461 - protein, 20 aa, Mycobacterium
YALLRSGDYGGPPFGGPVFT

SEQ ID NO: 1360462 - protein, 24 aa, Mycobacterium
YAQPVYDPALARPGIHFDPEPIED

SEQ ID NO: 1360463 - protein, 19 aa, Mycobacterium
YATPHQHRRHLPAPVGLHG

SEQ ID NO: 1360464 - protein, 20 aa, Mycobacterium
YAVLECGPSIYDCQQRSVKK

SEQ ID NO: 1360465 - protein, 22 aa, Mycobacterium
YAYLTGLVEELLGRALPSVERR

SEQ ID NO: 1360466 - protein, 29 aa, Mycobacterium
YCVVDARAWLRDPAPLWRTNVEGLQRVLD

SEQ ID NO: 1360467 - protein, 21 aa, Mycobacterium
YDAEWVVLLDDWTDGVGSSPA

SEQ ID NO: 1360468 - protein, 29 aa, Mycobacterium
YDGLADFPDRWWNALAVANAIAGSIYVHV

SEQ ID NO: 1360469 - protein, 20 aa, Mycobacterium
YDMNSGLYPAIGYANASQLP

SEQ ID NO: 1360470 - protein, 18 aa, Mycobacterium
YEARLLKEQFYSTAWDTL

SEQ ID NO: 1360471 - protein, 24 aa, Mycobacterium
YEARLLKEQFYSTAWDTLDPLALL

SEQ ID NO: 1360472 - protein, 18 aa, Mycobacterium
YEPGLPEVLRKNIDAGRL

SEQ ID NO: 1360473 - protein, 24 aa, Mycobacterium
YEQVATRWGNWAKLFFNNKGVVAH

SEQ ID NO: 1360474 - protein, 20 aa, Mycobacterium
YFALIRQHRRSAPDLVESVR

SEQ ID NO: 1360475 - protein, 18 aa, Mycobacterium
YFGGLQFKPSTWAEHGGR

SEQ ID NO: 1360476 - protein, 33 aa, Mycobacterium
YFGIPTTWLPPNYWGPPLRVVFNPNWTAWGVWV

SEQ ID NO: 1360477 - protein, 18 aa, Mycobacterium
YFNALYSAQFPLDGCPPA

SEQ ID NO: 1360478 - protein, 17 aa, Mycobacterium
YGAIIYNGPGAGEYSPN

SEQ ID NO: 1360479 - protein, 26 aa, Mycobacterium
YGATKAALLALTKYTATQYGRERVRC

SEQ ID NO: 1360480 - protein, 23 aa, Mycobacterium
YGEQQVVPFFLGPQGIADAISAA

SEQ ID NO: 1360481 - protein, 28 aa, Mycobacterium
YGLEPNGTMRPILRRRVITGLTVAQFFP

SEQ ID NO: 1360482 - protein, 24 aa, Mycobacterium
YGLFAERGLTDRVTWIGSAKLGLP

SEQ ID NO: 1360483 - protein, 19 aa, Mycobacterium
YGLRLNAMQAEWARSVIDR

SEQ ID NO: 1360484 - protein, 25 aa, Mycobacterium
YGMTKGAVASFTRGLARDLGASGIT

SEQ ID NO: 1360485 - protein, 18 aa, Mycobacterium
YGVFRLRDGSPIPALGPG

SEQ ID NO: 1360486 - protein, 18 aa, Mycobacterium
YGWVFFTTPDGRACGIGP

SEQ ID NO: 1360487 - protein, 29 aa, Mycobacterium
YHAYGRAIDLNPLLNPYIGGSGAVEPANA

SEQ ID NO: 1360488 - protein, 26 aa, Mycobacterium
YHDNIEQLLVLFPAVVSAEQAGLVAN

SEQ ID NO: 1360489 - protein, 31 aa, Mycobacterium
YHRDRFCGHLLLHPLSAPMTLRWLRDRFTDR

SEQ ID NO: 1360490 - protein, 26 aa, Mycobacterium
YIDEWSLPIQYKFTLNGARWSGAVDG

SEQ ID NO: 1360491 - protein, 18 aa, Mycobacterium
YLAVFDDHTEEILYFGRA

SEQ ID NO: 1360492 - protein, 31 aa, Mycobacterium; identical to SEQ ID NO: 1305355

SEQ ID NO: 1360493 - protein, 17 aa, Mycobacterium
YLDHCWGAETFAPGGPT

SEQ ID NO: 1360494 - protein, 33 aa, Mycobacterium
YLGPALRLLNFNNIPLPINAYLRPAVNPERIIY

SEQ ID NO: 1360495 - protein, 31 aa, Mycobacterium
YLGPALRSIPIHNLPFPINAYLRPAVSPERT

SEQ ID NO: 1360496 - protein, 19 aa, Mycobacterium
YLGRAKRCATTAQRLALFA

SEQ ID NO: 1360497 - protein, 17 aa, Mycobacterium
YLHQLSNTEFRQTRHAD

SEQ ID NO: 1360498 - protein, 21 aa, Mycobacterium
YLTLERARFGTALKVTLQVAP

SEQ ID NO: 1360499 - protein, 26 aa, Mycobacterium
YLTSLGWTMAGLPRTDLFAKHGVPMV

SEQ ID NO: 1360500 - protein, 34 aa, Mycobacterium
YMAPIFKNRQYNFPPLGFNFFVGAQARPNEITYS

SEQ ID NO: 1360501 - protein, 47 aa, Mycobacterium
YMGDALVFNLNLAIPLLPAPIPLPPQQLPPPCTTGFLPAQQRRVPTF

SEQ ID NO: 1360502 - protein, 22 aa, Mycobacterium
YNKALQILRAQGVKATFGGSFG

SEQ ID NO: 1360503 - protein, 24 aa, Mycobacterium
YNYQWETFLTSELPAYLAANKGIS

SEQ ID NO: 1360504 - protein, 23 aa, Mycobacterium
YPDPMIYAPVTGFYSLSYSSTGL

SEQ ID NO: 1360505 - protein, 37 aa, Mycobacterium
YPGAPPYGAALYGPGGTPLWPGLPPAPPPPTQEGAPA

SEQ ID NO: 1360506 - protein, 26 aa, Mycobacterium
YPTGREWIDRYLAPLSAALDGHVRFD

SEQ ID NO: 1360507 - protein, 18 aa, Mycobacterium
YQAMRPKILSAHYSGYRV

SEQ ID NO: 1360508 - protein, 25 aa, Mycobacterium
YQGNNYWWGGNLMGVKDRPIVLNVP

SEQ ID NO: 1360509 - protein, 20 aa, Mycobacterium
YQNLPLVNQVNSYSAYFADA

SEQ ID NO: 1360510 - protein, 23 aa, Mycobacterium
YRAVFAALRRRGLDPFVTVNHFT

SEQ ID NO: 1360511 - protein, 21 aa, Mycobacterium
YRLSSLRWWPDRTLTRRGLEV

SEQ ID NO: 1360512 - protein, 17 aa, Mycobacterium
YRMRVIIHEDDNGHMTA

SEQ ID NO: 1360513 - protein, 25 aa, Mycobacterium
YRPEQRTFFIWEGVTQYLSPEAVHA

SEQ ID NO: 1360514 - protein, 21 aa, Mycobacterium
YRVKSVLLVEITFCAFPASVP

SEQ ID NO: 1360515 - protein, 24 aa, Mycobacterium
YSEDWLRPDFVPPAAPPADQPQAV

SEQ ID NO: 1360516 - protein, 26 aa, Mycobacterium
YSEDWLRPDYVPPQSPPPPADVRPAV

SEQ ID NO: 1360517 - protein, 21 aa, Mycobacterium
YSLNKLMPPFIKSTTSNAIAV

SEQ ID NO: 1360518 - protein, 17 aa, Mycobacterium
YSVLMSRYLQAVQREQG

SEQ ID NO: 1360519 - protein, 29 aa, Mycobacterium
YSVSTQGRFRFLRVYPDPMIYAPVTGFYS

SEQ ID NO: 1360520 - protein, 27 aa, Mycobacterium
YTGPPAPFAVWGFRGSPVTDPAPCAAL

SEQ ID NO: 1360521 - protein, 24 aa, Mycobacterium
YTLDGALRSLPPRTYALAGAADEQ

SEQ ID NO: 1360522 - protein, 18 aa, Mycobacterium
YTLDRFYPGDVVDVTWID

SEQ ID NO: 1360523 - protein, 19 aa, Mycobacterium
YTLDYVYHQDGMGGYPLLY

SEQ ID NO: 1360524 - protein, 28 aa, Mycobacterium
YTLTVYVALVGIYKRFQEMAALTTFTTW

SEQ ID NO: 1360525 - protein, 17 aa, Mycobacterium
YTSLISAKTFWGNAGAT

SEQ ID NO: 1360526 - protein, 19 aa, Mycobacterium
YTTRQLLSALLMVSGNDAA

SEQ ID NO: 1360527 - protein, 20 aa, Mycobacterium
YTTRQLLSALLMVSGNDAAN

SEQ ID NO: 1360528 - protein, 22 aa, Mycobacterium
YTYKWETFLSQELPAWLEANRG

SEQ ID NO: 1360529 - protein, 24 aa, Mycobacterium
YTYQWETFLTAELPAYLAANKGIS

SEQ ID NO: 1360530 - protein, 18 aa, Mycobacterium
YVDHVTWAKWGDLSSLRV

SEQ ID NO: 1360531 - protein, 18 aa, Mycobacterium
YVLGGPVSRRYAGYVNYN

SEQ ID NO: 1360532 - protein, 31 aa, Mycobacterium
YVLTHEDDLPMFRYWWGVPSDFESVVRAEVE

SEQ ID NO: 1360533 - protein, 18 aa, Mycobacterium
YVMANAERFGIQDAIWRG

SEQ ID NO: 1360534 - protein, 25 aa, Mycobacterium
YVTNAFFNGFVPPFPTRSTFPGVFS

SEQ ID NO: 1360535 - protein, 18 aa, Mycobacterium
YWVNDTQLRWRPQDFWPA

SEQ ID NO: 1360536 - protein, 26 aa, Mycobacterium
MAFAYLRLPSLLFGVGRYQVTMKLQD

SEQ ID NO: 1360537 - protein, 18 aa, Mycobacterium
TLVLPFPVELLRFLERST

SEQ ID NO: 1360538 - protein, 19 aa, Mycobacterium
WNLPAVFGPIAITYNLEGV

SEQ ID NO: 1360539 - protein, 24 aa, Mycobacterium
AAGTILGGGLLFTAGLGLANAQPV

SEQ ID NO: 1360540 - protein, 24 aa, Mycobacterium
AANGPWDFIPTIQVPQIPGLPVPL

SEQ ID NO: 1360541 - protein, 24 aa, Mycobacterium
AAPPQLLFSTIFTPLIRLTNGTAN

SEQ ID NO: 1360542 - protein, 23 aa, Mycobacterium
AATLLIYTHGPALVRLHFESAPG

SEQ ID NO: 1360543 - protein, 26 aa, Mycobacterium
ACPVTWPWNLLGWPSINVPAGFTADG

SEQ ID NO: 1360544 - protein, 17 aa, Mycobacterium
AFRLLQRRALRPPVAID

SEQ ID NO: 1360545 - protein, 26 aa, Mycobacterium
AHWQTAAVLFGLWWIGAEALVGGPSD

SEQ ID NO: 1360546 - protein, 21 aa, Mycobacterium
AIVLTQNVIQLGVIPAENGTA

SEQ ID NO: 1360547 - protein, 20 aa, Mycobacterium
ALNPPSYHYFQLIDRLRVTL

SEQ ID NO: 1360548 - protein, 22 aa, Mycobacterium
AQALIAVLLAAAMFVAGCSSSS

SEQ ID NO: 1360549 - protein, 23 aa, Mycobacterium
ARDRIYWFFSLDYTARRQYSENT

SEQ ID NO: 1360550 - protein, 24 aa, Mycobacterium
ARRWGVLHVIWRQGFYPGIGAPSW

SEQ ID NO: 1360551 - protein, 24 aa, Mycobacterium
ASPLVTLYKQYVVRFGLGYTEEPR

SEQ ID NO: 1360552 - protein, 18 aa, Mycobacterium
AVFDRLLPGAPTPGAPGA

SEQ ID NO: 1360553 - protein, 17 aa, Mycobacterium
AVPAHWSTAAVAALRAV

SEQ ID NO: 1360554 - protein, 21 aa, Mycobacterium
AVTIMVLIVLLLGNATVTQVF

SEQ ID NO: 1360555 - protein, 17 aa, Mycobacterium
AWLFIQWATGKESMNKA

SEQ ID NO: 1360556 - protein, 25 aa, Mycobacterium
DERNPLPPPWYPQPGPPPAPAPGVI

SEQ ID NO: 1360557 - protein, 23 aa, Mycobacterium
DGLPLVRPLRLLPGGDIVADAIE

SEQ ID NO: 1360558 - protein, 18 aa, Mycobacterium
DLNNLYWNMSLWGDYNVV

SEQ ID NO: 1360559 - protein, 21 aa, Mycobacterium
DRPNAGLLLGNGYSYTATTCP

SEQ ID NO: 1360560 - protein, 21 aa, Mycobacterium
EIALLPVTKFFPASDIRILYG

SEQ ID NO: 1360561 - protein, 18 aa, Mycobacterium
EMLILVIAGLVILGPERL

SEQ ID NO: 1360562 - protein, 19 aa, Mycobacterium
EPKDLPVPVLLLGVQNDPI

SEQ ID NO: 1360563 - protein, 17 aa, Mycobacterium
ERMLRVQYFLIPEGRRD

SEQ ID NO: 1360564 - protein, 27 aa, Mycobacterium
ESALKPLIRALIRNLPKPLGKEGGLID

SEQ ID NO: 1360565 - protein, 18 aa, Mycobacterium
FHCQYAMQFIAVLRGYGL

SEQ ID NO: 1360566 - protein, 18 aa, Mycobacterium
FLCRAALPHLLETGGSIV

SEQ ID NO: 1360567 - protein, 18 aa, Mycobacterium
FLGVGLLDRDVPPSSTLS

SEQ ID NO: 1360568 - protein, 26 aa, Mycobacterium
GAGSTFYLPVFAPGALFYVGDPHMAM

SEQ ID NO: 1360569 - protein, 22 aa, Mycobacterium
GDAWRLGWSPALLHPDLKPGMK

SEQ ID NO: 1360570 - protein, 17 aa, Mycobacterium
GDLAIVRAIIALAAAFG

SEQ ID NO: 1360571 - protein, 26 aa, Mycobacterium
GDMDRVTLFRAWYSRGNFGQLAGAAE

SEQ ID NO: 1360572 - protein, 23 aa, Mycobacterium
GGGFWTTYSPFAPLLLTSADPTP

SEQ ID NO: 1360573 - protein, 17 aa, Mycobacterium
GIGQYIDFGPFGGAGAP

SEQ ID NO: 1360574 - protein, 17 aa, Mycobacterium
GLTGRLLDRFQPEATAR

SEQ ID NO: 1360575 - protein, 17 aa, Mycobacterium
GPVAVLFFDLDRLKAVN

SEQ ID NO: 1360576 - protein, 18 aa, Mycobacterium
GRPGPVAVLFFDLDRLKA

SEQ ID NO: 1360577 - protein, 21 aa, Mycobacterium
GVALFLAILIATSLSMVFGEL

SEQ ID NO: 1360578 - protein, 23 aa, Mycobacterium
HGADSSFLAPNPRAGGDGTNGGD

SEQ ID NO: 1360579 - protein, 21 aa, Mycobacterium
HPELRPLVDLLPIAGGSGTLS

SEQ ID NO: 1360580 - protein, 17 aa, Mycobacterium
HVWDLARLGWALRGDLT

SEQ ID NO: 1360581 - protein, 25 aa, Mycobacterium
IGAVALTLALLPALRAAPDGQVVFI

SEQ ID NO: 1360582 - protein, 18 aa, Mycobacterium
ILDALKFNFPPFGLNQIS

SEQ ID NO: 1360583 - protein, 17 aa, Mycobacterium
ILVRAEHLPLLQPIRDL

SEQ ID NO: 1360584 - protein, 22 aa, Mycobacterium
IPTTWLPPNYWGPPLRVVFNPN

SEQ ID NO: 1360585 - protein, 19 aa, Mycobacterium
IVLGLPDRGPYLVRAQSGD

SEQ ID NO: 1360586 - protein, 24 aa, Mycobacterium
KGPFQMILRLYWPKPDALNGTWKA

SEQ ID NO: 1360587 - protein, 28 aa, Mycobacterium
KHDAFMLGAYFIWQYGPPGWIEDLNPWL

SEQ ID NO: 1360588 - protein, 18 aa, Mycobacterium
LIALLCVLPIAVAPAPGV

SEQ ID NO: 1360589 - protein, 24 aa, Mycobacterium
LKDISLYLNFDMLGSPNPGYFTYD

SEQ ID NO: 1360590 - protein, 19 aa, Mycobacterium
LLVALTFAGGYAVAAHKTV

SEQ ID NO: 1360591 - protein, 17 aa, Mycobacterium
LLVGAWAYQTAHRLDRL

SEQ ID NO: 1360592 - protein, 18 aa, Mycobacterium
LLVIVLLVGAWAYQTAHR

SEQ ID NO: 1360593 - protein, 23 aa, Mycobacterium
LPSLPSPAWALSALLALGSRREL

SEQ ID NO: 1360594 - protein, 18 aa, Mycobacterium
LPTLFVLSAVVLVAACTL

SEQ ID NO: 1360595 - protein, 18 aa, Mycobacterium
LTADFRLFPPPQAIPDLT

SEQ ID NO: 1360596 - protein, 26 aa, Mycobacterium
MGLPRIPLPEFTLPRPAPPSSTPAPA

SEQ ID NO: 1360597 - protein, 17 aa, Mycobacterium
MLLVFELTGQFDPAEAI

SEQ ID NO: 1360598 - protein, 28 aa, Mycobacterium
NALYTPRLWAYLTSGLLGLQRGTDPGDL

SEQ ID NO: 1360599 - protein, 26 aa, Mycobacterium
NFLADKVVRWWLPERWTFVDEIPRTS

SEQ ID NO: 1360600 - protein, 21 aa, Mycobacterium
NLNGPFFLCRAALPHLLETGG

SEQ ID NO: 1360601 - protein, 22 aa, Mycobacterium
NSRNKLPAWLFIQWATGKESMN

SEQ ID NO: 1360602 - protein, 24 aa, Mycobacterium
NTICPGFFDCHVHFSLPGAGATPI

SEQ ID NO: 1360603 - protein, 17 aa, Mycobacterium
NVTAWRFLSPPSAFLEG

SEQ ID NO: 1360604 - protein, 24 aa, Mycobacterium
PAVHSLALLQPLAARYLDIITGRV

SEQ ID NO: 1360605 - protein, 23 aa, Mycobacterium
PAVLLNPLRWYPMASAAGGALTV

SEQ ID NO: 1360606 - protein, 19 aa, Mycobacterium
QFPMGLGLVSQFFGRYFTP

SEQ ID NO: 1360607 - protein, 21 aa, Mycobacterium
QLLRVVSLSTVALVLAGCAPG

SEQ ID NO: 1360608 - protein, 20 aa, Mycobacterium
QLPITLFAIGVLSPIYAGFV

SEQ ID NO: 1360609 - protein, 18 aa, Mycobacterium
QTIVLRRSRPLDISLDGQ

SEQ ID NO: 1360610 - protein, 24 aa, Mycobacterium
RADLTVPLPFPLPTLPNPVTPKAF

SEQ ID NO: 1360611 - protein, 17 aa, Mycobacterium
RGLLLVALLTFAVSAAH

SEQ ID NO: 1360612 - protein, 23 aa, Mycobacterium
RLKTDAPLLTSILTYHVVPGQAG

SEQ ID NO: 1360613 - protein, 23 aa, Mycobacterium
RRATWLLALLMATASLSASAGAG

SEQ ID NO: 1360614 - protein, 19 aa, Mycobacterium
RSLVFPVKRLADLGFKVLA

SEQ ID NO: 1360615 - protein, 17 aa, Mycobacterium
RWAALLVSVTLALTACG

SEQ ID NO: 1360616 - protein, 21 aa, Mycobacterium
SDAIFLLTQRPLDPAATPPPG

SEQ ID NO: 1360617 - protein, 23 aa, Mycobacterium
SGGLLSRLKPLFGLGLGARLGNG

SEQ ID NO: 1360618 - protein, 21 aa, Mycobacterium
SLFFTAIAATLVLLPWAVNGL

SEQ ID NO: 1360619 - protein, 23 aa, Mycobacterium
SVSLPFQLGFARVYRVFAERNLH

SEQ ID NO: 1360620 - protein, 19 aa, Mycobacterium
SWRVNCLGPFLGIQAVLEH

SEQ ID NO: 1360621 - protein, 18 aa, Mycobacterium
SYHYFQLIDRLRVTLHNG

SEQ ID NO: 1360622 - protein, 23 aa, Mycobacterium
TDLDYYHVFLGLLGPADVKGQRA

SEQ ID NO: 1360623 - protein, 18 aa, Mycobacterium
TLYSPNLWRYLTQGLTEL

SEQ ID NO: 1360624 - protein, 27 aa, Mycobacterium
TMLQSGRFQLTWKPEFPYIALAVIAKQ

SEQ ID NO: 1360625 - protein, 24 aa, Mycobacterium
TVSGQLTLLIPFIDKIRARVDLRE

SEQ ID NO: 1360626 - protein, 24 aa, Mycobacterium
VDGGVIYHYYWFRDQSKTKEISGN

SEQ ID NO: 1360627 - protein, 19 aa, Mycobacterium
VDGPALSGFFGVVQLGSTE

SEQ ID NO: 1360628 - protein, 19 aa, Mycobacterium
VELFQAPWWVPFKQADRAR

SEQ ID NO: 1360629 - protein, 17 aa, Mycobacterium
VFMGPLLTLLGRPKVQG

SEQ ID NO: 1360630 - protein, 17 aa, Mycobacterium
VIQAWTPALSGYEARRD

SEQ ID NO: 1360631 - protein, 17 aa, Mycobacterium
VLPPFLSRKHLPSRLAR

SEQ ID NO: 1360632 - protein, 27 aa, Mycobacterium
VPAGWYSEPWWKPALVAGAWGLGSVLL

SEQ ID NO: 1360633 - protein, 17 aa, Mycobacterium
VVPGLTGRLLDRFQPEA

SEQ ID NO: 1360634 - protein, 23 aa, Mycobacterium
WYALYRKWLTVLGPAPAPPVARY

SEQ ID NO: 1360635 - protein, 17 aa, Mycobacterium
YLNFDMLGSTNAGYFTY

SEQ ID NO: 1360636 - protein, 18 aa, Mycobacterium
YMNQFIIFDFTIPRLKRG

SEQ ID NO: 1360637 - protein, 19 aa, Mycobacterium
YPVLVRPSYVLGGRGMEIV

SEQ ID NO: 1360638 - protein, 24 aa, Mycobacterium
AALNHLTPRRLLLPMLGRAHPGMK

SEQ ID NO: 1360639 - protein, 28 aa, Mycobacterium
AAPRRMRPLLAVLLVALATAAALIVGTS

SEQ ID NO: 1360640 - protein, 17 aa, Mycobacterium
ACWIVQLFNPATAIADP

SEQ ID NO: 1360641 - protein, 22 aa, Mycobacterium
ADDFVAPRFLPQDPDYAALTCE

SEQ ID NO: 1360642 - protein, 22 aa, Mycobacterium
ADQIPPGYIPPAGITGPMAPEI

SEQ ID NO: 1360643 - protein, 18 aa, Mycobacterium
AFPRTQWIRWRKPVIGAP

SEQ ID NO: 1360644 - protein, 19 aa, Mycobacterium
AGPALAFWLTRNGYRVVVV

SEQ ID NO: 1360645 - protein, 20 aa, Mycobacterium
AIIHLAAVIPPPIYRNPKVA

SEQ ID NO: 1360646 - protein, 22 aa, Mycobacterium
AKALTQQLFWLAGPQVAAVATE

SEQ ID NO: 1360647 - protein, 22 aa, Mycobacterium
ALVAAALLAAPFGLAWYLHVRG

SEQ ID NO: 1360648 - protein, 18 aa, Mycobacterium
AMNGTWYAFGAPGGLTCV

SEQ ID NO: 1360649 - protein, 22 aa, Mycobacterium
APLAWRTALWFWTTQKAAAAAT

SEQ ID NO: 1360650 - protein, 20 aa, Mycobacterium
AVILGLLRALPGDLSILYPS

SEQ ID NO: 1360651 - protein, 23 aa, Mycobacterium
DASRPVFGFAPYPGVQPGDPARV

SEQ ID NO: 1360652 - protein, 20 aa, Mycobacterium
DIWDWAVPWEEWKSMSALSD

SEQ ID NO: 1360653 - protein, 20 aa, Mycobacterium
DRREAIAHAVRWARPGDVVL

SEQ ID NO: 1360654 - protein, 23 aa, Mycobacterium
DVLDIPFYVWDFADRFKEDVIDD

SEQ ID NO: 1360655 - protein, 29 aa, Mycobacterium
DYVLSLGWFPIPLPPLPTPPLPRLASESA

SEQ ID NO: 1360656 - protein, 23 aa, Mycobacterium
ECSQAGWTWLISDFGEETPGFSA

SEQ ID NO: 1360657 - protein, 18 aa, Mycobacterium
ELAGIPLLDLLDTDLRAA

SEQ ID NO: 1360658 - protein, 18 aa, Mycobacterium
ELVALNPELWITMASAMC

SEQ ID NO: 1360659 - protein, 31 aa, Mycobacterium
FIKSLEFLPTFPFHYTYLRNAVRGDYLNVFT

SEQ ID NO: 1360660 - protein, 19 aa, Mycobacterium
FLEYLDMFYNLGLAGRAMR

SEQ ID NO: 1360661 - protein, 18 aa, Mycobacterium
FRYFRAMRTYLGALPVTM

SEQ ID NO: 1360662 - protein, 17 aa, Mycobacterium
GEASPLWRAGLWGDAIP

SEQ ID NO: 1360663 - protein, 23 aa, Mycobacterium
GGHAGLLSIYGTGGAGGAGGIGA

SEQ ID NO: 1360664 - protein, 17 aa, Mycobacterium
GHYREHLPRWVDGRVAL

SEQ ID NO: 1360665 - protein, 23 aa, Mycobacterium
GIAAALPIFRRQGHGHFVTTVST

SEQ ID NO: 1360666 - protein, 22 aa, Mycobacterium
GLDARAWRLPWVAGTTLFEIDH

SEQ ID NO: 1360667 - protein, 18 aa, Mycobacterium
GMLFGYAGDGGIGGAAGS

SEQ ID NO: 1360668 - protein, 24 aa, Mycobacterium
GPALRLLNFNYLPMPINAYLKKSP

SEQ ID NO: 1360669 - protein, 20 aa, Mycobacterium
GPAWKVLRDLPLRPGDRHTV

SEQ ID NO: 1360670 - protein, 31 aa, Mycobacterium
HRRKAEGPRVLPVSGWLSAGAVTVAMGAAMI

SEQ ID NO: 1360671 - protein, 25 aa, Mycobacterium
IGWDTPIVSKLPWFALSDPAVTQMV

SEQ ID NO: 1360672 - protein, 17 aa, Mycobacterium
ILTVLIAAASVGLAVVL

SEQ ID NO: 1360673 - protein, 18 aa, Mycobacterium
ILWADMPTLPLYRQQRTL

SEQ ID NO: 1360674 - protein, 22 aa, Mycobacterium
IVFAATFVWIALLQYGLFAIDR

SEQ ID NO: 1360675 - protein, 19 aa, Mycobacterium
IVVLSLWEPGADKPVLVGL

SEQ ID NO: 1360676 - protein, 23 aa, Mycobacterium
KESYPVLWQIASPAGIPAATLAQ

SEQ ID NO: 1360677 - protein, 21 aa, Mycobacterium
KGKVRVIIPARWNFLNVVRPL

SEQ ID NO: 1360678 - protein, 20 aa, Mycobacterium
KPITNGLTYPFTFAFERSGE

SEQ ID NO: 1360679 - protein, 17 aa, Mycobacterium
KSLWCGIGGLIPFAKSG

SEQ ID NO: 1360680 - protein, 17 aa, Mycobacterium
LAALLAPLAPAGADPGV

SEQ ID NO: 1360681 - protein, 19 aa, Mycobacterium
LAAQIIWTLNRAGINGPYV

SEQ ID NO: 1360682 - protein, 17 aa, Mycobacterium
LIALVPVVAFGVLLSAV

SEQ ID NO: 1360683 - protein, 20 aa, Mycobacterium
LLSLAALVTALLLAGCSSPE

SEQ ID NO: 1360684 - protein, 17 aa, Mycobacterium
LPAKPFPKACPAPGVMQ

SEQ ID NO: 1360685 - protein, 18 aa, Mycobacterium
LSVLSVVLAALLALVGPF

SEQ ID NO: 1360686 - protein, 18 aa, Mycobacterium
LTMLLVAFVLLAGGGSPA

SEQ ID NO: 1360687 - protein, 17 aa, Mycobacterium
MNPLAWANAALGFIYVH

SEQ ID NO: 1360688 - protein, 19 aa, Mycobacterium
NSGWLYTWALGIPKGAKNP

SEQ ID NO: 1360689 - protein, 22 aa, Mycobacterium
PAPWVPPWMAPPPAPQPSCVVF

SEQ ID NO: 1360690 - protein, 18 aa, Mycobacterium
PCAYIQRYLTVAVKYQLP

SEQ ID NO: 1360691 - protein, 17 aa, Mycobacterium
PCVNIMQQLLTVPGRLP

SEQ ID NO: 1360692 - protein, 17 aa, Mycobacterium
PDTYRVMLRQGLYGNYF

SEQ ID NO: 1360693 - protein, 17 aa, Mycobacterium
PEWEVLRPSWFMQNFTG

SEQ ID NO: 1360694 - protein, 19 aa, Mycobacterium
PLMSELVPRLLFVHAHPDD

SEQ ID NO: 1360695 - protein, 25 aa, Mycobacterium
PLRRPDLLRVFLLGELTPVAARRYA

SEQ ID NO: 1360696 - protein, 18 aa, Mycobacterium
PPGVFPPLEGAAAVFDRL

SEQ ID NO: 1360697 - protein, 26 aa, Mycobacterium
PRRQRAWWAGMLVVPAMVLGLTSCSS

SEQ ID NO: 1360698 - protein, 17 aa, Mycobacterium
QLLTVPGRLPQTLPGAN

SEQ ID NO: 1360699 - protein, 18 aa, Mycobacterium
QMWGDAVFHCPFCHGWEV

SEQ ID NO: 1360700 - protein, 24 aa, Mycobacterium
QRTPERWFVVWLGSATNPVDREAA

SEQ ID NO: 1360701 - protein, 20 aa, Mycobacterium
RALAVIVLAVVLLTACGVTR

SEQ ID NO: 1360702 - protein, 18 aa, Mycobacterium
RFAVWLIFELLAVTLVDA

SEQ ID NO: 1360703 - protein, 20 aa, Mycobacterium
RRLLLWSAPLTLAVILVAVK

SEQ ID NO: 1360704 - protein, 23 aa, Mycobacterium
RTVVLNLWAYWCGPCADELPAMA

SEQ ID NO: 1360705 - protein, 24 aa, Mycobacterium
SGSGPAYFFLMVEALVDAAVASGL

SEQ ID NO: 1360706 - protein, 24 aa, Mycobacterium
SGYAGWVAWGLLHIAFLTGVSNRI

SEQ ID NO: 1360707 - protein, 25 aa, Mycobacterium
TAMKWMQRWPLRPIASRLWFRTADA

SEQ ID NO: 1360708 - protein, 22 aa, Mycobacterium
TEPALDLDLLLGGLKPVIRGLN

SEQ ID NO: 1360709 - protein, 17 aa, Mycobacterium
TGWHRLEYLLFSQNTTE

SEQ ID NO: 1360710 - protein, 20 aa, Mycobacterium
TLSNWRGLYGPPDMPQFAVA

SEQ ID NO: 1360711 - protein, 25 aa, Mycobacterium
TTNPPVEGAFYWLSNREVRWRPAEY

SEQ ID NO: 1360712 - protein, 27 aa, Mycobacterium
VARRLALLLTLPRFLPLTGPVAMRSTA

SEQ ID NO: 1360713 - protein, 17 aa, Mycobacterium
VDLGLPHLLLARPAWSA

SEQ ID NO: 1360714 - protein, 20 aa, Mycobacterium
VGQLPLTRPLLDLGVPPEIV

SEQ ID NO: 1360715 - protein, 18 aa, Mycobacterium
VMQWTPTGFWPAHSPISV

SEQ ID NO: 1360716 - protein, 17 aa, Mycobacterium
VVKLFIADDLLLSGKPL

SEQ ID NO: 1360717 - protein, 18 aa, Mycobacterium
WARLPAGVYVPLIGLSFG

SEQ ID NO: 1360718 - protein, 17 aa, Mycobacterium
WLSDSVMQWTPTGFWPA

SEQ ID NO: 1360719 - protein, 23 aa, Mycobacterium
YGDRVNFVLRYFPLRSHFNAERA

SEQ ID NO: 1360720 - protein, 23 aa, Mycobacterium
YGNYFTFYLCDLLLKVNGKGGQP

SEQ ID NO: 1360721 - protein, 26 aa, Mycobacterium
YNDGGQDLLLWVQPPPSSTSSSTPRS

SEQ ID NO: 1360722 - protein, 27 aa, Mycobacterium
AAAARPMNLLAIPWIDPVDVANASLFL

SEQ ID NO: 1360723 - protein, 17 aa, Mycobacterium
AAAVGFPGFWRFAVRNT

SEQ ID NO: 1360724 - protein, 22 aa, Mycobacterium
AADRWNWVLDGMVEIGALSEAD

SEQ ID NO: 1360725 - protein, 17 aa, Mycobacterium
AAPALFFVAAPSGGSTI

SEQ ID NO: 1360726 - protein, 22 aa, Mycobacterium
AAPLVTLYKRYAVRFGLGYTEE

SEQ ID NO: 1360727 - protein, 25 aa, Mycobacterium
AAYDPYPCVMVDRGWWILQANPGAS

SEQ ID NO: 1360728 - protein, 17 aa, Mycobacterium
ADDFVAPRFLPQDPDYA

SEQ ID NO: 1360729 - protein, 24 aa, Mycobacterium
ADHVSFPFRMGFARVYGLFAERGL

SEQ ID NO: 1360730 - protein, 20 aa, Mycobacterium
ADLGLPHLLLARPAWSAGDA

SEQ ID NO: 1360731 - protein, 24 aa, Mycobacterium
ADVLDIPFYVWDFADRFKEDVIDD

SEQ ID NO: 1360732 - protein, 23 aa, Mycobacterium
AEEAAFVLLALQAPVAGDLRAVV

SEQ ID NO: 1360733 - protein, 23 aa, Mycobacterium
AEGDWLYFVTIDLQGTTLFTRDY

SEQ ID NO: 1360734 - protein, 17 aa, Mycobacterium
AFLGARIGVRRGAVVDA

SEQ ID NO: 1360735 - protein, 36 aa, Mycobacterium; identical to SEQ ID NO: 1143727

SEQ ID NO: 1360736 - protein, 17 aa, Mycobacterium
AFVAVLLAAVAGLSTGS

SEQ ID NO: 1360737 - protein, 21 aa, Mycobacterium
AGALIPITSLFAPALSHAGAY

SEQ ID NO: 1360738 - protein, 23 aa, Mycobacterium
AGLDARAWRLPWVAGTTLFEIDH

SEQ ID NO: 1360739 - protein, 22 aa, Mycobacterium
AICPGFIETPLFESVIGIPGME

SEQ ID NO: 1360740 - protein, 23 aa, Mycobacterium
AILRRFDIIVLPLVNPDGRWVSV

SEQ ID NO: 1360741 - protein, 21 aa, Mycobacterium
ALAVALTAPWLWVPTAHAETF

SEQ ID NO: 1360742 - protein, 19 aa, Mycobacterium
ALGIFLRKAGFTDFTIFDR

SEQ ID NO: 1360743 - protein, 26 aa, Mycobacterium
ALIPGFIKRWFSWLGQLNFQACIFGI

SEQ ID NO: 1360744 - protein, 25 aa, Mycobacterium
ALMVPTLRPAQARVLLMAALAADVP

SEQ ID NO: 1360745 - protein, 23 aa, Mycobacterium
ALNHLTPRRLLLPMLGRAHPGMK

SEQ ID NO: 1360746 - protein, 18 aa, Mycobacterium
ALREAALASLRLLDDEPA

SEQ ID NO: 1360747 - protein, 19 aa, Mycobacterium
ALTEAPFLRRIALTGPVAA

SEQ ID NO: 1360748 - protein, 25 aa, Mycobacterium
ALTSLVYYHVFLGLLGPDDVKGQRP

SEQ ID NO: 1360749 - protein, 20 aa, Mycobacterium
ALVAAALLAAPFGLAWYLHV

SEQ ID NO: 1360750 - protein, 20 aa, Mycobacterium
ALVQSLWLAVRQTQYTWNNQ

SEQ ID NO: 1360751 - protein, 21 aa, Mycobacterium
APFSQTWRRCDFSKFAYTGPR

SEQ ID NO: 1360752 - protein, 25 aa, Mycobacterium
APTDSPLVLALWAAARRPSESAASQ

SEQ ID NO: 1360753 - protein, 17 aa, Mycobacterium
AQLFLPSPDIPIVASRD

SEQ ID NO: 1360754 - protein, 26 aa, Mycobacterium
ARLGGPGRWLLALPAHHIAGLQVLVR

SEQ ID NO: 1360755 - protein, 18 aa, Mycobacterium
ARLNFQLAFGARVGVRLT

SEQ ID NO: 1360756 - protein, 19 aa, Mycobacterium
ARPVWPPLLDTILTAVFDF

SEQ ID NO: 1360757 - protein, 17 aa, Mycobacterium
ARRHWPALLASLSGDDG

SEQ ID NO: 1360758 - protein, 26 aa, Mycobacterium
ASGPYFKVMLVNLAPYWILQPYVDAA

SEQ ID NO: 1360759 - protein, 20 aa, Mycobacterium
ATIMFWTMMNVDNPDLGLLL

SEQ ID NO: 1360760 - protein, 17 aa, Mycobacterium
AVGFPGFWRFAVRNTAA

SEQ ID NO: 1360761 - protein, 19 aa, Mycobacterium
AVILGLLRALPGDLSILYP

SEQ ID NO: 1360762 - protein, 17 aa, Mycobacterium
AVVALLTLLVGVGVGVA

SEQ ID NO: 1360763 - protein, 17 aa, Mycobacterium
AVVLFPTADEAATFFAE

SEQ ID NO: 1360764 - protein, 18 aa, Mycobacterium
CPSLIWQLRNSAAGYRPA

SEQ ID NO: 1360765 - protein, 18 aa, Mycobacterium
CTVPFYWTEAHHAHDYSR

SEQ ID NO: 1360766 - protein, 18 aa, Mycobacterium
DDPLWFWSDQYGRNIQFV

SEQ ID NO: 1360767 - protein, 17 aa, Mycobacterium
DDTTWVPGSPWLAGVDP

SEQ ID NO: 1360768 - protein, 28 aa, Mycobacterium
DEWRTFDLRGWWVTIAGVTFPDAHAANG

SEQ ID NO: 1360769 - protein, 21 aa, Mycobacterium
DFPDRWWNALAVANAIAGSIY

SEQ ID NO: 1360770 - protein, 19 aa, Mycobacterium
DFVAPRFLPQDPDYAALTC

SEQ ID NO: 1360771 - protein, 22 aa, Mycobacterium
DHPEWVIPVRWTPTHDLPPLEA

SEQ ID NO: 1360772 - protein, 17 aa, Mycobacterium
DLAEFLDLAPLTLDNIY

SEQ ID NO: 1360773 - protein, 17 aa, Mycobacterium
DMVWLDPAPMDDTYALA

SEQ ID NO: 1360774 - protein, 24 aa, Mycobacterium
DNVDLAFFGPFAYVVAGLNGAEIT

SEQ ID NO: 1360775 - protein, 23 aa, Mycobacterium
DNVDLAFFGPFGYVVAGLNGAKM

SEQ ID NO: 1360776 - protein, 24 aa, Mycobacterium
DPVILCAMPFFWIGGVLAATGALH

SEQ ID NO: 1360777 - protein, 23 aa, Mycobacterium
DSVVGPFTYLRPGTELGAAGKLG

SEQ ID NO: 1360778 - protein, 18 aa, Mycobacterium
DTIVLRRSRPLEISTDGG

SEQ ID NO: 1360779 - protein, 20 aa, Mycobacterium
DVALPPTWRLLTSRGPYELP

SEQ ID NO: 1360780 - protein, 21 aa, Mycobacterium
DVLPMLGWLDWFVDDEGMAKL

SEQ ID NO: 1360781 - protein, 30 aa, Mycobacterium
DYVLSLGWFPIPLPPLPTPPLPRLASESAP

SEQ ID NO: 1360782 - protein, 26 aa, Mycobacterium
EALRVAYRPPWELALHRWLDAVTPHR

SEQ ID NO: 1360783 - protein, 19 aa, Mycobacterium
EANPLVGLPFYVNPQSKGM

SEQ ID NO: 1360784 - protein, 24 aa, Mycobacterium
ECSQAGWTWLISDFGEETPGFSAS

SEQ ID NO: 1360785 - protein, 24 aa, Mycobacterium
EDDLPMFRYWWGVPSDFESVVRAE

SEQ ID NO: 1360786 - protein, 24 aa, Mycobacterium
EDMSWTFWSWNPNSTDTGGILADD

SEQ ID NO: 1360787 - protein, 17 aa, Mycobacterium
EDYPPLVLWVLGQENLA

SEQ ID NO: 1360788 - protein, 26 aa, Mycobacterium
EFLPTFPFHYKYLRNAVRGDYLNVFT

SEQ ID NO: 1360789 - protein, 18 aa, Mycobacterium
EGIPAIMQAFLQPILFPS

SEQ ID NO: 1360790 - protein, 18 aa, Mycobacterium
ELMLVLVPLIGAAYAAFR

SEQ ID NO: 1360791 - protein, 20 aa, Mycobacterium
EPVPLLRRFGLDAGERIAKL

SEQ ID NO: 1360792 - protein, 20 aa, Mycobacterium
ESAQKWPLCRGYNAGGSPVT

SEQ ID NO: 1360793 - protein, 17 aa, Mycobacterium
ESDIFTPHGLWTRNYKD

SEQ ID NO: 1360794 - protein, 21 aa, Mycobacterium
ESFLPGRLRLLVRLTRVAALR

SEQ ID NO: 1360795 - protein, 23 aa, Mycobacterium
ETPVLWTVFAWTRRTFFNATPVV

SEQ ID NO: 1360796 - protein, 18 aa, Mycobacterium
EVLNQWWHNPVSRSIMQD

SEQ ID NO: 1360797 - protein, 17 aa, Mycobacterium
EVRLVWSDEWRTFDLRG

SEQ ID NO: 1360798 - protein, 19 aa, Mycobacterium
EWVTWWLAVSRVGAVAVPL

SEQ ID NO: 1360799 - protein, 17 aa, Mycobacterium
EYTHDFVRLAHGAPFIA

SEQ ID NO: 1360800 - protein, 17 aa, Mycobacterium
FAALFAVVALVAGCSGS

SEQ ID NO: 1360801 - protein, 18 aa, Mycobacterium
FDCSGLVMWAFQQEGISL

SEQ ID NO: 1360802 - protein, 24 aa, Mycobacterium
FDGPYFVMQWLLRQPRKAVLPVVG

SEQ ID NO: 1360803 - protein, 21 aa, Mycobacterium
FDPDRFLSRRPTPFEYAPFGG

SEQ ID NO: 1360804 - protein, 18 aa, Mycobacterium
FGAKFVRFFPPEDPSPEK

SEQ ID NO: 1360805 - protein, 17 aa, Mycobacterium
FHVLYSSPPLNAAQAGP

SEQ ID NO: 1360806 - protein, 18 aa, Mycobacterium
FIAPRLFRPKDDPLYGVL

SEQ ID NO: 1360807 - protein, 20 aa, Mycobacterium
FLEYLDMFYNLGLAGRAMRR

SEQ ID NO: 1360808 - protein, 17 aa, Mycobacterium
FLNPYWRGKFSVPISTN

SEQ ID NO: 1360809 - protein, 25 aa, Mycobacterium
FLPTFPFHYKYLRNAVRGDYLNVYT

SEQ ID NO: 1360810 - protein, 18 aa, Mycobacterium
FLTTFPFVKENIGNFFRG

SEQ ID NO: 1360811 - protein, 19 aa, Mycobacterium
FPEWEILRPSWFMQNFTGA

SEQ ID NO: 1360812 - protein, 23 aa, Mycobacterium
FPPTQWIRWRRPVIGMPMTARIL

SEQ ID NO: 1360813 - protein, 18 aa, Mycobacterium
FTAVVGVGLTLTACGSNS

SEQ ID NO: 1360814 - protein, 24 aa, Mycobacterium
FTDPAPWPWYRRPGVVFAGAATLA

SEQ ID NO: 1360815 - protein, 27 aa, Mycobacterium
FYSDGGSEVLLWLEAPPAPATGSAGSG

SEQ ID NO: 1360816 - protein, 24 aa, Mycobacterium
GAAAPGLFSLLIGNGDEPGENGGW

SEQ ID NO: 1360817 - protein, 26 aa, Mycobacterium
GALMVPTLRPAQARVLLMAALAADVP

SEQ ID NO: 1360818 - protein, 22 aa, Mycobacterium
GAPTLLNLWASWCAPCREEMPV

SEQ ID NO: 1360819 - protein, 25 aa, Mycobacterium
GARDLAVWLTPPPAPPAPAAGGSAP

SEQ ID NO: 1360820 - protein, 20 aa, Mycobacterium
GARRLVIVPWFLAHGRITDR

SEQ ID NO: 1360821 - protein, 22 aa, Mycobacterium
GARRLVIVPWFLAHGRITDRVA

SEQ ID NO: 1360822 - protein, 19 aa, Mycobacterium
GFDCSGLILYAFAGVGIAL

SEQ ID NO: 1360823 - protein, 21 aa, Mycobacterium
GFDCSGLMLYMFAGVGIKLDH

SEQ ID NO: 1360824 - protein, 18 aa, Mycobacterium
GFFEKTFAPLGLRKIQAE

SEQ ID NO: 1360825 - protein, 20 aa, Mycobacterium
GFPGFWRFAVRNTAAAVREA

SEQ ID NO: 1360826 - protein, 30 aa, Mycobacterium
GGANPWHTNLPRLLWSALRPLLSALGFTAP

SEQ ID NO: 1360827 - protein, 22 aa, Mycobacterium
GGGALPFGIFAGGLLTGPELID

SEQ ID NO: 1360828 - protein, 23 aa, Mycobacterium
GGHAGLLSIYGTGGAGGAGGMGA

SEQ ID NO: 1360829 - protein, 24 aa, Mycobacterium
GGRSYPYWNLVLAPGAAPVPLDVP

SEQ ID NO: 1360830 - protein, 19 aa, Mycobacterium
GGRYLFVYEPLRGYQTAAN

SEQ ID NO: 1360831 - protein, 19 aa, Mycobacterium
GIQLRDNAVRPLLVDAAAG

SEQ ID NO: 1360832 - protein, 18 aa, Mycobacterium
GLAFALVLVALAGGVVAL

SEQ ID NO: 1360833 - protein, 19 aa, Mycobacterium
GLAVWRIRNIFGSHQLPTY

SEQ ID NO: 1360834 - protein, 17 aa, Mycobacterium
GLGPAWKVLRDLPLRPG

SEQ ID NO: 1360835 - protein, 22 aa, Mycobacterium
GLLRVFLLGLVPPEQARAHLHA

SEQ ID NO: 1360836 - protein, 24 aa, Mycobacterium
GLQRKLIVQLTQPGTYQTACKPGM

SEQ ID NO: 1360837 - protein, 18 aa, Mycobacterium
GMLFGYAGDGGIGGAAGT

SEQ ID NO: 1360838 - protein, 25 aa, Mycobacterium
GPALRLLNFNYLPMPINAYLKKSPS

SEQ ID NO: 1360839 - protein, 22 aa, Mycobacterium
GPAWKVLRDLPLPPGDRHTVTM

SEQ ID NO: 1360840 - protein, 23 aa, Mycobacterium
GPPAPFAVWGFRGSPVTDPAPCA

SEQ ID NO: 1360841 - protein, 23 aa, Mycobacterium
GQKWTGFHRLEKDLWVTGPQADT

SEQ ID NO: 1360842 - protein, 17 aa, Mycobacterium
GQTLLLHGLWPQPPDRQ

SEQ ID NO: 1360843 - protein, 28 aa, Mycobacterium
GRAVVPGWPWWPLVEVMKVLPPRFAKYF

SEQ ID NO: 1360844 - protein, 24 aa, Mycobacterium
GRLGYGLTPALWTLGLRSAWIPDS

SEQ ID NO: 1360845 - protein, 25 aa, Mycobacterium
GRPVVLNLWAYWCGPCADELPAMAE

SEQ ID NO: 1360846 - protein, 23 aa, Mycobacterium
GRRLKMVARILGSLAAAAMVIVG

SEQ ID NO: 1360847 - protein, 25 aa, Mycobacterium
GRTVVLNLWAYWCGPCADELPAMAE

SEQ ID NO: 1360848 - protein, 19 aa, Mycobacterium
GVLHVIWRQGYYPGIGAPS

SEQ ID NO: 1360849 - protein, 26 aa, Mycobacterium
GVTREHPLWLFTLRAQSWAGDYGSTV

SEQ ID NO: 1360850 - protein, 19 aa, Mycobacterium
GWPTIPILEIPFPGASPTD

SEQ ID NO: 1360851 - protein, 24 aa, Mycobacterium
HGLFGWLQFVPILGNLLNPGGGHG

SEQ ID NO: 1360852 - protein, 32 aa, Mycobacterium
HRRKAEGPRVLPVSGWLSAGAVTVAMGAAMIA

SEQ ID NO: 1360853 - protein, 23 aa, Mycobacterium
HSRQLLAAQLIWTLSRSGINGPY

SEQ ID NO: 1360854 - protein, 25 aa, Mycobacterium
HSRRLWTVLIFMLWYAIFVDKTVTP

SEQ ID NO: 1360855 - protein, 17 aa, Mycobacterium
HVDAKLYGVPFGDGAYG

SEQ ID NO: 1360856 - protein, 17 aa, Mycobacterium
IAAPMFHAWGFSQLLFA

SEQ ID NO: 1360857 - protein, 29 aa, Mycobacterium
IAGIAALLLFVALPIVYVKNYIKVPPNEV

SEQ ID NO: 1360858 - protein, 18 aa, Mycobacterium
IDTPLIFLQNTTGFMVGA

SEQ ID NO: 1360859 - protein, 17 aa, Mycobacterium
IFLQNTTGFMVGAEYEQ

SEQ ID NO: 1360860 - protein, 17 aa, Mycobacterium
IGGFFEKTFAPLGLRKI

SEQ ID NO: 1360861 - protein, 18 aa, Mycobacterium
IGHYREHLPRWVDGRVAL

SEQ ID NO: 1360862 - protein, 19 aa, Mycobacterium
IGLAFALVLVALAGGVVAL

SEQ ID NO: 1360863 - protein, 18 aa, Mycobacterium
IGLASVLVLLLIAGLVTV

SEQ ID NO: 1360864 - protein, 19 aa, Mycobacterium
IRILPPFLSRKHLPSRLAR

SEQ ID NO: 1360865 - protein, 24 aa, Mycobacterium
ISAYELLLCRIASLNIAYLHVVSE

SEQ ID NO: 1360866 - protein, 20 aa, Mycobacterium
KELIPKWFRGDFANLTLVLD

SEQ ID NO: 1360867 - protein, 17 aa, Mycobacterium
KFVRFFPPEDPSPEKLR

SEQ ID NO: 1360868 - protein, 21 aa, Mycobacterium
KGYPYTLVTPFIKPFVKLLCP

SEQ ID NO: 1360869 - protein, 27 aa, Mycobacterium
KLPGLPPLRLNLPTPEQFIASIPAPVV

SEQ ID NO: 1360870 - protein, 21 aa, Mycobacterium
KNAIDWLSRPWGNGALKGKPV

SEQ ID NO: 1360871 - protein, 22 aa, Mycobacterium
KPINPFYPIIAATYRYIGINLH

SEQ ID NO: 1360872 - protein, 18 aa, Mycobacterium
KSLWCGIGGLIPFAKSGP

SEQ ID NO: 1360873 - protein, 24 aa, Mycobacterium
KTTPPVEGAFYWLNNREVRWRPAK

SEQ ID NO: 1360874 - protein, 27 aa, Mycobacterium
KTYPVPLLMPVAWLPDPIIAALDAPLR

SEQ ID NO: 1360875 - protein, 17 aa, Mycobacterium
LAAAFFGLAAPAAQAAP

SEQ ID NO: 1360876 - protein, 26 aa, Mycobacterium
LAALGMVWPFLFYGAPAAAEPSPGVP

SEQ ID NO: 1360877 - protein, 20 aa, Mycobacterium
LAGMLPLAMAPPPPVPGVLL

SEQ ID NO: 1360878 - protein, 21 aa, Mycobacterium
LALSAALLTALFLSACTSTEQ

SEQ ID NO: 1360879 - protein, 23 aa, Mycobacterium
LAVELSSFQLHWAPSLRPEAGAV

SEQ ID NO: 1360880 - protein, 26 aa, Mycobacterium
LDDPEKRFFILLALRLRGVVGLGPND

SEQ ID NO: 1360881 - protein, 22 aa, Mycobacterium
LDLDALIGGFRPLFRALDPDQV

SEQ ID NO: 1360882 - protein, 21 aa, Mycobacterium
LDLDALIGGFRPLFRALDPEQ

SEQ ID NO: 1360883 - protein, 18 aa, Mycobacterium
LDWPLRPRPAVVRTFDAP

SEQ ID NO: 1360884 - protein, 19 aa, Mycobacterium
LGLALLLCALGFAGQIPPA

SEQ ID NO: 1360885 - protein, 22 aa, Mycobacterium
LGTMSPIWYLFTGVDYRAVADT

SEQ ID NO: 1360886 - protein, 17 aa, Mycobacterium
LIKADVLPMLGWLDWFV

SEQ ID NO: 1360887 - protein, 18 aa, Mycobacterium
LIPTFPFPNETIEKWQRG

SEQ ID NO: 1360888 - protein, 17 aa, Mycobacterium
LITPGQRVLFWVSAHAL

SEQ ID NO: 1360889 - protein, 22 aa, Mycobacterium
LIVLALRWLLIHTPKARVKAVP

SEQ ID NO: 1360890 - protein, 25 aa, Mycobacterium
LKDIALYLNFDMLGSPNPGYFTMDG

SEQ ID NO: 1360891 - protein, 26 aa, Mycobacterium
LKTLCRFHHLLKTFWLGATGWRDRQY

SEQ ID NO: 1360892 - protein, 17 aa, Mycobacterium
LLGLVTTGARINPQIYG

SEQ ID NO: 1360893 - protein, 19 aa, Mycobacterium
LLLHGLWPQPPDRQNCGVP

SEQ ID NO: 1360894 - protein, 17 aa, Mycobacterium
LLQGLRDLGLDWLADEW

SEQ ID NO: 1360895 - protein, 20 aa, Mycobacterium
LLRCRLLVCQLAEPSADRAA

SEQ ID NO: 1360896 - protein, 18 aa, Mycobacterium
LLVQDLQMRPGSSSGWHT

SEQ ID NO: 1360897 - protein, 20 aa, Mycobacterium
LNALFLPPAPAAPAAPAAPA

SEQ ID NO: 1360898 - protein, 20 aa, Mycobacterium
LNALFLPPAPAAPAAPPPPG

SEQ ID NO: 1360899 - protein, 26 aa, Mycobacterium
LNLAIPLLPAPIPLPPQQLPPPCTTG

SEQ ID NO: 1360900 - protein, 23 aa, Mycobacterium
LPFAALPLMFLGPVPLAAATQVI

SEQ ID NO: 1360901 - protein, 24 aa, Mycobacterium
LPGTQWQHRRFWRTPTPPPNTRAL

SEQ ID NO: 1360902 - protein, 30 aa, Mycobacterium
LPLRAMVMVLLFLGVVFLLVALQSMGGSDG

SEQ ID NO: 1360903 - protein, 18 aa, Mycobacterium
LQLLGLLQSRRVWSGEEL

SEQ ID NO: 1360904 - protein, 22 aa, Mycobacterium
LQLPVLRAQLRWMEAVLAMWIG

SEQ ID NO: 1360905 - protein, 18 aa, Mycobacterium
LQVPVHIPLFAEPVTAAG

SEQ ID NO: 1360906 - protein, 18 aa, Mycobacterium
LRTTWDVPTLALLGIGNG

SEQ ID NO: 1360907 - protein, 19 aa, Mycobacterium
LSLAALVTALLLAGCSSPE

SEQ ID NO: 1360908 - protein, 24 aa, Mycobacterium
LSNNLYWDPRFFIALGPNTNIVTD

SEQ ID NO: 1360909 - protein, 18 aa, Mycobacterium
LSVMRTILRLMGRSPEDF

SEQ ID NO: 1360910 - protein, 24 aa, Mycobacterium
LTAALPFMMLPLTVAGPLPAAGAA

SEQ ID NO: 1360911 - protein, 18 aa, Mycobacterium
LTIAVIAALLLTGCGVTR

SEQ ID NO: 1360912 - protein, 20 aa, Mycobacterium
LTLLIALVPVVAFGVLLSAV

SEQ ID NO: 1360913 - protein, 25 aa, Mycobacterium
LTRSMSFFSVLPWQKETIPNWIRGD

SEQ ID NO: 1360914 - protein, 18 aa, Mycobacterium
LTVLLLVGAVLAGVGRSA

SEQ ID NO: 1360915 - protein, 17 aa, Mycobacterium
LTVPKMIYRLGIFRAPR

SEQ ID NO: 1360916 - protein, 19 aa, Mycobacterium
LVLLSWPEDGPVIGIDPIG

SEQ ID NO: 1360917 - protein, 17 aa, Mycobacterium
LVLMTSVVAVLLVSAPP

SEQ ID NO: 1360918 - protein, 24 aa, Mycobacterium
LYAAISILALLYGRARHPGSAPAP

SEQ ID NO: 1360919 - protein, 18 aa, Mycobacterium
MAALLPLFAPAAAAQPQT

SEQ ID NO: 1360920 - protein, 19 aa, Mycobacterium
MALLTAFLFLVFSDTRTGA

SEQ ID NO: 1360921 - protein, 18 aa, Mycobacterium
MEAAYVSVYLWKNTVEKA

SEQ ID NO: 1360922 - protein, 19 aa, Mycobacterium
MELVIRRAMSQLGVPYSWG

SEQ ID NO: 1360923 - protein, 21 aa, Mycobacterium
MGRKFLTKLGILSPASAAADP

SEQ ID NO: 1360924 - protein, 17 aa, Mycobacterium
MIVDWLYSIGIRSRRMG

SEQ ID NO: 1360925 - protein, 17 aa, Mycobacterium
MLAPLLRDLAAAELPIL

SEQ ID NO: 1360926 - protein, 19 aa, Mycobacterium
MLLLVALLLVVGAGWAAAQ

SEQ ID NO: 1360927 - protein, 21 aa, Mycobacterium
MPVDKGVLPAFWSVGLEPGHE

SEQ ID NO: 1360928 - protein, 26 aa, Mycobacterium
MTRSLSFLTTFPWAKELIPKWFRGDF

SEQ ID NO: 1360929 - protein, 23 aa, Mycobacterium
NEEGLWILPPKWLQDNDVEIITD

SEQ ID NO: 1360930 - protein, 25 aa, Mycobacterium
NEGAEPLVMWVLYANPPATPLAIDV

SEQ ID NO: 1360931 - protein, 17 aa, Mycobacterium
NLAPYWILQPYVDAAFK

SEQ ID NO: 1360932 - protein, 19 aa, Mycobacterium
NLWWDRPITVTGVDIRAGT

SEQ ID NO: 1360933 - protein, 17 aa, Mycobacterium
NNRWWITCMVAFKTSYG

SEQ ID NO: 1360934 - protein, 23 aa, Mycobacterium
NPAQVFFQPYRPGANYTSTGRGC

SEQ ID NO: 1360935 - protein, 21 aa, Mycobacterium
NPLILRQRYPVPDAPYAVAGS

SEQ ID NO: 1360936 - protein, 20 aa, Mycobacterium
NPLLYRIAEGAPRPAYRDVT

SEQ ID NO: 1360937 - protein, 21 aa, Mycobacterium
NRRLKLPYDIWLRGSQCDEAN

SEQ ID NO: 1360938 - protein, 27 aa, Mycobacterium
NYDSWVIGNGYYWLSYVSYSGTRRYVA

SEQ ID NO: 1360939 - protein, 28 aa, Mycobacterium
PADPVESPLLWTLLAFARRQFGQPRTEI

SEQ ID NO: 1360940 - protein, 17 aa, Mycobacterium
PAGLAMLLRRAADLVAL

SEQ ID NO: 1360941 - protein, 27 aa, Mycobacterium
PAIMQAFLQPILFPSLALLMPVQGIIT

SEQ ID NO: 1360942 - protein, 23 aa, Mycobacterium
PAQPILPVVPPPPAAPWLPQAQP

SEQ ID NO: 1360943 - protein, 25 aa, Mycobacterium
PAQPQIPWPVFTFAPPTPEPSQEPA

SEQ ID NO: 1360944 - protein, 24 aa, Mycobacterium
PAWTLRGWSWFPDSTRAVVNEQQR

SEQ ID NO: 1360945 - protein, 23 aa, Mycobacterium
PDEMPAAALWWRLADALSRTAAI

SEQ ID NO: 1360946 - protein, 24 aa, Mycobacterium
PEEHLPLVLPFKYLGVPTETLIEL

SEQ ID NO: 1360947 - protein, 22 aa, Mycobacterium
PEQLDWMVLFSSCGYLAGFPGQ

SEQ ID NO: 1360948 - protein, 17 aa, Mycobacterium
PFRLGFAEVYGLFARAG

SEQ ID NO: 1360949 - protein, 25 aa, Mycobacterium
PGDPRYPYRPPLPQPPPGGPPPGPP

SEQ ID NO: 1360950 - protein, 21 aa, Mycobacterium
PGGTPLWPGLPPAPPPPTQEG

SEQ ID NO: 1360951 - protein, 18 aa, Mycobacterium
PIRDLIRMAAHSRHYLAV

SEQ ID NO: 1360952 - protein, 19 aa, Mycobacterium
PITNGLTYPFTFTFERSGE

SEQ ID NO: 1360953 - protein, 20 aa, Mycobacterium
PIYTCWLQGATWFLENGGWD

SEQ ID NO: 1360954 - protein, 18 aa, Mycobacterium
PKFLAASLLPLGAALAVA

SEQ ID NO: 1360955 - protein, 25 aa, Mycobacterium
PKGPFALVLRLYWPKPDALNGSWRS

SEQ ID NO: 1360956 - protein, 26 aa, Mycobacterium
PLRRPDLLRVFLLGELPPAAARRYAA

SEQ ID NO: 1360957 - protein, 19 aa, Mycobacterium
PLVALWDDTTWVPGSPWLA

SEQ ID NO: 1360958 - protein, 20 aa, Mycobacterium
PMFHAWGFSQLLFAALLACP

SEQ ID NO: 1360959 - protein, 17 aa, Mycobacterium
PMPCEVLWMVYSDEPFR

SEQ ID NO: 1360960 - protein, 17 aa, Mycobacterium
PPGVFPPLEGAAAVFDR

SEQ ID NO: 1360961 - protein, 17 aa, Mycobacterium
PPRKHAARLAWFQALAT

SEQ ID NO: 1360962 - protein, 23 aa, Mycobacterium
PQLAAPMRSWALAATKLLLLMGL

SEQ ID NO: 1360963 - protein, 27 aa, Mycobacterium
PQPTQVRITFWFDAKYPVPADAKAVIL

SEQ ID NO: 1360964 - protein, 24 aa, Mycobacterium
PTAKLPLVQLFPSLAAKEAELKAK

SEQ ID NO: 1360965 - protein, 24 aa, Mycobacterium
PTALPLCALITAWLRGLARPQAVA

SEQ ID NO: 1360966 - protein, 26 aa, Mycobacterium
PTENLPLLEPLRWLGLTGIADALNGP

SEQ ID NO: 1360967 - protein, 19 aa, Mycobacterium
PTPLLAALTLPFDAAQLQA

SEQ ID NO: 1360968 - protein, 21 aa, Mycobacterium
PTPTPLLAALTLPFDAAQLQA

SEQ ID NO: 1360969 - protein, 22 aa, Mycobacterium
PTPTPLLAALTLPFDAAQLQAA

SEQ ID NO: 1360970 - protein, 20 aa, Mycobacterium
PTPVSALVQSLWLAVRQTQY

SEQ ID NO: 1360971 - protein, 17 aa, Mycobacterium
PVARYWPEFGRAGKEDI

SEQ ID NO: 1360972 - protein, 28 aa, Mycobacterium
PVKVAGFLGWIAWGLLHIAFLTGVRNRV

SEQ ID NO: 1360973 - protein, 17 aa, Mycobacterium
PYAIYWDPQTYPAVKKI

SEQ ID NO: 1360974 - protein, 20 aa, Mycobacterium
PYPAWRELFNNILPAHIVKD

SEQ ID NO: 1360975 - protein, 22 aa, Mycobacterium
QAVVLFPYREKAAAFYEASVHQ

SEQ ID NO: 1360976 - protein, 24 aa, Mycobacterium
QDAGRWRVPLLFAIRPEVGVDDVR

SEQ ID NO: 1360977 - protein, 17 aa, Mycobacterium
QHHFPFIDPALRLTTTN

SEQ ID NO: 1360978 - protein, 23 aa, Mycobacterium
QLEYQLRPFPPDTGPYLLMIMHG

SEQ ID NO: 1360979 - protein, 18 aa, Mycobacterium
QLITFTILTVVALGVLGL

SEQ ID NO: 1360980 - protein, 17 aa, Mycobacterium
QMRPGSSSGWHTHPGPE

SEQ ID NO: 1360981 - protein, 24 aa, Mycobacterium
QNWDLVLYWWETPGRLSVAGGILA

SEQ ID NO: 1360982 - protein, 23 aa, Mycobacterium
QPDRVKVIFWYDARYKVPADANA

SEQ ID NO: 1360983 - protein, 26 aa, Mycobacterium
QPTQVRITFWFDAKYPVPADAKAVIL

SEQ ID NO: 1360984 - protein, 27 aa, Mycobacterium
QQQKPDLEIWYTLPVLPTGLTADGLNV

SEQ ID NO: 1360985 - protein, 31 aa, Mycobacterium
QSSANPALRPMIGDGGWLIGNGLDAADDCQG

SEQ ID NO: 1360986 - protein, 24 aa, Mycobacterium
QTRSPLLRVLVAATLLALIVAGGT

SEQ ID NO: 1360987 - protein, 25 aa, Mycobacterium
QVEGGIIYHYYWFRDQSQTKEISGN

SEQ ID NO: 1360988 - protein, 25 aa, Mycobacterium
QVLQSYLNIIYFGRGAYGVAAASRA

SEQ ID NO: 1360989 - protein, 17 aa, Mycobacterium
RALAILKSQGVKAYFGG

SEQ ID NO: 1360990 - protein, 24 aa, Mycobacterium
RATPPWWPMRRLVRALGADADEVL

SEQ ID NO: 1360991 - protein, 23 aa, Mycobacterium
RCVRAALPLLRSASWARIVNFSA

SEQ ID NO: 1360992 - protein, 23 aa, Mycobacterium
RDPATGATLWRYARDLELCGVTW

SEQ ID NO: 1360993 - protein, 23 aa, Mycobacterium
RETWNRLALPWFRGINSVIGVQR

SEQ ID NO: 1360994 - protein, 22 aa, Mycobacterium
RGHYMSPLLGTAAPRRADLLSA

SEQ ID NO: 1360995 - protein, 24 aa, Mycobacterium
RIPAVAAILARQIAIAPAAAVPAK

SEQ ID NO: 1360996 - protein, 18 aa, Mycobacterium
RKFLTQLGILPQASAPAD

SEQ ID NO: 1360997 - protein, 19 aa, Mycobacterium
RLIAPMRPDRYLRMGLAMR

SEQ ID NO: 1360998 - protein, 19 aa, Mycobacterium
RLIYLQHGFLASGAFYSYT

SEQ ID NO: 1360999 - protein, 19 aa, Mycobacterium
RLLARFVPFVRSDRFAVTV

SEQ ID NO: 1361000 - protein, 17 aa, Mycobacterium
RMMDPQHRLFLQTAWHA

SEQ ID NO: 1361001 - protein, 21 aa, Mycobacterium
RNRVFIADYSLGWIRVLDFDD

SEQ ID NO: 1361002 - protein, 23 aa, Mycobacterium
RPIIDSGYWRFWFKDRSSGWPLP

SEQ ID NO: 1361003 - protein, 22 aa, Mycobacterium
RPNLLIKIPATMAGLPAITAVI

SEQ ID NO: 1361004 - protein, 24 aa, Mycobacterium
RQRHDGRWIWRWDPAFIHSNFDFL

SEQ ID NO: 1361005 - protein, 17 aa, Mycobacterium
RRFVRFCLWSLALAAIA

SEQ ID NO: 1361006 - protein, 22 aa, Mycobacterium
RRGRPRRLQPYAWLGAGAVGFG

SEQ ID NO: 1361007 - protein, 22 aa, Mycobacterium
RSCPYWNLVLAPGAAPVPLDVP

SEQ ID NO: 1361008 - protein, 17 aa, Mycobacterium
RSSLSWFSPKVYGTVTA

SEQ ID NO: 1361009 - protein, 22 aa, Mycobacterium
RTPERWFVVWLGTATNPIPQAE

SEQ ID NO: 1361010 - protein, 17 aa, Mycobacterium
RVLAATLAVSLPFVLSA

SEQ ID NO: 1361011 - protein, 20 aa, Mycobacterium
RVPWQIRILPPFLSRKHLPS

SEQ ID NO: 1361012 - protein, 21 aa, Mycobacterium
RYPYREPLPAPPPGGPPPGPP

SEQ ID NO: 1361013 - protein, 18 aa, Mycobacterium
RYRFLTRNRLVAALSGAT

SEQ ID NO: 1361014 - protein, 20 aa, Mycobacterium
SAATGWLWDAGVRPGMTVAW

SEQ ID NO: 1361015 - protein, 17 aa, Mycobacterium
SAGLLRVFLLGLVPPEQ

SEQ ID NO: 1361016 - protein, 21 aa, Mycobacterium
SEIEMMRGWLALWGVGPAAAQ

SEQ ID NO: 1361017 - protein, 22 aa, Mycobacterium
SEPWMRPDYVPPAVPPAPEPVA

SEQ ID NO: 1361018 - protein, 21 aa, Mycobacterium
SFDWRTLPLVRQQAPSVPLVA

SEQ ID NO: 1361019 - protein, 19 aa, Mycobacterium
SFLPTFPFPKETLTNWMRG

SEQ ID NO: 1361020 - protein, 17 aa, Mycobacterium
SGDTRAFLGARIGVRRG

SEQ ID NO: 1361021 - protein, 22 aa, Mycobacterium
SGLIYNLTFGLLGRAGHSATTT

SEQ ID NO: 1361022 - protein, 28 aa, Mycobacterium
SGLYSQRYWPYLTSGLLGLQRGTDPGDL

SEQ ID NO: 1361023 - protein, 19 aa, Mycobacterium
SGWLYTWALGIPKAAKNPD

SEQ ID NO: 1361024 - protein, 28 aa, Mycobacterium
SIARRLALLLTFPRFLPAAGPLAMRSSA

SEQ ID NO: 1361025 - protein, 18 aa, Mycobacterium
SIPIHNLPFPINAYLRPA

SEQ ID NO: 1361026 - protein, 24 aa, Mycobacterium
SKGRDLYFTLSRWSDYSTLLMHTS

SEQ ID NO: 1361027 - protein, 22 aa, Mycobacterium
SLAPFQYYYWGDLLDGAMFDPE

SEQ ID NO: 1361028 - protein, 23 aa, Mycobacterium
SLMVPIHWATFRLAPHPWAEPAE

SEQ ID NO: 1361029 - protein, 21 aa, Mycobacterium
SNEEDILWLSLNGGSDRRSAA

SEQ ID NO: 1361030 - protein, 30 aa, Mycobacterium; identical to SEQ ID NO: 1332863

SEQ ID NO: 1361031 - protein, 22 aa, Mycobacterium
SPENLSFVFLGNSLRKYGGVRP

SEQ ID NO: 1361032 - protein, 22 aa, Mycobacterium
SPLWLVVAAALRRQLDSPTTSG

SEQ ID NO: 1361033 - protein, 23 aa, Mycobacterium
SPTVLLNPLKWYPMARAAADTVT

SEQ ID NO: 1361034 - protein, 29 aa, Mycobacterium
SQARWLPDMVSIVSLFFIPSVSGATFTDK

SEQ ID NO: 1361035 - protein, 22 aa, Mycobacterium
SRRLWTVLIFMLWHAIFVEGSV

SEQ ID NO: 1361036 - protein, 24 aa, Mycobacterium
STWVFDAPFFLLLNLAVGGNWPGP

SEQ ID NO: 1361037 - protein, 24 aa, Mycobacterium
TAARNWFERTFFAATPVYPPQTVM

SEQ ID NO: 1361038 - protein, 19 aa, Mycobacterium
TAVFAPPLTPAPPSTPVPP

SEQ ID NO: 1361039 - protein, 18 aa, Mycobacterium
TEDLPLLQGLRDLGLDWL

SEQ ID NO: 1361040 - protein, 28 aa, Mycobacterium
TEQPWWGAYAWYVTPPSPAYPFWDRSLY

SEQ ID NO: 1361041 - protein, 17 aa, Mycobacterium
TFAGIQLRDNAVRPLLV

SEQ ID NO: 1361042 - protein, 18 aa, Mycobacterium
TFAGIQLRDNAVRPLLVD

SEQ ID NO: 1361043 - protein, 17 aa, Mycobacterium
THPGCTVPFYWTEAHHA

SEQ ID NO: 1361044 - protein, 18 aa, Mycobacterium
TINLPFPQGWEAAGPRAP

SEQ ID NO: 1361045 - protein, 19 aa, Mycobacterium
TLSNWRGLYGPPDMPQFAV

SEQ ID NO: 1361046 - protein, 21 aa, Mycobacterium
TLYRKWLTVLGPAPAPPAARY

SEQ ID NO: 1361047 - protein, 18 aa, Mycobacterium
TMEKSPYAIYWDPQTYPA

SEQ ID NO: 1361048 - protein, 19 aa, Mycobacterium
TPFGWLRGFPFLAVQVVWA

SEQ ID NO: 1361049 - protein, 29 aa, Mycobacterium
TQWIPDAMALINLFFKSALPGYSFSDGLN

SEQ ID NO: 1361050 - protein, 18 aa, Mycobacterium
TRALSFLPTFPFPKETLT

SEQ ID NO: 1361051 - protein, 24 aa, Mycobacterium
TRTVLWFRTYQLIDAPRNITTYRT

SEQ ID NO: 1361052 - protein, 24 aa, Mycobacterium
TTDPPVEGAFYWLNNREVRWRPAQ

SEQ ID NO: 1361053 - protein, 24 aa, Mycobacterium
TTNPPVEGAFYWLNNREVRWRPAE

SEQ ID NO: 1361054 - protein, 21 aa, Mycobacterium
TTTLEWVLGPYFEGEFVKGAN

SEQ ID NO: 1361055 - protein, 17 aa, Mycobacterium
TVCSGGHGGLLIGNGGN

SEQ ID NO: 1361056 - protein, 17 aa, Mycobacterium
TVFYKNGAPIVWDRGRE

SEQ ID NO: 1361057 - protein, 17 aa, Mycobacterium
TVLTWRLDLERLAATAQ

SEQ ID NO: 1361058 - protein, 19 aa, Mycobacterium
TVRVFLHDLLWVQDRVGFQ

SEQ ID NO: 1361059 - protein, 25 aa, Mycobacterium
TVSGQLTLLLPFIDRIRARVDLRER

SEQ ID NO: 1361060 - protein, 22 aa, Mycobacterium
TYTPPAIWDPKFQNAAFFHRST

SEQ ID NO: 1361061 - protein, 22 aa, Mycobacterium
TYWDQAAALLDWGFALGPNSGV

SEQ ID NO: 1361062 - protein, 25 aa, Mycobacterium
VAGTALLLAILLIAGAALLVRQVFF

SEQ ID NO: 1361063 - protein, 23 aa, Mycobacterium
VALGVLGLYYLRLPSLAGIGEYK

SEQ ID NO: 1361064 - protein, 20 aa, Mycobacterium
VALVGIYKRFQEMAALTTFT

SEQ ID NO: 1361065 - protein, 26 aa, Mycobacterium
VGSYGAWFPYYICGISFRASDLEGRT

SEQ ID NO: 1361066 - protein, 24 aa, Mycobacterium
VHDPIVARPLIQLGLPAPAAGWLS

SEQ ID NO: 1361067 - protein, 20 aa, Mycobacterium
VIMVFAYMRLPAFLGIGQYR

SEQ ID NO: 1361068 - protein, 17 aa, Mycobacterium
VITVLTWRLDLERLAAT

SEQ ID NO: 1361069 - protein, 24 aa, Mycobacterium
VLIPTPLLPLLKPLADAGASQETI

SEQ ID NO: 1361070 - protein, 19 aa, Mycobacterium
VLVLLLIAGLVTVSPALKA

SEQ ID NO: 1361071 - protein, 26 aa, Mycobacterium
VPAGWYSEPWWKPALVAGAWGLGSAL

SEQ ID NO: 1361072 - protein, 28 aa, Mycobacterium
VPHHGIGYGLLRFLYGPTARTLSPVPPP

SEQ ID NO: 1361073 - protein, 17 aa, Mycobacterium
VPLIALVSVLLGIGTAA

SEQ ID NO: 1361074 - protein, 21 aa, Mycobacterium
VPLLQPFAFFVPRPILKAIDA

SEQ ID NO: 1361075 - protein, 18 aa, Mycobacterium
VRVSLDYVEGRWLIADFA

SEQ ID NO: 1361076 - protein, 20 aa, Mycobacterium
VSAFPRVVWVAGGLLKGASV

SEQ ID NO: 1361077 - protein, 25 aa, Mycobacterium
VSGYAGWVAWGLLHIAFLTGVSNRI

SEQ ID NO: 1361078 - protein, 25 aa, Mycobacterium
VSWDTPIVSRLPWFALSDPAVTQMV

SEQ ID NO: 1361079 - protein, 27 aa, Mycobacterium
VTGAPALLFISWPDRGPLLGADLEGRL

SEQ ID NO: 1361080 - protein, 24 aa, Mycobacterium
VTGASIFPLWPPAPPTFPESPEEL

SEQ ID NO: 1361081 - protein, 18 aa, Mycobacterium
WAKVFYHSLGLGTSARFV

SEQ ID NO: 1361082 - protein, 18 aa, Mycobacterium
WEVLWNVYTPLLTYRHAR

SEQ ID NO: 1361083 - protein, 19 aa, Mycobacterium
WFRGDFANLTLVLDLTLSR

SEQ ID NO: 1361084 - protein, 19 aa, Mycobacterium
WLLHIVSITVLFAVGGCHT

SEQ ID NO: 1361085 - protein, 17 aa, Mycobacterium
WLNNREVRWRPAEYWKP

SEQ ID NO: 1361086 - protein, 20 aa, Mycobacterium
WLPLLIVVVVAIAGLTVARI

SEQ ID NO: 1361087 - protein, 19 aa, Mycobacterium
WNMWTVLPILQDTTIVAAG

SEQ ID NO: 1361088 - protein, 24 aa, Mycobacterium
WQRLAWLRYLLGEPVPILDLSFDP

SEQ ID NO: 1361089 - protein, 25 aa, Mycobacterium
YAEIGLLGFALITDALGGVNVCLNA

SEQ ID NO: 1361090 - protein, 17 aa, Mycobacterium
YDKLPFITRNHTYTAHL

SEQ ID NO: 1361091 - protein, 17 aa, Mycobacterium
YENEWWHFTFKPETYPD

SEQ ID NO: 1361092 - protein, 23 aa, Mycobacterium
YGDFFSFYLCDIVLKLNGKGGQP

SEQ ID NO: 1361093 - protein, 23 aa, Mycobacterium
YGDFFSFYLCEIVLKLNGKGGQP

SEQ ID NO: 1361094 - protein, 23 aa, Mycobacterium
YGDFFSFYLCELVLKLNGKGGQP

SEQ ID NO: 1361095 - protein, 20 aa, Mycobacterium
YLQGYLAVDSLWLYLSNGNV

SEQ ID NO: 1361096 - protein, 25 aa, Mycobacterium
YNDGGQDLLLWVQPPPSSTSSSTPR

SEQ ID NO: 1361097 - protein, 21 aa, Mycobacterium
YPYREPLPAPAPGGPPPGPPA

SEQ ID NO: 1361098 - protein, 19 aa, Mycobacterium
YSSLLLLGLVTTGARINPQ

SEQ ID NO: 1361099 - protein, 18 aa, Mycobacterium
YYLNYAYNPMMVGITPPP

SEQ ID NO: 1361100 - protein, 6 aa, Mycobacterium tuberculosis
QSNGTY

SEQ ID NO: 1361101 - protein, 4 aa, Mycobacterium tuberculosis
TTPQ

SEQ ID NO: 1361102 - protein, 4 aa, Mycobacterium tuberculosis
GGST

SEQ ID NO: 1361103 - protein, 5 aa, Mycobacterium tuberculosis
GTGGV

SEQ ID NO: 1361104 - protein, 4 aa, Mycobacterium tuberculosis
HEGS

SEQ ID NO: 1361105 - protein, 13 aa, Mycobacterium tuberculosis
AYSHPSTRAALRS

SEQ ID NO: 1361106 - protein, 4 aa, Mycobacterium tuberculosis
DNPQ

SEQ ID NO: 1361107 - protein, 6 aa, Mycobacterium tuberculosis
LSPGAG

SEQ ID NO: 1361108 - protein, 6 aa, Mycobacterium tuberculosis
PSSGSF

SEQ ID NO: 1361109 - protein, 6 aa, Mycobacterium tuberculosis
ARSSAL

SEQ ID NO: 1361110 - protein, 8 aa, Mycobacterium tuberculosis
DAAKNDDS

SEQ ID NO: 1361111 - protein, 4 aa, Mycobacterium tuberculosis
GVDS

SEQ ID NO: 1361112 - protein, 4 aa, Mycobacterium tuberculosis
PPRP

SEQ ID NO: 1361113 - protein, 7 aa, Mycobacterium tuberculosis
ATVDAYD

SEQ ID NO: 1361114 - protein, 26 aa, Mycobacterium tuberculosis
HTIPERQDQIDRRKAKGSAGGRPPAF

SEQ ID NO: 1361115 - protein, 7 aa, Mycobacterium tuberculosis
QAADTGA

SEQ ID NO: 1361116 - protein, 4 aa, Mycobacterium tuberculosis
GGDT

SEQ ID NO: 1361117 - protein, 4 aa, Mycobacterium tuberculosis
GTGY

SEQ ID NO: 1361118 - protein, 4 aa, Mycobacterium tuberculosis
SPMC

SEQ ID NO: 1361119 - protein, 5 aa, Mycobacterium tuberculosis
AAGPF

SEQ ID NO: 1361120 - protein, 4 aa, Mycobacterium tuberculosis
AANA

SEQ ID NO: 1361121 - protein, 7 aa, Mycobacterium tuberculosis
AGPTGVE

SEQ ID NO: 1361122 - protein, 5 aa, Mycobacterium tuberculosis
GRGAQ

SEQ ID NO: 1361123 - protein, 4 aa, Mycobacterium tuberculosis
HELR

SEQ ID NO: 1361124 - protein, 4 aa, Mycobacterium tuberculosis
RGEF

SEQ ID NO: 1361125 - protein, 5 aa, Mycobacterium tuberculosis
AAAAG

SEQ ID NO: 1361126 - protein, 4 aa, Mycobacterium tuberculosis
AGTG

SEQ ID NO: 1361127 - protein, 4 aa, Mycobacterium tuberculosis
LRPE

SEQ ID NO: 1361128 - protein, 4 aa, Mycobacterium tuberculosis
APGR

SEQ ID NO: 1361129 - protein, 7 aa, Mycobacterium tuberculosis
TTRSSQL

SEQ ID NO: 1361130 - protein, 5 aa, Mycobacterium tuberculosis
VGDPP

SEQ ID NO: 1361131 - protein, 4 aa, Mycobacterium tuberculosis
DGDV

SEQ ID NO: 1361132 - protein, 4 aa, Mycobacterium tuberculosis
PVNE

SEQ ID NO: 1361133 - protein, 5 aa, Mycobacterium tuberculosis
SPQQA

SEQ ID NO: 1361134 - protein, 4 aa, Mycobacterium tuberculosis
AGEA

SEQ ID NO: 1361135 - protein, 4 aa, Mycobacterium tuberculosis
AGTS

SEQ ID NO: 1361136 - protein, 9 aa, Mycobacterium tuberculosis
HASTEYALG

SEQ ID NO: 1361137 - protein, 4 aa, Mycobacterium tuberculosis
PPRL

SEQ ID NO: 1361138 - protein, 4 aa, Mycobacterium tuberculosis
ADRG

SEQ ID NO: 1361139 - protein, 4 aa, Mycobacterium tuberculosis
APAE

SEQ ID NO: 1361140 - protein, 4 aa, Mycobacterium tuberculosis
TGGV

SEQ ID NO: 1361141 - protein, 6 aa, Mycobacterium tuberculosis
PARTPV

SEQ ID NO: 1361142 - protein, 5 aa, Mycobacterium tuberculosis
DNQPA

SEQ ID NO: 1361143 - protein, 9 aa, Mycobacterium tuberculosis
RLDRPEDAA

SEQ ID NO: 1361144 - protein, 4 aa, Mycobacterium tuberculosis
AGGA

SEQ ID NO: 1361145 - protein, 10 aa, Mycobacterium tuberculosis
GPSGAGKSTL

SEQ ID NO: 1361146 - protein, 6 aa, Mycobacterium tuberculosis
AAIPGQ

SEQ ID NO: 1361147 - protein, 4 aa, Mycobacterium tuberculosis
AAPE

SEQ ID NO: 1361148 - protein, 4 aa, Mycobacterium tuberculosis
GAAG

SEQ ID NO: 1361149 - protein, 4 aa, Mycobacterium tuberculosis
GTLT

SEQ ID NO: 1361150 - protein, 14 aa, Mycobacterium tuberculosis
NESAKRDYDVQGNG

SEQ ID NO: 1361151 - protein, 8 aa, Mycobacterium tuberculosis
NHSPDDIE

SEQ ID NO: 1361152 - protein, 4 aa, Mycobacterium tuberculosis
PVPA

SEQ ID NO: 1361153 - protein, 4 aa, Mycobacterium tuberculosis
TQPA

SEQ ID NO: 1361154 - protein, 5 aa, Mycobacterium tuberculosis
VGADT

SEQ ID NO: 1361155 - protein, 11 aa, Mycobacterium tuberculosis
APVSGGVVSPQ

SEQ ID NO: 1361156 - protein, 4 aa, Mycobacterium tuberculosis
ATGA

SEQ ID NO: 1361157 - protein, 8 aa, Mycobacterium tuberculosis
TPHTGPAP

SEQ ID NO: 1361158 - protein, 9 aa, Mycobacterium tuberculosis
EPAPASTSV

SEQ ID NO: 1361159 - protein, 5 aa, Mycobacterium tuberculosis
KPVNQ

SEQ ID NO: 1361160 - protein, 7 aa, Mycobacterium tuberculosis
SDRGAGA

SEQ ID NO: 1361161 - protein, 4 aa, Mycobacterium tuberculosis
ADTR

SEQ ID NO: 1361162 - protein, 5 aa, Mycobacterium tuberculosis
AGEPH

SEQ ID NO: 1361163 - protein, 17 aa, Mycobacterium tuberculosis
AGQLPPEPPIWPTTSTP

SEQ ID NO: 1361164 - protein, 6 aa, Mycobacterium tuberculosis
AIRPSY

SEQ ID NO: 1361165 - protein, 13 aa, Mycobacterium tuberculosis
AKKPEDRYASAGD

SEQ ID NO: 1361166 - protein, 10 aa, Mycobacterium tuberculosis
ALSDPDQDHA

SEQ ID NO: 1361167 - protein, 7 aa, Mycobacterium tuberculosis
APVEPTG

SEQ ID NO: 1361168 - protein, 4 aa, Mycobacterium tuberculosis
ASRQ

SEQ ID NO: 1361169 - protein, 5 aa, Mycobacterium tuberculosis
CGAPA

SEQ ID NO: 1361170 - protein, 6 aa, Mycobacterium tuberculosis
DKPIGT

SEQ ID NO: 1361171 - protein, 7 aa, Mycobacterium tuberculosis
DNPAGLS

SEQ ID NO: 1361172 - protein, 5 aa, Mycobacterium tuberculosis
ESVAP

SEQ ID NO: 1361173 - protein, 7 aa, Mycobacterium tuberculosis
GEEAGYH

SEQ ID NO: 1361174 - protein, 10 aa, Mycobacterium tuberculosis
GLGAGSVRQH

SEQ ID NO: 1361175 - protein, 7 aa, Mycobacterium tuberculosis
GSAPRFT

SEQ ID NO: 1361176 - protein, 4 aa, Mycobacterium tuberculosis
IPPA

SEQ ID NO: 1361177 - protein, 11 aa, Mycobacterium tuberculosis
IPQPSAIRPGI

SEQ ID NO: 1361178 - protein, 6 aa, Mycobacterium tuberculosis
KAGESP

SEQ ID NO: 1361179 - protein, 4 aa, Mycobacterium tuberculosis
KPGE

SEQ ID NO: 1361180 - protein, 6 aa, Mycobacterium tuberculosis
KSGVPY

SEQ ID NO: 1361181 - protein, 7 aa, Mycobacterium tuberculosis
LAKTTTN

SEQ ID NO: 1361182 - protein, 10 aa, Mycobacterium tuberculosis
LEAGRPPRRF

SEQ ID NO: 1361183 - protein, 4 aa, Mycobacterium tuberculosis
LKPR

SEQ ID NO: 1361184 - protein, 5 aa, Mycobacterium tuberculosis
LLPPR

SEQ ID NO: 1361185 - protein, 4 aa, Mycobacterium tuberculosis
PGTA

SEQ ID NO: 1361186 - protein, 6 aa, Mycobacterium tuberculosis
PLTPPR

SEQ ID NO: 1361187 - protein, 4 aa, Mycobacterium tuberculosis
PSVV

SEQ ID NO: 1361188 - protein, 7 aa, Mycobacterium tuberculosis
RLAKAGP

SEQ ID NO: 1361189 - protein, 27 aa, Mycobacterium tuberculosis
RTATEEPVATYSSNGQTGGSEGRSASD

SEQ ID NO: 1361190 - protein, 4 aa, Mycobacterium tuberculosis
SARV

SEQ ID NO: 1361191 - protein, 7 aa, Mycobacterium tuberculosis
SATGNPV

SEQ ID NO: 1361192 - protein, 10 aa, Mycobacterium tuberculosis
SATTDEKLTQ

SEQ ID NO: 1361193 - protein, 10 aa, Mycobacterium tuberculosis
SGDDDERKKR

SEQ ID NO: 1361194 - protein, 5 aa, Mycobacterium tuberculosis
SHPAR

SEQ ID NO: 1361195 - protein, 10 aa, Mycobacterium tuberculosis
SNPITAASQA

SEQ ID NO: 1361196 - protein, 12 aa, Mycobacterium tuberculosis
TAGKESVGQPAG

SEQ ID NO: 1361197 - protein, 10 aa, Mycobacterium tuberculosis
TGPQGGPARL

SEQ ID NO: 1361198 - protein, 9 aa, Mycobacterium tuberculosis
TSAQTPREA

SEQ ID NO: 1361199 - protein, 7 aa, Mycobacterium tuberculosis
TSTDVPG

SEQ ID NO: 1361200 - protein, 5 aa, Mycobacterium tuberculosis
VGAKQ

SEQ ID NO: 1361201 - protein, 11 aa, Mycobacterium tuberculosis
AAAEASSRAVD

SEQ ID NO: 1361202 - protein, 5 aa, Mycobacterium tuberculosis
AAAKR

SEQ ID NO: 1361203 - protein, 7 aa, Mycobacterium tuberculosis
AAANEAA

SEQ ID NO: 1361204 - protein, 8 aa, Mycobacterium tuberculosis
AAANQTSA

SEQ ID NO: 1361205 - protein, 8 aa, Mycobacterium tuberculosis
AAASVGEQ

SEQ ID NO: 1361206 - protein, 12 aa, Mycobacterium tuberculosis
AAATGSAARTAA

SEQ ID NO: 1361207 - protein, 16 aa, Mycobacterium tuberculosis
AAAVGGAAEFDADAGR

SEQ ID NO: 1361208 - protein, 7 aa, Mycobacterium tuberculosis
AADGESD

SEQ ID NO: 1361209 - protein, 7 aa, Mycobacterium tuberculosis
AADGRPA

SEQ ID NO: 1361210 - protein, 9 aa, Mycobacterium tuberculosis
AADPSTQTA

SEQ ID NO: 1361211 - protein, 6 aa, Mycobacterium tuberculosis
AADRRE

SEQ ID NO: 1361212 - protein, 34 aa, Mycobacterium tuberculosis; identical to SEQ ID NO: 149343

SEQ ID NO: 1361213 - protein, 10 aa, Mycobacterium tuberculosis
AAEQSSEHPL

SEQ ID NO: 1361214 - protein, 14 aa, Mycobacterium tuberculosis
AAERERPKLGGEER

SEQ ID NO: 1361215 - protein, 7 aa, Mycobacterium tuberculosis
AAGAKQG

SEQ ID NO: 1361216 - protein, 8 aa, Mycobacterium tuberculosis
AAGALSGV

SEQ ID NO: 1361217 - protein, 5 aa, Mycobacterium tuberculosis
AAGDR

SEQ ID NO: 1361218 - protein, 7 aa, Mycobacterium tuberculosis
AAGGDER

SEQ ID NO: 1361219 - protein, 7 aa, Mycobacterium tuberculosis
AAGSATD

SEQ ID NO: 1361220 - protein, 5 aa, Mycobacterium tuberculosis
AAGTT

SEQ ID NO: 1361221 - protein, 18 aa, Mycobacterium tuberculosis
AAKAQANAARKAAARQRR

SEQ ID NO: 1361222 - protein, 7 aa, Mycobacterium tuberculosis
AALTGTP

SEQ ID NO: 1361223 - protein, 7 aa, Mycobacterium tuberculosis
AANDESV

SEQ ID NO: 1361224 - protein, 17 aa, Mycobacterium tuberculosis
AANKQAKITNDTEVTGA

SEQ ID NO: 1361225 - protein, 14 aa, Mycobacterium tuberculosis
AAPAGSSKPLPDLP

SEQ ID NO: 1361226 - protein, 5 aa, Mycobacterium tuberculosis
AAPTA

SEQ ID NO: 1361227 - protein, 8 aa, Mycobacterium tuberculosis
AAPYDGSW

SEQ ID NO: 1361228 - protein, 19 aa, Mycobacterium tuberculosis
AAQAGETGDMEDAPDVVPT

SEQ ID NO: 1361229 - protein, 8 aa, Mycobacterium tuberculosis
AAQEELRK

SEQ ID NO: 1361230 - protein, 5 aa, Mycobacterium tuberculosis
AARAG

SEQ ID NO: 1361231 - protein, 14 aa, Mycobacterium tuberculosis
AARDAQKKGDFAAY

SEQ ID NO: 1361232 - protein, 12 aa, Mycobacterium tuberculosis
AARGAQPNTALA

SEQ ID NO: 1361233 - protein, 7 aa, Mycobacterium tuberculosis
AARTDDS

SEQ ID NO: 1361234 - protein, 9 aa, Mycobacterium tuberculosis
AASASAAAA

SEQ ID NO: 1361235 - protein, 13 aa, Mycobacterium tuberculosis
AASPGRRRHREVV

SEQ ID NO: 1361236 - protein, 15 aa, Mycobacterium tuberculosis
AASRASGWSRVSPRE

SEQ ID NO: 1361237 - protein, 9 aa, Mycobacterium tuberculosis
AASSANSGF

SEQ ID NO: 1361238 - protein, 10 aa, Mycobacterium tuberculosis
AATTTPAGVG

SEQ ID NO: 1361239 - protein, 6 aa, Mycobacterium tuberculosis
AAVGTT

SEQ ID NO: 1361240 - protein, 7 aa, Mycobacterium tuberculosis
AAYAAGS

SEQ ID NO: 1361241 - protein, 5 aa, Mycobacterium tuberculosis
ACSPG

SEQ ID NO: 1361242 - protein, 7 aa, Mycobacterium tuberculosis
ADAPSSV

SEQ ID NO: 1361243 - protein, 9 aa, Mycobacterium tuberculosis
ADDSPTGEM

SEQ ID NO: 1361244 - protein, 9 aa, Mycobacterium tuberculosis
ADGKQPSRA

SEQ ID NO: 1361245 - protein, 8 aa, Mycobacterium tuberculosis
ADGRRTHP

SEQ ID NO: 1361246 - protein, 9 aa, Mycobacterium tuberculosis
ADGSHAPEQ

SEQ ID NO: 1361247 - protein, 7 aa, Mycobacterium tuberculosis
ADHRRSA

SEQ ID NO: 1361248 - protein, 10 aa, Mycobacterium tuberculosis
ADLSGAGTAF

SEQ ID NO: 1361249 - protein, 13 aa, Mycobacterium tuberculosis
ADNALTGEDESAI

SEQ ID NO: 1361250 - protein, 7 aa, Mycobacterium tuberculosis
ADNDPVA

SEQ ID NO: 1361251 - protein, 15 aa, Mycobacterium tuberculosis
ADNEQRDKLRTVLES

SEQ ID NO: 1361252 - protein, 14 aa, Mycobacterium tuberculosis
ADNRDEYQEWLEEP

SEQ ID NO: 1361253 - protein, 8 aa, Mycobacterium tuberculosis
ADPDGTGY

SEQ ID NO: 1361254 - protein, 10 aa, Mycobacterium tuberculosis
ADPGASDDQF

SEQ ID NO: 1361255 - protein, 8 aa, Mycobacterium tuberculosis
ADQSTFGE

SEQ ID NO: 1361256 - protein, 6 aa, Mycobacterium tuberculosis
ADRNST

SEQ ID NO: 1361257 - protein, 6 aa, Mycobacterium tuberculosis
ADTADG

SEQ ID NO: 1361258 - protein, 9 aa, Mycobacterium tuberculosis
ADTSGRQAD

SEQ ID NO: 1361259 - protein, 16 aa, Mycobacterium tuberculosis
ADTYLDREQGFAFYGH

SEQ ID NO: 1361260 - protein, 13 aa, Mycobacterium tuberculosis
AEAQGSAASAKVA

SEQ ID NO: 1361261 - protein, 10 aa, Mycobacterium tuberculosis
AEDDPAPSTL

SEQ ID NO: 1361262 - protein, 8 aa, Mycobacterium tuberculosis
AEDTTGTV

SEQ ID NO: 1361263 - protein, 14 aa, Mycobacterium tuberculosis
AEHGSSIPDRGRTV

SEQ ID NO: 1361264 - protein, 8 aa, Mycobacterium tuberculosis
AEPDPNAG

SEQ ID NO: 1361265 - protein, 6 aa, Mycobacterium tuberculosis
AEPGLR

SEQ ID NO: 1361266 - protein, 6 aa, Mycobacterium tuberculosis
AEPGST

SEQ ID NO: 1361267 - protein, 23 aa, Mycobacterium tuberculosis
AEPHDTSPALLPQDAKTAAATSR

SEQ ID NO: 1361268 - protein, 6 aa, Mycobacterium tuberculosis
AEPSTA

SEQ ID NO: 1361269 - protein, 10 aa, Mycobacterium tuberculosis
AEQDDPDGGA

SEQ ID NO: 1361270 - protein, 15 aa, Mycobacterium tuberculosis
AERANPRRLADDAKT

SEQ ID NO: 1361271 - protein, 9 aa, Mycobacterium tuberculosis
AERERAAAP

SEQ ID NO: 1361272 - protein, 17 aa, Mycobacterium tuberculosis
AERQAPAAEPASQGSIA

SEQ ID NO: 1361273 - protein, 7 aa, Mycobacterium tuberculosis
AESPGEW

SEQ ID NO: 1361274 - protein, 8 aa, Mycobacterium tuberculosis
AETDPRAR

SEQ ID NO: 1361275 - protein, 8 aa, Mycobacterium tuberculosis
AEYPSEHP

SEQ ID NO: 1361276 - protein, 8 aa, Mycobacterium tuberculosis
AFADPESE

SEQ ID NO: 1361277 - protein, 8 aa, Mycobacterium tuberculosis
AFPGTGSN

SEQ ID NO: 1361278 - protein, 4 aa, Mycobacterium tuberculosis
AGAA

SEQ ID NO: 1361279 - protein, 12 aa, Mycobacterium tuberculosis
AGADSPPAREVG

SEQ ID NO: 1361280 - protein, 8 aa, Mycobacterium tuberculosis
AGAPEKAA

SEQ ID NO: 1361281 - protein, 10 aa, Mycobacterium tuberculosis
AGAPNLPSGY

SEQ ID NO: 1361282 - protein, 5 aa, Mycobacterium tuberculosis
AGASG

SEQ ID NO: 1361283 - protein, 8 aa, Mycobacterium tuberculosis
AGDEPIPE

SEQ ID NO: 1361284 - protein, 8 aa, Mycobacterium tuberculosis
AGDNRQYV

SEQ ID NO: 1361285 - protein, 11 aa, Mycobacterium tuberculosis
AGDTTKTASQV

SEQ ID NO: 1361286 - protein, 15 aa, Mycobacterium tuberculosis
AGEDHSKTGNPVQSA

SEQ ID NO: 1361287 - protein, 12 aa, Mycobacterium tuberculosis
AGEEIPQTKEEI

SEQ ID NO: 1361288 - protein, 6 aa, Mycobacterium tuberculosis
AGENRA

SEQ ID NO: 1361289 - protein, 5 aa, Mycobacterium tuberculosis
AGEPT

SEQ ID NO: 1361290 - protein, 17 aa, Mycobacterium tuberculosis
AGFGSTYADGERLGGRG

SEQ ID NO: 1361291 - protein, 9 aa, Mycobacterium tuberculosis
AGGGPVGVG

SEQ ID NO: 1361292 - protein, 5 aa, Mycobacterium tuberculosis
AGGIR

SEQ ID NO: 1361293 - protein, 9 aa, Mycobacterium tuberculosis
AGGRNLSAG

SEQ ID NO: 1361294 - protein, 5 aa, Mycobacterium tuberculosis
AGGTP

SEQ ID NO: 1361295 - protein, 9 aa, Mycobacterium tuberculosis
AGGTSTAAT

SEQ ID NO: 1361296 - protein, 7 aa, Mycobacterium tuberculosis
AGKDSFP

SEQ ID NO: 1361297 - protein, 19 aa, Mycobacterium tuberculosis
AGLGEATPGVQARQAAGKA

SEQ ID NO: 1361298 - protein, 5 aa, Mycobacterium tuberculosis
AGLSA

SEQ ID NO: 1361299 - protein, 8 aa, Mycobacterium tuberculosis
AGNRPRGQ

SEQ ID NO: 1361300 - protein, 8 aa, Mycobacterium tuberculosis
AGNRRRHD

SEQ ID NO: 1361301 - protein, 6 aa, Mycobacterium tuberculosis
AGPAGR

SEQ ID NO: 1361302 - protein, 5 aa, Mycobacterium tuberculosis
AGPKD

SEQ ID NO: 1361303 - protein, 7 aa, Mycobacterium tuberculosis
AGPNPGH

SEQ ID NO: 1361304 - protein, 6 aa, Mycobacterium tuberculosis
AGQSYF

SEQ ID NO: 1361305 - protein, 10 aa, Mycobacterium tuberculosis
AGRDHDSGSL

SEQ ID NO: 1361306 - protein, 7 aa, Mycobacterium tuberculosis
AGRRRTQ

SEQ ID NO: 1361307 - protein, 7 aa, Mycobacterium tuberculosis
AGRVGPI

SEQ ID NO: 1361308 - protein, 6 aa, Mycobacterium tuberculosis
AGSWQS

SEQ ID NO: 1361309 - protein, 36 aa, Mycobacterium tuberculosis; identical to SEQ ID NO: 149707

SEQ ID NO: 1361310 - protein, 4 aa, Mycobacterium tuberculosis
AGTR

SEQ ID NO: 1361311 - protein, 6 aa, Mycobacterium tuberculosis
AGTSTD

SEQ ID NO: 1361312 - protein, 17 aa, Mycobacterium tuberculosis
AGYQTRVSGDGGSISVG

SEQ ID NO: 1361313 - protein, 6 aa, Mycobacterium tuberculosis
AHAPER

SEQ ID NO: 1361314 - protein, 7 aa, Mycobacterium tuberculosis
AHHRPGI

SEQ ID NO: 1361315 - protein, 9 aa, Mycobacterium tuberculosis
AHPGASPAK

SEQ ID NO: 1361316 - protein, 6 aa, Mycobacterium tuberculosis
AHSGNA

SEQ ID NO: 1361317 - protein, 8 aa, Mycobacterium tuberculosis
AIAPPEGR

SEQ ID NO: 1361318 - protein, 4 aa, Mycobacterium tuberculosis
AIAQ

SEQ ID NO: 1361319 - protein, 7 aa, Mycobacterium tuberculosis
AIGPSAA

SEQ ID NO: 1361320 - protein, 6 aa, Mycobacterium tuberculosis
AIPPSA

SEQ ID NO: 1361321 - protein, 6 aa, Mycobacterium tuberculosis
AIRSDS

SEQ ID NO: 1361322 - protein, 7 aa, Mycobacterium tuberculosis
AKGNPRL

SEQ ID NO: 1361323 - protein, 11 aa, Mycobacterium tuberculosis
AKMDGATPGQA

SEQ ID NO: 1361324 - protein, 8 aa, Mycobacterium tuberculosis
AKPATRRY

SEQ ID NO: 1361325 - protein, 5 aa, Mycobacterium tuberculosis
AKQNS

SEQ ID NO: 1361326 - protein, 4 aa, Mycobacterium tuberculosis
AKQT

SEQ ID NO: 1361327 - protein, 6 aa, Mycobacterium tuberculosis
AKSNEQ

SEQ ID NO: 1361328 - protein, 10 aa, Mycobacterium tuberculosis
AKTGSRGTPV

SEQ ID NO: 1361329 - protein, 8 aa, Mycobacterium tuberculosis
ALLGGSPT

SEQ ID NO: 1361330 - protein, 14 aa, Mycobacterium tuberculosis
ALPRRASGRIQRDA

SEQ ID NO: 1361331 - protein, 10 aa, Mycobacterium tuberculosis
ALPSEPEQDG

SEQ ID NO: 1361332 - protein, 4 aa, Mycobacterium tuberculosis
ALPT

SEQ ID NO: 1361333 - protein, 24 aa, Mycobacterium tuberculosis
ALTPESGAGRGAAVDPSSLPRQTN

SEQ ID NO: 1361334 - protein, 11 aa, Mycobacterium tuberculosis
ANDPNQNGGYP

SEQ ID NO: 1361335 - protein, 8 aa, Mycobacterium tuberculosis
ANEKGRAL

SEQ ID NO: 1361336 - protein, 8 aa, Mycobacterium tuberculosis
ANNEDSVY

SEQ ID NO: 1361337 - protein, 5 aa, Mycobacterium tuberculosis
ANPHA

SEQ ID NO: 1361338 - protein, 6 aa, Mycobacterium tuberculosis
ANPRAH

SEQ ID NO: 1361339 - protein, 6 aa, Mycobacterium tuberculosis
ANRDGR

SEQ ID NO: 1361340 - protein, 8 aa, Mycobacterium tuberculosis
ANRPPGKL

SEQ ID NO: 1361341 - protein, 12 aa, Mycobacterium tuberculosis
ANSGLSGGERQR

SEQ ID NO: 1361342 - protein, 90 aa, Mycobacterium tuberculosis; identical to SEQ ID NO: 149852

SEQ ID NO: 1361343 - protein, 6 aa, Mycobacterium tuberculosis
APDGGE

SEQ ID NO: 1361344 - protein, 20 aa, Mycobacterium tuberculosis
APERKARALKRAGARSGHPK

SEQ ID NO: 1361345 - protein, 7 aa, Mycobacterium tuberculosis
APKRPSR

SEQ ID NO: 1361346 - protein, 6 aa, Mycobacterium tuberculosis
APLDGG

SEQ ID NO: 1361347 - protein, 5 aa, Mycobacterium tuberculosis
APLEE

SEQ ID NO: 1361348 - protein, 12 aa, Mycobacterium tuberculosis
APQTAGADEPDY

SEQ ID NO: 1361349 - protein, 11 aa, Mycobacterium tuberculosis
APRPDASYQDI

SEQ ID NO: 1361350 - protein, 12 aa, Mycobacterium tuberculosis
APRPQVERGGDV

SEQ ID NO: 1361351 - protein, 7 aa, Mycobacterium tuberculosis
APSRNGH

SEQ ID NO: 1361352 - protein, 5 aa, Mycobacterium tuberculosis
APSYE

SEQ ID NO: 1361353 - protein, 8 aa, Mycobacterium tuberculosis
APTPPLGP

SEQ ID NO: 1361354 - protein, 4 aa, Mycobacterium tuberculosis
APYG

SEQ ID NO: 1361355 - protein, 8 aa, Mycobacterium tuberculosis
AQADPGRT

SEQ ID NO: 1361356 - protein, 4 aa, Mycobacterium tuberculosis
AQAG

SEQ ID NO: 1361357 - protein, 13 aa, Mycobacterium tuberculosis
AQAGGNWPPPPTE

SEQ ID NO: 1361358 - protein, 8 aa, Mycobacterium tuberculosis
AQAPGQVT

SEQ ID NO: 1361359 - protein, 5 aa, Mycobacterium tuberculosis
AQEPQ

SEQ ID NO: 1361360 - protein, 5 aa, Mycobacterium tuberculosis
AQGSH

SEQ ID NO: 1361361 - protein, 25 aa, Mycobacterium tuberculosis
AQPNPQPMPPEYKERQRPREHAEWS

SEQ ID NO: 1361362 - protein, 6 aa, Mycobacterium tuberculosis
AQRGAS

SEQ ID NO: 1361363 - protein, 6 aa, Mycobacterium tuberculosis
AQSSAR

SEQ ID NO: 1361364 - protein, 10 aa, Mycobacterium tuberculosis
AQTAQTDPAV

SEQ ID NO: 1361365 - protein, 10 aa, Mycobacterium tuberculosis
ARAARQGRLQ

SEQ ID NO: 1361366 - protein, 10 aa, Mycobacterium tuberculosis
ARADSTSPVV

SEQ ID NO: 1361367 - protein, 7 aa, Mycobacterium tuberculosis
ARATGEP

SEQ ID NO: 1361368 - protein, 8 aa, Mycobacterium tuberculosis
ARDGGQVK

SEQ ID NO: 1361369 - protein, 9 aa, Mycobacterium tuberculosis
ARDHQAPAL

SEQ ID NO: 1361370 - protein, 8 aa, Mycobacterium tuberculosis
ARENGTVI

SEQ ID NO: 1361371 - protein, 14 aa, Mycobacterium tuberculosis
AREQAERGLAGSME

SEQ ID NO: 1361372 - protein, 10 aa, Mycobacterium tuberculosis
ARERGGGTRF

SEQ ID NO: 1361373 - protein, 8 aa, Mycobacterium tuberculosis
ARETRRDH

SEQ ID NO: 1361374 - protein, 4 aa, Mycobacterium tuberculosis
ARGA

SEQ ID NO: 1361375 - protein, 8 aa, Mycobacterium tuberculosis
ARGAQGLG

SEQ ID NO: 1361376 - protein, 19 aa, Mycobacterium tuberculosis
ARGDGADGGVEDPDREVGA

SEQ ID NO: 1361377 - protein, 9 aa, Mycobacterium tuberculosis
ARGKVAAAP

SEQ ID NO: 1361378 - protein, 10 aa, Mycobacterium tuberculosis
ARGRRQFQPP

SEQ ID NO: 1361379 - protein, 7 aa, Mycobacterium tuberculosis
ARHEPEA

SEQ ID NO: 1361380 - protein, 11 aa, Mycobacterium tuberculosis
ARNPDKALESA

SEQ ID NO: 1361381 - protein, 7 aa, Mycobacterium tuberculosis
ARPPKRH

SEQ ID NO: 1361382 - protein, 5 aa, Mycobacterium tuberculosis
ARPSA

SEQ ID NO: 1361383 - protein, 14 aa, Mycobacterium tuberculosis
ARPTGLESRDAETL

SEQ ID NO: 1361384 - protein, 7 aa, Mycobacterium tuberculosis
ARPTPIS

SEQ ID NO: 1361385 - protein, 8 aa, Mycobacterium tuberculosis
ARQPEAQG

SEQ ID NO: 1361386 - protein, 6 aa, Mycobacterium tuberculosis
ARQPTA

SEQ ID NO: 1361387 - protein, 17 aa, Mycobacterium tuberculosis
ARQTDSGDTQRSGHPSA

SEQ ID NO: 1361388 - protein, 13 aa, Mycobacterium tuberculosis
ARRPSQLAAQRDA

SEQ ID NO: 1361389 - protein, 4 aa, Mycobacterium tuberculosis
ARRS

SEQ ID NO: 1361390 - protein, 7 aa, Mycobacterium tuberculosis
ARSSSPH

SEQ ID NO: 1361391 - protein, 9 aa, Mycobacterium tuberculosis
ARSVAPGVR

SEQ ID NO: 1361392 - protein, 6 aa, Mycobacterium tuberculosis
ARTDGF

SEQ ID NO: 1361393 - protein, 6 aa, Mycobacterium tuberculosis
ARTGGL

SEQ ID NO: 1361394 - protein, 10 aa, Mycobacterium tuberculosis
ARVSPQRQNT

SEQ ID NO: 1361395 - protein, 11 aa, Mycobacterium tuberculosis
ASAAPTPGGVG

SEQ ID NO: 1361396 - protein, 15 aa, Mycobacterium tuberculosis
ASAASEFSEPLPTGA

SEQ ID NO: 1361397 - protein, 7 aa, Mycobacterium tuberculosis
ASAPALG

SEQ ID NO: 1361398 - protein, 8 aa, Mycobacterium tuberculosis
ASATKAKT

SEQ ID NO: 1361399 - protein, 5 aa, Mycobacterium tuberculosis
ASATR

SEQ ID NO: 1361400 - protein, 6 aa, Mycobacterium tuberculosis
ASESAR

SEQ ID NO: 1361401 - protein, 6 aa, Mycobacterium tuberculosis
ASETER

SEQ ID NO: 1361402 - protein, 69 aa, Mycobacterium tuberculosis; identical to SEQ ID NO: 155185

SEQ ID NO: 1361403 - protein, 7 aa, Mycobacterium tuberculosis
ASGPGDL

SEQ ID NO: 1361404 - protein, 5 aa, Mycobacterium tuberculosis
ASIPG

SEQ ID NO: 1361405 - protein, 5 aa, Mycobacterium tuberculosis
ASITS

SEQ ID NO: 1361406 - protein, 7 aa, Mycobacterium tuberculosis
ASLDHPG

SEQ ID NO: 1361407 - protein, 11 aa, Mycobacterium tuberculosis
ASNQHYSSRAA

SEQ ID NO: 1361408 - protein, 13 aa, Mycobacterium tuberculosis
ASPGASDAASSYP

SEQ ID NO: 1361409 - protein, 6 aa, Mycobacterium tuberculosis
ASQDPL

SEQ ID NO: 1361410 - protein, 10 aa, Mycobacterium tuberculosis
ASRNNPGPHG

SEQ ID NO: 1361411 - protein, 9 aa, Mycobacterium tuberculosis
ASSDPATYG

SEQ ID NO: 1361412 - protein, 13 aa, Mycobacterium tuberculosis
ASSSVSGRYPNLG

SEQ ID NO: 1361413 - protein, 6 aa, Mycobacterium tuberculosis
ASSTPY

SEQ ID NO: 1361414 - protein, 5 aa, Mycobacterium tuberculosis
ASTGL

SEQ ID NO: 1361415 - protein, 13 aa, Mycobacterium tuberculosis
ASTTGTSNGSVNS

SEQ ID NO: 1361416 - protein, 6 aa, Mycobacterium tuberculosis
ATATAS

SEQ ID NO: 1361417 - protein, 9 aa, Mycobacterium tuberculosis
ATDPPPPAL

SEQ ID NO: 1361418 - protein, 6 aa, Mycobacterium tuberculosis
ATDSAR

SEQ ID NO: 1361419 - protein, 8 aa, Mycobacterium tuberculosis
ATERQQRA

SEQ ID NO: 1361420 - protein, 6 aa, Mycobacterium tuberculosis
ATESAL

SEQ ID NO: 1361421 - protein, 4 aa, Mycobacterium tuberculosis
ATGT

SEQ ID NO: 1361422 - protein, 9 aa, Mycobacterium tuberculosis
ATGTEDGPP

SEQ ID NO: 1361423 - protein, 11 aa, Mycobacterium tuberculosis
ATISASASRTL

SEQ ID NO: 1361424 - protein, 12 aa, Mycobacterium tuberculosis
ATKDAIKATPLQ

SEQ ID NO: 1361425 - protein, 5 aa, Mycobacterium tuberculosis
ATKGK

SEQ ID NO: 1361426 - protein, 6 aa, Mycobacterium tuberculosis
ATPAGR

SEQ ID NO: 1361427 - protein, 17 aa, Mycobacterium tuberculosis
ATSLPPGALAIPQPALS

SEQ ID NO: 1361428 - protein, 9 aa, Mycobacterium tuberculosis
ATSSSIGSL

SEQ ID NO: 1361429 - protein, 8 aa, Mycobacterium tuberculosis
ATSSVDTR

SEQ ID NO: 1361430 - protein, 12 aa, Mycobacterium tuberculosis
AVPEPRAHYTGE

SEQ ID NO: 1361431 - protein, 5 aa, Mycobacterium tuberculosis
AVTAA

SEQ ID NO: 1361432 - protein, 4 aa, Mycobacterium tuberculosis
AVTP

SEQ ID NO: 1361433 - protein, 6 aa, Mycobacterium tuberculosis
AYPDNP

SEQ ID NO: 1361434 - protein, 9 aa, Mycobacterium tuberculosis
AYPSGGGDY

SEQ ID NO: 1361435 - protein, 7 aa, Mycobacterium tuberculosis
AYTTGKY

SEQ ID NO: 1361436 - protein, 8 aa, Mycobacterium tuberculosis
CDTQTDPN

SEQ ID NO: 1361437 - protein, 14 aa, Mycobacterium tuberculosis
CGPLSSKEPSRDSY

SEQ ID NO: 1361438 - protein, 21 aa, Mycobacterium tuberculosis
CKEPSARAPAPAAPTPQRRGS

SEQ ID NO: 1361439 - protein, 5 aa, Mycobacterium tuberculosis
CNERA

SEQ ID NO: 1361440 - protein, 5 aa, Mycobacterium tuberculosis
CTPTE

SEQ ID NO: 1361441 - protein, 5 aa, Mycobacterium tuberculosis
DAAEP

SEQ ID NO: 1361442 - protein, 8 aa, Mycobacterium tuberculosis
DAAERSYQ

SEQ ID NO: 1361443 - protein, 9 aa, Mycobacterium tuberculosis
DADGHAPGL

SEQ ID NO: 1361444 - protein, 6 aa, Mycobacterium tuberculosis
DAEGQR

SEQ ID NO: 1361445 - protein, 7 aa, Mycobacterium tuberculosis
DAGRGLG

SEQ ID NO: 1361446 - protein, 7 aa, Mycobacterium tuberculosis
DAGSGHK

SEQ ID NO: 1361447 - protein, 6 aa, Mycobacterium tuberculosis
DAGTRA

SEQ ID NO: 1361448 - protein, 8 aa, Mycobacterium tuberculosis
DAGVDGSV

SEQ ID NO: 1361449 - protein, 14 aa, Mycobacterium tuberculosis
DALDPASRSLRRGV

SEQ ID NO: 1361450 - protein, 6 aa, Mycobacterium tuberculosis
DAPGFS

SEQ ID NO: 1361451 - protein, 7 aa, Mycobacterium tuberculosis
DAPPGMT

SEQ ID NO: 1361452 - protein, 8 aa, Mycobacterium tuberculosis
DASRNDDS

SEQ ID NO: 1361453 - protein, 4 aa, Mycobacterium tuberculosis
DAYG

SEQ ID NO: 1361454 - protein, 8 aa, Mycobacterium tuberculosis
DDDEPGGD

SEQ ID NO: 1361455 - protein, 8 aa, Mycobacterium tuberculosis
DDFGAAEA

SEQ ID NO: 1361456 - protein, 7 aa, Mycobacterium tuberculosis
DDHRDAD

SEQ ID NO: 1361457 - protein, 9 aa, Mycobacterium tuberculosis
DDPANTTTP

SEQ ID NO: 1361458 - protein, 16 aa, Mycobacterium tuberculosis
DDPDTQLTGAPPGYQQ

SEQ ID NO: 1361459 - protein, 5 aa, Mycobacterium tuberculosis
DDRPR

SEQ ID NO: 1361460 - protein, 6 aa, Mycobacterium tuberculosis
DEGRPR

SEQ ID NO: 1361461 - protein, 4 aa, Mycobacterium tuberculosis
DEMG

SEQ ID NO: 1361462 - protein, 13 aa, Mycobacterium tuberculosis
DEPADRPVDHESA

SEQ ID NO: 1361463 - protein, 7 aa, Mycobacterium tuberculosis
DEPGYTT

SEQ ID NO: 1361464 - protein, 9 aa, Mycobacterium tuberculosis
DEPSGPDDL

SEQ ID NO: 1361465 - protein, 10 aa, Mycobacterium tuberculosis
DESQDPEPTQ

SEQ ID NO: 1361466 - protein, 11 aa, Mycobacterium tuberculosis
DETTGYGAKNV

SEQ ID NO: 1361467 - protein, 4 aa, Mycobacterium tuberculosis
DEVS

SEQ ID NO: 1361468 - protein, 5 aa, Mycobacterium tuberculosis
DFAPG

SEQ ID NO: 1361469 - protein, 4 aa, Mycobacterium tuberculosis
DGAN

SEQ ID NO: 1361470 - protein, 6 aa, Mycobacterium tuberculosis
DGGAGL

SEQ ID NO: 1361471 - protein, 9 aa, Mycobacterium tuberculosis
DGGPPRVES

SEQ ID NO: 1361472 - protein, 7 aa, Mycobacterium tuberculosis
DGREPEF

SEQ ID NO: 1361473 - protein, 9 aa, Mycobacterium tuberculosis
DGSAPDVSG

SEQ ID NO: 1361474 - protein, 5 aa, Mycobacterium tuberculosis
DGSHG

SEQ ID NO: 1361475 - protein, 8 aa, Mycobacterium tuberculosis
DGSTGPFG

SEQ ID NO: 1361476 - protein, 8 aa, Mycobacterium tuberculosis
DGTASATA

SEQ ID NO: 1361477 - protein, 7 aa, Mycobacterium tuberculosis
DGTPESA

SEQ ID NO: 1361478 - protein, 13 aa, Mycobacterium tuberculosis
DGTPLDDRRPGAI

SEQ ID NO: 1361479 - protein, 6 aa, Mycobacterium tuberculosis
DGTSKR

SEQ ID NO: 1361480 - protein, 5 aa, Mycobacterium tuberculosis
DGYSG

SEQ ID NO: 1361481 - protein, 10 aa, Mycobacterium tuberculosis
DHHANPTRRY

SEQ ID NO: 1361482 - protein, 6 aa, Mycobacterium tuberculosis
DITSET

SEQ ID NO: 1361483 - protein, 5 aa, Mycobacterium tuberculosis
DKGPQ

SEQ ID NO: 1361484 - protein, 5 aa, Mycobacterium tuberculosis
DKPGV

SEQ ID NO: 1361485 - protein, 11 aa, Mycobacterium tuberculosis
DKRPKTPPRTV

SEQ ID NO: 1361486 - protein, 7 aa, Mycobacterium tuberculosis
DLADPSY

SEQ ID NO: 1361487 - protein, 7 aa, Mycobacterium tuberculosis
DLASAGS

SEQ ID NO: 1361488 - protein, 8 aa, Mycobacterium tuberculosis
DLDPTLRR

SEQ ID NO: 1361489 - protein, 8 aa, Mycobacterium tuberculosis
DLGGQGIR

SEQ ID NO: 1361490 - protein, 17 aa, Mycobacterium tuberculosis
DLPEESRASGFGRSEST

SEQ ID NO: 1361491 - protein, 12 aa, Mycobacterium tuberculosis
DNDHTQAKTPPV

SEQ ID NO: 1361492 - protein, 7 aa, Mycobacterium tuberculosis
DNPTEGY

SEQ ID NO: 1361493 - protein, 8 aa, Mycobacterium tuberculosis
DNRATADR

SEQ ID NO: 1361494 - protein, 5 aa, Mycobacterium tuberculosis
DNTTA

SEQ ID NO: 1361495 - protein, 5 aa, Mycobacterium tuberculosis
DPDQP

SEQ ID NO: 1361496 - protein, 8 aa, Mycobacterium tuberculosis
DPEDLGAR

SEQ ID NO: 1361497 - protein, 5 aa, Mycobacterium tuberculosis
DPITA

SEQ ID NO: 1361498 - protein, 12 aa, Mycobacterium tuberculosis
DPNPTASSYQPP

SEQ ID NO: 1361499 - protein, 7 aa, Mycobacterium tuberculosis
DPQRRAQ

SEQ ID NO: 1361500 - protein, 13 aa, Mycobacterium tuberculosis
DPSRVRRSGGTGL

SEQ ID NO: 1361501 - protein, 6 aa, Mycobacterium tuberculosis
DQPGGL

SEQ ID NO: 1361502 - protein, 7 aa, Mycobacterium tuberculosis
DRAADPM

SEQ ID NO: 1361503 - protein, 5 aa, Mycobacterium tuberculosis
DRAAL

SEQ ID NO: 1361504 - protein, 5 aa, Mycobacterium tuberculosis
DRDSG

SEQ ID NO: 1361505 - protein, 11 aa, Mycobacterium tuberculosis
DRGASPATAAR

SEQ ID NO: 1361506 - protein, 8 aa, Mycobacterium tuberculosis
DRGGRERH

SEQ ID NO: 1361507 - protein, 11 aa, Mycobacterium tuberculosis
DRMSPQQASRI

SEQ ID NO: 1361508 - protein, 4 aa, Mycobacterium tuberculosis
DRNG

SEQ ID NO: 1361509 - protein, 8 aa, Mycobacterium tuberculosis
DRPAASEN

SEQ ID NO: 1361510 - protein, 7 aa, Mycobacterium tuberculosis
DRPPMPP

SEQ ID NO: 1361511 - protein, 12 aa, Mycobacterium tuberculosis
DRPPRRADEPRR

SEQ ID NO: 1361512 - protein, 16 aa, Mycobacterium tuberculosis
DRRRAAQTKADTEYNA

SEQ ID NO: 1361513 - protein, 7 aa, Mycobacterium tuberculosis
DRTATGE

SEQ ID NO: 1361514 - protein, 6 aa, Mycobacterium tuberculosis
DRVGGS

SEQ ID NO: 1361515 - protein, 31 aa, Mycobacterium tuberculosis; identical to SEQ ID NO: 150575

SEQ ID NO: 1361516 - protein, 18 aa, Mycobacterium tuberculosis
DSDGRGLHDRLTATAVVR

SEQ ID NO: 1361517 - protein, 9 aa, Mycobacterium tuberculosis
DSGAAAAGA

SEQ ID NO: 1361518 - protein, 7 aa, Mycobacterium tuberculosis
DSPEVGT

SEQ ID NO: 1361519 - protein, 17 aa, Mycobacterium tuberculosis
DSRPEDYEGAEISDGAG

SEQ ID NO: 1361520 - protein, 8 aa, Mycobacterium tuberculosis
DSSAAGAD

SEQ ID NO: 1361521 - protein, 13 aa, Mycobacterium tuberculosis
DSVRAGIGAARAG

SEQ ID NO: 1361522 - protein, 9 aa, Mycobacterium tuberculosis
DTAKSGDSF

SEQ ID NO: 1361523 - protein, 15 aa, Mycobacterium tuberculosis
DTASDSETSPTAAEP

SEQ ID NO: 1361524 - protein, 10 aa, Mycobacterium tuberculosis
DTGIERPAGT

SEQ ID NO: 1361525 - protein, 7 aa, Mycobacterium tuberculosis
DTPSQLS

SEQ ID NO: 1361526 - protein, 6 aa, Mycobacterium tuberculosis
DTPVSS

SEQ ID NO: 1361527 - protein, 21 aa, Mycobacterium tuberculosis
DTTEAVTKSVQSQATDRRDAA

SEQ ID NO: 1361528 - protein, 21 aa, Mycobacterium tuberculosis
DTTHDRHAAARAERERAELEA

SEQ ID NO: 1361529 - protein, 5 aa, Mycobacterium tuberculosis
DVPRA

SEQ ID NO: 1361530 - protein, 11 aa, Mycobacterium tuberculosis
DVRGQSSADAI

SEQ ID NO: 1361531 - protein, 11 aa, Mycobacterium tuberculosis
DVSAPRRRPEL

SEQ ID NO: 1361532 - protein, 15 aa, Mycobacterium tuberculosis
DVTNPAARNETSSPI

SEQ ID NO: 1361533 - protein, 12 aa, Mycobacterium tuberculosis
DYEESSDLDDEL

SEQ ID NO: 1361534 - protein, 7 aa, Mycobacterium tuberculosis
DYKTNSY

SEQ ID NO: 1361535 - protein, 4 aa, Mycobacterium tuberculosis
DYSD

SEQ ID NO: 1361536 - protein, 9 aa, Mycobacterium tuberculosis
EAANNPSQF

SEQ ID NO: 1361537 - protein, 9 aa, Mycobacterium tuberculosis
EAEAAEAEA

SEQ ID NO: 1361538 - protein, 4 aa, Mycobacterium tuberculosis
EAEG

SEQ ID NO: 1361539 - protein, 6 aa, Mycobacterium tuberculosis
EAGERK

SEQ ID NO: 1361540 - protein, 8 aa, Mycobacterium tuberculosis
EAGGKTQG

SEQ ID NO: 1361541 - protein, 22 aa, Mycobacterium tuberculosis
EAGPAGGPAPVESTDNLWLTRP

SEQ ID NO: 1361542 - protein, 7 aa, Mycobacterium tuberculosis
EAGPKRL

SEQ ID NO: 1361543 - protein, 8 aa, Mycobacterium tuberculosis
EAHGNPGA

SEQ ID NO: 1361544 - protein, 8 aa, Mycobacterium tuberculosis
EAKATRPL

SEQ ID NO: 1361545 - protein, 4 aa, Mycobacterium tuberculosis
EAPQ

SEQ ID NO: 1361546 - protein, 9 aa, Mycobacterium tuberculosis
EASAGEAGQ

SEQ ID NO: 1361547 - protein, 9 aa, Mycobacterium tuberculosis
EDAGPAGQQ

SEQ ID NO: 1361548 - protein, 7 aa, Mycobacterium tuberculosis
EDGRTSV

SEQ ID NO: 1361549 - protein, 13 aa, Mycobacterium tuberculosis
EDGTADDRLPNQS

SEQ ID NO: 1361550 - protein, 14 aa, Mycobacterium tuberculosis
EDNKTYDLSGQTGP

SEQ ID NO: 1361551 - protein, 23 aa, Mycobacterium tuberculosis
EDPKFASSVRGGGFRAPTARRRL

SEQ ID NO: 1361552 - protein, 6 aa, Mycobacterium tuberculosis
EDTPAD

SEQ ID NO: 1361553 - protein, 16 aa, Mycobacterium tuberculosis
EDTQRSNRYRATRNRV

SEQ ID NO: 1361554 - protein, 10 aa, Mycobacterium tuberculosis
EEDSEALPVG

SEQ ID NO: 1361555 - protein, 7 aa, Mycobacterium tuberculosis
EEPDDPD

SEQ ID NO: 1361556 - protein, 6 aa, Mycobacterium tuberculosis
EETGLR

SEQ ID NO: 1361557 - protein, 11 aa, Mycobacterium tuberculosis
EETKRPQRDVP

SEQ ID NO: 1361558 - protein, 8 aa, Mycobacterium tuberculosis
EEWPAPAT

SEQ ID NO: 1361559 - protein, 9 aa, Mycobacterium tuberculosis
EEYGGGGAG

SEQ ID NO: 1361560 - protein, 11 aa, Mycobacterium tuberculosis
EGEMSSPSSLS

SEQ ID NO: 1361561 - protein, 5 aa, Mycobacterium tuberculosis
EGHAP

SEQ ID NO: 1361562 - protein, 8 aa, Mycobacterium tuberculosis
EGNPDGPT

SEQ ID NO: 1361563 - protein, 11 aa, Mycobacterium tuberculosis
EGPGVPRGTEE

SEQ ID NO: 1361564 - protein, 16 aa, Mycobacterium tuberculosis
EGRDPTDREQESDTEG

SEQ ID NO: 1361565 - protein, 5 aa, Mycobacterium tuberculosis
EGREL

SEQ ID NO: 1361566 - protein, 8 aa, Mycobacterium tuberculosis
EGSAGQAS

SEQ ID NO: 1361567 - protein, 5 aa, Mycobacterium tuberculosis
EGSTI

SEQ ID NO: 1361568 - protein, 9 aa, Mycobacterium tuberculosis
EGYDTETAV

SEQ ID NO: 1361569 - protein, 9 aa, Mycobacterium tuberculosis
EHERAADTD

SEQ ID NO: 1361570 - protein, 6 aa, Mycobacterium tuberculosis
EHPERA

SEQ ID NO: 1361571 - protein, 6 aa, Mycobacterium tuberculosis
EHRAET

SEQ ID NO: 1361572 - protein, 6 aa, Mycobacterium tuberculosis
EIAPPT

SEQ ID NO: 1361573 - protein, 9 aa, Mycobacterium tuberculosis
EIDREQQRR

SEQ ID NO: 1361574 - protein, 8 aa, Mycobacterium tuberculosis
EKATASAD

SEQ ID NO: 1361575 - protein, 10 aa, Mycobacterium tuberculosis
EKTEPKPDLS

SEQ ID NO: 1361576 - protein, 8 aa, Mycobacterium tuberculosis
ELEDDADD

SEQ ID NO: 1361577 - protein, 9 aa, Mycobacterium tuberculosis
ELGPPKEVT

SEQ ID NO: 1361578 - protein, 10 aa, Mycobacterium tuberculosis
EMSPGGQPWS

SEQ ID NO: 1361579 - protein, 7 aa, Mycobacterium tuberculosis
ENARHAG

SEQ ID NO: 1361580 - protein, 10 aa, Mycobacterium tuberculosis
ENGNEVPQGA

SEQ ID NO: 1361581 - protein, 9 aa, Mycobacterium tuberculosis
ENRGSQERV

SEQ ID NO: 1361582 - protein, 20 aa, Mycobacterium tuberculosis
EPASTGARTSIGPGAASGQR

SEQ ID NO: 1361583 - protein, 20 aa, Mycobacterium tuberculosis
EPDAGSNSHKITTTARRDGS

SEQ ID NO: 1361584 - protein, 30 aa, Mycobacterium tuberculosis; identical to SEQ ID NO: 150824

SEQ ID NO: 1361585 - protein, 14 aa, Mycobacterium tuberculosis
EPEESPEPEPELPN

SEQ ID NO: 1361586 - protein, 5 aa, Mycobacterium tuberculosis
EQETA

SEQ ID NO: 1361587 - protein, 5 aa, Mycobacterium tuberculosis
EQGRG

SEQ ID NO: 1361588 - protein, 10 aa, Mycobacterium tuberculosis
ERAPRAARRR

SEQ ID NO: 1361589 - protein, 4 aa, Mycobacterium tuberculosis
ERDQ

SEQ ID NO: 1361590 - protein, 6 aa, Mycobacterium tuberculosis
EREPAE

SEQ ID NO: 1361591 - protein, 6 aa, Mycobacterium tuberculosis
ERGTGG

SEQ ID NO: 1361592 - protein, 12 aa, Mycobacterium tuberculosis
ERHDGASREIDR

SEQ ID NO: 1361593 - protein, 8 aa, Mycobacterium tuberculosis
ERHERSTH

SEQ ID NO: 1361594 - protein, 14 aa, Mycobacterium tuberculosis
ERLGSGATAGEGTQ

SEQ ID NO: 1361595 - protein, 11 aa, Mycobacterium tuberculosis
ERPGAGTAGPM

SEQ ID NO: 1361596 - protein, 10 aa, Mycobacterium tuberculosis
ERTPSHDEAR

SEQ ID NO: 1361597 - protein, 7 aa, Mycobacterium tuberculosis
ERTTGDK

SEQ ID NO: 1361598 - protein, 10 aa, Mycobacterium tuberculosis
ERVSAATKAV

SEQ ID NO: 1361599 - protein, 5 aa, Mycobacterium tuberculosis
ESARP

SEQ ID NO: 1361600 - protein, 11 aa, Mycobacterium tuberculosis
ESDGDGTTVES

SEQ ID NO: 1361601 - protein, 10 aa, Mycobacterium tuberculosis
ESDPASTEGI

SEQ ID NO: 1361602 - protein, 6 aa, Mycobacterium tuberculosis
ESGFAR

SEQ ID NO: 1361603 - protein, 6 aa, Mycobacterium tuberculosis
ESLPQT

SEQ ID NO: 1361604 - protein, 7 aa, Mycobacterium tuberculosis
ESLSGRD

SEQ ID NO: 1361605 - protein, 7 aa, Mycobacterium tuberculosis
ESPEFDR

SEQ ID NO: 1361606 - protein, 7 aa, Mycobacterium tuberculosis
ESRERQA

SEQ ID NO: 1361607 - protein, 17 aa, Mycobacterium tuberculosis
ESTADSDNDRDPPTDPN

SEQ ID NO: 1361608 - protein, 5 aa, Mycobacterium tuberculosis
ETGPE

SEQ ID NO: 1361609 - protein, 11 aa, Mycobacterium tuberculosis
ETLTSDQTAKL

SEQ ID NO: 1361610 - protein, 6 aa, Mycobacterium tuberculosis
ETSRQA

SEQ ID NO: 1361611 - protein, 7 aa, Mycobacterium tuberculosis
ETVEGRG

SEQ ID NO: 1361612 - protein, 5 aa, Mycobacterium tuberculosis
ETYSQ

SEQ ID NO: 1361613 - protein, 9 aa, Mycobacterium tuberculosis
EVAGGDPET

SEQ ID NO: 1361614 - protein, 8 aa, Mycobacterium tuberculosis
EVPAEDPT

SEQ ID NO: 1361615 - protein, 9 aa, Mycobacterium tuberculosis
EVTRDGESA

SEQ ID NO: 1361616 - protein, 11 aa, Mycobacterium tuberculosis
EYATEPDGSMP

SEQ ID NO: 1361617 - protein, 6 aa, Mycobacterium tuberculosis
FAGSGS

SEQ ID NO: 1361618 - protein, 6 aa, Mycobacterium tuberculosis
FDPNSK

SEQ ID NO: 1361619 - protein, 25 aa, Mycobacterium tuberculosis
FGGGGVAPSGGGDDKHVKATSAADA

SEQ ID NO: 1361620 - protein, 5 aa, Mycobacterium tuberculosis
FGGGT

SEQ ID NO: 1361621 - protein, 6 aa, Mycobacterium tuberculosis
FGGPGD

SEQ ID NO: 1361622 - protein, 6 aa, Mycobacterium tuberculosis
FGQSGQ

SEQ ID NO: 1361623 - protein, 7 aa, Mycobacterium tuberculosis
FGRSGGR

SEQ ID NO: 1361624 - protein, 4 aa, Mycobacterium tuberculosis
FGTA

SEQ ID NO: 1361625 - protein, 7 aa, Mycobacterium tuberculosis
FNPSTVG

SEQ ID NO: 1361626 - protein, 11 aa, Mycobacterium tuberculosis
FPKGPARNAAT

SEQ ID NO: 1361627 - protein, 5 aa, Mycobacterium tuberculosis
FPSSN

SEQ ID NO: 1361628 - protein, 7 aa, Mycobacterium tuberculosis
FSPEDTA

SEQ ID NO: 1361629 - protein, 5 aa, Mycobacterium tuberculosis
FTPKT

SEQ ID NO: 1361630 - protein, 13 aa, Mycobacterium tuberculosis
GAAAATAIAATTP

SEQ ID NO: 1361631 - protein, 11 aa, Mycobacterium tuberculosis
GAAAGRATAKA

SEQ ID NO: 1361632 - protein, 5 aa, Mycobacterium tuberculosis
GAAEP

SEQ ID NO: 1361633 - protein, 9 aa, Mycobacterium tuberculosis
GAARPARRS

SEQ ID NO: 1361634 - protein, 12 aa, Mycobacterium tuberculosis
GADGSAGSEDAD

SEQ ID NO: 1361635 - protein, 12 aa, Mycobacterium tuberculosis
GADVDAGGSQHN

SEQ ID NO: 1361636 - protein, 8 aa, Mycobacterium tuberculosis
GAEFGAGP

SEQ ID NO: 1361637 - protein, 5 aa, Mycobacterium tuberculosis
GAEIP

SEQ ID NO: 1361638 - protein, 9 aa, Mycobacterium tuberculosis
GAGIGDGVA

SEQ ID NO: 1361639 - protein, 23 aa, Mycobacterium tuberculosis
GAGQRYAGQRRTRRVRALEGQRY

SEQ ID NO: 1361640 - protein, 6 aa, Mycobacterium tuberculosis
GAGRPR

SEQ ID NO: 1361641 - protein, 4 aa, Mycobacterium tuberculosis
GAGT

SEQ ID NO: 1361642 - protein, 17 aa, Mycobacterium tuberculosis
GALGGKTGYTDDAGQTF

SEQ ID NO: 1361643 - protein, 13 aa, Mycobacterium tuberculosis
GALGGLSTTSPAW

SEQ ID NO: 1361644 - protein, 7 aa, Mycobacterium tuberculosis
GANPQDA

SEQ ID NO: 1361645 - protein, 9 aa, Mycobacterium tuberculosis
GAPALPNAT

SEQ ID NO: 1361646 - protein, 12 aa, Mycobacterium tuberculosis
GAPGSGKSTLAS

SEQ ID NO: 1361647 - protein, 13 aa, Mycobacterium tuberculosis
GAPPYRADSAGTL

SEQ ID NO: 1361648 - protein, 7 aa, Mycobacterium tuberculosis
GAPQQSW

SEQ ID NO: 1361649 - protein, 6 aa, Mycobacterium tuberculosis
GAPTPI

SEQ ID NO: 1361650 - protein, 7 aa, Mycobacterium tuberculosis
GARDRQG

SEQ ID NO: 1361651 - protein, 9 aa, Mycobacterium tuberculosis
GARGPGGDT

SEQ ID NO: 1361652 - protein, 9 aa, Mycobacterium tuberculosis
GASATASGL

SEQ ID NO: 1361653 - protein, 5 aa, Mycobacterium tuberculosis
GASER

SEQ ID NO: 1361654 - protein, 9 aa, Mycobacterium tuberculosis
GASSGVASN

SEQ ID NO: 1361655 - protein, 7 aa, Mycobacterium tuberculosis
GAVPGSP

SEQ ID NO: 1361656 - protein, 7 aa, Mycobacterium tuberculosis
GDADPLG

SEQ ID NO: 1361657 - protein, 7 aa, Mycobacterium tuberculosis
GDDRPAY

SEQ ID NO: 1361658 - protein, 4 aa, Mycobacterium tuberculosis
GDGV

SEQ ID NO: 1361659 - protein, 6 aa, Mycobacterium tuberculosis
GDKTTL

SEQ ID NO: 1361660 - protein, 13 aa, Mycobacterium tuberculosis
GDLGSTQSKQAYA

SEQ ID NO: 1361661 - protein, 5 aa, Mycobacterium tuberculosis
GDNAV

SEQ ID NO: 1361662 - protein, 7 aa, Mycobacterium tuberculosis
GDNGRAA

SEQ ID NO: 1361663 - protein, 7 aa, Mycobacterium tuberculosis
GDPDSQR

SEQ ID NO: 1361664 - protein, 6 aa, Mycobacterium tuberculosis
GDPEGQ

SEQ ID NO: 1361665 - protein, 9 aa, Mycobacterium tuberculosis
GDPETHRRT

SEQ ID NO: 1361666 - protein, 8 aa, Mycobacterium tuberculosis
GDPGNGEG

SEQ ID NO: 1361667 - protein, 5 aa, Mycobacterium tuberculosis
GDPLS

SEQ ID NO: 1361668 - protein, 7 aa, Mycobacterium tuberculosis
GDPMSQA

SEQ ID NO: 1361669 - protein, 13 aa, Mycobacterium tuberculosis
GDPPKKRSAANTH

SEQ ID NO: 1361670 - protein, 8 aa, Mycobacterium tuberculosis
GDRLDDSL

SEQ ID NO: 1361671 - protein, 8 aa, Mycobacterium tuberculosis
GDRPLTPA

SEQ ID NO: 1361672 - protein, 10 aa, Mycobacterium tuberculosis
GDTGLTSTGS

SEQ ID NO: 1361673 - protein, 13 aa, Mycobacterium tuberculosis
GDYDEAELEQQLD

SEQ ID NO: 1361674 - protein, 6 aa, Mycobacterium tuberculosis
GEGIGA

SEQ ID NO: 1361675 - protein, 7 aa, Mycobacterium tuberculosis
GEHGGLS

SEQ ID NO: 1361676 - protein, 6 aa, Mycobacterium tuberculosis
GENPVA

SEQ ID NO: 1361677 - protein, 5 aa, Mycobacterium tuberculosis
GERAS

SEQ ID NO: 1361678 - protein, 6 aa, Mycobacterium tuberculosis
GERISA

SEQ ID NO: 1361679 - protein, 9 aa, Mycobacterium tuberculosis
GESGPSGRH

SEQ ID NO: 1361680 - protein, 5 aa, Mycobacterium tuberculosis
GFEDG

SEQ ID NO: 1361681 - protein, 4 aa, Mycobacterium tuberculosis
GFSR

SEQ ID NO: 1361682 - protein, 9 aa, Mycobacterium tuberculosis
GGDDAATLA

SEQ ID NO: 1361683 - protein, 6 aa, Mycobacterium tuberculosis
GGDTTL

SEQ ID NO: 1361684 - protein, 12 aa, Mycobacterium tuberculosis
GGEGLGLRSPGP

SEQ ID NO: 1361685 - protein, 9 aa, Mycobacterium tuberculosis
GGGDTPPPA

SEQ ID NO: 1361686 - protein, 7 aa, Mycobacterium tuberculosis
GGGLRPA

SEQ ID NO: 1361687 - protein, 11 aa, Mycobacterium tuberculosis
GGGQRDPQTPI

SEQ ID NO: 1361688 - protein, 8 aa, Mycobacterium tuberculosis
GGGSEGLA

SEQ ID NO: 1361689 - protein, 13 aa, Mycobacterium tuberculosis
GGKAGFPPDGRAG

SEQ ID NO: 1361690 - protein, 7 aa, Mycobacterium tuberculosis
GGKEFGR

SEQ ID NO: 1361691 - protein, 9 aa, Mycobacterium tuberculosis
GGLAGEPED

SEQ ID NO: 1361692 - protein, 4 aa, Mycobacterium tuberculosis
GGNG

SEQ ID NO: 1361693 - protein, 4 aa, Mycobacterium tuberculosis
GGPI

SEQ ID NO: 1361694 - protein, 11 aa, Mycobacterium tuberculosis
GGPPDGNGGTP

SEQ ID NO: 1361695 - protein, 4 aa, Mycobacterium tuberculosis
GGQT

SEQ ID NO: 1361696 - protein, 13 aa, Mycobacterium tuberculosis
GGSAPVLEGPSSV

SEQ ID NO: 1361697 - protein, 7 aa, Mycobacterium tuberculosis
GGSGSVV

SEQ ID NO: 1361698 - protein, 6 aa, Mycobacterium tuberculosis
GGTGAL

SEQ ID NO: 1361699 - protein, 6 aa, Mycobacterium tuberculosis
GGTHGS

SEQ ID NO: 1361700 - protein, 5 aa, Mycobacterium tuberculosis
GGTST

SEQ ID NO: 1361701 - protein, 5 aa, Mycobacterium tuberculosis
GGTTY

SEQ ID NO: 1361702 - protein, 4 aa, Mycobacterium tuberculosis
GGTV

SEQ ID NO: 1361703 - protein, 6 aa, Mycobacterium tuberculosis
GHDPAT

SEQ ID NO: 1361704 - protein, 7 aa, Mycobacterium tuberculosis
GHNLDTT

SEQ ID NO: 1361705 - protein, 4 aa, Mycobacterium tuberculosis
GITT

SEQ ID NO: 1361706 - protein, 8 aa, Mycobacterium tuberculosis
GKDGHGGL

SEQ ID NO: 1361707 - protein, 8 aa, Mycobacterium tuberculosis
GKEANGSR

SEQ ID NO: 1361708 - protein, 6 aa, Mycobacterium tuberculosis
GKEVPA

SEQ ID NO: 1361709 - protein, 7 aa, Mycobacterium tuberculosis
GKPVPTV

SEQ ID NO: 1361710 - protein, 9 aa, Mycobacterium tuberculosis
GLASSSVGA

SEQ ID NO: 1361711 - protein, 4 aa, Mycobacterium tuberculosis
GLGG

SEQ ID NO: 1361712 - protein, 5 aa, Mycobacterium tuberculosis
GLGRP

SEQ ID NO: 1361713 - protein, 9 aa, Mycobacterium tuberculosis
GLKRQPDHQ

SEQ ID NO: 1361714 - protein, 13 aa, Mycobacterium tuberculosis
GLPDTGPGSLAPM

SEQ ID NO: 1361715 - protein, 6 aa, Mycobacterium tuberculosis
GLPPAA

SEQ ID NO: 1361716 - protein, 8 aa, Mycobacterium tuberculosis
GNANTDGT

SEQ ID NO: 1361717 - protein, 10 aa, Mycobacterium tuberculosis
GNAPNDDPYR

SEQ ID NO: 1361718 - protein, 10 aa, Mycobacterium tuberculosis
GNIAGNPSQY

SEQ ID NO: 1361719 - protein, 10 aa, Mycobacterium tuberculosis
GNNPGAQTSE

SEQ ID NO: 1361720 - protein, 8 aa, Mycobacterium tuberculosis
GNRDNANP

SEQ ID NO: 1361721 - protein, 5 aa, Mycobacterium tuberculosis
GNRPR

SEQ ID NO: 1361722 - protein, 6 aa, Mycobacterium tuberculosis
GNRSER

SEQ ID NO: 1361723 - protein, 5 aa, Mycobacterium tuberculosis
GPAAA

SEQ ID NO: 1361724 - protein, 6 aa, Mycobacterium tuberculosis
GPAPEG

SEQ ID NO: 1361725 - protein, 5 aa, Mycobacterium tuberculosis
GPATS

SEQ ID NO: 1361726 - protein, 8 aa, Mycobacterium tuberculosis
GPDDCASV

SEQ ID NO: 1361727 - protein, 9 aa, Mycobacterium tuberculosis
GPDDTERAI

SEQ ID NO: 1361728 - protein, 17 aa, Mycobacterium tuberculosis
GPDGQNPPDEVTDRLEN

SEQ ID NO: 1361729 - protein, 46 aa, Mycobacterium tuberculosis; identical to SEQ ID NO: 151385

SEQ ID NO: 1361730 - protein, 4 aa, Mycobacterium tuberculosis
GPGD

SEQ ID NO: 1361731 - protein, 9 aa, Mycobacterium tuberculosis
GPGRTSGGW

SEQ ID NO: 1361732 - protein, 4 aa, Mycobacterium tuberculosis
GPGT

SEQ ID NO: 1361733 - protein, 5 aa, Mycobacterium tuberculosis
GPLSD

SEQ ID NO: 1361734 - protein, 7 aa, Mycobacterium tuberculosis
GPLTPKD

SEQ ID NO: 1361735 - protein, 5 aa, Mycobacterium tuberculosis
GPMPT

SEQ ID NO: 1361736 - protein, 5 aa, Mycobacterium tuberculosis
GPNER

SEQ ID NO: 1361737 - protein, 12 aa, Mycobacterium tuberculosis
GPNGSPSTQATT

SEQ ID NO: 1361738 - protein, 8 aa, Mycobacterium tuberculosis
GPPGTGKT

SEQ ID NO: 1361739 - protein, 8 aa, Mycobacterium tuberculosis
GPQNMPKF

SEQ ID NO: 1361740 - protein, 5 aa, Mycobacterium tuberculosis
GPRTQ

SEQ ID NO: 1361741 - protein, 4 aa, Mycobacterium tuberculosis
GPRY

SEQ ID NO: 1361742 - protein, 8 aa, Mycobacterium tuberculosis
GPSGCGKS

SEQ ID NO: 1361743 - protein, 9 aa, Mycobacterium tuberculosis
GPTGAGKTT

SEQ ID NO: 1361744 - protein, 8 aa, Mycobacterium tuberculosis
GPVGNPNA

SEQ ID NO: 1361745 - protein, 14 aa, Mycobacterium tuberculosis
GPVRASSERTLQPV

SEQ ID NO: 1361746 - protein, 8 aa, Mycobacterium tuberculosis
GPYRESNL

SEQ ID NO: 1361747 - protein, 13 aa, Mycobacterium tuberculosis
GQGLPGGTSPASW

SEQ ID NO: 1361748 - protein, 5 aa, Mycobacterium tuberculosis
GQIPN

SEQ ID NO: 1361749 - protein, 9 aa, Mycobacterium tuberculosis
GQLPPDGDY

SEQ ID NO: 1361750 - protein, 6 aa, Mycobacterium tuberculosis
GQPDDG

SEQ ID NO: 1361751 - protein, 34 aa, Mycobacterium tuberculosis; identical to SEQ ID NO: 151448

SEQ ID NO: 1361752 - protein, 6 aa, Mycobacterium tuberculosis
GQQRGE

SEQ ID NO: 1361753 - protein, 6 aa, Mycobacterium tuberculosis
GQRPRN

SEQ ID NO: 1361754 - protein, 4 aa, Mycobacterium tuberculosis
GQRS

SEQ ID NO: 1361755 - protein, 14 aa, Mycobacterium tuberculosis
GRAHRPAAQNAGER

SEQ ID NO: 1361756 - protein, 7 aa, Mycobacterium tuberculosis
GRDPKTD

SEQ ID NO: 1361757 - protein, 17 aa, Mycobacterium tuberculosis
GRDQRGAASAANRGPDS

SEQ ID NO: 1361758 - protein, 13 aa, Mycobacterium tuberculosis
GRITPEEAHSHPQ

SEQ ID NO: 1361759 - protein, 10 aa, Mycobacterium tuberculosis
GRKPTREEER

SEQ ID NO: 1361760 - protein, 8 aa, Mycobacterium tuberculosis
GRKQDNPA

SEQ ID NO: 1361761 - protein, 8 aa, Mycobacterium tuberculosis
GRRPPDAV

SEQ ID NO: 1361762 - protein, 5 aa, Mycobacterium tuberculosis
GRRPV

SEQ ID NO: 1361763 - protein, 9 aa, Mycobacterium tuberculosis
GRSGAGKTT

SEQ ID NO: 1361764 - protein, 4 aa, Mycobacterium tuberculosis
GSAA

SEQ ID NO: 1361765 - protein, 5 aa, Mycobacterium tuberculosis
GSAGG

SEQ ID NO: 1361766 - protein, 14 aa, Mycobacterium tuberculosis
GSDAGHSAAPTYRD

SEQ ID NO: 1361767 - protein, 6 aa, Mycobacterium tuberculosis
GSFGGE

SEQ ID NO: 1361768 - protein, 18 aa, Mycobacterium tuberculosis
GSFTPRHASSSAQTPTPH

SEQ ID NO: 1361769 - protein, 10 aa, Mycobacterium tuberculosis
GSGAADPARL

SEQ ID NO: 1361770 - protein, 9 aa, Mycobacterium tuberculosis
GSGSPASRA

SEQ ID NO: 1361771 - protein, 7 aa, Mycobacterium tuberculosis
GSGSQRG

SEQ ID NO: 1361772 - protein, 10 aa, Mycobacterium tuberculosis
GSGVGKPGAE

SEQ ID NO: 1361773 - protein, 6 aa, Mycobacterium tuberculosis
GSKDGK

SEQ ID NO: 1361774 - protein, 4 aa, Mycobacterium tuberculosis
GSLT

SEQ ID NO: 1361775 - protein, 33 aa, Mycobacterium tuberculosis; identical to SEQ ID NO: 151552

SEQ ID NO: 1361776 - protein, 7 aa, Mycobacterium tuberculosis
GSQAPTA

SEQ ID NO: 1361777 - protein, 8 aa, Mycobacterium tuberculosis
GSRQGVTR

SEQ ID NO: 1361778 - protein, 6 aa, Mycobacterium tuberculosis
GSSIPG

SEQ ID NO: 1361779 - protein, 10 aa, Mycobacterium tuberculosis
GSTGSGKSSF

SEQ ID NO: 1361780 - protein, 9 aa, Mycobacterium tuberculosis
GSTGSGKST

SEQ ID NO: 1361781 - protein, 12 aa, Mycobacterium tuberculosis
GSTLEPQDQPYY

SEQ ID NO: 1361782 - protein, 5 aa, Mycobacterium tuberculosis
GSYTG

SEQ ID NO: 1361783 - protein, 12 aa, Mycobacterium tuberculosis
GTAPGAPGSDFP

SEQ ID NO: 1361784 - protein, 31 aa, Mycobacterium tuberculosis; identical to SEQ ID NO: 151587

SEQ ID NO: 1361785 - protein, 6 aa, Mycobacterium tuberculosis
GTATRG

SEQ ID NO: 1361786 - protein, 5 aa, Mycobacterium tuberculosis
GTDAG

SEQ ID NO: 1361787 - protein, 7 aa, Mycobacterium tuberculosis
GTDDQKK

SEQ ID NO: 1361788 - protein, 10 aa, Mycobacterium tuberculosis
GTDESPITEQ

SEQ ID NO: 1361789 - protein, 12 aa, Mycobacterium tuberculosis
GTDQEQAAATLG

SEQ ID NO: 1361790 - protein, 5 aa, Mycobacterium tuberculosis
GTHGP

SEQ ID NO: 1361791 - protein, 8 aa, Mycobacterium tuberculosis
GTIATDQR

SEQ ID NO: 1361792 - protein, 25 aa, Mycobacterium tuberculosis
GTKAAQHTNVHNPGPHDHPPGPDPL

SEQ ID NO: 1361793 - protein, 8 aa, Mycobacterium tuberculosis
GTKGKTAV

SEQ ID NO: 1361794 - protein, 18 aa, Mycobacterium tuberculosis
GTNGPAPYPEPSSHEPQA

SEQ ID NO: 1361795 - protein, 5 aa, Mycobacterium tuberculosis
GTPDE

SEQ ID NO: 1361796 - protein, 7 aa, Mycobacterium tuberculosis
GTPDLTG

SEQ ID NO: 1361797 - protein, 7 aa, Mycobacterium tuberculosis
GTPGDAR

SEQ ID NO: 1361798 - protein, 13 aa, Mycobacterium tuberculosis
GTPGQVTGPTGPI

SEQ ID NO: 1361799 - protein, 12 aa, Mycobacterium tuberculosis
GTPRGATGLAEG

SEQ ID NO: 1361800 - protein, 6 aa, Mycobacterium tuberculosis
GTRDFS

SEQ ID NO: 1361801 - protein, 5 aa, Mycobacterium tuberculosis
GTRQL

SEQ ID NO: 1361802 - protein, 9 aa, Mycobacterium tuberculosis
GVAKGDTAT

SEQ ID NO: 1361803 - protein, 10 aa, Mycobacterium tuberculosis
GVGDANVPAP

SEQ ID NO: 1361804 - protein, 9 aa, Mycobacterium tuberculosis
GVNDAPALA

SEQ ID NO: 1361805 - protein, 5 aa, Mycobacterium tuberculosis
GVPGV

SEQ ID NO: 1361806 - protein, 7 aa, Mycobacterium tuberculosis
GVRPSHG

SEQ ID NO: 1361807 - protein, 16 aa, Mycobacterium tuberculosis
GVSTATRAKDSDRQDA

SEQ ID NO: 1361808 - protein, 10 aa, Mycobacterium tuberculosis
GWVPPSPAPH

SEQ ID NO: 1361809 - protein, 7 aa, Mycobacterium tuberculosis
GYAARDG

SEQ ID NO: 1361810 - protein, 6 aa, Mycobacterium tuberculosis
GYGPTV

SEQ ID NO: 1361811 - protein, 6 aa, Mycobacterium tuberculosis
GYRSDR

SEQ ID NO: 1361812 - protein, 9 aa, Mycobacterium tuberculosis
GYTGGGGKQ

SEQ ID NO: 1361813 - protein, 6 aa, Mycobacterium tuberculosis
GYTPSV

SEQ ID NO: 1361814 - protein, 11 aa, Mycobacterium tuberculosis
GYYGSDSAGTF

SEQ ID NO: 1361815 - protein, 12 aa, Mycobacterium tuberculosis
HAGNASAAGATG

SEQ ID NO: 1361816 - protein, 16 aa, Mycobacterium tuberculosis
HAPGTDEEKIDGRRGQ

SEQ ID NO: 1361817 - protein, 6 aa, Mycobacterium tuberculosis
HATGGR

SEQ ID NO: 1361818 - protein, 5 aa, Mycobacterium tuberculosis
HDMRN

SEQ ID NO: 1361819 - protein, 7 aa, Mycobacterium tuberculosis
HDQTPLR

SEQ ID NO: 1361820 - protein, 4 aa, Mycobacterium tuberculosis
HEGD

SEQ ID NO: 1361821 - protein, 6 aa, Mycobacterium tuberculosis
HESGSE

SEQ ID NO: 1361822 - protein, 5 aa, Mycobacterium tuberculosis
HETRG

SEQ ID NO: 1361823 - protein, 6 aa, Mycobacterium tuberculosis
HGDRRR

SEQ ID NO: 1361824 - protein, 6 aa, Mycobacterium tuberculosis
HGESPT

SEQ ID NO: 1361825 - protein, 7 aa, Mycobacterium tuberculosis
HGGGTTA

SEQ ID NO: 1361826 - protein, 6 aa, Mycobacterium tuberculosis
HGNPSA

SEQ ID NO: 1361827 - protein, 10 aa, Mycobacterium tuberculosis
HGRPTADGTT

SEQ ID NO: 1361828 - protein, 4 aa, Mycobacterium tuberculosis
HGSG

SEQ ID NO: 1361829 - protein, 4 aa, Mycobacterium tuberculosis
HKAT

SEQ ID NO: 1361830 - protein, 9 aa, Mycobacterium tuberculosis
HNSSPPPPR

SEQ ID NO: 1361831 - protein, 6 aa, Mycobacterium tuberculosis
HPDKTA

SEQ ID NO: 1361832 - protein, 6 aa, Mycobacterium tuberculosis
HPGSGG

SEQ ID NO: 1361833 - protein, 4 aa, Mycobacterium tuberculosis
HPPT

SEQ ID NO: 1361834 - protein, 12 aa, Mycobacterium tuberculosis
HPREPLDGEAPA

SEQ ID NO: 1361835 - protein, 11 aa, Mycobacterium tuberculosis
HRADSEREKTS

SEQ ID NO: 1361836 - protein, 5 aa, Mycobacterium tuberculosis
HRGSA

SEQ ID NO: 1361837 - protein, 9 aa, Mycobacterium tuberculosis
HRPGTPSGF

SEQ ID NO: 1361838 - protein, 15 aa, Mycobacterium tuberculosis
HRQQRTDADAATQTT

SEQ ID NO: 1361839 - protein, 11 aa, Mycobacterium tuberculosis
HRSENPPPPQL

SEQ ID NO: 1361840 - protein, 9 aa, Mycobacterium tuberculosis
HSAAPQRAA

SEQ ID NO: 1361841 - protein, 7 aa, Mycobacterium tuberculosis
HSDPPGL

SEQ ID NO: 1361842 - protein, 12 aa, Mycobacterium tuberculosis
HSKGPAAARNTG

SEQ ID NO: 1361843 - protein, 14 aa, Mycobacterium tuberculosis
HSNDDEQDPDTFAS

SEQ ID NO: 1361844 - protein, 7 aa, Mycobacterium tuberculosis
HSPGAGG

SEQ ID NO: 1361845 - protein, 8 aa, Mycobacterium tuberculosis
HSQAPAPV

SEQ ID NO: 1361846 - protein, 8 aa, Mycobacterium tuberculosis
HSSDQRGT

SEQ ID NO: 1361847 - protein, 10 aa, Mycobacterium tuberculosis
HTEVKDNRRN

SEQ ID NO: 1361848 - protein, 5 aa, Mycobacterium tuberculosis
HTSRT

SEQ ID NO: 1361849 - protein, 7 aa, Mycobacterium tuberculosis
HVAGPDH

SEQ ID NO: 1361850 - protein, 14 aa, Mycobacterium tuberculosis
IAAGGNTAAESFGE

SEQ ID NO: 1361851 - protein, 12 aa, Mycobacterium tuberculosis
IAGAPTTSPTAL

SEQ ID NO: 1361852 - protein, 12 aa, Mycobacterium tuberculosis
IAGPGGDKLPTP

SEQ ID NO: 1361853 - protein, 9 aa, Mycobacterium tuberculosis
IASGGTSTV

SEQ ID NO: 1361854 - protein, 14 aa, Mycobacterium tuberculosis
IDEDQEADDARRRG

SEQ ID NO: 1361855 - protein, 6 aa, Mycobacterium tuberculosis
IDGAGE

SEQ ID NO: 1361856 - protein, 9 aa, Mycobacterium tuberculosis
IDNPDQRIQ

SEQ ID NO: 1361857 - protein, 9 aa, Mycobacterium tuberculosis
IDRSGAQAG

SEQ ID NO: 1361858 - protein, 8 aa, Mycobacterium tuberculosis
IETTGRQQ

SEQ ID NO: 1361859 - protein, 7 aa, Mycobacterium tuberculosis
IGDQPAV

SEQ ID NO: 1361860 - protein, 7 aa, Mycobacterium tuberculosis
IGNGSSY

SEQ ID NO: 1361861 - protein, 6 aa, Mycobacterium tuberculosis
IGQNRE

SEQ ID NO: 1361862 - protein, 10 aa, Mycobacterium tuberculosis
IGSGGHGAAG

SEQ ID NO: 1361863 - protein, 9 aa, Mycobacterium tuberculosis
IGTTTGPTL

SEQ ID NO: 1361864 - protein, 6 aa, Mycobacterium tuberculosis
IKPSNV

SEQ ID NO: 1361865 - protein, 8 aa, Mycobacterium tuberculosis
IKSNSDIT

SEQ ID NO: 1361866 - protein, 12 aa, Mycobacterium tuberculosis
IPAAGAPNSLGL

SEQ ID NO: 1361867 - protein, 4 aa, Mycobacterium tuberculosis
IPDP

SEQ ID NO: 1361868 - protein, 16 aa, Mycobacterium tuberculosis
IPGAPYATPVSAGSTS

SEQ ID NO: 1361869 - protein, 6 aa, Mycobacterium tuberculosis
IPGKSA

SEQ ID NO: 1361870 - protein, 9 aa, Mycobacterium tuberculosis
IPGPEPTSV

SEQ ID NO: 1361871 - protein, 6 aa, Mycobacterium tuberculosis
IPTGAE

SEQ ID NO: 1361872 - protein, 6 aa, Mycobacterium tuberculosis
IQPAEL

SEQ ID NO: 1361873 - protein, 12 aa, Mycobacterium tuberculosis
ISSDEELEPVTG

SEQ ID NO: 1361874 - protein, 8 aa, Mycobacterium tuberculosis
ITNKESGV

SEQ ID NO: 1361875 - protein, 8 aa, Mycobacterium tuberculosis
ITPGGAAD

SEQ ID NO: 1361876 - protein, 6 aa, Mycobacterium tuberculosis
ITPPKG

SEQ ID NO: 1361877 - protein, 20 aa, Mycobacterium tuberculosis
ITTSDGTVLSSNSNDGPQTS

SEQ ID NO: 1361878 - protein, 7 aa, Mycobacterium tuberculosis
IVGTGTH

SEQ ID NO: 1361879 - protein, 9 aa, Mycobacterium tuberculosis
KAEGQTGAA

SEQ ID NO: 1361880 - protein, 6 aa, Mycobacterium tuberculosis
KAKEDV

SEQ ID NO: 1361881 - protein, 4 aa, Mycobacterium tuberculosis
KAPG

SEQ ID NO: 1361882 - protein, 5 aa, Mycobacterium tuberculosis
KAQQP

SEQ ID NO: 1361883 - protein, 5 aa, Mycobacterium tuberculosis
KARAA

SEQ ID NO: 1361884 - protein, 6 aa, Mycobacterium tuberculosis
KDATGT

SEQ ID NO: 1361885 - protein, 6 aa, Mycobacterium tuberculosis
KDFPDN

SEQ ID NO: 1361886 - protein, 5 aa, Mycobacterium tuberculosis
KDGAK

SEQ ID NO: 1361887 - protein, 7 aa, Mycobacterium tuberculosis
KDPDLGT

SEQ ID NO: 1361888 - protein, 87 aa, Mycobacterium tuberculosis; identical to SEQ ID NO: 149272

SEQ ID NO: 1361889 - protein, 6 aa, Mycobacterium tuberculosis
KETERA

SEQ ID NO: 1361890 - protein, 28 aa, Mycobacterium tuberculosis
KETMPTNPDNPKGAYTAARTAKDQGVPI

SEQ ID NO: 1361891 - protein, 5 aa, Mycobacterium tuberculosis
KEYEE

SEQ ID NO: 1361892 - protein, 10 aa, Mycobacterium tuberculosis
KFAGSGNGPV

SEQ ID NO: 1361893 - protein, 17 aa, Mycobacterium tuberculosis
KGAVEDDSHADPPSTRA

SEQ ID NO: 1361894 - protein, 8 aa, Mycobacterium tuberculosis
KGDDDDTI

SEQ ID NO: 1361895 - protein, 15 aa, Mycobacterium tuberculosis
KGGENDAQNHAQTLS

SEQ ID NO: 1361896 - protein, 8 aa, Mycobacterium tuberculosis
KGGPTQGA

SEQ ID NO: 1361897 - protein, 10 aa, Mycobacterium tuberculosis
KGKPGDPRRL

SEQ ID NO: 1361898 - protein, 12 aa, Mycobacterium tuberculosis
KGLGAADERSYK

SEQ ID NO: 1361899 - protein, 8 aa, Mycobacterium tuberculosis
KGPHPATY

SEQ ID NO: 1361900 - protein, 12 aa, Mycobacterium tuberculosis
KGREAPGALRGS

SEQ ID NO: 1361901 - protein, 5 aa, Mycobacterium tuberculosis
KGRRR

SEQ ID NO: 1361902 - protein, 12 aa, Mycobacterium tuberculosis
KKDESDDEAAER

SEQ ID NO: 1361903 - protein, 11 aa, Mycobacterium tuberculosis
KKGEVEQPGDT

SEQ ID NO: 1361904 - protein, 5 aa, Mycobacterium tuberculosis
KKGLT

SEQ ID NO: 1361905 - protein, 9 aa, Mycobacterium tuberculosis
KKKPIRPVA

SEQ ID NO: 1361906 - protein, 7 aa, Mycobacterium tuberculosis
KKLKRAD

SEQ ID NO: 1361907 - protein, 13 aa, Mycobacterium tuberculosis
KKSVTEVSEELKA

SEQ ID NO: 1361908 - protein, 8 aa, Mycobacterium tuberculosis
KKYGKDRQ

SEQ ID NO: 1361909 - protein, 6 aa, Mycobacterium tuberculosis
KLAGGA

SEQ ID NO: 1361910 - protein, 10 aa, Mycobacterium tuberculosis
KNYQSGKIPE

SEQ ID NO: 1361911 - protein, 14 aa, Mycobacterium tuberculosis
KPAVPAKPDRDEAL

SEQ ID NO: 1361912 - protein, 12 aa, Mycobacterium tuberculosis
KPIYPKDSLTKE

SEQ ID NO: 1361913 - protein, 13 aa, Mycobacterium tuberculosis
KPPQGMAAESSSA

SEQ ID NO: 1361914 - protein, 6 aa, Mycobacterium tuberculosis
KPPVIK

SEQ ID NO: 1361915 - protein, 5 aa, Mycobacterium tuberculosis
KPTRH

SEQ ID NO: 1361916 - protein, 6 aa, Mycobacterium tuberculosis
KPVERP

SEQ ID NO: 1361917 - protein, 5 aa, Mycobacterium tuberculosis
KPYTE

SEQ ID NO: 1361918 - protein, 12 aa, Mycobacterium tuberculosis
KQLPPSDPSSVG

SEQ ID NO: 1361919 - protein, 13 aa, Mycobacterium tuberculosis
KQQASHRRAPLLS

SEQ ID NO: 1361920 - protein, 8 aa, Mycobacterium tuberculosis
KQTREEGY

SEQ ID NO: 1361921 - protein, 5 aa, Mycobacterium tuberculosis
KRDPN

SEQ ID NO: 1361922 - protein, 13 aa, Mycobacterium tuberculosis
KRYTYTGSGGVPL

SEQ ID NO: 1361923 - protein, 18 aa, Mycobacterium tuberculosis
KSAGELVPATTAPAGLAY

SEQ ID NO: 1361924 - protein, 8 aa, Mycobacterium tuberculosis
KSANGRYE

SEQ ID NO: 1361925 - protein, 7 aa, Mycobacterium tuberculosis
KTGTLTR

SEQ ID NO: 1361926 - protein, 27 aa, Mycobacterium tuberculosis
KTNTTATEVARPPTSGSAVPSAPTTTV

SEQ ID NO: 1361927 - protein, 5 aa, Mycobacterium tuberculosis
KTQPQ

SEQ ID NO: 1361928 - protein, 8 aa, Mycobacterium tuberculosis
KTSRVQKK

SEQ ID NO: 1361929 - protein, 5 aa, Mycobacterium tuberculosis
KWNNS

SEQ ID NO: 1361930 - protein, 12 aa, Mycobacterium tuberculosis
KYRERGADLPPL

SEQ ID NO: 1361931 - protein, 6 aa, Mycobacterium tuberculosis
LAAEAS

SEQ ID NO: 1361932 - protein, 9 aa, Mycobacterium tuberculosis
LAATRPPAE

SEQ ID NO: 1361933 - protein, 12 aa, Mycobacterium tuberculosis
LADNKKSDEQFA

SEQ ID NO: 1361934 - protein, 9 aa, Mycobacterium tuberculosis
LAEQAEEAE

SEQ ID NO: 1361935 - protein, 11 aa, Mycobacterium tuberculosis
LAGANPAEREP

SEQ ID NO: 1361936 - protein, 4 aa, Mycobacterium tuberculosis
LAGK

SEQ ID NO: 1361937 - protein, 13 aa, Mycobacterium tuberculosis
LAGPPKTPDRTIP

SEQ ID NO: 1361938 - protein, 8 aa, Mycobacterium tuberculosis
LAPPRGKS

SEQ ID NO: 1361939 - protein, 4 aa, Mycobacterium tuberculosis
LAQQ

SEQ ID NO: 1361940 - protein, 11 aa, Mycobacterium tuberculosis
LARKGTTPVTA

SEQ ID NO: 1361941 - protein, 5 aa, Mycobacterium tuberculosis
LASGP

SEQ ID NO: 1361942 - protein, 24 aa, Mycobacterium tuberculosis
LATPPGHGWPPGLPPLPRRPRRYR

SEQ ID NO: 1361943 - protein, 4 aa, Mycobacterium tuberculosis
LATT

SEQ ID NO: 1361944 - protein, 5 aa, Mycobacterium tuberculosis
LDGGT

SEQ ID NO: 1361945 - protein, 7 aa, Mycobacterium tuberculosis
LDGVSTG

SEQ ID NO: 1361946 - protein, 8 aa, Mycobacterium tuberculosis
LDNPDAAR

SEQ ID NO: 1361947 - protein, 10 aa, Mycobacterium tuberculosis
LEAGPPPRRL

SEQ ID NO: 1361948 - protein, 9 aa, Mycobacterium tuberculosis
LGAGAGGRM

SEQ ID NO: 1361949 - protein, 12 aa, Mycobacterium tuberculosis
LGAGSPDTKNLQ

SEQ ID NO: 1361950 - protein, 12 aa, Mycobacterium tuberculosis
LGAPASASVAAP

SEQ ID NO: 1361951 - protein, 7 aa, Mycobacterium tuberculosis
LGDPADS

SEQ ID NO: 1361952 - protein, 4 aa, Mycobacterium tuberculosis
LGGI

SEQ ID NO: 1361953 - protein, 13 aa, Mycobacterium tuberculosis
LGGPQGRGAPEDA

SEQ ID NO: 1361954 - protein, 23 aa, Mycobacterium tuberculosis
LGGRDTRVATPSGLDGPGMSTSA

SEQ ID NO: 1361955 - protein, 7 aa, Mycobacterium tuberculosis
LGKRGRG

SEQ ID NO: 1361956 - protein, 5 aa, Mycobacterium tuberculosis
LGPAG

SEQ ID NO: 1361957 - protein, 5 aa, Mycobacterium tuberculosis
LGPGR

SEQ ID NO: 1361958 - protein, 6 aa, Mycobacterium tuberculosis
LGPRPD

SEQ ID NO: 1361959 - protein, 4 aa, Mycobacterium tuberculosis
LGQG

SEQ ID NO: 1361960 - protein, 13 aa, Mycobacterium tuberculosis
LGSSLTSHTAANQ

SEQ ID NO: 1361961 - protein, 4 aa, Mycobacterium tuberculosis
LGTE

SEQ ID NO: 1361962 - protein, 8 aa, Mycobacterium tuberculosis
LGTTPSGT

SEQ ID NO: 1361963 - protein, 4 aa, Mycobacterium tuberculosis
LHPD

SEQ ID NO: 1361964 - protein, 9 aa, Mycobacterium tuberculosis
LHRPGGENE

SEQ ID NO: 1361965 - protein, 9 aa, Mycobacterium tuberculosis
LKNKTTELS

SEQ ID NO: 1361966 - protein, 4 aa, Mycobacterium tuberculosis
LKPE

SEQ ID NO: 1361967 - protein, 6 aa, Mycobacterium tuberculosis
LKPTEA

SEQ ID NO: 1361968 - protein, 6 aa, Mycobacterium tuberculosis
LNPDEY

SEQ ID NO: 1361969 - protein, 8 aa, Mycobacterium tuberculosis
LPAAGAAG

SEQ ID NO: 1361970 - protein, 17 aa, Mycobacterium tuberculosis
LPADPSPRKVPAGASGA

SEQ ID NO: 1361971 - protein, 16 aa, Mycobacterium tuberculosis
LPAGATRDVKFAKQIG

SEQ ID NO: 1361972 - protein, 5 aa, Mycobacterium tuberculosis
LPAGN

SEQ ID NO: 1361973 - protein, 8 aa, Mycobacterium tuberculosis
LPANEGYA

SEQ ID NO: 1361974 - protein, 6 aa, Mycobacterium tuberculosis
LPDAPP

SEQ ID NO: 1361975 - protein, 14 aa, Mycobacterium tuberculosis
LPDSGAASHPSTGL

SEQ ID NO: 1361976 - protein, 7 aa, Mycobacterium tuberculosis
LPEGSEV

SEQ ID NO: 1361977 - protein, 20 aa, Mycobacterium tuberculosis
LPGVTEAPNPTQRPPQPDRP

SEQ ID NO: 1361978 - protein, 7 aa, Mycobacterium tuberculosis
LPRPPTL

SEQ ID NO: 1361979 - protein, 5 aa, Mycobacterium tuberculosis
LPTGD

SEQ ID NO: 1361980 - protein, 10 aa, Mycobacterium tuberculosis
LQSTRSPQTV

SEQ ID NO: 1361981 - protein, 6 aa, Mycobacterium tuberculosis
LRPDAV

SEQ ID NO: 1361982 - protein, 6 aa, Mycobacterium tuberculosis
LRPEDK

SEQ ID NO: 1361983 - protein, 6 aa, Mycobacterium tuberculosis
LRPGEE

SEQ ID NO: 1361984 - protein, 14 aa, Mycobacterium tuberculosis
LRPSPEPVPAPQKQ

SEQ ID NO: 1361985 - protein, 8 aa, Mycobacterium tuberculosis
LRRQGAGR

SEQ ID NO: 1361986 - protein, 6 aa, Mycobacterium tuberculosis
LRTPRG

SEQ ID NO: 1361987 - protein, 27 aa, Mycobacterium tuberculosis
LSAPGARASARQRGDEGTSPEPAFPTP

SEQ ID NO: 1361988 - protein, 8 aa, Mycobacterium tuberculosis
LSDPVSDE

SEQ ID NO: 1361989 - protein, 8 aa, Mycobacterium tuberculosis
LSGGQRQR

SEQ ID NO: 1361990 - protein, 9 aa, Mycobacterium tuberculosis
LSIGPESAT

SEQ ID NO: 1361991 - protein, 6 aa, Mycobacterium tuberculosis
LSPGEP

SEQ ID NO: 1361992 - protein, 9 aa, Mycobacterium tuberculosis
LSPRPERGV

SEQ ID NO: 1361993 - protein, 8 aa, Mycobacterium tuberculosis
LSRPAGAH

SEQ ID NO: 1361994 - protein, 10 aa, Mycobacterium tuberculosis
LSSATADSNE

SEQ ID NO: 1361995 - protein, 19 aa, Mycobacterium tuberculosis
LSTATPAPAVAATDANDVP

SEQ ID NO: 1361996 - protein, 8 aa, Mycobacterium tuberculosis
LSTGADRI

SEQ ID NO: 1361997 - protein, 6 aa, Mycobacterium tuberculosis
LSTGPT

SEQ ID NO: 1361998 - protein, 8 aa, Mycobacterium tuberculosis
LSTGSGTD

SEQ ID NO: 1361999 - protein, 4 aa, Mycobacterium tuberculosis
LSTL

SEQ ID NO: 1362000 - protein, 10 aa, Mycobacterium tuberculosis
LSTTLPGGPV

SEQ ID NO: 1362001 - protein, 7 aa, Mycobacterium tuberculosis
LTAQPGY

SEQ ID NO: 1362002 - protein, 4 aa, Mycobacterium tuberculosis
LTDA

SEQ ID NO: 1362003 - protein, 16 aa, Mycobacterium tuberculosis
LTEDTPAPTGRSSGAG

SEQ ID NO: 1362004 - protein, 12 aa, Mycobacterium tuberculosis
LTEPDPAATELA

SEQ ID NO: 1362005 - protein, 18 aa, Mycobacterium tuberculosis
LTGSGSRAALTSTGRSQL

SEQ ID NO: 1362006 - protein, 4 aa, Mycobacterium tuberculosis
LTGT

SEQ ID NO: 1362007 - protein, 6 aa, Mycobacterium tuberculosis
LTPATR

SEQ ID NO: 1362008 - protein, 4 aa, Mycobacterium tuberculosis
LTPR

SEQ ID NO: 1362009 - protein, 4 aa, Mycobacterium tuberculosis
LTPS

SEQ ID NO: 1362010 - protein, 6 aa, Mycobacterium tuberculosis
LTQTKG

SEQ ID NO: 1362011 - protein, 6 aa, Mycobacterium tuberculosis
LYGGAT

SEQ ID NO: 1362012 - protein, 6 aa, Mycobacterium tuberculosis
MAPETA

SEQ ID NO: 1362013 - protein, 6 aa, Mycobacterium tuberculosis
MDADPE

SEQ ID NO: 1362014 - protein, 7 aa, Mycobacterium tuberculosis
MEGPTPV

SEQ ID NO: 1362015 - protein, 4 aa, Mycobacterium tuberculosis
MGAG

SEQ ID NO: 1362016 - protein, 9 aa, Mycobacterium tuberculosis
MGGHAAGEV

SEQ ID NO: 1362017 - protein, 5 aa, Mycobacterium tuberculosis
MHSGE

SEQ ID NO: 1362018 - protein, 4 aa, Mycobacterium tuberculosis
MPLP

SEQ ID NO: 1362019 - protein, 8 aa, Mycobacterium tuberculosis
MPPNSGSP

SEQ ID NO: 1362020 - protein, 7 aa, Mycobacterium tuberculosis
MQPGQDD

SEQ ID NO: 1362021 - protein, 13 aa, Mycobacterium tuberculosis
MRSGGDDPDGASG

SEQ ID NO: 1362022 - protein, 7 aa, Mycobacterium tuberculosis
NADAGLS

SEQ ID NO: 1362023 - protein, 16 aa, Mycobacterium tuberculosis
NAGSAGNTKPLTVEPS

SEQ ID NO: 1362024 - protein, 8 aa, Mycobacterium tuberculosis
NARGTPLS

SEQ ID NO: 1362025 - protein, 8 aa, Mycobacterium tuberculosis
NASGGSVG

SEQ ID NO: 1362026 - protein, 7 aa, Mycobacterium tuberculosis
NATGATR

SEQ ID NO: 1362027 - protein, 6 aa, Mycobacterium tuberculosis
NAYSGS

SEQ ID NO: 1362028 - protein, 8 aa, Mycobacterium tuberculosis
NDDRTGAA

SEQ ID NO: 1362029 - protein, 11 aa, Mycobacterium tuberculosis
NDLADGSRQLA

SEQ ID NO: 1362030 - protein, 5 aa, Mycobacterium tuberculosis
NEHSD

SEQ ID NO: 1362031 - protein, 7 aa, Mycobacterium tuberculosis
NELGAQG

SEQ ID NO: 1362032 - protein, 22 aa, Mycobacterium tuberculosis
NEMNPDSAPPKTPLRSGGPGSL

SEQ ID NO: 1362033 - protein, 8 aa, Mycobacterium tuberculosis
NEQRKEND

SEQ ID NO: 1362034 - protein, 14 aa, Mycobacterium tuberculosis
NGANDLASAGRQVA

SEQ ID NO: 1362035 - protein, 7 aa, Mycobacterium tuberculosis
NGDGEVP

SEQ ID NO: 1362036 - protein, 6 aa, Mycobacterium tuberculosis
NGTGHL

SEQ ID NO: 1362037 - protein, 13 aa, Mycobacterium tuberculosis
NGTITVSSSPGYT

SEQ ID NO: 1362038 - protein, 8 aa, Mycobacterium tuberculosis
NKPSAYST

SEQ ID NO: 1362039 - protein, 8 aa, Mycobacterium tuberculosis
NLATPNDT

SEQ ID NO: 1362040 - protein, 7 aa, Mycobacterium tuberculosis
NLPGTSQ

SEQ ID NO: 1362041 - protein, 6 aa, Mycobacterium tuberculosis
NNASGL

SEQ ID NO: 1362042 - protein, 6 aa, Mycobacterium tuberculosis
NNGKEF

SEQ ID NO: 1362043 - protein, 8 aa, Mycobacterium tuberculosis
NNPTSSPY

SEQ ID NO: 1362044 - protein, 11 aa, Mycobacterium tuberculosis
NPAAGTTRAPF

SEQ ID NO: 1362045 - protein, 10 aa, Mycobacterium tuberculosis
NPADASKKLT

SEQ ID NO: 1362046 - protein, 14 aa, Mycobacterium tuberculosis
NPANPATVKSSELS

SEQ ID NO: 1362047 - protein, 9 aa, Mycobacterium tuberculosis
NPDERADEM

SEQ ID NO: 1362048 - protein, 7 aa, Mycobacterium tuberculosis
NPGGSYT

SEQ ID NO: 1362049 - protein, 6 aa, Mycobacterium tuberculosis
NPKATL

SEQ ID NO: 1362050 - protein, 6 aa, Mycobacterium tuberculosis
NPKRNV

SEQ ID NO: 1362051 - protein, 8 aa, Mycobacterium tuberculosis
NPNPDGKH

SEQ ID NO: 1362052 - protein, 19 aa, Mycobacterium tuberculosis
NPPAGTGVNRDGIITLRFG

SEQ ID NO: 1362053 - protein, 8 aa, Mycobacterium tuberculosis
NPPNDTPL

SEQ ID NO: 1362054 - protein, 6 aa, Mycobacterium tuberculosis
NPPVSA

SEQ ID NO: 1362055 - protein, 8 aa, Mycobacterium tuberculosis
NPSAPRPW

SEQ ID NO: 1362056 - protein, 11 aa, Mycobacterium tuberculosis
NPSEGTPAGPW

SEQ ID NO: 1362057 - protein, 6 aa, Mycobacterium tuberculosis
NPSRYQ

SEQ ID NO: 1362058 - protein, 6 aa, Mycobacterium tuberculosis
NPSWRP

SEQ ID NO: 1362059 - protein, 6 aa, Mycobacterium tuberculosis
NPTGDQ

SEQ ID NO: 1362060 - protein, 10 aa, Mycobacterium tuberculosis
NPVPSTGAKI

SEQ ID NO: 1362061 - protein, 5 aa, Mycobacterium tuberculosis
NQLQS

SEQ ID NO: 1362062 - protein, 14 aa, Mycobacterium tuberculosis
NRGVGRSSVPKPIS

SEQ ID NO: 1362063 - protein, 5 aa, Mycobacterium tuberculosis
NRPDI

SEQ ID NO: 1362064 - protein, 7 aa, Mycobacterium tuberculosis
NRPPQYE

SEQ ID NO: 1362065 - protein, 6 aa, Mycobacterium tuberculosis
NRQNKD

SEQ ID NO: 1362066 - protein, 4 aa, Mycobacterium tuberculosis
NSAD

SEQ ID NO: 1362067 - protein, 6 aa, Mycobacterium tuberculosis
NSDAAG

SEQ ID NO: 1362068 - protein, 17 aa, Mycobacterium tuberculosis
NSGNRANRRIADSDDLA

SEQ ID NO: 1362069 - protein, 6 aa, Mycobacterium tuberculosis
NSSHDY

SEQ ID NO: 1362070 - protein, 8 aa, Mycobacterium tuberculosis
NSTPPEGI

SEQ ID NO: 1362071 - protein, 5 aa, Mycobacterium tuberculosis
NTAQA

SEQ ID NO: 1362072 - protein, 6 aa, Mycobacterium tuberculosis
NTNPYN

SEQ ID NO: 1362073 - protein, 9 aa, Mycobacterium tuberculosis
NTPRPSPET

SEQ ID NO: 1362074 - protein, 11 aa, Mycobacterium tuberculosis
NTTTTSPVTKN

SEQ ID NO: 1362075 - protein, 6 aa, Mycobacterium tuberculosis
NVEGSM

SEQ ID NO: 1362076 - protein, 15 aa, Mycobacterium tuberculosis
NVTHTGDRQPGPGRA

SEQ ID NO: 1362077 - protein, 16 aa, Mycobacterium tuberculosis
PAAGRTANELASDAGE

SEQ ID NO: 1362078 - protein, 12 aa, Mycobacterium tuberculosis
PAAKQKSLKTTA

SEQ ID NO: 1362079 - protein, 17 aa, Mycobacterium tuberculosis
PAALGNPDNPKFPTDGV

SEQ ID NO: 1362080 - protein, 10 aa, Mycobacterium tuberculosis
PAEDENVPEE

SEQ ID NO: 1362081 - protein, 7 aa, Mycobacterium tuberculosis
PAGAEEV

SEQ ID NO: 1362082 - protein, 7 aa, Mycobacterium tuberculosis
PANPGMA

SEQ ID NO: 1362083 - protein, 8 aa, Mycobacterium tuberculosis
PAPATDND

SEQ ID NO: 1362084 - protein, 5 aa, Mycobacterium tuberculosis
PAQRV

SEQ ID NO: 1362085 - protein, 19 aa, Mycobacterium tuberculosis
PAQVQPEGAVEPREKRATP

SEQ ID NO: 1362086 - protein, 8 aa, Mycobacterium tuberculosis
PARERPGA

SEQ ID NO: 1362087 - protein, 15 aa, Mycobacterium tuberculosis
PARRSAESAGYPEAD

SEQ ID NO: 1362088 - protein, 4 aa, Mycobacterium tuberculosis
PDAA

SEQ ID NO: 1362089 - protein, 8 aa, Mycobacterium tuberculosis
PDAPAEQV

SEQ ID NO: 1362090 - protein, 7 aa, Mycobacterium tuberculosis
PDATKAA

SEQ ID NO: 1362091 - protein, 5 aa, Mycobacterium tuberculosis
PDDTT

SEQ ID NO: 1362092 - protein, 7 aa, Mycobacterium tuberculosis
PDENQMQ

SEQ ID NO: 1362093 - protein, 8 aa, Mycobacterium tuberculosis
PDFGERGR

SEQ ID NO: 1362094 - protein, 5 aa, Mycobacterium tuberculosis
PDLPR

SEQ ID NO: 1362095 - protein, 5 aa, Mycobacterium tuberculosis
PDLPT

SEQ ID NO: 1362096 - protein, 6 aa, Mycobacterium tuberculosis
PDQIST

SEQ ID NO: 1362097 - protein, 15 aa, Mycobacterium tuberculosis
PDRRGVQAATPVVNT

SEQ ID NO: 1362098 - protein, 7 aa, Mycobacterium tuberculosis
PDYQTGG

SEQ ID NO: 1362099 - protein, 7 aa, Mycobacterium tuberculosis
PEATERT

SEQ ID NO: 1362100 - protein, 7 aa, Mycobacterium tuberculosis
PEERAEL

SEQ ID NO: 1362101 - protein, 5 aa, Mycobacterium tuberculosis
PEEYR

SEQ ID NO: 1362102 - protein, 5 aa, Mycobacterium tuberculosis
PEGIN

SEQ ID NO: 1362103 - protein, 9 aa, Mycobacterium tuberculosis
PEHGTAEEA

SEQ ID NO: 1362104 - protein, 11 aa, Mycobacterium tuberculosis
PEIEQPPSRRN

SEQ ID NO: 1362105 - protein, 14 aa, Mycobacterium tuberculosis
PENDPQDSGYQARQ

SEQ ID NO: 1362106 - protein, 10 aa, Mycobacterium tuberculosis
PEPDSPRRMP

SEQ ID NO: 1362107 - protein, 10 aa, Mycobacterium tuberculosis
PEQVSQARPM

SEQ ID NO: 1362108 - protein, 15 aa, Mycobacterium tuberculosis
PERPKPAQQPPDDPV

SEQ ID NO: 1362109 - protein, 8 aa, Mycobacterium tuberculosis
PETKGRKL

SEQ ID NO: 1362110 - protein, 9 aa, Mycobacterium tuberculosis
PFPQSPPRY

SEQ ID NO: 1362111 - protein, 7 aa, Mycobacterium tuberculosis
PFTSDQD

SEQ ID NO: 1362112 - protein, 8 aa, Mycobacterium tuberculosis
PGDPNEQI

SEQ ID NO: 1362113 - protein, 10 aa, Mycobacterium tuberculosis
PGGLTMPSED

SEQ ID NO: 1362114 - protein, 8 aa, Mycobacterium tuberculosis
PGITPFDT

SEQ ID NO: 1362115 - protein, 4 aa, Mycobacterium tuberculosis
PGKY

SEQ ID NO: 1362116 - protein, 6 aa, Mycobacterium tuberculosis
PGNGTG

SEQ ID NO: 1362117 - protein, 14 aa, Mycobacterium tuberculosis
PGQAFGPDGPLGGI

SEQ ID NO: 1362118 - protein, 9 aa, Mycobacterium tuberculosis
PGQGSERRT

SEQ ID NO: 1362119 - protein, 8 aa, Mycobacterium tuberculosis
PGSPPAGA

SEQ ID NO: 1362120 - protein, 9 aa, Mycobacterium tuberculosis
PGSSTIANQ

SEQ ID NO: 1362121 - protein, 17 aa, Mycobacterium tuberculosis
PGTATRVGAGGGEETVN

SEQ ID NO: 1362122 - protein, 4 aa, Mycobacterium tuberculosis
PGTG

SEQ ID NO: 1362123 - protein, 10 aa, Mycobacterium tuberculosis
PGTGPADRHD

SEQ ID NO: 1362124 - protein, 5 aa, Mycobacterium tuberculosis
PGTGR

SEQ ID NO: 1362125 - protein, 6 aa, Mycobacterium tuberculosis
PGTTTA

SEQ ID NO: 1362126 - protein, 20 aa, Mycobacterium tuberculosis
PGWEPRTIDKSNAAASLVTS

SEQ ID NO: 1362127 - protein, 7 aa, Mycobacterium tuberculosis
PHGSGAA

SEQ ID NO: 1362128 - protein, 4 aa, Mycobacterium tuberculosis
PHPE

SEQ ID NO: 1362129 - protein, 4 aa, Mycobacterium tuberculosis
PHTG

SEQ ID NO: 1362130 - protein, 15 aa, Mycobacterium tuberculosis
PIATGDHKAPAAKEG

SEQ ID NO: 1362131 - protein, 11 aa, Mycobacterium tuberculosis
PISQSDVGSVE

SEQ ID NO: 1362132 - protein, 11 aa, Mycobacterium tuberculosis
PKGPAEPPKQL

SEQ ID NO: 1362133 - protein, 5 aa, Mycobacterium tuberculosis
PKPVT

SEQ ID NO: 1362134 - protein, 4 aa, Mycobacterium tuberculosis
PLDP

SEQ ID NO: 1362135 - protein, 5 aa, Mycobacterium tuberculosis
PLGED

SEQ ID NO: 1362136 - protein, 5 aa, Mycobacterium tuberculosis
PLHTP

SEQ ID NO: 1362137 - protein, 12 aa, Mycobacterium tuberculosis
PLPPSPSGSFAS

SEQ ID NO: 1362138 - protein, 4 aa, Mycobacterium tuberculosis
PMPP

SEQ ID NO: 1362139 - protein, 4 aa, Mycobacterium tuberculosis
PNGK

SEQ ID NO: 1362140 - protein, 9 aa, Mycobacterium tuberculosis
PNGQAGSNA

SEQ ID NO: 1362141 - protein, 12 aa, Mycobacterium tuberculosis
PNGQGGELQPAT

SEQ ID NO: 1362142 - protein, 4 aa, Mycobacterium tuberculosis
PPAH

SEQ ID NO: 1362143 - protein, 7 aa, Mycobacterium tuberculosis
PPAHGGR

SEQ ID NO: 1362144 - protein, 4 aa, Mycobacterium tuberculosis
PPDV

SEQ ID NO: 1362145 - protein, 25 aa, Mycobacterium tuberculosis
PPEGQGDDPDWKPEEDWRDDPVEDG

SEQ ID NO: 1362146 - protein, 4 aa, Mycobacterium tuberculosis
PPGF

SEQ ID NO: 1362147 - protein, 5 aa, Mycobacterium tuberculosis
PPGQP

SEQ ID NO: 1362148 - protein, 7 aa, Mycobacterium tuberculosis
PPGSELT

SEQ ID NO: 1362149 - protein, 4 aa, Mycobacterium tuberculosis
PPPA

SEQ ID NO: 1362150 - protein, 18 aa, Mycobacterium tuberculosis
PPRSRGVPALTDAAANQA

SEQ ID NO: 1362151 - protein, 15 aa, Mycobacterium tuberculosis
PQNAEKARDLLARLA

SEQ ID NO: 1362152 - protein, 8 aa, Mycobacterium tuberculosis
PQPPAPRD

SEQ ID NO: 1362153 - protein, 4 aa, Mycobacterium tuberculosis
PQRR

SEQ ID NO: 1362154 - protein, 4 aa, Mycobacterium tuberculosis
PRAP

SEQ ID NO: 1362155 - protein, 6 aa, Mycobacterium tuberculosis
PRAPGP

SEQ ID NO: 1362156 - protein, 4 aa, Mycobacterium tuberculosis
PRDR

SEQ ID NO: 1362157 - protein, 7 aa, Mycobacterium tuberculosis
PRGAKGM

SEQ ID NO: 1362158 - protein, 4 aa, Mycobacterium tuberculosis
PRGE

SEQ ID NO: 1362159 - protein, 5 aa, Mycobacterium tuberculosis
PRKSI

SEQ ID NO: 1362160 - protein, 28 aa, Mycobacterium tuberculosis
PRLPPALNPDDADALPTTDRLTTRANRA

SEQ ID NO: 1362161 - protein, 15 aa, Mycobacterium tuberculosis
PRNPTGKVLKRELRK

SEQ ID NO: 1362162 - protein, 6 aa, Mycobacterium tuberculosis
PRSGGL

SEQ ID NO: 1362163 - protein, 7 aa, Mycobacterium tuberculosis
PRTKNSA

SEQ ID NO: 1362164 - protein, 8 aa, Mycobacterium tuberculosis
PSAATAAK

SEQ ID NO: 1362165 - protein, 6 aa, Mycobacterium tuberculosis
PSGFDV

SEQ ID NO: 1362166 - protein, 7 aa, Mycobacterium tuberculosis
PSGHRQV

SEQ ID NO: 1362167 - protein, 8 aa, Mycobacterium tuberculosis
PSGQLNES

SEQ ID NO: 1362168 - protein, 4 aa, Mycobacterium tuberculosis
PSPL

SEQ ID NO: 1362169 - protein, 6 aa, Mycobacterium tuberculosis
PTANGD

SEQ ID NO: 1362170 - protein, 7 aa, Mycobacterium tuberculosis
PTARSAA

SEQ ID NO: 1362171 - protein, 5 aa, Mycobacterium tuberculosis
PTFDG

SEQ ID NO: 1362172 - protein, 4 aa, Mycobacterium tuberculosis
PTPL

SEQ ID NO: 1362173 - protein, 28 aa, Mycobacterium tuberculosis
PTPSVSRAVPTPTAQPATTLPPAGASLS

SEQ ID NO: 1362174 - protein, 5 aa, Mycobacterium tuberculosis
PTSAV

SEQ ID NO: 1362175 - protein, 7 aa, Mycobacterium tuberculosis
PTSPAQR

SEQ ID NO: 1362176 - protein, 11 aa, Mycobacterium tuberculosis
PTTNREATKNA

SEQ ID NO: 1362177 - protein, 6 aa, Mycobacterium tuberculosis
PTWSRP

SEQ ID NO: 1362178 - protein, 5 aa, Mycobacterium tuberculosis
PVRRP

SEQ ID NO: 1362179 - protein, 8 aa, Mycobacterium tuberculosis
QAAHDSTA

SEQ ID NO: 1362180 - protein, 8 aa, Mycobacterium tuberculosis
QAAPSRGR

SEQ ID NO: 1362181 - protein, 12 aa, Mycobacterium tuberculosis
QAERSSDPERRA

SEQ ID NO: 1362182 - protein, 5 aa, Mycobacterium tuberculosis
QAGGA

SEQ ID NO: 1362183 - protein, 10 aa, Mycobacterium tuberculosis
QALAARPGVQ

SEQ ID NO: 1362184 - protein, 8 aa, Mycobacterium tuberculosis
QAPNRAGT

SEQ ID NO: 1362185 - protein, 9 aa, Mycobacterium tuberculosis
QASQTKART

SEQ ID NO: 1362186 - protein, 25 aa, Mycobacterium tuberculosis
QASVDSPRPAGEVTGTNPPAGTTVP

SEQ ID NO: 1362187 - protein, 13 aa, Mycobacterium tuberculosis
QAVASARARGDNT

SEQ ID NO: 1362188 - protein, 5 aa, Mycobacterium tuberculosis
QAVGR

SEQ ID NO: 1362189 - protein, 12 aa, Mycobacterium tuberculosis
QDNKGTYEVGRP

SEQ ID NO: 1362190 - protein, 5 aa, Mycobacterium tuberculosis
QDPDG

SEQ ID NO: 1362191 - protein, 5 aa, Mycobacterium tuberculosis
QDPYV

SEQ ID NO: 1362192 - protein, 9 aa, Mycobacterium tuberculosis
QEQEQASTA

SEQ ID NO: 1362193 - protein, 10 aa, Mycobacterium tuberculosis
QFPGPGRTEH

SEQ ID NO: 1362194 - protein, 10 aa, Mycobacterium tuberculosis
QGADSDQAVK

SEQ ID NO: 1362195 - protein, 6 aa, Mycobacterium tuberculosis
QGAIQG

SEQ ID NO: 1362196 - protein, 15 aa, Mycobacterium tuberculosis
QGAPGATANALAAPQ

SEQ ID NO: 1362197 - protein, 8 aa, Mycobacterium tuberculosis
QGASTGET

SEQ ID NO: 1362198 - protein, 8 aa, Mycobacterium tuberculosis
QGDGSERV

SEQ ID NO: 1362199 - protein, 6 aa, Mycobacterium tuberculosis
QGIANN

SEQ ID NO: 1362200 - protein, 7 aa, Mycobacterium tuberculosis
QGKDGRH

SEQ ID NO: 1362201 - protein, 8 aa, Mycobacterium tuberculosis
QGKLGGTS

SEQ ID NO: 1362202 - protein, 7 aa, Mycobacterium tuberculosis
QGPTLSR

SEQ ID NO: 1362203 - protein, 12 aa, Mycobacterium tuberculosis
QGVGSAIASPTG

SEQ ID NO: 1362204 - protein, 4 aa, Mycobacterium tuberculosis
QHGI

SEQ ID NO: 1362205 - protein, 4 aa, Mycobacterium tuberculosis
QHRG

SEQ ID NO: 1362206 - protein, 7 aa, Mycobacterium tuberculosis
QISGPQQ

SEQ ID NO: 1362207 - protein, 19 aa, Mycobacterium tuberculosis
QKLPDGQAERTESDGGTPL

SEQ ID NO: 1362208 - protein, 5 aa, Mycobacterium tuberculosis
QLGAE

SEQ ID NO: 1362209 - protein, 13 aa, Mycobacterium tuberculosis
QLGDSSEPRVSKT

SEQ ID NO: 1362210 - protein, 8 aa, Mycobacterium tuberculosis
QLGQQAGS

SEQ ID NO: 1362211 - protein, 8 aa, Mycobacterium tuberculosis
QLPETPAY

SEQ ID NO: 1362212 - protein, 11 aa, Mycobacterium tuberculosis
QLSGGNSYNAA

SEQ ID NO: 1362213 - protein, 12 aa, Mycobacterium tuberculosis
QPAGPATEATER

SEQ ID NO: 1362214 - protein, 5 aa, Mycobacterium tuberculosis
QPAGR

SEQ ID NO: 1362215 - protein, 9 aa, Mycobacterium tuberculosis
QPALSAPPQ

SEQ ID NO: 1362216 - protein, 7 aa, Mycobacterium tuberculosis
QPKKAAA

SEQ ID NO: 1362217 - protein, 6 aa, Mycobacterium tuberculosis
QPPGTK

SEQ ID NO: 1362218 - protein, 13 aa, Mycobacterium tuberculosis
QPPPTVSDRVPGL

SEQ ID NO: 1362219 - protein, 4 aa, Mycobacterium tuberculosis
QPPW

SEQ ID NO: 1362220 - protein, 4 aa, Mycobacterium tuberculosis
QPSE

SEQ ID NO: 1362221 - protein, 10 aa, Mycobacterium tuberculosis
QPSKSAQDLS

SEQ ID NO: 1362222 - protein, 6 aa, Mycobacterium tuberculosis
QQQPGW

SEQ ID NO: 1362223 - protein, 5 aa, Mycobacterium tuberculosis
QRELD

SEQ ID NO: 1362224 - protein, 9 aa, Mycobacterium tuberculosis
QRFGPNDYR

SEQ ID NO: 1362225 - protein, 5 aa, Mycobacterium tuberculosis
QRGNY

SEQ ID NO: 1362226 - protein, 5 aa, Mycobacterium tuberculosis
QRNRA

SEQ ID NO: 1362227 - protein, 5 aa, Mycobacterium tuberculosis
QRPPG

SEQ ID NO: 1362228 - protein, 5 aa, Mycobacterium tuberculosis
QRPSV

SEQ ID NO: 1362229 - protein, 11 aa, Mycobacterium tuberculosis
QRQPVPVDDET

SEQ ID NO: 1362230 - protein, 4 aa, Mycobacterium tuberculosis
QRRH

SEQ ID NO: 1362231 - protein, 9 aa, Mycobacterium tuberculosis
QRSKADPPF

SEQ ID NO: 1362232 - protein, 4 aa, Mycobacterium tuberculosis
QSAG

SEQ ID NO: 1362233 - protein, 5 aa, Mycobacterium tuberculosis
QSGVQ

SEQ ID NO: 1362234 - protein, 11 aa, Mycobacterium tuberculosis
QSMGGNGLTKE

SEQ ID NO: 1362235 - protein, 9 aa, Mycobacterium tuberculosis
QSPGPNNQQ

SEQ ID NO: 1362236 - protein, 9 aa, Mycobacterium tuberculosis
QTGGEASAR

SEQ ID NO: 1362237 - protein, 28 aa, Mycobacterium tuberculosis
QTNGDSPGRHGGRGTPSPTDGPRASTES

SEQ ID NO: 1362238 - protein, 5 aa, Mycobacterium tuberculosis
QTPDF

SEQ ID NO: 1362239 - protein, 5 aa, Mycobacterium tuberculosis
QVSGD

SEQ ID NO: 1362240 - protein, 15 aa, Mycobacterium tuberculosis
QYQARQSARESSSEQ

SEQ ID NO: 1362241 - protein, 12 aa, Mycobacterium tuberculosis
RAGCSRVDAIDE

SEQ ID NO: 1362242 - protein, 8 aa, Mycobacterium tuberculosis
RAGRDDKV

SEQ ID NO: 1362243 - protein, 10 aa, Mycobacterium tuberculosis
RAGRQADAQL

SEQ ID NO: 1362244 - protein, 21 aa, Mycobacterium tuberculosis
RASGAVNAAEYESKRAQIISE

SEQ ID NO: 1362245 - protein, 9 aa, Mycobacterium tuberculosis
RASGPEQRI

SEQ ID NO: 1362246 - protein, 6 aa, Mycobacterium tuberculosis
RATRPD

SEQ ID NO: 1362247 - protein, 14 aa, Mycobacterium tuberculosis
RDAAANPGNQAAAA

SEQ ID NO: 1362248 - protein, 5 aa, Mycobacterium tuberculosis
RDDEL

SEQ ID NO: 1362249 - protein, 4 aa, Mycobacterium tuberculosis
RDEG

SEQ ID NO: 1362250 - protein, 6 aa, Mycobacterium tuberculosis
RDEGTA

SEQ ID NO: 1362251 - protein, 4 aa, Mycobacterium tuberculosis
RDGE

SEQ ID NO: 1362252 - protein, 7 aa, Mycobacterium tuberculosis
RDGREDV

SEQ ID NO: 1362253 - protein, 7 aa, Mycobacterium tuberculosis
RDGSQTR

SEQ ID NO: 1362254 - protein, 6 aa, Mycobacterium tuberculosis
RDLRDP

SEQ ID NO: 1362255 - protein, 10 aa, Mycobacterium tuberculosis
RDPNGPPGAG

SEQ ID NO: 1362256 - protein, 6 aa, Mycobacterium tuberculosis
RDPQFG

SEQ ID NO: 1362257 - protein, 18 aa, Mycobacterium tuberculosis
REDGPPSHHTKRGTPSMG

SEQ ID NO: 1362258 - protein, 6 aa, Mycobacterium tuberculosis
REDPAT

SEQ ID NO: 1362259 - protein, 12 aa, Mycobacterium tuberculosis
REGADDDAEPIG

SEQ ID NO: 1362260 - protein, 14 aa, Mycobacterium tuberculosis
REPDRESSAPPDDV

SEQ ID NO: 1362261 - protein, 8 aa, Mycobacterium tuberculosis
RERASGTL

SEQ ID NO: 1362262 - protein, 7 aa, Mycobacterium tuberculosis
RERSGVG

SEQ ID NO: 1362263 - protein, 7 aa, Mycobacterium tuberculosis
RESQKRA

SEQ ID NO: 1362264 - protein, 9 aa, Mycobacterium tuberculosis
RETASPTAN

SEQ ID NO: 1362265 - protein, 15 aa, Mycobacterium tuberculosis
RETEEAAASLGANGA

SEQ ID NO: 1362266 - protein, 13 aa, Mycobacterium tuberculosis
RFGVEDSKEARDA

SEQ ID NO: 1362267 - protein, 5 aa, Mycobacterium tuberculosis
RFQGT

SEQ ID NO: 1362268 - protein, 15 aa, Mycobacterium tuberculosis
RGDTSRSRQAGSTGL

SEQ ID NO: 1362269 - protein, 4 aa, Mycobacterium tuberculosis
RGEL

SEQ ID NO: 1362270 - protein, 8 aa, Mycobacterium tuberculosis
RGGGPDNV

SEQ ID NO: 1362271 - protein, 5 aa, Mycobacterium tuberculosis
RGGHD

SEQ ID NO: 1362272 - protein, 10 aa, Mycobacterium tuberculosis
RGGPEGTGTT

SEQ ID NO: 1362273 - protein, 8 aa, Mycobacterium tuberculosis
RGGSGQEG

SEQ ID NO: 1362274 - protein, 7 aa, Mycobacterium tuberculosis
RGHGAGA

SEQ ID NO: 1362275 - protein, 4 aa, Mycobacterium tuberculosis
RGPQ

SEQ ID NO: 1362276 - protein, 7 aa, Mycobacterium tuberculosis
RGPRQTI

SEQ ID NO: 1362277 - protein, 4 aa, Mycobacterium tuberculosis
RGQW

SEQ ID NO: 1362278 - protein, 6 aa, Mycobacterium tuberculosis
RGRSRP

SEQ ID NO: 1362279 - protein, 6 aa, Mycobacterium tuberculosis
RGSGSI

SEQ ID NO: 1362280 - protein, 6 aa, Mycobacterium tuberculosis
RGSSGN

SEQ ID NO: 1362281 - protein, 17 aa, Mycobacterium tuberculosis
RHSAQGLRQARESATRR

SEQ ID NO: 1362282 - protein, 7 aa, Mycobacterium tuberculosis
RHTAESV

SEQ ID NO: 1362283 - protein, 7 aa, Mycobacterium tuberculosis
RHTGPTG

SEQ ID NO: 1362284 - protein, 8 aa, Mycobacterium tuberculosis
RKAGQPPK

SEQ ID NO: 1362285 - protein, 5 aa, Mycobacterium tuberculosis
RKEDK

SEQ ID NO: 1362286 - protein, 7 aa, Mycobacterium tuberculosis
RKGQESF

SEQ ID NO: 1362287 - protein, 8 aa, Mycobacterium tuberculosis
RKPDGKDL

SEQ ID NO: 1362288 - protein, 28 aa, Mycobacterium tuberculosis
RKPGESRGTEPNMRPDRNTNARRTAPDT

SEQ ID NO: 1362289 - protein, 28 aa, Mycobacterium tuberculosis
RKRANPQPAQTQPARKTPRTAPGQPARQ

SEQ ID NO: 1362290 - protein, 7 aa, Mycobacterium tuberculosis
RKRFGDT

SEQ ID NO: 1362291 - protein, 6 aa, Mycobacterium tuberculosis
RKSHGS

SEQ ID NO: 1362292 - protein, 5 aa, Mycobacterium tuberculosis
RLQSG

SEQ ID NO: 1362293 - protein, 5 aa, Mycobacterium tuberculosis
RLRSG

SEQ ID NO: 1362294 - protein, 4 aa, Mycobacterium tuberculosis
RLSQ

SEQ ID NO: 1362295 - protein, 4 aa, Mycobacterium tuberculosis
RNDA

SEQ ID NO: 1362296 - protein, 6 aa, Mycobacterium tuberculosis
RNDSEA

SEQ ID NO: 1362297 - protein, 8 aa, Mycobacterium tuberculosis
RNGESDPR

SEQ ID NO: 1362298 - protein, 11 aa, Mycobacterium tuberculosis
RNGGQTALSAA

SEQ ID NO: 1362299 - protein, 4 aa, Mycobacterium tuberculosis
RNGN

SEQ ID NO: 1362300 - protein, 4 aa, Mycobacterium tuberculosis
RNTD

SEQ ID NO: 1362301 - protein, 14 aa, Mycobacterium tuberculosis
RPAGGGTAKTPGPL

SEQ ID NO: 1362302 - protein, 14 aa, Mycobacterium tuberculosis
RPAPPVGWPPGPQL

SEQ ID NO: 1362303 - protein, 6 aa, Mycobacterium tuberculosis
RPDGGQ

SEQ ID NO: 1362304 - protein, 7 aa, Mycobacterium tuberculosis
RPDPVHK

SEQ ID NO: 1362305 - protein, 22 aa, Mycobacterium tuberculosis
RPDQQTDSGAARAAVAAASDGT

SEQ ID NO: 1362306 - protein, 8 aa, Mycobacterium tuberculosis
RPGASDRV

SEQ ID NO: 1362307 - protein, 11 aa, Mycobacterium tuberculosis
RPGDHDNTTGV

SEQ ID NO: 1362308 - protein, 10 aa, Mycobacterium tuberculosis
RPGPTPPATI

SEQ ID NO: 1362309 - protein, 8 aa, Mycobacterium tuberculosis
RPGSPPLK

SEQ ID NO: 1362310 - protein, 64 aa, Mycobacterium tuberculosis; identical to SEQ ID NO: 153636

SEQ ID NO: 1362311 - protein, 4 aa, Mycobacterium tuberculosis
RPRD

SEQ ID NO: 1362312 - protein, 4 aa, Mycobacterium tuberculosis
RPRE

SEQ ID NO: 1362313 - protein, 76 aa, Mycobacterium tuberculosis; identical to SEQ ID NO: 153640

SEQ ID NO: 1362314 - protein, 13 aa, Mycobacterium tuberculosis
RQEATQSRLPGSI

SEQ ID NO: 1362315 - protein, 7 aa, Mycobacterium tuberculosis
RQRPDHP

SEQ ID NO: 1362316 - protein, 7 aa, Mycobacterium tuberculosis
RQSDSEA

SEQ ID NO: 1362317 - protein, 14 aa, Mycobacterium tuberculosis
RRADTAADKANTAL

SEQ ID NO: 1362318 - protein, 9 aa, Mycobacterium tuberculosis
RRAGRASAR

SEQ ID NO: 1362319 - protein, 5 aa, Mycobacterium tuberculosis
RREPR

SEQ ID NO: 1362320 - protein, 7 aa, Mycobacterium tuberculosis
RRGARNR

SEQ ID NO: 1362321 - protein, 16 aa, Mycobacterium tuberculosis
RRGPATSRNAPPPSTA

SEQ ID NO: 1362322 - protein, 15 aa, Mycobacterium tuberculosis
RRHADGDTVGRRKAD

SEQ ID NO: 1362323 - protein, 5 aa, Mycobacterium tuberculosis
RRLKT

SEQ ID NO: 1362324 - protein, 28 aa, Mycobacterium tuberculosis
RRNSGSPAGSEDASTDGGEQPAAADEQS

SEQ ID NO: 1362325 - protein, 40 aa, Mycobacterium tuberculosis; identical to SEQ ID NO: 153706

SEQ ID NO: 1362326 - protein, 9 aa, Mycobacterium tuberculosis
RRRGGDPVS

SEQ ID NO: 1362327 - protein, 8 aa, Mycobacterium tuberculosis
RRRRPSSA

SEQ ID NO: 1362328 - protein, 4 aa, Mycobacterium tuberculosis
RRRT

SEQ ID NO: 1362329 - protein, 7 aa, Mycobacterium tuberculosis
RRSARSR

SEQ ID NO: 1362330 - protein, 20 aa, Mycobacterium tuberculosis
RRSATSTDAAPGAGDDLNQG

SEQ ID NO: 1362331 - protein, 9 aa, Mycobacterium tuberculosis
RRSRIEPTN

SEQ ID NO: 1362332 - protein, 10 aa, Mycobacterium tuberculosis
RSAKQSEATV

SEQ ID NO: 1362333 - protein, 10 aa, Mycobacterium tuberculosis
RSAVTGAHAP

SEQ ID NO: 1362334 - protein, 10 aa, Mycobacterium tuberculosis
RSEATKHRQA

SEQ ID NO: 1362335 - protein, 20 aa, Mycobacterium tuberculosis
RSGLAPAERDTAGQPIEPAD

SEQ ID NO: 1362336 - protein, 6 aa, Mycobacterium tuberculosis
RSGSLA

SEQ ID NO: 1362337 - protein, 9 aa, Mycobacterium tuberculosis
RSPQSPNGT

SEQ ID NO: 1362338 - protein, 6 aa, Mycobacterium tuberculosis
RSPSSV

SEQ ID NO: 1362339 - protein, 5 aa, Mycobacterium tuberculosis
RSTND

SEQ ID NO: 1362340 - protein, 20 aa, Mycobacterium tuberculosis
RSTQAAATTLAQRRSTLSAK

SEQ ID NO: 1362341 - protein, 8 aa, Mycobacterium tuberculosis
RSTSPIDS

SEQ ID NO: 1362342 - protein, 6 aa, Mycobacterium tuberculosis
RTADSV

SEQ ID NO: 1362343 - protein, 5 aa, Mycobacterium tuberculosis
RTERY

SEQ ID NO: 1362344 - protein, 4 aa, Mycobacterium tuberculosis
RTGG

SEQ ID NO: 1362345 - protein, 6 aa, Mycobacterium tuberculosis
RTKEST

SEQ ID NO: 1362346 - protein, 6 aa, Mycobacterium tuberculosis
RTPDGV

SEQ ID NO: 1362347 - protein, 6 aa, Mycobacterium tuberculosis
RTPGES

SEQ ID NO: 1362348 - protein, 4 aa, Mycobacterium tuberculosis
RTQS

SEQ ID NO: 1362349 - protein, 5 aa, Mycobacterium tuberculosis
RTRPE

SEQ ID NO: 1362350 - protein, 8 aa, Mycobacterium tuberculosis
RTRSAQAA

SEQ ID NO: 1362351 - protein, 6 aa, Mycobacterium tuberculosis
RTTADQ

SEQ ID NO: 1362352 - protein, 5 aa, Mycobacterium tuberculosis
RTTAK

SEQ ID NO: 1362353 - protein, 8 aa, Mycobacterium tuberculosis
RTTGGFGQ

SEQ ID NO: 1362354 - protein, 9 aa, Mycobacterium tuberculosis
RVTSSATSQ

SEQ ID NO: 1362355 - protein, 12 aa, Mycobacterium tuberculosis
RWPAERSPAADE

SEQ ID NO: 1362356 - protein, 4 aa, Mycobacterium tuberculosis
RYGR

SEQ ID NO: 1362357 - protein, 30 aa, Mycobacterium tuberculosis; identical to SEQ ID NO: 149285

SEQ ID NO: 1362358 - protein, 6 aa, Mycobacterium tuberculosis
SAAGST

SEQ ID NO: 1362359 - protein, 6 aa, Mycobacterium tuberculosis
SAAGTL

SEQ ID NO: 1362360 - protein, 4 aa, Mycobacterium tuberculosis
SAAW

SEQ ID NO: 1362361 - protein, 6 aa, Mycobacterium tuberculosis
SADGSF

SEQ ID NO: 1362362 - protein, 15 aa, Mycobacterium tuberculosis
SADSAAAAGEHEAAA

SEQ ID NO: 1362363 - protein, 11 aa, Mycobacterium tuberculosis
SAGDQSPQSTV

SEQ ID NO: 1362364 - protein, 5 aa, Mycobacterium tuberculosis
SAHQP

SEQ ID NO: 1362365 - protein, 8 aa, Mycobacterium tuberculosis
SALTSGAV

SEQ ID NO: 1362366 - protein, 8 aa, Mycobacterium tuberculosis
SAMTDSTN

SEQ ID NO: 1362367 - protein, 7 aa, Mycobacterium tuberculosis
SAPLTQQ

SEQ ID NO: 1362368 - protein, 5 aa, Mycobacterium tuberculosis
SAQGR

SEQ ID NO: 1362369 - protein, 5 aa, Mycobacterium tuberculosis
SAQPV

SEQ ID NO: 1362370 - protein, 4 aa, Mycobacterium tuberculosis
SAQV

SEQ ID NO: 1362371 - protein, 8 aa, Mycobacterium tuberculosis
SARQVTAE

SEQ ID NO: 1362372 - protein, 4 aa, Mycobacterium tuberculosis
SART

SEQ ID NO: 1362373 - protein, 6 aa, Mycobacterium tuberculosis
SARTIT

SEQ ID NO: 1362374 - protein, 7 aa, Mycobacterium tuberculosis
SCQPGAS

SEQ ID NO: 1362375 - protein, 5 aa, Mycobacterium tuberculosis
SDGNT

SEQ ID NO: 1362376 - protein, 4 aa, Mycobacterium tuberculosis
SDGP

SEQ ID NO: 1362377 - protein, 4 aa, Mycobacterium tuberculosis
SDLG

SEQ ID NO: 1362378 - protein, 4 aa, Mycobacterium tuberculosis
SDPS

SEQ ID NO: 1362379 - protein, 9 aa, Mycobacterium tuberculosis
SDQLGAKGG

SEQ ID NO: 1362380 - protein, 4 aa, Mycobacterium tuberculosis
SDRF

SEQ ID NO: 1362381 - protein, 4 aa, Mycobacterium tuberculosis
SDRS

SEQ ID NO: 1362382 - protein, 5 aa, Mycobacterium tuberculosis
SDSGS

SEQ ID NO: 1362383 - protein, 7 aa, Mycobacterium tuberculosis
SEAERRD

SEQ ID NO: 1362384 - protein, 9 aa, Mycobacterium tuberculosis
SEAVGGLGS

SEQ ID NO: 1362385 - protein, 11 aa, Mycobacterium tuberculosis
SEDGARPAPPD

SEQ ID NO: 1362386 - protein, 15 aa, Mycobacterium tuberculosis
SEQAEGKDTAAESVP

SEQ ID NO: 1362387 - protein, 7 aa, Mycobacterium tuberculosis
SESQRRR

SEQ ID NO: 1362388 - protein, 7 aa, Mycobacterium tuberculosis
SEYQSSS

SEQ ID NO: 1362389 - protein, 14 aa, Mycobacterium tuberculosis
SFASRTPVNNNPDK

SEQ ID NO: 1362390 - protein, 4 aa, Mycobacterium tuberculosis
SGAA

SEQ ID NO: 1362391 - protein, 10 aa, Mycobacterium tuberculosis
SGANNNGSAF

SEQ ID NO: 1362392 - protein, 16 aa, Mycobacterium tuberculosis
SGASDVDQRSITGESM

SEQ ID NO: 1362393 - protein, 9 aa, Mycobacterium tuberculosis
SGATPATQA

SEQ ID NO: 1362394 - protein, 6 aa, Mycobacterium tuberculosis
SGATPV

SEQ ID NO: 1362395 - protein, 7 aa, Mycobacterium tuberculosis
SGDEGAS

SEQ ID NO: 1362396 - protein, 5 aa, Mycobacterium tuberculosis
SGESP

SEQ ID NO: 1362397 - protein, 6 aa, Mycobacterium tuberculosis
SGEVPA

SEQ ID NO: 1362398 - protein, 4 aa, Mycobacterium tuberculosis
SGGQ

SEQ ID NO: 1362399 - protein, 6 aa, Mycobacterium tuberculosis
SGGRSN

SEQ ID NO: 1362400 - protein, 8 aa, Mycobacterium tuberculosis
SGKSRKSP

SEQ ID NO: 1362401 - protein, 9 aa, Mycobacterium tuberculosis
SGLNGKRPK

SEQ ID NO: 1362402 - protein, 11 aa, Mycobacterium tuberculosis
SGLPTPGVPPV

SEQ ID NO: 1362403 - protein, 8 aa, Mycobacterium tuberculosis
SGNLTGGG

SEQ ID NO: 1362404 - protein, 4 aa, Mycobacterium tuberculosis
SGQM

SEQ ID NO: 1362405 - protein, 9 aa, Mycobacterium tuberculosis
SGRPLERGP

SEQ ID NO: 1362406 - protein, 7 aa, Mycobacterium tuberculosis
SGRTSLR

SEQ ID NO: 1362407 - protein, 5 aa, Mycobacterium tuberculosis
SGRTT

SEQ ID NO: 1362408 - protein, 8 aa, Mycobacterium tuberculosis
SGSPQPGI

SEQ ID NO: 1362409 - protein, 9 aa, Mycobacterium tuberculosis
SGSTRTPAG

SEQ ID NO: 1362410 - protein, 13 aa, Mycobacterium tuberculosis
SGTAVAIESLILH

SEQ ID NO: 1362411 - protein, 4 aa, Mycobacterium tuberculosis
SGTE

SEQ ID NO: 1362412 - protein, 6 aa, Mycobacterium tuberculosis
SGTWRD

SEQ ID NO: 1362413 - protein, 6 aa, Mycobacterium tuberculosis
SGVASA

SEQ ID NO: 1362414 - protein, 5 aa, Mycobacterium tuberculosis
SGVAV

SEQ ID NO: 1362415 - protein, 4 aa, Mycobacterium tuberculosis
SGVL

SEQ ID NO: 1362416 - protein, 10 aa, Mycobacterium tuberculosis
SHDRRSDLDR

SEQ ID NO: 1362417 - protein, 10 aa, Mycobacterium tuberculosis
SHDRSTEPER

SEQ ID NO: 1362418 - protein, 6 aa, Mycobacterium tuberculosis
SHEEAT

SEQ ID NO: 1362419 - protein, 16 aa, Mycobacterium tuberculosis
SIARQSAEAAANPQTA

SEQ ID NO: 1362420 - protein, 8 aa, Mycobacterium tuberculosis
SIPPPEGK

SEQ ID NO: 1362421 - protein, 6 aa, Mycobacterium tuberculosis
SITPGG

SEQ ID NO: 1362422 - protein, 4 aa, Mycobacterium tuberculosis
SKDN

SEQ ID NO: 1362423 - protein, 7 aa, Mycobacterium tuberculosis
SKESPRT

SEQ ID NO: 1362424 - protein, 16 aa, Mycobacterium tuberculosis
SLAADPGKAIEGTAYS

SEQ ID NO: 1362425 - protein, 11 aa, Mycobacterium tuberculosis
SLKADGEVTEP

SEQ ID NO: 1362426 - protein, 6 aa, Mycobacterium tuberculosis
SLRDQR

SEQ ID NO: 1362427 - protein, 13 aa, Mycobacterium tuberculosis
SLSGDSSAFDTRG

SEQ ID NO: 1362428 - protein, 7 aa, Mycobacterium tuberculosis
SNAAQAD

SEQ ID NO: 1362429 - protein, 7 aa, Mycobacterium tuberculosis
SNARERT

SEQ ID NO: 1362430 - protein, 14 aa, Mycobacterium tuberculosis
SNSPPTGQLTDSPV

SEQ ID NO: 1362431 - protein, 10 aa, Mycobacterium tuberculosis
SNYDSDGYVG

SEQ ID NO: 1362432 - protein, 7 aa, Mycobacterium tuberculosis
SPDPRYT

SEQ ID NO: 1362433 - protein, 6 aa, Mycobacterium tuberculosis
SPDTLD

SEQ ID NO: 1362434 - protein, 7 aa, Mycobacterium tuberculosis
SPGEQQR

SEQ ID NO: 1362435 - protein, 16 aa, Mycobacterium tuberculosis
SPGSPGPGGTPVTAAG

SEQ ID NO: 1362436 - protein, 7 aa, Mycobacterium tuberculosis
SPPTRAA

SEQ ID NO: 1362437 - protein, 9 aa, Mycobacterium tuberculosis
SPQSYRGAP

SEQ ID NO: 1362438 - protein, 7 aa, Mycobacterium tuberculosis
SQDYNGD

SEQ ID NO: 1362439 - protein, 5 aa, Mycobacterium tuberculosis
SQSER

SEQ ID NO: 1362440 - protein, 12 aa, Mycobacterium tuberculosis
SQTLRGASENEC

SEQ ID NO: 1362441 - protein, 7 aa, Mycobacterium tuberculosis
SQTSNRL

SEQ ID NO: 1362442 - protein, 14 aa, Mycobacterium tuberculosis
SRAKQLSKDMPKTT

SEQ ID NO: 1362443 - protein, 7 aa, Mycobacterium tuberculosis
SRAKRTE

SEQ ID NO: 1362444 - protein, 13 aa, Mycobacterium tuberculosis
SREYQADESGAVL

SEQ ID NO: 1362445 - protein, 10 aa, Mycobacterium tuberculosis
SRFNRSKQAA

SEQ ID NO: 1362446 - protein, 10 aa, Mycobacterium tuberculosis
SRKTKDEDME

SEQ ID NO: 1362447 - protein, 6 aa, Mycobacterium tuberculosis
SRPARH

SEQ ID NO: 1362448 - protein, 6 aa, Mycobacterium tuberculosis
SRPQDP

SEQ ID NO: 1362449 - protein, 9 aa, Mycobacterium tuberculosis
SRRHDAAGN

SEQ ID NO: 1362450 - protein, 5 aa, Mycobacterium tuberculosis
SRSAD

SEQ ID NO: 1362451 - protein, 8 aa, Mycobacterium tuberculosis
SRTGGAPT

SEQ ID NO: 1362452 - protein, 15 aa, Mycobacterium tuberculosis
SRVTNSAGAKDEPRA

SEQ ID NO: 1362453 - protein, 17 aa, Mycobacterium tuberculosis
SSANGAGGAGPGQQRYR

SEQ ID NO: 1362454 - protein, 7 aa, Mycobacterium tuberculosis
SSAPPFE

SEQ ID NO: 1362455 - protein, 10 aa, Mycobacterium tuberculosis
SSAQPPTPRC

SEQ ID NO: 1362456 - protein, 9 aa, Mycobacterium tuberculosis
SSCGPTDHI

SEQ ID NO: 1362457 - protein, 6 aa, Mycobacterium tuberculosis
SSDGTA

SEQ ID NO: 1362458 - protein, 4 aa, Mycobacterium tuberculosis
SSFE

SEQ ID NO: 1362459 - protein, 7 aa, Mycobacterium tuberculosis
SSGLSGN

SEQ ID NO: 1362460 - protein, 8 aa, Mycobacterium tuberculosis
SSGRGQAA

SEQ ID NO: 1362461 - protein, 8 aa, Mycobacterium tuberculosis
SSPARGTM

SEQ ID NO: 1362462 - protein, 6 aa, Mycobacterium tuberculosis
SSPEPY

SEQ ID NO: 1362463 - protein, 5 aa, Mycobacterium tuberculosis
SSSFR

SEQ ID NO: 1362464 - protein, 8 aa, Mycobacterium tuberculosis
SSSRRGRA

SEQ ID NO: 1362465 - protein, 7 aa, Mycobacterium tuberculosis
SSTGEFR

SEQ ID NO: 1362466 - protein, 16 aa, Mycobacterium tuberculosis
SSTGHDVEGAQKNFTA

SEQ ID NO: 1362467 - protein, 4 aa, Mycobacterium tuberculosis
STAS

SEQ ID NO: 1362468 - protein, 4 aa, Mycobacterium tuberculosis
STFP

SEQ ID NO: 1362469 - protein, 5 aa, Mycobacterium tuberculosis
STGGV

SEQ ID NO: 1362470 - protein, 4 aa, Mycobacterium tuberculosis
STGR

SEQ ID NO: 1362471 - protein, 8 aa, Mycobacterium tuberculosis
STGSGKST

SEQ ID NO: 1362472 - protein, 11 aa, Mycobacterium tuberculosis
STPEDPASARF

SEQ ID NO: 1362473 - protein, 9 aa, Mycobacterium tuberculosis
STPSTAGRI

SEQ ID NO: 1362474 - protein, 6 aa, Mycobacterium tuberculosis
STQDTN

SEQ ID NO: 1362475 - protein, 7 aa, Mycobacterium tuberculosis
STSGTFQ

SEQ ID NO: 1362476 - protein, 7 aa, Mycobacterium tuberculosis
STSTFQG

SEQ ID NO: 1362477 - protein, 7 aa, Mycobacterium tuberculosis
STTGYGD

SEQ ID NO: 1362478 - protein, 12 aa, Mycobacterium tuberculosis
STTHADSDTQAM

SEQ ID NO: 1362479 - protein, 5 aa, Mycobacterium tuberculosis
STTQS

SEQ ID NO: 1362480 - protein, 13 aa, Mycobacterium tuberculosis
STTSKDSPNPSMA

SEQ ID NO: 1362481 - protein, 13 aa, Mycobacterium tuberculosis
STTSTSGSGGGRR

SEQ ID NO: 1362482 - protein, 4 aa, Mycobacterium tuberculosis
STVD

SEQ ID NO: 1362483 - protein, 25 aa, Mycobacterium tuberculosis
SVAGTADDAAVEGTKVGVNTGGTYT

SEQ ID NO: 1362484 - protein, 8 aa, Mycobacterium tuberculosis
SVPPSGAH

SEQ ID NO: 1362485 - protein, 8 aa, Mycobacterium tuberculosis
SVSGPSQD

SEQ ID NO: 1362486 - protein, 5 aa, Mycobacterium tuberculosis
SYPSR

SEQ ID NO: 1362487 - protein, 7 aa, Mycobacterium tuberculosis
SYSTQYP

SEQ ID NO: 1362488 - protein, 5 aa, Mycobacterium tuberculosis
TAAQE

SEQ ID NO: 1362489 - protein, 6 aa, Mycobacterium tuberculosis
TANTYS

SEQ ID NO: 1362490 - protein, 14 aa, Mycobacterium tuberculosis
TAPLGTSPDGRSAT

SEQ ID NO: 1362491 - protein, 10 aa, Mycobacterium tuberculosis
TAQESADSMD

SEQ ID NO: 1362492 - protein, 13 aa, Mycobacterium tuberculosis
TAQQPGQTLPVGA

SEQ ID NO: 1362493 - protein, 8 aa, Mycobacterium tuberculosis
TARDNGTL

SEQ ID NO: 1362494 - protein, 9 aa, Mycobacterium tuberculosis
TARPGTTTA

SEQ ID NO: 1362495 - protein, 4 aa, Mycobacterium tuberculosis
TASA

SEQ ID NO: 1362496 - protein, 7 aa, Mycobacterium tuberculosis
TASDGSV

SEQ ID NO: 1362497 - protein, 4 aa, Mycobacterium tuberculosis
TASR

SEQ ID NO: 1362498 - protein, 6 aa, Mycobacterium tuberculosis
TATTPA

SEQ ID NO: 1362499 - protein, 6 aa, Mycobacterium tuberculosis
TAYGTA

SEQ ID NO: 1362500 - protein, 6 aa, Mycobacterium tuberculosis
TDADRR

SEQ ID NO: 1362501 - protein, 8 aa, Mycobacterium tuberculosis
TDAERTSL

SEQ ID NO: 1362502 - protein, 10 aa, Mycobacterium tuberculosis
TDAGARDRAS

SEQ ID NO: 1362503 - protein, 5 aa, Mycobacterium tuberculosis
TDGAI

SEQ ID NO: 1362504 - protein, 5 aa, Mycobacterium tuberculosis
TDHTR

SEQ ID NO: 1362505 - protein, 8 aa, Mycobacterium tuberculosis
TDLRTPKA

SEQ ID NO: 1362506 - protein, 15 aa, Mycobacterium tuberculosis
TDPAANTSVSAGDEI

SEQ ID NO: 1362507 - protein, 6 aa, Mycobacterium tuberculosis
TDPDAA

SEQ ID NO: 1362508 - protein, 21 aa, Mycobacterium tuberculosis
TDPGASPNLSDVSKQRVSGSQ

SEQ ID NO: 1362509 - protein, 16 aa, Mycobacterium tuberculosis
TDTEADQTKPGDEPKK

SEQ ID NO: 1362510 - protein, 8 aa, Mycobacterium tuberculosis
TEARQPGG

SEQ ID NO: 1362511 - protein, 6 aa, Mycobacterium tuberculosis
TEGFSG

SEQ ID NO: 1362512 - protein, 12 aa, Mycobacterium tuberculosis
TEPDSGSDAFGG

SEQ ID NO: 1362513 - protein, 7 aa, Mycobacterium tuberculosis
TESAERD

SEQ ID NO: 1362514 - protein, 4 aa, Mycobacterium tuberculosis
TETT

SEQ ID NO: 1362515 - protein, 5 aa, Mycobacterium tuberculosis
TFSPA

SEQ ID NO: 1362516 - protein, 10 aa, Mycobacterium tuberculosis
TGAGSGIGRE

SEQ ID NO: 1362517 - protein, 4 aa, Mycobacterium tuberculosis
TGAT

SEQ ID NO: 1362518 - protein, 8 aa, Mycobacterium tuberculosis
TGATARES

SEQ ID NO: 1362519 - protein, 10 aa, Mycobacterium tuberculosis
TGCTRGPTVT

SEQ ID NO: 1362520 - protein, 4 aa, Mycobacterium tuberculosis
TGDP

SEQ ID NO: 1362521 - protein, 8 aa, Mycobacterium tuberculosis
TGEPDELT

SEQ ID NO: 1362522 - protein, 10 aa, Mycobacterium tuberculosis
TGETSPGVAG

SEQ ID NO: 1362523 - protein, 12 aa, Mycobacterium tuberculosis
TGGGLPAAAVAS

SEQ ID NO: 1362524 - protein, 10 aa, Mycobacterium tuberculosis
TGGGPQGSTD

SEQ ID NO: 1362525 - protein, 6 aa, Mycobacterium tuberculosis
TGHSLG

SEQ ID NO: 1362526 - protein, 22 aa, Mycobacterium tuberculosis
TGKGGALSSGKYAPDLAPANEQ

SEQ ID NO: 1362527 - protein, 5 aa, Mycobacterium tuberculosis
TGNSV

SEQ ID NO: 1362528 - protein, 4 aa, Mycobacterium tuberculosis
TGPG

SEQ ID NO: 1362529 - protein, 8 aa, Mycobacterium tuberculosis
TGPKTAVR

SEQ ID NO: 1362530 - protein, 16 aa, Mycobacterium tuberculosis
TGQGSRVAVAAAQDGT

SEQ ID NO: 1362531 - protein, 7 aa, Mycobacterium tuberculosis
TGQTRDA

SEQ ID NO: 1362532 - protein, 8 aa, Mycobacterium tuberculosis
TGRPDNPH

SEQ ID NO: 1362533 - protein, 12 aa, Mycobacterium tuberculosis
TGRPTVGRAGPV

SEQ ID NO: 1362534 - protein, 10 aa, Mycobacterium tuberculosis
TGTLTRGTPE

SEQ ID NO: 1362535 - protein, 4 aa, Mycobacterium tuberculosis
THGT

SEQ ID NO: 1362536 - protein, 17 aa, Mycobacterium tuberculosis
THRAGPGYRRRSPVETT

SEQ ID NO: 1362537 - protein, 10 aa, Mycobacterium tuberculosis
TIGGGFTDAG

SEQ ID NO: 1362538 - protein, 10 aa, Mycobacterium tuberculosis
TMGDPSPGFP

SEQ ID NO: 1362539 - protein, 20 aa, Mycobacterium tuberculosis
TNGANTAGTFSEGPAKTAIQ

SEQ ID NO: 1362540 - protein, 5 aa, Mycobacterium tuberculosis
TNPEH

SEQ ID NO: 1362541 - protein, 10 aa, Mycobacterium tuberculosis
TNSAGNYHPW

SEQ ID NO: 1362542 - protein, 12 aa, Mycobacterium tuberculosis
TNVTRYSDATAG

SEQ ID NO: 1362543 - protein, 9 aa, Mycobacterium tuberculosis
TPAAGAPAI

SEQ ID NO: 1362544 - protein, 5 aa, Mycobacterium tuberculosis
TPAEQ

SEQ ID NO: 1362545 - protein, 4 aa, Mycobacterium tuberculosis
TPAL

SEQ ID NO: 1362546 - protein, 11 aa, Mycobacterium tuberculosis
TPDRDFNRDSR

SEQ ID NO: 1362547 - protein, 4 aa, Mycobacterium tuberculosis
TPEY

SEQ ID NO: 1362548 - protein, 7 aa, Mycobacterium tuberculosis
TPFTGDS

SEQ ID NO: 1362549 - protein, 4 aa, Mycobacterium tuberculosis
TPGA

SEQ ID NO: 1362550 - protein, 11 aa, Mycobacterium tuberculosis
TPPQSTPLPQT

SEQ ID NO: 1362551 - protein, 7 aa, Mycobacterium tuberculosis
TPSGALT

SEQ ID NO: 1362552 - protein, 6 aa, Mycobacterium tuberculosis
TPTARG

SEQ ID NO: 1362553 - protein, 5 aa, Mycobacterium tuberculosis
TPTTA

SEQ ID NO: 1362554 - protein, 4 aa, Mycobacterium tuberculosis
TPTV

SEQ ID NO: 1362555 - protein, 4 aa, Mycobacterium tuberculosis
TQHA

SEQ ID NO: 1362556 - protein, 16 aa, Mycobacterium tuberculosis
TQQTTVDQSGGNLEGK

SEQ ID NO: 1362557 - protein, 11 aa, Mycobacterium tuberculosis
TRAGRSAFSPD

SEQ ID NO: 1362558 - protein, 6 aa, Mycobacterium tuberculosis
TRARRA

SEQ ID NO: 1362559 - protein, 4 aa, Mycobacterium tuberculosis
TRDA

SEQ ID NO: 1362560 - protein, 6 aa, Mycobacterium tuberculosis
TRDYSD

SEQ ID NO: 1362561 - protein, 7 aa, Mycobacterium tuberculosis
TRGDGGF

SEQ ID NO: 1362562 - protein, 12 aa, Mycobacterium tuberculosis
TRGGKPFTGAGY

SEQ ID NO: 1362563 - protein, 5 aa, Mycobacterium tuberculosis
TRGLP

SEQ ID NO: 1362564 - protein, 4 aa, Mycobacterium tuberculosis
TRPG

SEQ ID NO: 1362565 - protein, 6 aa, Mycobacterium tuberculosis
TRPQGV

SEQ ID NO: 1362566 - protein, 10 aa, Mycobacterium tuberculosis
TRPSDDESVE

SEQ ID NO: 1362567 - protein, 13 aa, Mycobacterium tuberculosis
TRQSGRLPETPAY

SEQ ID NO: 1362568 - protein, 14 aa, Mycobacterium tuberculosis
TRTPSSPAARPVGT

SEQ ID NO: 1362569 - protein, 7 aa, Mycobacterium tuberculosis
TRTSGPY

SEQ ID NO: 1362570 - protein, 10 aa, Mycobacterium tuberculosis
TSALDAENEA

SEQ ID NO: 1362571 - protein, 10 aa, Mycobacterium tuberculosis
TSAPRATPQD

SEQ ID NO: 1362572 - protein, 27 aa, Mycobacterium tuberculosis
TSAQGMPPGPPGRRAWQADTESTAPSA

SEQ ID NO: 1362573 - protein, 4 aa, Mycobacterium tuberculosis
TSGA

SEQ ID NO: 1362574 - protein, 13 aa, Mycobacterium tuberculosis
TSGPLPDQADQAA

SEQ ID NO: 1362575 - protein, 6 aa, Mycobacterium tuberculosis
TSHSSA

SEQ ID NO: 1362576 - protein, 5 aa, Mycobacterium tuberculosis
TSPVC

SEQ ID NO: 1362577 - protein, 4 aa, Mycobacterium tuberculosis
TSRA

SEQ ID NO: 1362578 - protein, 5 aa, Mycobacterium tuberculosis
TSRPA

SEQ ID NO: 1362579 - protein, 7 aa, Mycobacterium tuberculosis
TSRSEWP

SEQ ID NO: 1362580 - protein, 19 aa, Mycobacterium tuberculosis
TSTEETVESQVNAARDERD

SEQ ID NO: 1362581 - protein, 4 aa, Mycobacterium tuberculosis
TSTG

SEQ ID NO: 1362582 - protein, 7 aa, Mycobacterium tuberculosis
TSTGTGW

SEQ ID NO: 1362583 - protein, 8 aa, Mycobacterium tuberculosis
TSVSGAVG

SEQ ID NO: 1362584 - protein, 7 aa, Mycobacterium tuberculosis
TTAPLRT

SEQ ID NO: 1362585 - protein, 6 aa, Mycobacterium tuberculosis
TTATGI

SEQ ID NO: 1362586 - protein, 5 aa, Mycobacterium tuberculosis
TTDTV

SEQ ID NO: 1362587 - protein, 10 aa, Mycobacterium tuberculosis
TTESDTPTEV

SEQ ID NO: 1362588 - protein, 8 aa, Mycobacterium tuberculosis
TTGSGKSE

SEQ ID NO: 1362589 - protein, 13 aa, Mycobacterium tuberculosis
TTKGGPKGVGTAV

SEQ ID NO: 1362590 - protein, 8 aa, Mycobacterium tuberculosis
TTNPSAAA

SEQ ID NO: 1362591 - protein, 11 aa, Mycobacterium tuberculosis
TTSQSGPELSP

SEQ ID NO: 1362592 - protein, 5 aa, Mycobacterium tuberculosis
TTTPS

SEQ ID NO: 1362593 - protein, 11 aa, Mycobacterium tuberculosis
TVKPKSDIAPE

SEQ ID NO: 1362594 - protein, 5 aa, Mycobacterium tuberculosis
TVNGS

SEQ ID NO: 1362595 - protein, 7 aa, Mycobacterium tuberculosis
TVNGTGA

SEQ ID NO: 1362596 - protein, 7 aa, Mycobacterium tuberculosis
TVPPTAA

SEQ ID NO: 1362597 - protein, 11 aa, Mycobacterium tuberculosis
TVTPEGDTKTI

SEQ ID NO: 1362598 - protein, 7 aa, Mycobacterium tuberculosis
VAPPGST

SEQ ID NO: 1362599 - protein, 6 aa, Mycobacterium tuberculosis
VDGASA

SEQ ID NO: 1362600 - protein, 6 aa, Mycobacterium tuberculosis
VDTAGD

SEQ ID NO: 1362601 - protein, 5 aa, Mycobacterium tuberculosis
VDTNT

SEQ ID NO: 1362602 - protein, 6 aa, Mycobacterium tuberculosis
VEEITP

SEQ ID NO: 1362603 - protein, 7 aa, Mycobacterium tuberculosis
VEQGDLS

SEQ ID NO: 1362604 - protein, 7 aa, Mycobacterium tuberculosis
VFEPGDS

SEQ ID NO: 1362605 - protein, 6 aa, Mycobacterium tuberculosis
VGARGQ

SEQ ID NO: 1362606 - protein, 9 aa, Mycobacterium tuberculosis
VGASKDPSV

SEQ ID NO: 1362607 - protein, 7 aa, Mycobacterium tuberculosis
VGATPRS

SEQ ID NO: 1362608 - protein, 14 aa, Mycobacterium tuberculosis
VGGSPVQVSGPAAG

SEQ ID NO: 1362609 - protein, 19 aa, Mycobacterium tuberculosis
VGRQRGAGLGGGHDEREQT

SEQ ID NO: 1362610 - protein, 20 aa, Mycobacterium tuberculosis
VGTTTYSSTAQHSAVAAEPP

SEQ ID NO: 1362611 - protein, 12 aa, Mycobacterium tuberculosis
VKAGSPAQKGGI

SEQ ID NO: 1362612 - protein, 13 aa, Mycobacterium tuberculosis
VKGDQSGQTANGK

SEQ ID NO: 1362613 - protein, 7 aa, Mycobacterium tuberculosis
VKGGGSG

SEQ ID NO: 1362614 - protein, 9 aa, Mycobacterium tuberculosis
VNRDSVDAV

SEQ ID NO: 1362615 - protein, 6 aa, Mycobacterium tuberculosis
VPARPA

SEQ ID NO: 1362616 - protein, 30 aa, Mycobacterium tuberculosis; identical to SEQ ID NO: 154911

SEQ ID NO: 1362617 - protein, 8 aa, Mycobacterium tuberculosis
VPGDQPDE

SEQ ID NO: 1362618 - protein, 9 aa, Mycobacterium tuberculosis
VPGEDAHAR

SEQ ID NO: 1362619 - protein, 8 aa, Mycobacterium tuberculosis
VPGKTEVS

SEQ ID NO: 1362620 - protein, 9 aa, Mycobacterium tuberculosis
VPGRGPANL

SEQ ID NO: 1362621 - protein, 7 aa, Mycobacterium tuberculosis
VPISGSA

SEQ ID NO: 1362622 - protein, 4 aa, Mycobacterium tuberculosis
VPLD

SEQ ID NO: 1362623 - protein, 19 aa, Mycobacterium tuberculosis
VPNAETAKSLGLSSPQNAP

SEQ ID NO: 1362624 - protein, 4 aa, Mycobacterium tuberculosis
VPPQ

SEQ ID NO: 1362625 - protein, 9 aa, Mycobacterium tuberculosis
VPRAESPED

SEQ ID NO: 1362626 - protein, 7 aa, Mycobacterium tuberculosis
VPTAEGK

SEQ ID NO: 1362627 - protein, 11 aa, Mycobacterium tuberculosis
VPTDPDDRSVD

SEQ ID NO: 1362628 - protein, 4 aa, Mycobacterium tuberculosis
VPTR

SEQ ID NO: 1362629 - protein, 8 aa, Mycobacterium tuberculosis
VPTSADLG

SEQ ID NO: 1362630 - protein, 6 aa, Mycobacterium tuberculosis
VPTTGP

SEQ ID NO: 1362631 - protein, 6 aa, Mycobacterium tuberculosis
VQRQYP

SEQ ID NO: 1362632 - protein, 7 aa, Mycobacterium tuberculosis
VQSNPST

SEQ ID NO: 1362633 - protein, 8 aa, Mycobacterium tuberculosis
VRAGNSAI

SEQ ID NO: 1362634 - protein, 11 aa, Mycobacterium tuberculosis
VRDKRSDQALA

SEQ ID NO: 1362635 - protein, 5 aa, Mycobacterium tuberculosis
VRPAT

SEQ ID NO: 1362636 - protein, 7 aa, Mycobacterium tuberculosis
VRPDARE

SEQ ID NO: 1362637 - protein, 12 aa, Mycobacterium tuberculosis
VSANDSSCDTTA

SEQ ID NO: 1362638 - protein, 12 aa, Mycobacterium tuberculosis
VSDPTSAPPDWP

SEQ ID NO: 1362639 - protein, 24 aa, Mycobacterium tuberculosis
VSGDDDQLTLPNTAAGRASAISQR

SEQ ID NO: 1362640 - protein, 7 aa, Mycobacterium tuberculosis
VSLAGGG

SEQ ID NO: 1362641 - protein, 9 aa, Mycobacterium tuberculosis
VSNPDLAGR

SEQ ID NO: 1362642 - protein, 7 aa, Mycobacterium tuberculosis
VSPEQTS

SEQ ID NO: 1362643 - protein, 8 aa, Mycobacterium tuberculosis
VSRRTTTV

SEQ ID NO: 1362644 - protein, 9 aa, Mycobacterium tuberculosis
VSRSGSTIS

SEQ ID NO: 1362645 - protein, 9 aa, Mycobacterium tuberculosis
VSSASALGT

SEQ ID NO: 1362646 - protein, 10 aa, Mycobacterium tuberculosis
VSSSSSRTAL

SEQ ID NO: 1362647 - protein, 11 aa, Mycobacterium tuberculosis
VSTGPEQREIP

SEQ ID NO: 1362648 - protein, 5 aa, Mycobacterium tuberculosis
VSTTR

SEQ ID NO: 1362649 - protein, 11 aa, Mycobacterium tuberculosis
VTDKTRQPLYD

SEQ ID NO: 1362650 - protein, 10 aa, Mycobacterium tuberculosis
VTEGTVNATA

SEQ ID NO: 1362651 - protein, 5 aa, Mycobacterium tuberculosis
VTPRR

SEQ ID NO: 1362652 - protein, 10 aa, Mycobacterium tuberculosis
VTPSESPVSL

SEQ ID NO: 1362653 - protein, 11 aa, Mycobacterium tuberculosis
VTQPGTSNPKA

SEQ ID NO: 1362654 - protein, 6 aa, Mycobacterium tuberculosis
VTRDGE

SEQ ID NO: 1362655 - protein, 6 aa, Mycobacterium tuberculosis
VTRNPD

SEQ ID NO: 1362656 - protein, 16 aa, Mycobacterium tuberculosis
VTRPTTGGAPSPGNYL

SEQ ID NO: 1362657 - protein, 9 aa, Mycobacterium tuberculosis
VTTASSAGA

SEQ ID NO: 1362658 - protein, 5 aa, Mycobacterium tuberculosis
VTTPR

SEQ ID NO: 1362659 - protein, 6 aa, Mycobacterium tuberculosis
VTVGGA

SEQ ID NO: 1362660 - protein, 12 aa, Mycobacterium tuberculosis
VTVGTDDDAPGL

SEQ ID NO: 1362661 - protein, 6 aa, Mycobacterium tuberculosis
VVEDGS

SEQ ID NO: 1362662 - protein, 4 aa, Mycobacterium tuberculosis
WDTH

SEQ ID NO: 1362663 - protein, 7 aa, Mycobacterium tuberculosis
WGEPGEG

SEQ ID NO: 1362664 - protein, 10 aa, Mycobacterium tuberculosis
WNPGNTYGET

SEQ ID NO: 1362665 - protein, 4 aa, Mycobacterium tuberculosis
WRPT

SEQ ID NO: 1362666 - protein, 15 aa, Mycobacterium tuberculosis
WRSPADTSTAPLPKG

SEQ ID NO: 1362667 - protein, 10 aa, Mycobacterium tuberculosis
WTPGAHPHEA

SEQ ID NO: 1362668 - protein, 4 aa, Mycobacterium tuberculosis
YADR

SEQ ID NO: 1362669 - protein, 11 aa, Mycobacterium tuberculosis
YAGDRRRAREA

SEQ ID NO: 1362670 - protein, 7 aa, Mycobacterium tuberculosis
YAPDDAA

SEQ ID NO: 1362671 - protein, 4 aa, Mycobacterium tuberculosis
YAPT

SEQ ID NO: 1362672 - protein, 4 aa, Mycobacterium tuberculosis
YASH

SEQ ID NO: 1362673 - protein, 6 aa, Mycobacterium tuberculosis
YASTRH

SEQ ID NO: 1362674 - protein, 14 aa, Mycobacterium tuberculosis
YDDRKTLPASVESS

SEQ ID NO: 1362675 - protein, 9 aa, Mycobacterium tuberculosis
YDGGSGPVL

SEQ ID NO: 1362676 - protein, 14 aa, Mycobacterium tuberculosis
YGAKTAAKTAALER

SEQ ID NO: 1362677 - protein, 10 aa, Mycobacterium tuberculosis
YGERPGTQGA

SEQ ID NO: 1362678 - protein, 6 aa, Mycobacterium tuberculosis
YGGSAA

SEQ ID NO: 1362679 - protein, 9 aa, Mycobacterium tuberculosis
YGPATGSQI

SEQ ID NO: 1362680 - protein, 6 aa, Mycobacterium tuberculosis
YGPDKV

SEQ ID NO: 1362681 - protein, 6 aa, Mycobacterium tuberculosis
YGPPQR

SEQ ID NO: 1362682 - protein, 6 aa, Mycobacterium tuberculosis
YGQTQP

SEQ ID NO: 1362683 - protein, 6 aa, Mycobacterium tuberculosis
YGRDRS

SEQ ID NO: 1362684 - protein, 17 aa, Mycobacterium tuberculosis
YGRPDATDAQVERAARE

SEQ ID NO: 1362685 - protein, 5 aa, Mycobacterium tuberculosis
YGSRE

SEQ ID NO: 1362686 - protein, 19 aa, Mycobacterium tuberculosis
YHSGSPKISNAGGSNSVQQ

SEQ ID NO: 1362687 - protein, 12 aa, Mycobacterium tuberculosis
YKPSQVSAGSQP

SEQ ID NO: 1362688 - protein, 14 aa, Mycobacterium tuberculosis
YLPPTNSVRQAQEE

SEQ ID NO: 1362689 - protein, 9 aa, Mycobacterium tuberculosis
YNPTTGRAE

SEQ ID NO: 1362690 - protein, 21 aa, Mycobacterium tuberculosis
YPESDTADRQVETPPSPPADA

SEQ ID NO: 1362691 - protein, 10 aa, Mycobacterium tuberculosis
YPNAGNKTQT

SEQ ID NO: 1362692 - protein, 11 aa, Mycobacterium tuberculosis
YQIPTDASANV

SEQ ID NO: 1362693 - protein, 5 aa, Mycobacterium tuberculosis
YQPQL

SEQ ID NO: 1362694 - protein, 9 aa, Mycobacterium tuberculosis
YQTNKSDQI

SEQ ID NO: 1362695 - protein, 5 aa, Mycobacterium tuberculosis
YQTPY

SEQ ID NO: 1362696 - protein, 5 aa, Mycobacterium tuberculosis
AAAAT

SEQ ID NO: 1362697 - protein, 8 aa, Mycobacterium tuberculosis
AAADKITP

SEQ ID NO: 1362698 - protein, 9 aa, Mycobacterium tuberculosis
AAAPDDRAL

SEQ ID NO: 1362699 - protein, 12 aa, Mycobacterium tuberculosis
AAAPPGPVGSPQ

SEQ ID NO: 1362700 - protein, 9 aa, Mycobacterium tuberculosis
AAAQSTEFT

SEQ ID NO: 1362701 - protein, 9 aa, Mycobacterium tuberculosis
AAASRSTPT

SEQ ID NO: 1362702 - protein, 9 aa, Mycobacterium tuberculosis
AADAPPGRL

SEQ ID NO: 1362703 - protein, 10 aa, Mycobacterium tuberculosis
AADPEADAAR

SEQ ID NO: 1362704 - protein, 9 aa, Mycobacterium tuberculosis
AAGGDPEAM

SEQ ID NO: 1362705 - protein, 8 aa, Mycobacterium tuberculosis
AAGGGPFA

SEQ ID NO: 1362706 - protein, 6 aa, Mycobacterium tuberculosis
AAGGNI

SEQ ID NO: 1362707 - protein, 8 aa, Mycobacterium tuberculosis
AAGHPGPG

SEQ ID NO: 1362708 - protein, 6 aa, Mycobacterium tuberculosis
AAGVGA

SEQ ID NO: 1362709 - protein, 8 aa, Mycobacterium tuberculosis
AANNDHLK

SEQ ID NO: 1362710 - protein, 5 aa, Mycobacterium tuberculosis
AANPA

SEQ ID NO: 1362711 - protein, 10 aa, Mycobacterium tuberculosis
AAPGHPAASG

SEQ ID NO: 1362712 - protein, 6 aa, Mycobacterium tuberculosis
AAPGWE

SEQ ID NO: 1362713 - protein, 6 aa, Mycobacterium tuberculosis
AAQETL

SEQ ID NO: 1362714 - protein, 10 aa, Mycobacterium tuberculosis
AARARARAAR

SEQ ID NO: 1362715 - protein, 14 aa, Mycobacterium tuberculosis
AARDLRSHPRTGPY

SEQ ID NO: 1362716 - protein, 10 aa, Mycobacterium tuberculosis
AARHPSPNAG

SEQ ID NO: 1362717 - protein, 9 aa, Mycobacterium tuberculosis
AARQQTPNE

SEQ ID NO: 1362718 - protein, 17 aa, Mycobacterium tuberculosis
AASARSEPGEPVGSTRY

SEQ ID NO: 1362719 - protein, 21 aa, Mycobacterium tuberculosis
AASEQPPASVAEDVPPSHDDI

SEQ ID NO: 1362720 - protein, 15 aa, Mycobacterium tuberculosis
AASRTREARRASQEA

SEQ ID NO: 1362721 - protein, 4 aa, Mycobacterium tuberculosis
AATD

SEQ ID NO: 1362722 - protein, 6 aa, Mycobacterium tuberculosis
AATTSA

SEQ ID NO: 1362723 - protein, 4 aa, Mycobacterium tuberculosis
ADAR

SEQ ID NO: 1362724 - protein, 4 aa, Mycobacterium tuberculosis
ADAW

SEQ ID NO: 1362725 - protein, 9 aa, Mycobacterium tuberculosis
ADDPDAAKA

SEQ ID NO: 1362726 - protein, 8 aa, Mycobacterium tuberculosis
ADETGGPV

SEQ ID NO: 1362727 - protein, 5 aa, Mycobacterium tuberculosis
ADGAD

SEQ ID NO: 1362728 - protein, 10 aa, Mycobacterium tuberculosis
ADGEPASDWR

SEQ ID NO: 1362729 - protein, 15 aa, Mycobacterium tuberculosis
ADGGRDPQYHHDGPD

SEQ ID NO: 1362730 - protein, 15 aa, Mycobacterium tuberculosis
ADGKTCRFNPWPYPI

SEQ ID NO: 1362731 - protein, 9 aa, Mycobacterium tuberculosis
ADGNDNTQA

SEQ ID NO: 1362732 - protein, 8 aa, Mycobacterium tuberculosis
ADGRTAAD

SEQ ID NO: 1362733 - protein, 20 aa, Mycobacterium tuberculosis
ADQSSGGVDASEVTAAAGEE

SEQ ID NO: 1362734 - protein, 11 aa, Mycobacterium tuberculosis
ADRELASQTEA

SEQ ID NO: 1362735 - protein, 5 aa, Mycobacterium tuberculosis
ADRST

SEQ ID NO: 1362736 - protein, 10 aa, Mycobacterium tuberculosis
ADSGNSVTQT

SEQ ID NO: 1362737 - protein, 11 aa, Mycobacterium tuberculosis
ADSSRNVKGDS

SEQ ID NO: 1362738 - protein, 4 aa, Mycobacterium tuberculosis
ADTP

SEQ ID NO: 1362739 - protein, 6 aa, Mycobacterium tuberculosis
ADVPTQ

SEQ ID NO: 1362740 - protein, 37 aa, Mycobacterium tuberculosis; identical to SEQ ID NO: 149512

SEQ ID NO: 1362741 - protein, 10 aa, Mycobacterium tuberculosis
AEAPDPQRAV

SEQ ID NO: 1362742 - protein, 11 aa, Mycobacterium tuberculosis
AEGRGKAQAAA

SEQ ID NO: 1362743 - protein, 5 aa, Mycobacterium tuberculosis
AEHTD

SEQ ID NO: 1362744 - protein, 6 aa, Mycobacterium tuberculosis
AEPGGV

SEQ ID NO: 1362745 - protein, 5 aa, Mycobacterium tuberculosis
AERRL

SEQ ID NO: 1362746 - protein, 5 aa, Mycobacterium tuberculosis
AESNN

SEQ ID NO: 1362747 - protein, 12 aa, Mycobacterium tuberculosis
AEYGATDAQLQS

SEQ ID NO: 1362748 - protein, 10 aa, Mycobacterium tuberculosis
AGAAGTAAAL

SEQ ID NO: 1362749 - protein, 6 aa, Mycobacterium tuberculosis
AGADRA

SEQ ID NO: 1362750 - protein, 6 aa, Mycobacterium tuberculosis
AGDREP

SEQ ID NO: 1362751 - protein, 9 aa, Mycobacterium tuberculosis
AGETAEPAK

SEQ ID NO: 1362752 - protein, 7 aa, Mycobacterium tuberculosis
AGFGGGN

SEQ ID NO: 1362753 - protein, 11 aa, Mycobacterium tuberculosis
AGFSASEQDRV

SEQ ID NO: 1362754 - protein, 22 aa, Mycobacterium tuberculosis
AGGAAGPLGAKKGGQYPIGGDG

SEQ ID NO: 1362755 - protein, 12 aa, Mycobacterium tuberculosis
AGGASAPEHSQT

SEQ ID NO: 1362756 - protein, 5 aa, Mycobacterium tuberculosis
AGGCA

SEQ ID NO: 1362757 - protein, 8 aa, Mycobacterium tuberculosis
AGGGVDPR

SEQ ID NO: 1362758 - protein, 9 aa, Mycobacterium tuberculosis
AGGSGKTTA

SEQ ID NO: 1362759 - protein, 16 aa, Mycobacterium tuberculosis
AGKELSGLSSRDYPGA

SEQ ID NO: 1362760 - protein, 13 aa, Mycobacterium tuberculosis
AGNQGESLANESV

SEQ ID NO: 1362761 - protein, 13 aa, Mycobacterium tuberculosis
AGNQGTPLANESV

SEQ ID NO: 1362762 - protein, 9 aa, Mycobacterium tuberculosis
AGNTVDGTS

SEQ ID NO: 1362763 - protein, 9 aa, Mycobacterium tuberculosis
AGPAPPGLS

SEQ ID NO: 1362764 - protein, 5 aa, Mycobacterium tuberculosis
AGPGL

SEQ ID NO: 1362765 - protein, 4 aa, Mycobacterium tuberculosis
AGQG

SEQ ID NO: 1362766 - protein, 4 aa, Mycobacterium tuberculosis
AGQT

SEQ ID NO: 1362767 - protein, 11 aa, Mycobacterium tuberculosis
AGREPPPGLSA

SEQ ID NO: 1362768 - protein, 6 aa, Mycobacterium tuberculosis
AGRPVQ

SEQ ID NO: 1362769 - protein, 13 aa, Mycobacterium tuberculosis
AGSAASWSRTRST

SEQ ID NO: 1362770 - protein, 11 aa, Mycobacterium tuberculosis
AGSATTANGVA

SEQ ID NO: 1362771 - protein, 12 aa, Mycobacterium tuberculosis
AGSGTSERDREE

SEQ ID NO: 1362772 - protein, 7 aa, Mycobacterium tuberculosis
AGSKTQT

SEQ ID NO: 1362773 - protein, 7 aa, Mycobacterium tuberculosis
AGSNNQT

SEQ ID NO: 1362774 - protein, 4 aa, Mycobacterium tuberculosis
AGVA

SEQ ID NO: 1362775 - protein, 7 aa, Mycobacterium tuberculosis
AGWRPGP

SEQ ID NO: 1362776 - protein, 9 aa, Mycobacterium tuberculosis
AGYGAPAGV

SEQ ID NO: 1362777 - protein, 13 aa, Mycobacterium tuberculosis
AHAEPEPKSPPIP

SEQ ID NO: 1362778 - protein, 6 aa, Mycobacterium tuberculosis
AHERTD

SEQ ID NO: 1362779 - protein, 7 aa, Mycobacterium tuberculosis
AHPGDAK

SEQ ID NO: 1362780 - protein, 9 aa, Mycobacterium tuberculosis
AIEGNAAVP

SEQ ID NO: 1362781 - protein, 4 aa, Mycobacterium tuberculosis
AIGT

SEQ ID NO: 1362782 - protein, 6 aa, Mycobacterium tuberculosis
AIPPNA

SEQ ID NO: 1362783 - protein, 10 aa, Mycobacterium tuberculosis
AKGGNPQSCG

SEQ ID NO: 1362784 - protein, 8 aa, Mycobacterium tuberculosis
AKQPKDRY

SEQ ID NO: 1362785 - protein, 7 aa, Mycobacterium tuberculosis
AKTSSVD

SEQ ID NO: 1362786 - protein, 10 aa, Mycobacterium tuberculosis
ALSDSVAASE

SEQ ID NO: 1362787 - protein, 8 aa, Mycobacterium tuberculosis
ALSPNDRA

SEQ ID NO: 1362788 - protein, 8 aa, Mycobacterium tuberculosis
AMGQSRTQ

SEQ ID NO: 1362789 - protein, 5 aa, Mycobacterium tuberculosis
ANAAP

SEQ ID NO: 1362790 - protein, 7 aa, Mycobacterium tuberculosis
ANGSGKT

SEQ ID NO: 1362791 - protein, 14 aa, Mycobacterium tuberculosis
ANNRAGNPVGSSYL

SEQ ID NO: 1362792 - protein, 7 aa, Mycobacterium tuberculosis
ANPSYTR

SEQ ID NO: 1362793 - protein, 10 aa, Mycobacterium tuberculosis
ANVAAGARTR

SEQ ID NO: 1362794 - protein, 5 aa, Mycobacterium tuberculosis
APAGA

SEQ ID NO: 1362795 - protein, 10 aa, Mycobacterium tuberculosis
APAPAGTSAS

SEQ ID NO: 1362796 - protein, 12 aa, Mycobacterium tuberculosis
APEATGHGTDEA

SEQ ID NO: 1362797 - protein, 8 aa, Mycobacterium tuberculosis
APEEGQMS

SEQ ID NO: 1362798 - protein, 8 aa, Mycobacterium tuberculosis
APFKSATK

SEQ ID NO: 1362799 - protein, 17 aa, Mycobacterium tuberculosis
APGASSAPPPAPGRPSA

SEQ ID NO: 1362800 - protein, 8 aa, Mycobacterium tuberculosis
APGFDAKE

SEQ ID NO: 1362801 - protein, 4 aa, Mycobacterium tuberculosis
APGH

SEQ ID NO: 1362802 - protein, 12 aa, Mycobacterium tuberculosis
APGSAPAPGDVS

SEQ ID NO: 1362803 - protein, 5 aa, Mycobacterium tuberculosis
APIDH

SEQ ID NO: 1362804 - protein, 4 aa, Mycobacterium tuberculosis
APMP

SEQ ID NO: 1362805 - protein, 19 aa, Mycobacterium tuberculosis
APRPGGAMAPASTSSTGGH

SEQ ID NO: 1362806 - protein, 11 aa, Mycobacterium tuberculosis
APTPAVPSTAP

SEQ ID NO: 1362807 - protein, 4 aa, Mycobacterium tuberculosis
APYP

SEQ ID NO: 1362808 - protein, 14 aa, Mycobacterium tuberculosis
AQAAASTIRSADRD

SEQ ID NO: 1362809 - protein, 16 aa, Mycobacterium tuberculosis
AQAAKREQAPLPPGAP

SEQ ID NO: 1362810 - protein, 8 aa, Mycobacterium tuberculosis
AQAANGAP

SEQ ID NO: 1362811 - protein, 9 aa, Mycobacterium tuberculosis
AQADPPGTV

SEQ ID NO: 1362812 - protein, 12 aa, Mycobacterium tuberculosis
AQAQKADAQRLA

SEQ ID NO: 1362813 - protein, 14 aa, Mycobacterium tuberculosis
AQASLAAAASGAPL

SEQ ID NO: 1362814 - protein, 5 aa, Mycobacterium tuberculosis
AQHSR

SEQ ID NO: 1362815 - protein, 6 aa, Mycobacterium tuberculosis
AQIPSR

SEQ ID NO: 1362816 - protein, 6 aa, Mycobacterium tuberculosis
AQPPLG

SEQ ID NO: 1362817 - protein, 9 aa, Mycobacterium tuberculosis
AQQARADET

SEQ ID NO: 1362818 - protein, 18 aa, Mycobacterium tuberculosis
ARASTQPHNGEGHAHATD

SEQ ID NO: 1362819 - protein, 17 aa, Mycobacterium tuberculosis
ARATPAGRATGATIDAS

SEQ ID NO: 1362820 - protein, 10 aa, Mycobacterium tuberculosis
ARDFATSGLE

SEQ ID NO: 1362821 - protein, 4 aa, Mycobacterium tuberculosis
AREP

SEQ ID NO: 1362822 - protein, 6 aa, Mycobacterium tuberculosis
ARPAET

SEQ ID NO: 1362823 - protein, 8 aa, Mycobacterium tuberculosis
ARPEAGGK

SEQ ID NO: 1362824 - protein, 4 aa, Mycobacterium tuberculosis
ARPG

SEQ ID NO: 1362825 - protein, 8 aa, Mycobacterium tuberculosis
ARRRGREY

SEQ ID NO: 1362826 - protein, 7 aa, Mycobacterium tuberculosis
ARSGKTT

SEQ ID NO: 1362827 - protein, 17 aa, Mycobacterium tuberculosis
ARSPDMAEAAAGTGRDV

SEQ ID NO: 1362828 - protein, 8 aa, Mycobacterium tuberculosis
ARSQNALG

SEQ ID NO: 1362829 - protein, 14 aa, Mycobacterium tuberculosis
ARTPDGSAPSREAL

SEQ ID NO: 1362830 - protein, 20 aa, Mycobacterium tuberculosis
ASADAAGAAAQHEAAAAAYT

SEQ ID NO: 1362831 - protein, 5 aa, Mycobacterium tuberculosis
ASAGA

SEQ ID NO: 1362832 - protein, 9 aa, Mycobacterium tuberculosis
ASAQTSARR

SEQ ID NO: 1362833 - protein, 5 aa, Mycobacterium tuberculosis
ASDGY

SEQ ID NO: 1362834 - protein, 5 aa, Mycobacterium tuberculosis
ASEGY

SEQ ID NO: 1362835 - protein, 16 aa, Mycobacterium tuberculosis
ASGAALASAPRTVPAP

SEQ ID NO: 1362836 - protein, 8 aa, Mycobacterium tuberculosis
ASGESKSR

SEQ ID NO: 1362837 - protein, 4 aa, Mycobacterium tuberculosis
ASGS

SEQ ID NO: 1362838 - protein, 7 aa, Mycobacterium tuberculosis
ASKDNKA

SEQ ID NO: 1362839 - protein, 4 aa, Mycobacterium tuberculosis
ASLA

SEQ ID NO: 1362840 - protein, 5 aa, Mycobacterium tuberculosis
ASLAE

SEQ ID NO: 1362841 - protein, 6 aa, Mycobacterium tuberculosis
ASLPST

SEQ ID NO: 1362842 - protein, 9 aa, Mycobacterium tuberculosis
ASPDPGPVN

SEQ ID NO: 1362843 - protein, 6 aa, Mycobacterium tuberculosis
ASPSVS

SEQ ID NO: 1362844 - protein, 12 aa, Mycobacterium tuberculosis
ASRDTRQGVGAG

SEQ ID NO: 1362845 - protein, 16 aa, Mycobacterium tuberculosis
ASTTAAGPISQNAYGA

SEQ ID NO: 1362846 - protein, 4 aa, Mycobacterium tuberculosis
ASVA

SEQ ID NO: 1362847 - protein, 4 aa, Mycobacterium tuberculosis
ASWG

SEQ ID NO: 1362848 - protein, 10 aa, Mycobacterium tuberculosis
ATADQDRATD

SEQ ID NO: 1362849 - protein, 8 aa, Mycobacterium tuberculosis
ATAPADRF

SEQ ID NO: 1362850 - protein, 5 aa, Mycobacterium tuberculosis
ATAQR

SEQ ID NO: 1362851 - protein, 8 aa, Mycobacterium tuberculosis
ATELTGGN

SEQ ID NO: 1362852 - protein, 8 aa, Mycobacterium tuberculosis
ATGSTGTT

SEQ ID NO: 1362853 - protein, 12 aa, Mycobacterium tuberculosis
ATPEATSEETPT

SEQ ID NO: 1362854 - protein, 8 aa, Mycobacterium tuberculosis
ATTDTPPV

SEQ ID NO: 1362855 - protein, 7 aa, Mycobacterium tuberculosis
ATTPVGG

SEQ ID NO: 1362856 - protein, 7 aa, Mycobacterium tuberculosis
ATTRRDA

SEQ ID NO: 1362857 - protein, 8 aa, Mycobacterium tuberculosis
ATVAETNN

SEQ ID NO: 1362858 - protein, 17 aa, Mycobacterium tuberculosis
AVAANRKDFDPDELESD

SEQ ID NO: 1362859 - protein, 7 aa, Mycobacterium tuberculosis
AVDGSAA

SEQ ID NO: 1362860 - protein, 12 aa, Mycobacterium tuberculosis
AVGASRTAEGPH

SEQ ID NO: 1362861 - protein, 5 aa, Mycobacterium tuberculosis
AVGEG

SEQ ID NO: 1362862 - protein, 8 aa, Mycobacterium tuberculosis
AVKPSYGL

SEQ ID NO: 1362863 - protein, 11 aa, Mycobacterium tuberculosis
AVNNGTLPYGN

SEQ ID NO: 1362864 - protein, 8 aa, Mycobacterium tuberculosis
AVRTSTNE

SEQ ID NO: 1362865 - protein, 10 aa, Mycobacterium tuberculosis
AVSATGPAAP

SEQ ID NO: 1362866 - protein, 4 aa, Mycobacterium tuberculosis
AVSG

SEQ ID NO: 1362867 - protein, 11 aa, Mycobacterium tuberculosis
AVTPTRTDRPA

SEQ ID NO: 1362868 - protein, 4 aa, Mycobacterium tuberculosis
AYAP

SEQ ID NO: 1362869 - protein, 10 aa, Mycobacterium tuberculosis
CDESLPSPRV

SEQ ID NO: 1362870 - protein, 8 aa, Mycobacterium tuberculosis
DAANNDDS

SEQ ID NO: 1362871 - protein, 10 aa, Mycobacterium tuberculosis
DAASPETQAA

SEQ ID NO: 1362872 - protein, 9 aa, Mycobacterium tuberculosis
DADESSPPV

SEQ ID NO: 1362873 - protein, 8 aa, Mycobacterium tuberculosis
DADKPSMA

SEQ ID NO: 1362874 - protein, 5 aa, Mycobacterium tuberculosis
DAETE

SEQ ID NO: 1362875 - protein, 28 aa, Mycobacterium tuberculosis
DAKPGVKLPQPSSTTTPDLTPRAALTPE

SEQ ID NO: 1362876 - protein, 8 aa, Mycobacterium tuberculosis
DANGQPLS

SEQ ID NO: 1362877 - protein, 7 aa, Mycobacterium tuberculosis
DAPNAVA

SEQ ID NO: 1362878 - protein, 6 aa, Mycobacterium tuberculosis
DARAQQ

SEQ ID NO: 1362879 - protein, 15 aa, Mycobacterium tuberculosis
DARPSSGSRSAAHGH

SEQ ID NO: 1362880 - protein, 8 aa, Mycobacterium tuberculosis
DASQPSMA

SEQ ID NO: 1362881 - protein, 9 aa, Mycobacterium tuberculosis
DAYAPHESF

SEQ ID NO: 1362882 - protein, 26 aa, Mycobacterium tuberculosis
DDADRETDARTPAPAARHASRSQGRG

SEQ ID NO: 1362883 - protein, 19 aa, Mycobacterium tuberculosis
DDIEGGEDEDEEGVRTPKV

SEQ ID NO: 1362884 - protein, 6 aa, Mycobacterium tuberculosis
DDPGNI

SEQ ID NO: 1362885 - protein, 8 aa, Mycobacterium tuberculosis
DDRKQTAA

SEQ ID NO: 1362886 - protein, 8 aa, Mycobacterium tuberculosis
DDSSDDCA

SEQ ID NO: 1362887 - protein, 7 aa, Mycobacterium tuberculosis
DDVPDEV

SEQ ID NO: 1362888 - protein, 4 aa, Mycobacterium tuberculosis
DEGV

SEQ ID NO: 1362889 - protein, 15 aa, Mycobacterium tuberculosis
DELTAAPDSDDLGEG

SEQ ID NO: 1362890 - protein, 4 aa, Mycobacterium tuberculosis
DEMA

SEQ ID NO: 1362891 - protein, 7 aa, Mycobacterium tuberculosis
DEMSSDH

SEQ ID NO: 1362892 - protein, 12 aa, Mycobacterium tuberculosis
DEPPTGTAPNQV

SEQ ID NO: 1362893 - protein, 22 aa, Mycobacterium tuberculosis
DESDVDGYQSRSGPGAASSENR

SEQ ID NO: 1362894 - protein, 6 aa, Mycobacterium tuberculosis
DESPHG

SEQ ID NO: 1362895 - protein, 14 aa, Mycobacterium tuberculosis
DEYDQAETAPVEDL

SEQ ID NO: 1362896 - protein, 6 aa, Mycobacterium tuberculosis
DEYRGQ

SEQ ID NO: 1362897 - protein, 12 aa, Mycobacterium tuberculosis
DGDAQSAGRRAR

SEQ ID NO: 1362898 - protein, 9 aa, Mycobacterium tuberculosis
DGDYSGAAV

SEQ ID NO: 1362899 - protein, 5 aa, Mycobacterium tuberculosis
DGHDH

SEQ ID NO: 1362900 - protein, 4 aa, Mycobacterium tuberculosis
DGHR

SEQ ID NO: 1362901 - protein, 5 aa, Mycobacterium tuberculosis
DGKPV

SEQ ID NO: 1362902 - protein, 21 aa, Mycobacterium tuberculosis
DGPGYAGSSPTLGPTKTSSIT

SEQ ID NO: 1362903 - protein, 4 aa, Mycobacterium tuberculosis
DGPS

SEQ ID NO: 1362904 - protein, 7 aa, Mycobacterium tuberculosis
DGQDPDM

SEQ ID NO: 1362905 - protein, 4 aa, Mycobacterium tuberculosis
DGRS

SEQ ID NO: 1362906 - protein, 9 aa, Mycobacterium tuberculosis
DGSNDAAAI

SEQ ID NO: 1362907 - protein, 13 aa, Mycobacterium tuberculosis
DHAPGEPHPQPSR

SEQ ID NO: 1362908 - protein, 7 aa, Mycobacterium tuberculosis
DHQASVS

SEQ ID NO: 1362909 - protein, 8 aa, Mycobacterium tuberculosis
DIDKNTAY

SEQ ID NO: 1362910 - protein, 7 aa, Mycobacterium tuberculosis
DIRGTYR

SEQ ID NO: 1362911 - protein, 7 aa, Mycobacterium tuberculosis
DKDIQDA

SEQ ID NO: 1362912 - protein, 8 aa, Mycobacterium tuberculosis
DKPDLQGA

SEQ ID NO: 1362913 - protein, 7 aa, Mycobacterium tuberculosis
DKTAGQA

SEQ ID NO: 1362914 - protein, 5 aa, Mycobacterium tuberculosis
DLRNP

SEQ ID NO: 1362915 - protein, 5 aa, Mycobacterium tuberculosis
DLSGF

SEQ ID NO: 1362916 - protein, 11 aa, Mycobacterium tuberculosis
DNAVEDEGLQP

SEQ ID NO: 1362917 - protein, 6 aa, Mycobacterium tuberculosis
DNPDFQ

SEQ ID NO: 1362918 - protein, 12 aa, Mycobacterium tuberculosis
DNPGPSDPTTKA

SEQ ID NO: 1362919 - protein, 4 aa, Mycobacterium tuberculosis
DNPK

SEQ ID NO: 1362920 - protein, 8 aa, Mycobacterium tuberculosis
DNRAAADA

SEQ ID NO: 1362921 - protein, 9 aa, Mycobacterium tuberculosis
DNTGSPDAW

SEQ ID NO: 1362922 - protein, 9 aa, Mycobacterium tuberculosis
DPAKPLPAS

SEQ ID NO: 1362923 - protein, 6 aa, Mycobacterium tuberculosis
DPDEGF

SEQ ID NO: 1362924 - protein, 7 aa, Mycobacterium tuberculosis
DPGPGVA

SEQ ID NO: 1362925 - protein, 10 aa, Mycobacterium tuberculosis
DPGPRRLPYP

SEQ ID NO: 1362926 - protein, 8 aa, Mycobacterium tuberculosis
DPGSEQRW

SEQ ID NO: 1362927 - protein, 5 aa, Mycobacterium tuberculosis
DPHNG

SEQ ID NO: 1362928 - protein, 15 aa, Mycobacterium tuberculosis
DPPAGSYPNPDERRK

SEQ ID NO: 1362929 - protein, 8 aa, Mycobacterium tuberculosis
DPSGLTAT

SEQ ID NO: 1362930 - protein, 5 aa, Mycobacterium tuberculosis
DPTSG

SEQ ID NO: 1362931 - protein, 12 aa, Mycobacterium tuberculosis
DPTYADPSQSML

SEQ ID NO: 1362932 - protein, 11 aa, Mycobacterium tuberculosis
DPYRVGPASGL

SEQ ID NO: 1362933 - protein, 15 aa, Mycobacterium tuberculosis
DPYTGDEDPQTAQKI

SEQ ID NO: 1362934 - protein, 6 aa, Mycobacterium tuberculosis
DQPDIY

SEQ ID NO: 1362935 - protein, 7 aa, Mycobacterium tuberculosis
DQPLGGD

SEQ ID NO: 1362936 - protein, 9 aa, Mycobacterium tuberculosis
DQQQAGDRS

SEQ ID NO: 1362937 - protein, 9 aa, Mycobacterium tuberculosis
DQRPGAGSL

SEQ ID NO: 1362938 - protein, 6 aa, Mycobacterium tuberculosis
DRAGSA

SEQ ID NO: 1362939 - protein, 17 aa, Mycobacterium tuberculosis
DRATTAYTNTSGVSSES

SEQ ID NO: 1362940 - protein, 14 aa, Mycobacterium tuberculosis
DRESELRPPVRSGF

SEQ ID NO: 1362941 - protein, 7 aa, Mycobacterium tuberculosis
DRESIDD

SEQ ID NO: 1362942 - protein, 6 aa, Mycobacterium tuberculosis
DRGNNR

SEQ ID NO: 1362943 - protein, 15 aa, Mycobacterium tuberculosis
DRHTPEPARLRPAVG

SEQ ID NO: 1362944 - protein, 7 aa, Mycobacterium tuberculosis
DRIGGGR

SEQ ID NO: 1362945 - protein, 9 aa, Mycobacterium tuberculosis
DRPHPTEAD

SEQ ID NO: 1362946 - protein, 21 aa, Mycobacterium tuberculosis
DRRVASREDRHADSDYADDEL

SEQ ID NO: 1362947 - protein, 7 aa, Mycobacterium tuberculosis
DSDPQAG

SEQ ID NO: 1362948 - protein, 6 aa, Mycobacterium tuberculosis
DSDPTK

SEQ ID NO: 1362949 - protein, 4 aa, Mycobacterium tuberculosis
DSGS

SEQ ID NO: 1362950 - protein, 5 aa, Mycobacterium tuberculosis
DSKPL

SEQ ID NO: 1362951 - protein, 15 aa, Mycobacterium tuberculosis
DSNTTATSAPPRTKI

SEQ ID NO: 1362952 - protein, 10 aa, Mycobacterium tuberculosis
DSQGSVNVPT

SEQ ID NO: 1362953 - protein, 10 aa, Mycobacterium tuberculosis
DTASELPDGQ

SEQ ID NO: 1362954 - protein, 13 aa, Mycobacterium tuberculosis
DTDEQEPADPPRK

SEQ ID NO: 1362955 - protein, 10 aa, Mycobacterium tuberculosis
DTGTSFGGMG

SEQ ID NO: 1362956 - protein, 7 aa, Mycobacterium tuberculosis
DTPDGGL

SEQ ID NO: 1362957 - protein, 7 aa, Mycobacterium tuberculosis
DTPKGVQ

SEQ ID NO: 1362958 - protein, 7 aa, Mycobacterium tuberculosis
DTPRAQA

SEQ ID NO: 1362959 - protein, 5 aa, Mycobacterium tuberculosis
DTQPH

SEQ ID NO: 1362960 - protein, 7 aa, Mycobacterium tuberculosis
DTSGPGA

SEQ ID NO: 1362961 - protein, 6 aa, Mycobacterium tuberculosis
DTTHDV

SEQ ID NO: 1362962 - protein, 5 aa, Mycobacterium tuberculosis
DTTHV

SEQ ID NO: 1362963 - protein, 4 aa, Mycobacterium tuberculosis
DYGT

SEQ ID NO: 1362964 - protein, 8 aa, Mycobacterium tuberculosis
DYTGPGKR

SEQ ID NO: 1362965 - protein, 7 aa, Mycobacterium tuberculosis
EAAARPD

SEQ ID NO: 1362966 - protein, 16 aa, Mycobacterium tuberculosis
EAAEPVSRRRSHAGGL

SEQ ID NO: 1362967 - protein, 6 aa, Mycobacterium tuberculosis
EAASEH

SEQ ID NO: 1362968 - protein, 20 aa, Mycobacterium tuberculosis
EADGRETSGEEPAKWQSART

SEQ ID NO: 1362969 - protein, 9 aa, Mycobacterium tuberculosis
EAGHAAEQR

SEQ ID NO: 1362970 - protein, 6 aa, Mycobacterium tuberculosis
EAPPLT

SEQ ID NO: 1362971 - protein, 11 aa, Mycobacterium tuberculosis
EARATGQNREA

SEQ ID NO: 1362972 - protein, 12 aa, Mycobacterium tuberculosis
EARGLGQDRESA

SEQ ID NO: 1362973 - protein, 12 aa, Mycobacterium tuberculosis
EARQAGEDKEAA

SEQ ID NO: 1362974 - protein, 5 aa, Mycobacterium tuberculosis
EATRV

SEQ ID NO: 1362975 - protein, 6 aa, Mycobacterium tuberculosis
EATSAV

SEQ ID NO: 1362976 - protein, 14 aa, Mycobacterium tuberculosis
EATVKDTAAEIAAR

SEQ ID NO: 1362977 - protein, 19 aa, Mycobacterium tuberculosis
EDSRNGIQERIGQKVEAEP

SEQ ID NO: 1362978 - protein, 9 aa, Mycobacterium tuberculosis
EEAGTAKPK

SEQ ID NO: 1362979 - protein, 31 aa, Mycobacterium tuberculosis; identical to SEQ ID NO: 150713

SEQ ID NO: 1362980 - protein, 8 aa, Mycobacterium tuberculosis
EEGDSDSA

SEQ ID NO: 1362981 - protein, 5 aa, Mycobacterium tuberculosis
EERRR

SEQ ID NO: 1362982 - protein, 4 aa, Mycobacterium tuberculosis
EGDA

SEQ ID NO: 1362983 - protein, 10 aa, Mycobacterium tuberculosis
EGDGRDSARA

SEQ ID NO: 1362984 - protein, 10 aa, Mycobacterium tuberculosis
EGDPATPEGI

SEQ ID NO: 1362985 - protein, 6 aa, Mycobacterium tuberculosis
EGDSDS

SEQ ID NO: 1362986 - protein, 4 aa, Mycobacterium tuberculosis
EGED

SEQ ID NO: 1362987 - protein, 5 aa, Mycobacterium tuberculosis
EGMPR

SEQ ID NO: 1362988 - protein, 6 aa, Mycobacterium tuberculosis
EGRAGA

SEQ ID NO: 1362989 - protein, 10 aa, Mycobacterium tuberculosis
EGVARRGQLR

SEQ ID NO: 1362990 - protein, 6 aa, Mycobacterium tuberculosis
EHDRSE

SEQ ID NO: 1362991 - protein, 4 aa, Mycobacterium tuberculosis
EHIP

SEQ ID NO: 1362992 - protein, 5 aa, Mycobacterium tuberculosis
EHPVP

SEQ ID NO: 1362993 - protein, 6 aa, Mycobacterium tuberculosis
EHSTAD

SEQ ID NO: 1362994 - protein, 8 aa, Mycobacterium tuberculosis
EIREGRSF

SEQ ID NO: 1362995 - protein, 8 aa, Mycobacterium tuberculosis
ELGPGDAP

SEQ ID NO: 1362996 - protein, 10 aa, Mycobacterium tuberculosis
ELGTHPRART

SEQ ID NO: 1362997 - protein, 38 aa, Mycobacterium tuberculosis; identical to SEQ ID NO: 150802

SEQ ID NO: 1362998 - protein, 5 aa, Mycobacterium tuberculosis
EMPGG

SEQ ID NO: 1362999 - protein, 4 aa, Mycobacterium tuberculosis
ENGS

SEQ ID NO: 1363000 - protein, 6 aa, Mycobacterium tuberculosis
EPDEIE

SEQ ID NO: 1363001 - protein, 6 aa, Mycobacterium tuberculosis
EPDTNA

SEQ ID NO: 1363002 - protein, 5 aa, Mycobacterium tuberculosis
EPSTD

SEQ ID NO: 1363003 - protein, 13 aa, Mycobacterium tuberculosis
EQETTRRGAAVAP

SEQ ID NO: 1363004 - protein, 15 aa, Mycobacterium tuberculosis
ERADEKTRLGPAETP

SEQ ID NO: 1363005 - protein, 10 aa, Mycobacterium tuberculosis
ERASSTAPAD

SEQ ID NO: 1363006 - protein, 10 aa, Mycobacterium tuberculosis
ERGRKEPSSE

SEQ ID NO: 1363007 - protein, 13 aa, Mycobacterium tuberculosis
ERIPPPTGLARRA

SEQ ID NO: 1363008 - protein, 9 aa, Mycobacterium tuberculosis
ERNNNDGSV

SEQ ID NO: 1363009 - protein, 23 aa, Mycobacterium tuberculosis
ERPALEPRRQPAERSAPRGFADH

SEQ ID NO: 1363010 - protein, 14 aa, Mycobacterium tuberculosis
ERPGTLAPPPSTFG

SEQ ID NO: 1363011 - protein, 37 aa, Mycobacterium tuberculosis; identical to SEQ ID NO: 150875

SEQ ID NO: 1363012 - protein, 11 aa, Mycobacterium tuberculosis
ERRKTQRELSQ

SEQ ID NO: 1363013 - protein, 17 aa, Mycobacterium tuberculosis
ERSGEVNAKPGTKSGDR

SEQ ID NO: 1363014 - protein, 4 aa, Mycobacterium tuberculosis
ERSK

SEQ ID NO: 1363015 - protein, 9 aa, Mycobacterium tuberculosis
ESFEPQYES

SEQ ID NO: 1363016 - protein, 9 aa, Mycobacterium tuberculosis
ESGDTPHVA

SEQ ID NO: 1363017 - protein, 8 aa, Mycobacterium tuberculosis
ESGKEHKG

SEQ ID NO: 1363018 - protein, 6 aa, Mycobacterium tuberculosis
ESGSPT

SEQ ID NO: 1363019 - protein, 7 aa, Mycobacterium tuberculosis
ESITDPN

SEQ ID NO: 1363020 - protein, 15 aa, Mycobacterium tuberculosis
ESPSPTPGRRTVTAR

SEQ ID NO: 1363021 - protein, 11 aa, Mycobacterium tuberculosis
ETDSNGTPQLR

SEQ ID NO: 1363022 - protein, 6 aa, Mycobacterium tuberculosis
ETRSPT

SEQ ID NO: 1363023 - protein, 15 aa, Mycobacterium tuberculosis
EVATSDTDRAQRTPW

SEQ ID NO: 1363024 - protein, 7 aa, Mycobacterium tuberculosis
EVSDREG

SEQ ID NO: 1363025 - protein, 5 aa, Mycobacterium tuberculosis
EYAEE

SEQ ID NO: 1363026 - protein, 9 aa, Mycobacterium tuberculosis
EYAPASKRG

SEQ ID NO: 1363027 - protein, 15 aa, Mycobacterium tuberculosis
EYPTDQYSANDPKLN

SEQ ID NO: 1363028 - protein, 14 aa, Mycobacterium tuberculosis
FEDDTQGGAVNGED

SEQ ID NO: 1363029 - protein, 6 aa, Mycobacterium tuberculosis
FENPDF

SEQ ID NO: 1363030 - protein, 10 aa, Mycobacterium tuberculosis
FGESGTDPDF

SEQ ID NO: 1363031 - protein, 6 aa, Mycobacterium tuberculosis
FSGPQI

SEQ ID NO: 1363032 - protein, 12 aa, Mycobacterium tuberculosis
FSTSNDDAAKFD

SEQ ID NO: 1363033 - protein, 8 aa, Mycobacterium tuberculosis
FTNPDAAV

SEQ ID NO: 1363034 - protein, 15 aa, Mycobacterium tuberculosis
FTSGSQNMTGRWAAP

SEQ ID NO: 1363035 - protein, 9 aa, Mycobacterium tuberculosis
GAAPTTGYT

SEQ ID NO: 1363036 - protein, 9 aa, Mycobacterium tuberculosis
GAATAGGGA

SEQ ID NO: 1363037 - protein, 21 aa, Mycobacterium tuberculosis
GADGLQTPSPGAVSGSLEGGA

SEQ ID NO: 1363038 - protein, 6 aa, Mycobacterium tuberculosis
GAETEL

SEQ ID NO: 1363039 - protein, 9 aa, Mycobacterium tuberculosis
GAGDAGHAK

SEQ ID NO: 1363040 - protein, 6 aa, Mycobacterium tuberculosis
GATGSF

SEQ ID NO: 1363041 - protein, 12 aa, Mycobacterium tuberculosis
GATPPAAPAAPA

SEQ ID NO: 1363042 - protein, 8 aa, Mycobacterium tuberculosis
GATTAAAA

SEQ ID NO: 1363043 - protein, 7 aa, Mycobacterium tuberculosis
GATVSSR

SEQ ID NO: 1363044 - protein, 11 aa, Mycobacterium tuberculosis
GDEAKKPGDRV

SEQ ID NO: 1363045 - protein, 6 aa, Mycobacterium tuberculosis
GDEEVR

SEQ ID NO: 1363046 - protein, 5 aa, Mycobacterium tuberculosis
GDGLA

SEQ ID NO: 1363047 - protein, 11 aa, Mycobacterium tuberculosis
GDGRRTARPTR

SEQ ID NO: 1363048 - protein, 11 aa, Mycobacterium tuberculosis
GDGVNDAPALR

SEQ ID NO: 1363049 - protein, 10 aa, Mycobacterium tuberculosis
GDLDEDSWQD

SEQ ID NO: 1363050 - protein, 4 aa, Mycobacterium tuberculosis
GDLR

SEQ ID NO: 1363051 - protein, 46 aa, Mycobacterium tuberculosis; identical to SEQ ID NO: 151117

SEQ ID NO: 1363052 - protein, 9 aa, Mycobacterium tuberculosis
GDNPESAAA

SEQ ID NO: 1363053 - protein, 13 aa, Mycobacterium tuberculosis
GDPKGDGTGGPGY

SEQ ID NO: 1363054 - protein, 6 aa, Mycobacterium tuberculosis
GDPSDS

SEQ ID NO: 1363055 - protein, 10 aa, Mycobacterium tuberculosis
GDQPPREGSG

SEQ ID NO: 1363056 - protein, 5 aa, Mycobacterium tuberculosis
GDRSA

SEQ ID NO: 1363057 - protein, 8 aa, Mycobacterium tuberculosis
GDSTTAVG

SEQ ID NO: 1363058 - protein, 12 aa, Mycobacterium tuberculosis
GDTGLDSGRPQS

SEQ ID NO: 1363059 - protein, 6 aa, Mycobacterium tuberculosis
GDTPAR

SEQ ID NO: 1363060 - protein, 7 aa, Mycobacterium tuberculosis
GDVTETI

SEQ ID NO: 1363061 - protein, 5 aa, Mycobacterium tuberculosis
GEAIR

SEQ ID NO: 1363062 - protein, 10 aa, Mycobacterium tuberculosis
GEAQAPRKDP

SEQ ID NO: 1363063 - protein, 5 aa, Mycobacterium tuberculosis
GEDPL

SEQ ID NO: 1363064 - protein, 5 aa, Mycobacterium tuberculosis
GEIDD

SEQ ID NO: 1363065 - protein, 16 aa, Mycobacterium tuberculosis
GELDSGTSTPATNYGS

SEQ ID NO: 1363066 - protein, 12 aa, Mycobacterium tuberculosis
GEPWPQPVPEPA

SEQ ID NO: 1363067 - protein, 16 aa, Mycobacterium tuberculosis
GERAKREKRDSSGSFG

SEQ ID NO: 1363068 - protein, 4 aa, Mycobacterium tuberculosis
GERK

SEQ ID NO: 1363069 - protein, 4 aa, Mycobacterium tuberculosis
GGAA

SEQ ID NO: 1363070 - protein, 13 aa, Mycobacterium tuberculosis
GGAGDPDDTRVSQ

SEQ ID NO: 1363071 - protein, 8 aa, Mycobacterium tuberculosis
GGAGGPAL

SEQ ID NO: 1363072 - protein, 10 aa, Mycobacterium tuberculosis
GGAPNPYTYP

SEQ ID NO: 1363073 - protein, 9 aa, Mycobacterium tuberculosis
GGCNSAGGR

SEQ ID NO: 1363074 - protein, 8 aa, Mycobacterium tuberculosis
GGDGLSDC

SEQ ID NO: 1363075 - protein, 9 aa, Mycobacterium tuberculosis
GGELDPPKL

SEQ ID NO: 1363076 - protein, 7 aa, Mycobacterium tuberculosis
GGFSGGT

SEQ ID NO: 1363077 - protein, 10 aa, Mycobacterium tuberculosis
GGLRDPRNVS

SEQ ID NO: 1363078 - protein, 4 aa, Mycobacterium tuberculosis
GGMD

SEQ ID NO: 1363079 - protein, 8 aa, Mycobacterium tuberculosis
GGNAEDAL

SEQ ID NO: 1363080 - protein, 6 aa, Mycobacterium tuberculosis
GGPGFC

SEQ ID NO: 1363081 - protein, 15 aa, Mycobacterium tuberculosis
GGPGNTGPDFGKASP

SEQ ID NO: 1363082 - protein, 10 aa, Mycobacterium tuberculosis
GGPKSGKSTA

SEQ ID NO: 1363083 - protein, 4 aa, Mycobacterium tuberculosis
GGPL

SEQ ID NO: 1363084 - protein, 12 aa, Mycobacterium tuberculosis
GGQTSGASSARL

SEQ ID NO: 1363085 - protein, 9 aa, Mycobacterium tuberculosis
GGSNNTGSV

SEQ ID NO: 1363086 - protein, 7 aa, Mycobacterium tuberculosis
GGSPRGA

SEQ ID NO: 1363087 - protein, 4 aa, Mycobacterium tuberculosis
GGTR

SEQ ID NO: 1363088 - protein, 11 aa, Mycobacterium tuberculosis
GGTSLARTGRQ

SEQ ID NO: 1363089 - protein, 7 aa, Mycobacterium tuberculosis
GGVPSAY

SEQ ID NO: 1363090 - protein, 5 aa, Mycobacterium tuberculosis
GHGKL

SEQ ID NO: 1363091 - protein, 5 aa, Mycobacterium tuberculosis
GHPPG

SEQ ID NO: 1363092 - protein, 9 aa, Mycobacterium tuberculosis
GIASPESYS

SEQ ID NO: 1363093 - protein, 8 aa, Mycobacterium tuberculosis
GINDGPAL

SEQ ID NO: 1363094 - protein, 9 aa, Mycobacterium tuberculosis
GINDGPALA

SEQ ID NO: 1363095 - protein, 4 aa, Mycobacterium tuberculosis
GISA

SEQ ID NO: 1363096 - protein, 6 aa, Mycobacterium tuberculosis
GKAQAI

SEQ ID NO: 1363097 - protein, 9 aa, Mycobacterium tuberculosis
GKEEESAQT

SEQ ID NO: 1363098 - protein, 5 aa, Mycobacterium tuberculosis
GKFGP

SEQ ID NO: 1363099 - protein, 4 aa, Mycobacterium tuberculosis
GKGS

SEQ ID NO: 1363100 - protein, 5 aa, Mycobacterium tuberculosis
GKGTF

SEQ ID NO: 1363101 - protein, 5 aa, Mycobacterium tuberculosis
GKYTG

SEQ ID NO: 1363102 - protein, 36 aa, Mycobacterium tuberculosis; identical to SEQ ID NO: 151314

SEQ ID NO: 1363103 - protein, 4 aa, Mycobacterium tuberculosis
GLAT

SEQ ID NO: 1363104 - protein, 7 aa, Mycobacterium tuberculosis
GLGPPIG

SEQ ID NO: 1363105 - protein, 6 aa, Mycobacterium tuberculosis
GLQTGS

SEQ ID NO: 1363106 - protein, 8 aa, Mycobacterium tuberculosis
GMAGARAS

SEQ ID NO: 1363107 - protein, 4 aa, Mycobacterium tuberculosis
GNAG

SEQ ID NO: 1363108 - protein, 17 aa, Mycobacterium tuberculosis
GNDVANSFGTSVGAGTL

SEQ ID NO: 1363109 - protein, 7 aa, Mycobacterium tuberculosis
GNGPRTD

SEQ ID NO: 1363110 - protein, 7 aa, Mycobacterium tuberculosis
GNRETPA

SEQ ID NO: 1363111 - protein, 10 aa, Mycobacterium tuberculosis
GPAEDSSAQV

SEQ ID NO: 1363112 - protein, 5 aa, Mycobacterium tuberculosis
GPAIG

SEQ ID NO: 1363113 - protein, 5 aa, Mycobacterium tuberculosis
GPANA

SEQ ID NO: 1363114 - protein, 5 aa, Mycobacterium tuberculosis
GPATG

SEQ ID NO: 1363115 - protein, 6 aa, Mycobacterium tuberculosis
GPEANS

SEQ ID NO: 1363116 - protein, 6 aa, Mycobacterium tuberculosis
GPGRYG

SEQ ID NO: 1363117 - protein, 27 aa, Mycobacterium tuberculosis
GPKGTDGQPSKQAISDSAVSETWGGQI

SEQ ID NO: 1363118 - protein, 7 aa, Mycobacterium tuberculosis
GPLAPPR

SEQ ID NO: 1363119 - protein, 19 aa, Mycobacterium tuberculosis
GPNAEHPGAPLRGERSGYD

SEQ ID NO: 1363120 - protein, 6 aa, Mycobacterium tuberculosis
GPPGLR

SEQ ID NO: 1363121 - protein, 5 aa, Mycobacterium tuberculosis
GPVDS

SEQ ID NO: 1363122 - protein, 8 aa, Mycobacterium tuberculosis
GQASSTHM

SEQ ID NO: 1363123 - protein, 7 aa, Mycobacterium tuberculosis
GQEERET

SEQ ID NO: 1363124 - protein, 6 aa, Mycobacterium tuberculosis
GQGSAN

SEQ ID NO: 1363125 - protein, 5 aa, Mycobacterium tuberculosis
GRAGN

SEQ ID NO: 1363126 - protein, 6 aa, Mycobacterium tuberculosis
GRATGS

SEQ ID NO: 1363127 - protein, 5 aa, Mycobacterium tuberculosis
GRDVG

SEQ ID NO: 1363128 - protein, 5 aa, Mycobacterium tuberculosis
GRGEC

SEQ ID NO: 1363129 - protein, 10 aa, Mycobacterium tuberculosis
GRGGTEVAKD

SEQ ID NO: 1363130 - protein, 13 aa, Mycobacterium tuberculosis
GRIPGTAAGPSRR

SEQ ID NO: 1363131 - protein, 15 aa, Mycobacterium tuberculosis
GRIPSDKPPIKTPGE

SEQ ID NO: 1363132 - protein, 8 aa, Mycobacterium tuberculosis
GRKVQGSA

SEQ ID NO: 1363133 - protein, 9 aa, Mycobacterium tuberculosis
GRPDLPEGR

SEQ ID NO: 1363134 - protein, 20 aa, Mycobacterium tuberculosis
GRPGDDAGRPAARAGAGCSH

SEQ ID NO: 1363135 - protein, 6 aa, Mycobacterium tuberculosis
GRTGGH

SEQ ID NO: 1363136 - protein, 23 aa, Mycobacterium tuberculosis
GSDAGDHASAPQPSGSGSVPASV

SEQ ID NO: 1363137 - protein, 7 aa, Mycobacterium tuberculosis
GSDPARV

SEQ ID NO: 1363138 - protein, 4 aa, Mycobacterium tuberculosis
GSEP

SEQ ID NO: 1363139 - protein, 7 aa, Mycobacterium tuberculosis
GSEPAAT

SEQ ID NO: 1363140 - protein, 5 aa, Mycobacterium tuberculosis
GSGGM

SEQ ID NO: 1363141 - protein, 7 aa, Mycobacterium tuberculosis
GSGKSQT

SEQ ID NO: 1363142 - protein, 6 aa, Mycobacterium tuberculosis
GSGPLT

SEQ ID NO: 1363143 - protein, 8 aa, Mycobacterium tuberculosis
GSGPPVPL

SEQ ID NO: 1363144 - protein, 5 aa, Mycobacterium tuberculosis
GSGVV

SEQ ID NO: 1363145 - protein, 5 aa, Mycobacterium tuberculosis
GSHNG

SEQ ID NO: 1363146 - protein, 9 aa, Mycobacterium tuberculosis
GSIEERAQQ

SEQ ID NO: 1363147 - protein, 6 aa, Mycobacterium tuberculosis
GSNDIA

SEQ ID NO: 1363148 - protein, 18 aa, Mycobacterium tuberculosis
GSPDAPHDHHDRHDDHLG

SEQ ID NO: 1363149 - protein, 8 aa, Mycobacterium tuberculosis
GSPPYQGD

SEQ ID NO: 1363150 - protein, 4 aa, Mycobacterium tuberculosis
GSQA

SEQ ID NO: 1363151 - protein, 10 aa, Mycobacterium tuberculosis
GSRSIADYGG

SEQ ID NO: 1363152 - protein, 12 aa, Mycobacterium tuberculosis
GSSAIAKASLDA

SEQ ID NO: 1363153 - protein, 9 aa, Mycobacterium tuberculosis
GSSNSPISG

SEQ ID NO: 1363154 - protein, 9 aa, Mycobacterium tuberculosis
GSTADGNIT

SEQ ID NO: 1363155 - protein, 6 aa, Mycobacterium tuberculosis
GSTTST

SEQ ID NO: 1363156 - protein, 15 aa, Mycobacterium tuberculosis
GTAGKESVGRPAGLT

SEQ ID NO: 1363157 - protein, 11 aa, Mycobacterium tuberculosis
GTAPTTSGAAA

SEQ ID NO: 1363158 - protein, 8 aa, Mycobacterium tuberculosis
GTDRYPPF

SEQ ID NO: 1363159 - protein, 5 aa, Mycobacterium tuberculosis
GTITL

SEQ ID NO: 1363160 - protein, 9 aa, Mycobacterium tuberculosis
GTKPLSPEA

SEQ ID NO: 1363161 - protein, 14 aa, Mycobacterium tuberculosis
GTLTYDGADPERKR

SEQ ID NO: 1363162 - protein, 9 aa, Mycobacterium tuberculosis
GTRHRSNKE

SEQ ID NO: 1363163 - protein, 13 aa, Mycobacterium tuberculosis
GTSQKLTEKYNQD

SEQ ID NO: 1363164 - protein, 4 aa, Mycobacterium tuberculosis
GTTA

SEQ ID NO: 1363165 - protein, 7 aa, Mycobacterium tuberculosis
GTTGHPK

SEQ ID NO: 1363166 - protein, 18 aa, Mycobacterium tuberculosis
GTTGTPKGANRNTPPTLA

SEQ ID NO: 1363167 - protein, 9 aa, Mycobacterium tuberculosis
GTTPQVGQG

SEQ ID NO: 1363168 - protein, 12 aa, Mycobacterium tuberculosis
GVAPQDFDTPTE

SEQ ID NO: 1363169 - protein, 8 aa, Mycobacterium tuberculosis
GVEDNPGY

SEQ ID NO: 1363170 - protein, 4 aa, Mycobacterium tuberculosis
GVPH

SEQ ID NO: 1363171 - protein, 11 aa, Mycobacterium tuberculosis
GVPRDDEPPLD

SEQ ID NO: 1363172 - protein, 13 aa, Mycobacterium tuberculosis
GVRRASGRSDPSA

SEQ ID NO: 1363173 - protein, 52 aa, Mycobacterium tuberculosis; identical to SEQ ID NO: 151672

SEQ ID NO: 1363174 - protein, 7 aa, Mycobacterium tuberculosis
GYRPGYN

SEQ ID NO: 1363175 - protein, 5 aa, Mycobacterium tuberculosis
HAEAN

SEQ ID NO: 1363176 - protein, 5 aa, Mycobacterium tuberculosis
HAKPG

SEQ ID NO: 1363177 - protein, 6 aa, Mycobacterium tuberculosis
HARQRD

SEQ ID NO: 1363178 - protein, 6 aa, Mycobacterium tuberculosis
HDGKTQ

SEQ ID NO: 1363179 - protein, 9 aa, Mycobacterium tuberculosis
HDSAATAAK

SEQ ID NO: 1363180 - protein, 6 aa, Mycobacterium tuberculosis
HETPER

SEQ ID NO: 1363181 - protein, 24 aa, Mycobacterium tuberculosis
HGAATAVKAGRDGADADDDQRPAP

SEQ ID NO: 1363182 - protein, 13 aa, Mycobacterium tuberculosis
HGGELDQLTGGAH

SEQ ID NO: 1363183 - protein, 6 aa, Mycobacterium tuberculosis
HGPRTD

SEQ ID NO: 1363184 - protein, 4 aa, Mycobacterium tuberculosis
HGPT

SEQ ID NO: 1363185 - protein, 5 aa, Mycobacterium tuberculosis
HGPVS

SEQ ID NO: 1363186 - protein, 8 aa, Mycobacterium tuberculosis
HGSAAQRQ

SEQ ID NO: 1363187 - protein, 9 aa, Mycobacterium tuberculosis
HGTNDAQKT

SEQ ID NO: 1363188 - protein, 4 aa, Mycobacterium tuberculosis
HNTN

SEQ ID NO: 1363189 - protein, 24 aa, Mycobacterium tuberculosis
HPDPTALASVPGSRRQWERDPHDP

SEQ ID NO: 1363190 - protein, 34 aa, Mycobacterium tuberculosis; identical to SEQ ID NO: 151754

SEQ ID NO: 1363191 - protein, 9 aa, Mycobacterium tuberculosis
HPIDPRSYS

SEQ ID NO: 1363192 - protein, 5 aa, Mycobacterium tuberculosis
HPPIE

SEQ ID NO: 1363193 - protein, 6 aa, Mycobacterium tuberculosis
HPQRHT

SEQ ID NO: 1363194 - protein, 12 aa, Mycobacterium tuberculosis
HQANPTNPGDSL

SEQ ID NO: 1363195 - protein, 9 aa, Mycobacterium tuberculosis
HQESQSIAR

SEQ ID NO: 1363196 - protein, 5 aa, Mycobacterium tuberculosis
HRGAE

SEQ ID NO: 1363197 - protein, 6 aa, Mycobacterium tuberculosis
HSGDRS

SEQ ID NO: 1363198 - protein, 7 aa, Mycobacterium tuberculosis
HSPRNTW

SEQ ID NO: 1363199 - protein, 11 aa, Mycobacterium tuberculosis
IAAETQDEPDV

SEQ ID NO: 1363200 - protein, 7 aa, Mycobacterium tuberculosis
IDGEEAP

SEQ ID NO: 1363201 - protein, 4 aa, Mycobacterium tuberculosis
IDGF

SEQ ID NO: 1363202 - protein, 7 aa, Mycobacterium tuberculosis
IDGQETG

SEQ ID NO: 1363203 - protein, 12 aa, Mycobacterium tuberculosis
IDPQAQRAAEKA

SEQ ID NO: 1363204 - protein, 9 aa, Mycobacterium tuberculosis
IDPSASAET

SEQ ID NO: 1363205 - protein, 9 aa, Mycobacterium tuberculosis
IDQGPAAGT

SEQ ID NO: 1363206 - protein, 4 aa, Mycobacterium tuberculosis
IEPG

SEQ ID NO: 1363207 - protein, 42 aa, Mycobacterium tuberculosis; identical to SEQ ID NO: 151835

SEQ ID NO: 1363208 - protein, 8 aa, Mycobacterium tuberculosis
IGDRDSGA

SEQ ID NO: 1363209 - protein, 7 aa, Mycobacterium tuberculosis
IGESSPT

SEQ ID NO: 1363210 - protein, 6 aa, Mycobacterium tuberculosis
IGPTQQ

SEQ ID NO: 1363211 - protein, 8 aa, Mycobacterium tuberculosis
IGQTGMPS

SEQ ID NO: 1363212 - protein, 5 aa, Mycobacterium tuberculosis
IGRQG

SEQ ID NO: 1363213 - protein, 16 aa, Mycobacterium tuberculosis
IGSGGSGGREGPTAQI

SEQ ID NO: 1363214 - protein, 6 aa, Mycobacterium tuberculosis
IGSSMD

SEQ ID NO: 1363215 - protein, 4 aa, Mycobacterium tuberculosis
IPGV

SEQ ID NO: 1363216 - protein, 4 aa, Mycobacterium tuberculosis
IPNP

SEQ ID NO: 1363217 - protein, 6 aa, Mycobacterium tuberculosis
IPPSGV

SEQ ID NO: 1363218 - protein, 10 aa, Mycobacterium tuberculosis
IPRPSTVRPG

SEQ ID NO: 1363219 - protein, 4 aa, Mycobacterium tuberculosis
IQPG

SEQ ID NO: 1363220 - protein, 6 aa, Mycobacterium tuberculosis
IQSGPR

SEQ ID NO: 1363221 - protein, 14 aa, Mycobacterium tuberculosis
IRESGGDRSAVTGG

SEQ ID NO: 1363222 - protein, 12 aa, Mycobacterium tuberculosis
ISESRAEGAPDD

SEQ ID NO: 1363223 - protein, 17 aa, Mycobacterium tuberculosis
ISGGVQAAPLPPEPQLA

SEQ ID NO: 1363224 - protein, 6 aa, Mycobacterium tuberculosis
ISGTGA

SEQ ID NO: 1363225 - protein, 8 aa, Mycobacterium tuberculosis
ISSGGGTP

SEQ ID NO: 1363226 - protein, 9 aa, Mycobacterium tuberculosis
ITGTSPLNT

SEQ ID NO: 1363227 - protein, 11 aa, Mycobacterium tuberculosis
ITRPDGKPIEH

SEQ ID NO: 1363228 - protein, 9 aa, Mycobacterium tuberculosis
KADNRLDGG

SEQ ID NO: 1363229 - protein, 24 aa, Mycobacterium tuberculosis
KAGVAGGGEDGKPATEVTITSVLL

SEQ ID NO: 1363230 - protein, 10 aa, Mycobacterium tuberculosis
KAVRGPAKDT

SEQ ID NO: 1363231 - protein, 12 aa, Mycobacterium tuberculosis
KDASAGGEAGHQ

SEQ ID NO: 1363232 - protein, 7 aa, Mycobacterium tuberculosis
KDFSRET

SEQ ID NO: 1363233 - protein, 4 aa, Mycobacterium tuberculosis
KDRA

SEQ ID NO: 1363234 - protein, 4 aa, Mycobacterium tuberculosis
KEFT

SEQ ID NO: 1363235 - protein, 30 aa, Mycobacterium tuberculosis; identical to SEQ ID NO: 151980

SEQ ID NO: 1363236 - protein, 6 aa, Mycobacterium tuberculosis
KGATGF

SEQ ID NO: 1363237 - protein, 9 aa, Mycobacterium tuberculosis
KGEAGADSF

SEQ ID NO: 1363238 - protein, 8 aa, Mycobacterium tuberculosis
KGGPLPRG

SEQ ID NO: 1363239 - protein, 8 aa, Mycobacterium tuberculosis
KGGSAVKP

SEQ ID NO: 1363240 - protein, 10 aa, Mycobacterium tuberculosis
KGVSPTGNAA

SEQ ID NO: 1363241 - protein, 6 aa, Mycobacterium tuberculosis
KHTAPK

SEQ ID NO: 1363242 - protein, 8 aa, Mycobacterium tuberculosis
KIEPAGDK

SEQ ID NO: 1363243 - protein, 7 aa, Mycobacterium tuberculosis
KIGPSQA

SEQ ID NO: 1363244 - protein, 8 aa, Mycobacterium tuberculosis
KKDQLGEG

SEQ ID NO: 1363245 - protein, 6 aa, Mycobacterium tuberculosis
KKHVQS

SEQ ID NO: 1363246 - protein, 9 aa, Mycobacterium tuberculosis
KKNTDTELP

SEQ ID NO: 1363247 - protein, 10 aa, Mycobacterium tuberculosis
KLPDAARSLG

SEQ ID NO: 1363248 - protein, 11 aa, Mycobacterium tuberculosis
KLSGGQRKRAS

SEQ ID NO: 1363249 - protein, 5 aa, Mycobacterium tuberculosis
KNRDI

SEQ ID NO: 1363250 - protein, 7 aa, Mycobacterium tuberculosis
KPEPDGL

SEQ ID NO: 1363251 - protein, 12 aa, Mycobacterium tuberculosis
KPNAAQKESEYI

SEQ ID NO: 1363252 - protein, 6 aa, Mycobacterium tuberculosis
KPRSDI

SEQ ID NO: 1363253 - protein, 5 aa, Mycobacterium tuberculosis
KQGQT

SEQ ID NO: 1363254 - protein, 6 aa, Mycobacterium tuberculosis
KQSRDR

SEQ ID NO: 1363255 - protein, 6 aa, Mycobacterium tuberculosis
KRASTL

SEQ ID NO: 1363256 - protein, 4 aa, Mycobacterium tuberculosis
KRGS

SEQ ID NO: 1363257 - protein, 4 aa, Mycobacterium tuberculosis
KRPR

SEQ ID NO: 1363258 - protein, 11 aa, Mycobacterium tuberculosis
KRTKDPDGAHA

SEQ ID NO: 1363259 - protein, 7 aa, Mycobacterium tuberculosis
KSRPGKL

SEQ ID NO: 1363260 - protein, 8 aa, Mycobacterium tuberculosis
KTGTLTEN

SEQ ID NO: 1363261 - protein, 8 aa, Mycobacterium tuberculosis
KTGTLTES

SEQ ID NO: 1363262 - protein, 7 aa, Mycobacterium tuberculosis
KTSRAAA

SEQ ID NO: 1363263 - protein, 6 aa, Mycobacterium tuberculosis
KVPANA

SEQ ID NO: 1363264 - protein, 5 aa, Mycobacterium tuberculosis
KYPTG

SEQ ID NO: 1363265 - protein, 6 aa, Mycobacterium tuberculosis
KYVSDT

SEQ ID NO: 1363266 - protein, 6 aa, Mycobacterium tuberculosis
LAGKGA

SEQ ID NO: 1363267 - protein, 11 aa, Mycobacterium tuberculosis
LAKDAAGDKWS

SEQ ID NO: 1363268 - protein, 5 aa, Mycobacterium tuberculosis
LAPEH

SEQ ID NO: 1363269 - protein, 9 aa, Mycobacterium tuberculosis
LAPPSSHQG

SEQ ID NO: 1363270 - protein, 8 aa, Mycobacterium tuberculosis
LDAQTNPV

SEQ ID NO: 1363271 - protein, 11 aa, Mycobacterium tuberculosis
LDEGGDGPHGV

SEQ ID NO: 1363272 - protein, 8 aa, Mycobacterium tuberculosis
LDGESRGE

SEQ ID NO: 1363273 - protein, 7 aa, Mycobacterium tuberculosis
LDGRADQ

SEQ ID NO: 1363274 - protein, 9 aa, Mycobacterium tuberculosis
LDPPPGDDV

SEQ ID NO: 1363275 - protein, 19 aa, Mycobacterium tuberculosis
LDPQPGKLPDWSPTSSRTW

SEQ ID NO: 1363276 - protein, 11 aa, Mycobacterium tuberculosis
LDTQSGAARPV

SEQ ID NO: 1363277 - protein, 39 aa, Mycobacterium tuberculosis; identical to SEQ ID NO: 152179

SEQ ID NO: 1363278 - protein, 5 aa, Mycobacterium tuberculosis
LEEDP

SEQ ID NO: 1363279 - protein, 11 aa, Mycobacterium tuberculosis
LGAGGRCDSAS

SEQ ID NO: 1363280 - protein, 13 aa, Mycobacterium tuberculosis
LGAPDFPSPGYPL

SEQ ID NO: 1363281 - protein, 6 aa, Mycobacterium tuberculosis
LGATAG

SEQ ID NO: 1363282 - protein, 9 aa, Mycobacterium tuberculosis
LGDSSKVRV

SEQ ID NO: 1363283 - protein, 25 aa, Mycobacterium tuberculosis
LGEASGDLASDSPAMPRPTTVENDA

SEQ ID NO: 1363284 - protein, 6 aa, Mycobacterium tuberculosis
LGESAQ

SEQ ID NO: 1363285 - protein, 12 aa, Mycobacterium tuberculosis
LGKGEDDATPAF

SEQ ID NO: 1363286 - protein, 4 aa, Mycobacterium tuberculosis
LGLS

SEQ ID NO: 1363287 - protein, 7 aa, Mycobacterium tuberculosis
LGPGDQW

SEQ ID NO: 1363288 - protein, 11 aa, Mycobacterium tuberculosis
LGSAGSPGSGS

SEQ ID NO: 1363289 - protein, 5 aa, Mycobacterium tuberculosis
LGVSG

SEQ ID NO: 1363290 - protein, 7 aa, Mycobacterium tuberculosis
LKEPERN

SEQ ID NO: 1363291 - protein, 4 aa, Mycobacterium tuberculosis
LKEQ

SEQ ID NO: 1363292 - protein, 5 aa, Mycobacterium tuberculosis
LPANG

SEQ ID NO: 1363293 - protein, 7 aa, Mycobacterium tuberculosis
LPGAGDA

SEQ ID NO: 1363294 - protein, 12 aa, Mycobacterium tuberculosis
LPPDTTKDDRTQ

SEQ ID NO: 1363295 - protein, 114 aa, Mycobacterium tuberculosis; identical to SEQ ID NO: 152289

SEQ ID NO: 1363296 - protein, 16 aa, Mycobacterium tuberculosis
LPPRPGSPRTADPPVR

SEQ ID NO: 1363297 - protein, 7 aa, Mycobacterium tuberculosis
LPPSEGL

SEQ ID NO: 1363298 - protein, 6 aa, Mycobacterium tuberculosis
LPRRAS

SEQ ID NO: 1363299 - protein, 8 aa, Mycobacterium tuberculosis
LPTSTKDG

SEQ ID NO: 1363300 - protein, 9 aa, Mycobacterium tuberculosis
LQGGSTITQ

SEQ ID NO: 1363301 - protein, 9 aa, Mycobacterium tuberculosis
LQSASERLR

SEQ ID NO: 1363302 - protein, 6 aa, Mycobacterium tuberculosis
LRARTT

SEQ ID NO: 1363303 - protein, 10 aa, Mycobacterium tuberculosis
LRDDADLRDK

SEQ ID NO: 1363304 - protein, 8 aa, Mycobacterium tuberculosis
LRETNKER

SEQ ID NO: 1363305 - protein, 20 aa, Mycobacterium tuberculosis
LRGPNGKLGAPVGDQTVDGD

SEQ ID NO: 1363306 - protein, 23 aa, Mycobacterium tuberculosis
LRGTPAGETASFPTGWRGLRFST

SEQ ID NO: 1363307 - protein, 4 aa, Mycobacterium tuberculosis
LRRP

SEQ ID NO: 1363308 - protein, 14 aa, Mycobacterium tuberculosis
LSAAAAANTKHDIA

SEQ ID NO: 1363309 - protein, 6 aa, Mycobacterium tuberculosis
LSDAGR

SEQ ID NO: 1363310 - protein, 16 aa, Mycobacterium tuberculosis
LSPEQARGDSVDARSD

SEQ ID NO: 1363311 - protein, 8 aa, Mycobacterium tuberculosis
LSPFGDGT

SEQ ID NO: 1363312 - protein, 7 aa, Mycobacterium tuberculosis
LSPRDDG

SEQ ID NO: 1363313 - protein, 29 aa, Mycobacterium tuberculosis
LSRSDHARARPDIARPGAGGSRVSRADVT

SEQ ID NO: 1363314 - protein, 5 aa, Mycobacterium tuberculosis
LSSAE

SEQ ID NO: 1363315 - protein, 4 aa, Mycobacterium tuberculosis
LSSG

SEQ ID NO: 1363316 - protein, 9 aa, Mycobacterium tuberculosis
LTAPSSGRI

SEQ ID NO: 1363317 - protein, 8 aa, Mycobacterium tuberculosis
LTDAGTPI

SEQ ID NO: 1363318 - protein, 12 aa, Mycobacterium tuberculosis
LTDDTERMDTTQ

SEQ ID NO: 1363319 - protein, 9 aa, Mycobacterium tuberculosis
LTKSAVPKR

SEQ ID NO: 1363320 - protein, 10 aa, Mycobacterium tuberculosis
LTNPKGWTHN

SEQ ID NO: 1363321 - protein, 5 aa, Mycobacterium tuberculosis
LTRRS

SEQ ID NO: 1363322 - protein, 10 aa, Mycobacterium tuberculosis
LTRTDNSGWG

SEQ ID NO: 1363323 - protein, 5 aa, Mycobacterium tuberculosis
LTSSN

SEQ ID NO: 1363324 - protein, 4 aa, Mycobacterium tuberculosis
LTTR

SEQ ID NO: 1363325 - protein, 9 aa, Mycobacterium tuberculosis
MARASAESH

SEQ ID NO: 1363326 - protein, 7 aa, Mycobacterium tuberculosis
MGSGLNE

SEQ ID NO: 1363327 - protein, 12 aa, Mycobacterium tuberculosis
MNPGGGAASTVG

SEQ ID NO: 1363328 - protein, 7 aa, Mycobacterium tuberculosis
MPPTGGL

SEQ ID NO: 1363329 - protein, 9 aa, Mycobacterium tuberculosis
MPRGGPDAS

SEQ ID NO: 1363330 - protein, 7 aa, Mycobacterium tuberculosis
MPSGTAR

SEQ ID NO: 1363331 - protein, 5 aa, Mycobacterium tuberculosis
MQGTG

SEQ ID NO: 1363332 - protein, 8 aa, Mycobacterium tuberculosis
MQTESKDL

SEQ ID NO: 1363333 - protein, 4 aa, Mycobacterium tuberculosis
MSGG

SEQ ID NO: 1363334 - protein, 8 aa, Mycobacterium tuberculosis
MSPDAAPS

SEQ ID NO: 1363335 - protein, 7 aa, Mycobacterium tuberculosis
NAASTLA

SEQ ID NO: 1363336 - protein, 6 aa, Mycobacterium tuberculosis
NADPRT

SEQ ID NO: 1363337 - protein, 7 aa, Mycobacterium tuberculosis
NAGGGNL

SEQ ID NO: 1363338 - protein, 9 aa, Mycobacterium tuberculosis
NAGPNTNSS

SEQ ID NO: 1363339 - protein, 4 aa, Mycobacterium tuberculosis
NAGR

SEQ ID NO: 1363340 - protein, 8 aa, Mycobacterium tuberculosis
NAGSLDNP

SEQ ID NO: 1363341 - protein, 7 aa, Mycobacterium tuberculosis
NANGNVE

SEQ ID NO: 1363342 - protein, 11 aa, Mycobacterium tuberculosis
NAPSRGGADGV

SEQ ID NO: 1363343 - protein, 5 aa, Mycobacterium tuberculosis
NAQSD

SEQ ID NO: 1363344 - protein, 7 aa, Mycobacterium tuberculosis
NARPEKP

SEQ ID NO: 1363345 - protein, 6 aa, Mycobacterium tuberculosis
NDPAAL

SEQ ID NO: 1363346 - protein, 5 aa, Mycobacterium tuberculosis
NDPAT

SEQ ID NO: 1363347 - protein, 13 aa, Mycobacterium tuberculosis
NDPDGVAVDNSGN

SEQ ID NO: 1363348 - protein, 4 aa, Mycobacterium tuberculosis
NEQA

SEQ ID NO: 1363349 - protein, 6 aa, Mycobacterium tuberculosis
NESPCT

SEQ ID NO: 1363350 - protein, 11 aa, Mycobacterium tuberculosis
NETDGGFGPSS

SEQ ID NO: 1363351 - protein, 4 aa, Mycobacterium tuberculosis
NGAP

SEQ ID NO: 1363352 - protein, 6 aa, Mycobacterium tuberculosis
NGGAGA

SEQ ID NO: 1363353 - protein, 10 aa, Mycobacterium tuberculosis
NGSEPVSPAS

SEQ ID NO: 1363354 - protein, 9 aa, Mycobacterium tuberculosis
NGSGPRFTA

SEQ ID NO: 1363355 - protein, 12 aa, Mycobacterium tuberculosis
NGTPSDLGGDNI

SEQ ID NO: 1363356 - protein, 7 aa, Mycobacterium tuberculosis
NGTSTAN

SEQ ID NO: 1363357 - protein, 4 aa, Mycobacterium tuberculosis
NHYP

SEQ ID NO: 1363358 - protein, 10 aa, Mycobacterium tuberculosis
NKTAKTVGQI

SEQ ID NO: 1363359 - protein, 6 aa, Mycobacterium tuberculosis
NNTPEG

SEQ ID NO: 1363360 - protein, 8 aa, Mycobacterium tuberculosis
NPATTEAM

SEQ ID NO: 1363361 - protein, 7 aa, Mycobacterium tuberculosis
NPDSPDR

SEQ ID NO: 1363362 - protein, 8 aa, Mycobacterium tuberculosis
NPEQHKDF

SEQ ID NO: 1363363 - protein, 8 aa, Mycobacterium tuberculosis
NPQVNEPL

SEQ ID NO: 1363364 - protein, 7 aa, Mycobacterium tuberculosis
NPSRSLP

SEQ ID NO: 1363365 - protein, 9 aa, Mycobacterium tuberculosis
NPTDKPAVT

SEQ ID NO: 1363366 - protein, 6 aa, Mycobacterium tuberculosis
NPTSRM

SEQ ID NO: 1363367 - protein, 35 aa, Mycobacterium tuberculosis; identical to SEQ ID NO: 152585

SEQ ID NO: 1363368 - protein, 6 aa, Mycobacterium tuberculosis
NQGYAA

SEQ ID NO: 1363369 - protein, 7 aa, Mycobacterium tuberculosis
NQPLGDA

SEQ ID NO: 1363370 - protein, 7 aa, Mycobacterium tuberculosis
NRADPLA

SEQ ID NO: 1363371 - protein, 10 aa, Mycobacterium tuberculosis
NRDGSDAMST

SEQ ID NO: 1363372 - protein, 5 aa, Mycobacterium tuberculosis
NSDGS

SEQ ID NO: 1363373 - protein, 4 aa, Mycobacterium tuberculosis
NSQR

SEQ ID NO: 1363374 - protein, 6 aa, Mycobacterium tuberculosis
NSSDID

SEQ ID NO: 1363375 - protein, 10 aa, Mycobacterium tuberculosis
NTFTTDPANL

SEQ ID NO: 1363376 - protein, 28 aa, Mycobacterium tuberculosis
NTNGHASKAATKSVPNGKPADLAEGNGE

SEQ ID NO: 1363377 - protein, 6 aa, Mycobacterium tuberculosis
NTSDDG

SEQ ID NO: 1363378 - protein, 4 aa, Mycobacterium tuberculosis
NTVP

SEQ ID NO: 1363379 - protein, 6 aa, Mycobacterium tuberculosis
NVTTAT

SEQ ID NO: 1363380 - protein, 10 aa, Mycobacterium tuberculosis
PAAAPPLRES

SEQ ID NO: 1363381 - protein, 12 aa, Mycobacterium tuberculosis
PAAPPPPPDHRA

SEQ ID NO: 1363382 - protein, 10 aa, Mycobacterium tuberculosis
PAASSAGQDY

SEQ ID NO: 1363383 - protein, 15 aa, Mycobacterium tuberculosis
PAEPDGADDEEADHP

SEQ ID NO: 1363384 - protein, 10 aa, Mycobacterium tuberculosis
PAFTGQPTDA

SEQ ID NO: 1363385 - protein, 10 aa, Mycobacterium tuberculosis
PAGGVDTGKA

SEQ ID NO: 1363386 - protein, 8 aa, Mycobacterium tuberculosis
PAGPRPWQ

SEQ ID NO: 1363387 - protein, 4 aa, Mycobacterium tuberculosis
PAGS

SEQ ID NO: 1363388 - protein, 7 aa, Mycobacterium tuberculosis
PAGSANL

SEQ ID NO: 1363389 - protein, 9 aa, Mycobacterium tuberculosis
PALGSTPDN

SEQ ID NO: 1363390 - protein, 7 aa, Mycobacterium tuberculosis
PANGAVP

SEQ ID NO: 1363391 - protein, 7 aa, Mycobacterium tuberculosis
PAQPGAA

SEQ ID NO: 1363392 - protein, 4 aa, Mycobacterium tuberculosis
PARG

SEQ ID NO: 1363393 - protein, 9 aa, Mycobacterium tuberculosis
PATGANAVE

SEQ ID NO: 1363394 - protein, 61 aa, Mycobacterium tuberculosis; identical to SEQ ID NO: 152705

SEQ ID NO: 1363395 - protein, 10 aa, Mycobacterium tuberculosis
PDAGNPASFG

SEQ ID NO: 1363396 - protein, 9 aa, Mycobacterium tuberculosis
PDAGQRISA

SEQ ID NO: 1363397 - protein, 5 aa, Mycobacterium tuberculosis
PDGKA

SEQ ID NO: 1363398 - protein, 38 aa, Mycobacterium tuberculosis; identical to SEQ ID NO: 152725

SEQ ID NO: 1363399 - protein, 6 aa, Mycobacterium tuberculosis
PDGSIA

SEQ ID NO: 1363400 - protein, 7 aa, Mycobacterium tuberculosis
PDGSYSE

SEQ ID NO: 1363401 - protein, 7 aa, Mycobacterium tuberculosis
PDKVNSI

SEQ ID NO: 1363402 - protein, 6 aa, Mycobacterium tuberculosis
PDPNRA

SEQ ID NO: 1363403 - protein, 23 aa, Mycobacterium tuberculosis
PDRGAEPELGPQPDLPSRRGRRL

SEQ ID NO: 1363404 - protein, 5 aa, Mycobacterium tuberculosis
PDRPE

SEQ ID NO: 1363405 - protein, 16 aa, Mycobacterium tuberculosis
PDRPPTPVDGSPGRAV

SEQ ID NO: 1363406 - protein, 8 aa, Mycobacterium tuberculosis
PDTGLQPP

SEQ ID NO: 1363407 - protein, 6 aa, Mycobacterium tuberculosis
PDYDLG

SEQ ID NO: 1363408 - protein, 4 aa, Mycobacterium tuberculosis
PEAD

SEQ ID NO: 1363409 - protein, 6 aa, Mycobacterium tuberculosis
PEAPAI

SEQ ID NO: 1363410 - protein, 7 aa, Mycobacterium tuberculosis
PEAPRIT

SEQ ID NO: 1363411 - protein, 4 aa, Mycobacterium tuberculosis
PEDP

SEQ ID NO: 1363412 - protein, 4 aa, Mycobacterium tuberculosis
PEKG

SEQ ID NO: 1363413 - protein, 5 aa, Mycobacterium tuberculosis
PFATR

SEQ ID NO: 1363414 - protein, 5 aa, Mycobacterium tuberculosis
PGAPE

SEQ ID NO: 1363415 - protein, 16 aa, Mycobacterium tuberculosis
PGAPSRPASAVSRPSY

SEQ ID NO: 1363416 - protein, 6 aa, Mycobacterium tuberculosis
PGGKTA

SEQ ID NO: 1363417 - protein, 14 aa, Mycobacterium tuberculosis
PGKRAATPRECRSN

SEQ ID NO: 1363418 - protein, 8 aa, Mycobacterium tuberculosis
PGLGGNRP

SEQ ID NO: 1363419 - protein, 4 aa, Mycobacterium tuberculosis
PGMA

SEQ ID NO: 1363420 - protein, 4 aa, Mycobacterium tuberculosis
PGMD

SEQ ID NO: 1363421 - protein, 13 aa, Mycobacterium tuberculosis
PGNDGSEARNLGQ

SEQ ID NO: 1363422 - protein, 11 aa, Mycobacterium tuberculosis
PGRPRENPEWT

SEQ ID NO: 1363423 - protein, 13 aa, Mycobacterium tuberculosis
PHAGRRRGGGSGA

SEQ ID NO: 1363424 - protein, 30 aa, Mycobacterium tuberculosis; identical to SEQ ID NO: 152865

SEQ ID NO: 1363425 - protein, 19 aa, Mycobacterium tuberculosis
PHNDTGTAKHGAHKPTPRI

SEQ ID NO: 1363426 - protein, 5 aa, Mycobacterium tuberculosis
PHRPR

SEQ ID NO: 1363427 - protein, 10 aa, Mycobacterium tuberculosis
PIGDATSRAT

SEQ ID NO: 1363428 - protein, 4 aa, Mycobacterium tuberculosis
PKET

SEQ ID NO: 1363429 - protein, 15 aa, Mycobacterium tuberculosis
PKPGTGPSAAARERG

SEQ ID NO: 1363430 - protein, 9 aa, Mycobacterium tuberculosis
PKQAPKAVD

SEQ ID NO: 1363431 - protein, 22 aa, Mycobacterium tuberculosis
PKQRGGYAQFGTGTAQQGFPAD

SEQ ID NO: 1363432 - protein, 6 aa, Mycobacterium tuberculosis
PLADRS

SEQ ID NO: 1363433 - protein, 13 aa, Mycobacterium tuberculosis
PLGSRSPAEPAHP

SEQ ID NO: 1363434 - protein, 9 aa, Mycobacterium tuberculosis
PPAGAQPPF

SEQ ID NO: 1363435 - protein, 4 aa, Mycobacterium tuberculosis
PPDA

SEQ ID NO: 1363436 - protein, 35 aa, Mycobacterium tuberculosis; identical to SEQ ID NO: 152939

SEQ ID NO: 1363437 - protein, 4 aa, Mycobacterium tuberculosis
PPLP

SEQ ID NO: 1363438 - protein, 5 aa, Mycobacterium tuberculosis
PPLTS

SEQ ID NO: 1363439 - protein, 6 aa, Mycobacterium tuberculosis
PPNGTH

SEQ ID NO: 1363440 - protein, 11 aa, Mycobacterium tuberculosis
PPRFADDNGSA

SEQ ID NO: 1363441 - protein, 13 aa, Mycobacterium tuberculosis
PPRVAAEPPSPGS

SEQ ID NO: 1363442 - protein, 10 aa, Mycobacterium tuberculosis
PPSHAGRATT

SEQ ID NO: 1363443 - protein, 6 aa, Mycobacterium tuberculosis
PQPAAS

SEQ ID NO: 1363444 - protein, 11 aa, Mycobacterium tuberculosis
PQQDSSAPDAQ

SEQ ID NO: 1363445 - protein, 8 aa, Mycobacterium tuberculosis
PQSPPATG

SEQ ID NO: 1363446 - protein, 8 aa, Mycobacterium tuberculosis
PQWGPPAG

SEQ ID NO: 1363447 - protein, 8 aa, Mycobacterium tuberculosis
PRAGQDAL

SEQ ID NO: 1363448 - protein, 4 aa, Mycobacterium tuberculosis
PRDV

SEQ ID NO: 1363449 - protein, 5 aa, Mycobacterium tuberculosis
PRNEL

SEQ ID NO: 1363450 - protein, 8 aa, Mycobacterium tuberculosis
PRQQDEGD

SEQ ID NO: 1363451 - protein, 21 aa, Mycobacterium tuberculosis
PSGPELSRANASVARDTVAPG

SEQ ID NO: 1363452 - protein, 8 aa, Mycobacterium tuberculosis
PSGQATSF

SEQ ID NO: 1363453 - protein, 4 aa, Mycobacterium tuberculosis
PSLA

SEQ ID NO: 1363454 - protein, 16 aa, Mycobacterium tuberculosis
PSSGTAPGGKPAPKPQ

SEQ ID NO: 1363455 - protein, 6 aa, Mycobacterium tuberculosis
PSSSSH

SEQ ID NO: 1363456 - protein, 21 aa, Mycobacterium tuberculosis
PSSTAAERDPLPQTTDAPSAE

SEQ ID NO: 1363457 - protein, 14 aa, Mycobacterium tuberculosis
PSTLDPAVDPEGAH

SEQ ID NO: 1363458 - protein, 9 aa, Mycobacterium tuberculosis
PTARPQEPL

SEQ ID NO: 1363459 - protein, 4 aa, Mycobacterium tuberculosis
PTDG

SEQ ID NO: 1363460 - protein, 6 aa, Mycobacterium tuberculosis
PTEQLD

SEQ ID NO: 1363461 - protein, 6 aa, Mycobacterium tuberculosis
PTGSGL

SEQ ID NO: 1363462 - protein, 14 aa, Mycobacterium tuberculosis
PTPGSATTPMGRGP

SEQ ID NO: 1363463 - protein, 8 aa, Mycobacterium tuberculosis
PTSGLDPA

SEQ ID NO: 1363464 - protein, 11 aa, Mycobacterium tuberculosis
PTTAAGSAALG

SEQ ID NO: 1363465 - protein, 9 aa, Mycobacterium tuberculosis
PVAEGNERI

SEQ ID NO: 1363466 - protein, 6 aa, Mycobacterium tuberculosis
PVGGPT

SEQ ID NO: 1363467 - protein, 6 aa, Mycobacterium tuberculosis
PVPPQT

SEQ ID NO: 1363468 - protein, 39 aa, Mycobacterium tuberculosis; identical to SEQ ID NO: 153092

SEQ ID NO: 1363469 - protein, 16 aa, Mycobacterium tuberculosis
PVSEADADDEDNELTD

SEQ ID NO: 1363470 - protein, 16 aa, Mycobacterium tuberculosis
PVSGAPVASGASGNLK

SEQ ID NO: 1363471 - protein, 19 aa, Mycobacterium tuberculosis
PWQPPGQGADHSSDPTVAA

SEQ ID NO: 1363472 - protein, 4 aa, Mycobacterium tuberculosis
QAAY

SEQ ID NO: 1363473 - protein, 9 aa, Mycobacterium tuberculosis
QADGRGPAL

SEQ ID NO: 1363474 - protein, 8 aa, Mycobacterium tuberculosis
QADPATAD

SEQ ID NO: 1363475 - protein, 4 aa, Mycobacterium tuberculosis
QAEG

SEQ ID NO: 1363476 - protein, 6 aa, Mycobacterium tuberculosis
QAHTDD

SEQ ID NO: 1363477 - protein, 7 aa, Mycobacterium tuberculosis
QAPRSRG

SEQ ID NO: 1363478 - protein, 7 aa, Mycobacterium tuberculosis
QAPVDPQ

SEQ ID NO: 1363479 - protein, 20 aa, Mycobacterium tuberculosis
QAQGALAAAEQAEHAEQEAA

SEQ ID NO: 1363480 - protein, 16 aa, Mycobacterium tuberculosis
QASGNTDQAALESAQA

SEQ ID NO: 1363481 - protein, 40 aa, Mycobacterium tuberculosis
QASSQSAPRAAQGSSKPAPGARPVRPVGTRRPTGKRNAGR

SEQ ID NO: 1363482 - protein, 5 aa, Mycobacterium tuberculosis
QDGAT

SEQ ID NO: 1363483 - protein, 10 aa, Mycobacterium tuberculosis
QDGGEQQGMP

SEQ ID NO: 1363484 - protein, 11 aa, Mycobacterium tuberculosis
QDSVRESGPVR

SEQ ID NO: 1363485 - protein, 9 aa, Mycobacterium tuberculosis
QEANTQDFP

SEQ ID NO: 1363486 - protein, 6 aa, Mycobacterium tuberculosis
QEAPAQ

SEQ ID NO: 1363487 - protein, 6 aa, Mycobacterium tuberculosis
QFSADE

SEQ ID NO: 1363488 - protein, 4 aa, Mycobacterium tuberculosis
QGAT

SEQ ID NO: 1363489 - protein, 11 aa, Mycobacterium tuberculosis
QGATSDGNDAA

SEQ ID NO: 1363490 - protein, 6 aa, Mycobacterium tuberculosis
QGFDGR

SEQ ID NO: 1363491 - protein, 6 aa, Mycobacterium tuberculosis
QGQSAN

SEQ ID NO: 1363492 - protein, 7 aa, Mycobacterium tuberculosis
QGQSGST

SEQ ID NO: 1363493 - protein, 10 aa, Mycobacterium tuberculosis
QGRQSKSEHT

SEQ ID NO: 1363494 - protein, 10 aa, Mycobacterium tuberculosis
QHDPATVARA

SEQ ID NO: 1363495 - protein, 7 aa, Mycobacterium tuberculosis
QHPTGAG

SEQ ID NO: 1363496 - protein, 12 aa, Mycobacterium tuberculosis
QHRHERSRATVG

SEQ ID NO: 1363497 - protein, 8 aa, Mycobacterium tuberculosis
QKRPQPGK

SEQ ID NO: 1363498 - protein, 8 aa, Mycobacterium tuberculosis
QLPPGFDS

SEQ ID NO: 1363499 - protein, 11 aa, Mycobacterium tuberculosis
QNRTKEALASA

SEQ ID NO: 1363500 - protein, 8 aa, Mycobacterium tuberculosis
QNTSTDAN

SEQ ID NO: 1363501 - protein, 19 aa, Mycobacterium tuberculosis
QPEPTFTTSPQDADRFSDA

SEQ ID NO: 1363502 - protein, 7 aa, Mycobacterium tuberculosis
QPNGEVL

SEQ ID NO: 1363503 - protein, 9 aa, Mycobacterium tuberculosis
QPQPGQNAP

SEQ ID NO: 1363504 - protein, 5 aa, Mycobacterium tuberculosis
QPRRT

SEQ ID NO: 1363505 - protein, 11 aa, Mycobacterium tuberculosis
QPSQSNGQNYT

SEQ ID NO: 1363506 - protein, 6 aa, Mycobacterium tuberculosis
QPTDLV

SEQ ID NO: 1363507 - protein, 23 aa, Mycobacterium tuberculosis
QPTDPDVAQPRVADEAEQHAKKS

SEQ ID NO: 1363508 - protein, 9 aa, Mycobacterium tuberculosis
QPWPEPGDE

SEQ ID NO: 1363509 - protein, 31 aa, Mycobacterium tuberculosis; identical to SEQ ID NO: 153271

SEQ ID NO: 1363510 - protein, 10 aa, Mycobacterium tuberculosis
QQISTGTEIR

SEQ ID NO: 1363511 - protein, 7 aa, Mycobacterium tuberculosis
QRDRAND

SEQ ID NO: 1363512 - protein, 5 aa, Mycobacterium tuberculosis
QREAT

SEQ ID NO: 1363513 - protein, 6 aa, Mycobacterium tuberculosis
QRPLGD

SEQ ID NO: 1363514 - protein, 4 aa, Mycobacterium tuberculosis
QRPY

SEQ ID NO: 1363515 - protein, 10 aa, Mycobacterium tuberculosis
QRSIGDVPTG

SEQ ID NO: 1363516 - protein, 7 aa, Mycobacterium tuberculosis
QRTGWSG

SEQ ID NO: 1363517 - protein, 10 aa, Mycobacterium tuberculosis
QSARSTAAGL

SEQ ID NO: 1363518 - protein, 8 aa, Mycobacterium tuberculosis
QSDVDQAR

SEQ ID NO: 1363519 - protein, 4 aa, Mycobacterium tuberculosis
QSEV

SEQ ID NO: 1363520 - protein, 12 aa, Mycobacterium tuberculosis
QSSSPALGDRTT

SEQ ID NO: 1363521 - protein, 8 aa, Mycobacterium tuberculosis
QSYSGEAT

SEQ ID NO: 1363522 - protein, 4 aa, Mycobacterium tuberculosis
QTAS

SEQ ID NO: 1363523 - protein, 16 aa, Mycobacterium tuberculosis
QTASASGYNEPRGYDR

SEQ ID NO: 1363524 - protein, 15 aa, Mycobacterium tuberculosis
QTDSEAGTTPDRGTD

SEQ ID NO: 1363525 - protein, 10 aa, Mycobacterium tuberculosis
QTETDAAGST

SEQ ID NO: 1363526 - protein, 9 aa, Mycobacterium tuberculosis
QTGADQIKA

SEQ ID NO: 1363527 - protein, 16 aa, Mycobacterium tuberculosis
QTGDPNICDTFSAADL

SEQ ID NO: 1363528 - protein, 5 aa, Mycobacterium tuberculosis
QTLNT

SEQ ID NO: 1363529 - protein, 22 aa, Mycobacterium tuberculosis
QTLTTTPHPDTDAPLPVPPTDD

SEQ ID NO: 1363530 - protein, 6 aa, Mycobacterium tuberculosis
QTQPAV

SEQ ID NO: 1363531 - protein, 31 aa, Mycobacterium tuberculosis; identical to SEQ ID NO: 153350

SEQ ID NO: 1363532 - protein, 6 aa, Mycobacterium tuberculosis
QTSAGY

SEQ ID NO: 1363533 - protein, 12 aa, Mycobacterium tuberculosis
QVPDSPAMTGPY

SEQ ID NO: 1363534 - protein, 11 aa, Mycobacterium tuberculosis
QYPPSPDKAVK

SEQ ID NO: 1363535 - protein, 8 aa, Mycobacterium tuberculosis
RAAGRAGY

SEQ ID NO: 1363536 - protein, 7 aa, Mycobacterium tuberculosis
RAAGTHK

SEQ ID NO: 1363537 - protein, 7 aa, Mycobacterium tuberculosis
RAAPTQL

SEQ ID NO: 1363538 - protein, 53 aa, Mycobacterium tuberculosis; identical to SEQ ID NO: 153376

SEQ ID NO: 1363539 - protein, 10 aa, Mycobacterium tuberculosis
RADEESGRAE

SEQ ID NO: 1363540 - protein, 11 aa, Mycobacterium tuberculosis
RADTNGPQSGA

SEQ ID NO: 1363541 - protein, 8 aa, Mycobacterium tuberculosis
RADTQDKI

SEQ ID NO: 1363542 - protein, 7 aa, Mycobacterium tuberculosis
RAGGDAR

SEQ ID NO: 1363543 - protein, 7 aa, Mycobacterium tuberculosis
RAGVGPR

SEQ ID NO: 1363544 - protein, 10 aa, Mycobacterium tuberculosis
RAKSKAGSAL

SEQ ID NO: 1363545 - protein, 10 aa, Mycobacterium tuberculosis
RAKSQAGSAL

SEQ ID NO: 1363546 - protein, 12 aa, Mycobacterium tuberculosis
RALPDDVRRDRA

SEQ ID NO: 1363547 - protein, 6 aa, Mycobacterium tuberculosis
RASGDE

SEQ ID NO: 1363548 - protein, 8 aa, Mycobacterium tuberculosis
RATGTGYA

SEQ ID NO: 1363549 - protein, 6 aa, Mycobacterium tuberculosis
RATQID

SEQ ID NO: 1363550 - protein, 8 aa, Mycobacterium tuberculosis
RDDSGERT

SEQ ID NO: 1363551 - protein, 14 aa, Mycobacterium tuberculosis
RDQRKRRAYTPDEV

SEQ ID NO: 1363552 - protein, 6 aa, Mycobacterium tuberculosis
READAA

SEQ ID NO: 1363553 - protein, 10 aa, Mycobacterium tuberculosis
REARTAGRLQ

SEQ ID NO: 1363554 - protein, 10 aa, Mycobacterium tuberculosis
REDGAGELTD

SEQ ID NO: 1363555 - protein, 4 aa, Mycobacterium tuberculosis
REED

SEQ ID NO: 1363556 - protein, 8 aa, Mycobacterium tuberculosis
REEETRIS

SEQ ID NO: 1363557 - protein, 29 aa, Mycobacterium tuberculosis
REGDAEAVDPLGQQQLDQSGAVGVSPSAV

SEQ ID NO: 1363558 - protein, 6 aa, Mycobacterium tuberculosis
REIGRS

SEQ ID NO: 1363559 - protein, 4 aa, Mycobacterium tuberculosis
RERE

SEQ ID NO: 1363560 - protein, 4 aa, Mycobacterium tuberculosis
RETE

SEQ ID NO: 1363561 - protein, 7 aa, Mycobacterium tuberculosis
RGAGEGR

SEQ ID NO: 1363562 - protein, 8 aa, Mycobacterium tuberculosis
RGGPRKRH

SEQ ID NO: 1363563 - protein, 6 aa, Mycobacterium tuberculosis
RGGPYL

SEQ ID NO: 1363564 - protein, 13 aa, Mycobacterium tuberculosis
RGHSGQRLAPGAT

SEQ ID NO: 1363565 - protein, 6 aa, Mycobacterium tuberculosis
RGNSTG

SEQ ID NO: 1363566 - protein, 6 aa, Mycobacterium tuberculosis
RGQIGS

SEQ ID NO: 1363567 - protein, 10 aa, Mycobacterium tuberculosis
RGRDGRAPYD

SEQ ID NO: 1363568 - protein, 5 aa, Mycobacterium tuberculosis
RGRSL

SEQ ID NO: 1363569 - protein, 5 aa, Mycobacterium tuberculosis
RGRYQ

SEQ ID NO: 1363570 - protein, 4 aa, Mycobacterium tuberculosis
RGTH

SEQ ID NO: 1363571 - protein, 8 aa, Mycobacterium tuberculosis
RGTYGPKV

SEQ ID NO: 1363572 - protein, 13 aa, Mycobacterium tuberculosis
RGVAEKRTERGFR

SEQ ID NO: 1363573 - protein, 6 aa, Mycobacterium tuberculosis
RHPTPG

SEQ ID NO: 1363574 - protein, 6 aa, Mycobacterium tuberculosis
RHRTTS

SEQ ID NO: 1363575 - protein, 8 aa, Mycobacterium tuberculosis
RIASKSSA

SEQ ID NO: 1363576 - protein, 22 aa, Mycobacterium tuberculosis
RKEHADEPEVQEQPTLAPQVEP

SEQ ID NO: 1363577 - protein, 12 aa, Mycobacterium tuberculosis
RKPGETGGTFSA

SEQ ID NO: 1363578 - protein, 5 aa, Mycobacterium tuberculosis
RLDQG

SEQ ID NO: 1363579 - protein, 5 aa, Mycobacterium tuberculosis
RLPRQ

SEQ ID NO: 1363580 - protein, 8 aa, Mycobacterium tuberculosis
RMSQGRTL

SEQ ID NO: 1363581 - protein, 10 aa, Mycobacterium tuberculosis
RNAAADDTPA

SEQ ID NO: 1363582 - protein, 16 aa, Mycobacterium tuberculosis
RNEPISVGELQADAIA

SEQ ID NO: 1363583 - protein, 15 aa, Mycobacterium tuberculosis
RPADAVPHDQPGRGL

SEQ ID NO: 1363584 - protein, 8 aa, Mycobacterium tuberculosis
RPAGPGPL

SEQ ID NO: 1363585 - protein, 6 aa, Mycobacterium tuberculosis
RPASTQ

SEQ ID NO: 1363586 - protein, 8 aa, Mycobacterium tuberculosis
RPDNPQTL

SEQ ID NO: 1363587 - protein, 6 aa, Mycobacterium tuberculosis
RPDTSH

SEQ ID NO: 1363588 - protein, 8 aa, Mycobacterium tuberculosis
RPEATRDA

SEQ ID NO: 1363589 - protein, 11 aa, Mycobacterium tuberculosis
RPETQRALAPA

SEQ ID NO: 1363590 - protein, 11 aa, Mycobacterium tuberculosis
RPGDTDPDNEV

SEQ ID NO: 1363591 - protein, 7 aa, Mycobacterium tuberculosis
RPGETIA

SEQ ID NO: 1363592 - protein, 15 aa, Mycobacterium tuberculosis
RPGPNRVGPKGALQS

SEQ ID NO: 1363593 - protein, 4 aa, Mycobacterium tuberculosis
RPLG

SEQ ID NO: 1363594 - protein, 6 aa, Mycobacterium tuberculosis
RPRPAS

SEQ ID NO: 1363595 - protein, 13 aa, Mycobacterium tuberculosis
RPRTDKGSDGTRH

SEQ ID NO: 1363596 - protein, 12 aa, Mycobacterium tuberculosis
RPRTLDPSTLDN

SEQ ID NO: 1363597 - protein, 4 aa, Mycobacterium tuberculosis
RQAL

SEQ ID NO: 1363598 - protein, 6 aa, Mycobacterium tuberculosis
RQETPT

SEQ ID NO: 1363599 - protein, 6 aa, Mycobacterium tuberculosis
RQGTET

SEQ ID NO: 1363600 - protein, 11 aa, Mycobacterium tuberculosis
RQMRDNANELR

SEQ ID NO: 1363601 - protein, 8 aa, Mycobacterium tuberculosis
RQPDGGWG

SEQ ID NO: 1363602 - protein, 8 aa, Mycobacterium tuberculosis
RQQDRWSS

SEQ ID NO: 1363603 - protein, 14 aa, Mycobacterium tuberculosis
RQTDSGDSLETARP

SEQ ID NO: 1363604 - protein, 15 aa, Mycobacterium tuberculosis
RQTLADKIMTTVCVP

SEQ ID NO: 1363605 - protein, 6 aa, Mycobacterium tuberculosis
RRASGG

SEQ ID NO: 1363606 - protein, 6 aa, Mycobacterium tuberculosis
RRGDDM

SEQ ID NO: 1363607 - protein, 5 aa, Mycobacterium tuberculosis
RRGEM

SEQ ID NO: 1363608 - protein, 4 aa, Mycobacterium tuberculosis
RRGQ

SEQ ID NO: 1363609 - protein, 34 aa, Mycobacterium tuberculosis; identical to SEQ ID NO: 153694

SEQ ID NO: 1363610 - protein, 5 aa, Mycobacterium tuberculosis
RRGYR

SEQ ID NO: 1363611 - protein, 4 aa, Mycobacterium tuberculosis
RRMN

SEQ ID NO: 1363612 - protein, 15 aa, Mycobacterium tuberculosis
RRNAPQSDPDPLVLP

SEQ ID NO: 1363613 - protein, 8 aa, Mycobacterium tuberculosis
RRPPAGMS

SEQ ID NO: 1363614 - protein, 12 aa, Mycobacterium tuberculosis
RRPPDSSSEPVV

SEQ ID NO: 1363615 - protein, 6 aa, Mycobacterium tuberculosis
RRPSRL

SEQ ID NO: 1363616 - protein, 6 aa, Mycobacterium tuberculosis
RRRDEE

SEQ ID NO: 1363617 - protein, 4 aa, Mycobacterium tuberculosis
RRRI

SEQ ID NO: 1363618 - protein, 9 aa, Mycobacterium tuberculosis
RRRNPGPDV

SEQ ID NO: 1363619 - protein, 9 aa, Mycobacterium tuberculosis
RRTTPNPDC

SEQ ID NO: 1363620 - protein, 6 aa, Mycobacterium tuberculosis
RRVDPT

SEQ ID NO: 1363621 - protein, 6 aa, Mycobacterium tuberculosis
RRVESD

SEQ ID NO: 1363622 - protein, 4 aa, Mycobacterium tuberculosis
RSDA

SEQ ID NO: 1363623 - protein, 5 aa, Mycobacterium tuberculosis
RSGTP

SEQ ID NO: 1363624 - protein, 5 aa, Mycobacterium tuberculosis
RSIDS

SEQ ID NO: 1363625 - protein, 42 aa, Mycobacterium tuberculosis; identical to SEQ ID NO: 153749

SEQ ID NO: 1363626 - protein, 5 aa, Mycobacterium tuberculosis
RSPID

SEQ ID NO: 1363627 - protein, 10 aa, Mycobacterium tuberculosis
RSQKAASGAD

SEQ ID NO: 1363628 - protein, 5 aa, Mycobacterium tuberculosis
RSSAG

SEQ ID NO: 1363629 - protein, 13 aa, Mycobacterium tuberculosis
RSTARATSPQSSG

SEQ ID NO: 1363630 - protein, 15 aa, Mycobacterium tuberculosis
RSTVEANARGGTSRD

SEQ ID NO: 1363631 - protein, 5 aa, Mycobacterium tuberculosis
RTAAD

SEQ ID NO: 1363632 - protein, 13 aa, Mycobacterium tuberculosis
RTAGAAQAAGVPN

SEQ ID NO: 1363633 - protein, 8 aa, Mycobacterium tuberculosis
RTDTMGRS

SEQ ID NO: 1363634 - protein, 6 aa, Mycobacterium tuberculosis
RTGAAI

SEQ ID NO: 1363635 - protein, 13 aa, Mycobacterium tuberculosis
RTGFSREEQQRLA

SEQ ID NO: 1363636 - protein, 10 aa, Mycobacterium tuberculosis
RTGGPGALPA

SEQ ID NO: 1363637 - protein, 22 aa, Mycobacterium tuberculosis
RTGPTPPPPPVEQPAELGDPAH

SEQ ID NO: 1363638 - protein, 10 aa, Mycobacterium tuberculosis
RTGYADVPTP

SEQ ID NO: 1363639 - protein, 11 aa, Mycobacterium tuberculosis
RTPEVAAPPVK

SEQ ID NO: 1363640 - protein, 5 aa, Mycobacterium tuberculosis
RTPST

SEQ ID NO: 1363641 - protein, 6 aa, Mycobacterium tuberculosis
RTQELT

SEQ ID NO: 1363642 - protein, 15 aa, Mycobacterium tuberculosis
RTRAGIERGIAGELD

SEQ ID NO: 1363643 - protein, 7 aa, Mycobacterium tuberculosis
RTSSNDI

SEQ ID NO: 1363644 - protein, 8 aa, Mycobacterium tuberculosis
RVDPADDR

SEQ ID NO: 1363645 - protein, 5 aa, Mycobacterium tuberculosis
RVGTD

SEQ ID NO: 1363646 - protein, 5 aa, Mycobacterium tuberculosis
RVSKT

SEQ ID NO: 1363647 - protein, 6 aa, Mycobacterium tuberculosis
RYAGDE

SEQ ID NO: 1363648 - protein, 14 aa, Mycobacterium tuberculosis
SAAADEPAVECGGD

SEQ ID NO: 1363649 - protein, 8 aa, Mycobacterium tuberculosis
SAAPSNIG

SEQ ID NO: 1363650 - protein, 8 aa, Mycobacterium tuberculosis
SAASSWAS

SEQ ID NO: 1363651 - protein, 8 aa, Mycobacterium tuberculosis
SAATRGAS

SEQ ID NO: 1363652 - protein, 6 aa, Mycobacterium tuberculosis
SADTRR

SEQ ID NO: 1363653 - protein, 26 aa, Mycobacterium tuberculosis
SAGEPGARRSAKSVRKLASDDSQSAH

SEQ ID NO: 1363654 - protein, 6 aa, Mycobacterium tuberculosis
SAGKVG

SEQ ID NO: 1363655 - protein, 13 aa, Mycobacterium tuberculosis
SAGVDDAKEYNSV

SEQ ID NO: 1363656 - protein, 5 aa, Mycobacterium tuberculosis
SALST

SEQ ID NO: 1363657 - protein, 7 aa, Mycobacterium tuberculosis
SAPAAVR

SEQ ID NO: 1363658 - protein, 6 aa, Mycobacterium tuberculosis
SAPGTD

SEQ ID NO: 1363659 - protein, 14 aa, Mycobacterium tuberculosis
SAPHREQYSDPEKP

SEQ ID NO: 1363660 - protein, 4 aa, Mycobacterium tuberculosis
SAPV

SEQ ID NO: 1363661 - protein, 4 aa, Mycobacterium tuberculosis
SAQH

SEQ ID NO: 1363662 - protein, 6 aa, Mycobacterium tuberculosis
SASLNS

SEQ ID NO: 1363663 - protein, 6 aa, Mycobacterium tuberculosis
SASMGR

SEQ ID NO: 1363664 - protein, 13 aa, Mycobacterium tuberculosis
SATTDEKLTQLGN

SEQ ID NO: 1363665 - protein, 7 aa, Mycobacterium tuberculosis
SCPPPRH

SEQ ID NO: 1363666 - protein, 13 aa, Mycobacterium tuberculosis
SDAGATAQERERA

SEQ ID NO: 1363667 - protein, 8 aa, Mycobacterium tuberculosis
SDDQNPNL

SEQ ID NO: 1363668 - protein, 8 aa, Mycobacterium tuberculosis
SDGPERKV

SEQ ID NO: 1363669 - protein, 6 aa, Mycobacterium tuberculosis
SDGSEI

SEQ ID NO: 1363670 - protein, 8 aa, Mycobacterium tuberculosis
SDNGGSTT

SEQ ID NO: 1363671 - protein, 6 aa, Mycobacterium tuberculosis
SDSEVS

SEQ ID NO: 1363672 - protein, 6 aa, Mycobacterium tuberculosis
SEAKAN

SEQ ID NO: 1363673 - protein, 4 aa, Mycobacterium tuberculosis
SERP

SEQ ID NO: 1363674 - protein, 8 aa, Mycobacterium tuberculosis
SETTGQPI

SEQ ID NO: 1363675 - protein, 7 aa, Mycobacterium tuberculosis
SEYGGDP

SEQ ID NO: 1363676 - protein, 5 aa, Mycobacterium tuberculosis
SGADT

SEQ ID NO: 1363677 - protein, 4 aa, Mycobacterium tuberculosis
SGAG

SEQ ID NO: 1363678 - protein, 14 aa, Mycobacterium tuberculosis
SGAPFDGASLQGKP

SEQ ID NO: 1363679 - protein, 6 aa, Mycobacterium tuberculosis
SGAPRA

SEQ ID NO: 1363680 - protein, 5 aa, Mycobacterium tuberculosis
SGEEI

SEQ ID NO: 1363681 - protein, 6 aa, Mycobacterium tuberculosis
SGEWSK

SEQ ID NO: 1363682 - protein, 5 aa, Mycobacterium tuberculosis
SGGGQ

SEQ ID NO: 1363683 - protein, 6 aa, Mycobacterium tuberculosis
SGKPDF

SEQ ID NO: 1363684 - protein, 4 aa, Mycobacterium tuberculosis
SGMP

SEQ ID NO: 1363685 - protein, 4 aa, Mycobacterium tuberculosis
SGNY

SEQ ID NO: 1363686 - protein, 6 aa, Mycobacterium tuberculosis
SGQGGA

SEQ ID NO: 1363687 - protein, 4 aa, Mycobacterium tuberculosis
SGQS

SEQ ID NO: 1363688 - protein, 8 aa, Mycobacterium tuberculosis
SGRAAAAG

SEQ ID NO: 1363689 - protein, 8 aa, Mycobacterium tuberculosis
SGRGNSAV

SEQ ID NO: 1363690 - protein, 28 aa, Mycobacterium tuberculosis
SGSGCSGSAGYADIDRGTQVTVKNGQGD

SEQ ID NO: 1363691 - protein, 8 aa, Mycobacterium tuberculosis
SGSGTADV

SEQ ID NO: 1363692 - protein, 9 aa, Mycobacterium tuberculosis
SGVPENVNA

SEQ ID NO: 1363693 - protein, 4 aa, Mycobacterium tuberculosis
SHPG

SEQ ID NO: 1363694 - protein, 7 aa, Mycobacterium tuberculosis
SHSTSTT

SEQ ID NO: 1363695 - protein, 12 aa, Mycobacterium tuberculosis
SIPGQPTSQAAR

SEQ ID NO: 1363696 - protein, 6 aa, Mycobacterium tuberculosis
SLEATR

SEQ ID NO: 1363697 - protein, 8 aa, Mycobacterium tuberculosis
SLGGPVSS

SEQ ID NO: 1363698 - protein, 7 aa, Mycobacterium tuberculosis
SLPAPTH

SEQ ID NO: 1363699 - protein, 5 aa, Mycobacterium tuberculosis
SLPEA

SEQ ID NO: 1363700 - protein, 4 aa, Mycobacterium tuberculosis
SLPP

SEQ ID NO: 1363701 - protein, 6 aa, Mycobacterium tuberculosis
SLSGAE

SEQ ID NO: 1363702 - protein, 10 aa, Mycobacterium tuberculosis
SLSGGGTGTR

SEQ ID NO: 1363703 - protein, 16 aa, Mycobacterium tuberculosis
SLSPGGFQDPRSESAR

SEQ ID NO: 1363704 - protein, 8 aa, Mycobacterium tuberculosis
SNEDGRTA

SEQ ID NO: 1363705 - protein, 12 aa, Mycobacterium tuberculosis
SNRDRLAARASR

SEQ ID NO: 1363706 - protein, 6 aa, Mycobacterium tuberculosis
SPAQRA

SEQ ID NO: 1363707 - protein, 6 aa, Mycobacterium tuberculosis
SPARAV

SEQ ID NO: 1363708 - protein, 5 aa, Mycobacterium tuberculosis
SPGDF

SEQ ID NO: 1363709 - protein, 8 aa, Mycobacterium tuberculosis
SPGTGFGR

SEQ ID NO: 1363710 - protein, 5 aa, Mycobacterium tuberculosis
SPIER

SEQ ID NO: 1363711 - protein, 6 aa, Mycobacterium tuberculosis
SPPFQH

SEQ ID NO: 1363712 - protein, 21 aa, Mycobacterium tuberculosis
SPPTIDPGALPPDGPPGPLAP

SEQ ID NO: 1363713 - protein, 13 aa, Mycobacterium tuberculosis
SPQDPTEHADGAE

SEQ ID NO: 1363714 - protein, 6 aa, Mycobacterium tuberculosis
SPRSGI

SEQ ID NO: 1363715 - protein, 4 aa, Mycobacterium tuberculosis
SPRT

SEQ ID NO: 1363716 - protein, 5 aa, Mycobacterium tuberculosis
SPSQS

SEQ ID NO: 1363717 - protein, 11 aa, Mycobacterium tuberculosis
SQATGMATADK

SEQ ID NO: 1363718 - protein, 5 aa, Mycobacterium tuberculosis
SQGTT

SEQ ID NO: 1363719 - protein, 4 aa, Mycobacterium tuberculosis
SQHT

SEQ ID NO: 1363720 - protein, 7 aa, Mycobacterium tuberculosis
SQSAGDQ

SEQ ID NO: 1363721 - protein, 5 aa, Mycobacterium tuberculosis
SRGRT

SEQ ID NO: 1363722 - protein, 9 aa, Mycobacterium tuberculosis
SRKDQERAV

SEQ ID NO: 1363723 - protein, 5 aa, Mycobacterium tuberculosis
SRMGA

SEQ ID NO: 1363724 - protein, 7 aa, Mycobacterium tuberculosis
SRMPQSR

SEQ ID NO: 1363725 - protein, 27 aa, Mycobacterium tuberculosis
SRPARTPTVPSETQPAGRPLAMSSDRL

SEQ ID NO: 1363726 - protein, 18 aa, Mycobacterium tuberculosis
SRQRKAKVTQDDTGTYRI

SEQ ID NO: 1363727 - protein, 8 aa, Mycobacterium tuberculosis
SRSHPAPL

SEQ ID NO: 1363728 - protein, 6 aa, Mycobacterium tuberculosis
SRSRRD

SEQ ID NO: 1363729 - protein, 5 aa, Mycobacterium tuberculosis
SRSSI

SEQ ID NO: 1363730 - protein, 6 aa, Mycobacterium tuberculosis
SRTRDE

SEQ ID NO: 1363731 - protein, 10 aa, Mycobacterium tuberculosis
SRYAGEDRET

SEQ ID NO: 1363732 - protein, 9 aa, Mycobacterium tuberculosis
SSAASNIGS

SEQ ID NO: 1363733 - protein, 5 aa, Mycobacterium tuberculosis
SSAGV

SEQ ID NO: 1363734 - protein, 8 aa, Mycobacterium tuberculosis
SSEAATDV

SEQ ID NO: 1363735 - protein, 12 aa, Mycobacterium tuberculosis
SSLLAKPAYNGL

SEQ ID NO: 1363736 - protein, 5 aa, Mycobacterium tuberculosis
SSNPM

SEQ ID NO: 1363737 - protein, 7 aa, Mycobacterium tuberculosis
SSPDTNT

SEQ ID NO: 1363738 - protein, 5 aa, Mycobacterium tuberculosis
SSPTG

SEQ ID NO: 1363739 - protein, 5 aa, Mycobacterium tuberculosis
SSQAF

SEQ ID NO: 1363740 - protein, 5 aa, Mycobacterium tuberculosis
SSRIA

SEQ ID NO: 1363741 - protein, 18 aa, Mycobacterium tuberculosis
SSSAPTESSECSADRQPG

SEQ ID NO: 1363742 - protein, 7 aa, Mycobacterium tuberculosis
SSSDREF

SEQ ID NO: 1363743 - protein, 12 aa, Mycobacterium tuberculosis
SSTAPAPKASRR

SEQ ID NO: 1363744 - protein, 7 aa, Mycobacterium tuberculosis
SSWDGPA

SEQ ID NO: 1363745 - protein, 11 aa, Mycobacterium tuberculosis
STGTTKTGATA

SEQ ID NO: 1363746 - protein, 5 aa, Mycobacterium tuberculosis
STHKS

SEQ ID NO: 1363747 - protein, 9 aa, Mycobacterium tuberculosis
STNGGRETT

SEQ ID NO: 1363748 - protein, 9 aa, Mycobacterium tuberculosis
STNPRAGTL

SEQ ID NO: 1363749 - protein, 19 aa, Mycobacterium tuberculosis
STPPAVDSSEVPAAGEPPL

SEQ ID NO: 1363750 - protein, 7 aa, Mycobacterium tuberculosis
STSALDT

SEQ ID NO: 1363751 - protein, 8 aa, Mycobacterium tuberculosis
STSFPSGH

SEQ ID NO: 1363752 - protein, 5 aa, Mycobacterium tuberculosis
STSYA

SEQ ID NO: 1363753 - protein, 4 aa, Mycobacterium tuberculosis
SVAA

SEQ ID NO: 1363754 - protein, 29 aa, Mycobacterium tuberculosis
SVGSTGELTQREGPHELRSPDGPRQLPPP

SEQ ID NO: 1363755 - protein, 10 aa, Mycobacterium tuberculosis
SVHGDPRAIR

SEQ ID NO: 1363756 - protein, 7 aa, Mycobacterium tuberculosis
SVTGRGR

SEQ ID NO: 1363757 - protein, 4 aa, Mycobacterium tuberculosis
SWPT

SEQ ID NO: 1363758 - protein, 9 aa, Mycobacterium tuberculosis
SYGQSGGPL

SEQ ID NO: 1363759 - protein, 8 aa, Mycobacterium tuberculosis
SYPTYAEA

SEQ ID NO: 1363760 - protein, 12 aa, Mycobacterium tuberculosis
TAAGSQSADDRA

SEQ ID NO: 1363761 - protein, 5 aa, Mycobacterium tuberculosis
TAENP

SEQ ID NO: 1363762 - protein, 7 aa, Mycobacterium tuberculosis
TAGIDSS

SEQ ID NO: 1363763 - protein, 4 aa, Mycobacterium tuberculosis
TAGM

SEQ ID NO: 1363764 - protein, 5 aa, Mycobacterium tuberculosis
TAGRT

SEQ ID NO: 1363765 - protein, 8 aa, Mycobacterium tuberculosis
TAHHPPAG

SEQ ID NO: 1363766 - protein, 9 aa, Mycobacterium tuberculosis
TAKGGEVAA

SEQ ID NO: 1363767 - protein, 4 aa, Mycobacterium tuberculosis
TALT

SEQ ID NO: 1363768 - protein, 5 aa, Mycobacterium tuberculosis
TALTE

SEQ ID NO: 1363769 - protein, 8 aa, Mycobacterium tuberculosis
TAQPHTAP

SEQ ID NO: 1363770 - protein, 8 aa, Mycobacterium tuberculosis
TATAGASG

SEQ ID NO: 1363771 - protein, 13 aa, Mycobacterium tuberculosis
TATGAQSSDGKAA

SEQ ID NO: 1363772 - protein, 4 aa, Mycobacterium tuberculosis
TATI

SEQ ID NO: 1363773 - protein, 11 aa, Mycobacterium tuberculosis
TDGDEAVANET

SEQ ID NO: 1363774 - protein, 7 aa, Mycobacterium tuberculosis
TDGYRRG

SEQ ID NO: 1363775 - protein, 4 aa, Mycobacterium tuberculosis
TDHK

SEQ ID NO: 1363776 - protein, 8 aa, Mycobacterium tuberculosis
TDNSSARA

SEQ ID NO: 1363777 - protein, 6 aa, Mycobacterium tuberculosis
TDPHNR

SEQ ID NO: 1363778 - protein, 7 aa, Mycobacterium tuberculosis
TDTDNNR

SEQ ID NO: 1363779 - protein, 23 aa, Mycobacterium tuberculosis
TEATESAVARTDGDSTTDTASKL

SEQ ID NO: 1363780 - protein, 9 aa, Mycobacterium tuberculosis
TEDSSPTRV

SEQ ID NO: 1363781 - protein, 4 aa, Mycobacterium tuberculosis
TEFD

SEQ ID NO: 1363782 - protein, 6 aa, Mycobacterium tuberculosis
TERDGV

SEQ ID NO: 1363783 - protein, 7 aa, Mycobacterium tuberculosis
TERPHPY

SEQ ID NO: 1363784 - protein, 11 aa, Mycobacterium tuberculosis
TESVEKRSEQR

SEQ ID NO: 1363785 - protein, 7 aa, Mycobacterium tuberculosis
TETETAT

SEQ ID NO: 1363786 - protein, 8 aa, Mycobacterium tuberculosis
TGATSVPA

SEQ ID NO: 1363787 - protein, 7 aa, Mycobacterium tuberculosis
TGDFGAQ

SEQ ID NO: 1363788 - protein, 5 aa, Mycobacterium tuberculosis
TGEAV

SEQ ID NO: 1363789 - protein, 7 aa, Mycobacterium tuberculosis
TGETADR

SEQ ID NO: 1363790 - protein, 6 aa, Mycobacterium tuberculosis
TGGAGA

SEQ ID NO: 1363791 - protein, 9 aa, Mycobacterium tuberculosis
TGGPESETL

SEQ ID NO: 1363792 - protein, 10 aa, Mycobacterium tuberculosis
TGGQGDAPPA

SEQ ID NO: 1363793 - protein, 7 aa, Mycobacterium tuberculosis
TGGRTAQ

SEQ ID NO: 1363794 - protein, 9 aa, Mycobacterium tuberculosis
TGHSSGVGG

SEQ ID NO: 1363795 - protein, 7 aa, Mycobacterium tuberculosis
TGKPLSP

SEQ ID NO: 1363796 - protein, 8 aa, Mycobacterium tuberculosis
TGPGPLGA

SEQ ID NO: 1363797 - protein, 4 aa, Mycobacterium tuberculosis
TGQY

SEQ ID NO: 1363798 - protein, 9 aa, Mycobacterium tuberculosis
TGSPLDPSA

SEQ ID NO: 1363799 - protein, 6 aa, Mycobacterium tuberculosis
TGSPVA

SEQ ID NO: 1363800 - protein, 9 aa, Mycobacterium tuberculosis
TGSPVTPDH

SEQ ID NO: 1363801 - protein, 5 aa, Mycobacterium tuberculosis
TGSVG

SEQ ID NO: 1363802 - protein, 5 aa, Mycobacterium tuberculosis
TGTGE

SEQ ID NO: 1363803 - protein, 7 aa, Mycobacterium tuberculosis
TGTLTTG

SEQ ID NO: 1363804 - protein, 19 aa, Mycobacterium tuberculosis
TGTSTPRPAAAQTVRDSPA

SEQ ID NO: 1363805 - protein, 8 aa, Mycobacterium tuberculosis
THPTDGTV

SEQ ID NO: 1363806 - protein, 6 aa, Mycobacterium tuberculosis
TIESRA

SEQ ID NO: 1363807 - protein, 7 aa, Mycobacterium tuberculosis
TKTTPTA

SEQ ID NO: 1363808 - protein, 11 aa, Mycobacterium tuberculosis
TLGDGRSPKVA

SEQ ID NO: 1363809 - protein, 6 aa, Mycobacterium tuberculosis
TLGNGG

SEQ ID NO: 1363810 - protein, 6 aa, Mycobacterium tuberculosis
TLSSDP

SEQ ID NO: 1363811 - protein, 4 aa, Mycobacterium tuberculosis
TNGA

SEQ ID NO: 1363812 - protein, 8 aa, Mycobacterium tuberculosis
TNNARGEV

SEQ ID NO: 1363813 - protein, 6 aa, Mycobacterium tuberculosis
TPAPYG

SEQ ID NO: 1363814 - protein, 12 aa, Mycobacterium tuberculosis
TPPATRPSYAGA

SEQ ID NO: 1363815 - protein, 10 aa, Mycobacterium tuberculosis
TPPNSGSPEW

SEQ ID NO: 1363816 - protein, 6 aa, Mycobacterium tuberculosis
TPRAVA

SEQ ID NO: 1363817 - protein, 23 aa, Mycobacterium tuberculosis
TPRTSRTLAPRLDPEAVGRTTES

SEQ ID NO: 1363818 - protein, 13 aa, Mycobacterium tuberculosis
TPTKRTWSSGSLP

SEQ ID NO: 1363819 - protein, 5 aa, Mycobacterium tuberculosis
TPTPQ

SEQ ID NO: 1363820 - protein, 6 aa, Mycobacterium tuberculosis
TPTPRM

SEQ ID NO: 1363821 - protein, 66 aa, Mycobacterium tuberculosis; identical to SEQ ID NO: 154613

SEQ ID NO: 1363822 - protein, 6 aa, Mycobacterium tuberculosis
TQPMPG

SEQ ID NO: 1363823 - protein, 6 aa, Mycobacterium tuberculosis
TQPTVA

SEQ ID NO: 1363824 - protein, 9 aa, Mycobacterium tuberculosis
TQQGQLGAK

SEQ ID NO: 1363825 - protein, 7 aa, Mycobacterium tuberculosis
TQRADAP

SEQ ID NO: 1363826 - protein, 4 aa, Mycobacterium tuberculosis
TQSR

SEQ ID NO: 1363827 - protein, 8 aa, Mycobacterium tuberculosis
TQVATGSV

SEQ ID NO: 1363828 - protein, 5 aa, Mycobacterium tuberculosis
TRAGA

SEQ ID NO: 1363829 - protein, 19 aa, Mycobacterium tuberculosis
TRGTASGPARGRAGVTGRA

SEQ ID NO: 1363830 - protein, 9 aa, Mycobacterium tuberculosis
TRGTKRKPV

SEQ ID NO: 1363831 - protein, 4 aa, Mycobacterium tuberculosis
TRIE

SEQ ID NO: 1363832 - protein, 9 aa, Mycobacterium tuberculosis
TRPEGTTMD

SEQ ID NO: 1363833 - protein, 9 aa, Mycobacterium tuberculosis
TSAQAPPVR

SEQ ID NO: 1363834 - protein, 18 aa, Mycobacterium tuberculosis
TSDNDAAVTQPEAQRERR

SEQ ID NO: 1363835 - protein, 5 aa, Mycobacterium tuberculosis
TSPAK

SEQ ID NO: 1363836 - protein, 7 aa, Mycobacterium tuberculosis
TSRPPAD

SEQ ID NO: 1363837 - protein, 8 aa, Mycobacterium tuberculosis
TSTTSGGL

SEQ ID NO: 1363838 - protein, 6 aa, Mycobacterium tuberculosis
TSTVTA

SEQ ID NO: 1363839 - protein, 4 aa, Mycobacterium tuberculosis
TTGR

SEQ ID NO: 1363840 - protein, 8 aa, Mycobacterium tuberculosis
TTPGKPPS

SEQ ID NO: 1363841 - protein, 5 aa, Mycobacterium tuberculosis
TTSSR

SEQ ID NO: 1363842 - protein, 9 aa, Mycobacterium tuberculosis
TTTDSAEGV

SEQ ID NO: 1363843 - protein, 19 aa, Mycobacterium tuberculosis
TVPPDLARAENQTKGPNGL

SEQ ID NO: 1363844 - protein, 6 aa, Mycobacterium tuberculosis
TVSPAR

SEQ ID NO: 1363845 - protein, 5 aa, Mycobacterium tuberculosis
TVTGD

SEQ ID NO: 1363846 - protein, 12 aa, Mycobacterium tuberculosis
VADPAESSAAAA

SEQ ID NO: 1363847 - protein, 12 aa, Mycobacterium tuberculosis
VADTRAQPCDPD

SEQ ID NO: 1363848 - protein, 12 aa, Mycobacterium tuberculosis
VADVNGDDAGPA

SEQ ID NO: 1363849 - protein, 10 aa, Mycobacterium tuberculosis
VAETERDNRI

SEQ ID NO: 1363850 - protein, 11 aa, Mycobacterium tuberculosis
VAGAADAGRTL

SEQ ID NO: 1363851 - protein, 7 aa, Mycobacterium tuberculosis
VAGGALP

SEQ ID NO: 1363852 - protein, 10 aa, Mycobacterium tuberculosis
VAGPTDPYGV

SEQ ID NO: 1363853 - protein, 9 aa, Mycobacterium tuberculosis
VAPDDAQSM

SEQ ID NO: 1363854 - protein, 12 aa, Mycobacterium tuberculosis
VAPSRRSTTSVG

SEQ ID NO: 1363855 - protein, 6 aa, Mycobacterium tuberculosis
VDAPRT

SEQ ID NO: 1363856 - protein, 5 aa, Mycobacterium tuberculosis
VDDAE

SEQ ID NO: 1363857 - protein, 10 aa, Mycobacterium tuberculosis
VDDPSSALRT

SEQ ID NO: 1363858 - protein, 10 aa, Mycobacterium tuberculosis
VDEPAPPARA

SEQ ID NO: 1363859 - protein, 4 aa, Mycobacterium tuberculosis
VDPG

SEQ ID NO: 1363860 - protein, 12 aa, Mycobacterium tuberculosis
VDTRYSSSPTPL

SEQ ID NO: 1363861 - protein, 6 aa, Mycobacterium tuberculosis
VEDSGG

SEQ ID NO: 1363862 - protein, 6 aa, Mycobacterium tuberculosis
VEEGRG

SEQ ID NO: 1363863 - protein, 7 aa, Mycobacterium tuberculosis
VEESYGS

SEQ ID NO: 1363864 - protein, 8 aa, Mycobacterium tuberculosis
VEPDPGTV

SEQ ID NO: 1363865 - protein, 8 aa, Mycobacterium tuberculosis
VERARGRL

SEQ ID NO: 1363866 - protein, 7 aa, Mycobacterium tuberculosis
VESASEH

SEQ ID NO: 1363867 - protein, 6 aa, Mycobacterium tuberculosis
VGADTQ

SEQ ID NO: 1363868 - protein, 8 aa, Mycobacterium tuberculosis
VGAGTTAA

SEQ ID NO: 1363869 - protein, 5 aa, Mycobacterium tuberculosis
VGERL

SEQ ID NO: 1363870 - protein, 12 aa, Mycobacterium tuberculosis
VGESSQTSDRPD

SEQ ID NO: 1363871 - protein, 11 aa, Mycobacterium tuberculosis
VGGGPAGVGRA

SEQ ID NO: 1363872 - protein, 8 aa, Mycobacterium tuberculosis
VGNTAAPD

SEQ ID NO: 1363873 - protein, 5 aa, Mycobacterium tuberculosis
VGSYR

SEQ ID NO: 1363874 - protein, 5 aa, Mycobacterium tuberculosis
VGTAA

SEQ ID NO: 1363875 - protein, 7 aa, Mycobacterium tuberculosis
VGTDNEQ

SEQ ID NO: 1363876 - protein, 4 aa, Mycobacterium tuberculosis
VGTQ

SEQ ID NO: 1363877 - protein, 7 aa, Mycobacterium tuberculosis
VHTGPGT

SEQ ID NO: 1363878 - protein, 8 aa, Mycobacterium tuberculosis
VKDSARDA

SEQ ID NO: 1363879 - protein, 8 aa, Mycobacterium tuberculosis
VKQESTGV

SEQ ID NO: 1363880 - protein, 11 aa, Mycobacterium tuberculosis
VLTSSGRTAVT

SEQ ID NO: 1363881 - protein, 13 aa, Mycobacterium tuberculosis
VNPDRGLRKEASV

SEQ ID NO: 1363882 - protein, 12 aa, Mycobacterium tuberculosis
VNPGEATLSRRG

SEQ ID NO: 1363883 - protein, 6 aa, Mycobacterium tuberculosis
VNSSEQ

SEQ ID NO: 1363884 - protein, 5 aa, Mycobacterium tuberculosis
VPAAT

SEQ ID NO: 1363885 - protein, 4 aa, Mycobacterium tuberculosis
VPAP

SEQ ID NO: 1363886 - protein, 6 aa, Mycobacterium tuberculosis
VPAVPS

SEQ ID NO: 1363887 - protein, 35 aa, Mycobacterium tuberculosis; identical to SEQ ID NO: 154922

SEQ ID NO: 1363888 - protein, 5 aa, Mycobacterium tuberculosis
VPPAG

SEQ ID NO: 1363889 - protein, 7 aa, Mycobacterium tuberculosis
VPPEGNR

SEQ ID NO: 1363890 - protein, 7 aa, Mycobacterium tuberculosis
VPRGPIP

SEQ ID NO: 1363891 - protein, 8 aa, Mycobacterium tuberculosis
VPSPEAGQ

SEQ ID NO: 1363892 - protein, 34 aa, Mycobacterium tuberculosis; identical to SEQ ID NO: 154955

SEQ ID NO: 1363893 - protein, 6 aa, Mycobacterium tuberculosis
VQSPPA

SEQ ID NO: 1363894 - protein, 5 aa, Mycobacterium tuberculosis
VRAES

SEQ ID NO: 1363895 - protein, 11 aa, Mycobacterium tuberculosis
VRGASGSGKTT

SEQ ID NO: 1363896 - protein, 11 aa, Mycobacterium tuberculosis
VRGRPADAGLP

SEQ ID NO: 1363897 - protein, 11 aa, Mycobacterium tuberculosis
VRRNPDHELRR

SEQ ID NO: 1363898 - protein, 5 aa, Mycobacterium tuberculosis
VRSTR

SEQ ID NO: 1363899 - protein, 8 aa, Mycobacterium tuberculosis
VSADGEYR

SEQ ID NO: 1363900 - protein, 18 aa, Mycobacterium tuberculosis
VSARTRRRGQAVGQTERD

SEQ ID NO: 1363901 - protein, 11 aa, Mycobacterium tuberculosis
VSENAGAKPQT

SEQ ID NO: 1363902 - protein, 6 aa, Mycobacterium tuberculosis
VSGEVG

SEQ ID NO: 1363903 - protein, 17 aa, Mycobacterium tuberculosis
VSGQNQPSTSAMPPPGK

SEQ ID NO: 1363904 - protein, 18 aa, Mycobacterium tuberculosis
VSKPSDPVTPATRGPDQR

SEQ ID NO: 1363905 - protein, 11 aa, Mycobacterium tuberculosis
VSMSPSDAASI

SEQ ID NO: 1363906 - protein, 7 aa, Mycobacterium tuberculosis
VSTTASV

SEQ ID NO: 1363907 - protein, 15 aa, Mycobacterium tuberculosis
VTGNPGQGPDHDYAT

SEQ ID NO: 1363908 - protein, 8 aa, Mycobacterium tuberculosis
VTGPTPKP

SEQ ID NO: 1363909 - protein, 9 aa, Mycobacterium tuberculosis
VTPGDERVG

SEQ ID NO: 1363910 - protein, 6 aa, Mycobacterium tuberculosis
VTQPGD

SEQ ID NO: 1363911 - protein, 12 aa, Mycobacterium tuberculosis
WGPSSDPAWKRN

SEQ ID NO: 1363912 - protein, 15 aa, Mycobacterium tuberculosis
WPVEGTKAEKRAERS

SEQ ID NO: 1363913 - protein, 5 aa, Mycobacterium tuberculosis
WQGPS

SEQ ID NO: 1363914 - protein, 10 aa, Mycobacterium tuberculosis
WQQPEANEET

SEQ ID NO: 1363915 - protein, 10 aa, Mycobacterium tuberculosis
WSPTQASGQT

SEQ ID NO: 1363916 - protein, 9 aa, Mycobacterium tuberculosis
YGGDNANGF

SEQ ID NO: 1363917 - protein, 5 aa, Mycobacterium tuberculosis
YGSGP

SEQ ID NO: 1363918 - protein, 8 aa, Mycobacterium tuberculosis
YPDPSGAG

SEQ ID NO: 1363919 - protein, 9 aa, Mycobacterium tuberculosis
YPNGMPGPE

SEQ ID NO: 1363920 - protein, 7 aa, Mycobacterium tuberculosis
YPNQPNV

SEQ ID NO: 1363921 - protein, 4 aa, Mycobacterium tuberculosis
YPRE

SEQ ID NO: 1363922 - protein, 5 aa, Mycobacterium tuberculosis
YQTNY

SEQ ID NO: 1363923 - protein, 18 aa, Mycobacterium tuberculosis
YRGNDKKMRTEEVDAERA

SEQ ID NO: 1363924 - protein, 7 aa, Mycobacterium tuberculosis
YRRPPAE

SEQ ID NO: 1363925 - protein, 6 aa, Mycobacterium tuberculosis
YRTATE

SEQ ID NO: 1363926 - protein, 4 aa, Mycobacterium tuberculosis
YRTT

SEQ ID NO: 1363927 - protein, 6 aa, Mycobacterium tuberculosis
YSATPY

SEQ ID NO: 1363928 - protein, 7 aa, Mycobacterium tuberculosis
YSEHPAA

SEQ ID NO: 1363929 - protein, 8 aa, Mycobacterium tuberculosis
YTTTTTGA

SEQ ID NO: 1363930 - protein, 19 aa, Mycobacterium tuberculosis
AAAAASGTDGAEPGAAEPA

SEQ ID NO: 1363931 - protein, 7 aa, Mycobacterium tuberculosis
AAAAGTS

SEQ ID NO: 1363932 - protein, 8 aa, Mycobacterium tuberculosis
AAADEVST

SEQ ID NO: 1363933 - protein, 11 aa, Mycobacterium tuberculosis
AAAGTNPTVPT

SEQ ID NO: 1363934 - protein, 8 aa, Mycobacterium tuberculosis
AAAIPDAT

SEQ ID NO: 1363935 - protein, 15 aa, Mycobacterium tuberculosis
AAASAPAGAPATAGI

SEQ ID NO: 1363936 - protein, 7 aa, Mycobacterium tuberculosis
AADPTTC

SEQ ID NO: 1363937 - protein, 7 aa, Mycobacterium tuberculosis
AAEQTRP

SEQ ID NO: 1363938 - protein, 4 aa, Mycobacterium tuberculosis
AAER

SEQ ID NO: 1363939 - protein, 7 aa, Mycobacterium tuberculosis
AAPAKRS

SEQ ID NO: 1363940 - protein, 11 aa, Mycobacterium tuberculosis
AAPASNGPQVH

SEQ ID NO: 1363941 - protein, 27 aa, Mycobacterium tuberculosis
AAPPAGLPGPAPVAATPGLSGGSQPMV

SEQ ID NO: 1363942 - protein, 19 aa, Mycobacterium tuberculosis
AAQSSESPQGTPPATEAAP

SEQ ID NO: 1363943 - protein, 7 aa, Mycobacterium tuberculosis
AAQTGGV

SEQ ID NO: 1363944 - protein, 21 aa, Mycobacterium tuberculosis
AARTEPPEPPGAYSAARGRFN

SEQ ID NO: 1363945 - protein, 4 aa, Mycobacterium tuberculosis
AASP

SEQ ID NO: 1363946 - protein, 5 aa, Mycobacterium tuberculosis
AASPL

SEQ ID NO: 1363947 - protein, 6 aa, Mycobacterium tuberculosis
AATADA

SEQ ID NO: 1363948 - protein, 6 aa, Mycobacterium tuberculosis
AAVRPE

SEQ ID NO: 1363949 - protein, 9 aa, Mycobacterium tuberculosis
ADESSSALL

SEQ ID NO: 1363950 - protein, 5 aa, Mycobacterium tuberculosis
ADEVS

SEQ ID NO: 1363951 - protein, 6 aa, Mycobacterium tuberculosis
ADFSGT

SEQ ID NO: 1363952 - protein, 4 aa, Mycobacterium tuberculosis
ADLP

SEQ ID NO: 1363953 - protein, 6 aa, Mycobacterium tuberculosis
ADPTRC

SEQ ID NO: 1363954 - protein, 5 aa, Mycobacterium tuberculosis
ADQRP

SEQ ID NO: 1363955 - protein, 6 aa, Mycobacterium tuberculosis
AEAEPA

SEQ ID NO: 1363956 - protein, 6 aa, Mycobacterium tuberculosis
AGASFT

SEQ ID NO: 1363957 - protein, 10 aa, Mycobacterium tuberculosis
AGETTAPVGP

SEQ ID NO: 1363958 - protein, 12 aa, Mycobacterium tuberculosis
AGEVGGKLDEAT

SEQ ID NO: 1363959 - protein, 13 aa, Mycobacterium tuberculosis
AGGAFRMASGLGH

SEQ ID NO: 1363960 - protein, 16 aa, Mycobacterium tuberculosis
AGGGPSQLASMGSQQA

SEQ ID NO: 1363961 - protein, 7 aa, Mycobacterium tuberculosis
AGGSRPL

SEQ ID NO: 1363962 - protein, 6 aa, Mycobacterium tuberculosis
AGHDED

SEQ ID NO: 1363963 - protein, 14 aa, Mycobacterium tuberculosis
AGHRAPHRGSGFTG

SEQ ID NO: 1363964 - protein, 6 aa, Mycobacterium tuberculosis
AGHSRE

SEQ ID NO: 1363965 - protein, 11 aa, Mycobacterium tuberculosis
AGLAGSQNTGK

SEQ ID NO: 1363966 - protein, 10 aa, Mycobacterium tuberculosis
AGNGGPPVTR

SEQ ID NO: 1363967 - protein, 8 aa, Mycobacterium tuberculosis
AGRAPVGT

SEQ ID NO: 1363968 - protein, 8 aa, Mycobacterium tuberculosis
AGRYGADP

SEQ ID NO: 1363969 - protein, 7 aa, Mycobacterium tuberculosis
AGSGINP

SEQ ID NO: 1363970 - protein, 8 aa, Mycobacterium tuberculosis
AGSSTRYT

SEQ ID NO: 1363971 - protein, 9 aa, Mycobacterium tuberculosis
AGTAAPDEI

SEQ ID NO: 1363972 - protein, 9 aa, Mycobacterium tuberculosis
AGVAPSPDQ

SEQ ID NO: 1363973 - protein, 11 aa, Mycobacterium tuberculosis
AGVQSNDGKAA

SEQ ID NO: 1363974 - protein, 10 aa, Mycobacterium tuberculosis
AHNPPAGVDN

SEQ ID NO: 1363975 - protein, 8 aa, Mycobacterium tuberculosis
AHRPRPAT

SEQ ID NO: 1363976 - protein, 6 aa, Mycobacterium tuberculosis
AIGAGQ

SEQ ID NO: 1363977 - protein, 7 aa, Mycobacterium tuberculosis
AITGKST

SEQ ID NO: 1363978 - protein, 8 aa, Mycobacterium tuberculosis
AKAGLDGF

SEQ ID NO: 1363979 - protein, 12 aa, Mycobacterium tuberculosis
AKDDARKQNRTT

SEQ ID NO: 1363980 - protein, 11 aa, Mycobacterium tuberculosis
AKNPENRYQTA

SEQ ID NO: 1363981 - protein, 14 aa, Mycobacterium tuberculosis
AKPPSTSAVASRTG

SEQ ID NO: 1363982 - protein, 7 aa, Mycobacterium tuberculosis
AKREKQK

SEQ ID NO: 1363983 - protein, 7 aa, Mycobacterium tuberculosis
AKYPTGP

SEQ ID NO: 1363984 - protein, 14 aa, Mycobacterium tuberculosis
ALPGPFSPSSASVT

SEQ ID NO: 1363985 - protein, 17 aa, Mycobacterium tuberculosis
ALPSPQNGEQPNPTGPA

SEQ ID NO: 1363986 - protein, 5 aa, Mycobacterium tuberculosis
ALPVP

SEQ ID NO: 1363987 - protein, 6 aa, Mycobacterium tuberculosis
AMPPSS

SEQ ID NO: 1363988 - protein, 12 aa, Mycobacterium tuberculosis
ANSYGAAAPRVV

SEQ ID NO: 1363989 - protein, 4 aa, Mycobacterium tuberculosis
APAA

SEQ ID NO: 1363990 - protein, 13 aa, Mycobacterium tuberculosis
APAGVRSPAAVPP

SEQ ID NO: 1363991 - protein, 8 aa, Mycobacterium tuberculosis
APAPDGGI

SEQ ID NO: 1363992 - protein, 13 aa, Mycobacterium tuberculosis
APDAQSDNFSGVA

SEQ ID NO: 1363993 - protein, 23 aa, Mycobacterium tuberculosis
APEHGPGMPRVSDGRAPSTPDEV

SEQ ID NO: 1363994 - protein, 7 aa, Mycobacterium tuberculosis
APPSRGT

SEQ ID NO: 1363995 - protein, 5 aa, Mycobacterium tuberculosis
APSNE

SEQ ID NO: 1363996 - protein, 8 aa, Mycobacterium tuberculosis
AQAVGGLG

SEQ ID NO: 1363997 - protein, 4 aa, Mycobacterium tuberculosis
AQNG

SEQ ID NO: 1363998 - protein, 6 aa, Mycobacterium tuberculosis
AQQSYF

SEQ ID NO: 1363999 - protein, 8 aa, Mycobacterium tuberculosis
AQTAGGGS

SEQ ID NO: 1364000 - protein, 6 aa, Mycobacterium tuberculosis
ARDSNV

SEQ ID NO: 1364001 - protein, 8 aa, Mycobacterium tuberculosis
ARHPGGGV

SEQ ID NO: 1364002 - protein, 17 aa, Mycobacterium tuberculosis
ARRREKAGSPPPDKPMT

SEQ ID NO: 1364003 - protein, 16 aa, Mycobacterium tuberculosis
ASAESSAEKARDSEDR

SEQ ID NO: 1364004 - protein, 13 aa, Mycobacterium tuberculosis
ASASADSGAPTDS

SEQ ID NO: 1364005 - protein, 12 aa, Mycobacterium tuberculosis
ASATQSQPPLPA

SEQ ID NO: 1364006 - protein, 15 aa, Mycobacterium tuberculosis
ASGPRPRPDAVAAEP

SEQ ID NO: 1364007 - protein, 6 aa, Mycobacterium tuberculosis
ASIPGM

SEQ ID NO: 1364008 - protein, 7 aa, Mycobacterium tuberculosis
ASPDPAL

SEQ ID NO: 1364009 - protein, 7 aa, Mycobacterium tuberculosis
ASQPGCA

SEQ ID NO: 1364010 - protein, 11 aa, Mycobacterium tuberculosis
ASTAAASGPAI

SEQ ID NO: 1364011 - protein, 7 aa, Mycobacterium tuberculosis
ASTGTKV

SEQ ID NO: 1364012 - protein, 12 aa, Mycobacterium tuberculosis
ASTLRRSSLESK

SEQ ID NO: 1364013 - protein, 12 aa, Mycobacterium tuberculosis
ATADGADKSGLT

SEQ ID NO: 1364014 - protein, 8 aa, Mycobacterium tuberculosis
ATAPRRLS

SEQ ID NO: 1364015 - protein, 5 aa, Mycobacterium tuberculosis
ATEPS

SEQ ID NO: 1364016 - protein, 12 aa, Mycobacterium tuberculosis
ATNREVDPDGAV

SEQ ID NO: 1364017 - protein, 11 aa, Mycobacterium tuberculosis
ATPDNPYPTTT

SEQ ID NO: 1364018 - protein, 5 aa, Mycobacterium tuberculosis
ATPVQ

SEQ ID NO: 1364019 - protein, 7 aa, Mycobacterium tuberculosis
ATRGRSV

SEQ ID NO: 1364020 - protein, 6 aa, Mycobacterium tuberculosis
ATRRRR

SEQ ID NO: 1364021 - protein, 7 aa, Mycobacterium tuberculosis
ATSSDDG

SEQ ID NO: 1364022 - protein, 9 aa, Mycobacterium tuberculosis
ATTAEPPAH

SEQ ID NO: 1364023 - protein, 6 aa, Mycobacterium tuberculosis
AVAAPT

SEQ ID NO: 1364024 - protein, 10 aa, Mycobacterium tuberculosis
AVAAPTTGLA

SEQ ID NO: 1364025 - protein, 28 aa, Mycobacterium tuberculosis
AVDSPADDGVAPRLAGPEGANGEFDTPI

SEQ ID NO: 1364026 - protein, 10 aa, Mycobacterium tuberculosis
AVEPTDQGAR

SEQ ID NO: 1364027 - protein, 10 aa, Mycobacterium tuberculosis
AVRAAGRTPL

SEQ ID NO: 1364028 - protein, 12 aa, Mycobacterium tuberculosis
AVSGETQQKGSQ

SEQ ID NO: 1364029 - protein, 22 aa, Mycobacterium tuberculosis
AVTSSTALRTSLDGGTDQYQPA

SEQ ID NO: 1364030 - protein, 13 aa, Mycobacterium tuberculosis
AYDDKAKKTTKAV

SEQ ID NO: 1364031 - protein, 10 aa, Mycobacterium tuberculosis
CEQPNAGACS

SEQ ID NO: 1364032 - protein, 4 aa, Mycobacterium tuberculosis
CSND

SEQ ID NO: 1364033 - protein, 6 aa, Mycobacterium tuberculosis
DAASQR

SEQ ID NO: 1364034 - protein, 8 aa, Mycobacterium tuberculosis
DAGARTAG

SEQ ID NO: 1364035 - protein, 12 aa, Mycobacterium tuberculosis
DANYEGEEDVNG

SEQ ID NO: 1364036 - protein, 5 aa, Mycobacterium tuberculosis
DDAET

SEQ ID NO: 1364037 - protein, 8 aa, Mycobacterium tuberculosis
DDAPVPVN

SEQ ID NO: 1364038 - protein, 12 aa, Mycobacterium tuberculosis
DDVDPASTAAVG

SEQ ID NO: 1364039 - protein, 22 aa, Mycobacterium tuberculosis
DEAPVSAAPRTSAPNSETYTRR

SEQ ID NO: 1364040 - protein, 4 aa, Mycobacterium tuberculosis
DEAT

SEQ ID NO: 1364041 - protein, 5 aa, Mycobacterium tuberculosis
DERGV

SEQ ID NO: 1364042 - protein, 8 aa, Mycobacterium tuberculosis
DFGKPDGY

SEQ ID NO: 1364043 - protein, 14 aa, Mycobacterium tuberculosis
DFSPEEQQGSSQIG

SEQ ID NO: 1364044 - protein, 9 aa, Mycobacterium tuberculosis
DGAGPIPEL

SEQ ID NO: 1364045 - protein, 9 aa, Mycobacterium tuberculosis
DGGQLKKYG

SEQ ID NO: 1364046 - protein, 4 aa, Mycobacterium tuberculosis
DGMS

SEQ ID NO: 1364047 - protein, 5 aa, Mycobacterium tuberculosis
DGRGS

SEQ ID NO: 1364048 - protein, 8 aa, Mycobacterium tuberculosis
DGSPDAAL

SEQ ID NO: 1364049 - protein, 9 aa, Mycobacterium tuberculosis
DGVGVTGDT

SEQ ID NO: 1364050 - protein, 10 aa, Mycobacterium tuberculosis
DIPTDARADK

SEQ ID NO: 1364051 - protein, 8 aa, Mycobacterium tuberculosis
DISDGKRP

SEQ ID NO: 1364052 - protein, 24 aa, Mycobacterium tuberculosis
DKKPPLPGGDPSSSVLNRVEYGNR

SEQ ID NO: 1364053 - protein, 5 aa, Mycobacterium tuberculosis
DKPFE

SEQ ID NO: 1364054 - protein, 5 aa, Mycobacterium tuberculosis
DLGAS

SEQ ID NO: 1364055 - protein, 10 aa, Mycobacterium tuberculosis
DLPASGGLYP

SEQ ID NO: 1364056 - protein, 19 aa, Mycobacterium tuberculosis
DNASRGRRRGHLWPTDGSA

SEQ ID NO: 1364057 - protein, 7 aa, Mycobacterium tuberculosis
DNATAMG

SEQ ID NO: 1364058 - protein, 6 aa, Mycobacterium tuberculosis
DNEGSR

SEQ ID NO: 1364059 - protein, 14 aa, Mycobacterium tuberculosis
DNEPQGVAGGGKAV

SEQ ID NO: 1364060 - protein, 18 aa, Mycobacterium tuberculosis
DPAGPASSWARTVKPGAT

SEQ ID NO: 1364061 - protein, 6 aa, Mycobacterium tuberculosis
DPDTPV

SEQ ID NO: 1364062 - protein, 11 aa, Mycobacterium tuberculosis
DPEDDLTPARY

SEQ ID NO: 1364063 - protein, 6 aa, Mycobacterium tuberculosis
DPGAAV

SEQ ID NO: 1364064 - protein, 6 aa, Mycobacterium tuberculosis
DPKRGH

SEQ ID NO: 1364065 - protein, 9 aa, Mycobacterium tuberculosis
DPNGSNTEF

SEQ ID NO: 1364066 - protein, 21 aa, Mycobacterium tuberculosis
DPPRKSRTKASEQELASPYRG

SEQ ID NO: 1364067 - protein, 5 aa, Mycobacterium tuberculosis
DPPTL

SEQ ID NO: 1364068 - protein, 6 aa, Mycobacterium tuberculosis
DQDPGQ

SEQ ID NO: 1364069 - protein, 8 aa, Mycobacterium tuberculosis
DQPLGEKA

SEQ ID NO: 1364070 - protein, 7 aa, Mycobacterium tuberculosis
DRAPASV

SEQ ID NO: 1364071 - protein, 8 aa, Mycobacterium tuberculosis
DRCEEKAE

SEQ ID NO: 1364072 - protein, 5 aa, Mycobacterium tuberculosis
DRNQH

SEQ ID NO: 1364073 - protein, 27 aa, Mycobacterium tuberculosis
DRPAPAKNTSQAKARAKARKAKAPKLV

SEQ ID NO: 1364074 - protein, 7 aa, Mycobacterium tuberculosis
DRPEQPR

SEQ ID NO: 1364075 - protein, 9 aa, Mycobacterium tuberculosis
DSAREMEHN

SEQ ID NO: 1364076 - protein, 7 aa, Mycobacterium tuberculosis
DSGPQTF

SEQ ID NO: 1364077 - protein, 6 aa, Mycobacterium tuberculosis
DSRETW

SEQ ID NO: 1364078 - protein, 8 aa, Mycobacterium tuberculosis
DVPEEQPA

SEQ ID NO: 1364079 - protein, 13 aa, Mycobacterium tuberculosis
EAAKYGATTESSL

SEQ ID NO: 1364080 - protein, 4 aa, Mycobacterium tuberculosis
EAAP

SEQ ID NO: 1364081 - protein, 9 aa, Mycobacterium tuberculosis
EAATRERRG

SEQ ID NO: 1364082 - protein, 6 aa, Mycobacterium tuberculosis
EADTRV

SEQ ID NO: 1364083 - protein, 8 aa, Mycobacterium tuberculosis
EAERRQWS

SEQ ID NO: 1364084 - protein, 10 aa, Mycobacterium tuberculosis
EAPLEATGRG

SEQ ID NO: 1364085 - protein, 6 aa, Mycobacterium tuberculosis
EARSEH

SEQ ID NO: 1364086 - protein, 7 aa, Mycobacterium tuberculosis
EATPEDK

SEQ ID NO: 1364087 - protein, 9 aa, Mycobacterium tuberculosis
EAVKGTPLQ

SEQ ID NO: 1364088 - protein, 9 aa, Mycobacterium tuberculosis
EGDDCPDST

SEQ ID NO: 1364089 - protein, 25 aa, Mycobacterium tuberculosis
EGLRAAQRGQTGTVTSTDYTGSREL

SEQ ID NO: 1364090 - protein, 13 aa, Mycobacterium tuberculosis
EGNDDPRTQVATH

SEQ ID NO: 1364091 - protein, 7 aa, Mycobacterium tuberculosis
EGPMTPK

SEQ ID NO: 1364092 - protein, 10 aa, Mycobacterium tuberculosis
EGSDGTEIDR

SEQ ID NO: 1364093 - protein, 5 aa, Mycobacterium tuberculosis
EGTET

SEQ ID NO: 1364094 - protein, 5 aa, Mycobacterium tuberculosis
EHGEG

SEQ ID NO: 1364095 - protein, 8 aa, Mycobacterium tuberculosis
EHGSTGDR

SEQ ID NO: 1364096 - protein, 6 aa, Mycobacterium tuberculosis
EIEPGA

SEQ ID NO: 1364097 - protein, 7 aa, Mycobacterium tuberculosis
EKSLAEA

SEQ ID NO: 1364098 - protein, 10 aa, Mycobacterium tuberculosis
ELGPQQDTDE

SEQ ID NO: 1364099 - protein, 7 aa, Mycobacterium tuberculosis
EPAKTGA

SEQ ID NO: 1364100 - protein, 19 aa, Mycobacterium tuberculosis
EPGTGSPQPTGTILAELPL

SEQ ID NO: 1364101 - protein, 10 aa, Mycobacterium tuberculosis
EPSEAQTVSA

SEQ ID NO: 1364102 - protein, 8 aa, Mycobacterium tuberculosis
EQVTSPQC

SEQ ID NO: 1364103 - protein, 8 aa, Mycobacterium tuberculosis
ERDADKPA

SEQ ID NO: 1364104 - protein, 6 aa, Mycobacterium tuberculosis
ESEASR

SEQ ID NO: 1364105 - protein, 16 aa, Mycobacterium tuberculosis
ESVPVEKTAGDRVAGA

SEQ ID NO: 1364106 - protein, 7 aa, Mycobacterium tuberculosis
ETGATVS

SEQ ID NO: 1364107 - protein, 16 aa, Mycobacterium tuberculosis
ETKGNPWGQNASDRTN

SEQ ID NO: 1364108 - protein, 11 aa, Mycobacterium tuberculosis
ETSDTQRDTVK

SEQ ID NO: 1364109 - protein, 15 aa, Mycobacterium tuberculosis
EVRPSKGLQVFSFTY

SEQ ID NO: 1364110 - protein, 11 aa, Mycobacterium tuberculosis
EVSTDHAERER

SEQ ID NO: 1364111 - protein, 17 aa, Mycobacterium tuberculosis
EYPRRADDGNAKFADDL

SEQ ID NO: 1364112 - protein, 29 aa, Mycobacterium tuberculosis
FDAAPDADSEGDSKAAKTDEPRPAKRSTL

SEQ ID NO: 1364113 - protein, 5 aa, Mycobacterium tuberculosis
FDSDT

SEQ ID NO: 1364114 - protein, 8 aa, Mycobacterium tuberculosis
FGQAQNQA

SEQ ID NO: 1364115 - protein, 15 aa, Mycobacterium tuberculosis
FQPQENAASDRTDAE

SEQ ID NO: 1364116 - protein, 8 aa, Mycobacterium tuberculosis
FSPGEQVT

SEQ ID NO: 1364117 - protein, 9 aa, Mycobacterium tuberculosis
FSTSDPPDK

SEQ ID NO: 1364118 - protein, 11 aa, Mycobacterium tuberculosis
FTPNGIPADVT

SEQ ID NO: 1364119 - protein, 9 aa, Mycobacterium tuberculosis
FTPNGVPEH

SEQ ID NO: 1364120 - protein, 6 aa, Mycobacterium tuberculosis
GAAEYR

SEQ ID NO: 1364121 - protein, 9 aa, Mycobacterium tuberculosis
GADASSSEI

SEQ ID NO: 1364122 - protein, 18 aa, Mycobacterium tuberculosis
GADLGTAQTKATNASETL

SEQ ID NO: 1364123 - protein, 7 aa, Mycobacterium tuberculosis
GAGGNSY

SEQ ID NO: 1364124 - protein, 4 aa, Mycobacterium tuberculosis
GAGS

SEQ ID NO: 1364125 - protein, 25 aa, Mycobacterium tuberculosis
GAPGSAPREYDTDTSKYTYTGAGGV

SEQ ID NO: 1364126 - protein, 8 aa, Mycobacterium tuberculosis
GAPPYRAD

SEQ ID NO: 1364127 - protein, 26 aa, Mycobacterium tuberculosis
GARRPLRTRPRNKSPITAAGTEVIER

SEQ ID NO: 1364128 - protein, 6 aa, Mycobacterium tuberculosis
GATGPG

SEQ ID NO: 1364129 - protein, 9 aa, Mycobacterium tuberculosis
GATPDTDYA

SEQ ID NO: 1364130 - protein, 9 aa, Mycobacterium tuberculosis
GAVASSSGI

SEQ ID NO: 1364131 - protein, 5 aa, Mycobacterium tuberculosis
GAVST

SEQ ID NO: 1364132 - protein, 18 aa, Mycobacterium tuberculosis
GAWPTDGPPQTGTLGSGQ

SEQ ID NO: 1364133 - protein, 8 aa, Mycobacterium tuberculosis
GDAGSGTL

SEQ ID NO: 1364134 - protein, 7 aa, Mycobacterium tuberculosis
GDATKSD

SEQ ID NO: 1364135 - protein, 13 aa, Mycobacterium tuberculosis
GDEQAVGAPLTTT

SEQ ID NO: 1364136 - protein, 15 aa, Mycobacterium tuberculosis
GDNPATAKAIAQEAG

SEQ ID NO: 1364137 - protein, 9 aa, Mycobacterium tuberculosis
GDPATPEGI

SEQ ID NO: 1364138 - protein, 8 aa, Mycobacterium tuberculosis
GDTRNRGR

SEQ ID NO: 1364139 - protein, 4 aa, Mycobacterium tuberculosis
GEFG

SEQ ID NO: 1364140 - protein, 18 aa, Mycobacterium tuberculosis
GEGFENTTGTLAPRAAVP

SEQ ID NO: 1364141 - protein, 23 aa, Mycobacterium tuberculosis
GESGSEPAGERSADPGEERTESY

SEQ ID NO: 1364142 - protein, 9 aa, Mycobacterium tuberculosis
GGEVTPDSA

SEQ ID NO: 1364143 - protein, 4 aa, Mycobacterium tuberculosis
GGGA

SEQ ID NO: 1364144 - protein, 6 aa, Mycobacterium tuberculosis
GGGARG

SEQ ID NO: 1364145 - protein, 4 aa, Mycobacterium tuberculosis
GGPV

SEQ ID NO: 1364146 - protein, 8 aa, Mycobacterium tuberculosis
GGSAGGHL

SEQ ID NO: 1364147 - protein, 9 aa, Mycobacterium tuberculosis
GGSKPYGYA

SEQ ID NO: 1364148 - protein, 6 aa, Mycobacterium tuberculosis
GGWEPG

SEQ ID NO: 1364149 - protein, 34 aa, Mycobacterium tuberculosis; identical to SEQ ID NO: 151272

SEQ ID NO: 1364150 - protein, 13 aa, Mycobacterium tuberculosis
GHGEHQDGDDVGE

SEQ ID NO: 1364151 - protein, 6 aa, Mycobacterium tuberculosis
GKIAGN

SEQ ID NO: 1364152 - protein, 11 aa, Mycobacterium tuberculosis
GKQYSSGGGAV

SEQ ID NO: 1364153 - protein, 7 aa, Mycobacterium tuberculosis
GKSPGGI

SEQ ID NO: 1364154 - protein, 11 aa, Mycobacterium tuberculosis
GLETRARRQSV

SEQ ID NO: 1364155 - protein, 6 aa, Mycobacterium tuberculosis
GLGGGN

SEQ ID NO: 1364156 - protein, 10 aa, Mycobacterium tuberculosis
GLQTNPNSLS

SEQ ID NO: 1364157 - protein, 9 aa, Mycobacterium tuberculosis
GNDDPANRK

SEQ ID NO: 1364158 - protein, 4 aa, Mycobacterium tuberculosis
GPAA

SEQ ID NO: 1364159 - protein, 10 aa, Mycobacterium tuberculosis
GPAASREHRR

SEQ ID NO: 1364160 - protein, 7 aa, Mycobacterium tuberculosis
GPAATAS

SEQ ID NO: 1364161 - protein, 6 aa, Mycobacterium tuberculosis
GPALSR

SEQ ID NO: 1364162 - protein, 9 aa, Mycobacterium tuberculosis
GPGPGGLAS

SEQ ID NO: 1364163 - protein, 13 aa, Mycobacterium tuberculosis
GPITGGGRATHLR

SEQ ID NO: 1364164 - protein, 6 aa, Mycobacterium tuberculosis
GPLTPA

SEQ ID NO: 1364165 - protein, 9 aa, Mycobacterium tuberculosis
GPNAPSPSQ

SEQ ID NO: 1364166 - protein, 4 aa, Mycobacterium tuberculosis
GPPL

SEQ ID NO: 1364167 - protein, 9 aa, Mycobacterium tuberculosis
GQGAGRSRA

SEQ ID NO: 1364168 - protein, 7 aa, Mycobacterium tuberculosis
GQNDPKL

SEQ ID NO: 1364169 - protein, 12 aa, Mycobacterium tuberculosis
GQPASGRTDNLG

SEQ ID NO: 1364170 - protein, 29 aa, Mycobacterium tuberculosis
GQQDRAGKSWPGSTPKPQEDPVGVAPSAS

SEQ ID NO: 1364171 - protein, 22 aa, Mycobacterium tuberculosis
GRAASNAADSLGRKITEWRQPS

SEQ ID NO: 1364172 - protein, 6 aa, Mycobacterium tuberculosis
GRDGGD

SEQ ID NO: 1364173 - protein, 26 aa, Mycobacterium tuberculosis
GREGRTEVPAGPLADPVNGQPRPAAL

SEQ ID NO: 1364174 - protein, 21 aa, Mycobacterium tuberculosis
GRRQQGVGNQVPPSPRGEGAE

SEQ ID NO: 1364175 - protein, 7 aa, Mycobacterium tuberculosis
GSGVRAY

SEQ ID NO: 1364176 - protein, 11 aa, Mycobacterium tuberculosis
GTKRGPIPSYD

SEQ ID NO: 1364177 - protein, 11 aa, Mycobacterium tuberculosis
GTNPPANQTSA

SEQ ID NO: 1364178 - protein, 6 aa, Mycobacterium tuberculosis
GTQQGV

SEQ ID NO: 1364179 - protein, 8 aa, Mycobacterium tuberculosis
GTSSTYKD

SEQ ID NO: 1364180 - protein, 12 aa, Mycobacterium tuberculosis
GTVKSEDQIPDE

SEQ ID NO: 1364181 - protein, 12 aa, Mycobacterium tuberculosis
GTYTTGAQQQST

SEQ ID NO: 1364182 - protein, 10 aa, Mycobacterium tuberculosis
GVPSQNPNLI

SEQ ID NO: 1364183 - protein, 7 aa, Mycobacterium tuberculosis
GVSDHSA

SEQ ID NO: 1364184 - protein, 14 aa, Mycobacterium tuberculosis
GWYTDPDGSAGQRY

SEQ ID NO: 1364185 - protein, 6 aa, Mycobacterium tuberculosis
GYTPEG

SEQ ID NO: 1364186 - protein, 6 aa, Mycobacterium tuberculosis
HDDNDT

SEQ ID NO: 1364187 - protein, 7 aa, Mycobacterium tuberculosis
HDTGNAM

SEQ ID NO: 1364188 - protein, 20 aa, Mycobacterium tuberculosis
HEIRTGAAAAAQALGPGALG

SEQ ID NO: 1364189 - protein, 4 aa, Mycobacterium tuberculosis
HGPI

SEQ ID NO: 1364190 - protein, 26 aa, Mycobacterium tuberculosis
HNLAGGRDSAAKTGTTQFGDTTANKD

SEQ ID NO: 1364191 - protein, 5 aa, Mycobacterium tuberculosis
HPDSE

SEQ ID NO: 1364192 - protein, 7 aa, Mycobacterium tuberculosis
HQAAQRE

SEQ ID NO: 1364193 - protein, 12 aa, Mycobacterium tuberculosis
HRPPPLPPQQER

SEQ ID NO: 1364194 - protein, 16 aa, Mycobacterium tuberculosis
HRRKAPIPAPKPPHTK

SEQ ID NO: 1364195 - protein, 8 aa, Mycobacterium tuberculosis
HSDPANYG

SEQ ID NO: 1364196 - protein, 13 aa, Mycobacterium tuberculosis
HTNTPGSKNPKRW

SEQ ID NO: 1364197 - protein, 8 aa, Mycobacterium tuberculosis
HYPDRGAP

SEQ ID NO: 1364198 - protein, 9 aa, Mycobacterium tuberculosis
IDGKTNAEA

SEQ ID NO: 1364199 - protein, 9 aa, Mycobacterium tuberculosis
IDGNPATSW

SEQ ID NO: 1364200 - protein, 4 aa, Mycobacterium tuberculosis
IGAG

SEQ ID NO: 1364201 - protein, 4 aa, Mycobacterium tuberculosis
IGGA

SEQ ID NO: 1364202 - protein, 5 aa, Mycobacterium tuberculosis
IGSEG

SEQ ID NO: 1364203 - protein, 5 aa, Mycobacterium tuberculosis
IGSES

SEQ ID NO: 1364204 - protein, 10 aa, Mycobacterium tuberculosis
IGTGGSGGLF

SEQ ID NO: 1364205 - protein, 12 aa, Mycobacterium tuberculosis
IPGGAQDGVKRV

SEQ ID NO: 1364206 - protein, 19 aa, Mycobacterium tuberculosis
IPQNPGAGEPQNPFGSLGS

SEQ ID NO: 1364207 - protein, 4 aa, Mycobacterium tuberculosis
IQRN

SEQ ID NO: 1364208 - protein, 12 aa, Mycobacterium tuberculosis
ISERDDAENARV

SEQ ID NO: 1364209 - protein, 6 aa, Mycobacterium tuberculosis
ITAESR

SEQ ID NO: 1364210 - protein, 24 aa, Mycobacterium tuberculosis
ITAPAPRPKFDPYGQYGRYGQYGQ

SEQ ID NO: 1364211 - protein, 7 aa, Mycobacterium tuberculosis
ITARRQD

SEQ ID NO: 1364212 - protein, 9 aa, Mycobacterium tuberculosis
ITRDHREPV

SEQ ID NO: 1364213 - protein, 11 aa, Mycobacterium tuberculosis
KAGGDTSTLGV

SEQ ID NO: 1364214 - protein, 9 aa, Mycobacterium tuberculosis
KASTDPQAR

SEQ ID NO: 1364215 - protein, 8 aa, Mycobacterium tuberculosis
KDESPNVY

SEQ ID NO: 1364216 - protein, 17 aa, Mycobacterium tuberculosis
KDPSGAPLRSGFPDPNL

SEQ ID NO: 1364217 - protein, 8 aa, Mycobacterium tuberculosis
KEGNTDQR

SEQ ID NO: 1364218 - protein, 9 aa, Mycobacterium tuberculosis
KEKDGGERR

SEQ ID NO: 1364219 - protein, 12 aa, Mycobacterium tuberculosis
KENSNDVAAGRR

SEQ ID NO: 1364220 - protein, 6 aa, Mycobacterium tuberculosis
KEPKRE

SEQ ID NO: 1364221 - protein, 4 aa, Mycobacterium tuberculosis
KGAP

SEQ ID NO: 1364222 - protein, 6 aa, Mycobacterium tuberculosis
KGGGLS

SEQ ID NO: 1364223 - protein, 14 aa, Mycobacterium tuberculosis
KGKPMAADADLDGL

SEQ ID NO: 1364224 - protein, 18 aa, Mycobacterium tuberculosis
KIAGRSDGQTIPASLTRN

SEQ ID NO: 1364225 - protein, 9 aa, Mycobacterium tuberculosis
KKLRQSTNQ

SEQ ID NO: 1364226 - protein, 6 aa, Mycobacterium tuberculosis
KPDDGH

SEQ ID NO: 1364227 - protein, 6 aa, Mycobacterium tuberculosis
KPSWIG

SEQ ID NO: 1364228 - protein, 7 aa, Mycobacterium tuberculosis
KPTSPPV

SEQ ID NO: 1364229 - protein, 6 aa, Mycobacterium tuberculosis
KSMSGP

SEQ ID NO: 1364230 - protein, 8 aa, Mycobacterium tuberculosis
KTGTLTAN

SEQ ID NO: 1364231 - protein, 4 aa, Mycobacterium tuberculosis
KTYP

SEQ ID NO: 1364232 - protein, 9 aa, Mycobacterium tuberculosis
LADTGLPAA

SEQ ID NO: 1364233 - protein, 5 aa, Mycobacterium tuberculosis
LAGAE

SEQ ID NO: 1364234 - protein, 5 aa, Mycobacterium tuberculosis
LARRE

SEQ ID NO: 1364235 - protein, 5 aa, Mycobacterium tuberculosis
LASDD

SEQ ID NO: 1364236 - protein, 7 aa, Mycobacterium tuberculosis
LATDATA

SEQ ID NO: 1364237 - protein, 4 aa, Mycobacterium tuberculosis
LDPA

SEQ ID NO: 1364238 - protein, 8 aa, Mycobacterium tuberculosis
LDRGQEAG

SEQ ID NO: 1364239 - protein, 10 aa, Mycobacterium tuberculosis
LETGELSPYP

SEQ ID NO: 1364240 - protein, 15 aa, Mycobacterium tuberculosis
LGQSGQRPGRRHVPA

SEQ ID NO: 1364241 - protein, 9 aa, Mycobacterium tuberculosis
LKDPRGNPV

SEQ ID NO: 1364242 - protein, 5 aa, Mycobacterium tuberculosis
LNGGG

SEQ ID NO: 1364243 - protein, 6 aa, Mycobacterium tuberculosis
LNTEDR

SEQ ID NO: 1364244 - protein, 16 aa, Mycobacterium tuberculosis
LPADDGAPLAAAGGSR

SEQ ID NO: 1364245 - protein, 8 aa, Mycobacterium tuberculosis
LPDDQRKE

SEQ ID NO: 1364246 - protein, 8 aa, Mycobacterium tuberculosis
LPGTDRRN

SEQ ID NO: 1364247 - protein, 15 aa, Mycobacterium tuberculosis
LPPPPPQPGIDCRAA

SEQ ID NO: 1364248 - protein, 6 aa, Mycobacterium tuberculosis
LPTSGS

SEQ ID NO: 1364249 - protein, 7 aa, Mycobacterium tuberculosis
LPVPPSM

SEQ ID NO: 1364250 - protein, 7 aa, Mycobacterium tuberculosis
LQPPPEV

SEQ ID NO: 1364251 - protein, 8 aa, Mycobacterium tuberculosis
LRPPERAQ

SEQ ID NO: 1364252 - protein, 14 aa, Mycobacterium tuberculosis
LRSGVGSPTVFATS

SEQ ID NO: 1364253 - protein, 5 aa, Mycobacterium tuberculosis
LRSSG

SEQ ID NO: 1364254 - protein, 6 aa, Mycobacterium tuberculosis
LSAGDT

SEQ ID NO: 1364255 - protein, 13 aa, Mycobacterium tuberculosis
LSEATAAAAIPTT

SEQ ID NO: 1364256 - protein, 13 aa, Mycobacterium tuberculosis
LSEDGKGGPPNNG

SEQ ID NO: 1364257 - protein, 11 aa, Mycobacterium tuberculosis
LSERAEGPITA

SEQ ID NO: 1364258 - protein, 5 aa, Mycobacterium tuberculosis
LSGGQ

SEQ ID NO: 1364259 - protein, 25 aa, Mycobacterium tuberculosis
LSGPSNVGVEEEDTDAVDTTPTPVV

SEQ ID NO: 1364260 - protein, 9 aa, Mycobacterium tuberculosis
LTGPGGATQ

SEQ ID NO: 1364261 - protein, 6 aa, Mycobacterium tuberculosis
LTNAPQ

SEQ ID NO: 1364262 - protein, 14 aa, Mycobacterium tuberculosis
LTRQDSSDLPPTTE

SEQ ID NO: 1364263 - protein, 18 aa, Mycobacterium tuberculosis
LTTDNQMSYNDSRAEGTR

SEQ ID NO: 1364264 - protein, 8 aa, Mycobacterium tuberculosis
MAKNPAER

SEQ ID NO: 1364265 - protein, 6 aa, Mycobacterium tuberculosis
MPTPAE

SEQ ID NO: 1364266 - protein, 11 aa, Mycobacterium tuberculosis
MSDPPRAAAAS

SEQ ID NO: 1364267 - protein, 11 aa, Mycobacterium tuberculosis
NARGGPGGAPG

SEQ ID NO: 1364268 - protein, 4 aa, Mycobacterium tuberculosis
NDPR

SEQ ID NO: 1364269 - protein, 7 aa, Mycobacterium tuberculosis
NGQPTIS

SEQ ID NO: 1364270 - protein, 4 aa, Mycobacterium tuberculosis
NPDA

SEQ ID NO: 1364271 - protein, 8 aa, Mycobacterium tuberculosis
NPNNPNGG

SEQ ID NO: 1364272 - protein, 6 aa, Mycobacterium tuberculosis
NPPPVP

SEQ ID NO: 1364273 - protein, 19 aa, Mycobacterium tuberculosis
NPTAAMSQDELSGRVAALT

SEQ ID NO: 1364274 - protein, 6 aa, Mycobacterium tuberculosis
NQSTAL

SEQ ID NO: 1364275 - protein, 5 aa, Mycobacterium tuberculosis
NSGPI

SEQ ID NO: 1364276 - protein, 9 aa, Mycobacterium tuberculosis
NTEPAAGSV

SEQ ID NO: 1364277 - protein, 14 aa, Mycobacterium tuberculosis
PAKSQQPTGTGGQR

SEQ ID NO: 1364278 - protein, 16 aa, Mycobacterium tuberculosis
PAPQPSQLRPGRVPPA

SEQ ID NO: 1364279 - protein, 6 aa, Mycobacterium tuberculosis
PATEPL

SEQ ID NO: 1364280 - protein, 5 aa, Mycobacterium tuberculosis
PDEND

SEQ ID NO: 1364281 - protein, 8 aa, Mycobacterium tuberculosis
PDPTPQPL

SEQ ID NO: 1364282 - protein, 15 aa, Mycobacterium tuberculosis
PDSRPARPVSAEGGY

SEQ ID NO: 1364283 - protein, 8 aa, Mycobacterium tuberculosis
PEAVPPDV

SEQ ID NO: 1364284 - protein, 25 aa, Mycobacterium tuberculosis
PEPDPPPQAAPWPQQAPDGPGFSPP

SEQ ID NO: 1364285 - protein, 4 aa, Mycobacterium tuberculosis
PEQV

SEQ ID NO: 1364286 - protein, 5 aa, Mycobacterium tuberculosis
PEREP

SEQ ID NO: 1364287 - protein, 8 aa, Mycobacterium tuberculosis
PGAPRLPK

SEQ ID NO: 1364288 - protein, 7 aa, Mycobacterium tuberculosis
PGDVATA

SEQ ID NO: 1364289 - protein, 18 aa, Mycobacterium tuberculosis
PGEKIPVDGEVTDGRAAV

SEQ ID NO: 1364290 - protein, 12 aa, Mycobacterium tuberculosis
PGGGNFTATPAR

SEQ ID NO: 1364291 - protein, 5 aa, Mycobacterium tuberculosis
PGGSR

SEQ ID NO: 1364292 - protein, 9 aa, Mycobacterium tuberculosis
PGKEDDEPI

SEQ ID NO: 1364293 - protein, 4 aa, Mycobacterium tuberculosis
PGLP

SEQ ID NO: 1364294 - protein, 8 aa, Mycobacterium tuberculosis
PGLPGLPS

SEQ ID NO: 1364295 - protein, 9 aa, Mycobacterium tuberculosis
PGVRPGSGA

SEQ ID NO: 1364296 - protein, 7 aa, Mycobacterium tuberculosis
PHNSNSL

SEQ ID NO: 1364297 - protein, 8 aa, Mycobacterium tuberculosis
PHQSGGGA

SEQ ID NO: 1364298 - protein, 9 aa, Mycobacterium tuberculosis
PLDPSDPRD

SEQ ID NO: 1364299 - protein, 46 aa, Mycobacterium tuberculosis; identical to SEQ ID NO: 152913

SEQ ID NO: 1364300 - protein, 7 aa, Mycobacterium tuberculosis
PNAAPRT

SEQ ID NO: 1364301 - protein, 26 aa, Mycobacterium tuberculosis
PNGPRRPGPPGQPRRVRQGGTAITPP

SEQ ID NO: 1364302 - protein, 7 aa, Mycobacterium tuberculosis
PPASDTN

SEQ ID NO: 1364303 - protein, 10 aa, Mycobacterium tuberculosis
PPGPASAPYN

SEQ ID NO: 1364304 - protein, 13 aa, Mycobacterium tuberculosis
PPVVEPGPDRRPI

SEQ ID NO: 1364305 - protein, 15 aa, Mycobacterium tuberculosis
PPYDAASSGVGNSGY

SEQ ID NO: 1364306 - protein, 10 aa, Mycobacterium tuberculosis
PQGGAHDERT

SEQ ID NO: 1364307 - protein, 10 aa, Mycobacterium tuberculosis
PRDDHATPAE

SEQ ID NO: 1364308 - protein, 6 aa, Mycobacterium tuberculosis
PRDGNV

SEQ ID NO: 1364309 - protein, 12 aa, Mycobacterium tuberculosis
PRLAPGAPGGTV

SEQ ID NO: 1364310 - protein, 7 aa, Mycobacterium tuberculosis
PRNPTGK

SEQ ID NO: 1364311 - protein, 5 aa, Mycobacterium tuberculosis
PRPAS

SEQ ID NO: 1364312 - protein, 12 aa, Mycobacterium tuberculosis
PRRSTPGPSDRR

SEQ ID NO: 1364313 - protein, 5 aa, Mycobacterium tuberculosis
PRVQA

SEQ ID NO: 1364314 - protein, 23 aa, Mycobacterium tuberculosis
PSIADQVKESADSYNASAGPVGD

SEQ ID NO: 1364315 - protein, 5 aa, Mycobacterium tuberculosis
PTLSR

SEQ ID NO: 1364316 - protein, 9 aa, Mycobacterium tuberculosis
PTNEQRDRA

SEQ ID NO: 1364317 - protein, 6 aa, Mycobacterium tuberculosis
PTPSLD

SEQ ID NO: 1364318 - protein, 5 aa, Mycobacterium tuberculosis
PTSWE

SEQ ID NO: 1364319 - protein, 6 aa, Mycobacterium tuberculosis
PTYSNG

SEQ ID NO: 1364320 - protein, 8 aa, Mycobacterium tuberculosis
PVGAATSS

SEQ ID NO: 1364321 - protein, 15 aa, Mycobacterium tuberculosis
PVRGEPARKSLQCRP

SEQ ID NO: 1364322 - protein, 18 aa, Mycobacterium tuberculosis
PYAQRSSLEGPVTSPTGI

SEQ ID NO: 1364323 - protein, 5 aa, Mycobacterium tuberculosis
QADPD

SEQ ID NO: 1364324 - protein, 11 aa, Mycobacterium tuberculosis
QAQGDKAPVQR

SEQ ID NO: 1364325 - protein, 9 aa, Mycobacterium tuberculosis
QARAETDAA

SEQ ID NO: 1364326 - protein, 9 aa, Mycobacterium tuberculosis
QDARTQRRS

SEQ ID NO: 1364327 - protein, 7 aa, Mycobacterium tuberculosis
QDEKDPV

SEQ ID NO: 1364328 - protein, 7 aa, Mycobacterium tuberculosis
QDGLPDD

SEQ ID NO: 1364329 - protein, 9 aa, Mycobacterium tuberculosis
QEQTSAASA

SEQ ID NO: 1364330 - protein, 23 aa, Mycobacterium tuberculosis
QFAEPDDAEYPTDDAAERAQREH

SEQ ID NO: 1364331 - protein, 5 aa, Mycobacterium tuberculosis
QGAAR

SEQ ID NO: 1364332 - protein, 5 aa, Mycobacterium tuberculosis
QGTNT

SEQ ID NO: 1364333 - protein, 13 aa, Mycobacterium tuberculosis
QHAGSEPGPAVAI

SEQ ID NO: 1364334 - protein, 12 aa, Mycobacterium tuberculosis
QHEVDTAEVPSA

SEQ ID NO: 1364335 - protein, 8 aa, Mycobacterium tuberculosis
QLKRERDA

SEQ ID NO: 1364336 - protein, 26 aa, Mycobacterium tuberculosis
QLPPATTRIPAAPPSGPQPRYPTGGQ

SEQ ID NO: 1364337 - protein, 7 aa, Mycobacterium tuberculosis
QNEVSEQ

SEQ ID NO: 1364338 - protein, 17 aa, Mycobacterium tuberculosis
QPGPAEPELSSRDPDIA

SEQ ID NO: 1364339 - protein, 6 aa, Mycobacterium tuberculosis
QPQHAP

SEQ ID NO: 1364340 - protein, 33 aa, Mycobacterium tuberculosis; identical to SEQ ID NO: 153262

SEQ ID NO: 1364341 - protein, 7 aa, Mycobacterium tuberculosis
QPRTANM

SEQ ID NO: 1364342 - protein, 12 aa, Mycobacterium tuberculosis
QQERNNKDPGAM

SEQ ID NO: 1364343 - protein, 8 aa, Mycobacterium tuberculosis
QQSAQPSF

SEQ ID NO: 1364344 - protein, 10 aa, Mycobacterium tuberculosis
QRPPSESSRA

SEQ ID NO: 1364345 - protein, 11 aa, Mycobacterium tuberculosis
QSHSKNYSTRA

SEQ ID NO: 1364346 - protein, 9 aa, Mycobacterium tuberculosis
QSKEQPELA

SEQ ID NO: 1364347 - protein, 10 aa, Mycobacterium tuberculosis
QSLSDAENTL

SEQ ID NO: 1364348 - protein, 8 aa, Mycobacterium tuberculosis
QSNADEDK

SEQ ID NO: 1364349 - protein, 12 aa, Mycobacterium tuberculosis
QSPGQVSPDTKL

SEQ ID NO: 1364350 - protein, 20 aa, Mycobacterium tuberculosis
QSSSKFAPVGDPSSTGVGDV

SEQ ID NO: 1364351 - protein, 6 aa, Mycobacterium tuberculosis
QTQEYQ

SEQ ID NO: 1364352 - protein, 8 aa, Mycobacterium tuberculosis
QTRHPATA

SEQ ID NO: 1364353 - protein, 7 aa, Mycobacterium tuberculosis
QTSGQNL

SEQ ID NO: 1364354 - protein, 8 aa, Mycobacterium tuberculosis
QVNTGDQI

SEQ ID NO: 1364355 - protein, 9 aa, Mycobacterium tuberculosis
QVRKGASQR

SEQ ID NO: 1364356 - protein, 7 aa, Mycobacterium tuberculosis
RAADPGM

SEQ ID NO: 1364357 - protein, 4 aa, Mycobacterium tuberculosis
RAAH

SEQ ID NO: 1364358 - protein, 7 aa, Mycobacterium tuberculosis
RAASESA

SEQ ID NO: 1364359 - protein, 8 aa, Mycobacterium tuberculosis
RADPLTAA

SEQ ID NO: 1364360 - protein, 7 aa, Mycobacterium tuberculosis
RATISRP

SEQ ID NO: 1364361 - protein, 4 aa, Mycobacterium tuberculosis
RDHT

SEQ ID NO: 1364362 - protein, 8 aa, Mycobacterium tuberculosis
RDLRTPGA

SEQ ID NO: 1364363 - protein, 12 aa, Mycobacterium tuberculosis
RDPAQLGGPGLT

SEQ ID NO: 1364364 - protein, 14 aa, Mycobacterium tuberculosis
RDRHGHPDPGPQRR

SEQ ID NO: 1364365 - protein, 11 aa, Mycobacterium tuberculosis
RDTAPAAGPEL

SEQ ID NO: 1364366 - protein, 10 aa, Mycobacterium tuberculosis
READTAGRLT

SEQ ID NO: 1364367 - protein, 14 aa, Mycobacterium tuberculosis
REAPPPATDSTSPE

SEQ ID NO: 1364368 - protein, 4 aa, Mycobacterium tuberculosis
REGA

SEQ ID NO: 1364369 - protein, 7 aa, Mycobacterium tuberculosis
REQQGGR

SEQ ID NO: 1364370 - protein, 8 aa, Mycobacterium tuberculosis
RERGMSTQ

SEQ ID NO: 1364371 - protein, 10 aa, Mycobacterium tuberculosis
REYETSGDMR

SEQ ID NO: 1364372 - protein, 10 aa, Mycobacterium tuberculosis
RGDPASAEGI

SEQ ID NO: 1364373 - protein, 8 aa, Mycobacterium tuberculosis
RGGPAAGH

SEQ ID NO: 1364374 - protein, 5 aa, Mycobacterium tuberculosis
RGNSW

SEQ ID NO: 1364375 - protein, 5 aa, Mycobacterium tuberculosis
RGPAE

SEQ ID NO: 1364376 - protein, 6 aa, Mycobacterium tuberculosis
RGPART

SEQ ID NO: 1364377 - protein, 17 aa, Mycobacterium tuberculosis
RGQTGDRRRQATHPAAV

SEQ ID NO: 1364378 - protein, 13 aa, Mycobacterium tuberculosis
RGSVTAESGNGQT

SEQ ID NO: 1364379 - protein, 7 aa, Mycobacterium tuberculosis
RHAESLG

SEQ ID NO: 1364380 - protein, 7 aa, Mycobacterium tuberculosis
RHPGGAS

SEQ ID NO: 1364381 - protein, 14 aa, Mycobacterium tuberculosis
RHRRPNPSAPRSPL

SEQ ID NO: 1364382 - protein, 5 aa, Mycobacterium tuberculosis
RITPR

SEQ ID NO: 1364383 - protein, 8 aa, Mycobacterium tuberculosis
RKDPAYSH

SEQ ID NO: 1364384 - protein, 28 aa, Mycobacterium tuberculosis
RKPARPHDSHNGPTRESDQDTAASTTSC

SEQ ID NO: 1364385 - protein, 10 aa, Mycobacterium tuberculosis
RMESTDSVGQ

SEQ ID NO: 1364386 - protein, 11 aa, Mycobacterium tuberculosis
RPDAYTAADKL

SEQ ID NO: 1364387 - protein, 6 aa, Mycobacterium tuberculosis
RPHQDA

SEQ ID NO: 1364388 - protein, 9 aa, Mycobacterium tuberculosis
RPNAADVER

SEQ ID NO: 1364389 - protein, 8 aa, Mycobacterium tuberculosis
RPQQPPPA

SEQ ID NO: 1364390 - protein, 9 aa, Mycobacterium tuberculosis
RPSPPPTVA

SEQ ID NO: 1364391 - protein, 8 aa, Mycobacterium tuberculosis
RPTDRARR

SEQ ID NO: 1364392 - protein, 22 aa, Mycobacterium tuberculosis
RPTVPEAHTRQGARRIQPHLHR

SEQ ID NO: 1364393 - protein, 12 aa, Mycobacterium tuberculosis
RQPKQHQYAQPV

SEQ ID NO: 1364394 - protein, 5 aa, Mycobacterium tuberculosis
RRADR

SEQ ID NO: 1364395 - protein, 8 aa, Mycobacterium tuberculosis
RRGRGTPT

SEQ ID NO: 1364396 - protein, 9 aa, Mycobacterium tuberculosis
RRPGDTSAT

SEQ ID NO: 1364397 - protein, 5 aa, Mycobacterium tuberculosis
RRPLE

SEQ ID NO: 1364398 - protein, 9 aa, Mycobacterium tuberculosis
RRPSPLPTP

SEQ ID NO: 1364399 - protein, 12 aa, Mycobacterium tuberculosis
RRYAEAGNPYPG

SEQ ID NO: 1364400 - protein, 7 aa, Mycobacterium tuberculosis
RRYPSEP

SEQ ID NO: 1364401 - protein, 9 aa, Mycobacterium tuberculosis
RSAASGAAL

SEQ ID NO: 1364402 - protein, 12 aa, Mycobacterium tuberculosis
RSADNRDCPSRT

SEQ ID NO: 1364403 - protein, 13 aa, Mycobacterium tuberculosis
RSFSASVSGTELT

SEQ ID NO: 1364404 - protein, 8 aa, Mycobacterium tuberculosis
RSPRPPQA

SEQ ID NO: 1364405 - protein, 9 aa, Mycobacterium tuberculosis
RSQIDPTNR

SEQ ID NO: 1364406 - protein, 32 aa, Mycobacterium tuberculosis; identical to SEQ ID NO: 153756

SEQ ID NO: 1364407 - protein, 8 aa, Mycobacterium tuberculosis
RSREGQAL

SEQ ID NO: 1364408 - protein, 5 aa, Mycobacterium tuberculosis
RSREM

SEQ ID NO: 1364409 - protein, 18 aa, Mycobacterium tuberculosis
RSSGPRTSAPPPPPPADA

SEQ ID NO: 1364410 - protein, 6 aa, Mycobacterium tuberculosis
RTAGRG

SEQ ID NO: 1364411 - protein, 5 aa, Mycobacterium tuberculosis
RTESG

SEQ ID NO: 1364412 - protein, 10 aa, Mycobacterium tuberculosis
RTGPAGDDNI

SEQ ID NO: 1364413 - protein, 7 aa, Mycobacterium tuberculosis
RTGPNAP

SEQ ID NO: 1364414 - protein, 6 aa, Mycobacterium tuberculosis
RVEPAR

SEQ ID NO: 1364415 - protein, 11 aa, Mycobacterium tuberculosis
RVKPSNRGLQS

SEQ ID NO: 1364416 - protein, 15 aa, Mycobacterium tuberculosis
SAAPHALAGEPSPTP

SEQ ID NO: 1364417 - protein, 5 aa, Mycobacterium tuberculosis
SAATR

SEQ ID NO: 1364418 - protein, 7 aa, Mycobacterium tuberculosis
SAEDKIN

SEQ ID NO: 1364419 - protein, 10 aa, Mycobacterium tuberculosis
SAGSPRDTDA

SEQ ID NO: 1364420 - protein, 7 aa, Mycobacterium tuberculosis
SAKERPR

SEQ ID NO: 1364421 - protein, 5 aa, Mycobacterium tuberculosis
SAPRA

SEQ ID NO: 1364422 - protein, 6 aa, Mycobacterium tuberculosis
SAPRCP

SEQ ID NO: 1364423 - protein, 15 aa, Mycobacterium tuberculosis
SAQNGDGGQADSGAA

SEQ ID NO: 1364424 - protein, 8 aa, Mycobacterium tuberculosis
SATEGASV

SEQ ID NO: 1364425 - protein, 14 aa, Mycobacterium tuberculosis
SATGYRAPDGPYET

SEQ ID NO: 1364426 - protein, 9 aa, Mycobacterium tuberculosis
SDDGGPERF

SEQ ID NO: 1364427 - protein, 25 aa, Mycobacterium tuberculosis
SDDTHTGGAVQKPRGLNDENPPTAI

SEQ ID NO: 1364428 - protein, 11 aa, Mycobacterium tuberculosis
SDDTTRSRAKT

SEQ ID NO: 1364429 - protein, 13 aa, Mycobacterium tuberculosis
SDGTGTALDSASL

SEQ ID NO: 1364430 - protein, 4 aa, Mycobacterium tuberculosis
SDHA

SEQ ID NO: 1364431 - protein, 5 aa, Mycobacterium tuberculosis
SDYGG

SEQ ID NO: 1364432 - protein, 9 aa, Mycobacterium tuberculosis
SEADPAAGR

SEQ ID NO: 1364433 - protein, 10 aa, Mycobacterium tuberculosis
SEGEDLETED

SEQ ID NO: 1364434 - protein, 7 aa, Mycobacterium tuberculosis
SFQPNDK

SEQ ID NO: 1364435 - protein, 9 aa, Mycobacterium tuberculosis
SGDGSTYMP

SEQ ID NO: 1364436 - protein, 4 aa, Mycobacterium tuberculosis
SGFS

SEQ ID NO: 1364437 - protein, 4 aa, Mycobacterium tuberculosis
SGGI

SEQ ID NO: 1364438 - protein, 8 aa, Mycobacterium tuberculosis
SGGLNKDE

SEQ ID NO: 1364439 - protein, 4 aa, Mycobacterium tuberculosis
SGPT

SEQ ID NO: 1364440 - protein, 11 aa, Mycobacterium tuberculosis
SGRTGALSRSA

SEQ ID NO: 1364441 - protein, 4 aa, Mycobacterium tuberculosis
SGVP

SEQ ID NO: 1364442 - protein, 8 aa, Mycobacterium tuberculosis
SKETRPDV

SEQ ID NO: 1364443 - protein, 11 aa, Mycobacterium tuberculosis
SKSRSNGSGHG

SEQ ID NO: 1364444 - protein, 12 aa, Mycobacterium tuberculosis
SLRRTDKQKDSG

SEQ ID NO: 1364445 - protein, 4 aa, Mycobacterium tuberculosis
SMEP

SEQ ID NO: 1364446 - protein, 17 aa, Mycobacterium tuberculosis
SNGKRVTSEPEGLATGN

SEQ ID NO: 1364447 - protein, 7 aa, Mycobacterium tuberculosis
SNRSHTA

SEQ ID NO: 1364448 - protein, 5 aa, Mycobacterium tuberculosis
SPAAF

SEQ ID NO: 1364449 - protein, 13 aa, Mycobacterium tuberculosis
SPDGGADNPGEAD

SEQ ID NO: 1364450 - protein, 4 aa, Mycobacterium tuberculosis
SPEQ

SEQ ID NO: 1364451 - protein, 5 aa, Mycobacterium tuberculosis
SPEQK

SEQ ID NO: 1364452 - protein, 11 aa, Mycobacterium tuberculosis
SPKSLTGNQTD

SEQ ID NO: 1364453 - protein, 15 aa, Mycobacterium tuberculosis
SPPTLTSGRPSGNLP

SEQ ID NO: 1364454 - protein, 20 aa, Mycobacterium tuberculosis
SPQGGGPVNAYPPSRPGEKN

SEQ ID NO: 1364455 - protein, 11 aa, Mycobacterium tuberculosis
SPRSPAAPSLR

SEQ ID NO: 1364456 - protein, 6 aa, Mycobacterium tuberculosis
SQAGDL

SEQ ID NO: 1364457 - protein, 10 aa, Mycobacterium tuberculosis
SQAQQGGQQH

SEQ ID NO: 1364458 - protein, 6 aa, Mycobacterium tuberculosis
SQDTTH

SEQ ID NO: 1364459 - protein, 6 aa, Mycobacterium tuberculosis
SQIGGE

SEQ ID NO: 1364460 - protein, 7 aa, Mycobacterium tuberculosis
SRGDAGE

SEQ ID NO: 1364461 - protein, 8 aa, Mycobacterium tuberculosis
SRPLGAGT

SEQ ID NO: 1364462 - protein, 4 aa, Mycobacterium tuberculosis
SRTP

SEQ ID NO: 1364463 - protein, 63 aa, Mycobacterium tuberculosis; identical to SEQ ID NO: 154210

SEQ ID NO: 1364464 - protein, 4 aa, Mycobacterium tuberculosis
SSAP

SEQ ID NO: 1364465 - protein, 10 aa, Mycobacterium tuberculosis
SSARSGALDD

SEQ ID NO: 1364466 - protein, 5 aa, Mycobacterium tuberculosis
SSDGH

SEQ ID NO: 1364467 - protein, 6 aa, Mycobacterium tuberculosis
SSNQLA

SEQ ID NO: 1364468 - protein, 9 aa, Mycobacterium tuberculosis
SSSDQQSLA

SEQ ID NO: 1364469 - protein, 8 aa, Mycobacterium tuberculosis
SSTRGATV

SEQ ID NO: 1364470 - protein, 9 aa, Mycobacterium tuberculosis
SSVGQDLTR

SEQ ID NO: 1364471 - protein, 9 aa, Mycobacterium tuberculosis
SSWQGTAAT

SEQ ID NO: 1364472 - protein, 7 aa, Mycobacterium tuberculosis
STAGWRD

SEQ ID NO: 1364473 - protein, 9 aa, Mycobacterium tuberculosis
STGTPRPPF

SEQ ID NO: 1364474 - protein, 5 aa, Mycobacterium tuberculosis
STHAG

SEQ ID NO: 1364475 - protein, 5 aa, Mycobacterium tuberculosis
STLDG

SEQ ID NO: 1364476 - protein, 7 aa, Mycobacterium tuberculosis
STLGRNL

SEQ ID NO: 1364477 - protein, 6 aa, Mycobacterium tuberculosis
STPARI

SEQ ID NO: 1364478 - protein, 7 aa, Mycobacterium tuberculosis
SVAPSAL

SEQ ID NO: 1364479 - protein, 14 aa, Mycobacterium tuberculosis
SVDDLSDGHAAEQQ

SEQ ID NO: 1364480 - protein, 13 aa, Mycobacterium tuberculosis
SYGENNLAATATS

SEQ ID NO: 1364481 - protein, 13 aa, Mycobacterium tuberculosis
TAAEESLKGTPLE

SEQ ID NO: 1364482 - protein, 13 aa, Mycobacterium tuberculosis
TAAEQRAVPGDGA

SEQ ID NO: 1364483 - protein, 13 aa, Mycobacterium tuberculosis
TAAGSQSADGKAA

SEQ ID NO: 1364484 - protein, 15 aa, Mycobacterium tuberculosis
TAATGASELGSGGRT

SEQ ID NO: 1364485 - protein, 10 aa, Mycobacterium tuberculosis
TAGQGEDPRY

SEQ ID NO: 1364486 - protein, 12 aa, Mycobacterium tuberculosis
TAGRPRSADKPV

SEQ ID NO: 1364487 - protein, 5 aa, Mycobacterium tuberculosis
TALAP

SEQ ID NO: 1364488 - protein, 8 aa, Mycobacterium tuberculosis
TATRQAYG

SEQ ID NO: 1364489 - protein, 9 aa, Mycobacterium tuberculosis
TDDGPDIDP

SEQ ID NO: 1364490 - protein, 15 aa, Mycobacterium tuberculosis
TDDGRSASDPDADHA

SEQ ID NO: 1364491 - protein, 21 aa, Mycobacterium tuberculosis
TDFPSEAPARFEGDSYNEGGP

SEQ ID NO: 1364492 - protein, 8 aa, Mycobacterium tuberculosis
TDPAPANR

SEQ ID NO: 1364493 - protein, 4 aa, Mycobacterium tuberculosis
TDSD

SEQ ID NO: 1364494 - protein, 12 aa, Mycobacterium tuberculosis
TDVGTDSATYAR

SEQ ID NO: 1364495 - protein, 7 aa, Mycobacterium tuberculosis
TELGGQP

SEQ ID NO: 1364496 - protein, 34 aa, Mycobacterium tuberculosis; identical to SEQ ID NO: 154443

SEQ ID NO: 1364497 - protein, 10 aa, Mycobacterium tuberculosis
TGDGRPPGAR

SEQ ID NO: 1364498 - protein, 13 aa, Mycobacterium tuberculosis
TGDQGGSQANESV

SEQ ID NO: 1364499 - protein, 11 aa, Mycobacterium tuberculosis
TGEAETPAGPL

SEQ ID NO: 1364500 - protein, 4 aa, Mycobacterium tuberculosis
TGEQ

SEQ ID NO: 1364501 - protein, 9 aa, Mycobacterium tuberculosis
TGGNTGTQI

SEQ ID NO: 1364502 - protein, 18 aa, Mycobacterium tuberculosis
TGPAALNADQAEAGDKSI

SEQ ID NO: 1364503 - protein, 9 aa, Mycobacterium tuberculosis
TGPAPPGLA

SEQ ID NO: 1364504 - protein, 18 aa, Mycobacterium tuberculosis
TGQTRRECREEIRRSNGW

SEQ ID NO: 1364505 - protein, 6 aa, Mycobacterium tuberculosis
TGRGAE

SEQ ID NO: 1364506 - protein, 9 aa, Mycobacterium tuberculosis
TGSPIPTPS

SEQ ID NO: 1364507 - protein, 7 aa, Mycobacterium tuberculosis
TGTLSEN

SEQ ID NO: 1364508 - protein, 4 aa, Mycobacterium tuberculosis
THDD

SEQ ID NO: 1364509 - protein, 13 aa, Mycobacterium tuberculosis
TIPRTSSGKIGRR

SEQ ID NO: 1364510 - protein, 7 aa, Mycobacterium tuberculosis
TKAAITA

SEQ ID NO: 1364511 - protein, 18 aa, Mycobacterium tuberculosis
TKSHSRPHTSNDNPLSEA

SEQ ID NO: 1364512 - protein, 7 aa, Mycobacterium tuberculosis
TLGTSTE

SEQ ID NO: 1364513 - protein, 5 aa, Mycobacterium tuberculosis
TPAQI

SEQ ID NO: 1364514 - protein, 10 aa, Mycobacterium tuberculosis
TPGTERRTAT

SEQ ID NO: 1364515 - protein, 5 aa, Mycobacterium tuberculosis
TPRYQ

SEQ ID NO: 1364516 - protein, 6 aa, Mycobacterium tuberculosis
TPSSQT

SEQ ID NO: 1364517 - protein, 7 aa, Mycobacterium tuberculosis
TPTTAGT

SEQ ID NO: 1364518 - protein, 15 aa, Mycobacterium tuberculosis
TQATTAASDVQAVPG

SEQ ID NO: 1364519 - protein, 4 aa, Mycobacterium tuberculosis
TQQQ

SEQ ID NO: 1364520 - protein, 11 aa, Mycobacterium tuberculosis
TRPNGEPLKET

SEQ ID NO: 1364521 - protein, 10 aa, Mycobacterium tuberculosis
TRPPRDPDQP

SEQ ID NO: 1364522 - protein, 8 aa, Mycobacterium tuberculosis
TRPPSTSA

SEQ ID NO: 1364523 - protein, 7 aa, Mycobacterium tuberculosis
TSAGSDA

SEQ ID NO: 1364524 - protein, 11 aa, Mycobacterium tuberculosis
TSPADEGPTQA

SEQ ID NO: 1364525 - protein, 8 aa, Mycobacterium tuberculosis
TSTSPNQQ

SEQ ID NO: 1364526 - protein, 4 aa, Mycobacterium tuberculosis
TTAD

SEQ ID NO: 1364527 - protein, 13 aa, Mycobacterium tuberculosis
TTNPPADGPTDTV

SEQ ID NO: 1364528 - protein, 7 aa, Mycobacterium tuberculosis
TTPPPHG

SEQ ID NO: 1364529 - protein, 8 aa, Mycobacterium tuberculosis
TVESPANA

SEQ ID NO: 1364530 - protein, 4 aa, Mycobacterium tuberculosis
TVPT

SEQ ID NO: 1364531 - protein, 5 aa, Mycobacterium tuberculosis
TVSPR

SEQ ID NO: 1364532 - protein, 12 aa, Mycobacterium tuberculosis
TWESSPQQNPLN

SEQ ID NO: 1364533 - protein, 14 aa, Mycobacterium tuberculosis
TYPGRADDSRDAPT

SEQ ID NO: 1364534 - protein, 18 aa, Mycobacterium tuberculosis
VADGAENADSRGSGGRTA

SEQ ID NO: 1364535 - protein, 8 aa, Mycobacterium tuberculosis
VAENTADA

SEQ ID NO: 1364536 - protein, 7 aa, Mycobacterium tuberculosis
VAPETTA

SEQ ID NO: 1364537 - protein, 5 aa, Mycobacterium tuberculosis
VAPTT

SEQ ID NO: 1364538 - protein, 5 aa, Mycobacterium tuberculosis
VDETP

SEQ ID NO: 1364539 - protein, 7 aa, Mycobacterium tuberculosis
VDPEAGR

SEQ ID NO: 1364540 - protein, 7 aa, Mycobacterium tuberculosis
VEGEGCG

SEQ ID NO: 1364541 - protein, 8 aa, Mycobacterium tuberculosis
VEPPKGPA

SEQ ID NO: 1364542 - protein, 10 aa, Mycobacterium tuberculosis
VEQGDSGGPL

SEQ ID NO: 1364543 - protein, 9 aa, Mycobacterium tuberculosis
VESGSEHPI

SEQ ID NO: 1364544 - protein, 7 aa, Mycobacterium tuberculosis
VESTPAT

SEQ ID NO: 1364545 - protein, 6 aa, Mycobacterium tuberculosis
VGAEPT

SEQ ID NO: 1364546 - protein, 11 aa, Mycobacterium tuberculosis
VGGGPDAPGAG

SEQ ID NO: 1364547 - protein, 5 aa, Mycobacterium tuberculosis
VGGKD

SEQ ID NO: 1364548 - protein, 4 aa, Mycobacterium tuberculosis
VGPS

SEQ ID NO: 1364549 - protein, 10 aa, Mycobacterium tuberculosis
VGPSEGSKAR

SEQ ID NO: 1364550 - protein, 10 aa, Mycobacterium tuberculosis
VKPPSSPVTS

SEQ ID NO: 1364551 - protein, 9 aa, Mycobacterium tuberculosis
VMERPGDRS

SEQ ID NO: 1364552 - protein, 8 aa, Mycobacterium tuberculosis
VNDAPAMA

SEQ ID NO: 1364553 - protein, 7 aa, Mycobacterium tuberculosis
VNDPDRA

SEQ ID NO: 1364554 - protein, 13 aa, Mycobacterium tuberculosis
VNDRQEEAGRSGV

SEQ ID NO: 1364555 - protein, 7 aa, Mycobacterium tuberculosis
VNRDQPD

SEQ ID NO: 1364556 - protein, 12 aa, Mycobacterium tuberculosis
VPEEDKGLRTRS

SEQ ID NO: 1364557 - protein, 10 aa, Mycobacterium tuberculosis
VPPDQATDFG

SEQ ID NO: 1364558 - protein, 7 aa, Mycobacterium tuberculosis
VPPGDRA

SEQ ID NO: 1364559 - protein, 5 aa, Mycobacterium tuberculosis
VPPNY

SEQ ID NO: 1364560 - protein, 7 aa, Mycobacterium tuberculosis
VPPPPGI

SEQ ID NO: 1364561 - protein, 8 aa, Mycobacterium tuberculosis
VPPRDAAE

SEQ ID NO: 1364562 - protein, 21 aa, Mycobacterium tuberculosis
VPPVSGGPRHYEAPPPPQPEP

SEQ ID NO: 1364563 - protein, 10 aa, Mycobacterium tuberculosis
VPRPRPDHTQ

SEQ ID NO: 1364564 - protein, 12 aa, Mycobacterium tuberculosis
VPTPAPAREVPT

SEQ ID NO: 1364565 - protein, 13 aa, Mycobacterium tuberculosis
VSGRGSSAARGAA

SEQ ID NO: 1364566 - protein, 13 aa, Mycobacterium tuberculosis
VSKPEGKDKYGEE

SEQ ID NO: 1364567 - protein, 21 aa, Mycobacterium tuberculosis
VSPSPPEASQPAPGPRDPNRP

SEQ ID NO: 1364568 - protein, 7 aa, Mycobacterium tuberculosis
VSTDPVG

SEQ ID NO: 1364569 - protein, 39 aa, Mycobacterium tuberculosis; identical to SEQ ID NO: 155030

SEQ ID NO: 1364570 - protein, 50 aa, Mycobacterium tuberculosis; identical to SEQ ID NO: 155459

SEQ ID NO: 1364571 - protein, 7 aa, Mycobacterium tuberculosis
WKGTTTY

SEQ ID NO: 1364572 - protein, 9 aa, Mycobacterium tuberculosis
WRPGGTAPV

SEQ ID NO: 1364573 - protein, 10 aa, Mycobacterium tuberculosis
WSPDSGETIA

SEQ ID NO: 1364574 - protein, 4 aa, Mycobacterium tuberculosis
YDPS

SEQ ID NO: 1364575 - protein, 5 aa, Mycobacterium tuberculosis
YDSGT

SEQ ID NO: 1364576 - protein, 7 aa, Mycobacterium tuberculosis
YEPPQTA

SEQ ID NO: 1364577 - protein, 5 aa, Mycobacterium tuberculosis
YGPRP

SEQ ID NO: 1364578 - protein, 54 aa, Mycobacterium tuberculosis
YPYGPNTYGQDPYWGGQPQGGSYPPAYPPQQYPPGWPAGPYPPGPPPPGPGSKT

SEQ ID NO: 1364579 - protein, 8 aa, Mycobacterium tuberculosis
YSSPTTPV

SEQ ID NO: 1364580 - protein, 7 aa, Mycobacterium tuberculosis
YYNPPQH

SEQ ID NO: 1364581 - protein, 8 aa, Mycobacterium tuberculosis
AAAPGDQR

SEQ ID NO: 1364582 - protein, 6 aa, Mycobacterium tuberculosis
AAAPTS

SEQ ID NO: 1364583 - protein, 4 aa, Mycobacterium tuberculosis
AAEA

SEQ ID NO: 1364584 - protein, 13 aa, Mycobacterium tuberculosis
AAEEMDAPDRNLP

SEQ ID NO: 1364585 - protein, 6 aa, Mycobacterium tuberculosis
AAGATA

SEQ ID NO: 1364586 - protein, 10 aa, Mycobacterium tuberculosis
AANPAGARRI

SEQ ID NO: 1364587 - protein, 9 aa, Mycobacterium tuberculosis
AANPSTGAF

SEQ ID NO: 1364588 - protein, 7 aa, Mycobacterium tuberculosis
AAPSPVA

SEQ ID NO: 1364589 - protein, 11 aa, Mycobacterium tuberculosis
AAQAAAAAAER

SEQ ID NO: 1364590 - protein, 11 aa, Mycobacterium tuberculosis
AAQTATRDQNV

SEQ ID NO: 1364591 - protein, 14 aa, Mycobacterium tuberculosis
ADAPDAIDEANTAF

SEQ ID NO: 1364592 - protein, 9 aa, Mycobacterium tuberculosis
ADKPKTPRG

SEQ ID NO: 1364593 - protein, 7 aa, Mycobacterium tuberculosis
ADPDRAT

SEQ ID NO: 1364594 - protein, 6 aa, Mycobacterium tuberculosis
ADPIPA

SEQ ID NO: 1364595 - protein, 7 aa, Mycobacterium tuberculosis
ADPRDDA

SEQ ID NO: 1364596 - protein, 8 aa, Mycobacterium tuberculosis
ADQAPDAV

SEQ ID NO: 1364597 - protein, 13 aa, Mycobacterium tuberculosis
AEPAEGPDAPSAA

SEQ ID NO: 1364598 - protein, 6 aa, Mycobacterium tuberculosis
AEPGHV

SEQ ID NO: 1364599 - protein, 6 aa, Mycobacterium tuberculosis
AETGTG

SEQ ID NO: 1364600 - protein, 8 aa, Mycobacterium tuberculosis
AETPGSQW

SEQ ID NO: 1364601 - protein, 11 aa, Mycobacterium tuberculosis
AGGVPQDEGAK

SEQ ID NO: 1364602 - protein, 7 aa, Mycobacterium tuberculosis
AGNGGVA

SEQ ID NO: 1364603 - protein, 4 aa, Mycobacterium tuberculosis
AGPL

SEQ ID NO: 1364604 - protein, 11 aa, Mycobacterium tuberculosis
AGPVRSGRGGR

SEQ ID NO: 1364605 - protein, 62 aa, Mycobacterium tuberculosis; identical to SEQ ID NO: 149683

SEQ ID NO: 1364606 - protein, 10 aa, Mycobacterium tuberculosis
AGSRLGYQES

SEQ ID NO: 1364607 - protein, 5 aa, Mycobacterium tuberculosis
AGTAT

SEQ ID NO: 1364608 - protein, 15 aa, Mycobacterium tuberculosis
AGVSPAPAKPSMSAP

SEQ ID NO: 1364609 - protein, 4 aa, Mycobacterium tuberculosis
AHGT

SEQ ID NO: 1364610 - protein, 6 aa, Mycobacterium tuberculosis
AITGEN

SEQ ID NO: 1364611 - protein, 10 aa, Mycobacterium tuberculosis
ALPAPPRPTV

SEQ ID NO: 1364612 - protein, 7 aa, Mycobacterium tuberculosis
ANQIADP

SEQ ID NO: 1364613 - protein, 22 aa, Mycobacterium tuberculosis
ANYPPDDANYRRSRRPPPMPSA

SEQ ID NO: 1364614 - protein, 25 aa, Mycobacterium tuberculosis
ANYPRADHARREPELPGKQLTGSAR

SEQ ID NO: 1364615 - protein, 8 aa, Mycobacterium tuberculosis
APAASVGS

SEQ ID NO: 1364616 - protein, 16 aa, Mycobacterium tuberculosis
APDPYPGHNPDRPPSR

SEQ ID NO: 1364617 - protein, 9 aa, Mycobacterium tuberculosis
APLPSGSTV

SEQ ID NO: 1364618 - protein, 6 aa, Mycobacterium tuberculosis
APPAQL

SEQ ID NO: 1364619 - protein, 6 aa, Mycobacterium tuberculosis
APPPGV

SEQ ID NO: 1364620 - protein, 10 aa, Mycobacterium tuberculosis
APPPPPGVPP

SEQ ID NO: 1364621 - protein, 7 aa, Mycobacterium tuberculosis
ARANTEI

SEQ ID NO: 1364622 - protein, 11 aa, Mycobacterium tuberculosis
ARATGKASEAI

SEQ ID NO: 1364623 - protein, 15 aa, Mycobacterium tuberculosis
ARGESGEQLSDSEIR

SEQ ID NO: 1364624 - protein, 17 aa, Mycobacterium tuberculosis
ARPQPPNAHPVAQPPAQ

SEQ ID NO: 1364625 - protein, 6 aa, Mycobacterium tuberculosis
ARRQQG

SEQ ID NO: 1364626 - protein, 6 aa, Mycobacterium tuberculosis
ARSSAS

SEQ ID NO: 1364627 - protein, 4 aa, Mycobacterium tuberculosis
ARTD

SEQ ID NO: 1364628 - protein, 25 aa, Mycobacterium tuberculosis
ASDISAPAQPARGKPQQRPPSWSPR

SEQ ID NO: 1364629 - protein, 7 aa, Mycobacterium tuberculosis
ASKNSRL

SEQ ID NO: 1364630 - protein, 14 aa, Mycobacterium tuberculosis
ASRRLRPGRNGIAG

SEQ ID NO: 1364631 - protein, 5 aa, Mycobacterium tuberculosis
ASTDT

SEQ ID NO: 1364632 - protein, 4 aa, Mycobacterium tuberculosis
ATGE

SEQ ID NO: 1364633 - protein, 22 aa, Mycobacterium tuberculosis
AVPSTQPAPPIRAPGGDAADTR

SEQ ID NO: 1364634 - protein, 13 aa, Mycobacterium tuberculosis
DAAHDARAMDPKR

SEQ ID NO: 1364635 - protein, 7 aa, Mycobacterium tuberculosis
DAAPVTQ

SEQ ID NO: 1364636 - protein, 6 aa, Mycobacterium tuberculosis
DARPGD

SEQ ID NO: 1364637 - protein, 9 aa, Mycobacterium tuberculosis
DDGPGMSQE

SEQ ID NO: 1364638 - protein, 9 aa, Mycobacterium tuberculosis
DDPRGATPW

SEQ ID NO: 1364639 - protein, 6 aa, Mycobacterium tuberculosis
DDYPSS

SEQ ID NO: 1364640 - protein, 5 aa, Mycobacterium tuberculosis
DEYRP

SEQ ID NO: 1364641 - protein, 15 aa, Mycobacterium tuberculosis
DGAKATAVPREPDEA

SEQ ID NO: 1364642 - protein, 5 aa, Mycobacterium tuberculosis
DHDQM

SEQ ID NO: 1364643 - protein, 53 aa, Mycobacterium tuberculosis; identical to SEQ ID NO: 150408

SEQ ID NO: 1364644 - protein, 5 aa, Mycobacterium tuberculosis
DKVPA

SEQ ID NO: 1364645 - protein, 14 aa, Mycobacterium tuberculosis
DLERRKREAQQAVQ

SEQ ID NO: 1364646 - protein, 4 aa, Mycobacterium tuberculosis
DLQP

SEQ ID NO: 1364647 - protein, 11 aa, Mycobacterium tuberculosis
DNGSGVPEGER

SEQ ID NO: 1364648 - protein, 6 aa, Mycobacterium tuberculosis
DPEEVR

SEQ ID NO: 1364649 - protein, 16 aa, Mycobacterium tuberculosis
DPERTRKSAQRRDEGV

SEQ ID NO: 1364650 - protein, 7 aa, Mycobacterium tuberculosis
DPLPGTV

SEQ ID NO: 1364651 - protein, 4 aa, Mycobacterium tuberculosis
DPPP

SEQ ID NO: 1364652 - protein, 11 aa, Mycobacterium tuberculosis
DPSAGSDAATE

SEQ ID NO: 1364653 - protein, 7 aa, Mycobacterium tuberculosis
DQITGRP

SEQ ID NO: 1364654 - protein, 7 aa, Mycobacterium tuberculosis
DRPNPTS

SEQ ID NO: 1364655 - protein, 14 aa, Mycobacterium tuberculosis
DRSPRLTASGDPPT

SEQ ID NO: 1364656 - protein, 7 aa, Mycobacterium tuberculosis
DSDSPTY

SEQ ID NO: 1364657 - protein, 7 aa, Mycobacterium tuberculosis
DSQRRQH

SEQ ID NO: 1364658 - protein, 5 aa, Mycobacterium tuberculosis
DSSKT

SEQ ID NO: 1364659 - protein, 5 aa, Mycobacterium tuberculosis
DTAGL

SEQ ID NO: 1364660 - protein, 11 aa, Mycobacterium tuberculosis
DTQGADGPAGL

SEQ ID NO: 1364661 - protein, 21 aa, Mycobacterium tuberculosis
DTSIGEPAVGHAGSKPDAKLS

SEQ ID NO: 1364662 - protein, 8 aa, Mycobacterium tuberculosis
EAEDTRKH

SEQ ID NO: 1364663 - protein, 9 aa, Mycobacterium tuberculosis
EAVGGGEAF

SEQ ID NO: 1364664 - protein, 11 aa, Mycobacterium tuberculosis
EEQATADRLNR

SEQ ID NO: 1364665 - protein, 8 aa, Mycobacterium tuberculosis
EGAPADLR

SEQ ID NO: 1364666 - protein, 7 aa, Mycobacterium tuberculosis
EKTGTMG

SEQ ID NO: 1364667 - protein, 5 aa, Mycobacterium tuberculosis
EMGAD

SEQ ID NO: 1364668 - protein, 9 aa, Mycobacterium tuberculosis
ERGETRHSG

SEQ ID NO: 1364669 - protein, 12 aa, Mycobacterium tuberculosis
ERGPRLGPPPVM

SEQ ID NO: 1364670 - protein, 13 aa, Mycobacterium tuberculosis
ESALTGESTPVHK

SEQ ID NO: 1364671 - protein, 5 aa, Mycobacterium tuberculosis
ESGMS

SEQ ID NO: 1364672 - protein, 12 aa, Mycobacterium tuberculosis
ESLGGAADSDLG

SEQ ID NO: 1364673 - protein, 42 aa, Mycobacterium tuberculosis; identical to SEQ ID NO: 150939

SEQ ID NO: 1364674 - protein, 6 aa, Mycobacterium tuberculosis
EVRPEA

SEQ ID NO: 1364675 - protein, 4 aa, Mycobacterium tuberculosis
FDTP

SEQ ID NO: 1364676 - protein, 13 aa, Mycobacterium tuberculosis
FDTRRGELAPQPV

SEQ ID NO: 1364677 - protein, 9 aa, Mycobacterium tuberculosis
FPEAKEKAR

SEQ ID NO: 1364678 - protein, 17 aa, Mycobacterium tuberculosis
FPPEPVAPDAGSTPRVS

SEQ ID NO: 1364679 - protein, 8 aa, Mycobacterium tuberculosis
GAGLHEAR

SEQ ID NO: 1364680 - protein, 6 aa, Mycobacterium tuberculosis
GAGYQP

SEQ ID NO: 1364681 - protein, 25 aa, Mycobacterium tuberculosis
GAKRPGAKKAAPTPAAPAAPAAPVK

SEQ ID NO: 1364682 - protein, 6 aa, Mycobacterium tuberculosis
GANSGA

SEQ ID NO: 1364683 - protein, 5 aa, Mycobacterium tuberculosis
GCGPG

SEQ ID NO: 1364684 - protein, 23 aa, Mycobacterium tuberculosis
GDEHARERTPDAGRDRTFSGQHR

SEQ ID NO: 1364685 - protein, 9 aa, Mycobacterium tuberculosis
GDFGSGTTT

SEQ ID NO: 1364686 - protein, 16 aa, Mycobacterium tuberculosis
GDGPRAASTAGPVDQV

SEQ ID NO: 1364687 - protein, 6 aa, Mycobacterium tuberculosis
GDIAPT

SEQ ID NO: 1364688 - protein, 9 aa, Mycobacterium tuberculosis
GDNARTAAA

SEQ ID NO: 1364689 - protein, 16 aa, Mycobacterium tuberculosis
GDPNPQAARLPARARG

SEQ ID NO: 1364690 - protein, 15 aa, Mycobacterium tuberculosis
GGAGTLPPEKKPQVG

SEQ ID NO: 1364691 - protein, 4 aa, Mycobacterium tuberculosis
GGLG

SEQ ID NO: 1364692 - protein, 7 aa, Mycobacterium tuberculosis
GGSGTGI

SEQ ID NO: 1364693 - protein, 10 aa, Mycobacterium tuberculosis
GHDASPASDV

SEQ ID NO: 1364694 - protein, 15 aa, Mycobacterium tuberculosis
GITDQNGDEPPRTSD

SEQ ID NO: 1364695 - protein, 12 aa, Mycobacterium tuberculosis
GKTVTVTNKAKT

SEQ ID NO: 1364696 - protein, 11 aa, Mycobacterium tuberculosis
GLQTQTADTAQ

SEQ ID NO: 1364697 - protein, 5 aa, Mycobacterium tuberculosis
GMAPQ

SEQ ID NO: 1364698 - protein, 5 aa, Mycobacterium tuberculosis
GNQDT

SEQ ID NO: 1364699 - protein, 5 aa, Mycobacterium tuberculosis
GNQTT

SEQ ID NO: 1364700 - protein, 6 aa, Mycobacterium tuberculosis
GPHDAP

SEQ ID NO: 1364701 - protein, 5 aa, Mycobacterium tuberculosis
GPHPG

SEQ ID NO: 1364702 - protein, 12 aa, Mycobacterium tuberculosis
GPTPEQPKGPFG

SEQ ID NO: 1364703 - protein, 13 aa, Mycobacterium tuberculosis
GPVTGEQGTGTTA

SEQ ID NO: 1364704 - protein, 8 aa, Mycobacterium tuberculosis
GRPAPTDG

SEQ ID NO: 1364705 - protein, 5 aa, Mycobacterium tuberculosis
GSGAN

SEQ ID NO: 1364706 - protein, 13 aa, Mycobacterium tuberculosis
GSNRVRETESTVS

SEQ ID NO: 1364707 - protein, 12 aa, Mycobacterium tuberculosis
GSSALPTIAVPG

SEQ ID NO: 1364708 - protein, 7 aa, Mycobacterium tuberculosis
GSTGGVI

SEQ ID NO: 1364709 - protein, 5 aa, Mycobacterium tuberculosis
GSVYR

SEQ ID NO: 1364710 - protein, 8 aa, Mycobacterium tuberculosis
GTAIPSNV

SEQ ID NO: 1364711 - protein, 11 aa, Mycobacterium tuberculosis
GTAPAQPPKPR

SEQ ID NO: 1364712 - protein, 17 aa, Mycobacterium tuberculosis
GTATRSGLWSPGKIRIG

SEQ ID NO: 1364713 - protein, 7 aa, Mycobacterium tuberculosis
GTDYVPT

SEQ ID NO: 1364714 - protein, 11 aa, Mycobacterium tuberculosis
GTFSPDPRPNA

SEQ ID NO: 1364715 - protein, 4 aa, Mycobacterium tuberculosis
GTGT

SEQ ID NO: 1364716 - protein, 6 aa, Mycobacterium tuberculosis
GTLTEN

SEQ ID NO: 1364717 - protein, 7 aa, Mycobacterium tuberculosis
GTSGRSV

SEQ ID NO: 1364718 - protein, 19 aa, Mycobacterium tuberculosis
GTTDGKSQADISEITIYAA

SEQ ID NO: 1364719 - protein, 8 aa, Mycobacterium tuberculosis
GTVSTAPA

SEQ ID NO: 1364720 - protein, 11 aa, Mycobacterium tuberculosis
GTVTNTGDRPV

SEQ ID NO: 1364721 - protein, 9 aa, Mycobacterium tuberculosis
GVGGPSSRV

SEQ ID NO: 1364722 - protein, 7 aa, Mycobacterium tuberculosis
GVNDAPA

SEQ ID NO: 1364723 - protein, 13 aa, Mycobacterium tuberculosis
GVPGRGPETRTAN

SEQ ID NO: 1364724 - protein, 6 aa, Mycobacterium tuberculosis
HETTAT

SEQ ID NO: 1364725 - protein, 8 aa, Mycobacterium tuberculosis
HNGGGPLG

SEQ ID NO: 1364726 - protein, 4 aa, Mycobacterium tuberculosis
HSIT

SEQ ID NO: 1364727 - protein, 5 aa, Mycobacterium tuberculosis
IDGPT

SEQ ID NO: 1364728 - protein, 10 aa, Mycobacterium tuberculosis
IGEKTKGRNW

SEQ ID NO: 1364729 - protein, 6 aa, Mycobacterium tuberculosis
IGNGAR

SEQ ID NO: 1364730 - protein, 11 aa, Mycobacterium tuberculosis
IPPGADPDPGV

SEQ ID NO: 1364731 - protein, 5 aa, Mycobacterium tuberculosis
KAETE

SEQ ID NO: 1364732 - protein, 5 aa, Mycobacterium tuberculosis
KALKR

SEQ ID NO: 1364733 - protein, 7 aa, Mycobacterium tuberculosis
KARLGDP

SEQ ID NO: 1364734 - protein, 6 aa, Mycobacterium tuberculosis
KEDKQN

SEQ ID NO: 1364735 - protein, 6 aa, Mycobacterium tuberculosis
KEFDET

SEQ ID NO: 1364736 - protein, 14 aa, Mycobacterium tuberculosis
KEPPPPLPPDLPPN

SEQ ID NO: 1364737 - protein, 8 aa, Mycobacterium tuberculosis
KGDEPLVT

SEQ ID NO: 1364738 - protein, 7 aa, Mycobacterium tuberculosis
KGSPPTI

SEQ ID NO: 1364739 - protein, 13 aa, Mycobacterium tuberculosis
KGTAKKGEVPARP

SEQ ID NO: 1364740 - protein, 5 aa, Mycobacterium tuberculosis
KHGGA

SEQ ID NO: 1364741 - protein, 11 aa, Mycobacterium tuberculosis
KHSKMSQEDQV

SEQ ID NO: 1364742 - protein, 12 aa, Mycobacterium tuberculosis
KPVQPPQPVAEE

SEQ ID NO: 1364743 - protein, 41 aa, Mycobacterium tuberculosis; identical to SEQ ID NO: 152114

SEQ ID NO: 1364744 - protein, 9 aa, Mycobacterium tuberculosis
LARPDTAPA

SEQ ID NO: 1364745 - protein, 7 aa, Mycobacterium tuberculosis
LDGRTNE

SEQ ID NO: 1364746 - protein, 4 aa, Mycobacterium tuberculosis
LDPR

SEQ ID NO: 1364747 - protein, 18 aa, Mycobacterium tuberculosis
LDPRSTRRLDGHTDAPAD

SEQ ID NO: 1364748 - protein, 6 aa, Mycobacterium tuberculosis
LGHGDP

SEQ ID NO: 1364749 - protein, 4 aa, Mycobacterium tuberculosis
LGSP

SEQ ID NO: 1364750 - protein, 11 aa, Mycobacterium tuberculosis
LKDSGKTISDT

SEQ ID NO: 1364751 - protein, 6 aa, Mycobacterium tuberculosis
LNEGRG

SEQ ID NO: 1364752 - protein, 18 aa, Mycobacterium tuberculosis
LNRQTAEAERGGSDRPTT

SEQ ID NO: 1364753 - protein, 5 aa, Mycobacterium tuberculosis
LPGGP

SEQ ID NO: 1364754 - protein, 17 aa, Mycobacterium tuberculosis
LPGTGAFDPAGTSAIGS

SEQ ID NO: 1364755 - protein, 17 aa, Mycobacterium tuberculosis
LPNRRRRGRGRASRARL

SEQ ID NO: 1364756 - protein, 11 aa, Mycobacterium tuberculosis
LPQATPNGAAP

SEQ ID NO: 1364757 - protein, 7 aa, Mycobacterium tuberculosis
LPTTRTA

SEQ ID NO: 1364758 - protein, 8 aa, Mycobacterium tuberculosis
LRAPAADE

SEQ ID NO: 1364759 - protein, 25 aa, Mycobacterium tuberculosis
LSGGSYQNLETSASPDLATAVNIFL

SEQ ID NO: 1364760 - protein, 10 aa, Mycobacterium tuberculosis
LTARGGERGM

SEQ ID NO: 1364761 - protein, 4 aa, Mycobacterium tuberculosis
MPAD

SEQ ID NO: 1364762 - protein, 80 aa, Mycobacterium tuberculosis; identical to SEQ ID NO: 152427

SEQ ID NO: 1364763 - protein, 6 aa, Mycobacterium tuberculosis
NANYPQ

SEQ ID NO: 1364764 - protein, 4 aa, Mycobacterium tuberculosis
NDAK

SEQ ID NO: 1364765 - protein, 16 aa, Mycobacterium tuberculosis
NDYSDGIRGTDDDRVG

SEQ ID NO: 1364766 - protein, 4 aa, Mycobacterium tuberculosis
NEES

SEQ ID NO: 1364767 - protein, 10 aa, Mycobacterium tuberculosis
NGEETRSLDS

SEQ ID NO: 1364768 - protein, 10 aa, Mycobacterium tuberculosis
NGTGKTTTVG

SEQ ID NO: 1364769 - protein, 8 aa, Mycobacterium tuberculosis
NPDLPRSE

SEQ ID NO: 1364770 - protein, 11 aa, Mycobacterium tuberculosis
NPETGKYGPIY

SEQ ID NO: 1364771 - protein, 5 aa, Mycobacterium tuberculosis
NQAGQ

SEQ ID NO: 1364772 - protein, 7 aa, Mycobacterium tuberculosis
NRQPPER

SEQ ID NO: 1364773 - protein, 8 aa, Mycobacterium tuberculosis
NSRQLGTA

SEQ ID NO: 1364774 - protein, 6 aa, Mycobacterium tuberculosis
NTRIGQ

SEQ ID NO: 1364775 - protein, 19 aa, Mycobacterium tuberculosis
PAGGLSNDAVRQAAAKVGQ

SEQ ID NO: 1364776 - protein, 8 aa, Mycobacterium tuberculosis
PALTRSGA

SEQ ID NO: 1364777 - protein, 23 aa, Mycobacterium tuberculosis
PANRVNAAARDAENISDSNSGYP

SEQ ID NO: 1364778 - protein, 5 aa, Mycobacterium tuberculosis
PARRP

SEQ ID NO: 1364779 - protein, 4 aa, Mycobacterium tuberculosis
PDGH

SEQ ID NO: 1364780 - protein, 7 aa, Mycobacterium tuberculosis
PDGPLTG

SEQ ID NO: 1364781 - protein, 6 aa, Mycobacterium tuberculosis
PDPLDG

SEQ ID NO: 1364782 - protein, 4 aa, Mycobacterium tuberculosis
PDTD

SEQ ID NO: 1364783 - protein, 10 aa, Mycobacterium tuberculosis
PEAARTPSTT

SEQ ID NO: 1364784 - protein, 10 aa, Mycobacterium tuberculosis
PGCAPGPDGV

SEQ ID NO: 1364785 - protein, 4 aa, Mycobacterium tuberculosis
PGER

SEQ ID NO: 1364786 - protein, 7 aa, Mycobacterium tuberculosis
PGKRAPT

SEQ ID NO: 1364787 - protein, 8 aa, Mycobacterium tuberculosis
PGNEQAAA

SEQ ID NO: 1364788 - protein, 13 aa, Mycobacterium tuberculosis
PGNVAANVSSGAQ

SEQ ID NO: 1364789 - protein, 7 aa, Mycobacterium tuberculosis
PNAPPID

SEQ ID NO: 1364790 - protein, 4 aa, Mycobacterium tuberculosis
PNLG

SEQ ID NO: 1364791 - protein, 5 aa, Mycobacterium tuberculosis
PNLSP

SEQ ID NO: 1364792 - protein, 5 aa, Mycobacterium tuberculosis
PPEAD

SEQ ID NO: 1364793 - protein, 11 aa, Mycobacterium tuberculosis
PPENPSSTKLR

SEQ ID NO: 1364794 - protein, 4 aa, Mycobacterium tuberculosis
PPGA

SEQ ID NO: 1364795 - protein, 6 aa, Mycobacterium tuberculosis
PPGRSA

SEQ ID NO: 1364796 - protein, 9 aa, Mycobacterium tuberculosis
PPPPPPQPA

SEQ ID NO: 1364797 - protein, 5 aa, Mycobacterium tuberculosis
PPRVP

SEQ ID NO: 1364798 - protein, 7 aa, Mycobacterium tuberculosis
PQEDGPK

SEQ ID NO: 1364799 - protein, 5 aa, Mycobacterium tuberculosis
PQYSD

SEQ ID NO: 1364800 - protein, 13 aa, Mycobacterium tuberculosis
PRNRRSRVNPDAT

SEQ ID NO: 1364801 - protein, 10 aa, Mycobacterium tuberculosis
PSSGNGDAAY

SEQ ID NO: 1364802 - protein, 5 aa, Mycobacterium tuberculosis
PTADK

SEQ ID NO: 1364803 - protein, 15 aa, Mycobacterium tuberculosis
PTPHSRASLARYEIA

SEQ ID NO: 1364804 - protein, 10 aa, Mycobacterium tuberculosis
QAAEEGGESS

SEQ ID NO: 1364805 - protein, 8 aa, Mycobacterium tuberculosis
QAAPTADE

SEQ ID NO: 1364806 - protein, 11 aa, Mycobacterium tuberculosis
QAFSPANLPTT

SEQ ID NO: 1364807 - protein, 8 aa, Mycobacterium tuberculosis
QAGNGLSD

SEQ ID NO: 1364808 - protein, 8 aa, Mycobacterium tuberculosis
QHTPESAD

SEQ ID NO: 1364809 - protein, 26 aa, Mycobacterium tuberculosis
QLHGGTASLENSPLGGARLVLRLPGP

SEQ ID NO: 1364810 - protein, 9 aa, Mycobacterium tuberculosis
QNTSTAGVG

SEQ ID NO: 1364811 - protein, 4 aa, Mycobacterium tuberculosis
QPPL

SEQ ID NO: 1364812 - protein, 26 aa, Mycobacterium tuberculosis
QPPPPPGPVPAPGPAQAPPPESPAQG

SEQ ID NO: 1364813 - protein, 11 aa, Mycobacterium tuberculosis
QPQTPNGSINP

SEQ ID NO: 1364814 - protein, 13 aa, Mycobacterium tuberculosis
QPTAQPLPQSPAE

SEQ ID NO: 1364815 - protein, 6 aa, Mycobacterium tuberculosis
QQASAR

SEQ ID NO: 1364816 - protein, 6 aa, Mycobacterium tuberculosis
QRPALQ

SEQ ID NO: 1364817 - protein, 4 aa, Mycobacterium tuberculosis
QRSQ

SEQ ID NO: 1364818 - protein, 8 aa, Mycobacterium tuberculosis
QSSSTGGP

SEQ ID NO: 1364819 - protein, 8 aa, Mycobacterium tuberculosis
QSTVPGDA

SEQ ID NO: 1364820 - protein, 12 aa, Mycobacterium tuberculosis
QTSNAGEADPVP

SEQ ID NO: 1364821 - protein, 6 aa, Mycobacterium tuberculosis
QVNGGP

SEQ ID NO: 1364822 - protein, 11 aa, Mycobacterium tuberculosis
QVTTTSPKEVT

SEQ ID NO: 1364823 - protein, 13 aa, Mycobacterium tuberculosis
QYGGAAARGLDEA

SEQ ID NO: 1364824 - protein, 8 aa, Mycobacterium tuberculosis
RADPRLGE

SEQ ID NO: 1364825 - protein, 8 aa, Mycobacterium tuberculosis
RAQIPERT

SEQ ID NO: 1364826 - protein, 11 aa, Mycobacterium tuberculosis
RAQPPASTGPV

SEQ ID NO: 1364827 - protein, 6 aa, Mycobacterium tuberculosis
RARTTV

SEQ ID NO: 1364828 - protein, 4 aa, Mycobacterium tuberculosis
RDGT

SEQ ID NO: 1364829 - protein, 9 aa, Mycobacterium tuberculosis
RDRDGAAPI

SEQ ID NO: 1364830 - protein, 13 aa, Mycobacterium tuberculosis
RDSEPSVAGKDPF

SEQ ID NO: 1364831 - protein, 12 aa, Mycobacterium tuberculosis
RGHEQPTRLAVP

SEQ ID NO: 1364832 - protein, 16 aa, Mycobacterium tuberculosis
RGSKVGELAQDTRTSL

SEQ ID NO: 1364833 - protein, 12 aa, Mycobacterium tuberculosis
RGSTASHSGSGL

SEQ ID NO: 1364834 - protein, 7 aa, Mycobacterium tuberculosis
RHAQDQR

SEQ ID NO: 1364835 - protein, 7 aa, Mycobacterium tuberculosis
RLASAGP

SEQ ID NO: 1364836 - protein, 13 aa, Mycobacterium tuberculosis
RLDGERAPVPSAR

SEQ ID NO: 1364837 - protein, 4 aa, Mycobacterium tuberculosis
RLTA

SEQ ID NO: 1364838 - protein, 7 aa, Mycobacterium tuberculosis
RPPAPLT

SEQ ID NO: 1364839 - protein, 15 aa, Mycobacterium tuberculosis
RPPDLPPGTHDAQTD

SEQ ID NO: 1364840 - protein, 17 aa, Mycobacterium tuberculosis
RPPEVGVPSENPRLDEP

SEQ ID NO: 1364841 - protein, 7 aa, Mycobacterium tuberculosis
RPTASSD

SEQ ID NO: 1364842 - protein, 5 aa, Mycobacterium tuberculosis
RPTGV

SEQ ID NO: 1364843 - protein, 18 aa, Mycobacterium tuberculosis
RPVPQPWPSPASARTFAL

SEQ ID NO: 1364844 - protein, 5 aa, Mycobacterium tuberculosis
RQAET

SEQ ID NO: 1364845 - protein, 5 aa, Mycobacterium tuberculosis
RRSAE

SEQ ID NO: 1364846 - protein, 7 aa, Mycobacterium tuberculosis
RSGGPFA

SEQ ID NO: 1364847 - protein, 5 aa, Mycobacterium tuberculosis
RSGIR

SEQ ID NO: 1364848 - protein, 10 aa, Mycobacterium tuberculosis
RSPADESVRE

SEQ ID NO: 1364849 - protein, 9 aa, Mycobacterium tuberculosis
RTAHDDDGI

SEQ ID NO: 1364850 - protein, 16 aa, Mycobacterium tuberculosis
RTSPAPAKPAPNSGRR

SEQ ID NO: 1364851 - protein, 4 aa, Mycobacterium tuberculosis
RVSD

SEQ ID NO: 1364852 - protein, 8 aa, Mycobacterium tuberculosis
SADPAKPI

SEQ ID NO: 1364853 - protein, 12 aa, Mycobacterium tuberculosis
SAESLKETLRGQ

SEQ ID NO: 1364854 - protein, 9 aa, Mycobacterium tuberculosis
SARQASETR

SEQ ID NO: 1364855 - protein, 4 aa, Mycobacterium tuberculosis
SDAD

SEQ ID NO: 1364856 - protein, 8 aa, Mycobacterium tuberculosis
SDGEPATE

SEQ ID NO: 1364857 - protein, 26 aa, Mycobacterium tuberculosis
SDSPDGAAQLPGTPTHPGTGQAAASS

SEQ ID NO: 1364858 - protein, 13 aa, Mycobacterium tuberculosis
SEDGPALPGSDLS

SEQ ID NO: 1364859 - protein, 7 aa, Mycobacterium tuberculosis
SGHQPRV

SEQ ID NO: 1364860 - protein, 4 aa, Mycobacterium tuberculosis
SGIT

SEQ ID NO: 1364861 - protein, 10 aa, Mycobacterium tuberculosis
SGKRPFAGDG

SEQ ID NO: 1364862 - protein, 17 aa, Mycobacterium tuberculosis
SGLTGEFNSDANAIARG

SEQ ID NO: 1364863 - protein, 6 aa, Mycobacterium tuberculosis
SGVTTQ

SEQ ID NO: 1364864 - protein, 7 aa, Mycobacterium tuberculosis
SHLEQAG

SEQ ID NO: 1364865 - protein, 8 aa, Mycobacterium tuberculosis
SKAEAALQ

SEQ ID NO: 1364866 - protein, 7 aa, Mycobacterium tuberculosis
SNGAGTV

SEQ ID NO: 1364867 - protein, 19 aa, Mycobacterium tuberculosis
SNSTGQAGLATTATDQLKR

SEQ ID NO: 1364868 - protein, 6 aa, Mycobacterium tuberculosis
SNTAAT

SEQ ID NO: 1364869 - protein, 8 aa, Mycobacterium tuberculosis
SPDGSVHD

SEQ ID NO: 1364870 - protein, 12 aa, Mycobacterium tuberculosis
SPSVPTANVALI

SEQ ID NO: 1364871 - protein, 4 aa, Mycobacterium tuberculosis
SQPD

SEQ ID NO: 1364872 - protein, 23 aa, Mycobacterium tuberculosis
SRAGANANIGAGDAEDAGGARSD

SEQ ID NO: 1364873 - protein, 8 aa, Mycobacterium tuberculosis
SSEPGDNY

SEQ ID NO: 1364874 - protein, 20 aa, Mycobacterium tuberculosis
SSGPAPDPMHEPPPDNVDEP

SEQ ID NO: 1364875 - protein, 6 aa, Mycobacterium tuberculosis
SSLTGE

SEQ ID NO: 1364876 - protein, 8 aa, Mycobacterium tuberculosis
SSNSAQRA

SEQ ID NO: 1364877 - protein, 5 aa, Mycobacterium tuberculosis
SSRAG

SEQ ID NO: 1364878 - protein, 18 aa, Mycobacterium tuberculosis
SSRPEPSPRPPSVEVQPR

SEQ ID NO: 1364879 - protein, 6 aa, Mycobacterium tuberculosis
STEERR

SEQ ID NO: 1364880 - protein, 6 aa, Mycobacterium tuberculosis
STPTAI

SEQ ID NO: 1364881 - protein, 7 aa, Mycobacterium tuberculosis
TAAAQEA

SEQ ID NO: 1364882 - protein, 13 aa, Mycobacterium tuberculosis
TAAGEPNAAPAAC

SEQ ID NO: 1364883 - protein, 13 aa, Mycobacterium tuberculosis
TAQNDPSTVRGAR

SEQ ID NO: 1364884 - protein, 11 aa, Mycobacterium tuberculosis
TATGGRALPGS

SEQ ID NO: 1364885 - protein, 17 aa, Mycobacterium tuberculosis
TCPPESGPATESLPKSW

SEQ ID NO: 1364886 - protein, 12 aa, Mycobacterium tuberculosis
TEASSGRVPNPY

SEQ ID NO: 1364887 - protein, 14 aa, Mycobacterium tuberculosis
TEDAERQIDSCDPT

SEQ ID NO: 1364888 - protein, 5 aa, Mycobacterium tuberculosis
TGAHS

SEQ ID NO: 1364889 - protein, 9 aa, Mycobacterium tuberculosis
TGASGAGKT

SEQ ID NO: 1364890 - protein, 10 aa, Mycobacterium tuberculosis
TGESDGPPRA

SEQ ID NO: 1364891 - protein, 4 aa, Mycobacterium tuberculosis
TGGI

SEQ ID NO: 1364892 - protein, 9 aa, Mycobacterium tuberculosis
TGPRPGGFG

SEQ ID NO: 1364893 - protein, 7 aa, Mycobacterium tuberculosis
THSSGRI

SEQ ID NO: 1364894 - protein, 10 aa, Mycobacterium tuberculosis
TLPPAGQAPW

SEQ ID NO: 1364895 - protein, 15 aa, Mycobacterium tuberculosis
TLTSKTDPASGAGLA

SEQ ID NO: 1364896 - protein, 19 aa, Mycobacterium tuberculosis
TNANPQPVSESELGHTKRG

SEQ ID NO: 1364897 - protein, 21 aa, Mycobacterium tuberculosis
TPDYSAKKLDTDTWEDGTNGG

SEQ ID NO: 1364898 - protein, 5 aa, Mycobacterium tuberculosis
TPGAV

SEQ ID NO: 1364899 - protein, 7 aa, Mycobacterium tuberculosis
TPKAPGL

SEQ ID NO: 1364900 - protein, 15 aa, Mycobacterium tuberculosis
TPPQTPGGTAPRART

SEQ ID NO: 1364901 - protein, 6 aa, Mycobacterium tuberculosis
TPRPQL

SEQ ID NO: 1364902 - protein, 17 aa, Mycobacterium tuberculosis
TPTAGAHRAPLTNAVSR

SEQ ID NO: 1364903 - protein, 5 aa, Mycobacterium tuberculosis
TPTAL

SEQ ID NO: 1364904 - protein, 8 aa, Mycobacterium tuberculosis
TQEGAEGW

SEQ ID NO: 1364905 - protein, 10 aa, Mycobacterium tuberculosis
TQGAPPSPLQ

SEQ ID NO: 1364906 - protein, 9 aa, Mycobacterium tuberculosis
TRQPDPAGA

SEQ ID NO: 1364907 - protein, 11 aa, Mycobacterium tuberculosis
TSGRAVEAAGD

SEQ ID NO: 1364908 - protein, 7 aa, Mycobacterium tuberculosis
TSYADNP

SEQ ID NO: 1364909 - protein, 14 aa, Mycobacterium tuberculosis
TTARAARRYGAGNR

SEQ ID NO: 1364910 - protein, 4 aa, Mycobacterium tuberculosis
TTPL

SEQ ID NO: 1364911 - protein, 4 aa, Mycobacterium tuberculosis
TTQS

SEQ ID NO: 1364912 - protein, 8 aa, Mycobacterium tuberculosis
TVGGDADK

SEQ ID NO: 1364913 - protein, 6 aa, Mycobacterium tuberculosis
TYGPDR

SEQ ID NO: 1364914 - protein, 6 aa, Mycobacterium tuberculosis
VAAAGD

SEQ ID NO: 1364915 - protein, 13 aa, Mycobacterium tuberculosis
VAAAGSDRQPPID

SEQ ID NO: 1364916 - protein, 32 aa, Mycobacterium tuberculosis; identical to SEQ ID NO: 154820

SEQ ID NO: 1364917 - protein, 8 aa, Mycobacterium tuberculosis
VEQEERGR

SEQ ID NO: 1364918 - protein, 8 aa, Mycobacterium tuberculosis
VEVGPGDE

SEQ ID NO: 1364919 - protein, 10 aa, Mycobacterium tuberculosis
VPAPQPPTPV

SEQ ID NO: 1364920 - protein, 21 aa, Mycobacterium tuberculosis
VPTEVSQRSEGQGPQPTRIPA

SEQ ID NO: 1364921 - protein, 10 aa, Mycobacterium tuberculosis
VQSSLSGSTV

SEQ ID NO: 1364922 - protein, 14 aa, Mycobacterium tuberculosis
VSPPEESRYQMALP

SEQ ID NO: 1364923 - protein, 7 aa, Mycobacterium tuberculosis
VSPPPID

SEQ ID NO: 1364924 - protein, 18 aa, Mycobacterium tuberculosis
VTAESGRAFGRAERSAQL

SEQ ID NO: 1364925 - protein, 7 aa, Mycobacterium tuberculosis
VTASGDC

SEQ ID NO: 1364926 - protein, 4 aa, Mycobacterium tuberculosis
VTVP

SEQ ID NO: 1364927 - protein, 17 aa, Mycobacterium tuberculosis
WEPSPSSAAALAAGDTL

SEQ ID NO: 1364928 - protein, 7 aa, Mycobacterium tuberculosis
YDPVDND

SEQ ID NO: 1364929 - protein, 7 aa, Mycobacterium tuberculosis
YGEQPKA

SEQ ID NO: 1364930 - protein, 12 aa, Mycobacterium tuberculosis
YGESQMNGEGRT

SEQ ID NO: 1364931 - protein, 21 aa, Mycobacterium tuberculosis
YSRGGEKPDGRLYPEDQPERV

SEQ ID NO: 1364932 - protein, 7 aa, Mycobacterium tuberculosis
YSRKDTT

SEQ ID NO: 1364933 - protein, 5 aa, Mycobacterium tuberculosis
YTPGQ

SEQ ID NO: 1364934 - protein, 5 aa, Mycobacterium tuberculosis
YTSDQ

SEQ ID NO: 1364935 - protein, 9 aa, Mycobacterium tuberculosis
AAAETQDRW

SEQ ID NO: 1364936 - protein, 10 aa, Mycobacterium tuberculosis
AAAGQDAQRI

SEQ ID NO: 1364937 - protein, 13 aa, Mycobacterium tuberculosis
AAGDGADATARRR

SEQ ID NO: 1364938 - protein, 6 aa, Mycobacterium tuberculosis
AAGRVA

SEQ ID NO: 1364939 - protein, 4 aa, Mycobacterium tuberculosis
AAQV

SEQ ID NO: 1364940 - protein, 15 aa, Mycobacterium tuberculosis
AARGPHAPDSLPGGP

SEQ ID NO: 1364941 - protein, 7 aa, Mycobacterium tuberculosis
AAYGGDP

SEQ ID NO: 1364942 - protein, 10 aa, Mycobacterium tuberculosis
ADISGSGAAI

SEQ ID NO: 1364943 - protein, 7 aa, Mycobacterium tuberculosis
AEAEGKF

SEQ ID NO: 1364944 - protein, 27 aa, Mycobacterium tuberculosis
AEKAERHRHPDQAADQLAQSPGSLPGD

SEQ ID NO: 1364945 - protein, 12 aa, Mycobacterium tuberculosis
AESGDDSREVIG

SEQ ID NO: 1364946 - protein, 11 aa, Mycobacterium tuberculosis
AESITAKEHPL

SEQ ID NO: 1364947 - protein, 9 aa, Mycobacterium tuberculosis
AGADDQPRY

SEQ ID NO: 1364948 - protein, 7 aa, Mycobacterium tuberculosis
AGARPVV

SEQ ID NO: 1364949 - protein, 14 aa, Mycobacterium tuberculosis
AGAYRATKVGSEAY

SEQ ID NO: 1364950 - protein, 6 aa, Mycobacterium tuberculosis
AGEPAA

SEQ ID NO: 1364951 - protein, 7 aa, Mycobacterium tuberculosis
AGGAGQP

SEQ ID NO: 1364952 - protein, 11 aa, Mycobacterium tuberculosis
AGLTSPAMPAR

SEQ ID NO: 1364953 - protein, 7 aa, Mycobacterium tuberculosis
AGNPGTI

SEQ ID NO: 1364954 - protein, 31 aa, Mycobacterium tuberculosis; identical to SEQ ID NO: 149655

SEQ ID NO: 1364955 - protein, 9 aa, Mycobacterium tuberculosis
AGPDGTTAA

SEQ ID NO: 1364956 - protein, 14 aa, Mycobacterium tuberculosis
AGQPGNDGFSGVAP

SEQ ID NO: 1364957 - protein, 18 aa, Mycobacterium tuberculosis
AGSTGGGGKKVPEINADR

SEQ ID NO: 1364958 - protein, 8 aa, Mycobacterium tuberculosis
AGTAVHDS

SEQ ID NO: 1364959 - protein, 5 aa, Mycobacterium tuberculosis
AHRDD

SEQ ID NO: 1364960 - protein, 6 aa, Mycobacterium tuberculosis
AHRTGA

SEQ ID NO: 1364961 - protein, 13 aa, Mycobacterium tuberculosis
AKALSGELSRETL

SEQ ID NO: 1364962 - protein, 12 aa, Mycobacterium tuberculosis
AKERLSSSTVTT

SEQ ID NO: 1364963 - protein, 16 aa, Mycobacterium tuberculosis
AKGGSYATASAVTGTI

SEQ ID NO: 1364964 - protein, 6 aa, Mycobacterium tuberculosis
AKPAAV

SEQ ID NO: 1364965 - protein, 7 aa, Mycobacterium tuberculosis
AKPNGEL

SEQ ID NO: 1364966 - protein, 6 aa, Mycobacterium tuberculosis
ALEPER

SEQ ID NO: 1364967 - protein, 10 aa, Mycobacterium tuberculosis
ALPEGSTGPL

SEQ ID NO: 1364968 - protein, 21 aa, Mycobacterium tuberculosis
ALPSPDEQAPAKAPPSPYPAR

SEQ ID NO: 1364969 - protein, 8 aa, Mycobacterium tuberculosis
ALPSPGVN

SEQ ID NO: 1364970 - protein, 18 aa, Mycobacterium tuberculosis
ANSSTTGDDGWKEMLAPA

SEQ ID NO: 1364971 - protein, 7 aa, Mycobacterium tuberculosis
APANRGR

SEQ ID NO: 1364972 - protein, 8 aa, Mycobacterium tuberculosis
APEEPANL

SEQ ID NO: 1364973 - protein, 5 aa, Mycobacterium tuberculosis
APKAG

SEQ ID NO: 1364974 - protein, 10 aa, Mycobacterium tuberculosis
APRAEPGLGT

SEQ ID NO: 1364975 - protein, 12 aa, Mycobacterium tuberculosis
APSTTRASGDSD

SEQ ID NO: 1364976 - protein, 19 aa, Mycobacterium tuberculosis
APYGPGSARAGADGSGPQG

SEQ ID NO: 1364977 - protein, 9 aa, Mycobacterium tuberculosis
AQAPRPAPA

SEQ ID NO: 1364978 - protein, 9 aa, Mycobacterium tuberculosis
AQPEAQTAA

SEQ ID NO: 1364979 - protein, 5 aa, Mycobacterium tuberculosis
AQSRR

SEQ ID NO: 1364980 - protein, 17 aa, Mycobacterium tuberculosis
ARAARQRGNEISGGASA

SEQ ID NO: 1364981 - protein, 4 aa, Mycobacterium tuberculosis
ARAG

SEQ ID NO: 1364982 - protein, 4 aa, Mycobacterium tuberculosis
ARAQ

SEQ ID NO: 1364983 - protein, 8 aa, Mycobacterium tuberculosis
ARDDGTLA

SEQ ID NO: 1364984 - protein, 8 aa, Mycobacterium tuberculosis
AREAGRVA

SEQ ID NO: 1364985 - protein, 8 aa, Mycobacterium tuberculosis
ARGDRIPD

SEQ ID NO: 1364986 - protein, 6 aa, Mycobacterium tuberculosis
ARGQDM

SEQ ID NO: 1364987 - protein, 11 aa, Mycobacterium tuberculosis
ARPPARGVDNQ

SEQ ID NO: 1364988 - protein, 9 aa, Mycobacterium tuberculosis
ARTVQESGG

SEQ ID NO: 1364989 - protein, 7 aa, Mycobacterium tuberculosis
ASGSTYP

SEQ ID NO: 1364990 - protein, 30 aa, Mycobacterium tuberculosis
ASPASAITPPPIDPGALPPDVTGPDQPTEQ

SEQ ID NO: 1364991 - protein, 12 aa, Mycobacterium tuberculosis
ASQSLSATVGGV

SEQ ID NO: 1364992 - protein, 5 aa, Mycobacterium tuberculosis
ASRPE

SEQ ID NO: 1364993 - protein, 12 aa, Mycobacterium tuberculosis
ASRSGDLPPAVT

SEQ ID NO: 1364994 - protein, 13 aa, Mycobacterium tuberculosis
ASSPAAGTPSDRW

SEQ ID NO: 1364995 - protein, 17 aa, Mycobacterium tuberculosis
ASTHAGADGWKVMLAPT

SEQ ID NO: 1364996 - protein, 7 aa, Mycobacterium tuberculosis
ATGKTRS

SEQ ID NO: 1364997 - protein, 11 aa, Mycobacterium tuberculosis
ATKGASHTSQM

SEQ ID NO: 1364998 - protein, 9 aa, Mycobacterium tuberculosis
ATLKDGTEL

SEQ ID NO: 1364999 - protein, 12 aa, Mycobacterium tuberculosis
ATPKASRTTPEA

SEQ ID NO: 1365000 - protein, 8 aa, Mycobacterium tuberculosis
ATTNQPID

SEQ ID NO: 1365001 - protein, 30 aa, Mycobacterium tuberculosis; identical to SEQ ID NO: 150198

SEQ ID NO: 1365002 - protein, 19 aa, Mycobacterium tuberculosis
DAADAEALATAAAADAEPD

SEQ ID NO: 1365003 - protein, 6 aa, Mycobacterium tuberculosis
DAPGRR

SEQ ID NO: 1365004 - protein, 7 aa, Mycobacterium tuberculosis
DDPDTSL

SEQ ID NO: 1365005 - protein, 8 aa, Mycobacterium tuberculosis
DDPKWRTG

SEQ ID NO: 1365006 - protein, 6 aa, Mycobacterium tuberculosis
DDYADT

SEQ ID NO: 1365007 - protein, 5 aa, Mycobacterium tuberculosis
DEDTV

SEQ ID NO: 1365008 - protein, 18 aa, Mycobacterium tuberculosis
DERKRPVSNGRPARPPVT

SEQ ID NO: 1365009 - protein, 15 aa, Mycobacterium tuberculosis
DFGTTITGQPVGTEL

SEQ ID NO: 1365010 - protein, 11 aa, Mycobacterium tuberculosis
DGDISYGEYGR

SEQ ID NO: 1365011 - protein, 9 aa, Mycobacterium tuberculosis
DGEIGDGPG

SEQ ID NO: 1365012 - protein, 4 aa, Mycobacterium tuberculosis
DGLG

SEQ ID NO: 1365013 - protein, 6 aa, Mycobacterium tuberculosis
DGSAIG

SEQ ID NO: 1365014 - protein, 5 aa, Mycobacterium tuberculosis
DKEFG

SEQ ID NO: 1365015 - protein, 8 aa, Mycobacterium tuberculosis
DKHGHTTE

SEQ ID NO: 1365016 - protein, 4 aa, Mycobacterium tuberculosis
DLPP

SEQ ID NO: 1365017 - protein, 11 aa, Mycobacterium tuberculosis
DLQRPDAPWGR

SEQ ID NO: 1365018 - protein, 12 aa, Mycobacterium tuberculosis
DPHAGPAEPSIG

SEQ ID NO: 1365019 - protein, 10 aa, Mycobacterium tuberculosis
DPRDKKTPSL

SEQ ID NO: 1365020 - protein, 21 aa, Mycobacterium tuberculosis
DQRCRRRGTNSSDNNTNASAK

SEQ ID NO: 1365021 - protein, 8 aa, Mycobacterium tuberculosis
DRGPGIPV

SEQ ID NO: 1365022 - protein, 6 aa, Mycobacterium tuberculosis
DRIGGA

SEQ ID NO: 1365023 - protein, 6 aa, Mycobacterium tuberculosis
DSPDGV

SEQ ID NO: 1365024 - protein, 13 aa, Mycobacterium tuberculosis
DSSRARASGGTGL

SEQ ID NO: 1365025 - protein, 34 aa, Mycobacterium tuberculosis; identical to SEQ ID NO: 150611

SEQ ID NO: 1365026 - protein, 12 aa, Mycobacterium tuberculosis
DTDPGGQPPGTS

SEQ ID NO: 1365027 - protein, 7 aa, Mycobacterium tuberculosis
DTNRDEI

SEQ ID NO: 1365028 - protein, 10 aa, Mycobacterium tuberculosis
DTRGYKPVDT

SEQ ID NO: 1365029 - protein, 5 aa, Mycobacterium tuberculosis
DYGIE

SEQ ID NO: 1365030 - protein, 7 aa, Mycobacterium tuberculosis
EATATRI

SEQ ID NO: 1365031 - protein, 8 aa, Mycobacterium tuberculosis
EAVPSSRT

SEQ ID NO: 1365032 - protein, 4 aa, Mycobacterium tuberculosis
EAVS

SEQ ID NO: 1365033 - protein, 5 aa, Mycobacterium tuberculosis
EDGAH

SEQ ID NO: 1365034 - protein, 6 aa, Mycobacterium tuberculosis
EDPEPV

SEQ ID NO: 1365035 - protein, 5 aa, Mycobacterium tuberculosis
EESAA

SEQ ID NO: 1365036 - protein, 7 aa, Mycobacterium tuberculosis
EIGRDGL

SEQ ID NO: 1365037 - protein, 10 aa, Mycobacterium tuberculosis
EIPRSPNDQD

SEQ ID NO: 1365038 - protein, 22 aa, Mycobacterium tuberculosis
EKEPEPEPEPKAAAEPAEAPTL

SEQ ID NO: 1365039 - protein, 16 aa, Mycobacterium tuberculosis
ELGGGDGAVSGDTGLP

SEQ ID NO: 1365040 - protein, 16 aa, Mycobacterium tuberculosis
ENPTRQGGAQVLPGNA

SEQ ID NO: 1365041 - protein, 8 aa, Mycobacterium tuberculosis
EPRTEGGV

SEQ ID NO: 1365042 - protein, 8 aa, Mycobacterium tuberculosis
EQLGPDYA

SEQ ID NO: 1365043 - protein, 10 aa, Mycobacterium tuberculosis
ERQRKAQQAI

SEQ ID NO: 1365044 - protein, 9 aa, Mycobacterium tuberculosis
ESALTGESL

SEQ ID NO: 1365045 - protein, 7 aa, Mycobacterium tuberculosis
ESLSQER

SEQ ID NO: 1365046 - protein, 12 aa, Mycobacterium tuberculosis
ESTGGGRRRRRG

SEQ ID NO: 1365047 - protein, 7 aa, Mycobacterium tuberculosis
ESTRADW

SEQ ID NO: 1365048 - protein, 7 aa, Mycobacterium tuberculosis
FDDKGRP

SEQ ID NO: 1365049 - protein, 13 aa, Mycobacterium tuberculosis
FGGEAGPVPDDGF

SEQ ID NO: 1365050 - protein, 6 aa, Mycobacterium tuberculosis
FHDPPW

SEQ ID NO: 1365051 - protein, 8 aa, Mycobacterium tuberculosis
GAAGIGPA

SEQ ID NO: 1365052 - protein, 9 aa, Mycobacterium tuberculosis
GAGAPAPAV

SEQ ID NO: 1365053 - protein, 9 aa, Mycobacterium tuberculosis
GARDANDYE

SEQ ID NO: 1365054 - protein, 27 aa, Mycobacterium tuberculosis
GARRPPRPAPVASPAAAVAPTPKTSRE

SEQ ID NO: 1365055 - protein, 13 aa, Mycobacterium tuberculosis
GASSQGAQTYREA

SEQ ID NO: 1365056 - protein, 8 aa, Mycobacterium tuberculosis
GATTPGPV

SEQ ID NO: 1365057 - protein, 6 aa, Mycobacterium tuberculosis
GDGPQV

SEQ ID NO: 1365058 - protein, 12 aa, Mycobacterium tuberculosis
GDGTNDAPALAQ

SEQ ID NO: 1365059 - protein, 7 aa, Mycobacterium tuberculosis
GEHRDGG

SEQ ID NO: 1365060 - protein, 11 aa, Mycobacterium tuberculosis
GEQIDNAGNAA

SEQ ID NO: 1365061 - protein, 10 aa, Mycobacterium tuberculosis
GERRRAERER

SEQ ID NO: 1365062 - protein, 5 aa, Mycobacterium tuberculosis
GFSGK

SEQ ID NO: 1365063 - protein, 6 aa, Mycobacterium tuberculosis
GGIPGM

SEQ ID NO: 1365064 - protein, 9 aa, Mycobacterium tuberculosis
GHRQAKDPV

SEQ ID NO: 1365065 - protein, 5 aa, Mycobacterium tuberculosis
GIAAG

SEQ ID NO: 1365066 - protein, 7 aa, Mycobacterium tuberculosis
GIQPNPA

SEQ ID NO: 1365067 - protein, 7 aa, Mycobacterium tuberculosis
GKQALSA

SEQ ID NO: 1365068 - protein, 12 aa, Mycobacterium tuberculosis
GLAGKGKQINTT

SEQ ID NO: 1365069 - protein, 5 aa, Mycobacterium tuberculosis
GLSTA

SEQ ID NO: 1365070 - protein, 8 aa, Mycobacterium tuberculosis
GNPDGPAL

SEQ ID NO: 1365071 - protein, 4 aa, Mycobacterium tuberculosis
GPLR

SEQ ID NO: 1365072 - protein, 34 aa, Mycobacterium tuberculosis; identical to SEQ ID NO: 151407

SEQ ID NO: 1365073 - protein, 5 aa, Mycobacterium tuberculosis
GPSPY

SEQ ID NO: 1365074 - protein, 6 aa, Mycobacterium tuberculosis
GPVTTG

SEQ ID NO: 1365075 - protein, 4 aa, Mycobacterium tuberculosis
GQSI

SEQ ID NO: 1365076 - protein, 70 aa, Mycobacterium tuberculosis; identical to SEQ ID NO: 151473

SEQ ID NO: 1365077 - protein, 5 aa, Mycobacterium tuberculosis
GRSQM

SEQ ID NO: 1365078 - protein, 5 aa, Mycobacterium tuberculosis
GRTGR

SEQ ID NO: 1365079 - protein, 18 aa, Mycobacterium tuberculosis
GRTNRNPVQMPAPEPAIA

SEQ ID NO: 1365080 - protein, 6 aa, Mycobacterium tuberculosis
GSAARV

SEQ ID NO: 1365081 - protein, 7 aa, Mycobacterium tuberculosis
GSAASAT

SEQ ID NO: 1365082 - protein, 9 aa, Mycobacterium tuberculosis
GSQRGADAA

SEQ ID NO: 1365083 - protein, 17 aa, Mycobacterium tuberculosis
GSTHPVRPKIYRPPDHS

SEQ ID NO: 1365084 - protein, 7 aa, Mycobacterium tuberculosis
GSVATYS

SEQ ID NO: 1365085 - protein, 5 aa, Mycobacterium tuberculosis
GTATL

SEQ ID NO: 1365086 - protein, 18 aa, Mycobacterium tuberculosis
GTEDLSASVGSTHPPGTP

SEQ ID NO: 1365087 - protein, 7 aa, Mycobacterium tuberculosis
GTQPDYS

SEQ ID NO: 1365088 - protein, 4 aa, Mycobacterium tuberculosis
GVPV

SEQ ID NO: 1365089 - protein, 4 aa, Mycobacterium tuberculosis
GVTN

SEQ ID NO: 1365090 - protein, 6 aa, Mycobacterium tuberculosis
HGAGRA

SEQ ID NO: 1365091 - protein, 19 aa, Mycobacterium tuberculosis
HHAGPDAHASQSPAANGRV

SEQ ID NO: 1365092 - protein, 8 aa, Mycobacterium tuberculosis
HLPSKENG

SEQ ID NO: 1365093 - protein, 4 aa, Mycobacterium tuberculosis
HPEK

SEQ ID NO: 1365094 - protein, 8 aa, Mycobacterium tuberculosis
HPGVGSAS

SEQ ID NO: 1365095 - protein, 12 aa, Mycobacterium tuberculosis
HRANGQPPERAH

SEQ ID NO: 1365096 - protein, 6 aa, Mycobacterium tuberculosis
HRHRPA

SEQ ID NO: 1365097 - protein, 6 aa, Mycobacterium tuberculosis
HRSPRR

SEQ ID NO: 1365098 - protein, 4 aa, Mycobacterium tuberculosis
HRTG

SEQ ID NO: 1365099 - protein, 22 aa, Mycobacterium tuberculosis
HSDRAPAGPPSGAEHMSPDPVE

SEQ ID NO: 1365100 - protein, 7 aa, Mycobacterium tuberculosis
HSGSTAR

SEQ ID NO: 1365101 - protein, 4 aa, Mycobacterium tuberculosis
HSPD

SEQ ID NO: 1365102 - protein, 6 aa, Mycobacterium tuberculosis
IDTSSA

SEQ ID NO: 1365103 - protein, 9 aa, Mycobacterium tuberculosis
IGAGATAQL

SEQ ID NO: 1365104 - protein, 8 aa, Mycobacterium tuberculosis
IGGPPEQV

SEQ ID NO: 1365105 - protein, 6 aa, Mycobacterium tuberculosis
IGQNGL

SEQ ID NO: 1365106 - protein, 6 aa, Mycobacterium tuberculosis
IKGDAS

SEQ ID NO: 1365107 - protein, 8 aa, Mycobacterium tuberculosis
IKPGGEPI

SEQ ID NO: 1365108 - protein, 11 aa, Mycobacterium tuberculosis
ISTSPSSSTFP

SEQ ID NO: 1365109 - protein, 14 aa, Mycobacterium tuberculosis
ITSGSADGQRRSPR

SEQ ID NO: 1365110 - protein, 8 aa, Mycobacterium tuberculosis
KAGTDYAD

SEQ ID NO: 1365111 - protein, 15 aa, Mycobacterium tuberculosis
KCNNGSDPTVKKGAT

SEQ ID NO: 1365112 - protein, 5 aa, Mycobacterium tuberculosis
KDDSL

SEQ ID NO: 1365113 - protein, 5 aa, Mycobacterium tuberculosis
KEVAR

SEQ ID NO: 1365114 - protein, 15 aa, Mycobacterium tuberculosis
KFSPRTSGGDPQLAQ

SEQ ID NO: 1365115 - protein, 6 aa, Mycobacterium tuberculosis
KLPPSI

SEQ ID NO: 1365116 - protein, 11 aa, Mycobacterium tuberculosis
KPGADLDEDTI

SEQ ID NO: 1365117 - protein, 5 aa, Mycobacterium tuberculosis
KPPGL

SEQ ID NO: 1365118 - protein, 7 aa, Mycobacterium tuberculosis
KQRGKTT

SEQ ID NO: 1365119 - protein, 8 aa, Mycobacterium tuberculosis
KQVEPTPG

SEQ ID NO: 1365120 - protein, 6 aa, Mycobacterium tuberculosis
KTPPTL

SEQ ID NO: 1365121 - protein, 13 aa, Mycobacterium tuberculosis
LAGPNATHDADKP

SEQ ID NO: 1365122 - protein, 5 aa, Mycobacterium tuberculosis
LAPNG

SEQ ID NO: 1365123 - protein, 17 aa, Mycobacterium tuberculosis
LATAPSTIRQGTSARNV

SEQ ID NO: 1365124 - protein, 9 aa, Mycobacterium tuberculosis
LGAASSSCS

SEQ ID NO: 1365125 - protein, 5 aa, Mycobacterium tuberculosis
LGATR

SEQ ID NO: 1365126 - protein, 5 aa, Mycobacterium tuberculosis
LGEAA

SEQ ID NO: 1365127 - protein, 21 aa, Mycobacterium tuberculosis
LGGGGPGSARQDGSPKVPGIG

SEQ ID NO: 1365128 - protein, 7 aa, Mycobacterium tuberculosis
LGHTGPF

SEQ ID NO: 1365129 - protein, 12 aa, Mycobacterium tuberculosis
LGPGPVTTGAAA

SEQ ID NO: 1365130 - protein, 8 aa, Mycobacterium tuberculosis
LGTAGAAA

SEQ ID NO: 1365131 - protein, 4 aa, Mycobacterium tuberculosis
LNPD

SEQ ID NO: 1365132 - protein, 6 aa, Mycobacterium tuberculosis
LPRDAK

SEQ ID NO: 1365133 - protein, 18 aa, Mycobacterium tuberculosis
LRPEAAAAISAATKLTGA

SEQ ID NO: 1365134 - protein, 15 aa, Mycobacterium tuberculosis
LSSSPSDSASSLNEH

SEQ ID NO: 1365135 - protein, 8 aa, Mycobacterium tuberculosis
LSTDGKSG

SEQ ID NO: 1365136 - protein, 12 aa, Mycobacterium tuberculosis
LTPGRGFRNGPF

SEQ ID NO: 1365137 - protein, 15 aa, Mycobacterium tuberculosis
LTTPKNPTKRRITPK

SEQ ID NO: 1365138 - protein, 5 aa, Mycobacterium tuberculosis
MNPNG

SEQ ID NO: 1365139 - protein, 13 aa, Mycobacterium tuberculosis
MPSNVGDAAAGRH

SEQ ID NO: 1365140 - protein, 17 aa, Mycobacterium tuberculosis
MTPQRSLTRGLTPAPTA

SEQ ID NO: 1365141 - protein, 9 aa, Mycobacterium tuberculosis
NADQLADQA

SEQ ID NO: 1365142 - protein, 8 aa, Mycobacterium tuberculosis
NARRAPNR

SEQ ID NO: 1365143 - protein, 5 aa, Mycobacterium tuberculosis
NERGD

SEQ ID NO: 1365144 - protein, 8 aa, Mycobacterium tuberculosis
NLGKDERH

SEQ ID NO: 1365145 - protein, 11 aa, Mycobacterium tuberculosis
NRAAGRRRVPD

SEQ ID NO: 1365146 - protein, 8 aa, Mycobacterium tuberculosis
NRQEKRDR

SEQ ID NO: 1365147 - protein, 12 aa, Mycobacterium tuberculosis
NRQGHPGTRDRL

SEQ ID NO: 1365148 - protein, 19 aa, Mycobacterium tuberculosis
NTRSPLDFTSDPGAKPDGI

SEQ ID NO: 1365149 - protein, 12 aa, Mycobacterium tuberculosis
PAAGGPPRGQVQ

SEQ ID NO: 1365150 - protein, 29 aa, Mycobacterium tuberculosis
PAEPGGGAAPAKPVADPPVPAPKDTTPRN

SEQ ID NO: 1365151 - protein, 18 aa, Mycobacterium tuberculosis
PAEVAEAGPESPADPEIE

SEQ ID NO: 1365152 - protein, 12 aa, Mycobacterium tuberculosis
PAPAGADGSGAN

SEQ ID NO: 1365153 - protein, 10 aa, Mycobacterium tuberculosis
PAPQATGPGC

SEQ ID NO: 1365154 - protein, 5 aa, Mycobacterium tuberculosis
PASRS

SEQ ID NO: 1365155 - protein, 9 aa, Mycobacterium tuberculosis
PDDASSFGD

SEQ ID NO: 1365156 - protein, 21 aa, Mycobacterium tuberculosis
PDIAPPSSGLQTPPGPPNAYD

SEQ ID NO: 1365157 - protein, 7 aa, Mycobacterium tuberculosis
PDNPQRA

SEQ ID NO: 1365158 - protein, 7 aa, Mycobacterium tuberculosis
PDPAGQP

SEQ ID NO: 1365159 - protein, 5 aa, Mycobacterium tuberculosis
PDTGA

SEQ ID NO: 1365160 - protein, 8 aa, Mycobacterium tuberculosis
PEDDPEAR

SEQ ID NO: 1365161 - protein, 9 aa, Mycobacterium tuberculosis
PEDPTYDPT

SEQ ID NO: 1365162 - protein, 6 aa, Mycobacterium tuberculosis
PERRSA

SEQ ID NO: 1365163 - protein, 8 aa, Mycobacterium tuberculosis
PGGVGPGG

SEQ ID NO: 1365164 - protein, 22 aa, Mycobacterium tuberculosis
PGPVPPTPAPVGAPLPAEAGGG

SEQ ID NO: 1365165 - protein, 6 aa, Mycobacterium tuberculosis
PLPSLA

SEQ ID NO: 1365166 - protein, 11 aa, Mycobacterium tuberculosis
PLSGEGSDTDT

SEQ ID NO: 1365167 - protein, 8 aa, Mycobacterium tuberculosis
PNNERAYP

SEQ ID NO: 1365168 - protein, 10 aa, Mycobacterium tuberculosis
PPPGAGAPPW

SEQ ID NO: 1365169 - protein, 12 aa, Mycobacterium tuberculosis
PQADIDRPVGSA

SEQ ID NO: 1365170 - protein, 4 aa, Mycobacterium tuberculosis
PQPA

SEQ ID NO: 1365171 - protein, 19 aa, Mycobacterium tuberculosis
PQTVPDATHPGAEQVTHPG

SEQ ID NO: 1365172 - protein, 4 aa, Mycobacterium tuberculosis
PRDL

SEQ ID NO: 1365173 - protein, 22 aa, Mycobacterium tuberculosis
PREQVSQPATAASDYSAGGAES

SEQ ID NO: 1365174 - protein, 12 aa, Mycobacterium tuberculosis
PRPARSTQPVQR

SEQ ID NO: 1365175 - protein, 20 aa, Mycobacterium tuberculosis
PSAATTSPPPSPQQEKPPRL

SEQ ID NO: 1365176 - protein, 10 aa, Mycobacterium tuberculosis
PSGSGPTAIQ

SEQ ID NO: 1365177 - protein, 8 aa, Mycobacterium tuberculosis
PSPLPDEP

SEQ ID NO: 1365178 - protein, 5 aa, Mycobacterium tuberculosis
PTAAE

SEQ ID NO: 1365179 - protein, 4 aa, Mycobacterium tuberculosis
PTRR

SEQ ID NO: 1365180 - protein, 8 aa, Mycobacterium tuberculosis
PTTLPGSG

SEQ ID NO: 1365181 - protein, 21 aa, Mycobacterium tuberculosis
PVAEPTTAGATAWRTGPNSTP

SEQ ID NO: 1365182 - protein, 10 aa, Mycobacterium tuberculosis
QANSPSTPEL

SEQ ID NO: 1365183 - protein, 12 aa, Mycobacterium tuberculosis
QASSGGSAHPVY

SEQ ID NO: 1365184 - protein, 5 aa, Mycobacterium tuberculosis
QAYDD

SEQ ID NO: 1365185 - protein, 6 aa, Mycobacterium tuberculosis
QDPTAL

SEQ ID NO: 1365186 - protein, 27 aa, Mycobacterium tuberculosis
QEDAEDDSRPDAAEAAAAEPKSSAGPM

SEQ ID NO: 1365187 - protein, 8 aa, Mycobacterium tuberculosis
QEKKRTAR

SEQ ID NO: 1365188 - protein, 5 aa, Mycobacterium tuberculosis
QGKSQ

SEQ ID NO: 1365189 - protein, 8 aa, Mycobacterium tuberculosis
QLATRGPK

SEQ ID NO: 1365190 - protein, 25 aa, Mycobacterium tuberculosis
QLSTPGAGLSSATVTSAETGAWGPT

SEQ ID NO: 1365191 - protein, 11 aa, Mycobacterium tuberculosis
QNAAPPSPARI

SEQ ID NO: 1365192 - protein, 10 aa, Mycobacterium tuberculosis
QNPDEPGRST

SEQ ID NO: 1365193 - protein, 15 aa, Mycobacterium tuberculosis
QPDERPDDAEDSDAG

SEQ ID NO: 1365194 - protein, 29 aa, Mycobacterium tuberculosis
QQEPKQPPAPEPRPAPPPAKPAPPAGPVD

SEQ ID NO: 1365195 - protein, 10 aa, Mycobacterium tuberculosis
QRTKTREEVE

SEQ ID NO: 1365196 - protein, 7 aa, Mycobacterium tuberculosis
QSPARAT

SEQ ID NO: 1365197 - protein, 8 aa, Mycobacterium tuberculosis
QVNSGNEI

SEQ ID NO: 1365198 - protein, 12 aa, Mycobacterium tuberculosis
RAGRPPRAHRPH

SEQ ID NO: 1365199 - protein, 6 aa, Mycobacterium tuberculosis
RDPSQT

SEQ ID NO: 1365200 - protein, 8 aa, Mycobacterium tuberculosis
RDVAERQR

SEQ ID NO: 1365201 - protein, 7 aa, Mycobacterium tuberculosis
RGDCPDD

SEQ ID NO: 1365202 - protein, 11 aa, Mycobacterium tuberculosis
RGPEGADPASV

SEQ ID NO: 1365203 - protein, 8 aa, Mycobacterium tuberculosis
RGRAQNAM

SEQ ID NO: 1365204 - protein, 4 aa, Mycobacterium tuberculosis
RIGV

SEQ ID NO: 1365205 - protein, 8 aa, Mycobacterium tuberculosis
RKKAAAAE

SEQ ID NO: 1365206 - protein, 6 aa, Mycobacterium tuberculosis
RKNQYD

SEQ ID NO: 1365207 - protein, 14 aa, Mycobacterium tuberculosis
RLPPPGSAARPAMS

SEQ ID NO: 1365208 - protein, 5 aa, Mycobacterium tuberculosis
RMGRP

SEQ ID NO: 1365209 - protein, 15 aa, Mycobacterium tuberculosis
RNGITVKDSDGTVRR

SEQ ID NO: 1365210 - protein, 6 aa, Mycobacterium tuberculosis
RQGPKL

SEQ ID NO: 1365211 - protein, 13 aa, Mycobacterium tuberculosis
RQLADRPTPPWRP

SEQ ID NO: 1365212 - protein, 7 aa, Mycobacterium tuberculosis
RQPIPPW

SEQ ID NO: 1365213 - protein, 7 aa, Mycobacterium tuberculosis
RRGRGDD

SEQ ID NO: 1365214 - protein, 7 aa, Mycobacterium tuberculosis
RRSERQA

SEQ ID NO: 1365215 - protein, 15 aa, Mycobacterium tuberculosis
RSAGTEPAGQVNPTA

SEQ ID NO: 1365216 - protein, 5 aa, Mycobacterium tuberculosis
RSDTR

SEQ ID NO: 1365217 - protein, 8 aa, Mycobacterium tuberculosis
RSSAPAGA

SEQ ID NO: 1365218 - protein, 11 aa, Mycobacterium tuberculosis
RTASSDPEARR

SEQ ID NO: 1365219 - protein, 16 aa, Mycobacterium tuberculosis
RTGRSHARESSQGPNQ

SEQ ID NO: 1365220 - protein, 6 aa, Mycobacterium tuberculosis
RTSPAL

SEQ ID NO: 1365221 - protein, 8 aa, Mycobacterium tuberculosis
RTSTGARL

SEQ ID NO: 1365222 - protein, 4 aa, Mycobacterium tuberculosis
RVDP

SEQ ID NO: 1365223 - protein, 9 aa, Mycobacterium tuberculosis
RYPASGGTY

SEQ ID NO: 1365224 - protein, 7 aa, Mycobacterium tuberculosis
SAAGAAS

SEQ ID NO: 1365225 - protein, 6 aa, Mycobacterium tuberculosis
SACPVE

SEQ ID NO: 1365226 - protein, 4 aa, Mycobacterium tuberculosis
SAGA

SEQ ID NO: 1365227 - protein, 7 aa, Mycobacterium tuberculosis
SAGATVP

SEQ ID NO: 1365228 - protein, 9 aa, Mycobacterium tuberculosis
SAHATSTTA

SEQ ID NO: 1365229 - protein, 7 aa, Mycobacterium tuberculosis
SAPVVGP

SEQ ID NO: 1365230 - protein, 6 aa, Mycobacterium tuberculosis
SAQPSA

SEQ ID NO: 1365231 - protein, 9 aa, Mycobacterium tuberculosis
SARALPGSG

SEQ ID NO: 1365232 - protein, 4 aa, Mycobacterium tuberculosis
SARR

SEQ ID NO: 1365233 - protein, 40 aa, Mycobacterium tuberculosis
SDDGPPAWPSAEVPQDDTATIPEASAGRGSGRRGRRKDTQ

SEQ ID NO: 1365234 - protein, 5 aa, Mycobacterium tuberculosis
SDPRE

SEQ ID NO: 1365235 - protein, 6 aa, Mycobacterium tuberculosis
SERVQP

SEQ ID NO: 1365236 - protein, 4 aa, Mycobacterium tuberculosis
SGGA

SEQ ID NO: 1365237 - protein, 7 aa, Mycobacterium tuberculosis
SGPAGVD

SEQ ID NO: 1365238 - protein, 6 aa, Mycobacterium tuberculosis
SKSPVA

SEQ ID NO: 1365239 - protein, 6 aa, Mycobacterium tuberculosis
SLQTGG

SEQ ID NO: 1365240 - protein, 9 aa, Mycobacterium tuberculosis
SLSSAAGRL

SEQ ID NO: 1365241 - protein, 6 aa, Mycobacterium tuberculosis
SNPALR

SEQ ID NO: 1365242 - protein, 16 aa, Mycobacterium tuberculosis
SPGPPSPDNAVADTTT

SEQ ID NO: 1365243 - protein, 9 aa, Mycobacterium tuberculosis
SRDITPSEA

SEQ ID NO: 1365244 - protein, 8 aa, Mycobacterium tuberculosis
SRRNHGRS

SEQ ID NO: 1365245 - protein, 4 aa, Mycobacterium tuberculosis
SRRS

SEQ ID NO: 1365246 - protein, 9 aa, Mycobacterium tuberculosis
SRVTGSDLG

SEQ ID NO: 1365247 - protein, 8 aa, Mycobacterium tuberculosis
STASTLPK

SEQ ID NO: 1365248 - protein, 13 aa, Mycobacterium tuberculosis
TAAAATAAVAPPR

SEQ ID NO: 1365249 - protein, 8 aa, Mycobacterium tuberculosis
TAACGPPQ

SEQ ID NO: 1365250 - protein, 8 aa, Mycobacterium tuberculosis
TAATETTR

SEQ ID NO: 1365251 - protein, 7 aa, Mycobacterium tuberculosis
TAGATAV

SEQ ID NO: 1365252 - protein, 13 aa, Mycobacterium tuberculosis
TAHRGARESSNIV

SEQ ID NO: 1365253 - protein, 11 aa, Mycobacterium tuberculosis
TAKRGAQITQA

SEQ ID NO: 1365254 - protein, 10 aa, Mycobacterium tuberculosis
TAPKQGKDAN

SEQ ID NO: 1365255 - protein, 7 aa, Mycobacterium tuberculosis
TDSQDPY

SEQ ID NO: 1365256 - protein, 7 aa, Mycobacterium tuberculosis
TGQTPGN

SEQ ID NO: 1365257 - protein, 9 aa, Mycobacterium tuberculosis
TKPEVRRQS

SEQ ID NO: 1365258 - protein, 13 aa, Mycobacterium tuberculosis
TLPTEPMRSRGRN

SEQ ID NO: 1365259 - protein, 7 aa, Mycobacterium tuberculosis
TLRSSPP

SEQ ID NO: 1365260 - protein, 15 aa, Mycobacterium tuberculosis
TLTTDRGAEPELGAQ

SEQ ID NO: 1365261 - protein, 9 aa, Mycobacterium tuberculosis
TPAPGAAEE

SEQ ID NO: 1365262 - protein, 17 aa, Mycobacterium tuberculosis
TPKPGTGPSRKTQERGH

SEQ ID NO: 1365263 - protein, 8 aa, Mycobacterium tuberculosis
TPTPGAAQ

SEQ ID NO: 1365264 - protein, 22 aa, Mycobacterium tuberculosis
TPTSGPSAVYSPASGELVGPDG

SEQ ID NO: 1365265 - protein, 6 aa, Mycobacterium tuberculosis
TQASYA

SEQ ID NO: 1365266 - protein, 14 aa, Mycobacterium tuberculosis
TRQQGDSVEVSAEK

SEQ ID NO: 1365267 - protein, 9 aa, Mycobacterium tuberculosis
TRRGETEYG

SEQ ID NO: 1365268 - protein, 7 aa, Mycobacterium tuberculosis
TSQEFTE

SEQ ID NO: 1365269 - protein, 6 aa, Mycobacterium tuberculosis
TSRDDT

SEQ ID NO: 1365270 - protein, 9 aa, Mycobacterium tuberculosis
TSRTRTALT

SEQ ID NO: 1365271 - protein, 8 aa, Mycobacterium tuberculosis
TTGKEEPL

SEQ ID NO: 1365272 - protein, 8 aa, Mycobacterium tuberculosis
TTLATPGM

SEQ ID NO: 1365273 - protein, 9 aa, Mycobacterium tuberculosis
TTTTTGARY

SEQ ID NO: 1365274 - protein, 8 aa, Mycobacterium tuberculosis
TVKDDAAD

SEQ ID NO: 1365275 - protein, 17 aa, Mycobacterium tuberculosis
TWDNGTTHDDETDADAV

SEQ ID NO: 1365276 - protein, 26 aa, Mycobacterium tuberculosis
VAAQPSGETSDACCDGEDNEDREPEQ

SEQ ID NO: 1365277 - protein, 13 aa, Mycobacterium tuberculosis
VAEEPEPELPGVT

SEQ ID NO: 1365278 - protein, 7 aa, Mycobacterium tuberculosis
VAEEPTR

SEQ ID NO: 1365279 - protein, 6 aa, Mycobacterium tuberculosis
VAPAGS

SEQ ID NO: 1365280 - protein, 5 aa, Mycobacterium tuberculosis
VDSGH

SEQ ID NO: 1365281 - protein, 8 aa, Mycobacterium tuberculosis
VEDGTGEL

SEQ ID NO: 1365282 - protein, 7 aa, Mycobacterium tuberculosis
VEQGDLR

SEQ ID NO: 1365283 - protein, 8 aa, Mycobacterium tuberculosis
VEREAPTE

SEQ ID NO: 1365284 - protein, 5 aa, Mycobacterium tuberculosis
VGGGG

SEQ ID NO: 1365285 - protein, 4 aa, Mycobacterium tuberculosis
VGGL

SEQ ID NO: 1365286 - protein, 33 aa, Mycobacterium tuberculosis
VGPAAPIPDSTATPDASSTTPSRPQPPQDNNDD

SEQ ID NO: 1365287 - protein, 10 aa, Mycobacterium tuberculosis
VGPDTQERRA

SEQ ID NO: 1365288 - protein, 7 aa, Mycobacterium tuberculosis
VGTEGDD

SEQ ID NO: 1365289 - protein, 12 aa, Mycobacterium tuberculosis
VKGGPKGVGNAV

SEQ ID NO: 1365290 - protein, 4 aa, Mycobacterium tuberculosis
VNQT

SEQ ID NO: 1365291 - protein, 15 aa, Mycobacterium tuberculosis
VPEPDANPSTEVGQL

SEQ ID NO: 1365292 - protein, 7 aa, Mycobacterium tuberculosis
VPESATS

SEQ ID NO: 1365293 - protein, 13 aa, Mycobacterium tuberculosis
VPIPPPPPGPDVI

SEQ ID NO: 1365294 - protein, 8 aa, Mycobacterium tuberculosis
VRDPDAVR

SEQ ID NO: 1365295 - protein, 5 aa, Mycobacterium tuberculosis
VREPG

SEQ ID NO: 1365296 - protein, 6 aa, Mycobacterium tuberculosis
VRGEDD

SEQ ID NO: 1365297 - protein, 6 aa, Mycobacterium tuberculosis
VRSELE

SEQ ID NO: 1365298 - protein, 10 aa, Mycobacterium tuberculosis
VSASGSDSAV

SEQ ID NO: 1365299 - protein, 16 aa, Mycobacterium tuberculosis
VSTAGDEVKDPQKTMP

SEQ ID NO: 1365300 - protein, 10 aa, Mycobacterium tuberculosis
VTGTKAPGDI

SEQ ID NO: 1365301 - protein, 7 aa, Mycobacterium tuberculosis
VTTSPLP

SEQ ID NO: 1365302 - protein, 4 aa, Mycobacterium tuberculosis
WSSE

SEQ ID NO: 1365303 - protein, 9 aa, Mycobacterium tuberculosis
YGATSGQAL

SEQ ID NO: 1365304 - protein, 6 aa, Mycobacterium tuberculosis
YKSAQT

SEQ ID NO: 1365305 - protein, 7 aa, Mycobacterium tuberculosis
YLDAQGD

SEQ ID NO: 1365306 - protein, 5 aa, Mycobacterium tuberculosis
YPGLN

SEQ ID NO: 1365307 - protein, 9 aa, Mycobacterium tuberculosis
AAADAAHRA

SEQ ID NO: 1365308 - protein, 12 aa, Mycobacterium tuberculosis
AAADGASVPHGP

SEQ ID NO: 1365309 - protein, 13 aa, Mycobacterium tuberculosis
AAADGDPATAWTA

SEQ ID NO: 1365310 - protein, 7 aa, Mycobacterium tuberculosis
AAAGEAS

SEQ ID NO: 1365311 - protein, 8 aa, Mycobacterium tuberculosis
AADPRSRT

SEQ ID NO: 1365312 - protein, 14 aa, Mycobacterium tuberculosis
AAERERPQLGGEDR

SEQ ID NO: 1365313 - protein, 5 aa, Mycobacterium tuberculosis
AAGAS

SEQ ID NO: 1365314 - protein, 12 aa, Mycobacterium tuberculosis
AAGAVSADGKAA

SEQ ID NO: 1365315 - protein, 4 aa, Mycobacterium tuberculosis
AAGD

SEQ ID NO: 1365316 - protein, 8 aa, Mycobacterium tuberculosis
AAGKQAPN

SEQ ID NO: 1365317 - protein, 8 aa, Mycobacterium tuberculosis
AAGLSEGA

SEQ ID NO: 1365318 - protein, 7 aa, Mycobacterium tuberculosis
AALKASA

SEQ ID NO: 1365319 - protein, 8 aa, Mycobacterium tuberculosis
AAPELGEP

SEQ ID NO: 1365320 - protein, 9 aa, Mycobacterium tuberculosis
AAPRARRSI

SEQ ID NO: 1365321 - protein, 6 aa, Mycobacterium tuberculosis
AARPGT

SEQ ID NO: 1365322 - protein, 10 aa, Mycobacterium tuberculosis
AATDDGSAGV

SEQ ID NO: 1365323 - protein, 12 aa, Mycobacterium tuberculosis
AATYQDIRDGTK

SEQ ID NO: 1365324 - protein, 5 aa, Mycobacterium tuberculosis
ADDST

SEQ ID NO: 1365325 - protein, 5 aa, Mycobacterium tuberculosis
ADGGM

SEQ ID NO: 1365326 - protein, 8 aa, Mycobacterium tuberculosis
ADGSPSYE

SEQ ID NO: 1365327 - protein, 6 aa, Mycobacterium tuberculosis
ADPAVA

SEQ ID NO: 1365328 - protein, 21 aa, Mycobacterium tuberculosis
ADPQPSDLGDQSPGADAQAKW

SEQ ID NO: 1365329 - protein, 8 aa, Mycobacterium tuberculosis
AEATNTSA

SEQ ID NO: 1365330 - protein, 7 aa, Mycobacterium tuberculosis
AEEASRR

SEQ ID NO: 1365331 - protein, 5 aa, Mycobacterium tuberculosis
AEHGV

SEQ ID NO: 1365332 - protein, 4 aa, Mycobacterium tuberculosis
AEPG

SEQ ID NO: 1365333 - protein, 4 aa, Mycobacterium tuberculosis
AGAD

SEQ ID NO: 1365334 - protein, 11 aa, Mycobacterium tuberculosis
AGAKSQEPRHS

SEQ ID NO: 1365335 - protein, 13 aa, Mycobacterium tuberculosis
AGDGSKKDCKQNP

SEQ ID NO: 1365336 - protein, 21 aa, Mycobacterium tuberculosis
AGGSEVDQATVTGEPLPVDKS

SEQ ID NO: 1365337 - protein, 5 aa, Mycobacterium tuberculosis
AGHGG

SEQ ID NO: 1365338 - protein, 6 aa, Mycobacterium tuberculosis
AGKPLT

SEQ ID NO: 1365339 - protein, 7 aa, Mycobacterium tuberculosis
AGLDPGV

SEQ ID NO: 1365340 - protein, 15 aa, Mycobacterium tuberculosis
AGPHAGDRSPSRTVP

SEQ ID NO: 1365341 - protein, 11 aa, Mycobacterium tuberculosis
AGSGSGGEPTV

SEQ ID NO: 1365342 - protein, 4 aa, Mycobacterium tuberculosis
AGSL

SEQ ID NO: 1365343 - protein, 5 aa, Mycobacterium tuberculosis
AGSTA

SEQ ID NO: 1365344 - protein, 6 aa, Mycobacterium tuberculosis
AGTPLR

SEQ ID NO: 1365345 - protein, 5 aa, Mycobacterium tuberculosis
AHPEL
